United States Patent 11,254,933 (CRISPR/CAS TRANSCRIPTIONAL MODULATION) - sequence listing, part 11

SEQ ID NO: 466585 - DNA, 20 bp, mouse
gttcttgtctagaagggtag

SEQ ID NO: 466586 - DNA, 20 bp, mouse
gtactcggcgggcgaaggac

SEQ ID NO: 466587 - DNA, 20 bp, mouse
gcctctcacggcccaacccc

SEQ ID NO: 466588 - DNA, 20 bp, mouse
ggaaggacaggcattaaaga

SEQ ID NO: 466589 - DNA, 20 bp, mouse
gacgcgggaaagacgcagag

SEQ ID NO: 466590 - DNA, 20 bp, mouse
gagggtccctggcgccgggg

SEQ ID NO: 466591 - DNA, 20 bp, mouse
ggtcagggtccctggcgccg

SEQ ID NO: 466592 - DNA, 20 bp, mouse
gaagacgcagagtggccgca

SEQ ID NO: 466593 - DNA, 20 bp, mouse
gcgtgtctcggtggggttca

SEQ ID NO: 466594 - DNA, 20 bp, mouse
gctgggctcgtgtctcggtg

SEQ ID NO: 466595 - DNA, 20 bp, mouse
gtggggttcacggcgtcggg

SEQ ID NO: 466596 - DNA, 20 bp, mouse
gttcagttttggtctatttt

SEQ ID NO: 466597 - DNA, 20 bp, mouse
gtggtctattttcggcagtc

SEQ ID NO: 466598 - DNA, 20 bp, mouse
gaggaaatggccatgtgaaa

SEQ ID NO: 466599 - DNA, 20 bp, mouse
gcccgaggttacctcctctg

SEQ ID NO: 466600 - DNA, 20 bp, mouse
ggacttccaggcctcagagg

SEQ ID NO: 466601 - DNA, 20 bp, mouse
gcggggccctagagcgtagg

SEQ ID NO: 466602 - DNA, 20 bp, mouse
gggactgcgcaggcgcggtc

SEQ ID NO: 466603 - DNA, 20 bp, mouse
gggttacctcctctgaggcc

SEQ ID NO: 466604 - DNA, 20 bp, mouse
gcctctcacgacccaacccg

SEQ ID NO: 466605 - DNA, 20 bp, mouse
gcagacagcgatctcatgta

SEQ ID NO: 466606 - DNA, 20 bp, mouse
gggcggcggagatcccggtg

SEQ ID NO: 466607 - DNA, 20 bp, mouse
gagcctttggtggagggacc

SEQ ID NO: 466608 - DNA, 20 bp, mouse
gcctctcacgacccaacccg

SEQ ID NO: 466609 - DNA, 20 bp, mouse
ggggcggagtgggcgtgttc

SEQ ID NO: 466610 - DNA, 20 bp, mouse
gctagagcgtaggtagttat

SEQ ID NO: 466611 - DNA, 20 bp, mouse
ggtggtcagggtcccccgcg

SEQ ID NO: 466612 - DNA, 20 bp, mouse
ggaggaggtaacctcgggtt

SEQ ID NO: 466613 - DNA, 20 bp, mouse
gctacctacgctctagggcc

SEQ ID NO: 466614 - DNA, 20 bp, mouse
gggttgggtcgtgagaggga

SEQ ID NO: 466615 - DNA, 20 bp, mouse
gagggtcccccgcgcggggg

SEQ ID NO: 466616 - DNA, 20 bp, mouse
gctcgggttggactgtgaga

SEQ ID NO: 466617 - DNA, 20 bp, mouse
ggggttggactgtgagaggg

SEQ ID NO: 466618 - DNA, 20 bp, mouse
gagaatctttcagttttggt

SEQ ID NO: 466619 - DNA, 20 bp, mouse
gagcctttggtggagggacc

SEQ ID NO: 466620 - DNA, 20 bp, mouse
ggggcggagtgggcgtgttc

SEQ ID NO: 466621 - DNA, 20 bp, mouse
gctagagcgtaggtagttat

SEQ ID NO: 466622 - DNA, 20 bp, mouse
ggtggtcagggtcccccgcg

SEQ ID NO: 466623 - DNA, 20 bp, mouse
gctacctacgctctagggcc

SEQ ID NO: 466624 - DNA, 20 bp, mouse
gagggtcccccgcgcggggg

SEQ ID NO: 466625 - DNA, 20 bp, mouse
gcccactccgcccccgcgcg

SEQ ID NO: 466626 - DNA, 20 bp, mouse
gggccgttggtacccctcca

SEQ ID NO: 466627 - DNA, 20 bp, mouse
gtcagaaagccaccatggag

SEQ ID NO: 466628 - DNA, 20 bp, mouse
gcaccatggaggggtaccaa

SEQ ID NO: 466629 - DNA, 20 bp, mouse
gtaccaacggccctgcgatg

SEQ ID NO: 466630 - DNA, 20 bp, mouse
gcccaccctaaggatctcag

SEQ ID NO: 466631 - DNA, 20 bp, mouse
ggggagagcgagaagcctaa

SEQ ID NO: 466632 - DNA, 20 bp, mouse
gtttcctggcgccagagggg

SEQ ID NO: 466633 - DNA, 20 bp, mouse
gggggcggtacctcatcgca

SEQ ID NO: 466634 - DNA, 20 bp, mouse
ggcttttcctggcgccagag

SEQ ID NO: 466635 - DNA, 20 bp, mouse
gcaagggccgagaggttgta

SEQ ID NO: 466636 - DNA, 20 bp, mouse
gtattcgggcgggaagcgaa

SEQ ID NO: 466637 - DNA, 20 bp, mouse
gcccccgcctcactccaatg

SEQ ID NO: 466638 - DNA, 20 bp, mouse
gggaacagcagcacaagcgg

SEQ ID NO: 466639 - DNA, 20 bp, mouse
gaaatggcgacggaccgacc

SEQ ID NO: 466640 - DNA, 20 bp, mouse
gccgcgatcggcagcagcga

SEQ ID NO: 466641 - DNA, 20 bp, mouse
gagtgtctgtgcgggatcgg

SEQ ID NO: 466642 - DNA, 20 bp, mouse
ggacagttgctatagcgacc

SEQ ID NO: 466643 - DNA, 20 bp, mouse
gaagcggactccccgagcgg

SEQ ID NO: 466644 - DNA, 20 bp, mouse
ggttgctatagcgaccgggt

SEQ ID NO: 466645 - DNA, 20 bp, mouse
ggccgatcgcggcccaggtc

SEQ ID NO: 466646 - DNA, 20 bp, mouse
gactggctgagggtgtccgg

SEQ ID NO: 466647 - DNA, 20 bp, mouse
gtgagggtgtccggtggacg

SEQ ID NO: 466648 - DNA, 20 bp, mouse
gcgagctcagacctgcccac

SEQ ID NO: 466649 - DNA, 20 bp, mouse
gagacctgcccactggctga

SEQ ID NO: 466650 - DNA, 20 bp, mouse
gcggtggacgcggcgagcca

SEQ ID NO: 466651 - DNA, 20 bp, mouse
gcccactggctgagggtgtc

SEQ ID NO: 466652 - DNA, 20 bp, mouse
gccgtcctgagagggagtcg

SEQ ID NO: 466653 - DNA, 20 bp, mouse
ggtcagaccagggcacgcgg

SEQ ID NO: 466654 - DNA, 20 bp, mouse
gtccccgcgagatttagcaa

SEQ ID NO: 466655 - DNA, 20 bp, mouse
ggcgagatttagcaagggaa

SEQ ID NO: 466656 - DNA, 20 bp, mouse
gctcccgagcgagtgggtcc

SEQ ID NO: 466657 - DNA, 20 bp, mouse
ggaggaggctcccgagcgag

SEQ ID NO: 466658 - DNA, 20 bp, mouse
gtctcgggcgcgagccgcgg

SEQ ID NO: 466659 - DNA, 20 bp, mouse
gccgccgggacccactcgct

SEQ ID NO: 466660 - DNA, 20 bp, mouse
gccagcggtgcggcagggga

SEQ ID NO: 466661 - DNA, 20 bp, mouse
gccccgactccctcacatcg

SEQ ID NO: 466662 - DNA, 20 bp, mouse
ggcagccgcccgaggacgag

SEQ ID NO: 466663 - DNA, 20 bp, mouse
gccccgcggccccgatgtga

SEQ ID NO: 466664 - DNA, 20 bp, mouse
gccgaggacgagggggacgg

SEQ ID NO: 466665 - DNA, 20 bp, mouse
gcgcccgaggacgaggggga

SEQ ID NO: 466666 - DNA, 20 bp, mouse
ggctcgccccgcggacacag

SEQ ID NO: 466667 - DNA, 20 bp, mouse
gctggcttcgctacaagacg

SEQ ID NO: 466668 - DNA, 20 bp, mouse
gaggcggcggttggcccggt

SEQ ID NO: 466669 - DNA, 20 bp, mouse
ggtagcgaagccagcaggtg

SEQ ID NO: 466670 - DNA, 20 bp, mouse
ggtgctggaggcgacccacc

SEQ ID NO: 466671 - DNA, 20 bp, mouse
gttcgctacaagacgaggct

SEQ ID NO: 466672 - DNA, 20 bp, mouse
ggctcaccgcgctgatggac

SEQ ID NO: 466673 - DNA, 20 bp, mouse
gtcagcgcggtgagcgggaa

SEQ ID NO: 466674 - DNA, 20 bp, mouse
ggaggtaacggcgcccgggt

SEQ ID NO: 466675 - DNA, 20 bp, mouse
ggcagactctcggagcaaca

SEQ ID NO: 466676 - DNA, 20 bp, mouse
gcgggtgcgcgaaggagaag

SEQ ID NO: 466677 - DNA, 20 bp, mouse
gaagtcggaggagctgcatc

SEQ ID NO: 466678 - DNA, 20 bp, mouse
gactctgtccgggtgagggc

SEQ ID NO: 466679 - DNA, 20 bp, mouse
ggcttactctgtccgggtga

SEQ ID NO: 466680 - DNA, 20 bp, mouse
gttaggcgcttactctgtcc

SEQ ID NO: 466681 - DNA, 20 bp, mouse
gccgctgagtgccagaatgg

SEQ ID NO: 466682 - DNA, 20 bp, mouse
gatccctgcagaggtttagg

SEQ ID NO: 466683 - DNA, 20 bp, mouse
ggcaaaccctgagccaacta

SEQ ID NO: 466684 - DNA, 20 bp, mouse
gagaagggaagtaagagcga

SEQ ID NO: 466685 - DNA, 20 bp, mouse
gctagggctgggtcctcaag

SEQ ID NO: 466686 - DNA, 20 bp, mouse
ggctgaccaagtctccgcgg

SEQ ID NO: 466687 - DNA, 20 bp, mouse
gtaagctgaccaagtctccg

SEQ ID NO: 466688 - DNA, 20 bp, mouse
gctggatctgaactctggca

SEQ ID NO: 466689 - DNA, 20 bp, mouse
gccagagttcagatccagga

SEQ ID NO: 466690 - DNA, 20 bp, mouse
gccccaatgtgaagaaggac

SEQ ID NO: 466691 - DNA, 20 bp, mouse
gggagagggagtaggagctt

SEQ ID NO: 466692 - DNA, 20 bp, mouse
gcaggcgcgtgggacggaga

SEQ ID NO: 466693 - DNA, 20 bp, mouse
gcgtgggacggagagggagt

SEQ ID NO: 466694 - DNA, 20 bp, mouse
gtctcttggcatagccatcc

SEQ ID NO: 466695 - DNA, 20 bp, mouse
gctgcgcctccgcggagact

SEQ ID NO: 466696 - DNA, 20 bp, mouse
gcatctgctgggcagtcagg

SEQ ID NO: 466697 - DNA, 20 bp, mouse
gctgcatctgctgggcagtc

SEQ ID NO: 466698 - DNA, 20 bp, mouse
gaggtatgacattctcatgt

SEQ ID NO: 466699 - DNA, 20 bp, mouse
gtgttgtgcctgcatctgct

SEQ ID NO: 466700 - DNA, 20 bp, mouse
ggccccccaaaactcccatg

SEQ ID NO: 466701 - DNA, 20 bp, mouse
gttccctgcatccagaacag

SEQ ID NO: 466702 - DNA, 20 bp, mouse
gactctcctcagtatagggg

SEQ ID NO: 466703 - DNA, 20 bp, mouse
gcagctccagctgtccagac

SEQ ID NO: 466704 - DNA, 20 bp, mouse
gagctgggagctgggttcag

SEQ ID NO: 466705 - DNA, 20 bp, mouse
gcccatgtggtgtggaaaga

SEQ ID NO: 466706 - DNA, 20 bp, mouse
ggaagccgatcgggttgcta

SEQ ID NO: 466707 - DNA, 20 bp, mouse
ggcttccctagcaacccgat

SEQ ID NO: 466708 - DNA, 20 bp, mouse
gcgtcgctaggaagccgatc

SEQ ID NO: 466709 - DNA, 20 bp, mouse
gcactggcatggcgggacca

SEQ ID NO: 466710 - DNA, 20 bp, mouse
gaaagtggctgtgcagtccc

SEQ ID NO: 466711 - DNA, 20 bp, mouse
ggcttcctagcgacgtaaag

SEQ ID NO: 466712 - DNA, 20 bp, mouse
ggcacgcagacgccccgcaa

SEQ ID NO: 466713 - DNA, 20 bp, mouse
gtgaactcgctcactcgcac

SEQ ID NO: 466714 - DNA, 20 bp, mouse
gtcgctcactcgcactggca

SEQ ID NO: 466715 - DNA, 20 bp, mouse
gtagggaagcggggattgcg

SEQ ID NO: 466716 - DNA, 20 bp, mouse
gcgggagccgagcagatgat

SEQ ID NO: 466717 - DNA, 20 bp, mouse
ggtggaaacgcaagctgcag

SEQ ID NO: 466718 - DNA, 20 bp, mouse
ggcctcaaggacagagatta

SEQ ID NO: 466719 - DNA, 20 bp, mouse
ggagaaacctgacaacgggt

SEQ ID NO: 466720 - DNA, 20 bp, mouse
gaccgtgagaaacctgacaa

SEQ ID NO: 466721 - DNA, 20 bp, mouse
gggaggcgggtaccagacgg

SEQ ID NO: 466722 - DNA, 20 bp, mouse
ggaaacgcaagctgcagcgg

SEQ ID NO: 466723 - DNA, 20 bp, mouse
gaggccgagggcatgacgca

SEQ ID NO: 466724 - DNA, 20 bp, mouse
gccgccgccaacccgttgtc

SEQ ID NO: 466725 - DNA, 20 bp, mouse
gcggcggcggtgctgcgtcg

SEQ ID NO: 466726 - DNA, 20 bp, mouse
gggccaccagaagaccgtag

SEQ ID NO: 466727 - DNA, 20 bp, mouse
gccgggtaagcggagagaag

SEQ ID NO: 466728 - DNA, 20 bp, mouse
ggccagaggagccgggtaag

SEQ ID NO: 466729 - DNA, 20 bp, mouse
gccagaagaccgtagagggg

SEQ ID NO: 466730 - DNA, 20 bp, mouse
gtccaggccgtgggtggtta

SEQ ID NO: 466731 - DNA, 20 bp, mouse
gccaggctccaggccgtggg

SEQ ID NO: 466732 - DNA, 20 bp, mouse
ggatctcagcagacagaata

SEQ ID NO: 466733 - DNA, 20 bp, mouse
ggggcagccttaaccaccca

SEQ ID NO: 466734 - DNA, 20 bp, mouse
gtgcaaggcacggggagtca

SEQ ID NO: 466735 - DNA, 20 bp, mouse
gcccggagcatcctagacct

SEQ ID NO: 466736 - DNA, 20 bp, mouse
gtggcggggagagacgcgta

SEQ ID NO: 466737 - DNA, 20 bp, mouse
ggaccccaggcctgagctac

SEQ ID NO: 466738 - DNA, 20 bp, mouse
ggagacgcgtagggtccgcg

SEQ ID NO: 466739 - DNA, 20 bp, mouse
gcgggctgcactgtaggaga

SEQ ID NO: 466740 - DNA, 20 bp, mouse
gcaggcctgagctactggcg

SEQ ID NO: 466741 - DNA, 20 bp, mouse
gcatcctcgggctgcactgt

SEQ ID NO: 466742 - DNA, 20 bp, mouse
ggagggagcgcggttccagg

SEQ ID NO: 466743 - DNA, 20 bp, mouse
ggggaagcaccgcagacccc

SEQ ID NO: 466744 - DNA, 20 bp, mouse
gcgctgggataaagggatgg

SEQ ID NO: 466745 - DNA, 20 bp, mouse
gggaaccgcgctccctccgg

SEQ ID NO: 466746 - DNA, 20 bp, mouse
gcccaggccgaggaaggccc

SEQ ID NO: 466747 - DNA, 20 bp, mouse
ggggcttctggggcgaacgg

SEQ ID NO: 466748 - DNA, 20 bp, mouse
gctcgtgcgggctcattctg

SEQ ID NO: 466749 - DNA, 20 bp, mouse
gctgcggccaccagggacca

SEQ ID NO: 466750 - DNA, 20 bp, mouse
gggaccgagcccgcgcggca

SEQ ID NO: 466751 - DNA, 20 bp, mouse
gaccagggccgcagaacctg

SEQ ID NO: 466752 - DNA, 20 bp, mouse
ggagtcgcctgcggccacca

SEQ ID NO: 466753 - DNA, 20 bp, mouse
ggcagaggctgaggcacgca

SEQ ID NO: 466754 - DNA, 20 bp, mouse
gtcgcgcaggctaagacctg

SEQ ID NO: 466755 - DNA, 20 bp, mouse
gctcccccctagtctagaca

SEQ ID NO: 466756 - DNA, 20 bp, mouse
gtgacggtagagagatctgg

SEQ ID NO: 466757 - DNA, 20 bp, mouse
gtgcatcttgatccaactgt

SEQ ID NO: 466758 - DNA, 20 bp, mouse
ggaaaggaggccaaaagagc

SEQ ID NO: 466759 - DNA, 20 bp, mouse
gggaggacagttgaaggatg

SEQ ID NO: 466760 - DNA, 20 bp, mouse
gaagtgacggtagagagatc

SEQ ID NO: 466761 - DNA, 20 bp, mouse
gggtatgggattaagtccct

SEQ ID NO: 466762 - DNA, 20 bp, mouse
gacatccttggcaaaagtga

SEQ ID NO: 466763 - DNA, 20 bp, mouse
gaggctgtcctggaagcacc

SEQ ID NO: 466764 - DNA, 20 bp, mouse
ggtgggtaaaggtatcatgt

SEQ ID NO: 466765 - DNA, 20 bp, mouse
gcctcaggtacagtgggtaa

SEQ ID NO: 466766 - DNA, 20 bp, mouse
ggcgagagccgagggaatgt

SEQ ID NO: 466767 - DNA, 20 bp, mouse
gtgcaggaggcgagagccga

SEQ ID NO: 466768 - DNA, 20 bp, mouse
ggagagtaggatctagtagg

SEQ ID NO: 466769 - DNA, 20 bp, mouse
gaggcccagcaggaacgggt

SEQ ID NO: 466770 - DNA, 20 bp, mouse
gtgccgtccaggacgagtct

SEQ ID NO: 466771 - DNA, 20 bp, mouse
ggcagctcccagactcgtcc

SEQ ID NO: 466772 - DNA, 20 bp, mouse
ggactctgggaggcatgaag

SEQ ID NO: 466773 - DNA, 20 bp, mouse
gggccatcgggcaggagagt

SEQ ID NO: 466774 - DNA, 20 bp, mouse
gccttgcaccaggtccctca

SEQ ID NO: 466775 - DNA, 20 bp, mouse
gcagcaggaacgggtaggat

SEQ ID NO: 466776 - DNA, 20 bp, mouse
ggagggcctctggacatcaa

SEQ ID NO: 466777 - DNA, 20 bp, mouse
ggccagcctgcaagagagga

SEQ ID NO: 466778 - DNA, 20 bp, mouse
gcgcagccagcctgcaagag

SEQ ID NO: 466779 - DNA, 20 bp, mouse
gctgccctgccactcggaaa

SEQ ID NO: 466780 - DNA, 20 bp, mouse
gcaagccgtgggtgacgtca

SEQ ID NO: 466781 - DNA, 20 bp, mouse
ggcccggctgccctgccact

SEQ ID NO: 466782 - DNA, 20 bp, mouse
ggaggccagtggcaagccgt

SEQ ID NO: 466783 - DNA, 20 bp, mouse
gtgactgaggggctaagggt

SEQ ID NO: 466784 - DNA, 20 bp, mouse
gtgtccctttccgagtggca

SEQ ID NO: 466785 - DNA, 20 bp, mouse
gccttttgtccctttccgag

SEQ ID NO: 466786 - DNA, 20 bp, mouse
ggaacagaaggaccttctag

SEQ ID NO: 466787 - DNA, 20 bp, mouse
ggcttcaagttcagtgtcag

SEQ ID NO: 466788 - DNA, 20 bp, mouse
ggactctctgggcctgacgt

SEQ ID NO: 466789 - DNA, 20 bp, mouse
gaggccagagatgcagaccg

SEQ ID NO: 466790 - DNA, 20 bp, mouse
gggaccttctagaggccgga

SEQ ID NO: 466791 - DNA, 20 bp, mouse
gtggccttccggcctctaga

SEQ ID NO: 466792 - DNA, 20 bp, mouse
gcccttcgggcaagaactgg

SEQ ID NO: 466793 - DNA, 20 bp, mouse
gagggtcctgaataaagaga

SEQ ID NO: 466794 - DNA, 20 bp, mouse
gtaagcagagagggactctc

SEQ ID NO: 466795 - DNA, 20 bp, mouse
gcttgaagctgacatgaact

SEQ ID NO: 466796 - DNA, 20 bp, mouse
ggacacctgggggagagcag

SEQ ID NO: 466797 - DNA, 20 bp, mouse
gccagttggcctcaggctag

SEQ ID NO: 466798 - DNA, 20 bp, mouse
gatgcatcagtaccacaagg

SEQ ID NO: 466799 - DNA, 20 bp, mouse
gacggccactgctctccccc

SEQ ID NO: 466800 - DNA, 20 bp, mouse
ggaggatccggaacacgggt

SEQ ID NO: 466801 - DNA, 20 bp, mouse
gtggccgggctttctcaaca

SEQ ID NO: 466802 - DNA, 20 bp, mouse
gacagggtggagatttacaa

SEQ ID NO: 466803 - DNA, 20 bp, mouse
ggccatctggaaagcatact

SEQ ID NO: 466804 - DNA, 20 bp, mouse
gcgacgagggatgtattggg

SEQ ID NO: 466805 - DNA, 20 bp, mouse
gccccccccggaaaagaccg

SEQ ID NO: 466806 - DNA, 20 bp, mouse
gccactggccccagcagaat

SEQ ID NO: 466807 - DNA, 20 bp, mouse
ggaatgggatctgttccccc

SEQ ID NO: 466808 - DNA, 20 bp, mouse
gtcctgggctctgacatctg

SEQ ID NO: 466809 - DNA, 20 bp, mouse
ggtcttggcgtgtaactcct

SEQ ID NO: 466810 - DNA, 20 bp, mouse
ggtgtgtgtttgctgatctg

SEQ ID NO: 466811 - DNA, 20 bp, mouse
ggtggccgtcagagacacag

SEQ ID NO: 466812 - DNA, 20 bp, mouse
gccttagagaacagaagtct

SEQ ID NO: 466813 - DNA, 20 bp, mouse
gtgagtagctaaagatgtta

SEQ ID NO: 466814 - DNA, 20 bp, mouse
gttctgttctctaagggagg

SEQ ID NO: 466815 - DNA, 20 bp, mouse
gtgcttacgcagtatctgaa

SEQ ID NO: 466816 - DNA, 20 bp, mouse
gagggcgcggagactcagct

SEQ ID NO: 466817 - DNA, 20 bp, mouse
ggcgcggagactcagctggg

SEQ ID NO: 466818 - DNA, 20 bp, mouse
ggaagaggagggatctccgg

SEQ ID NO: 466819 - DNA, 20 bp, mouse
gtcagctgggcggagtttcg

SEQ ID NO: 466820 - DNA, 20 bp, mouse
gcccccgacctgaagaatgg

SEQ ID NO: 466821 - DNA, 20 bp, mouse
ggcgcttcggaatcaggaag

SEQ ID NO: 466822 - DNA, 20 bp, mouse
gaggctcacctgaccacgta

SEQ ID NO: 466823 - DNA, 20 bp, mouse
gacacgcctcgggggccccc

SEQ ID NO: 466824 - DNA, 20 bp, mouse
gcagcgagtacagaccagtg

SEQ ID NO: 466825 - DNA, 20 bp, mouse
gtggctgcaggctgtcggtg

SEQ ID NO: 466826 - DNA, 20 bp, mouse
gagagcaggaagggcgtccg

SEQ ID NO: 466827 - DNA, 20 bp, mouse
gctgccgggcgcataccacc

SEQ ID NO: 466828 - DNA, 20 bp, mouse
gcggacgcccggcaactgtg

SEQ ID NO: 466829 - DNA, 20 bp, mouse
ggcccggcagatggagttgt

SEQ ID NO: 466830 - DNA, 20 bp, mouse
ggcccggcaactgtgaggtc

SEQ ID NO: 466831 - DNA, 20 bp, mouse
gtgacactgtgggtcctcgg

SEQ ID NO: 466832 - DNA, 20 bp, mouse
gtagggtgccggtgagtgga

SEQ ID NO: 466833 - DNA, 20 bp, mouse
ggtgaggtcggggacagccc

SEQ ID NO: 466834 - DNA, 20 bp, mouse
gcgacgctccctccactcac

SEQ ID NO: 466835 - DNA, 20 bp, mouse
gcgtccgggtggtatgcgcc

SEQ ID NO: 466836 - DNA, 20 bp, mouse
ggcggtctccggagccagcg

SEQ ID NO: 466837 - DNA, 20 bp, mouse
gcccgggcccagcggcgggg

SEQ ID NO: 466838 - DNA, 20 bp, mouse
gcattgcgccgggaacgcgg

SEQ ID NO: 466839 - DNA, 20 bp, mouse
ggtgcccgggcccagcggcg

SEQ ID NO: 466840 - DNA, 20 bp, mouse
gccgccggcgggaaggaccc

SEQ ID NO: 466841 - DNA, 20 bp, mouse
ggcccggtgcccgggcccag

SEQ ID NO: 466842 - DNA, 20 bp, mouse
gccgcagtgggcgaccccca

SEQ ID NO: 466843 - DNA, 20 bp, mouse
gggggcagttctctataacg

SEQ ID NO: 466844 - DNA, 20 bp, mouse
gggcgctccggctctctcct

SEQ ID NO: 466845 - DNA, 20 bp, mouse
gtcccaacggcgggataccc

SEQ ID NO: 466846 - DNA, 20 bp, mouse
gagcagccagatgacacagg

SEQ ID NO: 466847 - DNA, 20 bp, mouse
ggccgggaggaccaagccgg

SEQ ID NO: 466848 - DNA, 20 bp, mouse
gtatgccgggaggaccaagc

SEQ ID NO: 466849 - DNA, 20 bp, mouse
gtcagactccaggctcatag

SEQ ID NO: 466850 - DNA, 20 bp, mouse
gtggtcctcccggcatacaa

SEQ ID NO: 466851 - DNA, 20 bp, mouse
gcttgtgggtgaaggagtga

SEQ ID NO: 466852 - DNA, 20 bp, mouse
gagtaaggtggcgatcttgt

SEQ ID NO: 466853 - DNA, 20 bp, mouse
gacctccggcttggtcctcc

SEQ ID NO: 466854 - DNA, 20 bp, mouse
ggaggttcccactatgagcc

SEQ ID NO: 466855 - DNA, 20 bp, mouse
gggtgtgcaattgcccttaa

SEQ ID NO: 466856 - DNA, 20 bp, mouse
gtacgtcggcgcctgagcgt

SEQ ID NO: 466857 - DNA, 20 bp, mouse
ggcgtgggctgcggcctgaa

SEQ ID NO: 466858 - DNA, 20 bp, mouse
gcaggccgcagcccacgctc

SEQ ID NO: 466859 - DNA, 20 bp, mouse
ggaccccgcgcggcctacgt

SEQ ID NO: 466860 - DNA, 20 bp, mouse
gggcgcctgagcgtgggctg

SEQ ID NO: 466861 - DNA, 20 bp, mouse
ggtgacgcgagggctccgca

SEQ ID NO: 466862 - DNA, 20 bp, mouse
gccgcaaggctgcgtgtcgt

SEQ ID NO: 466863 - DNA, 20 bp, mouse
ggacgcgtgccgtgacgcga

SEQ ID NO: 466864 - DNA, 20 bp, mouse
gcggattcaacagcagtgat

SEQ ID NO: 466865 - DNA, 20 bp, mouse
gtagcggcgctccagggcac

SEQ ID NO: 466866 - DNA, 20 bp, mouse
gagaatgcccggaacctcct

SEQ ID NO: 466867 - DNA, 20 bp, mouse
gccctcaccaaggaggttcc

SEQ ID NO: 466868 - DNA, 20 bp, mouse
gggagacgcgatccgatgga

SEQ ID NO: 466869 - DNA, 20 bp, mouse
gtccgggcattctgtggcac

SEQ ID NO: 466870 - DNA, 20 bp, mouse
ggcccggaacctccttggtg

SEQ ID NO: 466871 - DNA, 20 bp, mouse
gaattcttgtgaagatacag

SEQ ID NO: 466872 - DNA, 20 bp, mouse
gtcagaaggaaccttcctct

SEQ ID NO: 466873 - DNA, 20 bp, mouse
gcgcgggagacgcgatccga

SEQ ID NO: 466874 - DNA, 20 bp, mouse
gtcatccagcctggtccccg

SEQ ID NO: 466875 - DNA, 20 bp, mouse
gcggcgacgcgacagccccg

SEQ ID NO: 466876 - DNA, 20 bp, mouse
gggcgcttcagcgggacctg

SEQ ID NO: 466877 - DNA, 20 bp, mouse
ggaaggcaaaggcgcttcag

SEQ ID NO: 466878 - DNA, 20 bp, mouse
ggcgctttcacgtctccaga

SEQ ID NO: 466879 - DNA, 20 bp, mouse
ggggcccgccgtgccgctgg

SEQ ID NO: 466880 - DNA, 20 bp, mouse
gcggcggcgctcaagcggag

SEQ ID NO: 466881 - DNA, 20 bp, mouse
ggcgcttaggccagccagga

SEQ ID NO: 466882 - DNA, 20 bp, mouse
ggtctccacaggcccgacag

SEQ ID NO: 466883 - DNA, 20 bp, mouse
gtcgggcctgtggagacccc

SEQ ID NO: 466884 - DNA, 20 bp, mouse
gcagcgaggccgcacatggc

SEQ ID NO: 466885 - DNA, 20 bp, mouse
gacccccacccccagcggca

SEQ ID NO: 466886 - DNA, 20 bp, mouse
gggtggtgcgatgagagggg

SEQ ID NO: 466887 - DNA, 20 bp, mouse
gacggcggtggtgcgatgag

SEQ ID NO: 466888 - DNA, 20 bp, mouse
ggctgcgcggcgggtgacgg

SEQ ID NO: 466889 - DNA, 20 bp, mouse
gcgagctggacggggaggga

SEQ ID NO: 466890 - DNA, 20 bp, mouse
gaccgggaagggcgccccac

SEQ ID NO: 466891 - DNA, 20 bp, mouse
ggcgcggagcccggggcgca

SEQ ID NO: 466892 - DNA, 20 bp, mouse
gctcaggcggcgggacctac

SEQ ID NO: 466893 - DNA, 20 bp, mouse
gaccggaagcgctcctcagg

SEQ ID NO: 466894 - DNA, 20 bp, mouse
gggcccgagctggacgggga

SEQ ID NO: 466895 - DNA, 20 bp, mouse
gcataggaacgcgggcggtg

SEQ ID NO: 466896 - DNA, 20 bp, mouse
gcggctcccgcggctctggg

SEQ ID NO: 466897 - DNA, 20 bp, mouse
gcgggccagcgagtatcctg

SEQ ID NO: 466898 - DNA, 20 bp, mouse
ggtatcctggggtccgactg

SEQ ID NO: 466899 - DNA, 20 bp, mouse
gcgagcggcgtcggctcccg

SEQ ID NO: 466900 - DNA, 20 bp, mouse
gcgacgccgctcggccgaac

SEQ ID NO: 466901 - DNA, 20 bp, mouse
gcgccgctcggccgaaccgg

SEQ ID NO: 466902 - DNA, 20 bp, mouse
gcgggcggaagtaggactcg

SEQ ID NO: 466903 - DNA, 20 bp, mouse
gtggcgacggcggcccgcag

SEQ ID NO: 466904 - DNA, 20 bp, mouse
gagccgccggttcggccgag

SEQ ID NO: 466905 - DNA, 20 bp, mouse
gggccgaaccggcggctgaa

SEQ ID NO: 466906 - DNA, 20 bp, mouse
gcgcagaggtggggggccta

SEQ ID NO: 466907 - DNA, 20 bp, mouse
gcaactgctgcgaggctgtg

SEQ ID NO: 466908 - DNA, 20 bp, mouse
gctccggggcgcagaggtgg

SEQ ID NO: 466909 - DNA, 20 bp, mouse
gctgtggggtgcggactcca

SEQ ID NO: 466910 - DNA, 20 bp, mouse
gtacgcccgaagcctgccct

SEQ ID NO: 466911 - DNA, 20 bp, mouse
gggcggtgggtgtagagggt

SEQ ID NO: 466912 - DNA, 20 bp, mouse
gccgcaggtgagcaggccgg

SEQ ID NO: 466913 - DNA, 20 bp, mouse
gcccctgccaatgccgggaa

SEQ ID NO: 466914 - DNA, 20 bp, mouse
gcgagaggcgggcaggacgc

SEQ ID NO: 466915 - DNA, 20 bp, mouse
gggcagaacggtgcgagtgg

SEQ ID NO: 466916 - DNA, 20 bp, mouse
gtggacccaacgacaagagg

SEQ ID NO: 466917 - DNA, 20 bp, mouse
gacctggacccaacgacaag

SEQ ID NO: 466918 - DNA, 20 bp, mouse
ggcgaggtgcattcaggcag

SEQ ID NO: 466919 - DNA, 20 bp, mouse
ggctgaggctggacatactg

SEQ ID NO: 466920 - DNA, 20 bp, mouse
gcaggcggcgaggtgcattc

SEQ ID NO: 466921 - DNA, 20 bp, mouse
gggctgcagacgagctcctc

SEQ ID NO: 466922 - DNA, 20 bp, mouse
gaacgggaggtcccaaaacc

SEQ ID NO: 466923 - DNA, 20 bp, mouse
ggcagtccgtccgcccaata

SEQ ID NO: 466924 - DNA, 20 bp, mouse
ggctgcctcctcttgtcgtt

SEQ ID NO: 466925 - DNA, 20 bp, mouse
gctcctcctcggaacaacca

SEQ ID NO: 466926 - DNA, 20 bp, mouse
ggcgacccgaggctcgcggg

SEQ ID NO: 466927 - DNA, 20 bp, mouse
ggacccctaccgcccaccag

SEQ ID NO: 466928 - DNA, 20 bp, mouse
gcttgctggacgccggaaca

SEQ ID NO: 466929 - DNA, 20 bp, mouse
gcaccacgttggcctcccct

SEQ ID NO: 466930 - DNA, 20 bp, mouse
ggcgccggaccgcgaccgag

SEQ ID NO: 466931 - DNA, 20 bp, mouse
ggtccggcgcctgcgacccg

SEQ ID NO: 466932 - DNA, 20 bp, mouse
gcctgcgacccgaggctcgc

SEQ ID NO: 466933 - DNA, 20 bp, mouse
ggcggccgcccgcgagcctc

SEQ ID NO: 466934 - DNA, 20 bp, mouse
gaaagacagccgggccacag

SEQ ID NO: 466935 - DNA, 20 bp, mouse
ggaccgaggggaggccaacg

SEQ ID NO: 466936 - DNA, 20 bp, mouse
gggtccttacccaagcctgg

SEQ ID NO: 466937 - DNA, 20 bp, mouse
gcagtcccatctgacatctg

SEQ ID NO: 466938 - DNA, 20 bp, mouse
gctcccggaggatgtgacta

SEQ ID NO: 466939 - DNA, 20 bp, mouse
gcaactgcagcaggacgctg

SEQ ID NO: 466940 - DNA, 20 bp, mouse
gcaggacgctgtggtttcct

SEQ ID NO: 466941 - DNA, 20 bp, mouse
gcatcctccgggagaaatag

SEQ ID NO: 466942 - DNA, 20 bp, mouse
ggctgcagttgctggcttca

SEQ ID NO: 466943 - DNA, 20 bp, mouse
gtgggcgtgtcgcaaacagt

SEQ ID NO: 466944 - DNA, 20 bp, mouse
gcccagggtgtaaatcccac

SEQ ID NO: 466945 - DNA, 20 bp, mouse
gatgcgggagcctccaggct

SEQ ID NO: 466946 - DNA, 20 bp, mouse
gcggagcaccgaccaaggtg

SEQ ID NO: 466947 - DNA, 20 bp, mouse
gacagagagacgcacagcga

SEQ ID NO: 466948 - DNA, 20 bp, mouse
gcagtctattttcgtcccct

SEQ ID NO: 466949 - DNA, 20 bp, mouse
ggtgactgtcagaggaacta

SEQ ID NO: 466950 - DNA, 20 bp, mouse
gggtcttggatgggaaatag

SEQ ID NO: 466951 - DNA, 20 bp, mouse
gttcaggggttgaggggggt

SEQ ID NO: 466952 - DNA, 20 bp, mouse
gtagaaacatcatgcttcag

SEQ ID NO: 466953 - DNA, 20 bp, mouse
gtcaatgctgtgactgtcag

SEQ ID NO: 466954 - DNA, 20 bp, mouse
gtttctagaaaactacagaa

SEQ ID NO: 466955 - DNA, 20 bp, mouse
gagccctatgttgctcaaag

SEQ ID NO: 466956 - DNA, 20 bp, mouse
gtgtgggatgaggggaacag

SEQ ID NO: 466957 - DNA, 20 bp, mouse
ggcacagcgggggtcagtag

SEQ ID NO: 466958 - DNA, 20 bp, mouse
ggggcccagcactctgtcaa

SEQ ID NO: 466959 - DNA, 20 bp, mouse
gcagagtgcctggctgaagt

SEQ ID NO: 466960 - DNA, 20 bp, mouse
gtaacagaagatgagctcgc

SEQ ID NO: 466961 - DNA, 20 bp, mouse
gagcctcaggtagatgatgt

SEQ ID NO: 466962 - DNA, 20 bp, mouse
ggaagtaggcgaaggctctt

SEQ ID NO: 466963 - DNA, 20 bp, mouse
gcaacctctctcagactcca

SEQ ID NO: 466964 - DNA, 20 bp, mouse
ggaggttgagggcgaaggca

SEQ ID NO: 466965 - DNA, 20 bp, mouse
ggggtggaggttgagggcga

SEQ ID NO: 466966 - DNA, 20 bp, mouse
gggcggcgcgggcccatgac

SEQ ID NO: 466967 - DNA, 20 bp, mouse
ggccgcggcctgccagtcat

SEQ ID NO: 466968 - DNA, 20 bp, mouse
ggcccatgactggcaggccg

SEQ ID NO: 466969 - DNA, 20 bp, mouse
ggcccggactttgcaggcag

SEQ ID NO: 466970 - DNA, 20 bp, mouse
gaatcgcgagggccagtggg

SEQ ID NO: 466971 - DNA, 20 bp, mouse
gcgggatcgagccctcgccg

SEQ ID NO: 466972 - DNA, 20 bp, mouse
ggactggcaggccgcggcga

SEQ ID NO: 466973 - DNA, 20 bp, mouse
ggcgcgggcccatgactggc

SEQ ID NO: 466974 - DNA, 20 bp, mouse
gcacgcagctgcagatggtg

SEQ ID NO: 466975 - DNA, 20 bp, mouse
gcagaatcgcgagggccagt

SEQ ID NO: 466976 - DNA, 20 bp, mouse
ggcgcgcgccagacccgagt

SEQ ID NO: 466977 - DNA, 20 bp, mouse
ggccagacccgagtgggtag

SEQ ID NO: 466978 - DNA, 20 bp, mouse
gcggcgccccctacccactc

SEQ ID NO: 466979 - DNA, 20 bp, mouse
gccccctacccactcgggtc

SEQ ID NO: 466980 - DNA, 20 bp, mouse
gcaggtgcccagcgccacag

SEQ ID NO: 466981 - DNA, 20 bp, mouse
gtccgtggggagtggcgtcg

SEQ ID NO: 466982 - DNA, 20 bp, mouse
gcgcgcgcgcggggcacctg

SEQ ID NO: 466983 - DNA, 20 bp, mouse
gtggctgctacaatatatat

SEQ ID NO: 466984 - DNA, 20 bp, mouse
gagcgaagtgtagtaggtgg

SEQ ID NO: 466985 - DNA, 20 bp, mouse
ggcgggagatccgaatttgg

SEQ ID NO: 466986 - DNA, 20 bp, mouse
ggcggccggcagctgaaaaa

SEQ ID NO: 466987 - DNA, 20 bp, mouse
ggatgcaacggattgcgagg

SEQ ID NO: 466988 - DNA, 20 bp, mouse
gacggattgcgaggcggtgg

SEQ ID NO: 466989 - DNA, 20 bp, mouse
ggctgccggccgcagcaccc

SEQ ID NO: 466990 - DNA, 20 bp, mouse
gggagggatggaggcgtcgg

SEQ ID NO: 466991 - DNA, 20 bp, mouse
gggcggcagcccgggtgctg

SEQ ID NO: 466992 - DNA, 20 bp, mouse
ggccgatgcaacggattgcg

SEQ ID NO: 466993 - DNA, 20 bp, mouse
ggcaacggattgcgaggcgg

SEQ ID NO: 466994 - DNA, 20 bp, mouse
gtcgggggcagccgatgcaa

SEQ ID NO: 466995 - DNA, 20 bp, mouse
gggttcggaagcgccgggag

SEQ ID NO: 466996 - DNA, 20 bp, mouse
gcccaggcctgggacggtcc

SEQ ID NO: 466997 - DNA, 20 bp, mouse
ggtggcggtgccgggtgcga

SEQ ID NO: 466998 - DNA, 20 bp, mouse
ggtcccggcgccctcgcacc

SEQ ID NO: 466999 - DNA, 20 bp, mouse
gagggcgccgggaccgtccc

SEQ ID NO: 467000 - DNA, 20 bp, mouse
gagagggagggtggcggtgc

SEQ ID NO: 467001 - DNA, 20 bp, mouse
gctgggagccggcgagcagg

SEQ ID NO: 467002 - DNA, 20 bp, mouse
gccgaggccgagtggagcgg

SEQ ID NO: 467003 - DNA, 20 bp, mouse
ggccccggggctcctagaag

SEQ ID NO: 467004 - DNA, 20 bp, mouse
gcgctccgtcgcctaccctc

SEQ ID NO: 467005 - DNA, 20 bp, mouse
gcgagccggagggtaggcga

SEQ ID NO: 467006 - DNA, 20 bp, mouse
ggccggcttggagtccccgg

SEQ ID NO: 467007 - DNA, 20 bp, mouse
gtggcggccggaggactcag

SEQ ID NO: 467008 - DNA, 20 bp, mouse
ggtggcccggcgactaggaa

SEQ ID NO: 467009 - DNA, 20 bp, mouse
ggcccccggggactccaagc

SEQ ID NO: 467010 - DNA, 20 bp, mouse
ggcccttggcgactaggaca

SEQ ID NO: 467011 - DNA, 20 bp, mouse
gtagtcgccaagggccacga

SEQ ID NO: 467012 - DNA, 20 bp, mouse
gccctcagccaggccaggcg

SEQ ID NO: 467013 - DNA, 20 bp, mouse
gcggcgggcgggcgcgatgg

SEQ ID NO: 467014 - DNA, 20 bp, mouse
gctaggaacggaagcggaag

SEQ ID NO: 467015 - DNA, 20 bp, mouse
gcggcgactaggaacggaag

SEQ ID NO: 467016 - DNA, 20 bp, mouse
gaggatggcgccccatgcgg

SEQ ID NO: 467017 - DNA, 20 bp, mouse
ggcgcggctccggggactgg

SEQ ID NO: 467018 - DNA, 20 bp, mouse
gccccgcgtccaccagtccc

SEQ ID NO: 467019 - DNA, 20 bp, mouse
ggcgcgcggattcacacgag

SEQ ID NO: 467020 - DNA, 20 bp, mouse
gaaactcgggcccaccctcg

SEQ ID NO: 467021 - DNA, 20 bp, mouse
gcggccagcgccgcgagggt

SEQ ID NO: 467022 - DNA, 20 bp, mouse
gcacggcaccacagagcgcg

SEQ ID NO: 467023 - DNA, 20 bp, mouse
gggcgtcctggatctcaaag

SEQ ID NO: 467024 - DNA, 20 bp, mouse
ggggtgggcccgagtttaaa

SEQ ID NO: 467025 - DNA, 20 bp, mouse
gcgaggagccgctccgccac

SEQ ID NO: 467026 - DNA, 20 bp, mouse
gggtcagggtaggctcggag

SEQ ID NO: 467027 - DNA, 20 bp, mouse
ggtaggctcggaggggacca

SEQ ID NO: 467028 - DNA, 20 bp, mouse
ggaggggaccagggtgaccg

SEQ ID NO: 467029 - DNA, 20 bp, mouse
ggggaccagggtgaccgcgg

SEQ ID NO: 467030 - DNA, 20 bp, mouse
gccaggcgcagagggggtca

SEQ ID NO: 467031 - DNA, 20 bp, mouse
gatgagcccaggcgcagagg

SEQ ID NO: 467032 - DNA, 20 bp, mouse
ggggaacctgagcgcctccg

SEQ ID NO: 467033 - DNA, 20 bp, mouse
ggcgatgagcccaggcgcag

SEQ ID NO: 467034 - DNA, 20 bp, mouse
gggacagcatgagtcagcag

SEQ ID NO: 467035 - DNA, 20 bp, mouse
ggcggaaagatggccggcca

SEQ ID NO: 467036 - DNA, 20 bp, mouse
gtagcggggaccgcgatcca

SEQ ID NO: 467037 - DNA, 20 bp, mouse
ggagcttggcttaggcgggt

SEQ ID NO: 467038 - DNA, 20 bp, mouse
gcagccagcacaaccccagg

SEQ ID NO: 467039 - DNA, 20 bp, mouse
gtgtgggacggcatccaggg

SEQ ID NO: 467040 - DNA, 20 bp, mouse
gcccgcctccccatccgagg

SEQ ID NO: 467041 - DNA, 20 bp, mouse
gtgcttagatgcctagggag

SEQ ID NO: 467042 - DNA, 20 bp, mouse
ggcgatggagggtctctccg

SEQ ID NO: 467043 - DNA, 20 bp, mouse
gagcggccggctggcgacat

SEQ ID NO: 467044 - DNA, 20 bp, mouse
ggctggagcttggcttaggc

SEQ ID NO: 467045 - DNA, 20 bp, mouse
gaagctccagccctggatcg

SEQ ID NO: 467046 - DNA, 20 bp, mouse
gggcgagggaaggattccct

SEQ ID NO: 467047 - DNA, 20 bp, mouse
gggaccgggagcgcagcgta

SEQ ID NO: 467048 - DNA, 20 bp, mouse
ggcgcagaggctgaattgga

SEQ ID NO: 467049 - DNA, 20 bp, mouse
gtggggactgtacctgggac

SEQ ID NO: 467050 - DNA, 20 bp, mouse
ggtgcacaggctcagaagga

SEQ ID NO: 467051 - DNA, 20 bp, mouse
gcgggacgcgggctactgct

SEQ ID NO: 467052 - DNA, 20 bp, mouse
gcccggatcagtgcacaggt

SEQ ID NO: 467053 - DNA, 20 bp, mouse
ggccatctcgaacctgagag

SEQ ID NO: 467054 - DNA, 20 bp, mouse
gacacgtgcacaggctcaga

SEQ ID NO: 467055 - DNA, 20 bp, mouse
gcgcagcgtacggtgcgctt

SEQ ID NO: 467056 - DNA, 20 bp, mouse
gtcctgcggcacagagaccg

SEQ ID NO: 467057 - DNA, 20 bp, mouse
ggctccgcctcgcctcgcca

SEQ ID NO: 467058 - DNA, 20 bp, mouse
gctagagctaggcgacgtag

SEQ ID NO: 467059 - DNA, 20 bp, mouse
ggcctcgccatggtggagca

SEQ ID NO: 467060 - DNA, 20 bp, mouse
ggagctaggcgacgtagagg

SEQ ID NO: 467061 - DNA, 20 bp, mouse
gtcaccggagcgaggatcga

SEQ ID NO: 467062 - DNA, 20 bp, mouse
gtccctgctccaccatggcg

SEQ ID NO: 467063 - DNA, 20 bp, mouse
gcccgtgccccgggaccccc

SEQ ID NO: 467064 - DNA, 20 bp, mouse
gggctgcagcagcacttcgg

SEQ ID NO: 467065 - DNA, 20 bp, mouse
gtcgaaggtgaccacgaaca

SEQ ID NO: 467066 - DNA, 20 bp, mouse
gaagatgggcaagtgtccag

SEQ ID NO: 467067 - DNA, 20 bp, mouse
gcagtggctgcccgacgacc

SEQ ID NO: 467068 - DNA, 20 bp, mouse
ggtggttcctctcaatttaa

SEQ ID NO: 467069 - DNA, 20 bp, mouse
gaattcctgtcccggtcgtc

SEQ ID NO: 467070 - DNA, 20 bp, mouse
gacaggaattcgcaacagta

SEQ ID NO: 467071 - DNA, 20 bp, mouse
gctgtgcatgcgttcttcgg

SEQ ID NO: 467072 - DNA, 20 bp, mouse
gtagtctctgctgggaaaaa

SEQ ID NO: 467073 - DNA, 20 bp, mouse
gcgcaggcaggaatcaacac

SEQ ID NO: 467074 - DNA, 20 bp, mouse
gggttgctcccaaggataca

SEQ ID NO: 467075 - DNA, 20 bp, mouse
gcaatttaaaggctgaaaga

SEQ ID NO: 467076 - DNA, 20 bp, mouse
ggtgccaaagaggagaagtg

SEQ ID NO: 467077 - DNA, 20 bp, mouse
gaagggctgctgagtgaggg

SEQ ID NO: 467078 - DNA, 20 bp, mouse
gcctcctcacttctcctctt

SEQ ID NO: 467079 - DNA, 20 bp, mouse
gaaaaattgcagttaactaa

SEQ ID NO: 467080 - DNA, 20 bp, mouse
gactaagggctgctgagtga

SEQ ID NO: 467081 - DNA, 20 bp, mouse
gataggaacactgtcacctc

SEQ ID NO: 467082 - DNA, 20 bp, mouse
gtggatctgtggtgccaaag

SEQ ID NO: 467083 - DNA, 20 bp, mouse
gccatgtagctaagagtggt

SEQ ID NO: 467084 - DNA, 20 bp, mouse
gactgcaatttttgaactag

SEQ ID NO: 467085 - DNA, 20 bp, mouse
gtctctaatctgcaaatctt

SEQ ID NO: 467086 - DNA, 20 bp, mouse
gtcttcagagaagggatggc

SEQ ID NO: 467087 - DNA, 20 bp, mouse
gcaggtggtaagccacaact

SEQ ID NO: 467088 - DNA, 20 bp, mouse
gaggcaaaacggcaactcaa

SEQ ID NO: 467089 - DNA, 20 bp, mouse
ggaaaacatttcagcattag

SEQ ID NO: 467090 - DNA, 20 bp, mouse
gaaggctttgaaccaagttg

SEQ ID NO: 467091 - DNA, 20 bp, mouse
ggatttagaactctaatcat

SEQ ID NO: 467092 - DNA, 20 bp, mouse
gctaatcatgggctacgaga

SEQ ID NO: 467093 - DNA, 20 bp, mouse
gccgtaaaacgagcttctca

SEQ ID NO: 467094 - DNA, 20 bp, mouse
gcaactcaatggttaggatg

SEQ ID NO: 467095 - DNA, 20 bp, mouse
ggactcttaaggagctgcgt

SEQ ID NO: 467096 - DNA, 20 bp, mouse
gaacacaccccgggcaccca

SEQ ID NO: 467097 - DNA, 20 bp, mouse
ggcattgcctcaacacaccc

SEQ ID NO: 467098 - DNA, 20 bp, mouse
gttgtccttgggccctgtac

SEQ ID NO: 467099 - DNA, 20 bp, mouse
gccacaaggtcgttgtcctt

SEQ ID NO: 467100 - DNA, 20 bp, mouse
ggtggcctgtacagggccca

SEQ ID NO: 467101 - DNA, 20 bp, mouse
gaggaagacacaacacggtc

SEQ ID NO: 467102 - DNA, 20 bp, mouse
gcccagtgtgggtagaaaaa

SEQ ID NO: 467103 - DNA, 20 bp, mouse
gggtagaaaaagggtgaaag

SEQ ID NO: 467104 - DNA, 20 bp, mouse
ggcgcccaccttggccagca

SEQ ID NO: 467105 - DNA, 20 bp, mouse
gccaaggtgggcgcaacatc

SEQ ID NO: 467106 - DNA, 20 bp, mouse
gggcttggcaccacgaagag

SEQ ID NO: 467107 - DNA, 20 bp, mouse
gaggagctccgggattcaag

SEQ ID NO: 467108 - DNA, 20 bp, mouse
ggcagagccaaagaggcaat

SEQ ID NO: 467109 - DNA, 20 bp, mouse
gggtcccaagcctgttggaa

SEQ ID NO: 467110 - DNA, 20 bp, mouse
gggaatcttctgctaaagct

SEQ ID NO: 467111 - DNA, 20 bp, mouse
gcaatctgggcccttccaac

SEQ ID NO: 467112 - DNA, 20 bp, mouse
gggagctcctattgcctctt

SEQ ID NO: 467113 - DNA, 20 bp, mouse
ggtcatcccaggcgtggtac

SEQ ID NO: 467114 - DNA, 20 bp, mouse
gtgagagttactcacaatct

SEQ ID NO: 467115 - DNA, 20 bp, mouse
gagattccagtaccacgcct

SEQ ID NO: 467116 - DNA, 20 bp, mouse
gagggagaacattatcaggg

SEQ ID NO: 467117 - DNA, 20 bp, mouse
gaatgctgaggagcagagta

SEQ ID NO: 467118 - DNA, 20 bp, mouse
gtcagtttctggtgagtaca

SEQ ID NO: 467119 - DNA, 20 bp, mouse
gaggagcagagtaaggtaga

SEQ ID NO: 467120 - DNA, 20 bp, mouse
ggggatgccaggagctctcc

SEQ ID NO: 467121 - DNA, 20 bp, mouse
gccacttcttccaggaagtt

SEQ ID NO: 467122 - DNA, 20 bp, mouse
gtggaattggagcctccagg

SEQ ID NO: 467123 - DNA, 20 bp, mouse
gagttgggcactcccttccc

SEQ ID NO: 467124 - DNA, 20 bp, mouse
gaagtggttctgggaagacc

SEQ ID NO: 467125 - DNA, 20 bp, mouse
gttgctggattgcactgaga

SEQ ID NO: 467126 - DNA, 20 bp, mouse
gtccgtgagcaccctaatgt

SEQ ID NO: 467127 - DNA, 20 bp, mouse
gcaggtacagatgcaagacg

SEQ ID NO: 467128 - DNA, 20 bp, mouse
ggatctggcaggcgatccag

SEQ ID NO: 467129 - DNA, 20 bp, mouse
gaccgcggcaacctaggatc

SEQ ID NO: 467130 - DNA, 20 bp, mouse
gcagccctggtaccccaccg

SEQ ID NO: 467131 - DNA, 20 bp, mouse
gacctacattagggtgctca

SEQ ID NO: 467132 - DNA, 20 bp, mouse
gccgcggatggccccggaaa

SEQ ID NO: 467133 - DNA, 20 bp, mouse
gacgggtggtcgtaacaagt

SEQ ID NO: 467134 - DNA, 20 bp, mouse
ggcatgacccacagtgtcaa

SEQ ID NO: 467135 - DNA, 20 bp, mouse
gctgagaaaggacatatatc

SEQ ID NO: 467136 - DNA, 20 bp, mouse
gctgcggcccgggactctag

SEQ ID NO: 467137 - DNA, 20 bp, mouse
ggcgtcagctgccgggaccc

SEQ ID NO: 467138 - DNA, 20 bp, mouse
gcccggcagctgacgctctg

SEQ ID NO: 467139 - DNA, 20 bp, mouse
gagggatccccctagagtcc

SEQ ID NO: 467140 - DNA, 20 bp, mouse
gaggacagaaacccgggtcc

SEQ ID NO: 467141 - DNA, 20 bp, mouse
ggagccaacgggaaaaccta

SEQ ID NO: 467142 - DNA, 20 bp, mouse
gatccctggggtgggagacg

SEQ ID NO: 467143 - DNA, 20 bp, mouse
gccgtcacgtgaccaagggg

SEQ ID NO: 467144 - DNA, 20 bp, mouse
gtagtcactggagtgatgat

SEQ ID NO: 467145 - DNA, 20 bp, mouse
gagctgacgctctgcggccc

SEQ ID NO: 467146 - DNA, 20 bp, mouse
ggcgatggcagtgcgggtga

SEQ ID NO: 467147 - DNA, 20 bp, mouse
gcgggtgacggccgctcata

SEQ ID NO: 467148 - DNA, 20 bp, mouse
ggagggcgcgatggcagtgc

SEQ ID NO: 467149 - DNA, 20 bp, mouse
gtggcgcgttgcgacatgga

SEQ ID NO: 467150 - DNA, 20 bp, mouse
gtgcgacatggagggcgcga

SEQ ID NO: 467151 - DNA, 20 bp, mouse
gcctgtggcgcgttgcgaca

SEQ ID NO: 467152 - DNA, 20 bp, mouse
ggctcatacggcagaagccc

SEQ ID NO: 467153 - DNA, 20 bp, mouse
gacgcgccacaggaagatgg

SEQ ID NO: 467154 - DNA, 20 bp, mouse
gactcgagtagccaggatcc

SEQ ID NO: 467155 - DNA, 20 bp, mouse
gagaagcccgggccgaagcc

SEQ ID NO: 467156 - DNA, 20 bp, mouse
gttcagtgcgcgctccggag

SEQ ID NO: 467157 - DNA, 20 bp, mouse
gcgctcccgggacaccgctc

SEQ ID NO: 467158 - DNA, 20 bp, mouse
gcgctccggagcggtgtccc

SEQ ID NO: 467159 - DNA, 20 bp, mouse
ggccccaagtgaacctggag

SEQ ID NO: 467160 - DNA, 20 bp, mouse
ggcttgcgcggggatccggg

SEQ ID NO: 467161 - DNA, 20 bp, mouse
gcccgcaggaccgcgctccc

SEQ ID NO: 467162 - DNA, 20 bp, mouse
gttggtttccggccccgggt

SEQ ID NO: 467163 - DNA, 20 bp, mouse
gccgggaggaacactgtctg

SEQ ID NO: 467164 - DNA, 20 bp, mouse
gccagaggctaagggatgag

SEQ ID NO: 467165 - DNA, 20 bp, mouse
gcgcgcggccgcagtccccc

SEQ ID NO: 467166 - DNA, 20 bp, mouse
gctggctgcgagcttgagtt

SEQ ID NO: 467167 - DNA, 20 bp, mouse
gagactcggggcgctccaag

SEQ ID NO: 467168 - DNA, 20 bp, mouse
ggcacgcgtctggaggtgaa

SEQ ID NO: 467169 - DNA, 20 bp, mouse
gggcggccgcacgcgtctgg

SEQ ID NO: 467170 - DNA, 20 bp, mouse
gggcgaaggccaaaagcggg

SEQ ID NO: 467171 - DNA, 20 bp, mouse
gtgctccccgggagaccaga

SEQ ID NO: 467172 - DNA, 20 bp, mouse
ggtctggaggtgaaaggagc

SEQ ID NO: 467173 - DNA, 20 bp, mouse
gccacagtgtaggagaaccc

SEQ ID NO: 467174 - DNA, 20 bp, mouse
gcggtgtggaaggcacagcg

SEQ ID NO: 467175 - DNA, 20 bp, mouse
ggcactcacagcgcacggtg

SEQ ID NO: 467176 - DNA, 20 bp, mouse
ggagtacacagacgccgggg

SEQ ID NO: 467177 - DNA, 20 bp, mouse
gacagacgccggggcggtgt

SEQ ID NO: 467178 - DNA, 20 bp, mouse
ggaggacgcctacaccgccc

SEQ ID NO: 467179 - DNA, 20 bp, mouse
ggccggcgcgaacaacacaa

SEQ ID NO: 467180 - DNA, 20 bp, mouse
ggcggagtacacagacgccg

SEQ ID NO: 467181 - DNA, 20 bp, mouse
ggaggctcccgcaagtgaag

SEQ ID NO: 467182 - DNA, 20 bp, mouse
ggagtctccgggaagctttg

SEQ ID NO: 467183 - DNA, 20 bp, mouse
ggaaggactcgcagtacggg

SEQ ID NO: 467184 - DNA, 20 bp, mouse
ggaagctttggggaaggcgc

SEQ ID NO: 467185 - DNA, 20 bp, mouse
gtggcgctgctcagtctcta

SEQ ID NO: 467186 - DNA, 20 bp, mouse
ggggctagagtaacatgtaa

SEQ ID NO: 467187 - DNA, 20 bp, mouse
gtttcaattacattggaggt

SEQ ID NO: 467188 - DNA, 20 bp, mouse
gagcatttcaattacattgg

SEQ ID NO: 467189 - DNA, 20 bp, mouse
gcgcagcatttcaattacat

SEQ ID NO: 467190 - DNA, 20 bp, mouse
ggaaatgctgcgtattaaca

SEQ ID NO: 467191 - DNA, 20 bp, mouse
gtctatgcctgggacagggt

SEQ ID NO: 467192 - DNA, 20 bp, mouse
gactgtctatgcctgggaca

SEQ ID NO: 467193 - DNA, 20 bp, mouse
ggggcagtgttcaggaaaag

SEQ ID NO: 467194 - DNA, 20 bp, mouse
gacaccgactgtctatgcct

SEQ ID NO: 467195 - DNA, 20 bp, mouse
gtgtggctcccgtggaactg

SEQ ID NO: 467196 - DNA, 20 bp, mouse
gacttctcttctgtcctcat

SEQ ID NO: 467197 - DNA, 20 bp, mouse
gtggacccatgtttcctatg

SEQ ID NO: 467198 - DNA, 20 bp, mouse
gtttccctatgtctacctga

SEQ ID NO: 467199 - DNA, 20 bp, mouse
gctgtaacatcaccagttgg

SEQ ID NO: 467200 - DNA, 20 bp, mouse
gctgtcataatagttcatat

SEQ ID NO: 467201 - DNA, 20 bp, mouse
gaagtcctagcagcagcagg

SEQ ID NO: 467202 - DNA, 20 bp, mouse
gcagcagcaggaggcaaatt

SEQ ID NO: 467203 - DNA, 20 bp, mouse
gtaccaagctaaaagatcat

SEQ ID NO: 467204 - DNA, 20 bp, mouse
gtaaggtgttctcctccaac

SEQ ID NO: 467205 - DNA, 20 bp, mouse
gggtatctgcattgggtata

SEQ ID NO: 467206 - DNA, 20 bp, mouse
gggacagggtggcaaatgat

SEQ ID NO: 467207 - DNA, 20 bp, mouse
ggccattgaccccctcccgg

SEQ ID NO: 467208 - DNA, 20 bp, mouse
ggggccgttaacagttacac

SEQ ID NO: 467209 - DNA, 20 bp, mouse
gtggatgtcaaaccaccggg

SEQ ID NO: 467210 - DNA, 20 bp, mouse
gaccaccgggagggggtcaa

SEQ ID NO: 467211 - DNA, 20 bp, mouse
gctcacaggaaacatgggtc

SEQ ID NO: 467212 - DNA, 20 bp, mouse
gagatagggaaaacagagtt

SEQ ID NO: 467213 - DNA, 20 bp, mouse
gacgtggattatgacacaca

SEQ ID NO: 467214 - DNA, 20 bp, mouse
gtgctggatgtcaaaccacc

SEQ ID NO: 467215 - DNA, 20 bp, mouse
gggggtcaatggctggcatg

SEQ ID NO: 467216 - DNA, 20 bp, mouse
gcattacagcatcacatcgg

SEQ ID NO: 467217 - DNA, 20 bp, mouse
gacagcatcacatcgggggt

SEQ ID NO: 467218 - DNA, 20 bp, mouse
gtgtaatgagggttgttaac

SEQ ID NO: 467219 - DNA, 20 bp, mouse
gtattcttgtcggcgtagtg

SEQ ID NO: 467220 - DNA, 20 bp, mouse
gaatgcagataccaaacgac

SEQ ID NO: 467221 - DNA, 20 bp, mouse
gcttcactgaacctgtcgtt

SEQ ID NO: 467222 - DNA, 20 bp, mouse
gaggatttgtgcctggcatg

SEQ ID NO: 467223 - DNA, 20 bp, mouse
gctgggaaaggatttgtgcc

SEQ ID NO: 467224 - DNA, 20 bp, mouse
gctgttttcacagaaattgt

SEQ ID NO: 467225 - DNA, 20 bp, mouse
gattgtgtgcatattcttgt

SEQ ID NO: 467226 - DNA, 20 bp, mouse
gtccaggagaagtcccaccg

SEQ ID NO: 467227 - DNA, 20 bp, mouse
ggtcactgtgggtccacggt

SEQ ID NO: 467228 - DNA, 20 bp, mouse
gctggcatgagacaagcgtt

SEQ ID NO: 467229 - DNA, 20 bp, mouse
gctgggaaggggttggtcgc

SEQ ID NO: 467230 - DNA, 20 bp, mouse
gtcccgtctttgcaagtctt

SEQ ID NO: 467231 - DNA, 20 bp, mouse
ggggtcgttaacaagtatac

SEQ ID NO: 467232 - DNA, 20 bp, mouse
gcgtctttgcaagtcttggg

SEQ ID NO: 467233 - DNA, 20 bp, mouse
gatgaactatcatgacaatt

SEQ ID NO: 467234 - DNA, 20 bp, mouse
gtccacggtgggacttctcc

SEQ ID NO: 467235 - DNA, 20 bp, mouse
gaagtatacaggaaaatgta

SEQ ID NO: 467236 - DNA, 20 bp, mouse
gacaggagaggcgggtgatg

SEQ ID NO: 467237 - DNA, 20 bp, mouse
gaggcctgggacaggagagg

SEQ ID NO: 467238 - DNA, 20 bp, mouse
gtgcatagaccaagatgtaa

SEQ ID NO: 467239 - DNA, 20 bp, mouse
gatgctgggtagcaaaccac

SEQ ID NO: 467240 - DNA, 20 bp, mouse
ggaaaccaaccgcatcccag

SEQ ID NO: 467241 - DNA, 20 bp, mouse
gcaaaccactgggatgcggt

SEQ ID NO: 467242 - DNA, 20 bp, mouse
ggctttataagtgatatgct

SEQ ID NO: 467243 - DNA, 20 bp, mouse
gtccacagtgacacttttcc

SEQ ID NO: 467244 - DNA, 20 bp, mouse
ggcggttggtttctggcatg

SEQ ID NO: 467245 - DNA, 20 bp, mouse
gcaatgtaatgttgaaatgc

SEQ ID NO: 467246 - DNA, 20 bp, mouse
gccagcagaagcctcttgag

SEQ ID NO: 467247 - DNA, 20 bp, mouse
gcatggcggcgcccctcaag

SEQ ID NO: 467248 - DNA, 20 bp, mouse
ggcccgagggccaccacgtg

SEQ ID NO: 467249 - DNA, 20 bp, mouse
gcgcgcagacaaccccggaa

SEQ ID NO: 467250 - DNA, 20 bp, mouse
ggtgtttctagtccacatgg

SEQ ID NO: 467251 - DNA, 20 bp, mouse
gctggccgagccgcacgtgg

SEQ ID NO: 467252 - DNA, 20 bp, mouse
gcgtgagcagcccagatagg

SEQ ID NO: 467253 - DNA, 20 bp, mouse
gtcgccgccctagtccagag

SEQ ID NO: 467254 - DNA, 20 bp, mouse
gctgtttctggaactttcgg

SEQ ID NO: 467255 - DNA, 20 bp, mouse
gagggccaccacgtgcggct

SEQ ID NO: 467256 - DNA, 20 bp, mouse
ggcgagctcgaggcagacag

SEQ ID NO: 467257 - DNA, 20 bp, mouse
gaccgggtcaggaggcgggt

SEQ ID NO: 467258 - DNA, 20 bp, mouse
ggccgaagagaaaggcggga

SEQ ID NO: 467259 - DNA, 20 bp, mouse
gcgggagggcaggaagtacg

SEQ ID NO: 467260 - DNA, 20 bp, mouse
ggtgcgaggcccgtagagga

SEQ ID NO: 467261 - DNA, 20 bp, mouse
gggtagagggccgaagagaa

SEQ ID NO: 467262 - DNA, 20 bp, mouse
gctcggcgagtgggaggtcg

SEQ ID NO: 467263 - DNA, 20 bp, mouse
gagagggccgaagagaaagg

SEQ ID NO: 467264 - DNA, 20 bp, mouse
gaaacagtaccccagagtgg

SEQ ID NO: 467265 - DNA, 20 bp, mouse
gagtgggaggtcgaggtaga

SEQ ID NO: 467266 - DNA, 20 bp, mouse
gaggggtggaccctgctgga

SEQ ID NO: 467267 - DNA, 20 bp, mouse
gagtcaaactggattccaca

SEQ ID NO: 467268 - DNA, 20 bp, mouse
gtctccccagagctaaacac

SEQ ID NO: 467269 - DNA, 20 bp, mouse
ggtgctggacgccaacacag

SEQ ID NO: 467270 - DNA, 20 bp, mouse
gctcatctacacgcacggaa

SEQ ID NO: 467271 - DNA, 20 bp, mouse
ggctctggggagagtcaaac

SEQ ID NO: 467272 - DNA, 20 bp, mouse
gagagaggggtggaccctgc

SEQ ID NO: 467273 - DNA, 20 bp, mouse
gtgagcgataacaaggaggg

SEQ ID NO: 467274 - DNA, 20 bp, mouse
gcatctttggttgagagagg

SEQ ID NO: 467275 - DNA, 20 bp, mouse
gtagcgggagagcccggaga

SEQ ID NO: 467276 - DNA, 20 bp, mouse
gagcgcgcgggccccatgaa

SEQ ID NO: 467277 - DNA, 20 bp, mouse
gggaaggggaagacccggag

SEQ ID NO: 467278 - DNA, 20 bp, mouse
gctgcagcagcccggctctg

SEQ ID NO: 467279 - DNA, 20 bp, mouse
gtaagaggaaggggaagacc

SEQ ID NO: 467280 - DNA, 20 bp, mouse
ggggaagacccggagcgggg

SEQ ID NO: 467281 - DNA, 20 bp, mouse
gtagagtggaagccccgagg

SEQ ID NO: 467282 - DNA, 20 bp, mouse
gggttgtagtaaccattcat

SEQ ID NO: 467283 - DNA, 20 bp, mouse
gggatcagttgtaagaggaa

SEQ ID NO: 467284 - DNA, 20 bp, mouse
gcaacaggatcagttgtaag

SEQ ID NO: 467285 - DNA, 20 bp, mouse
gggatgcgggcgacctagag

SEQ ID NO: 467286 - DNA, 20 bp, mouse
gcggcgcgcgcagcggacgg

SEQ ID NO: 467287 - DNA, 20 bp, mouse
gagtgccgcggcgcagtccc

SEQ ID NO: 467288 - DNA, 20 bp, mouse
gcctagccaggcggcgtccg

SEQ ID NO: 467289 - DNA, 20 bp, mouse
gggaaagggtccattcctcg

SEQ ID NO: 467290 - DNA, 20 bp, mouse
gaacggggcagtgagtgccg

SEQ ID NO: 467291 - DNA, 20 bp, mouse
gtgcgcccgggactgcgccg

SEQ ID NO: 467292 - DNA, 20 bp, mouse
gactcagccctctctccccg

SEQ ID NO: 467293 - DNA, 20 bp, mouse
gcaggcgccgcatacaccgg

SEQ ID NO: 467294 - DNA, 20 bp, mouse
ggggcaggcgccgcatacac

SEQ ID NO: 467295 - DNA, 20 bp, mouse
gctccaaagacaaataaacg

SEQ ID NO: 467296 - DNA, 20 bp, mouse
ggggagcacgggcaagagga

SEQ ID NO: 467297 - DNA, 20 bp, mouse
gctggggagcgggagccgta

SEQ ID NO: 467298 - DNA, 20 bp, mouse
gcgcaagcgggtgggcccag

SEQ ID NO: 467299 - DNA, 20 bp, mouse
gagggctgtcgcaagcgggt

SEQ ID NO: 467300 - DNA, 20 bp, mouse
gagaggagggctgtcgcaag

SEQ ID NO: 467301 - DNA, 20 bp, mouse
ggggagggagcacgggcaag

SEQ ID NO: 467302 - DNA, 20 bp, mouse
ggccaggccccggggagcgg

SEQ ID NO: 467303 - DNA, 20 bp, mouse
gccgcacggaggcgccccag

SEQ ID NO: 467304 - DNA, 20 bp, mouse
gaggctgcggccgtggaggt

SEQ ID NO: 467305 - DNA, 20 bp, mouse
ggcggccaggccccggggag

SEQ ID NO: 467306 - DNA, 20 bp, mouse
gggcccagagggcaagtgac

SEQ ID NO: 467307 - DNA, 20 bp, mouse
gctcagttgtccagtgtatg

SEQ ID NO: 467308 - DNA, 20 bp, mouse
gcacagggaacctggcccca

SEQ ID NO: 467309 - DNA, 20 bp, mouse
gtagaaggagggccccaaaa

SEQ ID NO: 467310 - DNA, 20 bp, mouse
gttcagtgtaaccaggggag

SEQ ID NO: 467311 - DNA, 20 bp, mouse
gctgctgagtcacaaaggtg

SEQ ID NO: 467312 - DNA, 20 bp, mouse
ggcagcttggacatgctctg

SEQ ID NO: 467313 - DNA, 20 bp, mouse
gcagagagagggtgaaggac

SEQ ID NO: 467314 - DNA, 20 bp, mouse
gtgtgtggggaaaggccttg

SEQ ID NO: 467315 - DNA, 20 bp, mouse
gttagtgacccatcagagag

SEQ ID NO: 467316 - DNA, 20 bp, mouse
gtgcttgtgggcacgtggag

SEQ ID NO: 467317 - DNA, 20 bp, mouse
gtggcggtggtgctgcttgt

SEQ ID NO: 467318 - DNA, 20 bp, mouse
gtccgactctgaaagcggag

SEQ ID NO: 467319 - DNA, 20 bp, mouse
ggtggcagccgaacctcgcg

SEQ ID NO: 467320 - DNA, 20 bp, mouse
gccttccgccccgcgaggtt

SEQ ID NO: 467321 - DNA, 20 bp, mouse
ggtccctgttgaaaaggcag

SEQ ID NO: 467322 - DNA, 20 bp, mouse
gccagaatcggtctcccaag

SEQ ID NO: 467323 - DNA, 20 bp, mouse
gcggaggggtgtccatctcg

SEQ ID NO: 467324 - DNA, 20 bp, mouse
ggcggaagtccctgttgaaa

SEQ ID NO: 467325 - DNA, 20 bp, mouse
gtgcctggcctcagatcaag

SEQ ID NO: 467326 - DNA, 20 bp, mouse
ggctggctggcactcacccc

SEQ ID NO: 467327 - DNA, 20 bp, mouse
gcccaggcggcgcgatcgca

SEQ ID NO: 467328 - DNA, 20 bp, mouse
gcagggcgacttcctaacac

SEQ ID NO: 467329 - DNA, 20 bp, mouse
gaaagtcgcaagcctgtgtt

SEQ ID NO: 467330 - DNA, 20 bp, mouse
gccgctgtcgtggagggtct

SEQ ID NO: 467331 - DNA, 20 bp, mouse
gggctggcactcaccccagg

SEQ ID NO: 467332 - DNA, 20 bp, mouse
gctgtagctgcccaacgaga

SEQ ID NO: 467333 - DNA, 20 bp, mouse
ggaagactcgccctctcgtt

SEQ ID NO: 467334 - DNA, 20 bp, mouse
gggtgcactgcagggtccag

SEQ ID NO: 467335 - DNA, 20 bp, mouse
ggagggtctgggcacgtgga

SEQ ID NO: 467336 - DNA, 20 bp, mouse
gatggctccacagcacacca

SEQ ID NO: 467337 - DNA, 20 bp, mouse
gcccaaggcaggctgcgacg

SEQ ID NO: 467338 - DNA, 20 bp, mouse
gagcgcccaatgctccccca

SEQ ID NO: 467339 - DNA, 20 bp, mouse
gcaggccgccagagacatca

SEQ ID NO: 467340 - DNA, 20 bp, mouse
gcaaggaggagcctgcctcc

SEQ ID NO: 467341 - DNA, 20 bp, mouse
gcgctcgccgtggtgtgctg

SEQ ID NO: 467342 - DNA, 20 bp, mouse
gctgcgagctagcctcttgt

SEQ ID NO: 467343 - DNA, 20 bp, mouse
gaggcccagcgcgcacccta

SEQ ID NO: 467344 - DNA, 20 bp, mouse
gctcccatccctcctcagtt

SEQ ID NO: 467345 - DNA, 20 bp, mouse
ggcaggctccccgctcgccg

SEQ ID NO: 467346 - DNA, 20 bp, mouse
gggcgttcaggcgtggatca

SEQ ID NO: 467347 - DNA, 20 bp, mouse
gcagcaggacacttggtcag

SEQ ID NO: 467348 - DNA, 20 bp, mouse
gcagggcccaagcgaacgcg

SEQ ID NO: 467349 - DNA, 20 bp, mouse
gacttgcaggcgttcaggcg

SEQ ID NO: 467350 - DNA, 20 bp, mouse
gcccaatcccggcccatgct

SEQ ID NO: 467351 - DNA, 20 bp, mouse
gtgggtcctcgcgttcgctt

SEQ ID NO: 467352 - DNA, 20 bp, mouse
gcgaacgcgaggacccagca

SEQ ID NO: 467353 - DNA, 20 bp, mouse
ggccaccaggagcactgtcc

SEQ ID NO: 467354 - DNA, 20 bp, mouse
ggcactagagactatactca

SEQ ID NO: 467355 - DNA, 20 bp, mouse
gtcacgacttgcaggcgttc

SEQ ID NO: 467356 - DNA, 20 bp, mouse
ggagctggagccttagcggg

SEQ ID NO: 467357 - DNA, 20 bp, mouse
gtaggatgcacctcccgcta

SEQ ID NO: 467358 - DNA, 20 bp, mouse
ggtcgctcccgggctccgaa

SEQ ID NO: 467359 - DNA, 20 bp, mouse
gcttggagctggagccttag

SEQ ID NO: 467360 - DNA, 20 bp, mouse
gtcccgggctccgaacggcc

SEQ ID NO: 467361 - DNA, 20 bp, mouse
ggctctacgctcgaacctca

SEQ ID NO: 467362 - DNA, 20 bp, mouse
gagcccagcgcacttggagc

SEQ ID NO: 467363 - DNA, 20 bp, mouse
gacccggacaggagttgtgg

SEQ ID NO: 467364 - DNA, 20 bp, mouse
ggggaggtgcatcctaagcc

SEQ ID NO: 467365 - DNA, 20 bp, mouse
gagtactcaccgtcgctccc

SEQ ID NO: 467366 - DNA, 20 bp, mouse
ggaggggacaccggagtccg

SEQ ID NO: 467367 - DNA, 20 bp, mouse
ggtaactccggaggggacac

SEQ ID NO: 467368 - DNA, 20 bp, mouse
gcggggagaggccatgctca

SEQ ID NO: 467369 - DNA, 20 bp, mouse
gggtactggaagttcttctc

SEQ ID NO: 467370 - DNA, 20 bp, mouse
gtcttctccggtaactccgg

SEQ ID NO: 467371 - DNA, 20 bp, mouse
gcagggcagcgccgcagcca

SEQ ID NO: 467372 - DNA, 20 bp, mouse
gatggcctctccccggactc

SEQ ID NO: 467373 - DNA, 20 bp, mouse
gtgcggcgctgccctgagca

SEQ ID NO: 467374 - DNA, 20 bp, mouse
gagttcttctccggtaactc

SEQ ID NO: 467375 - DNA, 20 bp, mouse
gtaggtgcctccagtgtctg

SEQ ID NO: 467376 - DNA, 20 bp, mouse
gcagcagtgactgtgatgga

SEQ ID NO: 467377 - DNA, 20 bp, mouse
ggccgccgcggccaagccag

SEQ ID NO: 467378 - DNA, 20 bp, mouse
gttgacccgcccaggaacta

SEQ ID NO: 467379 - DNA, 20 bp, mouse
ggggcagcggcggggttcag

SEQ ID NO: 467380 - DNA, 20 bp, mouse
gactccaggggagaggaccc

SEQ ID NO: 467381 - DNA, 20 bp, mouse
ggtgatggccctggactcca

SEQ ID NO: 467382 - DNA, 20 bp, mouse
gggcctgggccgtagttcct

SEQ ID NO: 467383 - DNA, 20 bp, mouse
ggagggcacaaagtgtggag

SEQ ID NO: 467384 - DNA, 20 bp, mouse
gctgtgatggagggcagcgg

SEQ ID NO: 467385 - DNA, 20 bp, mouse
gcggagcaccaactgaggtt

SEQ ID NO: 467386 - DNA, 20 bp, mouse
gcgaggaccgagggaggggt

SEQ ID NO: 467387 - DNA, 20 bp, mouse
gatcccggcctcagccggag

SEQ ID NO: 467388 - DNA, 20 bp, mouse
ggccgggcgaggaccgaggg

SEQ ID NO: 467389 - DNA, 20 bp, mouse
gagcaaatcccggcctcagc

SEQ ID NO: 467390 - DNA, 20 bp, mouse
gcggctgcgactccaggact

SEQ ID NO: 467391 - DNA, 20 bp, mouse
gctcctctccggctgaggcc

SEQ ID NO: 467392 - DNA, 20 bp, mouse
ggagcttgagagccgagtcc

SEQ ID NO: 467393 - DNA, 20 bp, mouse
gctgggccgggcgaggaccg

SEQ ID NO: 467394 - DNA, 20 bp, mouse
ggctgtgatgatgtcctcgg

SEQ ID NO: 467395 - DNA, 20 bp, mouse
gcgtcgcgcggcgcagtcag

SEQ ID NO: 467396 - DNA, 20 bp, mouse
gagcaggccgcggagtttac

SEQ ID NO: 467397 - DNA, 20 bp, mouse
gacgctgcatcagcaggccg

SEQ ID NO: 467398 - DNA, 20 bp, mouse
gttactggaaactgtcatcg

SEQ ID NO: 467399 - DNA, 20 bp, mouse
gcagtttccagtaaactccg

SEQ ID NO: 467400 - DNA, 20 bp, mouse
gcgagcccccacggattaag

SEQ ID NO: 467401 - DNA, 20 bp, mouse
gtgcaagccaggaggtggtt

SEQ ID NO: 467402 - DNA, 20 bp, mouse
gtcccgaagaaaaacttagg

SEQ ID NO: 467403 - DNA, 20 bp, mouse
ggttaccccttaatccgtgg

SEQ ID NO: 467404 - DNA, 20 bp, mouse
ggtggaaatgacccaagatt

SEQ ID NO: 467405 - DNA, 20 bp, mouse
gtaactcacgctgcatcagc

SEQ ID NO: 467406 - DNA, 20 bp, mouse
gcaggcgccgccgcgcaggt

SEQ ID NO: 467407 - DNA, 20 bp, mouse
gcacgagcccacctgcgcgg

SEQ ID NO: 467408 - DNA, 20 bp, mouse
ggaggcgttgcagagaacgt

SEQ ID NO: 467409 - DNA, 20 bp, mouse
gtcgcgcgcagcggaaggtg

SEQ ID NO: 467410 - DNA, 20 bp, mouse
gctcacaggtagagatccca

SEQ ID NO: 467411 - DNA, 20 bp, mouse
gactcacgagcccacctgcg

SEQ ID NO: 467412 - DNA, 20 bp, mouse
gggatcccggggagcatacc

SEQ ID NO: 467413 - DNA, 20 bp, mouse
gctctggccaaaggatcccg

SEQ ID NO: 467414 - DNA, 20 bp, mouse
gaaacaggcccggagcggtg

SEQ ID NO: 467415 - DNA, 20 bp, mouse
gccggggagcataccaggag

SEQ ID NO: 467416 - DNA, 20 bp, mouse
gggcagtacgcgtagcatcg

SEQ ID NO: 467417 - DNA, 20 bp, mouse
ggcggagaacgggacctcct

SEQ ID NO: 467418 - DNA, 20 bp, mouse
ggcaaggtggcgcggagaac

SEQ ID NO: 467419 - DNA, 20 bp, mouse
gcgagaacctccaggagcac

SEQ ID NO: 467420 - DNA, 20 bp, mouse
gggggagcaggccggcaagg

SEQ ID NO: 467421 - DNA, 20 bp, mouse
gagggctcccagggtagaag

SEQ ID NO: 467422 - DNA, 20 bp, mouse
gcgggcccccgagaacctcc

SEQ ID NO: 467423 - DNA, 20 bp, mouse
gctctgacaggtcccaacca

SEQ ID NO: 467424 - DNA, 20 bp, mouse
gactctctagaggcccgggg

SEQ ID NO: 467425 - DNA, 20 bp, mouse
ggcaggaggattggatctca

SEQ ID NO: 467426 - DNA, 20 bp, mouse
ggtcctggctcccaactcca

SEQ ID NO: 467427 - DNA, 20 bp, mouse
gtggctcaggcgcaacccat

SEQ ID NO: 467428 - DNA, 20 bp, mouse
gtctaaaagggaaaaacccg

SEQ ID NO: 467429 - DNA, 20 bp, mouse
gcagaagccggcggagagag

SEQ ID NO: 467430 - DNA, 20 bp, mouse
gcttcaccccaaaggcccga

SEQ ID NO: 467431 - DNA, 20 bp, mouse
gccagcacgcgacagcagga

SEQ ID NO: 467432 - DNA, 20 bp, mouse
gcgcaggtcctgctgaccct

SEQ ID NO: 467433 - DNA, 20 bp, mouse
gtgagtgaccaggtctaaaa

SEQ ID NO: 467434 - DNA, 20 bp, mouse
gggttgcgcctgagccagct

SEQ ID NO: 467435 - DNA, 20 bp, mouse
gccctgtgcacactaatacg

SEQ ID NO: 467436 - DNA, 20 bp, mouse
gagagcacgcagggccgcca

SEQ ID NO: 467437 - DNA, 20 bp, mouse
ggcacgcagggccgccatgg

SEQ ID NO: 467438 - DNA, 20 bp, mouse
gctgggcagcagagcacgca

SEQ ID NO: 467439 - DNA, 20 bp, mouse
gggcgaagcgccgtagttct

SEQ ID NO: 467440 - DNA, 20 bp, mouse
ggcaggcggggcgattctgt

SEQ ID NO: 467441 - DNA, 20 bp, mouse
gacacatcgtctctccgcca

SEQ ID NO: 467442 - DNA, 20 bp, mouse
gagtccgctgcccagaacta

SEQ ID NO: 467443 - DNA, 20 bp, mouse
ggcgccgtagttctgggcag

SEQ ID NO: 467444 - DNA, 20 bp, mouse
gaacagtgagctacaggctc

SEQ ID NO: 467445 - DNA, 20 bp, mouse
gcggtgtccgcactcacccg

SEQ ID NO: 467446 - DNA, 20 bp, mouse
ggcgccatcttggatatcag

SEQ ID NO: 467447 - DNA, 20 bp, mouse
gcgcacccgcgtgcagcaga

SEQ ID NO: 467448 - DNA, 20 bp, mouse
ggagggcccggcaggtgaga

SEQ ID NO: 467449 - DNA, 20 bp, mouse
gctcgggcgcagggaagcgg

SEQ ID NO: 467450 - DNA, 20 bp, mouse
ggtggcccgggcgagagcgc

SEQ ID NO: 467451 - DNA, 20 bp, mouse
gtgcaccagcgctctcgccc

SEQ ID NO: 467452 - DNA, 20 bp, mouse
ggtggggactacagagccag

SEQ ID NO: 467453 - DNA, 20 bp, mouse
gcgctggtgcagggcctcac

SEQ ID NO: 467454 - DNA, 20 bp, mouse
gcgggtgctggtggagacgg

SEQ ID NO: 467455 - DNA, 20 bp, mouse
ggcggcggtggcgagagtct

SEQ ID NO: 467456 - DNA, 20 bp, mouse
gctgctgggcctaagcctcc

SEQ ID NO: 467457 - DNA, 20 bp, mouse
ggtggtcaaactgagcccgg

SEQ ID NO: 467458 - DNA, 20 bp, mouse
gccacagtatctagctatgg

SEQ ID NO: 467459 - DNA, 20 bp, mouse
ggcagggcaagaccgggaag

SEQ ID NO: 467460 - DNA, 20 bp, mouse
gcccagcccgggacttccta

SEQ ID NO: 467461 - DNA, 20 bp, mouse
gaaactgagcccggaggctt

SEQ ID NO: 467462 - DNA, 20 bp, mouse
gactttgggccggagagtcg

SEQ ID NO: 467463 - DNA, 20 bp, mouse
gagctatggcggcagtgacc

SEQ ID NO: 467464 - DNA, 20 bp, mouse
gactgtggtcaaactgagcc

SEQ ID NO: 467465 - DNA, 20 bp, mouse
gcagcatcgagcccgactcc

SEQ ID NO: 467466 - DNA, 20 bp, mouse
gccttgagcagaagagtacg

SEQ ID NO: 467467 - DNA, 20 bp, mouse
gtacgcggtgctggtgtcct

SEQ ID NO: 467468 - DNA, 20 bp, mouse
ggcttgcagcctctactgtc

SEQ ID NO: 467469 - DNA, 20 bp, mouse
gcttgcaggcgacttcctaa

SEQ ID NO: 467470 - DNA, 20 bp, mouse
gggcccgcgacaaacctcgc

SEQ ID NO: 467471 - DNA, 20 bp, mouse
gaccagatgacagagcgggg

SEQ ID NO: 467472 - DNA, 20 bp, mouse
gaaacctcgctggagacttt

SEQ ID NO: 467473 - DNA, 20 bp, mouse
gtggttgacctagttgagag

SEQ ID NO: 467474 - DNA, 20 bp, mouse
ggcagaagagtacgcggtgc

SEQ ID NO: 467475 - DNA, 20 bp, mouse
gtcggctctgtttgtcctca

SEQ ID NO: 467476 - DNA, 20 bp, mouse
gcaggccttgaagttcacaa

SEQ ID NO: 467477 - DNA, 20 bp, mouse
gacggcagtagcaacagcca

SEQ ID NO: 467478 - DNA, 20 bp, mouse
gggcagatctagacttgaag

SEQ ID NO: 467479 - DNA, 20 bp, mouse
gcccgactcacctccctcag

SEQ ID NO: 467480 - DNA, 20 bp, mouse
gtagcaacagccaggggagc

SEQ ID NO: 467481 - DNA, 20 bp, mouse
gcacgtgaggagggacgagg

SEQ ID NO: 467482 - DNA, 20 bp, mouse
gatctagacttgaaggggtt

SEQ ID NO: 467483 - DNA, 20 bp, mouse
gggatacggtccccatcctg

SEQ ID NO: 467484 - DNA, 20 bp, mouse
gacaggagcagaatagctag

SEQ ID NO: 467485 - DNA, 20 bp, mouse
gtcactggtcacccagaagc

SEQ ID NO: 467486 - DNA, 20 bp, mouse
gtgaaaggcgtttatcccaa

SEQ ID NO: 467487 - DNA, 20 bp, mouse
gaagtttctactatagtatg

SEQ ID NO: 467488 - DNA, 20 bp, mouse
gtcagccaaagaagtaacta

SEQ ID NO: 467489 - DNA, 20 bp, mouse
gtagggaaaatggtttccaa

SEQ ID NO: 467490 - DNA, 20 bp, mouse
ggttttgtttcactttcatc

SEQ ID NO: 467491 - DNA, 20 bp, mouse
gtggcatggctttaatatct

SEQ ID NO: 467492 - DNA, 20 bp, mouse
gtctactatagtatgtggca

SEQ ID NO: 467493 - DNA, 20 bp, mouse
gaagtccggtagtaaaatga

SEQ ID NO: 467494 - DNA, 20 bp, mouse
gctaaaagaactgcttccct

SEQ ID NO: 467495 - DNA, 20 bp, mouse
gctcagtccttaagttctaa

SEQ ID NO: 467496 - DNA, 20 bp, mouse
gtacacacccagctgatctg

SEQ ID NO: 467497 - DNA, 20 bp, mouse
ggatcagctgggtgtgtagc

SEQ ID NO: 467498 - DNA, 20 bp, mouse
gtaggggccagactctatgg

SEQ ID NO: 467499 - DNA, 20 bp, mouse
gagaagagagagggagtact

SEQ ID NO: 467500 - DNA, 20 bp, mouse
ggctggtccccagatcagct

SEQ ID NO: 467501 - DNA, 20 bp, mouse
gggggaccagcggagccatg

SEQ ID NO: 467502 - DNA, 20 bp, mouse
gattgctgaacccagcctca

SEQ ID NO: 467503 - DNA, 20 bp, mouse
gttcgggcagagcgttggat

SEQ ID NO: 467504 - DNA, 20 bp, mouse
gcggcacgtgcatcttacct

SEQ ID NO: 467505 - DNA, 20 bp, mouse
gtagagtctggcccctagaa

SEQ ID NO: 467506 - DNA, 20 bp, mouse
gggtcccacagagccggctc

SEQ ID NO: 467507 - DNA, 20 bp, mouse
gtccagcggtcccacagagc

SEQ ID NO: 467508 - DNA, 20 bp, mouse
ggctggccacgtgagtaggt

SEQ ID NO: 467509 - DNA, 20 bp, mouse
ggccagccgcagacccgagc

SEQ ID NO: 467510 - DNA, 20 bp, mouse
gtgcggctggccacgtgagt

SEQ ID NO: 467511 - DNA, 20 bp, mouse
gcagacccgagccggctctg

SEQ ID NO: 467512 - DNA, 20 bp, mouse
gtcaacatgacagcgtccag

SEQ ID NO: 467513 - DNA, 20 bp, mouse
gctcgtaaccggaagctccg

SEQ ID NO: 467514 - DNA, 20 bp, mouse
ggagtaggtgggtcgcgcgt

SEQ ID NO: 467515 - DNA, 20 bp, mouse
gcgcgacccacctactcacg

SEQ ID NO: 467516 - DNA, 20 bp, mouse
gagcctctctcgagccatgg

SEQ ID NO: 467517 - DNA, 20 bp, mouse
ggccatggcggcgcctgtga

SEQ ID NO: 467518 - DNA, 20 bp, mouse
gcgccgccatggctcgagag

SEQ ID NO: 467519 - DNA, 20 bp, mouse
gcactaagtctccccctcac

SEQ ID NO: 467520 - DNA, 20 bp, mouse
gccgccgcggtgagctccca

SEQ ID NO: 467521 - DNA, 20 bp, mouse
gggcagcctctctcgagcca

SEQ ID NO: 467522 - DNA, 20 bp, mouse
gcgagagcagagggcaggac

SEQ ID NO: 467523 - DNA, 20 bp, mouse
ggggccgggacgagagcaga

SEQ ID NO: 467524 - DNA, 20 bp, mouse
gggaacccggaactgagcac

SEQ ID NO: 467525 - DNA, 20 bp, mouse
gcagacaggtacgcagccgt

SEQ ID NO: 467526 - DNA, 20 bp, mouse
gtacctcgaggagaggccaa

SEQ ID NO: 467527 - DNA, 20 bp, mouse
gtccagatcacagcctaggg

SEQ ID NO: 467528 - DNA, 20 bp, mouse
ggaaaagacatctccaagaa

SEQ ID NO: 467529 - DNA, 20 bp, mouse
gagagctttacctcgaggag

SEQ ID NO: 467530 - DNA, 20 bp, mouse
gagcccttggcctctcctcg

SEQ ID NO: 467531 - DNA, 20 bp, mouse
ggcactctagagtgctctgg

SEQ ID NO: 467532 - DNA, 20 bp, mouse
gtttcctgcacagtgccaag

SEQ ID NO: 467533 - DNA, 20 bp, mouse
ggtcttggagacctctgtca

SEQ ID NO: 467534 - DNA, 20 bp, mouse
gccaagaggagactgctgcc

SEQ ID NO: 467535 - DNA, 20 bp, mouse
ggcctccctaggctgtgatc

SEQ ID NO: 467536 - DNA, 20 bp, mouse
gggctgggcgggacagaaca

SEQ ID NO: 467537 - DNA, 20 bp, mouse
gagccaccgtcgctcaggaa

SEQ ID NO: 467538 - DNA, 20 bp, mouse
ggggacccgttcctgagcga

SEQ ID NO: 467539 - DNA, 20 bp, mouse
ggacagtagtcgcctgtcag

SEQ ID NO: 467540 - DNA, 20 bp, mouse
gccctgcagcccccagccga

SEQ ID NO: 467541 - DNA, 20 bp, mouse
gcctttcccacccctcggag

SEQ ID NO: 467542 - DNA, 20 bp, mouse
gctgtcctgccatcggctgg

SEQ ID NO: 467543 - DNA, 20 bp, mouse
gtgcggcagcgccaagggag

SEQ ID NO: 467544 - DNA, 20 bp, mouse
ggtccttcacgacccctgac

SEQ ID NO: 467545 - DNA, 20 bp, mouse
ggcgactactgtcctgccat

SEQ ID NO: 467546 - DNA, 20 bp, mouse
gagagcggtatgccatctgg

SEQ ID NO: 467547 - DNA, 20 bp, mouse
gataccgctctcacaatagg

SEQ ID NO: 467548 - DNA, 20 bp, mouse
gggcataccgctctcacaat

SEQ ID NO: 467549 - DNA, 20 bp, mouse
gaatgactccagcagaacct

SEQ ID NO: 467550 - DNA, 20 bp, mouse
gagcagaaccttggttgcaa

SEQ ID NO: 467551 - DNA, 20 bp, mouse
gcacctagggacggaaatag

SEQ ID NO: 467552 - DNA, 20 bp, mouse
gttggaacctgtggcaccta

SEQ ID NO: 467553 - DNA, 20 bp, mouse
ggtggaatccgttgcaacca

SEQ ID NO: 467554 - DNA, 20 bp, mouse
gaacctgtggcacctaggga

SEQ ID NO: 467555 - DNA, 20 bp, mouse
gagtcagcatgacttgtggg

SEQ ID NO: 467556 - DNA, 20 bp, mouse
gccagcagaagatgggtcta

SEQ ID NO: 467557 - DNA, 20 bp, mouse
gactaactttctattttgaa

SEQ ID NO: 467558 - DNA, 20 bp, mouse
gttagttgcgctggcagcag

SEQ ID NO: 467559 - DNA, 20 bp, mouse
gtaaactcgcagtccagacc

SEQ ID NO: 467560 - DNA, 20 bp, mouse
gggagaaggcgagcaggtaa

SEQ ID NO: 467561 - DNA, 20 bp, mouse
gtctattttgaagggctccc

SEQ ID NO: 467562 - DNA, 20 bp, mouse
gggggccagccgggtgacag

SEQ ID NO: 467563 - DNA, 20 bp, mouse
gaggcgagcaggtaagggat

SEQ ID NO: 467564 - DNA, 20 bp, mouse
gctggcagcagaggtgtgcc

SEQ ID NO: 467565 - DNA, 20 bp, mouse
gtcgggtaccaggtaaacct

SEQ ID NO: 467566 - DNA, 20 bp, mouse
gcattaccacgcaagaggtt

SEQ ID NO: 467567 - DNA, 20 bp, mouse
ggcgatcctgctgttctcag

SEQ ID NO: 467568 - DNA, 20 bp, mouse
gcagatgagtgtccgagcag

SEQ ID NO: 467569 - DNA, 20 bp, mouse
gatgagtgtccgagcagggg

SEQ ID NO: 467570 - DNA, 20 bp, mouse
gcccagctgaggacgagatt

SEQ ID NO: 467571 - DNA, 20 bp, mouse
gcaagcgcaggggtaggatc

SEQ ID NO: 467572 - DNA, 20 bp, mouse
gactctggagaggattccgt

SEQ ID NO: 467573 - DNA, 20 bp, mouse
gagggacccaacctcttgcg

SEQ ID NO: 467574 - DNA, 20 bp, mouse
gtaggacccctgagaacagc

SEQ ID NO: 467575 - DNA, 20 bp, mouse
gggcacgagaggacaccgag

SEQ ID NO: 467576 - DNA, 20 bp, mouse
gtcgccaaaaccccaccgag

SEQ ID NO: 467577 - DNA, 20 bp, mouse
ggcgtttccggcggaggtgg

SEQ ID NO: 467578 - DNA, 20 bp, mouse
gcggtgggcgtgaagcccct

SEQ ID NO: 467579 - DNA, 20 bp, mouse
gtgggcgtgaagcccctcgg

SEQ ID NO: 467580 - DNA, 20 bp, mouse
gcttctgtgtctgtggcggt

SEQ ID NO: 467581 - DNA, 20 bp, mouse
gaagtgacatcactccgggt

SEQ ID NO: 467582 - DNA, 20 bp, mouse
gcccggaagcgccagccaac

SEQ ID NO: 467583 - DNA, 20 bp, mouse
gctccgggtaggccgagacg

SEQ ID NO: 467584 - DNA, 20 bp, mouse
gttggcgagcgaggtcgtct

SEQ ID NO: 467585 - DNA, 20 bp, mouse
ggggcgtgtggggtactcac

SEQ ID NO: 467586 - DNA, 20 bp, mouse
ggggctcacggacgcagtcc

SEQ ID NO: 467587 - DNA, 20 bp, mouse
gggcggcggtttgcgaactg

SEQ ID NO: 467588 - DNA, 20 bp, mouse
gctcacggacgcagtccggg

SEQ ID NO: 467589 - DNA, 20 bp, mouse
gacggacgcagtccgggcgg

SEQ ID NO: 467590 - DNA, 20 bp, mouse
gagccacgaccccgctagag

SEQ ID NO: 467591 - DNA, 20 bp, mouse
gtccgggagcgaaggtcagt

SEQ ID NO: 467592 - DNA, 20 bp, mouse
gccccatcccggctcacctc

SEQ ID NO: 467593 - DNA, 20 bp, mouse
gcggtttgcgaactgcggct

SEQ ID NO: 467594 - DNA, 20 bp, mouse
ggaccggaagtggaggcggt

SEQ ID NO: 467595 - DNA, 20 bp, mouse
gaggtagaggaactaacgtc

SEQ ID NO: 467596 - DNA, 20 bp, mouse
gagaggtatggagatctgaa

SEQ ID NO: 467597 - DNA, 20 bp, mouse
ggctcctaagaaactttccg

SEQ ID NO: 467598 - DNA, 20 bp, mouse
gtacagtgggtacagaggta

SEQ ID NO: 467599 - DNA, 20 bp, mouse
gtactgctgtggactttccc

SEQ ID NO: 467600 - DNA, 20 bp, mouse
gagcgacgggtgcactgatt

SEQ ID NO: 467601 - DNA, 20 bp, mouse
gacccgtcgctggttacagt

SEQ ID NO: 467602 - DNA, 20 bp, mouse
ggggccggatataggcaccg

SEQ ID NO: 467603 - DNA, 20 bp, mouse
gacccactgtaaccagcgac

SEQ ID NO: 467604 - DNA, 20 bp, mouse
gcaaagcaatacactttaca

SEQ ID NO: 467605 - DNA, 20 bp, mouse
gtatagagacatactttcaa

SEQ ID NO: 467606 - DNA, 20 bp, mouse
gcggacgcgcgaccatgcaa

SEQ ID NO: 467607 - DNA, 20 bp, mouse
ggccaaggcgcggaacggag

SEQ ID NO: 467608 - DNA, 20 bp, mouse
gacaagcgctcgccattgca

SEQ ID NO: 467609 - DNA, 20 bp, mouse
gagcgcttgagggaccccga

SEQ ID NO: 467610 - DNA, 20 bp, mouse
ggccaggccgggcctccggg

SEQ ID NO: 467611 - DNA, 20 bp, mouse
gatggtcgcgcgtccgccgc

SEQ ID NO: 467612 - DNA, 20 bp, mouse
gggtcggctggggacgcgcc

SEQ ID NO: 467613 - DNA, 20 bp, mouse
gttcaaaataatgcccgcgg

SEQ ID NO: 467614 - DNA, 20 bp, mouse
ggagcaccgcgtggaggccg

SEQ ID NO: 467615 - DNA, 20 bp, mouse
ggcggggaggcggtcggctg

SEQ ID NO: 467616 - DNA, 20 bp, mouse
ggcgggatgagtagccggaa

SEQ ID NO: 467617 - DNA, 20 bp, mouse
gtccccggaagaaccagccg

SEQ ID NO: 467618 - DNA, 20 bp, mouse
ggcgggaccagagcacgtca

SEQ ID NO: 467619 - DNA, 20 bp, mouse
gggaagggaagggacccggt

SEQ ID NO: 467620 - DNA, 20 bp, mouse
ggccaggctcccgctctcta

SEQ ID NO: 467621 - DNA, 20 bp, mouse
gagaaccagccgcggctcgg

SEQ ID NO: 467622 - DNA, 20 bp, mouse
gcgcggctcggaggatgagc

SEQ ID NO: 467623 - DNA, 20 bp, mouse
ggccgagcgggatgagtagc

SEQ ID NO: 467624 - DNA, 20 bp, mouse
gcacgcacacgaggccgagc

SEQ ID NO: 467625 - DNA, 20 bp, mouse
ggggagaaaggaccagacac

SEQ ID NO: 467626 - DNA, 20 bp, mouse
gcggtgctccgagccgtgga

SEQ ID NO: 467627 - DNA, 20 bp, mouse
gaggctgcgagccgtgtcga

SEQ ID NO: 467628 - DNA, 20 bp, mouse
gctgcgagccgtgtcgaggg

SEQ ID NO: 467629 - DNA, 20 bp, mouse
gcaccaccctccgccctcca

SEQ ID NO: 467630 - DNA, 20 bp, mouse
gccgagccgtggagggcgga

SEQ ID NO: 467631 - DNA, 20 bp, mouse
gcgagcgtcatggagcctgg

SEQ ID NO: 467632 - DNA, 20 bp, mouse
gccgtgtcgagggcggactg

SEQ ID NO: 467633 - DNA, 20 bp, mouse
gagcgctggcgctgggggac

SEQ ID NO: 467634 - DNA, 20 bp, mouse
gaggctggaggacctcggtg

SEQ ID NO: 467635 - DNA, 20 bp, mouse
ggtggcagcgctggcgctgg

SEQ ID NO: 467636 - DNA, 20 bp, mouse
ggaagcggggaggcgacgaa

SEQ ID NO: 467637 - DNA, 20 bp, mouse
gggggcagcgatccgtccgg

SEQ ID NO: 467638 - DNA, 20 bp, mouse
gagctgctcgagacccggcg

SEQ ID NO: 467639 - DNA, 20 bp, mouse
ggagcagctgccagagccgc

SEQ ID NO: 467640 - DNA, 20 bp, mouse
ggcgatccgtccggcggctc

SEQ ID NO: 467641 - DNA, 20 bp, mouse
gacccgaacggatctttcga

SEQ ID NO: 467642 - DNA, 20 bp, mouse
ggcgggggcagcgatccgtc

SEQ ID NO: 467643 - DNA, 20 bp, mouse
gggagtacgggaaaagactg

SEQ ID NO: 467644 - DNA, 20 bp, mouse
gcagtgggtggggacccgaa

SEQ ID NO: 467645 - DNA, 20 bp, mouse
ggcctgggtgaggacctgga

SEQ ID NO: 467646 - DNA, 20 bp, mouse
gaatgaagcgagagctggag

SEQ ID NO: 467647 - DNA, 20 bp, mouse
gaagcggccagcagtgacta

SEQ ID NO: 467648 - DNA, 20 bp, mouse
ggcgcactgtgtacaaacag

SEQ ID NO: 467649 - DNA, 20 bp, mouse
gaggtgggtgcgcttgagag

SEQ ID NO: 467650 - DNA, 20 bp, mouse
gagaggctggggctgcgagt

SEQ ID NO: 467651 - DNA, 20 bp, mouse
gcactgtgtacaaacagtgg

SEQ ID NO: 467652 - DNA, 20 bp, mouse
ggctgcgggggcttctgact

SEQ ID NO: 467653 - DNA, 20 bp, mouse
gggtgcgcttgagagaggct

SEQ ID NO: 467654 - DNA, 20 bp, mouse
gtcggggagccaggaaccca

SEQ ID NO: 467655 - DNA, 20 bp, mouse
ggccctgtcagagattcaag

SEQ ID NO: 467656 - DNA, 20 bp, mouse
gaggcagcgcgcaaggacag

SEQ ID NO: 467657 - DNA, 20 bp, mouse
gcggcgctgagagcctgacc

SEQ ID NO: 467658 - DNA, 20 bp, mouse
gaaggacagcggagcagacc

SEQ ID NO: 467659 - DNA, 20 bp, mouse
gcagcggagcagaccgggtc

SEQ ID NO: 467660 - DNA, 20 bp, mouse
ggcaagtggcccttccactg

SEQ ID NO: 467661 - DNA, 20 bp, mouse
gactggggcgaaagcgtcgc

SEQ ID NO: 467662 - DNA, 20 bp, mouse
ggtcagaagcgttcctgcac

SEQ ID NO: 467663 - DNA, 20 bp, mouse
ggtccttgcgcgctgcctcc

SEQ ID NO: 467664 - DNA, 20 bp, mouse
gcaaaggggtcagaagagtg

SEQ ID NO: 467665 - DNA, 20 bp, mouse
gaggctctcagcgccggtgc

SEQ ID NO: 467666 - DNA, 20 bp, mouse
ggcagcagcggcagagtgct

SEQ ID NO: 467667 - DNA, 20 bp, mouse
gagagcgatggaacaccagg

SEQ ID NO: 467668 - DNA, 20 bp, mouse
gaccaactgggggcatagag

SEQ ID NO: 467669 - DNA, 20 bp, mouse
gccttcccaaaaccaactgg

SEQ ID NO: 467670 - DNA, 20 bp, mouse
gcctgctctcccggctccct

SEQ ID NO: 467671 - DNA, 20 bp, mouse
gggcacagcgatggtagctg

SEQ ID NO: 467672 - DNA, 20 bp, mouse
ggcagtggtagctcctactg

SEQ ID NO: 467673 - DNA, 20 bp, mouse
gcagcgtgcaggcacagcga

SEQ ID NO: 467674 - DNA, 20 bp, mouse
gagccggcctcggcacccaa

SEQ ID NO: 467675 - DNA, 20 bp, mouse
gcagcaatgagctctcagct

SEQ ID NO: 467676 - DNA, 20 bp, mouse
ggccagccctgcgcagggat

SEQ ID NO: 467677 - DNA, 20 bp, mouse
ggtcccggctcagagttact

SEQ ID NO: 467678 - DNA, 20 bp, mouse
gctgcctgagctgcgcgtcc

SEQ ID NO: 467679 - DNA, 20 bp, mouse
ggagccgggacgcgcagctc

SEQ ID NO: 467680 - DNA, 20 bp, mouse
gggtcactgtgagcccgaga

SEQ ID NO: 467681 - DNA, 20 bp, mouse
ggcgcagctcaggcagcgac

SEQ ID NO: 467682 - DNA, 20 bp, mouse
gagccggccagccctgcgca

SEQ ID NO: 467683 - DNA, 20 bp, mouse
gctcccaggggcgggtagaa

SEQ ID NO: 467684 - DNA, 20 bp, mouse
gcgcaaaagggtagtgagac

SEQ ID NO: 467685 - DNA, 20 bp, mouse
gcgggagcaccgggcctgga

SEQ ID NO: 467686 - DNA, 20 bp, mouse
gtaggagcctgtggagtcta

SEQ ID NO: 467687 - DNA, 20 bp, mouse
ggttaggtcccagagtagag

SEQ ID NO: 467688 - DNA, 20 bp, mouse
ggtctaaggaagatcgcggg

SEQ ID NO: 467689 - DNA, 20 bp, mouse
gagcctgagctggagaacga

SEQ ID NO: 467690 - DNA, 20 bp, mouse
ggatcttccttagactccac

SEQ ID NO: 467691 - DNA, 20 bp, mouse
gtgtgcgcgcgaggctccca

SEQ ID NO: 467692 - DNA, 20 bp, mouse
gggagtctaaggaagatcgc

SEQ ID NO: 467693 - DNA, 20 bp, mouse
gaggaaggtctaggagcctg

SEQ ID NO: 467694 - DNA, 20 bp, mouse
gcaactgtgtctaggaggtg

SEQ ID NO: 467695 - DNA, 20 bp, mouse
ggacagccaggcttctctag

SEQ ID NO: 467696 - DNA, 20 bp, mouse
ggcgcgccagtggggaactt

SEQ ID NO: 467697 - DNA, 20 bp, mouse
gtctgcgagcagggtccggg

SEQ ID NO: 467698 - DNA, 20 bp, mouse
gctgaatgcagaccagcggg

SEQ ID NO: 467699 - DNA, 20 bp, mouse
gaactctgcgagcagggtcc

SEQ ID NO: 467700 - DNA, 20 bp, mouse
gggcgcgggtagaggcaacc

SEQ ID NO: 467701 - DNA, 20 bp, mouse
ggcggctaccagactctcac

SEQ ID NO: 467702 - DNA, 20 bp, mouse
ggagactgaatgcagaccag

SEQ ID NO: 467703 - DNA, 20 bp, mouse
gtcagtctggagaccaactg

SEQ ID NO: 467704 - DNA, 20 bp, mouse
ggagagccgcaagctcccta

SEQ ID NO: 467705 - DNA, 20 bp, mouse
ggccagcagcagcgccacca

SEQ ID NO: 467706 - DNA, 20 bp, mouse
ggccccgacttccccacagg

SEQ ID NO: 467707 - DNA, 20 bp, mouse
ggcggccccgacttccccac

SEQ ID NO: 467708 - DNA, 20 bp, mouse
ggccgcctgtggggaagtcg

SEQ ID NO: 467709 - DNA, 20 bp, mouse
ggagcacgagccagcgagga

SEQ ID NO: 467710 - DNA, 20 bp, mouse
gtcgctggctccctcctcgc

SEQ ID NO: 467711 - DNA, 20 bp, mouse
ggaagaggcggcggtggacg

SEQ ID NO: 467712 - DNA, 20 bp, mouse
ggagcctctcgccgcctgtg

SEQ ID NO: 467713 - DNA, 20 bp, mouse
gcttccccacaggcggcgag

SEQ ID NO: 467714 - DNA, 20 bp, mouse
gtcacgagcacgagccagcg

SEQ ID NO: 467715 - DNA, 20 bp, mouse
gagggcgcggagagtccccg

SEQ ID NO: 467716 - DNA, 20 bp, mouse
gccagcgcctagagacgagg

SEQ ID NO: 467717 - DNA, 20 bp, mouse
ggcagcgggtcggagatcga

SEQ ID NO: 467718 - DNA, 20 bp, mouse
gagacgaggcggaactcaaa

SEQ ID NO: 467719 - DNA, 20 bp, mouse
gcccgcccggaccaagggac

SEQ ID NO: 467720 - DNA, 20 bp, mouse
gccaccagcgcctagagacg

SEQ ID NO: 467721 - DNA, 20 bp, mouse
ggaggcggcaagaacctgga

SEQ ID NO: 467722 - DNA, 20 bp, mouse
ggcccgaggcggcaagaacc

SEQ ID NO: 467723 - DNA, 20 bp, mouse
gcgaaggattgagccaattg

SEQ ID NO: 467724 - DNA, 20 bp, mouse
gaaccgcccgcccggaccaa

SEQ ID NO: 467725 - DNA, 20 bp, mouse
gtcggtgcaaagtgtcgaga

SEQ ID NO: 467726 - DNA, 20 bp, mouse
gccgtcagaacgcaggtgag

SEQ ID NO: 467727 - DNA, 20 bp, mouse
gggcagagtgcgaggcctag

SEQ ID NO: 467728 - DNA, 20 bp, mouse
gataagtgcggcagtcgcct

SEQ ID NO: 467729 - DNA, 20 bp, mouse
gaggcctcaagccggacacg

SEQ ID NO: 467730 - DNA, 20 bp, mouse
gggctccgccctcttcccga

SEQ ID NO: 467731 - DNA, 20 bp, mouse
gttgcgaaaaagaacgtcca

SEQ ID NO: 467732 - DNA, 20 bp, mouse
ggacacgaggcgaggctacg

SEQ ID NO: 467733 - DNA, 20 bp, mouse
gcggccggagtagcacgcgg

SEQ ID NO: 467734 - DNA, 20 bp, mouse
gtcaagccggacacgaggcg

SEQ ID NO: 467735 - DNA, 20 bp, mouse
ggtgcggccggagtagcacg

SEQ ID NO: 467736 - DNA, 20 bp, mouse
ggagtcctcggctctgggta

SEQ ID NO: 467737 - DNA, 20 bp, mouse
gtgggtaaggacgcacatcc

SEQ ID NO: 467738 - DNA, 20 bp, mouse
gtgattgaaaacctaagcaa

SEQ ID NO: 467739 - DNA, 20 bp, mouse
gcggtctgagacccttgctt

SEQ ID NO: 467740 - DNA, 20 bp, mouse
gactcagtcagaaggactgg

SEQ ID NO: 467741 - DNA, 20 bp, mouse
gccgagggtgggagccacat

SEQ ID NO: 467742 - DNA, 20 bp, mouse
gcggggaagaggggaatatg

SEQ ID NO: 467743 - DNA, 20 bp, mouse
gggcgtaatgaggatccgag

SEQ ID NO: 467744 - DNA, 20 bp, mouse
gtctctgggaacccagcccg

SEQ ID NO: 467745 - DNA, 20 bp, mouse
gcagacaagccccaaggtca

SEQ ID NO: 467746 - DNA, 20 bp, mouse
gcccatggcgaaggctggaa

SEQ ID NO: 467747 - DNA, 20 bp, mouse
ggggagctgtgcaaaagcgg

SEQ ID NO: 467748 - DNA, 20 bp, mouse
gggaggacgagagcgccggg

SEQ ID NO: 467749 - DNA, 20 bp, mouse
gttcaggtctccgaatccca

SEQ ID NO: 467750 - DNA, 20 bp, mouse
gacggggagctgtgcaaaag

SEQ ID NO: 467751 - DNA, 20 bp, mouse
gaagcggaggacgagagcgc

SEQ ID NO: 467752 - DNA, 20 bp, mouse
gggaagaaccagctggacgt

SEQ ID NO: 467753 - DNA, 20 bp, mouse
gaggccgcggccagcgctga

SEQ ID NO: 467754 - DNA, 20 bp, mouse
gggccccgggagcactgact

SEQ ID NO: 467755 - DNA, 20 bp, mouse
ggagcgggacctcccgggag

SEQ ID NO: 467756 - DNA, 20 bp, mouse
gggtactcacacgccagcca

SEQ ID NO: 467757 - DNA, 20 bp, mouse
gcagctcccggaaaacgcag

SEQ ID NO: 467758 - DNA, 20 bp, mouse
ggctggcgtgtgagtaccgg

SEQ ID NO: 467759 - DNA, 20 bp, mouse
ggcctcaaggagcgcacgtg

SEQ ID NO: 467760 - DNA, 20 bp, mouse
gggcgtctgggcctgtgtgg

SEQ ID NO: 467761 - DNA, 20 bp, mouse
gccacgggaggcaaccctaa

SEQ ID NO: 467762 - DNA, 20 bp, mouse
ggtcctgagctcgcagttcc

SEQ ID NO: 467763 - DNA, 20 bp, mouse
gggctccgcacatcccagca

SEQ ID NO: 467764 - DNA, 20 bp, mouse
ggccgcacgtgcgctccttg

SEQ ID NO: 467765 - DNA, 20 bp, mouse
gcagcggcccgcctccacac

SEQ ID NO: 467766 - DNA, 20 bp, mouse
gggctgctggagaagagtct

SEQ ID NO: 467767 - DNA, 20 bp, mouse
gtccagcagcctcaactccg

SEQ ID NO: 467768 - DNA, 20 bp, mouse
gtcttctggcccagctccta

SEQ ID NO: 467769 - DNA, 20 bp, mouse
gtctggcccagctcctaggg

SEQ ID NO: 467770 - DNA, 20 bp, mouse
gggcggcggccgcggagttg

SEQ ID NO: 467771 - DNA, 20 bp, mouse
ggagtctgggactgaagccg

SEQ ID NO: 467772 - DNA, 20 bp, mouse
gcccagctcctagggaggcg

SEQ ID NO: 467773 - DNA, 20 bp, mouse
ggagcactgtacttattccc

SEQ ID NO: 467774 - DNA, 20 bp, mouse
gcggccagccgctggaaagg

SEQ ID NO: 467775 - DNA, 20 bp, mouse
ggtacagtgctcagggcgag

SEQ ID NO: 467776 - DNA, 20 bp, mouse
gtaagccgcaaaggagacaa

SEQ ID NO: 467777 - DNA, 20 bp, mouse
gagggcctggaggggaactg

SEQ ID NO: 467778 - DNA, 20 bp, mouse
gtcctttgcggcttactttg

SEQ ID NO: 467779 - DNA, 20 bp, mouse
gatagggtgaccctaatcac

SEQ ID NO: 467780 - DNA, 20 bp, mouse
ggccgcaaagtaagccgcaa

SEQ ID NO: 467781 - DNA, 20 bp, mouse
gcaagccgcgagccgatctg

SEQ ID NO: 467782 - DNA, 20 bp, mouse
gcggcttgtgaaccccagat

SEQ ID NO: 467783 - DNA, 20 bp, mouse
gggaatcaccatggcggctg

SEQ ID NO: 467784 - DNA, 20 bp, mouse
gtggtttctagggcctggag

SEQ ID NO: 467785 - DNA, 20 bp, mouse
gccactcaggcaaaggatgg

SEQ ID NO: 467786 - DNA, 20 bp, mouse
ggagccgaggagactcacca

SEQ ID NO: 467787 - DNA, 20 bp, mouse
gggaagcgcgccgacgatgg

SEQ ID NO: 467788 - DNA, 20 bp, mouse
gcagggaagcgcgccgacga

SEQ ID NO: 467789 - DNA, 20 bp, mouse
gggaccgagacgaatctctg

SEQ ID NO: 467790 - DNA, 20 bp, mouse
gccgcagccgccgccatcgt

SEQ ID NO: 467791 - DNA, 20 bp, mouse
ggactcaccatggtggcgga

SEQ ID NO: 467792 - DNA, 20 bp, mouse
gggccgggcgttgacgtcag

SEQ ID NO: 467793 - DNA, 20 bp, mouse
gagcgcgccgacgatggcgg

SEQ ID NO: 467794 - DNA, 20 bp, mouse
ggcgggacgctgagagggac

SEQ ID NO: 467795 - DNA, 20 bp, mouse
gggacgctgagagggacggg

SEQ ID NO: 467796 - DNA, 20 bp, mouse
ggacttgccgtggtccacat

SEQ ID NO: 467797 - DNA, 20 bp, mouse
ggggagatggcgctacggag

SEQ ID NO: 467798 - DNA, 20 bp, mouse
ggaagagggagatggcgcta

SEQ ID NO: 467799 - DNA, 20 bp, mouse
ggctgccagtggacaaatag

SEQ ID NO: 467800 - DNA, 20 bp, mouse
gtggcgctacggagaggaag

SEQ ID NO: 467801 - DNA, 20 bp, mouse
gatgtcagtcatcgcccatg

SEQ ID NO: 467802 - DNA, 20 bp, mouse
gatggcctggagagtcgatg

SEQ ID NO: 467803 - DNA, 20 bp, mouse
gagtgaggggacagccccga

SEQ ID NO: 467804 - DNA, 20 bp, mouse
gacccagagcacaacccctc

SEQ ID NO: 467805 - DNA, 20 bp, mouse
gccccgaggggttgtgctct

SEQ ID NO: 467806 - DNA, 20 bp, mouse
ggagcgctggagccgagcac

SEQ ID NO: 467807 - DNA, 20 bp, mouse
ggtggggcgcctgaagacgt

SEQ ID NO: 467808 - DNA, 20 bp, mouse
ggtcttcaggcgccccactg

SEQ ID NO: 467809 - DNA, 20 bp, mouse
ggcgcctgccacactgtggg

SEQ ID NO: 467810 - DNA, 20 bp, mouse
ggctggagccgagcacgggc

SEQ ID NO: 467811 - DNA, 20 bp, mouse
ggccgagcacgggctggagt

SEQ ID NO: 467812 - DNA, 20 bp, mouse
ggtcgcgcctgccacactgt

SEQ ID NO: 467813 - DNA, 20 bp, mouse
gccaggcccgcagccgcagt

SEQ ID NO: 467814 - DNA, 20 bp, mouse
gcacggccgcaaggatccca

SEQ ID NO: 467815 - DNA, 20 bp, mouse
gcactgtgggaggtaggtga

SEQ ID NO: 467816 - DNA, 20 bp, mouse
ggctcaggcgacggcgtgag

SEQ ID NO: 467817 - DNA, 20 bp, mouse
gacggcgtgagaggcagcgg

SEQ ID NO: 467818 - DNA, 20 bp, mouse
gggcgggtaaatgtgaatgt

SEQ ID NO: 467819 - DNA, 20 bp, mouse
gtgctgggtcacatcgacag

SEQ ID NO: 467820 - DNA, 20 bp, mouse
ggtgagaggcagcggcggga

SEQ ID NO: 467821 - DNA, 20 bp, mouse
gggggctggcgctcaggcga

SEQ ID NO: 467822 - DNA, 20 bp, mouse
ggcagcgtgtcgctagaacc

SEQ ID NO: 467823 - DNA, 20 bp, mouse
gcgggttctgcccccggcag

SEQ ID NO: 467824 - DNA, 20 bp, mouse
ggcggcataacgctcgacct

SEQ ID NO: 467825 - DNA, 20 bp, mouse
gggcagcggcacgacaaaac

SEQ ID NO: 467826 - DNA, 20 bp, mouse
gctcgcgccgcgcgccacca

SEQ ID NO: 467827 - DNA, 20 bp, mouse
gaaagcccggcgcctaactc

SEQ ID NO: 467828 - DNA, 20 bp, mouse
gcacccacggcgagcggccg

SEQ ID NO: 467829 - DNA, 20 bp, mouse
gcggcgcagacactgagcaa

SEQ ID NO: 467830 - DNA, 20 bp, mouse
gcaccacggccgctcgccgt

SEQ ID NO: 467831 - DNA, 20 bp, mouse
gcgcgcgcgtagagccacag

SEQ ID NO: 467832 - DNA, 20 bp, mouse
gcgcctctcgcacccgagtt

SEQ ID NO: 467833 - DNA, 20 bp, mouse
gggcgcgcggcgcgaggttc

SEQ ID NO: 467834 - DNA, 20 bp, mouse
gcgcctaactcgggtgcgag

SEQ ID NO: 467835 - DNA, 20 bp, mouse
ggattcaagcagctacgacg

SEQ ID NO: 467836 - DNA, 20 bp, mouse
ggcagagtgccaggacgctc

SEQ ID NO: 467837 - DNA, 20 bp, mouse
gtcatctggagcagagtgcc

SEQ ID NO: 467838 - DNA, 20 bp, mouse
ggatctggcccagaagtcat

SEQ ID NO: 467839 - DNA, 20 bp, mouse
gcaaatgcgcagagccaagc

SEQ ID NO: 467840 - DNA, 20 bp, mouse
ggtggaggggccattactgg

SEQ ID NO: 467841 - DNA, 20 bp, mouse
gtagatcttagagtgtcatc

SEQ ID NO: 467842 - DNA, 20 bp, mouse
ggactgggtagaaagagatc

SEQ ID NO: 467843 - DNA, 20 bp, mouse
gcttgaggaggagcgtggag

SEQ ID NO: 467844 - DNA, 20 bp, mouse
gaatgtctatgagggagctc

SEQ ID NO: 467845 - DNA, 20 bp, mouse
gaggagttggaactccacaa

SEQ ID NO: 467846 - DNA, 20 bp, mouse
ggaagctcccggtcagccac

SEQ ID NO: 467847 - DNA, 20 bp, mouse
gctaggaaacatggagcctg

SEQ ID NO: 467848 - DNA, 20 bp, mouse
gagagggctggctataggga

SEQ ID NO: 467849 - DNA, 20 bp, mouse
gatggagcctgtggctgacc

SEQ ID NO: 467850 - DNA, 20 bp, mouse
gacttggtcgggcaaagagg

SEQ ID NO: 467851 - DNA, 20 bp, mouse
ggatgcagttgccaacacag

SEQ ID NO: 467852 - DNA, 20 bp, mouse
gggaatggagcgagtgaaga

SEQ ID NO: 467853 - DNA, 20 bp, mouse
ggcggagttgggccccctgg

SEQ ID NO: 467854 - DNA, 20 bp, mouse
ggagccttcgaactccggca

SEQ ID NO: 467855 - DNA, 20 bp, mouse
gggctggcagagtctgcgag

SEQ ID NO: 467856 - DNA, 20 bp, mouse
gcctggcttggtctccgtgt

SEQ ID NO: 467857 - DNA, 20 bp, mouse
gaagaacatcgccaccgaca

SEQ ID NO: 467858 - DNA, 20 bp, mouse
gcggcgaagttgagtcccag

SEQ ID NO: 467859 - DNA, 20 bp, mouse
gtgtgttctcgctgcagcgg

SEQ ID NO: 467860 - DNA, 20 bp, mouse
ggtctgtgttctcgctgcag

SEQ ID NO: 467861 - DNA, 20 bp, mouse
ggcggaggagacgcctggct

SEQ ID NO: 467862 - DNA, 20 bp, mouse
gtgggcgaggccgcagtggc

SEQ ID NO: 467863 - DNA, 20 bp, mouse
ggttgagtcccagcggtggt

SEQ ID NO: 467864 - DNA, 20 bp, mouse
gcgaagttgagtcccagcgg

SEQ ID NO: 467865 - DNA, 20 bp, mouse
gaggtgatgggacggatagg

SEQ ID NO: 467866 - DNA, 20 bp, mouse
gtctatagtcatgacaacag

SEQ ID NO: 467867 - DNA, 20 bp, mouse
gctctagctaggtccggtcc

SEQ ID NO: 467868 - DNA, 20 bp, mouse
gcaccaaacggctaaactgg

SEQ ID NO: 467869 - DNA, 20 bp, mouse
gacagaggcttactctcagc

SEQ ID NO: 467870 - DNA, 20 bp, mouse
gtgttggagagctccaggat

SEQ ID NO: 467871 - DNA, 20 bp, mouse
ggccatctacaggaatcctc

SEQ ID NO: 467872 - DNA, 20 bp, mouse
gctaggtccggtccgggcat

SEQ ID NO: 467873 - DNA, 20 bp, mouse
gggtccgggcataggaatcc

SEQ ID NO: 467874 - DNA, 20 bp, mouse
gcaatggagacggcacaatg

SEQ ID NO: 467875 - DNA, 20 bp, mouse
gtttggtggaaataagcttc

SEQ ID NO: 467876 - DNA, 20 bp, mouse
gccgggtctggagcctgcgg

SEQ ID NO: 467877 - DNA, 20 bp, mouse
ggaagtcgcgaccgaagcag

SEQ ID NO: 467878 - DNA, 20 bp, mouse
gctgctgctagggcctggag

SEQ ID NO: 467879 - DNA, 20 bp, mouse
ggcgtctccggcccctgctt

SEQ ID NO: 467880 - DNA, 20 bp, mouse
gacttctctggatgtgctgg

SEQ ID NO: 467881 - DNA, 20 bp, mouse
ggcttcggtcgcgacttctc

SEQ ID NO: 467882 - DNA, 20 bp, mouse
gtaagactggagctatggcc

SEQ ID NO: 467883 - DNA, 20 bp, mouse
gtgagctaagactggagcta

SEQ ID NO: 467884 - DNA, 20 bp, mouse
ggagacccgcgcgagaggag

SEQ ID NO: 467885 - DNA, 20 bp, mouse
gcaggacagaagccacggga

SEQ ID NO: 467886 - DNA, 20 bp, mouse
gaaagggacgcggaagggac

SEQ ID NO: 467887 - DNA, 20 bp, mouse
gcggctccgcaccaagatgg

SEQ ID NO: 467888 - DNA, 20 bp, mouse
ggaccggctccgcaccaaga

SEQ ID NO: 467889 - DNA, 20 bp, mouse
gggcgacgtcgtggcacccc

SEQ ID NO: 467890 - DNA, 20 bp, mouse
gacctctcgaggggacggga

SEQ ID NO: 467891 - DNA, 20 bp, mouse
gacgtcgtggcaccccaggc

SEQ ID NO: 467892 - DNA, 20 bp, mouse
gggcgcttcctcaggcgcag

SEQ ID NO: 467893 - DNA, 20 bp, mouse
gccgccggggaggttcataa

SEQ ID NO: 467894 - DNA, 20 bp, mouse
ggcccgcgcagacctctcga

SEQ ID NO: 467895 - DNA, 20 bp, mouse
gttcgtgctggatgtctccc

SEQ ID NO: 467896 - DNA, 20 bp, mouse
gggctcacgacaagcagata

SEQ ID NO: 467897 - DNA, 20 bp, mouse
gaacgatagagtgtatctgg

SEQ ID NO: 467898 - DNA, 20 bp, mouse
gcagatagggctgctagctt

SEQ ID NO: 467899 - DNA, 20 bp, mouse
gaacacagtctacagaccag

SEQ ID NO: 467900 - DNA, 20 bp, mouse
gctaaacgatagagtgtatc

SEQ ID NO: 467901 - DNA, 20 bp, mouse
gtatgcagaagggtaaaggg

SEQ ID NO: 467902 - DNA, 20 bp, mouse
gcagggacgtgtgttccaga

SEQ ID NO: 467903 - DNA, 20 bp, mouse
gagtgggtagcgtcttgcac

SEQ ID NO: 467904 - DNA, 20 bp, mouse
gttagaaagctaacagcccc

SEQ ID NO: 467905 - DNA, 20 bp, mouse
ggaataatgttaaaccacga

SEQ ID NO: 467906 - DNA, 20 bp, mouse
gcaggctgcagaggcgctgg

SEQ ID NO: 467907 - DNA, 20 bp, mouse
gcgggtcaccaggataagag

SEQ ID NO: 467908 - DNA, 20 bp, mouse
ggccccatgaggagtgctga

SEQ ID NO: 467909 - DNA, 20 bp, mouse
ggctatcggggtccaggcag

SEQ ID NO: 467910 - DNA, 20 bp, mouse
gaccccgggatagcacgtcc

SEQ ID NO: 467911 - DNA, 20 bp, mouse
ggggaagtgagtatgggacc

SEQ ID NO: 467912 - DNA, 20 bp, mouse
ggccctcagcactcctcatg

SEQ ID NO: 467913 - DNA, 20 bp, mouse
gtagcagctctcctgtgtgg

SEQ ID NO: 467914 - DNA, 20 bp, mouse
gcccagagaagcccccgatt

SEQ ID NO: 467915 - DNA, 20 bp, mouse
ggttctgcttgagacgcaca

SEQ ID NO: 467916 - DNA, 20 bp, mouse
gctgccacgtctccccatgt

SEQ ID NO: 467917 - DNA, 20 bp, mouse
ggctcccacatggggagacg

SEQ ID NO: 467918 - DNA, 20 bp, mouse
gtcagaggtgctcccacatg

SEQ ID NO: 467919 - DNA, 20 bp, mouse
gtccggagggttctgaactc

SEQ ID NO: 467920 - DNA, 20 bp, mouse
gctatgactcctgatccgga

SEQ ID NO: 467921 - DNA, 20 bp, mouse
ggactctctcaaggagacgg

SEQ ID NO: 467922 - DNA, 20 bp, mouse
gaccagagttcagaaccctc

SEQ ID NO: 467923 - DNA, 20 bp, mouse
ggagctaagggactctctca

SEQ ID NO: 467924 - DNA, 20 bp, mouse
gtccaggcaagtgtgcacct

SEQ ID NO: 467925 - DNA, 20 bp, mouse
gacagggagacttggaccaa

SEQ ID NO: 467926 - DNA, 20 bp, mouse
gccactccgggaaccaaggt

SEQ ID NO: 467927 - DNA, 20 bp, mouse
gtaaggagaaagatcatcag

SEQ ID NO: 467928 - DNA, 20 bp, mouse
gggagtgtctggctaccaga

SEQ ID NO: 467929 - DNA, 20 bp, mouse
gatacgatcaacaacaggta

SEQ ID NO: 467930 - DNA, 20 bp, mouse
gtaattaattggatcaaact

SEQ ID NO: 467931 - DNA, 20 bp, mouse
gtaattggatcaaacttggt

SEQ ID NO: 467932 - DNA, 20 bp, mouse
gcttggttgggatgtcagct

SEQ ID NO: 467933 - DNA, 20 bp, mouse
gagcatgacactgaataccc

SEQ ID NO: 467934 - DNA, 20 bp, mouse
gtcctggcacttgagaacgg

SEQ ID NO: 467935 - DNA, 20 bp, mouse
gttgtccagcaggtacgccc

SEQ ID NO: 467936 - DNA, 20 bp, mouse
gaggtctgcagcaggagagt

SEQ ID NO: 467937 - DNA, 20 bp, mouse
gggacgtaccctggttgctg

SEQ ID NO: 467938 - DNA, 20 bp, mouse
ggcctgcttctgggacccag

SEQ ID NO: 467939 - DNA, 20 bp, mouse
gcaacagcgtcctgaagact

SEQ ID NO: 467940 - DNA, 20 bp, mouse
gaggcatgagccaagtcttc

SEQ ID NO: 467941 - DNA, 20 bp, mouse
gaaccagggtacgtcccagg

SEQ ID NO: 467942 - DNA, 20 bp, mouse
gctgtgaggagcgaaacgag

SEQ ID NO: 467943 - DNA, 20 bp, mouse
gcaccaagccgggtaaggag

SEQ ID NO: 467944 - DNA, 20 bp, mouse
gatccacctgggacgtaccc

SEQ ID NO: 467945 - DNA, 20 bp, mouse
gagcgaaacgaggggcgcgg

SEQ ID NO: 467946 - DNA, 20 bp, mouse
gagtagatccgcgaacctct

SEQ ID NO: 467947 - DNA, 20 bp, mouse
gggttgcgccgagaggttcg

SEQ ID NO: 467948 - DNA, 20 bp, mouse
gcgccgccaccggaaataag

SEQ ID NO: 467949 - DNA, 20 bp, mouse
gtgctatggtaatctaaaaa

SEQ ID NO: 467950 - DNA, 20 bp, mouse
gtatggtaatctaaaaaagg

SEQ ID NO: 467951 - DNA, 20 bp, mouse
gaaaaaggcggaggtctgtc

SEQ ID NO: 467952 - DNA, 20 bp, mouse
gcggcgaggcgcagttgcta

SEQ ID NO: 467953 - DNA, 20 bp, mouse
gggtaatctaaaaaaggcgg

SEQ ID NO: 467954 - DNA, 20 bp, mouse
gtctgtccggttgcgccgag

SEQ ID NO: 467955 - DNA, 20 bp, mouse
gtggtttgtgagctgaaatt

SEQ ID NO: 467956 - DNA, 20 bp, mouse
ggaggagcatggagggacga

SEQ ID NO: 467957 - DNA, 20 bp, mouse
ggggttcctaggaggcatca

SEQ ID NO: 467958 - DNA, 20 bp, mouse
gcgatgtcaagacagcacgg

SEQ ID NO: 467959 - DNA, 20 bp, mouse
gggaccacagggttcctagg

SEQ ID NO: 467960 - DNA, 20 bp, mouse
gctgtggtccagggtccaca

SEQ ID NO: 467961 - DNA, 20 bp, mouse
ggcttacgtgtcagtcccgt

SEQ ID NO: 467962 - DNA, 20 bp, mouse
gaaatgggaagaagagcagt

SEQ ID NO: 467963 - DNA, 20 bp, mouse
ggcaaatctctagaaatctg

SEQ ID NO: 467964 - DNA, 20 bp, mouse
gacagcacgggggaagacct

SEQ ID NO: 467965 - DNA, 20 bp, mouse
gcccagatctgatgagagtt

SEQ ID NO: 467966 - DNA, 20 bp, mouse
gcccggagtcagtttcatgg

SEQ ID NO: 467967 - DNA, 20 bp, mouse
gggtaccacagaaaacaccc

SEQ ID NO: 467968 - DNA, 20 bp, mouse
gcaggtgggagaacacgaga

SEQ ID NO: 467969 - DNA, 20 bp, mouse
gggcggcagctttcagccgg

SEQ ID NO: 467970 - DNA, 20 bp, mouse
ggccgccatgaaactgactc

SEQ ID NO: 467971 - DNA, 20 bp, mouse
gtgaatcaccaaggaactgt

SEQ ID NO: 467972 - DNA, 20 bp, mouse
gaactgcagaaggagaccga

SEQ ID NO: 467973 - DNA, 20 bp, mouse
gtgtggaaaaggaccctcgg

SEQ ID NO: 467974 - DNA, 20 bp, mouse
ggactccggggtgttttctg

SEQ ID NO: 467975 - DNA, 20 bp, mouse
gagctttcagccggaggctc

SEQ ID NO: 467976 - DNA, 20 bp, mouse
gctgccgagagaaaccgcca

SEQ ID NO: 467977 - DNA, 20 bp, mouse
gttgggcatggagagctcgg

SEQ ID NO: 467978 - DNA, 20 bp, mouse
gacctgcgcggcgcactcag

SEQ ID NO: 467979 - DNA, 20 bp, mouse
gctcggcgggtgacccatac

SEQ ID NO: 467980 - DNA, 20 bp, mouse
ggacgcgggcggctgtctga

SEQ ID NO: 467981 - DNA, 20 bp, mouse
gagagaaaccgccagggttt

SEQ ID NO: 467982 - DNA, 20 bp, mouse
gagcccgtagtggtgagcca

SEQ ID NO: 467983 - DNA, 20 bp, mouse
gccgcgcaggtcgccggtat

SEQ ID NO: 467984 - DNA, 20 bp, mouse
gtccccggcagtccaagtgg

SEQ ID NO: 467985 - DNA, 20 bp, mouse
gcggtaggcggcccgctccc

SEQ ID NO: 467986 - DNA, 20 bp, mouse
gcgaaggagtgcgtagggga

SEQ ID NO: 467987 - DNA, 20 bp, mouse
gtaggggagggcagcctggt

SEQ ID NO: 467988 - DNA, 20 bp, mouse
ggcagcgaaggagtgcgtag

SEQ ID NO: 467989 - DNA, 20 bp, mouse
gcagcctggtaggtctgaac

SEQ ID NO: 467990 - DNA, 20 bp, mouse
gggtctgaactggcgaggtc

SEQ ID NO: 467991 - DNA, 20 bp, mouse
gtcgccagttcagacctacc

SEQ ID NO: 467992 - DNA, 20 bp, mouse
gtgcgtaggggagggcagcc

SEQ ID NO: 467993 - DNA, 20 bp, mouse
gtataccgggaagtatggta

SEQ ID NO: 467994 - DNA, 20 bp, mouse
gtttcctgcccgggcagcga

SEQ ID NO: 467995 - DNA, 20 bp, mouse
gtgggctcctacctgcgggg

SEQ ID NO: 467996 - DNA, 20 bp, mouse
gctgaggctggaaccttcca

SEQ ID NO: 467997 - DNA, 20 bp, mouse
gacgcgtgagtggcctccag

SEQ ID NO: 467998 - DNA, 20 bp, mouse
ggtggcctccagcggaggga

SEQ ID NO: 467999 - DNA, 20 bp, mouse
ggagcagcaaagacccgggg

SEQ ID NO: 468000 - DNA, 20 bp, mouse
ggacggaccgcgcagctcac

SEQ ID NO: 468001 - DNA, 20 bp, mouse
ggtgagtggcctccagcgga

SEQ ID NO: 468002 - DNA, 20 bp, mouse
ggctccgcgcagcaccgact

SEQ ID NO: 468003 - DNA, 20 bp, mouse
gtccagcagtgcctgcgggc

SEQ ID NO: 468004 - DNA, 20 bp, mouse
ggctggagtcgacgcgtgag

SEQ ID NO: 468005 - DNA, 20 bp, mouse
gtcgtctcaggactgtgctg

SEQ ID NO: 468006 - DNA, 20 bp, mouse
ggtagtctgcacggagtact

SEQ ID NO: 468007 - DNA, 20 bp, mouse
gtcctgcctaggacactgga

SEQ ID NO: 468008 - DNA, 20 bp, mouse
gaaggacgatataagagaca

SEQ ID NO: 468009 - DNA, 20 bp, mouse
gaagtctgtttcccaggtaa

SEQ ID NO: 468010 - DNA, 20 bp, mouse
gaagagacagggtacttagg

SEQ ID NO: 468011 - DNA, 20 bp, mouse
gtcagggaactcatctctaa

SEQ ID NO: 468012 - DNA, 20 bp, mouse
gctccgtagcgaaggcgagg

SEQ ID NO: 468013 - DNA, 20 bp, mouse
gtataagagacagggtactt

SEQ ID NO: 468014 - DNA, 20 bp, mouse
ggtgtgttaccaggaagagt

SEQ ID NO: 468015 - DNA, 20 bp, mouse
gggtgctctcgtccttctca

SEQ ID NO: 468016 - DNA, 20 bp, mouse
gcggcaaaaggcaaccgagg

SEQ ID NO: 468017 - DNA, 20 bp, mouse
gaggacgagcccgggagaaa

SEQ ID NO: 468018 - DNA, 20 bp, mouse
ggagcggcaaaaggcaaccg

SEQ ID NO: 468019 - DNA, 20 bp, mouse
ggttgccagggtaacccgag

SEQ ID NO: 468020 - DNA, 20 bp, mouse
ggcagcgatggggaccaacc

SEQ ID NO: 468021 - DNA, 20 bp, mouse
gggcaggccgtgcaccgggt

SEQ ID NO: 468022 - DNA, 20 bp, mouse
gtgccctgcagctgccacct

SEQ ID NO: 468023 - DNA, 20 bp, mouse
gctcaccgtggagtctgtaa

SEQ ID NO: 468024 - DNA, 20 bp, mouse
ggaggacccaggagggtgag

SEQ ID NO: 468025 - DNA, 20 bp, mouse
ggctgctgtggagagacggt

SEQ ID NO: 468026 - DNA, 20 bp, mouse
gtggctgtcaacgtccgatg

SEQ ID NO: 468027 - DNA, 20 bp, mouse
gggcagaaacggtagagcca

SEQ ID NO: 468028 - DNA, 20 bp, mouse
ggcaggggtcaaacaagcag

SEQ ID NO: 468029 - DNA, 20 bp, mouse
gttggaccctgcatcctcat

SEQ ID NO: 468030 - DNA, 20 bp, mouse
gcaggagctagctcacaggt

SEQ ID NO: 468031 - DNA, 20 bp, mouse
gaacgtccgatgaggatgca

SEQ ID NO: 468032 - DNA, 20 bp, mouse
gtgaggtgtactcagcacac

SEQ ID NO: 468033 - DNA, 20 bp, mouse
gagatcctggccagatcctg

SEQ ID NO: 468034 - DNA, 20 bp, mouse
gatcgaagtacaggtagcag

SEQ ID NO: 468035 - DNA, 20 bp, mouse
gtgcggttaaagctgttgcc

SEQ ID NO: 468036 - DNA, 20 bp, mouse
gtgaggttcgcgatccggta

SEQ ID NO: 468037 - DNA, 20 bp, mouse
gtcctcgctggacatgatgg

SEQ ID NO: 468038 - DNA, 20 bp, mouse
gagctcctcgctggacatga

SEQ ID NO: 468039 - DNA, 20 bp, mouse
ggcaggctggacatccacca

SEQ ID NO: 468040 - DNA, 20 bp, mouse
gcaactctctgtccccgtac

SEQ ID NO: 468041 - DNA, 20 bp, mouse
gtgcgggcagagaccgacca

SEQ ID NO: 468042 - DNA, 20 bp, mouse
gctgcgcccccgaagaacgg

SEQ ID NO: 468043 - DNA, 20 bp, mouse
gggaactgaggttcgcgatc

SEQ ID NO: 468044 - DNA, 20 bp, mouse
gggctccgggtgcccggctg

SEQ ID NO: 468045 - DNA, 20 bp, mouse
ggaacgggggatccgagaca

SEQ ID NO: 468046 - DNA, 20 bp, mouse
gggcgcgcggacctcaacca

SEQ ID NO: 468047 - DNA, 20 bp, mouse
gaactcgtccgtggccatgg

SEQ ID NO: 468048 - DNA, 20 bp, mouse
gagcgctgcgcgggccacca

SEQ ID NO: 468049 - DNA, 20 bp, mouse
gttgctggccaactcgtccg

SEQ ID NO: 468050 - DNA, 20 bp, mouse
ggtcaggaagaggaagagcg

SEQ ID NO: 468051 - DNA, 20 bp, mouse
ggaagaggaagagcgcggcc

SEQ ID NO: 468052 - DNA, 20 bp, mouse
ggagcagccggggctcaacg

SEQ ID NO: 468053 - DNA, 20 bp, mouse
ggtaggggttgaagacgcgg

SEQ ID NO: 468054 - DNA, 20 bp, mouse
gtccgcgctgcccaacgcct

SEQ ID NO: 468055 - DNA, 20 bp, mouse
gcctggcggcggggagtgtc

SEQ ID NO: 468056 - DNA, 20 bp, mouse
gacccaagagaggggcccaa

SEQ ID NO: 468057 - DNA, 20 bp, mouse
gctaggcgcaggccaggggt

SEQ ID NO: 468058 - DNA, 20 bp, mouse
gacgagagctctgcagtgta

SEQ ID NO: 468059 - DNA, 20 bp, mouse
ggtaccgtggagaagcctgt

SEQ ID NO: 468060 - DNA, 20 bp, mouse
gggcttctccacggtacagt

SEQ ID NO: 468061 - DNA, 20 bp, mouse
gacctggcaacagccgacca

SEQ ID NO: 468062 - DNA, 20 bp, mouse
gcgtggtgcctactgtaccg

SEQ ID NO: 468063 - DNA, 20 bp, mouse
gcactgcagagctctcgtcc

SEQ ID NO: 468064 - DNA, 20 bp, mouse
gtaaggggagatacagacgg

SEQ ID NO: 468065 - DNA, 20 bp, mouse
ggcggagtcgagcagcgaag

SEQ ID NO: 468066 - DNA, 20 bp, mouse
gggcggcggctggagagcga

SEQ ID NO: 468067 - DNA, 20 bp, mouse
gagacggcggggccaggcgg

SEQ ID NO: 468068 - DNA, 20 bp, mouse
gcctcgttgcgcgcacgcag

SEQ ID NO: 468069 - DNA, 20 bp, mouse
ggagctcttgggggaatact

SEQ ID NO: 468070 - DNA, 20 bp, mouse
gccgcgggcgccgagaaacc

SEQ ID NO: 468071 - DNA, 20 bp, mouse
gacctcctcctgaacttcgg

SEQ ID NO: 468072 - DNA, 20 bp, mouse
gcgcggggcagaggcccgag

SEQ ID NO: 468073 - DNA, 20 bp, mouse
gcccaggtgagcttgattgg

SEQ ID NO: 468074 - DNA, 20 bp, mouse
gggcacccccgaagttcagg

SEQ ID NO: 468075 - DNA, 20 bp, mouse
gctggaaccgtagcaacccc

SEQ ID NO: 468076 - DNA, 20 bp, mouse
gctgagaagccgggagtgcg

SEQ ID NO: 468077 - DNA, 20 bp, mouse
gagtgcggggctcagtcggg

SEQ ID NO: 468078 - DNA, 20 bp, mouse
ggcggcggcagcagggagct

SEQ ID NO: 468079 - DNA, 20 bp, mouse
ggggagtgcggggctcagtc

SEQ ID NO: 468080 - DNA, 20 bp, mouse
gtgggcccgagaagtcctag

SEQ ID NO: 468081 - DNA, 20 bp, mouse
ggctgggaagctgagaagcc

SEQ ID NO: 468082 - DNA, 20 bp, mouse
gtgggcgtgactaagattgg

SEQ ID NO: 468083 - DNA, 20 bp, mouse
gagacaggcttggtaccgag

SEQ ID NO: 468084 - DNA, 20 bp, mouse
ggagaggggacgcactatgt

SEQ ID NO: 468085 - DNA, 20 bp, mouse
gggaacctggcagcagtcct

SEQ ID NO: 468086 - DNA, 20 bp, mouse
gctcgccgggacagagaagt

SEQ ID NO: 468087 - DNA, 20 bp, mouse
gcagccgggccagaccagac

SEQ ID NO: 468088 - DNA, 20 bp, mouse
gagaccagactggaccccag

SEQ ID NO: 468089 - DNA, 20 bp, mouse
gtcgcccctggggtccagtc

SEQ ID NO: 468090 - DNA, 20 bp, mouse
gctggaccccaggggcgatg

SEQ ID NO: 468091 - DNA, 20 bp, mouse
gttctctgtcccggcgagaa

SEQ ID NO: 468092 - DNA, 20 bp, mouse
gggcgagaaaggtacaaaag

SEQ ID NO: 468093 - DNA, 20 bp, mouse
gaagtgggccgggaccagcc

SEQ ID NO: 468094 - DNA, 20 bp, mouse
gagcagccgcatcgcccctg

SEQ ID NO: 468095 - DNA, 20 bp, mouse
gcgctcggccgtgctacctg

SEQ ID NO: 468096 - DNA, 20 bp, mouse
gatgcagggatgctaataag

SEQ ID NO: 468097 - DNA, 20 bp, mouse
gggagcaaggagcagaacgt

SEQ ID NO: 468098 - DNA, 20 bp, mouse
gaggaaggttggatgatgca

SEQ ID NO: 468099 - DNA, 20 bp, mouse
gatcatccaaccttcctcct

SEQ ID NO: 468100 - DNA, 20 bp, mouse
gtgaagaagccttttctccc

SEQ ID NO: 468101 - DNA, 20 bp, mouse
gagggttgatgagtagagag

SEQ ID NO: 468102 - DNA, 20 bp, mouse
ggagcagaacgtgggtatcg

SEQ ID NO: 468103 - DNA, 20 bp, mouse
gccccaaggctgccaagcca

SEQ ID NO: 468104 - DNA, 20 bp, mouse
gcccggtcctaaaaagttag

SEQ ID NO: 468105 - DNA, 20 bp, mouse
gagaacgtgggtatcggggt

SEQ ID NO: 468106 - DNA, 20 bp, mouse
ggcactgactgcagacactc

SEQ ID NO: 468107 - DNA, 20 bp, mouse
ggcgcgctggacagcagtgg

SEQ ID NO: 468108 - DNA, 20 bp, mouse
gtatgcgcgctggacagcag

SEQ ID NO: 468109 - DNA, 20 bp, mouse
gccactgtggcccggaggaa

SEQ ID NO: 468110 - DNA, 20 bp, mouse
gtcgccaagtccttaatccc

SEQ ID NO: 468111 - DNA, 20 bp, mouse
gtacccggccgaggcttcag

SEQ ID NO: 468112 - DNA, 20 bp, mouse
gcgactgggtccccctaaca

SEQ ID NO: 468113 - DNA, 20 bp, mouse
gcttcagggagacccgatcg

SEQ ID NO: 468114 - DNA, 20 bp, mouse
gcactcgggctcaatcgccg

SEQ ID NO: 468115 - DNA, 20 bp, mouse
gggagggagtctatgcgcgc

SEQ ID NO: 468116 - DNA, 20 bp, mouse
gccgggacaaaggcccgcag

SEQ ID NO: 468117 - DNA, 20 bp, mouse
gcggggacagaggcaccggt

SEQ ID NO: 468118 - DNA, 20 bp, mouse
gcgcagctccgcgatccgac

SEQ ID NO: 468119 - DNA, 20 bp, mouse
gtagtcaggcggcccctctc

SEQ ID NO: 468120 - DNA, 20 bp, mouse
gctgcgcgcagagcgggtcc

SEQ ID NO: 468121 - DNA, 20 bp, mouse
gggagagacgagtcggtgtg

SEQ ID NO: 468122 - DNA, 20 bp, mouse
gagaggcaccggtcggatcg

SEQ ID NO: 468123 - DNA, 20 bp, mouse
ggcgcgctgactctccgcgg

SEQ ID NO: 468124 - DNA, 20 bp, mouse
gcgagttgcgaggattcagg

SEQ ID NO: 468125 - DNA, 20 bp, mouse
gcctggagcgcagagataaa

SEQ ID NO: 468126 - DNA, 20 bp, mouse
gaacatgaggcgccgggcaa

SEQ ID NO: 468127 - DNA, 20 bp, mouse
ggccgggcgggggcaacatg

SEQ ID NO: 468128 - DNA, 20 bp, mouse
gccagcctcgccgggattga

SEQ ID NO: 468129 - DNA, 20 bp, mouse
gagcccgctgccctcaatcc

SEQ ID NO: 468130 - DNA, 20 bp, mouse
gccagtcccgagcccaggag

SEQ ID NO: 468131 - DNA, 20 bp, mouse
gacatggggagccgagggcc

SEQ ID NO: 468132 - DNA, 20 bp, mouse
gctgcagacggcccctgcaa

SEQ ID NO: 468133 - DNA, 20 bp, mouse
gagcgtggtagccacccctg

SEQ ID NO: 468134 - DNA, 20 bp, mouse
ggctgccctcaatcccggcg

SEQ ID NO: 468135 - DNA, 20 bp, mouse
gccgctacgtgggggacatg

SEQ ID NO: 468136 - DNA, 20 bp, mouse
gggccacggacgcctcgtcg

SEQ ID NO: 468137 - DNA, 20 bp, mouse
ggagagagcggacgccgacc

SEQ ID NO: 468138 - DNA, 20 bp, mouse
ggaccgggtacagcgaccac

SEQ ID NO: 468139 - DNA, 20 bp, mouse
gggacgaattgccgagagag

SEQ ID NO: 468140 - DNA, 20 bp, mouse
gcacggacgcctcgtcgggg

SEQ ID NO: 468141 - DNA, 20 bp, mouse
ggactgcggaagcccggcca

SEQ ID NO: 468142 - DNA, 20 bp, mouse
gggcctggcccgacactcac

SEQ ID NO: 468143 - DNA, 20 bp, mouse
gtggcccgacactcacgggt

SEQ ID NO: 468144 - DNA, 20 bp, mouse
ggccgaccgcagcatgactg

SEQ ID NO: 468145 - DNA, 20 bp, mouse
gggccggtggtcgctgtacc

SEQ ID NO: 468146 - DNA, 20 bp, mouse
gccgccgggctgtgaatgaa

SEQ ID NO: 468147 - DNA, 20 bp, mouse
ggctacgccggcctccccag

SEQ ID NO: 468148 - DNA, 20 bp, mouse
gcctgcccgagggatctcag

SEQ ID NO: 468149 - DNA, 20 bp, mouse
gcgtcgctggctgctagtcc

SEQ ID NO: 468150 - DNA, 20 bp, mouse
gcggctgcgggcggagaccg

SEQ ID NO: 468151 - DNA, 20 bp, mouse
gacagcccggcgggctcagg

SEQ ID NO: 468152 - DNA, 20 bp, mouse
gcccgccgccggccccccat

SEQ ID NO: 468153 - DNA, 20 bp, mouse
gtcggcacagacgtacgcac

SEQ ID NO: 468154 - DNA, 20 bp, mouse
gcccgcggagatgtacggta

SEQ ID NO: 468155 - DNA, 20 bp, mouse
gcgctccccgcggagatgta

SEQ ID NO: 468156 - DNA, 20 bp, mouse
gcccgaggaggaaggtgcgg

SEQ ID NO: 468157 - DNA, 20 bp, mouse
gcgcggaccagaccaccccg

SEQ ID NO: 468158 - DNA, 20 bp, mouse
gtgcgcggtcccgaggagga

SEQ ID NO: 468159 - DNA, 20 bp, mouse
ggggaccgcgcagcagaccg

SEQ ID NO: 468160 - DNA, 20 bp, mouse
gccgggctcccgctccccct

SEQ ID NO: 468161 - DNA, 20 bp, mouse
gggagggagagcttgccgag

SEQ ID NO: 468162 - DNA, 20 bp, mouse
gggagcgggagcccgggcaa

SEQ ID NO: 468163 - DNA, 20 bp, mouse
ggagtgcaaggggtgatcgg

SEQ ID NO: 468164 - DNA, 20 bp, mouse
gagcccctcgcgagaggaat

SEQ ID NO: 468165 - DNA, 20 bp, mouse
gggcccgagcccctcgcgag

SEQ ID NO: 468166 - DNA, 20 bp, mouse
gtaggtgcgtgggtgaggtg

SEQ ID NO: 468167 - DNA, 20 bp, mouse
gcacgcacctaagactccag

SEQ ID NO: 468168 - DNA, 20 bp, mouse
gagggacccggtactctcag

SEQ ID NO: 468169 - DNA, 20 bp, mouse
ggagctacccctggagtctt

SEQ ID NO: 468170 - DNA, 20 bp, mouse
gctccaggggtagctcagac

SEQ ID NO: 468171 - DNA, 20 bp, mouse
gagtcttaggtgcgtgggtg

SEQ ID NO: 468172 - DNA, 20 bp, mouse
gttccggtctgagctacccc

SEQ ID NO: 468173 - DNA, 20 bp, mouse
gggaagtcgcaggagcctgg

SEQ ID NO: 468174 - DNA, 20 bp, mouse
gtgagtggggggacttgcta

SEQ ID NO: 468175 - DNA, 20 bp, mouse
gagggacgccggcgaccaga

SEQ ID NO: 468176 - DNA, 20 bp, mouse
gcggcgtgcggcggaagcgc

SEQ ID NO: 468177 - DNA, 20 bp, mouse
ggcgggctcaggcggcggac

SEQ ID NO: 468178 - DNA, 20 bp, mouse
ggcggaaaccccggaatcga

SEQ ID NO: 468179 - DNA, 20 bp, mouse
ggcgttgtcgcggcgtgcgg

SEQ ID NO: 468180 - DNA, 20 bp, mouse
gccgggcgccggcgttgtcg

SEQ ID NO: 468181 - DNA, 20 bp, mouse
gacagcgccacctctactaa

SEQ ID NO: 468182 - DNA, 20 bp, mouse
ggcatccgagctgactgtga

SEQ ID NO: 468183 - DNA, 20 bp, mouse
gtcgttccccaagccccgaa

SEQ ID NO: 468184 - DNA, 20 bp, mouse
gagatcctgtcccttagtag

SEQ ID NO: 468185 - DNA, 20 bp, mouse
gtcctgtcccttagtagagg

SEQ ID NO: 468186 - DNA, 20 bp, mouse
ggccccaccgggatgaggga

SEQ ID NO: 468187 - DNA, 20 bp, mouse
gggattcctatctgtatata

SEQ ID NO: 468188 - DNA, 20 bp, mouse
gtccttccctatatacagat

SEQ ID NO: 468189 - DNA, 20 bp, mouse
gaccatccctcatcccggtg

SEQ ID NO: 468190 - DNA, 20 bp, mouse
gtcctatctgtatataggga

SEQ ID NO: 468191 - DNA, 20 bp, mouse
gccaagccccaccgggatga

SEQ ID NO: 468192 - DNA, 20 bp, mouse
ggaaagttccaagccccacc

SEQ ID NO: 468193 - DNA, 20 bp, mouse
gcaggccttgcagggctctt

SEQ ID NO: 468194 - DNA, 20 bp, mouse
gaacaacgaaatatgcagat

SEQ ID NO: 468195 - DNA, 20 bp, mouse
gcctctgagtgcagccggaa

SEQ ID NO: 468196 - DNA, 20 bp, mouse
gggccggccaaaccaacccc

SEQ ID NO: 468197 - DNA, 20 bp, mouse
gacagcgcccgtgctagcag

SEQ ID NO: 468198 - DNA, 20 bp, mouse
ggcagggctgtgcagctctt

SEQ ID NO: 468199 - DNA, 20 bp, mouse
gtggagaccagtgagaccag

SEQ ID NO: 468200 - DNA, 20 bp, mouse
gacagtgcccggggttggtt

SEQ ID NO: 468201 - DNA, 20 bp, mouse
gggccggccactgctagcac

SEQ ID NO: 468202 - DNA, 20 bp, mouse
gccctatccgagcaaaacgg

SEQ ID NO: 468203 - DNA, 20 bp, mouse
ggcaggaccgctggtctcac

SEQ ID NO: 468204 - DNA, 20 bp, mouse
gcgaagcccgctcagaagtt

SEQ ID NO: 468205 - DNA, 20 bp, mouse
gcgcccgtgctagcagtggc

SEQ ID NO: 468206 - DNA, 20 bp, mouse
gtctgtggcagcccgcgcag

SEQ ID NO: 468207 - DNA, 20 bp, mouse
ggtggcagcccgcgcagagg

SEQ ID NO: 468208 - DNA, 20 bp, mouse
ggaggaagcgccaggcccca

SEQ ID NO: 468209 - DNA, 20 bp, mouse
gtggagagctggggaacgtt

SEQ ID NO: 468210 - DNA, 20 bp, mouse
gccgcgcagaggtggagagc

SEQ ID NO: 468211 - DNA, 20 bp, mouse
ggaacgtttggagctgtgag

SEQ ID NO: 468212 - DNA, 20 bp, mouse
gtactccacctgtcacccag

SEQ ID NO: 468213 - DNA, 20 bp, mouse
gtgctcccctgggtgacagg

SEQ ID NO: 468214 - DNA, 20 bp, mouse
gcctggagagatactctgtt

SEQ ID NO: 468215 - DNA, 20 bp, mouse
gccagctgcgcgcaaaacca

SEQ ID NO: 468216 - DNA, 20 bp, mouse
gagacttcaggagggaccct

SEQ ID NO: 468217 - DNA, 20 bp, mouse
gaggcttcggtcgacaggac

SEQ ID NO: 468218 - DNA, 20 bp, mouse
ggtgcacagaggctcctccc

SEQ ID NO: 468219 - DNA, 20 bp, mouse
ggctcctcccgggtgaagaa

SEQ ID NO: 468220 - DNA, 20 bp, mouse
gaggcgtgcagacttcagga

SEQ ID NO: 468221 - DNA, 20 bp, mouse
gggacaggcgtgcagacttc

SEQ ID NO: 468222 - DNA, 20 bp, mouse
gcctcccgggtgaagaaggg

SEQ ID NO: 468223 - DNA, 20 bp, mouse
gtcgaccgaagccttcctcg

SEQ ID NO: 468224 - DNA, 20 bp, mouse
gggctgctgtgcagtccacg

SEQ ID NO: 468225 - DNA, 20 bp, mouse
gaagccacccttcttcaccc

SEQ ID NO: 468226 - DNA, 20 bp, mouse
gtcccggcagagccctacat

SEQ ID NO: 468227 - DNA, 20 bp, mouse
gagagggaagacccaggtcc

SEQ ID NO: 468228 - DNA, 20 bp, mouse
gtccaggagagggaagaccc

SEQ ID NO: 468229 - DNA, 20 bp, mouse
gtgttcgagatgcccatgta

SEQ ID NO: 468230 - DNA, 20 bp, mouse
gtagggctctgccgggacct

SEQ ID NO: 468231 - DNA, 20 bp, mouse
gggagagtccggggagacca

SEQ ID NO: 468232 - DNA, 20 bp, mouse
ggagtccggggagaccaggg

SEQ ID NO: 468233 - DNA, 20 bp, mouse
gcgaacagtgcaaggccgac

SEQ ID NO: 468234 - DNA, 20 bp, mouse
gcaacctcagagcattgaca

SEQ ID NO: 468235 - DNA, 20 bp, mouse
gaggggtccaaggagagtcc

SEQ ID NO: 468236 - DNA, 20 bp, mouse
gtgctgcagcctcctggaca

SEQ ID NO: 468237 - DNA, 20 bp, mouse
gagccgcagcttacactggt

SEQ ID NO: 468238 - DNA, 20 bp, mouse
gcacccaccagtgtaagctg

SEQ ID NO: 468239 - DNA, 20 bp, mouse
ggggagaggaagtcagtggt

SEQ ID NO: 468240 - DNA, 20 bp, mouse
gcagcagccgcagcttacac

SEQ ID NO: 468241 - DNA, 20 bp, mouse
gactggtgggtgggcctctc

SEQ ID NO: 468242 - DNA, 20 bp, mouse
ggtgaaggtgacatattcta

SEQ ID NO: 468243 - DNA, 20 bp, mouse
gccactgcagaccatgggag

SEQ ID NO: 468244 - DNA, 20 bp, mouse
gacctgtttccctgtccagg

SEQ ID NO: 468245 - DNA, 20 bp, mouse
gcggtatgatgagagtgtgg

SEQ ID NO: 468246 - DNA, 20 bp, mouse
gtcgggagtccgaggaggca

SEQ ID NO: 468247 - DNA, 20 bp, mouse
gggagccactcgggagtccg

SEQ ID NO: 468248 - DNA, 20 bp, mouse
ggacgcgaggatgagaaggt

SEQ ID NO: 468249 - DNA, 20 bp, mouse
ggctgaaccaggagccactc

SEQ ID NO: 468250 - DNA, 20 bp, mouse
gggaagctggcgtgcttgag

SEQ ID NO: 468251 - DNA, 20 bp, mouse
gatgagaaggtgggagaccc

SEQ ID NO: 468252 - DNA, 20 bp, mouse
ggagtgacacagcgccgggt

SEQ ID NO: 468253 - DNA, 20 bp, mouse
gcagtgacgcgaggatgaga

SEQ ID NO: 468254 - DNA, 20 bp, mouse
gctggcgtgcttgagcggag

SEQ ID NO: 468255 - DNA, 20 bp, mouse
gggcgctgtgtcactccgaa

SEQ ID NO: 468256 - DNA, 20 bp, mouse
gccgagctaactagacgtct

SEQ ID NO: 468257 - DNA, 20 bp, mouse
gccagacgccctagcccagg

SEQ ID NO: 468258 - DNA, 20 bp, mouse
ggatccagacgccctagccc

SEQ ID NO: 468259 - DNA, 20 bp, mouse
gcgcactgtgcgctcctcct

SEQ ID NO: 468260 - DNA, 20 bp, mouse
ggtgcgctcctcctgggcta

SEQ ID NO: 468261 - DNA, 20 bp, mouse
gcgtctggatcgagtcccgg

SEQ ID NO: 468262 - DNA, 20 bp, mouse
gatctctgaccgggagaggt

SEQ ID NO: 468263 - DNA, 20 bp, mouse
gagtcactgggcacaaccgt

SEQ ID NO: 468264 - DNA, 20 bp, mouse
gcgagacagacggagtccca

SEQ ID NO: 468265 - DNA, 20 bp, mouse
ggctgctgcgcgttgcgctg

SEQ ID NO: 468266 - DNA, 20 bp, mouse
gcgctaggcggccccgggca

SEQ ID NO: 468267 - DNA, 20 bp, mouse
gcggccatggccagtgacag

SEQ ID NO: 468268 - DNA, 20 bp, mouse
ggcgcgctgcacgtacacca

SEQ ID NO: 468269 - DNA, 20 bp, mouse
gggccgccgcccgctgcggg

SEQ ID NO: 468270 - DNA, 20 bp, mouse
gccgtcggggcgcccgcccg

SEQ ID NO: 468271 - DNA, 20 bp, mouse
gacaagctggtgtgccaggg

SEQ ID NO: 468272 - DNA, 20 bp, mouse
gggcccagccggctgcgtcg

SEQ ID NO: 468273 - DNA, 20 bp, mouse
gcgctctctccggcgcgatg

SEQ ID NO: 468274 - DNA, 20 bp, mouse
gtggagaacctgctgcgctg

SEQ ID NO: 468275 - DNA, 20 bp, mouse
gtgcgagctgtgcgggaaga

SEQ ID NO: 468276 - DNA, 20 bp, mouse
ggggcggctggcacaaacgg

SEQ ID NO: 468277 - DNA, 20 bp, mouse
ggcgcgaagggaaagacccg

SEQ ID NO: 468278 - DNA, 20 bp, mouse
gcggaggaaaaagctcggtg

SEQ ID NO: 468279 - DNA, 20 bp, mouse
gcaaacggcggcgccgaggc

SEQ ID NO: 468280 - DNA, 20 bp, mouse
gcgaagggaaagacccgggg

SEQ ID NO: 468281 - DNA, 20 bp, mouse
gcggcagcgaccccacgcta

SEQ ID NO: 468282 - DNA, 20 bp, mouse
gaggaaaaagctcggtgagg

SEQ ID NO: 468283 - DNA, 20 bp, mouse
gggcacaaacggcggcgccg

SEQ ID NO: 468284 - DNA, 20 bp, mouse
gcccctccgccaggacccag

SEQ ID NO: 468285 - DNA, 20 bp, mouse
gtcggcccggcccctcccct

SEQ ID NO: 468286 - DNA, 20 bp, mouse
ggaccggcgggagcagtgta

SEQ ID NO: 468287 - DNA, 20 bp, mouse
gctctgaagagaagggatcc

SEQ ID NO: 468288 - DNA, 20 bp, mouse
gatcccggctctgggaccgg

SEQ ID NO: 468289 - DNA, 20 bp, mouse
gtggcccagtgagaagtcgg

SEQ ID NO: 468290 - DNA, 20 bp, mouse
gccagtccggcgctgggtgg

SEQ ID NO: 468291 - DNA, 20 bp, mouse
ggggatcccggctctgggac

SEQ ID NO: 468292 - DNA, 20 bp, mouse
ggggccagtccggcgctggg

SEQ ID NO: 468293 - DNA, 20 bp, mouse
gctcgaaactctgaagagaa

SEQ ID NO: 468294 - DNA, 20 bp, mouse
ggcctcatgatgtgtcccag

SEQ ID NO: 468295 - DNA, 20 bp, mouse
ggggccctccgacttctcac

SEQ ID NO: 468296 - DNA, 20 bp, mouse
gcggcggcggcgaatcgcgg

SEQ ID NO: 468297 - DNA, 20 bp, mouse
gtggcggcggcggcgaatcg

SEQ ID NO: 468298 - DNA, 20 bp, mouse
gttgcggcggcggaagctgg

SEQ ID NO: 468299 - DNA, 20 bp, mouse
ggcaggggccgatcttgcgg

SEQ ID NO: 468300 - DNA, 20 bp, mouse
gccggggccgaagctactga

SEQ ID NO: 468301 - DNA, 20 bp, mouse
gatcccagcgcgcagaactt

SEQ ID NO: 468302 - DNA, 20 bp, mouse
gcggcggcggaagctggcgg

SEQ ID NO: 468303 - DNA, 20 bp, mouse
gcggcagcaccgaggaactg

SEQ ID NO: 468304 - DNA, 20 bp, mouse
gggggcaggggccgatcttg

SEQ ID NO: 468305 - DNA, 20 bp, mouse
ggtgctgccggaaccccaga

SEQ ID NO: 468306 - DNA, 20 bp, mouse
gtccccaacagccggatcac

SEQ ID NO: 468307 - DNA, 20 bp, mouse
gttggggagccaggagttgc

SEQ ID NO: 468308 - DNA, 20 bp, mouse
gtgattaatagctgggcgag

SEQ ID NO: 468309 - DNA, 20 bp, mouse
gacactacaccagcaactcc

SEQ ID NO: 468310 - DNA, 20 bp, mouse
gcagcgattgattaatagct

SEQ ID NO: 468311 - DNA, 20 bp, mouse
gggttgaactgagcctagga

SEQ ID NO: 468312 - DNA, 20 bp, mouse
gctctcagacggaaagtgtt

SEQ ID NO: 468313 - DNA, 20 bp, mouse
gcaacagccggatcacaggc

SEQ ID NO: 468314 - DNA, 20 bp, mouse
gcctgacagcctctacccgg

SEQ ID NO: 468315 - DNA, 20 bp, mouse
gaagatggtcaccgacgagg

SEQ ID NO: 468316 - DNA, 20 bp, mouse
gggtgggtgcttcacctctg

SEQ ID NO: 468317 - DNA, 20 bp, mouse
gggcggtgggactcaggtta

SEQ ID NO: 468318 - DNA, 20 bp, mouse
ggaagcgccagcagtcgcca

SEQ ID NO: 468319 - DNA, 20 bp, mouse
gatgcaaatagaggtcccgg

SEQ ID NO: 468320 - DNA, 20 bp, mouse
gaagcacccacccgcgcggg

SEQ ID NO: 468321 - DNA, 20 bp, mouse
gggtcgggttatgcaaatag

SEQ ID NO: 468322 - DNA, 20 bp, mouse
ggttatgcaaatagaggtcc

SEQ ID NO: 468323 - DNA, 20 bp, mouse
gctgggtagggaagaaatgg

SEQ ID NO: 468324 - DNA, 20 bp, mouse
gctgtttcgaagggagaggg

SEQ ID NO: 468325 - DNA, 20 bp, mouse
gcggcccccgcgctgaccac

SEQ ID NO: 468326 - DNA, 20 bp, mouse
gcaggcgagcggcatccgag

SEQ ID NO: 468327 - DNA, 20 bp, mouse
gtggaagctgcgttaggaac

SEQ ID NO: 468328 - DNA, 20 bp, mouse
gaagctgcgttaggaacagg

SEQ ID NO: 468329 - DNA, 20 bp, mouse
ggcatccgagaggcgatccg

SEQ ID NO: 468330 - DNA, 20 bp, mouse
gaacgcagcttccaggcgag

SEQ ID NO: 468331 - DNA, 20 bp, mouse
gcgttaggaacaggcggcgg

SEQ ID NO: 468332 - DNA, 20 bp, mouse
ggcgcgctcaacctcttctc

SEQ ID NO: 468333 - DNA, 20 bp, mouse
ggtcgctgctgccggagaag

SEQ ID NO: 468334 - DNA, 20 bp, mouse
ggaggcgatccgtggtgcag

SEQ ID NO: 468335 - DNA, 20 bp, mouse
gagctcgggagtgctatgac

SEQ ID NO: 468336 - DNA, 20 bp, mouse
gagccaggagccgccacccg

SEQ ID NO: 468337 - DNA, 20 bp, mouse
gccgcggcgccctggctcac

SEQ ID NO: 468338 - DNA, 20 bp, mouse
gggcaggtgccggtgagcca

SEQ ID NO: 468339 - DNA, 20 bp, mouse
gcaccggcacctgcctcggg

SEQ ID NO: 468340 - DNA, 20 bp, mouse
ggcttctccaaagtgcaaca

SEQ ID NO: 468341 - DNA, 20 bp, mouse
gcggcacctgcctcgggtgg

SEQ ID NO: 468342 - DNA, 20 bp, mouse
gccgcagctatataagtggg

SEQ ID NO: 468343 - DNA, 20 bp, mouse
gggctccgggcgcttggctg

SEQ ID NO: 468344 - DNA, 20 bp, mouse
gaggagccgccacccgaggc

SEQ ID NO: 468345 - DNA, 20 bp, mouse
ggcgcttggctggggcacga

SEQ ID NO: 468346 - DNA, 20 bp, mouse
ggaggagcggctctaaggag

SEQ ID NO: 468347 - DNA, 20 bp, mouse
ggcagggatggaggactcgg

SEQ ID NO: 468348 - DNA, 20 bp, mouse
gagggggcgctgctccggga

SEQ ID NO: 468349 - DNA, 20 bp, mouse
ggaggggacagcgggattag

SEQ ID NO: 468350 - DNA, 20 bp, mouse
gcacgcggctccagcaggga

SEQ ID NO: 468351 - DNA, 20 bp, mouse
gggaacagcgaagcccggcg

SEQ ID NO: 468352 - DNA, 20 bp, mouse
gtgtctctgcggagagacag

SEQ ID NO: 468353 - DNA, 20 bp, mouse
gtgctcgtttgcgggagccg

SEQ ID NO: 468354 - DNA, 20 bp, mouse
gccagcagggatggaggact

SEQ ID NO: 468355 - DNA, 20 bp, mouse
ggtcgctgggcgctctgccg

SEQ ID NO: 468356 - DNA, 20 bp, mouse
gtgagtctgcggggccgtcg

SEQ ID NO: 468357 - DNA, 20 bp, mouse
gagcccaccaggcggacccc

SEQ ID NO: 468358 - DNA, 20 bp, mouse
gactcagccagcccaccagg

SEQ ID NO: 468359 - DNA, 20 bp, mouse
gtgcccggggtccgcctggt

SEQ ID NO: 468360 - DNA, 20 bp, mouse
gccccgggcaaactcagcct

SEQ ID NO: 468361 - DNA, 20 bp, mouse
gccaagcctgagaagagatc

SEQ ID NO: 468362 - DNA, 20 bp, mouse
gatgtctgaggtttagacct

SEQ ID NO: 468363 - DNA, 20 bp, mouse
gcagactcagccagcccacc

SEQ ID NO: 468364 - DNA, 20 bp, mouse
gtgggctggctgagtctgcg

SEQ ID NO: 468365 - DNA, 20 bp, mouse
gtcaggccatgacttcagtg

SEQ ID NO: 468366 - DNA, 20 bp, mouse
gtggctgctacaggacggag

SEQ ID NO: 468367 - DNA, 20 bp, mouse
gctgctacaggacggagcgg

SEQ ID NO: 468368 - DNA, 20 bp, mouse
gtagcagccagccccgtctc

SEQ ID NO: 468369 - DNA, 20 bp, mouse
gatgatgccggagacggggc

SEQ ID NO: 468370 - DNA, 20 bp, mouse
ggaacatgatgccggagacg

SEQ ID NO: 468371 - DNA, 20 bp, mouse
gggccgaccaggagcaccat

SEQ ID NO: 468372 - DNA, 20 bp, mouse
gcccagcgcgaggataccaa

SEQ ID NO: 468373 - DNA, 20 bp, mouse
gagcgatagtgctcctccag

SEQ ID NO: 468374 - DNA, 20 bp, mouse
gagccgatggtgctcctggt

SEQ ID NO: 468375 - DNA, 20 bp, mouse
ggtcctgctcgatcaggtgg

SEQ ID NO: 468376 - DNA, 20 bp, mouse
gtctgcgctccccagatccc

SEQ ID NO: 468377 - DNA, 20 bp, mouse
ggtctcactccactgcggac

SEQ ID NO: 468378 - DNA, 20 bp, mouse
gcagtggagtgagacgggtg

SEQ ID NO: 468379 - DNA, 20 bp, mouse
gggagcactcaccagggatc

SEQ ID NO: 468380 - DNA, 20 bp, mouse
gtatacggagtactaaagag

SEQ ID NO: 468381 - DNA, 20 bp, mouse
ggaggcaagagaaggctctt

SEQ ID NO: 468382 - DNA, 20 bp, mouse
ggatttggggagcactcacc

SEQ ID NO: 468383 - DNA, 20 bp, mouse
ggagtactaaagagaggctg

SEQ ID NO: 468384 - DNA, 20 bp, mouse
ggaattgggagcgactggga

SEQ ID NO: 468385 - DNA, 20 bp, mouse
ggaccaaggggagcagagat

SEQ ID NO: 468386 - DNA, 20 bp, mouse
gggctgcgccgggtaggcag

SEQ ID NO: 468387 - DNA, 20 bp, mouse
gagcctgggctccgcagtag

SEQ ID NO: 468388 - DNA, 20 bp, mouse
ggtgtgagccgctgcctacc

SEQ ID NO: 468389 - DNA, 20 bp, mouse
gtgagccccgagctctggta

SEQ ID NO: 468390 - DNA, 20 bp, mouse
gtgctcgagctccgctactg

SEQ ID NO: 468391 - DNA, 20 bp, mouse
gagctctggtaaggcagtag

SEQ ID NO: 468392 - DNA, 20 bp, mouse
gtccccagatagatgactaa

SEQ ID NO: 468393 - DNA, 20 bp, mouse
gggactgaatccagcagctg

SEQ ID NO: 468394 - DNA, 20 bp, mouse
gcaccgtctggaagacctca

SEQ ID NO: 468395 - DNA, 20 bp, mouse
gctgtggatgaacctgggac

SEQ ID NO: 468396 - DNA, 20 bp, mouse
gggcggcgagagctactgtc

SEQ ID NO: 468397 - DNA, 20 bp, mouse
ggcggcggcggcaagttgtg

SEQ ID NO: 468398 - DNA, 20 bp, mouse
ggcgagcgacgcgggttctg

SEQ ID NO: 468399 - DNA, 20 bp, mouse
gggcccaccagcaggatcat

SEQ ID NO: 468400 - DNA, 20 bp, mouse
gtactgaagtgcggcggcgg

SEQ ID NO: 468401 - DNA, 20 bp, mouse
ggcggcggcaagttgtgggg

SEQ ID NO: 468402 - DNA, 20 bp, mouse
ggcacagagagcgagcgacg

SEQ ID NO: 468403 - DNA, 20 bp, mouse
gggttcttactgaagtgcgg

SEQ ID NO: 468404 - DNA, 20 bp, mouse
gtcttactgaagtgcggcgg

SEQ ID NO: 468405 - DNA, 20 bp, mouse
gcgctggcgagtgaaactcg

SEQ ID NO: 468406 - DNA, 20 bp, mouse
gaccagctcctaccgagatg

SEQ ID NO: 468407 - DNA, 20 bp, mouse
gcgtggctccccatctcggt

SEQ ID NO: 468408 - DNA, 20 bp, mouse
gctcagacgtgataaggccg

SEQ ID NO: 468409 - DNA, 20 bp, mouse
gacaggtgaaaataaaccag

SEQ ID NO: 468410 - DNA, 20 bp, mouse
gtgagagctcagacgtgata

SEQ ID NO: 468411 - DNA, 20 bp, mouse
gatgggcagagagaaaccgg

SEQ ID NO: 468412 - DNA, 20 bp, mouse
gttctgggtgggaagtccta

SEQ ID NO: 468413 - DNA, 20 bp, mouse
gtctggcatacataccacat

SEQ ID NO: 468414 - DNA, 20 bp, mouse
ggacccagtgggggagccag

SEQ ID NO: 468415 - DNA, 20 bp, mouse
ggagctggctggctaaggga

SEQ ID NO: 468416 - DNA, 20 bp, mouse
gggatcatagccagggagtg

SEQ ID NO: 468417 - DNA, 20 bp, mouse
gcagaggcggatcatagcca

SEQ ID NO: 468418 - DNA, 20 bp, mouse
gattgaccggtggattgcag

SEQ ID NO: 468419 - DNA, 20 bp, mouse
ggaaaatggctgagtatctg

SEQ ID NO: 468420 - DNA, 20 bp, mouse
gacctgatggcattgaccgg

SEQ ID NO: 468421 - DNA, 20 bp, mouse
ggaccggtggattgcagagg

SEQ ID NO: 468422 - DNA, 20 bp, mouse
ggcaggataccttgagaaaa

SEQ ID NO: 468423 - DNA, 20 bp, mouse
ggttacctgatggcattgac

SEQ ID NO: 468424 - DNA, 20 bp, mouse
gtccgggcggtgttacctga

SEQ ID NO: 468425 - DNA, 20 bp, mouse
ggcgaatcaggaacttacaa

SEQ ID NO: 468426 - DNA, 20 bp, mouse
gacgctgcgggcccgggcca

SEQ ID NO: 468427 - DNA, 20 bp, mouse
gtcagcatcagcggcggcca

SEQ ID NO: 468428 - DNA, 20 bp, mouse
gaagcgctccggcggagcac

SEQ ID NO: 468429 - DNA, 20 bp, mouse
gctgaggtgaggtgcggggc

SEQ ID NO: 468430 - DNA, 20 bp, mouse
ggcagcccagcgccgacagc

SEQ ID NO: 468431 - DNA, 20 bp, mouse
gcgcggcgagtgaaaggtca

SEQ ID NO: 468432 - DNA, 20 bp, mouse
ggctccggcggagcacgggc

SEQ ID NO: 468433 - DNA, 20 bp, mouse
ggagcacgggccggacgctg

SEQ ID NO: 468434 - DNA, 20 bp, mouse
ggccgggcccgatgcagcgg

SEQ ID NO: 468435 - DNA, 20 bp, mouse
gcgccgtgcacaaagcgctc

SEQ ID NO: 468436 - DNA, 20 bp, mouse
gcggccgccgaggtgcggaa

SEQ ID NO: 468437 - DNA, 20 bp, mouse
gctccccttccgcacctcgg

SEQ ID NO: 468438 - DNA, 20 bp, mouse
gcccgcgcaagcggcgatgg

SEQ ID NO: 468439 - DNA, 20 bp, mouse
ggtgcccaccgcccacgcag

SEQ ID NO: 468440 - DNA, 20 bp, mouse
gccccccgcgcaagcggcga

SEQ ID NO: 468441 - DNA, 20 bp, mouse
gggcggcggccgccgaggtg

SEQ ID NO: 468442 - DNA, 20 bp, mouse
gaccagggggccaacaccgg

SEQ ID NO: 468443 - DNA, 20 bp, mouse
ggctcggccccccgcgcaag

SEQ ID NO: 468444 - DNA, 20 bp, mouse
gagggggccaacaccggggg

SEQ ID NO: 468445 - DNA, 20 bp, mouse
gggcggcggcacgtgcgact

SEQ ID NO: 468446 - DNA, 20 bp, mouse
ggcccgggcatgcccagtgt

SEQ ID NO: 468447 - DNA, 20 bp, mouse
gggcatgcccgggccgcacg

SEQ ID NO: 468448 - DNA, 20 bp, mouse
gaggcgaaccgagcctcggt

SEQ ID NO: 468449 - DNA, 20 bp, mouse
gacggggcagctgggaagtc

SEQ ID NO: 468450 - DNA, 20 bp, mouse
gaccgccgcggctccagcca

SEQ ID NO: 468451 - DNA, 20 bp, mouse
ggagcaggcgaaccgagcct

SEQ ID NO: 468452 - DNA, 20 bp, mouse
gggctctccgagcgcccggg

SEQ ID NO: 468453 - DNA, 20 bp, mouse
gccagggcgctcgcccaccg

SEQ ID NO: 468454 - DNA, 20 bp, mouse
gcgcgtcccgggcccttcgg

SEQ ID NO: 468455 - DNA, 20 bp, mouse
gaggccggagctagttccta

SEQ ID NO: 468456 - DNA, 20 bp, mouse
gggtggaagcgactcgacca

SEQ ID NO: 468457 - DNA, 20 bp, mouse
gggaagcgactcgaccaagg

SEQ ID NO: 468458 - DNA, 20 bp, mouse
gcagagacgggcgcgcgaac

SEQ ID NO: 468459 - DNA, 20 bp, mouse
gtgcgcgtgcgcaggcaaga

SEQ ID NO: 468460 - DNA, 20 bp, mouse
gcccggcgagggctatatgg

SEQ ID NO: 468461 - DNA, 20 bp, mouse
ggaggagggccccatggagg

SEQ ID NO: 468462 - DNA, 20 bp, mouse
gcgagtcgcttccaccatgg

SEQ ID NO: 468463 - DNA, 20 bp, mouse
ggcctgaaagccgccatcca

SEQ ID NO: 468464 - DNA, 20 bp, mouse
ggcttccaccatggcggaga

SEQ ID NO: 468465 - DNA, 20 bp, mouse
gctgaagaggagcgctggag

SEQ ID NO: 468466 - DNA, 20 bp, mouse
gctgagacccgggaagaacg

SEQ ID NO: 468467 - DNA, 20 bp, mouse
gtgcgcaggcgtagctccaa

SEQ ID NO: 468468 - DNA, 20 bp, mouse
gggctcccgcaggccgaggt

SEQ ID NO: 468469 - DNA, 20 bp, mouse
gcccgggtctcagcgagcag

SEQ ID NO: 468470 - DNA, 20 bp, mouse
ggagcgcaatgcgcacgggt

SEQ ID NO: 468471 - DNA, 20 bp, mouse
gcgggaagaacggggccgtg

SEQ ID NO: 468472 - DNA, 20 bp, mouse
gcgcgacctggggagacccg

SEQ ID NO: 468473 - DNA, 20 bp, mouse
ggcgtccagggaagcccgga

SEQ ID NO: 468474 - DNA, 20 bp, mouse
ggcagcccgggaaggcaggg

SEQ ID NO: 468475 - DNA, 20 bp, mouse
gacccggggacgcccaatgg

SEQ ID NO: 468476 - DNA, 20 bp, mouse
gggtgcttctgaggattcaa

SEQ ID NO: 468477 - DNA, 20 bp, mouse
ggcttctgaggattcaacgg

SEQ ID NO: 468478 - DNA, 20 bp, mouse
gtcagaagcaccggctccgg

SEQ ID NO: 468479 - DNA, 20 bp, mouse
gcggacctgagccccatgaa

SEQ ID NO: 468480 - DNA, 20 bp, mouse
gtccgggatcctgctctctc

SEQ ID NO: 468481 - DNA, 20 bp, mouse
gcgagcttcccggagagagc

SEQ ID NO: 468482 - DNA, 20 bp, mouse
gtggcaatgtccgagcttcc

SEQ ID NO: 468483 - DNA, 20 bp, mouse
gtcctcagaagcaccggctc

SEQ ID NO: 468484 - DNA, 20 bp, mouse
gctgctcgtacagctctagg

SEQ ID NO: 468485 - DNA, 20 bp, mouse
gcgtcgccgacgccgttcat

SEQ ID NO: 468486 - DNA, 20 bp, mouse
gctcagtgactggggcggag

SEQ ID NO: 468487 - DNA, 20 bp, mouse
gcgtgctggagagacctagt

SEQ ID NO: 468488 - DNA, 20 bp, mouse
gttcttccgggcaccctcag

SEQ ID NO: 468489 - DNA, 20 bp, mouse
gagacgccgggcccgcccaa

SEQ ID NO: 468490 - DNA, 20 bp, mouse
gctccagcccgagctaagat

SEQ ID NO: 468491 - DNA, 20 bp, mouse
ggttcccggagggacaacaa

SEQ ID NO: 468492 - DNA, 20 bp, mouse
gaccctcagaggtcgaccct

SEQ ID NO: 468493 - DNA, 20 bp, mouse
gggcccgcgcgaccttcccc

SEQ ID NO: 468494 - DNA, 20 bp, mouse
gcgtagaggacatgacgcag

SEQ ID NO: 468495 - DNA, 20 bp, mouse
gcccagctccgagacaacga

SEQ ID NO: 468496 - DNA, 20 bp, mouse
ggccggccgttgcctaggaa

SEQ ID NO: 468497 - DNA, 20 bp, mouse
gtgctcgtccggctgtgacg

SEQ ID NO: 468498 - DNA, 20 bp, mouse
ggccagtgccgggaagtcga

SEQ ID NO: 468499 - DNA, 20 bp, mouse
ggagacgacgcgcccttcct

SEQ ID NO: 468500 - DNA, 20 bp, mouse
gtccggctgtgacggggaag

SEQ ID NO: 468501 - DNA, 20 bp, mouse
gcacagtgaccaaaacgcag

SEQ ID NO: 468502 - DNA, 20 bp, mouse
gagctctcgagagtccctcg

SEQ ID NO: 468503 - DNA, 20 bp, mouse
gacgcgcccttcctaggcaa

SEQ ID NO: 468504 - DNA, 20 bp, mouse
gctcggggatcccccaaact

SEQ ID NO: 468505 - DNA, 20 bp, mouse
gtgcaggggctactccccgg

SEQ ID NO: 468506 - DNA, 20 bp, mouse
gctcagaccggcagacggga

SEQ ID NO: 468507 - DNA, 20 bp, mouse
gcgggagggaggaacaacgg

SEQ ID NO: 468508 - DNA, 20 bp, mouse
gccgagcgggtgagttccgt

SEQ ID NO: 468509 - DNA, 20 bp, mouse
gtggggccgagcgtccagac

SEQ ID NO: 468510 - DNA, 20 bp, mouse
gaggcacggagcgaccgacg

SEQ ID NO: 468511 - DNA, 20 bp, mouse
ggtctgaggtgacagacctg

SEQ ID NO: 468512 - DNA, 20 bp, mouse
ggaggaacaacggaggattg

SEQ ID NO: 468513 - DNA, 20 bp, mouse
gccagccgcggcgcccacgg

SEQ ID NO: 468514 - DNA, 20 bp, mouse
gtcgatcccacagaccggaa

SEQ ID NO: 468515 - DNA, 20 bp, mouse
gcaggagagccacacaacga

SEQ ID NO: 468516 - DNA, 20 bp, mouse
gcgggaagcgtgctcaggag

SEQ ID NO: 468517 - DNA, 20 bp, mouse
ggaagaccgtgcgggaggtc

SEQ ID NO: 468518 - DNA, 20 bp, mouse
ggggaggctctcgcaagcac

SEQ ID NO: 468519 - DNA, 20 bp, mouse
ggaactgcggtgactccgac

SEQ ID NO: 468520 - DNA, 20 bp, mouse
gtgccgagcgtgggcacggg

SEQ ID NO: 468521 - DNA, 20 bp, mouse
ggagaatgcagcccgaggag

SEQ ID NO: 468522 - DNA, 20 bp, mouse
ggaggtcgggaagcgtgctc

SEQ ID NO: 468523 - DNA, 20 bp, mouse
gagcagagccccggtcccgg

SEQ ID NO: 468524 - DNA, 20 bp, mouse
gcaaggggcagtcctagggt

SEQ ID NO: 468525 - DNA, 20 bp, mouse
gcctagggagaagcctgcca

SEQ ID NO: 468526 - DNA, 20 bp, mouse
gcccggggcgcaggaagacg

SEQ ID NO: 468527 - DNA, 20 bp, mouse
gatgaagcggcggaagcccg

SEQ ID NO: 468528 - DNA, 20 bp, mouse
gggggcgcaggaagacgcgg

SEQ ID NO: 468529 - DNA, 20 bp, mouse
ggtagaggcgagggcccgac

SEQ ID NO: 468530 - DNA, 20 bp, mouse
gtgggcctgcgactccgtag

SEQ ID NO: 468531 - DNA, 20 bp, mouse
gagacgcggaggcggcggtg

SEQ ID NO: 468532 - DNA, 20 bp, mouse
gaggctgcagcggcgagaaa

SEQ ID NO: 468533 - DNA, 20 bp, mouse
gcgcttggggaacttgacac

SEQ ID NO: 468534 - DNA, 20 bp, mouse
gcggtggggcgcgagcaggg

SEQ ID NO: 468535 - DNA, 20 bp, mouse
ggtgtccgaggcccggagag

SEQ ID NO: 468536 - DNA, 20 bp, mouse
gctgtcaacagcggtgtgga

SEQ ID NO: 468537 - DNA, 20 bp, mouse
gggaactcacctgtcaacag

SEQ ID NO: 468538 - DNA, 20 bp, mouse
gtcacctgtcaacagcggtg

SEQ ID NO: 468539 - DNA, 20 bp, mouse
gactgggaggagggactact

SEQ ID NO: 468540 - DNA, 20 bp, mouse
gcagaaagaaatcaccgtaa

SEQ ID NO: 468541 - DNA, 20 bp, mouse
ggaggagggactactgggga

SEQ ID NO: 468542 - DNA, 20 bp, mouse
ggaacgatggatggataact

SEQ ID NO: 468543 - DNA, 20 bp, mouse
gaactctcaccccagcgcgt

SEQ ID NO: 468544 - DNA, 20 bp, mouse
ggaagggtccaagcaacacc

SEQ ID NO: 468545 - DNA, 20 bp, mouse
gttctctttccgggacaaga

SEQ ID NO: 468546 - DNA, 20 bp, mouse
ggccggcagcgtctggggac

SEQ ID NO: 468547 - DNA, 20 bp, mouse
gtccgaacggcaatgctggg

SEQ ID NO: 468548 - DNA, 20 bp, mouse
gtagtggccggcagcgtctg

SEQ ID NO: 468549 - DNA, 20 bp, mouse
gtctggggaccggcagagcg

SEQ ID NO: 468550 - DNA, 20 bp, mouse
gactcgggcccagagctgta

SEQ ID NO: 468551 - DNA, 20 bp, mouse
ggcttggggggaggctctag

SEQ ID NO: 468552 - DNA, 20 bp, mouse
ggccccccagcattgccgtt

SEQ ID NO: 468553 - DNA, 20 bp, mouse
gcgaggcggcctaggatctt

SEQ ID NO: 468554 - DNA, 20 bp, mouse
gagagctgtagggcaccggg

SEQ ID NO: 468555 - DNA, 20 bp, mouse
ggtgtcgcgctcgccgtcca

SEQ ID NO: 468556 - DNA, 20 bp, mouse
gcagcagcggcagggaacgg

SEQ ID NO: 468557 - DNA, 20 bp, mouse
ggccaggcccggacttccat

SEQ ID NO: 468558 - DNA, 20 bp, mouse
gcttccatgggcagcagcag

SEQ ID NO: 468559 - DNA, 20 bp, mouse
gctgctgcccatggaagtcc

SEQ ID NO: 468560 - DNA, 20 bp, mouse
ggaagagaaccggccaggcc

SEQ ID NO: 468561 - DNA, 20 bp, mouse
gcagggagcgagccactgtc

SEQ ID NO: 468562 - DNA, 20 bp, mouse
gaaacagaagagaaccggcc

SEQ ID NO: 468563 - DNA, 20 bp, mouse
gcaggacccgcttgtcacaa

SEQ ID NO: 468564 - DNA, 20 bp, mouse
ggggggttgcctgaccatag

SEQ ID NO: 468565 - DNA, 20 bp, mouse
gagtttctggatccggacag

SEQ ID NO: 468566 - DNA, 20 bp, mouse
gcagtggctgagacgtggcc

SEQ ID NO: 468567 - DNA, 20 bp, mouse
ggctgcggcgcgaagtcgag

SEQ ID NO: 468568 - DNA, 20 bp, mouse
ggcggcgcgaagtcgagagg

SEQ ID NO: 468569 - DNA, 20 bp, mouse
gtgcgcggcggggatctcgg

SEQ ID NO: 468570 - DNA, 20 bp, mouse
gagtgctccgaggctccgag

SEQ ID NO: 468571 - DNA, 20 bp, mouse
ggcgcgaagtcgagaggcgg

SEQ ID NO: 468572 - DNA, 20 bp, mouse
gaatgggcgatgtctgcaca

SEQ ID NO: 468573 - DNA, 20 bp, mouse
gcgcgcggccgaagtcgggg

SEQ ID NO: 468574 - DNA, 20 bp, mouse
gacggccgaagtgaccgtgg

SEQ ID NO: 468575 - DNA, 20 bp, mouse
ggacatcgcccattgagcga

SEQ ID NO: 468576 - DNA, 20 bp, mouse
gcgaggtagcggtgattctg

SEQ ID NO: 468577 - DNA, 20 bp, mouse
ggccccgcggcccccagcca

SEQ ID NO: 468578 - DNA, 20 bp, mouse
gccgcggcccccagccatgg

SEQ ID NO: 468579 - DNA, 20 bp, mouse
gagcggcctaggcgaggtag

SEQ ID NO: 468580 - DNA, 20 bp, mouse
gaatcaccgctacctcgcct

SEQ ID NO: 468581 - DNA, 20 bp, mouse
ggccagacgcctccagtctg

SEQ ID NO: 468582 - DNA, 20 bp, mouse
gtcagcccggccgcgtccag

SEQ ID NO: 468583 - DNA, 20 bp, mouse
ggtagcggtgattctggggt

SEQ ID NO: 468584 - DNA, 20 bp, mouse
gcggatgcgcgcggacgggt

SEQ ID NO: 468585 - DNA, 20 bp, mouse
gagtggtcgccccagactgg

SEQ ID NO: 468586 - DNA, 20 bp, mouse
gaagtcgctcgaggaagcca

SEQ ID NO: 468587 - DNA, 20 bp, mouse
gaggaagccatggaggacgg

SEQ ID NO: 468588 - DNA, 20 bp, mouse
gccttgcgggaagtcgctcg

SEQ ID NO: 468589 - DNA, 20 bp, mouse
gtcgaggaagccatggagga

SEQ ID NO: 468590 - DNA, 20 bp, mouse
gggtgagtgtgtcaacagag

SEQ ID NO: 468591 - DNA, 20 bp, mouse
gagaagggcgacgcgctgtc

SEQ ID NO: 468592 - DNA, 20 bp, mouse
gcacaaggcataaaattcag

SEQ ID NO: 468593 - DNA, 20 bp, mouse
gcggtccgcggcctccgcac

SEQ ID NO: 468594 - DNA, 20 bp, mouse
gacagagcggcggggacaca

SEQ ID NO: 468595 - DNA, 20 bp, mouse
ggtgtgtcaacagagcggcg

SEQ ID NO: 468596 - DNA, 20 bp, mouse
ggtgagtcccgggacggtgt

SEQ ID NO: 468597 - DNA, 20 bp, mouse
ggcttctgtaagtgagtccc

SEQ ID NO: 468598 - DNA, 20 bp, mouse
ggcatttccaacaccgtccc

SEQ ID NO: 468599 - DNA, 20 bp, mouse
gctgctgcgccggcttatca

SEQ ID NO: 468600 - DNA, 20 bp, mouse
gaactccgagcccttcgccg

SEQ ID NO: 468601 - DNA, 20 bp, mouse
ggaggcttcaagctgatagg

SEQ ID NO: 468602 - DNA, 20 bp, mouse
ggaccaccactggaacaacg

SEQ ID NO: 468603 - DNA, 20 bp, mouse
ggggctcctggtgggaccaa

SEQ ID NO: 468604 - DNA, 20 bp, mouse
gaagagagaccgagtgaacg

SEQ ID NO: 468605 - DNA, 20 bp, mouse
gagatcatccgggaggagta

SEQ ID NO: 468606 - DNA, 20 bp, mouse
gagccgagcaggacccgagt

SEQ ID NO: 468607 - DNA, 20 bp, mouse
gtgtcagccagaggcggcgt

SEQ ID NO: 468608 - DNA, 20 bp, mouse
ggctagtgcggtgccaggcg

SEQ ID NO: 468609 - DNA, 20 bp, mouse
gtgcggcgtgcggatagctg

SEQ ID NO: 468610 - DNA, 20 bp, mouse
ggatagctgaggtaaagccg

SEQ ID NO: 468611 - DNA, 20 bp, mouse
gctcttggcttgtcagccag

SEQ ID NO: 468612 - DNA, 20 bp, mouse
gttggcttgtcagccagagg

SEQ ID NO: 468613 - DNA, 20 bp, mouse
gcctggcaccgcactagccc

SEQ ID NO: 468614 - DNA, 20 bp, mouse
gggacccgagtaggcagaca

SEQ ID NO: 468615 - DNA, 20 bp, mouse
gtgggagaggctgcggcgtg

SEQ ID NO: 468616 - DNA, 20 bp, mouse
gagcctaggacccacagtca

SEQ ID NO: 468617 - DNA, 20 bp, mouse
ggttcgcgaaggtgagtgaa

SEQ ID NO: 468618 - DNA, 20 bp, mouse
ggtagtgtgagtgacctcgg

SEQ ID NO: 468619 - DNA, 20 bp, mouse
gactccgcgggaggcatcag

SEQ ID NO: 468620 - DNA, 20 bp, mouse
gtggcggtggctgttcgcga

SEQ ID NO: 468621 - DNA, 20 bp, mouse
gacagtcatggctgcggtgg

SEQ ID NO: 468622 - DNA, 20 bp, mouse
gcactgcgcggcaggatcaa

SEQ ID NO: 468623 - DNA, 20 bp, mouse
gaagggctagatgcaccaag

SEQ ID NO: 468624 - DNA, 20 bp, mouse
ggcgacgtgcagaaacccgg

SEQ ID NO: 468625 - DNA, 20 bp, mouse
gttgccggctgttcccagaa

SEQ ID NO: 468626 - DNA, 20 bp, mouse
ggcgccaggcaccgccgcag

SEQ ID NO: 468627 - DNA, 20 bp, mouse
gtgctggctgcgaagcaaga

SEQ ID NO: 468628 - DNA, 20 bp, mouse
gaagatggcagccactgcgg

SEQ ID NO: 468629 - DNA, 20 bp, mouse
gagcaagatggcagccactg

SEQ ID NO: 468630 - DNA, 20 bp, mouse
ggccgagcgagcaaacgcgg

SEQ ID NO: 468631 - DNA, 20 bp, mouse
gccggccgagcgagcaaacg

SEQ ID NO: 468632 - DNA, 20 bp, mouse
gcgtccgccgggaagtcaca

SEQ ID NO: 468633 - DNA, 20 bp, mouse
ggtgccgtgtgacttcccgg

SEQ ID NO: 468634 - DNA, 20 bp, mouse
gagcagtctgccggcctcga

SEQ ID NO: 468635 - DNA, 20 bp, mouse
ggagcgagcaaacgcggcgg

SEQ ID NO: 468636 - DNA, 20 bp, mouse
gaggcagccatgctgagact

SEQ ID NO: 468637 - DNA, 20 bp, mouse
gcccggaccctcaaccctgg

SEQ ID NO: 468638 - DNA, 20 bp, mouse
ggctcccggaccctcaaccc

SEQ ID NO: 468639 - DNA, 20 bp, mouse
gcagttccgggccagcatca

SEQ ID NO: 468640 - DNA, 20 bp, mouse
gttggcgccgagtctcagca

SEQ ID NO: 468641 - DNA, 20 bp, mouse
gcaagggctcggacaggtga

SEQ ID NO: 468642 - DNA, 20 bp, mouse
gcaacaaaacgaaggagtgg

SEQ ID NO: 468643 - DNA, 20 bp, mouse
gctagggccgggttcctagc

SEQ ID NO: 468644 - DNA, 20 bp, mouse
gagaagagcacagacgccag

SEQ ID NO: 468645 - DNA, 20 bp, mouse
gggtcaacaaaacgaaggag

SEQ ID NO: 468646 - DNA, 20 bp, mouse
ggcgcctgcgcagtgagagg

SEQ ID NO: 468647 - DNA, 20 bp, mouse
gttgggcgaagcgcacgctg

SEQ ID NO: 468648 - DNA, 20 bp, mouse
gcgcaagaacgggaaagggg

SEQ ID NO: 468649 - DNA, 20 bp, mouse
gtccgcatgcgcgctgggtt

SEQ ID NO: 468650 - DNA, 20 bp, mouse
gtcggcgcctgcgcagtgag

SEQ ID NO: 468651 - DNA, 20 bp, mouse
gccactaagcagcacggcgt

SEQ ID NO: 468652 - DNA, 20 bp, mouse
ggccgcactggacaaaacca

SEQ ID NO: 468653 - DNA, 20 bp, mouse
gggagtgggactggagtcga

SEQ ID NO: 468654 - DNA, 20 bp, mouse
gcagacaccggctggcgaga

SEQ ID NO: 468655 - DNA, 20 bp, mouse
ggggcgcaggaaatcaccag

SEQ ID NO: 468656 - DNA, 20 bp, mouse
ggagttagggctaaggactg

SEQ ID NO: 468657 - DNA, 20 bp, mouse
gaacgtttgagaggagggcg

SEQ ID NO: 468658 - DNA, 20 bp, mouse
gtgtccggggacgaggtgag

SEQ ID NO: 468659 - DNA, 20 bp, mouse
gcaggcccggcttctcacac

SEQ ID NO: 468660 - DNA, 20 bp, mouse
gccgccctgaggagagccga

SEQ ID NO: 468661 - DNA, 20 bp, mouse
gcggcttctcacacaggtgt

SEQ ID NO: 468662 - DNA, 20 bp, mouse
gccgagggagaccaagtctg

SEQ ID NO: 468663 - DNA, 20 bp, mouse
gatggcggccggctacagct

SEQ ID NO: 468664 - DNA, 20 bp, mouse
gcgcacttccaacgtttgag

SEQ ID NO: 468665 - DNA, 20 bp, mouse
gtacagctaggccgcaggcc

SEQ ID NO: 468666 - DNA, 20 bp, mouse
ggatcctgtcgggaaagatg

SEQ ID NO: 468667 - DNA, 20 bp, mouse
ggtgagggtggagtgactct

SEQ ID NO: 468668 - DNA, 20 bp, mouse
gaagccagggcctaccaatg

SEQ ID NO: 468669 - DNA, 20 bp, mouse
gcaatgtggcgagatcctgt

SEQ ID NO: 468670 - DNA, 20 bp, mouse
gtgctcccgccgcaaagcca

SEQ ID NO: 468671 - DNA, 20 bp, mouse
ggggcctacggtatgtcagg

SEQ ID NO: 468672 - DNA, 20 bp, mouse
gtcctgggtggctggagcgt

SEQ ID NO: 468673 - DNA, 20 bp, mouse
gcatcttgctcggagagaaa

SEQ ID NO: 468674 - DNA, 20 bp, mouse
gcctctccggatggaactca

SEQ ID NO: 468675 - DNA, 20 bp, mouse
gacgcacgccttggacgcta

SEQ ID NO: 468676 - DNA, 20 bp, mouse
gagaagccggtgtcactctc

SEQ ID NO: 468677 - DNA, 20 bp, mouse
gggctgcccgagagtgacac

SEQ ID NO: 468678 - DNA, 20 bp, mouse
ggatcctgacgagaaagatg

SEQ ID NO: 468679 - DNA, 20 bp, mouse
gtcgtgagcaagatggcggg

SEQ ID NO: 468680 - DNA, 20 bp, mouse
gagatggcgggcggagaagc

SEQ ID NO: 468681 - DNA, 20 bp, mouse
gccttctttcgtgagcaaga

SEQ ID NO: 468682 - DNA, 20 bp, mouse
gcgtcaggatcttgccactt

SEQ ID NO: 468683 - DNA, 20 bp, mouse
gagctctcggttccagggtt

SEQ ID NO: 468684 - DNA, 20 bp, mouse
gagctcgcggacttcgacga

SEQ ID NO: 468685 - DNA, 20 bp, mouse
gcagccgcatctttctcgtc

SEQ ID NO: 468686 - DNA, 20 bp, mouse
gtggcctggaccgggagaga

SEQ ID NO: 468687 - DNA, 20 bp, mouse
ggcgtcagcgaactccctag

SEQ ID NO: 468688 - DNA, 20 bp, mouse
ggcgcccagccggccagaga

SEQ ID NO: 468689 - DNA, 20 bp, mouse
ggaccgggagagaaggcgga

SEQ ID NO: 468690 - DNA, 20 bp, mouse
gctgcgacgcaagcctcggg

SEQ ID NO: 468691 - DNA, 20 bp, mouse
gcgcagacgcggcccggtgg

SEQ ID NO: 468692 - DNA, 20 bp, mouse
gccgccgcgagggaatcacg

SEQ ID NO: 468693 - DNA, 20 bp, mouse
gactccctagtggcctggac

SEQ ID NO: 468694 - DNA, 20 bp, mouse
gagcgcgccaacggtgagta

SEQ ID NO: 468695 - DNA, 20 bp, mouse
gcatctgctggcgaggcgcg

SEQ ID NO: 468696 - DNA, 20 bp, mouse
gcaggacgctgagaacgtgg

SEQ ID NO: 468697 - DNA, 20 bp, mouse
gaacgtggcggtgcccgagg

SEQ ID NO: 468698 - DNA, 20 bp, mouse
ggcggcgcgcggtgacttct

SEQ ID NO: 468699 - DNA, 20 bp, mouse
gaagcagcgcgggcccatgc

SEQ ID NO: 468700 - DNA, 20 bp, mouse
gccggcggcccaatccgaag

SEQ ID NO: 468701 - DNA, 20 bp, mouse
ggtctggggggtccgaagtg

SEQ ID NO: 468702 - DNA, 20 bp, mouse
gatgcaggacgctgagaacg

SEQ ID NO: 468703 - DNA, 20 bp, mouse
ggccgggtgagaagcagcgc

SEQ ID NO: 468704 - DNA, 20 bp, mouse
ggagccctctgctcccggga

SEQ ID NO: 468705 - DNA, 20 bp, mouse
gacgtgagcgaggaaggtaa

SEQ ID NO: 468706 - DNA, 20 bp, mouse
gtcacctgctcagagggact

SEQ ID NO: 468707 - DNA, 20 bp, mouse
gtgctccgtggagggcaagg

SEQ ID NO: 468708 - DNA, 20 bp, mouse
gtagctggttcgtgtctctt

SEQ ID NO: 468709 - DNA, 20 bp, mouse
gccctctgagcaggtgagac

SEQ ID NO: 468710 - DNA, 20 bp, mouse
gacatggcgacggcgctgaa

SEQ ID NO: 468711 - DNA, 20 bp, mouse
gggtgagacaggcacgacgc

SEQ ID NO: 468712 - DNA, 20 bp, mouse
ggggcctcgtgctccgtgga

SEQ ID NO: 468713 - DNA, 20 bp, mouse
gtagttcccggagaccggtt

SEQ ID NO: 468714 - DNA, 20 bp, mouse
gaccggctcggacagtgagt

SEQ ID NO: 468715 - DNA, 20 bp, mouse
gacgagctcctccccggaca

SEQ ID NO: 468716 - DNA, 20 bp, mouse
ggggatactccgaggagtca

SEQ ID NO: 468717 - DNA, 20 bp, mouse
gcgattgccgggatactccg

SEQ ID NO: 468718 - DNA, 20 bp, mouse
gccgaggagtcaaggcagga

SEQ ID NO: 468719 - DNA, 20 bp, mouse
gcacaggcgacaggacgtaa

SEQ ID NO: 468720 - DNA, 20 bp, mouse
gaagccttcacgggcccgga

SEQ ID NO: 468721 - DNA, 20 bp, mouse
gcccgccccgcccagcggag

SEQ ID NO: 468722 - DNA, 20 bp, mouse
gagccagcctgggctagacg

SEQ ID NO: 468723 - DNA, 20 bp, mouse
gtcgccatccgggcccgtga

SEQ ID NO: 468724 - DNA, 20 bp, mouse
gggcgacgtagcctcctcta

SEQ ID NO: 468725 - DNA, 20 bp, mouse
gctgttcgaacccctagagg

SEQ ID NO: 468726 - DNA, 20 bp, mouse
ggcccagcccgtgtctgtca

SEQ ID NO: 468727 - DNA, 20 bp, mouse
gtactccgccatcttgccgg

SEQ ID NO: 468728 - DNA, 20 bp, mouse
ggacggcgtagggacgagag

SEQ ID NO: 468729 - DNA, 20 bp, mouse
gaacaagcgctcctttcccc

SEQ ID NO: 468730 - DNA, 20 bp, mouse
gctgtcagggcggcccaagc

SEQ ID NO: 468731 - DNA, 20 bp, mouse
gctcctttcccccggcaaga

SEQ ID NO: 468732 - DNA, 20 bp, mouse
gctcggctgtgcgtccggag

SEQ ID NO: 468733 - DNA, 20 bp, mouse
gcagcccgtgtctgtcaggg

SEQ ID NO: 468734 - DNA, 20 bp, mouse
gtctctctgtgaaagaggtg

SEQ ID NO: 468735 - DNA, 20 bp, mouse
gacacgtgcgagccggaagc

SEQ ID NO: 468736 - DNA, 20 bp, mouse
gggagggacattagccggta

SEQ ID NO: 468737 - DNA, 20 bp, mouse
gtggcaggagggacattagc

SEQ ID NO: 468738 - DNA, 20 bp, mouse
gccggggctgcggtgacgac

SEQ ID NO: 468739 - DNA, 20 bp, mouse
ggcggtgacgaccggcgccg

SEQ ID NO: 468740 - DNA, 20 bp, mouse
gtcaggggcgatggaacgag

SEQ ID NO: 468741 - DNA, 20 bp, mouse
gatggcttctccggccgtac

SEQ ID NO: 468742 - DNA, 20 bp, mouse
gggacattagccggtacggc

SEQ ID NO: 468743 - DNA, 20 bp, mouse
gaaacaggctaagagttcag

SEQ ID NO: 468744 - DNA, 20 bp, mouse
gcagcaggatcagacgagac

SEQ ID NO: 468745 - DNA, 20 bp, mouse
gcgggaaggcaagccacagt

SEQ ID NO: 468746 - DNA, 20 bp, mouse
gtcccagcccgggtaaagac

SEQ ID NO: 468747 - DNA, 20 bp, mouse
gcggcttcctgtctttaccc

SEQ ID NO: 468748 - DNA, 20 bp, mouse
gcatactcaaagtcgccagt

SEQ ID NO: 468749 - DNA, 20 bp, mouse
gcaggaagccggagtagaag

SEQ ID NO: 468750 - DNA, 20 bp, mouse
gaagacttcgagatgccgac

SEQ ID NO: 468751 - DNA, 20 bp, mouse
gtgggccgaccaggtggagg

SEQ ID NO: 468752 - DNA, 20 bp, mouse
gaagcccagctgggccgacc

SEQ ID NO: 468753 - DNA, 20 bp, mouse
ggagcgtgggccccgggaac

SEQ ID NO: 468754 - DNA, 20 bp, mouse
gtgccagagggaattcgggg

SEQ ID NO: 468755 - DNA, 20 bp, mouse
gccggaagcctcttctactc

SEQ ID NO: 468756 - DNA, 20 bp, mouse
ggcgccgccagcagaaccgg

SEQ ID NO: 468757 - DNA, 20 bp, mouse
gccgccagcagaaccggagg

SEQ ID NO: 468758 - DNA, 20 bp, mouse
ggctctaccgccacctcctc

SEQ ID NO: 468759 - DNA, 20 bp, mouse
gttctgctggcggcgcggtg

SEQ ID NO: 468760 - DNA, 20 bp, mouse
ggtcagcccgcgcctgggga

SEQ ID NO: 468761 - DNA, 20 bp, mouse
ggaaggagaagggcgccgag

SEQ ID NO: 468762 - DNA, 20 bp, mouse
gtgcttcacggccgaatctc

SEQ ID NO: 468763 - DNA, 20 bp, mouse
gcgccggaagcggaactacg

SEQ ID NO: 468764 - DNA, 20 bp, mouse
ggctctagggagaggagtga

SEQ ID NO: 468765 - DNA, 20 bp, mouse
gtctcgtcggaaaacaggga

SEQ ID NO: 468766 - DNA, 20 bp, mouse
ggcctactgaggccccccga

SEQ ID NO: 468767 - DNA, 20 bp, mouse
gtgggaccggaaaaagacta

SEQ ID NO: 468768 - DNA, 20 bp, mouse
gggatggtgagttccaggcg

SEQ ID NO: 468769 - DNA, 20 bp, mouse
gggagagaggcaatgtgagt

SEQ ID NO: 468770 - DNA, 20 bp, mouse
gcctcgcgtcaccgccagga

SEQ ID NO: 468771 - DNA, 20 bp, mouse
gggcggtgacgcgaggagag

SEQ ID NO: 468772 - DNA, 20 bp, mouse
ggccgtcggggggcctcagt

SEQ ID NO: 468773 - DNA, 20 bp, mouse
gggggggcctcagtaggcat

SEQ ID NO: 468774 - DNA, 20 bp, mouse
gcctcagtaggcatgggacg

SEQ ID NO: 468775 - DNA, 20 bp, mouse
gcctgtgagcgactgcgtga

SEQ ID NO: 468776 - DNA, 20 bp, mouse
gaggccagagagccgaccct

SEQ ID NO: 468777 - DNA, 20 bp, mouse
gctcggctggacggccatgt

SEQ ID NO: 468778 - DNA, 20 bp, mouse
gaggacgaggacgtgaaggt

SEQ ID NO: 468779 - DNA, 20 bp, mouse
ggagaacgtgtccgcgtcta

SEQ ID NO: 468780 - DNA, 20 bp, mouse
gggagccaggctacgcccgt

SEQ ID NO: 468781 - DNA, 20 bp, mouse
ggtccagccgagggaacctc

SEQ ID NO: 468782 - DNA, 20 bp, mouse
gcgggggactcagactcttg

SEQ ID NO: 468783 - DNA, 20 bp, mouse
ggaagctcacgcgggaccca

SEQ ID NO: 468784 - DNA, 20 bp, mouse
gcacggcccgcaggcccggg

SEQ ID NO: 468785 - DNA, 20 bp, mouse
gagagccgaccctcggtgaa

SEQ ID NO: 468786 - DNA, 20 bp, mouse
ggaggacgtgaaggataact

SEQ ID NO: 468787 - DNA, 20 bp, mouse
ggactcagactcttgggacg

SEQ ID NO: 468788 - DNA, 20 bp, mouse
gagaacggcagcagaagaaa

SEQ ID NO: 468789 - DNA, 20 bp, mouse
ggatgatgatgaaaataaag

SEQ ID NO: 468790 - DNA, 20 bp, mouse
ggcaattagcagataaactc

SEQ ID NO: 468791 - DNA, 20 bp, mouse
gctccggctaaagaaattac

SEQ ID NO: 468792 - DNA, 20 bp, mouse
ggcaagaagaaattaaaaag

SEQ ID NO: 468793 - DNA, 20 bp, mouse
gaattagcaaaagaaacttt

SEQ ID NO: 468794 - DNA, 20 bp, mouse
gttagtactttagattcttc

SEQ ID NO: 468795 - DNA, 20 bp, mouse
gagtttcttttgctaattca

SEQ ID NO: 468796 - DNA, 20 bp, mouse
gtggagtcgaacaccaggca

SEQ ID NO: 468797 - DNA, 20 bp, mouse
gtggtgttcgactccagctg

SEQ ID NO: 468798 - DNA, 20 bp, mouse
gctccagctgaggctgccga

SEQ ID NO: 468799 - DNA, 20 bp, mouse
gagcagatgagagcgaacgt

SEQ ID NO: 468800 - DNA, 20 bp, mouse
ggccagagagcgcccttcag

SEQ ID NO: 468801 - DNA, 20 bp, mouse
gggaagagaggtgtaggaag

SEQ ID NO: 468802 - DNA, 20 bp, mouse
gaagcggggtggagaagacg

SEQ ID NO: 468803 - DNA, 20 bp, mouse
gtgagggacggagagaaact

SEQ ID NO: 468804 - DNA, 20 bp, mouse
ggaagacggggagccagcca

SEQ ID NO: 468805 - DNA, 20 bp, mouse
gctgctggaaggaaatcacg

SEQ ID NO: 468806 - DNA, 20 bp, mouse
gtcatcagcggggtaagaca

SEQ ID NO: 468807 - DNA, 20 bp, mouse
ggcggggtaagacatggcta

SEQ ID NO: 468808 - DNA, 20 bp, mouse
gtcagactcgtagtcatcag

SEQ ID NO: 468809 - DNA, 20 bp, mouse
gcgagtctgaggtaatgaag

SEQ ID NO: 468810 - DNA, 20 bp, mouse
gcggcgctccagaagcccgt

SEQ ID NO: 468811 - DNA, 20 bp, mouse
gtgtagtcgcagtcagtcgg

SEQ ID NO: 468812 - DNA, 20 bp, mouse
gttcttccgctctctcccac

SEQ ID NO: 468813 - DNA, 20 bp, mouse
ggactacacgcggggacata

SEQ ID NO: 468814 - DNA, 20 bp, mouse
gggccggcagaggagggacc

SEQ ID NO: 468815 - DNA, 20 bp, mouse
gacatacggccggcagagga

SEQ ID NO: 468816 - DNA, 20 bp, mouse
gggttgtgcgtaaccctgta

SEQ ID NO: 468817 - DNA, 20 bp, mouse
gccgcggccacaggcgacgg

SEQ ID NO: 468818 - DNA, 20 bp, mouse
gccgggacggagcccgtgag

SEQ ID NO: 468819 - DNA, 20 bp, mouse
gtctgtggctgacccggaag

SEQ ID NO: 468820 - DNA, 20 bp, mouse
gtcctcgctgatatcgatga

SEQ ID NO: 468821 - DNA, 20 bp, mouse
ggcgtgcgcggccgagggtc

SEQ ID NO: 468822 - DNA, 20 bp, mouse
gagagcgcgctccccctcac

SEQ ID NO: 468823 - DNA, 20 bp, mouse
gcgctgatatcgatgaaggc

SEQ ID NO: 468824 - DNA, 20 bp, mouse
ggggtcgtcatcgacgactg

SEQ ID NO: 468825 - DNA, 20 bp, mouse
gcgcgcacgcgccgagaccc

SEQ ID NO: 468826 - DNA, 20 bp, mouse
gcactccgccctagattcta

SEQ ID NO: 468827 - DNA, 20 bp, mouse
gccctttggagggaactacg

SEQ ID NO: 468828 - DNA, 20 bp, mouse
ggtctgcgagtcaggattct

SEQ ID NO: 468829 - DNA, 20 bp, mouse
gtcaggattctcggtaagaa

SEQ ID NO: 468830 - DNA, 20 bp, mouse
gccacggcgggccctttgga

SEQ ID NO: 468831 - DNA, 20 bp, mouse
gcgccctgcccgacacaggg

SEQ ID NO: 468832 - DNA, 20 bp, mouse
gtgatccttagaatctaggg

SEQ ID NO: 468833 - DNA, 20 bp, mouse
gtgaggtcgcgacataacgt

SEQ ID NO: 468834 - DNA, 20 bp, mouse
ggggaaggacgacctggcta

SEQ ID NO: 468835 - DNA, 20 bp, mouse
gaccacactggggtcagcgg

SEQ ID NO: 468836 - DNA, 20 bp, mouse
gccgcggattacaacaggta

SEQ ID NO: 468837 - DNA, 20 bp, mouse
gagggccgcggaaaccccgt

SEQ ID NO: 468838 - DNA, 20 bp, mouse
ggcccgactgaaaagacagg

SEQ ID NO: 468839 - DNA, 20 bp, mouse
gaacaggtacggcgctcccg

SEQ ID NO: 468840 - DNA, 20 bp, mouse
gatcatgtctggtggctccg

SEQ ID NO: 468841 - DNA, 20 bp, mouse
gtggctccgcggattacaac

SEQ ID NO: 468842 - DNA, 20 bp, mouse
ggacaggacggatacaagaa

SEQ ID NO: 468843 - DNA, 20 bp, mouse
gagcgcccgactgaaaagac

SEQ ID NO: 468844 - DNA, 20 bp, mouse
gaggtacggcgctcccgggg

SEQ ID NO: 468845 - DNA, 20 bp, mouse
gcacaatgtgtcctaagaaa

SEQ ID NO: 468846 - DNA, 20 bp, mouse
gtgcggaatccggatcatgg

SEQ ID NO: 468847 - DNA, 20 bp, mouse
ggcttgcagttgtctttctg

SEQ ID NO: 468848 - DNA, 20 bp, mouse
gggcatctacgcctacggtg

SEQ ID NO: 468849 - DNA, 20 bp, mouse
gttctgcggaatccggatca

SEQ ID NO: 468850 - DNA, 20 bp, mouse
gggcgttagccgccatgatc

SEQ ID NO: 468851 - DNA, 20 bp, mouse
gacgccacgatggcgacgtc

SEQ ID NO: 468852 - DNA, 20 bp, mouse
ggcaggccggagctctgggg

SEQ ID NO: 468853 - DNA, 20 bp, mouse
ggaggcccgcgccccaccgt

SEQ ID NO: 468854 - DNA, 20 bp, mouse
ggccgggccccggtaggacg

SEQ ID NO: 468855 - DNA, 20 bp, mouse
ggcggcgggaaccggatgta

SEQ ID NO: 468856 - DNA, 20 bp, mouse
gcacctgaggccgccatgtt

SEQ ID NO: 468857 - DNA, 20 bp, mouse
gccgagcgtggccaaagacc

SEQ ID NO: 468858 - DNA, 20 bp, mouse
gcgttgcgcgaggttggagt

SEQ ID NO: 468859 - DNA, 20 bp, mouse
gccgcctcgggatgtctagg

SEQ ID NO: 468860 - DNA, 20 bp, mouse
gaacgcaaaggacccggatg

SEQ ID NO: 468861 - DNA, 20 bp, mouse
gggaggcgcgaggctctcaa

SEQ ID NO: 468862 - DNA, 20 bp, mouse
gcccgacctccagcaaggag

SEQ ID NO: 468863 - DNA, 20 bp, mouse
gaggagcggaccaagcccgg

SEQ ID NO: 468864 - DNA, 20 bp, mouse
gccgttgcggaccctcgtgg

SEQ ID NO: 468865 - DNA, 20 bp, mouse
gcgagcgcgaggctgtggag

SEQ ID NO: 468866 - DNA, 20 bp, mouse
ggggagctggtccttaagga

SEQ ID NO: 468867 - DNA, 20 bp, mouse
gcagccagggaagccactcg

SEQ ID NO: 468868 - DNA, 20 bp, mouse
gacctcacaagggtgtgctg

SEQ ID NO: 468869 - DNA, 20 bp, mouse
gcggagggagctggtcctta

SEQ ID NO: 468870 - DNA, 20 bp, mouse
gtaatacacttacctcacaa

SEQ ID NO: 468871 - DNA, 20 bp, mouse
gtacgtccaggtgccagcca

SEQ ID NO: 468872 - DNA, 20 bp, mouse
gcaagcgcgtgccttcctta

SEQ ID NO: 468873 - DNA, 20 bp, mouse
gcgagtgagagggtaccgtg

SEQ ID NO: 468874 - DNA, 20 bp, mouse
gattgctaaaacagcagcgg

SEQ ID NO: 468875 - DNA, 20 bp, mouse
gaaacagcagcggaggcgga

SEQ ID NO: 468876 - DNA, 20 bp, mouse
ggctctgggaaaggcggatg

SEQ ID NO: 468877 - DNA, 20 bp, mouse
gctcagaagtggccatgaca

SEQ ID NO: 468878 - DNA, 20 bp, mouse
gggctccaccagcaactaag

SEQ ID NO: 468879 - DNA, 20 bp, mouse
gggagccttgagccttgtca

SEQ ID NO: 468880 - DNA, 20 bp, mouse
gtactcagttgctctgggaa

SEQ ID NO: 468881 - DNA, 20 bp, mouse
ggtggccatgacaaggctca

SEQ ID NO: 468882 - DNA, 20 bp, mouse
gtagctggggtgaaaaaagc

SEQ ID NO: 468883 - DNA, 20 bp, mouse
gtgagcctcttagttgctgg

SEQ ID NO: 468884 - DNA, 20 bp, mouse
gccagctactcagttgctct

SEQ ID NO: 468885 - DNA, 20 bp, mouse
gctgtgagcctcttagttgc

SEQ ID NO: 468886 - DNA, 20 bp, mouse
ggaggcagtggcgacagcgg

SEQ ID NO: 468887 - DNA, 20 bp, mouse
ggagcggaagtcactccgtg

SEQ ID NO: 468888 - DNA, 20 bp, mouse
gaagtcactccgtgaggcag

SEQ ID NO: 468889 - DNA, 20 bp, mouse
ggcgatgggacccggtagag

SEQ ID NO: 468890 - DNA, 20 bp, mouse
gacgccgagcgagtgcggga

SEQ ID NO: 468891 - DNA, 20 bp, mouse
gcggcagcccgcacccacca

SEQ ID NO: 468892 - DNA, 20 bp, mouse
gatcgaggctcggaagggag

SEQ ID NO: 468893 - DNA, 20 bp, mouse
gtggcgacagcggcggcaag

SEQ ID NO: 468894 - DNA, 20 bp, mouse
ggaagccgcgttcagagaga

SEQ ID NO: 468895 - DNA, 20 bp, mouse
gcagctgcgatgaggtaatg

SEQ ID NO: 468896 - DNA, 20 bp, mouse
ggcctggccggcggagaaca

SEQ ID NO: 468897 - DNA, 20 bp, mouse
gctggcgccgggagactact

SEQ ID NO: 468898 - DNA, 20 bp, mouse
gagaggctcgttagccccgg

SEQ ID NO: 468899 - DNA, 20 bp, mouse
ggctaacgagcctctcgaca

SEQ ID NO: 468900 - DNA, 20 bp, mouse
gcccggctgccgcacccccc

SEQ ID NO: 468901 - DNA, 20 bp, mouse
gtgtccagccagaaggtcca

SEQ ID NO: 468902 - DNA, 20 bp, mouse
ggagaacatggcgctgcccc

SEQ ID NO: 468903 - DNA, 20 bp, mouse
ggctccggtccgcttgtccg

SEQ ID NO: 468904 - DNA, 20 bp, mouse
gaggccgcggacaagcggac

SEQ ID NO: 468905 - DNA, 20 bp, mouse
ggggagactactaggcgctc

SEQ ID NO: 468906 - DNA, 20 bp, mouse
gactacagcaccactccggg

SEQ ID NO: 468907 - DNA, 20 bp, mouse
ggctgggccgaggtgccgcg

SEQ ID NO: 468908 - DNA, 20 bp, mouse
ggccatcgccgagggctacg

SEQ ID NO: 468909 - DNA, 20 bp, mouse
gggccagcgcctacctcccg

SEQ ID NO: 468910 - DNA, 20 bp, mouse
ggtgccctgagcatacagat

SEQ ID NO: 468911 - DNA, 20 bp, mouse
gaagagcgtgccgcccggag

SEQ ID NO: 468912 - DNA, 20 bp, mouse
gcagcaccaccccgggaggt

SEQ ID NO: 468913 - DNA, 20 bp, mouse
ggagggctacgcggcgagtg

SEQ ID NO: 468914 - DNA, 20 bp, mouse
gaggcgctggccggggtcac

SEQ ID NO: 468915 - DNA, 20 bp, mouse
ggggcgtcgggaaagcagaa

SEQ ID NO: 468916 - DNA, 20 bp, mouse
gcagcggcaacgatgactac

SEQ ID NO: 468917 - DNA, 20 bp, mouse
gcggaggccggaggaccggg

SEQ ID NO: 468918 - DNA, 20 bp, mouse
gctgggctggtggctaccac

SEQ ID NO: 468919 - DNA, 20 bp, mouse
ggcccgtaggacagctccag

SEQ ID NO: 468920 - DNA, 20 bp, mouse
gcaacgatgactaccggaag

SEQ ID NO: 468921 - DNA, 20 bp, mouse
gtcgaggctttgtgcagcag

SEQ ID NO: 468922 - DNA, 20 bp, mouse
gcggtcgaaggcgggagcaa

SEQ ID NO: 468923 - DNA, 20 bp, mouse
gccgccgccgcccggtcctc

SEQ ID NO: 468924 - DNA, 20 bp, mouse
ggactaccggaagcggtcga

SEQ ID NO: 468925 - DNA, 20 bp, mouse
gcaggcggaggccggaggac

SEQ ID NO: 468926 - DNA, 20 bp, mouse
gcgaggacatagcagcagga

SEQ ID NO: 468927 - DNA, 20 bp, mouse
gcctggaattgggcaactcg

SEQ ID NO: 468928 - DNA, 20 bp, mouse
ggtcccggcaccctggaatt

SEQ ID NO: 468929 - DNA, 20 bp, mouse
gtgctctgtgggccagtatg

SEQ ID NO: 468930 - DNA, 20 bp, mouse
gggtgaggtggggtcgacct

SEQ ID NO: 468931 - DNA, 20 bp, mouse
gtggacgaggacatagcagc

SEQ ID NO: 468932 - DNA, 20 bp, mouse
ggccgtctggcagctggtcc

SEQ ID NO: 468933 - DNA, 20 bp, mouse
gggccagtatgagggtgagg

SEQ ID NO: 468934 - DNA, 20 bp, mouse
gattgggcaactcgtggacg

SEQ ID NO: 468935 - DNA, 20 bp, mouse
ggcgtggtgctgtagccgtc

SEQ ID NO: 468936 - DNA, 20 bp, mouse
gagcgacgccgggcctggag

SEQ ID NO: 468937 - DNA, 20 bp, mouse
gggcgctcccagcaagggta

SEQ ID NO: 468938 - DNA, 20 bp, mouse
ggaggcgcagggccgcccgg

SEQ ID NO: 468939 - DNA, 20 bp, mouse
gagggaccaagtccacaggt

SEQ ID NO: 468940 - DNA, 20 bp, mouse
ggagcagggaccaagtccac

SEQ ID NO: 468941 - DNA, 20 bp, mouse
ggagcgggcgcggggggacg

SEQ ID NO: 468942 - DNA, 20 bp, mouse
ggcgcagggccgcccggcgg

SEQ ID NO: 468943 - DNA, 20 bp, mouse
gagaggctcctccggaagaa

SEQ ID NO: 468944 - DNA, 20 bp, mouse
gctctcgctcgggtaataag

SEQ ID NO: 468945 - DNA, 20 bp, mouse
ggaggagagccagcccgagc

SEQ ID NO: 468946 - DNA, 20 bp, mouse
gccgccgagcgggatctgtg

SEQ ID NO: 468947 - DNA, 20 bp, mouse
ggggtcgggcccggacatgg

SEQ ID NO: 468948 - DNA, 20 bp, mouse
gccctctgcgccggtcacgt

SEQ ID NO: 468949 - DNA, 20 bp, mouse
gggcccggcccggcacacgt

SEQ ID NO: 468950 - DNA, 20 bp, mouse
gggctgcgcctgcggagaag

SEQ ID NO: 468951 - DNA, 20 bp, mouse
gtgcgcctgcggagaagcgg

SEQ ID NO: 468952 - DNA, 20 bp, mouse
gtcggatgcccagaacctgt

SEQ ID NO: 468953 - DNA, 20 bp, mouse
gcgcgttgcgcagagctggg

SEQ ID NO: 468954 - DNA, 20 bp, mouse
gctgtgcggggagccggaaa

SEQ ID NO: 468955 - DNA, 20 bp, mouse
gagaagcggtggccgccgag

SEQ ID NO: 468956 - DNA, 20 bp, mouse
ggcgagccggagctctatgg

SEQ ID NO: 468957 - DNA, 20 bp, mouse
gagccggagctctatggagg

SEQ ID NO: 468958 - DNA, 20 bp, mouse
gggcggcgggtaccaggtgg

SEQ ID NO: 468959 - DNA, 20 bp, mouse
gcgacgaccggatccagagg

SEQ ID NO: 468960 - DNA, 20 bp, mouse
gcgccacctccatagagctc

SEQ ID NO: 468961 - DNA, 20 bp, mouse
gccagaggaggcagctgcgg

SEQ ID NO: 468962 - DNA, 20 bp, mouse
gccccgacgaccggatccag

SEQ ID NO: 468963 - DNA, 20 bp, mouse
gcgcctcagagtgataagtt

SEQ ID NO: 468964 - DNA, 20 bp, mouse
ggggcggcggccatcttaga

SEQ ID NO: 468965 - DNA, 20 bp, mouse
gcttagagggctccgctcgg

SEQ ID NO: 468966 - DNA, 20 bp, mouse
ggcaatcgcactctccactt

SEQ ID NO: 468967 - DNA, 20 bp, mouse
gagagtgcgattgcagaagg

SEQ ID NO: 468968 - DNA, 20 bp, mouse
gttcaaaagaataatattaa

SEQ ID NO: 468969 - DNA, 20 bp, mouse
gatcgcactctccactttgg

SEQ ID NO: 468970 - DNA, 20 bp, mouse
gcgttgtcaagccgccaaag

SEQ ID NO: 468971 - DNA, 20 bp, mouse
gagaataatattaatggatg

SEQ ID NO: 468972 - DNA, 20 bp, mouse
gtaatattaatggatggggt

SEQ ID NO: 468973 - DNA, 20 bp, mouse
ggagtgggtagtagatacat

SEQ ID NO: 468974 - DNA, 20 bp, mouse
gggtagtagatacattggag

SEQ ID NO: 468975 - DNA, 20 bp, mouse
gaagagtaaatggattacag

SEQ ID NO: 468976 - DNA, 20 bp, mouse
gtagcggggctcgggcgatg

SEQ ID NO: 468977 - DNA, 20 bp, mouse
gcgagccccgctaccgagaa

SEQ ID NO: 468978 - DNA, 20 bp, mouse
gtctctgtccccctccccgg

SEQ ID NO: 468979 - DNA, 20 bp, mouse
gagcatccaacatggcgctg

SEQ ID NO: 468980 - DNA, 20 bp, mouse
gccccgcgggccagcaccac

SEQ ID NO: 468981 - DNA, 20 bp, mouse
gcacggagaccggcagccgg

SEQ ID NO: 468982 - DNA, 20 bp, mouse
gagggccgaaaagctccgag

SEQ ID NO: 468983 - DNA, 20 bp, mouse
gccccggggtcgcgttgtca

SEQ ID NO: 468984 - DNA, 20 bp, mouse
ggcggcgcccttctcggtag

SEQ ID NO: 468985 - DNA, 20 bp, mouse
gaagggcgccgcttcccccg

SEQ ID NO: 468986 - DNA, 20 bp, mouse
ggagcggagacggcaaatgg

SEQ ID NO: 468987 - DNA, 20 bp, mouse
gctgtaggcccgatcgtcgt

SEQ ID NO: 468988 - DNA, 20 bp, mouse
gccgctggttcctcaaggag

SEQ ID NO: 468989 - DNA, 20 bp, mouse
gctggcccgctggttcctca

SEQ ID NO: 468990 - DNA, 20 bp, mouse
ggggcctacagcagcttcgg

SEQ ID NO: 468991 - DNA, 20 bp, mouse
gccgccgccgaagctgctgt

SEQ ID NO: 468992 - DNA, 20 bp, mouse
gcagcttcggcggcggtaga

SEQ ID NO: 468993 - DNA, 20 bp, mouse
gtcggcggcggtagagggtg

SEQ ID NO: 468994 - DNA, 20 bp, mouse
gaaggagcggagacggcaaa

SEQ ID NO: 468995 - DNA, 20 bp, mouse
gatcgggcctacagcagctt

SEQ ID NO: 468996 - DNA, 20 bp, mouse
gcagagcgagaacattccag

SEQ ID NO: 468997 - DNA, 20 bp, mouse
gtccagaggtgagtccgcgg

SEQ ID NO: 468998 - DNA, 20 bp, mouse
gccccccgcggactcacctc

SEQ ID NO: 468999 - DNA, 20 bp, mouse
ggagggtagcttgagcgcgg

SEQ ID NO: 469000 - DNA, 20 bp, mouse
gggtagcttgagcgcggcgg

SEQ ID NO: 469001 - DNA, 20 bp, mouse
ggccgagggtagcttgagcg

SEQ ID NO: 469002 - DNA, 20 bp, mouse
gccgccgccgagcagcggga

SEQ ID NO: 469003 - DNA, 20 bp, mouse
gaggtgccgccgccgagcag

SEQ ID NO: 469004 - DNA, 20 bp, mouse
gcattccagaggtgagtccg

SEQ ID NO: 469005 - DNA, 20 bp, mouse
ggtacaaggggcgggctccg

SEQ ID NO: 469006 - DNA, 20 bp, mouse
gagcacagtagcgggttcgg

SEQ ID NO: 469007 - DNA, 20 bp, mouse
gggcggcggcagcacagtag

SEQ ID NO: 469008 - DNA, 20 bp, mouse
ggcggcggcggcgctagagg

SEQ ID NO: 469009 - DNA, 20 bp, mouse
ggacccgtgtgcagcagcgg

SEQ ID NO: 469010 - DNA, 20 bp, mouse
gtaagacccgtgtgcagcag

SEQ ID NO: 469011 - DNA, 20 bp, mouse
gggcagcacagtagcgggtt

SEQ ID NO: 469012 - DNA, 20 bp, mouse
ggagagacggaactacgcgg

SEQ ID NO: 469013 - DNA, 20 bp, mouse
ggaggcagcagttgggctcg

SEQ ID NO: 469014 - DNA, 20 bp, mouse
gagcggcgcgaggtgcggag

SEQ ID NO: 469015 - DNA, 20 bp, mouse
gcgggttcggaggcagcagt

SEQ ID NO: 469016 - DNA, 20 bp, mouse
gccgcagccgcagggaccgg

SEQ ID NO: 469017 - DNA, 20 bp, mouse
gccgccgcagccgcagggac

SEQ ID NO: 469018 - DNA, 20 bp, mouse
gctgcgtccgccggtccctg

SEQ ID NO: 469019 - DNA, 20 bp, mouse
gggaccggcggacgcagcaa

SEQ ID NO: 469020 - DNA, 20 bp, mouse
ggcggctggtccaggagacg

SEQ ID NO: 469021 - DNA, 20 bp, mouse
ggtgcgcctaggacccgcag

SEQ ID NO: 469022 - DNA, 20 bp, mouse
ggccggaaggtgaagacctg

SEQ ID NO: 469023 - DNA, 20 bp, mouse
gcccggcgcaggaaggtcgt

SEQ ID NO: 469024 - DNA, 20 bp, mouse
ggctggtccaggagacgggg

SEQ ID NO: 469025 - DNA, 20 bp, mouse
gcagcgccgccgcagccgca

SEQ ID NO: 469026 - DNA, 20 bp, mouse
gagacccgcgcactgggaca

SEQ ID NO: 469027 - DNA, 20 bp, mouse
ggtggagagccgggtgcgag

SEQ ID NO: 469028 - DNA, 20 bp, mouse
gcgcgggtctgtggagagcc

SEQ ID NO: 469029 - DNA, 20 bp, mouse
ggagtcagccgggagacagt

SEQ ID NO: 469030 - DNA, 20 bp, mouse
gcactgggacagggcacata

SEQ ID NO: 469031 - DNA, 20 bp, mouse
gaacaagagcgaagacaggt

SEQ ID NO: 469032 - DNA, 20 bp, mouse
gtctccacagacccgcgcac

SEQ ID NO: 469033 - DNA, 20 bp, mouse
gcgccgccgcctctcgcacc

SEQ ID NO: 469034 - DNA, 20 bp, mouse
gagtcgcgcggggccctgga

SEQ ID NO: 469035 - DNA, 20 bp, mouse
ggtgccctgtcccagtgcgc

SEQ ID NO: 469036 - DNA, 20 bp, mouse
gcgccatgagagaggctggg

SEQ ID NO: 469037 - DNA, 20 bp, mouse
gggtgagctgttgggactct

SEQ ID NO: 469038 - DNA, 20 bp, mouse
gcgcagggcgagaggacttg

SEQ ID NO: 469039 - DNA, 20 bp, mouse
gagtcgcttggtgagctgtt

SEQ ID NO: 469040 - DNA, 20 bp, mouse
gtgttgcagcgtgtagacat

SEQ ID NO: 469041 - DNA, 20 bp, mouse
ggctctgaccgccatgagag

SEQ ID NO: 469042 - DNA, 20 bp, mouse
gtgggccgacagatccactc

SEQ ID NO: 469043 - DNA, 20 bp, mouse
gggttgacccggctccggag

SEQ ID NO: 469044 - DNA, 20 bp, mouse
ggcatctgaggggcccgaga

SEQ ID NO: 469045 - DNA, 20 bp, mouse
ggtcctctcgccctgcgacc

SEQ ID NO: 469046 - DNA, 20 bp, mouse
gcgaggcccgccggagcgga

SEQ ID NO: 469047 - DNA, 20 bp, mouse
gtccccgaggcccgccggag

SEQ ID NO: 469048 - DNA, 20 bp, mouse
gaggcccagcagtgtgcgag

SEQ ID NO: 469049 - DNA, 20 bp, mouse
gggcccgccggagcggaggg

SEQ ID NO: 469050 - DNA, 20 bp, mouse
gcactgctgggcctcggagc

SEQ ID NO: 469051 - DNA, 20 bp, mouse
ggcgggcctcggggagagag

SEQ ID NO: 469052 - DNA, 20 bp, mouse
ggaggcgcaggccggctccg

SEQ ID NO: 469053 - DNA, 20 bp, mouse
gtcgccgctcgcacactgct

SEQ ID NO: 469054 - DNA, 20 bp, mouse
gtgggcaggacgcccgaggg

SEQ ID NO: 469055 - DNA, 20 bp, mouse
gcctcactcgggagctgcgt

SEQ ID NO: 469056 - DNA, 20 bp, mouse
gaaggggacgcaacagtgag

SEQ ID NO: 469057 - DNA, 20 bp, mouse
gggtgtggtcgggtgcatgt

SEQ ID NO: 469058 - DNA, 20 bp, mouse
ggacatggtgcgcaggccaa

SEQ ID NO: 469059 - DNA, 20 bp, mouse
ggtgcttgtggcggcgtgag

SEQ ID NO: 469060 - DNA, 20 bp, mouse
gcgagccgaaccctgcgaca

SEQ ID NO: 469061 - DNA, 20 bp, mouse
gagtgggccgacagccctgg

SEQ ID NO: 469062 - DNA, 20 bp, mouse
gggcctcaccgtgagtgtgt

SEQ ID NO: 469063 - DNA, 20 bp, mouse
ggaatacaacaggtcagagt

SEQ ID NO: 469064 - DNA, 20 bp, mouse
gccgccatgcggtggagggg

SEQ ID NO: 469065 - DNA, 20 bp, mouse
ggcgtacgcaggtgtcgcag

SEQ ID NO: 469066 - DNA, 20 bp, mouse
gagtctgccaagggccatgg

SEQ ID NO: 469067 - DNA, 20 bp, mouse
ggcgagaacacagcccacca

SEQ ID NO: 469068 - DNA, 20 bp, mouse
gaggctggctagggaaactg

SEQ ID NO: 469069 - DNA, 20 bp, mouse
gagactatccagccggactc

SEQ ID NO: 469070 - DNA, 20 bp, mouse
gcacagcccaccatggccct

SEQ ID NO: 469071 - DNA, 20 bp, mouse
gcggctggatagtctgccaa

SEQ ID NO: 469072 - DNA, 20 bp, mouse
ggatagtctgccaagggcca

SEQ ID NO: 469073 - DNA, 20 bp, mouse
gatggcagccagagtccggc

SEQ ID NO: 469074 - DNA, 20 bp, mouse
gactctggctgccatgctac

SEQ ID NO: 469075 - DNA, 20 bp, mouse
gaggaacaatgccagtagca

SEQ ID NO: 469076 - DNA, 20 bp, mouse
gggcagagcggtagcggtag

SEQ ID NO: 469077 - DNA, 20 bp, mouse
gggcggcggcagagcggtag

SEQ ID NO: 469078 - DNA, 20 bp, mouse
gcggcgacttccgaaagagt

SEQ ID NO: 469079 - DNA, 20 bp, mouse
gcgggtcgtgcgcgctgagg

SEQ ID NO: 469080 - DNA, 20 bp, mouse
gctccgcacggcctcggcag

SEQ ID NO: 469081 - DNA, 20 bp, mouse
gtgggctcccgcgagagagg

SEQ ID NO: 469082 - DNA, 20 bp, mouse
ggagcgggtcgtgcgcgctg

SEQ ID NO: 469083 - DNA, 20 bp, mouse
gcgcacggcctcggcagcgg

SEQ ID NO: 469084 - DNA, 20 bp, mouse
ggcgggcggcgcggcgataa

SEQ ID NO: 469085 - DNA, 20 bp, mouse
gtccatacccaggcctaccg

SEQ ID NO: 469086 - DNA, 20 bp, mouse
gtgcacacacggcagtgcgg

SEQ ID NO: 469087 - DNA, 20 bp, mouse
ggctgcccgggataggactc

SEQ ID NO: 469088 - DNA, 20 bp, mouse
gagctgcacacacggcagtg

SEQ ID NO: 469089 - DNA, 20 bp, mouse
gggaggacgtcttaaaaggg

SEQ ID NO: 469090 - DNA, 20 bp, mouse
gtctgccagagtcctatccc

SEQ ID NO: 469091 - DNA, 20 bp, mouse
gggacgtcttaaaagggagg

SEQ ID NO: 469092 - DNA, 20 bp, mouse
gtcttaaaagggaggtggac

SEQ ID NO: 469093 - DNA, 20 bp, mouse
ggggggaggacgtcttaaaa

SEQ ID NO: 469094 - DNA, 20 bp, mouse
gcgcgcgtgctgcccgggat

SEQ ID NO: 469095 - DNA, 20 bp, mouse
gagtgagaacagaaataagg

SEQ ID NO: 469096 - DNA, 20 bp, mouse
ggaggagaggacccatcacc

SEQ ID NO: 469097 - DNA, 20 bp, mouse
gtcgacggccagacccccag

SEQ ID NO: 469098 - DNA, 20 bp, mouse
gctgcggcgggccctcagtt

SEQ ID NO: 469099 - DNA, 20 bp, mouse
gccatcacccggcacgggac

SEQ ID NO: 469100 - DNA, 20 bp, mouse
gaggacccatcacccggcac

SEQ ID NO: 469101 - DNA, 20 bp, mouse
gcccagcggcaggtggatgg

SEQ ID NO: 469102 - DNA, 20 bp, mouse
gacgggacaggccgaactga

SEQ ID NO: 469103 - DNA, 20 bp, mouse
gcggagcgcgcagcgcgggc

SEQ ID NO: 469104 - DNA, 20 bp, mouse
gggagcgggcacgcagtgga

SEQ ID NO: 469105 - DNA, 20 bp, mouse
gagttcggcctgtcccgtgc

SEQ ID NO: 469106 - DNA, 20 bp, mouse
gatctacatcctagaatcgg

SEQ ID NO: 469107 - DNA, 20 bp, mouse
gagctgaaacccccgattct

SEQ ID NO: 469108 - DNA, 20 bp, mouse
gtacttgagaccatctgagg

SEQ ID NO: 469109 - DNA, 20 bp, mouse
gaggcggcttgtatgtgtag

SEQ ID NO: 469110 - DNA, 20 bp, mouse
gcttatctacatcctagaat

SEQ ID NO: 469111 - DNA, 20 bp, mouse
ggatcacagatggagtggaa

SEQ ID NO: 469112 - DNA, 20 bp, mouse
gggatgctgaacgttgagat

SEQ ID NO: 469113 - DNA, 20 bp, mouse
gcaataagaatggttatggt

SEQ ID NO: 469114 - DNA, 20 bp, mouse
gtggaaatgtaaacctcgag

SEQ ID NO: 469115 - DNA, 20 bp, mouse
gattcttattggcaaatatt

SEQ ID NO: 469116 - DNA, 20 bp, mouse
gaaatggctcctgcagattg

SEQ ID NO: 469117 - DNA, 20 bp, mouse
gcagccgaggttcttacctg

SEQ ID NO: 469118 - DNA, 20 bp, mouse
ggcagacttccccaatctgc

SEQ ID NO: 469119 - DNA, 20 bp, mouse
gaagttctgtgctgttaaaa

SEQ ID NO: 469120 - DNA, 20 bp, mouse
gtaacagcacagaacttgcc

SEQ ID NO: 469121 - DNA, 20 bp, mouse
gtcttacctgtggcagaaca

SEQ ID NO: 469122 - DNA, 20 bp, mouse
gctgccacaggtaagaacct

SEQ ID NO: 469123 - DNA, 20 bp, mouse
gtcttcaggtttcgtcctct

SEQ ID NO: 469124 - DNA, 20 bp, mouse
gctgtgcacttcagaactat

SEQ ID NO: 469125 - DNA, 20 bp, mouse
gaataaacaagatgcttcag

SEQ ID NO: 469126 - DNA, 20 bp, mouse
gaggcgtgaggaccgcggga

SEQ ID NO: 469127 - DNA, 20 bp, mouse
gggaggttctggatcccggg

SEQ ID NO: 469128 - DNA, 20 bp, mouse
gcgcgggatggagcctgggt

SEQ ID NO: 469129 - DNA, 20 bp, mouse
gctgcgagccagctcgggag

SEQ ID NO: 469130 - DNA, 20 bp, mouse
gggccccgagcgtccgaccc

SEQ ID NO: 469131 - DNA, 20 bp, mouse
gcgagccagctcgggagtgg

SEQ ID NO: 469132 - DNA, 20 bp, mouse
gcgggaggcgtgaggaccgc

SEQ ID NO: 469133 - DNA, 20 bp, mouse
ggacgaaagcgcgacgggac

SEQ ID NO: 469134 - DNA, 20 bp, mouse
gctggatcccgggaggcgtg

SEQ ID NO: 469135 - DNA, 20 bp, mouse
gagaagggacgaaagcgcga

SEQ ID NO: 469136 - DNA, 20 bp, mouse
ggtctgcggccctgagggaa

SEQ ID NO: 469137 - DNA, 20 bp, mouse
gcaggcgctgcggtgactgg

SEQ ID NO: 469138 - DNA, 20 bp, mouse
ggcggtgtcgcctcccccgg

SEQ ID NO: 469139 - DNA, 20 bp, mouse
ggtcctgcgggaagccgagg

SEQ ID NO: 469140 - DNA, 20 bp, mouse
gcaggacgccgggccaacgg

SEQ ID NO: 469141 - DNA, 20 bp, mouse
gcggttgggggggatctgta

SEQ ID NO: 469142 - DNA, 20 bp, mouse
gccaaccgccgaggcgacgg

SEQ ID NO: 469143 - DNA, 20 bp, mouse
gaggagcgcgcggagcggcc

SEQ ID NO: 469144 - DNA, 20 bp, mouse
gagggactcggcgacgtgga

SEQ ID NO: 469145 - DNA, 20 bp, mouse
gccgcaggacgccgggccaa

SEQ ID NO: 469146 - DNA, 20 bp, mouse
gggtgtgtcagggttcggtg

SEQ ID NO: 469147 - DNA, 20 bp, mouse
gaagcggtcgaaggctccgc

SEQ ID NO: 469148 - DNA, 20 bp, mouse
gaccgtaccgaggtgtgtca

SEQ ID NO: 469149 - DNA, 20 bp, mouse
gggagtgttggggctactgt

SEQ ID NO: 469150 - DNA, 20 bp, mouse
gaccgaggtgtgtcagggtt

SEQ ID NO: 469151 - DNA, 20 bp, mouse
gctctctccacaaatcacgt

SEQ ID NO: 469152 - DNA, 20 bp, mouse
gaagaaatctaagcggtcga

SEQ ID NO: 469153 - DNA, 20 bp, mouse
gagggaatgtgaccgtaccg

SEQ ID NO: 469154 - DNA, 20 bp, mouse
ggactggtcagagaccagat

SEQ ID NO: 469155 - DNA, 20 bp, mouse
gagggttcggtgtggcaggc

SEQ ID NO: 469156 - DNA, 20 bp, mouse
gcctcggcgcagctctccag

SEQ ID NO: 469157 - DNA, 20 bp, mouse
gggcacccgctgatgaggag

SEQ ID NO: 469158 - DNA, 20 bp, mouse
gggaggccgcgccgagggaa

SEQ ID NO: 469159 - DNA, 20 bp, mouse
ggcgcccccctcctcatcag

SEQ ID NO: 469160 - DNA, 20 bp, mouse
ggcgccgcggaaaggagaag

SEQ ID NO: 469161 - DNA, 20 bp, mouse
ggagtcccgaggttcccggg

SEQ ID NO: 469162 - DNA, 20 bp, mouse
gccgaggctagcgagagaaa

SEQ ID NO: 469163 - DNA, 20 bp, mouse
ggagggactgaagagcggga

SEQ ID NO: 469164 - DNA, 20 bp, mouse
gccggcgccgaggtgagtca

SEQ ID NO: 469165 - DNA, 20 bp, mouse
ggagaaaggggaaatcgcac

SEQ ID NO: 469166 - DNA, 20 bp, mouse
gagcgcgctcccagcaccag

SEQ ID NO: 469167 - DNA, 20 bp, mouse
ggtggctaggtccagacaga

SEQ ID NO: 469168 - DNA, 20 bp, mouse
gcttacgtgaagacaagtgg

SEQ ID NO: 469169 - DNA, 20 bp, mouse
gctaaaggcagctaaaggat

SEQ ID NO: 469170 - DNA, 20 bp, mouse
gtgggtggccaccttcccgg

SEQ ID NO: 469171 - DNA, 20 bp, mouse
gctgagtcaaacacccccgg

SEQ ID NO: 469172 - DNA, 20 bp, mouse
gaggtgtcacttatatcaca

SEQ ID NO: 469173 - DNA, 20 bp, mouse
ggggctcagagacttagctg

SEQ ID NO: 469174 - DNA, 20 bp, mouse
gacccccggaggaggcactc

SEQ ID NO: 469175 - DNA, 20 bp, mouse
gctctggcttcctcacggag

SEQ ID NO: 469176 - DNA, 20 bp, mouse
ggagagagcaagtccctggt

SEQ ID NO: 469177 - DNA, 20 bp, mouse
ggatgggaggtgggtacgag

SEQ ID NO: 469178 - DNA, 20 bp, mouse
ggagaatgttgcatctcgga

SEQ ID NO: 469179 - DNA, 20 bp, mouse
gttaggagagagcaagtccc

SEQ ID NO: 469180 - DNA, 20 bp, mouse
ggagatggtacaaggttgtc

SEQ ID NO: 469181 - DNA, 20 bp, mouse
gcttcgtggcgatgggaggt

SEQ ID NO: 469182 - DNA, 20 bp, mouse
ggggatcaaggctccctgag

SEQ ID NO: 469183 - DNA, 20 bp, mouse
ggacccttcgtggcgatggg

SEQ ID NO: 469184 - DNA, 20 bp, mouse
ggccactgagctaagagccg

SEQ ID NO: 469185 - DNA, 20 bp, mouse
ggaagggggtcggtgacctt

SEQ ID NO: 469186 - DNA, 20 bp, mouse
gcacgacacgcacagagcca

SEQ ID NO: 469187 - DNA, 20 bp, mouse
gacacgcacagagccacggc

SEQ ID NO: 469188 - DNA, 20 bp, mouse
gcggagagcgagcgtgagcg

SEQ ID NO: 469189 - DNA, 20 bp, mouse
ggctccctggccgccagcgg

SEQ ID NO: 469190 - DNA, 20 bp, mouse
gggatcccagtcaggactgg

SEQ ID NO: 469191 - DNA, 20 bp, mouse
ggcagggaggacgagcgtcg

SEQ ID NO: 469192 - DNA, 20 bp, mouse
gaccctgcgcaaggtggtgg

SEQ ID NO: 469193 - DNA, 20 bp, mouse
gtcctgactgggatccgagc

SEQ ID NO: 469194 - DNA, 20 bp, mouse
gctgcagcactcggatccgg

SEQ ID NO: 469195 - DNA, 20 bp, mouse
gtgtgcgtgtcgtgtgtctg

SEQ ID NO: 469196 - DNA, 20 bp, mouse
gccaggccccggttccaagg

SEQ ID NO: 469197 - DNA, 20 bp, mouse
ggagcggtggggaaacgcag

SEQ ID NO: 469198 - DNA, 20 bp, mouse
gcccccaggccccggttcca

SEQ ID NO: 469199 - DNA, 20 bp, mouse
gtggcagtggcagctccggg

SEQ ID NO: 469200 - DNA, 20 bp, mouse
gggccccggttccaaggcgg

SEQ ID NO: 469201 - DNA, 20 bp, mouse
gcgctcacgtgggctctcat

SEQ ID NO: 469202 - DNA, 20 bp, mouse
gcccggttccaaggcggcgg

SEQ ID NO: 469203 - DNA, 20 bp, mouse
gcggtggggaaacgcagggg

SEQ ID NO: 469204 - DNA, 20 bp, mouse
gagagcccacgtgagcggtg

SEQ ID NO: 469205 - DNA, 20 bp, mouse
gtgagcccaggcccacaagg

SEQ ID NO: 469206 - DNA, 20 bp, mouse
gtgtcagcatggaaagtcgg

SEQ ID NO: 469207 - DNA, 20 bp, mouse
gagcgtttgggagtcttctt

SEQ ID NO: 469208 - DNA, 20 bp, mouse
gtcttggggagatttctagg

SEQ ID NO: 469209 - DNA, 20 bp, mouse
ggctgacaggcgtctgcaga

SEQ ID NO: 469210 - DNA, 20 bp, mouse
ggcctgtcagcatggaaagt

SEQ ID NO: 469211 - DNA, 20 bp, mouse
gctgcaacctacccagacgt

SEQ ID NO: 469212 - DNA, 20 bp, mouse
gcgagcacgagctcccgggg

SEQ ID NO: 469213 - DNA, 20 bp, mouse
gtctgcactgcgaagcccgg

SEQ ID NO: 469214 - DNA, 20 bp, mouse
ggcccgagcacgagctcccg

SEQ ID NO: 469215 - DNA, 20 bp, mouse
gcactcagggtgtctcctcc

SEQ ID NO: 469216 - DNA, 20 bp, mouse
ggcggaacgacgggagacgg

SEQ ID NO: 469217 - DNA, 20 bp, mouse
ggcggaggccgcggaacgac

SEQ ID NO: 469218 - DNA, 20 bp, mouse
ggccgcggaacgacgggaga

SEQ ID NO: 469219 - DNA, 20 bp, mouse
gcgctcgacgttcttcacta

SEQ ID NO: 469220 - DNA, 20 bp, mouse
gcgagcgcacgcacggcgag

SEQ ID NO: 469221 - DNA, 20 bp, mouse
gaagaccgcgcggcgaacag

SEQ ID NO: 469222 - DNA, 20 bp, mouse
gccggggcccgagaaagcgg

SEQ ID NO: 469223 - DNA, 20 bp, mouse
gtccgagtgtgaggagcggt

SEQ ID NO: 469224 - DNA, 20 bp, mouse
ggtggtgcgagaccccgacg

SEQ ID NO: 469225 - DNA, 20 bp, mouse
gcgcggccgggacggcgaag

SEQ ID NO: 469226 - DNA, 20 bp, mouse
gcgtgtgggcgcgtgagcga

SEQ ID NO: 469227 - DNA, 20 bp, mouse
gaagatggcggcgctgaagg

SEQ ID NO: 469228 - DNA, 20 bp, mouse
ggagttacgggttgtcgtgt

SEQ ID NO: 469229 - DNA, 20 bp, mouse
ggcgcagtcgctgaggaggg

SEQ ID NO: 469230 - DNA, 20 bp, mouse
gaacctgaaggatgtcactg

SEQ ID NO: 469231 - DNA, 20 bp, mouse
gcgcgtgagcgacggcagca

SEQ ID NO: 469232 - DNA, 20 bp, mouse
gcccagcacttaagaaccta

SEQ ID NO: 469233 - DNA, 20 bp, mouse
ggtcaaggtatcgccaggtg

SEQ ID NO: 469234 - DNA, 20 bp, mouse
gtggcctcgcgagaccctta

SEQ ID NO: 469235 - DNA, 20 bp, mouse
gcacttgcggggacctgtgg

SEQ ID NO: 469236 - DNA, 20 bp, mouse
ggggatggccgtagctgtgg

SEQ ID NO: 469237 - DNA, 20 bp, mouse
ggcagccgccgccacagcta

SEQ ID NO: 469238 - DNA, 20 bp, mouse
gatggccgtagctgtggcgg

SEQ ID NO: 469239 - DNA, 20 bp, mouse
gagcgggatggccgtagctg

SEQ ID NO: 469240 - DNA, 20 bp, mouse
gcagtacgtcagcagcggga

SEQ ID NO: 469241 - DNA, 20 bp, mouse
gcgcccggcagaaagatcag

SEQ ID NO: 469242 - DNA, 20 bp, mouse
ggtggaggctggagcccgag

SEQ ID NO: 469243 - DNA, 20 bp, mouse
gtatgacagtacgtcagcag

SEQ ID NO: 469244 - DNA, 20 bp, mouse
gccgcagctgtggaagcccg

SEQ ID NO: 469245 - DNA, 20 bp, mouse
gctgcgcgcagctagacctc

SEQ ID NO: 469246 - DNA, 20 bp, mouse
gcatgcagaaccgggaccac

SEQ ID NO: 469247 - DNA, 20 bp, mouse
gcagaggtggccctcacctg

SEQ ID NO: 469248 - DNA, 20 bp, mouse
ggaaccgggaccacaggtga

SEQ ID NO: 469249 - DNA, 20 bp, mouse
ggtcgcgcacatgcagaacc

SEQ ID NO: 469250 - DNA, 20 bp, mouse
gcgactttggcaccatggag

SEQ ID NO: 469251 - DNA, 20 bp, mouse
gagggcgggacagacccgga

SEQ ID NO: 469252 - DNA, 20 bp, mouse
ggacccaggaagctctgagt

SEQ ID NO: 469253 - DNA, 20 bp, mouse
gtggccctcacctgtggtcc

SEQ ID NO: 469254 - DNA, 20 bp, mouse
gtgggaggccaaggtctggt

SEQ ID NO: 469255 - DNA, 20 bp, mouse
gaggtctggttggccgggaa

SEQ ID NO: 469256 - DNA, 20 bp, mouse
gagcggcagcgggcgaggat

SEQ ID NO: 469257 - DNA, 20 bp, mouse
ggaggatgggcacgagatag

SEQ ID NO: 469258 - DNA, 20 bp, mouse
gagtgcgtgcgttcgggcag

SEQ ID NO: 469259 - DNA, 20 bp, mouse
gctctcggaggcgcggacgg

SEQ ID NO: 469260 - DNA, 20 bp, mouse
gtgagagcagcggcagccgg

SEQ ID NO: 469261 - DNA, 20 bp, mouse
ggctctgtcgccgctctcgg

SEQ ID NO: 469262 - DNA, 20 bp, mouse
gagagcggcgacagagcctc

SEQ ID NO: 469263 - DNA, 20 bp, mouse
gaacgcacgcacttagactc

SEQ ID NO: 469264 - DNA, 20 bp, mouse
gccgcaacgagggttcccag

SEQ ID NO: 469265 - DNA, 20 bp, mouse
gccgctctcggaggcgcgga

SEQ ID NO: 469266 - DNA, 20 bp, mouse
ggcagacggggccagtggag

SEQ ID NO: 469267 - DNA, 20 bp, mouse
ggcgcggagctgggcctcgg

SEQ ID NO: 469268 - DNA, 20 bp, mouse
gcgagcgtccctcactcacc

SEQ ID NO: 469269 - DNA, 20 bp, mouse
ggacggggccagtggagcgg

SEQ ID NO: 469270 - DNA, 20 bp, mouse
ggagggacgctcggggctcg

SEQ ID NO: 469271 - DNA, 20 bp, mouse
gagcagcctaagcctaggga

SEQ ID NO: 469272 - DNA, 20 bp, mouse
gactcacccggcacccgccg

SEQ ID NO: 469273 - DNA, 20 bp, mouse
gaccagcaccggagcacccc

SEQ ID NO: 469274 - DNA, 20 bp, mouse
gctggaccgaagccgggcag

SEQ ID NO: 469275 - DNA, 20 bp, mouse
gcaggagggcggggcagacg

SEQ ID NO: 469276 - DNA, 20 bp, mouse
gcgatcaggagtgggaacct

SEQ ID NO: 469277 - DNA, 20 bp, mouse
gtcggagcccgatcaggagt

SEQ ID NO: 469278 - DNA, 20 bp, mouse
gaaggcctcggagcccgatc

SEQ ID NO: 469279 - DNA, 20 bp, mouse
gggctccgaggccttcccaa

SEQ ID NO: 469280 - DNA, 20 bp, mouse
gcgagagtgcacccggtcta

SEQ ID NO: 469281 - DNA, 20 bp, mouse
gggaacaacccagaagcgag

SEQ ID NO: 469282 - DNA, 20 bp, mouse
gagattaacccggaactaac

SEQ ID NO: 469283 - DNA, 20 bp, mouse
gaagtcctagaccctagacc

SEQ ID NO: 469284 - DNA, 20 bp, mouse
gccagctagaccaggtcaat

SEQ ID NO: 469285 - DNA, 20 bp, mouse
gacaacccagaagcgagagg

SEQ ID NO: 469286 - DNA, 20 bp, mouse
gaggcgaccgagagcagctg

SEQ ID NO: 469287 - DNA, 20 bp, mouse
gctcaccggagcagagacag

SEQ ID NO: 469288 - DNA, 20 bp, mouse
gccggagcagagacagtggt

SEQ ID NO: 469289 - DNA, 20 bp, mouse
gccctgggcagcgggcagag

SEQ ID NO: 469290 - DNA, 20 bp, mouse
gtagtgcgtagcaggagcga

SEQ ID NO: 469291 - DNA, 20 bp, mouse
ggcaagccgggttgcaccct

SEQ ID NO: 469292 - DNA, 20 bp, mouse
gtgcgtagcaggagcgaagg

SEQ ID NO: 469293 - DNA, 20 bp, mouse
gggaccagccgcggcgatca

SEQ ID NO: 469294 - DNA, 20 bp, mouse
gggcgtgcagaggtttccct

SEQ ID NO: 469295 - DNA, 20 bp, mouse
ggccgcggctggtccccgag

SEQ ID NO: 469296 - DNA, 20 bp, mouse
gcacaggagcggaagaacta

SEQ ID NO: 469297 - DNA, 20 bp, mouse
gcagctgcaaacaccggcaa

SEQ ID NO: 469298 - DNA, 20 bp, mouse
gtttccccagctgcaaacac

SEQ ID NO: 469299 - DNA, 20 bp, mouse
gacggaaacgacgctctacg

SEQ ID NO: 469300 - DNA, 20 bp, mouse
gccgggtcgcggtgttcgca

SEQ ID NO: 469301 - DNA, 20 bp, mouse
ggccgtcccgccgagcccca

SEQ ID NO: 469302 - DNA, 20 bp, mouse
ggacccggaagtccgcacgg

SEQ ID NO: 469303 - DNA, 20 bp, mouse
gggtgtgtctgcgaatccca

SEQ ID NO: 469304 - DNA, 20 bp, mouse
gagcctccgtgcggacttcc

SEQ ID NO: 469305 - DNA, 20 bp, mouse
gttcccgcgcgcgagagggg

SEQ ID NO: 469306 - DNA, 20 bp, mouse
gcgagacaggcgacactgca

SEQ ID NO: 469307 - DNA, 20 bp, mouse
gccagcgttccggtaagggg

SEQ ID NO: 469308 - DNA, 20 bp, mouse
gacccagacagaggctgtgt

SEQ ID NO: 469309 - DNA, 20 bp, mouse
gtgggaggcagagaagacct

SEQ ID NO: 469310 - DNA, 20 bp, mouse
gggacgcgtccggtgagcaa

SEQ ID NO: 469311 - DNA, 20 bp, mouse
gtgcacggctgcgcgaaaag

SEQ ID NO: 469312 - DNA, 20 bp, mouse
gggattcgctggaacctcgg

SEQ ID NO: 469313 - DNA, 20 bp, mouse
gcgtccccagcgttccggta

SEQ ID NO: 469314 - DNA, 20 bp, mouse
gtgcgcgaaaagggggatgt

SEQ ID NO: 469315 - DNA, 20 bp, mouse
gtcaccgcgggaccacaaca

SEQ ID NO: 469316 - DNA, 20 bp, mouse
gatccctgggcagctccgag

SEQ ID NO: 469317 - DNA, 20 bp, mouse
ggccccctcggagctgccca

SEQ ID NO: 469318 - DNA, 20 bp, mouse
gcgtgggacgctgggagtgg

SEQ ID NO: 469319 - DNA, 20 bp, mouse
gcacctcaggggcgcaacac

SEQ ID NO: 469320 - DNA, 20 bp, mouse
gaactttgttgctctcggga

SEQ ID NO: 469321 - DNA, 20 bp, mouse
ggtcaaaacaaccacctcag

SEQ ID NO: 469322 - DNA, 20 bp, mouse
gccagcgtgcaggtgagtcg

SEQ ID NO: 469323 - DNA, 20 bp, mouse
ggcatcgctgcgctcagggg

SEQ ID NO: 469324 - DNA, 20 bp, mouse
ggacagggtggcggagatct

SEQ ID NO: 469325 - DNA, 20 bp, mouse
gccacggcgggaaggccacc

SEQ ID NO: 469326 - DNA, 20 bp, mouse
ggccggcgcgcgcagcacgg

SEQ ID NO: 469327 - DNA, 20 bp, mouse
gggcgcgcgcagcacggcgg

SEQ ID NO: 469328 - DNA, 20 bp, mouse
ggggagctccaagcgcccag

SEQ ID NO: 469329 - DNA, 20 bp, mouse
gcgcgcgccggccagccact

SEQ ID NO: 469330 - DNA, 20 bp, mouse
ggctccaagcgcccagtggc

SEQ ID NO: 469331 - DNA, 20 bp, mouse
gctctccaggcagactgtaa

SEQ ID NO: 469332 - DNA, 20 bp, mouse
ggacagttgtgctgatgaag

SEQ ID NO: 469333 - DNA, 20 bp, mouse
ggattgcacaactcgagcct

SEQ ID NO: 469334 - DNA, 20 bp, mouse
gactcgctggcgtgctacaa

SEQ ID NO: 469335 - DNA, 20 bp, mouse
ggaggcaagaccgaaggagg

SEQ ID NO: 469336 - DNA, 20 bp, mouse
ggagatggcgggtctgacag

SEQ ID NO: 469337 - DNA, 20 bp, mouse
gtcagcaagacgccaggctg

SEQ ID NO: 469338 - DNA, 20 bp, mouse
ggcagtcctccccgagatgg

SEQ ID NO: 469339 - DNA, 20 bp, mouse
gtccaggctgcgcgggatgg

SEQ ID NO: 469340 - DNA, 20 bp, mouse
gagaggatcagcaagacgcc

SEQ ID NO: 469341 - DNA, 20 bp, mouse
gcagacccgccatctcgggg

SEQ ID NO: 469342 - DNA, 20 bp, mouse
gcccctcctcgagacaggga

SEQ ID NO: 469343 - DNA, 20 bp, mouse
gacagcgtgggaccagcgag

SEQ ID NO: 469344 - DNA, 20 bp, mouse
ggaggcgctgagagcaggct

SEQ ID NO: 469345 - DNA, 20 bp, mouse
gccaggtggcaagactgatg

SEQ ID NO: 469346 - DNA, 20 bp, mouse
ggctggtacaagtaagtgta

SEQ ID NO: 469347 - DNA, 20 bp, mouse
gagtaagtgtagggtctcgc

SEQ ID NO: 469348 - DNA, 20 bp, mouse
gtgaagcggccttggctgag

SEQ ID NO: 469349 - DNA, 20 bp, mouse
gtagcgtctcctgggtgaag

SEQ ID NO: 469350 - DNA, 20 bp, mouse
gcccagctgcagggatccag

SEQ ID NO: 469351 - DNA, 20 bp, mouse
gagccaaggccgcttcaccc

SEQ ID NO: 469352 - DNA, 20 bp, mouse
gagggatctgggcagagcga

SEQ ID NO: 469353 - DNA, 20 bp, mouse
gctcctgggtgaagcggcct

SEQ ID NO: 469354 - DNA, 20 bp, mouse
gaagtgtagggtctcgcggg

SEQ ID NO: 469355 - DNA, 20 bp, mouse
gccggaagttagcgtctcct

SEQ ID NO: 469356 - DNA, 20 bp, mouse
gggccggagagaagtcccca

SEQ ID NO: 469357 - DNA, 20 bp, mouse
gtgccggggagggatcctgt

SEQ ID NO: 469358 - DNA, 20 bp, mouse
gcagcagtgaagggttcaaa

SEQ ID NO: 469359 - DNA, 20 bp, mouse
gggccctggggacttctctc

SEQ ID NO: 469360 - DNA, 20 bp, mouse
ggaaggtacacactcaccag

SEQ ID NO: 469361 - DNA, 20 bp, mouse
gtggccggcaggcggccctg

SEQ ID NO: 469362 - DNA, 20 bp, mouse
gctgcccgcctggtttccac

SEQ ID NO: 469363 - DNA, 20 bp, mouse
gccctctggtgacagaaagt

SEQ ID NO: 469364 - DNA, 20 bp, mouse
gactaggtgtgagcaaatgg

SEQ ID NO: 469365 - DNA, 20 bp, mouse
gtgaggaagtggccggcagg

SEQ ID NO: 469366 - DNA, 20 bp, mouse
gaacttgcccctgagaagaa

SEQ ID NO: 469367 - DNA, 20 bp, mouse
gtctcctcccttcttctcag

SEQ ID NO: 469368 - DNA, 20 bp, mouse
ggaggctggaggtgaagcac

SEQ ID NO: 469369 - DNA, 20 bp, mouse
gaggcaaaggggaagcccgg

SEQ ID NO: 469370 - DNA, 20 bp, mouse
gtgcaggggacagaggcgag

SEQ ID NO: 469371 - DNA, 20 bp, mouse
gtctcaaagagccaggctcc

SEQ ID NO: 469372 - DNA, 20 bp, mouse
gctggaggtgagagcctggg

SEQ ID NO: 469373 - DNA, 20 bp, mouse
gggccagagggactttacct

SEQ ID NO: 469374 - DNA, 20 bp, mouse
gtagtacctgaacaaaccta

SEQ ID NO: 469375 - DNA, 20 bp, mouse
ggactttacctgggagaagg

SEQ ID NO: 469376 - DNA, 20 bp, mouse
ggcgcggcgcagaaggaagg

SEQ ID NO: 469377 - DNA, 20 bp, mouse
gacccggcgcctgggcacaa

SEQ ID NO: 469378 - DNA, 20 bp, mouse
ggtggcgcggcgcagaagga

SEQ ID NO: 469379 - DNA, 20 bp, mouse
gtcggcgagcggctcgtggg

SEQ ID NO: 469380 - DNA, 20 bp, mouse
gtaccctggacagcgcatcg

SEQ ID NO: 469381 - DNA, 20 bp, mouse
gggccgcgatgcgctgtcca

SEQ ID NO: 469382 - DNA, 20 bp, mouse
gagaaggaaggcggctaccc

SEQ ID NO: 469383 - DNA, 20 bp, mouse
gcgagggaccccgcgaaacc

SEQ ID NO: 469384 - DNA, 20 bp, mouse
gtcgctgcctgcccaggaac

SEQ ID NO: 469385 - DNA, 20 bp, mouse
gccctcggcgagcggctcgt

SEQ ID NO: 469386 - DNA, 20 bp, mouse
gcagcgcacgtgccaggctc

SEQ ID NO: 469387 - DNA, 20 bp, mouse
ggcagaagggccccggagcc

SEQ ID NO: 469388 - DNA, 20 bp, mouse
ggagccaaagaagtagaaga

SEQ ID NO: 469389 - DNA, 20 bp, mouse
gacggtcactgcagcgcgag

SEQ ID NO: 469390 - DNA, 20 bp, mouse
gggaatcggagctagtaccg

SEQ ID NO: 469391 - DNA, 20 bp, mouse
ggagttacagagcttggggt

SEQ ID NO: 469392 - DNA, 20 bp, mouse
gggttagcagcgcacgtgcc

SEQ ID NO: 469393 - DNA, 20 bp, mouse
ggcgtcgtcggagactttac

SEQ ID NO: 469394 - DNA, 20 bp, mouse
gagaagatggagtgggtctc

SEQ ID NO: 469395 - DNA, 20 bp, mouse
ggaggagtactggtgagacc

SEQ ID NO: 469396 - DNA, 20 bp, mouse
ggcagagacaagaagccgga

SEQ ID NO: 469397 - DNA, 20 bp, mouse
gacaagaagccggagggcgg

SEQ ID NO: 469398 - DNA, 20 bp, mouse
ggcagcgcgcggcgacagag

SEQ ID NO: 469399 - DNA, 20 bp, mouse
gcgaggagaggtacgagcag

SEQ ID NO: 469400 - DNA, 20 bp, mouse
gccgcgactggggatgcagg

SEQ ID NO: 469401 - DNA, 20 bp, mouse
gcgagcagcggcgagaagag

SEQ ID NO: 469402 - DNA, 20 bp, mouse
ggtccagcgatagaactcca

SEQ ID NO: 469403 - DNA, 20 bp, mouse
gagaggctccgatggaccgt

SEQ ID NO: 469404 - DNA, 20 bp, mouse
ggtcctgaacgcgatgtcca

SEQ ID NO: 469405 - DNA, 20 bp, mouse
gcagtcgcggcgcctggagg

SEQ ID NO: 469406 - DNA, 20 bp, mouse
gggctacggggagcaccgga

SEQ ID NO: 469407 - DNA, 20 bp, mouse
ggagcggctacggggagcac

SEQ ID NO: 469408 - DNA, 20 bp, mouse
gcagccgcgatgcaagagga

SEQ ID NO: 469409 - DNA, 20 bp, mouse
gcgtagccgctcaggcagag

SEQ ID NO: 469410 - DNA, 20 bp, mouse
gacccacgcggactcctcct

SEQ ID NO: 469411 - DNA, 20 bp, mouse
ggctgcagccgcgatgcaag

SEQ ID NO: 469412 - DNA, 20 bp, mouse
gtcgctcagagaaagctcgg

SEQ ID NO: 469413 - DNA, 20 bp, mouse
ggcagcaggaccgcgcgagc

SEQ ID NO: 469414 - DNA, 20 bp, mouse
gaggatgtgcaagcgggcgc

SEQ ID NO: 469415 - DNA, 20 bp, mouse
ggcgccttcctcttgcatcg

SEQ ID NO: 469416 - DNA, 20 bp, mouse
gagcctctcagctacatcca

SEQ ID NO: 469417 - DNA, 20 bp, mouse
gagatcggccaggagactga

SEQ ID NO: 469418 - DNA, 20 bp, mouse
gcgcaggcaatgctcaaccc

SEQ ID NO: 469419 - DNA, 20 bp, mouse
gtacggtggatgcggacgct

SEQ ID NO: 469420 - DNA, 20 bp, mouse
gtgcgggcactaagaccgca

SEQ ID NO: 469421 - DNA, 20 bp, mouse
gggcggggcaatacctaggg

SEQ ID NO: 469422 - DNA, 20 bp, mouse
gggcagtagccagcagatcg

SEQ ID NO: 469423 - DNA, 20 bp, mouse
gtgacggcggggcaatacct

SEQ ID NO: 469424 - DNA, 20 bp, mouse
ggcgtgatggacaaacgtgc

SEQ ID NO: 469425 - DNA, 20 bp, mouse
gtcggccaggagactgacgg

SEQ ID NO: 469426 - DNA, 20 bp, mouse
gctaggggtacagggctcca

SEQ ID NO: 469427 - DNA, 20 bp, mouse
gccgcactcaccgcgccgag

SEQ ID NO: 469428 - DNA, 20 bp, mouse
gctgcgggccccagcagact

SEQ ID NO: 469429 - DNA, 20 bp, mouse
gagtctgggaagccaggacc

SEQ ID NO: 469430 - DNA, 20 bp, mouse
ggactgggcgaggctttcgg

SEQ ID NO: 469431 - DNA, 20 bp, mouse
gggaagatcggggccctccg

SEQ ID NO: 469432 - DNA, 20 bp, mouse
gaaggacgcgcgagccgaag

SEQ ID NO: 469433 - DNA, 20 bp, mouse
gagcagcaccgccaggaggg

SEQ ID NO: 469434 - DNA, 20 bp, mouse
gcgctgctcgcccctcggcg

SEQ ID NO: 469435 - DNA, 20 bp, mouse
gctgcggaccaggctgcgag

SEQ ID NO: 469436 - DNA, 20 bp, mouse
gagctcctcgaacccggttc

SEQ ID NO: 469437 - DNA, 20 bp, mouse
ggcggtccagcacactccag

SEQ ID NO: 469438 - DNA, 20 bp, mouse
gagcagagcccaggtcgctt

SEQ ID NO: 469439 - DNA, 20 bp, mouse
gcattgaccacctagcatca

SEQ ID NO: 469440 - DNA, 20 bp, mouse
gggttcgaggagctttgagt

SEQ ID NO: 469441 - DNA, 20 bp, mouse
gaagaaaccatgatgctagg

SEQ ID NO: 469442 - DNA, 20 bp, mouse
gtgagggtcatagagcacaa

SEQ ID NO: 469443 - DNA, 20 bp, mouse
ggagtagttccgctctgggg

SEQ ID NO: 469444 - DNA, 20 bp, mouse
ggcgcacttccgccccagag

SEQ ID NO: 469445 - DNA, 20 bp, mouse
gcacaagccacgggtaccct

SEQ ID NO: 469446 - DNA, 20 bp, mouse
gctacgccagcgcagagatg

SEQ ID NO: 469447 - DNA, 20 bp, mouse
gctaaaccgcggtaacgtgg

SEQ ID NO: 469448 - DNA, 20 bp, mouse
ggttaccgcggtttagaagg

SEQ ID NO: 469449 - DNA, 20 bp, mouse
gtacaaaggacagataggaa

SEQ ID NO: 469450 - DNA, 20 bp, mouse
gggaaaggtgcaaaatacgt

SEQ ID NO: 469451 - DNA, 20 bp, mouse
gttctccgccttctaaaccg

SEQ ID NO: 469452 - DNA, 20 bp, mouse
gtgggacaagggcgcaaggg

SEQ ID NO: 469453 - DNA, 20 bp, mouse
gaagggaggcccgccaaccg

SEQ ID NO: 469454 - DNA, 20 bp, mouse
gcaagtagtctcttccaaag

SEQ ID NO: 469455 - DNA, 20 bp, mouse
gacagtcccgggcggcttta

SEQ ID NO: 469456 - DNA, 20 bp, mouse
gcatcgtaggagcttcaaga

SEQ ID NO: 469457 - DNA, 20 bp, mouse
ggccacagaccgggagctga

SEQ ID NO: 469458 - DNA, 20 bp, mouse
gtggcggcggcagacacttg

SEQ ID NO: 469459 - DNA, 20 bp, mouse
gcgcctcggacgccacagac

SEQ ID NO: 469460 - DNA, 20 bp, mouse
ggttccgattgggtcatcgt

SEQ ID NO: 469461 - DNA, 20 bp, mouse
gtggcgtccgaggcgggtca

SEQ ID NO: 469462 - DNA, 20 bp, mouse
ggccctgacagaggaagact

SEQ ID NO: 469463 - DNA, 20 bp, mouse
gaccctcagctcccggtctg

SEQ ID NO: 469464 - DNA, 20 bp, mouse
gtcccggtctgtggcgtccg

SEQ ID NO: 469465 - DNA, 20 bp, mouse
ggtgccgccctgacccgcct

SEQ ID NO: 469466 - DNA, 20 bp, mouse
ggagggatcaaggcatgcgg

SEQ ID NO: 469467 - DNA, 20 bp, mouse
gactcgttgttggccatcgg

SEQ ID NO: 469468 - DNA, 20 bp, mouse
gtcccactccacggaatctg

SEQ ID NO: 469469 - DNA, 20 bp, mouse
ggaagggcgtagtctcctga

SEQ ID NO: 469470 - DNA, 20 bp, mouse
ggtggacctgctccccacta

SEQ ID NO: 469471 - DNA, 20 bp, mouse
ggacatcagaaggcgtcctg

SEQ ID NO: 469472 - DNA, 20 bp, mouse
gagtaggtctcacccatcct

SEQ ID NO: 469473 - DNA, 20 bp, mouse
gcggtggtgacgacatcaga

SEQ ID NO: 469474 - DNA, 20 bp, mouse
gggtgagggatcaaggcatg

SEQ ID NO: 469475 - DNA, 20 bp, mouse
gccgttggaacagttatcag

SEQ ID NO: 469476 - DNA, 20 bp, mouse
gctcgcgagcacggtcttgt

SEQ ID NO: 469477 - DNA, 20 bp, mouse
gcgcgtctgccgtaaaccga

SEQ ID NO: 469478 - DNA, 20 bp, mouse
gggacgctgcgcggtggagt

SEQ ID NO: 469479 - DNA, 20 bp, mouse
gtgtcgtgcggaccggaaga

SEQ ID NO: 469480 - DNA, 20 bp, mouse
gccgtaaaccgagggcatct

SEQ ID NO: 469481 - DNA, 20 bp, mouse
ggataaaaggatctcctcta

SEQ ID NO: 469482 - DNA, 20 bp, mouse
gcatccgggacgctgcgcgg

SEQ ID NO: 469483 - DNA, 20 bp, mouse
gagcgtgcaggattgcatcc

SEQ ID NO: 469484 - DNA, 20 bp, mouse
ggttgcagagcaggccctag

SEQ ID NO: 469485 - DNA, 20 bp, mouse
ggtctggagagggctcgccg

SEQ ID NO: 469486 - DNA, 20 bp, mouse
gcaactcacctagaagcggg

SEQ ID NO: 469487 - DNA, 20 bp, mouse
ggcccaactcacctagaagc

SEQ ID NO: 469488 - DNA, 20 bp, mouse
gggagtctcattggaagccc

SEQ ID NO: 469489 - DNA, 20 bp, mouse
gctagagtgcgggtctgtcc

SEQ ID NO: 469490 - DNA, 20 bp, mouse
gtgggttgcaaggtcgagag

SEQ ID NO: 469491 - DNA, 20 bp, mouse
gaacagacgcaggctctcac

SEQ ID NO: 469492 - DNA, 20 bp, mouse
gtgcaaggtcgagagtggaa

SEQ ID NO: 469493 - DNA, 20 bp, mouse
ggggacagagcgagaccctg

SEQ ID NO: 469494 - DNA, 20 bp, mouse
ggcccacctgcggggaacca

SEQ ID NO: 469495 - DNA, 20 bp, mouse
ggcggtgcctgcctagctcc

SEQ ID NO: 469496 - DNA, 20 bp, mouse
gtctgtccaggaggtcgcta

SEQ ID NO: 469497 - DNA, 20 bp, mouse
gacacagggaccaacggaga

SEQ ID NO: 469498 - DNA, 20 bp, mouse
gaccggaagaggctcagtgg

SEQ ID NO: 469499 - DNA, 20 bp, mouse
gcggctgagggcgatcccac

SEQ ID NO: 469500 - DNA, 20 bp, mouse
gacggatcgcagcgagctga

SEQ ID NO: 469501 - DNA, 20 bp, mouse
gtgcgctgggagcgtctcgg

SEQ ID NO: 469502 - DNA, 20 bp, mouse
ggggagggctctgggttcac

SEQ ID NO: 469503 - DNA, 20 bp, mouse
ggaaccccccaggtacctgt

SEQ ID NO: 469504 - DNA, 20 bp, mouse
gggcgcaggcggctacggag

SEQ ID NO: 469505 - DNA, 20 bp, mouse
ggcgggcgggtctgtccagg

SEQ ID NO: 469506 - DNA, 20 bp, mouse
gcggtctacgaagaccaagt

SEQ ID NO: 469507 - DNA, 20 bp, mouse
ggcgtctgggttctggatct

SEQ ID NO: 469508 - DNA, 20 bp, mouse
gtcaatcatggcggtcgcgg

SEQ ID NO: 469509 - DNA, 20 bp, mouse
gggcggtcgcggtggcgtct

SEQ ID NO: 469510 - DNA, 20 bp, mouse
gggtgcttgggcttcaatca

SEQ ID NO: 469511 - DNA, 20 bp, mouse
gctggcggcaggcggtgctt

SEQ ID NO: 469512 - DNA, 20 bp, mouse
ggctgtgctgctcgtccctg

SEQ ID NO: 469513 - DNA, 20 bp, mouse
ggcttcaatcatggcggtcg

SEQ ID NO: 469514 - DNA, 20 bp, mouse
gcgcggtggcgtctgggttc

SEQ ID NO: 469515 - DNA, 20 bp, mouse
gccagactataacttaacgg

SEQ ID NO: 469516 - DNA, 20 bp, mouse
ggcacccgcggccaccatac

SEQ ID NO: 469517 - DNA, 20 bp, mouse
gcagcccgctaggaaacaca

SEQ ID NO: 469518 - DNA, 20 bp, mouse
gtgtttcctagcgggctgta

SEQ ID NO: 469519 - DNA, 20 bp, mouse
gtcccaagcacggagatgag

SEQ ID NO: 469520 - DNA, 20 bp, mouse
ggagagccatacagcccgct

SEQ ID NO: 469521 - DNA, 20 bp, mouse
gtctcaacgctcccgtatgg

SEQ ID NO: 469522 - DNA, 20 bp, mouse
gtccatctagcgcccacagg

SEQ ID NO: 469523 - DNA, 20 bp, mouse
gtgagtgctagtggccgggg

SEQ ID NO: 469524 - DNA, 20 bp, mouse
ggggcggggcggcctcctgt

SEQ ID NO: 469525 - DNA, 20 bp, mouse
gtgaaccctgtgtttcctag

SEQ ID NO: 469526 - DNA, 20 bp, mouse
gcggagtcggcgaggagaga

SEQ ID NO: 469527 - DNA, 20 bp, mouse
gtcttcctagaacccggagt

SEQ ID NO: 469528 - DNA, 20 bp, mouse
gccgaaccgagtggacactg

SEQ ID NO: 469529 - DNA, 20 bp, mouse
gctagaacccggagtcggcg

SEQ ID NO: 469530 - DNA, 20 bp, mouse
ggtcggcgaggagagagggc

SEQ ID NO: 469531 - DNA, 20 bp, mouse
gcccgacggaggacacaacc

SEQ ID NO: 469532 - DNA, 20 bp, mouse
gtgggcccggccacaatctg

SEQ ID NO: 469533 - DNA, 20 bp, mouse
gagggagagctgcccgacgg

SEQ ID NO: 469534 - DNA, 20 bp, mouse
gattgtggccgggcccagga

SEQ ID NO: 469535 - DNA, 20 bp, mouse
gactcggttcgggcagttca

SEQ ID NO: 469536 - DNA, 20 bp, mouse
gctggctggcgtggaatctg

SEQ ID NO: 469537 - DNA, 20 bp, mouse
gacagtgcgcggagaaagct

SEQ ID NO: 469538 - DNA, 20 bp, mouse
gccacgccagccagactgag

SEQ ID NO: 469539 - DNA, 20 bp, mouse
gcccagctggaaacagtgcg

SEQ ID NO: 469540 - DNA, 20 bp, mouse
ggatgggcaggaccacccag

SEQ ID NO: 469541 - DNA, 20 bp, mouse
gcttcacccgcccctcagtc

SEQ ID NO: 469542 - DNA, 20 bp, mouse
gcagtaggattgacacgtag

SEQ ID NO: 469543 - DNA, 20 bp, mouse
ggccagccagactgaggggc

SEQ ID NO: 469544 - DNA, 20 bp, mouse
gggagtgaggtcagcaggat

SEQ ID NO: 469545 - DNA, 20 bp, mouse
gacccgcccctcagtctggc

SEQ ID NO: 469546 - DNA, 20 bp, mouse
ggcaagcggccggagggtgt

SEQ ID NO: 469547 - DNA, 20 bp, mouse
gcagaacgcaagcggccgga

SEQ ID NO: 469548 - DNA, 20 bp, mouse
gccctgggtcgtcatgacag

SEQ ID NO: 469549 - DNA, 20 bp, mouse
ggcggcgaacgcgaggaagt

SEQ ID NO: 469550 - DNA, 20 bp, mouse
gagaacggcccgagatccag

SEQ ID NO: 469551 - DNA, 20 bp, mouse
gtaaaagtacccacaccctc

SEQ ID NO: 469552 - DNA, 20 bp, mouse
gctcgggccgttctagggta

SEQ ID NO: 469553 - DNA, 20 bp, mouse
gcctgcagaacgcaagcggc

SEQ ID NO: 469554 - DNA, 20 bp, mouse
gcgtgtcggagacttagacg

SEQ ID NO: 469555 - DNA, 20 bp, mouse
gcttacctgcagaacgcaag

SEQ ID NO: 469556 - DNA, 20 bp, mouse
gcctgtctgagggaacacga

SEQ ID NO: 469557 - DNA, 20 bp, mouse
gagcctccagcgcaagatgg

SEQ ID NO: 469558 - DNA, 20 bp, mouse
gcggcgtcggaggtcccagg

SEQ ID NO: 469559 - DNA, 20 bp, mouse
gcggctgcctcgctgatgaa

SEQ ID NO: 469560 - DNA, 20 bp, mouse
gggagttacctgagacgccg

SEQ ID NO: 469561 - DNA, 20 bp, mouse
gcacggcgcctcctccccct

SEQ ID NO: 469562 - DNA, 20 bp, mouse
gagcagcctccagcgcaaga

SEQ ID NO: 469563 - DNA, 20 bp, mouse
gacaagtggagcccgaagcc

SEQ ID NO: 469564 - DNA, 20 bp, mouse
gcagtttcggcgtgcagtgg

SEQ ID NO: 469565 - DNA, 20 bp, mouse
ggaggcccccagcacggcgt

SEQ ID NO: 469566 - DNA, 20 bp, mouse
gctcagagctgctgtcatgg

SEQ ID NO: 469567 - DNA, 20 bp, mouse
gccaggcacctccgagctgt

SEQ ID NO: 469568 - DNA, 20 bp, mouse
gtgtgctgggagaccttgag

SEQ ID NO: 469569 - DNA, 20 bp, mouse
gggagatgcccacagctcgg

SEQ ID NO: 469570 - DNA, 20 bp, mouse
gctctgaggagtcaggccta

SEQ ID NO: 469571 - DNA, 20 bp, mouse
gccttaagtgagcatcccga

SEQ ID NO: 469572 - DNA, 20 bp, mouse
gcggcccgagtgctggtaga

SEQ ID NO: 469573 - DNA, 20 bp, mouse
gtcctgataataacagaagc

SEQ ID NO: 469574 - DNA, 20 bp, mouse
gaggagtcaggcctacggcc

SEQ ID NO: 469575 - DNA, 20 bp, mouse
gatctccgcggcccgagtgc

SEQ ID NO: 469576 - DNA, 20 bp, mouse
gcggaggtgcgagagcgtca

SEQ ID NO: 469577 - DNA, 20 bp, mouse
ggtgcagcggagggtcgtgg

SEQ ID NO: 469578 - DNA, 20 bp, mouse
gagagcgtcacggcgtgcag

SEQ ID NO: 469579 - DNA, 20 bp, mouse
gcgtcacggcgtgcagcgga

SEQ ID NO: 469580 - DNA, 20 bp, mouse
ggcctcccgcctcagccggt

SEQ ID NO: 469581 - DNA, 20 bp, mouse
gtccggccgaccggctgagg

SEQ ID NO: 469582 - DNA, 20 bp, mouse
gcctggtggccgagaggcag

SEQ ID NO: 469583 - DNA, 20 bp, mouse
ggctctcgcacctccggccg

SEQ ID NO: 469584 - DNA, 20 bp, mouse
ggcagtccacgaagagcgtg

SEQ ID NO: 469585 - DNA, 20 bp, mouse
gctcgaccgcgagcttacca

SEQ ID NO: 469586 - DNA, 20 bp, mouse
gagtggtcgccaggcgtcag

SEQ ID NO: 469587 - DNA, 20 bp, mouse
gattctaccttgctagggac

SEQ ID NO: 469588 - DNA, 20 bp, mouse
gtcggtccaactgcaacggg

SEQ ID NO: 469589 - DNA, 20 bp, mouse
ggtaagatgcccctgacgcc

SEQ ID NO: 469590 - DNA, 20 bp, mouse
ggaggggcacacagtcggtg

SEQ ID NO: 469591 - DNA, 20 bp, mouse
gcccgggagtggctagagag

SEQ ID NO: 469592 - DNA, 20 bp, mouse
gaccgaattctaccttgcta

SEQ ID NO: 469593 - DNA, 20 bp, mouse
ggcggctccctgaccaccag

SEQ ID NO: 469594 - DNA, 20 bp, mouse
gtgtgcctcccttctcactt

SEQ ID NO: 469595 - DNA, 20 bp, mouse
gagaggggagtgattagagg

SEQ ID NO: 469596 - DNA, 20 bp, mouse
gggcttcactgtccagggta

SEQ ID NO: 469597 - DNA, 20 bp, mouse
gtgcctaccgatggtctcag

SEQ ID NO: 469598 - DNA, 20 bp, mouse
ggtccagggtaaggcaggga

SEQ ID NO: 469599 - DNA, 20 bp, mouse
gagccactgagaccatcggt

SEQ ID NO: 469600 - DNA, 20 bp, mouse
gtcagtggcttcactgtcca

SEQ ID NO: 469601 - DNA, 20 bp, mouse
gccaggccgtattagcaaat

SEQ ID NO: 469602 - DNA, 20 bp, mouse
gagtgaggacggcaaaggta

SEQ ID NO: 469603 - DNA, 20 bp, mouse
gccgtattagcaaatgggaa

SEQ ID NO: 469604 - DNA, 20 bp, mouse
gaggctcagttgatcctcgg

SEQ ID NO: 469605 - DNA, 20 bp, mouse
gctcatcagagaagcccccg

SEQ ID NO: 469606 - DNA, 20 bp, mouse
gcggccggggcctacagaca

SEQ ID NO: 469607 - DNA, 20 bp, mouse
gctctggcgcttcttcttct

SEQ ID NO: 469608 - DNA, 20 bp, mouse
ggaggagcgcgggaaagcag

SEQ ID NO: 469609 - DNA, 20 bp, mouse
gtcttcttctaggctccgag

SEQ ID NO: 469610 - DNA, 20 bp, mouse
ggagcaccccaagagcacaa

SEQ ID NO: 469611 - DNA, 20 bp, mouse
ggagcctcaagagcggctgt

SEQ ID NO: 469612 - DNA, 20 bp, mouse
ggcccaagaaaccaaccgct

SEQ ID NO: 469613 - DNA, 20 bp, mouse
gaagcggtgttgaacgccag

SEQ ID NO: 469614 - DNA, 20 bp, mouse
gggctgtgacgcaaatgtga

SEQ ID NO: 469615 - DNA, 20 bp, mouse
gcccatgagggatgttgtac

SEQ ID NO: 469616 - DNA, 20 bp, mouse
ggagtggcgggagcagtagc

SEQ ID NO: 469617 - DNA, 20 bp, mouse
gctagggagggaccagggtg

SEQ ID NO: 469618 - DNA, 20 bp, mouse
gcataaaccccaagagatct

SEQ ID NO: 469619 - DNA, 20 bp, mouse
gccactgcagaagtcgccgg

SEQ ID NO: 469620 - DNA, 20 bp, mouse
gcaggtgagcccagatctct

SEQ ID NO: 469621 - DNA, 20 bp, mouse
gcggacaattcaaagagtgg

SEQ ID NO: 469622 - DNA, 20 bp, mouse
gaaccacacgaaggtcccta

SEQ ID NO: 469623 - DNA, 20 bp, mouse
gcccatggtgaacctagata

SEQ ID NO: 469624 - DNA, 20 bp, mouse
gggtccactgcagaagtcgc

SEQ ID NO: 469625 - DNA, 20 bp, mouse
gcccggaagtagatctatcc

SEQ ID NO: 469626 - DNA, 20 bp, mouse
ggttggtcccgggagagtca

SEQ ID NO: 469627 - DNA, 20 bp, mouse
gaggaacgaaggacttatgg

SEQ ID NO: 469628 - DNA, 20 bp, mouse
gttcaggaacgaaggactta

SEQ ID NO: 469629 - DNA, 20 bp, mouse
gacgggcagatcaggttctg

SEQ ID NO: 469630 - DNA, 20 bp, mouse
gcggtctcgcgtctcggtcg

SEQ ID NO: 469631 - DNA, 20 bp, mouse
ggcccaggccgaacaagggg

SEQ ID NO: 469632 - DNA, 20 bp, mouse
gtggggccagccaccagaca

SEQ ID NO: 469633 - DNA, 20 bp, mouse
gtagtccgcactggagatgg

SEQ ID NO: 469634 - DNA, 20 bp, mouse
gcgtgtgaggcccgactaca

SEQ ID NO: 469635 - DNA, 20 bp, mouse
gtacccgcaagtcctggctg

SEQ ID NO: 469636 - DNA, 20 bp, mouse
gagatgtctgcggccagtgg

SEQ ID NO: 469637 - DNA, 20 bp, mouse
gtggcttccaacctcgtgag

SEQ ID NO: 469638 - DNA, 20 bp, mouse
gcgaggttggaagccaccac

SEQ ID NO: 469639 - DNA, 20 bp, mouse
gacaagatgtctgcggccag

SEQ ID NO: 469640 - DNA, 20 bp, mouse
gcaagccggagcttcttagg

SEQ ID NO: 469641 - DNA, 20 bp, mouse
gccccaagccggagcttctt

SEQ ID NO: 469642 - DNA, 20 bp, mouse
gaaatcgccgctcacgaggt

SEQ ID NO: 469643 - DNA, 20 bp, mouse
gttcagtgcaggagcaggac

SEQ ID NO: 469644 - DNA, 20 bp, mouse
gtacggaagcctctccggga

SEQ ID NO: 469645 - DNA, 20 bp, mouse
gaacagtgagtgcggaggta

SEQ ID NO: 469646 - DNA, 20 bp, mouse
ggcggtggggacgacagcat

SEQ ID NO: 469647 - DNA, 20 bp, mouse
ggtggggacgacagcatggg

SEQ ID NO: 469648 - DNA, 20 bp, mouse
gccgaggcagagcagcgtcc

SEQ ID NO: 469649 - DNA, 20 bp, mouse
ggagcagcgtccaggcccgc

SEQ ID NO: 469650 - DNA, 20 bp, mouse
gccccagtcgcgggattgta

SEQ ID NO: 469651 - DNA, 20 bp, mouse
gtgcaatcccgggacatcgg

SEQ ID NO: 469652 - DNA, 20 bp, mouse
ggcgcccgggacgctccacg

SEQ ID NO: 469653 - DNA, 20 bp, mouse
ggcctccgggatctcagtag

SEQ ID NO: 469654 - DNA, 20 bp, mouse
ggcgcagagccggttccggg

SEQ ID NO: 469655 - DNA, 20 bp, mouse
ggccctgctccgcccggaac

SEQ ID NO: 469656 - DNA, 20 bp, mouse
gtgctgcagtaggcaggaca

SEQ ID NO: 469657 - DNA, 20 bp, mouse
gctggccacccaggagagaa

SEQ ID NO: 469658 - DNA, 20 bp, mouse
ggcctctgtcttgttgttca

SEQ ID NO: 469659 - DNA, 20 bp, mouse
gcagtccctgtatcagagaa

SEQ ID NO: 469660 - DNA, 20 bp, mouse
ggggtggccagaggttcctt

SEQ ID NO: 469661 - DNA, 20 bp, mouse
gtaggcaggacagggtggac

SEQ ID NO: 469662 - DNA, 20 bp, mouse
ggccttgtgctgcagtaggc

SEQ ID NO: 469663 - DNA, 20 bp, mouse
gggctgctggggtcttggag

SEQ ID NO: 469664 - DNA, 20 bp, mouse
gctggacccaaaggaacctc

SEQ ID NO: 469665 - DNA, 20 bp, mouse
gagggaatcccaggcccttc

SEQ ID NO: 469666 - DNA, 20 bp, mouse
ggtcatcagggaacagaaca

SEQ ID NO: 469667 - DNA, 20 bp, mouse
gcccctcagaagtacagaag

SEQ ID NO: 469668 - DNA, 20 bp, mouse
gtcaggcccagcagccaagg

SEQ ID NO: 469669 - DNA, 20 bp, mouse
ggtactgtcccctgaagcag

SEQ ID NO: 469670 - DNA, 20 bp, mouse
gagaggcacaagagtgacca

SEQ ID NO: 469671 - DNA, 20 bp, mouse
ggaggagactggcccgccca

SEQ ID NO: 469672 - DNA, 20 bp, mouse
ggctccagctggccctcttc

SEQ ID NO: 469673 - DNA, 20 bp, mouse
gtccttaggatccagtcatc

SEQ ID NO: 469674 - DNA, 20 bp, mouse
gcacaagagtgaccatgggc

SEQ ID NO: 469675 - DNA, 20 bp, mouse
gtcccctggaagtgcggtat

SEQ ID NO: 469676 - DNA, 20 bp, mouse
gcgtggggacgaagagccag

SEQ ID NO: 469677 - DNA, 20 bp, mouse
gcgccgcctgcagccttgtg

SEQ ID NO: 469678 - DNA, 20 bp, mouse
gggagcacatggccacccgg

SEQ ID NO: 469679 - DNA, 20 bp, mouse
gacacatcttgagccccaca

SEQ ID NO: 469680 - DNA, 20 bp, mouse
ggagcgcccgagcccgctgc

SEQ ID NO: 469681 - DNA, 20 bp, mouse
gccctagagtcccagatcct

SEQ ID NO: 469682 - DNA, 20 bp, mouse
ggggctgggggcgagcataa

SEQ ID NO: 469683 - DNA, 20 bp, mouse
gcggccagtgcggaggcgtg

SEQ ID NO: 469684 - DNA, 20 bp, mouse
gtcattgagggaccgcggag

SEQ ID NO: 469685 - DNA, 20 bp, mouse
ggggaaccggcagcgggctc

SEQ ID NO: 469686 - DNA, 20 bp, mouse
ggccactcggcgggacgcag

SEQ ID NO: 469687 - DNA, 20 bp, mouse
gagtagccccggccactcgg

SEQ ID NO: 469688 - DNA, 20 bp, mouse
ggcagcggccgcacagctcc

SEQ ID NO: 469689 - DNA, 20 bp, mouse
gtcggccgcctggagctgtg

SEQ ID NO: 469690 - DNA, 20 bp, mouse
ggtgtagaggctgtaacggg

SEQ ID NO: 469691 - DNA, 20 bp, mouse
ggccactcgcgaccgacccc

SEQ ID NO: 469692 - DNA, 20 bp, mouse
ggtggccgcgggagcccgga

SEQ ID NO: 469693 - DNA, 20 bp, mouse
ggtcgcggcgctgctctcgg

SEQ ID NO: 469694 - DNA, 20 bp, mouse
ggccgctgcgtcccgccgag

SEQ ID NO: 469695 - DNA, 20 bp, mouse
ggcgagtagccccggccact

SEQ ID NO: 469696 - DNA, 20 bp, mouse
gtcggcagggcgcagtgtgt

SEQ ID NO: 469697 - DNA, 20 bp, mouse
gagcgtgggcgggaggacag

SEQ ID NO: 469698 - DNA, 20 bp, mouse
gcaggggcacggggaccgag

SEQ ID NO: 469699 - DNA, 20 bp, mouse
gtgggtgagcgcggccggag

SEQ ID NO: 469700 - DNA, 20 bp, mouse
gcggcccggcctcagcatgg

SEQ ID NO: 469701 - DNA, 20 bp, mouse
gcgcagtgtgtgggtgagcg

SEQ ID NO: 469702 - DNA, 20 bp, mouse
gggcgggaaccagagcgact

SEQ ID NO: 469703 - DNA, 20 bp, mouse
gcagcgaggacgtgtcgtac

SEQ ID NO: 469704 - DNA, 20 bp, mouse
gagagccccagcggatgcag

SEQ ID NO: 469705 - DNA, 20 bp, mouse
ggttctgcaacggtgagcgt

SEQ ID NO: 469706 - DNA, 20 bp, mouse
ggaggaggggtgctgaaaga

SEQ ID NO: 469707 - DNA, 20 bp, mouse
gtctcttcctgaggcgagaa

SEQ ID NO: 469708 - DNA, 20 bp, mouse
gttcctgaggcgagaagggc

SEQ ID NO: 469709 - DNA, 20 bp, mouse
gctaagacacaggcccagag

SEQ ID NO: 469710 - DNA, 20 bp, mouse
gtggaagaccggagtcacta

SEQ ID NO: 469711 - DNA, 20 bp, mouse
gattccaaaactactcatgg

SEQ ID NO: 469712 - DNA, 20 bp, mouse
gcagccgccatgagtagttt

SEQ ID NO: 469713 - DNA, 20 bp, mouse
ggccggtccgggctccaccc

SEQ ID NO: 469714 - DNA, 20 bp, mouse
gagggtcacacagcacgatg

SEQ ID NO: 469715 - DNA, 20 bp, mouse
gtgctgttgcctaggaggga

SEQ ID NO: 469716 - DNA, 20 bp, mouse
gcccctaggatgccctgtaa

SEQ ID NO: 469717 - DNA, 20 bp, mouse
ggacctgaagactgttgcgg

SEQ ID NO: 469718 - DNA, 20 bp, mouse
ggtctctcgacacccttaca

SEQ ID NO: 469719 - DNA, 20 bp, mouse
gacagtcttcaggtcaggat

SEQ ID NO: 469720 - DNA, 20 bp, mouse
ggggaccagacagtacctag

SEQ ID NO: 469721 - DNA, 20 bp, mouse
ggctgcgtcggggtccccct

SEQ ID NO: 469722 - DNA, 20 bp, mouse
ggcgttgctatggcaacggg

SEQ ID NO: 469723 - DNA, 20 bp, mouse
ggtcaggattggctgcgtcg

SEQ ID NO: 469724 - DNA, 20 bp, mouse
gacccttacagggcatccta

SEQ ID NO: 469725 - DNA, 20 bp, mouse
ggaggaggtaggtccaccct

SEQ ID NO: 469726 - DNA, 20 bp, mouse
gtgtttgtgctgcagcgcag

SEQ ID NO: 469727 - DNA, 20 bp, mouse
gtgctgcagcgcaggggctc

SEQ ID NO: 469728 - DNA, 20 bp, mouse
ggcagcgcaggggctccgga

SEQ ID NO: 469729 - DNA, 20 bp, mouse
gtctcggggttaggctcccg

SEQ ID NO: 469730 - DNA, 20 bp, mouse
gcacaaacaggcgcgggaca

SEQ ID NO: 469731 - DNA, 20 bp, mouse
ggctcccggggtgcggtgac

SEQ ID NO: 469732 - DNA, 20 bp, mouse
ggggttaggctcccggggtg

SEQ ID NO: 469733 - DNA, 20 bp, mouse
gcgagcacgccactagacag

SEQ ID NO: 469734 - DNA, 20 bp, mouse
ggagccgtgccacccctcgg

SEQ ID NO: 469735 - DNA, 20 bp, mouse
gctccgagcagcgtcgtcgg

SEQ ID NO: 469736 - DNA, 20 bp, mouse
gggcgcggcgctcacggctg

SEQ ID NO: 469737 - DNA, 20 bp, mouse
ggagggtcagtcggtcaatc

SEQ ID NO: 469738 - DNA, 20 bp, mouse
gcggcgcggcgcggcgctca

SEQ ID NO: 469739 - DNA, 20 bp, mouse
ggccgggcgacgctgagaac

SEQ ID NO: 469740 - DNA, 20 bp, mouse
ggtcagccccgagggtcagt

SEQ ID NO: 469741 - DNA, 20 bp, mouse
ggcggtccccgcaagatgga

SEQ ID NO: 469742 - DNA, 20 bp, mouse
gagggcccccgcactgaagg

SEQ ID NO: 469743 - DNA, 20 bp, mouse
gcccgcggccggactcaccg

SEQ ID NO: 469744 - DNA, 20 bp, mouse
ggggcgacgctgagaaccgg

SEQ ID NO: 469745 - DNA, 20 bp, mouse
gcagcgccccgaccgtgcgg

SEQ ID NO: 469746 - DNA, 20 bp, mouse
gggctgtggaggcgaggtag

SEQ ID NO: 469747 - DNA, 20 bp, mouse
ggcgccgcaggtgacccggg

SEQ ID NO: 469748 - DNA, 20 bp, mouse
gggcgaggtagcggctagac

SEQ ID NO: 469749 - DNA, 20 bp, mouse
gctcgcctccacagccccgg

SEQ ID NO: 469750 - DNA, 20 bp, mouse
ggccctcagcatgttcggtg

SEQ ID NO: 469751 - DNA, 20 bp, mouse
gcggagcgccgcaggtgacc

SEQ ID NO: 469752 - DNA, 20 bp, mouse
ggacaaccaagcgaagaggg

SEQ ID NO: 469753 - DNA, 20 bp, mouse
ggcctcaccgaacatgctga

SEQ ID NO: 469754 - DNA, 20 bp, mouse
gtcccgcccgtgggctgaag

SEQ ID NO: 469755 - DNA, 20 bp, mouse
gacgggtgggcgcaccgaca

SEQ ID NO: 469756 - DNA, 20 bp, mouse
ggacgcaaggccggcagcag

SEQ ID NO: 469757 - DNA, 20 bp, mouse
ggagatcctggacgcaaggc

SEQ ID NO: 469758 - DNA, 20 bp, mouse
gggcaggcagaggatttcgc

SEQ ID NO: 469759 - DNA, 20 bp, mouse
gagctagctatgagacccaa

SEQ ID NO: 469760 - DNA, 20 bp, mouse
gctacgtgcgaggctggtcc

SEQ ID NO: 469761 - DNA, 20 bp, mouse
ggctggctggtgcgagatcc

SEQ ID NO: 469762 - DNA, 20 bp, mouse
ggtgcgaggctggtccgggt

SEQ ID NO: 469763 - DNA, 20 bp, mouse
ggtgcgagatcctggacgca

SEQ ID NO: 469764 - DNA, 20 bp, mouse
ggctgacacccgggctccac

SEQ ID NO: 469765 - DNA, 20 bp, mouse
gtgggcgccaggttgagcat

SEQ ID NO: 469766 - DNA, 20 bp, mouse
gcagcctgctctaccaccca

SEQ ID NO: 469767 - DNA, 20 bp, mouse
gctggagtatccagtgagag

SEQ ID NO: 469768 - DNA, 20 bp, mouse
gagccatagagggatagcag

SEQ ID NO: 469769 - DNA, 20 bp, mouse
ggcttcaaggagcctaagag

SEQ ID NO: 469770 - DNA, 20 bp, mouse
gtgcctctgctatccctcta

SEQ ID NO: 469771 - DNA, 20 bp, mouse
gcgtagtagtggaggaatct

SEQ ID NO: 469772 - DNA, 20 bp, mouse
ggaatctgggatatcagtgg

SEQ ID NO: 469773 - DNA, 20 bp, mouse
gctggtctggtcctctcttc

SEQ ID NO: 469774 - DNA, 20 bp, mouse
gtagcttaacgtagtagtgg

SEQ ID NO: 469775 - DNA, 20 bp, mouse
ggagatttgcaaccacagtg

SEQ ID NO: 469776 - DNA, 20 bp, mouse
gggcgtctggacacagtggc

SEQ ID NO: 469777 - DNA, 20 bp, mouse
ggtcgcgcccccaactcacc

SEQ ID NO: 469778 - DNA, 20 bp, mouse
gcccgtgcccggtgagttgg

SEQ ID NO: 469779 - DNA, 20 bp, mouse
ggcgccacggagcccagacc

SEQ ID NO: 469780 - DNA, 20 bp, mouse
gggtctgcgccacagaaatc

SEQ ID NO: 469781 - DNA, 20 bp, mouse
gggcgaatgccacccagggg

SEQ ID NO: 469782 - DNA, 20 bp, mouse
gacgcccgtgcccggtgagt

SEQ ID NO: 469783 - DNA, 20 bp, mouse
gagtacaacaggcaacaagt

SEQ ID NO: 469784 - DNA, 20 bp, mouse
gagggactgcggtgacgtcg

SEQ ID NO: 469785 - DNA, 20 bp, mouse
gtgcttgacggggaagggtt

SEQ ID NO: 469786 - DNA, 20 bp, mouse
gtaaagccccatctgaataa

SEQ ID NO: 469787 - DNA, 20 bp, mouse
gcggggcaagaggcccaacg

SEQ ID NO: 469788 - DNA, 20 bp, mouse
gtgacttcttcagcaactct

SEQ ID NO: 469789 - DNA, 20 bp, mouse
gcggctctagacactcaggg

SEQ ID NO: 469790 - DNA, 20 bp, mouse
gccccggctctagacactca

SEQ ID NO: 469791 - DNA, 20 bp, mouse
ggggcctcagagtggaagga

SEQ ID NO: 469792 - DNA, 20 bp, mouse
gtctcctctggagctaagag

SEQ ID NO: 469793 - DNA, 20 bp, mouse
gaccatgggcggggcacctt

SEQ ID NO: 469794 - DNA, 20 bp, mouse
gaaggcagacggagaagggt

SEQ ID NO: 469795 - DNA, 20 bp, mouse
gagaagcagaaaaccaccag

SEQ ID NO: 469796 - DNA, 20 bp, mouse
gtttggctgctcctcttctg

SEQ ID NO: 469797 - DNA, 20 bp, mouse
gactgccacagtacgatgtg

SEQ ID NO: 469798 - DNA, 20 bp, mouse
gtagggaagtctattcacca

SEQ ID NO: 469799 - DNA, 20 bp, mouse
ggcatggatggctgaggtgt

SEQ ID NO: 469800 - DNA, 20 bp, mouse
gtatgggccgaacccctcca

SEQ ID NO: 469801 - DNA, 20 bp, mouse
ggctgagttgccaccatcag

SEQ ID NO: 469802 - DNA, 20 bp, mouse
gaaagccccacatcgtactg

SEQ ID NO: 469803 - DNA, 20 bp, mouse
ggagttgccaccatcagagg

SEQ ID NO: 469804 - DNA, 20 bp, mouse
ggctacaggaagatctaccc

SEQ ID NO: 469805 - DNA, 20 bp, mouse
gccatcagaggtggacagac

SEQ ID NO: 469806 - DNA, 20 bp, mouse
gttgctgctgagaatgttcc

SEQ ID NO: 469807 - DNA, 20 bp, mouse
gaactggccatagaaaatag

SEQ ID NO: 469808 - DNA, 20 bp, mouse
ggtacaaaatgaacttgcaa

SEQ ID NO: 469809 - DNA, 20 bp, mouse
gacgttgctagggacctata

SEQ ID NO: 469810 - DNA, 20 bp, mouse
gttcttgaaggattctgtgc

SEQ ID NO: 469811 - DNA, 20 bp, mouse
gagaaagaaagtggatgata

SEQ ID NO: 469812 - DNA, 20 bp, mouse
gaatccttcaagaaagaaag

SEQ ID NO: 469813 - DNA, 20 bp, mouse
ggtgagatatatctccatat

SEQ ID NO: 469814 - DNA, 20 bp, mouse
gttactttaatataattgtg

SEQ ID NO: 469815 - DNA, 20 bp, mouse
gtgttgatggtaatatgcac

SEQ ID NO: 469816 - DNA, 20 bp, mouse
ggagctagaaagatcacggg

SEQ ID NO: 469817 - DNA, 20 bp, mouse
gagtaagggagagatccagg

SEQ ID NO: 469818 - DNA, 20 bp, mouse
ggtcacagcttgattagtaa

SEQ ID NO: 469819 - DNA, 20 bp, mouse
gggaccagccaggagcgggg

SEQ ID NO: 469820 - DNA, 20 bp, mouse
gtccaggaggaccgctgaag

SEQ ID NO: 469821 - DNA, 20 bp, mouse
gattagtaagggagagatcc

SEQ ID NO: 469822 - DNA, 20 bp, mouse
gctactgagagccgcttcag

SEQ ID NO: 469823 - DNA, 20 bp, mouse
gctagaaagatcacgggcgg

SEQ ID NO: 469824 - DNA, 20 bp, mouse
ggctcctggctggtccgcaa

SEQ ID NO: 469825 - DNA, 20 bp, mouse
gcctgggctgcagctctgcg

SEQ ID NO: 469826 - DNA, 20 bp, mouse
gcgaggaccgaggagaatgg

SEQ ID NO: 469827 - DNA, 20 bp, mouse
ggcccaacctggagagaggg

SEQ ID NO: 469828 - DNA, 20 bp, mouse
gacgcgcccaacctggagag

SEQ ID NO: 469829 - DNA, 20 bp, mouse
gtggattgtccttggactta

SEQ ID NO: 469830 - DNA, 20 bp, mouse
gcctttgcaaaaggcgggca

SEQ ID NO: 469831 - DNA, 20 bp, mouse
gtctctcctttgcaaaaggc

SEQ ID NO: 469832 - DNA, 20 bp, mouse
gtactcgccctgaggtggaa

SEQ ID NO: 469833 - DNA, 20 bp, mouse
gtcccccctctctccaggtt

SEQ ID NO: 469834 - DNA, 20 bp, mouse
gaacatgctgcgccgaggag

SEQ ID NO: 469835 - DNA, 20 bp, mouse
ggccatttaccaggcttcgg

SEQ ID NO: 469836 - DNA, 20 bp, mouse
gggaaaagggagcccggcac

SEQ ID NO: 469837 - DNA, 20 bp, mouse
gaaagggagcccggcactgg

SEQ ID NO: 469838 - DNA, 20 bp, mouse
ggctgtcagagatttcaggg

SEQ ID NO: 469839 - DNA, 20 bp, mouse
gatcttcctaggcagtagag

SEQ ID NO: 469840 - DNA, 20 bp, mouse
ggcgcgtctccgccagtgcc

SEQ ID NO: 469841 - DNA, 20 bp, mouse
gatgcaggcggaaaaaagaa

SEQ ID NO: 469842 - DNA, 20 bp, mouse
gcagctgtgcccagagagcg

SEQ ID NO: 469843 - DNA, 20 bp, mouse
ggctgccagcctcgctctct

SEQ ID NO: 469844 - DNA, 20 bp, mouse
gttaatggggggataagcca

SEQ ID NO: 469845 - DNA, 20 bp, mouse
gcgggcccgctggcaaagtg

SEQ ID NO: 469846 - DNA, 20 bp, mouse
gcgagcccgcgcgaaagccg

SEQ ID NO: 469847 - DNA, 20 bp, mouse
ggcgaaagccgaggcagcga

SEQ ID NO: 469848 - DNA, 20 bp, mouse
ggcgcgcggaccgggaggga

SEQ ID NO: 469849 - DNA, 20 bp, mouse
gccgccagcacgcacatgga

SEQ ID NO: 469850 - DNA, 20 bp, mouse
gggtggcaacggccgagcag

SEQ ID NO: 469851 - DNA, 20 bp, mouse
ggctgcctcggctttcgcgc

SEQ ID NO: 469852 - DNA, 20 bp, mouse
gctgcccgagcgggcccgag

SEQ ID NO: 469853 - DNA, 20 bp, mouse
ggcgggccggggcgccccac

SEQ ID NO: 469854 - DNA, 20 bp, mouse
gtgtctcaggttgcgctaag

SEQ ID NO: 469855 - DNA, 20 bp, mouse
gcggtcccggccgaccctcg

SEQ ID NO: 469856 - DNA, 20 bp, mouse
gcgccgaggccgtgaggaac

SEQ ID NO: 469857 - DNA, 20 bp, mouse
gagcagctgccggttcctca

SEQ ID NO: 469858 - DNA, 20 bp, mouse
ggagcccggctctcctcccg

SEQ ID NO: 469859 - DNA, 20 bp, mouse
gctcggagcggcctctggag

SEQ ID NO: 469860 - DNA, 20 bp, mouse
ggccgagcgcgagcgaccac

SEQ ID NO: 469861 - DNA, 20 bp, mouse
gcagccgcgggaggagagcc

SEQ ID NO: 469862 - DNA, 20 bp, mouse
ggcgccgagcgggtccccgg

SEQ ID NO: 469863 - DNA, 20 bp, mouse
gtgccggttcctcacggcct

SEQ ID NO: 469864 - DNA, 20 bp, mouse
ggaggaggcggcgacgcagg

SEQ ID NO: 469865 - DNA, 20 bp, mouse
ggaagagaccctccgctcgg

SEQ ID NO: 469866 - DNA, 20 bp, mouse
gtcaagcctcctgacaagga

SEQ ID NO: 469867 - DNA, 20 bp, mouse
ggctatcaagcctcctgaca

SEQ ID NO: 469868 - DNA, 20 bp, mouse
gaaacaaaaattcttcaaga

SEQ ID NO: 469869 - DNA, 20 bp, mouse
gatctagtgcagcttctaag

SEQ ID NO: 469870 - DNA, 20 bp, mouse
gaagatccctccttgtcagg

SEQ ID NO: 469871 - DNA, 20 bp, mouse
gtttttatgttaagactttt

SEQ ID NO: 469872 - DNA, 20 bp, mouse
ggcagcttctaagtggcatt

SEQ ID NO: 469873 - DNA, 20 bp, mouse
gtttcaaagacaggttaaca

SEQ ID NO: 469874 - DNA, 20 bp, mouse
gaaggaggtcagagtagttt

SEQ ID NO: 469875 - DNA, 20 bp, mouse
gcaaaggtacagtgttaagg

SEQ ID NO: 469876 - DNA, 20 bp, mouse
gagagccagcggcgcgacgg

SEQ ID NO: 469877 - DNA, 20 bp, mouse
gcggaggcgctgcagagacc

SEQ ID NO: 469878 - DNA, 20 bp, mouse
gcccgcagggagccgacgaa

SEQ ID NO: 469879 - DNA, 20 bp, mouse
gctcagagccagcggcgcga

SEQ ID NO: 469880 - DNA, 20 bp, mouse
gaggtccgtagcagcagatc

SEQ ID NO: 469881 - DNA, 20 bp, mouse
ggagacccggagccgacgcc

SEQ ID NO: 469882 - DNA, 20 bp, mouse
ggcagcagatccggagaccg

SEQ ID NO: 469883 - DNA, 20 bp, mouse
gacccggagccgacgccagg

SEQ ID NO: 469884 - DNA, 20 bp, mouse
ggaacagagacgcccttcgt

SEQ ID NO: 469885 - DNA, 20 bp, mouse
gagcccgggagccactaccc

SEQ ID NO: 469886 - DNA, 20 bp, mouse
ggctagagcagggaagtccg

SEQ ID NO: 469887 - DNA, 20 bp, mouse
ggccgggcgccgctagagca

SEQ ID NO: 469888 - DNA, 20 bp, mouse
ggccgcgcagaggccgccat

SEQ ID NO: 469889 - DNA, 20 bp, mouse
gcagagccgccccgccagag

SEQ ID NO: 469890 - DNA, 20 bp, mouse
ggcctgcaacagccctgcca

SEQ ID NO: 469891 - DNA, 20 bp, mouse
ggcccatggcggcctctgcg

SEQ ID NO: 469892 - DNA, 20 bp, mouse
gcgcgaaacgcggagaacac

SEQ ID NO: 469893 - DNA, 20 bp, mouse
gtaagtggagactcccaccc

SEQ ID NO: 469894 - DNA, 20 bp, mouse
gacgtctgagcccaagagga

SEQ ID NO: 469895 - DNA, 20 bp, mouse
ggcggtgagcctctctggcg

SEQ ID NO: 469896 - DNA, 20 bp, mouse
ggcgcgcgcatgcctaccgg

SEQ ID NO: 469897 - DNA, 20 bp, mouse
gagcgtccttgtcctccggt

SEQ ID NO: 469898 - DNA, 20 bp, mouse
ggcatgcctaccggaggaca

SEQ ID NO: 469899 - DNA, 20 bp, mouse
ggcagcgcgcgcatgcctac

SEQ ID NO: 469900 - DNA, 20 bp, mouse
gcagtagcgtccttgtcctc

SEQ ID NO: 469901 - DNA, 20 bp, mouse
gagccccgcgcccagcgcta

SEQ ID NO: 469902 - DNA, 20 bp, mouse
gcggggaactggccaagtac

SEQ ID NO: 469903 - DNA, 20 bp, mouse
gcgcgcccagcgctagggtc

SEQ ID NO: 469904 - DNA, 20 bp, mouse
gggcagctgaagggcgtcgg

SEQ ID NO: 469905 - DNA, 20 bp, mouse
gtcgggggccacgccagcac

SEQ ID NO: 469906 - DNA, 20 bp, mouse
gcatgtggggcaactcaagt

SEQ ID NO: 469907 - DNA, 20 bp, mouse
ggagacaggggagccccttc

SEQ ID NO: 469908 - DNA, 20 bp, mouse
gaaactgctctattcatgtg

SEQ ID NO: 469909 - DNA, 20 bp, mouse
ggcccccaatctgacacagg

SEQ ID NO: 469910 - DNA, 20 bp, mouse
ggaaggacccccagagccag

SEQ ID NO: 469911 - DNA, 20 bp, mouse
ggcctcctgtgtcagattgg

SEQ ID NO: 469912 - DNA, 20 bp, mouse
ggctgggcttcctaccctgg

SEQ ID NO: 469913 - DNA, 20 bp, mouse
gcccctgggtgtccccatct

SEQ ID NO: 469914 - DNA, 20 bp, mouse
ggctttccaaggtcagatga

SEQ ID NO: 469915 - DNA, 20 bp, mouse
gccagcccccaatctgacac

SEQ ID NO: 469916 - DNA, 20 bp, mouse
gtgagggatacggctcatct

SEQ ID NO: 469917 - DNA, 20 bp, mouse
gacggccgctctgctgcagg

SEQ ID NO: 469918 - DNA, 20 bp, mouse
gaggatcggcctgagggata

SEQ ID NO: 469919 - DNA, 20 bp, mouse
gctgaagagcgagtgaccaa

SEQ ID NO: 469920 - DNA, 20 bp, mouse
ggccactataaaaggaacac

SEQ ID NO: 469921 - DNA, 20 bp, mouse
ggctgcaggtggcatcatga

SEQ ID NO: 469922 - DNA, 20 bp, mouse
gggcaggtcaaatggtccac

SEQ ID NO: 469923 - DNA, 20 bp, mouse
ggtgacgttcatcttgattg

SEQ ID NO: 469924 - DNA, 20 bp, mouse
gagagcatagccactataaa

SEQ ID NO: 469925 - DNA, 20 bp, mouse
gcagagtgctggggcataac

SEQ ID NO: 469926 - DNA, 20 bp, mouse
gtcctctggcggccgctcag

SEQ ID NO: 469927 - DNA, 20 bp, mouse
gacagcgacagggtttcctc

SEQ ID NO: 469928 - DNA, 20 bp, mouse
ggcgctagccatggctcaca

SEQ ID NO: 469929 - DNA, 20 bp, mouse
gggctcacacggccgctgag

SEQ ID NO: 469930 - DNA, 20 bp, mouse
gtctcggcgatgggaatccc

SEQ ID NO: 469931 - DNA, 20 bp, mouse
gagcctcgaggcgctagcca

SEQ ID NO: 469932 - DNA, 20 bp, mouse
ggcgacagggtttcctctgg

SEQ ID NO: 469933 - DNA, 20 bp, mouse
gcgctgtggaaagggtaatg

SEQ ID NO: 469934 - DNA, 20 bp, mouse
gtaccctttccacagcgaca

SEQ ID NO: 469935 - DNA, 20 bp, mouse
gggaccacgcccacaaaggc

SEQ ID NO: 469936 - DNA, 20 bp, mouse
ggagtctctagctgactggg

SEQ ID NO: 469937 - DNA, 20 bp, mouse
ggtggtgggaaagagtcact

SEQ ID NO: 469938 - DNA, 20 bp, mouse
gcagcagctgtcggcggtcc

SEQ ID NO: 469939 - DNA, 20 bp, mouse
ggttcgcgcggggatccgaa

SEQ ID NO: 469940 - DNA, 20 bp, mouse
gagagtcactgggctctttc

SEQ ID NO: 469941 - DNA, 20 bp, mouse
gtatccggtatccagaggta

SEQ ID NO: 469942 - DNA, 20 bp, mouse
ggggctcgagactcacagca

SEQ ID NO: 469943 - DNA, 20 bp, mouse
ggggtctgactgtcagggca

SEQ ID NO: 469944 - DNA, 20 bp, mouse
gtgtgtcccgtccccaggcc

SEQ ID NO: 469945 - DNA, 20 bp, mouse
ggaaggctggagcagggacg

SEQ ID NO: 469946 - DNA, 20 bp, mouse
gcggcagtcgctgacagtca

SEQ ID NO: 469947 - DNA, 20 bp, mouse
gacagtcatggagacctcgt

SEQ ID NO: 469948 - DNA, 20 bp, mouse
gccccgggtcagcaccgacg

SEQ ID NO: 469949 - DNA, 20 bp, mouse
gacctcgtcggtgctgaccc

SEQ ID NO: 469950 - DNA, 20 bp, mouse
ggctgacccggggagctgca

SEQ ID NO: 469951 - DNA, 20 bp, mouse
gggcgcgggaccagacggag

SEQ ID NO: 469952 - DNA, 20 bp, mouse
ggccagaacgagatcccgat

SEQ ID NO: 469953 - DNA, 20 bp, mouse
gtcccgcgcctgcttctccg

SEQ ID NO: 469954 - DNA, 20 bp, mouse
gtggctgttggagcagtgtc

SEQ ID NO: 469955 - DNA, 20 bp, mouse
gaagcaggcgcgggaccaga

SEQ ID NO: 469956 - DNA, 20 bp, mouse
gcgcgcaccgggctcaactc

SEQ ID NO: 469957 - DNA, 20 bp, mouse
gccgggctcaactcaggtaa

SEQ ID NO: 469958 - DNA, 20 bp, mouse
gttgtcccggaccctctcgc

SEQ ID NO: 469959 - DNA, 20 bp, mouse
gttcgaccctctgcccgtag

SEQ ID NO: 469960 - DNA, 20 bp, mouse
gcatggagacctgtccccga

SEQ ID NO: 469961 - DNA, 20 bp, mouse
gcccagggaaaggtacacct

SEQ ID NO: 469962 - DNA, 20 bp, mouse
ggtaaggggggctcccctac

SEQ ID NO: 469963 - DNA, 20 bp, mouse
gcgcgcccgcgagagggtcc

SEQ ID NO: 469964 - DNA, 20 bp, mouse
gtccatggggtcggtatcgg

SEQ ID NO: 469965 - DNA, 20 bp, mouse
ggtctccatggggtcggtat

SEQ ID NO: 469966 - DNA, 20 bp, mouse
gccccagcgagggctctcac

SEQ ID NO: 469967 - DNA, 20 bp, mouse
gccccgccaagccccagcga

SEQ ID NO: 469968 - DNA, 20 bp, mouse
gcctaccggcttgcaacagt

SEQ ID NO: 469969 - DNA, 20 bp, mouse
gaccggcttgcaacagttgg

SEQ ID NO: 469970 - DNA, 20 bp, mouse
gaagcaacagcaactcctac

SEQ ID NO: 469971 - DNA, 20 bp, mouse
gcggccgccggtagtagtcc

SEQ ID NO: 469972 - DNA, 20 bp, mouse
gcacccgacagggattagag

SEQ ID NO: 469973 - DNA, 20 bp, mouse
ggccctgcaacagtgcacca

SEQ ID NO: 469974 - DNA, 20 bp, mouse
gaggggcggcgaacccctct

SEQ ID NO: 469975 - DNA, 20 bp, mouse
gagggtggaagcacccgaca

SEQ ID NO: 469976 - DNA, 20 bp, mouse
gcaacaacgctaaacagact

SEQ ID NO: 469977 - DNA, 20 bp, mouse
gggagccgccccagcatcct

SEQ ID NO: 469978 - DNA, 20 bp, mouse
gaaaagggactgttacgaaa

SEQ ID NO: 469979 - DNA, 20 bp, mouse
gctgttacgaaagggtcaaa

SEQ ID NO: 469980 - DNA, 20 bp, mouse
gtacttgttaaggaattcct

SEQ ID NO: 469981 - DNA, 20 bp, mouse
gaggtcaacgatcttcctct

SEQ ID NO: 469982 - DNA, 20 bp, mouse
gaaatactctcggaagtgca

SEQ ID NO: 469983 - DNA, 20 bp, mouse
gcccagcatcctaggtatgt

SEQ ID NO: 469984 - DNA, 20 bp, mouse
ggcggctccttcaagtcact

SEQ ID NO: 469985 - DNA, 20 bp, mouse
gtcgtaacagtccctttttc

SEQ ID NO: 469986 - DNA, 20 bp, mouse
ggaggcgcttagtgctgctc

SEQ ID NO: 469987 - DNA, 20 bp, mouse
gaaggacgcaggctcttgga

SEQ ID NO: 469988 - DNA, 20 bp, mouse
gtggagacaaggaccatacc

SEQ ID NO: 469989 - DNA, 20 bp, mouse
gcttcgcttggggacccggt

SEQ ID NO: 469990 - DNA, 20 bp, mouse
gggctgacccgagtgctccc

SEQ ID NO: 469991 - DNA, 20 bp, mouse
gcgctatccggggagcactc

SEQ ID NO: 469992 - DNA, 20 bp, mouse
gctcgggtcagcctcgtgga

SEQ ID NO: 469993 - DNA, 20 bp, mouse
ggtccccaagcgaagctagt

SEQ ID NO: 469994 - DNA, 20 bp, mouse
gaactcggtgatcactggtg

SEQ ID NO: 469995 - DNA, 20 bp, mouse
gggctcccgcccaggctagt

SEQ ID NO: 469996 - DNA, 20 bp, mouse
gggactgcagactcagtcgg

SEQ ID NO: 469997 - DNA, 20 bp, mouse
gactcagtcggtggcgttgg

SEQ ID NO: 469998 - DNA, 20 bp, mouse
gcagtcggtggcgttggcgg

SEQ ID NO: 469999 - DNA, 20 bp, mouse
ggagagagcaggagtggcgg

SEQ ID NO: 470000 - DNA, 20 bp, mouse
gccagagatggagggtgcca

SEQ ID NO: 470001 - DNA, 20 bp, mouse
gcagactcagtcggtggcgt

SEQ ID NO: 470002 - DNA, 20 bp, mouse
ggtctgaggcagtcaaggaa

SEQ ID NO: 470003 - DNA, 20 bp, mouse
gcgatacgggcctcacctcg

SEQ ID NO: 470004 - DNA, 20 bp, mouse
gactgagtctgcagtcctcg

SEQ ID NO: 470005 - DNA, 20 bp, mouse
gggcggcaaggagcgagtaa

SEQ ID NO: 470006 - DNA, 20 bp, mouse
gtgagtggagtgtctcctct

SEQ ID NO: 470007 - DNA, 20 bp, mouse
gaaatgcccagtctgagagg

SEQ ID NO: 470008 - DNA, 20 bp, mouse
gtacttgagagaggtctggt

SEQ ID NO: 470009 - DNA, 20 bp, mouse
gctggagtccaggatttccc

SEQ ID NO: 470010 - DNA, 20 bp, mouse
gaaacctggaaagccttcct

SEQ ID NO: 470011 - DNA, 20 bp, mouse
ggttccaaggaaggctttcc

SEQ ID NO: 470012 - DNA, 20 bp, mouse
ggactccaggggcaacccca

SEQ ID NO: 470013 - DNA, 20 bp, mouse
gagagagcctggggtctagg

SEQ ID NO: 470014 - DNA, 20 bp, mouse
gtccaggggcaaccccacgg

SEQ ID NO: 470015 - DNA, 20 bp, mouse
gctcccctggacccaagaat

SEQ ID NO: 470016 - DNA, 20 bp, mouse
ggccctaagtctcctaccat

SEQ ID NO: 470017 - DNA, 20 bp, mouse
gtcccatggtaggagactta

SEQ ID NO: 470018 - DNA, 20 bp, mouse
gcgcagaggcgggatcacta

SEQ ID NO: 470019 - DNA, 20 bp, mouse
gctaccatgggagatgaaga

SEQ ID NO: 470020 - DNA, 20 bp, mouse
gccgccgtcttcatctccca

SEQ ID NO: 470021 - DNA, 20 bp, mouse
ggagacttagggctacagcg

SEQ ID NO: 470022 - DNA, 20 bp, mouse
gctccctctggcccacgctg

SEQ ID NO: 470023 - DNA, 20 bp, mouse
gccagcctgcggatgtctac

SEQ ID NO: 470024 - DNA, 20 bp, mouse
gtgtctacgggcacctggta

SEQ ID NO: 470025 - DNA, 20 bp, mouse
gaggacgctggcgggccccc

SEQ ID NO: 470026 - DNA, 20 bp, mouse
gtcgggtgtagtaccctagg

SEQ ID NO: 470027 - DNA, 20 bp, mouse
gggcgacagcgaacgaccag

SEQ ID NO: 470028 - DNA, 20 bp, mouse
gttgcagaggaagccgccta

SEQ ID NO: 470029 - DNA, 20 bp, mouse
ggcgcaggcccggaccacgt

SEQ ID NO: 470030 - DNA, 20 bp, mouse
gtcccgggcgcgccactcaa

SEQ ID NO: 470031 - DNA, 20 bp, mouse
ggagggcccagcaacaaccg

SEQ ID NO: 470032 - DNA, 20 bp, mouse
gccctgccggatgctaccac

SEQ ID NO: 470033 - DNA, 20 bp, mouse
gaccacgtgggcagccggag

SEQ ID NO: 470034 - DNA, 20 bp, mouse
gcagacgggagtcccttgag

SEQ ID NO: 470035 - DNA, 20 bp, mouse
gcaggtgccggggaagacaa

SEQ ID NO: 470036 - DNA, 20 bp, mouse
gtagcagcgcccgggagagt

SEQ ID NO: 470037 - DNA, 20 bp, mouse
ggacagaggacgccccgtgg

SEQ ID NO: 470038 - DNA, 20 bp, mouse
gcgggcgctgctactcacac

SEQ ID NO: 470039 - DNA, 20 bp, mouse
gccgctgctgccgcagacag

SEQ ID NO: 470040 - DNA, 20 bp, mouse
ggcagacagaggacgccccg

SEQ ID NO: 470041 - DNA, 20 bp, mouse
gggagagtgggatctgctca

SEQ ID NO: 470042 - DNA, 20 bp, mouse
gaggggcgctggagactccg

SEQ ID NO: 470043 - DNA, 20 bp, mouse
gaggagacgccgaggcaagg

SEQ ID NO: 470044 - DNA, 20 bp, mouse
gcgatcgggaggagacgccg

SEQ ID NO: 470045 - DNA, 20 bp, mouse
gaccgggaaccccccatggg

SEQ ID NO: 470046 - DNA, 20 bp, mouse
gggttgggaagacagttgtg

SEQ ID NO: 470047 - DNA, 20 bp, mouse
gtagtagaaggtgcacggtt

SEQ ID NO: 470048 - DNA, 20 bp, mouse
gcccggagtgccctcagggt

SEQ ID NO: 470049 - DNA, 20 bp, mouse
gtggacccggagtgccctca

SEQ ID NO: 470050 - DNA, 20 bp, mouse
ggcctaggccatctagtaga

SEQ ID NO: 470051 - DNA, 20 bp, mouse
ggggtccaggaacttccgag

SEQ ID NO: 470052 - DNA, 20 bp, mouse
gccccaccctgagggcactc

SEQ ID NO: 470053 - DNA, 20 bp, mouse
gccatctagtagaaggtgca

SEQ ID NO: 470054 - DNA, 20 bp, mouse
ggtgggaccgagggggtcta

SEQ ID NO: 470055 - DNA, 20 bp, mouse
ggcgaggcagaaagcccgag

SEQ ID NO: 470056 - DNA, 20 bp, mouse
gggccactccaggatgaatg

SEQ ID NO: 470057 - DNA, 20 bp, mouse
gaatgcggagaccaaggagt

SEQ ID NO: 470058 - DNA, 20 bp, mouse
gagagaagctgacttgaagg

SEQ ID NO: 470059 - DNA, 20 bp, mouse
gaggatgaatgcggagacca

SEQ ID NO: 470060 - DNA, 20 bp, mouse
gggaggactgatgagaatgt

SEQ ID NO: 470061 - DNA, 20 bp, mouse
gggtggggacgagcaggacc

SEQ ID NO: 470062 - DNA, 20 bp, mouse
gcatcctggagtggccggtg

SEQ ID NO: 470063 - DNA, 20 bp, mouse
gcgtccccaccggccactcc

SEQ ID NO: 470064 - DNA, 20 bp, mouse
gatcatctgtggagtagtgg

SEQ ID NO: 470065 - DNA, 20 bp, mouse
ggtgtaacatctgacttcgg

SEQ ID NO: 470066 - DNA, 20 bp, mouse
ggcgcgacggcgaccaggca

SEQ ID NO: 470067 - DNA, 20 bp, mouse
ggcgacccgacacccgggag

SEQ ID NO: 470068 - DNA, 20 bp, mouse
gagggcacgggccccggcac

SEQ ID NO: 470069 - DNA, 20 bp, mouse
gggcacgggtcagcgggaaa

SEQ ID NO: 470070 - DNA, 20 bp, mouse
gatggagcgcgacggcgacc

SEQ ID NO: 470071 - DNA, 20 bp, mouse
gcggcgaccaggcagggcac

SEQ ID NO: 470072 - DNA, 20 bp, mouse
gacccggcatgggagagcgt

SEQ ID NO: 470073 - DNA, 20 bp, mouse
ggcgcccatggacctaggag

SEQ ID NO: 470074 - DNA, 20 bp, mouse
gattaaagctcggcccgcgg

SEQ ID NO: 470075 - DNA, 20 bp, mouse
gccaggcagggcacgggccc

SEQ ID NO: 470076 - DNA, 20 bp, mouse
gccctcggcatggcaagaca

SEQ ID NO: 470077 - DNA, 20 bp, mouse
gcccgaaagcagagcattca

SEQ ID NO: 470078 - DNA, 20 bp, mouse
gaccaggtaggaggatggta

SEQ ID NO: 470079 - DNA, 20 bp, mouse
gtgccatgccgagggattct

SEQ ID NO: 470080 - DNA, 20 bp, mouse
gttccaagaatccctcggca

SEQ ID NO: 470081 - DNA, 20 bp, mouse
gaggttttccaagaatccct

SEQ ID NO: 470082 - DNA, 20 bp, mouse
gtcccacctgggaagttgac

SEQ ID NO: 470083 - DNA, 20 bp, mouse
gggtagtgatcggagagatt

SEQ ID NO: 470084 - DNA, 20 bp, mouse
ggaatcctgccaattcggaa

SEQ ID NO: 470085 - DNA, 20 bp, mouse
ggccttgtcttgccatgccg

SEQ ID NO: 470086 - DNA, 20 bp, mouse
gcctgtctagccagaaaata

SEQ ID NO: 470087 - DNA, 20 bp, mouse
gcaagcaagcctaagtggga

SEQ ID NO: 470088 - DNA, 20 bp, mouse
gtacacagctacgggaacaa

SEQ ID NO: 470089 - DNA, 20 bp, mouse
gcaagcctaagtgggaaggc

SEQ ID NO: 470090 - DNA, 20 bp, mouse
ggacacaagcaagcctaagt

SEQ ID NO: 470091 - DNA, 20 bp, mouse
gagacaggtttacacagcta

SEQ ID NO: 470092 - DNA, 20 bp, mouse
gagtgcctgccttcccactt

SEQ ID NO: 470093 - DNA, 20 bp, mouse
gttcttaatgggctcctctg

SEQ ID NO: 470094 - DNA, 20 bp, mouse
gtacgggaacaatggattcc

SEQ ID NO: 470095 - DNA, 20 bp, mouse
gtgagactgtctttcttaat

SEQ ID NO: 470096 - DNA, 20 bp, mouse
ggcgtccgccgaccagatag

SEQ ID NO: 470097 - DNA, 20 bp, mouse
gctcccggccactatctggt

SEQ ID NO: 470098 - DNA, 20 bp, mouse
gcgcgctcccggccactatc

SEQ ID NO: 470099 - DNA, 20 bp, mouse
ggcgcgccagaccgaagtgg

SEQ ID NO: 470100 - DNA, 20 bp, mouse
gtccgcgcgccagaccgaag

SEQ ID NO: 470101 - DNA, 20 bp, mouse
gggggaggaggagcatacgg

SEQ ID NO: 470102 - DNA, 20 bp, mouse
gctccaccgccacttcggtc

SEQ ID NO: 470103 - DNA, 20 bp, mouse
gcgtcccaggaagcgctccg

SEQ ID NO: 470104 - DNA, 20 bp, mouse
gggcaggtggatgtcaactg

SEQ ID NO: 470105 - DNA, 20 bp, mouse
gccctcggcgagctggggaa

SEQ ID NO: 470106 - DNA, 20 bp, mouse
gaacgtttgggaccaagagg

SEQ ID NO: 470107 - DNA, 20 bp, mouse
gtgcgtgcaggtgagcgaac

SEQ ID NO: 470108 - DNA, 20 bp, mouse
gcagaaacaaggggcactgt

SEQ ID NO: 470109 - DNA, 20 bp, mouse
gcgggctgcagcgacgagtc

SEQ ID NO: 470110 - DNA, 20 bp, mouse
ggaggagtgggcttatgtca

SEQ ID NO: 470111 - DNA, 20 bp, mouse
gccggtgacagccccagtgt

SEQ ID NO: 470112 - DNA, 20 bp, mouse
gtagcaaccccgtagagaag

SEQ ID NO: 470113 - DNA, 20 bp, mouse
gtggaacgtttgggaccaag

SEQ ID NO: 470114 - DNA, 20 bp, mouse
gtcagggtgtttgccagggt

SEQ ID NO: 470115 - DNA, 20 bp, mouse
gccccagtgtgggcctctgg

SEQ ID NO: 470116 - DNA, 20 bp, mouse
gcagctgtgccagctcaccc

SEQ ID NO: 470117 - DNA, 20 bp, mouse
gaacaccaggagcttccggt

SEQ ID NO: 470118 - DNA, 20 bp, mouse
gaggtactcaccagtcatga

SEQ ID NO: 470119 - DNA, 20 bp, mouse
ggtagtaattgggataggag

SEQ ID NO: 470120 - DNA, 20 bp, mouse
gtcagagagattgtgaacag

SEQ ID NO: 470121 - DNA, 20 bp, mouse
gaactccagactccatcctc

SEQ ID NO: 470122 - DNA, 20 bp, mouse
gcccttgcaaagcctgagga

SEQ ID NO: 470123 - DNA, 20 bp, mouse
gagggtgtagtaattgggat

SEQ ID NO: 470124 - DNA, 20 bp, mouse
ggctttgctgccatgctgcc

SEQ ID NO: 470125 - DNA, 20 bp, mouse
gcagtctgaaataggtcctt

SEQ ID NO: 470126 - DNA, 20 bp, mouse
gcccatgaccggctctcagg

SEQ ID NO: 470127 - DNA, 20 bp, mouse
gcagctgagtgtcccatgac

SEQ ID NO: 470128 - DNA, 20 bp, mouse
ggccgcctgagagccggtca

SEQ ID NO: 470129 - DNA, 20 bp, mouse
gtgtcccatgaccggctctc

SEQ ID NO: 470130 - DNA, 20 bp, mouse
ggggctggtcatggtgacaa

SEQ ID NO: 470131 - DNA, 20 bp, mouse
gtcagctgtccttctctgtg

SEQ ID NO: 470132 - DNA, 20 bp, mouse
gggactccatggctcaggaa

SEQ ID NO: 470133 - DNA, 20 bp, mouse
ggaccaggtgccaccaacag

SEQ ID NO: 470134 - DNA, 20 bp, mouse
gctctcaggcggctcaggcc

SEQ ID NO: 470135 - DNA, 20 bp, mouse
gaggagtggagcaaagtccc

SEQ ID NO: 470136 - DNA, 20 bp, mouse
gagtcagccggaaaagggaa

SEQ ID NO: 470137 - DNA, 20 bp, mouse
gcgggaagtcagccggaaaa

SEQ ID NO: 470138 - DNA, 20 bp, mouse
gtctgcctcaggctgtacag

SEQ ID NO: 470139 - DNA, 20 bp, mouse
gggttgctcagtcaaaatgg

SEQ ID NO: 470140 - DNA, 20 bp, mouse
gcggcgaggagaagcaggtg

SEQ ID NO: 470141 - DNA, 20 bp, mouse
ggcctgcgcgacattagtag

SEQ ID NO: 470142 - DNA, 20 bp, mouse
gcagggcccgggaagtcagc

SEQ ID NO: 470143 - DNA, 20 bp, mouse
gccaacccctgtacagcctg

SEQ ID NO: 470144 - DNA, 20 bp, mouse
ggagaccggcgaggagaagc

SEQ ID NO: 470145 - DNA, 20 bp, mouse
gggcggccaatcagcggcag

SEQ ID NO: 470146 - DNA, 20 bp, mouse
gagctacagtgagtctgagg

SEQ ID NO: 470147 - DNA, 20 bp, mouse
gtgtagctatgtcattcagg

SEQ ID NO: 470148 - DNA, 20 bp, mouse
ggcgatgggtcaggagtgac

SEQ ID NO: 470149 - DNA, 20 bp, mouse
gtgggtgagagcgatgggtc

SEQ ID NO: 470150 - DNA, 20 bp, mouse
gggaggtgggtgagagcgat

SEQ ID NO: 470151 - DNA, 20 bp, mouse
gagagctagaggggccccag

SEQ ID NO: 470152 - DNA, 20 bp, mouse
gggagatcatgcacatgctg

SEQ ID NO: 470153 - DNA, 20 bp, mouse
ggcagcgactcagcgaccac

SEQ ID NO: 470154 - DNA, 20 bp, mouse
gttgatgaggtagtccatca

SEQ ID NO: 470155 - DNA, 20 bp, mouse
ggtggcgccagttcttcccg

SEQ ID NO: 470156 - DNA, 20 bp, mouse
gagctcaagcggtcccgcag

SEQ ID NO: 470157 - DNA, 20 bp, mouse
gtcaagcggtcccgcagggg

SEQ ID NO: 470158 - DNA, 20 bp, mouse
gcctatgcaagaagctcaag

SEQ ID NO: 470159 - DNA, 20 bp, mouse
gcgccggaggtcagcacacc

SEQ ID NO: 470160 - DNA, 20 bp, mouse
gagcagaaggttaaccccaa

SEQ ID NO: 470161 - DNA, 20 bp, mouse
gggcacagctgccatggtcc

SEQ ID NO: 470162 - DNA, 20 bp, mouse
gagcctaagaagggtccctg

SEQ ID NO: 470163 - DNA, 20 bp, mouse
gggcagtttgggaggttacc

SEQ ID NO: 470164 - DNA, 20 bp, mouse
gggcggcgggcgatctccag

SEQ ID NO: 470165 - DNA, 20 bp, mouse
gggcagctgtgccgcccctg

SEQ ID NO: 470166 - DNA, 20 bp, mouse
gaaacacccaagacagacga

SEQ ID NO: 470167 - DNA, 20 bp, mouse
gtctgcgagagaggtactca

SEQ ID NO: 470168 - DNA, 20 bp, mouse
gtcgacttcagcctactcca

SEQ ID NO: 470169 - DNA, 20 bp, mouse
gctcttccctcgtctgtctt

SEQ ID NO: 470170 - DNA, 20 bp, mouse
gcctttatatcttccataag

SEQ ID NO: 470171 - DNA, 20 bp, mouse
ggagtacttgaaagaaccaa

SEQ ID NO: 470172 - DNA, 20 bp, mouse
ggtctggagtcatctagtgt

SEQ ID NO: 470173 - DNA, 20 bp, mouse
gagcagctagctctcggtcc

SEQ ID NO: 470174 - DNA, 20 bp, mouse
gaatgctgtaagctgtgtgg

SEQ ID NO: 470175 - DNA, 20 bp, mouse
gctctttaggtacagaggac

SEQ ID NO: 470176 - DNA, 20 bp, mouse
gcacgcgggagaacacagca

SEQ ID NO: 470177 - DNA, 20 bp, mouse
gtccagccatgggagcacgc

SEQ ID NO: 470178 - DNA, 20 bp, mouse
gagcagggaccccggacagc

SEQ ID NO: 470179 - DNA, 20 bp, mouse
ggttctcccgcgtgctccca

SEQ ID NO: 470180 - DNA, 20 bp, mouse
ggtgagcgcgagcaccttga

SEQ ID NO: 470181 - DNA, 20 bp, mouse
gtggccggggccccagagtt

SEQ ID NO: 470182 - DNA, 20 bp, mouse
ggccccggagcctaactctg

SEQ ID NO: 470183 - DNA, 20 bp, mouse
gacaccaactttccagccat

SEQ ID NO: 470184 - DNA, 20 bp, mouse
gggtgggagggccttaacgt

SEQ ID NO: 470185 - DNA, 20 bp, mouse
gcagcaggcagcgggaggcc

SEQ ID NO: 470186 - DNA, 20 bp, mouse
ggcggggccagaccttacct

SEQ ID NO: 470187 - DNA, 20 bp, mouse
gcgaaagcagcgcccaggta

SEQ ID NO: 470188 - DNA, 20 bp, mouse
ggcagcgcccaggtaaggtc

SEQ ID NO: 470189 - DNA, 20 bp, mouse
gctggactcccgcaccccag

SEQ ID NO: 470190 - DNA, 20 bp, mouse
gtggccccgcgcgcaggagt

SEQ ID NO: 470191 - DNA, 20 bp, mouse
ggcgggttgctgaaaagcgg

SEQ ID NO: 470192 - DNA, 20 bp, mouse
gaaaagcggaggcgcctctg

SEQ ID NO: 470193 - DNA, 20 bp, mouse
gctgggcgctgctttcgctg

SEQ ID NO: 470194 - DNA, 20 bp, mouse
gtccaggaggcggagcgagg

SEQ ID NO: 470195 - DNA, 20 bp, mouse
gagacagctgtcaggccctg

SEQ ID NO: 470196 - DNA, 20 bp, mouse
gagtatggggaggtgagtgg

SEQ ID NO: 470197 - DNA, 20 bp, mouse
gttcagtatggggaggtgag

SEQ ID NO: 470198 - DNA, 20 bp, mouse
gcttaagagagaagacaatc

SEQ ID NO: 470199 - DNA, 20 bp, mouse
gttgccctttcagtatgggg

SEQ ID NO: 470200 - DNA, 20 bp, mouse
gcttcagcatcaaaatctca

SEQ ID NO: 470201 - DNA, 20 bp, mouse
ggaaagggcaagcaaggtcc

SEQ ID NO: 470202 - DNA, 20 bp, mouse
gttgcttgccctttcagtat

SEQ ID NO: 470203 - DNA, 20 bp, mouse
gtctaactcccaagagagaa

SEQ ID NO: 470204 - DNA, 20 bp, mouse
gtcaaaatctcagggtttac

SEQ ID NO: 470205 - DNA, 20 bp, mouse
gagagagaagacaatcgggc

SEQ ID NO: 470206 - DNA, 20 bp, mouse
gcgccgcgtggctcccggaa

SEQ ID NO: 470207 - DNA, 20 bp, mouse
gccggccaccagctttccgg

SEQ ID NO: 470208 - DNA, 20 bp, mouse
ggtgaggcccgggtcccgag

SEQ ID NO: 470209 - DNA, 20 bp, mouse
ggggtcaggacgctccgaag

SEQ ID NO: 470210 - DNA, 20 bp, mouse
gcggaaaggagccgaacctc

SEQ ID NO: 470211 - DNA, 20 bp, mouse
gagctggtggccgggatgcg

SEQ ID NO: 470212 - DNA, 20 bp, mouse
gcgaacctccggaaagctgg

SEQ ID NO: 470213 - DNA, 20 bp, mouse
gccgggatgcggggcgctag

SEQ ID NO: 470214 - DNA, 20 bp, mouse
ggcgagctgtgacgtgacgt

SEQ ID NO: 470215 - DNA, 20 bp, mouse
gagccgaacctccggaaagc

SEQ ID NO: 470216 - DNA, 20 bp, mouse
ggagtgtgcacgagcctcgg

SEQ ID NO: 470217 - DNA, 20 bp, mouse
gggcggagatcgctccgagg

SEQ ID NO: 470218 - DNA, 20 bp, mouse
gcccgcccggctccaacccc

SEQ ID NO: 470219 - DNA, 20 bp, mouse
gcgcgcgcgccgccctggcg

SEQ ID NO: 470220 - DNA, 20 bp, mouse
gcgccccgcgcgcatcggag

SEQ ID NO: 470221 - DNA, 20 bp, mouse
ggcggcgggcgtccgcgcca

SEQ ID NO: 470222 - DNA, 20 bp, mouse
ggaggccgggagctcggcag

SEQ ID NO: 470223 - DNA, 20 bp, mouse
gagcctcggcggcgctcccg

SEQ ID NO: 470224 - DNA, 20 bp, mouse
ggagctcccggcctcccgcc

SEQ ID NO: 470225 - DNA, 20 bp, mouse
gggggcgcgagacaagtcgt

SEQ ID NO: 470226 - DNA, 20 bp, mouse
gggagctggtgagtacccga

SEQ ID NO: 470227 - DNA, 20 bp, mouse
gtggtgctcctggtgaactc

SEQ ID NO: 470228 - DNA, 20 bp, mouse
ggcactcacagcaaacaggc

SEQ ID NO: 470229 - DNA, 20 bp, mouse
gaggaggccccggctccctc

SEQ ID NO: 470230 - DNA, 20 bp, mouse
gccccagtcctgtagaatag

SEQ ID NO: 470231 - DNA, 20 bp, mouse
ggtgagtgcctgagttcacc

SEQ ID NO: 470232 - DNA, 20 bp, mouse
gggtgagtacccgagggagc

SEQ ID NO: 470233 - DNA, 20 bp, mouse
gcctgctccggtcttttcaa

SEQ ID NO: 470234 - DNA, 20 bp, mouse
gccggggcctcctgcattgt

SEQ ID NO: 470235 - DNA, 20 bp, mouse
gataggggatcctacaatgc

SEQ ID NO: 470236 - DNA, 20 bp, mouse
gggccccgcaggagaggtag

SEQ ID NO: 470237 - DNA, 20 bp, mouse
gggtgacgcaaagtgcacgt

SEQ ID NO: 470238 - DNA, 20 bp, mouse
gagggctgtgggctacactc

SEQ ID NO: 470239 - DNA, 20 bp, mouse
gtggcccggaggactgacta

SEQ ID NO: 470240 - DNA, 20 bp, mouse
ggaggtagtggcgtagccgg

SEQ ID NO: 470241 - DNA, 20 bp, mouse
gtccctcggccccgcaggag

SEQ ID NO: 470242 - DNA, 20 bp, mouse
gccgggcccagggaggtatc

SEQ ID NO: 470243 - DNA, 20 bp, mouse
ggacgcaaagtgcacgtagg

SEQ ID NO: 470244 - DNA, 20 bp, mouse
ggagccgtgcagggtaagcg

SEQ ID NO: 470245 - DNA, 20 bp, mouse
gaggctctgttgacgcggac

SEQ ID NO: 470246 - DNA, 20 bp, mouse
ggagccactgggaaccgctg

SEQ ID NO: 470247 - DNA, 20 bp, mouse
gggctgtgcagagggacgag

SEQ ID NO: 470248 - DNA, 20 bp, mouse
gctcccgcaatcccactcac

SEQ ID NO: 470249 - DNA, 20 bp, mouse
gtgaggaccaggaccaggcc

SEQ ID NO: 470250 - DNA, 20 bp, mouse
gggtcctcagcggttcccag

SEQ ID NO: 470251 - DNA, 20 bp, mouse
ggagagctgcgggacggata

SEQ ID NO: 470252 - DNA, 20 bp, mouse
gggaggagagagaagcgaca

SEQ ID NO: 470253 - DNA, 20 bp, mouse
gcccactcacgggaatcccg

SEQ ID NO: 470254 - DNA, 20 bp, mouse
ggatcctctgggcccgtggg

SEQ ID NO: 470255 - DNA, 20 bp, mouse
gggagtgagggtcagtacag

SEQ ID NO: 470256 - DNA, 20 bp, mouse
gtgcaggtgagcgacctcag

SEQ ID NO: 470257 - DNA, 20 bp, mouse
gcagaccaggacagcccctg

SEQ ID NO: 470258 - DNA, 20 bp, mouse
gcccctcactcacccaggaa

SEQ ID NO: 470259 - DNA, 20 bp, mouse
ggaggtcgctcacctgcact

SEQ ID NO: 470260 - DNA, 20 bp, mouse
ggtatgacacccctgaggtg

SEQ ID NO: 470261 - DNA, 20 bp, mouse
gggctcccctcacccaggac

SEQ ID NO: 470262 - DNA, 20 bp, mouse
gccaaagcacagggacaagt

SEQ ID NO: 470263 - DNA, 20 bp, mouse
gcctagggacaggctaaatg

SEQ ID NO: 470264 - DNA, 20 bp, mouse
gcacagccccaggttcaagt

SEQ ID NO: 470265 - DNA, 20 bp, mouse
gctcaggtatgacacccctg

SEQ ID NO: 470266 - DNA, 20 bp, mouse
gctactgagggtctaagtcc

SEQ ID NO: 470267 - DNA, 20 bp, mouse
gtaggtgcccgagctactga

SEQ ID NO: 470268 - DNA, 20 bp, mouse
gggcagccgaagagtgtggt

SEQ ID NO: 470269 - DNA, 20 bp, mouse
gtccgggcagccgaagagtg

SEQ ID NO: 470270 - DNA, 20 bp, mouse
gcgaagagtgtggtaggtaa

SEQ ID NO: 470271 - DNA, 20 bp, mouse
gtcccggccctgaggaccac

SEQ ID NO: 470272 - DNA, 20 bp, mouse
gcctgtagggctctccgaca

SEQ ID NO: 470273 - DNA, 20 bp, mouse
gacagctggagaggcgggag

SEQ ID NO: 470274 - DNA, 20 bp, mouse
gcttagaccctcagtagctc

SEQ ID NO: 470275 - DNA, 20 bp, mouse
gtagctcaccaccatcaccg

SEQ ID NO: 470276 - DNA, 20 bp, mouse
gctgcagcttgactagggag

SEQ ID NO: 470277 - DNA, 20 bp, mouse
gcagcttgactagggagcgg

SEQ ID NO: 470278 - DNA, 20 bp, mouse
gcccacctgcagcttgacta

SEQ ID NO: 470279 - DNA, 20 bp, mouse
gcttgactagggagcggcgg

SEQ ID NO: 470280 - DNA, 20 bp, mouse
gggccaggaacaggcgggga

SEQ ID NO: 470281 - DNA, 20 bp, mouse
ggcaggcgccggccaggaac

SEQ ID NO: 470282 - DNA, 20 bp, mouse
gcgccggccaggaacaggcg

SEQ ID NO: 470283 - DNA, 20 bp, mouse
gcatggggatcgaggcaaca

SEQ ID NO: 470284 - DNA, 20 bp, mouse
gggctgactccgctacacag

SEQ ID NO: 470285 - DNA, 20 bp, mouse
ggaacaggcggggaaggcgc

SEQ ID NO: 470286 - DNA, 20 bp, mouse
gccagccgagaggaaatggc

SEQ ID NO: 470287 - DNA, 20 bp, mouse
gtgagtgtaggggtcctgag

SEQ ID NO: 470288 - DNA, 20 bp, mouse
ggctggctctgctaaactct

SEQ ID NO: 470289 - DNA, 20 bp, mouse
ggcaaccagccatttcctct

SEQ ID NO: 470290 - DNA, 20 bp, mouse
gtttagcagagccagccgag

SEQ ID NO: 470291 - DNA, 20 bp, mouse
gactcacactaaggaagaag

SEQ ID NO: 470292 - DNA, 20 bp, mouse
gcaggccgcgggaggcgagg

SEQ ID NO: 470293 - DNA, 20 bp, mouse
ggagagacacctacaacccg

SEQ ID NO: 470294 - DNA, 20 bp, mouse
gccctcaagggaacaaactc

SEQ ID NO: 470295 - DNA, 20 bp, mouse
ggccagcgccctcttccgag

SEQ ID NO: 470296 - DNA, 20 bp, mouse
gctatcctgtaaggaggatt

SEQ ID NO: 470297 - DNA, 20 bp, mouse
ggagagagcggagagggacc

SEQ ID NO: 470298 - DNA, 20 bp, mouse
gaggaggagagagagcggag

SEQ ID NO: 470299 - DNA, 20 bp, mouse
gtgtgtgctagcctgtgggg

SEQ ID NO: 470300 - DNA, 20 bp, mouse
gccgctaccgctatcctgta

SEQ ID NO: 470301 - DNA, 20 bp, mouse
gctaccgctatcctgtaagg

SEQ ID NO: 470302 - DNA, 20 bp, mouse
gcgcgagcagggagtgagga

SEQ ID NO: 470303 - DNA, 20 bp, mouse
gtcgcgcagcggacaagcag

SEQ ID NO: 470304 - DNA, 20 bp, mouse
gggcgtcgacgcctaagggg

SEQ ID NO: 470305 - DNA, 20 bp, mouse
gctccgccgccacccaacag

SEQ ID NO: 470306 - DNA, 20 bp, mouse
gccgcgtcaggacagccggg

SEQ ID NO: 470307 - DNA, 20 bp, mouse
gtcggcacatccgggtccac

SEQ ID NO: 470308 - DNA, 20 bp, mouse
gccgccgcgtcaggacagcc

SEQ ID NO: 470309 - DNA, 20 bp, mouse
gcggatgtgccgagcggctg

SEQ ID NO: 470310 - DNA, 20 bp, mouse
ggcgcgcggcgagggactaa

SEQ ID NO: 470311 - DNA, 20 bp, mouse
gggcggaggcaggaccgaag

SEQ ID NO: 470312 - DNA, 20 bp, mouse
ggagagcgctgaccagagaa

SEQ ID NO: 470313 - DNA, 20 bp, mouse
ggcgagcggccctacaggat

SEQ ID NO: 470314 - DNA, 20 bp, mouse
ggcgctgagaggggaccggt

SEQ ID NO: 470315 - DNA, 20 bp, mouse
ggctgaggcgctgctgacgg

SEQ ID NO: 470316 - DNA, 20 bp, mouse
gagagagagagcagcgacaa

SEQ ID NO: 470317 - DNA, 20 bp, mouse
gagagcagcgacaagggacc

SEQ ID NO: 470318 - DNA, 20 bp, mouse
ggttccgtttagccccgaac

SEQ ID NO: 470319 - DNA, 20 bp, mouse
ggacactgccgaggattgta

SEQ ID NO: 470320 - DNA, 20 bp, mouse
gagagtcccgctcaatcagg

SEQ ID NO: 470321 - DNA, 20 bp, mouse
gactcctgttcggggctaaa

SEQ ID NO: 470322 - DNA, 20 bp, mouse
ggaggcggccgtacaatcct

SEQ ID NO: 470323 - DNA, 20 bp, mouse
gggactccggagctgtacac

SEQ ID NO: 470324 - DNA, 20 bp, mouse
gccaatgcctgggaccaagt

SEQ ID NO: 470325 - DNA, 20 bp, mouse
ggaaaagtgactcctgttcg

SEQ ID NO: 470326 - DNA, 20 bp, mouse
gtcttaaagggagagagccg

SEQ ID NO: 470327 - DNA, 20 bp, mouse
gagtggcaggaacctcttaa

SEQ ID NO: 470328 - DNA, 20 bp, mouse
gaggcggtccaggctcacct

SEQ ID NO: 470329 - DNA, 20 bp, mouse
gacctggcagggacctggcc

SEQ ID NO: 470330 - DNA, 20 bp, mouse
gcgcagctcccggaacgatc

SEQ ID NO: 470331 - DNA, 20 bp, mouse
gggcccccggcggggcaaag

SEQ ID NO: 470332 - DNA, 20 bp, mouse
ggcagggacctggccgggcc

SEQ ID NO: 470333 - DNA, 20 bp, mouse
gggagagcgaggacgcggcc

SEQ ID NO: 470334 - DNA, 20 bp, mouse
ggtcacaggatcctcggcgg

SEQ ID NO: 470335 - DNA, 20 bp, mouse
gcagtgcaggtggaggcccc

SEQ ID NO: 470336 - DNA, 20 bp, mouse
gtcgtctcgcggaggaaagg

SEQ ID NO: 470337 - DNA, 20 bp, mouse
ggcctcgtctcgcggaggaa

SEQ ID NO: 470338 - DNA, 20 bp, mouse
ggcttcagcccgacgaacaa

SEQ ID NO: 470339 - DNA, 20 bp, mouse
ggcgcgccggggctgctcgc

SEQ ID NO: 470340 - DNA, 20 bp, mouse
gcggccgagaaccccgggtg

SEQ ID NO: 470341 - DNA, 20 bp, mouse
gccgcgccggcctcgtctcg

SEQ ID NO: 470342 - DNA, 20 bp, mouse
gcgccggcctcgtctcgcgg

SEQ ID NO: 470343 - DNA, 20 bp, mouse
gggccccccgctctactcag

SEQ ID NO: 470344 - DNA, 20 bp, mouse
ggagaaccccgggtgaggcg

SEQ ID NO: 470345 - DNA, 20 bp, mouse
ggacgaacaatggcaggagg

SEQ ID NO: 470346 - DNA, 20 bp, mouse
gtctccctgagcccccacta

SEQ ID NO: 470347 - DNA, 20 bp, mouse
gctgggccaagccctagtgg

SEQ ID NO: 470348 - DNA, 20 bp, mouse
ggccagggccagggcggaga

SEQ ID NO: 470349 - DNA, 20 bp, mouse
gggtccgctgcgggacgagg

SEQ ID NO: 470350 - DNA, 20 bp, mouse
gtccgcgcccagcccagggg

SEQ ID NO: 470351 - DNA, 20 bp, mouse
gtctctgggccaagccctag

SEQ ID NO: 470352 - DNA, 20 bp, mouse
ggctcgctcgcgggctctct

SEQ ID NO: 470353 - DNA, 20 bp, mouse
gctgggcgccgcgagcgagg

SEQ ID NO: 470354 - DNA, 20 bp, mouse
ggaggtggccgtctccgccc

SEQ ID NO: 470355 - DNA, 20 bp, mouse
gcgaggaggccggctggcca

SEQ ID NO: 470356 - DNA, 20 bp, mouse
gtgggcggccactggacgaa

SEQ ID NO: 470357 - DNA, 20 bp, mouse
gagcgtcttggagcctgcct

SEQ ID NO: 470358 - DNA, 20 bp, mouse
ggtcttggagcctgcctggg

SEQ ID NO: 470359 - DNA, 20 bp, mouse
gagcctgcctgggcggccac

SEQ ID NO: 470360 - DNA, 20 bp, mouse
ggcgcagctccggagcgtct

SEQ ID NO: 470361 - DNA, 20 bp, mouse
gtctgagtcccttcgtccag

SEQ ID NO: 470362 - DNA, 20 bp, mouse
gccgcgccctgctaacctgg

SEQ ID NO: 470363 - DNA, 20 bp, mouse
gtctccggataagcaaacca

SEQ ID NO: 470364 - DNA, 20 bp, mouse
gccggagatgtgcctagaga

SEQ ID NO: 470365 - DNA, 20 bp, mouse
ggcgaagccatcatcagcat

SEQ ID NO: 470366 - DNA, 20 bp, mouse
gtctctgacggccccagtca

SEQ ID NO: 470367 - DNA, 20 bp, mouse
gcaatttgaaacccagagga

SEQ ID NO: 470368 - DNA, 20 bp, mouse
gcggcgtccgaggctggaac

SEQ ID NO: 470369 - DNA, 20 bp, mouse
ggggcgagcaagctcgagag

SEQ ID NO: 470370 - DNA, 20 bp, mouse
gtttgaaacccagaggaggg

SEQ ID NO: 470371 - DNA, 20 bp, mouse
gaagcccggacggccatccc

SEQ ID NO: 470372 - DNA, 20 bp, mouse
gcgccgcctccaccctcctc

SEQ ID NO: 470373 - DNA, 20 bp, mouse
gacgcgtcccgttccagcct

SEQ ID NO: 470374 - DNA, 20 bp, mouse
gcgagcaagctcgagagggg

SEQ ID NO: 470375 - DNA, 20 bp, mouse
gtggcgaccctcgggagaga

SEQ ID NO: 470376 - DNA, 20 bp, mouse
ggctcggagagaggccccca

SEQ ID NO: 470377 - DNA, 20 bp, mouse
ggcgctggcgtcctgctcgg

SEQ ID NO: 470378 - DNA, 20 bp, mouse
gggcagaaaaagttacctgg

SEQ ID NO: 470379 - DNA, 20 bp, mouse
ggaggtcgccggccactcga

SEQ ID NO: 470380 - DNA, 20 bp, mouse
ggtgcgcaggagactccgcg

SEQ ID NO: 470381 - DNA, 20 bp, mouse
gctggcgctggcgtcctgct

SEQ ID NO: 470382 - DNA, 20 bp, mouse
ggagcccttcggcccgccaa

SEQ ID NO: 470383 - DNA, 20 bp, mouse
ggcccggggcacggacgcag

SEQ ID NO: 470384 - DNA, 20 bp, mouse
gcgcgccgcggcgtggggac

SEQ ID NO: 470385 - DNA, 20 bp, mouse
gagggcccgatcgcccccag

SEQ ID NO: 470386 - DNA, 20 bp, mouse
gccgggcgcggcaggaccca

SEQ ID NO: 470387 - DNA, 20 bp, mouse
gccccgggctgtgagagtgg

SEQ ID NO: 470388 - DNA, 20 bp, mouse
gcacagaggcctggcaccct

SEQ ID NO: 470389 - DNA, 20 bp, mouse
gccaggcctctgtggctcca

SEQ ID NO: 470390 - DNA, 20 bp, mouse
gccgggcgtctgcggacctg

SEQ ID NO: 470391 - DNA, 20 bp, mouse
gcgtctgcggacctgcggcc

SEQ ID NO: 470392 - DNA, 20 bp, mouse
gctgggaccgcagaacgcaa

SEQ ID NO: 470393 - DNA, 20 bp, mouse
ggccgggaccaggcactggt

SEQ ID NO: 470394 - DNA, 20 bp, mouse
gtggaaaagccgggcgtctg

SEQ ID NO: 470395 - DNA, 20 bp, mouse
ggacgcagggcgagcagcga

SEQ ID NO: 470396 - DNA, 20 bp, mouse
gcgcgtagcgctgcatggag

SEQ ID NO: 470397 - DNA, 20 bp, mouse
gggagcggcggccaaaggtc

SEQ ID NO: 470398 - DNA, 20 bp, mouse
gtccgtcgagcaggaagaca

SEQ ID NO: 470399 - DNA, 20 bp, mouse
ggtagcgctgcatggagcgg

SEQ ID NO: 470400 - DNA, 20 bp, mouse
gaggaagacacggcagtaaa

SEQ ID NO: 470401 - DNA, 20 bp, mouse
gtgcatggagcggcggccaa

SEQ ID NO: 470402 - DNA, 20 bp, mouse
gcacgcgccgcgtcactcac

SEQ ID NO: 470403 - DNA, 20 bp, mouse
gcggcagccgggccccctcg

SEQ ID NO: 470404 - DNA, 20 bp, mouse
gcagcgctacgcgcggggcg

SEQ ID NO: 470405 - DNA, 20 bp, mouse
gaagacacggcagtaaaggg

SEQ ID NO: 470406 - DNA, 20 bp, mouse
ggcccagccggctagaggag

SEQ ID NO: 470407 - DNA, 20 bp, mouse
gcagagacaccgagaaatgg

SEQ ID NO: 470408 - DNA, 20 bp, mouse
gctccagagacaccgagaaa

SEQ ID NO: 470409 - DNA, 20 bp, mouse
ggagatgcccagccggctag

SEQ ID NO: 470410 - DNA, 20 bp, mouse
gacagctacggggaggtcag

SEQ ID NO: 470411 - DNA, 20 bp, mouse
ggggcggccggggtcctccg

SEQ ID NO: 470412 - DNA, 20 bp, mouse
ggccttgcgccgccatttct

SEQ ID NO: 470413 - DNA, 20 bp, mouse
gcccaccctgcgctaatccc

SEQ ID NO: 470414 - DNA, 20 bp, mouse
gaccctgcgctaatccccgg

SEQ ID NO: 470415 - DNA, 20 bp, mouse
ggaggaccccggccgcccga

SEQ ID NO: 470416 - DNA, 20 bp, mouse
gtccacactggcgaagatgg

SEQ ID NO: 470417 - DNA, 20 bp, mouse
gatctccacactggcgaaga

SEQ ID NO: 470418 - DNA, 20 bp, mouse
gacacagaagcgacagtgtg

SEQ ID NO: 470419 - DNA, 20 bp, mouse
gaggggaattggcttttcag

SEQ ID NO: 470420 - DNA, 20 bp, mouse
ggtgtgaggtcagcacttcc

SEQ ID NO: 470421 - DNA, 20 bp, mouse
gggtaagctaacccagttct

SEQ ID NO: 470422 - DNA, 20 bp, mouse
gcaggctcacaggaggagtg

SEQ ID NO: 470423 - DNA, 20 bp, mouse
ggttagcttaccttgcccca

SEQ ID NO: 470424 - DNA, 20 bp, mouse
gtccaccatcttcgccagtg

SEQ ID NO: 470425 - DNA, 20 bp, mouse
gtcacccagcagccaagaac

SEQ ID NO: 470426 - DNA, 20 bp, mouse
ggagtgagcgaggcgcggag

SEQ ID NO: 470427 - DNA, 20 bp, mouse
gtgacaccagccgggagggt

SEQ ID NO: 470428 - DNA, 20 bp, mouse
ggccctgacaccagccggga

SEQ ID NO: 470429 - DNA, 20 bp, mouse
gcaccagccgggagggtggg

SEQ ID NO: 470430 - DNA, 20 bp, mouse
ggctggtgtcagggcccgga

SEQ ID NO: 470431 - DNA, 20 bp, mouse
ggatcctcacagcggaagac

SEQ ID NO: 470432 - DNA, 20 bp, mouse
gcgctctcttcaatacgcca

SEQ ID NO: 470433 - DNA, 20 bp, mouse
gccgtttccccagagcggag

SEQ ID NO: 470434 - DNA, 20 bp, mouse
gctggcggcgggtcggacag

SEQ ID NO: 470435 - DNA, 20 bp, mouse
ggtcggcggcggagagaaga

SEQ ID NO: 470436 - DNA, 20 bp, mouse
ggggcagccgcaggatccga

SEQ ID NO: 470437 - DNA, 20 bp, mouse
gtccatggagggcggcggag

SEQ ID NO: 470438 - DNA, 20 bp, mouse
ggactttcgtccatggaggg

SEQ ID NO: 470439 - DNA, 20 bp, mouse
gaggatccgagggcgtccgg

SEQ ID NO: 470440 - DNA, 20 bp, mouse
gcccgctccgccgccctcca

SEQ ID NO: 470441 - DNA, 20 bp, mouse
gtgagactttcgtccatgga

SEQ ID NO: 470442 - DNA, 20 bp, mouse
gtttcgtccatggagggcgg

SEQ ID NO: 470443 - DNA, 20 bp, mouse
gacagcctccgggcagcgta

SEQ ID NO: 470444 - DNA, 20 bp, mouse
gtcattcccccggacgccct

SEQ ID NO: 470445 - DNA, 20 bp, mouse
gaaagtgagactttcgtcca

SEQ ID NO: 470446 - DNA, 20 bp, mouse
ggagcggcggatctagagtg

SEQ ID NO: 470447 - DNA, 20 bp, mouse
gcgcagggagcggatcgggc

SEQ ID NO: 470448 - DNA, 20 bp, mouse
gcatggcgcagggagcggat

SEQ ID NO: 470449 - DNA, 20 bp, mouse
gttggccatggcgcagggag

SEQ ID NO: 470450 - DNA, 20 bp, mouse
gcgcgctgcactgaggaagg

SEQ ID NO: 470451 - DNA, 20 bp, mouse
ggcggacattaccacagcgg

SEQ ID NO: 470452 - DNA, 20 bp, mouse
gcagcggcggcgagcgatcc

SEQ ID NO: 470453 - DNA, 20 bp, mouse
gatggcggacattaccacag

SEQ ID NO: 470454 - DNA, 20 bp, mouse
gcgccttacaggaacagccc

SEQ ID NO: 470455 - DNA, 20 bp, mouse
gcttacaggaacagcccggg

SEQ ID NO: 470456 - DNA, 20 bp, mouse
gctgcacgtgagacctgcgg

SEQ ID NO: 470457 - DNA, 20 bp, mouse
gcctagcacgacgaaagcag

SEQ ID NO: 470458 - DNA, 20 bp, mouse
gattctgcacgtgagacctg

SEQ ID NO: 470459 - DNA, 20 bp, mouse
gagtgctcgaaatggaacca

SEQ ID NO: 470460 - DNA, 20 bp, mouse
gtgcagaatcagtccatcag

SEQ ID NO: 470461 - DNA, 20 bp, mouse
gctcgtgcaggagttatgta

SEQ ID NO: 470462 - DNA, 20 bp, mouse
gctcgaaatggaaccagggc

SEQ ID NO: 470463 - DNA, 20 bp, mouse
gaactggtgagtgctcgaaa

SEQ ID NO: 470464 - DNA, 20 bp, mouse
gtggatggctaagagccaac

SEQ ID NO: 470465 - DNA, 20 bp, mouse
gcagctgcatgtttcactag

SEQ ID NO: 470466 - DNA, 20 bp, mouse
ggctccggacaccgggacac

SEQ ID NO: 470467 - DNA, 20 bp, mouse
gagagctggggcgattcacg

SEQ ID NO: 470468 - DNA, 20 bp, mouse
gcgattcacgcggctttccc

SEQ ID NO: 470469 - DNA, 20 bp, mouse
ggacaccgggacaccggcct

SEQ ID NO: 470470 - DNA, 20 bp, mouse
gtggagctcggctgaccctg

SEQ ID NO: 470471 - DNA, 20 bp, mouse
ggcacagcacccagacccag

SEQ ID NO: 470472 - DNA, 20 bp, mouse
gagaccatcgtaggacacca

SEQ ID NO: 470473 - DNA, 20 bp, mouse
gctgccaacaggaaacgcag

SEQ ID NO: 470474 - DNA, 20 bp, mouse
gctttcccaggccggtgtcc

SEQ ID NO: 470475 - DNA, 20 bp, mouse
gcccccgaggcccctggacc

SEQ ID NO: 470476 - DNA, 20 bp, mouse
gccgcgacgtcgcggaggta

SEQ ID NO: 470477 - DNA, 20 bp, mouse
ggtcgcggaggtagggtgta

SEQ ID NO: 470478 - DNA, 20 bp, mouse
gacagaccgcgacgtcgcgg

SEQ ID NO: 470479 - DNA, 20 bp, mouse
gccaaggccagccgcaccaa

SEQ ID NO: 470480 - DNA, 20 bp, mouse
gccaggaggccggaactggg

SEQ ID NO: 470481 - DNA, 20 bp, mouse
gccgcaccaaaggcaaggtg

SEQ ID NO: 470482 - DNA, 20 bp, mouse
ggaaacagaccgcgacgtcg

SEQ ID NO: 470483 - DNA, 20 bp, mouse
ggaggtagggtgtatggccg

SEQ ID NO: 470484 - DNA, 20 bp, mouse
gccccgccgggccaaggcca

SEQ ID NO: 470485 - DNA, 20 bp, mouse
gagcgcacgcagccaggcgt

SEQ ID NO: 470486 - DNA, 20 bp, mouse
gctggtcctcctagacggaa

SEQ ID NO: 470487 - DNA, 20 bp, mouse
ggtcctcctagacggaaggg

SEQ ID NO: 470488 - DNA, 20 bp, mouse
gaccctccacccttccgtct

SEQ ID NO: 470489 - DNA, 20 bp, mouse
ggcttcagaatatggctctg

SEQ ID NO: 470490 - DNA, 20 bp, mouse
gctccacccttccgtctagg

SEQ ID NO: 470491 - DNA, 20 bp, mouse
gtttctctggtcctcctaga

SEQ ID NO: 470492 - DNA, 20 bp, mouse
gttacgcacctttgaacaag

SEQ ID NO: 470493 - DNA, 20 bp, mouse
ggatcaaaacaaggaacgtg

SEQ ID NO: 470494 - DNA, 20 bp, mouse
gactaaatcttcccattgta

SEQ ID NO: 470495 - DNA, 20 bp, mouse
gaatcttcccattgtaaggt

SEQ ID NO: 470496 - DNA, 20 bp, mouse
gcctgggaccacggccccta

SEQ ID NO: 470497 - DNA, 20 bp, mouse
gcgacctggcccagccgtag

SEQ ID NO: 470498 - DNA, 20 bp, mouse
gcggccgggacctgggacca

SEQ ID NO: 470499 - DNA, 20 bp, mouse
ggtgctggccaacagagtag

SEQ ID NO: 470500 - DNA, 20 bp, mouse
ggggccgtggtcccaggtcc

SEQ ID NO: 470501 - DNA, 20 bp, mouse
gcgctactggggagaagcca

SEQ ID NO: 470502 - DNA, 20 bp, mouse
ggaagccagggagaagtagt

SEQ ID NO: 470503 - DNA, 20 bp, mouse
gtaggggtgactgatcccgt

SEQ ID NO: 470504 - DNA, 20 bp, mouse
gaggggccagcgccgctcca

SEQ ID NO: 470505 - DNA, 20 bp, mouse
gagcagcaatgcaagcccca

SEQ ID NO: 470506 - DNA, 20 bp, mouse
ggacggagctgtcagtgcgg

SEQ ID NO: 470507 - DNA, 20 bp, mouse
ggcactgacagctccgtctg

SEQ ID NO: 470508 - DNA, 20 bp, mouse
gggagctgtcagtgcggcgg

SEQ ID NO: 470509 - DNA, 20 bp, mouse
gagccggcgttggggtctgg

SEQ ID NO: 470510 - DNA, 20 bp, mouse
gggcagacgaacaggcgcag

SEQ ID NO: 470511 - DNA, 20 bp, mouse
gagcaaggcagagtggtatc

SEQ ID NO: 470512 - DNA, 20 bp, mouse
gttaggtctggagacctaag

SEQ ID NO: 470513 - DNA, 20 bp, mouse
ggagcccgaggcaggttcaa

SEQ ID NO: 470514 - DNA, 20 bp, mouse
ggattggagtaaggattcgt

SEQ ID NO: 470515 - DNA, 20 bp, mouse
gtagggaccacaagagcccg

SEQ ID NO: 470516 - DNA, 20 bp, mouse
gcggcgggcgggcaggattg

SEQ ID NO: 470517 - DNA, 20 bp, mouse
ggccgcggcggcacagggaa

SEQ ID NO: 470518 - DNA, 20 bp, mouse
gaggattggggcaccgagac

SEQ ID NO: 470519 - DNA, 20 bp, mouse
gaaggtgcgtcccagagagg

SEQ ID NO: 470520 - DNA, 20 bp, mouse
ggctgtccgcacgccggtct

SEQ ID NO: 470521 - DNA, 20 bp, mouse
gtagaagttgtctctgtcgg

SEQ ID NO: 470522 - DNA, 20 bp, mouse
gggtctcagtgcgcaaggtt

SEQ ID NO: 470523 - DNA, 20 bp, mouse
gatgtcccggagtccctgct

SEQ ID NO: 470524 - DNA, 20 bp, mouse
ggggtagaagttgtctctgt

SEQ ID NO: 470525 - DNA, 20 bp, mouse
gcagggatcgcggggagcga

SEQ ID NO: 470526 - DNA, 20 bp, mouse
gtggtgcaccgggcagtgag

SEQ ID NO: 470527 - DNA, 20 bp, mouse
ggcataccactgatgtgagg

SEQ ID NO: 470528 - DNA, 20 bp, mouse
gcagccgagcaggacgagga

SEQ ID NO: 470529 - DNA, 20 bp, mouse
gagggaacagcgccgtccgg

SEQ ID NO: 470530 - DNA, 20 bp, mouse
ggcagcagccgagcaggacg

SEQ ID NO: 470531 - DNA, 20 bp, mouse
gggagcccacagcccccgga

SEQ ID NO: 470532 - DNA, 20 bp, mouse
gacatcagtggtatgcttcg

SEQ ID NO: 470533 - DNA, 20 bp, mouse
gtcagactgcgagcggagca

SEQ ID NO: 470534 - DNA, 20 bp, mouse
ggggggagcgctctgattgc

SEQ ID NO: 470535 - DNA, 20 bp, mouse
ggcccggtgcaccagcaaca

SEQ ID NO: 470536 - DNA, 20 bp, mouse
gtattccactgggatagaag

SEQ ID NO: 470537 - DNA, 20 bp, mouse
gcgttggcaccggcgaacca

SEQ ID NO: 470538 - DNA, 20 bp, mouse
ggcaggagcagcgttggcac

SEQ ID NO: 470539 - DNA, 20 bp, mouse
ggcaccggcgaaccatggct

SEQ ID NO: 470540 - DNA, 20 bp, mouse
gccactgggatagaagcggc

SEQ ID NO: 470541 - DNA, 20 bp, mouse
gtccaaagagaaacgaaaag

SEQ ID NO: 470542 - DNA, 20 bp, mouse
ggcggggtataccctagaac

SEQ ID NO: 470543 - DNA, 20 bp, mouse
gaaatagaaaatcccagcca

SEQ ID NO: 470544 - DNA, 20 bp, mouse
gtgcggtccgggacccggag

SEQ ID NO: 470545 - DNA, 20 bp, mouse
gaatcccagccatggttcgc

SEQ ID NO: 470546 - DNA, 20 bp, mouse
gcgcggcgaccagggcgaac

SEQ ID NO: 470547 - DNA, 20 bp, mouse
ggcggagtgcgcggcgacca

SEQ ID NO: 470548 - DNA, 20 bp, mouse
gtgcagtcgccggttcgccc

SEQ ID NO: 470549 - DNA, 20 bp, mouse
gtgagcagcgggaaccgcag

SEQ ID NO: 470550 - DNA, 20 bp, mouse
ggccgcgcgggtgcagtcgc

SEQ ID NO: 470551 - DNA, 20 bp, mouse
gagagcgcagcagagcccgg

SEQ ID NO: 470552 - DNA, 20 bp, mouse
ggcgatctagagaactggag

SEQ ID NO: 470553 - DNA, 20 bp, mouse
gaccgagtagagtggagccc

SEQ ID NO: 470554 - DNA, 20 bp, mouse
gaccggcgactgcacccgcg

SEQ ID NO: 470555 - DNA, 20 bp, mouse
gcagagtgtctacggatcaa

SEQ ID NO: 470556 - DNA, 20 bp, mouse
ggccgccaggagctccccgg

SEQ ID NO: 470557 - DNA, 20 bp, mouse
gtcgctcgagcgggacacgg

SEQ ID NO: 470558 - DNA, 20 bp, mouse
ggccgccggggagctcctgg

SEQ ID NO: 470559 - DNA, 20 bp, mouse
gctcgagcgggacacggtgg

SEQ ID NO: 470560 - DNA, 20 bp, mouse
gtcctggcggctggaggcga

SEQ ID NO: 470561 - DNA, 20 bp, mouse
gcccaggctactcagtcaag

SEQ ID NO: 470562 - DNA, 20 bp, mouse
gcggtccaagccgttagcag

SEQ ID NO: 470563 - DNA, 20 bp, mouse
gcagatagtaagggtagtct

SEQ ID NO: 470564 - DNA, 20 bp, mouse
gcctgcggaccgggtggagg

SEQ ID NO: 470565 - DNA, 20 bp, mouse
gacttcccctgcggaccggg

SEQ ID NO: 470566 - DNA, 20 bp, mouse
ggtgcgaacgaaccggaggg

SEQ ID NO: 470567 - DNA, 20 bp, mouse
gacggtgcgaacgaaccgga

SEQ ID NO: 470568 - DNA, 20 bp, mouse
gaaacacggtgcgaacgaac

SEQ ID NO: 470569 - DNA, 20 bp, mouse
gtctgcagtcggagacttgc

SEQ ID NO: 470570 - DNA, 20 bp, mouse
gcaggctgcgaaggaaggta

SEQ ID NO: 470571 - DNA, 20 bp, mouse
ggatttctctctcccccctc

SEQ ID NO: 470572 - DNA, 20 bp, mouse
gcaagcggccggtctgcagt

SEQ ID NO: 470573 - DNA, 20 bp, mouse
ggacggcctgggacccagaa

SEQ ID NO: 470574 - DNA, 20 bp, mouse
gggagtgtggagcaagcggc

SEQ ID NO: 470575 - DNA, 20 bp, mouse
gagcgtggagcagacggcct

SEQ ID NO: 470576 - DNA, 20 bp, mouse
gcctgggcgcaggatggcat

SEQ ID NO: 470577 - DNA, 20 bp, mouse
ggtgacgacccagagagcgg

SEQ ID NO: 470578 - DNA, 20 bp, mouse
gtcggagggaggatgccctg

SEQ ID NO: 470579 - DNA, 20 bp, mouse
gggcaggagcgcgccacgcg

SEQ ID NO: 470580 - DNA, 20 bp, mouse
ggggccgagcccgaggagcg

SEQ ID NO: 470581 - DNA, 20 bp, mouse
gaggctggctgaggtcgagg

SEQ ID NO: 470582 - DNA, 20 bp, mouse
gtgggaaccgaggaccaaac

SEQ ID NO: 470583 - DNA, 20 bp, mouse
gctcctcgggctcggcccgg

SEQ ID NO: 470584 - DNA, 20 bp, mouse
gaccccggccggcgcacacg

SEQ ID NO: 470585 - DNA, 20 bp, mouse
gtgaaggcactggacggaca

SEQ ID NO: 470586 - DNA, 20 bp, mouse
ggcccgctctgtcctcccgt

SEQ ID NO: 470587 - DNA, 20 bp, mouse
gctacagcggagcctacggg

SEQ ID NO: 470588 - DNA, 20 bp, mouse
ggagctacagcggagcctac

SEQ ID NO: 470589 - DNA, 20 bp, mouse
ggccagagcgcgaaaggaca

SEQ ID NO: 470590 - DNA, 20 bp, mouse
gggtgagggagagcgagcct

SEQ ID NO: 470591 - DNA, 20 bp, mouse
gcgcgagagcgtgtgcgtcc

SEQ ID NO: 470592 - DNA, 20 bp, mouse
gtagctcgcaatgtgacacc

SEQ ID NO: 470593 - DNA, 20 bp, mouse
gccttcgcggagcaacttgg

SEQ ID NO: 470594 - DNA, 20 bp, mouse
ggagcgggccagactgacgg

SEQ ID NO: 470595 - DNA, 20 bp, mouse
ggtcacattgcgagctacag

SEQ ID NO: 470596 - DNA, 20 bp, mouse
gcttccacggcggctagcag

SEQ ID NO: 470597 - DNA, 20 bp, mouse
gcattctgctggctgcgcgg

SEQ ID NO: 470598 - DNA, 20 bp, mouse
gccccgctcaccttccacgg

SEQ ID NO: 470599 - DNA, 20 bp, mouse
gcatccccgctcaccttcca

SEQ ID NO: 470600 - DNA, 20 bp, mouse
gaccgcggggccgagtgagg

SEQ ID NO: 470601 - DNA, 20 bp, mouse
gagaatgagccatccagccc

SEQ ID NO: 470602 - DNA, 20 bp, mouse
gcgagtgagggggcgacccg

SEQ ID NO: 470603 - DNA, 20 bp, mouse
gatccagcccgggcagaacg

SEQ ID NO: 470604 - DNA, 20 bp, mouse
ggcctcggcaccgagctcag

SEQ ID NO: 470605 - DNA, 20 bp, mouse
ggcgccccgccgctccccgc

SEQ ID NO: 470606 - DNA, 20 bp, mouse
ggagcggcgcagccagatac

SEQ ID NO: 470607 - DNA, 20 bp, mouse
ggcgagcgcacaaggatccc

SEQ ID NO: 470608 - DNA, 20 bp, mouse
gctcggggcacagtccactg

SEQ ID NO: 470609 - DNA, 20 bp, mouse
gtaccggctcctaccccgga

SEQ ID NO: 470610 - DNA, 20 bp, mouse
gagccggcgggaagcagcag

SEQ ID NO: 470611 - DNA, 20 bp, mouse
ggcagaagtgagtacgtgag

SEQ ID NO: 470612 - DNA, 20 bp, mouse
gcgccgtccggggtaggagc

SEQ ID NO: 470613 - DNA, 20 bp, mouse
gtgcgctcgccgtccggggt

SEQ ID NO: 470614 - DNA, 20 bp, mouse
gcggggtaggagccggtatc

SEQ ID NO: 470615 - DNA, 20 bp, mouse
gtgaggccgagctcagatcc

SEQ ID NO: 470616 - DNA, 20 bp, mouse
gaagtgggaaccgagcagga

SEQ ID NO: 470617 - DNA, 20 bp, mouse
gcgccggtcgcggtcaagga

SEQ ID NO: 470618 - DNA, 20 bp, mouse
gcggtcgcggtcaaggaagg

SEQ ID NO: 470619 - DNA, 20 bp, mouse
gaacaggctgggccagggct

SEQ ID NO: 470620 - DNA, 20 bp, mouse
ggagtcgagactgagtcggg

SEQ ID NO: 470621 - DNA, 20 bp, mouse
gtgggaaccgagcaggaggg

SEQ ID NO: 470622 - DNA, 20 bp, mouse
ggccgagtcgagactgagtc

SEQ ID NO: 470623 - DNA, 20 bp, mouse
gaccggcgcactaaccccgg

SEQ ID NO: 470624 - DNA, 20 bp, mouse
gggacccccgaagccccgaa

SEQ ID NO: 470625 - DNA, 20 bp, mouse
gaccaaagtgggaaccgagc

SEQ ID NO: 470626 - DNA, 20 bp, mouse
ggccctggggaatcgtgcgg

SEQ ID NO: 470627 - DNA, 20 bp, mouse
gcaagcagggactgctccct

SEQ ID NO: 470628 - DNA, 20 bp, mouse
gtgagctgtggtctcgggtt

SEQ ID NO: 470629 - DNA, 20 bp, mouse
gcgggggccggtgtcacgat

SEQ ID NO: 470630 - DNA, 20 bp, mouse
ggcgtcgcgcgtgtcctctc

SEQ ID NO: 470631 - DNA, 20 bp, mouse
gccaggctgggagagacgag

SEQ ID NO: 470632 - DNA, 20 bp, mouse
gtactgggtatagctctcca

SEQ ID NO: 470633 - DNA, 20 bp, mouse
gaggtgcagatccaccgcgg

SEQ ID NO: 470634 - DNA, 20 bp, mouse
gttccccagggccccgccta

SEQ ID NO: 470635 - DNA, 20 bp, mouse
gtactgtgtctggagagtaa

SEQ ID NO: 470636 - DNA, 20 bp, mouse
gctcaagaggagtttgagag

SEQ ID NO: 470637 - DNA, 20 bp, mouse
gaagaggagtttgagagtgg

SEQ ID NO: 470638 - DNA, 20 bp, mouse
gtctcgggttcctactcccg

SEQ ID NO: 470639 - DNA, 20 bp, mouse
gtaagctccggggacagcag

SEQ ID NO: 470640 - DNA, 20 bp, mouse
gtactgtcagggtcgctctc

SEQ ID NO: 470641 - DNA, 20 bp, mouse
gcaccagccgccgcgggagt

SEQ ID NO: 470642 - DNA, 20 bp, mouse
gtgacgcccctggaagagga

SEQ ID NO: 470643 - DNA, 20 bp, mouse
gaccctgacagtaagctccg

SEQ ID NO: 470644 - DNA, 20 bp, mouse
ggggttgacgcccctggaag

SEQ ID NO: 470645 - DNA, 20 bp, mouse
ggcttccgaagcgcaagcaa

SEQ ID NO: 470646 - DNA, 20 bp, mouse
ggcaactctgaaaagcacgt

SEQ ID NO: 470647 - DNA, 20 bp, mouse
gccaggctagtatggttcag

SEQ ID NO: 470648 - DNA, 20 bp, mouse
gccgtgagctggttagggta

SEQ ID NO: 470649 - DNA, 20 bp, mouse
gaaagaaagccaggctagta

SEQ ID NO: 470650 - DNA, 20 bp, mouse
gctagcctggctttctttta

SEQ ID NO: 470651 - DNA, 20 bp, mouse
gtgaaaagcacgtgggtaac

SEQ ID NO: 470652 - DNA, 20 bp, mouse
gaaaattgcagaaccgctct

SEQ ID NO: 470653 - DNA, 20 bp, mouse
gttgttgtacgtatgtataa

SEQ ID NO: 470654 - DNA, 20 bp, mouse
gtggcctccagactccctta

SEQ ID NO: 470655 - DNA, 20 bp, mouse
gacaggtcctgtgaccctaa

SEQ ID NO: 470656 - DNA, 20 bp, mouse
gaaggctgtggcctagagtg

SEQ ID NO: 470657 - DNA, 20 bp, mouse
gactccgtcaaggtcgaacg

SEQ ID NO: 470658 - DNA, 20 bp, mouse
ggctacacgcagcgccatgg

SEQ ID NO: 470659 - DNA, 20 bp, mouse
ggagggccagcactccgtca

SEQ ID NO: 470660 - DNA, 20 bp, mouse
gtgggctggacgtatggaca

SEQ ID NO: 470661 - DNA, 20 bp, mouse
gacacagacacgaagctgga

SEQ ID NO: 470662 - DNA, 20 bp, mouse
ggcggctacacgcagcgcca

SEQ ID NO: 470663 - DNA, 20 bp, mouse
ggccccggcgatagagggga

SEQ ID NO: 470664 - DNA, 20 bp, mouse
ggctgacacagacacgaagc

SEQ ID NO: 470665 - DNA, 20 bp, mouse
gagcgcggctccccttacct

SEQ ID NO: 470666 - DNA, 20 bp, mouse
gtagagtgagtcatgagagg

SEQ ID NO: 470667 - DNA, 20 bp, mouse
gctatcggagtccactggac

SEQ ID NO: 470668 - DNA, 20 bp, mouse
gagtggcagctaaagtacct

SEQ ID NO: 470669 - DNA, 20 bp, mouse
ggcttcagcgagaggcgtga

SEQ ID NO: 470670 - DNA, 20 bp, mouse
ggagtccactggaccggtcg

SEQ ID NO: 470671 - DNA, 20 bp, mouse
gggtcgaggaaacagatgcg

SEQ ID NO: 470672 - DNA, 20 bp, mouse
gctcatgactcactctaaag

SEQ ID NO: 470673 - DNA, 20 bp, mouse
gccgtgctatcggagtccac

SEQ ID NO: 470674 - DNA, 20 bp, mouse
ggcgctgtcaccacaaactc

SEQ ID NO: 470675 - DNA, 20 bp, mouse
gcgaggacggcacatcacat

SEQ ID NO: 470676 - DNA, 20 bp, mouse
gtctactggtccctggtgta

SEQ ID NO: 470677 - DNA, 20 bp, mouse
ggacgcgggcctggagacag

SEQ ID NO: 470678 - DNA, 20 bp, mouse
gcctggtgtacggctactgc

SEQ ID NO: 470679 - DNA, 20 bp, mouse
gcttttgtggagcatcggta

SEQ ID NO: 470680 - DNA, 20 bp, mouse
ggccctgctctactggtccc

SEQ ID NO: 470681 - DNA, 20 bp, mouse
gaaaagtttgagcaggtgga

SEQ ID NO: 470682 - DNA, 20 bp, mouse
ggcacccggaggaccccagg

SEQ ID NO: 470683 - DNA, 20 bp, mouse
gctaggcaccgcggcttcca

SEQ ID NO: 470684 - DNA, 20 bp, mouse
ggctgcgcgccctgctctac

SEQ ID NO: 470685 - DNA, 20 bp, mouse
gtggggagccctggaagccg

SEQ ID NO: 470686 - DNA, 20 bp, mouse
gccgaagcggaagagcatgg

SEQ ID NO: 470687 - DNA, 20 bp, mouse
ggagcgccggccaccgcggg

SEQ ID NO: 470688 - DNA, 20 bp, mouse
gcggcaccaccacgccgaag

SEQ ID NO: 470689 - DNA, 20 bp, mouse
gtggcggtggcccgagtcct

SEQ ID NO: 470690 - DNA, 20 bp, mouse
gacgccgaagcggaagagca

SEQ ID NO: 470691 - DNA, 20 bp, mouse
gtgccgctcgccaggctccc

SEQ ID NO: 470692 - DNA, 20 bp, mouse
gcggctcgcggcccgagtta

SEQ ID NO: 470693 - DNA, 20 bp, mouse
gcgggtagggtcaagatggt

SEQ ID NO: 470694 - DNA, 20 bp, mouse
ggagctggaggcgtacgagg

SEQ ID NO: 470695 - DNA, 20 bp, mouse
gtacgcctccagctccacct

SEQ ID NO: 470696 - DNA, 20 bp, mouse
gaggagaacgccgagctctg

SEQ ID NO: 470697 - DNA, 20 bp, mouse
ggatctggcgcagaacccag

SEQ ID NO: 470698 - DNA, 20 bp, mouse
ggaggccgcagcaaacgggg

SEQ ID NO: 470699 - DNA, 20 bp, mouse
gtctgaggccgcagcaaacg

SEQ ID NO: 470700 - DNA, 20 bp, mouse
gacccttcaaggccaagaag

SEQ ID NO: 470701 - DNA, 20 bp, mouse
ggacgtgaggcgccactacg

SEQ ID NO: 470702 - DNA, 20 bp, mouse
gccggaggagagagcgaccc

SEQ ID NO: 470703 - DNA, 20 bp, mouse
ggaccaggcggcgacacacc

SEQ ID NO: 470704 - DNA, 20 bp, mouse
gcacattctgcggaggccac

SEQ ID NO: 470705 - DNA, 20 bp, mouse
gggtgcaccagcctccgcca

SEQ ID NO: 470706 - DNA, 20 bp, mouse
ggacgggaagcaaccgaagg

SEQ ID NO: 470707 - DNA, 20 bp, mouse
gacggagggccgcacagcga

SEQ ID NO: 470708 - DNA, 20 bp, mouse
ggcggacgggaagcaaccga

SEQ ID NO: 470709 - DNA, 20 bp, mouse
ggtgcgcacgcacagacgca

SEQ ID NO: 470710 - DNA, 20 bp, mouse
gagcgggccgaggtgagcga

SEQ ID NO: 470711 - DNA, 20 bp, mouse
ggcaatgctggcctccgtcg

SEQ ID NO: 470712 - DNA, 20 bp, mouse
gcggcaggcaaacccgaccc

SEQ ID NO: 470713 - DNA, 20 bp, mouse
gacctcggcccgcttatacc

SEQ ID NO: 470714 - DNA, 20 bp, mouse
gctggaagcccggtataagc

SEQ ID NO: 470715 - DNA, 20 bp, mouse
gcccctcccgggcgccgggg

SEQ ID NO: 470716 - DNA, 20 bp, mouse
ggccggcgacgcgggagaag

SEQ ID NO: 470717 - DNA, 20 bp, mouse
gtcaaacgctgcacaggctc

SEQ ID NO: 470718 - DNA, 20 bp, mouse
gtcgcgctggccaggaacgg

SEQ ID NO: 470719 - DNA, 20 bp, mouse
ggccatgttggctggcgtgt

SEQ ID NO: 470720 - DNA, 20 bp, mouse
gcactcgcgctggccaggaa

SEQ ID NO: 470721 - DNA, 20 bp, mouse
gctccgagcgggctcaggtg

SEQ ID NO: 470722 - DNA, 20 bp, mouse
gtgggtgtcaaacgctgcac

SEQ ID NO: 470723 - DNA, 20 bp, mouse
gcccctctcggccgccatgt

SEQ ID NO: 470724 - DNA, 20 bp, mouse
gctgccggcgcgccccctct

SEQ ID NO: 470725 - DNA, 20 bp, mouse
ggctgcagccgccggcgacg

SEQ ID NO: 470726 - DNA, 20 bp, mouse
gtggccggcaggagtcgagg

SEQ ID NO: 470727 - DNA, 20 bp, mouse
ggcagccgcgagagtctgag

SEQ ID NO: 470728 - DNA, 20 bp, mouse
gtgctggccggcaggagtcg

SEQ ID NO: 470729 - DNA, 20 bp, mouse
ggtggccgctcagactctcg

SEQ ID NO: 470730 - DNA, 20 bp, mouse
gctctctcggaaggaccgca

SEQ ID NO: 470731 - DNA, 20 bp, mouse
gtcctcccgagagtgctggc

SEQ ID NO: 470732 - DNA, 20 bp, mouse
gtgagcggccacccgctggg

SEQ ID NO: 470733 - DNA, 20 bp, mouse
ggccggccagcactctcggg

SEQ ID NO: 470734 - DNA, 20 bp, mouse
ggcgagggagcccactctgg

SEQ ID NO: 470735 - DNA, 20 bp, mouse
ggggagcttacctccagagt

SEQ ID NO: 470736 - DNA, 20 bp, mouse
ggtcctgtcttcctccgcgg

SEQ ID NO: 470737 - DNA, 20 bp, mouse
ggaggtcctgtcttcctccg

SEQ ID NO: 470738 - DNA, 20 bp, mouse
ggcgctggacggttgagttg

SEQ ID NO: 470739 - DNA, 20 bp, mouse
gctccgccgcggaggaagac

SEQ ID NO: 470740 - DNA, 20 bp, mouse
gaacgaccgggccagaggaa

SEQ ID NO: 470741 - DNA, 20 bp, mouse
gcgggagacggaaggaaccg

SEQ ID NO: 470742 - DNA, 20 bp, mouse
ggggtcgcttggaggagcgc

SEQ ID NO: 470743 - DNA, 20 bp, mouse
ggctcctccaagcgacccct

SEQ ID NO: 470744 - DNA, 20 bp, mouse
gcacgagggctgttacccag

SEQ ID NO: 470745 - DNA, 20 bp, mouse
gtggggagagctgcgctgga

SEQ ID NO: 470746 - DNA, 20 bp, mouse
gctgaccaggagcttctaag

SEQ ID NO: 470747 - DNA, 20 bp, mouse
gtgacccagctgtggactag

SEQ ID NO: 470748 - DNA, 20 bp, mouse
gctgccggacacagctgacc

SEQ ID NO: 470749 - DNA, 20 bp, mouse
gcagctgtggactaggggaa

SEQ ID NO: 470750 - DNA, 20 bp, mouse
gccaggctgccccagcaagt

SEQ ID NO: 470751 - DNA, 20 bp, mouse
gcgccctggagtgatgctca

SEQ ID NO: 470752 - DNA, 20 bp, mouse
gtgccctgagcatcactcca

SEQ ID NO: 470753 - DNA, 20 bp, mouse
ggctgccacttagaagctcc

SEQ ID NO: 470754 - DNA, 20 bp, mouse
gctggtgtctgaactcgatg

SEQ ID NO: 470755 - DNA, 20 bp, mouse
gaaaggtaagaactgtacat

SEQ ID NO: 470756 - DNA, 20 bp, mouse
gcctactgagagaatcggat

SEQ ID NO: 470757 - DNA, 20 bp, mouse
gccaggaaggagctgtagaa

SEQ ID NO: 470758 - DNA, 20 bp, mouse
ggaaaggtgacccacacctg

SEQ ID NO: 470759 - DNA, 20 bp, mouse
gaaagcttcattctggcgag

SEQ ID NO: 470760 - DNA, 20 bp, mouse
gggctggtagttctagaaca

SEQ ID NO: 470761 - DNA, 20 bp, mouse
ggcctgcttgcaagagtcca

SEQ ID NO: 470762 - DNA, 20 bp, mouse
gtacagcctactgagagaat

SEQ ID NO: 470763 - DNA, 20 bp, mouse
ggagagaatcggatgggcga

SEQ ID NO: 470764 - DNA, 20 bp, mouse
ggtcagctagactaggtccc

SEQ ID NO: 470765 - DNA, 20 bp, mouse
ggaggagagagatacttata

SEQ ID NO: 470766 - DNA, 20 bp, mouse
gctggcggcgagggttcagg

SEQ ID NO: 470767 - DNA, 20 bp, mouse
gggagctgcggtctactcgt

SEQ ID NO: 470768 - DNA, 20 bp, mouse
gtgaaccctcgccgccagga

SEQ ID NO: 470769 - DNA, 20 bp, mouse
ggagggttcaggtggaagca

SEQ ID NO: 470770 - DNA, 20 bp, mouse
gaacgtgtgcgcgcgaccga

SEQ ID NO: 470771 - DNA, 20 bp, mouse
gcggcggcgcccttacccag

SEQ ID NO: 470772 - DNA, 20 bp, mouse
gaacaggcccgtccgtcccg

SEQ ID NO: 470773 - DNA, 20 bp, mouse
gcgagcctcccgccccggga

SEQ ID NO: 470774 - DNA, 20 bp, mouse
gccggcggtggcggcccgtg

SEQ ID NO: 470775 - DNA, 20 bp, mouse
ggacaaccgaagggaaagtg

SEQ ID NO: 470776 - DNA, 20 bp, mouse
gggcggcgttacctgtgtca

SEQ ID NO: 470777 - DNA, 20 bp, mouse
ggtgcatgatggaaacacca

SEQ ID NO: 470778 - DNA, 20 bp, mouse
gcatcatgcacgggagggga

SEQ ID NO: 470779 - DNA, 20 bp, mouse
gtacctgtgtcagggagagc

SEQ ID NO: 470780 - DNA, 20 bp, mouse
gagctgggctgccgcagcca

SEQ ID NO: 470781 - DNA, 20 bp, mouse
gcgccaggtgagctccggtg

SEQ ID NO: 470782 - DNA, 20 bp, mouse
ggtcgagccgggccgaccgg

SEQ ID NO: 470783 - DNA, 20 bp, mouse
gtggggctcacgctagacag

SEQ ID NO: 470784 - DNA, 20 bp, mouse
ggagcgccgacgggacctgg

SEQ ID NO: 470785 - DNA, 20 bp, mouse
gtttccatcatgcacgggag

SEQ ID NO: 470786 - DNA, 20 bp, mouse
gcgagtccgcacgaagatgg

SEQ ID NO: 470787 - DNA, 20 bp, mouse
ggctgcgagaggggtacaag

SEQ ID NO: 470788 - DNA, 20 bp, mouse
gcggagcgccgaaggaacgg

SEQ ID NO: 470789 - DNA, 20 bp, mouse
gggccgagtccgcacgaaga

SEQ ID NO: 470790 - DNA, 20 bp, mouse
gacccctctcgcagcaggta

SEQ ID NO: 470791 - DNA, 20 bp, mouse
gaccatacctgctgcgagag

SEQ ID NO: 470792 - DNA, 20 bp, mouse
ggcgcgcgctgaaggctcag

SEQ ID NO: 470793 - DNA, 20 bp, mouse
gcggctgcgaagaggtgatg

SEQ ID NO: 470794 - DNA, 20 bp, mouse
gtgaaggtgacaggccggag

SEQ ID NO: 470795 - DNA, 20 bp, mouse
gctccggagcgccgaaggaa

SEQ ID NO: 470796 - DNA, 20 bp, mouse
gctcgtccaagcaactgtca

SEQ ID NO: 470797 - DNA, 20 bp, mouse
gtcttgccttgacagttgct

SEQ ID NO: 470798 - DNA, 20 bp, mouse
gcccttcttggcattcctag

SEQ ID NO: 470799 - DNA, 20 bp, mouse
gctaaacctggtaagatctt

SEQ ID NO: 470800 - DNA, 20 bp, mouse
gcctagccaagagacgaaca

SEQ ID NO: 470801 - DNA, 20 bp, mouse
gttggctaggatgggatcgg

SEQ ID NO: 470802 - DNA, 20 bp, mouse
gctccccaagcaaggaaaag

SEQ ID NO: 470803 - DNA, 20 bp, mouse
gagccaagagacgaacaggg

SEQ ID NO: 470804 - DNA, 20 bp, mouse
gttaccttcctgcactgctg

SEQ ID NO: 470805 - DNA, 20 bp, mouse
ggatgtgtgtagaccttgaa

SEQ ID NO: 470806 - DNA, 20 bp, mouse
gcgcgcacacacggcccggg

SEQ ID NO: 470807 - DNA, 20 bp, mouse
gcgggcgaagcgggctcccg

SEQ ID NO: 470808 - DNA, 20 bp, mouse
gcggcgcgcacacacggccc

SEQ ID NO: 470809 - DNA, 20 bp, mouse
gctagacgcgagggaggtga

SEQ ID NO: 470810 - DNA, 20 bp, mouse
gggctgtgtccgggagcgag

SEQ ID NO: 470811 - DNA, 20 bp, mouse
gtgctcggagggcggatcct

SEQ ID NO: 470812 - DNA, 20 bp, mouse
gtccccgggtgggattcccg

SEQ ID NO: 470813 - DNA, 20 bp, mouse
ggaggtcgtggcactccctg

SEQ ID NO: 470814 - DNA, 20 bp, mouse
gcgctgcagacacgccgctg

SEQ ID NO: 470815 - DNA, 20 bp, mouse
gtcagtgcggctccccgggt

SEQ ID NO: 470816 - DNA, 20 bp, mouse
ggctggttatcagggagggt

SEQ ID NO: 470817 - DNA, 20 bp, mouse
ggcgagccagggcggacaca

SEQ ID NO: 470818 - DNA, 20 bp, mouse
gtatgagttcggagtcggga

SEQ ID NO: 470819 - DNA, 20 bp, mouse
gccagggcggacacagggtg

SEQ ID NO: 470820 - DNA, 20 bp, mouse
gccaacgaggaaatccttcc

SEQ ID NO: 470821 - DNA, 20 bp, mouse
gtcacagttaagggggactg

SEQ ID NO: 470822 - DNA, 20 bp, mouse
gaactcatacccctccaacg

SEQ ID NO: 470823 - DNA, 20 bp, mouse
gcctgaactacagcgagcca

SEQ ID NO: 470824 - DNA, 20 bp, mouse
ggaactacagcgagccaggg

SEQ ID NO: 470825 - DNA, 20 bp, mouse
gctgactcagcctcacaggg

SEQ ID NO: 470826 - DNA, 20 bp, mouse
gaagcacaggcgctgaggga

SEQ ID NO: 470827 - DNA, 20 bp, mouse
ggaggggcctaaccaagcac

SEQ ID NO: 470828 - DNA, 20 bp, mouse
gcggcggacaagctgaccga

SEQ ID NO: 470829 - DNA, 20 bp, mouse
gtcagcgcctgtgcttggtt

SEQ ID NO: 470830 - DNA, 20 bp, mouse
ggcgctgagggacggagcgc

SEQ ID NO: 470831 - DNA, 20 bp, mouse
gctcagattggcaaattccc

SEQ ID NO: 470832 - DNA, 20 bp, mouse
gctctggagctccctctccc

SEQ ID NO: 470833 - DNA, 20 bp, mouse
ggtcccgcctgtcccgggag

SEQ ID NO: 470834 - DNA, 20 bp, mouse
gtgagtccggagatccgatc

SEQ ID NO: 470835 - DNA, 20 bp, mouse
gcccgcagcccccctagcca

SEQ ID NO: 470836 - DNA, 20 bp, mouse
ggccagtggtccactaatgt

SEQ ID NO: 470837 - DNA, 20 bp, mouse
gaggccacctgatcaccagt

SEQ ID NO: 470838 - DNA, 20 bp, mouse
ggcttctctgccagcgcctc

SEQ ID NO: 470839 - DNA, 20 bp, mouse
ggtggtccactaatgttgga

SEQ ID NO: 470840 - DNA, 20 bp, mouse
ggcctcaggcagagacctac

SEQ ID NO: 470841 - DNA, 20 bp, mouse
gaggtctctgcctgaggcgc

SEQ ID NO: 470842 - DNA, 20 bp, mouse
ggagctccctccaacattag

SEQ ID NO: 470843 - DNA, 20 bp, mouse
ggccaacatggacatctcgg

SEQ ID NO: 470844 - DNA, 20 bp, mouse
gagtctgatgcttgagccag

SEQ ID NO: 470845 - DNA, 20 bp, mouse
gcaagcatcagactccttgg

SEQ ID NO: 470846 - DNA, 20 bp, mouse
ggagggacggatgctggtaa

SEQ ID NO: 470847 - DNA, 20 bp, mouse
gctggtaagggcttctaagg

SEQ ID NO: 470848 - DNA, 20 bp, mouse
gatgctggtaagggcttcta

SEQ ID NO: 470849 - DNA, 20 bp, mouse
gtacatggtccacagcccgt

SEQ ID NO: 470850 - DNA, 20 bp, mouse
gtctaaggaggctcgaggaa

SEQ ID NO: 470851 - DNA, 20 bp, mouse
gtggaggtggcagctcccga

SEQ ID NO: 470852 - DNA, 20 bp, mouse
gccagcgtggtcccgagaga

SEQ ID NO: 470853 - DNA, 20 bp, mouse
gaggtggtgggcccaggctt

SEQ ID NO: 470854 - DNA, 20 bp, mouse
gatccgtccctcaaaggctg

SEQ ID NO: 470855 - DNA, 20 bp, mouse
gggaggaagtgcccaagcct

SEQ ID NO: 470856 - DNA, 20 bp, mouse
ggcagcgacactgcgcgaca

SEQ ID NO: 470857 - DNA, 20 bp, mouse
gtgcagagctaggaaagcct

SEQ ID NO: 470858 - DNA, 20 bp, mouse
gctgaacgcccactccgcag

SEQ ID NO: 470859 - DNA, 20 bp, mouse
gcgcgacagggcaatgaaac

SEQ ID NO: 470860 - DNA, 20 bp, mouse
gcacggcgttgtgcagagct

SEQ ID NO: 470861 - DNA, 20 bp, mouse
ggggctggtaaagaaggtag

SEQ ID NO: 470862 - DNA, 20 bp, mouse
gtgtcgctgccgctgcggag

SEQ ID NO: 470863 - DNA, 20 bp, mouse
gtcgggctttgacaagtaca

SEQ ID NO: 470864 - DNA, 20 bp, mouse
ggcccgggcgcgggggagat

SEQ ID NO: 470865 - DNA, 20 bp, mouse
gggtcgcggtcgggaagctt

SEQ ID NO: 470866 - DNA, 20 bp, mouse
gatgcccacagatgccacgg

SEQ ID NO: 470867 - DNA, 20 bp, mouse
ggcaatgcccacagatgcca

SEQ ID NO: 470868 - DNA, 20 bp, mouse
gaaccatcacaggacctcta

SEQ ID NO: 470869 - DNA, 20 bp, mouse
gcaggacctctaagggagag

SEQ ID NO: 470870 - DNA, 20 bp, mouse
gaattgtacactcacctccg

SEQ ID NO: 470871 - DNA, 20 bp, mouse
gtcccttagaggtcctgtga

SEQ ID NO: 470872 - DNA, 20 bp, mouse
gcaattcctctctcccttag

SEQ ID NO: 470873 - DNA, 20 bp, mouse
gttggtctaaagcaaggatg

SEQ ID NO: 470874 - DNA, 20 bp, mouse
gcagcttctggccctggtag

SEQ ID NO: 470875 - DNA, 20 bp, mouse
gacgctgaaggcactgcccc

SEQ ID NO: 470876 - DNA, 20 bp, mouse
ggcagttgagcaacactcgg

SEQ ID NO: 470877 - DNA, 20 bp, mouse
ggttgagcaacactcggtgg

SEQ ID NO: 470878 - DNA, 20 bp, mouse
gcaagcagttgagcaacact

SEQ ID NO: 470879 - DNA, 20 bp, mouse
gagcgttcggattgtacgtc

SEQ ID NO: 470880 - DNA, 20 bp, mouse
ggactgaccctccgagagat

SEQ ID NO: 470881 - DNA, 20 bp, mouse
gtgggcaacaacctatctct

SEQ ID NO: 470882 - DNA, 20 bp, mouse
gagctccagaggaggcaccc

SEQ ID NO: 470883 - DNA, 20 bp, mouse
gggtctgggtaagtcttgga

SEQ ID NO: 470884 - DNA, 20 bp, mouse
gcaacaacctatctctcgga

SEQ ID NO: 470885 - DNA, 20 bp, mouse
ggatcattgcgtgggatcta

SEQ ID NO: 470886 - DNA, 20 bp, mouse
ggaattaacacgaggttagt

SEQ ID NO: 470887 - DNA, 20 bp, mouse
gcaaattcaccagttaagaa

SEQ ID NO: 470888 - DNA, 20 bp, mouse
ggaaaaaggctagttttcgt

SEQ ID NO: 470889 - DNA, 20 bp, mouse
gacacgaggttagtaggtga

SEQ ID NO: 470890 - DNA, 20 bp, mouse
gaaggaagggaattaacacg

SEQ ID NO: 470891 - DNA, 20 bp, mouse
gtggtcaggggcaaatacca

SEQ ID NO: 470892 - DNA, 20 bp, mouse
ggtgactataatataatgaa

SEQ ID NO: 470893 - DNA, 20 bp, mouse
gttgcccctgaccaatggat

SEQ ID NO: 470894 - DNA, 20 bp, mouse
gattcccttcctttcttaac

SEQ ID NO: 470895 - DNA, 20 bp, mouse
gttaaagttgttatactagg

SEQ ID NO: 470896 - DNA, 20 bp, mouse
gggcaatgacgactgaaagt

SEQ ID NO: 470897 - DNA, 20 bp, mouse
ggtgacagaaagtcagaata

SEQ ID NO: 470898 - DNA, 20 bp, mouse
gaatcacaccaatttcccaa

SEQ ID NO: 470899 - DNA, 20 bp, mouse
gtgaggagacagtagattgc

SEQ ID NO: 470900 - DNA, 20 bp, mouse
gtagactgataatgtctggg

SEQ ID NO: 470901 - DNA, 20 bp, mouse
gataaaatccattgggaaat

SEQ ID NO: 470902 - DNA, 20 bp, mouse
gaattgtgaaacactttcag

SEQ ID NO: 470903 - DNA, 20 bp, mouse
gtgaagaaaataatacagat

SEQ ID NO: 470904 - DNA, 20 bp, mouse
gacaccaggctcctctagaa

SEQ ID NO: 470905 - DNA, 20 bp, mouse
ggcaggtcctaagtctcaat

SEQ ID NO: 470906 - DNA, 20 bp, mouse
gccagcgcagtaccgcctgg

SEQ ID NO: 470907 - DNA, 20 bp, mouse
gacctgtcgggcccctaaca

SEQ ID NO: 470908 - DNA, 20 bp, mouse
gtgcatgcgaacccacctgt

SEQ ID NO: 470909 - DNA, 20 bp, mouse
gctcgttcgggccttgttag

SEQ ID NO: 470910 - DNA, 20 bp, mouse
gtactgcgctgggctcgttc

SEQ ID NO: 470911 - DNA, 20 bp, mouse
gtcggtaccagggtgcattg

SEQ ID NO: 470912 - DNA, 20 bp, mouse
gtcggaaccaacgaactgtc

SEQ ID NO: 470913 - DNA, 20 bp, mouse
gcggcaaaatggctgccccc

SEQ ID NO: 470914 - DNA, 20 bp, mouse
ggtgggttcgcatgcaggga

SEQ ID NO: 470915 - DNA, 20 bp, mouse
gccaaggatacggtccaagg

SEQ ID NO: 470916 - DNA, 20 bp, mouse
gtcccgggcggccagactgg

SEQ ID NO: 470917 - DNA, 20 bp, mouse
gagactggcggctgtgatga

SEQ ID NO: 470918 - DNA, 20 bp, mouse
gcggtcccgggcggccagac

SEQ ID NO: 470919 - DNA, 20 bp, mouse
gtgatgaaggtgaggagtct

SEQ ID NO: 470920 - DNA, 20 bp, mouse
gtctcggcctggcccggtgg

SEQ ID NO: 470921 - DNA, 20 bp, mouse
ggcgggcccagtcctccacc

SEQ ID NO: 470922 - DNA, 20 bp, mouse
gccgcacggtacagggctgt

SEQ ID NO: 470923 - DNA, 20 bp, mouse
gaaggtgaggagtctcggcc

SEQ ID NO: 470924 - DNA, 20 bp, mouse
gactgggcggacctagggag

SEQ ID NO: 470925 - DNA, 20 bp, mouse
ggagtctcggcctggcccgg

SEQ ID NO: 470926 - DNA, 20 bp, mouse
gggagtagcagtctgatgag

SEQ ID NO: 470927 - DNA, 20 bp, mouse
gggcagtaggcggatctgac

SEQ ID NO: 470928 - DNA, 20 bp, mouse
gggatctgaccggacagttg

SEQ ID NO: 470929 - DNA, 20 bp, mouse
gcgcgggattccagggacag

SEQ ID NO: 470930 - DNA, 20 bp, mouse
gttctcagcgcgggattcca

SEQ ID NO: 470931 - DNA, 20 bp, mouse
gggtcaggggtcgggcaggt

SEQ ID NO: 470932 - DNA, 20 bp, mouse
gcccatccctgcctcatgag

SEQ ID NO: 470933 - DNA, 20 bp, mouse
gctgggagcacaggtaagca

SEQ ID NO: 470934 - DNA, 20 bp, mouse
gtcactcccctcatgaggca

SEQ ID NO: 470935 - DNA, 20 bp, mouse
ggcacaggtaagcagggctc

SEQ ID NO: 470936 - DNA, 20 bp, mouse
gagggctgctcgaggaagtg

SEQ ID NO: 470937 - DNA, 20 bp, mouse
gggaaggggccgcctgggaa

SEQ ID NO: 470938 - DNA, 20 bp, mouse
ggcgagggcaggcacaggcg

SEQ ID NO: 470939 - DNA, 20 bp, mouse
ggcgcggcgagggcaggcac

SEQ ID NO: 470940 - DNA, 20 bp, mouse
ggaagtgcggcgtgaagttg

SEQ ID NO: 470941 - DNA, 20 bp, mouse
gagccgcgggtacccaaggt

SEQ ID NO: 470942 - DNA, 20 bp, mouse
gcacaggcgcggcgccggaa

SEQ ID NO: 470943 - DNA, 20 bp, mouse
gaggagcgccccttcccagg

SEQ ID NO: 470944 - DNA, 20 bp, mouse
ggggagggctcgggccgcta

SEQ ID NO: 470945 - DNA, 20 bp, mouse
ggcgcgcggctcccaatcac

SEQ ID NO: 470946 - DNA, 20 bp, mouse
gtcccgctcgagagtgaagg

SEQ ID NO: 470947 - DNA, 20 bp, mouse
ggtctcccgctcgagagtga

SEQ ID NO: 470948 - DNA, 20 bp, mouse
gtctcgagcgggagacggag

SEQ ID NO: 470949 - DNA, 20 bp, mouse
gctcgagagtgaaggtggcg

SEQ ID NO: 470950 - DNA, 20 bp, mouse
ggagagtgaaggtggcgcgg

SEQ ID NO: 470951 - DNA, 20 bp, mouse
gacctcgcgcggcccacggg

SEQ ID NO: 470952 - DNA, 20 bp, mouse
gccgcagggaaagaggacgg

SEQ ID NO: 470953 - DNA, 20 bp, mouse
gccccgccgaggctcccgtg

SEQ ID NO: 470954 - DNA, 20 bp, mouse
gcgaccgcagggaaagagga

SEQ ID NO: 470955 - DNA, 20 bp, mouse
ggaaagaagggagacgagtc

SEQ ID NO: 470956 - DNA, 20 bp, mouse
ggcccggggcccccaagatt

SEQ ID NO: 470957 - DNA, 20 bp, mouse
gccgctccggactccgacta

SEQ ID NO: 470958 - DNA, 20 bp, mouse
ggccgcggccacctaatcgc

SEQ ID NO: 470959 - DNA, 20 bp, mouse
gacctgaacagccagcgatt

SEQ ID NO: 470960 - DNA, 20 bp, mouse
gtccgagatgggcaactctc

SEQ ID NO: 470961 - DNA, 20 bp, mouse
gtgaacagccagcgattagg

SEQ ID NO: 470962 - DNA, 20 bp, mouse
gggcgacgccctgggaataa

SEQ ID NO: 470963 - DNA, 20 bp, mouse
ggtcggagtccggagcggga

SEQ ID NO: 470964 - DNA, 20 bp, mouse
gcggggcccccaagattagg

SEQ ID NO: 470965 - DNA, 20 bp, mouse
gctgcaaccggagccgtagt

SEQ ID NO: 470966 - DNA, 20 bp, mouse
gtgcgcagcggaggaaagcc

SEQ ID NO: 470967 - DNA, 20 bp, mouse
ggaaagcctggctggttgtg

SEQ ID NO: 470968 - DNA, 20 bp, mouse
gcagcggaggaaagcctggc

SEQ ID NO: 470969 - DNA, 20 bp, mouse
gacatgggtcagagcagggg

SEQ ID NO: 470970 - DNA, 20 bp, mouse
ggtgtgaggaaagctgacag

SEQ ID NO: 470971 - DNA, 20 bp, mouse
gagcgagcggaggatcactc

SEQ ID NO: 470972 - DNA, 20 bp, mouse
ggagcctaagggtgacagag

SEQ ID NO: 470973 - DNA, 20 bp, mouse
gggctacatgggtcagagca

SEQ ID NO: 470974 - DNA, 20 bp, mouse
gaagctggcgacgggactct

SEQ ID NO: 470975 - DNA, 20 bp, mouse
ggggagaagggaaacaccgg

SEQ ID NO: 470976 - DNA, 20 bp, mouse
ggcggctgtggtagtgtcgg

SEQ ID NO: 470977 - DNA, 20 bp, mouse
gtgtcggcggcaggctgtcc

SEQ ID NO: 470978 - DNA, 20 bp, mouse
gggtcgtgctgtggcggtgg

SEQ ID NO: 470979 - DNA, 20 bp, mouse
gggcggccctgaggagagta

SEQ ID NO: 470980 - DNA, 20 bp, mouse
gggccctgaggagagtaagg

SEQ ID NO: 470981 - DNA, 20 bp, mouse
gggcgccggtcgtgctgtgg

SEQ ID NO: 470982 - DNA, 20 bp, mouse
ggcgcacccgagcccaccgg

SEQ ID NO: 470983 - DNA, 20 bp, mouse
gcgggagcgccgagccgggt

SEQ ID NO: 470984 - DNA, 20 bp, mouse
ggccggtcgtgctgtggcgg

SEQ ID NO: 470985 - DNA, 20 bp, mouse
gggccgccttactctcctca

SEQ ID NO: 470986 - DNA, 20 bp, mouse
gagcgatcaggagcgcgaga

SEQ ID NO: 470987 - DNA, 20 bp, mouse
ggatcaggagcgcgagacgg

SEQ ID NO: 470988 - DNA, 20 bp, mouse
ggccggggcgagcatcgcta

SEQ ID NO: 470989 - DNA, 20 bp, mouse
ggcgggtccccggcgctcgt

SEQ ID NO: 470990 - DNA, 20 bp, mouse
ggcgcgagacggtggagcgc

SEQ ID NO: 470991 - DNA, 20 bp, mouse
gggcagcgcggggaggtggt

SEQ ID NO: 470992 - DNA, 20 bp, mouse
ggagccggggcccccagcgt

SEQ ID NO: 470993 - DNA, 20 bp, mouse
gaggggtgggatgttcacga

SEQ ID NO: 470994 - DNA, 20 bp, mouse
gcgttatcgggggagctgag

SEQ ID NO: 470995 - DNA, 20 bp, mouse
gaggacagtgagggtggcta

SEQ ID NO: 470996 - DNA, 20 bp, mouse
gataccacggggggaaacag

SEQ ID NO: 470997 - DNA, 20 bp, mouse
gtgcctagaaggaaatacca

SEQ ID NO: 470998 - DNA, 20 bp, mouse
gtagaaggaaataccacggg

SEQ ID NO: 470999 - DNA, 20 bp, mouse
gctgagactaggccgggact

SEQ ID NO: 471000 - DNA, 20 bp, mouse
ggacgagcgaagggccagag

SEQ ID NO: 471001 - DNA, 20 bp, mouse
ggctaggaccgagagggaca

SEQ ID NO: 471002 - DNA, 20 bp, mouse
ggaggccggggattgatgat

SEQ ID NO: 471003 - DNA, 20 bp, mouse
gggcgtggcgacatcgtcgt

SEQ ID NO: 471004 - DNA, 20 bp, mouse
gcgcagagctaggaccgaga

SEQ ID NO: 471005 - DNA, 20 bp, mouse
gcggaggctgagactaggcc

SEQ ID NO: 471006 - DNA, 20 bp, mouse
gggctctgcggtgggcaatg

SEQ ID NO: 471007 - DNA, 20 bp, mouse
ggggtctctgaaagagcggg

SEQ ID NO: 471008 - DNA, 20 bp, mouse
gaccccatctcacttcatgg

SEQ ID NO: 471009 - DNA, 20 bp, mouse
ggagaccccatctcacttca

SEQ ID NO: 471010 - DNA, 20 bp, mouse
gagccgccatgaagtgagat

SEQ ID NO: 471011 - DNA, 20 bp, mouse
gcccagcacccggaagaccc

SEQ ID NO: 471012 - DNA, 20 bp, mouse
ggaggcggctcgagagcacc

SEQ ID NO: 471013 - DNA, 20 bp, mouse
ggagcgggcggctctgcggt

SEQ ID NO: 471014 - DNA, 20 bp, mouse
gacttcatggcggctgatcg

SEQ ID NO: 471015 - DNA, 20 bp, mouse
ggaaagagcgggcggctctg

SEQ ID NO: 471016 - DNA, 20 bp, mouse
gagtaactcctgcggagagg

SEQ ID NO: 471017 - DNA, 20 bp, mouse
gaactcctgcggagaggagg

SEQ ID NO: 471018 - DNA, 20 bp, mouse
ggcaagtaactcctgcggag

SEQ ID NO: 471019 - DNA, 20 bp, mouse
gcattagcaagtaactcctg

SEQ ID NO: 471020 - DNA, 20 bp, mouse
gtgagcccagcaggattcta

SEQ ID NO: 471021 - DNA, 20 bp, mouse
gccataacagctctagatgc

SEQ ID NO: 471022 - DNA, 20 bp, mouse
gcaccacccaaggagacttc

SEQ ID NO: 471023 - DNA, 20 bp, mouse
gtccgccgctgggaaacagg

SEQ ID NO: 471024 - DNA, 20 bp, mouse
gatgggcaaaagagatcgag

SEQ ID NO: 471025 - DNA, 20 bp, mouse
gtcttgccagaagtctcctt

SEQ ID NO: 471026 - DNA, 20 bp, mouse
ggcctctcgtactccaacag

SEQ ID NO: 471027 - DNA, 20 bp, mouse
ggccgctgttggagtacgag

SEQ ID NO: 471028 - DNA, 20 bp, mouse
gtgcggccgcggtcccggaa

SEQ ID NO: 471029 - DNA, 20 bp, mouse
gaggcctgtcgggcgaacgg

SEQ ID NO: 471030 - DNA, 20 bp, mouse
ggccaggcctgtcgggcgaa

SEQ ID NO: 471031 - DNA, 20 bp, mouse
gtcgggcgaacggcggagta

SEQ ID NO: 471032 - DNA, 20 bp, mouse
gtggctgccacgacaaggga

SEQ ID NO: 471033 - DNA, 20 bp, mouse
gccgacaggcctggctccat

SEQ ID NO: 471034 - DNA, 20 bp, mouse
gcagcaccaggcaggccggg

SEQ ID NO: 471035 - DNA, 20 bp, mouse
gaacgcagggagagacgcca

SEQ ID NO: 471036 - DNA, 20 bp, mouse
gctggaacccgctgtcacca

SEQ ID NO: 471037 - DNA, 20 bp, mouse
ggttccaggcggagagcggt

SEQ ID NO: 471038 - DNA, 20 bp, mouse
gtgtcaccagggcttgaagg

SEQ ID NO: 471039 - DNA, 20 bp, mouse
gtcagcccggaggcgctgga

SEQ ID NO: 471040 - DNA, 20 bp, mouse
gccgccttgaaggataccca

SEQ ID NO: 471041 - DNA, 20 bp, mouse
gtgggctctgcgtgagttgg

SEQ ID NO: 471042 - DNA, 20 bp, mouse
ggagcccaccgctctccgcc

SEQ ID NO: 471043 - DNA, 20 bp, mouse
gcggtctcccgaaagaacag

SEQ ID NO: 471044 - DNA, 20 bp, mouse
gctgcgccatgggagtgcag

SEQ ID NO: 471045 - DNA, 20 bp, mouse
ggtgagaactaaagcatagg

SEQ ID NO: 471046 - DNA, 20 bp, mouse
gttgtctcaacgctccgtcg

SEQ ID NO: 471047 - DNA, 20 bp, mouse
gagcgacgaagaattcgttt

SEQ ID NO: 471048 - DNA, 20 bp, mouse
gtccttgagagggagagtca

SEQ ID NO: 471049 - DNA, 20 bp, mouse
gtctcaacgctccgtcgcgg

SEQ ID NO: 471050 - DNA, 20 bp, mouse
ggcctagggcgcatgcgcta

SEQ ID NO: 471051 - DNA, 20 bp, mouse
gtctcacccggccttctgtc

SEQ ID NO: 471052 - DNA, 20 bp, mouse
gtgggcagccgcgtggttct

SEQ ID NO: 471053 - DNA, 20 bp, mouse
ggtggttctgggtgagtgtt

SEQ ID NO: 471054 - DNA, 20 bp, mouse
gggcagccggacagaaggcc

SEQ ID NO: 471055 - DNA, 20 bp, mouse
gccgtgggccggatatcttc

SEQ ID NO: 471056 - DNA, 20 bp, mouse
gcagggaatccggagagccc

SEQ ID NO: 471057 - DNA, 20 bp, mouse
gagccacagcagatcctagg

SEQ ID NO: 471058 - DNA, 20 bp, mouse
gctgggctcacgcactagac

SEQ ID NO: 471059 - DNA, 20 bp, mouse
gtctccggattccctggcca

SEQ ID NO: 471060 - DNA, 20 bp, mouse
gcacagcagatcctaggggg

SEQ ID NO: 471061 - DNA, 20 bp, mouse
gttcaagcgcggttttaact

SEQ ID NO: 471062 - DNA, 20 bp, mouse
gactggccgagagttacctg

SEQ ID NO: 471063 - DNA, 20 bp, mouse
gacttacgagtgacttggca

SEQ ID NO: 471064 - DNA, 20 bp, mouse
ggtaactctcggccagttgt

SEQ ID NO: 471065 - DNA, 20 bp, mouse
ggcagatcctagggggaggt

SEQ ID NO: 471066 - DNA, 20 bp, mouse
gcgctatgtggggcctgacg

SEQ ID NO: 471067 - DNA, 20 bp, mouse
gctcggcggcgaggagagca

SEQ ID NO: 471068 - DNA, 20 bp, mouse
gtatgtggggcctgacgcgg

SEQ ID NO: 471069 - DNA, 20 bp, mouse
gcatcgcccgcccggagcgg

SEQ ID NO: 471070 - DNA, 20 bp, mouse
ggggcatcgcccgcccggag

SEQ ID NO: 471071 - DNA, 20 bp, mouse
gcgaggagagcacggcacgt

SEQ ID NO: 471072 - DNA, 20 bp, mouse
gtagcgccccccgctccggg

SEQ ID NO: 471073 - DNA, 20 bp, mouse
ggagcggggggcgctatgtg

SEQ ID NO: 471074 - DNA, 20 bp, mouse
ggagcgttggctggtcgctg

SEQ ID NO: 471075 - DNA, 20 bp, mouse
gtacgggctctggcgagcgt

SEQ ID NO: 471076 - DNA, 20 bp, mouse
gacatctcgggtccacacac

SEQ ID NO: 471077 - DNA, 20 bp, mouse
gccagttccccggtctgtca

SEQ ID NO: 471078 - DNA, 20 bp, mouse
gacacaccggctggaggcct

SEQ ID NO: 471079 - DNA, 20 bp, mouse
gtagagcgcagtccacacgg

SEQ ID NO: 471080 - DNA, 20 bp, mouse
gggcgctgccatgacagacc

SEQ ID NO: 471081 - DNA, 20 bp, mouse
gtccaaacccgactgtcgag

SEQ ID NO: 471082 - DNA, 20 bp, mouse
ggggtccacacaccggctgg

SEQ ID NO: 471083 - DNA, 20 bp, mouse
gtcgggtcgcaggaccgact

SEQ ID NO: 471084 - DNA, 20 bp, mouse
gctgatggcaggctctccaa

SEQ ID NO: 471085 - DNA, 20 bp, mouse
gcactccaggagagacctga

SEQ ID NO: 471086 - DNA, 20 bp, mouse
gaggctgaacagagaaacac

SEQ ID NO: 471087 - DNA, 20 bp, mouse
gcggacggactccacaaggt

SEQ ID NO: 471088 - DNA, 20 bp, mouse
gctgtgtgctgtggtgggtg

SEQ ID NO: 471089 - DNA, 20 bp, mouse
ggtgtgggtgacgtcgctgg

SEQ ID NO: 471090 - DNA, 20 bp, mouse
gcgcacggacggactccaca

SEQ ID NO: 471091 - DNA, 20 bp, mouse
gcgtccagcggggcgagggt

SEQ ID NO: 471092 - DNA, 20 bp, mouse
ggtttttctgtgggcgtgaa

SEQ ID NO: 471093 - DNA, 20 bp, mouse
ggcgcccgcccaggcacacg

SEQ ID NO: 471094 - DNA, 20 bp, mouse
gcaggcacacgcggcacaca

SEQ ID NO: 471095 - DNA, 20 bp, mouse
ggtgcgtccgtgcgtcccgt

SEQ ID NO: 471096 - DNA, 20 bp, mouse
gagagtcacagcgacttggt

SEQ ID NO: 471097 - DNA, 20 bp, mouse
gaaggtgcctgtggctgagt

SEQ ID NO: 471098 - DNA, 20 bp, mouse
ggctcagagtcacagcgact

SEQ ID NO: 471099 - DNA, 20 bp, mouse
gagcgggagcaaggtgcctg

SEQ ID NO: 471100 - DNA, 20 bp, mouse
ggttggaaccgagctgatcc

SEQ ID NO: 471101 - DNA, 20 bp, mouse
gtcggttccaactcagccac

SEQ ID NO: 471102 - DNA, 20 bp, mouse
gacagcgacttggtgggctc

SEQ ID NO: 471103 - DNA, 20 bp, mouse
gcagcttgcggagtgcgcgg

SEQ ID NO: 471104 - DNA, 20 bp, mouse
ggcggcggccagcgggagca

SEQ ID NO: 471105 - DNA, 20 bp, mouse
gggagtgcgcggcggccagc

SEQ ID NO: 471106 - DNA, 20 bp, mouse
gtgagaggcgaggccgggtg

SEQ ID NO: 471107 - DNA, 20 bp, mouse
gacgcgggcgccaggagcag

SEQ ID NO: 471108 - DNA, 20 bp, mouse
ggcggcgagggcgtcccaac

SEQ ID NO: 471109 - DNA, 20 bp, mouse
gggacgggacggggcaacgc

SEQ ID NO: 471110 - DNA, 20 bp, mouse
ggcgcgcagccactgaggac

SEQ ID NO: 471111 - DNA, 20 bp, mouse
gaacgggcgcgggacgggac

SEQ ID NO: 471112 - DNA, 20 bp, mouse
ggtcccaacgggcgcgggac

SEQ ID NO: 471113 - DNA, 20 bp, mouse
gaggttgccgagtccgggaa

SEQ ID NO: 471114 - DNA, 20 bp, mouse
ggagcagcggcccggagttg

SEQ ID NO: 471115 - DNA, 20 bp, mouse
gcggagtgcgatattaaccc

SEQ ID NO: 471116 - DNA, 20 bp, mouse
gccttgcggatggtctgagt

SEQ ID NO: 471117 - DNA, 20 bp, mouse
gttatcaaggcagataagtt

SEQ ID NO: 471118 - DNA, 20 bp, mouse
gaccccccacaccacaatag

SEQ ID NO: 471119 - DNA, 20 bp, mouse
ggtcagccaatggcaggaag

SEQ ID NO: 471120 - DNA, 20 bp, mouse
gggcgctcaacagtgaattt

SEQ ID NO: 471121 - DNA, 20 bp, mouse
gattatggccagcactatta

SEQ ID NO: 471122 - DNA, 20 bp, mouse
gtcctctattgtggtgtggg

SEQ ID NO: 471123 - DNA, 20 bp, mouse
gtacgaggcattaaccacag

SEQ ID NO: 471124 - DNA, 20 bp, mouse
gccagaaagtagttttgatg

SEQ ID NO: 471125 - DNA, 20 bp, mouse
gccctgccctccaacctctg

SEQ ID NO: 471126 - DNA, 20 bp, mouse
gtggcctgcaacgctcccac

SEQ ID NO: 471127 - DNA, 20 bp, mouse
gatcgtgccgccgagccggt

SEQ ID NO: 471128 - DNA, 20 bp, mouse
ggccaggacagggtccacta

SEQ ID NO: 471129 - DNA, 20 bp, mouse
gggtccactagggaagactg

SEQ ID NO: 471130 - DNA, 20 bp, mouse
gagagtgcgagggcttgcca

SEQ ID NO: 471131 - DNA, 20 bp, mouse
gcagcgggctcggacccacg

SEQ ID NO: 471132 - DNA, 20 bp, mouse
gaacgctcccaccggctcgg

SEQ ID NO: 471133 - DNA, 20 bp, mouse
gaggcgtgcacagtgcacca

SEQ ID NO: 471134 - DNA, 20 bp, mouse
gggggcggccgaggaggcgt

SEQ ID NO: 471135 - DNA, 20 bp, mouse
gacgcctcggcaggccctag

SEQ ID NO: 471136 - DNA, 20 bp, mouse
gcggctgggaccgtaccact

SEQ ID NO: 471137 - DNA, 20 bp, mouse
gcccgggcttctgtgaaaca

SEQ ID NO: 471138 - DNA, 20 bp, mouse
gccgccgaaggaaacggccc

SEQ ID NO: 471139 - DNA, 20 bp, mouse
gagcgtcttacctagtggta

SEQ ID NO: 471140 - DNA, 20 bp, mouse
ggaaggaaacggccccggca

SEQ ID NO: 471141 - DNA, 20 bp, mouse
ggcctggacgagacaacgaa

SEQ ID NO: 471142 - DNA, 20 bp, mouse
gactcggcaggaacgccccc

SEQ ID NO: 471143 - DNA, 20 bp, mouse
ggagccgctccgctgcccgg

SEQ ID NO: 471144 - DNA, 20 bp, mouse
gcagctgttgacccatccag

SEQ ID NO: 471145 - DNA, 20 bp, mouse
ggttttagcgtcttacctag

SEQ ID NO: 471146 - DNA, 20 bp, mouse
gtcctccagagtcttagggt

SEQ ID NO: 471147 - DNA, 20 bp, mouse
gttccggccggtccccatgg

SEQ ID NO: 471148 - DNA, 20 bp, mouse
gggtccccatggaggcgctg

SEQ ID NO: 471149 - DNA, 20 bp, mouse
ggaagtcctccagagtctta

SEQ ID NO: 471150 - DNA, 20 bp, mouse
ggcttccccagcgcctccat

SEQ ID NO: 471151 - DNA, 20 bp, mouse
gcctttccggccggtcccca

SEQ ID NO: 471152 - DNA, 20 bp, mouse
gccctccgtggcctgctaag

SEQ ID NO: 471153 - DNA, 20 bp, mouse
gccggaagcgggaggctgga

SEQ ID NO: 471154 - DNA, 20 bp, mouse
ggcagggcgagagcgagatt

SEQ ID NO: 471155 - DNA, 20 bp, mouse
ggcggggcctggcattctaa

SEQ ID NO: 471156 - DNA, 20 bp, mouse
ggcagcagaggtgttagcgg

SEQ ID NO: 471157 - DNA, 20 bp, mouse
ggcggcagcagaggtgttag

SEQ ID NO: 471158 - DNA, 20 bp, mouse
ggggaccccggcaaccgcta

SEQ ID NO: 471159 - DNA, 20 bp, mouse
gaggcagcgatcggcaggga

SEQ ID NO: 471160 - DNA, 20 bp, mouse
gcgcgatggtgagtccttag

SEQ ID NO: 471161 - DNA, 20 bp, mouse
gatcgctgcctggaagaggg

SEQ ID NO: 471162 - DNA, 20 bp, mouse
gtagccgactgtaggaacaa

SEQ ID NO: 471163 - DNA, 20 bp, mouse
gttggctgttggcggcgttg

SEQ ID NO: 471164 - DNA, 20 bp, mouse
ggatcaggtccggggcctac

SEQ ID NO: 471165 - DNA, 20 bp, mouse
ggcatctgatgagaaatgaa

SEQ ID NO: 471166 - DNA, 20 bp, mouse
gcccggaagtaggaggcgtc

SEQ ID NO: 471167 - DNA, 20 bp, mouse
gacacgctcccggaagtagg

SEQ ID NO: 471168 - DNA, 20 bp, mouse
gaccgcgcttcacgttcccg

SEQ ID NO: 471169 - DNA, 20 bp, mouse
ggcgcttcacgttcccgcgg

SEQ ID NO: 471170 - DNA, 20 bp, mouse
gtccggcggagtttgtgtgg

SEQ ID NO: 471171 - DNA, 20 bp, mouse
gggcgcagcagaagacgccg

SEQ ID NO: 471172 - DNA, 20 bp, mouse
ggccgccacacaaactccgc

SEQ ID NO: 471173 - DNA, 20 bp, mouse
gtcggtccaccgagacccgc

SEQ ID NO: 471174 - DNA, 20 bp, mouse
gagcatcgtcggcctcgaga

SEQ ID NO: 471175 - DNA, 20 bp, mouse
gcgcatctggcggggagggt

SEQ ID NO: 471176 - DNA, 20 bp, mouse
ggggatggcgaccaagagac

SEQ ID NO: 471177 - DNA, 20 bp, mouse
gagactggcgcggtacgtta

SEQ ID NO: 471178 - DNA, 20 bp, mouse
ggaacaccgcccaccctaag

SEQ ID NO: 471179 - DNA, 20 bp, mouse
gtgggtttcgcagagttcaa

SEQ ID NO: 471180 - DNA, 20 bp, mouse
ggatagagcatgccacggta

SEQ ID NO: 471181 - DNA, 20 bp, mouse
ggaggagcccgagaaacccc

SEQ ID NO: 471182 - DNA, 20 bp, mouse
gctctgcgaaacccagggtc

SEQ ID NO: 471183 - DNA, 20 bp, mouse
gacgtaccgcgccagtctct

SEQ ID NO: 471184 - DNA, 20 bp, mouse
ggtcacgttccaggtcccag

SEQ ID NO: 471185 - DNA, 20 bp, mouse
gccccgggtcctccctaccg

SEQ ID NO: 471186 - DNA, 20 bp, mouse
gagagtgcgcggaggtgagt

SEQ ID NO: 471187 - DNA, 20 bp, mouse
ggcttcccacagcccgttcc

SEQ ID NO: 471188 - DNA, 20 bp, mouse
gcagggaagcgtaaggggag

SEQ ID NO: 471189 - DNA, 20 bp, mouse
gtcggggtcagagtgcgcgg

SEQ ID NO: 471190 - DNA, 20 bp, mouse
ggccatggcgacagcctctc

SEQ ID NO: 471191 - DNA, 20 bp, mouse
gctctccggcagctgacggg

SEQ ID NO: 471192 - DNA, 20 bp, mouse
gcggctttgcgagagagact

SEQ ID NO: 471193 - DNA, 20 bp, mouse
gtcggtgtgttgtggactcg

SEQ ID NO: 471194 - DNA, 20 bp, mouse
gaggtccagggaagcgtaag

SEQ ID NO: 471195 - DNA, 20 bp, mouse
ggaggtgagtcggtgtgttg

SEQ ID NO: 471196 - DNA, 20 bp, mouse
gttctcttcggaagcagggt

SEQ ID NO: 471197 - DNA, 20 bp, mouse
gagcgccgcgcgactggtgg

SEQ ID NO: 471198 - DNA, 20 bp, mouse
ggggccagagatcccggctg

SEQ ID NO: 471199 - DNA, 20 bp, mouse
ggtccagtatgtcttctctt

SEQ ID NO: 471200 - DNA, 20 bp, mouse
gggaagcgccgcgcgactgg

SEQ ID NO: 471201 - DNA, 20 bp, mouse
ggagcactgagggatcgtag

SEQ ID NO: 471202 - DNA, 20 bp, mouse
gttccgaagagaagacatac

SEQ ID NO: 471203 - DNA, 20 bp, mouse
gggcctacacgagaggaatc

SEQ ID NO: 471204 - DNA, 20 bp, mouse
ggtgggcgggcctacacgag

SEQ ID NO: 471205 - DNA, 20 bp, mouse
ggcgcgactggtggcggctg

SEQ ID NO: 471206 - DNA, 20 bp, mouse
gttcggtcacaaaagagggt

SEQ ID NO: 471207 - DNA, 20 bp, mouse
ggaagcataagacctctaaa

SEQ ID NO: 471208 - DNA, 20 bp, mouse
gcccagcccgggccaagtct

SEQ ID NO: 471209 - DNA, 20 bp, mouse
gctgcttcggtcacaaaaga

SEQ ID NO: 471210 - DNA, 20 bp, mouse
gtgatcctgactctaggtgg

SEQ ID NO: 471211 - DNA, 20 bp, mouse
ggttaggggcgcacaccctg

SEQ ID NO: 471212 - DNA, 20 bp, mouse
ggcgctgcggggcaagttag

SEQ ID NO: 471213 - DNA, 20 bp, mouse
gcctaggagaactgatgtcg

SEQ ID NO: 471214 - DNA, 20 bp, mouse
gtgggtgggaaaggcgagtc

SEQ ID NO: 471215 - DNA, 20 bp, mouse
gacccagccctcccaactca

SEQ ID NO: 471216 - DNA, 20 bp, mouse
gcgtctgcaaggagacgtgg

SEQ ID NO: 471217 - DNA, 20 bp, mouse
gagccgtctgcaaggagacg

SEQ ID NO: 471218 - DNA, 20 bp, mouse
ggtggccccaagcccttgta

SEQ ID NO: 471219 - DNA, 20 bp, mouse
ggccccaagcccttgtaagg

SEQ ID NO: 471220 - DNA, 20 bp, mouse
gggttgggtcccctgcacta

SEQ ID NO: 471221 - DNA, 20 bp, mouse
gagccgcctccgccttacaa

SEQ ID NO: 471222 - DNA, 20 bp, mouse
gctgcaaggagacgtggcgg

SEQ ID NO: 471223 - DNA, 20 bp, mouse
gccaagcccttgtaaggcgg

SEQ ID NO: 471224 - DNA, 20 bp, mouse
gagaaggctgcggctcgtga

SEQ ID NO: 471225 - DNA, 20 bp, mouse
gagcccttgtaaggcggagg

SEQ ID NO: 471226 - DNA, 20 bp, mouse
ggatgcgtcactgaccggtg

SEQ ID NO: 471227 - DNA, 20 bp, mouse
ggggtggcggctgcacgtgc

SEQ ID NO: 471228 - DNA, 20 bp, mouse
ggccgcagtaccgggcaggt

SEQ ID NO: 471229 - DNA, 20 bp, mouse
gggggcgatgcgtcactgac

SEQ ID NO: 471230 - DNA, 20 bp, mouse
gggctgttggcagcagttgg

SEQ ID NO: 471231 - DNA, 20 bp, mouse
ggtcactgaccggtgaggcg

SEQ ID NO: 471232 - DNA, 20 bp, mouse
gggactggcctgtcactcaa

SEQ ID NO: 471233 - DNA, 20 bp, mouse
gcttgatcgcaggcactcgg

SEQ ID NO: 471234 - DNA, 20 bp, mouse
gcctaacgcttggggagtcg

SEQ ID NO: 471235 - DNA, 20 bp, mouse
gtcctgagcatggggagaag

SEQ ID NO: 471236 - DNA, 20 bp, mouse
gatgccgagcgtgcacggag

SEQ ID NO: 471237 - DNA, 20 bp, mouse
gccgagcgtgcacggagggg

SEQ ID NO: 471238 - DNA, 20 bp, mouse
gctcctccgcgaggcagaca

SEQ ID NO: 471239 - DNA, 20 bp, mouse
gactggcccggaaggaagta

SEQ ID NO: 471240 - DNA, 20 bp, mouse
gagcttccgctcggacccgt

SEQ ID NO: 471241 - DNA, 20 bp, mouse
gggtttctacggttgcacgg

SEQ ID NO: 471242 - DNA, 20 bp, mouse
gctgtgtacggagcgcctgg

SEQ ID NO: 471243 - DNA, 20 bp, mouse
gggggactggactcccgggt

SEQ ID NO: 471244 - DNA, 20 bp, mouse
gacgggggttcggctgtgta

SEQ ID NO: 471245 - DNA, 20 bp, mouse
gggcaggggactggactccc

SEQ ID NO: 471246 - DNA, 20 bp, mouse
gggtagacagagagaaccct

SEQ ID NO: 471247 - DNA, 20 bp, mouse
gcagtcagaggccctctgtg

SEQ ID NO: 471248 - DNA, 20 bp, mouse
gcaggaagatctcaagagat

SEQ ID NO: 471249 - DNA, 20 bp, mouse
gggcagggtggtctgacatc

SEQ ID NO: 471250 - DNA, 20 bp, mouse
ggccagagtctcaaagccaa

SEQ ID NO: 471251 - DNA, 20 bp, mouse
gggaacactgggctccccac

SEQ ID NO: 471252 - DNA, 20 bp, mouse
ggacatcgggcaagagtgcc

SEQ ID NO: 471253 - DNA, 20 bp, mouse
ggggctccccacaggcaggg

SEQ ID NO: 471254 - DNA, 20 bp, mouse
gactgggctccccacaggca

SEQ ID NO: 471255 - DNA, 20 bp, mouse
gccgggacccagcagatggt

SEQ ID NO: 471256 - DNA, 20 bp, mouse
gagtgaatggcagggtatcc

SEQ ID NO: 471257 - DNA, 20 bp, mouse
gccgggatcgtataagccat

SEQ ID NO: 471258 - DNA, 20 bp, mouse
ggaaatgcaagtctcaaaga

SEQ ID NO: 471259 - DNA, 20 bp, mouse
gcagttccagctgcaggatg

SEQ ID NO: 471260 - DNA, 20 bp, mouse
gtgcagctggaactgtagtg

SEQ ID NO: 471261 - DNA, 20 bp, mouse
gagggtatcctggcagttct

SEQ ID NO: 471262 - DNA, 20 bp, mouse
gggcttgtttataaactgat

SEQ ID NO: 471263 - DNA, 20 bp, mouse
gagatgaagagtgaatggca

SEQ ID NO: 471264 - DNA, 20 bp, mouse
gaatctgagcagcagcacca

SEQ ID NO: 471265 - DNA, 20 bp, mouse
gaatgtactaccaccagcaa

SEQ ID NO: 471266 - DNA, 20 bp, mouse
gacagtgcttagacacttga

SEQ ID NO: 471267 - DNA, 20 bp, mouse
gtctacgcatagagctatta

SEQ ID NO: 471268 - DNA, 20 bp, mouse
ggccggaagcgatggaggta

SEQ ID NO: 471269 - DNA, 20 bp, mouse
ggctgcgggcctgccaggac

SEQ ID NO: 471270 - DNA, 20 bp, mouse
gctgttccaggagcccgtcc

SEQ ID NO: 471271 - DNA, 20 bp, mouse
gcccgagccggaagcgatgg

SEQ ID NO: 471272 - DNA, 20 bp, mouse
ggaacagcaactcagaataa

SEQ ID NO: 471273 - DNA, 20 bp, mouse
ggcaactcagaataagggat

SEQ ID NO: 471274 - DNA, 20 bp, mouse
gcgacccgagccggaagcga

SEQ ID NO: 471275 - DNA, 20 bp, mouse
ggcccagaagcaccgagtta

SEQ ID NO: 471276 - DNA, 20 bp, mouse
gtgcacgtcagactgagagt

SEQ ID NO: 471277 - DNA, 20 bp, mouse
gagccctgaaaacctttcgg

SEQ ID NO: 471278 - DNA, 20 bp, mouse
gtcgataagctctaatgctg

SEQ ID NO: 471279 - DNA, 20 bp, mouse
gagagttggtttcgaactgt

SEQ ID NO: 471280 - DNA, 20 bp, mouse
gagcgggacagagtgcaatg

SEQ ID NO: 471281 - DNA, 20 bp, mouse
gactgatgcagatgagaccc

SEQ ID NO: 471282 - DNA, 20 bp, mouse
gaagatgagaagatcctcaa

SEQ ID NO: 471283 - DNA, 20 bp, mouse
ggagacccaggcatactaca

SEQ ID NO: 471284 - DNA, 20 bp, mouse
gggctcagaatgaatatgat

SEQ ID NO: 471285 - DNA, 20 bp, mouse
gatagcaagattcctccgaa

SEQ ID NO: 471286 - DNA, 20 bp, mouse
ggagtggagctcggagtcag

SEQ ID NO: 471287 - DNA, 20 bp, mouse
gtccgagctccactccatgg

SEQ ID NO: 471288 - DNA, 20 bp, mouse
gggcagttgccgccatggag

SEQ ID NO: 471289 - DNA, 20 bp, mouse
gggagtcagcggctgtgcgg

SEQ ID NO: 471290 - DNA, 20 bp, mouse
gggactgtcgcaggctgggg

SEQ ID NO: 471291 - DNA, 20 bp, mouse
gcccggactgtcgcaggctg

SEQ ID NO: 471292 - DNA, 20 bp, mouse
ggcggagcgtcgggagggag

SEQ ID NO: 471293 - DNA, 20 bp, mouse
ggcaccgcggagcgtcggga

SEQ ID NO: 471294 - DNA, 20 bp, mouse
gctcggagtcagcggctgtg

SEQ ID NO: 471295 - DNA, 20 bp, mouse
gtgtcgcaggctggggcggt

SEQ ID NO: 471296 - DNA, 20 bp, mouse
gcgcggcaccggcggaggat

SEQ ID NO: 471297 - DNA, 20 bp, mouse
gaacgacagcgcggcaccgg

SEQ ID NO: 471298 - DNA, 20 bp, mouse
gggcggaggatcggtggaca

SEQ ID NO: 471299 - DNA, 20 bp, mouse
gggcaccggcggaggatcgg

SEQ ID NO: 471300 - DNA, 20 bp, mouse
gggtggacacggagctgact

SEQ ID NO: 471301 - DNA, 20 bp, mouse
gggacacggagctgactggg

SEQ ID NO: 471302 - DNA, 20 bp, mouse
ggacagcgcggcaccggcgg

SEQ ID NO: 471303 - DNA, 20 bp, mouse
gccccggggtgagtaaccag

SEQ ID NO: 471304 - DNA, 20 bp, mouse
gcttatagggctgggaatgg

SEQ ID NO: 471305 - DNA, 20 bp, mouse
ggcgcgaacagagggctgga

SEQ ID NO: 471306 - DNA, 20 bp, mouse
ggctgcagcaggaacccgag

SEQ ID NO: 471307 - DNA, 20 bp, mouse
gactggtctcgccatagtct

SEQ ID NO: 471308 - DNA, 20 bp, mouse
gctattgcctgaggcactga

SEQ ID NO: 471309 - DNA, 20 bp, mouse
gacagttgaaatctctggac

SEQ ID NO: 471310 - DNA, 20 bp, mouse
gccccagccaggtttatgag

SEQ ID NO: 471311 - DNA, 20 bp, mouse
gagaccacagttgaaatctc

SEQ ID NO: 471312 - DNA, 20 bp, mouse
gtgaggggttcactcactag

SEQ ID NO: 471313 - DNA, 20 bp, mouse
gagagctccgctattgcctg

SEQ ID NO: 471314 - DNA, 20 bp, mouse
gaaaggggggagggtcacgt

SEQ ID NO: 471315 - DNA, 20 bp, mouse
gatagcggagctctctccac

SEQ ID NO: 471316 - DNA, 20 bp, mouse
ggccggggagccaagcacgg

SEQ ID NO: 471317 - DNA, 20 bp, mouse
gcggcggcgcgggtagaggg

SEQ ID NO: 471318 - DNA, 20 bp, mouse
ggagcggcggccggagacag

SEQ ID NO: 471319 - DNA, 20 bp, mouse
gtgcgccggggagccaagca

SEQ ID NO: 471320 - DNA, 20 bp, mouse
ggcacggcggcgcgggtaga

SEQ ID NO: 471321 - DNA, 20 bp, mouse
gggcgcgggtagagggcggt

SEQ ID NO: 471322 - DNA, 20 bp, mouse
gagtccaacgagcaagcccc

SEQ ID NO: 471323 - DNA, 20 bp, mouse
gaggcgcgcgggcggcccag

SEQ ID NO: 471324 - DNA, 20 bp, mouse
gaacgagcaagccccaggcg

SEQ ID NO: 471325 - DNA, 20 bp, mouse
ggcttgctcgttggactcct

SEQ ID NO: 471326 - DNA, 20 bp, mouse
ggggtctgagcgccggtctc

SEQ ID NO: 471327 - DNA, 20 bp, mouse
gcgggagcctccaggacccg

SEQ ID NO: 471328 - DNA, 20 bp, mouse
gcagtcgctgctgctgcgaa

SEQ ID NO: 471329 - DNA, 20 bp, mouse
gggacccggggtctgagcgc

SEQ ID NO: 471330 - DNA, 20 bp, mouse
ggccgcgacgacgacagcag

SEQ ID NO: 471331 - DNA, 20 bp, mouse
gagtgttccttgcccgagac

SEQ ID NO: 471332 - DNA, 20 bp, mouse
gtgagcgccggtctcgggca

SEQ ID NO: 471333 - DNA, 20 bp, mouse
ggcccgaggaccaaaggcag

SEQ ID NO: 471334 - DNA, 20 bp, mouse
ggttccgccgggccgttact

SEQ ID NO: 471335 - DNA, 20 bp, mouse
gacagcagggggcagtgcct

SEQ ID NO: 471336 - DNA, 20 bp, mouse
ggtgggtgccaatccaggac

SEQ ID NO: 471337 - DNA, 20 bp, mouse
gtcaccagcctgtcctggat

SEQ ID NO: 471338 - DNA, 20 bp, mouse
gcactgtagatgttgagagt

SEQ ID NO: 471339 - DNA, 20 bp, mouse
gtgagagtgggtgccaatcc

SEQ ID NO: 471340 - DNA, 20 bp, mouse
ggaggacaaacgagaggatt

SEQ ID NO: 471341 - DNA, 20 bp, mouse
gaggattaggcatctagacc

SEQ ID NO: 471342 - DNA, 20 bp, mouse
gacacacgaggacaaacgag

SEQ ID NO: 471343 - DNA, 20 bp, mouse
ggcagcagcgatgagttcca

SEQ ID NO: 471344 - DNA, 20 bp, mouse
gcctcatggcagcttcactg

SEQ ID NO: 471345 - DNA, 20 bp, mouse
ggcagcgatgagttccacgg

SEQ ID NO: 471346 - DNA, 20 bp, mouse
ggcagcgccagacaccccgg

SEQ ID NO: 471347 - DNA, 20 bp, mouse
gtcacgccggatggtgggag

SEQ ID NO: 471348 - DNA, 20 bp, mouse
ggcgccagacaccccggcgg

SEQ ID NO: 471349 - DNA, 20 bp, mouse
gcaggcggagcgctccgagt

SEQ ID NO: 471350 - DNA, 20 bp, mouse
gaggagcacggacagcagtg

SEQ ID NO: 471351 - DNA, 20 bp, mouse
gggccatcacgccggatggt

SEQ ID NO: 471352 - DNA, 20 bp, mouse
ggagacaggcaagctacagg

SEQ ID NO: 471353 - DNA, 20 bp, mouse
gaggtgcagatagacgcccg

SEQ ID NO: 471354 - DNA, 20 bp, mouse
gccgggcccaacgtccccgt

SEQ ID NO: 471355 - DNA, 20 bp, mouse
ggcagcggcctacacacgaa

SEQ ID NO: 471356 - DNA, 20 bp, mouse
ggctggagctccgggtcgag

SEQ ID NO: 471357 - DNA, 20 bp, mouse
ggctccgggtcgagaggacg

SEQ ID NO: 471358 - DNA, 20 bp, mouse
gactggaccgggctagaaaa

SEQ ID NO: 471359 - DNA, 20 bp, mouse
gcgccagcggaggagagtcg

SEQ ID NO: 471360 - DNA, 20 bp, mouse
ggctccagcggcgaacaccc

SEQ ID NO: 471361 - DNA, 20 bp, mouse
ggagcagcaaggagcatctg

SEQ ID NO: 471362 - DNA, 20 bp, mouse
ggcacctcgtcctctcgacc

SEQ ID NO: 471363 - DNA, 20 bp, mouse
gggagagtcgaggcaagcag

SEQ ID NO: 471364 - DNA, 20 bp, mouse
gaccgggctagaaaagggct

SEQ ID NO: 471365 - DNA, 20 bp, mouse
gaggcgttcagggacacagt

SEQ ID NO: 471366 - DNA, 20 bp, mouse
ggccaggccccttaccccaa

SEQ ID NO: 471367 - DNA, 20 bp, mouse
gcgagggcaagagagcggcg

SEQ ID NO: 471368 - DNA, 20 bp, mouse
ggcgtcggcggccgagtgcg

SEQ ID NO: 471369 - DNA, 20 bp, mouse
gacgcaccccggcccatccc

SEQ ID NO: 471370 - DNA, 20 bp, mouse
gccaagggagcgggaccccg

SEQ ID NO: 471371 - DNA, 20 bp, mouse
gtcggctgcgccggcgtcgg

SEQ ID NO: 471372 - DNA, 20 bp, mouse
gtctcgccggggccatgcac

SEQ ID NO: 471373 - DNA, 20 bp, mouse
gagctgcaccgggaagaccg

SEQ ID NO: 471374 - DNA, 20 bp, mouse
gcagctgcggcccagggatg

SEQ ID NO: 471375 - DNA, 20 bp, mouse
gggccccggcgagaagccga

SEQ ID NO: 471376 - DNA, 20 bp, mouse
gatactggccagctacacac

SEQ ID NO: 471377 - DNA, 20 bp, mouse
gagctacacaccggagactt

SEQ ID NO: 471378 - DNA, 20 bp, mouse
gctgaacgcctggatctccg

SEQ ID NO: 471379 - DNA, 20 bp, mouse
ggctggccagtatctaataa

SEQ ID NO: 471380 - DNA, 20 bp, mouse
ggcatcgggagccctctcag

SEQ ID NO: 471381 - DNA, 20 bp, mouse
gctggacctttattagatac

SEQ ID NO: 471382 - DNA, 20 bp, mouse
gcagcacctagattccactg

SEQ ID NO: 471383 - DNA, 20 bp, mouse
gggcatggagaacctgtcga

SEQ ID NO: 471384 - DNA, 20 bp, mouse
gggagactccacggagatcc

SEQ ID NO: 471385 - DNA, 20 bp, mouse
gaataaaggtccagaacatc

SEQ ID NO: 471386 - DNA, 20 bp, mouse
gggaaccaggctactgacca

SEQ ID NO: 471387 - DNA, 20 bp, mouse
gaccaggctactgaccaggg

SEQ ID NO: 471388 - DNA, 20 bp, mouse
gcggcaacccgaatgtgcac

SEQ ID NO: 471389 - DNA, 20 bp, mouse
gaggtgttgtgggtgagcgg

SEQ ID NO: 471390 - DNA, 20 bp, mouse
gcggtgtctacaggtgttgt

SEQ ID NO: 471391 - DNA, 20 bp, mouse
gtacaggtgttgtgggtgag

SEQ ID NO: 471392 - DNA, 20 bp, mouse
gcggagtactcagggagagt

SEQ ID NO: 471393 - DNA, 20 bp, mouse
gccttggcccggagtactca

SEQ ID NO: 471394 - DNA, 20 bp, mouse
gacttgggttggagccaccc

SEQ ID NO: 471395 - DNA, 20 bp, mouse
ggtcaaacaccgggtctgga

SEQ ID NO: 471396 - DNA, 20 bp, mouse
gcgcaggtcgcctcacatcc

SEQ ID NO: 471397 - DNA, 20 bp, mouse
gagacgccggcgcccgaggt

SEQ ID NO: 471398 - DNA, 20 bp, mouse
gcaggaggcaggggaaacga

SEQ ID NO: 471399 - DNA, 20 bp, mouse
gccccggccgcgcagcagga

SEQ ID NO: 471400 - DNA, 20 bp, mouse
gccgcccagctggttcccgg

SEQ ID NO: 471401 - DNA, 20 bp, mouse
gctccgggtacccggatgtg

SEQ ID NO: 471402 - DNA, 20 bp, mouse
gagaggagccgggacacacg

SEQ ID NO: 471403 - DNA, 20 bp, mouse
gcgtgacaggcggccagcgg

SEQ ID NO: 471404 - DNA, 20 bp, mouse
ggcagcgcgaccctgaggac

SEQ ID NO: 471405 - DNA, 20 bp, mouse
ggaggcaggggaaacgacgg

SEQ ID NO: 471406 - DNA, 20 bp, mouse
ggagcgtctacggggcaaca

SEQ ID NO: 471407 - DNA, 20 bp, mouse
gtctcacgcaggcaaggaga

SEQ ID NO: 471408 - DNA, 20 bp, mouse
gcaaggtcgtaagcttgctg

SEQ ID NO: 471409 - DNA, 20 bp, mouse
ggccaacccgagcgtctacg

SEQ ID NO: 471410 - DNA, 20 bp, mouse
gggtctgagcgaggtaatat

SEQ ID NO: 471411 - DNA, 20 bp, mouse
ggcagaggggtcatttcgtg

SEQ ID NO: 471412 - DNA, 20 bp, mouse
gtcgctcagacctccaggaa

SEQ ID NO: 471413 - DNA, 20 bp, mouse
gagccccgccgggacccgtg

SEQ ID NO: 471414 - DNA, 20 bp, mouse
ggccccgtagacgctcgggt

SEQ ID NO: 471415 - DNA, 20 bp, mouse
gcagcctgcacgttcaggga

SEQ ID NO: 471416 - DNA, 20 bp, mouse
gctcgccagggaagaaggtt

SEQ ID NO: 471417 - DNA, 20 bp, mouse
gtagaagctgcccctcaccg

SEQ ID NO: 471418 - DNA, 20 bp, mouse
gccagaggcagtgctcgggg

SEQ ID NO: 471419 - DNA, 20 bp, mouse
gtccatcttacctcggtgag

SEQ ID NO: 471420 - DNA, 20 bp, mouse
gggcagcttctaactcgcca

SEQ ID NO: 471421 - DNA, 20 bp, mouse
gcccaggctgggatcccgga

SEQ ID NO: 471422 - DNA, 20 bp, mouse
gaagccccaaccttcttccc

SEQ ID NO: 471423 - DNA, 20 bp, mouse
gatggtgtgggcggagccag

SEQ ID NO: 471424 - DNA, 20 bp, mouse
gtctaactcgccagggaaga

SEQ ID NO: 471425 - DNA, 20 bp, mouse
ggagccagaggcagtgctcg

SEQ ID NO: 471426 - DNA, 20 bp, mouse
gatcccaaggagagcccgac

SEQ ID NO: 471427 - DNA, 20 bp, mouse
ggggatctgagaagagtggt

SEQ ID NO: 471428 - DNA, 20 bp, mouse
ggaaagggaccggactatag

SEQ ID NO: 471429 - DNA, 20 bp, mouse
ggggctactcacaaatccca

SEQ ID NO: 471430 - DNA, 20 bp, mouse
gctccatgtgaactcagact

SEQ ID NO: 471431 - DNA, 20 bp, mouse
ggcgtctcgcggaggattgt

SEQ ID NO: 471432 - DNA, 20 bp, mouse
gaactgtgcggtcgcccgtc

SEQ ID NO: 471433 - DNA, 20 bp, mouse
gtcgcccgtcgggctctcct

SEQ ID NO: 471434 - DNA, 20 bp, mouse
ggtgagtagcccctatagtc

SEQ ID NO: 471435 - DNA, 20 bp, mouse
gagctctgaagagaacaatg

SEQ ID NO: 471436 - DNA, 20 bp, mouse
gcctccagcaaagaccacga

SEQ ID NO: 471437 - DNA, 20 bp, mouse
gggacagtgctggatgactg

SEQ ID NO: 471438 - DNA, 20 bp, mouse
ggtccatgcctgagactgta

SEQ ID NO: 471439 - DNA, 20 bp, mouse
gagcaaagaccacgacggca

SEQ ID NO: 471440 - DNA, 20 bp, mouse
gaccctccgggagccctgca

SEQ ID NO: 471441 - DNA, 20 bp, mouse
gtcctggtacctctgcacct

SEQ ID NO: 471442 - DNA, 20 bp, mouse
ggcccaggtgcagaggtacc

SEQ ID NO: 471443 - DNA, 20 bp, mouse
gtccgggagccctgcacggt

SEQ ID NO: 471444 - DNA, 20 bp, mouse
gataaaactcataaccgtgt

SEQ ID NO: 471445 - DNA, 20 bp, mouse
ggcctggagcgccaaatatg

SEQ ID NO: 471446 - DNA, 20 bp, mouse
gctgctaggccggtgaggaa

SEQ ID NO: 471447 - DNA, 20 bp, mouse
ggctccaccaagcaccgggt

SEQ ID NO: 471448 - DNA, 20 bp, mouse
gtgcttggtggagctcgggc

SEQ ID NO: 471449 - DNA, 20 bp, mouse
gggacgctgctaggccggtg

SEQ ID NO: 471450 - DNA, 20 bp, mouse
gcgaagctgccgttcctcac

SEQ ID NO: 471451 - DNA, 20 bp, mouse
gcaccgcaggggtctccaca

SEQ ID NO: 471452 - DNA, 20 bp, mouse
gggcagcttcgagggaatta

SEQ ID NO: 471453 - DNA, 20 bp, mouse
ggtgcccacccggtgcttgg

SEQ ID NO: 471454 - DNA, 20 bp, mouse
gcgggctggaggacgctgct

SEQ ID NO: 471455 - DNA, 20 bp, mouse
gctgaggacaaggagcgtcc

SEQ ID NO: 471456 - DNA, 20 bp, mouse
ggagctgggcagttgatggt

SEQ ID NO: 471457 - DNA, 20 bp, mouse
gggcccctgggagttcatgg

SEQ ID NO: 471458 - DNA, 20 bp, mouse
gagaggcccctgggagttca

SEQ ID NO: 471459 - DNA, 20 bp, mouse
gagccaccatgaactcccag

SEQ ID NO: 471460 - DNA, 20 bp, mouse
gcccccacctagaggcccct

SEQ ID NO: 471461 - DNA, 20 bp, mouse
gactcccaggggcctctagg

SEQ ID NO: 471462 - DNA, 20 bp, mouse
ggccatcagcgcccagtcca

SEQ ID NO: 471463 - DNA, 20 bp, mouse
ggtatatggcccccacctag

SEQ ID NO: 471464 - DNA, 20 bp, mouse
gcagctccaaagcacggacc

SEQ ID NO: 471465 - DNA, 20 bp, mouse
gccagatcctgggataccga

SEQ ID NO: 471466 - DNA, 20 bp, mouse
gtgcagccgtcggaggagtg

SEQ ID NO: 471467 - DNA, 20 bp, mouse
gagccggctctgcgatcccg

SEQ ID NO: 471468 - DNA, 20 bp, mouse
ggagctggagttgagtcccc

SEQ ID NO: 471469 - DNA, 20 bp, mouse
gatgcagagagcctgccagc

SEQ ID NO: 471470 - DNA, 20 bp, mouse
gctcgccgtgcagccgtcgg

SEQ ID NO: 471471 - DNA, 20 bp, mouse
gcgtcggaggagtgcggacc

SEQ ID NO: 471472 - DNA, 20 bp, mouse
ggtccccgggatcgcagagc

SEQ ID NO: 471473 - DNA, 20 bp, mouse
gcaagagaggtagcctgtgg

SEQ ID NO: 471474 - DNA, 20 bp, mouse
gtggcaggctctctgcatcc

SEQ ID NO: 471475 - DNA, 20 bp, mouse
gccagctctgcagcgctctg

SEQ ID NO: 471476 - DNA, 20 bp, mouse
gggatatggccaccttggaa

SEQ ID NO: 471477 - DNA, 20 bp, mouse
ggcctcaaatagccgttcca

SEQ ID NO: 471478 - DNA, 20 bp, mouse
gcaagtctgactctcagtag

SEQ ID NO: 471479 - DNA, 20 bp, mouse
ggtggccatatccccatcct

SEQ ID NO: 471480 - DNA, 20 bp, mouse
ggcaaccagcaggcacacaa

SEQ ID NO: 471481 - DNA, 20 bp, mouse
ggcagcagccacgggcaacc

SEQ ID NO: 471482 - DNA, 20 bp, mouse
gagctctgccaggttgcccg

SEQ ID NO: 471483 - DNA, 20 bp, mouse
gtccaggtgaccagcccggg

SEQ ID NO: 471484 - DNA, 20 bp, mouse
gcactggtggcctccaagga

SEQ ID NO: 471485 - DNA, 20 bp, mouse
gccagtgctggatacatctg

SEQ ID NO: 471486 - DNA, 20 bp, mouse
ggctgagacagtaagacgga

SEQ ID NO: 471487 - DNA, 20 bp, mouse
ggtggcgcggtgtgtgatca

SEQ ID NO: 471488 - DNA, 20 bp, mouse
gatgtgctcgaatgatcgag

SEQ ID NO: 471489 - DNA, 20 bp, mouse
gatgggtttgtagaagtcaa

SEQ ID NO: 471490 - DNA, 20 bp, mouse
ggatcaaggcagagcgtgtg

SEQ ID NO: 471491 - DNA, 20 bp, mouse
gctcgaatgatcgagtggcg

SEQ ID NO: 471492 - DNA, 20 bp, mouse
gtgaaccagcagggtaggat

SEQ ID NO: 471493 - DNA, 20 bp, mouse
ggctcttgaaccagcagggt

SEQ ID NO: 471494 - DNA, 20 bp, mouse
ggggaagcagccagtaggca

SEQ ID NO: 471495 - DNA, 20 bp, mouse
gagccagtaggcagggcact

SEQ ID NO: 471496 - DNA, 20 bp, mouse
gccgggtctgcagtagagtc

SEQ ID NO: 471497 - DNA, 20 bp, mouse
gacgttcgttcgttagtcgt

SEQ ID NO: 471498 - DNA, 20 bp, mouse
gtggctgcgagtcccgctca

SEQ ID NO: 471499 - DNA, 20 bp, mouse
gcctgggagtagaggaggtg

SEQ ID NO: 471500 - DNA, 20 bp, mouse
gctgcagacccggatgccaa

SEQ ID NO: 471501 - DNA, 20 bp, mouse
gaacttcctgggagtagagg

SEQ ID NO: 471502 - DNA, 20 bp, mouse
gggatgccaagggatgccag

SEQ ID NO: 471503 - DNA, 20 bp, mouse
gactcccaggaagtttcaag

SEQ ID NO: 471504 - DNA, 20 bp, mouse
ggagtcccgctcagggaccg

SEQ ID NO: 471505 - DNA, 20 bp, mouse
gactttcctcggtccctgag

SEQ ID NO: 471506 - DNA, 20 bp, mouse
gctggcggcctcgaggaggg

SEQ ID NO: 471507 - DNA, 20 bp, mouse
gaggccgccagggcaaaagg

SEQ ID NO: 471508 - DNA, 20 bp, mouse
ggccctggcggcctcgagga

SEQ ID NO: 471509 - DNA, 20 bp, mouse
gtggagcgccggccaggtgt

SEQ ID NO: 471510 - DNA, 20 bp, mouse
gtggtccaaacgaggagtcg

SEQ ID NO: 471511 - DNA, 20 bp, mouse
gccccgggaggcgcgcgcaa

SEQ ID NO: 471512 - DNA, 20 bp, mouse
gtcgaggccgccagggcaaa

SEQ ID NO: 471513 - DNA, 20 bp, mouse
ggggccaccggagccaagct

SEQ ID NO: 471514 - DNA, 20 bp, mouse
gggccaggtgtgggcttggg

SEQ ID NO: 471515 - DNA, 20 bp, mouse
gaccggagccaagctgggtt

SEQ ID NO: 471516 - DNA, 20 bp, mouse
gccacacacgcggaccgacg

SEQ ID NO: 471517 - DNA, 20 bp, mouse
ggtcatggccgcagaggaag

SEQ ID NO: 471518 - DNA, 20 bp, mouse
ggggcgctcggccacacacg

SEQ ID NO: 471519 - DNA, 20 bp, mouse
ggccgcgcagccgacaggta

SEQ ID NO: 471520 - DNA, 20 bp, mouse
gtcgtctgtctgctgtcggt

SEQ ID NO: 471521 - DNA, 20 bp, mouse
gggcggagtcatggccgcag

SEQ ID NO: 471522 - DNA, 20 bp, mouse
gcgcagccgacaggtagggt

SEQ ID NO: 471523 - DNA, 20 bp, mouse
ggtgcgctggggccggacct

SEQ ID NO: 471524 - DNA, 20 bp, mouse
gggtgccgcccccaacacac

SEQ ID NO: 471525 - DNA, 20 bp, mouse
gtcgcggcattgtggactca

SEQ ID NO: 471526 - DNA, 20 bp, mouse
ggtgtcctacaagcagccag

SEQ ID NO: 471527 - DNA, 20 bp, mouse
ggcggcgccgccgagtgagg

SEQ ID NO: 471528 - DNA, 20 bp, mouse
gggcgccgctggctgcttgt

SEQ ID NO: 471529 - DNA, 20 bp, mouse
gccagcggcgccgccgagtg

SEQ ID NO: 471530 - DNA, 20 bp, mouse
ggcgtcggccgggtcaggac

SEQ ID NO: 471531 - DNA, 20 bp, mouse
gaaggcccgaggctaactgg

SEQ ID NO: 471532 - DNA, 20 bp, mouse
gacctatgacccagagagga

SEQ ID NO: 471533 - DNA, 20 bp, mouse
ggccggagcccaaggtccgg

SEQ ID NO: 471534 - DNA, 20 bp, mouse
gcgcccccacgtggcctcaa

SEQ ID NO: 471535 - DNA, 20 bp, mouse
ggctgcttgtaggacacaaa

SEQ ID NO: 471536 - DNA, 20 bp, mouse
gcagaggggacgccaagccg

SEQ ID NO: 471537 - DNA, 20 bp, mouse
gaggggacgccaagccgtgg

SEQ ID NO: 471538 - DNA, 20 bp, mouse
gggacgccaagccgtggagg

SEQ ID NO: 471539 - DNA, 20 bp, mouse
ggttagtgggctccaagtgt

SEQ ID NO: 471540 - DNA, 20 bp, mouse
gaagctacagtagggttagt

SEQ ID NO: 471541 - DNA, 20 bp, mouse
gcacgcggaagacgagtgaa

SEQ ID NO: 471542 - DNA, 20 bp, mouse
gcccagcctcctccacggct

SEQ ID NO: 471543 - DNA, 20 bp, mouse
gaggcggcgggcaaatcacg

SEQ ID NO: 471544 - DNA, 20 bp, mouse
gcagccttaaagctacagta

SEQ ID NO: 471545 - DNA, 20 bp, mouse
ggcgctccggacgtaggagg

SEQ ID NO: 471546 - DNA, 20 bp, mouse
gccgaatgtcgtccgaagac

SEQ ID NO: 471547 - DNA, 20 bp, mouse
ggcaggaggccactccgtag

SEQ ID NO: 471548 - DNA, 20 bp, mouse
gagcctgcgaacacagaacg

SEQ ID NO: 471549 - DNA, 20 bp, mouse
gctgagggcatcaatgcccg

SEQ ID NO: 471550 - DNA, 20 bp, mouse
gggcggcgagtccagaccgt

SEQ ID NO: 471551 - DNA, 20 bp, mouse
gagccatccagcccgtcctc

SEQ ID NO: 471552 - DNA, 20 bp, mouse
gtcaatgcccgaggacgggc

SEQ ID NO: 471553 - DNA, 20 bp, mouse
gcgagccgctggggctgtgg

SEQ ID NO: 471554 - DNA, 20 bp, mouse
gccgtgccgcaagagctacg

SEQ ID NO: 471555 - DNA, 20 bp, mouse
gggcgtccgacgagccgctg

SEQ ID NO: 471556 - DNA, 20 bp, mouse
gctcctggtgacaggcccat

SEQ ID NO: 471557 - DNA, 20 bp, mouse
gcccataggcacggccagtt

SEQ ID NO: 471558 - DNA, 20 bp, mouse
gtgcctatgggcctgtcacc

SEQ ID NO: 471559 - DNA, 20 bp, mouse
gctgcactacgaagaagagt

SEQ ID NO: 471560 - DNA, 20 bp, mouse
ggcacggccagttgggaccg

SEQ ID NO: 471561 - DNA, 20 bp, mouse
gtgcgagcctcggtcccaac

SEQ ID NO: 471562 - DNA, 20 bp, mouse
ggggctttaagtccttgatt

SEQ ID NO: 471563 - DNA, 20 bp, mouse
gattaacacacgcgttctcc

SEQ ID NO: 471564 - DNA, 20 bp, mouse
ggtgtgcgggagagtggacc

SEQ ID NO: 471565 - DNA, 20 bp, mouse
gtcccaactggccgtgccta

SEQ ID NO: 471566 - DNA, 20 bp, mouse
gggagtgcgagaggttcccg

SEQ ID NO: 471567 - DNA, 20 bp, mouse
ggcactccgcaccaggaatc

SEQ ID NO: 471568 - DNA, 20 bp, mouse
gtcctggtgcggagtgcgag

SEQ ID NO: 471569 - DNA, 20 bp, mouse
gccgtgcccgattcctggtg

SEQ ID NO: 471570 - DNA, 20 bp, mouse
ggcctcccgcgcgtacccgg

SEQ ID NO: 471571 - DNA, 20 bp, mouse
gacacaaaacaagtcaccgg

SEQ ID NO: 471572 - DNA, 20 bp, mouse
gtggtcgccggctgcaagag

SEQ ID NO: 471573 - DNA, 20 bp, mouse
ggcccggctggaggtcggaa

SEQ ID NO: 471574 - DNA, 20 bp, mouse
ggccagcgagactgtccgcc

SEQ ID NO: 471575 - DNA, 20 bp, mouse
gaggctagagcgaggaactg

SEQ ID NO: 471576 - DNA, 20 bp, mouse
gccacctctggccaggacct

SEQ ID NO: 471577 - DNA, 20 bp, mouse
ggcggtttggagcctaggta

SEQ ID NO: 471578 - DNA, 20 bp, mouse
gaagcagctggtaccacctc

SEQ ID NO: 471579 - DNA, 20 bp, mouse
gaggcgccactctaaaggag

SEQ ID NO: 471580 - DNA, 20 bp, mouse
gaacgagcgccactcgggta

SEQ ID NO: 471581 - DNA, 20 bp, mouse
ggttaagtcaccagcttctg

SEQ ID NO: 471582 - DNA, 20 bp, mouse
gtcctcaacgagcgccactc

SEQ ID NO: 471583 - DNA, 20 bp, mouse
gcgccactctaaaggagcgg

SEQ ID NO: 471584 - DNA, 20 bp, mouse
gtccatgaccggagcgcggt

SEQ ID NO: 471585 - DNA, 20 bp, mouse
gggagcggcggagactgcga

SEQ ID NO: 471586 - DNA, 20 bp, mouse
gttcaggggagtgctccatg

SEQ ID NO: 471587 - DNA, 20 bp, mouse
ggggctggcgccctcttcag

SEQ ID NO: 471588 - DNA, 20 bp, mouse
gtggagcactcccctgaaga

SEQ ID NO: 471589 - DNA, 20 bp, mouse
gcgccagccccgagccgtca

SEQ ID NO: 471590 - DNA, 20 bp, mouse
gcggcgccagcccaagtaca

SEQ ID NO: 471591 - DNA, 20 bp, mouse
gctgcaggcagctcagtgtc

SEQ ID NO: 471592 - DNA, 20 bp, mouse
gcggcaccagcaccaacaag

SEQ ID NO: 471593 - DNA, 20 bp, mouse
gccgtcccgcgtggagtccg

SEQ ID NO: 471594 - DNA, 20 bp, mouse
ggggcagcgggtcttagcgt

SEQ ID NO: 471595 - DNA, 20 bp, mouse
ggctccatggggcagcttct

SEQ ID NO: 471596 - DNA, 20 bp, mouse
gagagcgacctgcggtccgt

SEQ ID NO: 471597 - DNA, 20 bp, mouse
gagccgcgcccgcctcggca

SEQ ID NO: 471598 - DNA, 20 bp, mouse
gggtagcccagggcgtacac

SEQ ID NO: 471599 - DNA, 20 bp, mouse
ggcgccagcgccccactgag

SEQ ID NO: 471600 - DNA, 20 bp, mouse
gcccgcggtccccctcagtg

SEQ ID NO: 471601 - DNA, 20 bp, mouse
gcgcgggctagagcgacctg

SEQ ID NO: 471602 - DNA, 20 bp, mouse
ggcccgtttgaggagtggag

SEQ ID NO: 471603 - DNA, 20 bp, mouse
gggcgggcgcggctctccca

SEQ ID NO: 471604 - DNA, 20 bp, mouse
ggcactcctccctgccgagg

SEQ ID NO: 471605 - DNA, 20 bp, mouse
gtgagcactcctccctgccg

SEQ ID NO: 471606 - DNA, 20 bp, mouse
gcggcgcacatctgtcctca

SEQ ID NO: 471607 - DNA, 20 bp, mouse
gagcaggagctgcgcggctg

SEQ ID NO: 471608 - DNA, 20 bp, mouse
gagatgtgcgccggcatagg

SEQ ID NO: 471609 - DNA, 20 bp, mouse
gccacgaagctgtagagctc

SEQ ID NO: 471610 - DNA, 20 bp, mouse
gggtagcccgccaggtagac

SEQ ID NO: 471611 - DNA, 20 bp, mouse
ggttggtgcaccccctatgc

SEQ ID NO: 471612 - DNA, 20 bp, mouse
gcatctgtcctcaaggcacg

SEQ ID NO: 471613 - DNA, 20 bp, mouse
ggaaccgccgcgggaagctg

SEQ ID NO: 471614 - DNA, 20 bp, mouse
gcgagcgctggcctctctcc

SEQ ID NO: 471615 - DNA, 20 bp, mouse
ggctcgggttctaccagctc

SEQ ID NO: 471616 - DNA, 20 bp, mouse
gcaaagatggcgctgcacgg

SEQ ID NO: 471617 - DNA, 20 bp, mouse
gccgtggctgcgggagtcca

SEQ ID NO: 471618 - DNA, 20 bp, mouse
ggctaagaactgccgcccgg

SEQ ID NO: 471619 - DNA, 20 bp, mouse
gaggagcacgccgcacaggg

SEQ ID NO: 471620 - DNA, 20 bp, mouse
gttgcaaagatggcgctgca

SEQ ID NO: 471621 - DNA, 20 bp, mouse
ggaatgcagctgaaggacgg

SEQ ID NO: 471622 - DNA, 20 bp, mouse
gcggtggcacgggaatgagt

SEQ ID NO: 471623 - DNA, 20 bp, mouse
gcgcgcccgacttgcaaaga

SEQ ID NO: 471624 - DNA, 20 bp, mouse
gattttgctacagcggagca

SEQ ID NO: 471625 - DNA, 20 bp, mouse
ggcgctgcacggtggcgcgc

SEQ ID NO: 471626 - DNA, 20 bp, mouse
gcaccgcacaacaagactac

SEQ ID NO: 471627 - DNA, 20 bp, mouse
gcttccttagaggcaggtgt

SEQ ID NO: 471628 - DNA, 20 bp, mouse
gacaagactacaggtgcaga

SEQ ID NO: 471629 - DNA, 20 bp, mouse
gaatcgccctctgggagaga

SEQ ID NO: 471630 - DNA, 20 bp, mouse
gagcctggtaccttccttag

SEQ ID NO: 471631 - DNA, 20 bp, mouse
gatctccaataagcttacct

SEQ ID NO: 471632 - DNA, 20 bp, mouse
ggggcgattctggaacgctg

SEQ ID NO: 471633 - DNA, 20 bp, mouse
gggagcaattagaataaact

SEQ ID NO: 471634 - DNA, 20 bp, mouse
gcacatccctctctcccaga

SEQ ID NO: 471635 - DNA, 20 bp, mouse
gcgttccagaatcgccctct

SEQ ID NO: 471636 - DNA, 20 bp, mouse
ggcggcggcggctctgacgt

SEQ ID NO: 471637 - DNA, 20 bp, mouse
gcggctctgacgtaggacac

SEQ ID NO: 471638 - DNA, 20 bp, mouse
gctaagggcccagtcctggg

SEQ ID NO: 471639 - DNA, 20 bp, mouse
gtacctaagggcccagtcct

SEQ ID NO: 471640 - DNA, 20 bp, mouse
gatcagaggccccatgtgag

SEQ ID NO: 471641 - DNA, 20 bp, mouse
gccgccgggccgctctaggg

SEQ ID NO: 471642 - DNA, 20 bp, mouse
ggcccagtcctgggcggcag

SEQ ID NO: 471643 - DNA, 20 bp, mouse
gagcggcggcgctaactctg

SEQ ID NO: 471644 - DNA, 20 bp, mouse
ggtcagaggctactacccag

SEQ ID NO: 471645 - DNA, 20 bp, mouse
gccgacggcccggcgcacaa

SEQ ID NO: 471646 - DNA, 20 bp, mouse
gtctctggtagaggaggcgg

SEQ ID NO: 471647 - DNA, 20 bp, mouse
gttcgggtctctggtagagg

SEQ ID NO: 471648 - DNA, 20 bp, mouse
ggcgttcgggtctctggtag

SEQ ID NO: 471649 - DNA, 20 bp, mouse
ggagtgccccgcgagagtca

SEQ ID NO: 471650 - DNA, 20 bp, mouse
gcggtgagtccggacaggga

SEQ ID NO: 471651 - DNA, 20 bp, mouse
gcctgtcaggcgaaggtcac

SEQ ID NO: 471652 - DNA, 20 bp, mouse
gactctcgcggggcactctg

SEQ ID NO: 471653 - DNA, 20 bp, mouse
gtcgcgagcgttcgggtctc

SEQ ID NO: 471654 - DNA, 20 bp, mouse
gcgggcggtgagtccggaca

SEQ ID NO: 471655 - DNA, 20 bp, mouse
gacgcggacggtgggagtcg

SEQ ID NO: 471656 - DNA, 20 bp, mouse
ggggtgctgggacctagtcg

SEQ ID NO: 471657 - DNA, 20 bp, mouse
gcgcgctcgtggctgtcaag

SEQ ID NO: 471658 - DNA, 20 bp, mouse
gatcttcctgcagcagtcac

SEQ ID NO: 471659 - DNA, 20 bp, mouse
gtgctgggacctagtcgggg

SEQ ID NO: 471660 - DNA, 20 bp, mouse
gagcagtcactggccgggtc

SEQ ID NO: 471661 - DNA, 20 bp, mouse
gtcctgcagcagtcactggc

SEQ ID NO: 471662 - DNA, 20 bp, mouse
ggtgtgtgactatctggatt

SEQ ID NO: 471663 - DNA, 20 bp, mouse
ggattaggagcaacctgacc

SEQ ID NO: 471664 - DNA, 20 bp, mouse
gacccgacgtcagtcatact

SEQ ID NO: 471665 - DNA, 20 bp, mouse
gcccggccagtgactgctgc

SEQ ID NO: 471666 - DNA, 20 bp, mouse
ggtacgccgcgaagcaaggg

SEQ ID NO: 471667 - DNA, 20 bp, mouse
gcgggtacgccgcgaagcaa

SEQ ID NO: 471668 - DNA, 20 bp, mouse
ggccgcgaagcaagggcggt

SEQ ID NO: 471669 - DNA, 20 bp, mouse
gtggacttctaggctacgag

SEQ ID NO: 471670 - DNA, 20 bp, mouse
gccggcgcaaagcagaagag

SEQ ID NO: 471671 - DNA, 20 bp, mouse
gccgagggtgctggacttct

SEQ ID NO: 471672 - DNA, 20 bp, mouse
gatacaaaggagagaggcgt

SEQ ID NO: 471673 - DNA, 20 bp, mouse
ggcgcaaagcagaagagggg

SEQ ID NO: 471674 - DNA, 20 bp, mouse
ggagatgctggcagtacccc

SEQ ID NO: 471675 - DNA, 20 bp, mouse
gggcaactccaaggtcggta

SEQ ID NO: 471676 - DNA, 20 bp, mouse
gtcggacctgcacctcccag

SEQ ID NO: 471677 - DNA, 20 bp, mouse
gggcgctgggacgccgttgg

SEQ ID NO: 471678 - DNA, 20 bp, mouse
ggcgggcgctgggacgccgt

SEQ ID NO: 471679 - DNA, 20 bp, mouse
gcactaacttgccagctggg

SEQ ID NO: 471680 - DNA, 20 bp, mouse
gaggagattgccgagccgta

SEQ ID NO: 471681 - DNA, 20 bp, mouse
ggaagctgggccctacggct

SEQ ID NO: 471682 - DNA, 20 bp, mouse
gcctagctaggatccttagg

SEQ ID NO: 471683 - DNA, 20 bp, mouse
ggccccctccagccccggat

SEQ ID NO: 471684 - DNA, 20 bp, mouse
gcgtcccagcgcccgctggg

SEQ ID NO: 471685 - DNA, 20 bp, mouse
gctacttgagaccctatcac

SEQ ID NO: 471686 - DNA, 20 bp, mouse
gctgctgtcgccaggactgg

SEQ ID NO: 471687 - DNA, 20 bp, mouse
gggccggccggcagggacaa

SEQ ID NO: 471688 - DNA, 20 bp, mouse
ggcctcctcggcccaggtcc

SEQ ID NO: 471689 - DNA, 20 bp, mouse
gtccgggacctgggccgagg

SEQ ID NO: 471690 - DNA, 20 bp, mouse
ggaggccgggcgctggaatg

SEQ ID NO: 471691 - DNA, 20 bp, mouse
gttccagcgcccggcctcct

SEQ ID NO: 471692 - DNA, 20 bp, mouse
ggctggaatgcggtcttccc

SEQ ID NO: 471693 - DNA, 20 bp, mouse
gcgctccgggacctgggccg

SEQ ID NO: 471694 - DNA, 20 bp, mouse
gaagacacagcccccagtcc

SEQ ID NO: 471695 - DNA, 20 bp, mouse
ggcgctctgaagtttccaga

SEQ ID NO: 471696 - DNA, 20 bp, mouse
ggcgcagtgcagagacgcgg

SEQ ID NO: 471697 - DNA, 20 bp, mouse
gggtgcgcagtgcagagacg

SEQ ID NO: 471698 - DNA, 20 bp, mouse
ggtgcagagacgcggaggca

SEQ ID NO: 471699 - DNA, 20 bp, mouse
gcggaggcacggccgctctc

SEQ ID NO: 471700 - DNA, 20 bp, mouse
gcccgcggtctagcgcactg

SEQ ID NO: 471701 - DNA, 20 bp, mouse
gtgaggcatcttcccgagag

SEQ ID NO: 471702 - DNA, 20 bp, mouse
gggcaaccgggcggccggac

SEQ ID NO: 471703 - DNA, 20 bp, mouse
ggacacgaccacgacgacca

SEQ ID NO: 471704 - DNA, 20 bp, mouse
ggcctcagtgcgctagaccg

SEQ ID NO: 471705 - DNA, 20 bp, mouse
ggctagcgtcaggccagtcc

SEQ ID NO: 471706 - DNA, 20 bp, mouse
gcggctgctgggagcctcca

SEQ ID NO: 471707 - DNA, 20 bp, mouse
gatgggacggcggccctcgg

SEQ ID NO: 471708 - DNA, 20 bp, mouse
gagaaggcggtggccagcgc

SEQ ID NO: 471709 - DNA, 20 bp, mouse
ggcgctgccgggctgcagag

SEQ ID NO: 471710 - DNA, 20 bp, mouse
gtgggcaggtggacctccgg

SEQ ID NO: 471711 - DNA, 20 bp, mouse
gcaccgtgacgctgaagcat

SEQ ID NO: 471712 - DNA, 20 bp, mouse
gccgcagtgctcatggagca

SEQ ID NO: 471713 - DNA, 20 bp, mouse
gacgctgaagcatgggacgg

SEQ ID NO: 471714 - DNA, 20 bp, mouse
gacttggaggatgcactgac

SEQ ID NO: 471715 - DNA, 20 bp, mouse
gcgcgcagcacgctgacagt

SEQ ID NO: 471716 - DNA, 20 bp, mouse
gagggcaggaggcacaggag

SEQ ID NO: 471717 - DNA, 20 bp, mouse
gtacccagggcaggaggcac

SEQ ID NO: 471718 - DNA, 20 bp, mouse
gtagtgacctccgataccca

SEQ ID NO: 471719 - DNA, 20 bp, mouse
gagagctcataggtccctat

SEQ ID NO: 471720 - DNA, 20 bp, mouse
ggcagcgtcccaggttacag

SEQ ID NO: 471721 - DNA, 20 bp, mouse
gcgtcccaggttacagaggg

SEQ ID NO: 471722 - DNA, 20 bp, mouse
gctcctgccctgggtatcgg

SEQ ID NO: 471723 - DNA, 20 bp, mouse
ggacctccgatacccagggc

SEQ ID NO: 471724 - DNA, 20 bp, mouse
ggtaacctgggacgctgcaa

SEQ ID NO: 471725 - DNA, 20 bp, mouse
gtttcggagggagagctcat

SEQ ID NO: 471726 - DNA, 20 bp, mouse
gccagccccggacaagacca

SEQ ID NO: 471727 - DNA, 20 bp, mouse
ggagttccgttgcccagggc

SEQ ID NO: 471728 - DNA, 20 bp, mouse
ggccagagttccgttgccca

SEQ ID NO: 471729 - DNA, 20 bp, mouse
gacggccagaacgccacccc

SEQ ID NO: 471730 - DNA, 20 bp, mouse
ggagtccttggtcttgtccg

SEQ ID NO: 471731 - DNA, 20 bp, mouse
gatggcccggggtggcgttc

SEQ ID NO: 471732 - DNA, 20 bp, mouse
gcagggcaggcaggaaaggg

SEQ ID NO: 471733 - DNA, 20 bp, mouse
gtcctgcctgccctgggcaa

SEQ ID NO: 471734 - DNA, 20 bp, mouse
gtccgttgcccagggcaggc

SEQ ID NO: 471735 - DNA, 20 bp, mouse
gtcatctcctgcggtgctgt

SEQ ID NO: 471736 - DNA, 20 bp, mouse
gacacaactagactgtggag

SEQ ID NO: 471737 - DNA, 20 bp, mouse
gtccccacaggggaagggat

SEQ ID NO: 471738 - DNA, 20 bp, mouse
gaggtagtccttccccacag

SEQ ID NO: 471739 - DNA, 20 bp, mouse
gaggtcacccatggttatag

SEQ ID NO: 471740 - DNA, 20 bp, mouse
gacggctccgtccctcagta

SEQ ID NO: 471741 - DNA, 20 bp, mouse
gagagcacagatatctggtg

SEQ ID NO: 471742 - DNA, 20 bp, mouse
gacacagaggtatgagactg

SEQ ID NO: 471743 - DNA, 20 bp, mouse
ggttccaaaggagaagccaa

SEQ ID NO: 471744 - DNA, 20 bp, mouse
gtcttcttggaacgggttgt

SEQ ID NO: 471745 - DNA, 20 bp, mouse
gtctttttttatggcctggt

SEQ ID NO: 471746 - DNA, 20 bp, mouse
gcagccgtgcgagcgagcaa

SEQ ID NO: 471747 - DNA, 20 bp, mouse
gagggagcgagcgccccgga

SEQ ID NO: 471748 - DNA, 20 bp, mouse
ggagcgagcgccccggacgg

SEQ ID NO: 471749 - DNA, 20 bp, mouse
ggaggaacgccctaaagcgg

SEQ ID NO: 471750 - DNA, 20 bp, mouse
ggagcgccccggacggagga

SEQ ID NO: 471751 - DNA, 20 bp, mouse
gggtgaggaacgccctaaag

SEQ ID NO: 471752 - DNA, 20 bp, mouse
gctcgctccctcctccgtcc

SEQ ID NO: 471753 - DNA, 20 bp, mouse
gccgctcgctcctctgtccc

SEQ ID NO: 471754 - DNA, 20 bp, mouse
gcctgggcctgggctcggtg

SEQ ID NO: 471755 - DNA, 20 bp, mouse
ggcgctctgtccccttccac

SEQ ID NO: 471756 - DNA, 20 bp, mouse
gcgcggcgttgagcacagag

SEQ ID NO: 471757 - DNA, 20 bp, mouse
gcacagagtggacaccactg

SEQ ID NO: 471758 - DNA, 20 bp, mouse
gagcgcgcggctaggagatc

SEQ ID NO: 471759 - DNA, 20 bp, mouse
gggggactgacgggcctcag

SEQ ID NO: 471760 - DNA, 20 bp, mouse
ggatggcccggcgggatcag

SEQ ID NO: 471761 - DNA, 20 bp, mouse
gcgcggctaggagatcgggc

SEQ ID NO: 471762 - DNA, 20 bp, mouse
gtgaggaccatcgcgcacag

SEQ ID NO: 471763 - DNA, 20 bp, mouse
ggagggccggagggaaccgg

SEQ ID NO: 471764 - DNA, 20 bp, mouse
gcgggcgagacgaggccgta

SEQ ID NO: 471765 - DNA, 20 bp, mouse
gccccgggcaggaaccgcac

SEQ ID NO: 471766 - DNA, 20 bp, mouse
gaggcgctttcggcttccaa

SEQ ID NO: 471767 - DNA, 20 bp, mouse
ggcccctggaggagaagtag

SEQ ID NO: 471768 - DNA, 20 bp, mouse
ggcttccaaggggaagtgct

SEQ ID NO: 471769 - DNA, 20 bp, mouse
gaagcagagtcgccctacag

SEQ ID NO: 471770 - DNA, 20 bp, mouse
gcctaacgggactaaagaga

SEQ ID NO: 471771 - DNA, 20 bp, mouse
gctgacagagctgaattcgg

SEQ ID NO: 471772 - DNA, 20 bp, mouse
gcctctgacagagctgaatt

SEQ ID NO: 471773 - DNA, 20 bp, mouse
ggagtgcaagaggagacgga

SEQ ID NO: 471774 - DNA, 20 bp, mouse
gggctctgattcgcaaacgt

SEQ ID NO: 471775 - DNA, 20 bp, mouse
ggaaggccacgctaggcgaa

SEQ ID NO: 471776 - DNA, 20 bp, mouse
gtgcgcacgggtccctggaa

SEQ ID NO: 471777 - DNA, 20 bp, mouse
ggtgtgacatgaaaagtggt

SEQ ID NO: 471778 - DNA, 20 bp, mouse
gcccccctggctaggagaga

SEQ ID NO: 471779 - DNA, 20 bp, mouse
ggtgcgcatccctaaagcag

SEQ ID NO: 471780 - DNA, 20 bp, mouse
gggacaggttccccatcttg

SEQ ID NO: 471781 - DNA, 20 bp, mouse
gctctgggcttatctgcaac

SEQ ID NO: 471782 - DNA, 20 bp, mouse
gctatcaggccccccgggaa

SEQ ID NO: 471783 - DNA, 20 bp, mouse
gccagttcgtggctcacctc

SEQ ID NO: 471784 - DNA, 20 bp, mouse
gccgaaaagggaccgttcca

SEQ ID NO: 471785 - DNA, 20 bp, mouse
ggttccccatcttgaggatt

SEQ ID NO: 471786 - DNA, 20 bp, mouse
ggagcccgagtggagacgga

SEQ ID NO: 471787 - DNA, 20 bp, mouse
gggaggagcccgagtggaga

SEQ ID NO: 471788 - DNA, 20 bp, mouse
ggcgccgtccgtctccactc

SEQ ID NO: 471789 - DNA, 20 bp, mouse
ggccaccagtctcacctctc

SEQ ID NO: 471790 - DNA, 20 bp, mouse
gccgcgcgggcaggacggaa

SEQ ID NO: 471791 - DNA, 20 bp, mouse
ggtgagactggtggcgtcgg

SEQ ID NO: 471792 - DNA, 20 bp, mouse
ggagacggacggcgccggag

SEQ ID NO: 471793 - DNA, 20 bp, mouse
ggaggtgagactggtggcgt

SEQ ID NO: 471794 - DNA, 20 bp, mouse
gtccttctgggtggatgagg

SEQ ID NO: 471795 - DNA, 20 bp, mouse
gggctggatgggcacatcgg

SEQ ID NO: 471796 - DNA, 20 bp, mouse
ggcgcccggaaaacaagccg

SEQ ID NO: 471797 - DNA, 20 bp, mouse
gcagacagttgtgagcccgg

SEQ ID NO: 471798 - DNA, 20 bp, mouse
gaaaacaagccggggctctg

SEQ ID NO: 471799 - DNA, 20 bp, mouse
ggccggggctctggggaccc

SEQ ID NO: 471800 - DNA, 20 bp, mouse
ggcgccgaacagagagagtg

SEQ ID NO: 471801 - DNA, 20 bp, mouse
gggatggagcggaggatgaa

SEQ ID NO: 471802 - DNA, 20 bp, mouse
ggtgaagctgcggaagggga

SEQ ID NO: 471803 - DNA, 20 bp, mouse
gctcacgctgcagaaggtgt

SEQ ID NO: 471804 - DNA, 20 bp, mouse
gggctcaggccgcctcgctc

SEQ ID NO: 471805 - DNA, 20 bp, mouse
gctcaggtgaagctgcggaa

SEQ ID NO: 471806 - DNA, 20 bp, mouse
gcgcctgcgcgcctccgtgg

SEQ ID NO: 471807 - DNA, 20 bp, mouse
gtgcagggcggcgcagagtc

SEQ ID NO: 471808 - DNA, 20 bp, mouse
gggctgggccgcagcgatcg

SEQ ID NO: 471809 - DNA, 20 bp, mouse
gagggcggcgcagagtccgg

SEQ ID NO: 471810 - DNA, 20 bp, mouse
ggaaccagtccgcacctgag

SEQ ID NO: 471811 - DNA, 20 bp, mouse
gcggagtggccgctcaggtg

SEQ ID NO: 471812 - DNA, 20 bp, mouse
ggccgcggaggaggcacccg

SEQ ID NO: 471813 - DNA, 20 bp, mouse
gtccggagcgagcggagaac

SEQ ID NO: 471814 - DNA, 20 bp, mouse
ggcggcccagcccgccacgg

SEQ ID NO: 471815 - DNA, 20 bp, mouse
ggctgcagcgggttgcaggg

SEQ ID NO: 471816 - DNA, 20 bp, mouse
ggagccggcgagcacggcgt

SEQ ID NO: 471817 - DNA, 20 bp, mouse
ggagcccaagaggatctcgg

SEQ ID NO: 471818 - DNA, 20 bp, mouse
ggattgggcgcgaggtgcgg

SEQ ID NO: 471819 - DNA, 20 bp, mouse
gcagcagccccggggtaagg

SEQ ID NO: 471820 - DNA, 20 bp, mouse
ggacatgtctcacagcgaaa

SEQ ID NO: 471821 - DNA, 20 bp, mouse
gaacccagaaacgctcggcg

SEQ ID NO: 471822 - DNA, 20 bp, mouse
gtctccgccgagatcctctt

SEQ ID NO: 471823 - DNA, 20 bp, mouse
gtcgcccagcggaggaagga

SEQ ID NO: 471824 - DNA, 20 bp, mouse
gtcttctcaacgcgcggatt

SEQ ID NO: 471825 - DNA, 20 bp, mouse
gggttccgatcgcccagcgg

SEQ ID NO: 471826 - DNA, 20 bp, mouse
ggggcggccctccccaatca

SEQ ID NO: 471827 - DNA, 20 bp, mouse
gtagaggagcctgagtccgt

SEQ ID NO: 471828 - DNA, 20 bp, mouse
gggctcctctagagtgtgca

SEQ ID NO: 471829 - DNA, 20 bp, mouse
gccagccctgcacactctag

SEQ ID NO: 471830 - DNA, 20 bp, mouse
gaggagcctgagtccgtggg

SEQ ID NO: 471831 - DNA, 20 bp, mouse
ggctggaggagtccagaggc

SEQ ID NO: 471832 - DNA, 20 bp, mouse
ggcgccagtcgtcctagaga

SEQ ID NO: 471833 - DNA, 20 bp, mouse
gcgcgccggagagcaatttg

SEQ ID NO: 471834 - DNA, 20 bp, mouse
ggatcagatcacctagggaa

SEQ ID NO: 471835 - DNA, 20 bp, mouse
gacttccggggaccgagcag

SEQ ID NO: 471836 - DNA, 20 bp, mouse
gcgaggcccagcgcacggaa

SEQ ID NO: 471837 - DNA, 20 bp, mouse
gccgccgtgcgaacctggta

SEQ ID NO: 471838 - DNA, 20 bp, mouse
ggtgcggccggacaccgcga

SEQ ID NO: 471839 - DNA, 20 bp, mouse
gccgtgcgaacctggtaagg

SEQ ID NO: 471840 - DNA, 20 bp, mouse
gcccatctgggagagatcca

SEQ ID NO: 471841 - DNA, 20 bp, mouse
ggaacctggtaaggcggacg

SEQ ID NO: 471842 - DNA, 20 bp, mouse
ggcgtagctcctccaccctg

SEQ ID NO: 471843 - DNA, 20 bp, mouse
gtccgccggctggtccgtcg

SEQ ID NO: 471844 - DNA, 20 bp, mouse
gcttggggcaaggaacggaa

SEQ ID NO: 471845 - DNA, 20 bp, mouse
ggacaccgcgacggaccagc

SEQ ID NO: 471846 - DNA, 20 bp, mouse
gggaggaccgcgtcacatgg

SEQ ID NO: 471847 - DNA, 20 bp, mouse
gcaggcaggtagagcctccg

SEQ ID NO: 471848 - DNA, 20 bp, mouse
gcaggctgctggagcttctt

SEQ ID NO: 471849 - DNA, 20 bp, mouse
gctggacaaggaggcggcag

SEQ ID NO: 471850 - DNA, 20 bp, mouse
ggcgctggcgctgggatcgc

SEQ ID NO: 471851 - DNA, 20 bp, mouse
gcaaggaggaccgcgtcaca

SEQ ID NO: 471852 - DNA, 20 bp, mouse
ggctgggatcgcaggcaagg

SEQ ID NO: 471853 - DNA, 20 bp, mouse
gtaggaccgtgcagtagaac

SEQ ID NO: 471854 - DNA, 20 bp, mouse
gcccaatcggcgcagaatca

SEQ ID NO: 471855 - DNA, 20 bp, mouse
ggggcggggcgaggatccca

SEQ ID NO: 471856 - DNA, 20 bp, mouse
ggcagcgggaaagggtacag

SEQ ID NO: 471857 - DNA, 20 bp, mouse
gacagaggcgcggacctggc

SEQ ID NO: 471858 - DNA, 20 bp, mouse
ggctgcacccgagccgaggg

SEQ ID NO: 471859 - DNA, 20 bp, mouse
ggctcgggtgcagcgggaaa

SEQ ID NO: 471860 - DNA, 20 bp, mouse
gctttagtgcaggtcatgga

SEQ ID NO: 471861 - DNA, 20 bp, mouse
gtgcgcgcacggctccaggt

SEQ ID NO: 471862 - DNA, 20 bp, mouse
gggccggcggcgggatgcag

SEQ ID NO: 471863 - DNA, 20 bp, mouse
ggggtacagaggcgcggacc

SEQ ID NO: 471864 - DNA, 20 bp, mouse
gcccgctgcacccgagccga

SEQ ID NO: 471865 - DNA, 20 bp, mouse
gcgggtccaagctcctccct

SEQ ID NO: 471866 - DNA, 20 bp, mouse
ggcccgtcgcccccatctgg

SEQ ID NO: 471867 - DNA, 20 bp, mouse
gggacccgagcccagtacca

SEQ ID NO: 471868 - DNA, 20 bp, mouse
gggtctgtagccaccagatg

SEQ ID NO: 471869 - DNA, 20 bp, mouse
ggactctgcggggcctgtgt

SEQ ID NO: 471870 - DNA, 20 bp, mouse
ggagcccagtaccagggcag

SEQ ID NO: 471871 - DNA, 20 bp, mouse
gcctatggctaccaagcgtg

SEQ ID NO: 471872 - DNA, 20 bp, mouse
ggaaagagtcctgccctgta

SEQ ID NO: 471873 - DNA, 20 bp, mouse
gctgctgggccgggccgaga

SEQ ID NO: 471874 - DNA, 20 bp, mouse
gtgtagggcacaagatcaag

SEQ ID NO: 471875 - DNA, 20 bp, mouse
ggaagctccgcgactctgcg

SEQ ID NO: 471876 - DNA, 20 bp, mouse
gacatgtagttgagttgcag

SEQ ID NO: 471877 - DNA, 20 bp, mouse
gtagttgagttgcagcggaa

SEQ ID NO: 471878 - DNA, 20 bp, mouse
ggcaactcaactacatgtca

SEQ ID NO: 471879 - DNA, 20 bp, mouse
ggaggtggcttacgaagtga

SEQ ID NO: 471880 - DNA, 20 bp, mouse
gaacctgaacagttataagt

SEQ ID NO: 471881 - DNA, 20 bp, mouse
gacggctgggcgagctctga

SEQ ID NO: 471882 - DNA, 20 bp, mouse
gtcaggttagtagagaggaa

SEQ ID NO: 471883 - DNA, 20 bp, mouse
gtgaaggtaggtagcacatg

SEQ ID NO: 471884 - DNA, 20 bp, mouse
gaagaagagcagaactgagg

SEQ ID NO: 471885 - DNA, 20 bp, mouse
gctgaacagttataagtggg

SEQ ID NO: 471886 - DNA, 20 bp, mouse
ggatttggctgagagagcaa

SEQ ID NO: 471887 - DNA, 20 bp, mouse
gggtctccagcgcactgaga

SEQ ID NO: 471888 - DNA, 20 bp, mouse
ggtgtttcagtgcggattaa

SEQ ID NO: 471889 - DNA, 20 bp, mouse
gtttcagtgcggattaacgg

SEQ ID NO: 471890 - DNA, 20 bp, mouse
ggcaaaggggtgtttcagtg

SEQ ID NO: 471891 - DNA, 20 bp, mouse
gacaggacatgttggtgatt

SEQ ID NO: 471892 - DNA, 20 bp, mouse
gagaagccgtctcagtgcgc

SEQ ID NO: 471893 - DNA, 20 bp, mouse
gggtaagcacacctggacac

SEQ ID NO: 471894 - DNA, 20 bp, mouse
gaatcagagggcctgtgtcc

SEQ ID NO: 471895 - DNA, 20 bp, mouse
gtgtctacagaaagtttctg

SEQ ID NO: 471896 - DNA, 20 bp, mouse
gacatgtagttgagttgcag

SEQ ID NO: 471897 - DNA, 20 bp, mouse
gtagttgagttgcagcggaa

SEQ ID NO: 471898 - DNA, 20 bp, mouse
ggcaactcaactacatgtca

SEQ ID NO: 471899 - DNA, 20 bp, mouse
ggaggtggcttacgaagtga

SEQ ID NO: 471900 - DNA, 20 bp, mouse
gaacctgaacagttataagt

SEQ ID NO: 471901 - DNA, 20 bp, mouse
gacggctgggcgagctctga

SEQ ID NO: 471902 - DNA, 20 bp, mouse
gtcaggttagtagagaggaa

SEQ ID NO: 471903 - DNA, 20 bp, mouse
gtgaaggtaggtagcacatg

SEQ ID NO: 471904 - DNA, 20 bp, mouse
gaagaagagcagaactgagg

SEQ ID NO: 471905 - DNA, 20 bp, mouse
gctgaacagttataagtggg

SEQ ID NO: 471906 - DNA, 20 bp, mouse
gaagcggcccgaccagagcc

SEQ ID NO: 471907 - DNA, 20 bp, mouse
gggttctcccgagtcgtcgg

SEQ ID NO: 471908 - DNA, 20 bp, mouse
gaccgtaccgccgacgactc

SEQ ID NO: 471909 - DNA, 20 bp, mouse
gtcccgagtcgtcggcggta

SEQ ID NO: 471910 - DNA, 20 bp, mouse
ggctccgcccggctctggtc

SEQ ID NO: 471911 - DNA, 20 bp, mouse
gccctcaccttggaaacctg

SEQ ID NO: 471912 - DNA, 20 bp, mouse
gtcgtcggcggtacggtgga

SEQ ID NO: 471913 - DNA, 20 bp, mouse
gagagccgggcggagctggc

SEQ ID NO: 471914 - DNA, 20 bp, mouse
gcggggttctcccgagtcgt

SEQ ID NO: 471915 - DNA, 20 bp, mouse
gagtccaccccaggtttcca

SEQ ID NO: 471916 - DNA, 20 bp, mouse
gtcagcgggtgaaatggcag

SEQ ID NO: 471917 - DNA, 20 bp, mouse
ggcgggtgaaatggcagtgg

SEQ ID NO: 471918 - DNA, 20 bp, mouse
ggcgacggccgcggtccccg

SEQ ID NO: 471919 - DNA, 20 bp, mouse
gccctgggagggatcctgag

SEQ ID NO: 471920 - DNA, 20 bp, mouse
gggcgctctcggcgcaggta

SEQ ID NO: 471921 - DNA, 20 bp, mouse
gctcccagcgtggattctgg

SEQ ID NO: 471922 - DNA, 20 bp, mouse
gcacggtcacgtctgctcga

SEQ ID NO: 471923 - DNA, 20 bp, mouse
gcggagccaaaggcctaagg

SEQ ID NO: 471924 - DNA, 20 bp, mouse
ggacgtcgcgaagagacact

SEQ ID NO: 471925 - DNA, 20 bp, mouse
ggagggtcccgcaaaccccg

SEQ ID NO: 471926 - DNA, 20 bp, mouse
ggcgcccgccaagatggcag

SEQ ID NO: 471927 - DNA, 20 bp, mouse
ggcacgcgcgcccgccaaga

SEQ ID NO: 471928 - DNA, 20 bp, mouse
gccgcccggcagccacgatg

SEQ ID NO: 471929 - DNA, 20 bp, mouse
ggccccgactcacctcatcg

SEQ ID NO: 471930 - DNA, 20 bp, mouse
ggcgactgacagctgggccc

SEQ ID NO: 471931 - DNA, 20 bp, mouse
gcgcggcgcgcgcagcggta

SEQ ID NO: 471932 - DNA, 20 bp, mouse
ggtccgcctgagactcgggg

SEQ ID NO: 471933 - DNA, 20 bp, mouse
ggccaagatggcaggggccg

SEQ ID NO: 471934 - DNA, 20 bp, mouse
ggtccgggccgctagctgcg

SEQ ID NO: 471935 - DNA, 20 bp, mouse
ggacgcgcacgcgccggccc

SEQ ID NO: 471936 - DNA, 20 bp, mouse
gtctcctgggaggagggcgg

SEQ ID NO: 471937 - DNA, 20 bp, mouse
ggcaggtgccggctcaggct

SEQ ID NO: 471938 - DNA, 20 bp, mouse
gatggtggtgaagcaggtgc

SEQ ID NO: 471939 - DNA, 20 bp, mouse
ggcccggctagtagccagcg

SEQ ID NO: 471940 - DNA, 20 bp, mouse
gcagccaaggggtcccctaa

SEQ ID NO: 471941 - DNA, 20 bp, mouse
gtactagccgggctctgggg

SEQ ID NO: 471942 - DNA, 20 bp, mouse
ggtgaagcaggtgccggctc

SEQ ID NO: 471943 - DNA, 20 bp, mouse
gtgagtggggccctgggtag

SEQ ID NO: 471944 - DNA, 20 bp, mouse
gctcatccgcaggagaatgt

SEQ ID NO: 471945 - DNA, 20 bp, mouse
gggctactagccgggctctg

SEQ ID NO: 471946 - DNA, 20 bp, mouse
ggaggagcgctcgcatcaca

SEQ ID NO: 471947 - DNA, 20 bp, mouse
ggaccgcggagatggcagtg

SEQ ID NO: 471948 - DNA, 20 bp, mouse
gcagaggcggtgcggcacag

SEQ ID NO: 471949 - DNA, 20 bp, mouse
gtcgacggcgaccgcggaga

SEQ ID NO: 471950 - DNA, 20 bp, mouse
ggtgccgcaccgcctctggg

SEQ ID NO: 471951 - DNA, 20 bp, mouse
gctccccactgccatctccg

SEQ ID NO: 471952 - DNA, 20 bp, mouse
gagccccagcgccgtgtcga

SEQ ID NO: 471953 - DNA, 20 bp, mouse
gaagaggagctaaggcgaca

SEQ ID NO: 471954 - DNA, 20 bp, mouse
ggccgtgtcgacggcgaccg

SEQ ID NO: 471955 - DNA, 20 bp, mouse
gccccggactctccagaggg

SEQ ID NO: 471956 - DNA, 20 bp, mouse
gctgggagcgggcaaaggac

SEQ ID NO: 471957 - DNA, 20 bp, mouse
gcccccgaggccaaaccccc

SEQ ID NO: 471958 - DNA, 20 bp, mouse
gacccccgggcgagcagaac

SEQ ID NO: 471959 - DNA, 20 bp, mouse
gcgagaagacacgagaagtg

SEQ ID NO: 471960 - DNA, 20 bp, mouse
gcagacaaatagatccaggt

SEQ ID NO: 471961 - DNA, 20 bp, mouse
ggccagagcgagggaatgac

SEQ ID NO: 471962 - DNA, 20 bp, mouse
gtccgactcggaaggatgta

SEQ ID NO: 471963 - DNA, 20 bp, mouse
gttgtgggatgccagagcga

SEQ ID NO: 471964 - DNA, 20 bp, mouse
ggccagttctgctcgcccgg

SEQ ID NO: 471965 - DNA, 20 bp, mouse
ggggaggcggaaaaaattgt

SEQ ID NO: 471966 - DNA, 20 bp, mouse
gatcccactccgcttacccg

SEQ ID NO: 471967 - DNA, 20 bp, mouse
gcgtccacgggtaagcggag

SEQ ID NO: 471968 - DNA, 20 bp, mouse
ggcgagaaaatggcgtccac

SEQ ID NO: 471969 - DNA, 20 bp, mouse
ggaaccagcccgcctagtgg

SEQ ID NO: 471970 - DNA, 20 bp, mouse
gggtaagcggagtgggatcg

SEQ ID NO: 471971 - DNA, 20 bp, mouse
gaatggcgtccacgggtaag

SEQ ID NO: 471972 - DNA, 20 bp, mouse
ggcctagggggaacgcgaga

SEQ ID NO: 471973 - DNA, 20 bp, mouse
gtgggtgtcccagctgtcgc

SEQ ID NO: 471974 - DNA, 20 bp, mouse
gcgcggcccgacgagctcgg

SEQ ID NO: 471975 - DNA, 20 bp, mouse
ggacgagcgcctcccagtct

SEQ ID NO: 471976 - DNA, 20 bp, mouse
gaccagaggcaaactcacta

SEQ ID NO: 471977 - DNA, 20 bp, mouse
gctagggactgcacttaaaa

SEQ ID NO: 471978 - DNA, 20 bp, mouse
gctgtgttcgaacaaaccag

SEQ ID NO: 471979 - DNA, 20 bp, mouse
gacctgtagggtgggactcc

SEQ ID NO: 471980 - DNA, 20 bp, mouse
gccaggggagtgagagtgag

SEQ ID NO: 471981 - DNA, 20 bp, mouse
gagtgcactgcactactctg

SEQ ID NO: 471982 - DNA, 20 bp, mouse
ggcagtccctagcgccacag

SEQ ID NO: 471983 - DNA, 20 bp, mouse
gagtcccaccctacaggtga

SEQ ID NO: 471984 - DNA, 20 bp, mouse
gaccctagtgagtttgcctc

SEQ ID NO: 471985 - DNA, 20 bp, mouse
gaccaggagtcccaccctac

SEQ ID NO: 471986 - DNA, 20 bp, mouse
gggctggaggccgcaggtaa

SEQ ID NO: 471987 - DNA, 20 bp, mouse
gagcctcgaccgaacacctg

SEQ ID NO: 471988 - DNA, 20 bp, mouse
gaggtaagggaagctcgggt

SEQ ID NO: 471989 - DNA, 20 bp, mouse
ggtggggtgccgcaggtgtt

SEQ ID NO: 471990 - DNA, 20 bp, mouse
gtgccgcaggtgttcggtcg

SEQ ID NO: 471991 - DNA, 20 bp, mouse
gggttccagcttgtcagcgt

SEQ ID NO: 471992 - DNA, 20 bp, mouse
gctgccacacaaccccagag

SEQ ID NO: 471993 - DNA, 20 bp, mouse
gggtgttcggtcgaggctgg

SEQ ID NO: 471994 - DNA, 20 bp, mouse
gtgcgcccagaccgccgcgg

SEQ ID NO: 471995 - DNA, 20 bp, mouse
gggcagtgccaacaacgcct

SEQ ID NO: 471996 - DNA, 20 bp, mouse
gcacctggggttcagaacgg

SEQ ID NO: 471997 - DNA, 20 bp, mouse
ggctcacctggggttcagaa

SEQ ID NO: 471998 - DNA, 20 bp, mouse
gggttcagaacggcggcgag

SEQ ID NO: 471999 - DNA, 20 bp, mouse
gcggaaagcgggagacccgg

SEQ ID NO: 472000 - DNA, 20 bp, mouse
gcgcccggccgcccgcatag

SEQ ID NO: 472001 - DNA, 20 bp, mouse
ggcgcaaatcgaaaggtcca

SEQ ID NO: 472002 - DNA, 20 bp, mouse
ggagcgagcgagcccctatg

SEQ ID NO: 472003 - DNA, 20 bp, mouse
gcggatctccgggaagtgag

SEQ ID NO: 472004 - DNA, 20 bp, mouse
gcgatcccgcgcaaatcgaa

SEQ ID NO: 472005 - DNA, 20 bp, mouse
ggcgggagacccggaggccg

SEQ ID NO: 472006 - DNA, 20 bp, mouse
gtgaggggcgtgcctgaaag

SEQ ID NO: 472007 - DNA, 20 bp, mouse
ggaacaaaaacccgaatgag

SEQ ID NO: 472008 - DNA, 20 bp, mouse
ggacaggggtgaagagctaa

SEQ ID NO: 472009 - DNA, 20 bp, mouse
ggtcaggacgcagaggatga

SEQ ID NO: 472010 - DNA, 20 bp, mouse
gtcaggcacgcccctcattc

SEQ ID NO: 472011 - DNA, 20 bp, mouse
gggcctccgacctcaggctg

SEQ ID NO: 472012 - DNA, 20 bp, mouse
gaagcgcaaagactcaatcg

SEQ ID NO: 472013 - DNA, 20 bp, mouse
gtgcgcttgggcacaccagg

SEQ ID NO: 472014 - DNA, 20 bp, mouse
gcctgtcccagaattcccgg

SEQ ID NO: 472015 - DNA, 20 bp, mouse
gcgcctggagaccttaccct

SEQ ID NO: 472016 - DNA, 20 bp, mouse
gtccaagacggactcaggaa

SEQ ID NO: 472017 - DNA, 20 bp, mouse
gcgaggttggtgctccaaga

SEQ ID NO: 472018 - DNA, 20 bp, mouse
gccagagccccggacagcac

SEQ ID NO: 472019 - DNA, 20 bp, mouse
gacggactcaggaagggcgc

SEQ ID NO: 472020 - DNA, 20 bp, mouse
gcgtgaccggatacgggaag

SEQ ID NO: 472021 - DNA, 20 bp, mouse
ggaccggatacgggaagtgg

SEQ ID NO: 472022 - DNA, 20 bp, mouse
ggtgcagagagacacgtgac

SEQ ID NO: 472023 - DNA, 20 bp, mouse
ggagacacgtgaccggatac

SEQ ID NO: 472024 - DNA, 20 bp, mouse
ggcccttcctgagtccgtct

SEQ ID NO: 472025 - DNA, 20 bp, mouse
gggtgctccaagacggactc

SEQ ID NO: 472026 - DNA, 20 bp, mouse
ggcggcggcctggaaccggt

SEQ ID NO: 472027 - DNA, 20 bp, mouse
gggaagtgcggccctagtgc

SEQ ID NO: 472028 - DNA, 20 bp, mouse
ggccctagtgctggctgcgg

SEQ ID NO: 472029 - DNA, 20 bp, mouse
ggtgtcaggtcccagccaac

SEQ ID NO: 472030 - DNA, 20 bp, mouse
gacccggggcgtcctcaccc

SEQ ID NO: 472031 - DNA, 20 bp, mouse
gggccgccgcagccagcact

SEQ ID NO: 472032 - DNA, 20 bp, mouse
gaggcgcggtgagggacccg

SEQ ID NO: 472033 - DNA, 20 bp, mouse
gggcctggaaccggttggct

SEQ ID NO: 472034 - DNA, 20 bp, mouse
gcgggctggacccggaggag

SEQ ID NO: 472035 - DNA, 20 bp, mouse
gcaggtgagtgtcgcgtcct

SEQ ID NO: 472036 - DNA, 20 bp, mouse
gccggtccggctccgggagg

SEQ ID NO: 472037 - DNA, 20 bp, mouse
gagcggcgttgcggacggtg

SEQ ID NO: 472038 - DNA, 20 bp, mouse
gagcgccccgcccaccgcac

SEQ ID NO: 472039 - DNA, 20 bp, mouse
ggtggcagcggcgttgcgga

SEQ ID NO: 472040 - DNA, 20 bp, mouse
gcttccggtccggctccggg

SEQ ID NO: 472041 - DNA, 20 bp, mouse
gcagccccgaccaaggagat

SEQ ID NO: 472042 - DNA, 20 bp, mouse
ggcgttgcacacttccggtc

SEQ ID NO: 472043 - DNA, 20 bp, mouse
gcccagggacccgcactaga

SEQ ID NO: 472044 - DNA, 20 bp, mouse
gggaggtggcagcggcgttg

SEQ ID NO: 472045 - DNA, 20 bp, mouse
ggtagaagcagccccgacca

SEQ ID NO: 472046 - DNA, 20 bp, mouse
gtgggagagaggcttccttg

SEQ ID NO: 472047 - DNA, 20 bp, mouse
gcactgctcacgggaccgga

SEQ ID NO: 472048 - DNA, 20 bp, mouse
gggtttctgggccgtgaagt

SEQ ID NO: 472049 - DNA, 20 bp, mouse
gggagggactccagctcctt

SEQ ID NO: 472050 - DNA, 20 bp, mouse
gttccttggggagaggaatt

SEQ ID NO: 472051 - DNA, 20 bp, mouse
gccctcactgctcacgggac

SEQ ID NO: 472052 - DNA, 20 bp, mouse
gggccttgggggagaagtag

SEQ ID NO: 472053 - DNA, 20 bp, mouse
gctgctggtgccaaaggagc

SEQ ID NO: 472054 - DNA, 20 bp, mouse
gagccaaattcctctcccca

SEQ ID NO: 472055 - DNA, 20 bp, mouse
gtgtaacgcccaggatagtt

SEQ ID NO: 472056 - DNA, 20 bp, mouse
gaagctctggatggcatcgt

SEQ ID NO: 472057 - DNA, 20 bp, mouse
ggcagttcagaagctctgga

SEQ ID NO: 472058 - DNA, 20 bp, mouse
gcctctgcaggccccagatg

SEQ ID NO: 472059 - DNA, 20 bp, mouse
gagcatggccctagaaaccg

SEQ ID NO: 472060 - DNA, 20 bp, mouse
gtaggacagcgcagaaggga

SEQ ID NO: 472061 - DNA, 20 bp, mouse
gatggcatcgtgggcacact

SEQ ID NO: 472062 - DNA, 20 bp, mouse
gaggagtgttccgcctgtgt

SEQ ID NO: 472063 - DNA, 20 bp, mouse
gataggtggctcctcatctg

SEQ ID NO: 472064 - DNA, 20 bp, mouse
ggcctctgcagggaagactt

SEQ ID NO: 472065 - DNA, 20 bp, mouse
ggcatcagcttgttgaagtg

SEQ ID NO: 472066 - DNA, 20 bp, mouse
gcaagcaggatcctgagacc

SEQ ID NO: 472067 - DNA, 20 bp, mouse
ggccagcacagcccaactgg

SEQ ID NO: 472068 - DNA, 20 bp, mouse
gctggcagccatctctctcc

SEQ ID NO: 472069 - DNA, 20 bp, mouse
ggcctgatcggagcttgaca

SEQ ID NO: 472070 - DNA, 20 bp, mouse
gctctcctggacctggtctc

SEQ ID NO: 472071 - DNA, 20 bp, mouse
gtccaccagttgggctgtgc

SEQ ID NO: 472072 - DNA, 20 bp, mouse
gtggggtccgagtagagagt

SEQ ID NO: 472073 - DNA, 20 bp, mouse
gccgtgggtggggacccaag

SEQ ID NO: 472074 - DNA, 20 bp, mouse
gcaagaggctgagactactc

SEQ ID NO: 472075 - DNA, 20 bp, mouse
gagctgttggtccaccagtt

SEQ ID NO: 472076 - DNA, 20 bp, mouse
gcgctcccgtaccaagatgg

SEQ ID NO: 472077 - DNA, 20 bp, mouse
gagcagctggtgggaaatac

SEQ ID NO: 472078 - DNA, 20 bp, mouse
gtctcgctcccgtaccaaga

SEQ ID NO: 472079 - DNA, 20 bp, mouse
gcgagatgagcagccccgag

SEQ ID NO: 472080 - DNA, 20 bp, mouse
gtgccccgaggagaagactg

SEQ ID NO: 472081 - DNA, 20 bp, mouse
gttctgccgccatcttggta

SEQ ID NO: 472082 - DNA, 20 bp, mouse
ggcaaaagcaaagacccctc

SEQ ID NO: 472083 - DNA, 20 bp, mouse
gctcggtgatcaggtgaggg

SEQ ID NO: 472084 - DNA, 20 bp, mouse
gcgagagccaggtgcttgac

SEQ ID NO: 472085 - DNA, 20 bp, mouse
gcatctcggtgatcaggtga

SEQ ID NO: 472086 - DNA, 20 bp, mouse
gcacacagcgaaggcagaga

SEQ ID NO: 472087 - DNA, 20 bp, mouse
gcccggtcctcacacagcga

SEQ ID NO: 472088 - DNA, 20 bp, mouse
ggcgccgggaggcagctgac

SEQ ID NO: 472089 - DNA, 20 bp, mouse
gcgtctgcggctccgcttca

SEQ ID NO: 472090 - DNA, 20 bp, mouse
ggacgtcccggagaccggac

SEQ ID NO: 472091 - DNA, 20 bp, mouse
gctcgcgacggtgctacagg

SEQ ID NO: 472092 - DNA, 20 bp, mouse
gccggccggcatggccacga

SEQ ID NO: 472093 - DNA, 20 bp, mouse
gcgtgcgaggcggtgacaat

SEQ ID NO: 472094 - DNA, 20 bp, mouse
gcggtaggccgagctgggac

SEQ ID NO: 472095 - DNA, 20 bp, mouse
gagcggtgcgcagcccgggc

SEQ ID NO: 472096 - DNA, 20 bp, mouse
gccgcttccagccaagatgg

SEQ ID NO: 472097 - DNA, 20 bp, mouse
gcggagagctgcgaggctct

SEQ ID NO: 472098 - DNA, 20 bp, mouse
gcacggtcccggagcacgag

SEQ ID NO: 472099 - DNA, 20 bp, mouse
ggaggctctgggcacggtcc

SEQ ID NO: 472100 - DNA, 20 bp, mouse
gcctaaggagtccctggtca

SEQ ID NO: 472101 - DNA, 20 bp, mouse
gcgcggaccacaggagcgag

SEQ ID NO: 472102 - DNA, 20 bp, mouse
gtcgcagctctccgccatct

SEQ ID NO: 472103 - DNA, 20 bp, mouse
gacgcgcgcgcacccggcag

SEQ ID NO: 472104 - DNA, 20 bp, mouse
gcagggcagcccgaaagccg

SEQ ID NO: 472105 - DNA, 20 bp, mouse
gagctctccgccatcttggc

SEQ ID NO: 472106 - DNA, 20 bp, mouse
gcccagcggccgcagatcct

SEQ ID NO: 472107 - DNA, 20 bp, mouse
gtcctgggcagagggatcgt

SEQ ID NO: 472108 - DNA, 20 bp, mouse
gtcgctgagagagggccgcg

SEQ ID NO: 472109 - DNA, 20 bp, mouse
gtggggtactcgctgagaga

SEQ ID NO: 472110 - DNA, 20 bp, mouse
ggaggagagcctggagacgg

SEQ ID NO: 472111 - DNA, 20 bp, mouse
gctgctggggagctactctg

SEQ ID NO: 472112 - DNA, 20 bp, mouse
gctctcaggcgagggaaggt

SEQ ID NO: 472113 - DNA, 20 bp, mouse
ggcagcgccctgcgatggag

SEQ ID NO: 472114 - DNA, 20 bp, mouse
gctctcggaggacctgtgat

SEQ ID NO: 472115 - DNA, 20 bp, mouse
ggcgatggagcgggcgaaga

SEQ ID NO: 472116 - DNA, 20 bp, mouse
gtgcgggggaatcatagcag

SEQ ID NO: 472117 - DNA, 20 bp, mouse
ggccgggcggaagcctcctg

SEQ ID NO: 472118 - DNA, 20 bp, mouse
ggaagtgggcgtgacaggga

SEQ ID NO: 472119 - DNA, 20 bp, mouse
ggggcggaagcctcctgcgg

SEQ ID NO: 472120 - DNA, 20 bp, mouse
gacggaagccgagcagggtt

SEQ ID NO: 472121 - DNA, 20 bp, mouse
gcagggacggaagccgagca

SEQ ID NO: 472122 - DNA, 20 bp, mouse
gtcgatctcccgccgccggg

SEQ ID NO: 472123 - DNA, 20 bp, mouse
gggaggaagtgggcgtgaca

SEQ ID NO: 472124 - DNA, 20 bp, mouse
gagctaaaacagcggggagt

SEQ ID NO: 472125 - DNA, 20 bp, mouse
ggggtttggagctaaaacag

SEQ ID NO: 472126 - DNA, 20 bp, mouse
ggccgcgggagcaagacgag

SEQ ID NO: 472127 - DNA, 20 bp, mouse
gcacccgagcccggtggaga

SEQ ID NO: 472128 - DNA, 20 bp, mouse
gcaggcgctggcagaggaga

SEQ ID NO: 472129 - DNA, 20 bp, mouse
gcctccgctgccttctccac

SEQ ID NO: 472130 - DNA, 20 bp, mouse
gtccgggccccacccgagcc

SEQ ID NO: 472131 - DNA, 20 bp, mouse
gcggcgagtaacagccactg

SEQ ID NO: 472132 - DNA, 20 bp, mouse
gaactgtcgcagcagtcgga

SEQ ID NO: 472133 - DNA, 20 bp, mouse
gtgccttctccaccgggctc

SEQ ID NO: 472134 - DNA, 20 bp, mouse
ggcgcgggagatctcctacc

SEQ ID NO: 472135 - DNA, 20 bp, mouse
ggcaatgcagcgctcggctc

SEQ ID NO: 472136 - DNA, 20 bp, mouse
gtgctggcgcccgcgagtca

SEQ ID NO: 472137 - DNA, 20 bp, mouse
gcgccgcgagtccctgagac

SEQ ID NO: 472138 - DNA, 20 bp, mouse
gttcccgtctcagggactcg

SEQ ID NO: 472139 - DNA, 20 bp, mouse
gactcgcggcgatttctgaa

SEQ ID NO: 472140 - DNA, 20 bp, mouse
gagcttcgcttcccgtctca

SEQ ID NO: 472141 - DNA, 20 bp, mouse
gggcttgcagactcaccgtg

SEQ ID NO: 472142 - DNA, 20 bp, mouse
gtcttggccggggctgtagt

SEQ ID NO: 472143 - DNA, 20 bp, mouse
gacagagtctcagctcgggg

SEQ ID NO: 472144 - DNA, 20 bp, mouse
gtggggaaccgagccggctt

SEQ ID NO: 472145 - DNA, 20 bp, mouse
gctttgcagccatgactcgc

SEQ ID NO: 472146 - DNA, 20 bp, mouse
gcggggatgcagtacctcac

SEQ ID NO: 472147 - DNA, 20 bp, mouse
gcccaaggaccggaactcaa

SEQ ID NO: 472148 - DNA, 20 bp, mouse
gtgcatccccggtaagtgag

SEQ ID NO: 472149 - DNA, 20 bp, mouse
gggagaccgctcacttaccg

SEQ ID NO: 472150 - DNA, 20 bp, mouse
gggatgcagtacctcaccgg

SEQ ID NO: 472151 - DNA, 20 bp, mouse
gaagcatggcaccaccggtg

SEQ ID NO: 472152 - DNA, 20 bp, mouse
gcggcagcggcacctacacc

SEQ ID NO: 472153 - DNA, 20 bp, mouse
gtgccccgggacagatctct

SEQ ID NO: 472154 - DNA, 20 bp, mouse
gttgtggatggtggcaagca

SEQ ID NO: 472155 - DNA, 20 bp, mouse
gttctcatccgggttgtgga

SEQ ID NO: 472156 - DNA, 20 bp, mouse
gccgccctaggacggaaaaa

SEQ ID NO: 472157 - DNA, 20 bp, mouse
gtcgcgagaagagccgccct

SEQ ID NO: 472158 - DNA, 20 bp, mouse
gactgatgctcccggggact

SEQ ID NO: 472159 - DNA, 20 bp, mouse
ggcgcggactgatgctcccg

SEQ ID NO: 472160 - DNA, 20 bp, mouse
ggcgtcaggcttggtcgcac

SEQ ID NO: 472161 - DNA, 20 bp, mouse
gaatggcgcctcccagtccc

SEQ ID NO: 472162 - DNA, 20 bp, mouse
gcgcgcacggagagcgggag

SEQ ID NO: 472163 - DNA, 20 bp, mouse
gctgtcgggcccctcgggag

SEQ ID NO: 472164 - DNA, 20 bp, mouse
gaccatctccgcgtcaggct

SEQ ID NO: 472165 - DNA, 20 bp, mouse
ggtcgcactggtcgccggcg

SEQ ID NO: 472166 - DNA, 20 bp, mouse
gggcccaagctctcactgag

SEQ ID NO: 472167 - DNA, 20 bp, mouse
gcaagatggcgttggagatg

SEQ ID NO: 472168 - DNA, 20 bp, mouse
gaacctctcagtgagagctt

SEQ ID NO: 472169 - DNA, 20 bp, mouse
ggagaggtttgcgagcttta

SEQ ID NO: 472170 - DNA, 20 bp, mouse
ggatgtgtcccgggtaactc

SEQ ID NO: 472171 - DNA, 20 bp, mouse
gcaagtcattggcgccaaga

SEQ ID NO: 472172 - DNA, 20 bp, mouse
gagaagcgtgaggctcgcaa

SEQ ID NO: 472173 - DNA, 20 bp, mouse
ggccgggagtcagaagcgtg

SEQ ID NO: 472174 - DNA, 20 bp, mouse
gctcggggacttagatacaa

SEQ ID NO: 472175 - DNA, 20 bp, mouse
gccgtggtgatcgtgtcccc

SEQ ID NO: 472176 - DNA, 20 bp, mouse
gctgtccgcgggaccggagt

SEQ ID NO: 472177 - DNA, 20 bp, mouse
gtccgcgggaccggagtcgg

SEQ ID NO: 472178 - DNA, 20 bp, mouse
gcggaagcggaagtagatac

SEQ ID NO: 472179 - DNA, 20 bp, mouse
ggtcacaaggagcccagcgg

SEQ ID NO: 472180 - DNA, 20 bp, mouse
gggcagcccgccaccgactc

SEQ ID NO: 472181 - DNA, 20 bp, mouse
gatggctgaagtactgtccg

SEQ ID NO: 472182 - DNA, 20 bp, mouse
gcgaggctgcgcgtagtgtg

SEQ ID NO: 472183 - DNA, 20 bp, mouse
ggcgatggtgacgcctgcca

SEQ ID NO: 472184 - DNA, 20 bp, mouse
ggccaccgactccggtcccg

SEQ ID NO: 472185 - DNA, 20 bp, mouse
gacaaggagcccagcggagg

SEQ ID NO: 472186 - DNA, 20 bp, mouse
ggtccaggtcgagctgtcgg

SEQ ID NO: 472187 - DNA, 20 bp, mouse
ggctcctggccgcacatcaa

SEQ ID NO: 472188 - DNA, 20 bp, mouse
gatcgagcagggcaacacca

SEQ ID NO: 472189 - DNA, 20 bp, mouse
gcaggtcgagctgtcggagg

SEQ ID NO: 472190 - DNA, 20 bp, mouse
gccggtaaccctgatcggac

SEQ ID NO: 472191 - DNA, 20 bp, mouse
gtctatccggtaaccctgat

SEQ ID NO: 472192 - DNA, 20 bp, mouse
gagctgtcggaggcggagtc

SEQ ID NO: 472193 - DNA, 20 bp, mouse
gtggagctcctgtccgatca

SEQ ID NO: 472194 - DNA, 20 bp, mouse
ggccgcacgaggcgagtaag

SEQ ID NO: 472195 - DNA, 20 bp, mouse
gcctggccgcacatcaaggg

SEQ ID NO: 472196 - DNA, 20 bp, mouse
gcgtggtcagcggctatgga

SEQ ID NO: 472197 - DNA, 20 bp, mouse
gccgcagcgcgcgtggtcag

SEQ ID NO: 472198 - DNA, 20 bp, mouse
gccggtgtcagtgagtaaat

SEQ ID NO: 472199 - DNA, 20 bp, mouse
gcgcgcgtggtcagcggcta

SEQ ID NO: 472200 - DNA, 20 bp, mouse
gactgcagactggacttcgg

SEQ ID NO: 472201 - DNA, 20 bp, mouse
gaactgcgcgcgccgctaag

SEQ ID NO: 472202 - DNA, 20 bp, mouse
ggtgggagccgcagcgcgcg

SEQ ID NO: 472203 - DNA, 20 bp, mouse
ggcgcgcgctgagttaaact

SEQ ID NO: 472204 - DNA, 20 bp, mouse
gcgcatgcgcaataggtacg

SEQ ID NO: 472205 - DNA, 20 bp, mouse
ggcggcgcgcgcagttctac

SEQ ID NO: 472206 - DNA, 20 bp, mouse
gcatggagtgcaggtagcgg

SEQ ID NO: 472207 - DNA, 20 bp, mouse
ggttcatggagtgcaggtag

SEQ ID NO: 472208 - DNA, 20 bp, mouse
gggcgggcgggcagttcccg

SEQ ID NO: 472209 - DNA, 20 bp, mouse
gatgtccacagctctcggga

SEQ ID NO: 472210 - DNA, 20 bp, mouse
gtgaacgatgtagaccttct

SEQ ID NO: 472211 - DNA, 20 bp, mouse
gggagattcctagctcatca

SEQ ID NO: 472212 - DNA, 20 bp, mouse
gagaggccgtgtatccgagg

SEQ ID NO: 472213 - DNA, 20 bp, mouse
gctagctcatcagggagcgg

SEQ ID NO: 472214 - DNA, 20 bp, mouse
gggagtgcaggtagcggtgg

SEQ ID NO: 472215 - DNA, 20 bp, mouse
gtctcgggcactgcactctc

SEQ ID NO: 472216 - DNA, 20 bp, mouse
ggagcgggccggaaaaatgg

SEQ ID NO: 472217 - DNA, 20 bp, mouse
ggctgggttcaagtgagtgg

SEQ ID NO: 472218 - DNA, 20 bp, mouse
ggcggctgggttcaagtgag

SEQ ID NO: 472219 - DNA, 20 bp, mouse
ggcagagcgggccggaaaaa

SEQ ID NO: 472220 - DNA, 20 bp, mouse
ggtccctcagcgcctcgagt

SEQ ID NO: 472221 - DNA, 20 bp, mouse
ggcgcgcgcaaagagggccc

SEQ ID NO: 472222 - DNA, 20 bp, mouse
gcccagaagagggtcaacct

SEQ ID NO: 472223 - DNA, 20 bp, mouse
gcgcaaagagggcccgggtg

SEQ ID NO: 472224 - DNA, 20 bp, mouse
ggccacaagtgactgcaggt

SEQ ID NO: 472225 - DNA, 20 bp, mouse
gaagccagtgcacaggtcca

SEQ ID NO: 472226 - DNA, 20 bp, mouse
ggggccacgcaaaggatgaa

SEQ ID NO: 472227 - DNA, 20 bp, mouse
gatagtggcgggccacgcaa

SEQ ID NO: 472228 - DNA, 20 bp, mouse
gagcggcgtctccttcatag

SEQ ID NO: 472229 - DNA, 20 bp, mouse
gggcgctcacagttggaaag

SEQ ID NO: 472230 - DNA, 20 bp, mouse
gaggaagcggcgctcacagt

SEQ ID NO: 472231 - DNA, 20 bp, mouse
ggcgtggcccgccactatga

SEQ ID NO: 472232 - DNA, 20 bp, mouse
gaattgcgcggagcaggaag

SEQ ID NO: 472233 - DNA, 20 bp, mouse
gggcgtctccttcatagtgg

SEQ ID NO: 472234 - DNA, 20 bp, mouse
gggtcgtggtgtggactcgg

SEQ ID NO: 472235 - DNA, 20 bp, mouse
gttccgcgccgggaagaagc

SEQ ID NO: 472236 - DNA, 20 bp, mouse
gggaccagcccacacataca

SEQ ID NO: 472237 - DNA, 20 bp, mouse
gaaaggcgcggagctattat

SEQ ID NO: 472238 - DNA, 20 bp, mouse
ggcaggcccagcccaagagg

SEQ ID NO: 472239 - DNA, 20 bp, mouse
gtatgtgtgggctggtcccg

SEQ ID NO: 472240 - DNA, 20 bp, mouse
gcctggagagagcacccggg

SEQ ID NO: 472241 - DNA, 20 bp, mouse
gagaaatgaggaactccgga

SEQ ID NO: 472242 - DNA, 20 bp, mouse
ggagcctggagagagcaccc

SEQ ID NO: 472243 - DNA, 20 bp, mouse
ggggctatgggatcaagttc

SEQ ID NO: 472244 - DNA, 20 bp, mouse
gcaggtactggaaagaaatg

SEQ ID NO: 472245 - DNA, 20 bp, mouse
gatgcaggtgctgcttggag

SEQ ID NO: 472246 - DNA, 20 bp, mouse
gattcggcgaccgaacgcgg

SEQ ID NO: 472247 - DNA, 20 bp, mouse
gaacattcggcgaccgaacg

SEQ ID NO: 472248 - DNA, 20 bp, mouse
gtgtgggagccgctgcagaa

SEQ ID NO: 472249 - DNA, 20 bp, mouse
gttcagaaccgggtaacatt

SEQ ID NO: 472250 - DNA, 20 bp, mouse
gtgagcgcaggagtaaacac

SEQ ID NO: 472251 - DNA, 20 bp, mouse
gggcgaccgaacgcggcggt

SEQ ID NO: 472252 - DNA, 20 bp, mouse
gtcggtcgccgaatgttacc

SEQ ID NO: 472253 - DNA, 20 bp, mouse
gccgccgagaggaatccgag

SEQ ID NO: 472254 - DNA, 20 bp, mouse
ggagaggaatccgagcggag

SEQ ID NO: 472255 - DNA, 20 bp, mouse
gcggtcggcagtgatagcgc

SEQ ID NO: 472256 - DNA, 20 bp, mouse
gaggtaccctggagccagcg

SEQ ID NO: 472257 - DNA, 20 bp, mouse
ggccggcctccagttcccca

SEQ ID NO: 472258 - DNA, 20 bp, mouse
gggcttccccgctggctcca

SEQ ID NO: 472259 - DNA, 20 bp, mouse
gggagcccgccgccagcacc

SEQ ID NO: 472260 - DNA, 20 bp, mouse
gccggcgcaggcttccccgc

SEQ ID NO: 472261 - DNA, 20 bp, mouse
ggcgcgccgtgtcagccgtg

SEQ ID NO: 472262 - DNA, 20 bp, mouse
gcagttccccacggctgaca

SEQ ID NO: 472263 - DNA, 20 bp, mouse
gcggggcacaggtacagcag

SEQ ID NO: 472264 - DNA, 20 bp, mouse
ggcgcactgcgcatgcgaag

SEQ ID NO: 472265 - DNA, 20 bp, mouse
gccgcgagccacggctgtgt

SEQ ID NO: 472266 - DNA, 20 bp, mouse
ggctgccggctggacctgtg

SEQ ID NO: 472267 - DNA, 20 bp, mouse
gccggctaggagctgtcaca

SEQ ID NO: 472268 - DNA, 20 bp, mouse
gcctgccccacaggtccagc

SEQ ID NO: 472269 - DNA, 20 bp, mouse
gctccaggtcccactccaga

SEQ ID NO: 472270 - DNA, 20 bp, mouse
gaggtccagccggcagctcc

SEQ ID NO: 472271 - DNA, 20 bp, mouse
gactccagaaggtatcaagt

SEQ ID NO: 472272 - DNA, 20 bp, mouse
gggccagccaccaaacacag

SEQ ID NO: 472273 - DNA, 20 bp, mouse
gtggggcaggaacaggaatt

SEQ ID NO: 472274 - DNA, 20 bp, mouse
gtgctctgcaccctccggct

SEQ ID NO: 472275 - DNA, 20 bp, mouse
gcccaagggcaggctatcta

SEQ ID NO: 472276 - DNA, 20 bp, mouse
gcctaggttatcaattggac

SEQ ID NO: 472277 - DNA, 20 bp, mouse
gtgcaggcggcgcatttcct

SEQ ID NO: 472278 - DNA, 20 bp, mouse
gacgagggcaaaacaagcag

SEQ ID NO: 472279 - DNA, 20 bp, mouse
ggagggaggggtggccactc

SEQ ID NO: 472280 - DNA, 20 bp, mouse
gcatttcctaggttatcaat

SEQ ID NO: 472281 - DNA, 20 bp, mouse
gctccaggcactcactttgc

SEQ ID NO: 472282 - DNA, 20 bp, mouse
gatcaattggacgggcagag

SEQ ID NO: 472283 - DNA, 20 bp, mouse
gcaggcactcactttgcagg

SEQ ID NO: 472284 - DNA, 20 bp, mouse
ggtcacccaaagcgagggag

SEQ ID NO: 472285 - DNA, 20 bp, mouse
ggaggttggaagcccggttt

SEQ ID NO: 472286 - DNA, 20 bp, mouse
gactttcacgcaggcaacgg

SEQ ID NO: 472287 - DNA, 20 bp, mouse
ggcgcagccggcggccagag

SEQ ID NO: 472288 - DNA, 20 bp, mouse
ggcggtggctcgttactgac

SEQ ID NO: 472289 - DNA, 20 bp, mouse
gatgccgcccggactcctac

SEQ ID NO: 472290 - DNA, 20 bp, mouse
gcagagcggcttgtgggaag

SEQ ID NO: 472291 - DNA, 20 bp, mouse
gttcacgcaggcaacggcgg

SEQ ID NO: 472292 - DNA, 20 bp, mouse
gcggactttcacgcaggcaa

SEQ ID NO: 472293 - DNA, 20 bp, mouse
ggggaagcggactttcacgc

SEQ ID NO: 472294 - DNA, 20 bp, mouse
gctggagagaagagcccgac

SEQ ID NO: 472295 - DNA, 20 bp, mouse
gctgggaggcgcgcagccgg

SEQ ID NO: 472296 - DNA, 20 bp, mouse
gaggatactgcagccaggaa

SEQ ID NO: 472297 - DNA, 20 bp, mouse
gtaaccaaacgagaaaaggg

SEQ ID NO: 472298 - DNA, 20 bp, mouse
gaagggaggatactgcagcc

SEQ ID NO: 472299 - DNA, 20 bp, mouse
gcatagtgtctttaagtgga

SEQ ID NO: 472300 - DNA, 20 bp, mouse
ggggaggaggatagacctgc

SEQ ID NO: 472301 - DNA, 20 bp, mouse
ggttaaaagtgagcattgta

SEQ ID NO: 472302 - DNA, 20 bp, mouse
gaaggcatagtgtctttaag

SEQ ID NO: 472303 - DNA, 20 bp, mouse
gcccctcctgacaaggggag

SEQ ID NO: 472304 - DNA, 20 bp, mouse
gcgttcgcacctgtggtcag

SEQ ID NO: 472305 - DNA, 20 bp, mouse
gatagatccgggtcacagaa

SEQ ID NO: 472306 - DNA, 20 bp, mouse
gtcctccgggagcgcagcgg

SEQ ID NO: 472307 - DNA, 20 bp, mouse
ggagagcagcgcgcactgca

SEQ ID NO: 472308 - DNA, 20 bp, mouse
ggcggcgctggctccgggcg

SEQ ID NO: 472309 - DNA, 20 bp, mouse
ggccccgcggcccccacgca

SEQ ID NO: 472310 - DNA, 20 bp, mouse
gcgggccgcgccgtgcgtgg

SEQ ID NO: 472311 - DNA, 20 bp, mouse
ggcagggccgactccccgcc

SEQ ID NO: 472312 - DNA, 20 bp, mouse
gtagtgtctacggggtcccc

SEQ ID NO: 472313 - DNA, 20 bp, mouse
gggccggcgcgtccctcctc

SEQ ID NO: 472314 - DNA, 20 bp, mouse
gcgcgccggcctcctccctg

SEQ ID NO: 472315 - DNA, 20 bp, mouse
gacggggtccccgggagacg

SEQ ID NO: 472316 - DNA, 20 bp, mouse
gccaataggtgactataccc

SEQ ID NO: 472317 - DNA, 20 bp, mouse
ggtggaatgagagagagtcc

SEQ ID NO: 472318 - DNA, 20 bp, mouse
gcggatccgtgtctcccaat

SEQ ID NO: 472319 - DNA, 20 bp, mouse
gagtcacctattgggagaca

SEQ ID NO: 472320 - DNA, 20 bp, mouse
gagctgccagtgccagggct

SEQ ID NO: 472321 - DNA, 20 bp, mouse
gggtgactatacccaggttc

SEQ ID NO: 472322 - DNA, 20 bp, mouse
gcttggctcagacctgaacc

SEQ ID NO: 472323 - DNA, 20 bp, mouse
gtccgggctcctgtgcagaa

SEQ ID NO: 472324 - DNA, 20 bp, mouse
gagtgttcccagtgagcccg

SEQ ID NO: 472325 - DNA, 20 bp, mouse
gaaggaggttagccttcgag

SEQ ID NO: 472326 - DNA, 20 bp, mouse
gacactgcccagcacgacat

SEQ ID NO: 472327 - DNA, 20 bp, mouse
ggcggcggggactcaccaga

SEQ ID NO: 472328 - DNA, 20 bp, mouse
ggcacgacatgggacgatta

SEQ ID NO: 472329 - DNA, 20 bp, mouse
gccggcgcctaggcgagaag

SEQ ID NO: 472330 - DNA, 20 bp, mouse
gacgcccgggaaaagctcga

SEQ ID NO: 472331 - DNA, 20 bp, mouse
ggacgattacggacccactc

SEQ ID NO: 472332 - DNA, 20 bp, mouse
gccggcaggcagggacgagg

SEQ ID NO: 472333 - DNA, 20 bp, mouse
gaacagagtggcggaaaccg

SEQ ID NO: 472334 - DNA, 20 bp, mouse
gagctcgagggcagaccggc

SEQ ID NO: 472335 - DNA, 20 bp, mouse
ggagggcagaccggcaggca

SEQ ID NO: 472336 - DNA, 20 bp, mouse
gagctccgcgcgctagggag

SEQ ID NO: 472337 - DNA, 20 bp, mouse
ggctagggagaggctgcccg

SEQ ID NO: 472338 - DNA, 20 bp, mouse
ggctccagctccgcgcgcta

SEQ ID NO: 472339 - DNA, 20 bp, mouse
gcggtcggcgccctagagag

SEQ ID NO: 472340 - DNA, 20 bp, mouse
gccgctcagtcccctctcta

SEQ ID NO: 472341 - DNA, 20 bp, mouse
gggcgcggcgcacgctccgg

SEQ ID NO: 472342 - DNA, 20 bp, mouse
gctagggcgccgaccgggaa

SEQ ID NO: 472343 - DNA, 20 bp, mouse
ggagttagcagcgtgcagac

SEQ ID NO: 472344 - DNA, 20 bp, mouse
ggagggcgcggagattaccg

SEQ ID NO: 472345 - DNA, 20 bp, mouse
gcgcgcaagccgggagccgc

SEQ ID NO: 472346 - DNA, 20 bp, mouse
gtagcgcgcaggcgtcctag

SEQ ID NO: 472347 - DNA, 20 bp, mouse
ggggtggctgcgtctcagga

SEQ ID NO: 472348 - DNA, 20 bp, mouse
gcgcgcaggcgtcctagtgg

SEQ ID NO: 472349 - DNA, 20 bp, mouse
gtgagtgagtaaacaagacg

SEQ ID NO: 472350 - DNA, 20 bp, mouse
gccgagtgtggtgggacccg

SEQ ID NO: 472351 - DNA, 20 bp, mouse
gtggcgggtggctgcgtctc

SEQ ID NO: 472352 - DNA, 20 bp, mouse
gtaaacaagacggggctggg

SEQ ID NO: 472353 - DNA, 20 bp, mouse
ggacgcagccacccgccact

SEQ ID NO: 472354 - DNA, 20 bp, mouse
gcgccaaggcccacccacgt

SEQ ID NO: 472355 - DNA, 20 bp, mouse
ggcgtgacgcttgaacctca

SEQ ID NO: 472356 - DNA, 20 bp, mouse
gacacccagtgggacatcga

SEQ ID NO: 472357 - DNA, 20 bp, mouse
ggaaggcagtggagtcccgg

SEQ ID NO: 472358 - DNA, 20 bp, mouse
gggtcgcgtccgacacccag

SEQ ID NO: 472359 - DNA, 20 bp, mouse
gagtgggacatcgaaggcag

SEQ ID NO: 472360 - DNA, 20 bp, mouse
ggctcgagtgagacccgctt

SEQ ID NO: 472361 - DNA, 20 bp, mouse
gctgcgtttggcgctcggtc

SEQ ID NO: 472362 - DNA, 20 bp, mouse
gtctggaacgcgccccgggg

SEQ ID NO: 472363 - DNA, 20 bp, mouse
gccctccgcgcctacaaaag

SEQ ID NO: 472364 - DNA, 20 bp, mouse
gcggtcccacgagtgaactg

SEQ ID NO: 472365 - DNA, 20 bp, mouse
gggatctggaacgcgccccg

SEQ ID NO: 472366 - DNA, 20 bp, mouse
gggctgtacggcggaggcga

SEQ ID NO: 472367 - DNA, 20 bp, mouse
ggagacgcgtcgggacctgc

SEQ ID NO: 472368 - DNA, 20 bp, mouse
gcggctattcggctgtacgg

SEQ ID NO: 472369 - DNA, 20 bp, mouse
gcctcggctattcggctgta

SEQ ID NO: 472370 - DNA, 20 bp, mouse
gggcgacggcggagacgcgt

SEQ ID NO: 472371 - DNA, 20 bp, mouse
gctattcggctgtacggcgg

SEQ ID NO: 472372 - DNA, 20 bp, mouse
ggaactgggcgaacaggtgt

SEQ ID NO: 472373 - DNA, 20 bp, mouse
gaaaccgcccaggaaggtgt

SEQ ID NO: 472374 - DNA, 20 bp, mouse
gctggttggtggctctgcgt

SEQ ID NO: 472375 - DNA, 20 bp, mouse
gccggccggttcttatactc

SEQ ID NO: 472376 - DNA, 20 bp, mouse
gcccatggtgtggtcaagga

SEQ ID NO: 472377 - DNA, 20 bp, mouse
gtccgggcgggcagaggtgt

SEQ ID NO: 472378 - DNA, 20 bp, mouse
ggtgtggtcaaggacggcag

SEQ ID NO: 472379 - DNA, 20 bp, mouse
ggagcaggctgagttgcacc

SEQ ID NO: 472380 - DNA, 20 bp, mouse
ggccgtccttgaccacacca

SEQ ID NO: 472381 - DNA, 20 bp, mouse
gagttgcaccgggctcccca

SEQ ID NO: 472382 - DNA, 20 bp, mouse
gggcccagccagaagattga

SEQ ID NO: 472383 - DNA, 20 bp, mouse
gcaccgggctccccatggtg

SEQ ID NO: 472384 - DNA, 20 bp, mouse
gagagcggcccggggagagg

SEQ ID NO: 472385 - DNA, 20 bp, mouse
gggccctgctgactccgggc

SEQ ID NO: 472386 - DNA, 20 bp, mouse
gcagaaagtatctgcaggta

SEQ ID NO: 472387 - DNA, 20 bp, mouse
gtctttgctgtagtcctcgg

SEQ ID NO: 472388 - DNA, 20 bp, mouse
ggaaagcaaacactccgccg

SEQ ID NO: 472389 - DNA, 20 bp, mouse
gctgcaggtacggcttcaaa

SEQ ID NO: 472390 - DNA, 20 bp, mouse
gaacttccgtggagggagag

SEQ ID NO: 472391 - DNA, 20 bp, mouse
gtaccggctcacgtagaaaa

SEQ ID NO: 472392 - DNA, 20 bp, mouse
gaaactaaggaaaacttccg

SEQ ID NO: 472393 - DNA, 20 bp, mouse
gcaccccctgtagtaaacta

SEQ ID NO: 472394 - DNA, 20 bp, mouse
gtaaggaaaacttccgtgga

SEQ ID NO: 472395 - DNA, 20 bp, mouse
gaagcaacagtgttccatac

SEQ ID NO: 472396 - DNA, 20 bp, mouse
gacgggcacagcaactccaa

SEQ ID NO: 472397 - DNA, 20 bp, mouse
gacggagagtgaccagaccc

SEQ ID NO: 472398 - DNA, 20 bp, mouse
gatcgcgaggctgttcccat

SEQ ID NO: 472399 - DNA, 20 bp, mouse
gcacgcgccgacgggaaggg

SEQ ID NO: 472400 - DNA, 20 bp, mouse
ggttacaatcccgacgcgac

SEQ ID NO: 472401 - DNA, 20 bp, mouse
gccccacgcgccgacgggaa

SEQ ID NO: 472402 - DNA, 20 bp, mouse
gaactgtaatgggcaccgag

SEQ ID NO: 472403 - DNA, 20 bp, mouse
ggagagtgaccagacccggg

SEQ ID NO: 472404 - DNA, 20 bp, mouse
ggccgggagtaccctctctg

SEQ ID NO: 472405 - DNA, 20 bp, mouse
ggcggaaaagtggactccca

SEQ ID NO: 472406 - DNA, 20 bp, mouse
ggggcaggcagcggggccat

SEQ ID NO: 472407 - DNA, 20 bp, mouse
gaggaacaacagagccgtca

SEQ ID NO: 472408 - DNA, 20 bp, mouse
gactcatcagcagagacccc

SEQ ID NO: 472409 - DNA, 20 bp, mouse
gtctattgatcctcactcct

SEQ ID NO: 472410 - DNA, 20 bp, mouse
gcaggtgactgagagacttg

SEQ ID NO: 472411 - DNA, 20 bp, mouse
gtcctcacatccaccagcat

SEQ ID NO: 472412 - DNA, 20 bp, mouse
gttgaggcctataggatcaa

SEQ ID NO: 472413 - DNA, 20 bp, mouse
gcactcctgggcaggcagcg

SEQ ID NO: 472414 - DNA, 20 bp, mouse
gccgtcatggcgtctgccga

SEQ ID NO: 472415 - DNA, 20 bp, mouse
gacctgaactagcaggtgac

SEQ ID NO: 472416 - DNA, 20 bp, mouse
gactaccagagcaccctctc

SEQ ID NO: 472417 - DNA, 20 bp, mouse
gggcaaagtgaccagaaagt

SEQ ID NO: 472418 - DNA, 20 bp, mouse
ggccttccatctcaacacag

SEQ ID NO: 472419 - DNA, 20 bp, mouse
gactgccacagcttggaaca

SEQ ID NO: 472420 - DNA, 20 bp, mouse
gagtgttggggagtggtcag

SEQ ID NO: 472421 - DNA, 20 bp, mouse
gggcaggtcccctttcccaa

SEQ ID NO: 472422 - DNA, 20 bp, mouse
gagcatggtagagttcaaag

SEQ ID NO: 472423 - DNA, 20 bp, mouse
gctgtgctctcaggatagca

SEQ ID NO: 472424 - DNA, 20 bp, mouse
ggcagccctgttccaagctg

SEQ ID NO: 472425 - DNA, 20 bp, mouse
gctatcctgagagcacagct

SEQ ID NO: 472426 - DNA, 20 bp, mouse
gtagtttggatacaaggagg

SEQ ID NO: 472427 - DNA, 20 bp, mouse
ggtttagtttggatacaagg

SEQ ID NO: 472428 - DNA, 20 bp, mouse
gttatttcaagggtaagaag

SEQ ID NO: 472429 - DNA, 20 bp, mouse
ggcttgggtgacactcttga

SEQ ID NO: 472430 - DNA, 20 bp, mouse
gctgacgctggacttcaatg

SEQ ID NO: 472431 - DNA, 20 bp, mouse
ggatacaccagaatgctcca

SEQ ID NO: 472432 - DNA, 20 bp, mouse
gggtaagaagtggggtaact

SEQ ID NO: 472433 - DNA, 20 bp, mouse
ggactatgagagcatttaga

SEQ ID NO: 472434 - DNA, 20 bp, mouse
gatacgacaaacgtttagtt

SEQ ID NO: 472435 - DNA, 20 bp, mouse
gctccaagacttacagagaa

SEQ ID NO: 472436 - DNA, 20 bp, mouse
gtgcatagagttctcctgag

SEQ ID NO: 472437 - DNA, 20 bp, mouse
gtatttagtaatgagatcct

SEQ ID NO: 472438 - DNA, 20 bp, mouse
gcccaaatctagagaaataa

SEQ ID NO: 472439 - DNA, 20 bp, mouse
gaaagcatgcattacaaaac

SEQ ID NO: 472440 - DNA, 20 bp, mouse
gagaggagagaatataatgt

SEQ ID NO: 472441 - DNA, 20 bp, mouse
gcaggagaactctatgcaga

SEQ ID NO: 472442 - DNA, 20 bp, mouse
ggttctctcctctttttaag

SEQ ID NO: 472443 - DNA, 20 bp, mouse
gagcattatcagcattaatt

SEQ ID NO: 472444 - DNA, 20 bp, mouse
gctttaaagtagttagaccc

SEQ ID NO: 472445 - DNA, 20 bp, mouse
gctctagatttgggagcacg

SEQ ID NO: 472446 - DNA, 20 bp, mouse
ggtcagctcctgggatctga

SEQ ID NO: 472447 - DNA, 20 bp, mouse
gctggtctgaggaccacctg

SEQ ID NO: 472448 - DNA, 20 bp, mouse
gacactatgtcgcacgtccg

SEQ ID NO: 472449 - DNA, 20 bp, mouse
gggctagggcaaccaatgaa

SEQ ID NO: 472450 - DNA, 20 bp, mouse
ggctgtgtaccaggctaacc

SEQ ID NO: 472451 - DNA, 20 bp, mouse
gtacagggacagtccccagg

SEQ ID NO: 472452 - DNA, 20 bp, mouse
ggtgtgtggtgcaggtagga

SEQ ID NO: 472453 - DNA, 20 bp, mouse
ggaatacagggacagtcccc

SEQ ID NO: 472454 - DNA, 20 bp, mouse
gacatagtgtgtcagctcct

SEQ ID NO: 472455 - DNA, 20 bp, mouse
ggaggcctcgggcaggatag

SEQ ID NO: 472456 - DNA, 20 bp, mouse
gggagcctgcgggtgactag

SEQ ID NO: 472457 - DNA, 20 bp, mouse
gctcagaaagaagtaggcga

SEQ ID NO: 472458 - DNA, 20 bp, mouse
gccaggtaagagctgcgggt

SEQ ID NO: 472459 - DNA, 20 bp, mouse
gggacgcgggaagacagcaa

SEQ ID NO: 472460 - DNA, 20 bp, mouse
ggaaagaagtaggcgacggc

SEQ ID NO: 472461 - DNA, 20 bp, mouse
gtctttctgagtagctcggt

SEQ ID NO: 472462 - DNA, 20 bp, mouse
gagacagcaagggaccgcac

SEQ ID NO: 472463 - DNA, 20 bp, mouse
gccggggccccattgtccca

SEQ ID NO: 472464 - DNA, 20 bp, mouse
ggtcgcctctagtcacccgc

SEQ ID NO: 472465 - DNA, 20 bp, mouse
gtagctcggtcggagcctgc

SEQ ID NO: 472466 - DNA, 20 bp, mouse
gaacaggtcccgccccagga

SEQ ID NO: 472467 - DNA, 20 bp, mouse
ggagccctactctgagcaca

SEQ ID NO: 472468 - DNA, 20 bp, mouse
ggaagctcgtgttaagggaa

SEQ ID NO: 472469 - DNA, 20 bp, mouse
ggcgggcaatccgccaccag

SEQ ID NO: 472470 - DNA, 20 bp, mouse
gccaccagtggttcgaaact

SEQ ID NO: 472471 - DNA, 20 bp, mouse
gtgcaccgggtgagctcgag

SEQ ID NO: 472472 - DNA, 20 bp, mouse
ggacgtggttcggggagata

SEQ ID NO: 472473 - DNA, 20 bp, mouse
ggctacagagagtgtccagg

SEQ ID NO: 472474 - DNA, 20 bp, mouse
ggctccgagtttcgaaccac

SEQ ID NO: 472475 - DNA, 20 bp, mouse
ggaacgctctgggctggtgg

SEQ ID NO: 472476 - DNA, 20 bp, mouse
ggctcatacatggagctgag

SEQ ID NO: 472477 - DNA, 20 bp, mouse
gtagcatgggggtgagagag

SEQ ID NO: 472478 - DNA, 20 bp, mouse
gtccacttgctgctcataca

SEQ ID NO: 472479 - DNA, 20 bp, mouse
gggagttaacaagaaaatta

SEQ ID NO: 472480 - DNA, 20 bp, mouse
gttcttgtggtctagcatgg

SEQ ID NO: 472481 - DNA, 20 bp, mouse
gtgtcctgagacccggttac

SEQ ID NO: 472482 - DNA, 20 bp, mouse
gcccagctgcaaccaagata

SEQ ID NO: 472483 - DNA, 20 bp, mouse
ggtggtaagtccccttcttg

SEQ ID NO: 472484 - DNA, 20 bp, mouse
gtccttgcctctacagagaa

SEQ ID NO: 472485 - DNA, 20 bp, mouse
gagaaggggacttaccactt

SEQ ID NO: 472486 - DNA, 20 bp, mouse
ggcaccaaaggatacagcag

SEQ ID NO: 472487 - DNA, 20 bp, mouse
gccaggatcagaagctttct

SEQ ID NO: 472488 - DNA, 20 bp, mouse
gacatcatcgtagatgctgg

SEQ ID NO: 472489 - DNA, 20 bp, mouse
gagagtaccaggggaagcca

SEQ ID NO: 472490 - DNA, 20 bp, mouse
gtgagcaggcttacagtctt

SEQ ID NO: 472491 - DNA, 20 bp, mouse
gtgagagtcttaggcattgt

SEQ ID NO: 472492 - DNA, 20 bp, mouse
ggctgtatcctttggtgctg

SEQ ID NO: 472493 - DNA, 20 bp, mouse
gcactcaccatggcttcccc

SEQ ID NO: 472494 - DNA, 20 bp, mouse
gctcccacagaaggccctct

SEQ ID NO: 472495 - DNA, 20 bp, mouse
gggccttctgtgggagagag

SEQ ID NO: 472496 - DNA, 20 bp, mouse
gacgctacaggagcgatcgg

SEQ ID NO: 472497 - DNA, 20 bp, mouse
gcgaggtctcggggcttcag

SEQ ID NO: 472498 - DNA, 20 bp, mouse
ggctacgctacaggagcgat

SEQ ID NO: 472499 - DNA, 20 bp, mouse
ggggagcgagtgatgggtac

SEQ ID NO: 472500 - DNA, 20 bp, mouse
gcgaggatcgccatgtccaa

SEQ ID NO: 472501 - DNA, 20 bp, mouse
gcgcggtcacctggaggagg

SEQ ID NO: 472502 - DNA, 20 bp, mouse
gggtctcggggcttcagcgg

SEQ ID NO: 472503 - DNA, 20 bp, mouse
gggaggcagccgagaaacgt

SEQ ID NO: 472504 - DNA, 20 bp, mouse
gtgcacccgcggtcacctgg

SEQ ID NO: 472505 - DNA, 20 bp, mouse
gggcttcagcggcggcgcgt

SEQ ID NO: 472506 - DNA, 20 bp, mouse
gggttagacagccaccacag

SEQ ID NO: 472507 - DNA, 20 bp, mouse
ggcgcgctgatctgtctccc

SEQ ID NO: 472508 - DNA, 20 bp, mouse
gacagccaccacaggggaca

SEQ ID NO: 472509 - DNA, 20 bp, mouse
gctaggcatagagggaggta

SEQ ID NO: 472510 - DNA, 20 bp, mouse
gggcagaggccgcgcaacta

SEQ ID NO: 472511 - DNA, 20 bp, mouse
ggagcactgagcactgtcgg

SEQ ID NO: 472512 - DNA, 20 bp, mouse
ggacagatcagcgcgcaaca

SEQ ID NO: 472513 - DNA, 20 bp, mouse
gcaccaggaggaagaagcac

SEQ ID NO: 472514 - DNA, 20 bp, mouse
gtggggcagccaccaggcag

SEQ ID NO: 472515 - DNA, 20 bp, mouse
ggtgtccctgtcccctgtgg

SEQ ID NO: 472516 - DNA, 20 bp, mouse
gccagctccagggacctcta

SEQ ID NO: 472517 - DNA, 20 bp, mouse
gcatggttccacaggcgcat

SEQ ID NO: 472518 - DNA, 20 bp, mouse
gtggaaccatgatgagactg

SEQ ID NO: 472519 - DNA, 20 bp, mouse
gtgcagtccctagaggtccc

SEQ ID NO: 472520 - DNA, 20 bp, mouse
gatatacctgcagtccctag

SEQ ID NO: 472521 - DNA, 20 bp, mouse
gagagctgcctatttccggg

SEQ ID NO: 472522 - DNA, 20 bp, mouse
gaagtgtgctgctcatgagg

SEQ ID NO: 472523 - DNA, 20 bp, mouse
gatgcttgccacccggaaat

SEQ ID NO: 472524 - DNA, 20 bp, mouse
gacagggcaactgcactaga

SEQ ID NO: 472525 - DNA, 20 bp, mouse
gccccaggctctaatttcac

SEQ ID NO: 472526 - DNA, 20 bp, mouse
ggaccttgtgcagtatggca

SEQ ID NO: 472527 - DNA, 20 bp, mouse
gcttctcagagcctaaatgg

SEQ ID NO: 472528 - DNA, 20 bp, mouse
ggtcatgaacaaactaagag

SEQ ID NO: 472529 - DNA, 20 bp, mouse
gttcatgaccttgtgcagta

SEQ ID NO: 472530 - DNA, 20 bp, mouse
ggtcatcagtgggtattgta

SEQ ID NO: 472531 - DNA, 20 bp, mouse
gtagacagcaggtcatcagt

SEQ ID NO: 472532 - DNA, 20 bp, mouse
gatcagtgggtattgtaggg

SEQ ID NO: 472533 - DNA, 20 bp, mouse
gtgtgagttaagaggcagtt

SEQ ID NO: 472534 - DNA, 20 bp, mouse
gttagcccttgacttgggag

SEQ ID NO: 472535 - DNA, 20 bp, mouse
gacttgggagtggtatggtg

SEQ ID NO: 472536 - DNA, 20 bp, mouse
gactagagcagaaattgaaa

SEQ ID NO: 472537 - DNA, 20 bp, mouse
gtattttgcagagcattttc

SEQ ID NO: 472538 - DNA, 20 bp, mouse
gccatcagaagatactacct

SEQ ID NO: 472539 - DNA, 20 bp, mouse
gagcacaaaacagatctgaa

SEQ ID NO: 472540 - DNA, 20 bp, mouse
gaatgctctgcaaaatattt

SEQ ID NO: 472541 - DNA, 20 bp, mouse
gtgtgctgcatacagactca

SEQ ID NO: 472542 - DNA, 20 bp, mouse
gagatactaccttggtgcag

SEQ ID NO: 472543 - DNA, 20 bp, mouse
gtggtgcagtggaattgtcc

SEQ ID NO: 472544 - DNA, 20 bp, mouse
gacatggagaaaagtctact

SEQ ID NO: 472545 - DNA, 20 bp, mouse
ggcgaagagtgctatttgca

SEQ ID NO: 472546 - DNA, 20 bp, mouse
gccttggcagtcggagacag

SEQ ID NO: 472547 - DNA, 20 bp, mouse
ggtagcagctgctccaggac

SEQ ID NO: 472548 - DNA, 20 bp, mouse
ggacaggaaagatgtctaat

SEQ ID NO: 472549 - DNA, 20 bp, mouse
gtctccgactgccaagggac

SEQ ID NO: 472550 - DNA, 20 bp, mouse
gattcctctgcgcaagtgtg

SEQ ID NO: 472551 - DNA, 20 bp, mouse
gaaagatgtctaatgggacc

SEQ ID NO: 472552 - DNA, 20 bp, mouse
gctcccctctccagtcccaa

SEQ ID NO: 472553 - DNA, 20 bp, mouse
gagggatcggaagtcctgtt

SEQ ID NO: 472554 - DNA, 20 bp, mouse
gcagccccacacttgcgcag

SEQ ID NO: 472555 - DNA, 20 bp, mouse
gctggcttccggcagggggt

SEQ ID NO: 472556 - DNA, 20 bp, mouse
gccacagatgaagcaggtgt

SEQ ID NO: 472557 - DNA, 20 bp, mouse
ggctgtggcaataatgaact

SEQ ID NO: 472558 - DNA, 20 bp, mouse
gtataggtaagaaggcaatc

SEQ ID NO: 472559 - DNA, 20 bp, mouse
gcttactctgctccctagga

SEQ ID NO: 472560 - DNA, 20 bp, mouse
ggagtttctggtaagtggtc

SEQ ID NO: 472561 - DNA, 20 bp, mouse
gcaaacctcatacacattga

SEQ ID NO: 472562 - DNA, 20 bp, mouse
gtgatatggatgttgatttt

SEQ ID NO: 472563 - DNA, 20 bp, mouse
gagagcctggagcactgtaa

SEQ ID NO: 472564 - DNA, 20 bp, mouse
ggcaacctttacagtgctcc

SEQ ID NO: 472565 - DNA, 20 bp, mouse
gatccattacagccatccta

SEQ ID NO: 472566 - DNA, 20 bp, mouse
gagcaggcctgaatgcccca

SEQ ID NO: 472567 - DNA, 20 bp, mouse
gggtttctgcagctgccatg

SEQ ID NO: 472568 - DNA, 20 bp, mouse
ggagctgcagcatcgtcccc

SEQ ID NO: 472569 - DNA, 20 bp, mouse
ggcctgctgggattagtaac

SEQ ID NO: 472570 - DNA, 20 bp, mouse
ggagccaaggccctaaatat

SEQ ID NO: 472571 - DNA, 20 bp, mouse
gcagaaactgggacaaccag

SEQ ID NO: 472572 - DNA, 20 bp, mouse
gagctgcaagagtattccag

SEQ ID NO: 472573 - DNA, 20 bp, mouse
gcagctgccatggggcattc

SEQ ID NO: 472574 - DNA, 20 bp, mouse
gtgcaagagtattccagggg

SEQ ID NO: 472575 - DNA, 20 bp, mouse
gatgagagtagactggatgg

SEQ ID NO: 472576 - DNA, 20 bp, mouse
gtatctgctgaggatgacac

SEQ ID NO: 472577 - DNA, 20 bp, mouse
gctgaatagagtatctgctg

SEQ ID NO: 472578 - DNA, 20 bp, mouse
gcaagtgctctcatggacta

SEQ ID NO: 472579 - DNA, 20 bp, mouse
gcagtgcagaatcccagaaa

SEQ ID NO: 472580 - DNA, 20 bp, mouse
ggagacacaccagagcaatc

SEQ ID NO: 472581 - DNA, 20 bp, mouse
gatctggaagaacacatcta

SEQ ID NO: 472582 - DNA, 20 bp, mouse
gcaattgtagttatctccag

SEQ ID NO: 472583 - DNA, 20 bp, mouse
gaaggcaaaggaaaaaaccc

SEQ ID NO: 472584 - DNA, 20 bp, mouse
gaagtatgagttcaatccaa

SEQ ID NO: 472585 - DNA, 20 bp, mouse
gattgaactcatacttacca

SEQ ID NO: 472586 - DNA, 20 bp, mouse
gggtgcctggccaggctcag

SEQ ID NO: 472587 - DNA, 20 bp, mouse
gccctcaaccggaagtaagg

SEQ ID NO: 472588 - DNA, 20 bp, mouse
gcgcggctagccggtcaaca

SEQ ID NO: 472589 - DNA, 20 bp, mouse
ggctctgcgtcctccttggg

SEQ ID NO: 472590 - DNA, 20 bp, mouse
gcgggctctgcgtcctcctt

SEQ ID NO: 472591 - DNA, 20 bp, mouse
ggaagcgctggccctcacag

SEQ ID NO: 472592 - DNA, 20 bp, mouse
gtagccggtcaacatggctg

SEQ ID NO: 472593 - DNA, 20 bp, mouse
ggcataaggcaggcactcct

SEQ ID NO: 472594 - DNA, 20 bp, mouse
gcctccctcaaccggaagta

SEQ ID NO: 472595 - DNA, 20 bp, mouse
gctgcgtcctccttgggcgg

SEQ ID NO: 472596 - DNA, 20 bp, mouse
gaccgtcatggcagaatccc

SEQ ID NO: 472597 - DNA, 20 bp, mouse
gaagcacctgaacaccgtca

SEQ ID NO: 472598 - DNA, 20 bp, mouse
gactgagtagatatcctaaa

SEQ ID NO: 472599 - DNA, 20 bp, mouse
gaagatggtgatgagagccg

SEQ ID NO: 472600 - DNA, 20 bp, mouse
ggccggggattctgccatga

SEQ ID NO: 472601 - DNA, 20 bp, mouse
gagatatcctaaaaggaaga

SEQ ID NO: 472602 - DNA, 20 bp, mouse
ggcacgtcagccaggaactc

SEQ ID NO: 472603 - DNA, 20 bp, mouse
gtactcagtaccgaatgtgc

SEQ ID NO: 472604 - DNA, 20 bp, mouse
gggagattgtgcaagcgtca

SEQ ID NO: 472605 - DNA, 20 bp, mouse
gttgcacaatctcctaacaa

SEQ ID NO: 472606 - DNA, 20 bp, mouse
gcgctcagaagtacccatgg

SEQ ID NO: 472607 - DNA, 20 bp, mouse
gcaagggcctcgcctggtac

SEQ ID NO: 472608 - DNA, 20 bp, mouse
ggtgagcgcggggaccccca

SEQ ID NO: 472609 - DNA, 20 bp, mouse
ggccgcaccaggaggctccg

SEQ ID NO: 472610 - DNA, 20 bp, mouse
ggaagtaaggccagggtccc

SEQ ID NO: 472611 - DNA, 20 bp, mouse
gtcgtccagaagtaaggcca

SEQ ID NO: 472612 - DNA, 20 bp, mouse
gctgccctcgtccagaagta

SEQ ID NO: 472613 - DNA, 20 bp, mouse
gcgtggccgaggcccagccg

SEQ ID NO: 472614 - DNA, 20 bp, mouse
gcctgcagctgaggcaacgg

SEQ ID NO: 472615 - DNA, 20 bp, mouse
gctaccacaagggcctcgcc

SEQ ID NO: 472616 - DNA, 20 bp, mouse
ggacactaaatgctgggcgt

SEQ ID NO: 472617 - DNA, 20 bp, mouse
gctgaaggcatggagatcca

SEQ ID NO: 472618 - DNA, 20 bp, mouse
gcagcccgcaattgaaatga

SEQ ID NO: 472619 - DNA, 20 bp, mouse
gagttgagacactaaatgct

SEQ ID NO: 472620 - DNA, 20 bp, mouse
gaaggcatggagatccacgg

SEQ ID NO: 472621 - DNA, 20 bp, mouse
gtagctcctcaaacctccgg

SEQ ID NO: 472622 - DNA, 20 bp, mouse
gaagagagcacaaccctccg

SEQ ID NO: 472623 - DNA, 20 bp, mouse
gtcaccaggggcgtgaatag

SEQ ID NO: 472624 - DNA, 20 bp, mouse
gctgcgatgcccctttgggt

SEQ ID NO: 472625 - DNA, 20 bp, mouse
gctcaaacctccggaggact

SEQ ID NO: 472626 - DNA, 20 bp, mouse
gagcccggcagtctgctccg

SEQ ID NO: 472627 - DNA, 20 bp, mouse
gccggctcccgagatgttag

SEQ ID NO: 472628 - DNA, 20 bp, mouse
gtgaggtggcccatccaggt

SEQ ID NO: 472629 - DNA, 20 bp, mouse
ggagatgttagaggcgcgct

SEQ ID NO: 472630 - DNA, 20 bp, mouse
gacctcggcgggcgtgaaag

SEQ ID NO: 472631 - DNA, 20 bp, mouse
ggaagctggtgaggtcgtag

SEQ ID NO: 472632 - DNA, 20 bp, mouse
gtcgtgcggcatcatccggg

SEQ ID NO: 472633 - DNA, 20 bp, mouse
ggagctccgctctcccgcca

SEQ ID NO: 472634 - DNA, 20 bp, mouse
gcacgcccgccgaggtccag

SEQ ID NO: 472635 - DNA, 20 bp, mouse
ggagctcggatctcggagcc

SEQ ID NO: 472636 - DNA, 20 bp, mouse
gaccgccacccgagaggact

SEQ ID NO: 472637 - DNA, 20 bp, mouse
ggcgcgtgccgagtcctctc

SEQ ID NO: 472638 - DNA, 20 bp, mouse
gggtcggctgcaggagatca

SEQ ID NO: 472639 - DNA, 20 bp, mouse
gcagccgaccgccacccgag

SEQ ID NO: 472640 - DNA, 20 bp, mouse
gctgcaggctaggcaaaccc

SEQ ID NO: 472641 - DNA, 20 bp, mouse
gcgtgccgagtcctctcggg

SEQ ID NO: 472642 - DNA, 20 bp, mouse
gcgagccggcctggagacca

SEQ ID NO: 472643 - DNA, 20 bp, mouse
gtccaggccgggttttgcag

SEQ ID NO: 472644 - DNA, 20 bp, mouse
gacctggcgcagaaagagta

SEQ ID NO: 472645 - DNA, 20 bp, mouse
ggaacagacgagctccgcgt

SEQ ID NO: 472646 - DNA, 20 bp, mouse
gttgccggagaagttcatgg

SEQ ID NO: 472647 - DNA, 20 bp, mouse
gtaggcaacagtgggtgacc

SEQ ID NO: 472648 - DNA, 20 bp, mouse
gcaacagtgggtgacctggc

SEQ ID NO: 472649 - DNA, 20 bp, mouse
ggaagttcatggtggcaacg

SEQ ID NO: 472650 - DNA, 20 bp, mouse
ggagctgttgtggtcagctg

SEQ ID NO: 472651 - DNA, 20 bp, mouse
gttgccaccatgaacttctc

SEQ ID NO: 472652 - DNA, 20 bp, mouse
gactggacaaagctactcca

SEQ ID NO: 472653 - DNA, 20 bp, mouse
gactggagaactcctcaatt

SEQ ID NO: 472654 - DNA, 20 bp, mouse
gtccaggtctggtgttgagg

SEQ ID NO: 472655 - DNA, 20 bp, mouse
ggttctcctggctctgcaat

SEQ ID NO: 472656 - DNA, 20 bp, mouse
ggtgcacagttaacttatgg

SEQ ID NO: 472657 - DNA, 20 bp, mouse
gcgggtgcacagttaactta

SEQ ID NO: 472658 - DNA, 20 bp, mouse
ggcacaggtaattcttatgt

SEQ ID NO: 472659 - DNA, 20 bp, mouse
ggacggtacctaggaaaaca

SEQ ID NO: 472660 - DNA, 20 bp, mouse
gcagttataagccaactaaa

SEQ ID NO: 472661 - DNA, 20 bp, mouse
gttatgggggactgctgcac

SEQ ID NO: 472662 - DNA, 20 bp, mouse
gcctaggtaccgtctgaggg

SEQ ID NO: 472663 - DNA, 20 bp, mouse
gttttgaagttactaagctt

SEQ ID NO: 472664 - DNA, 20 bp, mouse
ggctgtttgggaatctacta

SEQ ID NO: 472665 - DNA, 20 bp, mouse
gtgttccctccacatgaagt

SEQ ID NO: 472666 - DNA, 20 bp, mouse
ggagtctgaggaaggaccct

SEQ ID NO: 472667 - DNA, 20 bp, mouse
gtctcctacctgagagtctg

SEQ ID NO: 472668 - DNA, 20 bp, mouse
gcttcctcagactctcaggt

SEQ ID NO: 472669 - DNA, 20 bp, mouse
gaggcagtcccggggctccg

SEQ ID NO: 472670 - DNA, 20 bp, mouse
gtgcttcagaggcagtcccg

SEQ ID NO: 472671 - DNA, 20 bp, mouse
gtggagcttgaagccagtcg

SEQ ID NO: 472672 - DNA, 20 bp, mouse
gtcctctaaccccggagccc

SEQ ID NO: 472673 - DNA, 20 bp, mouse
gaggaggaagaaacgatgag

SEQ ID NO: 472674 - DNA, 20 bp, mouse
ggctggtctagagctagcta

SEQ ID NO: 472675 - DNA, 20 bp, mouse
ggacaaagtaatctgcattt

SEQ ID NO: 472676 - DNA, 20 bp, mouse
gctgagatcatggcattcga

SEQ ID NO: 472677 - DNA, 20 bp, mouse
gaggcaagggaagaaatcat

SEQ ID NO: 472678 - DNA, 20 bp, mouse
gtctctctagtggacaggac

SEQ ID NO: 472679 - DNA, 20 bp, mouse
ggagagcagggcttgcccga

SEQ ID NO: 472680 - DNA, 20 bp, mouse
gcatggcattcgacggcacg

SEQ ID NO: 472681 - DNA, 20 bp, mouse
gaaagcaggaggtgcaagta

SEQ ID NO: 472682 - DNA, 20 bp, mouse
gtaatcccctataatcccgt

SEQ ID NO: 472683 - DNA, 20 bp, mouse
gaaaagttcatggagaaaat

SEQ ID NO: 472684 - DNA, 20 bp, mouse
gagaatatcttgtctccctc

SEQ ID NO: 472685 - DNA, 20 bp, mouse
gatgtgcaattaccaggcaa

SEQ ID NO: 472686 - DNA, 20 bp, mouse
gctcctagccagtccagaca

SEQ ID NO: 472687 - DNA, 20 bp, mouse
ggacagggaatactgaggtg

SEQ ID NO: 472688 - DNA, 20 bp, mouse
gctggctaggagcttgcggg

SEQ ID NO: 472689 - DNA, 20 bp, mouse
gcactcggtgagcgaacgaa

SEQ ID NO: 472690 - DNA, 20 bp, mouse
ggagcttgcgggaggcacat

SEQ ID NO: 472691 - DNA, 20 bp, mouse
gagcagtgtaggtgatccgg

SEQ ID NO: 472692 - DNA, 20 bp, mouse
gacgaacggcgcaggatcta

SEQ ID NO: 472693 - DNA, 20 bp, mouse
ggcgagcctcgtagctggag

SEQ ID NO: 472694 - DNA, 20 bp, mouse
ggatctagggtcaggagggc

SEQ ID NO: 472695 - DNA, 20 bp, mouse
ggctgacgtaggcgacggga

SEQ ID NO: 472696 - DNA, 20 bp, mouse
gccatgtgcagaagtggaat

SEQ ID NO: 472697 - DNA, 20 bp, mouse
ggaccggaaggtcaagtcac

SEQ ID NO: 472698 - DNA, 20 bp, mouse
gtcatcctgactctcactca

SEQ ID NO: 472699 - DNA, 20 bp, mouse
ggtcaagtcactggtgacgc

SEQ ID NO: 472700 - DNA, 20 bp, mouse
gcaccagtgacttgaccttc

SEQ ID NO: 472701 - DNA, 20 bp, mouse
gctgggaatagagttcgacg

SEQ ID NO: 472702 - DNA, 20 bp, mouse
gcaggagacaacactaacta

SEQ ID NO: 472703 - DNA, 20 bp, mouse
gcgaggtgacagcagatgac

SEQ ID NO: 472704 - DNA, 20 bp, mouse
gaggagcgggcggtcagtga

SEQ ID NO: 472705 - DNA, 20 bp, mouse
gcactggtgacgctggacgg

SEQ ID NO: 472706 - DNA, 20 bp, mouse
ggaagacagctcctcctcga

SEQ ID NO: 472707 - DNA, 20 bp, mouse
gagcttccaggttcccacaa

SEQ ID NO: 472708 - DNA, 20 bp, mouse
gtgagctatctggacttcag

SEQ ID NO: 472709 - DNA, 20 bp, mouse
gattttgtaaaccttcgagg

SEQ ID NO: 472710 - DNA, 20 bp, mouse
ggtgagaaaggctgcagcac

SEQ ID NO: 472711 - DNA, 20 bp, mouse
gggacaggatggagctgtgg

SEQ ID NO: 472712 - DNA, 20 bp, mouse
ggcagcccggggggacagga

SEQ ID NO: 472713 - DNA, 20 bp, mouse
gagctccatcctgtcccccc

SEQ ID NO: 472714 - DNA, 20 bp, mouse
gctacatacaccctccatgc

SEQ ID NO: 472715 - DNA, 20 bp, mouse
gatgctgcttcccgcatgga

SEQ ID NO: 472716 - DNA, 20 bp, mouse
gccttaagactggccatggt

SEQ ID NO: 472717 - DNA, 20 bp, mouse
gcggtggcacaggtgaggat

SEQ ID NO: 472718 - DNA, 20 bp, mouse
ggcgcagatggcgccaggag

SEQ ID NO: 472719 - DNA, 20 bp, mouse
ggcggagccggcgacaaagg

SEQ ID NO: 472720 - DNA, 20 bp, mouse
gacattaagaggcaactgag

SEQ ID NO: 472721 - DNA, 20 bp, mouse
gccccgatcgcatggtggaa

SEQ ID NO: 472722 - DNA, 20 bp, mouse
ggctggcacgcacctgtgaa

SEQ ID NO: 472723 - DNA, 20 bp, mouse
gggagcaccttgcggcagtt

SEQ ID NO: 472724 - DNA, 20 bp, mouse
gcaccttgcggcagttagga

SEQ ID NO: 472725 - DNA, 20 bp, mouse
gagctcccccgatcgcatgg

SEQ ID NO: 472726 - DNA, 20 bp, mouse
gtatttgccactgaaggcca

SEQ ID NO: 472727 - DNA, 20 bp, mouse
gcagctctcttccagcacca

SEQ ID NO: 472728 - DNA, 20 bp, mouse
gcaaactcttggggtagagt

SEQ ID NO: 472729 - DNA, 20 bp, mouse
gttatagctagctctgggat

SEQ ID NO: 472730 - DNA, 20 bp, mouse
gggataggaacccaaactct

SEQ ID NO: 472731 - DNA, 20 bp, mouse
gcaaagaagctcactcaccc

SEQ ID NO: 472732 - DNA, 20 bp, mouse
gagtatctctaattcatgta

SEQ ID NO: 472733 - DNA, 20 bp, mouse
gaaggccacatagtagtgac

SEQ ID NO: 472734 - DNA, 20 bp, mouse
gatgagttcatgaagcgcct

SEQ ID NO: 472735 - DNA, 20 bp, mouse
gatagtagtgactggtgaag

SEQ ID NO: 472736 - DNA, 20 bp, mouse
gcgcctagtcagctgaaaat

SEQ ID NO: 472737 - DNA, 20 bp, mouse
ggctgaaaataggcaggaac

SEQ ID NO: 472738 - DNA, 20 bp, mouse
gctgactaggcggttaagga

SEQ ID NO: 472739 - DNA, 20 bp, mouse
gtagtcagctgaaaataggc

SEQ ID NO: 472740 - DNA, 20 bp, mouse
gacctggtaagtaaaatcgg

SEQ ID NO: 472741 - DNA, 20 bp, mouse
ggcttctgctgaggtgcaaa

SEQ ID NO: 472742 - DNA, 20 bp, mouse
ggcttcttctctaaataaga

SEQ ID NO: 472743 - DNA, 20 bp, mouse
gaaggcagcagcttctgctg

SEQ ID NO: 472744 - DNA, 20 bp, mouse
ggtacatgaaagctctgggt

SEQ ID NO: 472745 - DNA, 20 bp, mouse
ggggtttttgtgaattacgg

SEQ ID NO: 472746 - DNA, 20 bp, mouse
gcgatgattgagcccttctt

SEQ ID NO: 472747 - DNA, 20 bp, mouse
gacagctttctgggcagacc

SEQ ID NO: 472748 - DNA, 20 bp, mouse
gaccgaaaaccatgaagtgt

SEQ ID NO: 472749 - DNA, 20 bp, mouse
gtcatcgtgcacagctttct

SEQ ID NO: 472750 - DNA, 20 bp, mouse
gctcagatgagtataaccca

SEQ ID NO: 472751 - DNA, 20 bp, mouse
gagtttccaggtgcctaaga

SEQ ID NO: 472752 - DNA, 20 bp, mouse
gagaattacgtgagagaact

SEQ ID NO: 472753 - DNA, 20 bp, mouse
gcagtatgacgaccttccag

SEQ ID NO: 472754 - DNA, 20 bp, mouse
gctcagtgaaatgatctaag

SEQ ID NO: 472755 - DNA, 20 bp, mouse
ggggtgagagacaccattac

SEQ ID NO: 472756 - DNA, 20 bp, mouse
gcctatgtgggatcgctgag

SEQ ID NO: 472757 - DNA, 20 bp, mouse
gagcaccaggaatgggtcca

SEQ ID NO: 472758 - DNA, 20 bp, mouse
gaggaatgggtccatggcag

SEQ ID NO: 472759 - DNA, 20 bp, mouse
ggtgcagcagcaccaggaat

SEQ ID NO: 472760 - DNA, 20 bp, mouse
gcccagtcggagccagtgga

SEQ ID NO: 472761 - DNA, 20 bp, mouse
gggatcgctgaggggcagcc

SEQ ID NO: 472762 - DNA, 20 bp, mouse
ggcgctgcagtagatcgtgt

SEQ ID NO: 472763 - DNA, 20 bp, mouse
ggcccggcgtaccactgcca

SEQ ID NO: 472764 - DNA, 20 bp, mouse
gcgctgtccggcagcctgtc

SEQ ID NO: 472765 - DNA, 20 bp, mouse
gctgctggagcagaacgacc

SEQ ID NO: 472766 - DNA, 20 bp, mouse
ggccatagcaagcttggcgg

SEQ ID NO: 472767 - DNA, 20 bp, mouse
gacgccaggctcgcgaacta

SEQ ID NO: 472768 - DNA, 20 bp, mouse
gcgcgaactaggggagcgtc

SEQ ID NO: 472769 - DNA, 20 bp, mouse
ggtgcgcgctccgggccgcg

SEQ ID NO: 472770 - DNA, 20 bp, mouse
gtacgcgggtcaggatgcca

SEQ ID NO: 472771 - DNA, 20 bp, mouse
gcgggcgggagaaggagcga

SEQ ID NO: 472772 - DNA, 20 bp, mouse
gccgcggggcagcgcacgcc

SEQ ID NO: 472773 - DNA, 20 bp, mouse
gagaccggagcggtagacgg

SEQ ID NO: 472774 - DNA, 20 bp, mouse
gtcgggagccatagcaagct

SEQ ID NO: 472775 - DNA, 20 bp, mouse
gtctgagaggtgcgcgctcc

SEQ ID NO: 472776 - DNA, 20 bp, mouse
gcggccaggagagggaccgt

SEQ ID NO: 472777 - DNA, 20 bp, mouse
gcagcaggcgggcctagggt

SEQ ID NO: 472778 - DNA, 20 bp, mouse
gccgcggctcgcaacaccga

SEQ ID NO: 472779 - DNA, 20 bp, mouse
gcgtagcgcacggggcatcc

SEQ ID NO: 472780 - DNA, 20 bp, mouse
gacaccgacggtccctctcc

SEQ ID NO: 472781 - DNA, 20 bp, mouse
gcccgtgcgctacggcctcc

SEQ ID NO: 472782 - DNA, 20 bp, mouse
ggggcgccgaccgcacactg

SEQ ID NO: 472783 - DNA, 20 bp, mouse
gcctagggtgggcggaggaa

SEQ ID NO: 472784 - DNA, 20 bp, mouse
gtacggcctccgggcgcccg

SEQ ID NO: 472785 - DNA, 20 bp, mouse
gcccatgctgccagtctacc

SEQ ID NO: 472786 - DNA, 20 bp, mouse
gcaggcgcacgctcttacgg

SEQ ID NO: 472787 - DNA, 20 bp, mouse
gggaggcgaggtggcaatca

SEQ ID NO: 472788 - DNA, 20 bp, mouse
gtcccagcggaagatgggta

SEQ ID NO: 472789 - DNA, 20 bp, mouse
gtacggcggccgcagcggca

SEQ ID NO: 472790 - DNA, 20 bp, mouse
gagagacactgagggaggcg

SEQ ID NO: 472791 - DNA, 20 bp, mouse
ggggcaggcgcacgctctta

SEQ ID NO: 472792 - DNA, 20 bp, mouse
gtctgctcccagcggaagat

SEQ ID NO: 472793 - DNA, 20 bp, mouse
gcacggtgcggaggacgcca

SEQ ID NO: 472794 - DNA, 20 bp, mouse
gtgggtaggggcgcccccag

SEQ ID NO: 472795 - DNA, 20 bp, mouse
gtgtgtacagcggcaatggg

SEQ ID NO: 472796 - DNA, 20 bp, mouse
ggagctggggacaagcgagg

SEQ ID NO: 472797 - DNA, 20 bp, mouse
gcccggaggcgcactacgaa

SEQ ID NO: 472798 - DNA, 20 bp, mouse
gggtgagtccagggaaccca

SEQ ID NO: 472799 - DNA, 20 bp, mouse
gccccagctcggtgagtcca

SEQ ID NO: 472800 - DNA, 20 bp, mouse
ggagctcacacccgaatccc

SEQ ID NO: 472801 - DNA, 20 bp, mouse
ggcgaggaggacccgggatt

SEQ ID NO: 472802 - DNA, 20 bp, mouse
gcactacgaacggtctccat

SEQ ID NO: 472803 - DNA, 20 bp, mouse
ggggacaagcgaggaggacc

SEQ ID NO: 472804 - DNA, 20 bp, mouse
gcagcagcgccgtcccccgg

SEQ ID NO: 472805 - DNA, 20 bp, mouse
gtccctggactcaccgagct

SEQ ID NO: 472806 - DNA, 20 bp, mouse
gcgccgcctgggaggaggac

SEQ ID NO: 472807 - DNA, 20 bp, mouse
ggccacggcaaacccgacgg

SEQ ID NO: 472808 - DNA, 20 bp, mouse
gcaggcggcgacggaaggac

SEQ ID NO: 472809 - DNA, 20 bp, mouse
gccttccgtcgccgcctggg

SEQ ID NO: 472810 - DNA, 20 bp, mouse
gccagccacggcaaacccga

SEQ ID NO: 472811 - DNA, 20 bp, mouse
gggaggctggtctcgatgcc

SEQ ID NO: 472812 - DNA, 20 bp, mouse
ggcccccgtcgggtttgccg

SEQ ID NO: 472813 - DNA, 20 bp, mouse
gctcgccgcagctgccggga

SEQ ID NO: 472814 - DNA, 20 bp, mouse
gcgctttccccgcccccgtc

SEQ ID NO: 472815 - DNA, 20 bp, mouse
ggcccacactacaaccactg

SEQ ID NO: 472816 - DNA, 20 bp, mouse
gcgggtcaggagcgtagagg

SEQ ID NO: 472817 - DNA, 20 bp, mouse
gggacgggtcaggagcgtag

SEQ ID NO: 472818 - DNA, 20 bp, mouse
gagaggcggcggcaaaatgg

SEQ ID NO: 472819 - DNA, 20 bp, mouse
ggtcaggagcgtagaggcgg

SEQ ID NO: 472820 - DNA, 20 bp, mouse
ggaaggctgaggacccacag

SEQ ID NO: 472821 - DNA, 20 bp, mouse
gcgtagaggcggcggcaaaa

SEQ ID NO: 472822 - DNA, 20 bp, mouse
gctgaggacccacagaggtt

SEQ ID NO: 472823 - DNA, 20 bp, mouse
gacccgccggaagtgatctc

SEQ ID NO: 472824 - DNA, 20 bp, mouse
gggtcgagcccggctagcag

SEQ ID NO: 472825 - DNA, 20 bp, mouse
gcgagcccggctagcagagg

SEQ ID NO: 472826 - DNA, 20 bp, mouse
gcgggcagcagagcccacgg

SEQ ID NO: 472827 - DNA, 20 bp, mouse
gagcagagcccacggcgggt

SEQ ID NO: 472828 - DNA, 20 bp, mouse
gggacatgctgacgagcacc

SEQ ID NO: 472829 - DNA, 20 bp, mouse
gagagcccacggcgggtagg

SEQ ID NO: 472830 - DNA, 20 bp, mouse
gccaaccccctacccgccgt

SEQ ID NO: 472831 - DNA, 20 bp, mouse
gtaggccaggaagtgctcag

SEQ ID NO: 472832 - DNA, 20 bp, mouse
ggggcggtccctgaatctaa

SEQ ID NO: 472833 - DNA, 20 bp, mouse
gcatagggcaggttttggat

SEQ ID NO: 472834 - DNA, 20 bp, mouse
gagcatgtcctttattccag

SEQ ID NO: 472835 - DNA, 20 bp, mouse
gatgggaaagtcggagtcct

SEQ ID NO: 472836 - DNA, 20 bp, mouse
gctgccccagagagacgagg

SEQ ID NO: 472837 - DNA, 20 bp, mouse
gcgactgccccagagagacg

SEQ ID NO: 472838 - DNA, 20 bp, mouse
gtgcaagtgggtgttggagg

SEQ ID NO: 472839 - DNA, 20 bp, mouse
gctacaggccaaggctgcta

SEQ ID NO: 472840 - DNA, 20 bp, mouse
gagaccgagtctacaggcca

SEQ ID NO: 472841 - DNA, 20 bp, mouse
ggtagactcggtctgcaagt

SEQ ID NO: 472842 - DNA, 20 bp, mouse
gtcggtctgcaagtgggtgt

SEQ ID NO: 472843 - DNA, 20 bp, mouse
gcagccttggcctgtagact

SEQ ID NO: 472844 - DNA, 20 bp, mouse
gcgtagtccgggggagtcgg

SEQ ID NO: 472845 - DNA, 20 bp, mouse
gagtaagcgggcattaacac

SEQ ID NO: 472846 - DNA, 20 bp, mouse
gcggagccgcaggacaagag

SEQ ID NO: 472847 - DNA, 20 bp, mouse
ggggcggtccctatattcct

SEQ ID NO: 472848 - DNA, 20 bp, mouse
gtaagtgcttgcagcggtac

SEQ ID NO: 472849 - DNA, 20 bp, mouse
gaagagttaagtgcttgcag

SEQ ID NO: 472850 - DNA, 20 bp, mouse
gtatcgcgactgcgaagggg

SEQ ID NO: 472851 - DNA, 20 bp, mouse
gctcttctccaaggaatata

SEQ ID NO: 472852 - DNA, 20 bp, mouse
gggtcatggccgtggaggta

SEQ ID NO: 472853 - DNA, 20 bp, mouse
gtgaggctaggccaactcag

SEQ ID NO: 472854 - DNA, 20 bp, mouse
gccatatcgcgactgcgaag

SEQ ID NO: 472855 - DNA, 20 bp, mouse
gcggcttcctgcgctgtcag

SEQ ID NO: 472856 - DNA, 20 bp, mouse
gcggaaggcagtaggaggct

SEQ ID NO: 472857 - DNA, 20 bp, mouse
gacgtagtcagcagctctcg

SEQ ID NO: 472858 - DNA, 20 bp, mouse
gtctcgcggccgcgcccacc

SEQ ID NO: 472859 - DNA, 20 bp, mouse
gaacccctggaggtacgtgt

SEQ ID NO: 472860 - DNA, 20 bp, mouse
gcctgggacgcagtcaggag

SEQ ID NO: 472861 - DNA, 20 bp, mouse
gaggctgggcgcccggcatg

SEQ ID NO: 472862 - DNA, 20 bp, mouse
ggggtctcgttgagcccgga

SEQ ID NO: 472863 - DNA, 20 bp, mouse
ggagctgctgactacgtcgt

SEQ ID NO: 472864 - DNA, 20 bp, mouse
gaagaggccccggaaagaag

SEQ ID NO: 472865 - DNA, 20 bp, mouse
ggcaggcgcagtagggcagt

SEQ ID NO: 472866 - DNA, 20 bp, mouse
ggatgttgctagaatccacg

SEQ ID NO: 472867 - DNA, 20 bp, mouse
gaagcctggccgggttgcag

SEQ ID NO: 472868 - DNA, 20 bp, mouse
ggttgctagaatccacgcgg

SEQ ID NO: 472869 - DNA, 20 bp, mouse
gcggaggaaagaagagacgc

SEQ ID NO: 472870 - DNA, 20 bp, mouse
gcaggctgcggtgacccaag

SEQ ID NO: 472871 - DNA, 20 bp, mouse
gcagggtggcagggaagtag

SEQ ID NO: 472872 - DNA, 20 bp, mouse
ggaaggggtccctgaagcgg

SEQ ID NO: 472873 - DNA, 20 bp, mouse
ggaggaaggggtccctgaag

SEQ ID NO: 472874 - DNA, 20 bp, mouse
gcatccactgcaacccggcc

SEQ ID NO: 472875 - DNA, 20 bp, mouse
gcgctccggtaagcctggcc

SEQ ID NO: 472876 - DNA, 20 bp, mouse
gctgggagccttctacaact

SEQ ID NO: 472877 - DNA, 20 bp, mouse
gtgacacacaccgatcacct

SEQ ID NO: 472878 - DNA, 20 bp, mouse
gaaagtccatggttccctgg

SEQ ID NO: 472879 - DNA, 20 bp, mouse
gcatggttccctggaggccc

SEQ ID NO: 472880 - DNA, 20 bp, mouse
gggggcacagagaacaaggg

SEQ ID NO: 472881 - DNA, 20 bp, mouse
gaaccaaagccaaaagtcca

SEQ ID NO: 472882 - DNA, 20 bp, mouse
gagagttgcagttgcagccg

SEQ ID NO: 472883 - DNA, 20 bp, mouse
ggaaatctaacagctgtcta

SEQ ID NO: 472884 - DNA, 20 bp, mouse
gtcaagcacccagttgtaga

SEQ ID NO: 472885 - DNA, 20 bp, mouse
gtatgctggacctctttgag

SEQ ID NO: 472886 - DNA, 20 bp, mouse
gcccgccaccactgagccag

SEQ ID NO: 472887 - DNA, 20 bp, mouse
gtgttgctcctctggctcag

SEQ ID NO: 472888 - DNA, 20 bp, mouse
gctggcgacagggcgtagaa

SEQ ID NO: 472889 - DNA, 20 bp, mouse
gcgacagggcgtagaagggc

SEQ ID NO: 472890 - DNA, 20 bp, mouse
gacaaggaggctccggcctg

SEQ ID NO: 472891 - DNA, 20 bp, mouse
gtccagggtgcctggcgaca

SEQ ID NO: 472892 - DNA, 20 bp, mouse
gatcaggagcgggtctcagc

SEQ ID NO: 472893 - DNA, 20 bp, mouse
gccgactcaccaggacctgt

SEQ ID NO: 472894 - DNA, 20 bp, mouse
ggtggtggtccgggtgtcca

SEQ ID NO: 472895 - DNA, 20 bp, mouse
gtcctctggctcagtggtgg

SEQ ID NO: 472896 - DNA, 20 bp, mouse
ggcaaggagggcagcccgga

SEQ ID NO: 472897 - DNA, 20 bp, mouse
ggccggcggcggggcaagga

SEQ ID NO: 472898 - DNA, 20 bp, mouse
gggtgttggagtgcaagaga

SEQ ID NO: 472899 - DNA, 20 bp, mouse
gcgacacccggacaacgcgc

SEQ ID NO: 472900 - DNA, 20 bp, mouse
gaagagagggccgcacacgc

SEQ ID NO: 472901 - DNA, 20 bp, mouse
gcacccggacaacgcgccgg

SEQ ID NO: 472902 - DNA, 20 bp, mouse
gggacaacgcgccggcggcg

SEQ ID NO: 472903 - DNA, 20 bp, mouse
gtgcgagcccccagtggctg

SEQ ID NO: 472904 - DNA, 20 bp, mouse
gccgagaggccaagcgccag

SEQ ID NO: 472905 - DNA, 20 bp, mouse
gctgcacgtgtggcgggacc

SEQ ID NO: 472906 - DNA, 20 bp, mouse
gtagcaccgctggagcacag

SEQ ID NO: 472907 - DNA, 20 bp, mouse
gggcggaccggtgagactga

SEQ ID NO: 472908 - DNA, 20 bp, mouse
ggcgccgtcgcccgcacctc

SEQ ID NO: 472909 - DNA, 20 bp, mouse
gcggctgcgtccggaggtgc

SEQ ID NO: 472910 - DNA, 20 bp, mouse
ggctccagcggtgctaaccg

SEQ ID NO: 472911 - DNA, 20 bp, mouse
ggaaccgctggagacccggg

SEQ ID NO: 472912 - DNA, 20 bp, mouse
gcaggtgaggccccgggaag

SEQ ID NO: 472913 - DNA, 20 bp, mouse
gggcgaaccgctggagaccc

SEQ ID NO: 472914 - DNA, 20 bp, mouse
ggtcgcctgggcacctccca

SEQ ID NO: 472915 - DNA, 20 bp, mouse
gctgcagggaccgcttcggg

SEQ ID NO: 472916 - DNA, 20 bp, mouse
gctgctcgcgatcagacggg

SEQ ID NO: 472917 - DNA, 20 bp, mouse
gcggcggcggcggtacggaa

SEQ ID NO: 472918 - DNA, 20 bp, mouse
ggaaagggcgcccactcccc

SEQ ID NO: 472919 - DNA, 20 bp, mouse
gtgcagctcgcccggggagt

SEQ ID NO: 472920 - DNA, 20 bp, mouse
gtctctgctcgcgatcagac

SEQ ID NO: 472921 - DNA, 20 bp, mouse
ggcagcgaccgttctcctag

SEQ ID NO: 472922 - DNA, 20 bp, mouse
gcccggccgcccgcgaggag

SEQ ID NO: 472923 - DNA, 20 bp, mouse
gagaggcgccgctaggagaa

SEQ ID NO: 472924 - DNA, 20 bp, mouse
gctcgcgatcagacgggcgg

SEQ ID NO: 472925 - DNA, 20 bp, mouse
gagcccgggcctgagagcac

SEQ ID NO: 472926 - DNA, 20 bp, mouse
gttaccttggagagccgggt

SEQ ID NO: 472927 - DNA, 20 bp, mouse
gtccgcagctcggctcctga

SEQ ID NO: 472928 - DNA, 20 bp, mouse
gtgcggtactcacccttcat

SEQ ID NO: 472929 - DNA, 20 bp, mouse
gcggagaaagaggctccgag

SEQ ID NO: 472930 - DNA, 20 bp, mouse
gctccagtgcgtcccatgaa

SEQ ID NO: 472931 - DNA, 20 bp, mouse
ggacgacggccgggacaaag

SEQ ID NO: 472932 - DNA, 20 bp, mouse
gcacccttcatgggacgcac

SEQ ID NO: 472933 - DNA, 20 bp, mouse
gagagcagccgagccagggt

SEQ ID NO: 472934 - DNA, 20 bp, mouse
gcgctccggaagcggaagtc

SEQ ID NO: 472935 - DNA, 20 bp, mouse
gtcctgacggcagttctgga

SEQ ID NO: 472936 - DNA, 20 bp, mouse
gggaggcgcggaggcgacac

SEQ ID NO: 472937 - DNA, 20 bp, mouse
ggcggaggcgacaccggaag

SEQ ID NO: 472938 - DNA, 20 bp, mouse
gcggcgcctgcgacatgggg

SEQ ID NO: 472939 - DNA, 20 bp, mouse
gggcgacgctctggaatcca

SEQ ID NO: 472940 - DNA, 20 bp, mouse
gaacagtcggagctgtgtcc

SEQ ID NO: 472941 - DNA, 20 bp, mouse
ggtcagagctcagacccgtg

SEQ ID NO: 472942 - DNA, 20 bp, mouse
gcgggcgctgagtccccctc

SEQ ID NO: 472943 - DNA, 20 bp, mouse
gagctcagacccgtgcgggt

SEQ ID NO: 472944 - DNA, 20 bp, mouse
gtaccacggcgcctgcgaca

SEQ ID NO: 472945 - DNA, 20 bp, mouse
gggaagaggcgggtcccaga

SEQ ID NO: 472946 - DNA, 20 bp, mouse
gggcgccgggctgtagcgga

SEQ ID NO: 472947 - DNA, 20 bp, mouse
gggctgcggagaagcgagcg

SEQ ID NO: 472948 - DNA, 20 bp, mouse
ggagctcgggactgcggctg

SEQ ID NO: 472949 - DNA, 20 bp, mouse
gctcccggagggtgtagtgg

SEQ ID NO: 472950 - DNA, 20 bp, mouse
gcgcaccctccgctacagcc

SEQ ID NO: 472951 - DNA, 20 bp, mouse
gtgtagtggcggcggagggt

SEQ ID NO: 472952 - DNA, 20 bp, mouse
gttcagggcgggagcacgga

SEQ ID NO: 472953 - DNA, 20 bp, mouse
gagtctcccggagggtgtag

SEQ ID NO: 472954 - DNA, 20 bp, mouse
gtgtagcggagggtgcgcgc

SEQ ID NO: 472955 - DNA, 20 bp, mouse
gaggcgcgcatcccgcatgg

SEQ ID NO: 472956 - DNA, 20 bp, mouse
ggcgcagccacggctccgga

SEQ ID NO: 472957 - DNA, 20 bp, mouse
gacggctccggacggcggga

SEQ ID NO: 472958 - DNA, 20 bp, mouse
gggcagcgcagccacggctc

SEQ ID NO: 472959 - DNA, 20 bp, mouse
gcagccacggctccggacgg

SEQ ID NO: 472960 - DNA, 20 bp, mouse
ggtgcggggcagcgcagcca

SEQ ID NO: 472961 - DNA, 20 bp, mouse
gtccggacggcgggacggca

SEQ ID NO: 472962 - DNA, 20 bp, mouse
gcgtggccgcggatgagtcg

SEQ ID NO: 472963 - DNA, 20 bp, mouse
gtggttccccgactcatccg

SEQ ID NO: 472964 - DNA, 20 bp, mouse
gagcgctctgcggacctcgc

SEQ ID NO: 472965 - DNA, 20 bp, mouse
ggggacggcagggcccggcg

SEQ ID NO: 472966 - DNA, 20 bp, mouse
gagcagcccgggcactgcag

SEQ ID NO: 472967 - DNA, 20 bp, mouse
ggcagaggaactagcagccc

SEQ ID NO: 472968 - DNA, 20 bp, mouse
ggagctcctctgcagtgccc

SEQ ID NO: 472969 - DNA, 20 bp, mouse
gtctgcaggtctcagactta

SEQ ID NO: 472970 - DNA, 20 bp, mouse
gacctcacctcagggaggca

SEQ ID NO: 472971 - DNA, 20 bp, mouse
gagcaggtcctagatggctg

SEQ ID NO: 472972 - DNA, 20 bp, mouse
ggagaagtaagactcgaatc

SEQ ID NO: 472973 - DNA, 20 bp, mouse
gtgaggcagccgcccccaaa

SEQ ID NO: 472974 - DNA, 20 bp, mouse
gtcgagtcttacttctctac

SEQ ID NO: 472975 - DNA, 20 bp, mouse
gcttacttctctacaggtcc

SEQ ID NO: 472976 - DNA, 20 bp, mouse
ggagagggcggttccgacgg

SEQ ID NO: 472977 - DNA, 20 bp, mouse
gggcgagagggcggttccga

SEQ ID NO: 472978 - DNA, 20 bp, mouse
gccggagtaagaagcccgtc

SEQ ID NO: 472979 - DNA, 20 bp, mouse
gagagccgccccgagccgga

SEQ ID NO: 472980 - DNA, 20 bp, mouse
gaagcccgtccggctcgggg

SEQ ID NO: 472981 - DNA, 20 bp, mouse
gggcaccttagccaccgagg

SEQ ID NO: 472982 - DNA, 20 bp, mouse
ggcccgccgggagaaagcga

SEQ ID NO: 472983 - DNA, 20 bp, mouse
gtaagaagcccgtccggctc

SEQ ID NO: 472984 - DNA, 20 bp, mouse
gcgccctctcgccacctcgg

SEQ ID NO: 472985 - DNA, 20 bp, mouse
ggccaacgacagggtccccc

SEQ ID NO: 472986 - DNA, 20 bp, mouse
gatggcccggaacagctcgg

SEQ ID NO: 472987 - DNA, 20 bp, mouse
gtctcccggaggccgagtgg

SEQ ID NO: 472988 - DNA, 20 bp, mouse
gtaggactcgagggaaacgg

SEQ ID NO: 472989 - DNA, 20 bp, mouse
gcccggccggcgcaccacgg

SEQ ID NO: 472990 - DNA, 20 bp, mouse
gtcggcctccgggagacaaa

SEQ ID NO: 472991 - DNA, 20 bp, mouse
gccccgcggctaggactcga

SEQ ID NO: 472992 - DNA, 20 bp, mouse
gcccatggcccggaacagct

SEQ ID NO: 472993 - DNA, 20 bp, mouse
gaggcagggcatcaccaccg

SEQ ID NO: 472994 - DNA, 20 bp, mouse
gtcgggggccggcgacgaca

SEQ ID NO: 472995 - DNA, 20 bp, mouse
gagggccctttgtctcccgg

SEQ ID NO: 472996 - DNA, 20 bp, mouse
gcagagcgagaaagcccagg

SEQ ID NO: 472997 - DNA, 20 bp, mouse
gctttgtgggccccaaggag

SEQ ID NO: 472998 - DNA, 20 bp, mouse
gcctgaccggctctcacctc

SEQ ID NO: 472999 - DNA, 20 bp, mouse
gctgccggagggagagaccg

SEQ ID NO: 473000 - DNA, 20 bp, mouse
ggcgacagcatcgcactcga

SEQ ID NO: 473001 - DNA, 20 bp, mouse
gctcgacgggccaggccctc

SEQ ID NO: 473002 - DNA, 20 bp, mouse
gtctcacctccggcgcccga

SEQ ID NO: 473003 - DNA, 20 bp, mouse
gccaggccctcgggcgccgg

SEQ ID NO: 473004 - DNA, 20 bp, mouse
gctcccggagcccgcctgac

SEQ ID NO: 473005 - DNA, 20 bp, mouse
ggttcagagcgagaaagccc

SEQ ID NO: 473006 - DNA, 20 bp, mouse
gttctcccggagggaatcgt

SEQ ID NO: 473007 - DNA, 20 bp, mouse
gggctactacgtgtgaagac

SEQ ID NO: 473008 - DNA, 20 bp, mouse
gccggcgagctcttccgagt

SEQ ID NO: 473009 - DNA, 20 bp, mouse
gacagccagggcgtcccact

SEQ ID NO: 473010 - DNA, 20 bp, mouse
gtaggaggcggagggtcccg

SEQ ID NO: 473011 - DNA, 20 bp, mouse
gtcttccgagtgggacgccc

SEQ ID NO: 473012 - DNA, 20 bp, mouse
gggtccctgcagacctgaga

SEQ ID NO: 473013 - DNA, 20 bp, mouse
gccagggacgttctcccgga

SEQ ID NO: 473014 - DNA, 20 bp, mouse
gggaactccaagggccggta

SEQ ID NO: 473015 - DNA, 20 bp, mouse
gggcaagagtctcagtacag

SEQ ID NO: 473016 - DNA, 20 bp, mouse
gtgagcccgccccttcggtg

SEQ ID NO: 473017 - DNA, 20 bp, mouse
gcggatcgggcggcaacgga

SEQ ID NO: 473018 - DNA, 20 bp, mouse
gaggctccgcaggagagcga

SEQ ID NO: 473019 - DNA, 20 bp, mouse
ggtgcggccaaggtaaacgg

SEQ ID NO: 473020 - DNA, 20 bp, mouse
ggccggagcgggaccctgag

SEQ ID NO: 473021 - DNA, 20 bp, mouse
gtcctccgcaccgaaggggc

SEQ ID NO: 473022 - DNA, 20 bp, mouse
gttgctcctccgcaccgaag

SEQ ID NO: 473023 - DNA, 20 bp, mouse
gagccgaaccggcccggatc

SEQ ID NO: 473024 - DNA, 20 bp, mouse
gctccgcaggagagcgaggg

SEQ ID NO: 473025 - DNA, 20 bp, mouse
gcgaaccggcccggatcggg

SEQ ID NO: 473026 - DNA, 20 bp, mouse
gtagcaagcgagtccagggt

SEQ ID NO: 473027 - DNA, 20 bp, mouse
gagcgagtccagggtcggca

SEQ ID NO: 473028 - DNA, 20 bp, mouse
gtactggacaccagcctggt

SEQ ID NO: 473029 - DNA, 20 bp, mouse
gtctctactggacaccagcc

SEQ ID NO: 473030 - DNA, 20 bp, mouse
gctgccctggggtccccgag

SEQ ID NO: 473031 - DNA, 20 bp, mouse
gccacctctcggggacccca

SEQ ID NO: 473032 - DNA, 20 bp, mouse
gattctagcaagcgagtcca

SEQ ID NO: 473033 - DNA, 20 bp, mouse
gatgcgcgccctgccgaccc

SEQ ID NO: 473034 - DNA, 20 bp, mouse
ggcagggcgcgcattcttgc

SEQ ID NO: 473035 - DNA, 20 bp, mouse
gaagagcgctgtggagagac

SEQ ID NO: 473036 - DNA, 20 bp, mouse
ggagcgaagctgccatagag

SEQ ID NO: 473037 - DNA, 20 bp, mouse
gaaaagacccgggattccag

SEQ ID NO: 473038 - DNA, 20 bp, mouse
gactggatctttccactcta

SEQ ID NO: 473039 - DNA, 20 bp, mouse
ggcttgcctagcaggtggag

SEQ ID NO: 473040 - DNA, 20 bp, mouse
ggctccagccgctggaatcc

SEQ ID NO: 473041 - DNA, 20 bp, mouse
ggacccgggattccagcggc

SEQ ID NO: 473042 - DNA, 20 bp, mouse
gtggtcctagctgtgagcca

SEQ ID NO: 473043 - DNA, 20 bp, mouse
gaagctatccatattcgaat

SEQ ID NO: 473044 - DNA, 20 bp, mouse
gagcttccactccacctgct

SEQ ID NO: 473045 - DNA, 20 bp, mouse
ggtaaccacctattcgaata

SEQ ID NO: 473046 - DNA, 20 bp, mouse
ggccaagcggtaagagcccg

SEQ ID NO: 473047 - DNA, 20 bp, mouse
gcccgcccgggaaggggatg

SEQ ID NO: 473048 - DNA, 20 bp, mouse
ggatggggagagggcgcccc

SEQ ID NO: 473049 - DNA, 20 bp, mouse
ggagtgcgcgcgggagtccc

SEQ ID NO: 473050 - DNA, 20 bp, mouse
ggtcccctcccgcccgggaa

SEQ ID NO: 473051 - DNA, 20 bp, mouse
ggcgcactcggccggccaag

SEQ ID NO: 473052 - DNA, 20 bp, mouse
gacgtggcggggcgggaccc

SEQ ID NO: 473053 - DNA, 20 bp, mouse
ggcggccgagggccctgcgt

SEQ ID NO: 473054 - DNA, 20 bp, mouse
gggagctccaggccggacga

SEQ ID NO: 473055 - DNA, 20 bp, mouse
ggccccgggctcttaccgct

SEQ ID NO: 473056 - DNA, 20 bp, mouse
gcgcgacggtcgggtcggat

SEQ ID NO: 473057 - DNA, 20 bp, mouse
gacttccgcgacggtcgggt

SEQ ID NO: 473058 - DNA, 20 bp, mouse
ggtcaggagtacttccgcga

SEQ ID NO: 473059 - DNA, 20 bp, mouse
gcggtggccgcggtgagggg

SEQ ID NO: 473060 - DNA, 20 bp, mouse
ggagtacttccgcgacggtc

SEQ ID NO: 473061 - DNA, 20 bp, mouse
gggtcggatcggcgagcgag

SEQ ID NO: 473062 - DNA, 20 bp, mouse
gatcggcgagcgagcggcgg

SEQ ID NO: 473063 - DNA, 20 bp, mouse
gccgcctccgcgctgaggtc

SEQ ID NO: 473064 - DNA, 20 bp, mouse
gccgacaccgcccctcaccg

SEQ ID NO: 473065 - DNA, 20 bp, mouse
gacccggaagtactcctcga

SEQ ID NO: 473066 - DNA, 20 bp, mouse
gaaaggaggaagctacccaa

SEQ ID NO: 473067 - DNA, 20 bp, mouse
gggaataggcggtggaccag

SEQ ID NO: 473068 - DNA, 20 bp, mouse
gcctgcaagggaataggcgg

SEQ ID NO: 473069 - DNA, 20 bp, mouse
gttcaggcctgcaagggaat

SEQ ID NO: 473070 - DNA, 20 bp, mouse
gaggcggtggaccagtggat

SEQ ID NO: 473071 - DNA, 20 bp, mouse
gcctgaagcttcttcccctt

SEQ ID NO: 473072 - DNA, 20 bp, mouse
gaggccactgccagaagggt

SEQ ID NO: 473073 - DNA, 20 bp, mouse
gccctgaagtgctgattcgg

SEQ ID NO: 473074 - DNA, 20 bp, mouse
gttccacgtcccccatccac

SEQ ID NO: 473075 - DNA, 20 bp, mouse
ggggggacgtggaaagtcac

SEQ ID NO: 473076 - DNA, 20 bp, mouse
gctgaacaggggattctcgg

SEQ ID NO: 473077 - DNA, 20 bp, mouse
gttctaggaccgcaccagga

SEQ ID NO: 473078 - DNA, 20 bp, mouse
ggcaccaggagggctgaaca

SEQ ID NO: 473079 - DNA, 20 bp, mouse
gttacgctccaggctttcgg

SEQ ID NO: 473080 - DNA, 20 bp, mouse
gcggctgctcggaggcgact

SEQ ID NO: 473081 - DNA, 20 bp, mouse
gagcctggagcgtaacgggg

SEQ ID NO: 473082 - DNA, 20 bp, mouse
gggaagccagtgctactcca

SEQ ID NO: 473083 - DNA, 20 bp, mouse
ggaaagcctggagcgtaacg

SEQ ID NO: 473084 - DNA, 20 bp, mouse
gaacgtccctggagtagcac

SEQ ID NO: 473085 - DNA, 20 bp, mouse
gccaggactggattccgggt

SEQ ID NO: 473086 - DNA, 20 bp, mouse
gccccacaccggaacaaacc

SEQ ID NO: 473087 - DNA, 20 bp, mouse
gcgagggcggagcttcccag

SEQ ID NO: 473088 - DNA, 20 bp, mouse
gctctgcagcgacagtcagc

SEQ ID NO: 473089 - DNA, 20 bp, mouse
gtggactgcagtatgaataa

SEQ ID NO: 473090 - DNA, 20 bp, mouse
gccatgggcggggcctctag

SEQ ID NO: 473091 - DNA, 20 bp, mouse
ggggccgatttgagtctcga

SEQ ID NO: 473092 - DNA, 20 bp, mouse
gcaggggcggatcttttcca

SEQ ID NO: 473093 - DNA, 20 bp, mouse
gggcggggcctctagaggcg

SEQ ID NO: 473094 - DNA, 20 bp, mouse
gatgaataagggtcttccat

SEQ ID NO: 473095 - DNA, 20 bp, mouse
ggcactaagacgacgctggg

SEQ ID NO: 473096 - DNA, 20 bp, mouse
gaccccagaccagacttctc

SEQ ID NO: 473097 - DNA, 20 bp, mouse
gtgtgtgcaccagagaagtc

SEQ ID NO: 473098 - DNA, 20 bp, mouse
ggtcatagtgagcatctggg

SEQ ID NO: 473099 - DNA, 20 bp, mouse
gcagcagggggccagaagag

SEQ ID NO: 473100 - DNA, 20 bp, mouse
ggcgcctcagatgaaatcaa

SEQ ID NO: 473101 - DNA, 20 bp, mouse
gaccagagaagtctggtctg

SEQ ID NO: 473102 - DNA, 20 bp, mouse
ggcagcagctggcagaacca

SEQ ID NO: 473103 - DNA, 20 bp, mouse
ggtctcaaaagcagcatcag

SEQ ID NO: 473104 - DNA, 20 bp, mouse
gtggtctggggtcagccacg

SEQ ID NO: 473105 - DNA, 20 bp, mouse
gatacgcgtatgaaaacaaa

SEQ ID NO: 473106 - DNA, 20 bp, mouse
gagccgggtgggccatgtcc

SEQ ID NO: 473107 - DNA, 20 bp, mouse
gccgaggcggaggttcctgg

SEQ ID NO: 473108 - DNA, 20 bp, mouse
gaggcggcaggtagccgggt

SEQ ID NO: 473109 - DNA, 20 bp, mouse
gcccgctgcggccccggaca

SEQ ID NO: 473110 - DNA, 20 bp, mouse
gagtgtggggctcgccgtgg

SEQ ID NO: 473111 - DNA, 20 bp, mouse
gccgcctcggccgcccgctg

SEQ ID NO: 473112 - DNA, 20 bp, mouse
gggtgaggcggcaggtagcc

SEQ ID NO: 473113 - DNA, 20 bp, mouse
gcatgggccggggaccagag

SEQ ID NO: 473114 - DNA, 20 bp, mouse
ggtcggtctgcagccactca

SEQ ID NO: 473115 - DNA, 20 bp, mouse
gtgcgcggccacccccgtcc

SEQ ID NO: 473116 - DNA, 20 bp, mouse
ggcagtaagaagtatagcgt

SEQ ID NO: 473117 - DNA, 20 bp, mouse
gtatggagaaggacactctc

SEQ ID NO: 473118 - DNA, 20 bp, mouse
gctctcaggataggtgagac

SEQ ID NO: 473119 - DNA, 20 bp, mouse
gattactcaccagtggctca

SEQ ID NO: 473120 - DNA, 20 bp, mouse
gcttcatggggcaggacatg

SEQ ID NO: 473121 - DNA, 20 bp, mouse
gttttttatgagctggagct

SEQ ID NO: 473122 - DNA, 20 bp, mouse
gaattaagtgttatcttcat

SEQ ID NO: 473123 - DNA, 20 bp, mouse
gagaaggttctggtggagta

SEQ ID NO: 473124 - DNA, 20 bp, mouse
gtggtttaagaaggttctgg

SEQ ID NO: 473125 - DNA, 20 bp, mouse
gtatctatcatcattggttc

SEQ ID NO: 473126 - DNA, 20 bp, mouse
gagcctgacttcaggaccag

SEQ ID NO: 473127 - DNA, 20 bp, mouse
ggcagcgacgggcaccgacg

SEQ ID NO: 473128 - DNA, 20 bp, mouse
gggcggctgcatcacctcgt

SEQ ID NO: 473129 - DNA, 20 bp, mouse
ggccccctggtcctgaagtc

SEQ ID NO: 473130 - DNA, 20 bp, mouse
gctgctcggggcccgaggga

SEQ ID NO: 473131 - DNA, 20 bp, mouse
gagccgcctgcagcccatga

SEQ ID NO: 473132 - DNA, 20 bp, mouse
gccggctgctcggggcccga

SEQ ID NO: 473133 - DNA, 20 bp, mouse
ggtcaggctacgtcacccgc

SEQ ID NO: 473134 - DNA, 20 bp, mouse
ggcaacaacggaggcaacgg

SEQ ID NO: 473135 - DNA, 20 bp, mouse
gacggcaccgtcgccctcat

SEQ ID NO: 473136 - DNA, 20 bp, mouse
ggaaggggcgcgacccgggt

SEQ ID NO: 473137 - DNA, 20 bp, mouse
gcagagggcactagggtcct

SEQ ID NO: 473138 - DNA, 20 bp, mouse
gcggctccacccagccgaag

SEQ ID NO: 473139 - DNA, 20 bp, mouse
ggcagcccaggggatgtcgg

SEQ ID NO: 473140 - DNA, 20 bp, mouse
gcatccggcgcagcgcccgg

SEQ ID NO: 473141 - DNA, 20 bp, mouse
gctctcgccgcctcccaccc

SEQ ID NO: 473142 - DNA, 20 bp, mouse
ggggtccccagcgcatcaga

SEQ ID NO: 473143 - DNA, 20 bp, mouse
ggcgagagcgcgagcgacac

SEQ ID NO: 473144 - DNA, 20 bp, mouse
gagccgaaggggcgcgaccc

SEQ ID NO: 473145 - DNA, 20 bp, mouse
ggtgcacgcgcagcgccatc

SEQ ID NO: 473146 - DNA, 20 bp, mouse
gccggtagctgcagctggag

SEQ ID NO: 473147 - DNA, 20 bp, mouse
ggcagacgcggtgagtgtgt

SEQ ID NO: 473148 - DNA, 20 bp, mouse
gggccatgcgaaaaccgttg

SEQ ID NO: 473149 - DNA, 20 bp, mouse
gttgctaagagggaccagac

SEQ ID NO: 473150 - DNA, 20 bp, mouse
ggggatctccggaggacgag

SEQ ID NO: 473151 - DNA, 20 bp, mouse
ggggcggtgcgcgctcagtg

SEQ ID NO: 473152 - DNA, 20 bp, mouse
gggaaatgccggtgccccaa

SEQ ID NO: 473153 - DNA, 20 bp, mouse
gttcacttctaaggacgcgg

SEQ ID NO: 473154 - DNA, 20 bp, mouse
gtcctcggcgggtcctcaga

SEQ ID NO: 473155 - DNA, 20 bp, mouse
gggcgagggctgggaaatgc

SEQ ID NO: 473156 - DNA, 20 bp, mouse
gcagacatggccctgggagg

SEQ ID NO: 473157 - DNA, 20 bp, mouse
gtcggcctcgcagagcgcgg

SEQ ID NO: 473158 - DNA, 20 bp, mouse
ggggaggcggcagcacatgg

SEQ ID NO: 473159 - DNA, 20 bp, mouse
gcctgggaggcggcagcaca

SEQ ID NO: 473160 - DNA, 20 bp, mouse
ggcctcggcctcgcagagcg

SEQ ID NO: 473161 - DNA, 20 bp, mouse
gcccagggccatgtctgggg

SEQ ID NO: 473162 - DNA, 20 bp, mouse
gaagccctgcacgcccatgg

SEQ ID NO: 473163 - DNA, 20 bp, mouse
ggcctcgcagagcgcggcgg

SEQ ID NO: 473164 - DNA, 20 bp, mouse
gagctgcagaagctggcccg

SEQ ID NO: 473165 - DNA, 20 bp, mouse
ggccgccgccgcgctctgcg

SEQ ID NO: 473166 - DNA, 20 bp, mouse
gagactgtgggtctgaaatc

SEQ ID NO: 473167 - DNA, 20 bp, mouse
ggtgagcacgccgtagactg

SEQ ID NO: 473168 - DNA, 20 bp, mouse
gatgcgacagcagagatcca

SEQ ID NO: 473169 - DNA, 20 bp, mouse
gccgggcggaagttcaataa

SEQ ID NO: 473170 - DNA, 20 bp, mouse
gatctggttgacgcagtctg

SEQ ID NO: 473171 - DNA, 20 bp, mouse
gctggaaggagtctggggta

SEQ ID NO: 473172 - DNA, 20 bp, mouse
gctctcccctccacccaggg

SEQ ID NO: 473173 - DNA, 20 bp, mouse
gcgctccacctgcaagtgga

SEQ ID NO: 473174 - DNA, 20 bp, mouse
ggactctcagactctggtag

SEQ ID NO: 473175 - DNA, 20 bp, mouse
gtctaaccagacacttctcc

SEQ ID NO: 473176 - DNA, 20 bp, mouse
ggaggaagcatgggcgtcca

SEQ ID NO: 473177 - DNA, 20 bp, mouse
gctacccacggaggaagcat

SEQ ID NO: 473178 - DNA, 20 bp, mouse
gccgctgttccttctaccca

SEQ ID NO: 473179 - DNA, 20 bp, mouse
gctggagaagcgctgtcccg

SEQ ID NO: 473180 - DNA, 20 bp, mouse
gctgttccttctacccacgg

SEQ ID NO: 473181 - DNA, 20 bp, mouse
gcccccggagtaagcaccaa

SEQ ID NO: 473182 - DNA, 20 bp, mouse
gacgcccatgcttcctccgt

SEQ ID NO: 473183 - DNA, 20 bp, mouse
ggggctccacgcatcaccag

SEQ ID NO: 473184 - DNA, 20 bp, mouse
gcagggcttccaagagttcc

SEQ ID NO: 473185 - DNA, 20 bp, mouse
gggctgaccagactcagaag

SEQ ID NO: 473186 - DNA, 20 bp, mouse
gagattctcgaaggcggcgg

SEQ ID NO: 473187 - DNA, 20 bp, mouse
ggctgacagattctcgaagg

SEQ ID NO: 473188 - DNA, 20 bp, mouse
gcccgctgacagattctcga

SEQ ID NO: 473189 - DNA, 20 bp, mouse
gctgaggccgtggatcaggg

SEQ ID NO: 473190 - DNA, 20 bp, mouse
ggacagattctcgaaggcgg

SEQ ID NO: 473191 - DNA, 20 bp, mouse
gctgggactcccattccccg

SEQ ID NO: 473192 - DNA, 20 bp, mouse
ggccttgggccgcggggaat

SEQ ID NO: 473193 - DNA, 20 bp, mouse
gtcgctgaggccgtggatca

SEQ ID NO: 473194 - DNA, 20 bp, mouse
gcagggggcgagcagtggtt

SEQ ID NO: 473195 - DNA, 20 bp, mouse
gacagcgcccccctgatcca

SEQ ID NO: 473196 - DNA, 20 bp, mouse
gacacagccggcagtgctct

SEQ ID NO: 473197 - DNA, 20 bp, mouse
gggaagagctggcccctcgg

SEQ ID NO: 473198 - DNA, 20 bp, mouse
gtgcctagcaagtatccgaa

SEQ ID NO: 473199 - DNA, 20 bp, mouse
gggctcctggtgctttgcta

SEQ ID NO: 473200 - DNA, 20 bp, mouse
gggctcggctacatttacag

SEQ ID NO: 473201 - DNA, 20 bp, mouse
gagccattcggatacttgct

SEQ ID NO: 473202 - DNA, 20 bp, mouse
gacctgagcacatggatcag

SEQ ID NO: 473203 - DNA, 20 bp, mouse
gagaaatgggagcctccgag

SEQ ID NO: 473204 - DNA, 20 bp, mouse
gactggggaggacggagtgt

SEQ ID NO: 473205 - DNA, 20 bp, mouse
gcgaatggctcaggagaaaa

SEQ ID NO: 473206 - DNA, 20 bp, mouse
gggcagatgggcagcagact

SEQ ID NO: 473207 - DNA, 20 bp, mouse
ggggcagcagactgggactt

SEQ ID NO: 473208 - DNA, 20 bp, mouse
ggatgagaccattggcagat

SEQ ID NO: 473209 - DNA, 20 bp, mouse
gtcctatgttggccataata

SEQ ID NO: 473210 - DNA, 20 bp, mouse
gggtgaggatactaatatat

SEQ ID NO: 473211 - DNA, 20 bp, mouse
gctttaacagatgagaccat

SEQ ID NO: 473212 - DNA, 20 bp, mouse
gttagtatcctcacccacag

SEQ ID NO: 473213 - DNA, 20 bp, mouse
gaggaaatgactatatggta

SEQ ID NO: 473214 - DNA, 20 bp, mouse
gctcagatcaattgtttctt

SEQ ID NO: 473215 - DNA, 20 bp, mouse
gcacaggtgagaatatcaaa

SEQ ID NO: 473216 - DNA, 20 bp, mouse
gggctctcggagggtccccg

SEQ ID NO: 473217 - DNA, 20 bp, mouse
gccggagacgaggctctcgg

SEQ ID NO: 473218 - DNA, 20 bp, mouse
gtcgcggggccgggttgttg

SEQ ID NO: 473219 - DNA, 20 bp, mouse
gcctgggtcagggtgggaag

SEQ ID NO: 473220 - DNA, 20 bp, mouse
gaggccggagacgaggctct

SEQ ID NO: 473221 - DNA, 20 bp, mouse
gtccggcctccgcaacaacc

SEQ ID NO: 473222 - DNA, 20 bp, mouse
gacgcgcgccatgaacccga

SEQ ID NO: 473223 - DNA, 20 bp, mouse
gcaccaggcgaggatccgag

SEQ ID NO: 473224 - DNA, 20 bp, mouse
ggcgagaagaaccccacccc

SEQ ID NO: 473225 - DNA, 20 bp, mouse
ggcggcgagcggcttcctcg

SEQ ID NO: 473226 - DNA, 20 bp, mouse
ggccaggagcatgtgtgatc

SEQ ID NO: 473227 - DNA, 20 bp, mouse
gcaggaagagacgcacctct

SEQ ID NO: 473228 - DNA, 20 bp, mouse
gacattccccgctggagcac

SEQ ID NO: 473229 - DNA, 20 bp, mouse
gtggagcactggaggaagcc

SEQ ID NO: 473230 - DNA, 20 bp, mouse
gagcaaaccgttcccagtgt

SEQ ID NO: 473231 - DNA, 20 bp, mouse
gtgatgaaggccacccgaca

SEQ ID NO: 473232 - DNA, 20 bp, mouse
gggttcctgtatctcatcca

SEQ ID NO: 473233 - DNA, 20 bp, mouse
gcctgccatggatgagatac

SEQ ID NO: 473234 - DNA, 20 bp, mouse
gggggaatgtcactcaagtg

SEQ ID NO: 473235 - DNA, 20 bp, mouse
gaccagatcacacatgctcc

SEQ ID NO: 473236 - DNA, 20 bp, mouse
gtgcctgtcagagaggctgg

SEQ ID NO: 473237 - DNA, 20 bp, mouse
gtcagagaggctggcggcag

SEQ ID NO: 473238 - DNA, 20 bp, mouse
gcttctagcagcacgagtcc

SEQ ID NO: 473239 - DNA, 20 bp, mouse
gcgtgctgctagaaggagag

SEQ ID NO: 473240 - DNA, 20 bp, mouse
gctggtggtgcctgtcagag

SEQ ID NO: 473241 - DNA, 20 bp, mouse
ggcggcagtggcggctgtcc

SEQ ID NO: 473242 - DNA, 20 bp, mouse
gcagtggcggctgtccgggc

SEQ ID NO: 473243 - DNA, 20 bp, mouse
gcggtctcccggcgcctcag

SEQ ID NO: 473244 - DNA, 20 bp, mouse
gtctgactgacaacccagcc

SEQ ID NO: 473245 - DNA, 20 bp, mouse
gctgtgctaggccgaccctg

SEQ ID NO: 473246 - DNA, 20 bp, mouse
ggagctgacgaaggtgaagt

SEQ ID NO: 473247 - DNA, 20 bp, mouse
gcgtagtcgggagctgacga

SEQ ID NO: 473248 - DNA, 20 bp, mouse
gctgcggggtgacaggtagg

SEQ ID NO: 473249 - DNA, 20 bp, mouse
gggaggcgggagcaagacac

SEQ ID NO: 473250 - DNA, 20 bp, mouse
gcagacctgggagcaagctc

SEQ ID NO: 473251 - DNA, 20 bp, mouse
gcaagctcgggagggtcgtg

SEQ ID NO: 473252 - DNA, 20 bp, mouse
gcctgggagcaagctcggga

SEQ ID NO: 473253 - DNA, 20 bp, mouse
gagcaagacacaggtagtga

SEQ ID NO: 473254 - DNA, 20 bp, mouse
gggtggcggtaggaagcctg

SEQ ID NO: 473255 - DNA, 20 bp, mouse
gctcaggtaagagaaggacg

SEQ ID NO: 473256 - DNA, 20 bp, mouse
ggcagcaccgcggccatggg

SEQ ID NO: 473257 - DNA, 20 bp, mouse
gctgacacatccaccttcag

SEQ ID NO: 473258 - DNA, 20 bp, mouse
gcggaggcgagcgcaagtct

SEQ ID NO: 473259 - DNA, 20 bp, mouse
gcatggccgcggtgctgcac

SEQ ID NO: 473260 - DNA, 20 bp, mouse
gggcaagcagcaggcgcagt

SEQ ID NO: 473261 - DNA, 20 bp, mouse
gtgagaggcaggtactccca

SEQ ID NO: 473262 - DNA, 20 bp, mouse
gaccttcagcggcaagcagc

SEQ ID NO: 473263 - DNA, 20 bp, mouse
gagcacccgcgactcaggtg

SEQ ID NO: 473264 - DNA, 20 bp, mouse
gcacagggcgggggcaggag

SEQ ID NO: 473265 - DNA, 20 bp, mouse
ggaggcaggtactcccaggg

SEQ ID NO: 473266 - DNA, 20 bp, mouse
ggacgcggtggggatctcgg

SEQ ID NO: 473267 - DNA, 20 bp, mouse
ggcagcagcggccggaggga

SEQ ID NO: 473268 - DNA, 20 bp, mouse
gagcgcagagagagcagccg

SEQ ID NO: 473269 - DNA, 20 bp, mouse
ggcggcgtcagtctgagtag

SEQ ID NO: 473270 - DNA, 20 bp, mouse
ggcttgggcgcgggctagag

SEQ ID NO: 473271 - DNA, 20 bp, mouse
gagggacgcggtggggatct

SEQ ID NO: 473272 - DNA, 20 bp, mouse
ggcttaggctacagccccaa

SEQ ID NO: 473273 - DNA, 20 bp, mouse
gctcggcttgaggaggggag

SEQ ID NO: 473274 - DNA, 20 bp, mouse
ggaggggagaggagacgctt

SEQ ID NO: 473275 - DNA, 20 bp, mouse
ggagggcgtggctccgacag

SEQ ID NO: 473276 - DNA, 20 bp, mouse
ggacccaggacagctctgta

SEQ ID NO: 473277 - DNA, 20 bp, mouse
gctctgctcaggatactgga

SEQ ID NO: 473278 - DNA, 20 bp, mouse
gccaggacagctctgtatgg

SEQ ID NO: 473279 - DNA, 20 bp, mouse
ggccgctgccgtctacccag

SEQ ID NO: 473280 - DNA, 20 bp, mouse
gccccctgggtagacggcag

SEQ ID NO: 473281 - DNA, 20 bp, mouse
ggtctacccagggggcagga

SEQ ID NO: 473282 - DNA, 20 bp, mouse
ggtcctgggtccctctgctc

SEQ ID NO: 473283 - DNA, 20 bp, mouse
gctctgtatggtggcaggat

SEQ ID NO: 473284 - DNA, 20 bp, mouse
ggtccctctgctcaggatac

SEQ ID NO: 473285 - DNA, 20 bp, mouse
gatactggatggcagctgag

SEQ ID NO: 473286 - DNA, 20 bp, mouse
gccggtggctctcagacgaa

SEQ ID NO: 473287 - DNA, 20 bp, mouse
gagagcgagcgcagaagcag

SEQ ID NO: 473288 - DNA, 20 bp, mouse
gcaggccgagcctccaggcg

SEQ ID NO: 473289 - DNA, 20 bp, mouse
gagcagaggtgagcccggaa

SEQ ID NO: 473290 - DNA, 20 bp, mouse
ggaaggcgcaccgcgcctgg

SEQ ID NO: 473291 - DNA, 20 bp, mouse
gtgctcccactacgcaccgg

SEQ ID NO: 473292 - DNA, 20 bp, mouse
gcgctgctcccactacgcac

SEQ ID NO: 473293 - DNA, 20 bp, mouse
gttctgcgctcgctctcgga

SEQ ID NO: 473294 - DNA, 20 bp, mouse
gcagacgaatggcaccctgc

SEQ ID NO: 473295 - DNA, 20 bp, mouse
gagcagcacggcatccagga

SEQ ID NO: 473296 - DNA, 20 bp, mouse
gtgcccagcacagaaatcat

SEQ ID NO: 473297 - DNA, 20 bp, mouse
ggctgggcaaaatgtttctg

SEQ ID NO: 473298 - DNA, 20 bp, mouse
gggcagcgcgaagggcctgg

SEQ ID NO: 473299 - DNA, 20 bp, mouse
gcgaagggcctggaggacga

SEQ ID NO: 473300 - DNA, 20 bp, mouse
gattaggtaatgacttacaa

SEQ ID NO: 473301 - DNA, 20 bp, mouse
gtgtggcagcgcgaagggcc

SEQ ID NO: 473302 - DNA, 20 bp, mouse
gatgcgggcggagaggtcag

SEQ ID NO: 473303 - DNA, 20 bp, mouse
gtattgggaagcagactgaa

SEQ ID NO: 473304 - DNA, 20 bp, mouse
ggtgagaggaaagaatcctg

SEQ ID NO: 473305 - DNA, 20 bp, mouse
ggtttctgtggcagcgcgaa

SEQ ID NO: 473306 - DNA, 20 bp, mouse
gcgcggtcaccaccagggag

SEQ ID NO: 473307 - DNA, 20 bp, mouse
ggacagcttgtgagaagggg

SEQ ID NO: 473308 - DNA, 20 bp, mouse
gggaggccggagcatggata

SEQ ID NO: 473309 - DNA, 20 bp, mouse
gcaagctgtcccctccctgg

SEQ ID NO: 473310 - DNA, 20 bp, mouse
gagccggtcagggtaagagg

SEQ ID NO: 473311 - DNA, 20 bp, mouse
gcggtcagggtaagaggtgg

SEQ ID NO: 473312 - DNA, 20 bp, mouse
gctcccgggagaggggaaca

SEQ ID NO: 473313 - DNA, 20 bp, mouse
gtcacaagctgtcccctccc

SEQ ID NO: 473314 - DNA, 20 bp, mouse
gtaccacccacggccccacc

SEQ ID NO: 473315 - DNA, 20 bp, mouse
gtcgggccgcggtcaccacc

SEQ ID NO: 473316 - DNA, 20 bp, mouse
gcgcggagggaggtccccag

SEQ ID NO: 473317 - DNA, 20 bp, mouse
gagccgagcggagacagccg

SEQ ID NO: 473318 - DNA, 20 bp, mouse
gcgctgcagagcggctgggg

SEQ ID NO: 473319 - DNA, 20 bp, mouse
gcccggcgagggccccgagt

SEQ ID NO: 473320 - DNA, 20 bp, mouse
gcggttcccggtgctccccc

SEQ ID NO: 473321 - DNA, 20 bp, mouse
ggagggccccgagtcggtga

SEQ ID NO: 473322 - DNA, 20 bp, mouse
gtgctgtggagaggctacca

SEQ ID NO: 473323 - DNA, 20 bp, mouse
gtgagccgcgaaggatgctg

SEQ ID NO: 473324 - DNA, 20 bp, mouse
gtcccggccctcaccgactc

SEQ ID NO: 473325 - DNA, 20 bp, mouse
ggcggcgctgcagagcggct

SEQ ID NO: 473326 - DNA, 20 bp, mouse
ggcgcgaggcgatccggacg

SEQ ID NO: 473327 - DNA, 20 bp, mouse
ggggactaggagcgagagga

SEQ ID NO: 473328 - DNA, 20 bp, mouse
gggcgcggctgatccatgaa

SEQ ID NO: 473329 - DNA, 20 bp, mouse
gggacgcagcgagaagcggg

SEQ ID NO: 473330 - DNA, 20 bp, mouse
gccaaggccgggcgacaccg

SEQ ID NO: 473331 - DNA, 20 bp, mouse
ggtgtcgcgaggtgaggaca

SEQ ID NO: 473332 - DNA, 20 bp, mouse
gggcgatccggacgcggcag

SEQ ID NO: 473333 - DNA, 20 bp, mouse
ggaagggcggacacccaccc

SEQ ID NO: 473334 - DNA, 20 bp, mouse
gaggccgggcgacaccgcgg

SEQ ID NO: 473335 - DNA, 20 bp, mouse
gcgcccggccttggcagctg

SEQ ID NO: 473336 - DNA, 20 bp, mouse
ggtggcagggttgctgtcga

SEQ ID NO: 473337 - DNA, 20 bp, mouse
gggataggtcgacagagacg

SEQ ID NO: 473338 - DNA, 20 bp, mouse
ggcaggagctcaagaagtct

SEQ ID NO: 473339 - DNA, 20 bp, mouse
gcgacagagacgaggagttc

SEQ ID NO: 473340 - DNA, 20 bp, mouse
ggaaagtagttctctttcgg

SEQ ID NO: 473341 - DNA, 20 bp, mouse
ggtcgagggcaccgagcagg

SEQ ID NO: 473342 - DNA, 20 bp, mouse
gaggcctcccaggctccaag

SEQ ID NO: 473343 - DNA, 20 bp, mouse
gcgcggagactgagccatgt

SEQ ID NO: 473344 - DNA, 20 bp, mouse
ggctggtgcatgtctgcagg

SEQ ID NO: 473345 - DNA, 20 bp, mouse
gtcccaggctccgtcaaggt

SEQ ID NO: 473346 - DNA, 20 bp, mouse
gcagcgtgcgagctccgacg

SEQ ID NO: 473347 - DNA, 20 bp, mouse
gcgtgcgagctccgacgggg

SEQ ID NO: 473348 - DNA, 20 bp, mouse
gcgggtcgaggccatgctgg

SEQ ID NO: 473349 - DNA, 20 bp, mouse
ggggacaccgaggcccatgg

SEQ ID NO: 473350 - DNA, 20 bp, mouse
ggtcgaggccatgctggcgg

SEQ ID NO: 473351 - DNA, 20 bp, mouse
gccccgggacaggaagatgt

SEQ ID NO: 473352 - DNA, 20 bp, mouse
ggaggcccatggcggcgagt

SEQ ID NO: 473353 - DNA, 20 bp, mouse
gcccatggcggcgagtaggc

SEQ ID NO: 473354 - DNA, 20 bp, mouse
gcggcgggtcgaggccatgc

SEQ ID NO: 473355 - DNA, 20 bp, mouse
gagagcacggctggtcaggt

SEQ ID NO: 473356 - DNA, 20 bp, mouse
ggaggtggtaagaggactcg

SEQ ID NO: 473357 - DNA, 20 bp, mouse
ggcccgagaagaagccgaag

SEQ ID NO: 473358 - DNA, 20 bp, mouse
gtctgggcggggcatagagg

SEQ ID NO: 473359 - DNA, 20 bp, mouse
gaggcgcgggaagccgccga

SEQ ID NO: 473360 - DNA, 20 bp, mouse
gctctctgggcggggcatag

SEQ ID NO: 473361 - DNA, 20 bp, mouse
gcgagcaggacgctgaggac

SEQ ID NO: 473362 - DNA, 20 bp, mouse
ggtggtaagaggactcgcgg

SEQ ID NO: 473363 - DNA, 20 bp, mouse
gcttctcgggcctgctccct

SEQ ID NO: 473364 - DNA, 20 bp, mouse
gggtggccggctgaaggcgc

SEQ ID NO: 473365 - DNA, 20 bp, mouse
ggggaagccgccgagggagc

SEQ ID NO: 473366 - DNA, 20 bp, mouse
gccgagcccgcgaggagcca

SEQ ID NO: 473367 - DNA, 20 bp, mouse
gccgtctgacgcgcccccgg

SEQ ID NO: 473368 - DNA, 20 bp, mouse
gtcctcgcgggctcgggcag

SEQ ID NO: 473369 - DNA, 20 bp, mouse
gcgcagccctggctcctcgc

SEQ ID NO: 473370 - DNA, 20 bp, mouse
gcgggctcgggcagcggctg

SEQ ID NO: 473371 - DNA, 20 bp, mouse
ggggcgcgtcagacggaagg

SEQ ID NO: 473372 - DNA, 20 bp, mouse
gtcacggcggccacactcaa

SEQ ID NO: 473373 - DNA, 20 bp, mouse
ggacgctgacagccctccaa

SEQ ID NO: 473374 - DNA, 20 bp, mouse
gcggcgcgggtggcacctcg

SEQ ID NO: 473375 - DNA, 20 bp, mouse
ggcagcggtggcggtaacac

SEQ ID NO: 473376 - DNA, 20 bp, mouse
gaggtggagtagccacggac

SEQ ID NO: 473377 - DNA, 20 bp, mouse
ggacttaagcgcctaccaaa

SEQ ID NO: 473378 - DNA, 20 bp, mouse
gttaagcgcctaccaaaagg

SEQ ID NO: 473379 - DNA, 20 bp, mouse
gcctgcccagctgcctgtca

SEQ ID NO: 473380 - DNA, 20 bp, mouse
gccgtggctactccaccttt

SEQ ID NO: 473381 - DNA, 20 bp, mouse
gcttccccgtgactcaaagg

SEQ ID NO: 473382 - DNA, 20 bp, mouse
gcaacttccccgtgactcaa

SEQ ID NO: 473383 - DNA, 20 bp, mouse
gtgaggtttcaacctgtccg

SEQ ID NO: 473384 - DNA, 20 bp, mouse
gggctactccaccttttggt

SEQ ID NO: 473385 - DNA, 20 bp, mouse
ggggaaaatgctgggcgact

SEQ ID NO: 473386 - DNA, 20 bp, mouse
ggccgtggccccggatgttg

SEQ ID NO: 473387 - DNA, 20 bp, mouse
gtcagcagccacaacatccg

SEQ ID NO: 473388 - DNA, 20 bp, mouse
ggacgaaagaaggcaggaca

SEQ ID NO: 473389 - DNA, 20 bp, mouse
gacatccggggccacggccc

SEQ ID NO: 473390 - DNA, 20 bp, mouse
gaaccccgaagctggacccg

SEQ ID NO: 473391 - DNA, 20 bp, mouse
gctgcggccgggcggagaag

SEQ ID NO: 473392 - DNA, 20 bp, mouse
gactgcgcagaagcacgatt

SEQ ID NO: 473393 - DNA, 20 bp, mouse
ggccacaacatccggggcca

SEQ ID NO: 473394 - DNA, 20 bp, mouse
gcagccagggcgacgaaaga

SEQ ID NO: 473395 - DNA, 20 bp, mouse
gggagccggacatagctcgg

SEQ ID NO: 473396 - DNA, 20 bp, mouse
gccgagcgccggagacgagc

SEQ ID NO: 473397 - DNA, 20 bp, mouse
gccaagagccggctcgtctc

SEQ ID NO: 473398 - DNA, 20 bp, mouse
gagggcgccagaggcagacg

SEQ ID NO: 473399 - DNA, 20 bp, mouse
ggcagtcgcgtcggtcccaa

SEQ ID NO: 473400 - DNA, 20 bp, mouse
gactgaggccagggcgccag

SEQ ID NO: 473401 - DNA, 20 bp, mouse
ggactgcgcatgctcgccgg

SEQ ID NO: 473402 - DNA, 20 bp, mouse
gcgaggccgtgccggttgag

SEQ ID NO: 473403 - DNA, 20 bp, mouse
gggacaccgggcacgacgag

SEQ ID NO: 473404 - DNA, 20 bp, mouse
gcgcgggtggaagcgaatga

SEQ ID NO: 473405 - DNA, 20 bp, mouse
gccggctcttggctttgcgg

SEQ ID NO: 473406 - DNA, 20 bp, mouse
gcaacaccggcagcgactgt

SEQ ID NO: 473407 - DNA, 20 bp, mouse
gtgtgggcggaccaaggagt

SEQ ID NO: 473408 - DNA, 20 bp, mouse
ggggcggaccaaggagtcgg

SEQ ID NO: 473409 - DNA, 20 bp, mouse
gcggaccaaggagtcggtgg

SEQ ID NO: 473410 - DNA, 20 bp, mouse
gagcgactgtgggcggacca

SEQ ID NO: 473411 - DNA, 20 bp, mouse
ggagacctgagacagctcgc

SEQ ID NO: 473412 - DNA, 20 bp, mouse
ggtctcaggtctctaccgag

SEQ ID NO: 473413 - DNA, 20 bp, mouse
gcctcctccagtcagcctct

SEQ ID NO: 473414 - DNA, 20 bp, mouse
gggtgccgccaccgactcct

SEQ ID NO: 473415 - DNA, 20 bp, mouse
gtctctaccgagaggctgac

SEQ ID NO: 473416 - DNA, 20 bp, mouse
gtcgcgccagatcacctcag

SEQ ID NO: 473417 - DNA, 20 bp, mouse
gctcgtcaccgaggccaggt

SEQ ID NO: 473418 - DNA, 20 bp, mouse
gtggcttgagaagcccgcac

SEQ ID NO: 473419 - DNA, 20 bp, mouse
gaagttaagcgaggccagta

SEQ ID NO: 473420 - DNA, 20 bp, mouse
gcgccagatcacctcagggg

SEQ ID NO: 473421 - DNA, 20 bp, mouse
gcagtagggtgagggagacg

SEQ ID NO: 473422 - DNA, 20 bp, mouse
ggtcaccgaggccaggtggg

SEQ ID NO: 473423 - DNA, 20 bp, mouse
gcagcgcaggacggcccgaa

SEQ ID NO: 473424 - DNA, 20 bp, mouse
gagcgaggccagtagggtga

SEQ ID NO: 473425 - DNA, 20 bp, mouse
gcgagctccgggcctcgcgt

SEQ ID NO: 473426 - DNA, 20 bp, mouse
ggctatttaagaggaagaat

SEQ ID NO: 473427 - DNA, 20 bp, mouse
gcatcttcttggtcatcgtt

SEQ ID NO: 473428 - DNA, 20 bp, mouse
gaaggagtctctgtcgtcca

SEQ ID NO: 473429 - DNA, 20 bp, mouse
gattgcaatgcatcgtgcag

SEQ ID NO: 473430 - DNA, 20 bp, mouse
gggcgctgcacaggaacatg

SEQ ID NO: 473431 - DNA, 20 bp, mouse
ggagcctgggcttgagtcag

SEQ ID NO: 473432 - DNA, 20 bp, mouse
gcatcgtgcagcgggccagg

SEQ ID NO: 473433 - DNA, 20 bp, mouse
ggcgcctctgactcaagccc

SEQ ID NO: 473434 - DNA, 20 bp, mouse
ggacaaagccaaagactcaa

SEQ ID NO: 473435 - DNA, 20 bp, mouse
gagaacatctggaagatgca

SEQ ID NO: 473436 - DNA, 20 bp, mouse
ggccctgtgtgcaggacccg

SEQ ID NO: 473437 - DNA, 20 bp, mouse
gtccgcgggtcctgcacaca

SEQ ID NO: 473438 - DNA, 20 bp, mouse
gcagcaggttgtgtgttccg

SEQ ID NO: 473439 - DNA, 20 bp, mouse
ggcttgactggaaggcactc

SEQ ID NO: 473440 - DNA, 20 bp, mouse
gcacacagggcttgactgga

SEQ ID NO: 473441 - DNA, 20 bp, mouse
gtatccttgcctgcagctgg

SEQ ID NO: 473442 - DNA, 20 bp, mouse
gctcgtgtgcgaatctgcac

SEQ ID NO: 473443 - DNA, 20 bp, mouse
ggagaacactaccttcgcag

SEQ ID NO: 473444 - DNA, 20 bp, mouse
gtgcaggcaaggatatttat

SEQ ID NO: 473445 - DNA, 20 bp, mouse
gtctaacagcctggagaccc

SEQ ID NO: 473446 - DNA, 20 bp, mouse
gaggcgcagagcctccctaa

SEQ ID NO: 473447 - DNA, 20 bp, mouse
ggcggcagacgcggagaagt

SEQ ID NO: 473448 - DNA, 20 bp, mouse
ggcagacgcggagaagtggg

SEQ ID NO: 473449 - DNA, 20 bp, mouse
gccctaacggcgagcgggag

SEQ ID NO: 473450 - DNA, 20 bp, mouse
gcgagaactgaggccctaag

SEQ ID NO: 473451 - DNA, 20 bp, mouse
ggcgaccccccggagacccc

SEQ ID NO: 473452 - DNA, 20 bp, mouse
ggaggctgaagcgactgcag

SEQ ID NO: 473453 - DNA, 20 bp, mouse
ggtcgacgaggcgagaactg

SEQ ID NO: 473454 - DNA, 20 bp, mouse
gacccttggcgacgtcgacg

SEQ ID NO: 473455 - DNA, 20 bp, mouse
gtgcaagggacagccccggt

SEQ ID NO: 473456 - DNA, 20 bp, mouse
gtgctccgcgcaaccctggt

SEQ ID NO: 473457 - DNA, 20 bp, mouse
gagctcctagctgcctacca

SEQ ID NO: 473458 - DNA, 20 bp, mouse
ggagctgctccgcgcaaccc

SEQ ID NO: 473459 - DNA, 20 bp, mouse
gcgaggctgcggggacgatg

SEQ ID NO: 473460 - DNA, 20 bp, mouse
gggcacgctcgctctacctt

SEQ ID NO: 473461 - DNA, 20 bp, mouse
gcattgccaggcaagtctta

SEQ ID NO: 473462 - DNA, 20 bp, mouse
ggcaaccctggtaggcagct

SEQ ID NO: 473463 - DNA, 20 bp, mouse
ggtgtgggtgctctaactcc

SEQ ID NO: 473464 - DNA, 20 bp, mouse
gtaactccgggagagcaatt

SEQ ID NO: 473465 - DNA, 20 bp, mouse
ggaatgcaagtcgattgtaa

SEQ ID NO: 473466 - DNA, 20 bp, mouse
gggcaggaggcaggaaggat

SEQ ID NO: 473467 - DNA, 20 bp, mouse
ggaattgagagacctcgctg

SEQ ID NO: 473468 - DNA, 20 bp, mouse
ggaggctggatgccacagcg

SEQ ID NO: 473469 - DNA, 20 bp, mouse
ggctgcagtgggcagaatcg

SEQ ID NO: 473470 - DNA, 20 bp, mouse
gctgcctcctgcctcggccc

SEQ ID NO: 473471 - DNA, 20 bp, mouse
gcctcggcccgggctgcagt

SEQ ID NO: 473472 - DNA, 20 bp, mouse
gccgttctcacgcagggcaa

SEQ ID NO: 473473 - DNA, 20 bp, mouse
gatgggcgcggcggatcccg

SEQ ID NO: 473474 - DNA, 20 bp, mouse
gagcatgtccccggatcccc

SEQ ID NO: 473475 - DNA, 20 bp, mouse
gaccagcgagccggcagaga

SEQ ID NO: 473476 - DNA, 20 bp, mouse
gaagatgttcaagggaccag

SEQ ID NO: 473477 - DNA, 20 bp, mouse
gtcaaggagaggactagtgt

SEQ ID NO: 473478 - DNA, 20 bp, mouse
gaaactcgctggagattctc

SEQ ID NO: 473479 - DNA, 20 bp, mouse
gtgttggatgcacggattat

SEQ ID NO: 473480 - DNA, 20 bp, mouse
gctggcacacagcttcctcg

SEQ ID NO: 473481 - DNA, 20 bp, mouse
gattctctggctggcccctg

SEQ ID NO: 473482 - DNA, 20 bp, mouse
ggattatgggctaaactcgc

SEQ ID NO: 473483 - DNA, 20 bp, mouse
gaaccgcctgtgcagcccca

SEQ ID NO: 473484 - DNA, 20 bp, mouse
gtgaaacaacggattcctgt

SEQ ID NO: 473485 - DNA, 20 bp, mouse
gagggtctgtcagacccata

SEQ ID NO: 473486 - DNA, 20 bp, mouse
gtaagcgacggggcgagacg

SEQ ID NO: 473487 - DNA, 20 bp, mouse
ggccggtaggtggcaggagg

SEQ ID NO: 473488 - DNA, 20 bp, mouse
ggtctgggacgggaaaggag

SEQ ID NO: 473489 - DNA, 20 bp, mouse
ggtccggaatctaagcgacg

SEQ ID NO: 473490 - DNA, 20 bp, mouse
ggccccctcctgccacctac

SEQ ID NO: 473491 - DNA, 20 bp, mouse
gctggccgcagaggagaaaa

SEQ ID NO: 473492 - DNA, 20 bp, mouse
gcctatgtctgggacgggaa

SEQ ID NO: 473493 - DNA, 20 bp, mouse
gcaggacctaacagtcccaa

SEQ ID NO: 473494 - DNA, 20 bp, mouse
gttgggccgccggagctcaa

SEQ ID NO: 473495 - DNA, 20 bp, mouse
gggccagggcgggcaagcca

SEQ ID NO: 473496 - DNA, 20 bp, mouse
gccgtgtccgtagctgggag

SEQ ID NO: 473497 - DNA, 20 bp, mouse
gagcctgccgctcccagcta

SEQ ID NO: 473498 - DNA, 20 bp, mouse
gtgctccgggaggctctggg

SEQ ID NO: 473499 - DNA, 20 bp, mouse
gagcagcagtgcggacaccg

SEQ ID NO: 473500 - DNA, 20 bp, mouse
gtacggacacggaggccatg

SEQ ID NO: 473501 - DNA, 20 bp, mouse
ggggcggcaatggaacttgg

SEQ ID NO: 473502 - DNA, 20 bp, mouse
ggcaggtcaggggtcataca

SEQ ID NO: 473503 - DNA, 20 bp, mouse
gctgggcttagtgagccaca

SEQ ID NO: 473504 - DNA, 20 bp, mouse
gcggcaggctggggcggcaa

SEQ ID NO: 473505 - DNA, 20 bp, mouse
ggtgcggacaccggggtgct

SEQ ID NO: 473506 - DNA, 20 bp, mouse
gtccctgcgctggacaagtg

SEQ ID NO: 473507 - DNA, 20 bp, mouse
gcaggacgcgcagctcctac

SEQ ID NO: 473508 - DNA, 20 bp, mouse
ggggtgagcgctgtccccgt

SEQ ID NO: 473509 - DNA, 20 bp, mouse
gttgtccagcgcagggacac

SEQ ID NO: 473510 - DNA, 20 bp, mouse
gagcgggactcggagcagca

SEQ ID NO: 473511 - DNA, 20 bp, mouse
gccggagccgcggagcagat

SEQ ID NO: 473512 - DNA, 20 bp, mouse
gcccggacctctcaagtcca

SEQ ID NO: 473513 - DNA, 20 bp, mouse
ggcccgaggacagcgggact

SEQ ID NO: 473514 - DNA, 20 bp, mouse
gaggtccgggcacctgccag

SEQ ID NO: 473515 - DNA, 20 bp, mouse
ggccccacttgtccagcgca

SEQ ID NO: 473516 - DNA, 20 bp, mouse
gatgactgtgagatcctgaa

SEQ ID NO: 473517 - DNA, 20 bp, mouse
gagagtagagctggatacat

SEQ ID NO: 473518 - DNA, 20 bp, mouse
gagggagctctcttgagtga

SEQ ID NO: 473519 - DNA, 20 bp, mouse
gacatgggcagagctcagtg

SEQ ID NO: 473520 - DNA, 20 bp, mouse
gtcagggcacccaaccaggt

SEQ ID NO: 473521 - DNA, 20 bp, mouse
gccctgcagctgagatctgg

SEQ ID NO: 473522 - DNA, 20 bp, mouse
gtgcatcagggcacccaacc

SEQ ID NO: 473523 - DNA, 20 bp, mouse
gtcggcggaaggctaagatc

SEQ ID NO: 473524 - DNA, 20 bp, mouse
gtaggcctaaccctgcatca

SEQ ID NO: 473525 - DNA, 20 bp, mouse
gtgctctggttgacttggta

SEQ ID NO: 473526 - DNA, 20 bp, mouse
gctgcgcaggtgcacaaggt

SEQ ID NO: 473527 - DNA, 20 bp, mouse
gttccgccaggaagacaacc

SEQ ID NO: 473528 - DNA, 20 bp, mouse
gaccatggcagcatgtgcag

SEQ ID NO: 473529 - DNA, 20 bp, mouse
ggtaagtgtggagggttcag

SEQ ID NO: 473530 - DNA, 20 bp, mouse
ggaaccctccacacttaccc

SEQ ID NO: 473531 - DNA, 20 bp, mouse
gctgcggggtgttcaagtgg

SEQ ID NO: 473532 - DNA, 20 bp, mouse
ggagtatctccgtgtgacaa

SEQ ID NO: 473533 - DNA, 20 bp, mouse
ggtggtggctgatttaactg

SEQ ID NO: 473534 - DNA, 20 bp, mouse
ggtcacacggagatactctt

SEQ ID NO: 473535 - DNA, 20 bp, mouse
gtgtctgcggggtgttcaag

SEQ ID NO: 473536 - DNA, 20 bp, mouse
gtgcttcccactggccgcag

SEQ ID NO: 473537 - DNA, 20 bp, mouse
ggcaggtgggtgcttcccac

SEQ ID NO: 473538 - DNA, 20 bp, mouse
gtgctgccactgcggccagt

SEQ ID NO: 473539 - DNA, 20 bp, mouse
gtcctcccaagggcaatctg

SEQ ID NO: 473540 - DNA, 20 bp, mouse
gaagtccgaggtgaaggatg

SEQ ID NO: 473541 - DNA, 20 bp, mouse
gtgggccctgtggcttgcag

SEQ ID NO: 473542 - DNA, 20 bp, mouse
gctggcccctgcaagccaca

SEQ ID NO: 473543 - DNA, 20 bp, mouse
gagcaaaacagcatcggtca

SEQ ID NO: 473544 - DNA, 20 bp, mouse
gttacagacgtgagccggcc

SEQ ID NO: 473545 - DNA, 20 bp, mouse
gcacctcggactttccacta

SEQ ID NO: 473546 - DNA, 20 bp, mouse
gcccctccgcaggcttaggc

SEQ ID NO: 473547 - DNA, 20 bp, mouse
gcgtccccctccgcaggctt

SEQ ID NO: 473548 - DNA, 20 bp, mouse
gtccgcggtcgccttgacga

SEQ ID NO: 473549 - DNA, 20 bp, mouse
ggcggtcgccttgacgacgg

SEQ ID NO: 473550 - DNA, 20 bp, mouse
ggtgtgccagcctaagcctg

SEQ ID NO: 473551 - DNA, 20 bp, mouse
gctccagcgtccccctccgc

SEQ ID NO: 473552 - DNA, 20 bp, mouse
ggccagcctaagcctgcgga

SEQ ID NO: 473553 - DNA, 20 bp, mouse
gccttcaacttggagttccg

SEQ ID NO: 473554 - DNA, 20 bp, mouse
gacagcgtccgccgtcgtca

SEQ ID NO: 473555 - DNA, 20 bp, mouse
gaggcaagggagtccttagg

SEQ ID NO: 473556 - DNA, 20 bp, mouse
gcagagacgcggcatgcccc

SEQ ID NO: 473557 - DNA, 20 bp, mouse
gcgctccggtcgccgtcagt

SEQ ID NO: 473558 - DNA, 20 bp, mouse
gcgcggcatgcccctggcag

SEQ ID NO: 473559 - DNA, 20 bp, mouse
gaccggcacaggagccctca

SEQ ID NO: 473560 - DNA, 20 bp, mouse
gggcacaggagccctcacgg

SEQ ID NO: 473561 - DNA, 20 bp, mouse
gggcgctgctcctatcaccc

SEQ ID NO: 473562 - DNA, 20 bp, mouse
gctcacggtggagtcggcca

SEQ ID NO: 473563 - DNA, 20 bp, mouse
gccaggagcgcgggccagga

SEQ ID NO: 473564 - DNA, 20 bp, mouse
gagcccgctctcccctgcca

SEQ ID NO: 473565 - DNA, 20 bp, mouse
ggaccccatcccttgaagag

SEQ ID NO: 473566 - DNA, 20 bp, mouse
ggcgggtgagcgagagacaa

SEQ ID NO: 473567 - DNA, 20 bp, mouse
gcccgagggccaggcaggca

SEQ ID NO: 473568 - DNA, 20 bp, mouse
gcagggaagtgcgcaggtag

SEQ ID NO: 473569 - DNA, 20 bp, mouse
ggtagaggcgctgcagagaa

SEQ ID NO: 473570 - DNA, 20 bp, mouse
gtggacggacggaccgacag

SEQ ID NO: 473571 - DNA, 20 bp, mouse
ggtgagcgagagacaacggc

SEQ ID NO: 473572 - DNA, 20 bp, mouse
gtccgtccagggagccaagg

SEQ ID NO: 473573 - DNA, 20 bp, mouse
gggcgctgcagagaaaggca

SEQ ID NO: 473574 - DNA, 20 bp, mouse
gggcaggcagggaagtgcgc

SEQ ID NO: 473575 - DNA, 20 bp, mouse
gccgctgccagggggcgaag

SEQ ID NO: 473576 - DNA, 20 bp, mouse
gactcagagaccagacccag

SEQ ID NO: 473577 - DNA, 20 bp, mouse
gtacatgtggagcctcaggt

SEQ ID NO: 473578 - DNA, 20 bp, mouse
ggcgggaggtagagcggaga

SEQ ID NO: 473579 - DNA, 20 bp, mouse
gcccaagcccaggcaaccct

SEQ ID NO: 473580 - DNA, 20 bp, mouse
gagagagctccggcacctcg

SEQ ID NO: 473581 - DNA, 20 bp, mouse
gcgcgctgcgggcactggaa

SEQ ID NO: 473582 - DNA, 20 bp, mouse
gtccggcacctcgtggacag

SEQ ID NO: 473583 - DNA, 20 bp, mouse
ggtagtagcccgagcacagg

SEQ ID NO: 473584 - DNA, 20 bp, mouse
ggatttggggtccaagtgcc

SEQ ID NO: 473585 - DNA, 20 bp, mouse
ggggctgggccatcagagaa

SEQ ID NO: 473586 - DNA, 20 bp, mouse
gagcaggctgtgagcctgaa

SEQ ID NO: 473587 - DNA, 20 bp, mouse
gcagctagctgtcacagagt

SEQ ID NO: 473588 - DNA, 20 bp, mouse
gtgacagcagcattaagaca

SEQ ID NO: 473589 - DNA, 20 bp, mouse
gtggagttaatgactgctta

SEQ ID NO: 473590 - DNA, 20 bp, mouse
gtcttggttcagtgtgacag

SEQ ID NO: 473591 - DNA, 20 bp, mouse
gacatttttaacatgatact

SEQ ID NO: 473592 - DNA, 20 bp, mouse
ggtcacagagtaggaaatct

SEQ ID NO: 473593 - DNA, 20 bp, mouse
ggttcagtgtgacagaggct

SEQ ID NO: 473594 - DNA, 20 bp, mouse
gatatattacctgtgcccag

SEQ ID NO: 473595 - DNA, 20 bp, mouse
gctttcttgaaacactgggt

SEQ ID NO: 473596 - DNA, 20 bp, mouse
gtgtgtgaggtcttgttggt

SEQ ID NO: 473597 - DNA, 20 bp, mouse
gggtgtgtgtgaggtcttgt

SEQ ID NO: 473598 - DNA, 20 bp, mouse
gctggaaggctacaacactt

SEQ ID NO: 473599 - DNA, 20 bp, mouse
gctgaccacacctcatccca

SEQ ID NO: 473600 - DNA, 20 bp, mouse
gctgcctgggcatgaggtcg

SEQ ID NO: 473601 - DNA, 20 bp, mouse
gtacaacacttaggcaagtt

SEQ ID NO: 473602 - DNA, 20 bp, mouse
ggtcgaggcagttctaccct

SEQ ID NO: 473603 - DNA, 20 bp, mouse
gctgcctcgacctcatgccc

SEQ ID NO: 473604 - DNA, 20 bp, mouse
ggcagttctaccctgggatg

SEQ ID NO: 473605 - DNA, 20 bp, mouse
gagcctgacttcctattctc

SEQ ID NO: 473606 - DNA, 20 bp, mouse
ggagttcatgaactgcacga

SEQ ID NO: 473607 - DNA, 20 bp, mouse
gtcatgaactgcacgagggc

SEQ ID NO: 473608 - DNA, 20 bp, mouse
gctgcattctgaaggacgac

SEQ ID NO: 473609 - DNA, 20 bp, mouse
ggcttctgggctgcagtacc

SEQ ID NO: 473610 - DNA, 20 bp, mouse
ggactggcactgcattctga

SEQ ID NO: 473611 - DNA, 20 bp, mouse
gtgcagcccagaagccatca

SEQ ID NO: 473612 - DNA, 20 bp, mouse
gtgaatcccgtggagtatac

SEQ ID NO: 473613 - DNA, 20 bp, mouse
gtcttcctgggagcttacaa

SEQ ID NO: 473614 - DNA, 20 bp, mouse
gttctgtaacgcagtcatcc

SEQ ID NO: 473615 - DNA, 20 bp, mouse
ggaagtccatgatggcttct

SEQ ID NO: 473616 - DNA, 20 bp, mouse
gttcgcctgaggagcgatgg

SEQ ID NO: 473617 - DNA, 20 bp, mouse
gccctgcccgggcctgtcgg

SEQ ID NO: 473618 - DNA, 20 bp, mouse
gtggttcgcctgaggagcga

SEQ ID NO: 473619 - DNA, 20 bp, mouse
gggccgggctaggtgagttc

SEQ ID NO: 473620 - DNA, 20 bp, mouse
gcccggccgccgacaggccc

SEQ ID NO: 473621 - DNA, 20 bp, mouse
ggaggggctgcgaacatctg

SEQ ID NO: 473622 - DNA, 20 bp, mouse
ggcctgtcggcggccgggct

SEQ ID NO: 473623 - DNA, 20 bp, mouse
gaagggacagggtgaagggt

SEQ ID NO: 473624 - DNA, 20 bp, mouse
ggccgccgccatcgctcctc

SEQ ID NO: 473625 - DNA, 20 bp, mouse
ggcgaacatctgaggtaggg

SEQ ID NO: 473626 - DNA, 20 bp, mouse
gggcggcgacgcggacacgg

SEQ ID NO: 473627 - DNA, 20 bp, mouse
gggtcgttcggctgcaatcg

SEQ ID NO: 473628 - DNA, 20 bp, mouse
ggcgcggcggctctgatcgg

SEQ ID NO: 473629 - DNA, 20 bp, mouse
gagcggcggcgacgcggaca

SEQ ID NO: 473630 - DNA, 20 bp, mouse
ggggcggctccgaggtcgtt

SEQ ID NO: 473631 - DNA, 20 bp, mouse
ggaggcgcggcggctctgat

SEQ ID NO: 473632 - DNA, 20 bp, mouse
gtggagagcagaggccccgg

SEQ ID NO: 473633 - DNA, 20 bp, mouse
gcgggcagccgcagcagggg

SEQ ID NO: 473634 - DNA, 20 bp, mouse
gggctgcaatcggggcaccg

SEQ ID NO: 473635 - DNA, 20 bp, mouse
gagcttctcccgggacgacc

SEQ ID NO: 473636 - DNA, 20 bp, mouse
ggcggcccggctcccggtgg

SEQ ID NO: 473637 - DNA, 20 bp, mouse
ggctcccggtggcggcgcag

SEQ ID NO: 473638 - DNA, 20 bp, mouse
ggaggaggcggcccaacggg

SEQ ID NO: 473639 - DNA, 20 bp, mouse
ggcggaggaggcggcccaac

SEQ ID NO: 473640 - DNA, 20 bp, mouse
gcgaagacgaagcccggaag

SEQ ID NO: 473641 - DNA, 20 bp, mouse
ggccaccgctgcgccgccac

SEQ ID NO: 473642 - DNA, 20 bp, mouse
ggtcccgcctcccgcccgtt

SEQ ID NO: 473643 - DNA, 20 bp, mouse
ggagcgaggcgcaagatcga

SEQ ID NO: 473644 - DNA, 20 bp, mouse
gggccctggtcggaccggag

SEQ ID NO: 473645 - DNA, 20 bp, mouse
gctgcagcagtgccccgagc

SEQ ID NO: 473646 - DNA, 20 bp, mouse
gcaccaggaggccagactgg

SEQ ID NO: 473647 - DNA, 20 bp, mouse
gccgcaccaggaggccagac

SEQ ID NO: 473648 - DNA, 20 bp, mouse
ggagcagggagggtctacag

SEQ ID NO: 473649 - DNA, 20 bp, mouse
gtgtctgcaaatcccatcac

SEQ ID NO: 473650 - DNA, 20 bp, mouse
ggtaatgtgagagcccggag

SEQ ID NO: 473651 - DNA, 20 bp, mouse
gaatcccatcaccggagcaa

SEQ ID NO: 473652 - DNA, 20 bp, mouse
gcgatcgtctcgggcaggac

SEQ ID NO: 473653 - DNA, 20 bp, mouse
gatggcttcgccgcaccagg

SEQ ID NO: 473654 - DNA, 20 bp, mouse
ggagtcttcgctttcgtact

SEQ ID NO: 473655 - DNA, 20 bp, mouse
gagggctgtccgatcgtctc

SEQ ID NO: 473656 - DNA, 20 bp, mouse
ggcagtgacaaccgtgacag

SEQ ID NO: 473657 - DNA, 20 bp, mouse
ggctagcagtacctaaccgc

SEQ ID NO: 473658 - DNA, 20 bp, mouse
gtgccgtggagacagagtca

SEQ ID NO: 473659 - DNA, 20 bp, mouse
gtaggaagatgactgtgggg

SEQ ID NO: 473660 - DNA, 20 bp, mouse
ggcccctgactctgtctcca

SEQ ID NO: 473661 - DNA, 20 bp, mouse
gtagttaggaagatgactgt

SEQ ID NO: 473662 - DNA, 20 bp, mouse
gcaaggctaaagccatgaag

SEQ ID NO: 473663 - DNA, 20 bp, mouse
gtcaggggcgtgtcatcaaa

SEQ ID NO: 473664 - DNA, 20 bp, mouse
gaccgtgacagcggcgccgg

SEQ ID NO: 473665 - DNA, 20 bp, mouse
gagcaaggaatcctcaagag

SEQ ID NO: 473666 - DNA, 20 bp, mouse
gaggccgccgaggctccaca

SEQ ID NO: 473667 - DNA, 20 bp, mouse
gcgccaggcgcaggccgccg

SEQ ID NO: 473668 - DNA, 20 bp, mouse
ggtgctgtgcgtcggcggag

SEQ ID NO: 473669 - DNA, 20 bp, mouse
gggaccaggtggaggcatca

SEQ ID NO: 473670 - DNA, 20 bp, mouse
gtggcgctcaatgtcaccaa

SEQ ID NO: 473671 - DNA, 20 bp, mouse
ggaggatggggaccaggtgg

SEQ ID NO: 473672 - DNA, 20 bp, mouse
gtgtcaccaagggcccgcgt

SEQ ID NO: 473673 - DNA, 20 bp, mouse
gacattgagcgccagcgccg

SEQ ID NO: 473674 - DNA, 20 bp, mouse
ggaatgagcgccagatacca

SEQ ID NO: 473675 - DNA, 20 bp, mouse
ggtggggtgctgtgcgtcgg

SEQ ID NO: 473676 - DNA, 20 bp, mouse
ggcctagtcgcagaacgctg

SEQ ID NO: 473677 - DNA, 20 bp, mouse
ggcgctacagaaggcgactg

SEQ ID NO: 473678 - DNA, 20 bp, mouse
gagcatccaggatcaggagg

SEQ ID NO: 473679 - DNA, 20 bp, mouse
ggccgcagcgttctgcgact

SEQ ID NO: 473680 - DNA, 20 bp, mouse
gtgagcccccaggtcagagt

SEQ ID NO: 473681 - DNA, 20 bp, mouse
gccagcgggcagaatcccag

SEQ ID NO: 473682 - DNA, 20 bp, mouse
gactccagtgtaagatgctc

SEQ ID NO: 473683 - DNA, 20 bp, mouse
ggatgatttgaggagcgcgg

SEQ ID NO: 473684 - DNA, 20 bp, mouse
gatttgaggagcgcggtggg

SEQ ID NO: 473685 - DNA, 20 bp, mouse
gcgttctgcgactaggcttg

SEQ ID NO: 473686 - DNA, 20 bp, mouse
ggccacggcaagagccacgg

SEQ ID NO: 473687 - DNA, 20 bp, mouse
gggaaggcgcgcagagtcca

SEQ ID NO: 473688 - DNA, 20 bp, mouse
gagtccagggcagcgctgag

SEQ ID NO: 473689 - DNA, 20 bp, mouse
gggagagaagcccggacccg

SEQ ID NO: 473690 - DNA, 20 bp, mouse
gtccgggcttctctccgccg

SEQ ID NO: 473691 - DNA, 20 bp, mouse
ggccacggcggagagaagcc

SEQ ID NO: 473692 - DNA, 20 bp, mouse
gtccgccgtggctcttgccg

SEQ ID NO: 473693 - DNA, 20 bp, mouse
gtgctgcgggagccaggacg

SEQ ID NO: 473694 - DNA, 20 bp, mouse
gctcctgggtccccgggtcc

SEQ ID NO: 473695 - DNA, 20 bp, mouse
gaggacgcggagcccggtta

SEQ ID NO: 473696 - DNA, 20 bp, mouse
ggcgcgtgccgctcgcagag

SEQ ID NO: 473697 - DNA, 20 bp, mouse
gcgctcgcagagaggcagct

SEQ ID NO: 473698 - DNA, 20 bp, mouse
gagactcctggaggccccag

SEQ ID NO: 473699 - DNA, 20 bp, mouse
gagctgggtgtccagagccg

SEQ ID NO: 473700 - DNA, 20 bp, mouse
gtacgtactgtagacgaggt

SEQ ID NO: 473701 - DNA, 20 bp, mouse
gcacctgtgtagataggtca

SEQ ID NO: 473702 - DNA, 20 bp, mouse
gcccgcgcccgggactaggc

SEQ ID NO: 473703 - DNA, 20 bp, mouse
ggcgccccgcgcccgggact

SEQ ID NO: 473704 - DNA, 20 bp, mouse
gcgcgctgcggccacggctc

SEQ ID NO: 473705 - DNA, 20 bp, mouse
ggtgagcgccaagagactcc

SEQ ID NO: 473706 - DNA, 20 bp, mouse
ggtggggttctggagtgaag

SEQ ID NO: 473707 - DNA, 20 bp, mouse
gtcttacccagggatgtagt

SEQ ID NO: 473708 - DNA, 20 bp, mouse
gctgaagaggcccaaagcca

SEQ ID NO: 473709 - DNA, 20 bp, mouse
ggagctcccagctcttaccc

SEQ ID NO: 473710 - DNA, 20 bp, mouse
gctgtcaagggcaaaaactg

SEQ ID NO: 473711 - DNA, 20 bp, mouse
gagaaccccactacatccct

SEQ ID NO: 473712 - DNA, 20 bp, mouse
gagaaagggctgaaccagca

SEQ ID NO: 473713 - DNA, 20 bp, mouse
gctctgaggtggaactgtag

SEQ ID NO: 473714 - DNA, 20 bp, mouse
gcccaaagccagggctacta

SEQ ID NO: 473715 - DNA, 20 bp, mouse
gcaggcaacaggtctcttca

SEQ ID NO: 473716 - DNA, 20 bp, mouse
gcagggcccagagtccctcc

SEQ ID NO: 473717 - DNA, 20 bp, mouse
gaagtgttgaccacagccat

SEQ ID NO: 473718 - DNA, 20 bp, mouse
ggcccagagtccctcctgga

SEQ ID NO: 473719 - DNA, 20 bp, mouse
ggccctggacacagtacaca

SEQ ID NO: 473720 - DNA, 20 bp, mouse
gggtcaacacttccatccca

SEQ ID NO: 473721 - DNA, 20 bp, mouse
gcaggaaggactggacaccc

SEQ ID NO: 473722 - DNA, 20 bp, mouse
ggcgccagttcccatggctg

SEQ ID NO: 473723 - DNA, 20 bp, mouse
gggaactgcgccagttccca

SEQ ID NO: 473724 - DNA, 20 bp, mouse
gtatggaaaggggaatctag

SEQ ID NO: 473725 - DNA, 20 bp, mouse
gggggtcaagatgagaactg

SEQ ID NO: 473726 - DNA, 20 bp, mouse
ggagctcccgggctccgtag

SEQ ID NO: 473727 - DNA, 20 bp, mouse
gggagccgagctccgaggga

SEQ ID NO: 473728 - DNA, 20 bp, mouse
gggcgggagccgagctccga

SEQ ID NO: 473729 - DNA, 20 bp, mouse
gcggagaattcgcaccgcta

SEQ ID NO: 473730 - DNA, 20 bp, mouse
gtcgcaccgctacggagccc

SEQ ID NO: 473731 - DNA, 20 bp, mouse
gagggaaccacgctgtccta

SEQ ID NO: 473732 - DNA, 20 bp, mouse
ggtgcccaggtcttcagggt

SEQ ID NO: 473733 - DNA, 20 bp, mouse
ggcccgggagctcgggaggc

SEQ ID NO: 473734 - DNA, 20 bp, mouse
gaccccaggagcaaatacga

SEQ ID NO: 473735 - DNA, 20 bp, mouse
gccttcaaaaaagaacggtg

SEQ ID NO: 473736 - DNA, 20 bp, mouse
gtgtgctgaattgagaaggt

SEQ ID NO: 473737 - DNA, 20 bp, mouse
gccaggctgagtgagcagat

SEQ ID NO: 473738 - DNA, 20 bp, mouse
gtgaattgagaaggtgggtg

SEQ ID NO: 473739 - DNA, 20 bp, mouse
ggagggacgctaagtgtgcc

SEQ ID NO: 473740 - DNA, 20 bp, mouse
ggcggccctagggacatggt

SEQ ID NO: 473741 - DNA, 20 bp, mouse
gctagggccgctgaaattcc

SEQ ID NO: 473742 - DNA, 20 bp, mouse
gaggctaagtgtgcaagaga

SEQ ID NO: 473743 - DNA, 20 bp, mouse
gtcggacccggggccatctg

SEQ ID NO: 473744 - DNA, 20 bp, mouse
gcaacgggacagtaagggaa

SEQ ID NO: 473745 - DNA, 20 bp, mouse
gagttgaagcttggcagtca

SEQ ID NO: 473746 - DNA, 20 bp, mouse
gccgcggagaaacccgacag

SEQ ID NO: 473747 - DNA, 20 bp, mouse
ggctcggctgcaggcaagag

SEQ ID NO: 473748 - DNA, 20 bp, mouse
ggtggcgccggggagaacga

SEQ ID NO: 473749 - DNA, 20 bp, mouse
ggaatcctctgcagtagccg

SEQ ID NO: 473750 - DNA, 20 bp, mouse
gttctccgcggctactgcag

SEQ ID NO: 473751 - DNA, 20 bp, mouse
ggcggcggccgcaactgaag

SEQ ID NO: 473752 - DNA, 20 bp, mouse
gctgctgcagacgaaaaccg

SEQ ID NO: 473753 - DNA, 20 bp, mouse
gcgtccccttcccccactgt

SEQ ID NO: 473754 - DNA, 20 bp, mouse
gccctcgtccgtgtccagta

SEQ ID NO: 473755 - DNA, 20 bp, mouse
gtccacgggagcgggccggg

SEQ ID NO: 473756 - DNA, 20 bp, mouse
ggtgagtacgggaagcatgg

SEQ ID NO: 473757 - DNA, 20 bp, mouse
gggtgtctgcgcagcgtcgg

SEQ ID NO: 473758 - DNA, 20 bp, mouse
gggaggcagcgcgggcctag

SEQ ID NO: 473759 - DNA, 20 bp, mouse
gtgcgcagcgtcggcgggag

SEQ ID NO: 473760 - DNA, 20 bp, mouse
gtgcggtgtctgcgcagcgt

SEQ ID NO: 473761 - DNA, 20 bp, mouse
ggaagtgaggtcgtgggctg

SEQ ID NO: 473762 - DNA, 20 bp, mouse
gcccagacgacgctcggttg

SEQ ID NO: 473763 - DNA, 20 bp, mouse
gccctctcgctggaaaacgt

SEQ ID NO: 473764 - DNA, 20 bp, mouse
gctcaggccaccgtgagtac

SEQ ID NO: 473765 - DNA, 20 bp, mouse
gtcggagggtaccttagcaa

SEQ ID NO: 473766 - DNA, 20 bp, mouse
gacgccggcggagggacggt

SEQ ID NO: 473767 - DNA, 20 bp, mouse
ggagccgcgcgtgccggggt

SEQ ID NO: 473768 - DNA, 20 bp, mouse
gcgtcacgccggcggaggga

SEQ ID NO: 473769 - DNA, 20 bp, mouse
gcggagcgcgaatgaccgag

SEQ ID NO: 473770 - DNA, 20 bp, mouse
gcgccgcgggggcccgaagg

SEQ ID NO: 473771 - DNA, 20 bp, mouse
gcgctagtgcgtcacgccgg

SEQ ID NO: 473772 - DNA, 20 bp, mouse
gacccggaggatcccaggtg

SEQ ID NO: 473773 - DNA, 20 bp, mouse
gagtgcgtcacgccggcgga

SEQ ID NO: 473774 - DNA, 20 bp, mouse
gggacgagccgcgcgtgccg

SEQ ID NO: 473775 - DNA, 20 bp, mouse
gccgctacccggaggatccc

SEQ ID NO: 473776 - DNA, 20 bp, mouse
gatgcagcatggtgaacact

SEQ ID NO: 473777 - DNA, 20 bp, mouse
gagcatggtgaacactgggc

SEQ ID NO: 473778 - DNA, 20 bp, mouse
gaggtcaccaggcctactgg

SEQ ID NO: 473779 - DNA, 20 bp, mouse
gtctggctgacaccatgaaa

SEQ ID NO: 473780 - DNA, 20 bp, mouse
gtcactgagaatcctccagt

SEQ ID NO: 473781 - DNA, 20 bp, mouse
gaagggtcagccagcctgta

SEQ ID NO: 473782 - DNA, 20 bp, mouse
gcaaaggtcaccaggcctac

SEQ ID NO: 473783 - DNA, 20 bp, mouse
gatcctcgaagggattattc

SEQ ID NO: 473784 - DNA, 20 bp, mouse
gcatggctgttaagggtcaa

SEQ ID NO: 473785 - DNA, 20 bp, mouse
gaattcaggaggtatatggt

SEQ ID NO: 473786 - DNA, 20 bp, mouse
gagagaccatgtggccactc

SEQ ID NO: 473787 - DNA, 20 bp, mouse
gacgccgcagaggagagcac

SEQ ID NO: 473788 - DNA, 20 bp, mouse
gagaatctcgttgagagctg

SEQ ID NO: 473789 - DNA, 20 bp, mouse
gccatgtggccactcaggtt

SEQ ID NO: 473790 - DNA, 20 bp, mouse
ggccaggtggtcagtagatg

SEQ ID NO: 473791 - DNA, 20 bp, mouse
gcaggctcctagagaccatg

SEQ ID NO: 473792 - DNA, 20 bp, mouse
gcagccagccccaacctgag

SEQ ID NO: 473793 - DNA, 20 bp, mouse
ggccagcccagacgccgcag

SEQ ID NO: 473794 - DNA, 20 bp, mouse
ggtggtcagtagatggggaa

SEQ ID NO: 473795 - DNA, 20 bp, mouse
ggtgtttcatgacttcaaac

SEQ ID NO: 473796 - DNA, 20 bp, mouse
ggccacagcgccatggaggg

SEQ ID NO: 473797 - DNA, 20 bp, mouse
gggcgccgcgcctccctcca

SEQ ID NO: 473798 - DNA, 20 bp, mouse
gggagccacagcgccatgga

SEQ ID NO: 473799 - DNA, 20 bp, mouse
gcggcgcgggagcccaaggt

SEQ ID NO: 473800 - DNA, 20 bp, mouse
gtgcggggccccggccaatc

SEQ ID NO: 473801 - DNA, 20 bp, mouse
ggcgggagcccaaggtcggt

SEQ ID NO: 473802 - DNA, 20 bp, mouse
gggctcgccacgctcggtca

SEQ ID NO: 473803 - DNA, 20 bp, mouse
gcgccacgctcggtcacggg

SEQ ID NO: 473804 - DNA, 20 bp, mouse
gggggccccggccaatcggg

SEQ ID NO: 473805 - DNA, 20 bp, mouse
ggcgcggagccacagcgcca

SEQ ID NO: 473806 - DNA, 20 bp, mouse
gccggagcgggagcccaacc

SEQ ID NO: 473807 - DNA, 20 bp, mouse
gacagagcggtgcagaactg

SEQ ID NO: 473808 - DNA, 20 bp, mouse
ggctctgtgcagctccgggt

SEQ ID NO: 473809 - DNA, 20 bp, mouse
gcgagcagcagccccagcag

SEQ ID NO: 473810 - DNA, 20 bp, mouse
ggacttgccgggagcccggg

SEQ ID NO: 473811 - DNA, 20 bp, mouse
gcagcccgcagggtgagtat

SEQ ID NO: 473812 - DNA, 20 bp, mouse
gggtgagtatcggcctcgag

SEQ ID NO: 473813 - DNA, 20 bp, mouse
ggtgcagaactggggctgag

SEQ ID NO: 473814 - DNA, 20 bp, mouse
gcaccgctctgtgcagctcc

SEQ ID NO: 473815 - DNA, 20 bp, mouse
gcagagacaatcgcgccgag

SEQ ID NO: 473816 - DNA, 20 bp, mouse
gcaccgcagacggcgcgagg

SEQ ID NO: 473817 - DNA, 20 bp, mouse
gcgtctgcggtgcacagcct

SEQ ID NO: 473818 - DNA, 20 bp, mouse
ggcacagcctcggcaggagg

SEQ ID NO: 473819 - DNA, 20 bp, mouse
gcagggcgcaggggacgcga

SEQ ID NO: 473820 - DNA, 20 bp, mouse
gaagagccagggagccacgg

SEQ ID NO: 473821 - DNA, 20 bp, mouse
gcagcacagcggccaggccg

SEQ ID NO: 473822 - DNA, 20 bp, mouse
ggccacggaggcatattgcg

SEQ ID NO: 473823 - DNA, 20 bp, mouse
ggagcaaaagcagcgggagg

SEQ ID NO: 473824 - DNA, 20 bp, mouse
gtcgccatggcgaagagcca

SEQ ID NO: 473825 - DNA, 20 bp, mouse
gctccccctcgcgccgtctg

SEQ ID NO: 473826 - DNA, 20 bp, mouse
gagtccgagccagggcgcaa

SEQ ID NO: 473827 - DNA, 20 bp, mouse
ggtgcaatcgaacttggtcg

SEQ ID NO: 473828 - DNA, 20 bp, mouse
gcgtggccttccagatctct

SEQ ID NO: 473829 - DNA, 20 bp, mouse
ggctgcaatgctgagagggt

SEQ ID NO: 473830 - DNA, 20 bp, mouse
gagagagaaagtccgagcca

SEQ ID NO: 473831 - DNA, 20 bp, mouse
ggcaggggcgagaccccgag

SEQ ID NO: 473832 - DNA, 20 bp, mouse
gagagtggacaaggcaggtg

SEQ ID NO: 473833 - DNA, 20 bp, mouse
gtgagagggtaggtgcgagg

SEQ ID NO: 473834 - DNA, 20 bp, mouse
ggggagttcgcccagagatc

SEQ ID NO: 473835 - DNA, 20 bp, mouse
gccggaagtgcaatcgaact

SEQ ID NO: 473836 - DNA, 20 bp, mouse
ggctgcaagcggatagagtt

SEQ ID NO: 473837 - DNA, 20 bp, mouse
gttccggcgactgatcgcag

SEQ ID NO: 473838 - DNA, 20 bp, mouse
gctggagatagtgcaagcgg

SEQ ID NO: 473839 - DNA, 20 bp, mouse
gggctggcgtacgctgcaag

SEQ ID NO: 473840 - DNA, 20 bp, mouse
gcagcctcagaggcacccgg

SEQ ID NO: 473841 - DNA, 20 bp, mouse
gtcccggccggtaatggaag

SEQ ID NO: 473842 - DNA, 20 bp, mouse
ggtgcaagccaaggttccat

SEQ ID NO: 473843 - DNA, 20 bp, mouse
ggactgagctacgcgagaag

SEQ ID NO: 473844 - DNA, 20 bp, mouse
gcaaggctcccggccggtaa

SEQ ID NO: 473845 - DNA, 20 bp, mouse
gttgctggagatagtgcaag

SEQ ID NO: 473846 - DNA, 20 bp, mouse
gaacgcgcgatggagcgagt

SEQ ID NO: 473847 - DNA, 20 bp, mouse
ggcgatggagcgagtaggtg

SEQ ID NO: 473848 - DNA, 20 bp, mouse
gttccagccgacctaggatc

SEQ ID NO: 473849 - DNA, 20 bp, mouse
ggtctccccggaacgcgcga

SEQ ID NO: 473850 - DNA, 20 bp, mouse
ggattccagaagctactctg

SEQ ID NO: 473851 - DNA, 20 bp, mouse
gcgcccgggctctaagacgt

SEQ ID NO: 473852 - DNA, 20 bp, mouse
gtgaggtttgaccggcctgg

SEQ ID NO: 473853 - DNA, 20 bp, mouse
gggtttgaccggcctggcgg

SEQ ID NO: 473854 - DNA, 20 bp, mouse
gtcggctggaatccaccctg

SEQ ID NO: 473855 - DNA, 20 bp, mouse
gattccacttccggtctccc

SEQ ID NO: 473856 - DNA, 20 bp, mouse
gcgcagagccgactctccgg

SEQ ID NO: 473857 - DNA, 20 bp, mouse
gtggctgagactgcgccggg

SEQ ID NO: 473858 - DNA, 20 bp, mouse
gctctccggaggagagcggg

SEQ ID NO: 473859 - DNA, 20 bp, mouse
gcgactctccggaggagagc

SEQ ID NO: 473860 - DNA, 20 bp, mouse
gaaccgcagagccgactctc

SEQ ID NO: 473861 - DNA, 20 bp, mouse
gtcagccacccgctctcctc

SEQ ID NO: 473862 - DNA, 20 bp, mouse
gagcagcctgccgggacaac

SEQ ID NO: 473863 - DNA, 20 bp, mouse
gcgggtggctgagactgcgc

SEQ ID NO: 473864 - DNA, 20 bp, mouse
gggtccgcagcgccgaccat

SEQ ID NO: 473865 - DNA, 20 bp, mouse
gtacgaacttccggttgtcc

SEQ ID NO: 473866 - DNA, 20 bp, mouse
ggggtctccggctgccgagg

SEQ ID NO: 473867 - DNA, 20 bp, mouse
gccagaggctggcacccggg

SEQ ID NO: 473868 - DNA, 20 bp, mouse
ggagcatcgcgcagccgcct

SEQ ID NO: 473869 - DNA, 20 bp, mouse
gacccgggaggcctgcgccg

SEQ ID NO: 473870 - DNA, 20 bp, mouse
gaggcctgcgccggggtctc

SEQ ID NO: 473871 - DNA, 20 bp, mouse
gcggcggcgcgggttcttcc

SEQ ID NO: 473872 - DNA, 20 bp, mouse
ggactcggctctgcgagcga

SEQ ID NO: 473873 - DNA, 20 bp, mouse
gagccccagaggctggcacc

SEQ ID NO: 473874 - DNA, 20 bp, mouse
gtgggaggccgaagcggact

SEQ ID NO: 473875 - DNA, 20 bp, mouse
gtagcattcccgggaccggg

SEQ ID NO: 473876 - DNA, 20 bp, mouse
gaccgaggcggcagtatgga

SEQ ID NO: 473877 - DNA, 20 bp, mouse
gggagggcgagagcacgttg

SEQ ID NO: 473878 - DNA, 20 bp, mouse
gagcgaccgaggcggcagta

SEQ ID NO: 473879 - DNA, 20 bp, mouse
ggtggcggcagcgaccgagg

SEQ ID NO: 473880 - DNA, 20 bp, mouse
gtgctccgcgatagtggctg

SEQ ID NO: 473881 - DNA, 20 bp, mouse
gtatcgcggagcatgacggg

SEQ ID NO: 473882 - DNA, 20 bp, mouse
gacgggaggctggagcgtag

SEQ ID NO: 473883 - DNA, 20 bp, mouse
ggccctccatactgccgcct

SEQ ID NO: 473884 - DNA, 20 bp, mouse
gcccggatgagagcccggga

SEQ ID NO: 473885 - DNA, 20 bp, mouse
gacgcgctgcgagtaggacc

SEQ ID NO: 473886 - DNA, 20 bp, mouse
gctgaaggtgtagcccgaaa

SEQ ID NO: 473887 - DNA, 20 bp, mouse
gggcccggcacctacgtggt

SEQ ID NO: 473888 - DNA, 20 bp, mouse
ggaggtggagatttccatca

SEQ ID NO: 473889 - DNA, 20 bp, mouse
gaggaagccgaaggccccag

SEQ ID NO: 473890 - DNA, 20 bp, mouse
gacagcaacgccgaccacgt

SEQ ID NO: 473891 - DNA, 20 bp, mouse
gcctccgcggggcatgatgg

SEQ ID NO: 473892 - DNA, 20 bp, mouse
gagggggcccggcacctacg

SEQ ID NO: 473893 - DNA, 20 bp, mouse
gcgccagagaagggcccgcg

SEQ ID NO: 473894 - DNA, 20 bp, mouse
gtcatggcggcttccatttc

SEQ ID NO: 473895 - DNA, 20 bp, mouse
gttgaaggccgagcctccag

SEQ ID NO: 473896 - DNA, 20 bp, mouse
gttgcggtggcgaggaacca

SEQ ID NO: 473897 - DNA, 20 bp, mouse
ggttggggttcgccttgcgg

SEQ ID NO: 473898 - DNA, 20 bp, mouse
gtaatctattcactaatccc

SEQ ID NO: 473899 - DNA, 20 bp, mouse
gggttcgccttgcggtggcg

SEQ ID NO: 473900 - DNA, 20 bp, mouse
gccgcaggaaggatcctacc

SEQ ID NO: 473901 - DNA, 20 bp, mouse
ggcggcctgggcgacccggt

SEQ ID NO: 473902 - DNA, 20 bp, mouse
gccgggcagcgacgacacgg

SEQ ID NO: 473903 - DNA, 20 bp, mouse
ggacacggaggttagtccga

SEQ ID NO: 473904 - DNA, 20 bp, mouse
gcaggtaggttggcgaagag

SEQ ID NO: 473905 - DNA, 20 bp, mouse
gctttgccgggagggtggac

SEQ ID NO: 473906 - DNA, 20 bp, mouse
gaggctgtcggtgcagaggt

SEQ ID NO: 473907 - DNA, 20 bp, mouse
gttgctgctgggactcgggg

SEQ ID NO: 473908 - DNA, 20 bp, mouse
gccgccatgaagagagtagg

SEQ ID NO: 473909 - DNA, 20 bp, mouse
ggaaccgccatgaagagagt

SEQ ID NO: 473910 - DNA, 20 bp, mouse
gtgggactcggggaggctgt

SEQ ID NO: 473911 - DNA, 20 bp, mouse
ggtcttgctgctgggactcg

SEQ ID NO: 473912 - DNA, 20 bp, mouse
gcagcaggggcggtactacc

SEQ ID NO: 473913 - DNA, 20 bp, mouse
ggtctcagatggcagcgcgg

SEQ ID NO: 473914 - DNA, 20 bp, mouse
gggggaggctgtcggtgcag

SEQ ID NO: 473915 - DNA, 20 bp, mouse
gggttccttcccgctcacac

SEQ ID NO: 473916 - DNA, 20 bp, mouse
ggtcagcagggacagtcgag

SEQ ID NO: 473917 - DNA, 20 bp, mouse
gagaggagggaccttctcgg

SEQ ID NO: 473918 - DNA, 20 bp, mouse
gaggcctggcaggctcggtt

SEQ ID NO: 473919 - DNA, 20 bp, mouse
ggcagggacagtcgagagga

SEQ ID NO: 473920 - DNA, 20 bp, mouse
gcctagcgcactcaccgtta

SEQ ID NO: 473921 - DNA, 20 bp, mouse
gacggtgagtgcgctaggcc

SEQ ID NO: 473922 - DNA, 20 bp, mouse
gtgagtgcgctaggcctggc

SEQ ID NO: 473923 - DNA, 20 bp, mouse
gctcggttgggcccccgaga

SEQ ID NO: 473924 - DNA, 20 bp, mouse
gccaggcccggatcactcac

SEQ ID NO: 473925 - DNA, 20 bp, mouse
ggtggggaggagcacgtgag

SEQ ID NO: 473926 - DNA, 20 bp, mouse
gagcaggagtgtgccagccg

SEQ ID NO: 473927 - DNA, 20 bp, mouse
gacaagaaagcccacagccg

SEQ ID NO: 473928 - DNA, 20 bp, mouse
ggaaagcccacagccgcggc

SEQ ID NO: 473929 - DNA, 20 bp, mouse
gctgcttggacagaaggccg

SEQ ID NO: 473930 - DNA, 20 bp, mouse
ggtgtgccagccgcggctgt

SEQ ID NO: 473931 - DNA, 20 bp, mouse
ggaggccaatcccctgtcag

SEQ ID NO: 473932 - DNA, 20 bp, mouse
gatggagaggtgagagatac

SEQ ID NO: 473933 - DNA, 20 bp, mouse
ggggccagcttaggaggcct

SEQ ID NO: 473934 - DNA, 20 bp, mouse
gagggaagccgtgtcacagt

SEQ ID NO: 473935 - DNA, 20 bp, mouse
gtgtttattcaagaggagcc

SEQ ID NO: 473936 - DNA, 20 bp, mouse
gaggaggcgataggaaccag

SEQ ID NO: 473937 - DNA, 20 bp, mouse
ggtcagctgccaggccgctc

SEQ ID NO: 473938 - DNA, 20 bp, mouse
gtccaagccccgagctgcag

SEQ ID NO: 473939 - DNA, 20 bp, mouse
gggaagagaaggaacggctc

SEQ ID NO: 473940 - DNA, 20 bp, mouse
gtggggcgtaaggacgacag

SEQ ID NO: 473941 - DNA, 20 bp, mouse
gacctgacgaccctccatgg

SEQ ID NO: 473942 - DNA, 20 bp, mouse
gcgctcgggccttccactcc

SEQ ID NO: 473943 - DNA, 20 bp, mouse
ggtggaaggcccgagcggcc

SEQ ID NO: 473944 - DNA, 20 bp, mouse
gcactcccggagccagcctc

SEQ ID NO: 473945 - DNA, 20 bp, mouse
ggcctccgccggtaacagga

SEQ ID NO: 473946 - DNA, 20 bp, mouse
ggagagagttaggttaagag

SEQ ID NO: 473947 - DNA, 20 bp, mouse
gtattcctgcgggaccccag

SEQ ID NO: 473948 - DNA, 20 bp, mouse
gcggatgcagcctcttgggt

SEQ ID NO: 473949 - DNA, 20 bp, mouse
gtctccctggctccacagga

SEQ ID NO: 473950 - DNA, 20 bp, mouse
gttgtctataaggaaagcaa

SEQ ID NO: 473951 - DNA, 20 bp, mouse
gtaactctctctgggattag

SEQ ID NO: 473952 - DNA, 20 bp, mouse
gtccctcctggaagatgtcc

SEQ ID NO: 473953 - DNA, 20 bp, mouse
gggtccacctgcagcccctg

SEQ ID NO: 473954 - DNA, 20 bp, mouse
gggcctctccctggctccac

SEQ ID NO: 473955 - DNA, 20 bp, mouse
gaacttctgtcccacccaag

SEQ ID NO: 473956 - DNA, 20 bp, mouse
gcagctcgtcaggcttgcgg

SEQ ID NO: 473957 - DNA, 20 bp, mouse
gcgtgcagtgagctccgtgc

SEQ ID NO: 473958 - DNA, 20 bp, mouse
gccttgagtgggctgaatgg

SEQ ID NO: 473959 - DNA, 20 bp, mouse
ggggaggggcacagtactgt

SEQ ID NO: 473960 - DNA, 20 bp, mouse
gcttgcgggggtctacggtg

SEQ ID NO: 473961 - DNA, 20 bp, mouse
ggttgtgcacagcccttgag

SEQ ID NO: 473962 - DNA, 20 bp, mouse
gaggggcacagtactgtggg

SEQ ID NO: 473963 - DNA, 20 bp, mouse
ggtcagtacggagtcccaag

SEQ ID NO: 473964 - DNA, 20 bp, mouse
gccagggccccccgccaacg

SEQ ID NO: 473965 - DNA, 20 bp, mouse
gtcaggcttgcgggggtcta

SEQ ID NO: 473966 - DNA, 20 bp, mouse
gggccatggcaggacgtgtg

SEQ ID NO: 473967 - DNA, 20 bp, mouse
gcagagcaaaaacatggcca

SEQ ID NO: 473968 - DNA, 20 bp, mouse
ggtggggcagatgaagaatc

SEQ ID NO: 473969 - DNA, 20 bp, mouse
gactctaaagagataacctg

SEQ ID NO: 473970 - DNA, 20 bp, mouse
gtgccccacacgtcctgcca

SEQ ID NO: 473971 - DNA, 20 bp, mouse
gctttctcctggtaagggca

SEQ ID NO: 473972 - DNA, 20 bp, mouse
gacttctcagagcaaaaaca

SEQ ID NO: 473973 - DNA, 20 bp, mouse
gacgacctttctcctggtaa

SEQ ID NO: 473974 - DNA, 20 bp, mouse
gtgagctggcccaagagggt

SEQ ID NO: 473975 - DNA, 20 bp, mouse
gtggcccaagagggttggga

SEQ ID NO: 473976 - DNA, 20 bp, mouse
ggagccgcgcgtcctggtaa

SEQ ID NO: 473977 - DNA, 20 bp, mouse
gtcctggtaacggcgctcgg

SEQ ID NO: 473978 - DNA, 20 bp, mouse
ggcggagggaggcggagacg

SEQ ID NO: 473979 - DNA, 20 bp, mouse
ggcggcgggaggcgggtccg

SEQ ID NO: 473980 - DNA, 20 bp, mouse
ggccggcgcggcgacgacac

SEQ ID NO: 473981 - DNA, 20 bp, mouse
ggccgccgagcgccgttacc

SEQ ID NO: 473982 - DNA, 20 bp, mouse
gacgggacaggcgacagccc

SEQ ID NO: 473983 - DNA, 20 bp, mouse
ggcccccgagccgcgcgtcc

SEQ ID NO: 473984 - DNA, 20 bp, mouse
gtggctgcggggaaatgacg

SEQ ID NO: 473985 - DNA, 20 bp, mouse
ggcgccgttaccaggacgcg

SEQ ID NO: 473986 - DNA, 20 bp, mouse
gcccgggaaggagacacctc

SEQ ID NO: 473987 - DNA, 20 bp, mouse
ggactgcagtgccacctctc

SEQ ID NO: 473988 - DNA, 20 bp, mouse
ggtgagagctttctccagag

SEQ ID NO: 473989 - DNA, 20 bp, mouse
gctccggaaagagagccacg

SEQ ID NO: 473990 - DNA, 20 bp, mouse
gtgcgcgagtgggcccggga

SEQ ID NO: 473991 - DNA, 20 bp, mouse
gccacaggcacccagagtag

SEQ ID NO: 473992 - DNA, 20 bp, mouse
ggagtgtagaagcaccccag

SEQ ID NO: 473993 - DNA, 20 bp, mouse
ggagagccacgcggctgtgc

SEQ ID NO: 473994 - DNA, 20 bp, mouse
gagctcgcgcaggttcctgg

SEQ ID NO: 473995 - DNA, 20 bp, mouse
gtcctgccagcacagccgcg

SEQ ID NO: 473996 - DNA, 20 bp, mouse
gtaacgccttaaatcccggt

SEQ ID NO: 473997 - DNA, 20 bp, mouse
gagcatgcacggctccgcca

SEQ ID NO: 473998 - DNA, 20 bp, mouse
gaggtgacttgtccaggtca

SEQ ID NO: 473999 - DNA, 20 bp, mouse
gtcgggacgcgcaaggaggg

SEQ ID NO: 474000 - DNA, 20 bp, mouse
gtcccgggaccagcgagcca

SEQ ID NO: 474001 - DNA, 20 bp, mouse
gggcctggctcgttcttcct

SEQ ID NO: 474002 - DNA, 20 bp, mouse
gcaaggctgaagcgttccaa

SEQ ID NO: 474003 - DNA, 20 bp, mouse
ggcctcgggtcagtcacgaa

SEQ ID NO: 474004 - DNA, 20 bp, mouse
gtacttaacgccttaaatcc

SEQ ID NO: 474005 - DNA, 20 bp, mouse
ggccttggtcggagctctcg

SEQ ID NO: 474006 - DNA, 20 bp, mouse
gagtccttgaagcttcctag

SEQ ID NO: 474007 - DNA, 20 bp, mouse
gaaggactcccgaggttaca

SEQ ID NO: 474008 - DNA, 20 bp, mouse
gatgctactaagtgtccact

SEQ ID NO: 474009 - DNA, 20 bp, mouse
gcaagctcagtggattatca

SEQ ID NO: 474010 - DNA, 20 bp, mouse
gactacttggacctactaga

SEQ ID NO: 474011 - DNA, 20 bp, mouse
gtagtgttccttgtaacctc

SEQ ID NO: 474012 - DNA, 20 bp, mouse
ggactgactgtactgatgct

SEQ ID NO: 474013 - DNA, 20 bp, mouse
gcttatgggctttctcaacg

SEQ ID NO: 474014 - DNA, 20 bp, mouse
ggattatcacggttgcttat

SEQ ID NO: 474015 - DNA, 20 bp, mouse
gtctcaaattgcaagctcag

SEQ ID NO: 474016 - DNA, 20 bp, mouse
gtactagaggagctgtggcc

SEQ ID NO: 474017 - DNA, 20 bp, mouse
gagggcccagggaggttcct

SEQ ID NO: 474018 - DNA, 20 bp, mouse
gaggggctaagggcccaggg

SEQ ID NO: 474019 - DNA, 20 bp, mouse
gacagtatgggcagctttag

SEQ ID NO: 474020 - DNA, 20 bp, mouse
ggggtacccaggaacctccc

SEQ ID NO: 474021 - DNA, 20 bp, mouse
ggggcagctttaggggctaa

SEQ ID NO: 474022 - DNA, 20 bp, mouse
gggtgtctggcagttactag

SEQ ID NO: 474023 - DNA, 20 bp, mouse
gggagctgtggccgggcaga

SEQ ID NO: 474024 - DNA, 20 bp, mouse
gacatcagaccctaatagaa

SEQ ID NO: 474025 - DNA, 20 bp, mouse
gttcctgggtaccctctgcc

SEQ ID NO: 474026 - DNA, 20 bp, mouse
gctgcagaggcgagagccaa

SEQ ID NO: 474027 - DNA, 20 bp, mouse
ggtcaagcggccagggaaag

SEQ ID NO: 474028 - DNA, 20 bp, mouse
ggaggcgagagccaagggcg

SEQ ID NO: 474029 - DNA, 20 bp, mouse
gaagaggcagtgaactgcag

SEQ ID NO: 474030 - DNA, 20 bp, mouse
gtgacgcattagcattagaa

SEQ ID NO: 474031 - DNA, 20 bp, mouse
gagaaagggtcaagcggcca

SEQ ID NO: 474032 - DNA, 20 bp, mouse
ggagactgccccaggcccac

SEQ ID NO: 474033 - DNA, 20 bp, mouse
gcacaggagcacggtggtgt

SEQ ID NO: 474034 - DNA, 20 bp, mouse
gaagctcatatcagccaggt

SEQ ID NO: 474035 - DNA, 20 bp, mouse
gcgtcaggcctgatcttgag

SEQ ID NO: 474036 - DNA, 20 bp, mouse
gagtgtggggccccaacact

SEQ ID NO: 474037 - DNA, 20 bp, mouse
gggacagctgacgggagtgt

SEQ ID NO: 474038 - DNA, 20 bp, mouse
gtggccttgggacagctgac

SEQ ID NO: 474039 - DNA, 20 bp, mouse
gcacaggatggtaagcatgg

SEQ ID NO: 474040 - DNA, 20 bp, mouse
gatggtaagcatggtggact

SEQ ID NO: 474041 - DNA, 20 bp, mouse
ggtccacaggatggtaagca

SEQ ID NO: 474042 - DNA, 20 bp, mouse
gcattggtagaggcccgtgt

SEQ ID NO: 474043 - DNA, 20 bp, mouse
gtattctctaggctcagtgg

SEQ ID NO: 474044 - DNA, 20 bp, mouse
gggtagaggcccgtgttgga

SEQ ID NO: 474045 - DNA, 20 bp, mouse
gtatattggaaacactggat

SEQ ID NO: 474046 - DNA, 20 bp, mouse
gcaccagggcgagagtggga

SEQ ID NO: 474047 - DNA, 20 bp, mouse
gcccccaccagggcgagagt

SEQ ID NO: 474048 - DNA, 20 bp, mouse
gtgcgtcaccgacattcccc

SEQ ID NO: 474049 - DNA, 20 bp, mouse
gctaggtgcgccctgtaggg

SEQ ID NO: 474050 - DNA, 20 bp, mouse
gagagcgagggatacccgag

SEQ ID NO: 474051 - DNA, 20 bp, mouse
gtgccttcccactctcgccc

SEQ ID NO: 474052 - DNA, 20 bp, mouse
gtgcttggcacctccctaca

SEQ ID NO: 474053 - DNA, 20 bp, mouse
gtcccctggcagctgggacc

SEQ ID NO: 474054 - DNA, 20 bp, mouse
ggaagtgctgcggtctttct

SEQ ID NO: 474055 - DNA, 20 bp, mouse
gcctggtgggggaagtgctg

SEQ ID NO: 474056 - DNA, 20 bp, mouse
ggcgaacgggaggtcgagat

SEQ ID NO: 474057 - DNA, 20 bp, mouse
ggcggtcggacgcgaacggg

SEQ ID NO: 474058 - DNA, 20 bp, mouse
gggtgagggcagcacactgc

SEQ ID NO: 474059 - DNA, 20 bp, mouse
gaagggcagcgggacggcag

SEQ ID NO: 474060 - DNA, 20 bp, mouse
gcttcgcccggcttgacagg

SEQ ID NO: 474061 - DNA, 20 bp, mouse
gcgggaggtcgagatgggtg

SEQ ID NO: 474062 - DNA, 20 bp, mouse
gggcagcggtcggacgcgaa

SEQ ID NO: 474063 - DNA, 20 bp, mouse
gccgcttcgcccggcttgac

SEQ ID NO: 474064 - DNA, 20 bp, mouse
ggcagcgggacggcagcggt

SEQ ID NO: 474065 - DNA, 20 bp, mouse
ggccgggcgaagcggcaact

SEQ ID NO: 474066 - DNA, 20 bp, mouse
gctgggcccaacggattaag

SEQ ID NO: 474067 - DNA, 20 bp, mouse
gtccgttgggcccagtaaag

SEQ ID NO: 474068 - DNA, 20 bp, mouse
gggcggccgcgtggcctcgt

SEQ ID NO: 474069 - DNA, 20 bp, mouse
gcgctgcccacgaggccacg

SEQ ID NO: 474070 - DNA, 20 bp, mouse
gcccaggccccttaatccgt

SEQ ID NO: 474071 - DNA, 20 bp, mouse
gctgtgacagaggggaccag

SEQ ID NO: 474072 - DNA, 20 bp, mouse
ggccgctttactgggcccaa

SEQ ID NO: 474073 - DNA, 20 bp, mouse
gagattggcaagggtgtcca

SEQ ID NO: 474074 - DNA, 20 bp, mouse
gggcgttgccgtggcgacgg

SEQ ID NO: 474075 - DNA, 20 bp, mouse
gacggcaacgccgctttact

SEQ ID NO: 474076 - DNA, 20 bp, mouse
gtgcgcagcggcggtggcat

SEQ ID NO: 474077 - DNA, 20 bp, mouse
gcgagaagccggcccagaaa

SEQ ID NO: 474078 - DNA, 20 bp, mouse
ggaagctcacggccacgatg

SEQ ID NO: 474079 - DNA, 20 bp, mouse
gtcgggccgggcggagagcc

SEQ ID NO: 474080 - DNA, 20 bp, mouse
ggcggcggtggcatgggcgc

SEQ ID NO: 474081 - DNA, 20 bp, mouse
ggccgctgcgcagggcccgc

SEQ ID NO: 474082 - DNA, 20 bp, mouse
gcgacgcgagcggctcgggc

SEQ ID NO: 474083 - DNA, 20 bp, mouse
ggccaggggagcgcgcggac

SEQ ID NO: 474084 - DNA, 20 bp, mouse
gtcctctcaccgaggcgccg

SEQ ID NO: 474085 - DNA, 20 bp, mouse
gcgggcaccggtgcgggctg

SEQ ID NO: 474086 - DNA, 20 bp, mouse
gaggagcccgggagcaccac

SEQ ID NO: 474087 - DNA, 20 bp, mouse
ggcaccaccggcagagacat

SEQ ID NO: 474088 - DNA, 20 bp, mouse
gcgaggagccagcccagaat

SEQ ID NO: 474089 - DNA, 20 bp, mouse
ggcccgacagccccgccacc

SEQ ID NO: 474090 - DNA, 20 bp, mouse
ggcgcccatgtctctgccgg

SEQ ID NO: 474091 - DNA, 20 bp, mouse
gtctctgccggtggtgctcc

SEQ ID NO: 474092 - DNA, 20 bp, mouse
gagcggcggctcctgagcgg

SEQ ID NO: 474093 - DNA, 20 bp, mouse
ggaggctgcagagcaccccg

SEQ ID NO: 474094 - DNA, 20 bp, mouse
gcagagacatgggcgcgcgg

SEQ ID NO: 474095 - DNA, 20 bp, mouse
gggagcccgagcgacagcag

SEQ ID NO: 474096 - DNA, 20 bp, mouse
gaaggaagccgagcatggtg

SEQ ID NO: 474097 - DNA, 20 bp, mouse
ggagctaaggaagccgagca

SEQ ID NO: 474098 - DNA, 20 bp, mouse
gtgaagaggggtgccgagaa

SEQ ID NO: 474099 - DNA, 20 bp, mouse
gggaaggaggcccaaaggag

SEQ ID NO: 474100 - DNA, 20 bp, mouse
gcgttccggaacccaggcaa

SEQ ID NO: 474101 - DNA, 20 bp, mouse
gctcctggctaggtcctctg

SEQ ID NO: 474102 - DNA, 20 bp, mouse
ggctgcagcaggtcagcctg

SEQ ID NO: 474103 - DNA, 20 bp, mouse
gcattcagggccgcctggtg

SEQ ID NO: 474104 - DNA, 20 bp, mouse
gactctggagacagtttcca

SEQ ID NO: 474105 - DNA, 20 bp, mouse
gggaggcgatgaggacgcga

SEQ ID NO: 474106 - DNA, 20 bp, mouse
gaggaggtcggtgtccgggt

SEQ ID NO: 474107 - DNA, 20 bp, mouse
ggctggtgctcgggcaggag

SEQ ID NO: 474108 - DNA, 20 bp, mouse
gggcggcgggtcccccgagg

SEQ ID NO: 474109 - DNA, 20 bp, mouse
gcagtggtggaggaggtgtc

SEQ ID NO: 474110 - DNA, 20 bp, mouse
gggtgaggaggtcggtgtcc

SEQ ID NO: 474111 - DNA, 20 bp, mouse
ggtggaggaggtgtccggtg

SEQ ID NO: 474112 - DNA, 20 bp, mouse
ggacgcttcagtgatagctc

SEQ ID NO: 474113 - DNA, 20 bp, mouse
ggagattcctaaggccgagg

SEQ ID NO: 474114 - DNA, 20 bp, mouse
gcacagggacccagtcctag

SEQ ID NO: 474115 - DNA, 20 bp, mouse
gcagggtcgctgtgagacct

SEQ ID NO: 474116 - DNA, 20 bp, mouse
gaggaacaggaagccccgaa

SEQ ID NO: 474117 - DNA, 20 bp, mouse
ggaagccccgaagggtcaaa

SEQ ID NO: 474118 - DNA, 20 bp, mouse
ggaaaccaagaaaagaacga

SEQ ID NO: 474119 - DNA, 20 bp, mouse
gcgggcgcgtaagaaagagt

SEQ ID NO: 474120 - DNA, 20 bp, mouse
gtcgcctcccgcgctctcgt

SEQ ID NO: 474121 - DNA, 20 bp, mouse
ggaaaagaacgacggcttaa

SEQ ID NO: 474122 - DNA, 20 bp, mouse
ggcgggctggagacaaacct

SEQ ID NO: 474123 - DNA, 20 bp, mouse
ggaaatgtgttgtggctgta

SEQ ID NO: 474124 - DNA, 20 bp, mouse
ggtaggcgccgcggaggtga

SEQ ID NO: 474125 - DNA, 20 bp, mouse
gtgggctctaatcctaactc

SEQ ID NO: 474126 - DNA, 20 bp, mouse
gcagagttaagagtccaata

SEQ ID NO: 474127 - DNA, 20 bp, mouse
ggactcttaactctggtcag

SEQ ID NO: 474128 - DNA, 20 bp, mouse
gtcatggcgggagtgaggga

SEQ ID NO: 474129 - DNA, 20 bp, mouse
gtcttaactctggtcagcgg

SEQ ID NO: 474130 - DNA, 20 bp, mouse
gagagcgacgcgagtccacc

SEQ ID NO: 474131 - DNA, 20 bp, mouse
gagttaagagtccaatatgg

SEQ ID NO: 474132 - DNA, 20 bp, mouse
gggggcggacgggatctgag

SEQ ID NO: 474133 - DNA, 20 bp, mouse
gtccaatatggcggacacaa

SEQ ID NO: 474134 - DNA, 20 bp, mouse
gtcagcggcggcaccgggcc

SEQ ID NO: 474135 - DNA, 20 bp, mouse
gtggcggacacaaggggaaa

SEQ ID NO: 474136 - DNA, 20 bp, mouse
gtgtcctgtgaggggagcgg

SEQ ID NO: 474137 - DNA, 20 bp, mouse
gtgttgtcctgtgaggggag

SEQ ID NO: 474138 - DNA, 20 bp, mouse
ggagaggagccagcgagcgg

SEQ ID NO: 474139 - DNA, 20 bp, mouse
gccgccgccgctcccctcac

SEQ ID NO: 474140 - DNA, 20 bp, mouse
gcacaggacaacagccaata

SEQ ID NO: 474141 - DNA, 20 bp, mouse
gttggctgttgtcctgtgag

SEQ ID NO: 474142 - DNA, 20 bp, mouse
gaggacaacagccaatatgg

SEQ ID NO: 474143 - DNA, 20 bp, mouse
gcgcgagaggagccagcgag

SEQ ID NO: 474144 - DNA, 20 bp, mouse
gctcccgcttccaggctcgg

SEQ ID NO: 474145 - DNA, 20 bp, mouse
gccgccgccgagcctggaag

SEQ ID NO: 474146 - DNA, 20 bp, mouse
gacgctcaacagctgctccg

SEQ ID NO: 474147 - DNA, 20 bp, mouse
ggacgcgggcgcatgtttgt

SEQ ID NO: 474148 - DNA, 20 bp, mouse
ggcttccgcactccctgacg

SEQ ID NO: 474149 - DNA, 20 bp, mouse
ggccccggagcgctcgaccc

SEQ ID NO: 474150 - DNA, 20 bp, mouse
gtccggggtcgagcgctccg

SEQ ID NO: 474151 - DNA, 20 bp, mouse
gaaggttccgaggttgccct

SEQ ID NO: 474152 - DNA, 20 bp, mouse
gaagccataggccccagtga

SEQ ID NO: 474153 - DNA, 20 bp, mouse
gaagggtgggatgataggga

SEQ ID NO: 474154 - DNA, 20 bp, mouse
ggcatgtttgtgggcagccc

SEQ ID NO: 474155 - DNA, 20 bp, mouse
gggacatagtgctcaggctg

SEQ ID NO: 474156 - DNA, 20 bp, mouse
gtggtggagggtgcctgatc

SEQ ID NO: 474157 - DNA, 20 bp, mouse
gccctggcagcggccagatc

SEQ ID NO: 474158 - DNA, 20 bp, mouse
ggaccgcaaagtgaagctgg

SEQ ID NO: 474159 - DNA, 20 bp, mouse
gcccttggtgatagtgtaca

SEQ ID NO: 474160 - DNA, 20 bp, mouse
gagcaggtggagagcaggct

SEQ ID NO: 474161 - DNA, 20 bp, mouse
gtgggaccgcaaagtgaagc

SEQ ID NO: 474162 - DNA, 20 bp, mouse
gccgtcctccctccttaaag

SEQ ID NO: 474163 - DNA, 20 bp, mouse
ggccaggccgccgggcacga

SEQ ID NO: 474164 - DNA, 20 bp, mouse
gagctgggcccagaagtagc

SEQ ID NO: 474165 - DNA, 20 bp, mouse
gggagggaggacgggcaaag

SEQ ID NO: 474166 - DNA, 20 bp, mouse
ggccggcccactggaagcgg

SEQ ID NO: 474167 - DNA, 20 bp, mouse
gaagcagggagcgccctcag

SEQ ID NO: 474168 - DNA, 20 bp, mouse
gcggcgaggagggcgaggtg

SEQ ID NO: 474169 - DNA, 20 bp, mouse
gccggccggcccactggaag

SEQ ID NO: 474170 - DNA, 20 bp, mouse
gtcacttccggccggcccac

SEQ ID NO: 474171 - DNA, 20 bp, mouse
gcgccgccgccgcttccagt

SEQ ID NO: 474172 - DNA, 20 bp, mouse
ggagcggggagagacaaggc

SEQ ID NO: 474173 - DNA, 20 bp, mouse
ggcgcggcgcggaggcacgg

SEQ ID NO: 474174 - DNA, 20 bp, mouse
gaccgacgcccgcggtcccg

SEQ ID NO: 474175 - DNA, 20 bp, mouse
gcgggcgtcggttcccgggg

SEQ ID NO: 474176 - DNA, 20 bp, mouse
gtatgcagccgagcggccag

SEQ ID NO: 474177 - DNA, 20 bp, mouse
gcggtggcaggcgagcgcac

SEQ ID NO: 474178 - DNA, 20 bp, mouse
gggagccagccacagccacc

SEQ ID NO: 474179 - DNA, 20 bp, mouse
ggctactctatgcagccgag

SEQ ID NO: 474180 - DNA, 20 bp, mouse
gactcggggcagagcatcca

SEQ ID NO: 474181 - DNA, 20 bp, mouse
ggcacggagccgggtggctg

SEQ ID NO: 474182 - DNA, 20 bp, mouse
ggcgactggcgcgcagctcc

SEQ ID NO: 474183 - DNA, 20 bp, mouse
ggacgcgcacggggaggcag

SEQ ID NO: 474184 - DNA, 20 bp, mouse
gcgctcgcctgccaccgagg

SEQ ID NO: 474185 - DNA, 20 bp, mouse
ggcgcggcacggagcactcg

SEQ ID NO: 474186 - DNA, 20 bp, mouse
ggtagtgggtctgctcacgt

SEQ ID NO: 474187 - DNA, 20 bp, mouse
gtatatgcaagaagtgtagt

SEQ ID NO: 474188 - DNA, 20 bp, mouse
gtcgttgtacaaggaagggg

SEQ ID NO: 474189 - DNA, 20 bp, mouse
ggcaagataactccaaacga

SEQ ID NO: 474190 - DNA, 20 bp, mouse
gggctcgttgtacaaggaag

SEQ ID NO: 474191 - DNA, 20 bp, mouse
gcagcctgcagttctgacaa

SEQ ID NO: 474192 - DNA, 20 bp, mouse
gcaaggcttgttattcccag

SEQ ID NO: 474193 - DNA, 20 bp, mouse
gagcaacttgagctcctctg

SEQ ID NO: 474194 - DNA, 20 bp, mouse
gatctcttacctccaagcag

SEQ ID NO: 474195 - DNA, 20 bp, mouse
gtgcaaagagcgaacctcag

SEQ ID NO: 474196 - DNA, 20 bp, mouse
ggcagggcaggacacaacac

SEQ ID NO: 474197 - DNA, 20 bp, mouse
gtccccgccaccagattgca

SEQ ID NO: 474198 - DNA, 20 bp, mouse
ggtcctgccctgcaatctgg

SEQ ID NO: 474199 - DNA, 20 bp, mouse
gactctggaaaggtccccag

SEQ ID NO: 474200 - DNA, 20 bp, mouse
gtaggagctgctgaacaggg

SEQ ID NO: 474201 - DNA, 20 bp, mouse
gtcacacgtagactcacatg

SEQ ID NO: 474202 - DNA, 20 bp, mouse
gcagggcggtgggtacaggt

SEQ ID NO: 474203 - DNA, 20 bp, mouse
gtacaggtgggtgccagggc

SEQ ID NO: 474204 - DNA, 20 bp, mouse
gtgggtacaggtgggtgcca

SEQ ID NO: 474205 - DNA, 20 bp, mouse
gctactggcagactcatccc

SEQ ID NO: 474206 - DNA, 20 bp, mouse
ggaagcgtgagataagagtg

SEQ ID NO: 474207 - DNA, 20 bp, mouse
gctggaaatgagtagagaaa

SEQ ID NO: 474208 - DNA, 20 bp, mouse
gggtagacaaagctaagaag

SEQ ID NO: 474209 - DNA, 20 bp, mouse
gactccgtggggtcaggcag

SEQ ID NO: 474210 - DNA, 20 bp, mouse
gggggtaaaacggccaggaa

SEQ ID NO: 474211 - DNA, 20 bp, mouse
gacccccatcgagaactggt

SEQ ID NO: 474212 - DNA, 20 bp, mouse
gaactggacgccagagtcca

SEQ ID NO: 474213 - DNA, 20 bp, mouse
gtagcaaatgagacactagg

SEQ ID NO: 474214 - DNA, 20 bp, mouse
ggtctcccaccagttctcga

SEQ ID NO: 474215 - DNA, 20 bp, mouse
gggcactcctcatttttcta

SEQ ID NO: 474216 - DNA, 20 bp, mouse
gtatctaagtggtctccaac

SEQ ID NO: 474217 - DNA, 20 bp, mouse
ggatagcgaagcggactgga

SEQ ID NO: 474218 - DNA, 20 bp, mouse
ggacctgtccagacaagccg

SEQ ID NO: 474219 - DNA, 20 bp, mouse
ggggccagggtaccatccag

SEQ ID NO: 474220 - DNA, 20 bp, mouse
ggtccgcttcgctatctaag

SEQ ID NO: 474221 - DNA, 20 bp, mouse
ggaccacttagatagcgaag

SEQ ID NO: 474222 - DNA, 20 bp, mouse
gaagagaagggtcgctgctg

SEQ ID NO: 474223 - DNA, 20 bp, mouse
gctgacaggggaccacccaa

SEQ ID NO: 474224 - DNA, 20 bp, mouse
gctccgggtgacatgattca

SEQ ID NO: 474225 - DNA, 20 bp, mouse
gatgggcaggcgactgacag

SEQ ID NO: 474226 - DNA, 20 bp, mouse
gggcgccgcagtgactcgtc

SEQ ID NO: 474227 - DNA, 20 bp, mouse
gcaagcccgacgagtcactg

SEQ ID NO: 474228 - DNA, 20 bp, mouse
ggactcgtcgggcttggcgg

SEQ ID NO: 474229 - DNA, 20 bp, mouse
ggcggcttctgaggtttcag

SEQ ID NO: 474230 - DNA, 20 bp, mouse
gcgaggccgcagcagcccac

SEQ ID NO: 474231 - DNA, 20 bp, mouse
gctgcggtgggcacactcgg

SEQ ID NO: 474232 - DNA, 20 bp, mouse
ggagcagcgagcgcagtggg

SEQ ID NO: 474233 - DNA, 20 bp, mouse
gacgcctcgtcggacatggt

SEQ ID NO: 474234 - DNA, 20 bp, mouse
gcaccccgcgaggagctcct

SEQ ID NO: 474235 - DNA, 20 bp, mouse
gcagcgagcagcgagcgcag

SEQ ID NO: 474236 - DNA, 20 bp, mouse
ggtacattcaggacagagtt

SEQ ID NO: 474237 - DNA, 20 bp, mouse
gagtagggatggtctgtccg

SEQ ID NO: 474238 - DNA, 20 bp, mouse
gtcctgaatgtactggagta

SEQ ID NO: 474239 - DNA, 20 bp, mouse
ggaatgtactggagtaggga

SEQ ID NO: 474240 - DNA, 20 bp, mouse
ggagaagcagtttatagcca

SEQ ID NO: 474241 - DNA, 20 bp, mouse
ggagttaggcagcgaaatgt

SEQ ID NO: 474242 - DNA, 20 bp, mouse
gcaaaggtctcgtcagacag

SEQ ID NO: 474243 - DNA, 20 bp, mouse
gacaactgtggaaacgggac

SEQ ID NO: 474244 - DNA, 20 bp, mouse
ggaaccctcctagtgctcat

SEQ ID NO: 474245 - DNA, 20 bp, mouse
gcagacagaggtgacgccag

SEQ ID NO: 474246 - DNA, 20 bp, mouse
gagatgggttctgacactcc

SEQ ID NO: 474247 - DNA, 20 bp, mouse
gttgtggtgggactcagaga

SEQ ID NO: 474248 - DNA, 20 bp, mouse
gtacaaagcacagagaaggc

SEQ ID NO: 474249 - DNA, 20 bp, mouse
gtgagtggaacaggggtcta

SEQ ID NO: 474250 - DNA, 20 bp, mouse
gacagtacagagcttgtggt

SEQ ID NO: 474251 - DNA, 20 bp, mouse
gatgggacggctggaccggg

SEQ ID NO: 474252 - DNA, 20 bp, mouse
ggttaagcagtaaaatggga

SEQ ID NO: 474253 - DNA, 20 bp, mouse
gcatcgtgtgctccaaggga

SEQ ID NO: 474254 - DNA, 20 bp, mouse
gcagcccgctgagtggaaca

SEQ ID NO: 474255 - DNA, 20 bp, mouse
gtggggccagtcgctcccaa

SEQ ID NO: 474256 - DNA, 20 bp, mouse
gagcgcgcagccgctagact

SEQ ID NO: 474257 - DNA, 20 bp, mouse
gtgcagaccgaaagctcggg

SEQ ID NO: 474258 - DNA, 20 bp, mouse
gagaacgactcccagtctag

SEQ ID NO: 474259 - DNA, 20 bp, mouse
gctagccccgcagaactggt

SEQ ID NO: 474260 - DNA, 20 bp, mouse
gaagccggcggtgcccgcaa

SEQ ID NO: 474261 - DNA, 20 bp, mouse
gttgcgcccgaggagagcag

SEQ ID NO: 474262 - DNA, 20 bp, mouse
gacctgcagaccgaaagctc

SEQ ID NO: 474263 - DNA, 20 bp, mouse
gccgaaagctcgggaggacc

SEQ ID NO: 474264 - DNA, 20 bp, mouse
ggctttcggtctgcaggttg

SEQ ID NO: 474265 - DNA, 20 bp, mouse
gagttctgcggggctaggcc

SEQ ID NO: 474266 - DNA, 20 bp, mouse
ggtcccagccagatcccaga

SEQ ID NO: 474267 - DNA, 20 bp, mouse
gagcaagtgcgccccgtcca

SEQ ID NO: 474268 - DNA, 20 bp, mouse
gaagtgcgccccgtccaggg

SEQ ID NO: 474269 - DNA, 20 bp, mouse
gcctggagccaccctggacg

SEQ ID NO: 474270 - DNA, 20 bp, mouse
ggagcagccgagtcagatcc

SEQ ID NO: 474271 - DNA, 20 bp, mouse
gcagggctgtctgcaccctc

SEQ ID NO: 474272 - DNA, 20 bp, mouse
ggagaagccaaagctaccgt

SEQ ID NO: 474273 - DNA, 20 bp, mouse
gctagtaagaatgggctctg

SEQ ID NO: 474274 - DNA, 20 bp, mouse
gtaagacacggcgcttccca

SEQ ID NO: 474275 - DNA, 20 bp, mouse
gtggactcccggatctgact

SEQ ID NO: 474276 - DNA, 20 bp, mouse
gggagtggcgcctccagtcg

SEQ ID NO: 474277 - DNA, 20 bp, mouse
ggcggatggagggcgcgatc

SEQ ID NO: 474278 - DNA, 20 bp, mouse
gccaaagcggctgcacccag

SEQ ID NO: 474279 - DNA, 20 bp, mouse
gcgcgatcgggcggccaaag

SEQ ID NO: 474280 - DNA, 20 bp, mouse
gggccgccgcgagcagtgta

SEQ ID NO: 474281 - DNA, 20 bp, mouse
ggcccagaggcaccgagggg

SEQ ID NO: 474282 - DNA, 20 bp, mouse
gggcgttggcggcggatgga

SEQ ID NO: 474283 - DNA, 20 bp, mouse
gtgagcccagaggcaccgag

SEQ ID NO: 474284 - DNA, 20 bp, mouse
ggcgctctgggcactcgcag

SEQ ID NO: 474285 - DNA, 20 bp, mouse
gcacagatcgcctcccggag

SEQ ID NO: 474286 - DNA, 20 bp, mouse
gaagtgactgagactgctgg

SEQ ID NO: 474287 - DNA, 20 bp, mouse
ggcatgcggggaccgggagt

SEQ ID NO: 474288 - DNA, 20 bp, mouse
ggagaagtgactgagactgc

SEQ ID NO: 474289 - DNA, 20 bp, mouse
gagaaccccgaacctactcc

SEQ ID NO: 474290 - DNA, 20 bp, mouse
ggcgctccgagcaccaggaa

SEQ ID NO: 474291 - DNA, 20 bp, mouse
gctggcggcatgcggggacc

SEQ ID NO: 474292 - DNA, 20 bp, mouse
gagactgctggcggcatgcg

SEQ ID NO: 474293 - DNA, 20 bp, mouse
gcaggttctcagcctcggaa

SEQ ID NO: 474294 - DNA, 20 bp, mouse
gcggggaccgggagtaggtt

SEQ ID NO: 474295 - DNA, 20 bp, mouse
ggaggctggcgcggacacgg

SEQ ID NO: 474296 - DNA, 20 bp, mouse
gtaacaggcggaaacctcca

SEQ ID NO: 474297 - DNA, 20 bp, mouse
gaggcggcgttgctaacagg

SEQ ID NO: 474298 - DNA, 20 bp, mouse
gagcaacgccgcctcactag

SEQ ID NO: 474299 - DNA, 20 bp, mouse
gggaggctcttccactagtg

SEQ ID NO: 474300 - DNA, 20 bp, mouse
ggaaacctccagggaagatg

SEQ ID NO: 474301 - DNA, 20 bp, mouse
ggtgaggcggcgttgctaac

SEQ ID NO: 474302 - DNA, 20 bp, mouse
gggctcttccactagtgagg

SEQ ID NO: 474303 - DNA, 20 bp, mouse
ggggaagatggggaaagtga

SEQ ID NO: 474304 - DNA, 20 bp, mouse
ggctgtctgggagcacttcc

SEQ ID NO: 474305 - DNA, 20 bp, mouse
ggtcaggaccctaaccagag

SEQ ID NO: 474306 - DNA, 20 bp, mouse
gtggcccagggagctacaca

SEQ ID NO: 474307 - DNA, 20 bp, mouse
gcccagggagctacacatgg

SEQ ID NO: 474308 - DNA, 20 bp, mouse
ggacgcacagagacaagaac

SEQ ID NO: 474309 - DNA, 20 bp, mouse
gatcagtgtctctggcacca

SEQ ID NO: 474310 - DNA, 20 bp, mouse
gtccgcatggtgagcagagc

SEQ ID NO: 474311 - DNA, 20 bp, mouse
ggccagccttgggcattctc

SEQ ID NO: 474312 - DNA, 20 bp, mouse
gactagcccatcagtgtctc

SEQ ID NO: 474313 - DNA, 20 bp, mouse
gcatctcagcagcgtccgca

SEQ ID NO: 474314 - DNA, 20 bp, mouse
ggccgcaaggcaccttccct

SEQ ID NO: 474315 - DNA, 20 bp, mouse
gatggtggggctgcctgccg

SEQ ID NO: 474316 - DNA, 20 bp, mouse
gacaaagcaggggcgactca

SEQ ID NO: 474317 - DNA, 20 bp, mouse
gcccgggctggcaggagcgg

SEQ ID NO: 474318 - DNA, 20 bp, mouse
gcctctgcctctaggagtct

SEQ ID NO: 474319 - DNA, 20 bp, mouse
gccgtgtagagggcgatcac

SEQ ID NO: 474320 - DNA, 20 bp, mouse
gggactcctgtgccccgggc

SEQ ID NO: 474321 - DNA, 20 bp, mouse
gtgtagagggcgatcactgg

SEQ ID NO: 474322 - DNA, 20 bp, mouse
ggctctcgccccctaggagg

SEQ ID NO: 474323 - DNA, 20 bp, mouse
gctcaggtggggaggtcccg

SEQ ID NO: 474324 - DNA, 20 bp, mouse
ggccagggaccgctcaggtg

SEQ ID NO: 474325 - DNA, 20 bp, mouse
gtttgcgcctagactcctag

SEQ ID NO: 474326 - DNA, 20 bp, mouse
gtgagtggcgcggttggaga

SEQ ID NO: 474327 - DNA, 20 bp, mouse
gtgctaaggacggtccccag

SEQ ID NO: 474328 - DNA, 20 bp, mouse
gcgcaccgcgcgggcggcta

SEQ ID NO: 474329 - DNA, 20 bp, mouse
gcaccaagcgggccccgtag

SEQ ID NO: 474330 - DNA, 20 bp, mouse
gtccaaccgcgccactcacc

SEQ ID NO: 474331 - DNA, 20 bp, mouse
gtgacagaagggcgacacca

SEQ ID NO: 474332 - DNA, 20 bp, mouse
gccggcttcgtgtgacagaa

SEQ ID NO: 474333 - DNA, 20 bp, mouse
gcggtgctcgctgctaagga

SEQ ID NO: 474334 - DNA, 20 bp, mouse
ggcgccaaggggcacaactt

SEQ ID NO: 474335 - DNA, 20 bp, mouse
gtggggctgcccctccccgg

SEQ ID NO: 474336 - DNA, 20 bp, mouse
ggcagggagaggcgacgatc

SEQ ID NO: 474337 - DNA, 20 bp, mouse
gcacgcggcggagagaacgg

SEQ ID NO: 474338 - DNA, 20 bp, mouse
gcgagggggcgcgcagggag

SEQ ID NO: 474339 - DNA, 20 bp, mouse
gggacggcgaccacactcag

SEQ ID NO: 474340 - DNA, 20 bp, mouse
gggagaggcgacgatctggc

SEQ ID NO: 474341 - DNA, 20 bp, mouse
gcgggcgctgcgctccgggt

SEQ ID NO: 474342 - DNA, 20 bp, mouse
gcgtacgagggtctccggga

SEQ ID NO: 474343 - DNA, 20 bp, mouse
gctagcagctagcagctcgg

SEQ ID NO: 474344 - DNA, 20 bp, mouse
gcctcagcctgacagaacag

SEQ ID NO: 474345 - DNA, 20 bp, mouse
gcccgcagcccactaggtgg

SEQ ID NO: 474346 - DNA, 20 bp, mouse
gtgaggacggcggcccagga

SEQ ID NO: 474347 - DNA, 20 bp, mouse
gtttggagcttgctgagtgg

SEQ ID NO: 474348 - DNA, 20 bp, mouse
gctgagtggcggtgtcatcg

SEQ ID NO: 474349 - DNA, 20 bp, mouse
ggcaagctccaaagtgacta

SEQ ID NO: 474350 - DNA, 20 bp, mouse
gtccaaagtgactacgggag

SEQ ID NO: 474351 - DNA, 20 bp, mouse
ggccactcccgtagtcactt

SEQ ID NO: 474352 - DNA, 20 bp, mouse
gcactttggagcttgctgag

SEQ ID NO: 474353 - DNA, 20 bp, mouse
ggtgtgggaacggccctggt

SEQ ID NO: 474354 - DNA, 20 bp, mouse
gtggcggtgtcatcgtggtg

SEQ ID NO: 474355 - DNA, 20 bp, mouse
gggatctcctccaccgacca

SEQ ID NO: 474356 - DNA, 20 bp, mouse
ggggccacccggccgagcgg

SEQ ID NO: 474357 - DNA, 20 bp, mouse
gactaggcctccaccaccca

SEQ ID NO: 474358 - DNA, 20 bp, mouse
gcggaggacgagcaaacact

SEQ ID NO: 474359 - DNA, 20 bp, mouse
gcgcggctggccctgggtgg

SEQ ID NO: 474360 - DNA, 20 bp, mouse
ggggccgtgaggaactgcct

SEQ ID NO: 474361 - DNA, 20 bp, mouse
ggtcggagcacgttgctagt

SEQ ID NO: 474362 - DNA, 20 bp, mouse
ggcttcgggaggggaccgga

SEQ ID NO: 474363 - DNA, 20 bp, mouse
gggccgcgatgggtcgtcag

SEQ ID NO: 474364 - DNA, 20 bp, mouse
gctgcctcggcagggccacc

SEQ ID NO: 474365 - DNA, 20 bp, mouse
gcggccgggtggccctgccg

SEQ ID NO: 474366 - DNA, 20 bp, mouse
ggattcccgagtgggcacac

SEQ ID NO: 474367 - DNA, 20 bp, mouse
gagcgtcaacagcccggcca

SEQ ID NO: 474368 - DNA, 20 bp, mouse
gctcgcggcgcgccatggcc

SEQ ID NO: 474369 - DNA, 20 bp, mouse
gctgttgacgctgcttggcc

SEQ ID NO: 474370 - DNA, 20 bp, mouse
gggcaggaagagtgagcacc

SEQ ID NO: 474371 - DNA, 20 bp, mouse
gcagggtccgagtggctgtg

SEQ ID NO: 474372 - DNA, 20 bp, mouse
gtgtggggagtcttacctgg

SEQ ID NO: 474373 - DNA, 20 bp, mouse
gcacactggagctgcgctcg

SEQ ID NO: 474374 - DNA, 20 bp, mouse
gcagagcggtggagcacagg

SEQ ID NO: 474375 - DNA, 20 bp, mouse
gtcggaccctgatccccaag

SEQ ID NO: 474376 - DNA, 20 bp, mouse
gggaggcgcgaagccggcgg

SEQ ID NO: 474377 - DNA, 20 bp, mouse
gcccaaagttgcggccgggg

SEQ ID NO: 474378 - DNA, 20 bp, mouse
gcgacgcgccggtgataggg

SEQ ID NO: 474379 - DNA, 20 bp, mouse
gtgggcactcggcagaccaa

SEQ ID NO: 474380 - DNA, 20 bp, mouse
gtgggctacccccctatcac

SEQ ID NO: 474381 - DNA, 20 bp, mouse
ggcagcgacgcccagaagtc

SEQ ID NO: 474382 - DNA, 20 bp, mouse
gcggcgcgcgcagccccagg

SEQ ID NO: 474383 - DNA, 20 bp, mouse
gcggggaggcgcgaagccgg

SEQ ID NO: 474384 - DNA, 20 bp, mouse
gctgcgcgccggggacaagg

SEQ ID NO: 474385 - DNA, 20 bp, mouse
ggcgccccgcccctacgagg

SEQ ID NO: 474386 - DNA, 20 bp, mouse
ggcgagagcagatgcccctg

SEQ ID NO: 474387 - DNA, 20 bp, mouse
gcgggcgccgggaggatgga

SEQ ID NO: 474388 - DNA, 20 bp, mouse
gcgccaggcgagagaaagag

SEQ ID NO: 474389 - DNA, 20 bp, mouse
gcgccccagccgcgccccca

SEQ ID NO: 474390 - DNA, 20 bp, mouse
gcccgggattgagggtgtca

SEQ ID NO: 474391 - DNA, 20 bp, mouse
gggattgagggtgtcaggga

SEQ ID NO: 474392 - DNA, 20 bp, mouse
ggccggggttgcgggctcag

SEQ ID NO: 474393 - DNA, 20 bp, mouse
gcgcgcccccatggccgccg

SEQ ID NO: 474394 - DNA, 20 bp, mouse
gtaatctgcaacctccctcc

SEQ ID NO: 474395 - DNA, 20 bp, mouse
ggggttgcgggctcaggggt

SEQ ID NO: 474396 - DNA, 20 bp, mouse
gagcaaggagccttagagta

SEQ ID NO: 474397 - DNA, 20 bp, mouse
gtgaggacgccaccacccgc

SEQ ID NO: 474398 - DNA, 20 bp, mouse
gggagccttagagtaaggca

SEQ ID NO: 474399 - DNA, 20 bp, mouse
gcgccgatcacccgcgggag

SEQ ID NO: 474400 - DNA, 20 bp, mouse
ggcgggagctaccgagagca

SEQ ID NO: 474401 - DNA, 20 bp, mouse
gcaccacccgcgggccgacc

SEQ ID NO: 474402 - DNA, 20 bp, mouse
gggcgcagagtgggccgggt

SEQ ID NO: 474403 - DNA, 20 bp, mouse
ggcgcggctgccagatgttg

SEQ ID NO: 474404 - DNA, 20 bp, mouse
gctcacccgccgatcacccg

SEQ ID NO: 474405 - DNA, 20 bp, mouse
ggcctggatggaacaacaaa

SEQ ID NO: 474406 - DNA, 20 bp, mouse
gtcgggctcacgagaaagta

SEQ ID NO: 474407 - DNA, 20 bp, mouse
gccagcgtggggacttagag

SEQ ID NO: 474408 - DNA, 20 bp, mouse
gaagtcaggtacctaggtct

SEQ ID NO: 474409 - DNA, 20 bp, mouse
ggactgctccacccagacct

SEQ ID NO: 474410 - DNA, 20 bp, mouse
ggagcccgagcccagcaaat

SEQ ID NO: 474411 - DNA, 20 bp, mouse
gtcaggtacctaggtctggg

SEQ ID NO: 474412 - DNA, 20 bp, mouse
gcgagcctcagctccagcgt

SEQ ID NO: 474413 - DNA, 20 bp, mouse
gagagaggatgccaactggt

SEQ ID NO: 474414 - DNA, 20 bp, mouse
gccgcgctccgtgcaccggg

SEQ ID NO: 474415 - DNA, 20 bp, mouse
gtccgtgcaccgggcggaag

SEQ ID NO: 474416 - DNA, 20 bp, mouse
gaactgcactacaaccgagg

SEQ ID NO: 474417 - DNA, 20 bp, mouse
gggcccctgagctgcgccag

SEQ ID NO: 474418 - DNA, 20 bp, mouse
gcgtccgctggcgcagctca

SEQ ID NO: 474419 - DNA, 20 bp, mouse
ggcggacgcaggtgcctcct

SEQ ID NO: 474420 - DNA, 20 bp, mouse
gcaaaactgcactacaaccg

SEQ ID NO: 474421 - DNA, 20 bp, mouse
gcccaaggaccccgcctccg

SEQ ID NO: 474422 - DNA, 20 bp, mouse
gtggtgggctgagggcacat

SEQ ID NO: 474423 - DNA, 20 bp, mouse
gccagtgaggtccacggagg

SEQ ID NO: 474424 - DNA, 20 bp, mouse
gggcccagagacccctgtcc

SEQ ID NO: 474425 - DNA, 20 bp, mouse
ggagtctgtcctgatcgctg

SEQ ID NO: 474426 - DNA, 20 bp, mouse
gaggctgcgagaagggaccg

SEQ ID NO: 474427 - DNA, 20 bp, mouse
gggacagagtgagcctcccc

SEQ ID NO: 474428 - DNA, 20 bp, mouse
ggtggagcagaaagggacgg

SEQ ID NO: 474429 - DNA, 20 bp, mouse
gacggaggaggccatgaatg

SEQ ID NO: 474430 - DNA, 20 bp, mouse
ggcctccccaggctgcgaga

SEQ ID NO: 474431 - DNA, 20 bp, mouse
ggcccagtacgcgaactcat

SEQ ID NO: 474432 - DNA, 20 bp, mouse
ggagccttggcaactcacat

SEQ ID NO: 474433 - DNA, 20 bp, mouse
ggggcataggctggctgaag

SEQ ID NO: 474434 - DNA, 20 bp, mouse
ggttggagtggaggtcctga

SEQ ID NO: 474435 - DNA, 20 bp, mouse
gtggtggaccttggtcgcgt

SEQ ID NO: 474436 - DNA, 20 bp, mouse
gggctactgaagcctcggag

SEQ ID NO: 474437 - DNA, 20 bp, mouse
gaggagcgaggggtcccgga

SEQ ID NO: 474438 - DNA, 20 bp, mouse
gcgcagagagcagtgccggg

SEQ ID NO: 474439 - DNA, 20 bp, mouse
gcaccgaggcacccccgcag

SEQ ID NO: 474440 - DNA, 20 bp, mouse
ggcccaggggcggggaacag

SEQ ID NO: 474441 - DNA, 20 bp, mouse
gggctcaacccacccgggaa

SEQ ID NO: 474442 - DNA, 20 bp, mouse
gagtcgggccacaggagcta

SEQ ID NO: 474443 - DNA, 20 bp, mouse
gcctctggctagcccctccg

SEQ ID NO: 474444 - DNA, 20 bp, mouse
gatgggagccgttcccgggt

SEQ ID NO: 474445 - DNA, 20 bp, mouse
gttgttgggacacgtgacca

SEQ ID NO: 474446 - DNA, 20 bp, mouse
gcccagacaaagggtggctt

SEQ ID NO: 474447 - DNA, 20 bp, mouse
ggggcccccaacccagacaa

SEQ ID NO: 474448 - DNA, 20 bp, mouse
gagcggggtgagtgtgtact

SEQ ID NO: 474449 - DNA, 20 bp, mouse
ggcttcgtgtgcaacactag

SEQ ID NO: 474450 - DNA, 20 bp, mouse
gtaaccagtcccccctacta

SEQ ID NO: 474451 - DNA, 20 bp, mouse
gggacgggaccgggacggaa

SEQ ID NO: 474452 - DNA, 20 bp, mouse
ggttgcacacgaagctgatc

SEQ ID NO: 474453 - DNA, 20 bp, mouse
gggggtgagtgtgtactagg

SEQ ID NO: 474454 - DNA, 20 bp, mouse
gttgggggcccgtagtaggg

SEQ ID NO: 474455 - DNA, 20 bp, mouse
gggatgagaaccgacctggg

SEQ ID NO: 474456 - DNA, 20 bp, mouse
ggttgcacttgagaaggtag

SEQ ID NO: 474457 - DNA, 20 bp, mouse
gggtcctgttgcacttgaga

SEQ ID NO: 474458 - DNA, 20 bp, mouse
gcccacacctgtagttccgt

SEQ ID NO: 474459 - DNA, 20 bp, mouse
gcttgagaaggtagtggatt

SEQ ID NO: 474460 - DNA, 20 bp, mouse
gacaggacccacggaactac

SEQ ID NO: 474461 - DNA, 20 bp, mouse
gaggcggggctctgacccaa

SEQ ID NO: 474462 - DNA, 20 bp, mouse
gacccacggaactacaggtg

SEQ ID NO: 474463 - DNA, 20 bp, mouse
gaagagacgaggccgaaggt

SEQ ID NO: 474464 - DNA, 20 bp, mouse
ggctcagtgtgtgagcaaag

SEQ ID NO: 474465 - DNA, 20 bp, mouse
gtcccgcccttcccccacaa

SEQ ID NO: 474466 - DNA, 20 bp, mouse
gccggaggcccaaccgataa

SEQ ID NO: 474467 - DNA, 20 bp, mouse
gctgagggtctagaatactg

SEQ ID NO: 474468 - DNA, 20 bp, mouse
gcctggagctgtagacccga

SEQ ID NO: 474469 - DNA, 20 bp, mouse
gcacttgagcagggtcggag

SEQ ID NO: 474470 - DNA, 20 bp, mouse
ggcggttgcctaggtgatag

SEQ ID NO: 474471 - DNA, 20 bp, mouse
gcaccacaccggctctgagt

SEQ ID NO: 474472 - DNA, 20 bp, mouse
gggagctgtagacccgaggg

SEQ ID NO: 474473 - DNA, 20 bp, mouse
gtggccgccggatggtgcgg

SEQ ID NO: 474474 - DNA, 20 bp, mouse
gtcgcgatccgctatcacct

SEQ ID NO: 474475 - DNA, 20 bp, mouse
gaagtggccgccggatggtg

SEQ ID NO: 474476 - DNA, 20 bp, mouse
gctagcatccatatccaagg

SEQ ID NO: 474477 - DNA, 20 bp, mouse
gaagaacgccgccttggata

SEQ ID NO: 474478 - DNA, 20 bp, mouse
gtacagtagcagcagaaact

SEQ ID NO: 474479 - DNA, 20 bp, mouse
gctgtgtggaccacttggat

SEQ ID NO: 474480 - DNA, 20 bp, mouse
gaacaaggaaccgcattaca

SEQ ID NO: 474481 - DNA, 20 bp, mouse
gcactgtaagaacgccgcct

SEQ ID NO: 474482 - DNA, 20 bp, mouse
ggatgctagcttttagaaca

SEQ ID NO: 474483 - DNA, 20 bp, mouse
gctcacatatactttttctt

SEQ ID NO: 474484 - DNA, 20 bp, mouse
gcacaatttaccttgtaatg

SEQ ID NO: 474485 - DNA, 20 bp, mouse
gtccatcttgcccatccaag

SEQ ID NO: 474486 - DNA, 20 bp, mouse
gaggccagctggctcccaga

SEQ ID NO: 474487 - DNA, 20 bp, mouse
ggttgtggtgctaggaccgg

SEQ ID NO: 474488 - DNA, 20 bp, mouse
gggccccaactcccagagag

SEQ ID NO: 474489 - DNA, 20 bp, mouse
gcaaggtacgctcttcccag

SEQ ID NO: 474490 - DNA, 20 bp, mouse
gaaaagtaggcccaaactca

SEQ ID NO: 474491 - DNA, 20 bp, mouse
gtggctcgcagcagctgagg

SEQ ID NO: 474492 - DNA, 20 bp, mouse
gcagcatccagagaactaga

SEQ ID NO: 474493 - DNA, 20 bp, mouse
gctgacagtggaaggtgctc

SEQ ID NO: 474494 - DNA, 20 bp, mouse
gtgcattcgacaaggccagc

SEQ ID NO: 474495 - DNA, 20 bp, mouse
gcacagctgtgcattcgaca

SEQ ID NO: 474496 - DNA, 20 bp, mouse
gcacgtgacgaggttcccgg

SEQ ID NO: 474497 - DNA, 20 bp, mouse
ggcgcggttccgacagcgtg

SEQ ID NO: 474498 - DNA, 20 bp, mouse
gcggcgggcggcgtcacgag

SEQ ID NO: 474499 - DNA, 20 bp, mouse
gtgcgctgcggcggaagggt

SEQ ID NO: 474500 - DNA, 20 bp, mouse
ggcgcgctggctggacgcac

SEQ ID NO: 474501 - DNA, 20 bp, mouse
gcagtggccagacccagaaa

SEQ ID NO: 474502 - DNA, 20 bp, mouse
gccgcgcagccccacgctgt

SEQ ID NO: 474503 - DNA, 20 bp, mouse
gcggctgcgctgcggcggaa

SEQ ID NO: 474504 - DNA, 20 bp, mouse
gtggctgcaagcccagctaa

SEQ ID NO: 474505 - DNA, 20 bp, mouse
gcgctggctggacgcaccgg

SEQ ID NO: 474506 - DNA, 20 bp, mouse
ggggttgcctagagctaccg

SEQ ID NO: 474507 - DNA, 20 bp, mouse
gagttgcagagtcaccgcag

SEQ ID NO: 474508 - DNA, 20 bp, mouse
ggtagctctaggcaacccca

SEQ ID NO: 474509 - DNA, 20 bp, mouse
gtaccgcggcagtagccccg

SEQ ID NO: 474510 - DNA, 20 bp, mouse
gagaccggcgtagctccgtg

SEQ ID NO: 474511 - DNA, 20 bp, mouse
gctggaccggtcgggcggat

SEQ ID NO: 474512 - DNA, 20 bp, mouse
gccgcccgaccggtccaggg

SEQ ID NO: 474513 - DNA, 20 bp, mouse
gctactgccgcggtagctct

SEQ ID NO: 474514 - DNA, 20 bp, mouse
gccgcccgccccctcaccag

SEQ ID NO: 474515 - DNA, 20 bp, mouse
gctccgcggggctactgccg

SEQ ID NO: 474516 - DNA, 20 bp, mouse
gggtgcggatgtccacccag

SEQ ID NO: 474517 - DNA, 20 bp, mouse
ggcatgcccgcggaactcct

SEQ ID NO: 474518 - DNA, 20 bp, mouse
gccaggctgagacccctggg

SEQ ID NO: 474519 - DNA, 20 bp, mouse
gggcgaccgaggagttccgc

SEQ ID NO: 474520 - DNA, 20 bp, mouse
gcgcgccaggctgagacccc

SEQ ID NO: 474521 - DNA, 20 bp, mouse
gagcggggcgggaccggtca

SEQ ID NO: 474522 - DNA, 20 bp, mouse
gactcctcggtcgccatgac

SEQ ID NO: 474523 - DNA, 20 bp, mouse
ggctccgccagtggccagac

SEQ ID NO: 474524 - DNA, 20 bp, mouse
gaggccacagcaacccgctc

SEQ ID NO: 474525 - DNA, 20 bp, mouse
gggaccggtcatggcgaccg

SEQ ID NO: 474526 - DNA, 20 bp, mouse
ggcggcccggccgggaatcc

SEQ ID NO: 474527 - DNA, 20 bp, mouse
ggcatcccgccgagccaggt

SEQ ID NO: 474528 - DNA, 20 bp, mouse
gcgcggcgaggccggcagga

SEQ ID NO: 474529 - DNA, 20 bp, mouse
gatgcagagtagggtaacgg

SEQ ID NO: 474530 - DNA, 20 bp, mouse
ggcgggatgcaggtgctaag

SEQ ID NO: 474531 - DNA, 20 bp, mouse
gggtaggttcccacatctgg

SEQ ID NO: 474532 - DNA, 20 bp, mouse
gccgcggcccgccctcctgc

SEQ ID NO: 474533 - DNA, 20 bp, mouse
gagaggatgcttcagaaggt

SEQ ID NO: 474534 - DNA, 20 bp, mouse
ggatgacaggaaggtccctt

SEQ ID NO: 474535 - DNA, 20 bp, mouse
gaccacctggattcccggcc

SEQ ID NO: 474536 - DNA, 20 bp, mouse
gactcaagagctcgaggcaa

SEQ ID NO: 474537 - DNA, 20 bp, mouse
ggggcggactcaagagctcg

SEQ ID NO: 474538 - DNA, 20 bp, mouse
gcatggccgcgggaagcgaa

SEQ ID NO: 474539 - DNA, 20 bp, mouse
ggttactcgcgcaggtctgg

SEQ ID NO: 474540 - DNA, 20 bp, mouse
ggccccgcggagcagagtta

SEQ ID NO: 474541 - DNA, 20 bp, mouse
gcgagtacttggagtaccgg

SEQ ID NO: 474542 - DNA, 20 bp, mouse
gagagttaaggcctcacctc

SEQ ID NO: 474543 - DNA, 20 bp, mouse
gggctgacgttgcctcctgg

SEQ ID NO: 474544 - DNA, 20 bp, mouse
gttgtccgtccgagcacggt

SEQ ID NO: 474545 - DNA, 20 bp, mouse
ggggacgaacccggacccag

SEQ ID NO: 474546 - DNA, 20 bp, mouse
gagtttgtttgggaaggcgt

SEQ ID NO: 474547 - DNA, 20 bp, mouse
gcaagcccaagcagagaggt

SEQ ID NO: 474548 - DNA, 20 bp, mouse
ggcggtgaggcttgagacag

SEQ ID NO: 474549 - DNA, 20 bp, mouse
gcacctgcagaccttagcaa

SEQ ID NO: 474550 - DNA, 20 bp, mouse
gtcaccaagcccaagcagag

SEQ ID NO: 474551 - DNA, 20 bp, mouse
ggctgtaggtgctaactgag

SEQ ID NO: 474552 - DNA, 20 bp, mouse
ggaccttagcaaagggactc

SEQ ID NO: 474553 - DNA, 20 bp, mouse
gtgggagatgtggacctgag

SEQ ID NO: 474554 - DNA, 20 bp, mouse
ggagacagaggctctaaggt

SEQ ID NO: 474555 - DNA, 20 bp, mouse
ggctgtgcagacctaggaat

SEQ ID NO: 474556 - DNA, 20 bp, mouse
ggaagggcaccaaatctcag

SEQ ID NO: 474557 - DNA, 20 bp, mouse
gtatcaggcagtcggacgaa

SEQ ID NO: 474558 - DNA, 20 bp, mouse
ggcgggttgcggccatgcag

SEQ ID NO: 474559 - DNA, 20 bp, mouse
gcccgcagatcggagcgtcg

SEQ ID NO: 474560 - DNA, 20 bp, mouse
gatggccgcaacccgcagat

SEQ ID NO: 474561 - DNA, 20 bp, mouse
ggccacgacgctccgatctg

SEQ ID NO: 474562 - DNA, 20 bp, mouse
gtgtgtgggcaggacaaggg

SEQ ID NO: 474563 - DNA, 20 bp, mouse
gcgtcgtggcctctgagatt

SEQ ID NO: 474564 - DNA, 20 bp, mouse
gggagaaaggcccccttagg

SEQ ID NO: 474565 - DNA, 20 bp, mouse
gcagggatcgccctcaccga

SEQ ID NO: 474566 - DNA, 20 bp, mouse
ggacggcggctgtgattgag

SEQ ID NO: 474567 - DNA, 20 bp, mouse
gtggcggcgaccggcgacaa

SEQ ID NO: 474568 - DNA, 20 bp, mouse
gagctcccggccagtccgga

SEQ ID NO: 474569 - DNA, 20 bp, mouse
ggggcgtggagcagcagtgg

SEQ ID NO: 474570 - DNA, 20 bp, mouse
gtgactgggcccggccctca

SEQ ID NO: 474571 - DNA, 20 bp, mouse
gtcccggccagtccggacgg

SEQ ID NO: 474572 - DNA, 20 bp, mouse
gaagcagctcccggccagtc

SEQ ID NO: 474573 - DNA, 20 bp, mouse
gtcacagccgccgtccggac

SEQ ID NO: 474574 - DNA, 20 bp, mouse
ggacaacggagcagccatga

SEQ ID NO: 474575 - DNA, 20 bp, mouse
gcggctgtgattgagaggct

SEQ ID NO: 474576 - DNA, 20 bp, mouse
gaaatgttaagtggtgaccc

SEQ ID NO: 474577 - DNA, 20 bp, mouse
gagcttcggcagaagcgtca

SEQ ID NO: 474578 - DNA, 20 bp, mouse
ggcaggagccagtttgctac

SEQ ID NO: 474579 - DNA, 20 bp, mouse
gaaggttgcccagtgtacaa

SEQ ID NO: 474580 - DNA, 20 bp, mouse
gcttggtccggtcactggag

SEQ ID NO: 474581 - DNA, 20 bp, mouse
gtgtacaaggggtagagaac

SEQ ID NO: 474582 - DNA, 20 bp, mouse
gcgctgtgtggcaaaggtgg

SEQ ID NO: 474583 - DNA, 20 bp, mouse
gttcggcagaagcgtcaggg

SEQ ID NO: 474584 - DNA, 20 bp, mouse
gtcactggaggggctggtgg

SEQ ID NO: 474585 - DNA, 20 bp, mouse
gcgacggcggcgctgacccg

SEQ ID NO: 474586 - DNA, 20 bp, mouse
ggctgggggcccacaacggg

SEQ ID NO: 474587 - DNA, 20 bp, mouse
gtgggcccccagcgcaactg

SEQ ID NO: 474588 - DNA, 20 bp, mouse
gtgcgctgggggcccacaac

SEQ ID NO: 474589 - DNA, 20 bp, mouse
gcccgggtgacctgttccaa

SEQ ID NO: 474590 - DNA, 20 bp, mouse
gcgcaactggggacgtgttc

SEQ ID NO: 474591 - DNA, 20 bp, mouse
gacgtccccagttgcgctgg

SEQ ID NO: 474592 - DNA, 20 bp, mouse
gacagaaactactttcgaaa

SEQ ID NO: 474593 - DNA, 20 bp, mouse
gcaggtcacccgggaagcga

SEQ ID NO: 474594 - DNA, 20 bp, mouse
ggtcacccgggaagcgaagg

SEQ ID NO: 474595 - DNA, 20 bp, mouse
gactttcgaaaaggctgttc

SEQ ID NO: 474596 - DNA, 20 bp, mouse
gaggctgaggtaccacccac

SEQ ID NO: 474597 - DNA, 20 bp, mouse
ggtagtgcgcagtgtgccca

SEQ ID NO: 474598 - DNA, 20 bp, mouse
gtacctcagccagttccggt

SEQ ID NO: 474599 - DNA, 20 bp, mouse
gcacccaccggaactggctg

SEQ ID NO: 474600 - DNA, 20 bp, mouse
gaggtaccacccaccggaac

SEQ ID NO: 474601 - DNA, 20 bp, mouse
gcaaccagccactggagagt

SEQ ID NO: 474602 - DNA, 20 bp, mouse
ggcactacctcagccagttc

SEQ ID NO: 474603 - DNA, 20 bp, mouse
ggccagccccgaggcaacct

SEQ ID NO: 474604 - DNA, 20 bp, mouse
gagcctcagtcagtaagtgt

SEQ ID NO: 474605 - DNA, 20 bp, mouse
gggagagtaggccagccccg

SEQ ID NO: 474606 - DNA, 20 bp, mouse
ggcgaggcgagtcgaaaagg

SEQ ID NO: 474607 - DNA, 20 bp, mouse
gtgtggtgcggagagccgaa

SEQ ID NO: 474608 - DNA, 20 bp, mouse
gcgcacctcgccgaacagca

SEQ ID NO: 474609 - DNA, 20 bp, mouse
gggagcgaggcgagtcgaaa

SEQ ID NO: 474610 - DNA, 20 bp, mouse
gacggagcagtgcagccctc

SEQ ID NO: 474611 - DNA, 20 bp, mouse
gcgagtcgaaaaggaggcag

SEQ ID NO: 474612 - DNA, 20 bp, mouse
ggccctctggcctgggagcg

SEQ ID NO: 474613 - DNA, 20 bp, mouse
gccccggggcctgcatgtga

SEQ ID NO: 474614 - DNA, 20 bp, mouse
gctgccgcgcaggcttccac

SEQ ID NO: 474615 - DNA, 20 bp, mouse
gtgcactgctccgtgctgtt

SEQ ID NO: 474616 - DNA, 20 bp, mouse
gtggccacgggaggacgctc

SEQ ID NO: 474617 - DNA, 20 bp, mouse
ggtgcccaggagaccccaca

SEQ ID NO: 474618 - DNA, 20 bp, mouse
ggaggacgctccggtccagg

SEQ ID NO: 474619 - DNA, 20 bp, mouse
ggaagcaactgcccgagccc

SEQ ID NO: 474620 - DNA, 20 bp, mouse
gagaggccgaggccggtccc

SEQ ID NO: 474621 - DNA, 20 bp, mouse
gcgcgcagcagacacctgcc

SEQ ID NO: 474622 - DNA, 20 bp, mouse
gcgggaggacgctccggtcc

SEQ ID NO: 474623 - DNA, 20 bp, mouse
gcgaccctgtggggtctcct

SEQ ID NO: 474624 - DNA, 20 bp, mouse
gtcctcccgtggccagggct

SEQ ID NO: 474625 - DNA, 20 bp, mouse
ggtcgtggcttacctgccag

SEQ ID NO: 474626 - DNA, 20 bp, mouse
gatgctcaaggatgttgaca

SEQ ID NO: 474627 - DNA, 20 bp, mouse
gccggagctgcagatgctca

SEQ ID NO: 474628 - DNA, 20 bp, mouse
gaccatagcgactgggcctc

SEQ ID NO: 474629 - DNA, 20 bp, mouse
gagttacccgtcagttacca

SEQ ID NO: 474630 - DNA, 20 bp, mouse
gcggaggccctggtaactga

SEQ ID NO: 474631 - DNA, 20 bp, mouse
gtagcgactgggcctccggc

SEQ ID NO: 474632 - DNA, 20 bp, mouse
ggggtaactaggtttcagag

SEQ ID NO: 474633 - DNA, 20 bp, mouse
gggcccagtcgctatggtaa

SEQ ID NO: 474634 - DNA, 20 bp, mouse
ggcagctaggatttacctgc

SEQ ID NO: 474635 - DNA, 20 bp, mouse
gtaacagaaaacgaatgtgg

SEQ ID NO: 474636 - DNA, 20 bp, mouse
gcctcagacctccaacagag

SEQ ID NO: 474637 - DNA, 20 bp, mouse
gggctgatgtacctctctgt

SEQ ID NO: 474638 - DNA, 20 bp, mouse
gtgctgtgggaggattaata

SEQ ID NO: 474639 - DNA, 20 bp, mouse
gtgtcacacaggctggttcg

SEQ ID NO: 474640 - DNA, 20 bp, mouse
gcagcaagcccagaaaggac

SEQ ID NO: 474641 - DNA, 20 bp, mouse
ggttcggggctgtgacattc

SEQ ID NO: 474642 - DNA, 20 bp, mouse
ggctttctcaggagtctctt

SEQ ID NO: 474643 - DNA, 20 bp, mouse
ggtgcagcctgtcttctagc

SEQ ID NO: 474644 - DNA, 20 bp, mouse
gtcctgagaaagctgggtcg

SEQ ID NO: 474645 - DNA, 20 bp, mouse
gactcagcctgctagaagac

SEQ ID NO: 474646 - DNA, 20 bp, mouse
gtatggcagcagacagtgac

SEQ ID NO: 474647 - DNA, 20 bp, mouse
ggctgccatacgatgctggg

SEQ ID NO: 474648 - DNA, 20 bp, mouse
gccactgagggagcaggtaa

SEQ ID NO: 474649 - DNA, 20 bp, mouse
gcaggcaagggtgtttgggt

SEQ ID NO: 474650 - DNA, 20 bp, mouse
gcaggagatagcaaagtcag

SEQ ID NO: 474651 - DNA, 20 bp, mouse
gcaggcaggcaagggtgttt

SEQ ID NO: 474652 - DNA, 20 bp, mouse
gggaggccagcaggaaccgg

SEQ ID NO: 474653 - DNA, 20 bp, mouse
gagcaaagtcagaggcacag

SEQ ID NO: 474654 - DNA, 20 bp, mouse
gtggggaagctggcggccga

SEQ ID NO: 474655 - DNA, 20 bp, mouse
gagcacgctcttccagtctg

SEQ ID NO: 474656 - DNA, 20 bp, mouse
gttgagatctgggctcatcg

SEQ ID NO: 474657 - DNA, 20 bp, mouse
gagctagtggctctttctga

SEQ ID NO: 474658 - DNA, 20 bp, mouse
gtaccggagaagcagccctc

SEQ ID NO: 474659 - DNA, 20 bp, mouse
gccagcaatcagaaggatca

SEQ ID NO: 474660 - DNA, 20 bp, mouse
gtgaaatacagttgagatct

SEQ ID NO: 474661 - DNA, 20 bp, mouse
gtgctctacgaggccaaatg

SEQ ID NO: 474662 - DNA, 20 bp, mouse
ggagaagcagccctctggag

SEQ ID NO: 474663 - DNA, 20 bp, mouse
gctgcttctccggtatggag

SEQ ID NO: 474664 - DNA, 20 bp, mouse
gatcgggtattggtccacag

SEQ ID NO: 474665 - DNA, 20 bp, mouse
gagcatagccagcaatcaga

SEQ ID NO: 474666 - DNA, 20 bp, mouse
gacacacacacacgcgaaga

SEQ ID NO: 474667 - DNA, 20 bp, mouse
gagttgctgtgctaaaacca

SEQ ID NO: 474668 - DNA, 20 bp, mouse
ggcccaggacgtagaagaag

SEQ ID NO: 474669 - DNA, 20 bp, mouse
gctctgaaaggcatccatgt

SEQ ID NO: 474670 - DNA, 20 bp, mouse
gaggcatggagactcttcac

SEQ ID NO: 474671 - DNA, 20 bp, mouse
ggagggaaagacgtttgcct

SEQ ID NO: 474672 - DNA, 20 bp, mouse
gagtattctcaacgctgcag

SEQ ID NO: 474673 - DNA, 20 bp, mouse
gcgttgagaatactgcctat

SEQ ID NO: 474674 - DNA, 20 bp, mouse
gccaaggatcagtaacaccc

SEQ ID NO: 474675 - DNA, 20 bp, mouse
gaagagacgttcgctaccca

SEQ ID NO: 474676 - DNA, 20 bp, mouse
gccagtgtgagcagaaccca

SEQ ID NO: 474677 - DNA, 20 bp, mouse
gcccaggaggaaaagcgcga

SEQ ID NO: 474678 - DNA, 20 bp, mouse
ggcaggaacaccaggccgta

SEQ ID NO: 474679 - DNA, 20 bp, mouse
gggacactggaacaccactg

SEQ ID NO: 474680 - DNA, 20 bp, mouse
gccgtagggcaggttccagg

SEQ ID NO: 474681 - DNA, 20 bp, mouse
ggaacccatggaaaagttca

SEQ ID NO: 474682 - DNA, 20 bp, mouse
gagcctggtgaccctactga

SEQ ID NO: 474683 - DNA, 20 bp, mouse
ggtcaccaggctatagccca

SEQ ID NO: 474684 - DNA, 20 bp, mouse
gcgatgtaaagtacagtaca

SEQ ID NO: 474685 - DNA, 20 bp, mouse
ggccacggccacccaggtga

SEQ ID NO: 474686 - DNA, 20 bp, mouse
gaagtgtggcggagttcccg

SEQ ID NO: 474687 - DNA, 20 bp, mouse
gcccttctggacttgctcgt

SEQ ID NO: 474688 - DNA, 20 bp, mouse
gcggcttgcgagcgctatgg

SEQ ID NO: 474689 - DNA, 20 bp, mouse
gtgtatgcaaacaggaagtg

SEQ ID NO: 474690 - DNA, 20 bp, mouse
ggcacggcttgcgagcgcta

SEQ ID NO: 474691 - DNA, 20 bp, mouse
ggagaaggcctgggctacac

SEQ ID NO: 474692 - DNA, 20 bp, mouse
gtggcggagttcccggggca

SEQ ID NO: 474693 - DNA, 20 bp, mouse
ggcctacgagcaagtccaga

SEQ ID NO: 474694 - DNA, 20 bp, mouse
gggagaagcgggtgaggcag

SEQ ID NO: 474695 - DNA, 20 bp, mouse
gcgctcgcaagccgtgcccc

SEQ ID NO: 474696 - DNA, 20 bp, mouse
gggccgccgcgcgtgcacac

SEQ ID NO: 474697 - DNA, 20 bp, mouse
gctgggctcctgagagcggt

SEQ ID NO: 474698 - DNA, 20 bp, mouse
gtcctgagagcggtcggacg

SEQ ID NO: 474699 - DNA, 20 bp, mouse
gctcaggagcccaggcctcc

SEQ ID NO: 474700 - DNA, 20 bp, mouse
ggccgcgtccgaccgctctc

SEQ ID NO: 474701 - DNA, 20 bp, mouse
gggcccaaggcggaaaggag

SEQ ID NO: 474702 - DNA, 20 bp, mouse
gcgccgcgccgaagccgaag

SEQ ID NO: 474703 - DNA, 20 bp, mouse
gtcggcgcggcgtcactctc

SEQ ID NO: 474704 - DNA, 20 bp, mouse
gagggaggccctgaccccac

SEQ ID NO: 474705 - DNA, 20 bp, mouse
ggcacacgggaccgaccttc

SEQ ID NO: 474706 - DNA, 20 bp, mouse
gccggcagagcgagacaact

SEQ ID NO: 474707 - DNA, 20 bp, mouse
gggagaagcagaccggatca

SEQ ID NO: 474708 - DNA, 20 bp, mouse
gactgggtaactccctgatc

SEQ ID NO: 474709 - DNA, 20 bp, mouse
ggccagactgtgaggcgcaa

SEQ ID NO: 474710 - DNA, 20 bp, mouse
gggtccgcaggtcctcacgg

SEQ ID NO: 474711 - DNA, 20 bp, mouse
ggaggcgcaacggattccta

SEQ ID NO: 474712 - DNA, 20 bp, mouse
gcgggccaaggatgttgtct

SEQ ID NO: 474713 - DNA, 20 bp, mouse
gtcgatccgctcgaggctgg

SEQ ID NO: 474714 - DNA, 20 bp, mouse
gaggatgttgtctgggtgta

SEQ ID NO: 474715 - DNA, 20 bp, mouse
gttgtctcgctctgccggct

SEQ ID NO: 474716 - DNA, 20 bp, mouse
gcaggtaggccagctttcat

SEQ ID NO: 474717 - DNA, 20 bp, mouse
gctcttggctgcaatcccca

SEQ ID NO: 474718 - DNA, 20 bp, mouse
gatgtgcagctcaagcaggt

SEQ ID NO: 474719 - DNA, 20 bp, mouse
gtgagacctaggatccttgt

SEQ ID NO: 474720 - DNA, 20 bp, mouse
gcagctttcataggtccctg

SEQ ID NO: 474721 - DNA, 20 bp, mouse
ggtagacatcaggtgagggt

SEQ ID NO: 474722 - DNA, 20 bp, mouse
gtcctaggtctcacaagagg

SEQ ID NO: 474723 - DNA, 20 bp, mouse
gggatcctaggtctcacaag

SEQ ID NO: 474724 - DNA, 20 bp, mouse
gtggttcccacaaggatcct

SEQ ID NO: 474725 - DNA, 20 bp, mouse
gccttggggcaggcagaaaa

SEQ ID NO: 474726 - DNA, 20 bp, mouse
ggaggagccggggaaagccg

SEQ ID NO: 474727 - DNA, 20 bp, mouse
gcggcctccgacaggactga

SEQ ID NO: 474728 - DNA, 20 bp, mouse
gtggccgcgtcgggaagcgt

SEQ ID NO: 474729 - DNA, 20 bp, mouse
gcctccgacaggactgacgg

SEQ ID NO: 474730 - DNA, 20 bp, mouse
ggggcgcgcggcgaagccgg

SEQ ID NO: 474731 - DNA, 20 bp, mouse
gcggcggtggcacctcccgt

SEQ ID NO: 474732 - DNA, 20 bp, mouse
ggcgcgaccgcagacgggtg

SEQ ID NO: 474733 - DNA, 20 bp, mouse
gcggcggcgcgaccgcagac

SEQ ID NO: 474734 - DNA, 20 bp, mouse
gagcggacggagcacctcgc

SEQ ID NO: 474735 - DNA, 20 bp, mouse
gatcgcgcctcggctttccc

SEQ ID NO: 474736 - DNA, 20 bp, mouse
gaccgcgcgcacgaccacag

SEQ ID NO: 474737 - DNA, 20 bp, mouse
gatcgccgagaaccccgaag

SEQ ID NO: 474738 - DNA, 20 bp, mouse
gatctgcagcgcgccctctg

SEQ ID NO: 474739 - DNA, 20 bp, mouse
gccccagtgggtgcagaaga

SEQ ID NO: 474740 - DNA, 20 bp, mouse
gtgatgtgaagcgagcaagt

SEQ ID NO: 474741 - DNA, 20 bp, mouse
gggagccggacacccccgga

SEQ ID NO: 474742 - DNA, 20 bp, mouse
gaagcggagccggacacccc

SEQ ID NO: 474743 - DNA, 20 bp, mouse
gacctctcggaccacacttg

SEQ ID NO: 474744 - DNA, 20 bp, mouse
gcccccggagggaagcaatg

SEQ ID NO: 474745 - DNA, 20 bp, mouse
gcgtccgggaggaagatctc

SEQ ID NO: 474746 - DNA, 20 bp, mouse
ggtccctgccgccgagtcag

SEQ ID NO: 474747 - DNA, 20 bp, mouse
gtctttagagcagggtctgg

SEQ ID NO: 474748 - DNA, 20 bp, mouse
ggtccctgccactgactcgg

SEQ ID NO: 474749 - DNA, 20 bp, mouse
ggaaggagtccccaccgcag

SEQ ID NO: 474750 - DNA, 20 bp, mouse
gctgccgccgagtcagtggc

SEQ ID NO: 474751 - DNA, 20 bp, mouse
gtggaccaagagcaccgctg

SEQ ID NO: 474752 - DNA, 20 bp, mouse
gcagggacgtctttagagca

SEQ ID NO: 474753 - DNA, 20 bp, mouse
ggacgtccctgccactgact

SEQ ID NO: 474754 - DNA, 20 bp, mouse
gccccaaggcccgactatag

SEQ ID NO: 474755 - DNA, 20 bp, mouse
ggccgatcaagcagccgcac

SEQ ID NO: 474756 - DNA, 20 bp, mouse
gtagcggcggaagatggctg

SEQ ID NO: 474757 - DNA, 20 bp, mouse
gagtgcggagcccagggtag

SEQ ID NO: 474758 - DNA, 20 bp, mouse
gacctgcagtgcggagccca

SEQ ID NO: 474759 - DNA, 20 bp, mouse
gccagggtagcggcggaaga

SEQ ID NO: 474760 - DNA, 20 bp, mouse
gccgactccgagcatcagct

SEQ ID NO: 474761 - DNA, 20 bp, mouse
gggagtatgggtgacaccca

SEQ ID NO: 474762 - DNA, 20 bp, mouse
gtgcggctccccgggagtat

SEQ ID NO: 474763 - DNA, 20 bp, mouse
gactatgggttggagagcta

SEQ ID NO: 474764 - DNA, 20 bp, mouse
gggtgtcacccatactcccg

SEQ ID NO: 474765 - DNA, 20 bp, mouse
gcagaacccaggcggagctg

SEQ ID NO: 474766 - DNA, 20 bp, mouse
gcccgctgcggtggtctcgg

SEQ ID NO: 474767 - DNA, 20 bp, mouse
gaggcgagcgaggaaccgcg

SEQ ID NO: 474768 - DNA, 20 bp, mouse
gtcgcctgcgctcctagaag

SEQ ID NO: 474769 - DNA, 20 bp, mouse
ggcctccaggtgacacagac

SEQ ID NO: 474770 - DNA, 20 bp, mouse
ggcggtggtctcggaggtgg

SEQ ID NO: 474771 - DNA, 20 bp, mouse
gcctgcgctcctagaagggg

SEQ ID NO: 474772 - DNA, 20 bp, mouse
gcgagtgtgcgcggtggcat

SEQ ID NO: 474773 - DNA, 20 bp, mouse
gacctccgagaccaccgcag

SEQ ID NO: 474774 - DNA, 20 bp, mouse
gcagaggacgagctgaccgg

SEQ ID NO: 474775 - DNA, 20 bp, mouse
gccctgggtggtgacttcgg

SEQ ID NO: 474776 - DNA, 20 bp, mouse
gcggcggcgaggcaaaccca

SEQ ID NO: 474777 - DNA, 20 bp, mouse
gacccagggaacacccccga

SEQ ID NO: 474778 - DNA, 20 bp, mouse
gtagtcctccctgccgtcgg

SEQ ID NO: 474779 - DNA, 20 bp, mouse
gctgtgcacgggccaaggcg

SEQ ID NO: 474780 - DNA, 20 bp, mouse
gaacacccccgacggcaggg

SEQ ID NO: 474781 - DNA, 20 bp, mouse
gggaatggtgaaggcgagga

SEQ ID NO: 474782 - DNA, 20 bp, mouse
ggggaacacccccgacggca

SEQ ID NO: 474783 - DNA, 20 bp, mouse
gagggagagtggctgtgcac

SEQ ID NO: 474784 - DNA, 20 bp, mouse
gaaggcggggtgcggggacc

SEQ ID NO: 474785 - DNA, 20 bp, mouse
gcctgggacggcaccagagt

SEQ ID NO: 474786 - DNA, 20 bp, mouse
ggggcagcccccagcaggag

SEQ ID NO: 474787 - DNA, 20 bp, mouse
gaggagcggagcggagactg

SEQ ID NO: 474788 - DNA, 20 bp, mouse
gtgaggcaggtggttggcgt

SEQ ID NO: 474789 - DNA, 20 bp, mouse
gtccgctccgctcctgctgg

SEQ ID NO: 474790 - DNA, 20 bp, mouse
gactcgccgcagctgtctag

SEQ ID NO: 474791 - DNA, 20 bp, mouse
gacctgggcgttggaagagg

SEQ ID NO: 474792 - DNA, 20 bp, mouse
gtcccgcttagggtcagtcc

SEQ ID NO: 474793 - DNA, 20 bp, mouse
gctgcggcgagtgagcggtc

SEQ ID NO: 474794 - DNA, 20 bp, mouse
gggccggttaagatcggagg

SEQ ID NO: 474795 - DNA, 20 bp, mouse
ggacagctgcggcgagtgag

SEQ ID NO: 474796 - DNA, 20 bp, mouse
gaagcttaccacctgcactt

SEQ ID NO: 474797 - DNA, 20 bp, mouse
gaacattcttaactatctga

SEQ ID NO: 474798 - DNA, 20 bp, mouse
gacttgggctatgtttctca

SEQ ID NO: 474799 - DNA, 20 bp, mouse
gaacatagcccaagtgcagg

SEQ ID NO: 474800 - DNA, 20 bp, mouse
gagaaacatagcccaagtgc

SEQ ID NO: 474801 - DNA, 20 bp, mouse
gtggcctggaatttactcca

SEQ ID NO: 474802 - DNA, 20 bp, mouse
gcttgcctatcatagtactt

SEQ ID NO: 474803 - DNA, 20 bp, mouse
ggtaacatctttactttcag

SEQ ID NO: 474804 - DNA, 20 bp, mouse
gactacccttacgacaccac

SEQ ID NO: 474805 - DNA, 20 bp, mouse
gaagatgttactcttacctg

SEQ ID NO: 474806 - DNA, 20 bp, mouse
gaggtgggcggaaggctaag

SEQ ID NO: 474807 - DNA, 20 bp, mouse
ggaaatctgaggtacgaggt

SEQ ID NO: 474808 - DNA, 20 bp, mouse
gacctggtccggcatcccac

SEQ ID NO: 474809 - DNA, 20 bp, mouse
ggtgtgaaatctgaggtacg

SEQ ID NO: 474810 - DNA, 20 bp, mouse
gaaagggatgagggacgacc

SEQ ID NO: 474811 - DNA, 20 bp, mouse
gtgggtgggagcagtaatgg

SEQ ID NO: 474812 - DNA, 20 bp, mouse
ggaggtacgaggtgggcgga

SEQ ID NO: 474813 - DNA, 20 bp, mouse
gaaagaactagaagtccggt

SEQ ID NO: 474814 - DNA, 20 bp, mouse
gtagagttgtagggttgaag

SEQ ID NO: 474815 - DNA, 20 bp, mouse
gacggctcgaggggttagtg

SEQ ID NO: 474816 - DNA, 20 bp, mouse
gtcagatccagaggtaccat

SEQ ID NO: 474817 - DNA, 20 bp, mouse
gcagcgtcggccatccagag

SEQ ID NO: 474818 - DNA, 20 bp, mouse
gtagcaacctgagcagccct

SEQ ID NO: 474819 - DNA, 20 bp, mouse
gcctgccgggggcgattcca

SEQ ID NO: 474820 - DNA, 20 bp, mouse
gtggctgaagtacctgccgg

SEQ ID NO: 474821 - DNA, 20 bp, mouse
ggcttgcaggtcattcccag

SEQ ID NO: 474822 - DNA, 20 bp, mouse
gtgctctcccatggtacctc

SEQ ID NO: 474823 - DNA, 20 bp, mouse
ggtcggccatccagagaggt

SEQ ID NO: 474824 - DNA, 20 bp, mouse
gagggctgtccgcctagtga

SEQ ID NO: 474825 - DNA, 20 bp, mouse
gggctgctcaggttgctaag

SEQ ID NO: 474826 - DNA, 20 bp, mouse
gccctcaagaagaaaggcgt

SEQ ID NO: 474827 - DNA, 20 bp, mouse
gtgcaaagaaaatgtaaggt

SEQ ID NO: 474828 - DNA, 20 bp, mouse
ggtgggaagcggctggatgc

SEQ ID NO: 474829 - DNA, 20 bp, mouse
gagactctctctgtagaaat

SEQ ID NO: 474830 - DNA, 20 bp, mouse
gatgatgcaaagaaaatgta

SEQ ID NO: 474831 - DNA, 20 bp, mouse
gccgaagccacgcaaaggta

SEQ ID NO: 474832 - DNA, 20 bp, mouse
gcatagccgaagccacgcaa

SEQ ID NO: 474833 - DNA, 20 bp, mouse
gatgcttatgaggtacaggt

SEQ ID NO: 474834 - DNA, 20 bp, mouse
gttcgatgctcttctcttct

SEQ ID NO: 474835 - DNA, 20 bp, mouse
gttaatctccagcacatgtt

SEQ ID NO: 474836 - DNA, 20 bp, mouse
gcagtgccatggcggagtgt

SEQ ID NO: 474837 - DNA, 20 bp, mouse
ggtctaggagccagggtcgt

SEQ ID NO: 474838 - DNA, 20 bp, mouse
gacaagactgggcagtgcca

SEQ ID NO: 474839 - DNA, 20 bp, mouse
gcggctccagcccacgaccc

SEQ ID NO: 474840 - DNA, 20 bp, mouse
gggcgctccctcagcagtct

SEQ ID NO: 474841 - DNA, 20 bp, mouse
gaaacttgccacacaagact

SEQ ID NO: 474842 - DNA, 20 bp, mouse
gtagcaacttgggaagccgt

SEQ ID NO: 474843 - DNA, 20 bp, mouse
gtgagggagcgccagaactg

SEQ ID NO: 474844 - DNA, 20 bp, mouse
gctggctcctagactgctga

SEQ ID NO: 474845 - DNA, 20 bp, mouse
gtacaatagtgaggggacag

SEQ ID NO: 474846 - DNA, 20 bp, mouse
gcggccgagcaggaacgagg

SEQ ID NO: 474847 - DNA, 20 bp, mouse
gaggaacgaggcggcgacag

SEQ ID NO: 474848 - DNA, 20 bp, mouse
gtccacagcagcggagcggg

SEQ ID NO: 474849 - DNA, 20 bp, mouse
gggcatccacagcagcggag

SEQ ID NO: 474850 - DNA, 20 bp, mouse
ggctgtggatgcctctccgg

SEQ ID NO: 474851 - DNA, 20 bp, mouse
ggagtccgcaccacgctcac

SEQ ID NO: 474852 - DNA, 20 bp, mouse
gtgcagccccgggcgaggga

SEQ ID NO: 474853 - DNA, 20 bp, mouse
ggggctggaagtcgactctc

SEQ ID NO: 474854 - DNA, 20 bp, mouse
ggactccggtgagcgtggtg

SEQ ID NO: 474855 - DNA, 20 bp, mouse
ggctgctgtggatgcctctc

SEQ ID NO: 474856 - DNA, 20 bp, mouse
ggcgaagagccaggcgacag

SEQ ID NO: 474857 - DNA, 20 bp, mouse
gtccgcacctgcccctctgg

SEQ ID NO: 474858 - DNA, 20 bp, mouse
gagccaggcgacagcggcga

SEQ ID NO: 474859 - DNA, 20 bp, mouse
gcttcgcggctccgccagag

SEQ ID NO: 474860 - DNA, 20 bp, mouse
gcggcgacggcggcttggag

SEQ ID NO: 474861 - DNA, 20 bp, mouse
gaggggcgtgaggagacgac

SEQ ID NO: 474862 - DNA, 20 bp, mouse
ggcggacgccgagaatgaat

SEQ ID NO: 474863 - DNA, 20 bp, mouse
gcggcggcttggagtgggga

SEQ ID NO: 474864 - DNA, 20 bp, mouse
gcaagagacccggatgtaca

SEQ ID NO: 474865 - DNA, 20 bp, mouse
gcgcggcccgggcggaagag

SEQ ID NO: 474866 - DNA, 20 bp, mouse
gagcagcagcggcccggccc

SEQ ID NO: 474867 - DNA, 20 bp, mouse
gcctgcagcccggtgaacca

SEQ ID NO: 474868 - DNA, 20 bp, mouse
gttcgcgagcggccccgccg

SEQ ID NO: 474869 - DNA, 20 bp, mouse
ggcagcccggtgaaccaggg

SEQ ID NO: 474870 - DNA, 20 bp, mouse
gaaatcgctataaaaggaag

SEQ ID NO: 474871 - DNA, 20 bp, mouse
ggcgctgcagggcctgaccc

SEQ ID NO: 474872 - DNA, 20 bp, mouse
gggccagaaatcgctataaa

SEQ ID NO: 474873 - DNA, 20 bp, mouse
gacacacgccgcttccgggt

SEQ ID NO: 474874 - DNA, 20 bp, mouse
ggacgcgcgagccgccgacc

SEQ ID NO: 474875 - DNA, 20 bp, mouse
gcccggcgccgcacaaaagg

SEQ ID NO: 474876 - DNA, 20 bp, mouse
gttgcttggagaagtcgtgg

SEQ ID NO: 474877 - DNA, 20 bp, mouse
gccaccatggcccagtacaa

SEQ ID NO: 474878 - DNA, 20 bp, mouse
gggagaagtcgtggaggcga

SEQ ID NO: 474879 - DNA, 20 bp, mouse
ggaggtctcccagagacgag

SEQ ID NO: 474880 - DNA, 20 bp, mouse
ggtcgtggaggcgacggcga

SEQ ID NO: 474881 - DNA, 20 bp, mouse
gatgcacctaatgaagaaga

SEQ ID NO: 474882 - DNA, 20 bp, mouse
ggcagtggcggtttcagcgg

SEQ ID NO: 474883 - DNA, 20 bp, mouse
gaagggcgctgcaagcgagg

SEQ ID NO: 474884 - DNA, 20 bp, mouse
gctctgggagacctcaacag

SEQ ID NO: 474885 - DNA, 20 bp, mouse
gcagaggattgcagaggtgt

SEQ ID NO: 474886 - DNA, 20 bp, mouse
gtattcgcaaaagcaccaga

SEQ ID NO: 474887 - DNA, 20 bp, mouse
gatccagctggggcagatgt

SEQ ID NO: 474888 - DNA, 20 bp, mouse
gactggcttgaatccagctg

SEQ ID NO: 474889 - DNA, 20 bp, mouse
gctcatacatcaaaaggtga

SEQ ID NO: 474890 - DNA, 20 bp, mouse
gggagactaatgagccctat

SEQ ID NO: 474891 - DNA, 20 bp, mouse
gtcttggctcatacatcaaa

SEQ ID NO: 474892 - DNA, 20 bp, mouse
gcatcaaaaggtgaggggac

SEQ ID NO: 474893 - DNA, 20 bp, mouse
gtcacaaactagcaggaagg

SEQ ID NO: 474894 - DNA, 20 bp, mouse
gtccattatcctgcaagcag

SEQ ID NO: 474895 - DNA, 20 bp, mouse
ggaatcacaaactagcagga

SEQ ID NO: 474896 - DNA, 20 bp, mouse
gcttcctgactgaccatgaa

SEQ ID NO: 474897 - DNA, 20 bp, mouse
gatgtcctttccaagcaggt

SEQ ID NO: 474898 - DNA, 20 bp, mouse
gtcaggaagcagagcaacac

SEQ ID NO: 474899 - DNA, 20 bp, mouse
gcccatgggttagataggac

SEQ ID NO: 474900 - DNA, 20 bp, mouse
gggaagcagagcaacacagg

SEQ ID NO: 474901 - DNA, 20 bp, mouse
gaagtgaccatggactgaac

SEQ ID NO: 474902 - DNA, 20 bp, mouse
gtcacacaccttgtcctccc

SEQ ID NO: 474903 - DNA, 20 bp, mouse
ggtagatacggcctacctgg

SEQ ID NO: 474904 - DNA, 20 bp, mouse
gtggcagaactgtgatgcta

SEQ ID NO: 474905 - DNA, 20 bp, mouse
gaatcacccatgggttagat

SEQ ID NO: 474906 - DNA, 20 bp, mouse
ggcaccgagctccgtagctg

SEQ ID NO: 474907 - DNA, 20 bp, mouse
ggcgatgagcaggcgaacga

SEQ ID NO: 474908 - DNA, 20 bp, mouse
gcgcgctccgcgcatgggga

SEQ ID NO: 474909 - DNA, 20 bp, mouse
ggcgcgcggaacaccctcta

SEQ ID NO: 474910 - DNA, 20 bp, mouse
ggagctccgtagctggggca

SEQ ID NO: 474911 - DNA, 20 bp, mouse
gtggggcccaggggactcta

SEQ ID NO: 474912 - DNA, 20 bp, mouse
ggcggcgcggcgaccaatga

SEQ ID NO: 474913 - DNA, 20 bp, mouse
gcaggccgcgctccgcgcat

SEQ ID NO: 474914 - DNA, 20 bp, mouse
gcgtcgagagccgggtgcat

SEQ ID NO: 474915 - DNA, 20 bp, mouse
gggctcaccgtccccatgcg

SEQ ID NO: 474916 - DNA, 20 bp, mouse
gccgccgggcagctcgaccg

SEQ ID NO: 474917 - DNA, 20 bp, mouse
gcgcggctgcgtgaactcgg

SEQ ID NO: 474918 - DNA, 20 bp, mouse
gcgcgcactgcacctcgtag

SEQ ID NO: 474919 - DNA, 20 bp, mouse
gtaccgagcgactcccgggg

SEQ ID NO: 474920 - DNA, 20 bp, mouse
ggcgtgcagcccggacgact

SEQ ID NO: 474921 - DNA, 20 bp, mouse
ggtcggtgcgagctccccgg

SEQ ID NO: 474922 - DNA, 20 bp, mouse
gcggcggcagcagtgggcat

SEQ ID NO: 474923 - DNA, 20 bp, mouse
ggccgtataacaaggagaca

SEQ ID NO: 474924 - DNA, 20 bp, mouse
gcaccagggcgagcaagagt

SEQ ID NO: 474925 - DNA, 20 bp, mouse
gagcggcacgccgggcgccc

SEQ ID NO: 474926 - DNA, 20 bp, mouse
gtaggagccgcggtaggtag

SEQ ID NO: 474927 - DNA, 20 bp, mouse
ggagctgtaggagccgcggt

SEQ ID NO: 474928 - DNA, 20 bp, mouse
gagccgcggtaggtagcgga

SEQ ID NO: 474929 - DNA, 20 bp, mouse
gtgccctccgctacctaccg

SEQ ID NO: 474930 - DNA, 20 bp, mouse
gggcagggcaacagagggag

SEQ ID NO: 474931 - DNA, 20 bp, mouse
gtggctgtgtcggaagggaa

SEQ ID NO: 474932 - DNA, 20 bp, mouse
gaagcgaactcaggacgcag

SEQ ID NO: 474933 - DNA, 20 bp, mouse
gcgcttcccgcggtcagatg

SEQ ID NO: 474934 - DNA, 20 bp, mouse
gatggctctcgtgaagacag

SEQ ID NO: 474935 - DNA, 20 bp, mouse
gtggtgctggggcctcgggg

SEQ ID NO: 474936 - DNA, 20 bp, mouse
gagagtcagcagcatggatg

SEQ ID NO: 474937 - DNA, 20 bp, mouse
gagcagcatggatgcgggtg

SEQ ID NO: 474938 - DNA, 20 bp, mouse
gcggcgcgctcttcttcccc

SEQ ID NO: 474939 - DNA, 20 bp, mouse
gcgggtggagattagaaata

SEQ ID NO: 474940 - DNA, 20 bp, mouse
gcgcgcaggtccgcagcaga

SEQ ID NO: 474941 - DNA, 20 bp, mouse
gtcgctgcgcggcgtgctcc

SEQ ID NO: 474942 - DNA, 20 bp, mouse
gggcggcggagtgtgatacc

SEQ ID NO: 474943 - DNA, 20 bp, mouse
ggcgccatggccgccctgga

SEQ ID NO: 474944 - DNA, 20 bp, mouse
gccagagcaagggcagcggg

SEQ ID NO: 474945 - DNA, 20 bp, mouse
gcactgaggacactaacctg

SEQ ID NO: 474946 - DNA, 20 bp, mouse
gctgtggctcagagctgcat

SEQ ID NO: 474947 - DNA, 20 bp, mouse
ggcggctgcgacagagatgg

SEQ ID NO: 474948 - DNA, 20 bp, mouse
gcgaccagacaccaagaaac

SEQ ID NO: 474949 - DNA, 20 bp, mouse
gaggaggtggtagcctgtgg

SEQ ID NO: 474950 - DNA, 20 bp, mouse
gtctgtcgcagccgctgctg

SEQ ID NO: 474951 - DNA, 20 bp, mouse
gtgggagacaacgctgctgc

SEQ ID NO: 474952 - DNA, 20 bp, mouse
gaccgctctcccgccaccac

SEQ ID NO: 474953 - DNA, 20 bp, mouse
ggcgggagagcggtgttgac

SEQ ID NO: 474954 - DNA, 20 bp, mouse
ggcagcggctgcgacagaga

SEQ ID NO: 474955 - DNA, 20 bp, mouse
gggtccggtttcttggtgtc

SEQ ID NO: 474956 - DNA, 20 bp, mouse
gggcgccgcgagccgaggag

SEQ ID NO: 474957 - DNA, 20 bp, mouse
gcccagcaggccgccccgga

SEQ ID NO: 474958 - DNA, 20 bp, mouse
gggcggcctgctgggcctca

SEQ ID NO: 474959 - DNA, 20 bp, mouse
gcccggaaggagaaacgctc

SEQ ID NO: 474960 - DNA, 20 bp, mouse
gagctgcgaaagcgggccgg

SEQ ID NO: 474961 - DNA, 20 bp, mouse
ggcccgctttcgcagctgtc

SEQ ID NO: 474962 - DNA, 20 bp, mouse
ggggcctcatggaggctgtt

SEQ ID NO: 474963 - DNA, 20 bp, mouse
gtacttggccggcaaagtgg

SEQ ID NO: 474964 - DNA, 20 bp, mouse
ggccagacagctgcgaaagc

SEQ ID NO: 474965 - DNA, 20 bp, mouse
gagcctccatgaggcccagc

SEQ ID NO: 474966 - DNA, 20 bp, mouse
gtggagtccggagagcacga

SEQ ID NO: 474967 - DNA, 20 bp, mouse
ggcgctgccctcgtgctctc

SEQ ID NO: 474968 - DNA, 20 bp, mouse
ggcctctgtacaaaagaatc

SEQ ID NO: 474969 - DNA, 20 bp, mouse
gtcttggagatggcattgcg

SEQ ID NO: 474970 - DNA, 20 bp, mouse
gggccgccggctccaggaac

SEQ ID NO: 474971 - DNA, 20 bp, mouse
gctggagccggcggccacac

SEQ ID NO: 474972 - DNA, 20 bp, mouse
gagacccggagagcagggtc

SEQ ID NO: 474973 - DNA, 20 bp, mouse
gggggtcgcagatcccgtgt

SEQ ID NO: 474974 - DNA, 20 bp, mouse
gtgaggtaaaccgaaagtca

SEQ ID NO: 474975 - DNA, 20 bp, mouse
gcgaccccgaccctgctctc

SEQ ID NO: 474976 - DNA, 20 bp, mouse
gtagtcggaggtcctgggta

SEQ ID NO: 474977 - DNA, 20 bp, mouse
ggttgttccagcgcaggtga

SEQ ID NO: 474978 - DNA, 20 bp, mouse
gcgcggagctccactcctgg

SEQ ID NO: 474979 - DNA, 20 bp, mouse
ggctgggctccctccaggag

SEQ ID NO: 474980 - DNA, 20 bp, mouse
ggcgcagggcaggttgggtt

SEQ ID NO: 474981 - DNA, 20 bp, mouse
gggatggcgcgtggtgcccg

SEQ ID NO: 474982 - DNA, 20 bp, mouse
ggcgtgtagtcggaggtcct

SEQ ID NO: 474983 - DNA, 20 bp, mouse
ggcgaggcgcagggcaggtt

SEQ ID NO: 474984 - DNA, 20 bp, mouse
gcgcaggtgagggcggcgga

SEQ ID NO: 474985 - DNA, 20 bp, mouse
ggggcgcggagctccactcc

SEQ ID NO: 474986 - DNA, 20 bp, mouse
gagcccggtgagccgcagaa

SEQ ID NO: 474987 - DNA, 20 bp, mouse
gctaccgaggatttccatca

SEQ ID NO: 474988 - DNA, 20 bp, mouse
gacgcggtccctagaggagg

SEQ ID NO: 474989 - DNA, 20 bp, mouse
gcagccctgatggaaatcct

SEQ ID NO: 474990 - DNA, 20 bp, mouse
gccaaggacgcggtccctag

SEQ ID NO: 474991 - DNA, 20 bp, mouse
gaggacgcggtccctagagg

SEQ ID NO: 474992 - DNA, 20 bp, mouse
gccggctcagacagccctga

SEQ ID NO: 474993 - DNA, 20 bp, mouse
gtctgagccggtcagcagcc

SEQ ID NO: 474994 - DNA, 20 bp, mouse
gggacacacgcccaatacgg

SEQ ID NO: 474995 - DNA, 20 bp, mouse
gggcctggagcgcacgccgg

SEQ ID NO: 474996 - DNA, 20 bp, mouse
gcgctggagctgctacagag

SEQ ID NO: 474997 - DNA, 20 bp, mouse
gtgctacagagcggctgtca

SEQ ID NO: 474998 - DNA, 20 bp, mouse
ggcggtgtctataggaccag

SEQ ID NO: 474999 - DNA, 20 bp, mouse
ggcgctcccgccgccctcta

SEQ ID NO: 475000 - DNA, 20 bp, mouse
gcctggccgaggccgcgcta

SEQ ID NO: 475001 - DNA, 20 bp, mouse
gggcacgtcaccgtagaggg

SEQ ID NO: 475002 - DNA, 20 bp, mouse
ggcgtcggaggcgcttgctg

SEQ ID NO: 475003 - DNA, 20 bp, mouse
gccaggcacgtcaccgtaga

SEQ ID NO: 475004 - DNA, 20 bp, mouse
gtgctgaggagagccggccg

SEQ ID NO: 475005 - DNA, 20 bp, mouse
gctggacgcgcggtggacag

SEQ ID NO: 475006 - DNA, 20 bp, mouse
gagcatgcggggttaccgag

SEQ ID NO: 475007 - DNA, 20 bp, mouse
ggtccgggtatcgagcaggg

SEQ ID NO: 475008 - DNA, 20 bp, mouse
gcgggtccgggtatcgagca

SEQ ID NO: 475009 - DNA, 20 bp, mouse
gtaccgaggggcttaaggag

SEQ ID NO: 475010 - DNA, 20 bp, mouse
gaggagagggtgttgatctt

SEQ ID NO: 475011 - DNA, 20 bp, mouse
gccccataggctaagtggag

SEQ ID NO: 475012 - DNA, 20 bp, mouse
ggcagggaggtgagcatgcg

SEQ ID NO: 475013 - DNA, 20 bp, mouse
ggccgcgcggagtttcaaat

SEQ ID NO: 475014 - DNA, 20 bp, mouse
gtggagtggcacacaggtca

SEQ ID NO: 475015 - DNA, 20 bp, mouse
ggagcctcggcgcttacgca

SEQ ID NO: 475016 - DNA, 20 bp, mouse
ggcctgggcgcggaagggaa

SEQ ID NO: 475017 - DNA, 20 bp, mouse
gctcgcgctgtcggtactct

SEQ ID NO: 475018 - DNA, 20 bp, mouse
gaacggcgcggacactcaca

SEQ ID NO: 475019 - DNA, 20 bp, mouse
gtgcaaggacctcgcgctgt

SEQ ID NO: 475020 - DNA, 20 bp, mouse
gaagtccgggagccgatggg

SEQ ID NO: 475021 - DNA, 20 bp, mouse
gccactgtgggcaggcccga

SEQ ID NO: 475022 - DNA, 20 bp, mouse
gtgccccggggctccactgt

SEQ ID NO: 475023 - DNA, 20 bp, mouse
ggatccgggtcgcgagaacg

SEQ ID NO: 475024 - DNA, 20 bp, mouse
gtgcccacagtggagccccg

SEQ ID NO: 475025 - DNA, 20 bp, mouse
gccgccacggcagtgccccg

SEQ ID NO: 475026 - DNA, 20 bp, mouse
gctcacaacctaggacacac

SEQ ID NO: 475027 - DNA, 20 bp, mouse
gtggctgctcagagctaaag

SEQ ID NO: 475028 - DNA, 20 bp, mouse
gctgaaggcactcacaacct

SEQ ID NO: 475029 - DNA, 20 bp, mouse
gagtggctcccgtgtgtcct

SEQ ID NO: 475030 - DNA, 20 bp, mouse
ggagcaaggcgatcataatg

SEQ ID NO: 475031 - DNA, 20 bp, mouse
gttcatccagaagatcctca

SEQ ID NO: 475032 - DNA, 20 bp, mouse
gggtcaaggaattgcattgt

SEQ ID NO: 475033 - DNA, 20 bp, mouse
gaatcgcctcccaggcagtg

SEQ ID NO: 475034 - DNA, 20 bp, mouse
gattgcattgtgggaagacc

SEQ ID NO: 475035 - DNA, 20 bp, mouse
gggctgcgctgctctactgt

SEQ ID NO: 475036 - DNA, 20 bp, mouse
gacgcgcgggtggcagagag

SEQ ID NO: 475037 - DNA, 20 bp, mouse
ggccgcgccgggtgaagttg

SEQ ID NO: 475038 - DNA, 20 bp, mouse
gagcggagcgagcgcggtag

SEQ ID NO: 475039 - DNA, 20 bp, mouse
gggagacgcttagtaccggg

SEQ ID NO: 475040 - DNA, 20 bp, mouse
gaggaagcccggacacccaa

SEQ ID NO: 475041 - DNA, 20 bp, mouse
ggcgagcgcggtagcggaga

SEQ ID NO: 475042 - DNA, 20 bp, mouse
gctggccccgcaacttcacc

SEQ ID NO: 475043 - DNA, 20 bp, mouse
gggtccgagggtaacagtcg

SEQ ID NO: 475044 - DNA, 20 bp, mouse
gggaggtgcacggcagcgag

SEQ ID NO: 475045 - DNA, 20 bp, mouse
ggcccggagacgcttagtac

SEQ ID NO: 475046 - DNA, 20 bp, mouse
gaggcccaggactgtcccca

SEQ ID NO: 475047 - DNA, 20 bp, mouse
gcccgactctgagggaccct

SEQ ID NO: 475048 - DNA, 20 bp, mouse
gagttgaaggtggcttctcg

SEQ ID NO: 475049 - DNA, 20 bp, mouse
gatgcagggaaatccttggg

SEQ ID NO: 475050 - DNA, 20 bp, mouse
gaaccctgaaaaccagttga

SEQ ID NO: 475051 - DNA, 20 bp, mouse
gggttggcacctggtaccgc

SEQ ID NO: 475052 - DNA, 20 bp, mouse
gtcacctggggcagaggccc

SEQ ID NO: 475053 - DNA, 20 bp, mouse
gccctcagagtcggggaagc

SEQ ID NO: 475054 - DNA, 20 bp, mouse
gcactcctgactgccaccaa

SEQ ID NO: 475055 - DNA, 20 bp, mouse
gcctcccgcttgcacacaga

SEQ ID NO: 475056 - DNA, 20 bp, mouse
ggcgcagagactcctcgcca

SEQ ID NO: 475057 - DNA, 20 bp, mouse
gccggggccgggactcagag

SEQ ID NO: 475058 - DNA, 20 bp, mouse
gggcctacctggaggtaatg

SEQ ID NO: 475059 - DNA, 20 bp, mouse
gcggggcgatgtgagtgcca

SEQ ID NO: 475060 - DNA, 20 bp, mouse
gcgcccgaggagcgggacca

SEQ ID NO: 475061 - DNA, 20 bp, mouse
gcgcgcacggagggaggacg

SEQ ID NO: 475062 - DNA, 20 bp, mouse
gcgatgtgagtgccatggcg

SEQ ID NO: 475063 - DNA, 20 bp, mouse
gtccgcctccgactgcggcg

SEQ ID NO: 475064 - DNA, 20 bp, mouse
ggaggagcgggaccagggct

SEQ ID NO: 475065 - DNA, 20 bp, mouse
gcctgcggaccggcacctgg

SEQ ID NO: 475066 - DNA, 20 bp, mouse
gagcccggccaggcccgcag

SEQ ID NO: 475067 - DNA, 20 bp, mouse
gaacgcgagccgaggacgag

SEQ ID NO: 475068 - DNA, 20 bp, mouse
gtcgcggtccttgctcagaa

SEQ ID NO: 475069 - DNA, 20 bp, mouse
gcatgcgggccgctcgtcct

SEQ ID NO: 475070 - DNA, 20 bp, mouse
gccgcatggagagcgagcgg

SEQ ID NO: 475071 - DNA, 20 bp, mouse
gcgtcctcggctcgcgttaa

SEQ ID NO: 475072 - DNA, 20 bp, mouse
gggtgctaccacacggggag

SEQ ID NO: 475073 - DNA, 20 bp, mouse
gccccggctgcggaaccccg

SEQ ID NO: 475074 - DNA, 20 bp, mouse
gccggccaggtgctaccaca

SEQ ID NO: 475075 - DNA, 20 bp, mouse
gtaaggaccgtggcaaccag

SEQ ID NO: 475076 - DNA, 20 bp, mouse
ggagcggcgaccggagctca

SEQ ID NO: 475077 - DNA, 20 bp, mouse
gttcgggtccagaggaaccg

SEQ ID NO: 475078 - DNA, 20 bp, mouse
ggcgacactgggcaatgcgg

SEQ ID NO: 475079 - DNA, 20 bp, mouse
gcgcgcgacactgggcaatg

SEQ ID NO: 475080 - DNA, 20 bp, mouse
gacccagccggcggtccacg

SEQ ID NO: 475081 - DNA, 20 bp, mouse
gagtgtcgcgcgtccaggtc

SEQ ID NO: 475082 - DNA, 20 bp, mouse
gccgaggcagacacctccta

SEQ ID NO: 475083 - DNA, 20 bp, mouse
gagcggaccacggtagacca

SEQ ID NO: 475084 - DNA, 20 bp, mouse
ggactccgaggacccggaga

SEQ ID NO: 475085 - DNA, 20 bp, mouse
gtaaggagcacaaggagcca

SEQ ID NO: 475086 - DNA, 20 bp, mouse
ggtggtcacctctctcacta

SEQ ID NO: 475087 - DNA, 20 bp, mouse
gactgcagccctagtgagag

SEQ ID NO: 475088 - DNA, 20 bp, mouse
gcccagagtggtgctgaagt

SEQ ID NO: 475089 - DNA, 20 bp, mouse
gtgcagtttgtagactctca

SEQ ID NO: 475090 - DNA, 20 bp, mouse
gcaggggcttcaggctctag

SEQ ID NO: 475091 - DNA, 20 bp, mouse
gtgctcctgggtcacaaagg

SEQ ID NO: 475092 - DNA, 20 bp, mouse
gctgaagtcggcatgttcaa

SEQ ID NO: 475093 - DNA, 20 bp, mouse
gacccccagcccaggcctct

SEQ ID NO: 475094 - DNA, 20 bp, mouse
gttgtgacccaggagcactg

SEQ ID NO: 475095 - DNA, 20 bp, mouse
gaagatgcagggtagactcc

SEQ ID NO: 475096 - DNA, 20 bp, mouse
gtgcaggtgtgaggacatgt

SEQ ID NO: 475097 - DNA, 20 bp, mouse
gaaatcgtgttcccaagaaa

SEQ ID NO: 475098 - DNA, 20 bp, mouse
gcccatggatcggtaactgt

SEQ ID NO: 475099 - DNA, 20 bp, mouse
gtcgtgttcccaagaaaggg

SEQ ID NO: 475100 - DNA, 20 bp, mouse
gtacaacgacagctgtacaa

SEQ ID NO: 475101 - DNA, 20 bp, mouse
ggtggctggccgagatgcct

SEQ ID NO: 475102 - DNA, 20 bp, mouse
gaacgacagctgtacaaggg

SEQ ID NO: 475103 - DNA, 20 bp, mouse
gtgtgggcagaaaccttgct

SEQ ID NO: 475104 - DNA, 20 bp, mouse
gatcgggcagtggaaggacc

SEQ ID NO: 475105 - DNA, 20 bp, mouse
gaactgtgggcagtgtaata

SEQ ID NO: 475106 - DNA, 20 bp, mouse
gaacctcctggatgtcaaac

SEQ ID NO: 475107 - DNA, 20 bp, mouse
ggattagtactggttatctg

SEQ ID NO: 475108 - DNA, 20 bp, mouse
gtagaggcttagagactagt

SEQ ID NO: 475109 - DNA, 20 bp, mouse
ggaccaaacagcccctgaga

SEQ ID NO: 475110 - DNA, 20 bp, mouse
gggacaggcaactaagtccc

SEQ ID NO: 475111 - DNA, 20 bp, mouse
gtttcacatttctttagcag

SEQ ID NO: 475112 - DNA, 20 bp, mouse
gtacattgatacgaaaccag

SEQ ID NO: 475113 - DNA, 20 bp, mouse
gcctcaactagaagagttag

SEQ ID NO: 475114 - DNA, 20 bp, mouse
ggaagcagaaacgtgctatt

SEQ ID NO: 475115 - DNA, 20 bp, mouse
gtagatctttggaaacctcc

SEQ ID NO: 475116 - DNA, 20 bp, mouse
ggccggggcgtggcgatgaa

SEQ ID NO: 475117 - DNA, 20 bp, mouse
gcactcggcgttcctcccca

SEQ ID NO: 475118 - DNA, 20 bp, mouse
gggaacgccgagtgaagcct

SEQ ID NO: 475119 - DNA, 20 bp, mouse
gggggcgtggcgatgaaggg

SEQ ID NO: 475120 - DNA, 20 bp, mouse
ggcgttcctccccagggccg

SEQ ID NO: 475121 - DNA, 20 bp, mouse
gtcacctgctccgccccgag

SEQ ID NO: 475122 - DNA, 20 bp, mouse
ggagatcttaaggccgctcg

SEQ ID NO: 475123 - DNA, 20 bp, mouse
ggcgttggaggcgcccaggg

SEQ ID NO: 475124 - DNA, 20 bp, mouse
ggaggggttggccctagaga

SEQ ID NO: 475125 - DNA, 20 bp, mouse
ggtacatgaactctgaccga

SEQ ID NO: 475126 - DNA, 20 bp, mouse
gccccagggccgagagactc

SEQ ID NO: 475127 - DNA, 20 bp, mouse
gtggccatggccctgcagag

SEQ ID NO: 475128 - DNA, 20 bp, mouse
ggggccgagagactctggta

SEQ ID NO: 475129 - DNA, 20 bp, mouse
gagagactctggtatggcca

SEQ ID NO: 475130 - DNA, 20 bp, mouse
gggatgggaacccacttcgg

SEQ ID NO: 475131 - DNA, 20 bp, mouse
gacagcgggtgccataacag

SEQ ID NO: 475132 - DNA, 20 bp, mouse
ggtcagcactaggccgtggg

SEQ ID NO: 475133 - DNA, 20 bp, mouse
ggtagtcagcactaggccgt

SEQ ID NO: 475134 - DNA, 20 bp, mouse
gcagagaggtagtcagcact

SEQ ID NO: 475135 - DNA, 20 bp, mouse
gggcacccgctgttatgagg

SEQ ID NO: 475136 - DNA, 20 bp, mouse
gcagctgcccatgatcagaa

SEQ ID NO: 475137 - DNA, 20 bp, mouse
gcagctggccaaggcctaag

SEQ ID NO: 475138 - DNA, 20 bp, mouse
gcactcccaggcccactcca

SEQ ID NO: 475139 - DNA, 20 bp, mouse
gtccaccaagactttctagg

SEQ ID NO: 475140 - DNA, 20 bp, mouse
gatgcctgggagaagttcag

SEQ ID NO: 475141 - DNA, 20 bp, mouse
gttctggagaatgaaccatc

SEQ ID NO: 475142 - DNA, 20 bp, mouse
gggttcgtttccccatccac

SEQ ID NO: 475143 - DNA, 20 bp, mouse
ggggaaacgaaccctggagt

SEQ ID NO: 475144 - DNA, 20 bp, mouse
gaggcccctgaacttctccc

SEQ ID NO: 475145 - DNA, 20 bp, mouse
ggccctctgcactgttgtcc

SEQ ID NO: 475146 - DNA, 20 bp, mouse
gcagcccaactccaaggtgt

SEQ ID NO: 475147 - DNA, 20 bp, mouse
gcccaactccaaggtgtcgg

SEQ ID NO: 475148 - DNA, 20 bp, mouse
gcagacccagcccaactcca

SEQ ID NO: 475149 - DNA, 20 bp, mouse
gtccaccgacaccttggagt

SEQ ID NO: 475150 - DNA, 20 bp, mouse
gggagtggaactcggagtag

SEQ ID NO: 475151 - DNA, 20 bp, mouse
gtgtagttccaccgacacct

SEQ ID NO: 475152 - DNA, 20 bp, mouse
gtgcgaaaccataagcatca

SEQ ID NO: 475153 - DNA, 20 bp, mouse
gaccataagcatcagggagc

SEQ ID NO: 475154 - DNA, 20 bp, mouse
ggcaggaggtacctggataa

SEQ ID NO: 475155 - DNA, 20 bp, mouse
gcaggccctggagtggaact

SEQ ID NO: 475156 - DNA, 20 bp, mouse
ggtcgctccgaagtgagcag

SEQ ID NO: 475157 - DNA, 20 bp, mouse
ggcgaactgagcctattccg

SEQ ID NO: 475158 - DNA, 20 bp, mouse
gaggggagaagcctcggaat

SEQ ID NO: 475159 - DNA, 20 bp, mouse
gcagcggtgtagcgaggtgg

SEQ ID NO: 475160 - DNA, 20 bp, mouse
ggccagagcccgcgtggaaa

SEQ ID NO: 475161 - DNA, 20 bp, mouse
ggctacaccgctgctcactt

SEQ ID NO: 475162 - DNA, 20 bp, mouse
gcacttcggagcgaccgctg

SEQ ID NO: 475163 - DNA, 20 bp, mouse
gctccacgcggcttcttcgt

SEQ ID NO: 475164 - DNA, 20 bp, mouse
gttgcggcccgtaacccgta

SEQ ID NO: 475165 - DNA, 20 bp, mouse
gacgggcgagctccgagaag

SEQ ID NO: 475166 - DNA, 20 bp, mouse
gagccagaggctgctaggtg

SEQ ID NO: 475167 - DNA, 20 bp, mouse
gtgggagaccgaggaggctc

SEQ ID NO: 475168 - DNA, 20 bp, mouse
ggcccgcacctagcagcctc

SEQ ID NO: 475169 - DNA, 20 bp, mouse
gcgcagagcggagagaacgg

SEQ ID NO: 475170 - DNA, 20 bp, mouse
gggctgctaggtgcgggctg

SEQ ID NO: 475171 - DNA, 20 bp, mouse
ggcccgcagagcggagagaa

SEQ ID NO: 475172 - DNA, 20 bp, mouse
ggatgacgcccgtcacgggg

SEQ ID NO: 475173 - DNA, 20 bp, mouse
gcacttcagagaccacgcgg

SEQ ID NO: 475174 - DNA, 20 bp, mouse
ggcgggccccgcgctccgag

SEQ ID NO: 475175 - DNA, 20 bp, mouse
gaattctggtgagcgggcca

SEQ ID NO: 475176 - DNA, 20 bp, mouse
gggatcccatcgctggggaa

SEQ ID NO: 475177 - DNA, 20 bp, mouse
gcagtggccgtcactcacca

SEQ ID NO: 475178 - DNA, 20 bp, mouse
gaccagggatcccatcgctg

SEQ ID NO: 475179 - DNA, 20 bp, mouse
gtgggatccctggtgagtga

SEQ ID NO: 475180 - DNA, 20 bp, mouse
ggcgggcgaccagatcagca

SEQ ID NO: 475181 - DNA, 20 bp, mouse
ggatctggtcgcccgcgcag

SEQ ID NO: 475182 - DNA, 20 bp, mouse
gccgcgaaggtgtccaaggt

SEQ ID NO: 475183 - DNA, 20 bp, mouse
ggctgcccttccccagcgat

SEQ ID NO: 475184 - DNA, 20 bp, mouse
ggcagcgtctcctttccagg

SEQ ID NO: 475185 - DNA, 20 bp, mouse
ggttgtattgccgcctggaa

SEQ ID NO: 475186 - DNA, 20 bp, mouse
ggacagtctcaggcacaacc

SEQ ID NO: 475187 - DNA, 20 bp, mouse
gagactgtcagataaagcgg

SEQ ID NO: 475188 - DNA, 20 bp, mouse
gaccctgcccgaggggaccc

SEQ ID NO: 475189 - DNA, 20 bp, mouse
gctcaggcacaacctggcgg

SEQ ID NO: 475190 - DNA, 20 bp, mouse
ggccagtcggggacaaacag

SEQ ID NO: 475191 - DNA, 20 bp, mouse
gaggcacaacctggcggcgg

SEQ ID NO: 475192 - DNA, 20 bp, mouse
ggcggcggcgatcacggccc

SEQ ID NO: 475193 - DNA, 20 bp, mouse
ggtcagataaagcggcgggc

SEQ ID NO: 475194 - DNA, 20 bp, mouse
gactctcggtccagcgagga

SEQ ID NO: 475195 - DNA, 20 bp, mouse
ggataaagcggcgggccggc

SEQ ID NO: 475196 - DNA, 20 bp, mouse
ggagggacgcgagaccgagg

SEQ ID NO: 475197 - DNA, 20 bp, mouse
gagacgaagcgggagctagg

SEQ ID NO: 475198 - DNA, 20 bp, mouse
gcggcggagggagacgaagc

SEQ ID NO: 475199 - DNA, 20 bp, mouse
ggtttaggcccggaccgcgg

SEQ ID NO: 475200 - DNA, 20 bp, mouse
gcccgtttaggcccggaccg

SEQ ID NO: 475201 - DNA, 20 bp, mouse
ggtccgggcctaaacgggag

SEQ ID NO: 475202 - DNA, 20 bp, mouse
gtaggcccggaccgcggcgg

SEQ ID NO: 475203 - DNA, 20 bp, mouse
gagagagggacgcgagaccg

SEQ ID NO: 475204 - DNA, 20 bp, mouse
gggcagtaggtgtcccggga

SEQ ID NO: 475205 - DNA, 20 bp, mouse
ggggagacgaagcgggagct

SEQ ID NO: 475206 - DNA, 20 bp, mouse
gagaggtggaaggcacaggg

SEQ ID NO: 475207 - DNA, 20 bp, mouse
gtcagcggctacagcgacag

SEQ ID NO: 475208 - DNA, 20 bp, mouse
gcggagcgcacctctcggaa

SEQ ID NO: 475209 - DNA, 20 bp, mouse
gtttactgcgggggactcga

SEQ ID NO: 475210 - DNA, 20 bp, mouse
gccgaggacctgcagagagg

SEQ ID NO: 475211 - DNA, 20 bp, mouse
gagccctgcgcggcagtcag

SEQ ID NO: 475212 - DNA, 20 bp, mouse
ggttgagccgaactttactg

SEQ ID NO: 475213 - DNA, 20 bp, mouse
gcggctgcggacgaacacag

SEQ ID NO: 475214 - DNA, 20 bp, mouse
gcagcccgtgcccggcgcac

SEQ ID NO: 475215 - DNA, 20 bp, mouse
ggccgaggcgaagcaggcgg

SEQ ID NO: 475216 - DNA, 20 bp, mouse
gggtttgtctgtttccgcgg

SEQ ID NO: 475217 - DNA, 20 bp, mouse
ggcagcagaggttcatgcag

SEQ ID NO: 475218 - DNA, 20 bp, mouse
ggcagaggttcatgcagcgg

SEQ ID NO: 475219 - DNA, 20 bp, mouse
gagcgtgcgctcctaggagg

SEQ ID NO: 475220 - DNA, 20 bp, mouse
gggcagccgcggtgcagcag

SEQ ID NO: 475221 - DNA, 20 bp, mouse
ggcggcatggagctgcggga

SEQ ID NO: 475222 - DNA, 20 bp, mouse
gagctgcgggagggtggcgg

SEQ ID NO: 475223 - DNA, 20 bp, mouse
ggaggttcatgcagcggcgg

SEQ ID NO: 475224 - DNA, 20 bp, mouse
gcggagcgtgcgctcctagg

SEQ ID NO: 475225 - DNA, 20 bp, mouse
ggtgcgctcctaggaggcgg

SEQ ID NO: 475226 - DNA, 20 bp, mouse
gagagcgccggcgacgacat

SEQ ID NO: 475227 - DNA, 20 bp, mouse
gcgcgcgggtgagtcttcag

SEQ ID NO: 475228 - DNA, 20 bp, mouse
ggaggatgcccggacatgtg

SEQ ID NO: 475229 - DNA, 20 bp, mouse
gcccatgcctatccatggag

SEQ ID NO: 475230 - DNA, 20 bp, mouse
gcaggcaacgcgcccggaag

SEQ ID NO: 475231 - DNA, 20 bp, mouse
ggcccggaagaggctctggg

SEQ ID NO: 475232 - DNA, 20 bp, mouse
ggggctttgcggggcgaacc

SEQ ID NO: 475233 - DNA, 20 bp, mouse
gagacagaagaggcccccga

SEQ ID NO: 475234 - DNA, 20 bp, mouse
ggacgcgcagggctgaagtt

SEQ ID NO: 475235 - DNA, 20 bp, mouse
ggtcgccggcgctctgggtg

SEQ ID NO: 475236 - DNA, 20 bp, mouse
gtccaagtaggcaagagggg

SEQ ID NO: 475237 - DNA, 20 bp, mouse
ggaactcggcaagccagtat

SEQ ID NO: 475238 - DNA, 20 bp, mouse
gttctccaagtaggcaagag

SEQ ID NO: 475239 - DNA, 20 bp, mouse
gagctatgggcttcccatac

SEQ ID NO: 475240 - DNA, 20 bp, mouse
gtccccaagaagcattgttg

SEQ ID NO: 475241 - DNA, 20 bp, mouse
gaatgcggacgacaccaggg

SEQ ID NO: 475242 - DNA, 20 bp, mouse
gtgagtcggtcaaggcatgt

SEQ ID NO: 475243 - DNA, 20 bp, mouse
gtccagacgtaggaagaatg

SEQ ID NO: 475244 - DNA, 20 bp, mouse
ggcccctccggcagaatcgg

SEQ ID NO: 475245 - DNA, 20 bp, mouse
gcagcagcatgagtcggtca

SEQ ID NO: 475246 - DNA, 20 bp, mouse
gctgggcgccaccttcgcag

SEQ ID NO: 475247 - DNA, 20 bp, mouse
gcggcgggtgagtggagcac

SEQ ID NO: 475248 - DNA, 20 bp, mouse
gggagcacggggaccggacg

SEQ ID NO: 475249 - DNA, 20 bp, mouse
gaggtggcgcccaggaagct

SEQ ID NO: 475250 - DNA, 20 bp, mouse
gaccctcagagaagattagg

SEQ ID NO: 475251 - DNA, 20 bp, mouse
ggccgccgccgctgcgaagg

SEQ ID NO: 475252 - DNA, 20 bp, mouse
ggccaccttcgcagcggcgg

SEQ ID NO: 475253 - DNA, 20 bp, mouse
ggtgagtggagcacggggac

SEQ ID NO: 475254 - DNA, 20 bp, mouse
gggcgccaccttcgcagcgg

SEQ ID NO: 475255 - DNA, 20 bp, mouse
ggagggtctggggagagcga

SEQ ID NO: 475256 - DNA, 20 bp, mouse
ggctataaggaagaagatac

SEQ ID NO: 475257 - DNA, 20 bp, mouse
gatctgggttggctgctata

SEQ ID NO: 475258 - DNA, 20 bp, mouse
gaaaccatggagcctcgggt

SEQ ID NO: 475259 - DNA, 20 bp, mouse
gcaacccacccgaggctcca

SEQ ID NO: 475260 - DNA, 20 bp, mouse
ggggccctgttgcacatgca

SEQ ID NO: 475261 - DNA, 20 bp, mouse
gctagagcccaacccacccg

SEQ ID NO: 475262 - DNA, 20 bp, mouse
gacatgcagggctgccaagc

SEQ ID NO: 475263 - DNA, 20 bp, mouse
gcagccctgcatgtgcaaca

SEQ ID NO: 475264 - DNA, 20 bp, mouse
ggcctctccccgttccagga

SEQ ID NO: 475265 - DNA, 20 bp, mouse
ggcttggttcagacttaggg

SEQ ID NO: 475266 - DNA, 20 bp, mouse
gagacaggcaggccgcggga

SEQ ID NO: 475267 - DNA, 20 bp, mouse
gctgttggacgaccttcccg

SEQ ID NO: 475268 - DNA, 20 bp, mouse
gagctcgaagcgagcagcca

SEQ ID NO: 475269 - DNA, 20 bp, mouse
ggggcggtccgcacggagac

SEQ ID NO: 475270 - DNA, 20 bp, mouse
gtgcggaccgcccaacccca

SEQ ID NO: 475271 - DNA, 20 bp, mouse
gagacaagtggatcggttct

SEQ ID NO: 475272 - DNA, 20 bp, mouse
gccaccgtagacaagtggat

SEQ ID NO: 475273 - DNA, 20 bp, mouse
ggagcggccgggcgaggatg

SEQ ID NO: 475274 - DNA, 20 bp, mouse
gctcgctgaacagctccgtg

SEQ ID NO: 475275 - DNA, 20 bp, mouse
gacagctccgtggggttggg

SEQ ID NO: 475276 - DNA, 20 bp, mouse
ggccgaagcctggggtctgt

SEQ ID NO: 475277 - DNA, 20 bp, mouse
gcagaccgggccgaagcctg

SEQ ID NO: 475278 - DNA, 20 bp, mouse
gacctacagaccccaggctt

SEQ ID NO: 475279 - DNA, 20 bp, mouse
gcctgagctggccctcagac

SEQ ID NO: 475280 - DNA, 20 bp, mouse
ggatcggaggacagtactca

SEQ ID NO: 475281 - DNA, 20 bp, mouse
gtggcaccacgcgatccaga

SEQ ID NO: 475282 - DNA, 20 bp, mouse
gctcagtaggacagcaggag

SEQ ID NO: 475283 - DNA, 20 bp, mouse
ggttgggtggagagctgctc

SEQ ID NO: 475284 - DNA, 20 bp, mouse
gggacctgtgaagctgaatt

SEQ ID NO: 475285 - DNA, 20 bp, mouse
gctcatggctgctaacatct

SEQ ID NO: 475286 - DNA, 20 bp, mouse
gccctcgagcgctccaggtg

SEQ ID NO: 475287 - DNA, 20 bp, mouse
gtcgagcgctccaggtgcgg

SEQ ID NO: 475288 - DNA, 20 bp, mouse
ggcgccccagccctgtcccg

SEQ ID NO: 475289 - DNA, 20 bp, mouse
gagcctggggccccgggaca

SEQ ID NO: 475290 - DNA, 20 bp, mouse
gcgctccaggtgcggcggtg

SEQ ID NO: 475291 - DNA, 20 bp, mouse
ggacagcagggtccgagcct

SEQ ID NO: 475292 - DNA, 20 bp, mouse
ggcctggagcccctacgagg

SEQ ID NO: 475293 - DNA, 20 bp, mouse
gcgaactggtcaagaaggag

SEQ ID NO: 475294 - DNA, 20 bp, mouse
gagtaggccagggactcagt

SEQ ID NO: 475295 - DNA, 20 bp, mouse
gggagactgcctcctcgtag

SEQ ID NO: 475296 - DNA, 20 bp, mouse
gtgtgggaacgcggcccgac

SEQ ID NO: 475297 - DNA, 20 bp, mouse
gcaggcggatcccaagacag

SEQ ID NO: 475298 - DNA, 20 bp, mouse
gacctgggagaaggccatgg

SEQ ID NO: 475299 - DNA, 20 bp, mouse
gcctcaggtgcggttctcag

SEQ ID NO: 475300 - DNA, 20 bp, mouse
gccatggtggccctcgctgt

SEQ ID NO: 475301 - DNA, 20 bp, mouse
gctggaccgccggtgactaa

SEQ ID NO: 475302 - DNA, 20 bp, mouse
gggacgacccgaggaaccac

SEQ ID NO: 475303 - DNA, 20 bp, mouse
gctgagagcgcggtgcccgt

SEQ ID NO: 475304 - DNA, 20 bp, mouse
gccgaaccccaggacaacgg

SEQ ID NO: 475305 - DNA, 20 bp, mouse
gggccgcgttcccacagcga

SEQ ID NO: 475306 - DNA, 20 bp, mouse
gggagcccaccgccgcccag

SEQ ID NO: 475307 - DNA, 20 bp, mouse
gccgctcacctggccaggta

SEQ ID NO: 475308 - DNA, 20 bp, mouse
ggagtggctgtcggacggac

SEQ ID NO: 475309 - DNA, 20 bp, mouse
gccgcgaggccgctgggcgg

SEQ ID NO: 475310 - DNA, 20 bp, mouse
gaggtccagagaccagaccc

SEQ ID NO: 475311 - DNA, 20 bp, mouse
ggcggggagtggctgtcgga

SEQ ID NO: 475312 - DNA, 20 bp, mouse
ggctccaccagagcgctcag

SEQ ID NO: 475313 - DNA, 20 bp, mouse
gacagggagactgcgctccg

SEQ ID NO: 475314 - DNA, 20 bp, mouse
ggaggccgctgggcggcggt

SEQ ID NO: 475315 - DNA, 20 bp, mouse
gcttccggggcgagggtcag

SEQ ID NO: 475316 - DNA, 20 bp, mouse
gcggctgtaggaaagcggag

SEQ ID NO: 475317 - DNA, 20 bp, mouse
gtcgggcgcagggaaatcac

SEQ ID NO: 475318 - DNA, 20 bp, mouse
ggcccaagccagcgtagaca

SEQ ID NO: 475319 - DNA, 20 bp, mouse
gtgctccacctggcaagtcc

SEQ ID NO: 475320 - DNA, 20 bp, mouse
gcttgggcgtctgctccacc

SEQ ID NO: 475321 - DNA, 20 bp, mouse
gccgcgcggctgtaggaaag

SEQ ID NO: 475322 - DNA, 20 bp, mouse
gtccgtgtctacgctggctt

SEQ ID NO: 475323 - DNA, 20 bp, mouse
gggagccaggacttgccagg

SEQ ID NO: 475324 - DNA, 20 bp, mouse
gtatccggagacgagcagtg

SEQ ID NO: 475325 - DNA, 20 bp, mouse
gatgcgctccgtgtctacgc

SEQ ID NO: 475326 - DNA, 20 bp, mouse
ggcgccggagcgggagggac

SEQ ID NO: 475327 - DNA, 20 bp, mouse
gaacaagcgccggagcggga

SEQ ID NO: 475328 - DNA, 20 bp, mouse
gagggacgggattgtagatc

SEQ ID NO: 475329 - DNA, 20 bp, mouse
ggccgcacccgagacttcta

SEQ ID NO: 475330 - DNA, 20 bp, mouse
gtgcccctcccggtccccta

SEQ ID NO: 475331 - DNA, 20 bp, mouse
gggattgtagatccggctcg

SEQ ID NO: 475332 - DNA, 20 bp, mouse
ggcatttaaagagacagacg

SEQ ID NO: 475333 - DNA, 20 bp, mouse
gagccctaggggaccgggag

SEQ ID NO: 475334 - DNA, 20 bp, mouse
gctaggcgagcaacaagcgc

SEQ ID NO: 475335 - DNA, 20 bp, mouse
ggagcaacaagcgccggagc

SEQ ID NO: 475336 - DNA, 20 bp, mouse
gcgcgcgagccgccaggaag

SEQ ID NO: 475337 - DNA, 20 bp, mouse
ggcgcctgaggaccacgagg

SEQ ID NO: 475338 - DNA, 20 bp, mouse
ggtcctcaggcgccatcgcg

SEQ ID NO: 475339 - DNA, 20 bp, mouse
gccacctgccagggaaagga

SEQ ID NO: 475340 - DNA, 20 bp, mouse
gatggcgcctgaggaccacg

SEQ ID NO: 475341 - DNA, 20 bp, mouse
gttcgagcgccgcttcctgg

SEQ ID NO: 475342 - DNA, 20 bp, mouse
gaaactctgcagcagagacg

SEQ ID NO: 475343 - DNA, 20 bp, mouse
gtggccccctcgtggtcctc

SEQ ID NO: 475344 - DNA, 20 bp, mouse
gggccaggtccccatccgaa

SEQ ID NO: 475345 - DNA, 20 bp, mouse
gccatcgcggggcagggcca

SEQ ID NO: 475346 - DNA, 20 bp, mouse
gggcgccccaacgagatgag

SEQ ID NO: 475347 - DNA, 20 bp, mouse
gggttccgctcatctcgttg

SEQ ID NO: 475348 - DNA, 20 bp, mouse
gaagctgcgcgcgcgtgtgt

SEQ ID NO: 475349 - DNA, 20 bp, mouse
gtggctggcggcacctggag

SEQ ID NO: 475350 - DNA, 20 bp, mouse
ggtccgccggcatggcccgg

SEQ ID NO: 475351 - DNA, 20 bp, mouse
gcgtcgggttccagggacct

SEQ ID NO: 475352 - DNA, 20 bp, mouse
gcgcagcccccgggccatgc

SEQ ID NO: 475353 - DNA, 20 bp, mouse
gaggacgagctgaaccgagg

SEQ ID NO: 475354 - DNA, 20 bp, mouse
gtgagcggaaccgggtccgc

SEQ ID NO: 475355 - DNA, 20 bp, mouse
ggccgtgggaagccctagag

SEQ ID NO: 475356 - DNA, 20 bp, mouse
gacggcaacatggccttgaa

SEQ ID NO: 475357 - DNA, 20 bp, mouse
ggtatgcgcttgggatgttt

SEQ ID NO: 475358 - DNA, 20 bp, mouse
gtaggtgagccggagagaca

SEQ ID NO: 475359 - DNA, 20 bp, mouse
gagcagtgaccacggcaaca

SEQ ID NO: 475360 - DNA, 20 bp, mouse
ggcccagcatgcggtaacca

SEQ ID NO: 475361 - DNA, 20 bp, mouse
gacggtgcaggtatgcgctt

SEQ ID NO: 475362 - DNA, 20 bp, mouse
gagctgcctcccgcacccca

SEQ ID NO: 475363 - DNA, 20 bp, mouse
gacatggccttgaacggtgc

SEQ ID NO: 475364 - DNA, 20 bp, mouse
gtgtttgggcagtggccgtg

SEQ ID NO: 475365 - DNA, 20 bp, mouse
gcgcatctcccgtctgatgg

SEQ ID NO: 475366 - DNA, 20 bp, mouse
gggcggagtcctaggagtcg

SEQ ID NO: 475367 - DNA, 20 bp, mouse
gctctccggagaccgggcca

SEQ ID NO: 475368 - DNA, 20 bp, mouse
gctctccgtggcccggtctc

SEQ ID NO: 475369 - DNA, 20 bp, mouse
gacaaagcacggcctgcggg

SEQ ID NO: 475370 - DNA, 20 bp, mouse
gaagcacggcctgcgggcgg

SEQ ID NO: 475371 - DNA, 20 bp, mouse
gccagagaaccagctctccg

SEQ ID NO: 475372 - DNA, 20 bp, mouse
gtgagatctctccggagacc

SEQ ID NO: 475373 - DNA, 20 bp, mouse
gtcggggacggaacaaagca

SEQ ID NO: 475374 - DNA, 20 bp, mouse
gggagcataggcggagtcct

SEQ ID NO: 475375 - DNA, 20 bp, mouse
ggatctcagccaccgcccgc

SEQ ID NO: 475376 - DNA, 20 bp, mouse
gcagctcccggtagaagtgg

SEQ ID NO: 475377 - DNA, 20 bp, mouse
ggccgcccgggacccaggat

SEQ ID NO: 475378 - DNA, 20 bp, mouse
gtctcagctcccggtagaag

SEQ ID NO: 475379 - DNA, 20 bp, mouse
gccgaaggaaagggccgggt

SEQ ID NO: 475380 - DNA, 20 bp, mouse
ggatgggagcccaacgagcg

SEQ ID NO: 475381 - DNA, 20 bp, mouse
gcgacgccgccacttctacc

SEQ ID NO: 475382 - DNA, 20 bp, mouse
gctgctcccgcgcgccctgg

SEQ ID NO: 475383 - DNA, 20 bp, mouse
gggcctggtgggccgagaag

SEQ ID NO: 475384 - DNA, 20 bp, mouse
ggcccggagccgcgctcgtt

SEQ ID NO: 475385 - DNA, 20 bp, mouse
gtcccatcctgggtcccggg

SEQ ID NO: 475386 - DNA, 20 bp, mouse
gggtcccctagtcagagaga

SEQ ID NO: 475387 - DNA, 20 bp, mouse
gtctgactaggggacccctg

SEQ ID NO: 475388 - DNA, 20 bp, mouse
gagagaaggcagctagtact

SEQ ID NO: 475389 - DNA, 20 bp, mouse
gcttggggaggataaggaca

SEQ ID NO: 475390 - DNA, 20 bp, mouse
gggataaggacagggcccca

SEQ ID NO: 475391 - DNA, 20 bp, mouse
ggcacctgctgccaggatct

SEQ ID NO: 475392 - DNA, 20 bp, mouse
gagctgccttctctctgact

SEQ ID NO: 475393 - DNA, 20 bp, mouse
gtcttcacgcagcacaggtg

SEQ ID NO: 475394 - DNA, 20 bp, mouse
gggagtctggggccattaga

SEQ ID NO: 475395 - DNA, 20 bp, mouse
gactcaaaggcaatcaggga

SEQ ID NO: 475396 - DNA, 20 bp, mouse
gtaggggagcagagaatagg

SEQ ID NO: 475397 - DNA, 20 bp, mouse
gctgcaacgcgaaggaccta

SEQ ID NO: 475398 - DNA, 20 bp, mouse
gtagagctgtaggcagtcca

SEQ ID NO: 475399 - DNA, 20 bp, mouse
gctttacagctaatttccct

SEQ ID NO: 475400 - DNA, 20 bp, mouse
gggaagttctctctcgaggt

SEQ ID NO: 475401 - DNA, 20 bp, mouse
gagaggcggcattggagagg

SEQ ID NO: 475402 - DNA, 20 bp, mouse
gagtctggtaaaaaccccaa

SEQ ID NO: 475403 - DNA, 20 bp, mouse
gtctctctcgaggtcggctg

SEQ ID NO: 475404 - DNA, 20 bp, mouse
gggaggagggcctcaccctt

SEQ ID NO: 475405 - DNA, 20 bp, mouse
gactcaaaactgcaacgcga

SEQ ID NO: 475406 - DNA, 20 bp, mouse
gaccgcggttccgggatggt

SEQ ID NO: 475407 - DNA, 20 bp, mouse
ggcggttccgggatggtggg

SEQ ID NO: 475408 - DNA, 20 bp, mouse
gcgggacacccctccaccag

SEQ ID NO: 475409 - DNA, 20 bp, mouse
gagtggcctagaggtcacca

SEQ ID NO: 475410 - DNA, 20 bp, mouse
gccgccgccgcccaccatcc

SEQ ID NO: 475411 - DNA, 20 bp, mouse
gacggcgggcgaggaagatg

SEQ ID NO: 475412 - DNA, 20 bp, mouse
gtccggggagcggccagtga

SEQ ID NO: 475413 - DNA, 20 bp, mouse
ggttccgggatggtgggcgg

SEQ ID NO: 475414 - DNA, 20 bp, mouse
gcccacggctaagaaccgaa

SEQ ID NO: 475415 - DNA, 20 bp, mouse
gaggaagtgcgcggaaggag

SEQ ID NO: 475416 - DNA, 20 bp, mouse
ggtacgcgttgccggcgaga

SEQ ID NO: 475417 - DNA, 20 bp, mouse
gggaaggagcgcatgcgcta

SEQ ID NO: 475418 - DNA, 20 bp, mouse
gcgtcaggctgccctctcgc

SEQ ID NO: 475419 - DNA, 20 bp, mouse
gagagggcagcctgacgact

SEQ ID NO: 475420 - DNA, 20 bp, mouse
gctgtaggggagcaccgggg

SEQ ID NO: 475421 - DNA, 20 bp, mouse
gggagcaccggggaggacga

SEQ ID NO: 475422 - DNA, 20 bp, mouse
gatctagggtaagacggcgg

SEQ ID NO: 475423 - DNA, 20 bp, mouse
ggcgggagtcgggtgcggag

SEQ ID NO: 475424 - DNA, 20 bp, mouse
gggccagcagcgggaagctc

SEQ ID NO: 475425 - DNA, 20 bp, mouse
gagagccccggcaactcctc

SEQ ID NO: 475426 - DNA, 20 bp, mouse
gcccgaaaccagcatggaag

SEQ ID NO: 475427 - DNA, 20 bp, mouse
gtggaccaagcgaccatgag

SEQ ID NO: 475428 - DNA, 20 bp, mouse
gctcgggcccgaaaccagca

SEQ ID NO: 475429 - DNA, 20 bp, mouse
gactcaccccagcgcctcca

SEQ ID NO: 475430 - DNA, 20 bp, mouse
ggtacacaaggcctgctccg

SEQ ID NO: 475431 - DNA, 20 bp, mouse
gtccagacgcaactgcggtg

SEQ ID NO: 475432 - DNA, 20 bp, mouse
gtggtttcgggcccgagctc

SEQ ID NO: 475433 - DNA, 20 bp, mouse
gtagccgggaccctgggagc

SEQ ID NO: 475434 - DNA, 20 bp, mouse
ggcaggccttgtgtaccggg

SEQ ID NO: 475435 - DNA, 20 bp, mouse
gccgccggctcccagggtcc

SEQ ID NO: 475436 - DNA, 20 bp, mouse
ggctaccatggccccatcca

SEQ ID NO: 475437 - DNA, 20 bp, mouse
ggggtgaccttctgacactg

SEQ ID NO: 475438 - DNA, 20 bp, mouse
gtccgcagacggagttgcca

SEQ ID NO: 475439 - DNA, 20 bp, mouse
gagacggagttgccatggat

SEQ ID NO: 475440 - DNA, 20 bp, mouse
gagaaggtcacccgctacca

SEQ ID NO: 475441 - DNA, 20 bp, mouse
gcgcgcaccgggtccgcaga

SEQ ID NO: 475442 - DNA, 20 bp, mouse
gcgagacgccccctccggga

SEQ ID NO: 475443 - DNA, 20 bp, mouse
gctctggagcggcgagagga

SEQ ID NO: 475444 - DNA, 20 bp, mouse
gactggggtaaaagattcgg

SEQ ID NO: 475445 - DNA, 20 bp, mouse
gcacagaggaagagttcctg

SEQ ID NO: 475446 - DNA, 20 bp, mouse
ggaactcactgcagcggaac

SEQ ID NO: 475447 - DNA, 20 bp, mouse
gcaggctgagtcgctctcaa

SEQ ID NO: 475448 - DNA, 20 bp, mouse
gtcgctctcaaagggccaca

SEQ ID NO: 475449 - DNA, 20 bp, mouse
gtctcaaagggccacaaggc

SEQ ID NO: 475450 - DNA, 20 bp, mouse
gcccaggtgaaggaccctaa

SEQ ID NO: 475451 - DNA, 20 bp, mouse
ggccttgctctggctggtcc

SEQ ID NO: 475452 - DNA, 20 bp, mouse
gccctgaagtggatacagat

SEQ ID NO: 475453 - DNA, 20 bp, mouse
gaagtggatacagatcggag

SEQ ID NO: 475454 - DNA, 20 bp, mouse
gagccagagcaaggcgctac

SEQ ID NO: 475455 - DNA, 20 bp, mouse
gcgacaactgaaacgtagaa

SEQ ID NO: 475456 - DNA, 20 bp, mouse
gctaggggtgctgccatggg

SEQ ID NO: 475457 - DNA, 20 bp, mouse
gcggctaggggtgctgccat

SEQ ID NO: 475458 - DNA, 20 bp, mouse
gggaccagcgcggcccagga

SEQ ID NO: 475459 - DNA, 20 bp, mouse
gggcatagcgtctggaacac

SEQ ID NO: 475460 - DNA, 20 bp, mouse
gccatgggtggtgggccccg

SEQ ID NO: 475461 - DNA, 20 bp, mouse
ggggtgctgccatgggtggt

SEQ ID NO: 475462 - DNA, 20 bp, mouse
gccggggcctccgaaaaact

SEQ ID NO: 475463 - DNA, 20 bp, mouse
gcccaggacggctgactcgc

SEQ ID NO: 475464 - DNA, 20 bp, mouse
ggcgagcccggcatagcgtc

SEQ ID NO: 475465 - DNA, 20 bp, mouse
gtgccgggctcgccggctag

SEQ ID NO: 475466 - DNA, 20 bp, mouse
gaatgcgcgggcgggaggtt

SEQ ID NO: 475467 - DNA, 20 bp, mouse
gcaactggaacgtggcaatt

SEQ ID NO: 475468 - DNA, 20 bp, mouse
gcacgttccagttgcaccaa

SEQ ID NO: 475469 - DNA, 20 bp, mouse
ggtcccagcgtgcaatgcgc

SEQ ID NO: 475470 - DNA, 20 bp, mouse
gcagcgtgcaatgcgcgggc

SEQ ID NO: 475471 - DNA, 20 bp, mouse
gagttgttcaggcaactatt

SEQ ID NO: 475472 - DNA, 20 bp, mouse
gcgtgcaatgcgcgggcggg

SEQ ID NO: 475473 - DNA, 20 bp, mouse
ggtctcccagtccacaactg

SEQ ID NO: 475474 - DNA, 20 bp, mouse
gtggtagccagaggggacct

SEQ ID NO: 475475 - DNA, 20 bp, mouse
gagccagaggggacctggga

SEQ ID NO: 475476 - DNA, 20 bp, mouse
gccgcggccgcaagggagtg

SEQ ID NO: 475477 - DNA, 20 bp, mouse
gtgcgcccgagtctcaacgt

SEQ ID NO: 475478 - DNA, 20 bp, mouse
gaaaacttggcacagcctca

SEQ ID NO: 475479 - DNA, 20 bp, mouse
gtcaagccgcagaagccggg

SEQ ID NO: 475480 - DNA, 20 bp, mouse
ggacggtgagaagctacggt

SEQ ID NO: 475481 - DNA, 20 bp, mouse
ggcacgcgcagtgcactctg

SEQ ID NO: 475482 - DNA, 20 bp, mouse
gcttctgcggcttgaaaact

SEQ ID NO: 475483 - DNA, 20 bp, mouse
gctctgggtgaggaccaccc

SEQ ID NO: 475484 - DNA, 20 bp, mouse
gctgccctagcaggaaacgg

SEQ ID NO: 475485 - DNA, 20 bp, mouse
ggcaggacggtgagaagcta

SEQ ID NO: 475486 - DNA, 20 bp, mouse
gcgggaaagtcgaaaacgaa

SEQ ID NO: 475487 - DNA, 20 bp, mouse
gaagcaactggcgggtcccc

SEQ ID NO: 475488 - DNA, 20 bp, mouse
gtggcgggtccccaggttag

SEQ ID NO: 475489 - DNA, 20 bp, mouse
ggactttcccgctagaagaa

SEQ ID NO: 475490 - DNA, 20 bp, mouse
gacgaagggaagcaactggc

SEQ ID NO: 475491 - DNA, 20 bp, mouse
gcctaaaaagccactaacct

SEQ ID NO: 475492 - DNA, 20 bp, mouse
gggcgagtaacgtcacgcca

SEQ ID NO: 475493 - DNA, 20 bp, mouse
gcagagcgccgttcttctag

SEQ ID NO: 475494 - DNA, 20 bp, mouse
gtgcatataggaacccgaag

SEQ ID NO: 475495 - DNA, 20 bp, mouse
gtggctttttaggctttcct

SEQ ID NO: 475496 - DNA, 20 bp, mouse
gcccctggccgggatagtaa

SEQ ID NO: 475497 - DNA, 20 bp, mouse
gtggccgggatagtaatggt

SEQ ID NO: 475498 - DNA, 20 bp, mouse
gaatctgcgtggagtttagt

SEQ ID NO: 475499 - DNA, 20 bp, mouse
gtccgggagagggacttcca

SEQ ID NO: 475500 - DNA, 20 bp, mouse
gtagtaggtgagcccctggc

SEQ ID NO: 475501 - DNA, 20 bp, mouse
gtgggcgtcggttggatccc

SEQ ID NO: 475502 - DNA, 20 bp, mouse
gccaaggcctgggcgtcggt

SEQ ID NO: 475503 - DNA, 20 bp, mouse
gtctcccggagcgggacaca

SEQ ID NO: 475504 - DNA, 20 bp, mouse
gggatagtaatggtgggtcc

SEQ ID NO: 475505 - DNA, 20 bp, mouse
ggccctggaagtccctctcc

SEQ ID NO: 475506 - DNA, 20 bp, mouse
ggagctttgcgcggctggag

SEQ ID NO: 475507 - DNA, 20 bp, mouse
gcggctaggacacgcgggat

SEQ ID NO: 475508 - DNA, 20 bp, mouse
gagggtgctccggctttcct

SEQ ID NO: 475509 - DNA, 20 bp, mouse
gtggcttcgggagctttgcg

SEQ ID NO: 475510 - DNA, 20 bp, mouse
gggcggcggctaggacacgc

SEQ ID NO: 475511 - DNA, 20 bp, mouse
ggcgcagagcggacgcgggg

SEQ ID NO: 475512 - DNA, 20 bp, mouse
gccagcgcagagcggacgcg

SEQ ID NO: 475513 - DNA, 20 bp, mouse
gcggcgtcgccagcgcagag

SEQ ID NO: 475514 - DNA, 20 bp, mouse
gaggctacggagtccgaccc

SEQ ID NO: 475515 - DNA, 20 bp, mouse
gccgccccttcaggctctac

SEQ ID NO: 475516 - DNA, 20 bp, mouse
ggggtcgctggtgagcacgt

SEQ ID NO: 475517 - DNA, 20 bp, mouse
gaccagcgacccacacgaca

SEQ ID NO: 475518 - DNA, 20 bp, mouse
ggctgttggccgtgtcgtgt

SEQ ID NO: 475519 - DNA, 20 bp, mouse
gtgcacaagcggctccatgg

SEQ ID NO: 475520 - DNA, 20 bp, mouse
gaacagctcggagaatcgct

SEQ ID NO: 475521 - DNA, 20 bp, mouse
gctcgcgcctcgggatgtca

SEQ ID NO: 475522 - DNA, 20 bp, mouse
gtgctgcacaagcggctcca

SEQ ID NO: 475523 - DNA, 20 bp, mouse
ggccgtgtcgtgtgggtcgc

SEQ ID NO: 475524 - DNA, 20 bp, mouse
gagcacgtgggacgccgaaa

SEQ ID NO: 475525 - DNA, 20 bp, mouse
gggaggaccaggcgcgactg

SEQ ID NO: 475526 - DNA, 20 bp, mouse
ggcagagcgccgccagagac

SEQ ID NO: 475527 - DNA, 20 bp, mouse
ggtctgcagggcctccgcgg

SEQ ID NO: 475528 - DNA, 20 bp, mouse
ggtgttgaggctagtttagg

SEQ ID NO: 475529 - DNA, 20 bp, mouse
gagagtgttgaggctagttt

SEQ ID NO: 475530 - DNA, 20 bp, mouse
gcgctctgccttagaaccaa

SEQ ID NO: 475531 - DNA, 20 bp, mouse
ggaggctagtttaggaggag

SEQ ID NO: 475532 - DNA, 20 bp, mouse
ggcggttagggtgaagacac

SEQ ID NO: 475533 - DNA, 20 bp, mouse
gtggactgccgttggttcta

SEQ ID NO: 475534 - DNA, 20 bp, mouse
gttgcagcttggccaaccac

SEQ ID NO: 475535 - DNA, 20 bp, mouse
gttagggtgaagacaccggt

SEQ ID NO: 475536 - DNA, 20 bp, mouse
gctgcagggcagggccaata

SEQ ID NO: 475537 - DNA, 20 bp, mouse
ggtcacctcaacctcagctc

SEQ ID NO: 475538 - DNA, 20 bp, mouse
gttggaaggatcccgagctg

SEQ ID NO: 475539 - DNA, 20 bp, mouse
gggatcccgagctgaggttg

SEQ ID NO: 475540 - DNA, 20 bp, mouse
gagggcagggccaataggga

SEQ ID NO: 475541 - DNA, 20 bp, mouse
gcggctgcgtggagtagagc

SEQ ID NO: 475542 - DNA, 20 bp, mouse
ggctctgggcaacggaagtg

SEQ ID NO: 475543 - DNA, 20 bp, mouse
gaggttgaggtgactgttca

SEQ ID NO: 475544 - DNA, 20 bp, mouse
gagtcggaagtgcacctcgg

SEQ ID NO: 475545 - DNA, 20 bp, mouse
gtggagtagagcgggaattt

SEQ ID NO: 475546 - DNA, 20 bp, mouse
gggttctgaggaagtagcag

SEQ ID NO: 475547 - DNA, 20 bp, mouse
gcgtccatggcgcacaggaa

SEQ ID NO: 475548 - DNA, 20 bp, mouse
gacgccgcgcgacacagggt

SEQ ID NO: 475549 - DNA, 20 bp, mouse
gaggaagtagcagcgggaaa

SEQ ID NO: 475550 - DNA, 20 bp, mouse
gcagcgggaaatggcgcaac

SEQ ID NO: 475551 - DNA, 20 bp, mouse
ggcgacagaacgacccctca

SEQ ID NO: 475552 - DNA, 20 bp, mouse
gtcggctcaggtaccctgag

SEQ ID NO: 475553 - DNA, 20 bp, mouse
ggtatcggcgctacttctcc

SEQ ID NO: 475554 - DNA, 20 bp, mouse
gcgcatgcgcggtcgctagg

SEQ ID NO: 475555 - DNA, 20 bp, mouse
gcaggcagccggagacgccg

SEQ ID NO: 475556 - DNA, 20 bp, mouse
gtcgctggcgggagactaat

SEQ ID NO: 475557 - DNA, 20 bp, mouse
gatccaggcgggttcctcag

SEQ ID NO: 475558 - DNA, 20 bp, mouse
gcagcagcggagctccgctg

SEQ ID NO: 475559 - DNA, 20 bp, mouse
gctaatgggcgtccgagtcg

SEQ ID NO: 475560 - DNA, 20 bp, mouse
gatgggcgtccgagtcgcgg

SEQ ID NO: 475561 - DNA, 20 bp, mouse
gggacccactgtgtcgctgg

SEQ ID NO: 475562 - DNA, 20 bp, mouse
gctgccggaggaggacgacg

SEQ ID NO: 475563 - DNA, 20 bp, mouse
gcagcgcaaccgccgcgact

SEQ ID NO: 475564 - DNA, 20 bp, mouse
gggcggcgtacgaggctgag

SEQ ID NO: 475565 - DNA, 20 bp, mouse
ggcacctcgtcgtcctcctc

SEQ ID NO: 475566 - DNA, 20 bp, mouse
gacgaagacaggcgttagga

SEQ ID NO: 475567 - DNA, 20 bp, mouse
gtaggagggcggcgccgcca

SEQ ID NO: 475568 - DNA, 20 bp, mouse
gagcgacgccagacgaagac

SEQ ID NO: 475569 - DNA, 20 bp, mouse
gaagacaggcgttaggaggg

SEQ ID NO: 475570 - DNA, 20 bp, mouse
gccagacgaagacaggcgtt

SEQ ID NO: 475571 - DNA, 20 bp, mouse
gtccatggtcagctgctccc

SEQ ID NO: 475572 - DNA, 20 bp, mouse
gtgcccatccccggttgtca

SEQ ID NO: 475573 - DNA, 20 bp, mouse
gtagcccgccgcttactgtg

SEQ ID NO: 475574 - DNA, 20 bp, mouse
gcatggagccccacagtaag

SEQ ID NO: 475575 - DNA, 20 bp, mouse
ggtaagcccattgctagtga

SEQ ID NO: 475576 - DNA, 20 bp, mouse
ggaaggagaagtaggatcta

SEQ ID NO: 475577 - DNA, 20 bp, mouse
ggattctcactgcacagcgt

SEQ ID NO: 475578 - DNA, 20 bp, mouse
gatactggcgatgtaagggt

SEQ ID NO: 475579 - DNA, 20 bp, mouse
gaggctgcctgggctgagta

SEQ ID NO: 475580 - DNA, 20 bp, mouse
gtctgcggtcgtccccgaga

SEQ ID NO: 475581 - DNA, 20 bp, mouse
gggggacgaccgcagagtag

SEQ ID NO: 475582 - DNA, 20 bp, mouse
gcctgacttcagcttccaag

SEQ ID NO: 475583 - DNA, 20 bp, mouse
ggcaatcaccgccagaccag

SEQ ID NO: 475584 - DNA, 20 bp, mouse
ggtctacatagaagaaaatt

SEQ ID NO: 475585 - DNA, 20 bp, mouse
gcttagttcctcctgagaaa

SEQ ID NO: 475586 - DNA, 20 bp, mouse
gagtgaggagagcgcgacca

SEQ ID NO: 475587 - DNA, 20 bp, mouse
gcggcgtagccatcgctgaa

SEQ ID NO: 475588 - DNA, 20 bp, mouse
gcgtgccgctcacctcgacg

SEQ ID NO: 475589 - DNA, 20 bp, mouse
gcacctcgacgcggaagctc

SEQ ID NO: 475590 - DNA, 20 bp, mouse
ggcttccgcgtcgaggtgag

SEQ ID NO: 475591 - DNA, 20 bp, mouse
gcatcgctgaagggagagcg

SEQ ID NO: 475592 - DNA, 20 bp, mouse
ggggcggtgaaaagcgagtg

SEQ ID NO: 475593 - DNA, 20 bp, mouse
gctcttcagcagccggtcgg

SEQ ID NO: 475594 - DNA, 20 bp, mouse
ggggacagtcccagcagagg

SEQ ID NO: 475595 - DNA, 20 bp, mouse
gggcccgagcttccgcgtcg

SEQ ID NO: 475596 - DNA, 20 bp, mouse
ggtcctcccggagatgaagg

SEQ ID NO: 475597 - DNA, 20 bp, mouse
gttgggagccgggagagcag

SEQ ID NO: 475598 - DNA, 20 bp, mouse
gacggtcctcccggagatga

SEQ ID NO: 475599 - DNA, 20 bp, mouse
gagagcctacaggactctgg

SEQ ID NO: 475600 - DNA, 20 bp, mouse
ggaggaccgtgaccaccagc

SEQ ID NO: 475601 - DNA, 20 bp, mouse
gcgagtgcctccttcatctc

SEQ ID NO: 475602 - DNA, 20 bp, mouse
gtgcctccttcatctccggg

SEQ ID NO: 475603 - DNA, 20 bp, mouse
ggactctggaggactgtgag

SEQ ID NO: 475604 - DNA, 20 bp, mouse
gcagtcctccagagtcctgt

SEQ ID NO: 475605 - DNA, 20 bp, mouse
gggtacctgctgcttcagtg

SEQ ID NO: 475606 - DNA, 20 bp, mouse
gccgaggtccgagccatcaa

SEQ ID NO: 475607 - DNA, 20 bp, mouse
gccgggaccagccgcctccg

SEQ ID NO: 475608 - DNA, 20 bp, mouse
gaggtccgagccatcaaagg

SEQ ID NO: 475609 - DNA, 20 bp, mouse
ggcgcgagctaggcaggcgg

SEQ ID NO: 475610 - DNA, 20 bp, mouse
gcgcctccgaggctgttgag

SEQ ID NO: 475611 - DNA, 20 bp, mouse
ggaggcggctggtcccggcg

SEQ ID NO: 475612 - DNA, 20 bp, mouse
gcccggacccggagccaccg

SEQ ID NO: 475613 - DNA, 20 bp, mouse
ggctgttgagcgggaaatga

SEQ ID NO: 475614 - DNA, 20 bp, mouse
ggcgggcgcgcgagctaggc

SEQ ID NO: 475615 - DNA, 20 bp, mouse
ggcgagcgaggggtccccgc

SEQ ID NO: 475616 - DNA, 20 bp, mouse
ggctagctgtcgggatcggg

SEQ ID NO: 475617 - DNA, 20 bp, mouse
ggcggcgcgggcgcaggacg

SEQ ID NO: 475618 - DNA, 20 bp, mouse
ggcgcgggcgcaggacgtgg

SEQ ID NO: 475619 - DNA, 20 bp, mouse
gaggccggtgtggcacggtg

SEQ ID NO: 475620 - DNA, 20 bp, mouse
gcgggcgcaggacgtggagg

SEQ ID NO: 475621 - DNA, 20 bp, mouse
ggcggcggcgcaggccggtg

SEQ ID NO: 475622 - DNA, 20 bp, mouse
gcgtcctcaccgtgccacac

SEQ ID NO: 475623 - DNA, 20 bp, mouse
gggcgcaggccggtgtggca

SEQ ID NO: 475624 - DNA, 20 bp, mouse
gagcagctagctgtcgggat

SEQ ID NO: 475625 - DNA, 20 bp, mouse
gcggggaagcagctagctgt

SEQ ID NO: 475626 - DNA, 20 bp, mouse
gcccagcgcgcccagcgtct

SEQ ID NO: 475627 - DNA, 20 bp, mouse
gaggttaagctcagtgacgg

SEQ ID NO: 475628 - DNA, 20 bp, mouse
gtctgtgaccaggagctcaa

SEQ ID NO: 475629 - DNA, 20 bp, mouse
ggagcggctcaagggaccta

SEQ ID NO: 475630 - DNA, 20 bp, mouse
gctctggctaccgagacgct

SEQ ID NO: 475631 - DNA, 20 bp, mouse
gtcttgacgggaagaggcca

SEQ ID NO: 475632 - DNA, 20 bp, mouse
gtggccttgctgcagagtag

SEQ ID NO: 475633 - DNA, 20 bp, mouse
gcgccggggaaaccaaacgc

SEQ ID NO: 475634 - DNA, 20 bp, mouse
gttccgggatcttcactaag

SEQ ID NO: 475635 - DNA, 20 bp, mouse
gctgctgtgcacgaaaacga

SEQ ID NO: 475636 - DNA, 20 bp, mouse
gagcacgctgggagtagcca

SEQ ID NO: 475637 - DNA, 20 bp, mouse
gacgctgggagtagccatgg

SEQ ID NO: 475638 - DNA, 20 bp, mouse
gggctggaggtagctgatgg

SEQ ID NO: 475639 - DNA, 20 bp, mouse
gggccgccggacctgactag

SEQ ID NO: 475640 - DNA, 20 bp, mouse
ggcagcaacagctccaaaac

SEQ ID NO: 475641 - DNA, 20 bp, mouse
gccggtcccctagtcaggtc

SEQ ID NO: 475642 - DNA, 20 bp, mouse
gggcggctggaggtagctga

SEQ ID NO: 475643 - DNA, 20 bp, mouse
gaaaacgggattatccgcca

SEQ ID NO: 475644 - DNA, 20 bp, mouse
gggtgcgctggtgggaagtc

SEQ ID NO: 475645 - DNA, 20 bp, mouse
gtacgtgctggtgcaccgtg

SEQ ID NO: 475646 - DNA, 20 bp, mouse
gcggggcgggcactcactgt

SEQ ID NO: 475647 - DNA, 20 bp, mouse
gtcactgtaggtccggccca

SEQ ID NO: 475648 - DNA, 20 bp, mouse
gccgagcccaagccacgggg

SEQ ID NO: 475649 - DNA, 20 bp, mouse
ggcccagggcttggaagagc

SEQ ID NO: 475650 - DNA, 20 bp, mouse
ggcaccgagcccaagccacg

SEQ ID NO: 475651 - DNA, 20 bp, mouse
ggctgctgggcgaggagact

SEQ ID NO: 475652 - DNA, 20 bp, mouse
gcgggcactcactgtaggtc

SEQ ID NO: 475653 - DNA, 20 bp, mouse
gcagtcggcatggcgagtcg

SEQ ID NO: 475654 - DNA, 20 bp, mouse
gacctgctcttccaagccct

SEQ ID NO: 475655 - DNA, 20 bp, mouse
gagggcgagcagacttcccc

SEQ ID NO: 475656 - DNA, 20 bp, mouse
ggcgtcccaaagcttaccag

SEQ ID NO: 475657 - DNA, 20 bp, mouse
gggccgcaggctgcccacac

SEQ ID NO: 475658 - DNA, 20 bp, mouse
gatgcagcgtcccacatccc

SEQ ID NO: 475659 - DNA, 20 bp, mouse
gccttgctgcagacatgctg

SEQ ID NO: 475660 - DNA, 20 bp, mouse
gtgtgggacgctgcatactg

SEQ ID NO: 475661 - DNA, 20 bp, mouse
gaacagcgggcggcctgtgt

SEQ ID NO: 475662 - DNA, 20 bp, mouse
gagcaagggaaaacagcggg

SEQ ID NO: 475663 - DNA, 20 bp, mouse
gtgcagacatgctgtggatc

SEQ ID NO: 475664 - DNA, 20 bp, mouse
gtatggctggagagggactc

SEQ ID NO: 475665 - DNA, 20 bp, mouse
gtgcagcaagggaaaacagc

SEQ ID NO: 475666 - DNA, 20 bp, mouse
gggcacccagccccaggaaa

SEQ ID NO: 475667 - DNA, 20 bp, mouse
ggtagtggtgacacaggtgg

SEQ ID NO: 475668 - DNA, 20 bp, mouse
gcctccacaaggctgtgaga

SEQ ID NO: 475669 - DNA, 20 bp, mouse
gggaggagactcaggtgtca

SEQ ID NO: 475670 - DNA, 20 bp, mouse
gagaaggaaaccctttcctg

SEQ ID NO: 475671 - DNA, 20 bp, mouse
ggtggtagtggtgacacagg

SEQ ID NO: 475672 - DNA, 20 bp, mouse
gggggacatgggtaattcat

SEQ ID NO: 475673 - DNA, 20 bp, mouse
gctgcatggcacccagcccc

SEQ ID NO: 475674 - DNA, 20 bp, mouse
ggttgcagccaggaacgcga

SEQ ID NO: 475675 - DNA, 20 bp, mouse
ggcggtggtagtggtgacac

SEQ ID NO: 475676 - DNA, 20 bp, mouse
gggagccagagagacggcag

SEQ ID NO: 475677 - DNA, 20 bp, mouse
gcgcggcaggcgaactggac

SEQ ID NO: 475678 - DNA, 20 bp, mouse
gcccggaaccccgaacgcag

SEQ ID NO: 475679 - DNA, 20 bp, mouse
gaggagcgcggcaggcgaac

SEQ ID NO: 475680 - DNA, 20 bp, mouse
gcgcagcggcgtacctgtct

SEQ ID NO: 475681 - DNA, 20 bp, mouse
gtagcgcgcgcggaaccgag

SEQ ID NO: 475682 - DNA, 20 bp, mouse
gagacgacaagcgaggagcg

SEQ ID NO: 475683 - DNA, 20 bp, mouse
gcgtctctctggctccctct

SEQ ID NO: 475684 - DNA, 20 bp, mouse
gtggaggcagacgacaagcg

SEQ ID NO: 475685 - DNA, 20 bp, mouse
gcaaccgggtgcaggagtct

SEQ ID NO: 475686 - DNA, 20 bp, mouse
gcccgcggcctcctcatcag

SEQ ID NO: 475687 - DNA, 20 bp, mouse
ggcgtctgggggcgatccgg

SEQ ID NO: 475688 - DNA, 20 bp, mouse
gcggtggcccgctgatgagg

SEQ ID NO: 475689 - DNA, 20 bp, mouse
gaccctgtcccggccccaag

SEQ ID NO: 475690 - DNA, 20 bp, mouse
gactcggtggcccgctgatg

SEQ ID NO: 475691 - DNA, 20 bp, mouse
gtcgcagtccagcgccaggg

SEQ ID NO: 475692 - DNA, 20 bp, mouse
gtgaggggcggacctcggga

SEQ ID NO: 475693 - DNA, 20 bp, mouse
gtgttagtggtggtgaccac

SEQ ID NO: 475694 - DNA, 20 bp, mouse
gccaagaggcgagcagcccg

SEQ ID NO: 475695 - DNA, 20 bp, mouse
ggggcgatccgggggctgct

SEQ ID NO: 475696 - DNA, 20 bp, mouse
gaagaaaagcggtcccaggg

SEQ ID NO: 475697 - DNA, 20 bp, mouse
gcccagggcggcgtgcacca

SEQ ID NO: 475698 - DNA, 20 bp, mouse
gcagaagaaaagcggtccca

SEQ ID NO: 475699 - DNA, 20 bp, mouse
gtgggacacggtctgtatcc

SEQ ID NO: 475700 - DNA, 20 bp, mouse
ggggcggcgtgcaccaagga

SEQ ID NO: 475701 - DNA, 20 bp, mouse
ggctgtagtgcgaccttcct

SEQ ID NO: 475702 - DNA, 20 bp, mouse
gtcccagaaggcacagcgag

SEQ ID NO: 475703 - DNA, 20 bp, mouse
gggattcgccggttggtcag

SEQ ID NO: 475704 - DNA, 20 bp, mouse
gaaggcacagcgagaggcat

SEQ ID NO: 475705 - DNA, 20 bp, mouse
ggaaccctgcggggtacgga

SEQ ID NO: 475706 - DNA, 20 bp, mouse
ggaaccccgtgactacacat

SEQ ID NO: 475707 - DNA, 20 bp, mouse
gctgttcgaaggtgagtgga

SEQ ID NO: 475708 - DNA, 20 bp, mouse
ggtcacggggttctgttcga

SEQ ID NO: 475709 - DNA, 20 bp, mouse
gtgcgcctatgtgtagtcac

SEQ ID NO: 475710 - DNA, 20 bp, mouse
gggttctgttcgaaggtgag

SEQ ID NO: 475711 - DNA, 20 bp, mouse
gaagatcccggaaccggagt

SEQ ID NO: 475712 - DNA, 20 bp, mouse
gtggctgattgtagattctc

SEQ ID NO: 475713 - DNA, 20 bp, mouse
ggacaggtcggtcttggtta

SEQ ID NO: 475714 - DNA, 20 bp, mouse
gtgcggaaagacaccgactc

SEQ ID NO: 475715 - DNA, 20 bp, mouse
gtcaccagacgcgccgcttg

SEQ ID NO: 475716 - DNA, 20 bp, mouse
gacccgggacaggacagaca

SEQ ID NO: 475717 - DNA, 20 bp, mouse
gccctgggagcgtccgtaca

SEQ ID NO: 475718 - DNA, 20 bp, mouse
gggaatgttctccaggtaag

SEQ ID NO: 475719 - DNA, 20 bp, mouse
gaaggggcagcgtccgtgta

SEQ ID NO: 475720 - DNA, 20 bp, mouse
gacggacgctgccccttacc

SEQ ID NO: 475721 - DNA, 20 bp, mouse
gaagcggagcagggcaacgg

SEQ ID NO: 475722 - DNA, 20 bp, mouse
gtacggacgctcccagggct

SEQ ID NO: 475723 - DNA, 20 bp, mouse
gtcgccggatgtgggtgggt

SEQ ID NO: 475724 - DNA, 20 bp, mouse
gcacggagcttccgagccct

SEQ ID NO: 475725 - DNA, 20 bp, mouse
ggagcccacggagcacgagt

SEQ ID NO: 475726 - DNA, 20 bp, mouse
gactcacctgaagcccgcga

SEQ ID NO: 475727 - DNA, 20 bp, mouse
ggcggcccgggactggagtt

SEQ ID NO: 475728 - DNA, 20 bp, mouse
gctgtgcattgacttacccg

SEQ ID NO: 475729 - DNA, 20 bp, mouse
gtgcattgacttacccgggg

SEQ ID NO: 475730 - DNA, 20 bp, mouse
gctctcagcatcaccctcta

SEQ ID NO: 475731 - DNA, 20 bp, mouse
ggatgctgagaggtgctccg

SEQ ID NO: 475732 - DNA, 20 bp, mouse
gagggccgctggccggaagt

SEQ ID NO: 475733 - DNA, 20 bp, mouse
gcagcaggcccgggagaacc

SEQ ID NO: 475734 - DNA, 20 bp, mouse
gagctccctaactccagtcc

SEQ ID NO: 475735 - DNA, 20 bp, mouse
gcaacgtaagcggaaggtga

SEQ ID NO: 475736 - DNA, 20 bp, mouse
gtgtgtaaactggataggag

SEQ ID NO: 475737 - DNA, 20 bp, mouse
gagacccctcgtgggagata

SEQ ID NO: 475738 - DNA, 20 bp, mouse
ggtggccaggagttaaaaaa

SEQ ID NO: 475739 - DNA, 20 bp, mouse
gaggggtgggttcaagtctt

SEQ ID NO: 475740 - DNA, 20 bp, mouse
gttggccaccccagaaagat

SEQ ID NO: 475741 - DNA, 20 bp, mouse
gtcctcttcctccagcagtt

SEQ ID NO: 475742 - DNA, 20 bp, mouse
ggctcgggcctcagcatcgg

SEQ ID NO: 475743 - DNA, 20 bp, mouse
gtacatcttagacccctcgt

SEQ ID NO: 475744 - DNA, 20 bp, mouse
gcggcagcgaagacctatgt

SEQ ID NO: 475745 - DNA, 20 bp, mouse
gacgctgatcgtcaaggcag

SEQ ID NO: 475746 - DNA, 20 bp, mouse
ggagggacagaggagcgaaa

SEQ ID NO: 475747 - DNA, 20 bp, mouse
gagctgaaggctccagagtg

SEQ ID NO: 475748 - DNA, 20 bp, mouse
ggctcctctgtccctcactc

SEQ ID NO: 475749 - DNA, 20 bp, mouse
gcagaggctgctgagaaagt

SEQ ID NO: 475750 - DNA, 20 bp, mouse
gagctcctgagaggtagtga

SEQ ID NO: 475751 - DNA, 20 bp, mouse
ggctggggccccagtcccca

SEQ ID NO: 475752 - DNA, 20 bp, mouse
gggaaggaactgggaggtcg

SEQ ID NO: 475753 - DNA, 20 bp, mouse
gtggcaagacagacatagag

SEQ ID NO: 475754 - DNA, 20 bp, mouse
ggccagcttgctcaaagacc

SEQ ID NO: 475755 - DNA, 20 bp, mouse
gttctcagcagcctctgggc

SEQ ID NO: 475756 - DNA, 20 bp, mouse
gtgactatgggacactgtat

SEQ ID NO: 475757 - DNA, 20 bp, mouse
gggagaatgatgcaagaagg

SEQ ID NO: 475758 - DNA, 20 bp, mouse
ggcaggagaatgatgcaaga

SEQ ID NO: 475759 - DNA, 20 bp, mouse
gtgccagggacagggcccct

SEQ ID NO: 475760 - DNA, 20 bp, mouse
gtcaacagccagagcagaat

SEQ ID NO: 475761 - DNA, 20 bp, mouse
gatatgatgagtgtgactat

SEQ ID NO: 475762 - DNA, 20 bp, mouse
ggtttgccactgtctcccag

SEQ ID NO: 475763 - DNA, 20 bp, mouse
gtcccaggacaggtctatta

SEQ ID NO: 475764 - DNA, 20 bp, mouse
gggcaaacagcttcaggagc

SEQ ID NO: 475765 - DNA, 20 bp, mouse
gaggtggtgggtgaaaacag

SEQ ID NO: 475766 - DNA, 20 bp, mouse
gggctgtctccagggtgcag

SEQ ID NO: 475767 - DNA, 20 bp, mouse
gccacagagcccctgcaccc

SEQ ID NO: 475768 - DNA, 20 bp, mouse
gagctagcttcgggctctcc

SEQ ID NO: 475769 - DNA, 20 bp, mouse
gccaaaaagcgcagggccaa

SEQ ID NO: 475770 - DNA, 20 bp, mouse
gaaggcgacggagcatccct

SEQ ID NO: 475771 - DNA, 20 bp, mouse
gagtcttcgcagctagcttc

SEQ ID NO: 475772 - DNA, 20 bp, mouse
gagctgcgaagactcttctc

SEQ ID NO: 475773 - DNA, 20 bp, mouse
gttagaacttaccccggaac

SEQ ID NO: 475774 - DNA, 20 bp, mouse
gcgtccaggacgctcagact

SEQ ID NO: 475775 - DNA, 20 bp, mouse
gagagtgaggcgaaaggcga

SEQ ID NO: 475776 - DNA, 20 bp, mouse
gtccctggttaagtgaagac

SEQ ID NO: 475777 - DNA, 20 bp, mouse
gcccagtcttcacttaacca

SEQ ID NO: 475778 - DNA, 20 bp, mouse
ggctctaaggtacttacctt

SEQ ID NO: 475779 - DNA, 20 bp, mouse
gggactggttcagttcacac

SEQ ID NO: 475780 - DNA, 20 bp, mouse
gctctgggtactttctccaa

SEQ ID NO: 475781 - DNA, 20 bp, mouse
ggttttagcctgcagctcta

SEQ ID NO: 475782 - DNA, 20 bp, mouse
gttcctagtcatcagatccc

SEQ ID NO: 475783 - DNA, 20 bp, mouse
gacagggcgtatcacaaatt

SEQ ID NO: 475784 - DNA, 20 bp, mouse
gataaagtccgtgtcttggg

SEQ ID NO: 475785 - DNA, 20 bp, mouse
gctctgaagtgtccatagtg

SEQ ID NO: 475786 - DNA, 20 bp, mouse
gccgcgggctaggtgagaca

SEQ ID NO: 475787 - DNA, 20 bp, mouse
gcgggctaggtgagacacgg

SEQ ID NO: 475788 - DNA, 20 bp, mouse
ggaagatggagtcaagaaag

SEQ ID NO: 475789 - DNA, 20 bp, mouse
gcccgtgggcctggaggtaa

SEQ ID NO: 475790 - DNA, 20 bp, mouse
gaggagcgctcggtagccag

SEQ ID NO: 475791 - DNA, 20 bp, mouse
gggtcgcggtacggtaatca

SEQ ID NO: 475792 - DNA, 20 bp, mouse
gcgcggtacggtaatcaagg

SEQ ID NO: 475793 - DNA, 20 bp, mouse
gggtacggtaatcaaggcgg

SEQ ID NO: 475794 - DNA, 20 bp, mouse
ggattgcgcggtctcccatg

SEQ ID NO: 475795 - DNA, 20 bp, mouse
gtgagacacgggggactgct

SEQ ID NO: 475796 - DNA, 20 bp, mouse
gcccgggcccggcgaggcag

SEQ ID NO: 475797 - DNA, 20 bp, mouse
gctgcgagaggcctcggcca

SEQ ID NO: 475798 - DNA, 20 bp, mouse
gcgagaggcctcggccaggg

SEQ ID NO: 475799 - DNA, 20 bp, mouse
gggcgagcggagatctggga

SEQ ID NO: 475800 - DNA, 20 bp, mouse
gcctcggccagggaggccgg

SEQ ID NO: 475801 - DNA, 20 bp, mouse
ggagcgcctgcgagaggcct

SEQ ID NO: 475802 - DNA, 20 bp, mouse
gcacaaagagcgcctgcgag

SEQ ID NO: 475803 - DNA, 20 bp, mouse
gaggcgacggcggaaggacg

SEQ ID NO: 475804 - DNA, 20 bp, mouse
ggacggcggaaggacgcgga

SEQ ID NO: 475805 - DNA, 20 bp, mouse
gaccacgcacggcctggacg

SEQ ID NO: 475806 - DNA, 20 bp, mouse
gactgtcgccggcggagagg

SEQ ID NO: 475807 - DNA, 20 bp, mouse
gtcgccggcggagaggtggt

SEQ ID NO: 475808 - DNA, 20 bp, mouse
gaggccagaggctgcgaggt

SEQ ID NO: 475809 - DNA, 20 bp, mouse
gccgaacggagcgcactgag

SEQ ID NO: 475810 - DNA, 20 bp, mouse
ggaggtgggactgtcgccgg

SEQ ID NO: 475811 - DNA, 20 bp, mouse
gtgcgaggtgggactgtcgc

SEQ ID NO: 475812 - DNA, 20 bp, mouse
gggtggtaggcctggccgaa

SEQ ID NO: 475813 - DNA, 20 bp, mouse
gcaagcccaaccagatccca

SEQ ID NO: 475814 - DNA, 20 bp, mouse
gaggcctaccacctctccgc

SEQ ID NO: 475815 - DNA, 20 bp, mouse
ggcctctggcctcaaataga

SEQ ID NO: 475816 - DNA, 20 bp, mouse
gcgcaccggccgctctgagg

SEQ ID NO: 475817 - DNA, 20 bp, mouse
gagggtctggagggccgcac

SEQ ID NO: 475818 - DNA, 20 bp, mouse
gggtgacgcacggcgagtga

SEQ ID NO: 475819 - DNA, 20 bp, mouse
ggcctgcgcgcggtgacgca

SEQ ID NO: 475820 - DNA, 20 bp, mouse
gtgaagccaggtaaggacca

SEQ ID NO: 475821 - DNA, 20 bp, mouse
gacgcgagcgccgcacacca

SEQ ID NO: 475822 - DNA, 20 bp, mouse
gagaccctgacccagagttg

SEQ ID NO: 475823 - DNA, 20 bp, mouse
ggtgacggcggcaacaggga

SEQ ID NO: 475824 - DNA, 20 bp, mouse
ggagtgacagtgggtgacgg

SEQ ID NO: 475825 - DNA, 20 bp, mouse
gcgttgacagggagtgacag

SEQ ID NO: 475826 - DNA, 20 bp, mouse
gcgcggcaggtaagcgggtg

SEQ ID NO: 475827 - DNA, 20 bp, mouse
ggtaagcgggtgcggcgtgg

SEQ ID NO: 475828 - DNA, 20 bp, mouse
gggtcctggctgtgctcccc

SEQ ID NO: 475829 - DNA, 20 bp, mouse
gagccattggggactctggg

SEQ ID NO: 475830 - DNA, 20 bp, mouse
gcggcacaggggtcatctcc

SEQ ID NO: 475831 - DNA, 20 bp, mouse
ggactctgggaggctgtgcg

SEQ ID NO: 475832 - DNA, 20 bp, mouse
gctgaagttgaccctgcccg

SEQ ID NO: 475833 - DNA, 20 bp, mouse
gcgccgagctgggttcagta

SEQ ID NO: 475834 - DNA, 20 bp, mouse
gcaacttcaggtggccacat

SEQ ID NO: 475835 - DNA, 20 bp, mouse
ggattgggacgggttgagca

SEQ ID NO: 475836 - DNA, 20 bp, mouse
gccgtgtagcaggagcttga

SEQ ID NO: 475837 - DNA, 20 bp, mouse
gctgcaaacgcagaaaccat

SEQ ID NO: 475838 - DNA, 20 bp, mouse
gggcttccgtgtccttccca

SEQ ID NO: 475839 - DNA, 20 bp, mouse
gtccctgggacatcagagag

SEQ ID NO: 475840 - DNA, 20 bp, mouse
gagaaaccatgggaaggaca

SEQ ID NO: 475841 - DNA, 20 bp, mouse
gatcagagagaggaatccct

SEQ ID NO: 475842 - DNA, 20 bp, mouse
gtgcgtttgcaggagctgct

SEQ ID NO: 475843 - DNA, 20 bp, mouse
gtctgtccacgccaccctca

SEQ ID NO: 475844 - DNA, 20 bp, mouse
ggccatggtgggatttgcag

SEQ ID NO: 475845 - DNA, 20 bp, mouse
ggacacggaagccttgaggg

SEQ ID NO: 475846 - DNA, 20 bp, mouse
gccgctgcggctaatcctgc

SEQ ID NO: 475847 - DNA, 20 bp, mouse
gtagccgcagcgggatgcag

SEQ ID NO: 475848 - DNA, 20 bp, mouse
gggccccctgcatcccgctg

SEQ ID NO: 475849 - DNA, 20 bp, mouse
gggatcgcgagggacccggg

SEQ ID NO: 475850 - DNA, 20 bp, mouse
gacacgggctcagggaccaa

SEQ ID NO: 475851 - DNA, 20 bp, mouse
ggcgtcaaagcgtggatccg

SEQ ID NO: 475852 - DNA, 20 bp, mouse
ggccgcggtgcgcacatccc

SEQ ID NO: 475853 - DNA, 20 bp, mouse
gaatggggacaaattgttgg

SEQ ID NO: 475854 - DNA, 20 bp, mouse
gcggggatcgcgagggaccc

SEQ ID NO: 475855 - DNA, 20 bp, mouse
gcacgcacacgcggctccag

SEQ ID NO: 475856 - DNA, 20 bp, mouse
gacacgctcgagccaggcct

SEQ ID NO: 475857 - DNA, 20 bp, mouse
gccggcggcggacaaaggca

SEQ ID NO: 475858 - DNA, 20 bp, mouse
ggggctccggcggcggacaa

SEQ ID NO: 475859 - DNA, 20 bp, mouse
gcggcggacaaaggcacggc

SEQ ID NO: 475860 - DNA, 20 bp, mouse
gacaaaggcacggcgggcag

SEQ ID NO: 475861 - DNA, 20 bp, mouse
ggcgcgctccggagcatcgg

SEQ ID NO: 475862 - DNA, 20 bp, mouse
ggcgcgcaggagcctcgcgt

SEQ ID NO: 475863 - DNA, 20 bp, mouse
gcggcacggggcgctccatg

SEQ ID NO: 475864 - DNA, 20 bp, mouse
ggcagcgggacgaggcgcga

SEQ ID NO: 475865 - DNA, 20 bp, mouse
gtggggctggcgggctccgg

SEQ ID NO: 475866 - DNA, 20 bp, mouse
gtgcgcggacagactgacgg

SEQ ID NO: 475867 - DNA, 20 bp, mouse
gggtgaatccagagtccggg

SEQ ID NO: 475868 - DNA, 20 bp, mouse
gcggactctggattcaccga

SEQ ID NO: 475869 - DNA, 20 bp, mouse
gactctggattcaccgacgg

SEQ ID NO: 475870 - DNA, 20 bp, mouse
gctgtccgcgcacccgccgt

SEQ ID NO: 475871 - DNA, 20 bp, mouse
gagcgcggggtggagatcga

SEQ ID NO: 475872 - DNA, 20 bp, mouse
gctttcccgccggggatggg

SEQ ID NO: 475873 - DNA, 20 bp, mouse
gacctagaggaagcgcgggg

SEQ ID NO: 475874 - DNA, 20 bp, mouse
ggttactgcaagctctgcag

SEQ ID NO: 475875 - DNA, 20 bp, mouse
gcccctgcacgagagattct

SEQ ID NO: 475876 - DNA, 20 bp, mouse
ggggcggcttggttccggag

SEQ ID NO: 475877 - DNA, 20 bp, mouse
gctctgcggtgggactgggg

SEQ ID NO: 475878 - DNA, 20 bp, mouse
gaggctctgcggtgggactg

SEQ ID NO: 475879 - DNA, 20 bp, mouse
gggagggccgggacagtgcc

SEQ ID NO: 475880 - DNA, 20 bp, mouse
gtgcagtggctcccagcacc

SEQ ID NO: 475881 - DNA, 20 bp, mouse
gggagtcagcatctcgagag

SEQ ID NO: 475882 - DNA, 20 bp, mouse
gccagcacccggcactgtcc

SEQ ID NO: 475883 - DNA, 20 bp, mouse
gaggagaagcgacgcgagga

SEQ ID NO: 475884 - DNA, 20 bp, mouse
gggaaggcaggctctgcggt

SEQ ID NO: 475885 - DNA, 20 bp, mouse
gtggttccggaggggccgag

SEQ ID NO: 475886 - DNA, 20 bp, mouse
ggtggccttggaagctgcaa

SEQ ID NO: 475887 - DNA, 20 bp, mouse
ggggtcccttgcagcttcca

SEQ ID NO: 475888 - DNA, 20 bp, mouse
ggcaagggacccgcgcactg

SEQ ID NO: 475889 - DNA, 20 bp, mouse
gccagcagcaaggctgtgag

SEQ ID NO: 475890 - DNA, 20 bp, mouse
gggaggtagcgccgaggcca

SEQ ID NO: 475891 - DNA, 20 bp, mouse
gcccaactccagcacaggag

SEQ ID NO: 475892 - DNA, 20 bp, mouse
gggacttggagcggagtcta

SEQ ID NO: 475893 - DNA, 20 bp, mouse
ggcaggcggctgcggactag

SEQ ID NO: 475894 - DNA, 20 bp, mouse
ggcagcccaacgggagaagg

SEQ ID NO: 475895 - DNA, 20 bp, mouse
gactccaagacgcactgcgg

SEQ ID NO: 475896 - DNA, 20 bp, mouse
gggctcggactctcaggcgg

SEQ ID NO: 475897 - DNA, 20 bp, mouse
gactagcggctcggactctc

SEQ ID NO: 475898 - DNA, 20 bp, mouse
gtcccagctgtggccgcctg

SEQ ID NO: 475899 - DNA, 20 bp, mouse
gcagagactgtgggtgccac

SEQ ID NO: 475900 - DNA, 20 bp, mouse
gggagggggccgcagagttg

SEQ ID NO: 475901 - DNA, 20 bp, mouse
ggtccgagccgctagtccag

SEQ ID NO: 475902 - DNA, 20 bp, mouse
ggggaccccatgagacccac

SEQ ID NO: 475903 - DNA, 20 bp, mouse
gtgccacaggcggccacagc

SEQ ID NO: 475904 - DNA, 20 bp, mouse
ggggtcccgccagggtcggg

SEQ ID NO: 475905 - DNA, 20 bp, mouse
gcccggatcttgcagctgtc

SEQ ID NO: 475906 - DNA, 20 bp, mouse
gcccgcggagagagcactgt

SEQ ID NO: 475907 - DNA, 20 bp, mouse
gcgcagcgtcagctcctgat

SEQ ID NO: 475908 - DNA, 20 bp, mouse
ggccaagagcgcacagaagg

SEQ ID NO: 475909 - DNA, 20 bp, mouse
gcctgataggcagcgcaccg

SEQ ID NO: 475910 - DNA, 20 bp, mouse
gggcgcggcggcgatgcaga

SEQ ID NO: 475911 - DNA, 20 bp, mouse
ggcgctggatctagcgcagg

SEQ ID NO: 475912 - DNA, 20 bp, mouse
gagccccgcgagctgacgaa

SEQ ID NO: 475913 - DNA, 20 bp, mouse
gaacccagccacacgaagta

SEQ ID NO: 475914 - DNA, 20 bp, mouse
gggcgccaagagcgcacaga

SEQ ID NO: 475915 - DNA, 20 bp, mouse
ggatgcaacgtggaccgcgc

SEQ ID NO: 475916 - DNA, 20 bp, mouse
gccacaggtgatagtcacag

SEQ ID NO: 475917 - DNA, 20 bp, mouse
ggcaggcaggtggagcccac

SEQ ID NO: 475918 - DNA, 20 bp, mouse
gggctaaaggtgctgactaa

SEQ ID NO: 475919 - DNA, 20 bp, mouse
gaggtgctgactaaaggtgc

SEQ ID NO: 475920 - DNA, 20 bp, mouse
gaggaaggctcagggcacgg

SEQ ID NO: 475921 - DNA, 20 bp, mouse
gtggcgcaggtgctggctaa

SEQ ID NO: 475922 - DNA, 20 bp, mouse
ggctgactaaaggtgcaggc

SEQ ID NO: 475923 - DNA, 20 bp, mouse
gtggcgcaccgcagacgaga

SEQ ID NO: 475924 - DNA, 20 bp, mouse
gcgttctaacggataagatg

SEQ ID NO: 475925 - DNA, 20 bp, mouse
gtccatgacgaagcgggtca

SEQ ID NO: 475926 - DNA, 20 bp, mouse
gcttcaacgagtaggctgtg

SEQ ID NO: 475927 - DNA, 20 bp, mouse
ggagagcaaggatttctaca

SEQ ID NO: 475928 - DNA, 20 bp, mouse
gaggtgtgtcttcaacgagt

SEQ ID NO: 475929 - DNA, 20 bp, mouse
gggatttctacaaggagcaa

SEQ ID NO: 475930 - DNA, 20 bp, mouse
ggcgcaggcaacccaagcca

SEQ ID NO: 475931 - DNA, 20 bp, mouse
gggcaacccaagccagggtg

SEQ ID NO: 475932 - DNA, 20 bp, mouse
gaggccggccttgcgcactg

SEQ ID NO: 475933 - DNA, 20 bp, mouse
gttgcgcactgcggaagaga

SEQ ID NO: 475934 - DNA, 20 bp, mouse
gctctccaggacttacaggt

SEQ ID NO: 475935 - DNA, 20 bp, mouse
gagcagctgggtgagttctc

SEQ ID NO: 475936 - DNA, 20 bp, mouse
ggggaggcagcaggcccggg

SEQ ID NO: 475937 - DNA, 20 bp, mouse
gtaatgggtagagcagacct

SEQ ID NO: 475938 - DNA, 20 bp, mouse
ggtggttgtgctggtggaac

SEQ ID NO: 475939 - DNA, 20 bp, mouse
gcgggagggaaggccatgta

SEQ ID NO: 475940 - DNA, 20 bp, mouse
ggcagcaggcccggggggta

SEQ ID NO: 475941 - DNA, 20 bp, mouse
gtcaccatgtggccgtgggg

SEQ ID NO: 475942 - DNA, 20 bp, mouse
gagctcaccatgtggccgtg

SEQ ID NO: 475943 - DNA, 20 bp, mouse
gctggtggaactggaaggcc

SEQ ID NO: 475944 - DNA, 20 bp, mouse
gcaaggaggagctcaccatg

SEQ ID NO: 475945 - DNA, 20 bp, mouse
gctgggtatttctcaaacta

SEQ ID NO: 475946 - DNA, 20 bp, mouse
gcgtgaggcagacacagtag

SEQ ID NO: 475947 - DNA, 20 bp, mouse
gtctgagcaccgggaccgtg

SEQ ID NO: 475948 - DNA, 20 bp, mouse
ggtagtggcagcgaccagag

SEQ ID NO: 475949 - DNA, 20 bp, mouse
gtggcggagcttctgagcac

SEQ ID NO: 475950 - DNA, 20 bp, mouse
gtgtgtctgcctcacggtcc

SEQ ID NO: 475951 - DNA, 20 bp, mouse
gcatggcgaccggcgggcag

SEQ ID NO: 475952 - DNA, 20 bp, mouse
gggcagcggcagaaggcggc

SEQ ID NO: 475953 - DNA, 20 bp, mouse
gaggagccagagcccagtcc

SEQ ID NO: 475954 - DNA, 20 bp, mouse
gaccggcgggcagcggcaga

SEQ ID NO: 475955 - DNA, 20 bp, mouse
gaccctagaccaggtcccca

SEQ ID NO: 475956 - DNA, 20 bp, mouse
gtgcccgcagcgctcagaga

SEQ ID NO: 475957 - DNA, 20 bp, mouse
gtgagcgctgcgggcactct

SEQ ID NO: 475958 - DNA, 20 bp, mouse
gcagcgctcagagaaggcgc

SEQ ID NO: 475959 - DNA, 20 bp, mouse
gcttcgcgcactgacctctc

SEQ ID NO: 475960 - DNA, 20 bp, mouse
gtcagccggaacccggaccg

SEQ ID NO: 475961 - DNA, 20 bp, mouse
ggcgggcactctgggcgcag

SEQ ID NO: 475962 - DNA, 20 bp, mouse
gcccgcgggcctgccatcca

SEQ ID NO: 475963 - DNA, 20 bp, mouse
ggcctcgcgcgcccccggtc

SEQ ID NO: 475964 - DNA, 20 bp, mouse
gcaccaccccgcccgctcga

SEQ ID NO: 475965 - DNA, 20 bp, mouse
gcgcgtccgtgcagcaccta

SEQ ID NO: 475966 - DNA, 20 bp, mouse
ggctaagaatggatttacag

SEQ ID NO: 475967 - DNA, 20 bp, mouse
gggaacccggaagcacctaa

SEQ ID NO: 475968 - DNA, 20 bp, mouse
gtgcgcagtgtggatgagct

SEQ ID NO: 475969 - DNA, 20 bp, mouse
gagctgggacttgctaagaa

SEQ ID NO: 475970 - DNA, 20 bp, mouse
gacctgcagccgggattccg

SEQ ID NO: 475971 - DNA, 20 bp, mouse
ggcgattctgttgcgcagtg

SEQ ID NO: 475972 - DNA, 20 bp, mouse
gcggtcactacgaccagggg

SEQ ID NO: 475973 - DNA, 20 bp, mouse
gccgcggtaggaggattgtc

SEQ ID NO: 475974 - DNA, 20 bp, mouse
gtgcttccgggttccgggct

SEQ ID NO: 475975 - DNA, 20 bp, mouse
gaaacggtcactacgaccag

SEQ ID NO: 475976 - DNA, 20 bp, mouse
ggcactgcgtagtgaagcca

SEQ ID NO: 475977 - DNA, 20 bp, mouse
ggactcagaatgcgtttcat

SEQ ID NO: 475978 - DNA, 20 bp, mouse
ggtgggcgcggggaaaaact

SEQ ID NO: 475979 - DNA, 20 bp, mouse
ggaagtagctccttagcctg

SEQ ID NO: 475980 - DNA, 20 bp, mouse
ggcccaggtggggatgacaa

SEQ ID NO: 475981 - DNA, 20 bp, mouse
gtggttgctaggcaacgctc

SEQ ID NO: 475982 - DNA, 20 bp, mouse
ggttactgctgttcacgttg

SEQ ID NO: 475983 - DNA, 20 bp, mouse
gtaggttagagaagaccgaa

SEQ ID NO: 475984 - DNA, 20 bp, mouse
gactacgcagtgccaccccc

SEQ ID NO: 475985 - DNA, 20 bp, mouse
gactgctgttcacgttgagg

SEQ ID NO: 475986 - DNA, 20 bp, mouse
gaaccgcggacggcagacaa

SEQ ID NO: 475987 - DNA, 20 bp, mouse
gcgggcgctcgggctgcgga

SEQ ID NO: 475988 - DNA, 20 bp, mouse
ggcgcgcgccggcgaggccc

SEQ ID NO: 475989 - DNA, 20 bp, mouse
ggggcagtttgaaccgcgga

SEQ ID NO: 475990 - DNA, 20 bp, mouse
gtcctcccggcgcgtccgag

SEQ ID NO: 475991 - DNA, 20 bp, mouse
gccccgggaggcgccgagag

SEQ ID NO: 475992 - DNA, 20 bp, mouse
gcgtagcggcgggaggaaga

SEQ ID NO: 475993 - DNA, 20 bp, mouse
gggctgggcagtttgaaccg

SEQ ID NO: 475994 - DNA, 20 bp, mouse
gccgggcgcgggatgccgca

SEQ ID NO: 475995 - DNA, 20 bp, mouse
ggcggcccggccggaaggcg

SEQ ID NO: 475996 - DNA, 20 bp, mouse
gaagcccgaggctggagtag

SEQ ID NO: 475997 - DNA, 20 bp, mouse
ggccagtagccgcctctgag

SEQ ID NO: 475998 - DNA, 20 bp, mouse
gggcggctactggcccgcaa

SEQ ID NO: 475999 - DNA, 20 bp, mouse
gccaatggagcagtccggag

SEQ ID NO: 476000 - DNA, 20 bp, mouse
gctacagggcttgaagcccg

SEQ ID NO: 476001 - DNA, 20 bp, mouse
gggagcagcacgtcttccca

SEQ ID NO: 476002 - DNA, 20 bp, mouse
ggccgcctctgagtggtgat

SEQ ID NO: 476003 - DNA, 20 bp, mouse
gagatgtcttctcagctaca

SEQ ID NO: 476004 - DNA, 20 bp, mouse
gtagctgagaagacatctaa

SEQ ID NO: 476005 - DNA, 20 bp, mouse
gccggaggggagcaagaacc

SEQ ID NO: 476006 - DNA, 20 bp, mouse
gtccgagcggagctccccgg

SEQ ID NO: 476007 - DNA, 20 bp, mouse
gcctgagcctcccaccgggg

SEQ ID NO: 476008 - DNA, 20 bp, mouse
ggccgccctgagcctcccac

SEQ ID NO: 476009 - DNA, 20 bp, mouse
gggctgtgcccagataaata

SEQ ID NO: 476010 - DNA, 20 bp, mouse
gctctccgcagagttccgag

SEQ ID NO: 476011 - DNA, 20 bp, mouse
gagctccgctcggaactctg

SEQ ID NO: 476012 - DNA, 20 bp, mouse
gcctcagcctccccggtggg

SEQ ID NO: 476013 - DNA, 20 bp, mouse
gcgctttgcagggaacccgg

SEQ ID NO: 476014 - DNA, 20 bp, mouse
gagaagccctggccgaggta

SEQ ID NO: 476015 - DNA, 20 bp, mouse
gaaagcggccttatttatct

SEQ ID NO: 476016 - DNA, 20 bp, mouse
ggggcagcgcgggcccgact

SEQ ID NO: 476017 - DNA, 20 bp, mouse
gtcagtcagcgccgcggcgg

SEQ ID NO: 476018 - DNA, 20 bp, mouse
gggcccagccgcagttaaaa

SEQ ID NO: 476019 - DNA, 20 bp, mouse
ggcgcacccggcacacgcga

SEQ ID NO: 476020 - DNA, 20 bp, mouse
ggttcagtcagtcagcgccg

SEQ ID NO: 476021 - DNA, 20 bp, mouse
gcagtcagtcagcgccgcgg

SEQ ID NO: 476022 - DNA, 20 bp, mouse
gcagttaaaatggtccgagt

SEQ ID NO: 476023 - DNA, 20 bp, mouse
gaagtgctgcgaggagacgg

SEQ ID NO: 476024 - DNA, 20 bp, mouse
gccgaggagggcgaccggga

SEQ ID NO: 476025 - DNA, 20 bp, mouse
gcatatagaaggccccgagg

SEQ ID NO: 476026 - DNA, 20 bp, mouse
gccctacgctggcaggctgg

SEQ ID NO: 476027 - DNA, 20 bp, mouse
gtcccccagcctgccagcgt

SEQ ID NO: 476028 - DNA, 20 bp, mouse
ggcgtagggatgctcgaagc

SEQ ID NO: 476029 - DNA, 20 bp, mouse
gctccacagagaccccggta

SEQ ID NO: 476030 - DNA, 20 bp, mouse
ggagggcctggtaggagggt

SEQ ID NO: 476031 - DNA, 20 bp, mouse
ggtgcgcctgggaacagatg

SEQ ID NO: 476032 - DNA, 20 bp, mouse
gtgtgaggctgcagctccgg

SEQ ID NO: 476033 - DNA, 20 bp, mouse
ggcagccacgccccttaccg

SEQ ID NO: 476034 - DNA, 20 bp, mouse
gcgcaagcggaagtacgtct

SEQ ID NO: 476035 - DNA, 20 bp, mouse
gggtaggagacggcaaggat

SEQ ID NO: 476036 - DNA, 20 bp, mouse
ggagcggcgacctgggccca

SEQ ID NO: 476037 - DNA, 20 bp, mouse
ggcgcgaggctaggggagta

SEQ ID NO: 476038 - DNA, 20 bp, mouse
gcgaagcagcgcgaggctag

SEQ ID NO: 476039 - DNA, 20 bp, mouse
gtcagggggccgcagtacag

SEQ ID NO: 476040 - DNA, 20 bp, mouse
gagggatgagagcggcgacc

SEQ ID NO: 476041 - DNA, 20 bp, mouse
gagtacaggggcggacccag

SEQ ID NO: 476042 - DNA, 20 bp, mouse
gctcgcgctgcttcggccct

SEQ ID NO: 476043 - DNA, 20 bp, mouse
ggggtccagggaaagaccag

SEQ ID NO: 476044 - DNA, 20 bp, mouse
gacaggggcggacccagggg

SEQ ID NO: 476045 - DNA, 20 bp, mouse
ggggtcgcgcgtttgaaggg

SEQ ID NO: 476046 - DNA, 20 bp, mouse
gctcactacacctctgatgg

SEQ ID NO: 476047 - DNA, 20 bp, mouse
gttgcggccaggagactctc

SEQ ID NO: 476048 - DNA, 20 bp, mouse
ggcctggcctgagagtctcc

SEQ ID NO: 476049 - DNA, 20 bp, mouse
gcagcaacgccgagggctgt

SEQ ID NO: 476050 - DNA, 20 bp, mouse
gatggttggtaaggtcagag

SEQ ID NO: 476051 - DNA, 20 bp, mouse
gtgtaggcagatggttggta

SEQ ID NO: 476052 - DNA, 20 bp, mouse
ggccaggagactctcaggcc

SEQ ID NO: 476053 - DNA, 20 bp, mouse
gcagaggtgtagtgagcttg

SEQ ID NO: 476054 - DNA, 20 bp, mouse
gcacacaggcccggcaacga

SEQ ID NO: 476055 - DNA, 20 bp, mouse
ggtgtagtgagcttgcggcc

SEQ ID NO: 476056 - DNA, 20 bp, mouse
ggcgggccccagactcacca

SEQ ID NO: 476057 - DNA, 20 bp, mouse
gtcgcggccatggtgagtct

SEQ ID NO: 476058 - DNA, 20 bp, mouse
gcccacagcctgaagtcaca

SEQ ID NO: 476059 - DNA, 20 bp, mouse
ggccgtgtgacttcaggctg

SEQ ID NO: 476060 - DNA, 20 bp, mouse
ggccggcgccgtgtgacttc

SEQ ID NO: 476061 - DNA, 20 bp, mouse
gctggcgtcaccaggacaac

SEQ ID NO: 476062 - DNA, 20 bp, mouse
ggatgctgggcgcctagggg

SEQ ID NO: 476063 - DNA, 20 bp, mouse
gggccgggcgcgtcagggca

SEQ ID NO: 476064 - DNA, 20 bp, mouse
ggatgaggccgggcgcgtca

SEQ ID NO: 476065 - DNA, 20 bp, mouse
gccaggtcctggatgccagg

SEQ ID NO: 476066 - DNA, 20 bp, mouse
gagaggaccgagctagcgac

SEQ ID NO: 476067 - DNA, 20 bp, mouse
gtagcgactggcagtcgtcg

SEQ ID NO: 476068 - DNA, 20 bp, mouse
gcggcgagaagagcagaaca

SEQ ID NO: 476069 - DNA, 20 bp, mouse
ggaccgctcgagtcccgcgg

SEQ ID NO: 476070 - DNA, 20 bp, mouse
gctcagtgccaggctccaga

SEQ ID NO: 476071 - DNA, 20 bp, mouse
gagctggttgcgctaagagg

SEQ ID NO: 476072 - DNA, 20 bp, mouse
gccatgaggagggacgtgaa

SEQ ID NO: 476073 - DNA, 20 bp, mouse
ggaggcggcggcagcaccta

SEQ ID NO: 476074 - DNA, 20 bp, mouse
gagcaggcgaacctcccgga

SEQ ID NO: 476075 - DNA, 20 bp, mouse
gggcccccgcgggactcgag

SEQ ID NO: 476076 - DNA, 20 bp, mouse
gggagcccgcccacctgaga

SEQ ID NO: 476077 - DNA, 20 bp, mouse
gggacagtgagagactaaat

SEQ ID NO: 476078 - DNA, 20 bp, mouse
gcactgtccgcggctttatg

SEQ ID NO: 476079 - DNA, 20 bp, mouse
gccagcgccgcataaagccg

SEQ ID NO: 476080 - DNA, 20 bp, mouse
gcgccagcagctaccttctc

SEQ ID NO: 476081 - DNA, 20 bp, mouse
ggaaagaggacgccaacccg

SEQ ID NO: 476082 - DNA, 20 bp, mouse
gcagcagctaccttctcagg

SEQ ID NO: 476083 - DNA, 20 bp, mouse
gcatttgtggcgcagcacta

SEQ ID NO: 476084 - DNA, 20 bp, mouse
gccatccccccagtccccgg

SEQ ID NO: 476085 - DNA, 20 bp, mouse
gaccagactggaccagaaag

SEQ ID NO: 476086 - DNA, 20 bp, mouse
gttatgtgcatggtgagtgg

SEQ ID NO: 476087 - DNA, 20 bp, mouse
gcacataacccagctcaatc

SEQ ID NO: 476088 - DNA, 20 bp, mouse
gcctccggctgtccttgtcc

SEQ ID NO: 476089 - DNA, 20 bp, mouse
gcggagctgggagcaagtcc

SEQ ID NO: 476090 - DNA, 20 bp, mouse
gctgggagcaagtcctggag

SEQ ID NO: 476091 - DNA, 20 bp, mouse
gagtcctggagaggctcctc

SEQ ID NO: 476092 - DNA, 20 bp, mouse
ggcacgtgaatgcccagaaa

SEQ ID NO: 476093 - DNA, 20 bp, mouse
ggcgcagcctgtccatctgt

SEQ ID NO: 476094 - DNA, 20 bp, mouse
gggaatgccaacagatggac

SEQ ID NO: 476095 - DNA, 20 bp, mouse
ggggttatgtgcatggtgag

SEQ ID NO: 476096 - DNA, 20 bp, mouse
gcgaagcttcggcccagtta

SEQ ID NO: 476097 - DNA, 20 bp, mouse
gcgcccgcccgagacgccct

SEQ ID NO: 476098 - DNA, 20 bp, mouse
gcgggccgcgcggacgacgg

SEQ ID NO: 476099 - DNA, 20 bp, mouse
gtgctcgcctagggcgtctc

SEQ ID NO: 476100 - DNA, 20 bp, mouse
ggaccgcgcgggacagagaa

SEQ ID NO: 476101 - DNA, 20 bp, mouse
gccgcccccggcagcaggta

SEQ ID NO: 476102 - DNA, 20 bp, mouse
ggtcgatcgctgctcgccta

SEQ ID NO: 476103 - DNA, 20 bp, mouse
gtctcgggcgggcgacgagg

SEQ ID NO: 476104 - DNA, 20 bp, mouse
gcgcctagggcgtctcgggc

SEQ ID NO: 476105 - DNA, 20 bp, mouse
gccgcgtgcgaggtgagagc

SEQ ID NO: 476106 - DNA, 20 bp, mouse
gggcagcagcacgggatact

SEQ ID NO: 476107 - DNA, 20 bp, mouse
gcacagcggcgcagcaccat

SEQ ID NO: 476108 - DNA, 20 bp, mouse
gcgccgcaagcccgcagcgt

SEQ ID NO: 476109 - DNA, 20 bp, mouse
gagagagccgcgacaggagg

SEQ ID NO: 476110 - DNA, 20 bp, mouse
gccgcgtgagagggaagtca

SEQ ID NO: 476111 - DNA, 20 bp, mouse
gtcccgtgctgctgccgcgg

SEQ ID NO: 476112 - DNA, 20 bp, mouse
gcgacccggaaggaagaccg

SEQ ID NO: 476113 - DNA, 20 bp, mouse
gcagcaccataggcacgcgt

SEQ ID NO: 476114 - DNA, 20 bp, mouse
gggcccggcccagcgcgacc

SEQ ID NO: 476115 - DNA, 20 bp, mouse
gccgggcgcgcgccactctg

SEQ ID NO: 476116 - DNA, 20 bp, mouse
gcccgcggcgagggtgtcta

SEQ ID NO: 476117 - DNA, 20 bp, mouse
gggcgagggtgtctatggag

SEQ ID NO: 476118 - DNA, 20 bp, mouse
ggctgctgaggcggacgctg

SEQ ID NO: 476119 - DNA, 20 bp, mouse
gggtgtctatggagaggcgg

SEQ ID NO: 476120 - DNA, 20 bp, mouse
ggcgcgccgcctctgccccg

SEQ ID NO: 476121 - DNA, 20 bp, mouse
gccgggagcgcccctcaccc

SEQ ID NO: 476122 - DNA, 20 bp, mouse
gcgtccacttcatcggggaa

SEQ ID NO: 476123 - DNA, 20 bp, mouse
gtcgcgcggcgccaacgcgg

SEQ ID NO: 476124 - DNA, 20 bp, mouse
gttcatccgccagtgcgggg

SEQ ID NO: 476125 - DNA, 20 bp, mouse
ggagggcggccgcggaggag

SEQ ID NO: 476126 - DNA, 20 bp, mouse
gtaactcgcctagaggccac

SEQ ID NO: 476127 - DNA, 20 bp, mouse
gcacgggagccatagccccc

SEQ ID NO: 476128 - DNA, 20 bp, mouse
gctaaaagcggaaggtgggt

SEQ ID NO: 476129 - DNA, 20 bp, mouse
gtatggctcccgtggcctct

SEQ ID NO: 476130 - DNA, 20 bp, mouse
gccgggagctgaactaaaag

SEQ ID NO: 476131 - DNA, 20 bp, mouse
gcgacgtctaactcgcctag

SEQ ID NO: 476132 - DNA, 20 bp, mouse
gtgaactaaaagcggaaggt

SEQ ID NO: 476133 - DNA, 20 bp, mouse
ggttcagctcccgggggcta

SEQ ID NO: 476134 - DNA, 20 bp, mouse
gccgctcggcggaggactgg

SEQ ID NO: 476135 - DNA, 20 bp, mouse
ggatgcgcggggccgctcgg

SEQ ID NO: 476136 - DNA, 20 bp, mouse
gtgcgtccgcggcttccccg

SEQ ID NO: 476137 - DNA, 20 bp, mouse
ggcgcggcggccacttgttg

SEQ ID NO: 476138 - DNA, 20 bp, mouse
gacaagtctctgctcactcg

SEQ ID NO: 476139 - DNA, 20 bp, mouse
gctcggggcaccgcaacaag

SEQ ID NO: 476140 - DNA, 20 bp, mouse
gggtggagcggcgagtctag

SEQ ID NO: 476141 - DNA, 20 bp, mouse
gggaagccgcggacgcacgg

SEQ ID NO: 476142 - DNA, 20 bp, mouse
ggcgcatggggaccccacgg

SEQ ID NO: 476143 - DNA, 20 bp, mouse
ggaggcgcatggggacccca

SEQ ID NO: 476144 - DNA, 20 bp, mouse
gtccgcggcttccccgggga

SEQ ID NO: 476145 - DNA, 20 bp, mouse
gcagtgctctgcgaccggag

SEQ ID NO: 476146 - DNA, 20 bp, mouse
gtggccacggaggacagcta

SEQ ID NO: 476147 - DNA, 20 bp, mouse
ggggctttacccggagacag

SEQ ID NO: 476148 - DNA, 20 bp, mouse
gggactaggtgggctttacc

SEQ ID NO: 476149 - DNA, 20 bp, mouse
gcacggaggacagctagggc

SEQ ID NO: 476150 - DNA, 20 bp, mouse
ggacaggggactggccacgg

SEQ ID NO: 476151 - DNA, 20 bp, mouse
gttacccggagacaggggac

SEQ ID NO: 476152 - DNA, 20 bp, mouse
ggtcccgccttctccgccca

SEQ ID NO: 476153 - DNA, 20 bp, mouse
gcgttatcttacctgctcag

SEQ ID NO: 476154 - DNA, 20 bp, mouse
gggacccggcgactctgcta

SEQ ID NO: 476155 - DNA, 20 bp, mouse
gggccctgggcggagaaggc

SEQ ID NO: 476156 - DNA, 20 bp, mouse
ggccgagcgccgcagtcctc

SEQ ID NO: 476157 - DNA, 20 bp, mouse
gcagtcctccggcagccctg

SEQ ID NO: 476158 - DNA, 20 bp, mouse
gcgacgccctggaagccgca

SEQ ID NO: 476159 - DNA, 20 bp, mouse
ggcgaagtcggaccccgctg

SEQ ID NO: 476160 - DNA, 20 bp, mouse
gggcagccctgcggcttcca

SEQ ID NO: 476161 - DNA, 20 bp, mouse
gcgcctcttacctcagggag

SEQ ID NO: 476162 - DNA, 20 bp, mouse
ggagcggcgctgcccggccg

SEQ ID NO: 476163 - DNA, 20 bp, mouse
gcgggcagcgccgctccctg

SEQ ID NO: 476164 - DNA, 20 bp, mouse
ggtcacgtgacagccaccgg

SEQ ID NO: 476165 - DNA, 20 bp, mouse
gggtaagaggcgcaggaagg

SEQ ID NO: 476166 - DNA, 20 bp, mouse
gcgcagggcgctctttcagg

SEQ ID NO: 476167 - DNA, 20 bp, mouse
gggacgggcgatctcggaga

SEQ ID NO: 476168 - DNA, 20 bp, mouse
gagcccgaggcgaagcgcgg

SEQ ID NO: 476169 - DNA, 20 bp, mouse
ggcagacagagagacgggcc

SEQ ID NO: 476170 - DNA, 20 bp, mouse
gcgtccgcctggggagcccg

SEQ ID NO: 476171 - DNA, 20 bp, mouse
ggaaagagaaaattcctcgc

SEQ ID NO: 476172 - DNA, 20 bp, mouse
ggggcccgccgactcccgag

SEQ ID NO: 476173 - DNA, 20 bp, mouse
ggacgaggaacggaggagcc

SEQ ID NO: 476174 - DNA, 20 bp, mouse
gtcgcctcgggctccccagg

SEQ ID NO: 476175 - DNA, 20 bp, mouse
ggcgctctttcagggggtgt

SEQ ID NO: 476176 - DNA, 20 bp, mouse
gatacttagggtctgagcaa

SEQ ID NO: 476177 - DNA, 20 bp, mouse
ggagaactaatcccagatca

SEQ ID NO: 476178 - DNA, 20 bp, mouse
gtatgtctggaacgaacttc

SEQ ID NO: 476179 - DNA, 20 bp, mouse
gacgaacttcaggtcagaat

SEQ ID NO: 476180 - DNA, 20 bp, mouse
gttgtaaagtctcatactta

SEQ ID NO: 476181 - DNA, 20 bp, mouse
gtctgggccctaacttcttt

SEQ ID NO: 476182 - DNA, 20 bp, mouse
gctgggattagttctcttcc

SEQ ID NO: 476183 - DNA, 20 bp, mouse
gttgcctgtccaagatctgt

SEQ ID NO: 476184 - DNA, 20 bp, mouse
gagcagattccaacagatct

SEQ ID NO: 476185 - DNA, 20 bp, mouse
gatagtctcctaaagaagtt

SEQ ID NO: 476186 - DNA, 20 bp, mouse
gggttgctatcgttgcacta

SEQ ID NO: 476187 - DNA, 20 bp, mouse
gctgctggaagcagtaaggt

SEQ ID NO: 476188 - DNA, 20 bp, mouse
ggggtagagcaggaaaaaca

SEQ ID NO: 476189 - DNA, 20 bp, mouse
gtggcctgctggaagcagta

SEQ ID NO: 476190 - DNA, 20 bp, mouse
gctggcatccggggtctctt

SEQ ID NO: 476191 - DNA, 20 bp, mouse
gcactgctcacctcagcagc

SEQ ID NO: 476192 - DNA, 20 bp, mouse
ggcttccttcttcaagcctc

SEQ ID NO: 476193 - DNA, 20 bp, mouse
gaagtgcgctgcggtttcaa

SEQ ID NO: 476194 - DNA, 20 bp, mouse
gtcagaaatagagggcgggt

SEQ ID NO: 476195 - DNA, 20 bp, mouse
gtgttggttgttaattgcag

SEQ ID NO: 476196 - DNA, 20 bp, mouse
gccctgggccgggctcactc

SEQ ID NO: 476197 - DNA, 20 bp, mouse
gaggctgcaacgttgcccgg

SEQ ID NO: 476198 - DNA, 20 bp, mouse
gagggacaggcggcctagct

SEQ ID NO: 476199 - DNA, 20 bp, mouse
gagggtcgtgtccaaaccag

SEQ ID NO: 476200 - DNA, 20 bp, mouse
gagctcggcggccctgggcc

SEQ ID NO: 476201 - DNA, 20 bp, mouse
ggcctgagtgagcccggccc

SEQ ID NO: 476202 - DNA, 20 bp, mouse
gccgtgatctggggtcctag

SEQ ID NO: 476203 - DNA, 20 bp, mouse
gtacctgtccgggagctcac

SEQ ID NO: 476204 - DNA, 20 bp, mouse
gtgcccggggtgtccaccag

SEQ ID NO: 476205 - DNA, 20 bp, mouse
ggcccggtgagctcccggac

SEQ ID NO: 476206 - DNA, 20 bp, mouse
ggcccggcccaggaccccgg

SEQ ID NO: 476207 - DNA, 20 bp, mouse
gggaaaggctgaatgtccgg

SEQ ID NO: 476208 - DNA, 20 bp, mouse
ggctgtctgggccgaaggag

SEQ ID NO: 476209 - DNA, 20 bp, mouse
gcccggcggcgacaccaccc

SEQ ID NO: 476210 - DNA, 20 bp, mouse
ggggcttgctggtcggggaa

SEQ ID NO: 476211 - DNA, 20 bp, mouse
ggaagaggcggagctcgcgg

SEQ ID NO: 476212 - DNA, 20 bp, mouse
gaggaggggcttgctggtcg

SEQ ID NO: 476213 - DNA, 20 bp, mouse
gcgcccgcggtggtcaggag

SEQ ID NO: 476214 - DNA, 20 bp, mouse
gatgtccggcggcatcgcct

SEQ ID NO: 476215 - DNA, 20 bp, mouse
gtcgtctgtgctcgctgtct

SEQ ID NO: 476216 - DNA, 20 bp, mouse
gagagcctgagcgctgcggg

SEQ ID NO: 476217 - DNA, 20 bp, mouse
gtatctagcggggccagcag

SEQ ID NO: 476218 - DNA, 20 bp, mouse
gacagcaccgcagcgatgga

SEQ ID NO: 476219 - DNA, 20 bp, mouse
gccgcagcgatggatggaga

SEQ ID NO: 476220 - DNA, 20 bp, mouse
gaaaccctagagatagtcta

SEQ ID NO: 476221 - DNA, 20 bp, mouse
gctcgccacccgcagcgctc

SEQ ID NO: 476222 - DNA, 20 bp, mouse
gtggagggaggaggacgcct

SEQ ID NO: 476223 - DNA, 20 bp, mouse
gtggatggagatggtgatcc

SEQ ID NO: 476224 - DNA, 20 bp, mouse
ggacgcctgggtctccaaaa

SEQ ID NO: 476225 - DNA, 20 bp, mouse
ggatacagactcgggagaca

SEQ ID NO: 476226 - DNA, 20 bp, mouse
gaagatggcgtcggtagcgg

SEQ ID NO: 476227 - DNA, 20 bp, mouse
gtacgcggacaagatggcgt

SEQ ID NO: 476228 - DNA, 20 bp, mouse
gctcaggtacgcggacaaga

SEQ ID NO: 476229 - DNA, 20 bp, mouse
gcccgcacagcggccccctc

SEQ ID NO: 476230 - DNA, 20 bp, mouse
ggacaagatggcgtcggtag

SEQ ID NO: 476231 - DNA, 20 bp, mouse
ggcgggggacagcgctatgg

SEQ ID NO: 476232 - DNA, 20 bp, mouse
gggggacagcgctatggagg

SEQ ID NO: 476233 - DNA, 20 bp, mouse
gagcggccccctcaggtacg

SEQ ID NO: 476234 - DNA, 20 bp, mouse
gccagagcagcgggcaggtg

SEQ ID NO: 476235 - DNA, 20 bp, mouse
gcccctccggagctccgatg

SEQ ID NO: 476236 - DNA, 20 bp, mouse
gaggccctacagagtctcag

SEQ ID NO: 476237 - DNA, 20 bp, mouse
gagtctcaggggtaccggag

SEQ ID NO: 476238 - DNA, 20 bp, mouse
ggtacccctgagactctgta

SEQ ID NO: 476239 - DNA, 20 bp, mouse
gagggagctcgggttgtagg

SEQ ID NO: 476240 - DNA, 20 bp, mouse
gctcagggagctcgggttgt

SEQ ID NO: 476241 - DNA, 20 bp, mouse
gagccgggtgagggcgaatg

SEQ ID NO: 476242 - DNA, 20 bp, mouse
gccacaggcggcatactctg

SEQ ID NO: 476243 - DNA, 20 bp, mouse
gtcctcgcctaccggcccga

SEQ ID NO: 476244 - DNA, 20 bp, mouse
gggaagcggcccaccggaag

SEQ ID NO: 476245 - DNA, 20 bp, mouse
gggtaggcgaggaatggagc

SEQ ID NO: 476246 - DNA, 20 bp, mouse
gtcgctagacagaaggaggt

SEQ ID NO: 476247 - DNA, 20 bp, mouse
gccattcgctagacagaagg

SEQ ID NO: 476248 - DNA, 20 bp, mouse
gcgcaggtaaagatcgtaaa

SEQ ID NO: 476249 - DNA, 20 bp, mouse
gggcctgacagtgcagggtt

SEQ ID NO: 476250 - DNA, 20 bp, mouse
ggacagtgcagggttagggt

SEQ ID NO: 476251 - DNA, 20 bp, mouse
gtgggcggcctgacagtgca

SEQ ID NO: 476252 - DNA, 20 bp, mouse
ggtccctaatgggaatgctg

SEQ ID NO: 476253 - DNA, 20 bp, mouse
gtgggaatgctggggatgac

SEQ ID NO: 476254 - DNA, 20 bp, mouse
ggaactggaaaccccctcac

SEQ ID NO: 476255 - DNA, 20 bp, mouse
gttctgcctaccaatagcat

SEQ ID NO: 476256 - DNA, 20 bp, mouse
ggccccccaagcctagactg

SEQ ID NO: 476257 - DNA, 20 bp, mouse
gtggggcctgggcagccgag

SEQ ID NO: 476258 - DNA, 20 bp, mouse
gactagcagcaagaagtcca

SEQ ID NO: 476259 - DNA, 20 bp, mouse
ggggatgaagacccaagtcc

SEQ ID NO: 476260 - DNA, 20 bp, mouse
gcagcggggacgggggcctg

SEQ ID NO: 476261 - DNA, 20 bp, mouse
gaccaggctgtgcagacagg

SEQ ID NO: 476262 - DNA, 20 bp, mouse
gagtcctggagagaggtggg

SEQ ID NO: 476263 - DNA, 20 bp, mouse
gcctgggcagccgaggggcc

SEQ ID NO: 476264 - DNA, 20 bp, mouse
gtaggcttggggggcctcaa

SEQ ID NO: 476265 - DNA, 20 bp, mouse
gctcctgccctcatctctcc

SEQ ID NO: 476266 - DNA, 20 bp, mouse
gtggacgctgcggctcggtg

SEQ ID NO: 476267 - DNA, 20 bp, mouse
gaggccgcacggacccgcag

SEQ ID NO: 476268 - DNA, 20 bp, mouse
ggccctcggcgggaggcgga

SEQ ID NO: 476269 - DNA, 20 bp, mouse
ggacggcttccggcaataat

SEQ ID NO: 476270 - DNA, 20 bp, mouse
ggtgagaagggcctcaggac

SEQ ID NO: 476271 - DNA, 20 bp, mouse
gtggaactgccctggaacag

SEQ ID NO: 476272 - DNA, 20 bp, mouse
gtcgtctggaagggacccgc

SEQ ID NO: 476273 - DNA, 20 bp, mouse
gcggcaataattggacgctg

SEQ ID NO: 476274 - DNA, 20 bp, mouse
gtgcggctcggtgtggttgg

SEQ ID NO: 476275 - DNA, 20 bp, mouse
ggtccagcggtggccctcgg

SEQ ID NO: 476276 - DNA, 20 bp, mouse
gccaggcgcggcacactcgg

SEQ ID NO: 476277 - DNA, 20 bp, mouse
ggggcagggcgtgtcttcgt

SEQ ID NO: 476278 - DNA, 20 bp, mouse
gtaagggacgtgggagacag

SEQ ID NO: 476279 - DNA, 20 bp, mouse
ggggcctagaggaagcctag

SEQ ID NO: 476280 - DNA, 20 bp, mouse
ggagaggcggtaagggacgt

SEQ ID NO: 476281 - DNA, 20 bp, mouse
gcctgacctacataagagag

SEQ ID NO: 476282 - DNA, 20 bp, mouse
gacataagagagcggtagag

SEQ ID NO: 476283 - DNA, 20 bp, mouse
gaacccctgtggccaaggtg

SEQ ID NO: 476284 - DNA, 20 bp, mouse
ggccagcagcagcaaccata

SEQ ID NO: 476285 - DNA, 20 bp, mouse
gccgcccctaggcttcctct

SEQ ID NO: 476286 - DNA, 20 bp, mouse
gaatcaaactcccaagatgg

SEQ ID NO: 476287 - DNA, 20 bp, mouse
gggcgacggcggctcctgtt

SEQ ID NO: 476288 - DNA, 20 bp, mouse
gaggaatcaaactcccaaga

SEQ ID NO: 476289 - DNA, 20 bp, mouse
gtgttctcgatggctacgat

SEQ ID NO: 476290 - DNA, 20 bp, mouse
gaagctgaggatgttctcga

SEQ ID NO: 476291 - DNA, 20 bp, mouse
gtgtcccgatccccttacat

SEQ ID NO: 476292 - DNA, 20 bp, mouse
ggtcgtaggacataaagctg

SEQ ID NO: 476293 - DNA, 20 bp, mouse
gcccgatccccttacattgg

SEQ ID NO: 476294 - DNA, 20 bp, mouse
gagccagctccgcctggtga

SEQ ID NO: 476295 - DNA, 20 bp, mouse
gatccccttacattggagga

SEQ ID NO: 476296 - DNA, 20 bp, mouse
gtgagcagcagagggtcggt

SEQ ID NO: 476297 - DNA, 20 bp, mouse
gtgccgtagaggccgagacg

SEQ ID NO: 476298 - DNA, 20 bp, mouse
gtcggtgggcagcgactcca

SEQ ID NO: 476299 - DNA, 20 bp, mouse
gagggtcagcagccccgtct

SEQ ID NO: 476300 - DNA, 20 bp, mouse
gggcaagatggctgccgtag

SEQ ID NO: 476301 - DNA, 20 bp, mouse
gtgcagcgggccgggcaaga

SEQ ID NO: 476302 - DNA, 20 bp, mouse
gaggcagggaaggaggcccg

SEQ ID NO: 476303 - DNA, 20 bp, mouse
ggccgggttgcggaagagag

SEQ ID NO: 476304 - DNA, 20 bp, mouse
gtgatgaccagagccctcgt

SEQ ID NO: 476305 - DNA, 20 bp, mouse
gccgcagcagggtgactgca

SEQ ID NO: 476306 - DNA, 20 bp, mouse
ggaggcgcagaggattggga

SEQ ID NO: 476307 - DNA, 20 bp, mouse
ggttggaggccgaggagaaa

SEQ ID NO: 476308 - DNA, 20 bp, mouse
gaccggaccggaccacgcac

SEQ ID NO: 476309 - DNA, 20 bp, mouse
gggcggcggtccgggcaggg

SEQ ID NO: 476310 - DNA, 20 bp, mouse
gggagaaaaggcggcggtcc

SEQ ID NO: 476311 - DNA, 20 bp, mouse
ggggcggaggcgcagaggat

SEQ ID NO: 476312 - DNA, 20 bp, mouse
gcagaggattgggacgggac

SEQ ID NO: 476313 - DNA, 20 bp, mouse
gcatttgccgggagcctcaa

SEQ ID NO: 476314 - DNA, 20 bp, mouse
gcagcgtccccgcaccggac

SEQ ID NO: 476315 - DNA, 20 bp, mouse
gtggagtcggcgcagttcag

SEQ ID NO: 476316 - DNA, 20 bp, mouse
ggccatgcccgtcaccaccg

SEQ ID NO: 476317 - DNA, 20 bp, mouse
ggcgcctccgcggtggtgac

SEQ ID NO: 476318 - DNA, 20 bp, mouse
gatgcccgtcaccaccgcgg

SEQ ID NO: 476319 - DNA, 20 bp, mouse
gcggtgtgtgctcggctctg

SEQ ID NO: 476320 - DNA, 20 bp, mouse
gcggcggcggcacccacgcg

SEQ ID NO: 476321 - DNA, 20 bp, mouse
gcggcgtgggccccgcgcgt

SEQ ID NO: 476322 - DNA, 20 bp, mouse
ggtccgtgtgcaagattcgg

SEQ ID NO: 476323 - DNA, 20 bp, mouse
gcgcggcccggccgagactg

SEQ ID NO: 476324 - DNA, 20 bp, mouse
gcccgaggaggagcgcatcg

SEQ ID NO: 476325 - DNA, 20 bp, mouse
gactgcggcggcggacagtg

SEQ ID NO: 476326 - DNA, 20 bp, mouse
gagggctgcggatcctgggt

SEQ ID NO: 476327 - DNA, 20 bp, mouse
gcggcgaccgggacaagagt

SEQ ID NO: 476328 - DNA, 20 bp, mouse
gaaggtcgcctcctgactct

SEQ ID NO: 476329 - DNA, 20 bp, mouse
ggtgggtcaactagtgtgga

SEQ ID NO: 476330 - DNA, 20 bp, mouse
gcacaggggcgcaggcgttg

SEQ ID NO: 476331 - DNA, 20 bp, mouse
gacgcgaccgacggacggga

SEQ ID NO: 476332 - DNA, 20 bp, mouse
ggcggacgcgaccgacggac

SEQ ID NO: 476333 - DNA, 20 bp, mouse
gagagcgcggacgcgaccga

SEQ ID NO: 476334 - DNA, 20 bp, mouse
gcgggataaatactgcgctc

SEQ ID NO: 476335 - DNA, 20 bp, mouse
gcggggatccttgcactcac

SEQ ID NO: 476336 - DNA, 20 bp, mouse
gggagcgcgaacccgagccg

SEQ ID NO: 476337 - DNA, 20 bp, mouse
gcgccgccaccgcaccaacc

SEQ ID NO: 476338 - DNA, 20 bp, mouse
gctcgggttcgcgctcccgg

SEQ ID NO: 476339 - DNA, 20 bp, mouse
gcgcaccaaccgggcggccc

SEQ ID NO: 476340 - DNA, 20 bp, mouse
gggacgcggaggctcggtag

SEQ ID NO: 476341 - DNA, 20 bp, mouse
gttcgcgctcccggcggtcg

SEQ ID NO: 476342 - DNA, 20 bp, mouse
gaccgacacgggcaccggag

SEQ ID NO: 476343 - DNA, 20 bp, mouse
ggtgccgcaaccccgaccgc

SEQ ID NO: 476344 - DNA, 20 bp, mouse
gccgggtaccgggagaacca

SEQ ID NO: 476345 - DNA, 20 bp, mouse
gcggaggctcggtagtggta

SEQ ID NO: 476346 - DNA, 20 bp, mouse
gcccgacactgaggcggacc

SEQ ID NO: 476347 - DNA, 20 bp, mouse
ggggctgcggcagcccgatg

SEQ ID NO: 476348 - DNA, 20 bp, mouse
gcagtgtcggggagcgagtc

SEQ ID NO: 476349 - DNA, 20 bp, mouse
ggggcaggtggacaccgtgg

SEQ ID NO: 476350 - DNA, 20 bp, mouse
ggcccggcagaagcacaggt

SEQ ID NO: 476351 - DNA, 20 bp, mouse
gggctctctggaggacgctg

SEQ ID NO: 476352 - DNA, 20 bp, mouse
gcgcgaggacggctctctgg

SEQ ID NO: 476353 - DNA, 20 bp, mouse
ggccctgccgcggggagcag

SEQ ID NO: 476354 - DNA, 20 bp, mouse
gcggcagggccgaacgttgg

SEQ ID NO: 476355 - DNA, 20 bp, mouse
ggcggggcaggtggacaccg

SEQ ID NO: 476356 - DNA, 20 bp, mouse
ggcagccacgacgccatctt

SEQ ID NO: 476357 - DNA, 20 bp, mouse
ggcgtcccaagatggcgtcg

SEQ ID NO: 476358 - DNA, 20 bp, mouse
gcggcggtggcgtcccaaga

SEQ ID NO: 476359 - DNA, 20 bp, mouse
gggtgacgagggaagatctc

SEQ ID NO: 476360 - DNA, 20 bp, mouse
gctggttgtcctagcgacgg

SEQ ID NO: 476361 - DNA, 20 bp, mouse
gcaatttcaaacagagtctc

SEQ ID NO: 476362 - DNA, 20 bp, mouse
gtcgctaggacaaccaggaa

SEQ ID NO: 476363 - DNA, 20 bp, mouse
gcagcagggccacccgatgg

SEQ ID NO: 476364 - DNA, 20 bp, mouse
gggctgggagctgagagacg

SEQ ID NO: 476365 - DNA, 20 bp, mouse
ggttgtcctagcgacggcgg

SEQ ID NO: 476366 - DNA, 20 bp, mouse
gaagtgagccgcggcctggg

SEQ ID NO: 476367 - DNA, 20 bp, mouse
ggcgacagcctcccaggccg

SEQ ID NO: 476368 - DNA, 20 bp, mouse
gcaccacaaaaacagacgga

SEQ ID NO: 476369 - DNA, 20 bp, mouse
ggcctgggaggctgtcgcga

SEQ ID NO: 476370 - DNA, 20 bp, mouse
gaccgtcgcgacagcctccc

SEQ ID NO: 476371 - DNA, 20 bp, mouse
gggccggcgtaagtgagccg

SEQ ID NO: 476372 - DNA, 20 bp, mouse
gcggaagacgctagaggcgg

SEQ ID NO: 476373 - DNA, 20 bp, mouse
gacaaaaacagacggagggc

SEQ ID NO: 476374 - DNA, 20 bp, mouse
gcttgggagcaaggcctgaa

SEQ ID NO: 476375 - DNA, 20 bp, mouse
gggccgcggctcacttacgc

SEQ ID NO: 476376 - DNA, 20 bp, mouse
gggctcgggctgcagggacg

SEQ ID NO: 476377 - DNA, 20 bp, mouse
gggatcgctgcgcccggctc

SEQ ID NO: 476378 - DNA, 20 bp, mouse
gatgctcttggagtcggcgt

SEQ ID NO: 476379 - DNA, 20 bp, mouse
ggcagcgcgggcagaggggc

SEQ ID NO: 476380 - DNA, 20 bp, mouse
ggagcagcagcgcgggcaga

SEQ ID NO: 476381 - DNA, 20 bp, mouse
gaagcacccacgcaccagga

SEQ ID NO: 476382 - DNA, 20 bp, mouse
gcgctgggcccgcatgggag

SEQ ID NO: 476383 - DNA, 20 bp, mouse
ggggcgcagcgatccggtaa

SEQ ID NO: 476384 - DNA, 20 bp, mouse
gctcctgatgctcttggagt

SEQ ID NO: 476385 - DNA, 20 bp, mouse
gcggcgtgggagcagcagcg

SEQ ID NO: 476386 - DNA, 20 bp, mouse
gccgggtcgtaccagcgggg

SEQ ID NO: 476387 - DNA, 20 bp, mouse
gagcccgggtcgtaccagcg

SEQ ID NO: 476388 - DNA, 20 bp, mouse
gtggtacgacccgggctggt

SEQ ID NO: 476389 - DNA, 20 bp, mouse
ggaggcagggagggacccgg

SEQ ID NO: 476390 - DNA, 20 bp, mouse
gtggctggaagcgagccccg

SEQ ID NO: 476391 - DNA, 20 bp, mouse
ggcgagcacacacccggaag

SEQ ID NO: 476392 - DNA, 20 bp, mouse
gcgacccgggctggtcggtt

SEQ ID NO: 476393 - DNA, 20 bp, mouse
gtgggcagggctccaggccg

SEQ ID NO: 476394 - DNA, 20 bp, mouse
gtattcggtggccaaggagc

SEQ ID NO: 476395 - DNA, 20 bp, mouse
gcccggaggatgtgtagtgt

SEQ ID NO: 476396 - DNA, 20 bp, mouse
gtctgctgcagcggaagcac

SEQ ID NO: 476397 - DNA, 20 bp, mouse
gaagcaggtctggaggaggt

SEQ ID NO: 476398 - DNA, 20 bp, mouse
ggatcaagcaggtctggagg

SEQ ID NO: 476399 - DNA, 20 bp, mouse
gcacccaagttctgttggaa

SEQ ID NO: 476400 - DNA, 20 bp, mouse
gtccagacctgcttgatcaa

SEQ ID NO: 476401 - DNA, 20 bp, mouse
gtgcctttccaacagaactt

SEQ ID NO: 476402 - DNA, 20 bp, mouse
gcttgggtgctctgctgcag

SEQ ID NO: 476403 - DNA, 20 bp, mouse
ggccgttgatcaagcaggtc

SEQ ID NO: 476404 - DNA, 20 bp, mouse
gacctgcccacggcacacac

SEQ ID NO: 476405 - DNA, 20 bp, mouse
gcaatgtctaagtgctggag

SEQ ID NO: 476406 - DNA, 20 bp, mouse
ggtgcagctaggagacaggg

SEQ ID NO: 476407 - DNA, 20 bp, mouse
gctgtctcctagctgcaccg

SEQ ID NO: 476408 - DNA, 20 bp, mouse
gatcacgggcggggtacgca

SEQ ID NO: 476409 - DNA, 20 bp, mouse
gggcggggtacgcagggcgg

SEQ ID NO: 476410 - DNA, 20 bp, mouse
ggggaggcggccgggaggtg

SEQ ID NO: 476411 - DNA, 20 bp, mouse
gacgggcggggtacgcaggg

SEQ ID NO: 476412 - DNA, 20 bp, mouse
gccgtgaggccgctagaact

SEQ ID NO: 476413 - DNA, 20 bp, mouse
gctcgcgatgcgatcacggg

SEQ ID NO: 476414 - DNA, 20 bp, mouse
gaggcggcggcggccaccca

SEQ ID NO: 476415 - DNA, 20 bp, mouse
gtagaactgggagggattct

SEQ ID NO: 476416 - DNA, 20 bp, mouse
ggcggtggcatcagggacgg

SEQ ID NO: 476417 - DNA, 20 bp, mouse
gagcagcggcggtggcatca

SEQ ID NO: 476418 - DNA, 20 bp, mouse
gagccgcggcggcgtttgag

SEQ ID NO: 476419 - DNA, 20 bp, mouse
gcgcggcggcgtttgagtgg

SEQ ID NO: 476420 - DNA, 20 bp, mouse
ggcggcggcggtggtagccg

SEQ ID NO: 476421 - DNA, 20 bp, mouse
ggagcggtctgggccaggtg

SEQ ID NO: 476422 - DNA, 20 bp, mouse
ggcaccggcctgaggcagag

SEQ ID NO: 476423 - DNA, 20 bp, mouse
gtcaccgctggcggaacccg

SEQ ID NO: 476424 - DNA, 20 bp, mouse
gggcttcccaggctaaggtg

SEQ ID NO: 476425 - DNA, 20 bp, mouse
gcgaaaccgagagcgcggag

SEQ ID NO: 476426 - DNA, 20 bp, mouse
gacggctcggcagctccggt

SEQ ID NO: 476427 - DNA, 20 bp, mouse
gcagccagtcttggacctgg

SEQ ID NO: 476428 - DNA, 20 bp, mouse
gaccagagatgcccccccac

SEQ ID NO: 476429 - DNA, 20 bp, mouse
ggccgggacggcttcaggag

SEQ ID NO: 476430 - DNA, 20 bp, mouse
gccgcccgcagcagacggct

SEQ ID NO: 476431 - DNA, 20 bp, mouse
gtccggtgggggggcatctc

SEQ ID NO: 476432 - DNA, 20 bp, mouse
gctagtcgggagattccccc

SEQ ID NO: 476433 - DNA, 20 bp, mouse
gctgctgcgggcgggactaa

SEQ ID NO: 476434 - DNA, 20 bp, mouse
gggcatctctggtctctagt

SEQ ID NO: 476435 - DNA, 20 bp, mouse
gattcccccaggtccaagac

SEQ ID NO: 476436 - DNA, 20 bp, mouse
ggccccagcaaggagacgtt

SEQ ID NO: 476437 - DNA, 20 bp, mouse
ggccaaacgtctccttgctg

SEQ ID NO: 476438 - DNA, 20 bp, mouse
gagcagtgagcgccccagca

SEQ ID NO: 476439 - DNA, 20 bp, mouse
gtcggggactgaggcacagt

SEQ ID NO: 476440 - DNA, 20 bp, mouse
ggctaagagcaggtgacaga

SEQ ID NO: 476441 - DNA, 20 bp, mouse
gacgtaacccggctaagagc

SEQ ID NO: 476442 - DNA, 20 bp, mouse
gagtgggcagagacctagag

SEQ ID NO: 476443 - DNA, 20 bp, mouse
ggagacgtttggcgggcagt

SEQ ID NO: 476444 - DNA, 20 bp, mouse
ggcggggtctgatgagtagt

SEQ ID NO: 476445 - DNA, 20 bp, mouse
ggcgatcctgccaggccgtg

SEQ ID NO: 476446 - DNA, 20 bp, mouse
gcggctggcgctgaaagggg

SEQ ID NO: 476447 - DNA, 20 bp, mouse
gagttgagggcaagaagcaa

SEQ ID NO: 476448 - DNA, 20 bp, mouse
ggatccgccatgcgagttga

SEQ ID NO: 476449 - DNA, 20 bp, mouse
gactcgcatggcggatcccg

SEQ ID NO: 476450 - DNA, 20 bp, mouse
ggagcggctggcgctgaaag

SEQ ID NO: 476451 - DNA, 20 bp, mouse
gccgagacggggcgaagcgg

SEQ ID NO: 476452 - DNA, 20 bp, mouse
gcctcgggcggcgctagtgg

SEQ ID NO: 476453 - DNA, 20 bp, mouse
gccggctggtgaggcgatgg

SEQ ID NO: 476454 - DNA, 20 bp, mouse
gggagcggtggaggcgcgag

SEQ ID NO: 476455 - DNA, 20 bp, mouse
ggcgcgccccgcctcactga

SEQ ID NO: 476456 - DNA, 20 bp, mouse
gaggctggagaggagcgagt

SEQ ID NO: 476457 - DNA, 20 bp, mouse
gacccgcaggacccagcttg

SEQ ID NO: 476458 - DNA, 20 bp, mouse
gggccagaacccggaagggg

SEQ ID NO: 476459 - DNA, 20 bp, mouse
gtcgggagagctgcagcgcg

SEQ ID NO: 476460 - DNA, 20 bp, mouse
gcggggccagaacccggaag

SEQ ID NO: 476461 - DNA, 20 bp, mouse
gatggtgagagccccaagct

SEQ ID NO: 476462 - DNA, 20 bp, mouse
ggcagctctcccgactacgc

SEQ ID NO: 476463 - DNA, 20 bp, mouse
ggggcttcggggccagaacc

SEQ ID NO: 476464 - DNA, 20 bp, mouse
gggctagggaggggtcttgg

SEQ ID NO: 476465 - DNA, 20 bp, mouse
gccgaggaagtagaagaatg

SEQ ID NO: 476466 - DNA, 20 bp, mouse
gctccaggcggtagggagaa

SEQ ID NO: 476467 - DNA, 20 bp, mouse
ggcgcctcctccaggcggta

SEQ ID NO: 476468 - DNA, 20 bp, mouse
gctagagtgcgcatgcttgt

SEQ ID NO: 476469 - DNA, 20 bp, mouse
ggaggaggcgctgcgggtga

SEQ ID NO: 476470 - DNA, 20 bp, mouse
gacacccggacacgcccccc

SEQ ID NO: 476471 - DNA, 20 bp, mouse
gcgaggggggcgggcccaca

SEQ ID NO: 476472 - DNA, 20 bp, mouse
gctggggcttaagaaacctt

SEQ ID NO: 476473 - DNA, 20 bp, mouse
gaggcgggtccaagatctgg

SEQ ID NO: 476474 - DNA, 20 bp, mouse
gcgcccttctccctaccgcc

SEQ ID NO: 476475 - DNA, 20 bp, mouse
ggcgggtgagggcgcctggg

SEQ ID NO: 476476 - DNA, 20 bp, mouse
gtgaggacgcagctccgggg

SEQ ID NO: 476477 - DNA, 20 bp, mouse
gacgcagctccggggcggag

SEQ ID NO: 476478 - DNA, 20 bp, mouse
gttttcccgccagataatgg

SEQ ID NO: 476479 - DNA, 20 bp, mouse
gatctggcgggaaaagcctg

SEQ ID NO: 476480 - DNA, 20 bp, mouse
gggagcggagagagcggagc

SEQ ID NO: 476481 - DNA, 20 bp, mouse
gaatctacttgaggcgacgg

SEQ ID NO: 476482 - DNA, 20 bp, mouse
gccgccaaagaggtcaccta

SEQ ID NO: 476483 - DNA, 20 bp, mouse
gggcttttcccgccagataa

SEQ ID NO: 476484 - DNA, 20 bp, mouse
ggagctgaggacgcagctcc

SEQ ID NO: 476485 - DNA, 20 bp, mouse
gcctgtcaccggctcctcgg

SEQ ID NO: 476486 - DNA, 20 bp, mouse
gagagttgtactgcatggac

SEQ ID NO: 476487 - DNA, 20 bp, mouse
gcacaggagtgagatcctat

SEQ ID NO: 476488 - DNA, 20 bp, mouse
ggtctctacacagagtccca

SEQ ID NO: 476489 - DNA, 20 bp, mouse
gctctcctgcgttcttcaca

SEQ ID NO: 476490 - DNA, 20 bp, mouse
ggtctccatgtgaagaacgc

SEQ ID NO: 476491 - DNA, 20 bp, mouse
gtcaattaggcctacagtgg

SEQ ID NO: 476492 - DNA, 20 bp, mouse
gctatcaattaggcctacag

SEQ ID NO: 476493 - DNA, 20 bp, mouse
ggagaaagagttgtactgca

SEQ ID NO: 476494 - DNA, 20 bp, mouse
gcttcagcactgcagcagag

SEQ ID NO: 476495 - DNA, 20 bp, mouse
gtagcatgtacacagtgcac

SEQ ID NO: 476496 - DNA, 20 bp, mouse
gctggtccctgtgcagggaa

SEQ ID NO: 476497 - DNA, 20 bp, mouse
gccgcgcctttaggtaggag

SEQ ID NO: 476498 - DNA, 20 bp, mouse
gcggcaccgcgcctttaggt

SEQ ID NO: 476499 - DNA, 20 bp, mouse
gagctgcctctcctacctaa

SEQ ID NO: 476500 - DNA, 20 bp, mouse
gtccggaggactgaaatcgc

SEQ ID NO: 476501 - DNA, 20 bp, mouse
ggacaggacggtggatggag

SEQ ID NO: 476502 - DNA, 20 bp, mouse
gggaggactgaaatcgcggg

SEQ ID NO: 476503 - DNA, 20 bp, mouse
ggagccggcaccgcgccttt

SEQ ID NO: 476504 - DNA, 20 bp, mouse
gctgaaatcgcgggaggagc

SEQ ID NO: 476505 - DNA, 20 bp, mouse
ggctctgcccttccctgcac

SEQ ID NO: 476506 - DNA, 20 bp, mouse
gggcgacgacaggaaaaagg

SEQ ID NO: 476507 - DNA, 20 bp, mouse
gaaaggtggccggccagacg

SEQ ID NO: 476508 - DNA, 20 bp, mouse
gggcggcgacgacaggaaaa

SEQ ID NO: 476509 - DNA, 20 bp, mouse
gaactcgggctccaatgctg

SEQ ID NO: 476510 - DNA, 20 bp, mouse
gggctcatgccgcaaaactc

SEQ ID NO: 476511 - DNA, 20 bp, mouse
gtcgggctccaatgctgggg

SEQ ID NO: 476512 - DNA, 20 bp, mouse
gagtgtgaggcgggcatcgt

SEQ ID NO: 476513 - DNA, 20 bp, mouse
gggaggaaggcgcggagcaa

SEQ ID NO: 476514 - DNA, 20 bp, mouse
gccgagccgcagctcttaaa

SEQ ID NO: 476515 - DNA, 20 bp, mouse
gcccagtcccgggcccaaat

SEQ ID NO: 476516 - DNA, 20 bp, mouse
gctgggcaccggaggaaggg

SEQ ID NO: 476517 - DNA, 20 bp, mouse
gggcgaggtgacagaggacc

SEQ ID NO: 476518 - DNA, 20 bp, mouse
gacagaggaccgggtcgccg

SEQ ID NO: 476519 - DNA, 20 bp, mouse
ggggccttgggcctggacct

SEQ ID NO: 476520 - DNA, 20 bp, mouse
ggaggaagcaggcccgaggt

SEQ ID NO: 476521 - DNA, 20 bp, mouse
gtacccctaaggcacaccag

SEQ ID NO: 476522 - DNA, 20 bp, mouse
gtgcccagcggccgcgacct

SEQ ID NO: 476523 - DNA, 20 bp, mouse
ggctgaggccccccttcctc

SEQ ID NO: 476524 - DNA, 20 bp, mouse
gggcacgcgagggtcccgga

SEQ ID NO: 476525 - DNA, 20 bp, mouse
ggtgacgccagtgggaagac

SEQ ID NO: 476526 - DNA, 20 bp, mouse
gtcgagcggaaggctctagg

SEQ ID NO: 476527 - DNA, 20 bp, mouse
gcgagcgctggggattcctc

SEQ ID NO: 476528 - DNA, 20 bp, mouse
gctcacctgaaccccaacgt

SEQ ID NO: 476529 - DNA, 20 bp, mouse
ggagccccacgacagcgacg

SEQ ID NO: 476530 - DNA, 20 bp, mouse
ggaccgagcggcgagcgctg

SEQ ID NO: 476531 - DNA, 20 bp, mouse
gggagtcggagccaacgctc

SEQ ID NO: 476532 - DNA, 20 bp, mouse
ggggggcgtagtcgaccgag

SEQ ID NO: 476533 - DNA, 20 bp, mouse
gcggaagtgactactcaccg

SEQ ID NO: 476534 - DNA, 20 bp, mouse
gtgccgagcgtcacagtcac

SEQ ID NO: 476535 - DNA, 20 bp, mouse
gctccgggcctgcgctcccg

SEQ ID NO: 476536 - DNA, 20 bp, mouse
gctgcctgcagaagcccgag

SEQ ID NO: 476537 - DNA, 20 bp, mouse
gcctgcagaagcccgagtgg

SEQ ID NO: 476538 - DNA, 20 bp, mouse
gacttcgcgggagtctgggg

SEQ ID NO: 476539 - DNA, 20 bp, mouse
ggtgacttcgcgggagtctg

SEQ ID NO: 476540 - DNA, 20 bp, mouse
gttcgcgctggagaacacga

SEQ ID NO: 476541 - DNA, 20 bp, mouse
gcttgcaaggtccgccactc

SEQ ID NO: 476542 - DNA, 20 bp, mouse
gcggcggcggtggagatccc

SEQ ID NO: 476543 - DNA, 20 bp, mouse
gagaggtgctgtgacttcgc

SEQ ID NO: 476544 - DNA, 20 bp, mouse
gcccacaggccgagtcgtcg

SEQ ID NO: 476545 - DNA, 20 bp, mouse
ggagaacacgatggctgcga

SEQ ID NO: 476546 - DNA, 20 bp, mouse
gaggagacgtctggacgcag

SEQ ID NO: 476547 - DNA, 20 bp, mouse
gcggcccagcaggagacgtc

SEQ ID NO: 476548 - DNA, 20 bp, mouse
gagacgtctggacgcagcgg

SEQ ID NO: 476549 - DNA, 20 bp, mouse
gggagaagcgcaccaggcag

SEQ ID NO: 476550 - DNA, 20 bp, mouse
gcgtccagacgtctcctgct

SEQ ID NO: 476551 - DNA, 20 bp, mouse
gaggggtcgccggtcgccag

SEQ ID NO: 476552 - DNA, 20 bp, mouse
gacgggcaggagtagacacc

SEQ ID NO: 476553 - DNA, 20 bp, mouse
gccgcgcccggctcccggag

SEQ ID NO: 476554 - DNA, 20 bp, mouse
ggcagtttccgcagcagagc

SEQ ID NO: 476555 - DNA, 20 bp, mouse
gtaactgcgggcccggcgta

SEQ ID NO: 476556 - DNA, 20 bp, mouse
gaacatctggagaaaccgta

SEQ ID NO: 476557 - DNA, 20 bp, mouse
gcgtaaggcactgcgatgga

SEQ ID NO: 476558 - DNA, 20 bp, mouse
gaaaccgtaaggcactgcga

SEQ ID NO: 476559 - DNA, 20 bp, mouse
gacttctacaggcagtttct

SEQ ID NO: 476560 - DNA, 20 bp, mouse
gcctcttcgggatgaacatc

SEQ ID NO: 476561 - DNA, 20 bp, mouse
gtggcacacggggacccagt

SEQ ID NO: 476562 - DNA, 20 bp, mouse
gtcccgaagaggctccaaaa

SEQ ID NO: 476563 - DNA, 20 bp, mouse
gaccctccggaaccactctt

SEQ ID NO: 476564 - DNA, 20 bp, mouse
gaccaaacaccagagggaca

SEQ ID NO: 476565 - DNA, 20 bp, mouse
gcggtaaagccatgtttcta

SEQ ID NO: 476566 - DNA, 20 bp, mouse
ggcccggccagaggaatcca

SEQ ID NO: 476567 - DNA, 20 bp, mouse
gctgcgtcggccgagggtga

SEQ ID NO: 476568 - DNA, 20 bp, mouse
ggcgggctggcagctagagt

SEQ ID NO: 476569 - DNA, 20 bp, mouse
gcccaggcggcggggaacga

SEQ ID NO: 476570 - DNA, 20 bp, mouse
gtctagctgccagcccgccc

SEQ ID NO: 476571 - DNA, 20 bp, mouse
gccaccggagagagcaccta

SEQ ID NO: 476572 - DNA, 20 bp, mouse
gcgggccgatcgctgctgag

SEQ ID NO: 476573 - DNA, 20 bp, mouse
ggcagctccgccctcaccct

SEQ ID NO: 476574 - DNA, 20 bp, mouse
gcgtcggccgagggtgaggg

SEQ ID NO: 476575 - DNA, 20 bp, mouse
ggccagaggaatccagggaa

SEQ ID NO: 476576 - DNA, 20 bp, mouse
gagtcaaaagggcgttatgt

SEQ ID NO: 476577 - DNA, 20 bp, mouse
gtagcaaaaggatacatcta

SEQ ID NO: 476578 - DNA, 20 bp, mouse
gggagagattgaaggagtga

SEQ ID NO: 476579 - DNA, 20 bp, mouse
ggagattgaaggagtgaagg

SEQ ID NO: 476580 - DNA, 20 bp, mouse
gtggttaaatgaggtaggag

SEQ ID NO: 476581 - DNA, 20 bp, mouse
gaggatacatctagggctca

SEQ ID NO: 476582 - DNA, 20 bp, mouse
gcctcaaatatggttaaatg

SEQ ID NO: 476583 - DNA, 20 bp, mouse
gaaatatggttaaatgaggt

SEQ ID NO: 476584 - DNA, 20 bp, mouse
gttttcatcaacggcacact

SEQ ID NO: 476585 - DNA, 20 bp, mouse
gaggagaagattttcatcaa

SEQ ID NO: 476586 - DNA, 20 bp, mouse
ggatttgaggtcttcacagt

SEQ ID NO: 476587 - DNA, 20 bp, mouse
gtcatgtagggtgcacctaa

SEQ ID NO: 476588 - DNA, 20 bp, mouse
gtgtagggtgcacctaatgg

SEQ ID NO: 476589 - DNA, 20 bp, mouse
gagacatatctagtgcttat

SEQ ID NO: 476590 - DNA, 20 bp, mouse
gcatcggcacactaggtaaa

SEQ ID NO: 476591 - DNA, 20 bp, mouse
gaagaagaaaggaaggatgg

SEQ ID NO: 476592 - DNA, 20 bp, mouse
gtgaaggatggaactactgt

SEQ ID NO: 476593 - DNA, 20 bp, mouse
gaataagttaattttaggga

SEQ ID NO: 476594 - DNA, 20 bp, mouse
ggtctgaataagttaatttt

SEQ ID NO: 476595 - DNA, 20 bp, mouse
gcctcaaatctggttagttg

SEQ ID NO: 476596 - DNA, 20 bp, mouse
gttttcatcatcggcaaaca

SEQ ID NO: 476597 - DNA, 20 bp, mouse
gttatttaggatgcaccaat

SEQ ID NO: 476598 - DNA, 20 bp, mouse
gggccaaaggggccttattt

SEQ ID NO: 476599 - DNA, 20 bp, mouse
gatggctgaactcttccaat

SEQ ID NO: 476600 - DNA, 20 bp, mouse
ggggattgaaggagtgtagg

SEQ ID NO: 476601 - DNA, 20 bp, mouse
ggagggaggggggtgaagga

SEQ ID NO: 476602 - DNA, 20 bp, mouse
gggagggattgaaggagtgt

SEQ ID NO: 476603 - DNA, 20 bp, mouse
gcatcggcaaacaaggtaaa

SEQ ID NO: 476604 - DNA, 20 bp, mouse
gggagagagggagggattga

SEQ ID NO: 476605 - DNA, 20 bp, mouse
gaggagtgtaggaggatgcc

SEQ ID NO: 476606 - DNA, 20 bp, mouse
gcccagcaacacactctcac

SEQ ID NO: 476607 - DNA, 20 bp, mouse
ggcctgtgagagtgtgttgc

SEQ ID NO: 476608 - DNA, 20 bp, mouse
gtagatatacctcagattcc

SEQ ID NO: 476609 - DNA, 20 bp, mouse
gagagaaaggagagtgagtg

SEQ ID NO: 476610 - DNA, 20 bp, mouse
ggtcaaaagggccttttgta

SEQ ID NO: 476611 - DNA, 20 bp, mouse
gttacctagtttgcctatga

SEQ ID NO: 476612 - DNA, 20 bp, mouse
gttttgtagggtgcacagaa

SEQ ID NO: 476613 - DNA, 20 bp, mouse
gtttaggagaaattgaagga

SEQ ID NO: 476614 - DNA, 20 bp, mouse
gaagttttaggagaaattga

SEQ ID NO: 476615 - DNA, 20 bp, mouse
gtgaaggatggagttcctgt

SEQ ID NO: 476616 - DNA, 20 bp, mouse
gtagggcgtggcaagcggga

SEQ ID NO: 476617 - DNA, 20 bp, mouse
ggaaggcggcgggaagggta

SEQ ID NO: 476618 - DNA, 20 bp, mouse
gcagcaggtcccgggcctcc

SEQ ID NO: 476619 - DNA, 20 bp, mouse
ggttcgtgcgggccaagctg

SEQ ID NO: 476620 - DNA, 20 bp, mouse
ggtagggcggtgccaccgga

SEQ ID NO: 476621 - DNA, 20 bp, mouse
gaccgggcagatgaccacca

SEQ ID NO: 476622 - DNA, 20 bp, mouse
ggcagcgcgcagcaggtccc

SEQ ID NO: 476623 - DNA, 20 bp, mouse
gaggggcccggtcaagaagg

SEQ ID NO: 476624 - DNA, 20 bp, mouse
gggtaggggcccggtcaaga

SEQ ID NO: 476625 - DNA, 20 bp, mouse
gcgcgctgcgcaggtgaaca

SEQ ID NO: 476626 - DNA, 20 bp, mouse
gaggagaaaggagagtagtg

SEQ ID NO: 476627 - DNA, 20 bp, mouse
gaggagagtagtgtggactt

SEQ ID NO: 476628 - DNA, 20 bp, mouse
gaagacaggttatgtgagtg

SEQ ID NO: 476629 - DNA, 20 bp, mouse
gtaggcaaactaggcaaact

SEQ ID NO: 476630 - DNA, 20 bp, mouse
gaggaagacagaaggaagac

SEQ ID NO: 476631 - DNA, 20 bp, mouse
gaaggtaagttttaggaggg

SEQ ID NO: 476632 - DNA, 20 bp, mouse
gtgagtgggaaaggtcaaag

SEQ ID NO: 476633 - DNA, 20 bp, mouse
gccgagactccaagaatgag

SEQ ID NO: 476634 - DNA, 20 bp, mouse
gaataaggtaagttttagga

SEQ ID NO: 476635 - DNA, 20 bp, mouse
gctaggcaaactaggcaaat

SEQ ID NO: 476636 - DNA, 20 bp, mouse
gtcatgtagggtgcacggaa

SEQ ID NO: 476637 - DNA, 20 bp, mouse
gtgtcagtttgctattgtga

SEQ ID NO: 476638 - DNA, 20 bp, mouse
gctgacatatctactgctta

SEQ ID NO: 476639 - DNA, 20 bp, mouse
ggaagagtcagtgtcgactt

SEQ ID NO: 476640 - DNA, 20 bp, mouse
gcataggcaaactaggtaga

SEQ ID NO: 476641 - DNA, 20 bp, mouse
gtgtagggtgcacggaatgg

SEQ ID NO: 476642 - DNA, 20 bp, mouse
gagatttgaggtcttcatac

SEQ ID NO: 476643 - DNA, 20 bp, mouse
gtgtaattaaagcacttgta

SEQ ID NO: 476644 - DNA, 20 bp, mouse
ggaataagttaattttaagg

SEQ ID NO: 476645 - DNA, 20 bp, mouse
ggaaagaaagaaggaagggt

SEQ ID NO: 476646 - DNA, 20 bp, mouse
ggagcagcggccgtaggtcc

SEQ ID NO: 476647 - DNA, 20 bp, mouse
gcggaagccgctcccctgtg

SEQ ID NO: 476648 - DNA, 20 bp, mouse
gaaatacagacctggaccta

SEQ ID NO: 476649 - DNA, 20 bp, mouse
ggacccagagcagcggccgt

SEQ ID NO: 476650 - DNA, 20 bp, mouse
gctgggtccgcagcctcaca

SEQ ID NO: 476651 - DNA, 20 bp, mouse
ggaccaagggagtcacgaac

SEQ ID NO: 476652 - DNA, 20 bp, mouse
ggtcagtgccgcgcggaaca

SEQ ID NO: 476653 - DNA, 20 bp, mouse
gccaatcgcaaatacagacc

SEQ ID NO: 476654 - DNA, 20 bp, mouse
gagtaacgccgcgggcgctg

SEQ ID NO: 476655 - DNA, 20 bp, mouse
gcgccgggctcacaccgact

SEQ ID NO: 476656 - DNA, 20 bp, mouse
gaaaaaggaacaagcttggg

SEQ ID NO: 476657 - DNA, 20 bp, mouse
ggccaaaggggtctcatgta

SEQ ID NO: 476658 - DNA, 20 bp, mouse
gtcatgtagggtgcattgaa

SEQ ID NO: 476659 - DNA, 20 bp, mouse
gtgtagggtgcattgaatgg

SEQ ID NO: 476660 - DNA, 20 bp, mouse
gagatacatctaggtctcat

SEQ ID NO: 476661 - DNA, 20 bp, mouse
gaatggacctccatcttttg

SEQ ID NO: 476662 - DNA, 20 bp, mouse
gaggagtggtggtgcgggac

SEQ ID NO: 476663 - DNA, 20 bp, mouse
gagtaaaaaggaacaagctt

SEQ ID NO: 476664 - DNA, 20 bp, mouse
gttttcatcaatggcaatct

SEQ ID NO: 476665 - DNA, 20 bp, mouse
gagaaggaaggaaggatgcc

SEQ ID NO: 476666 - DNA, 20 bp, mouse
gtttccatcagaggcaaacg

SEQ ID NO: 476667 - DNA, 20 bp, mouse
gttgcctcgtttgcctctga

SEQ ID NO: 476668 - DNA, 20 bp, mouse
gctgacacattagcatctcc

SEQ ID NO: 476669 - DNA, 20 bp, mouse
gaataaggtaggtttaaaga

SEQ ID NO: 476670 - DNA, 20 bp, mouse
gggagggaaggaaagaagcc

SEQ ID NO: 476671 - DNA, 20 bp, mouse
gaagaaaagtagctgagtcc

SEQ ID NO: 476672 - DNA, 20 bp, mouse
gaggagaagatttccatcag

SEQ ID NO: 476673 - DNA, 20 bp, mouse
gcgagactccaagactaagt

SEQ ID NO: 476674 - DNA, 20 bp, mouse
gagacgggtctgaataaggt

SEQ ID NO: 476675 - DNA, 20 bp, mouse
ggacttttcccacttagtct

SEQ ID NO: 476676 - DNA, 20 bp, mouse
ggatcaagctgggaggagaa

SEQ ID NO: 476677 - DNA, 20 bp, mouse
gggagaagatttccatcata

SEQ ID NO: 476678 - DNA, 20 bp, mouse
gcatagggaaactagacaaa

SEQ ID NO: 476679 - DNA, 20 bp, mouse
gtgtagggtgcaccgaatag

SEQ ID NO: 476680 - DNA, 20 bp, mouse
gtttaagtagggagggatgg

SEQ ID NO: 476681 - DNA, 20 bp, mouse
gcagatatatctagcggaca

SEQ ID NO: 476682 - DNA, 20 bp, mouse
ggctgtgttgagtgtgatgc

SEQ ID NO: 476683 - DNA, 20 bp, mouse
gaaatctggttaaatgagtc

SEQ ID NO: 476684 - DNA, 20 bp, mouse
gtggttaaatgagtcaggag

SEQ ID NO: 476685 - DNA, 20 bp, mouse
gaaggtaagtttaagtaggg

SEQ ID NO: 476686 - DNA, 20 bp, mouse
gcagagctgaatagacaggt

SEQ ID NO: 476687 - DNA, 20 bp, mouse
ggggaaagagtgaggacgaa

SEQ ID NO: 476688 - DNA, 20 bp, mouse
gtataggttggcacttctgt

SEQ ID NO: 476689 - DNA, 20 bp, mouse
gtgtttgctattctataggt

SEQ ID NO: 476690 - DNA, 20 bp, mouse
ggaacaaggtaaatgctctt

SEQ ID NO: 476691 - DNA, 20 bp, mouse
gaggtcttcagagtggatat

SEQ ID NO: 476692 - DNA, 20 bp, mouse
gagatacatctagggggcat

SEQ ID NO: 476693 - DNA, 20 bp, mouse
gcacttctgcctcatttaag

SEQ ID NO: 476694 - DNA, 20 bp, mouse
ggaaaaagggaaggaagcaa

SEQ ID NO: 476695 - DNA, 20 bp, mouse
gcaagggaggggttgaggga

SEQ ID NO: 476696 - DNA, 20 bp, mouse
gaatagcaaacgggtatata

SEQ ID NO: 476697 - DNA, 20 bp, mouse
ggaggtaggagtggtaacac

SEQ ID NO: 476698 - DNA, 20 bp, mouse
gcgtttgctattctgaagaa

SEQ ID NO: 476699 - DNA, 20 bp, mouse
ggtatataaggttcatggat

SEQ ID NO: 476700 - DNA, 20 bp, mouse
gaacgggtatataaggttca

SEQ ID NO: 476701 - DNA, 20 bp, mouse
gcctcaaatatggttcgttg

SEQ ID NO: 476702 - DNA, 20 bp, mouse
gtgaagaatggaggtcctgt

SEQ ID NO: 476703 - DNA, 20 bp, mouse
gtggttcgttgaggtaggag

SEQ ID NO: 476704 - DNA, 20 bp, mouse
gttgctattctgaagaatgg

SEQ ID NO: 476705 - DNA, 20 bp, mouse
gaggtaattttaaggaagga

SEQ ID NO: 476706 - DNA, 20 bp, mouse
gggccctggctgctcatgag

SEQ ID NO: 476707 - DNA, 20 bp, mouse
gggaaccgcgggcccaggga

SEQ ID NO: 476708 - DNA, 20 bp, mouse
gggccgctcatgagcagcca

SEQ ID NO: 476709 - DNA, 20 bp, mouse
gggcctgcagccggagagga

SEQ ID NO: 476710 - DNA, 20 bp, mouse
ggtgtcgcctcctctcgagg

SEQ ID NO: 476711 - DNA, 20 bp, mouse
ggttcccggggggacccgag

SEQ ID NO: 476712 - DNA, 20 bp, mouse
gctgggcccgcggttcccgg

SEQ ID NO: 476713 - DNA, 20 bp, mouse
gaggcaggccggggacagga

SEQ ID NO: 476714 - DNA, 20 bp, mouse
ggtgcgtcgagccggccccg

SEQ ID NO: 476715 - DNA, 20 bp, mouse
gggtcgcgcggggaaagcaa

SEQ ID NO: 476716 - DNA, 20 bp, mouse
ggaggtggagactagagcgg

SEQ ID NO: 476717 - DNA, 20 bp, mouse
ggtggaggtggagactagag

SEQ ID NO: 476718 - DNA, 20 bp, mouse
gcgcctccataaagacgtgg

SEQ ID NO: 476719 - DNA, 20 bp, mouse
ggcagcgggcagaggcaccg

SEQ ID NO: 476720 - DNA, 20 bp, mouse
gccaaagccgggactcaccg

SEQ ID NO: 476721 - DNA, 20 bp, mouse
ggtggagactagagcggcgg

SEQ ID NO: 476722 - DNA, 20 bp, mouse
gggacaagggacaccgaagg

SEQ ID NO: 476723 - DNA, 20 bp, mouse
gtggcgcctccataaagacg

SEQ ID NO: 476724 - DNA, 20 bp, mouse
gtagagcggcggcggaagcc

SEQ ID NO: 476725 - DNA, 20 bp, mouse
ggaggcaccgcggtgagtcc

SEQ ID NO: 476726 - DNA, 20 bp, mouse
gcaagcagccggacacacgg

SEQ ID NO: 476727 - DNA, 20 bp, mouse
ggaagattaggcagcggaac

SEQ ID NO: 476728 - DNA, 20 bp, mouse
gtgcgtcccgagcagcgttc

SEQ ID NO: 476729 - DNA, 20 bp, mouse
gctccactgaggagaactcg

SEQ ID NO: 476730 - DNA, 20 bp, mouse
ggaaaaggaagattaggcag

SEQ ID NO: 476731 - DNA, 20 bp, mouse
gttccccgagttctcctcag

SEQ ID NO: 476732 - DNA, 20 bp, mouse
gcagaaccagaacgctgctc

SEQ ID NO: 476733 - DNA, 20 bp, mouse
ggggcacagaatccctgaag

SEQ ID NO: 476734 - DNA, 20 bp, mouse
gggttctgagctgcgtctgc

SEQ ID NO: 476735 - DNA, 20 bp, mouse
ggagcgatggtgtgagctgg

SEQ ID NO: 476736 - DNA, 20 bp, mouse
ggagtgtcctgacctgtctg

SEQ ID NO: 476737 - DNA, 20 bp, mouse
gcaggacactcgcaaagaga

SEQ ID NO: 476738 - DNA, 20 bp, mouse
gaccaagcctcagacaggtc

SEQ ID NO: 476739 - DNA, 20 bp, mouse
ggaaggttggaagacaaaaa

SEQ ID NO: 476740 - DNA, 20 bp, mouse
gatcaacaggaaccaagcca

SEQ ID NO: 476741 - DNA, 20 bp, mouse
ggctcctgtgaaccatggct

SEQ ID NO: 476742 - DNA, 20 bp, mouse
ggagctaacgatgctttgtg

SEQ ID NO: 476743 - DNA, 20 bp, mouse
gcgacaaaaaggcagaccct

SEQ ID NO: 476744 - DNA, 20 bp, mouse
gcacagtctgatgtggcaga

SEQ ID NO: 476745 - DNA, 20 bp, mouse
gcaaaaacggcaacaggcct

SEQ ID NO: 476746 - DNA, 20 bp, mouse
gaggccgacgcggcacccag

SEQ ID NO: 476747 - DNA, 20 bp, mouse
gcccaggggctgccagaatg

SEQ ID NO: 476748 - DNA, 20 bp, mouse
gtgacgcgcccaggccgacg

SEQ ID NO: 476749 - DNA, 20 bp, mouse
ggtgccggcggaactcctcc

SEQ ID NO: 476750 - DNA, 20 bp, mouse
gatggacgaccacaacctgg

SEQ ID NO: 476751 - DNA, 20 bp, mouse
gggcctgggcgcgtcaagca

SEQ ID NO: 476752 - DNA, 20 bp, mouse
ggcggaactcctccaggttg

SEQ ID NO: 476753 - DNA, 20 bp, mouse
gcagcccctgggtgccgcgt

SEQ ID NO: 476754 - DNA, 20 bp, mouse
gacaggcgctgaggcgacgg

SEQ ID NO: 476755 - DNA, 20 bp, mouse
gggacagtccgtccccattc

SEQ ID NO: 476756 - DNA, 20 bp, mouse
gcgccctgaggaaagatcca

SEQ ID NO: 476757 - DNA, 20 bp, mouse
gggatccccactccgccctg

SEQ ID NO: 476758 - DNA, 20 bp, mouse
gcgccatggatctttcctca

SEQ ID NO: 476759 - DNA, 20 bp, mouse
gctgcctaggaaacaagacg

SEQ ID NO: 476760 - DNA, 20 bp, mouse
gaaggctcaagaggcccggt

SEQ ID NO: 476761 - DNA, 20 bp, mouse
gtgtacagccgcgcccaccc

SEQ ID NO: 476762 - DNA, 20 bp, mouse
ggtacgcgcaccctacccag

SEQ ID NO: 476763 - DNA, 20 bp, mouse
gaagatccatggcgcccggg

SEQ ID NO: 476764 - DNA, 20 bp, mouse
gacgactcgcgcatccaggt

SEQ ID NO: 476765 - DNA, 20 bp, mouse
gcgcacggccgggactttgg

SEQ ID NO: 476766 - DNA, 20 bp, mouse
gaagaaacaagtggcagcga

SEQ ID NO: 476767 - DNA, 20 bp, mouse
ggctggtgacaacagcttca

SEQ ID NO: 476768 - DNA, 20 bp, mouse
gttctttggaaccttttcca

SEQ ID NO: 476769 - DNA, 20 bp, mouse
gtctcagcctccagatcgag

SEQ ID NO: 476770 - DNA, 20 bp, mouse
gggtgacagaaagtcagttc

SEQ ID NO: 476771 - DNA, 20 bp, mouse
ggcagggaggctcctgacaa

SEQ ID NO: 476772 - DNA, 20 bp, mouse
gaagctgttgtcaccagccc

SEQ ID NO: 476773 - DNA, 20 bp, mouse
gtggcttcctctcgatctgg

SEQ ID NO: 476774 - DNA, 20 bp, mouse
gtggctgtgggaactagagc

SEQ ID NO: 476775 - DNA, 20 bp, mouse
gaactagagctggaagactg

SEQ ID NO: 476776 - DNA, 20 bp, mouse
gttagcacctgaaggtgcag

SEQ ID NO: 476777 - DNA, 20 bp, mouse
gaggggcgatggtcactgga

SEQ ID NO: 476778 - DNA, 20 bp, mouse
gtggtgcagttagcacctga

SEQ ID NO: 476779 - DNA, 20 bp, mouse
gtatagacagataccaatgg

SEQ ID NO: 476780 - DNA, 20 bp, mouse
ggagtatagacagataccaa

SEQ ID NO: 476781 - DNA, 20 bp, mouse
ggagctatggcttcgaaaat

SEQ ID NO: 476782 - DNA, 20 bp, mouse
gactgcctgaaaagcaccca

SEQ ID NO: 476783 - DNA, 20 bp, mouse
ggaccagagctctagcatcc

SEQ ID NO: 476784 - DNA, 20 bp, mouse
gtgccaggatgctagagctc

SEQ ID NO: 476785 - DNA, 20 bp, mouse
gagacagataccaatggagg

SEQ ID NO: 476786 - DNA, 20 bp, mouse
gaggagcaagaacaagatca

SEQ ID NO: 476787 - DNA, 20 bp, mouse
gatcatcctgggtgcgctgg

SEQ ID NO: 476788 - DNA, 20 bp, mouse
ggagccaagcccgccaggga

SEQ ID NO: 476789 - DNA, 20 bp, mouse
gatcacggctgagatcatcc

SEQ ID NO: 476790 - DNA, 20 bp, mouse
gtggtcagggaactgttcgt

SEQ ID NO: 476791 - DNA, 20 bp, mouse
ggggcttgagtgggaatcta

SEQ ID NO: 476792 - DNA, 20 bp, mouse
gtggccctgggcgatgagaa

SEQ ID NO: 476793 - DNA, 20 bp, mouse
gcctgggtggggacccaaca

SEQ ID NO: 476794 - DNA, 20 bp, mouse
ggggtgagccaagcccgcca

SEQ ID NO: 476795 - DNA, 20 bp, mouse
gcgcagcccccagcgcaccc

SEQ ID NO: 476796 - DNA, 20 bp, mouse
gtatgtggagcacttggata

SEQ ID NO: 476797 - DNA, 20 bp, mouse
gcacttggataaggtagctc

SEQ ID NO: 476798 - DNA, 20 bp, mouse
ggtgctccacatattccaga

SEQ ID NO: 476799 - DNA, 20 bp, mouse
gttagacctgggcctgaacc

SEQ ID NO: 476800 - DNA, 20 bp, mouse
gcacatattccagaaggaga

SEQ ID NO: 476801 - DNA, 20 bp, mouse
ggtcctaagggcttagacct

SEQ ID NO: 476802 - DNA, 20 bp, mouse
gccttggacacacctttcta

SEQ ID NO: 476803 - DNA, 20 bp, mouse
gtgtatgaaaagcacagtat

SEQ ID NO: 476804 - DNA, 20 bp, mouse
ggtctcagcttcggtcctaa

SEQ ID NO: 476805 - DNA, 20 bp, mouse
gtctgtgagcagttcattaa

SEQ ID NO: 476806 - DNA, 20 bp, mouse
gtccggaagaaacaggagtg

SEQ ID NO: 476807 - DNA, 20 bp, mouse
ggtgaacatggtgagcggag

SEQ ID NO: 476808 - DNA, 20 bp, mouse
ggcggcgtgaacatggtgag

SEQ ID NO: 476809 - DNA, 20 bp, mouse
ggagcgattccggaagaaac

SEQ ID NO: 476810 - DNA, 20 bp, mouse
gccttagttcgaagggagta

SEQ ID NO: 476811 - DNA, 20 bp, mouse
gttcgaagggagtagggagg

SEQ ID NO: 476812 - DNA, 20 bp, mouse
ggtcgcgctgcgagcgattc

SEQ ID NO: 476813 - DNA, 20 bp, mouse
gcgagtctatatctggccaa

SEQ ID NO: 476814 - DNA, 20 bp, mouse
ggaagcaccgagtctatatc

SEQ ID NO: 476815 - DNA, 20 bp, mouse
ggccgcactcctgtttcttc

SEQ ID NO: 476816 - DNA, 20 bp, mouse
gagggcctggatgcagaata

SEQ ID NO: 476817 - DNA, 20 bp, mouse
ggaagaggcagtctagggcc

SEQ ID NO: 476818 - DNA, 20 bp, mouse
gtagttgtccctcttctgca

SEQ ID NO: 476819 - DNA, 20 bp, mouse
gtgactagataggactgggt

SEQ ID NO: 476820 - DNA, 20 bp, mouse
gagccacctggatgtaagga

SEQ ID NO: 476821 - DNA, 20 bp, mouse
gccggagcaaccctcctgtg

SEQ ID NO: 476822 - DNA, 20 bp, mouse
gaatctggtcctgcagctcg

SEQ ID NO: 476823 - DNA, 20 bp, mouse
gaagttgactagataggact

SEQ ID NO: 476824 - DNA, 20 bp, mouse
gaggcagagaggggttagaa

SEQ ID NO: 476825 - DNA, 20 bp, mouse
ggttagaagggggcaatctc

SEQ ID NO: 476826 - DNA, 20 bp, mouse
gcagctttggagatgacatg

SEQ ID NO: 476827 - DNA, 20 bp, mouse
ggggtaagtagggctcaagg

SEQ ID NO: 476828 - DNA, 20 bp, mouse
gatggaaagggagcctctgg

SEQ ID NO: 476829 - DNA, 20 bp, mouse
ggcaggcttaatgccaccag

SEQ ID NO: 476830 - DNA, 20 bp, mouse
gtgctactttggggtaagta

SEQ ID NO: 476831 - DNA, 20 bp, mouse
ggctcaaggaggcttgctag

SEQ ID NO: 476832 - DNA, 20 bp, mouse
gcatgtaatgtgcaagacac

SEQ ID NO: 476833 - DNA, 20 bp, mouse
gacatgattcttaccagctt

SEQ ID NO: 476834 - DNA, 20 bp, mouse
gggactcagctggtcctggg

SEQ ID NO: 476835 - DNA, 20 bp, mouse
gttccagtcggtggggaagt

SEQ ID NO: 476836 - DNA, 20 bp, mouse
gactatctgccaagccggga

SEQ ID NO: 476837 - DNA, 20 bp, mouse
ggcgagtcagctgcaggcac

SEQ ID NO: 476838 - DNA, 20 bp, mouse
gtctggagcgagtcagctgc

SEQ ID NO: 476839 - DNA, 20 bp, mouse
gccatggggatcagtaggaa

SEQ ID NO: 476840 - DNA, 20 bp, mouse
gaggcaggggaaggacacct

SEQ ID NO: 476841 - DNA, 20 bp, mouse
gaggcatgtcaggagtaagt

SEQ ID NO: 476842 - DNA, 20 bp, mouse
gacaggcttccctcccggct

SEQ ID NO: 476843 - DNA, 20 bp, mouse
ggctctccatggggatcagt

SEQ ID NO: 476844 - DNA, 20 bp, mouse
gtgaatcagcctggcatagg

SEQ ID NO: 476845 - DNA, 20 bp, mouse
gggctgtccacagtagcata

SEQ ID NO: 476846 - DNA, 20 bp, mouse
gcagtggtggaagtagccat

SEQ ID NO: 476847 - DNA, 20 bp, mouse
ggcagcagaattgtcagtgg

SEQ ID NO: 476848 - DNA, 20 bp, mouse
gacagcagcagaattgtcag

SEQ ID NO: 476849 - DNA, 20 bp, mouse
gtgcacactctggaagccaa

SEQ ID NO: 476850 - DNA, 20 bp, mouse
gtgtttcagaatgcacactc

SEQ ID NO: 476851 - DNA, 20 bp, mouse
gactggatcagagtctgatg

SEQ ID NO: 476852 - DNA, 20 bp, mouse
gtccggtaccaccagacatg

SEQ ID NO: 476853 - DNA, 20 bp, mouse
gaaccggggagagattaaca

SEQ ID NO: 476854 - DNA, 20 bp, mouse
gggagtctagacagtaagag

SEQ ID NO: 476855 - DNA, 20 bp, mouse
gagggccagagccccatgtc

SEQ ID NO: 476856 - DNA, 20 bp, mouse
gctgtaagtaccagagctgt

SEQ ID NO: 476857 - DNA, 20 bp, mouse
gtgggactcagtctagatga

SEQ ID NO: 476858 - DNA, 20 bp, mouse
gtaagggttccggatatctg

SEQ ID NO: 476859 - DNA, 20 bp, mouse
gctactactaccaacagctc

SEQ ID NO: 476860 - DNA, 20 bp, mouse
gcctcacgaagcacaaatca

SEQ ID NO: 476861 - DNA, 20 bp, mouse
gagtcaaatagggcccttaa

SEQ ID NO: 476862 - DNA, 20 bp, mouse
gggaggtctctgctgaacga

SEQ ID NO: 476863 - DNA, 20 bp, mouse
ggaggggactgtgagttcat

SEQ ID NO: 476864 - DNA, 20 bp, mouse
gggcatagaacccccactat

SEQ ID NO: 476865 - DNA, 20 bp, mouse
ggcctgacctgaaacttggg

SEQ ID NO: 476866 - DNA, 20 bp, mouse
gctctaagcagaggatccat

SEQ ID NO: 476867 - DNA, 20 bp, mouse
gaactggaggctctaagcag

SEQ ID NO: 476868 - DNA, 20 bp, mouse
gcaggatgtaagagaagaac

SEQ ID NO: 476869 - DNA, 20 bp, mouse
gggagtgttatgacctgagg

SEQ ID NO: 476870 - DNA, 20 bp, mouse
gtccctctgcctgcagccga

SEQ ID NO: 476871 - DNA, 20 bp, mouse
gcagaggatccatcggctgc

SEQ ID NO: 476872 - DNA, 20 bp, mouse
gatcctgtctgtacacagtt

SEQ ID NO: 476873 - DNA, 20 bp, mouse
gcctggagctccaggtctga

SEQ ID NO: 476874 - DNA, 20 bp, mouse
ggtctgtacacagttaggac

SEQ ID NO: 476875 - DNA, 20 bp, mouse
gggaggagtgttatgacctg

SEQ ID NO: 476876 - DNA, 20 bp, mouse
gggcccctgaaggatggggt

SEQ ID NO: 476877 - DNA, 20 bp, mouse
gttggggcccctgaaggatg

SEQ ID NO: 476878 - DNA, 20 bp, mouse
gagaggcctccagttagtgc

SEQ ID NO: 476879 - DNA, 20 bp, mouse
ggcctcccgcctgaagagta

SEQ ID NO: 476880 - DNA, 20 bp, mouse
gagtgctggcggaagtgtca

SEQ ID NO: 476881 - DNA, 20 bp, mouse
gttccgccagcactaactgg

SEQ ID NO: 476882 - DNA, 20 bp, mouse
gggatggggtaggcaccggg

SEQ ID NO: 476883 - DNA, 20 bp, mouse
gaccgatgggcactgagagt

SEQ ID NO: 476884 - DNA, 20 bp, mouse
gtgaaggatggggtaggcac

SEQ ID NO: 476885 - DNA, 20 bp, mouse
gcacttccgccagcactaac

SEQ ID NO: 476886 - DNA, 20 bp, mouse
gcaggtagcgccgcgagagg

SEQ ID NO: 476887 - DNA, 20 bp, mouse
ggagaggcggtgagtgtccc

SEQ ID NO: 476888 - DNA, 20 bp, mouse
gtagggccaggctagagacc

SEQ ID NO: 476889 - DNA, 20 bp, mouse
gaaggcggggcgccactcta

SEQ ID NO: 476890 - DNA, 20 bp, mouse
ggcaccggagccccgcgccg

SEQ ID NO: 476891 - DNA, 20 bp, mouse
gtgcaccccgcaccccgcac

SEQ ID NO: 476892 - DNA, 20 bp, mouse
ggacccggaagagggattgg

SEQ ID NO: 476893 - DNA, 20 bp, mouse
ggttcccaggcgaggaagag

SEQ ID NO: 476894 - DNA, 20 bp, mouse
gtcgggccgggtcaggatgg

SEQ ID NO: 476895 - DNA, 20 bp, mouse
gcgaggaagaggggcagcga

SEQ ID NO: 476896 - DNA, 20 bp, mouse
ggcggacgcggaacccggcg

SEQ ID NO: 476897 - DNA, 20 bp, mouse
gacacagcggcgggcgggtg

SEQ ID NO: 476898 - DNA, 20 bp, mouse
gccggtccgtgtttacacag

SEQ ID NO: 476899 - DNA, 20 bp, mouse
gggcggcggcaagatggtca

SEQ ID NO: 476900 - DNA, 20 bp, mouse
gcgcgcagtggccaacccgg

SEQ ID NO: 476901 - DNA, 20 bp, mouse
gcgggtgcggacgcggaacc

SEQ ID NO: 476902 - DNA, 20 bp, mouse
ggcggccgagcgagagtcca

SEQ ID NO: 476903 - DNA, 20 bp, mouse
ggcccgccgctgtgtaaaca

SEQ ID NO: 476904 - DNA, 20 bp, mouse
gcagcgcggcccgggagtct

SEQ ID NO: 476905 - DNA, 20 bp, mouse
gagctcggccgggcaacccc

SEQ ID NO: 476906 - DNA, 20 bp, mouse
gtgcatcgcggctccagcaa

SEQ ID NO: 476907 - DNA, 20 bp, mouse
gccggcgcggaagaacacag

SEQ ID NO: 476908 - DNA, 20 bp, mouse
gagttccggagtagagtgtc

SEQ ID NO: 476909 - DNA, 20 bp, mouse
gcggggcggcggctgcatcg

SEQ ID NO: 476910 - DNA, 20 bp, mouse
ggcggagcgggccaactctg

SEQ ID NO: 476911 - DNA, 20 bp, mouse
ggctgccagacactctactc

SEQ ID NO: 476912 - DNA, 20 bp, mouse
gtctactccggaactcgggg

SEQ ID NO: 476913 - DNA, 20 bp, mouse
gctcacagggagcggtgagg

SEQ ID NO: 476914 - DNA, 20 bp, mouse
gaaaggtccaggccaccggg

SEQ ID NO: 476915 - DNA, 20 bp, mouse
gcactctactccggaactcg

SEQ ID NO: 476916 - DNA, 20 bp, mouse
gccgccgccgaggaaggtaa

SEQ ID NO: 476917 - DNA, 20 bp, mouse
gggaagaggaatcggcccgg

SEQ ID NO: 476918 - DNA, 20 bp, mouse
ggcgagcggcaggagcagcc

SEQ ID NO: 476919 - DNA, 20 bp, mouse
gagccgggtcgcagcgagtg

SEQ ID NO: 476920 - DNA, 20 bp, mouse
gcgcagcgagtgtggagaga

SEQ ID NO: 476921 - DNA, 20 bp, mouse
gaatcggcccggaggctgcg

SEQ ID NO: 476922 - DNA, 20 bp, mouse
gctccacactcgctgcgacc

SEQ ID NO: 476923 - DNA, 20 bp, mouse
gcgcctgcctcgcagcctcc

SEQ ID NO: 476924 - DNA, 20 bp, mouse
ggcgcccttaccttcctcgg

SEQ ID NO: 476925 - DNA, 20 bp, mouse
gaaacgccgccgtcaggggt

SEQ ID NO: 476926 - DNA, 20 bp, mouse
ggagccagggagtcaaggag

SEQ ID NO: 476927 - DNA, 20 bp, mouse
gactccctggctctggacgg

SEQ ID NO: 476928 - DNA, 20 bp, mouse
gtggctctggacggaggctg

SEQ ID NO: 476929 - DNA, 20 bp, mouse
gtgaggaatccaggcagtga

SEQ ID NO: 476930 - DNA, 20 bp, mouse
gcagccactccttgactccc

SEQ ID NO: 476931 - DNA, 20 bp, mouse
gaggagagaggtgcctgtcc

SEQ ID NO: 476932 - DNA, 20 bp, mouse
gctgaaaaggcccacagcgt

SEQ ID NO: 476933 - DNA, 20 bp, mouse
ggagatgggacattttagaa

SEQ ID NO: 476934 - DNA, 20 bp, mouse
gaggctgcatgaatgctagt

SEQ ID NO: 476935 - DNA, 20 bp, mouse
gggtgcctgtccaggtgaga

SEQ ID NO: 476936 - DNA, 20 bp, mouse
gcagggccatggcaactggt

SEQ ID NO: 476937 - DNA, 20 bp, mouse
gctctgcaaagctatagagg

SEQ ID NO: 476938 - DNA, 20 bp, mouse
ggggagccgaccagttgcca

SEQ ID NO: 476939 - DNA, 20 bp, mouse
ggactctgagcagctagcac

SEQ ID NO: 476940 - DNA, 20 bp, mouse
ggctcaggtggagactctgt

SEQ ID NO: 476941 - DNA, 20 bp, mouse
gggtcaggctgaaggcctca

SEQ ID NO: 476942 - DNA, 20 bp, mouse
gagagtctcctggtacatat

SEQ ID NO: 476943 - DNA, 20 bp, mouse
gtgtggcagccacaaagtag

SEQ ID NO: 476944 - DNA, 20 bp, mouse
gacactagaaggcactgagt

SEQ ID NO: 476945 - DNA, 20 bp, mouse
gatgcggctggcacatgccc

SEQ ID NO: 476946 - DNA, 20 bp, mouse
gtagcatgaggaccaggctg

SEQ ID NO: 476947 - DNA, 20 bp, mouse
gggctcctgctactgatctg

SEQ ID NO: 476948 - DNA, 20 bp, mouse
gcaggagccaaggtagcatg

SEQ ID NO: 476949 - DNA, 20 bp, mouse
ggctggggatggtaacttga

SEQ ID NO: 476950 - DNA, 20 bp, mouse
gcctggtcctcatgctacct

SEQ ID NO: 476951 - DNA, 20 bp, mouse
gtggccacaggggaatgagg

SEQ ID NO: 476952 - DNA, 20 bp, mouse
ggagggctggtgatacacta

SEQ ID NO: 476953 - DNA, 20 bp, mouse
ggacacctctgtgagtagtc

SEQ ID NO: 476954 - DNA, 20 bp, mouse
gaagttagacaacttggagt

SEQ ID NO: 476955 - DNA, 20 bp, mouse
gctgaggtttgaggaagtcg

SEQ ID NO: 476956 - DNA, 20 bp, mouse
ggaaccagacatctgctcac

SEQ ID NO: 476957 - DNA, 20 bp, mouse
ggtagtcactcacagctcca

SEQ ID NO: 476958 - DNA, 20 bp, mouse
gctcttgctcttgctcgcaa

SEQ ID NO: 476959 - DNA, 20 bp, mouse
gcagctccaaggagaaatct

SEQ ID NO: 476960 - DNA, 20 bp, mouse
gtctgtgtgaacaccacaca

SEQ ID NO: 476961 - DNA, 20 bp, mouse
ggggaacacagcctcacacg

SEQ ID NO: 476962 - DNA, 20 bp, mouse
ggaggaagaaacggtagcaa

SEQ ID NO: 476963 - DNA, 20 bp, mouse
gcagatgtggctgactctac

SEQ ID NO: 476964 - DNA, 20 bp, mouse
gtgagtagatggctcaatat

SEQ ID NO: 476965 - DNA, 20 bp, mouse
gtctctctccactacaggcc

SEQ ID NO: 476966 - DNA, 20 bp, mouse
ggcctgctctgcctcaagaa

SEQ ID NO: 476967 - DNA, 20 bp, mouse
gcagcatggtgcctttcttg

SEQ ID NO: 476968 - DNA, 20 bp, mouse
gtgcacactggcaagctgag

SEQ ID NO: 476969 - DNA, 20 bp, mouse
gatccacagagattactatg

SEQ ID NO: 476970 - DNA, 20 bp, mouse
ggcctttcttgaggcagagc

SEQ ID NO: 476971 - DNA, 20 bp, mouse
ggagactggtagttctgagc

SEQ ID NO: 476972 - DNA, 20 bp, mouse
gctccacatagtaatctctg

SEQ ID NO: 476973 - DNA, 20 bp, mouse
gtgctctgtggtgagttaaa

SEQ ID NO: 476974 - DNA, 20 bp, mouse
gctgaggggaactggcccag

SEQ ID NO: 476975 - DNA, 20 bp, mouse
gggtatctcatggaagaatc

SEQ ID NO: 476976 - DNA, 20 bp, mouse
ggagctgcacgctcacacag

SEQ ID NO: 476977 - DNA, 20 bp, mouse
gcacagcagggcagacataa

SEQ ID NO: 476978 - DNA, 20 bp, mouse
gtcagacgtgaaggactgaa

SEQ ID NO: 476979 - DNA, 20 bp, mouse
gtacttacccagtaacatct

SEQ ID NO: 476980 - DNA, 20 bp, mouse
gtcctcaaaggtaagaagaa

SEQ ID NO: 476981 - DNA, 20 bp, mouse
ggccacgctgcaagcaggga

SEQ ID NO: 476982 - DNA, 20 bp, mouse
gctggagtctggattacgta

SEQ ID NO: 476983 - DNA, 20 bp, mouse
ggaagacaagtcagacgtga

SEQ ID NO: 476984 - DNA, 20 bp, mouse
gtaatacaactgtcttggaa

SEQ ID NO: 476985 - DNA, 20 bp, mouse
ggtaatccagactccagtgg

SEQ ID NO: 476986 - DNA, 20 bp, mouse
gggagggggagagtatgaca

SEQ ID NO: 476987 - DNA, 20 bp, mouse
ggggtgagtcagtaatgagg

SEQ ID NO: 476988 - DNA, 20 bp, mouse
gtgcaggcagagtcattatg

SEQ ID NO: 476989 - DNA, 20 bp, mouse
ggcatcagcaggatttgggg

SEQ ID NO: 476990 - DNA, 20 bp, mouse
gtctgggtgagtcagtaatg

SEQ ID NO: 476991 - DNA, 20 bp, mouse
gtgaaacctgaggtcagcaa

SEQ ID NO: 476992 - DNA, 20 bp, mouse
ggtatggacaaaggaaactc

SEQ ID NO: 476993 - DNA, 20 bp, mouse
ggtaatgagggggcatcagc

SEQ ID NO: 476994 - DNA, 20 bp, mouse
ggagaaccatatgaaacctg

SEQ ID NO: 476995 - DNA, 20 bp, mouse
ggctccatttcatcacccca

SEQ ID NO: 476996 - DNA, 20 bp, mouse
gggtgcagctcaagtcctta

SEQ ID NO: 476997 - DNA, 20 bp, mouse
gcacagaggcatgagactcg

SEQ ID NO: 476998 - DNA, 20 bp, mouse
gtgctcaggaagagtgtcta

SEQ ID NO: 476999 - DNA, 20 bp, mouse
ggcagatggaccacagatct

SEQ ID NO: 477000 - DNA, 20 bp, mouse
gctgtggtccatctgcccta

SEQ ID NO: 477001 - DNA, 20 bp, mouse
ggatctgggatagaacactg

SEQ ID NO: 477002 - DNA, 20 bp, mouse
gtgagctgcacctgtctcaa

SEQ ID NO: 477003 - DNA, 20 bp, mouse
gagcagagggagtcccaccc

SEQ ID NO: 477004 - DNA, 20 bp, mouse
gtctagggctgaccaagcag

SEQ ID NO: 477005 - DNA, 20 bp, mouse
ggtgttctatcccagatctg

SEQ ID NO: 477006 - DNA, 20 bp, mouse
gctccccggcgtctaaacac

SEQ ID NO: 477007 - DNA, 20 bp, mouse
ggggagcgggagatcccgac

SEQ ID NO: 477008 - DNA, 20 bp, mouse
gccgcacaagaggtctctag

SEQ ID NO: 477009 - DNA, 20 bp, mouse
gagccgccacaggcctgcga

SEQ ID NO: 477010 - DNA, 20 bp, mouse
gccgccttccgtgaagacca

SEQ ID NO: 477011 - DNA, 20 bp, mouse
ggacgcgcggagtggactga

SEQ ID NO: 477012 - DNA, 20 bp, mouse
gcggcgcggccggttgagga

SEQ ID NO: 477013 - DNA, 20 bp, mouse
gtagacgccggggagtgggc

SEQ ID NO: 477014 - DNA, 20 bp, mouse
gtctaaacacaggtgggagc

SEQ ID NO: 477015 - DNA, 20 bp, mouse
gctgctccctcgcaggcctg

SEQ ID NO: 477016 - DNA, 20 bp, mouse
gcggcctccgagcaacaggt

SEQ ID NO: 477017 - DNA, 20 bp, mouse
gcccaggagtccggatgtag

SEQ ID NO: 477018 - DNA, 20 bp, mouse
gacaggtgagagctattgtt

SEQ ID NO: 477019 - DNA, 20 bp, mouse
gctggcgtacggaagacttg

SEQ ID NO: 477020 - DNA, 20 bp, mouse
gagaatccgcgttgaagaac

SEQ ID NO: 477021 - DNA, 20 bp, mouse
ggagttacggggcttggggt

SEQ ID NO: 477022 - DNA, 20 bp, mouse
gagcaacaggtgggcgtggg

SEQ ID NO: 477023 - DNA, 20 bp, mouse
gtctcacctgttcttcaacg

SEQ ID NO: 477024 - DNA, 20 bp, mouse
gaagccccgtaactccaaca

SEQ ID NO: 477025 - DNA, 20 bp, mouse
gcggatcgggtgaagctccg

SEQ ID NO: 477026 - DNA, 20 bp, mouse
gcgcgtgtccggctgcgaga

SEQ ID NO: 477027 - DNA, 20 bp, mouse
ggcggccgccataaccctgt

SEQ ID NO: 477028 - DNA, 20 bp, mouse
gcccagaagactagggtcac

SEQ ID NO: 477029 - DNA, 20 bp, mouse
gggagtcctgcgcagtgctg

SEQ ID NO: 477030 - DNA, 20 bp, mouse
ggcactgcgcaggactccgc

SEQ ID NO: 477031 - DNA, 20 bp, mouse
gcggaaggttccgggtcccg

SEQ ID NO: 477032 - DNA, 20 bp, mouse
gcagcaaccgagaggcgagg

SEQ ID NO: 477033 - DNA, 20 bp, mouse
gcgcggggccagcaaccgag

SEQ ID NO: 477034 - DNA, 20 bp, mouse
gaggccgcggaaagggacgg

SEQ ID NO: 477035 - DNA, 20 bp, mouse
ggcatgcaggcggggactcg

SEQ ID NO: 477036 - DNA, 20 bp, mouse
gctcacgccccgggccatgg

SEQ ID NO: 477037 - DNA, 20 bp, mouse
gccatggaggcggccatgat

SEQ ID NO: 477038 - DNA, 20 bp, mouse
gggccgcccgtaacaggacc

SEQ ID NO: 477039 - DNA, 20 bp, mouse
gagcgcccgggtcctgttac

SEQ ID NO: 477040 - DNA, 20 bp, mouse
ggcccgggtcctgttacggg

SEQ ID NO: 477041 - DNA, 20 bp, mouse
gctgggtccccaagatcccc

SEQ ID NO: 477042 - DNA, 20 bp, mouse
gccggtcacgtggcctatca

SEQ ID NO: 477043 - DNA, 20 bp, mouse
gcgcctggaaacacacgagt

SEQ ID NO: 477044 - DNA, 20 bp, mouse
gacgccccgggccatggagg

SEQ ID NO: 477045 - DNA, 20 bp, mouse
gtggccgcctccatggcccg

SEQ ID NO: 477046 - DNA, 20 bp, mouse
gaggccgtcgatcagagaag

SEQ ID NO: 477047 - DNA, 20 bp, mouse
gcgaccaacaggaggcgccg

SEQ ID NO: 477048 - DNA, 20 bp, mouse
gcttccccggcgcctcctgt

SEQ ID NO: 477049 - DNA, 20 bp, mouse
gtacctgccggcgctctccg

SEQ ID NO: 477050 - DNA, 20 bp, mouse
gagagcgccggcaggtaagc

SEQ ID NO: 477051 - DNA, 20 bp, mouse
gaggaggcgccggggaagca

SEQ ID NO: 477052 - DNA, 20 bp, mouse
ggctcgcgcggggaactcga

SEQ ID NO: 477053 - DNA, 20 bp, mouse
ggcggctctggagggagatc

SEQ ID NO: 477054 - DNA, 20 bp, mouse
ggcgccggcaggtaagccgg

SEQ ID NO: 477055 - DNA, 20 bp, mouse
ggggcccgcccggagcgtaa

SEQ ID NO: 477056 - DNA, 20 bp, mouse
gtgccagcagcgaggagcca

SEQ ID NO: 477057 - DNA, 20 bp, mouse
ggagaagtgcaaccagcaag

SEQ ID NO: 477058 - DNA, 20 bp, mouse
gtactcggagtgctcctgga

SEQ ID NO: 477059 - DNA, 20 bp, mouse
gtccgagcagagctgaggcg

SEQ ID NO: 477060 - DNA, 20 bp, mouse
ggccaccagtgccagcagcg

SEQ ID NO: 477061 - DNA, 20 bp, mouse
gggcctgtgatcaagagcgg

SEQ ID NO: 477062 - DNA, 20 bp, mouse
ggagtgctcctggagggaga

SEQ ID NO: 477063 - DNA, 20 bp, mouse
gtgtgatacgaggtgaacgg

SEQ ID NO: 477064 - DNA, 20 bp, mouse
ggggggtccgagcagagctg

SEQ ID NO: 477065 - DNA, 20 bp, mouse
gtccagaggagcgtcctcgg

SEQ ID NO: 477066 - DNA, 20 bp, mouse
gaggcccgggaacgccgacc

SEQ ID NO: 477067 - DNA, 20 bp, mouse
ggacggccagggatcctctg

SEQ ID NO: 477068 - DNA, 20 bp, mouse
gcggcgctccggcaaggccc

SEQ ID NO: 477069 - DNA, 20 bp, mouse
ggtgcggagcgctgccaggt

SEQ ID NO: 477070 - DNA, 20 bp, mouse
gggccagggatcctctgcgg

SEQ ID NO: 477071 - DNA, 20 bp, mouse
gaacgtgaggagcgtccggg

SEQ ID NO: 477072 - DNA, 20 bp, mouse
gcgccgccgcagaggatccc

SEQ ID NO: 477073 - DNA, 20 bp, mouse
gggtagcgggacccacagtg

SEQ ID NO: 477074 - DNA, 20 bp, mouse
gctgccaggtcggcgttccc

SEQ ID NO: 477075 - DNA, 20 bp, mouse
gctgcggcggcgctccggca

SEQ ID NO: 477076 - DNA, 20 bp, mouse
gatcttagcgggtctccggg

SEQ ID NO: 477077 - DNA, 20 bp, mouse
gacaaccttcaccttctccc

SEQ ID NO: 477078 - DNA, 20 bp, mouse
ggtcatcttagcgggtctcc

SEQ ID NO: 477079 - DNA, 20 bp, mouse
gacgtggtacgctacctggt

SEQ ID NO: 477080 - DNA, 20 bp, mouse
gcccgggctgtcatcttagc

SEQ ID NO: 477081 - DNA, 20 bp, mouse
gtaaaatggccgccgcgaag

SEQ ID NO: 477082 - DNA, 20 bp, mouse
ggaagctgctggccggccgt

SEQ ID NO: 477083 - DNA, 20 bp, mouse
gcaggtagcgtaccacgtcc

SEQ ID NO: 477084 - DNA, 20 bp, mouse
gtgtcctcgccccttcgcgg

SEQ ID NO: 477085 - DNA, 20 bp, mouse
ggcggccattttattcctcc

SEQ ID NO: 477086 - DNA, 20 bp, mouse
ggcaccagcaccggaactta

SEQ ID NO: 477087 - DNA, 20 bp, mouse
gcagcaccggaacttagggc

SEQ ID NO: 477088 - DNA, 20 bp, mouse
gcagcagcgcgacccaggga

SEQ ID NO: 477089 - DNA, 20 bp, mouse
gcgccgcagacggagccgaa

SEQ ID NO: 477090 - DNA, 20 bp, mouse
ggggcctctcgagaccccag

SEQ ID NO: 477091 - DNA, 20 bp, mouse
gggcggcctgagacccgggg

SEQ ID NO: 477092 - DNA, 20 bp, mouse
ggcggcgaggagctaagtgg

SEQ ID NO: 477093 - DNA, 20 bp, mouse
gctcccttcggctccgtctg

SEQ ID NO: 477094 - DNA, 20 bp, mouse
gcaccgccggaggcacaagt

SEQ ID NO: 477095 - DNA, 20 bp, mouse
gtgggccgaggggatctcca

SEQ ID NO: 477096 - DNA, 20 bp, mouse
gcccattacaccatccgcca

SEQ ID NO: 477097 - DNA, 20 bp, mouse
ggcagctgctgcaacgcgaa

SEQ ID NO: 477098 - DNA, 20 bp, mouse
ggagggtgcagacagctccg

SEQ ID NO: 477099 - DNA, 20 bp, mouse
gtggaggcgaaggtgacgga

SEQ ID NO: 477100 - DNA, 20 bp, mouse
ggctgcaacgcgaacggccc

SEQ ID NO: 477101 - DNA, 20 bp, mouse
gcgcgttgcagcagctgccg

SEQ ID NO: 477102 - DNA, 20 bp, mouse
ggccgtggcggatggtgtaa

SEQ ID NO: 477103 - DNA, 20 bp, mouse
ggccccggggcaggtagcga

SEQ ID NO: 477104 - DNA, 20 bp, mouse
ggcgccattgggtcgaggga

SEQ ID NO: 477105 - DNA, 20 bp, mouse
gtgcggccgcaggcggagta

SEQ ID NO: 477106 - DNA, 20 bp, mouse
gtggagtccacagcgttctc

SEQ ID NO: 477107 - DNA, 20 bp, mouse
gggaacgatactgaaagaac

SEQ ID NO: 477108 - DNA, 20 bp, mouse
gtaagcagctagcagtggtt

SEQ ID NO: 477109 - DNA, 20 bp, mouse
gagccttaagcagctagcag

SEQ ID NO: 477110 - DNA, 20 bp, mouse
ggagccgcgggaacagcacc

SEQ ID NO: 477111 - DNA, 20 bp, mouse
gcgagagcgcgggctttgga

SEQ ID NO: 477112 - DNA, 20 bp, mouse
ggagcgcgggctttggaagg

SEQ ID NO: 477113 - DNA, 20 bp, mouse
ggatcacgtgacgagagcgc

SEQ ID NO: 477114 - DNA, 20 bp, mouse
gaccggcgaagaggaatgtt

SEQ ID NO: 477115 - DNA, 20 bp, mouse
gggctcgtgcactcgagacg

SEQ ID NO: 477116 - DNA, 20 bp, mouse
gcaggctcacgtgcacagtg

SEQ ID NO: 477117 - DNA, 20 bp, mouse
ggctcacgtgcacagtgtgg

SEQ ID NO: 477118 - DNA, 20 bp, mouse
ggttgcaagactgggaacta

SEQ ID NO: 477119 - DNA, 20 bp, mouse
gtatagaacgagcataccca

SEQ ID NO: 477120 - DNA, 20 bp, mouse
gcacagatcggggcgtatgt

SEQ ID NO: 477121 - DNA, 20 bp, mouse
gaagctatatcttacaaaat

SEQ ID NO: 477122 - DNA, 20 bp, mouse
gagcttcctgtgagttcttc

SEQ ID NO: 477123 - DNA, 20 bp, mouse
gacctgaacactgcatgtgg

SEQ ID NO: 477124 - DNA, 20 bp, mouse
gcagatatgtgctgactagc

SEQ ID NO: 477125 - DNA, 20 bp, mouse
ggaccctatacaaaacaagt

SEQ ID NO: 477126 - DNA, 20 bp, mouse
gagtcacgggcaacactggt

SEQ ID NO: 477127 - DNA, 20 bp, mouse
gggtacccggcagccctgtt

SEQ ID NO: 477128 - DNA, 20 bp, mouse
ggcaacactggtgggcagaa

SEQ ID NO: 477129 - DNA, 20 bp, mouse
gagtgccaccaccagctctc

SEQ ID NO: 477130 - DNA, 20 bp, mouse
gtgtgagtcacgggcaacac

SEQ ID NO: 477131 - DNA, 20 bp, mouse
ggacctccaacctaagtcct

SEQ ID NO: 477132 - DNA, 20 bp, mouse
ggtggccgagaagcagacgt

SEQ ID NO: 477133 - DNA, 20 bp, mouse
ggacttaggttggaggtcta

SEQ ID NO: 477134 - DNA, 20 bp, mouse
gcttgtcggtcatgggtacc

SEQ ID NO: 477135 - DNA, 20 bp, mouse
ggcgagtccagtgtgagtca

SEQ ID NO: 477136 - DNA, 20 bp, mouse
gcagaggagtcaccaagaag

SEQ ID NO: 477137 - DNA, 20 bp, mouse
gtgcttagttcctggaccag

SEQ ID NO: 477138 - DNA, 20 bp, mouse
gcaggaactaagcagaatcc

SEQ ID NO: 477139 - DNA, 20 bp, mouse
gctgggtaaaagcagacacc

SEQ ID NO: 477140 - DNA, 20 bp, mouse
gaaacctgtgtccaggacct

SEQ ID NO: 477141 - DNA, 20 bp, mouse
gcaggtgttcttgtaaccag

SEQ ID NO: 477142 - DNA, 20 bp, mouse
ggagaaagcagtgttttact

SEQ ID NO: 477143 - DNA, 20 bp, mouse
gcaggggagtagggagcgag

SEQ ID NO: 477144 - DNA, 20 bp, mouse
gcacagaccagaggaacaac

SEQ ID NO: 477145 - DNA, 20 bp, mouse
gttactaaagacagaaacta

SEQ ID NO: 477146 - DNA, 20 bp, mouse
gggccaccaaggagctctat

SEQ ID NO: 477147 - DNA, 20 bp, mouse
gtgccgatagagctccttgg

SEQ ID NO: 477148 - DNA, 20 bp, mouse
ggtacagagagggaagacct

SEQ ID NO: 477149 - DNA, 20 bp, mouse
gagctgccgatagagctcct

SEQ ID NO: 477150 - DNA, 20 bp, mouse
gtccaagcagctctctggat

SEQ ID NO: 477151 - DNA, 20 bp, mouse
gcccaaaagggaccccaggt

SEQ ID NO: 477152 - DNA, 20 bp, mouse
ggaacactggggtacagaga

SEQ ID NO: 477153 - DNA, 20 bp, mouse
gtgatacgctgcaggaatca

SEQ ID NO: 477154 - DNA, 20 bp, mouse
gtgagatagacgctgagtga

SEQ ID NO: 477155 - DNA, 20 bp, mouse
gtatgaggacccagaagagg

SEQ ID NO: 477156 - DNA, 20 bp, mouse
gcgggactcggaccgtgctt

SEQ ID NO: 477157 - DNA, 20 bp, mouse
gggaccgcaccaaggtacag

SEQ ID NO: 477158 - DNA, 20 bp, mouse
gagcctgcgccgccaagctg

SEQ ID NO: 477159 - DNA, 20 bp, mouse
gaagctgtggccccgggact

SEQ ID NO: 477160 - DNA, 20 bp, mouse
gggctaatcccaatcctcag

SEQ ID NO: 477161 - DNA, 20 bp, mouse
gtggagctcagtctgatcag

SEQ ID NO: 477162 - DNA, 20 bp, mouse
ggtctcgcgggaccgcacca

SEQ ID NO: 477163 - DNA, 20 bp, mouse
gtcccggggccacagcttgg

SEQ ID NO: 477164 - DNA, 20 bp, mouse
gcagaggtcccaagtcttcg

SEQ ID NO: 477165 - DNA, 20 bp, mouse
gggcggagcgaccttcacca

SEQ ID NO: 477166 - DNA, 20 bp, mouse
ggccgggactccattagcag

SEQ ID NO: 477167 - DNA, 20 bp, mouse
gccgaggcaacaggcgaggc

SEQ ID NO: 477168 - DNA, 20 bp, mouse
gacccgcgtcgctgctcggg

SEQ ID NO: 477169 - DNA, 20 bp, mouse
ggccgctgctaatggagtcc

SEQ ID NO: 477170 - DNA, 20 bp, mouse
gtcctcccgagcagcgacgc

SEQ ID NO: 477171 - DNA, 20 bp, mouse
ggctacgcgcgcacaaccaa

SEQ ID NO: 477172 - DNA, 20 bp, mouse
gggcacccgcgtcgctgctc

SEQ ID NO: 477173 - DNA, 20 bp, mouse
ggccgggctcccgaggcaac

SEQ ID NO: 477174 - DNA, 20 bp, mouse
ggtcagcgtcactcccccaa

SEQ ID NO: 477175 - DNA, 20 bp, mouse
gcgactcggcacccagaccg

SEQ ID NO: 477176 - DNA, 20 bp, mouse
ggcaggaccaggccagacca

SEQ ID NO: 477177 - DNA, 20 bp, mouse
gttcatgataaggccactac

SEQ ID NO: 477178 - DNA, 20 bp, mouse
gtgcagctgcaggtggcagt

SEQ ID NO: 477179 - DNA, 20 bp, mouse
gcaggccagaccagggtaac

SEQ ID NO: 477180 - DNA, 20 bp, mouse
ggcctggcagaactgtgagt

SEQ ID NO: 477181 - DNA, 20 bp, mouse
ggacacctgttaccctggtc

SEQ ID NO: 477182 - DNA, 20 bp, mouse
gctgaaggaagcaactgagc

SEQ ID NO: 477183 - DNA, 20 bp, mouse
gtctagggtggtggcaagtg

SEQ ID NO: 477184 - DNA, 20 bp, mouse
ggaggcttgggttagagtac

SEQ ID NO: 477185 - DNA, 20 bp, mouse
gctaacccaagcctctaggg

SEQ ID NO: 477186 - DNA, 20 bp, mouse
gaggtggagttacctttctc

SEQ ID NO: 477187 - DNA, 20 bp, mouse
ggtccaccgccacctacccc

SEQ ID NO: 477188 - DNA, 20 bp, mouse
gaactcctggatctcgaagg

SEQ ID NO: 477189 - DNA, 20 bp, mouse
gataaactcctggatctcga

SEQ ID NO: 477190 - DNA, 20 bp, mouse
gggtggcggtggaccgacta

SEQ ID NO: 477191 - DNA, 20 bp, mouse
gcagagagcagcctggactg

SEQ ID NO: 477192 - DNA, 20 bp, mouse
gctcctggggtaggtggcgg

SEQ ID NO: 477193 - DNA, 20 bp, mouse
gctgcgggcgggacatgggt

SEQ ID NO: 477194 - DNA, 20 bp, mouse
gaactggcccggcagattct

SEQ ID NO: 477195 - DNA, 20 bp, mouse
gagcaggaaagcccagtgat

SEQ ID NO: 477196 - DNA, 20 bp, mouse
gtgagccactgcacaatgtc

SEQ ID NO: 477197 - DNA, 20 bp, mouse
ggccagaacctgtgagtcac

SEQ ID NO: 477198 - DNA, 20 bp, mouse
gtggcagagtggcttacagt

SEQ ID NO: 477199 - DNA, 20 bp, mouse
gagctaccaaccagccgatg

SEQ ID NO: 477200 - DNA, 20 bp, mouse
gacctgtgactcacaggttc

SEQ ID NO: 477201 - DNA, 20 bp, mouse
ggtaagtggcttctccacat

SEQ ID NO: 477202 - DNA, 20 bp, mouse
ggtggcttacagtgggtaag

SEQ ID NO: 477203 - DNA, 20 bp, mouse
gcttgcaaagctcttgattc

SEQ ID NO: 477204 - DNA, 20 bp, mouse
gcttctccacatcggctggt

SEQ ID NO: 477205 - DNA, 20 bp, mouse
ggacactgcactctggtcag

SEQ ID NO: 477206 - DNA, 20 bp, mouse
gcagctccatcgggaacacc

SEQ ID NO: 477207 - DNA, 20 bp, mouse
gggccaggagaccaactcac

SEQ ID NO: 477208 - DNA, 20 bp, mouse
gtgttaattaacaaattgga

SEQ ID NO: 477209 - DNA, 20 bp, mouse
gaattggagggatcctctcc

SEQ ID NO: 477210 - DNA, 20 bp, mouse
gagcaactggtgtataaaca

SEQ ID NO: 477211 - DNA, 20 bp, mouse
ggtcccgttgatctaagaca

SEQ ID NO: 477212 - DNA, 20 bp, mouse
gagtctaaaaagtaaggagt

SEQ ID NO: 477213 - DNA, 20 bp, mouse
gatggagctgcaaaggatga

SEQ ID NO: 477214 - DNA, 20 bp, mouse
gaccaactcacaggagcaac

SEQ ID NO: 477215 - DNA, 20 bp, mouse
gtctaagacagggaggaaca

SEQ ID NO: 477216 - DNA, 20 bp, mouse
ggtcgcagcctagcttgggg

SEQ ID NO: 477217 - DNA, 20 bp, mouse
gtgacttgggcgctacggag

SEQ ID NO: 477218 - DNA, 20 bp, mouse
gtcgcgtcgcagcctagctt

SEQ ID NO: 477219 - DNA, 20 bp, mouse
gcggcagcgatgagacagag

SEQ ID NO: 477220 - DNA, 20 bp, mouse
gcagtcaagcagaccctagg

SEQ ID NO: 477221 - DNA, 20 bp, mouse
gtgagccccgcggtacagaa

SEQ ID NO: 477222 - DNA, 20 bp, mouse
gcggggctgcagtgttctgg

SEQ ID NO: 477223 - DNA, 20 bp, mouse
ggaccctaggcggaagttga

SEQ ID NO: 477224 - DNA, 20 bp, mouse
ggtttgaccgaaagggcccg

SEQ ID NO: 477225 - DNA, 20 bp, mouse
ggggcgggaagtctaggtca

SEQ ID NO: 477226 - DNA, 20 bp, mouse
gtccaggacccgctcaggtg

SEQ ID NO: 477227 - DNA, 20 bp, mouse
gaggaaggaatcggatccca

SEQ ID NO: 477228 - DNA, 20 bp, mouse
gctcgtgcccgggctcccgg

SEQ ID NO: 477229 - DNA, 20 bp, mouse
ggtcggtggttggggatgtc

SEQ ID NO: 477230 - DNA, 20 bp, mouse
gagctcaagggccccggagt

SEQ ID NO: 477231 - DNA, 20 bp, mouse
gcccaaccaccgactagagg

SEQ ID NO: 477232 - DNA, 20 bp, mouse
gcggtgcagcacaacgtcag

SEQ ID NO: 477233 - DNA, 20 bp, mouse
gccagggtgctgcagagcgg

SEQ ID NO: 477234 - DNA, 20 bp, mouse
ggcaccgggccacctctagt

SEQ ID NO: 477235 - DNA, 20 bp, mouse
gggcccagggtgctgcagag

SEQ ID NO: 477236 - DNA, 20 bp, mouse
ggagccggccgggagtgtcc

SEQ ID NO: 477237 - DNA, 20 bp, mouse
gtcggaggccgagcccccac

SEQ ID NO: 477238 - DNA, 20 bp, mouse
gggcgcgatggcggctgacg

SEQ ID NO: 477239 - DNA, 20 bp, mouse
ggcgtggcctggaagcgaca

SEQ ID NO: 477240 - DNA, 20 bp, mouse
ggggcgtggctgtctgaccg

SEQ ID NO: 477241 - DNA, 20 bp, mouse
ggccgggagtgtccaggaac

SEQ ID NO: 477242 - DNA, 20 bp, mouse
gtccacaaggaagcacacag

SEQ ID NO: 477243 - DNA, 20 bp, mouse
gcgtggctgtctgaccgggg

SEQ ID NO: 477244 - DNA, 20 bp, mouse
ggcggccgtgcggcccatca

SEQ ID NO: 477245 - DNA, 20 bp, mouse
ggagtgcagcctcctgcaag

SEQ ID NO: 477246 - DNA, 20 bp, mouse
gacagacctgcggagaggac

SEQ ID NO: 477247 - DNA, 20 bp, mouse
gcctcttggaagttaacgat

SEQ ID NO: 477248 - DNA, 20 bp, mouse
ggcaggtctgtgacaagcag

SEQ ID NO: 477249 - DNA, 20 bp, mouse
gttgtcacagacctgcggag

SEQ ID NO: 477250 - DNA, 20 bp, mouse
gcgatcccgcgactcaaccc

SEQ ID NO: 477251 - DNA, 20 bp, mouse
gttggcgcaccaatgactcg

SEQ ID NO: 477252 - DNA, 20 bp, mouse
ggacgctggcgactcagtca

SEQ ID NO: 477253 - DNA, 20 bp, mouse
gggttcggctggtgatgctg

SEQ ID NO: 477254 - DNA, 20 bp, mouse
gtagcgactgctccagctcg

SEQ ID NO: 477255 - DNA, 20 bp, mouse
gttaacgattggcgagatct

SEQ ID NO: 477256 - DNA, 20 bp, mouse
gggctcggaacgcatctcct

SEQ ID NO: 477257 - DNA, 20 bp, mouse
gtcggaacgcatctccttgg

SEQ ID NO: 477258 - DNA, 20 bp, mouse
gcgcatctccttggcggtgg

SEQ ID NO: 477259 - DNA, 20 bp, mouse
gacagtgatctcacgcggag

SEQ ID NO: 477260 - DNA, 20 bp, mouse
gcctctttcccccaccgcca

SEQ ID NO: 477261 - DNA, 20 bp, mouse
ggagcaaagttaaagagggc

SEQ ID NO: 477262 - DNA, 20 bp, mouse
gttgccctgggactatgaaa

SEQ ID NO: 477263 - DNA, 20 bp, mouse
gacagaagagacacgctgca

SEQ ID NO: 477264 - DNA, 20 bp, mouse
gtcccagggcaatagctggt

SEQ ID NO: 477265 - DNA, 20 bp, mouse
ggaaagaggtaaaagcgagg

SEQ ID NO: 477266 - DNA, 20 bp, mouse
gaatggaaagcccagcgcaa

SEQ ID NO: 477267 - DNA, 20 bp, mouse
ggtgggccaaggcaaagact

SEQ ID NO: 477268 - DNA, 20 bp, mouse
ggcagatacatagagagcga

SEQ ID NO: 477269 - DNA, 20 bp, mouse
gggatggctaacaagttcaa

SEQ ID NO: 477270 - DNA, 20 bp, mouse
gcaggtccatgaggccgagt

SEQ ID NO: 477271 - DNA, 20 bp, mouse
ggagagcgaaggagagctgt

SEQ ID NO: 477272 - DNA, 20 bp, mouse
ggccaagggccagccccagg

SEQ ID NO: 477273 - DNA, 20 bp, mouse
gagcgctggccgctacctgg

SEQ ID NO: 477274 - DNA, 20 bp, mouse
ggaagcctccgcctgcgtag

SEQ ID NO: 477275 - DNA, 20 bp, mouse
gagcgtgggacactgcgcct

SEQ ID NO: 477276 - DNA, 20 bp, mouse
gacgcaggggagaggatctg

SEQ ID NO: 477277 - DNA, 20 bp, mouse
gtgtcagaacacagacccgg

SEQ ID NO: 477278 - DNA, 20 bp, mouse
gggatctgaggagcagctgt

SEQ ID NO: 477279 - DNA, 20 bp, mouse
gactggaccagaggagaacc

SEQ ID NO: 477280 - DNA, 20 bp, mouse
gcagacccggaggctgaggg

SEQ ID NO: 477281 - DNA, 20 bp, mouse
gtccaggactcctcctctac

SEQ ID NO: 477282 - DNA, 20 bp, mouse
gtaccaaaaccggggagcta

SEQ ID NO: 477283 - DNA, 20 bp, mouse
gaggactcctcctctacagg

SEQ ID NO: 477284 - DNA, 20 bp, mouse
gggtaagctgacaggttggg

SEQ ID NO: 477285 - DNA, 20 bp, mouse
gacaaagtcacctcctgtag

SEQ ID NO: 477286 - DNA, 20 bp, mouse
gcaggagccagccgggtgct

SEQ ID NO: 477287 - DNA, 20 bp, mouse
gggctgagggttacacacag

SEQ ID NO: 477288 - DNA, 20 bp, mouse
gcactctgctgcccagcacc

SEQ ID NO: 477289 - DNA, 20 bp, mouse
gtgccagttgtccaatactc

SEQ ID NO: 477290 - DNA, 20 bp, mouse
gcccacactcaccagagtat

SEQ ID NO: 477291 - DNA, 20 bp, mouse
gagctatggtggtggggtgt

SEQ ID NO: 477292 - DNA, 20 bp, mouse
gtggccctggtggtcttcgt

SEQ ID NO: 477293 - DNA, 20 bp, mouse
ggagttggggttccctcact

SEQ ID NO: 477294 - DNA, 20 bp, mouse
gtgatgtcgacactgggtga

SEQ ID NO: 477295 - DNA, 20 bp, mouse
gtcccacgaggaacaccaac

SEQ ID NO: 477296 - DNA, 20 bp, mouse
ggtcgtctgtgcacactcag

SEQ ID NO: 477297 - DNA, 20 bp, mouse
ggcgctctctcagacagcgg

SEQ ID NO: 477298 - DNA, 20 bp, mouse
gtctctcagacagcggcggg

SEQ ID NO: 477299 - DNA, 20 bp, mouse
ggagagagcgctcatctgcg

SEQ ID NO: 477300 - DNA, 20 bp, mouse
gacactggcctgaacaccgt

SEQ ID NO: 477301 - DNA, 20 bp, mouse
gcagggtgtgcgaggggcca

SEQ ID NO: 477302 - DNA, 20 bp, mouse
ggagcacttagactgcccaa

SEQ ID NO: 477303 - DNA, 20 bp, mouse
ggcacactcaggggacatgc

SEQ ID NO: 477304 - DNA, 20 bp, mouse
gcttggtccagggtgtgcga

SEQ ID NO: 477305 - DNA, 20 bp, mouse
gaagatgagccccagaacgg

SEQ ID NO: 477306 - DNA, 20 bp, mouse
gatgaggcaggtgaccctca

SEQ ID NO: 477307 - DNA, 20 bp, mouse
ggctggccacgctcaagatg

SEQ ID NO: 477308 - DNA, 20 bp, mouse
gtggtgtctgcgtttaggga

SEQ ID NO: 477309 - DNA, 20 bp, mouse
gagcgtggccagcacagtct

SEQ ID NO: 477310 - DNA, 20 bp, mouse
gcgtttagggatggctcatg

SEQ ID NO: 477311 - DNA, 20 bp, mouse
gcatgaggaactgcatctaa

SEQ ID NO: 477312 - DNA, 20 bp, mouse
gagcatggtgtctgcgttta

SEQ ID NO: 477313 - DNA, 20 bp, mouse
gagacaccatgctgtccctg

SEQ ID NO: 477314 - DNA, 20 bp, mouse
gtttaaatgccaggccaggg

SEQ ID NO: 477315 - DNA, 20 bp, mouse
gtgagcctgacaagtgtatg

SEQ ID NO: 477316 - DNA, 20 bp, mouse
gtgaaaccatgaggcatcta

SEQ ID NO: 477317 - DNA, 20 bp, mouse
ggtctcccagctaagtctac

SEQ ID NO: 477318 - DNA, 20 bp, mouse
gagcagccatagatgcctca

SEQ ID NO: 477319 - DNA, 20 bp, mouse
gggttcatcgtagtcatcat

SEQ ID NO: 477320 - DNA, 20 bp, mouse
gagctaagtctacaggcaaa

SEQ ID NO: 477321 - DNA, 20 bp, mouse
ggggcaactgctcggaattt

SEQ ID NO: 477322 - DNA, 20 bp, mouse
gtctcaccctggagaaacga

SEQ ID NO: 477323 - DNA, 20 bp, mouse
gactttgctttcatacttac

SEQ ID NO: 477324 - DNA, 20 bp, mouse
gattcaccttcgtttctcca

SEQ ID NO: 477325 - DNA, 20 bp, mouse
gctgtcgatcctatatatag

SEQ ID NO: 477326 - DNA, 20 bp, mouse
ggctgcggctgtctcagcaa

SEQ ID NO: 477327 - DNA, 20 bp, mouse
gggaagagccctgggaactg

SEQ ID NO: 477328 - DNA, 20 bp, mouse
gtcgtcctgggtctgcaccg

SEQ ID NO: 477329 - DNA, 20 bp, mouse
gctgggtctcagcgccgcgg

SEQ ID NO: 477330 - DNA, 20 bp, mouse
gtaactgggtctcagcgccg

SEQ ID NO: 477331 - DNA, 20 bp, mouse
gcggcaggcgggaagagccc

SEQ ID NO: 477332 - DNA, 20 bp, mouse
gtgcagacccaggacgaagg

SEQ ID NO: 477333 - DNA, 20 bp, mouse
gcctgccgcggtgcagaccc

SEQ ID NO: 477334 - DNA, 20 bp, mouse
ggcttctccgccttcgtcct

SEQ ID NO: 477335 - DNA, 20 bp, mouse
ggccagccggatcccaccga

SEQ ID NO: 477336 - DNA, 20 bp, mouse
gcaaggcagtcagaagcgat

SEQ ID NO: 477337 - DNA, 20 bp, mouse
ggctggccagggagtgctga

SEQ ID NO: 477338 - DNA, 20 bp, mouse
ggactcagtgtgcaacctgg

SEQ ID NO: 477339 - DNA, 20 bp, mouse
gcctggccagcgggtgaagc

SEQ ID NO: 477340 - DNA, 20 bp, mouse
gagtaccagatcagatagaa

SEQ ID NO: 477341 - DNA, 20 bp, mouse
gcaacaggtacagatggtgg

SEQ ID NO: 477342 - DNA, 20 bp, mouse
ggccatcagagtaagccctg

SEQ ID NO: 477343 - DNA, 20 bp, mouse
ggccaggcacccaggatgga

SEQ ID NO: 477344 - DNA, 20 bp, mouse
gcaggactcagtgtgcaacc

SEQ ID NO: 477345 - DNA, 20 bp, mouse
gagctggacagggtgagcat

SEQ ID NO: 477346 - DNA, 20 bp, mouse
gccacgtgctggctttgtga

SEQ ID NO: 477347 - DNA, 20 bp, mouse
ggccagcacgtggagagctg

SEQ ID NO: 477348 - DNA, 20 bp, mouse
ggtgggtggtcctgtctcct

SEQ ID NO: 477349 - DNA, 20 bp, mouse
gagatcagctggatcccgga

SEQ ID NO: 477350 - DNA, 20 bp, mouse
gtctactccggggccacaga

SEQ ID NO: 477351 - DNA, 20 bp, mouse
ggccccggagtagacaacct

SEQ ID NO: 477352 - DNA, 20 bp, mouse
gcctcctggggtcctgtggg

SEQ ID NO: 477353 - DNA, 20 bp, mouse
gagggcgctgccaaggagac

SEQ ID NO: 477354 - DNA, 20 bp, mouse
ggccctgatcagcccctcct

SEQ ID NO: 477355 - DNA, 20 bp, mouse
ggaagacaagggcgctgcca

SEQ ID NO: 477356 - DNA, 20 bp, mouse
gtgcatgagttcagccctgg

SEQ ID NO: 477357 - DNA, 20 bp, mouse
gcagactggtcttggaagaa

SEQ ID NO: 477358 - DNA, 20 bp, mouse
gccaaacaggaaccattcaa

SEQ ID NO: 477359 - DNA, 20 bp, mouse
gagcgcaagacaaacactgt

SEQ ID NO: 477360 - DNA, 20 bp, mouse
ggggagatgcagactggtct

SEQ ID NO: 477361 - DNA, 20 bp, mouse
gagttgctgtggcacggtag

SEQ ID NO: 477362 - DNA, 20 bp, mouse
ggcaggaagttgctgtggca

SEQ ID NO: 477363 - DNA, 20 bp, mouse
gagatagggttgctatgggt

SEQ ID NO: 477364 - DNA, 20 bp, mouse
gtcgtactggtgagaagata

SEQ ID NO: 477365 - DNA, 20 bp, mouse
gccactaaggcacactgggt

SEQ ID NO: 477366 - DNA, 20 bp, mouse
gctgccggagagtccgacga

SEQ ID NO: 477367 - DNA, 20 bp, mouse
ggagagtccgacgacggagt

SEQ ID NO: 477368 - DNA, 20 bp, mouse
gggagtcggagcgcaggccc

SEQ ID NO: 477369 - DNA, 20 bp, mouse
gagcgcaggcccgggaagcg

SEQ ID NO: 477370 - DNA, 20 bp, mouse
gcgcgcaggcctcgcttccc

SEQ ID NO: 477371 - DNA, 20 bp, mouse
gagcgaggcctgcgcgggga

SEQ ID NO: 477372 - DNA, 20 bp, mouse
gcaggccgcaggtaatgcgt

SEQ ID NO: 477373 - DNA, 20 bp, mouse
ggggttgcgcgacacggtca

SEQ ID NO: 477374 - DNA, 20 bp, mouse
gtgcgctccgactccgtcgt

SEQ ID NO: 477375 - DNA, 20 bp, mouse
ggcggcgaaggcctgctcca

SEQ ID NO: 477376 - DNA, 20 bp, mouse
gccccgggcgcagcactccg

SEQ ID NO: 477377 - DNA, 20 bp, mouse
gcactccgcggcaaggcgag

SEQ ID NO: 477378 - DNA, 20 bp, mouse
gctactagagaggggaaccc

SEQ ID NO: 477379 - DNA, 20 bp, mouse
gactctgggctactagagag

SEQ ID NO: 477380 - DNA, 20 bp, mouse
gggcgcagcactccgcggca

SEQ ID NO: 477381 - DNA, 20 bp, mouse
gggacaacggcgaggtgcgt

SEQ ID NO: 477382 - DNA, 20 bp, mouse
ggacagaacacccgaactct

SEQ ID NO: 477383 - DNA, 20 bp, mouse
ggcacgcagcgaccagcctc

SEQ ID NO: 477384 - DNA, 20 bp, mouse
ggctgtgcgggtcggtcagt

SEQ ID NO: 477385 - DNA, 20 bp, mouse
gcgctgcgtgctgtgcgggt

SEQ ID NO: 477386 - DNA, 20 bp, mouse
gcgctagcggccagcgacag

SEQ ID NO: 477387 - DNA, 20 bp, mouse
gggctcccgcgaccctccgg

SEQ ID NO: 477388 - DNA, 20 bp, mouse
ggagcgcagccacttacccg

SEQ ID NO: 477389 - DNA, 20 bp, mouse
ggccggctcccgcgaccctc

SEQ ID NO: 477390 - DNA, 20 bp, mouse
gagcgcccgggtccgccgga

SEQ ID NO: 477391 - DNA, 20 bp, mouse
ggcgaccctccggcggaccc

SEQ ID NO: 477392 - DNA, 20 bp, mouse
gccacccgcggggaacgcag

SEQ ID NO: 477393 - DNA, 20 bp, mouse
ggcggtgcgggacggaatgt

SEQ ID NO: 477394 - DNA, 20 bp, mouse
gtcgctggccgctagcgccc

SEQ ID NO: 477395 - DNA, 20 bp, mouse
gcgctagcgcccgggtccgc

SEQ ID NO: 477396 - DNA, 20 bp, mouse
gctcagagagccggctggag

SEQ ID NO: 477397 - DNA, 20 bp, mouse
gggagaggcagcttcagtcc

SEQ ID NO: 477398 - DNA, 20 bp, mouse
ggcaccctgtgacagcgcaa

SEQ ID NO: 477399 - DNA, 20 bp, mouse
ggacgggaatgaagtccgct

SEQ ID NO: 477400 - DNA, 20 bp, mouse
gcagcgcaaaggctgcccag

SEQ ID NO: 477401 - DNA, 20 bp, mouse
gcagcctttgcgctgtcaca

SEQ ID NO: 477402 - DNA, 20 bp, mouse
gtgtacaaagctagtaggaa

SEQ ID NO: 477403 - DNA, 20 bp, mouse
ggaagaactggcaggctggg

SEQ ID NO: 477404 - DNA, 20 bp, mouse
gaacacactggcaggcacga

SEQ ID NO: 477405 - DNA, 20 bp, mouse
gctggtaggagatgatgata

SEQ ID NO: 477406 - DNA, 20 bp, mouse
gggctttccaagggacttgg

SEQ ID NO: 477407 - DNA, 20 bp, mouse
ggcttcaacctgtttacaag

SEQ ID NO: 477408 - DNA, 20 bp, mouse
gtttacaagcggctttccaa

SEQ ID NO: 477409 - DNA, 20 bp, mouse
gtctccacctccaagtccct

SEQ ID NO: 477410 - DNA, 20 bp, mouse
ggcactgacatttagactcc

SEQ ID NO: 477411 - DNA, 20 bp, mouse
gggagaagacaacagcgcct

SEQ ID NO: 477412 - DNA, 20 bp, mouse
gttggagttgtcagaactgg

SEQ ID NO: 477413 - DNA, 20 bp, mouse
ggtgcttttcagccagaggt

SEQ ID NO: 477414 - DNA, 20 bp, mouse
ggaaggtgccaaccgcagag

SEQ ID NO: 477415 - DNA, 20 bp, mouse
gccgcggcagtaggaactgg

SEQ ID NO: 477416 - DNA, 20 bp, mouse
gctagtcagggcccaagggt

SEQ ID NO: 477417 - DNA, 20 bp, mouse
gggagctagtcagggcccaa

SEQ ID NO: 477418 - DNA, 20 bp, mouse
ggggccctgactagctccag

SEQ ID NO: 477419 - DNA, 20 bp, mouse
gattaggggacagaattcat

SEQ ID NO: 477420 - DNA, 20 bp, mouse
gaccaccggctcccaccctt

SEQ ID NO: 477421 - DNA, 20 bp, mouse
ggtgggagccggtggtgttg

SEQ ID NO: 477422 - DNA, 20 bp, mouse
gggtgttggggaacgtactg

SEQ ID NO: 477423 - DNA, 20 bp, mouse
gtcctcccggggcgcgatgg

SEQ ID NO: 477424 - DNA, 20 bp, mouse
ggggaacgtactggggtctg

SEQ ID NO: 477425 - DNA, 20 bp, mouse
gctgatccgacagaagcggg

SEQ ID NO: 477426 - DNA, 20 bp, mouse
gacaaggttagtcagagtct

SEQ ID NO: 477427 - DNA, 20 bp, mouse
ggcagtgctaatatttgagg

SEQ ID NO: 477428 - DNA, 20 bp, mouse
ggaataggacaggcgcgggg

SEQ ID NO: 477429 - DNA, 20 bp, mouse
ggggcctggaggaataggac

SEQ ID NO: 477430 - DNA, 20 bp, mouse
gttagtcagagtctgggcag

SEQ ID NO: 477431 - DNA, 20 bp, mouse
ggaggcagtgctaatatttg

SEQ ID NO: 477432 - DNA, 20 bp, mouse
ggatagccagctccttgatc

SEQ ID NO: 477433 - DNA, 20 bp, mouse
gcggcggagcaggaacccga

SEQ ID NO: 477434 - DNA, 20 bp, mouse
gaaatcagtgggctccccag

SEQ ID NO: 477435 - DNA, 20 bp, mouse
gcggcagaagcggcaggcga

SEQ ID NO: 477436 - DNA, 20 bp, mouse
gtggcctggcatcgtcgctg

SEQ ID NO: 477437 - DNA, 20 bp, mouse
ggctgtcgcgctcttctgga

SEQ ID NO: 477438 - DNA, 20 bp, mouse
ggagggaggaggcagcgcac

SEQ ID NO: 477439 - DNA, 20 bp, mouse
gcgcggcaccgtcgcagcac

SEQ ID NO: 477440 - DNA, 20 bp, mouse
ggatcaaacaggtaatggcc

SEQ ID NO: 477441 - DNA, 20 bp, mouse
gactagtggaagcgccggag

SEQ ID NO: 477442 - DNA, 20 bp, mouse
gtccacgcgacacagggcgg

SEQ ID NO: 477443 - DNA, 20 bp, mouse
gggcaggcgagactagcagg

SEQ ID NO: 477444 - DNA, 20 bp, mouse
gggaagcgccggaggggcca

SEQ ID NO: 477445 - DNA, 20 bp, mouse
gtttcccgcagggatcaaac

SEQ ID NO: 477446 - DNA, 20 bp, mouse
gtgtggccgcacctgcctga

SEQ ID NO: 477447 - DNA, 20 bp, mouse
gccctgctcaagctgccctc

SEQ ID NO: 477448 - DNA, 20 bp, mouse
gtatcgctggagccctctca

SEQ ID NO: 477449 - DNA, 20 bp, mouse
ggtgggtccctggccgcgat

SEQ ID NO: 477450 - DNA, 20 bp, mouse
gagccaagagcggaccgctg

SEQ ID NO: 477451 - DNA, 20 bp, mouse
gggtggtggcgaccctgaga

SEQ ID NO: 477452 - DNA, 20 bp, mouse
gctaaggaaagcagagggag

SEQ ID NO: 477453 - DNA, 20 bp, mouse
gagagggctccagcgatacg

SEQ ID NO: 477454 - DNA, 20 bp, mouse
gtgggcgatgggtcctagta

SEQ ID NO: 477455 - DNA, 20 bp, mouse
gagggaggggcggtctggag

SEQ ID NO: 477456 - DNA, 20 bp, mouse
gtactgctccgacagtgggg

SEQ ID NO: 477457 - DNA, 20 bp, mouse
gcacaacccacaaagcaact

SEQ ID NO: 477458 - DNA, 20 bp, mouse
ggactcaagttgcaggcgca

SEQ ID NO: 477459 - DNA, 20 bp, mouse
gcctggtcctggccactctg

SEQ ID NO: 477460 - DNA, 20 bp, mouse
gagttactgctccgacagtg

SEQ ID NO: 477461 - DNA, 20 bp, mouse
gtctgtggctggctgtgtct

SEQ ID NO: 477462 - DNA, 20 bp, mouse
gactgggcgcttgtggcgtg

SEQ ID NO: 477463 - DNA, 20 bp, mouse
gtcaggaccccgaggtgtca

SEQ ID NO: 477464 - DNA, 20 bp, mouse
gcgcggagactgcgatgcgg

SEQ ID NO: 477465 - DNA, 20 bp, mouse
gccccgcgggtaggtgaccc

SEQ ID NO: 477466 - DNA, 20 bp, mouse
gccaggaagccagctatgag

SEQ ID NO: 477467 - DNA, 20 bp, mouse
gaggagagatggatgcggag

SEQ ID NO: 477468 - DNA, 20 bp, mouse
ggcgcctgggccagatcgag

SEQ ID NO: 477469 - DNA, 20 bp, mouse
gtctcagcggcggggagcgt

SEQ ID NO: 477470 - DNA, 20 bp, mouse
gcgtccaaagaacttctcag

SEQ ID NO: 477471 - DNA, 20 bp, mouse
gaagccagctatgagaggcc

SEQ ID NO: 477472 - DNA, 20 bp, mouse
gaacccggggagtcagctaa

SEQ ID NO: 477473 - DNA, 20 bp, mouse
gtcaggtgggcgaagtctgt

SEQ ID NO: 477474 - DNA, 20 bp, mouse
gccgcgcccgccgccaagac

SEQ ID NO: 477475 - DNA, 20 bp, mouse
ggggcgcgaactgcctgtct

SEQ ID NO: 477476 - DNA, 20 bp, mouse
gcccgccctcaggtttgatg

SEQ ID NO: 477477 - DNA, 20 bp, mouse
ggagagcgtcctctatcagg

SEQ ID NO: 477478 - DNA, 20 bp, mouse
gagctgcaggtaccgagctg

SEQ ID NO: 477479 - DNA, 20 bp, mouse
ggagctgctgaccctgagga

SEQ ID NO: 477480 - DNA, 20 bp, mouse
ggctcattcttaaggagatg

SEQ ID NO: 477481 - DNA, 20 bp, mouse
ggttgccgcatcaaacctga

SEQ ID NO: 477482 - DNA, 20 bp, mouse
ggtccccgggcgcaaaggat

SEQ ID NO: 477483 - DNA, 20 bp, mouse
gaaatcaagagagatcgtag

SEQ ID NO: 477484 - DNA, 20 bp, mouse
ggccgcatcaaacctgaggg

SEQ ID NO: 477485 - DNA, 20 bp, mouse
ggcttcgggcagaggtcccc

SEQ ID NO: 477486 - DNA, 20 bp, mouse
gggcgggcgcccagacggag

SEQ ID NO: 477487 - DNA, 20 bp, mouse
gcgtcacggccgctccgtct

SEQ ID NO: 477488 - DNA, 20 bp, mouse
ggagccggcgggcgcccaga

SEQ ID NO: 477489 - DNA, 20 bp, mouse
gaggaggagacatgagccgg

SEQ ID NO: 477490 - DNA, 20 bp, mouse
gctgcagtgcgaacgcgtca

SEQ ID NO: 477491 - DNA, 20 bp, mouse
gaggcagggtggccagaccc

SEQ ID NO: 477492 - DNA, 20 bp, mouse
gcccggccgccgccagcggt

SEQ ID NO: 477493 - DNA, 20 bp, mouse
gctgaagcgggcggacggga

SEQ ID NO: 477494 - DNA, 20 bp, mouse
gaggcggcgatgcgcacggc

SEQ ID NO: 477495 - DNA, 20 bp, mouse
gccaggggcagcatgcacgg

SEQ ID NO: 477496 - DNA, 20 bp, mouse
gcgggccgttgtacactcaa

SEQ ID NO: 477497 - DNA, 20 bp, mouse
gtaacagagggtctgaactg

SEQ ID NO: 477498 - DNA, 20 bp, mouse
gctaggcaccgtggacccag

SEQ ID NO: 477499 - DNA, 20 bp, mouse
ggcccggcgggacacggact

SEQ ID NO: 477500 - DNA, 20 bp, mouse
ggagccccttgagtgtacaa

SEQ ID NO: 477501 - DNA, 20 bp, mouse
ggaagggccatggctgccag

SEQ ID NO: 477502 - DNA, 20 bp, mouse
gggctctactgcaagaacgg

SEQ ID NO: 477503 - DNA, 20 bp, mouse
gtacactcaaggggctctct

SEQ ID NO: 477504 - DNA, 20 bp, mouse
gtagtgtcccaagtccccgg

SEQ ID NO: 477505 - DNA, 20 bp, mouse
gaagtggcctggtgggaagg

SEQ ID NO: 477506 - DNA, 20 bp, mouse
gcacaagctgtgtaaggata

SEQ ID NO: 477507 - DNA, 20 bp, mouse
ggagacagaggcctgcaatg

SEQ ID NO: 477508 - DNA, 20 bp, mouse
gacccagcccgagacagcgt

SEQ ID NO: 477509 - DNA, 20 bp, mouse
ggtagagcacaagctgtgta

SEQ ID NO: 477510 - DNA, 20 bp, mouse
gtaacagagggtctgaactg

SEQ ID NO: 477511 - DNA, 20 bp, mouse
gtcgggctgggtgcccagaa

SEQ ID NO: 477512 - DNA, 20 bp, mouse
ggcccggcgggacacggact

SEQ ID NO: 477513 - DNA, 20 bp, mouse
gctgtgtaaggatagggtgc

SEQ ID NO: 477514 - DNA, 20 bp, mouse
gggctctactgcaagaacgg

SEQ ID NO: 477515 - DNA, 20 bp, mouse
gtggagaaagctctgcctag

SEQ ID NO: 477516 - DNA, 20 bp, mouse
gtggcagcagccaccgggat

SEQ ID NO: 477517 - DNA, 20 bp, mouse
ggggctgctgcccatcccgg

SEQ ID NO: 477518 - DNA, 20 bp, mouse
gctagcggccccggaactcg

SEQ ID NO: 477519 - DNA, 20 bp, mouse
gcaggcacttaccgtctcct

SEQ ID NO: 477520 - DNA, 20 bp, mouse
gggacccgccccgcggcagg

SEQ ID NO: 477521 - DNA, 20 bp, mouse
ggcccccacggtgagaggaa

SEQ ID NO: 477522 - DNA, 20 bp, mouse
gggcgggtcctcgagttccg

SEQ ID NO: 477523 - DNA, 20 bp, mouse
gctgccgggaggaggacgag

SEQ ID NO: 477524 - DNA, 20 bp, mouse
ggccgacccctcggagctag

SEQ ID NO: 477525 - DNA, 20 bp, mouse
ggcagcagccccctgccgcg

SEQ ID NO: 477526 - DNA, 20 bp, mouse
gatgggtcaggttcagactg

SEQ ID NO: 477527 - DNA, 20 bp, mouse
gcccagctgagaagacacta

SEQ ID NO: 477528 - DNA, 20 bp, mouse
gggggctcaggcaaagtgaa

SEQ ID NO: 477529 - DNA, 20 bp, mouse
gagtcggacccacagtccca

SEQ ID NO: 477530 - DNA, 20 bp, mouse
ggagcgcagccctgatggaa

SEQ ID NO: 477531 - DNA, 20 bp, mouse
gtcctccctgatctccaggt

SEQ ID NO: 477532 - DNA, 20 bp, mouse
gtgccaggggctctcccgaa

SEQ ID NO: 477533 - DNA, 20 bp, mouse
gagaagacactaaggctgtc

SEQ ID NO: 477534 - DNA, 20 bp, mouse
gcctcatggaggttgagagg

SEQ ID NO: 477535 - DNA, 20 bp, mouse
gtggggacggggcctcatgg

SEQ ID NO: 477536 - DNA, 20 bp, mouse
gccaggctaggcccagccag

SEQ ID NO: 477537 - DNA, 20 bp, mouse
ggagggtacccgcatctgga

SEQ ID NO: 477538 - DNA, 20 bp, mouse
ggccaggacagtgagtgctg

SEQ ID NO: 477539 - DNA, 20 bp, mouse
gcgggatgcgcagccgcctc

SEQ ID NO: 477540 - DNA, 20 bp, mouse
ggatgggcactgcatcccgt

SEQ ID NO: 477541 - DNA, 20 bp, mouse
ggcgctgtccggcacaggtc

SEQ ID NO: 477542 - DNA, 20 bp, mouse
gtgcgcagccgcctctggct

SEQ ID NO: 477543 - DNA, 20 bp, mouse
ggcacgtcgccctccagatg

SEQ ID NO: 477544 - DNA, 20 bp, mouse
gggtcagtggcctacttaca

SEQ ID NO: 477545 - DNA, 20 bp, mouse
gtggaacaccgcgcgctgtc

SEQ ID NO: 477546 - DNA, 20 bp, mouse
gtgacactcccagacaggct

SEQ ID NO: 477547 - DNA, 20 bp, mouse
gcacgcccaccaggagtcta

SEQ ID NO: 477548 - DNA, 20 bp, mouse
gcccagttggagccaagcaa

SEQ ID NO: 477549 - DNA, 20 bp, mouse
ggctgtagccgtgtacaggt

SEQ ID NO: 477550 - DNA, 20 bp, mouse
gaaatctgacactcccagac

SEQ ID NO: 477551 - DNA, 20 bp, mouse
gaatggggaagtgtccggat

SEQ ID NO: 477552 - DNA, 20 bp, mouse
gagcctgacccacctgtaca

SEQ ID NO: 477553 - DNA, 20 bp, mouse
gagccgtgtacaggtgggtc

SEQ ID NO: 477554 - DNA, 20 bp, mouse
gcctgccttagactcctggt

SEQ ID NO: 477555 - DNA, 20 bp, mouse
gaaaggagggaatctagccc

SEQ ID NO: 477556 - DNA, 20 bp, mouse
ggccagcgcgggtctcacga

SEQ ID NO: 477557 - DNA, 20 bp, mouse
gcgccaggccggctcgactg

SEQ ID NO: 477558 - DNA, 20 bp, mouse
gcgcgggtctcacgaaggcg

SEQ ID NO: 477559 - DNA, 20 bp, mouse
ggccgccacgtcctagatag

SEQ ID NO: 477560 - DNA, 20 bp, mouse
gagccacagtcgagccggcc

SEQ ID NO: 477561 - DNA, 20 bp, mouse
gtgcagctggaggtggtact

SEQ ID NO: 477562 - DNA, 20 bp, mouse
gagccagatcaggcccatcc

SEQ ID NO: 477563 - DNA, 20 bp, mouse
ggcctctatctaggacgtgg

SEQ ID NO: 477564 - DNA, 20 bp, mouse
gacccaagcggccgcgtgaa

SEQ ID NO: 477565 - DNA, 20 bp, mouse
ggtgctcgtaaacgccacca

SEQ ID NO: 477566 - DNA, 20 bp, mouse
gtaagtagcgagagcaaata

SEQ ID NO: 477567 - DNA, 20 bp, mouse
gagagcaaatagggacgcaa

SEQ ID NO: 477568 - DNA, 20 bp, mouse
ggagggaccgccgcacccaa

SEQ ID NO: 477569 - DNA, 20 bp, mouse
ggagctgcgggccgtgagtt

SEQ ID NO: 477570 - DNA, 20 bp, mouse
ggcaaatagggacgcaacgg

SEQ ID NO: 477571 - DNA, 20 bp, mouse
gaatagggacgcaacggtgg

SEQ ID NO: 477572 - DNA, 20 bp, mouse
gcacgcggcacgcagaattg

SEQ ID NO: 477573 - DNA, 20 bp, mouse
ggcagcactcaccgaactca

SEQ ID NO: 477574 - DNA, 20 bp, mouse
gcgcaggcggcggtccgcag

SEQ ID NO: 477575 - DNA, 20 bp, mouse
gcgggcagtagtagtctcgg

SEQ ID NO: 477576 - DNA, 20 bp, mouse
gtagcctcggggaagggaga

SEQ ID NO: 477577 - DNA, 20 bp, mouse
gaggctatgtccaccctgtg

SEQ ID NO: 477578 - DNA, 20 bp, mouse
ggcgagggaggcagcgccag

SEQ ID NO: 477579 - DNA, 20 bp, mouse
ggaagcgtctcactcccgaa

SEQ ID NO: 477580 - DNA, 20 bp, mouse
gcctccctcgccgcacaggg

SEQ ID NO: 477581 - DNA, 20 bp, mouse
gcagggtggacatagcctcg

SEQ ID NO: 477582 - DNA, 20 bp, mouse
ggtggacatagcctcgggga

SEQ ID NO: 477583 - DNA, 20 bp, mouse
ggagagagaggccacccgag

SEQ ID NO: 477584 - DNA, 20 bp, mouse
ggaagctgcgactggtgagg

SEQ ID NO: 477585 - DNA, 20 bp, mouse
gagtctcccgggttcctagg

SEQ ID NO: 477586 - DNA, 20 bp, mouse
gctgtggccggtatagacca

SEQ ID NO: 477587 - DNA, 20 bp, mouse
gcccacgccatggtctatac

SEQ ID NO: 477588 - DNA, 20 bp, mouse
ggccggtatagaccatggcg

SEQ ID NO: 477589 - DNA, 20 bp, mouse
gacgtgcctgagaggcaagg

SEQ ID NO: 477590 - DNA, 20 bp, mouse
ggcacgctactggactccag

SEQ ID NO: 477591 - DNA, 20 bp, mouse
ggggacagagccctgcatgc

SEQ ID NO: 477592 - DNA, 20 bp, mouse
gaatcaaagagaatcacctt

SEQ ID NO: 477593 - DNA, 20 bp, mouse
ggttctctagccggcatgca

SEQ ID NO: 477594 - DNA, 20 bp, mouse
gaccacgtgcctgagaggca

SEQ ID NO: 477595 - DNA, 20 bp, mouse
ggctcgagacctggacaaga

SEQ ID NO: 477596 - DNA, 20 bp, mouse
gaagcgcacgcgctcacaca

SEQ ID NO: 477597 - DNA, 20 bp, mouse
gtgtagtacggacggatgga

SEQ ID NO: 477598 - DNA, 20 bp, mouse
ggtttgtagctacagtagag

SEQ ID NO: 477599 - DNA, 20 bp, mouse
gattgtttccataaatcaac

SEQ ID NO: 477600 - DNA, 20 bp, mouse
gcatagactaatgaattcca

SEQ ID NO: 477601 - DNA, 20 bp, mouse
ggagaggctcaagttgcacg

SEQ ID NO: 477602 - DNA, 20 bp, mouse
ggtgctgtagtacggacgga

SEQ ID NO: 477603 - DNA, 20 bp, mouse
ggtgcgcttgtgtgagtgcg

SEQ ID NO: 477604 - DNA, 20 bp, mouse
gacaattatgattctgctgg

SEQ ID NO: 477605 - DNA, 20 bp, mouse
gggatggaaggagactcttg

SEQ ID NO: 477606 - DNA, 20 bp, mouse
gcggccaccggctccagcag

SEQ ID NO: 477607 - DNA, 20 bp, mouse
gctccagcagcggctcagag

SEQ ID NO: 477608 - DNA, 20 bp, mouse
ggccagcggctatcccgacg

SEQ ID NO: 477609 - DNA, 20 bp, mouse
gcgggctcctgagcagccag

SEQ ID NO: 477610 - DNA, 20 bp, mouse
gggacaagccgaaggtgcgg

SEQ ID NO: 477611 - DNA, 20 bp, mouse
ggacattccacgagccgcgt

SEQ ID NO: 477612 - DNA, 20 bp, mouse
gcggaggctgagggaggtcg

SEQ ID NO: 477613 - DNA, 20 bp, mouse
ggctatcccgacgcggctcg

SEQ ID NO: 477614 - DNA, 20 bp, mouse
gtaccccgaggagggatcta

SEQ ID NO: 477615 - DNA, 20 bp, mouse
gctggccgacggggacgcgg

SEQ ID NO: 477616 - DNA, 20 bp, mouse
ggcgcggcgacacctgttcg

SEQ ID NO: 477617 - DNA, 20 bp, mouse
gaggctctgcggaggtccag

SEQ ID NO: 477618 - DNA, 20 bp, mouse
ggcgcaggaggagcgctccg

SEQ ID NO: 477619 - DNA, 20 bp, mouse
ggaggagcgctccgcggcca

SEQ ID NO: 477620 - DNA, 20 bp, mouse
gcccccgccggcgcgcagag

SEQ ID NO: 477621 - DNA, 20 bp, mouse
gcgcagagtggcgcaggcgg

SEQ ID NO: 477622 - DNA, 20 bp, mouse
gtgaggcgagcggcaagcgg

SEQ ID NO: 477623 - DNA, 20 bp, mouse
gacggatcctgactccagaa

SEQ ID NO: 477624 - DNA, 20 bp, mouse
gggtccagcggcttgcagtg

SEQ ID NO: 477625 - DNA, 20 bp, mouse
gcggcttgcagtgaggcgag

SEQ ID NO: 477626 - DNA, 20 bp, mouse
gtgcagatccaggtgtactg

SEQ ID NO: 477627 - DNA, 20 bp, mouse
gtgcaccccagcgtgaggac

SEQ ID NO: 477628 - DNA, 20 bp, mouse
gcaggtgtactggggaatgc

SEQ ID NO: 477629 - DNA, 20 bp, mouse
gcaacctgcaccccagcgtg

SEQ ID NO: 477630 - DNA, 20 bp, mouse
gactcacagaaaggtgagcc

SEQ ID NO: 477631 - DNA, 20 bp, mouse
gctggaggctgaaagagcca

SEQ ID NO: 477632 - DNA, 20 bp, mouse
gtggacccaaggaggtccag

SEQ ID NO: 477633 - DNA, 20 bp, mouse
gggcttccagtcctcacgct

SEQ ID NO: 477634 - DNA, 20 bp, mouse
gactaaagcgtggctgagac

SEQ ID NO: 477635 - DNA, 20 bp, mouse
gtgggtccagaccacattat

SEQ ID NO: 477636 - DNA, 20 bp, mouse
gagaggtggaagggccctat

SEQ ID NO: 477637 - DNA, 20 bp, mouse
ggcttaccgaattctagaag

SEQ ID NO: 477638 - DNA, 20 bp, mouse
gcattcgctctactccaata

SEQ ID NO: 477639 - DNA, 20 bp, mouse
gggtcccaggaatcccagag

SEQ ID NO: 477640 - DNA, 20 bp, mouse
gcctcagcgcaggcaacagg

SEQ ID NO: 477641 - DNA, 20 bp, mouse
ggatctgcgaatgaaggcta

SEQ ID NO: 477642 - DNA, 20 bp, mouse
gccctgctaactgagaacac

SEQ ID NO: 477643 - DNA, 20 bp, mouse
gaaagtccggtcaggagagt

SEQ ID NO: 477644 - DNA, 20 bp, mouse
gcggctgccgggagggacaa

SEQ ID NO: 477645 - DNA, 20 bp, mouse
gaaagagctgtctgtcctaa

SEQ ID NO: 477646 - DNA, 20 bp, mouse
gagcgctcctgcgggtactt

SEQ ID NO: 477647 - DNA, 20 bp, mouse
gccgggtcctctgcacgcag

SEQ ID NO: 477648 - DNA, 20 bp, mouse
gtcctgcgggtactttggcg

SEQ ID NO: 477649 - DNA, 20 bp, mouse
ggccccgccaaagtacccgc

SEQ ID NO: 477650 - DNA, 20 bp, mouse
ggccgcagctggaaaagcag

SEQ ID NO: 477651 - DNA, 20 bp, mouse
gcacgccggagccccaggag

SEQ ID NO: 477652 - DNA, 20 bp, mouse
gcggggctctccgctgcggg

SEQ ID NO: 477653 - DNA, 20 bp, mouse
gccagcccgggcgggaacaa

SEQ ID NO: 477654 - DNA, 20 bp, mouse
ggcgctcggagcgctcctgc

SEQ ID NO: 477655 - DNA, 20 bp, mouse
gggaacgggagccggaaccc

SEQ ID NO: 477656 - DNA, 20 bp, mouse
ggccccgccgcaccttgatg

SEQ ID NO: 477657 - DNA, 20 bp, mouse
ggctgaaccgcatcaaggtg

SEQ ID NO: 477658 - DNA, 20 bp, mouse
gtcggggctgcgcgggacgc

SEQ ID NO: 477659 - DNA, 20 bp, mouse
gaccgcatcaaggtgcggcg

SEQ ID NO: 477660 - DNA, 20 bp, mouse
gaaccggggatgcttctgaa

SEQ ID NO: 477661 - DNA, 20 bp, mouse
gttactgaactatttcagga

SEQ ID NO: 477662 - DNA, 20 bp, mouse
gatagttcagtaactaaccg

SEQ ID NO: 477663 - DNA, 20 bp, mouse
gttagttactgaactatttc

SEQ ID NO: 477664 - DNA, 20 bp, mouse
ggcgggcagcgagcgatgga

SEQ ID NO: 477665 - DNA, 20 bp, mouse
gccggggctcggggctgcgc

SEQ ID NO: 477666 - DNA, 20 bp, mouse
gctcgtctcggccccatccc

SEQ ID NO: 477667 - DNA, 20 bp, mouse
gacacagcggcgggacgtac

SEQ ID NO: 477668 - DNA, 20 bp, mouse
gcgcgaggcttgtcgctcag

SEQ ID NO: 477669 - DNA, 20 bp, mouse
gcagcggctgcgggtcgcgg

SEQ ID NO: 477670 - DNA, 20 bp, mouse
ggtggaataactacacgcgt

SEQ ID NO: 477671 - DNA, 20 bp, mouse
gagtcctgctcacacagcgg

SEQ ID NO: 477672 - DNA, 20 bp, mouse
gggttctggtccgcccggga

SEQ ID NO: 477673 - DNA, 20 bp, mouse
ggccttcgggaaccagcaga

SEQ ID NO: 477674 - DNA, 20 bp, mouse
gcctgccgggaactgaggta

SEQ ID NO: 477675 - DNA, 20 bp, mouse
gacgggaaacccactcgtct

SEQ ID NO: 477676 - DNA, 20 bp, mouse
ggaggggagagagccgggag

SEQ ID NO: 477677 - DNA, 20 bp, mouse
gcgcgcggccgccagagctc

SEQ ID NO: 477678 - DNA, 20 bp, mouse
gggcggcggcaggcgcggaa

SEQ ID NO: 477679 - DNA, 20 bp, mouse
ggcggcgaggggagagagcc

SEQ ID NO: 477680 - DNA, 20 bp, mouse
gcggctggcgaagctcccag

SEQ ID NO: 477681 - DNA, 20 bp, mouse
gcaggcgcggaacgggcgca

SEQ ID NO: 477682 - DNA, 20 bp, mouse
ggagcaggcgatgatctcgg

SEQ ID NO: 477683 - DNA, 20 bp, mouse
gaacagctaggacatgacac

SEQ ID NO: 477684 - DNA, 20 bp, mouse
ggcacggacgatcgaacgcg

SEQ ID NO: 477685 - DNA, 20 bp, mouse
gcgccagcaaagtttggagt

SEQ ID NO: 477686 - DNA, 20 bp, mouse
gcagtgcactgtggcagcgg

SEQ ID NO: 477687 - DNA, 20 bp, mouse
ggccccagttcagtgcactg

SEQ ID NO: 477688 - DNA, 20 bp, mouse
gcccgccggagtggatcgca

SEQ ID NO: 477689 - DNA, 20 bp, mouse
gcgggctcagaagcagtcag

SEQ ID NO: 477690 - DNA, 20 bp, mouse
ggccacagtgcactgaactg

SEQ ID NO: 477691 - DNA, 20 bp, mouse
gggcgccgtgcgatccactc

SEQ ID NO: 477692 - DNA, 20 bp, mouse
gctccggcggggggactcag

SEQ ID NO: 477693 - DNA, 20 bp, mouse
ggccgtgcgatccactccgg

SEQ ID NO: 477694 - DNA, 20 bp, mouse
ggctctgcggcaaccaggga

SEQ ID NO: 477695 - DNA, 20 bp, mouse
gcaccactgagtccccccgc

SEQ ID NO: 477696 - DNA, 20 bp, mouse
gcgcgcgcgggtcacgatcc

SEQ ID NO: 477697 - DNA, 20 bp, mouse
ggcagttgcagggacattcc

SEQ ID NO: 477698 - DNA, 20 bp, mouse
ggcgggtcacgatcccggca

SEQ ID NO: 477699 - DNA, 20 bp, mouse
gcaaggtccccgggacagag

SEQ ID NO: 477700 - DNA, 20 bp, mouse
ggctggcacactcacccgcc

SEQ ID NO: 477701 - DNA, 20 bp, mouse
gacggccgctgtccccacgg

SEQ ID NO: 477702 - DNA, 20 bp, mouse
gcccacggcggccgggagta

SEQ ID NO: 477703 - DNA, 20 bp, mouse
gtccaagagcgacggggtgg

SEQ ID NO: 477704 - DNA, 20 bp, mouse
gggagggaggtgcacgtcag

SEQ ID NO: 477705 - DNA, 20 bp, mouse
gccgccacgctgcagttgca

SEQ ID NO: 477706 - DNA, 20 bp, mouse
gcgcagggaaggacgcctcg

SEQ ID NO: 477707 - DNA, 20 bp, mouse
ggagttgacaaagccccgca

SEQ ID NO: 477708 - DNA, 20 bp, mouse
gaaacggcgaggcttggcga

SEQ ID NO: 477709 - DNA, 20 bp, mouse
gcgctgtccgcgcggataaa

SEQ ID NO: 477710 - DNA, 20 bp, mouse
gagcccggctcacctcgaca

SEQ ID NO: 477711 - DNA, 20 bp, mouse
gggccccacaggagcagcta

SEQ ID NO: 477712 - DNA, 20 bp, mouse
gtccgcgcggataaacggcg

SEQ ID NO: 477713 - DNA, 20 bp, mouse
ggggcgcgcagcaggcaacg

SEQ ID NO: 477714 - DNA, 20 bp, mouse
gggaaggacgcctcgcggcg

SEQ ID NO: 477715 - DNA, 20 bp, mouse
gtcgacagggatcagcgcgg

SEQ ID NO: 477716 - DNA, 20 bp, mouse
gggctgcaaagaccaactca

SEQ ID NO: 477717 - DNA, 20 bp, mouse
ggccagcactgtgacctctt

SEQ ID NO: 477718 - DNA, 20 bp, mouse
gtcacccagacaccatgagt

SEQ ID NO: 477719 - DNA, 20 bp, mouse
ggcccaagaggtcacagtgc

SEQ ID NO: 477720 - DNA, 20 bp, mouse
ggtaaagagctgggagcacc

SEQ ID NO: 477721 - DNA, 20 bp, mouse
gagtgctggctgtaaagagc

SEQ ID NO: 477722 - DNA, 20 bp, mouse
gtggagagaacagtaaaagc

SEQ ID NO: 477723 - DNA, 20 bp, mouse
gtaaaagcaggcagcaaaga

SEQ ID NO: 477724 - DNA, 20 bp, mouse
gcacttactgccaggcccgt

SEQ ID NO: 477725 - DNA, 20 bp, mouse
gctatcctgaaactagagaa

SEQ ID NO: 477726 - DNA, 20 bp, mouse
gcctgcaagaacccctggga

SEQ ID NO: 477727 - DNA, 20 bp, mouse
gtaggccccagacatctgta

SEQ ID NO: 477728 - DNA, 20 bp, mouse
ggcggtgcggctgtgcatgg

SEQ ID NO: 477729 - DNA, 20 bp, mouse
gcgcaccgcacccagcaggg

SEQ ID NO: 477730 - DNA, 20 bp, mouse
gagccgcaccgcacccagca

SEQ ID NO: 477731 - DNA, 20 bp, mouse
gcgtgcctgcaagaacccct

SEQ ID NO: 477732 - DNA, 20 bp, mouse
gaagtaagtgaccctcccag

SEQ ID NO: 477733 - DNA, 20 bp, mouse
ggcctggctgtgagacccaa

SEQ ID NO: 477734 - DNA, 20 bp, mouse
gtggaccgccctgctgggtg

SEQ ID NO: 477735 - DNA, 20 bp, mouse
gaaactgaaaggccaaccag

SEQ ID NO: 477736 - DNA, 20 bp, mouse
gcctgggacttactttctgt

SEQ ID NO: 477737 - DNA, 20 bp, mouse
gcctccaggttcagtttcgt

SEQ ID NO: 477738 - DNA, 20 bp, mouse
gctttaagaagcagaatcta

SEQ ID NO: 477739 - DNA, 20 bp, mouse
gtcaccaacgaaactgaacc

SEQ ID NO: 477740 - DNA, 20 bp, mouse
gcttaaagaaccactcctcc

SEQ ID NO: 477741 - DNA, 20 bp, mouse
gtaagctcatggcctctcga

SEQ ID NO: 477742 - DNA, 20 bp, mouse
ggagacatacctaatatctc

SEQ ID NO: 477743 - DNA, 20 bp, mouse
gagaaagtaagtcccaggcc

SEQ ID NO: 477744 - DNA, 20 bp, mouse
gtaagcccctccattttcca

SEQ ID NO: 477745 - DNA, 20 bp, mouse
ggagttttctcccctggcct

SEQ ID NO: 477746 - DNA, 20 bp, mouse
gacttcagttagaagttcct

SEQ ID NO: 477747 - DNA, 20 bp, mouse
gaatgaatcaggacttagct

SEQ ID NO: 477748 - DNA, 20 bp, mouse
gagagttgcttgcaacttgg

SEQ ID NO: 477749 - DNA, 20 bp, mouse
ggactggccaaggtgaaata

SEQ ID NO: 477750 - DNA, 20 bp, mouse
gtgcagggaaatagacatag

SEQ ID NO: 477751 - DNA, 20 bp, mouse
gagcagagttgcttgcaact

SEQ ID NO: 477752 - DNA, 20 bp, mouse
gtatggcaagacatatctca

SEQ ID NO: 477753 - DNA, 20 bp, mouse
gtattatctgtactgctgac

SEQ ID NO: 477754 - DNA, 20 bp, mouse
gggactcagaaagtagcctt

SEQ ID NO: 477755 - DNA, 20 bp, mouse
gactctttcatgacagcgaa

SEQ ID NO: 477756 - DNA, 20 bp, mouse
ggctcggcaggcagcgagga

SEQ ID NO: 477757 - DNA, 20 bp, mouse
gctgccgcactgcaaggatg

SEQ ID NO: 477758 - DNA, 20 bp, mouse
gggagcacaacctgactgag

SEQ ID NO: 477759 - DNA, 20 bp, mouse
gggagctggatggtcagcgt

SEQ ID NO: 477760 - DNA, 20 bp, mouse
gaactcagccacaaccaacc

SEQ ID NO: 477761 - DNA, 20 bp, mouse
ggctgggctgccgcactgca

SEQ ID NO: 477762 - DNA, 20 bp, mouse
gctcgctgcctgccgagcgg

SEQ ID NO: 477763 - DNA, 20 bp, mouse
ggttgtgctcctccaccgct

SEQ ID NO: 477764 - DNA, 20 bp, mouse
gtaaagcgcctggtcaggct

SEQ ID NO: 477765 - DNA, 20 bp, mouse
gggaggtgctcaaagaagtg

SEQ ID NO: 477766 - DNA, 20 bp, mouse
gtccccagagtaggtagtag

SEQ ID NO: 477767 - DNA, 20 bp, mouse
gccaggagaggcgatgtggg

SEQ ID NO: 477768 - DNA, 20 bp, mouse
gctgcgggtgactcgatctg

SEQ ID NO: 477769 - DNA, 20 bp, mouse
gcaaccaggagaggcgatgt

SEQ ID NO: 477770 - DNA, 20 bp, mouse
gaacttccagcaaccaggag

SEQ ID NO: 477771 - DNA, 20 bp, mouse
ggcccctactacctactctg

SEQ ID NO: 477772 - DNA, 20 bp, mouse
gcgatgtggggggtaaagtg

SEQ ID NO: 477773 - DNA, 20 bp, mouse
ggccgcctacctggtctcaa

SEQ ID NO: 477774 - DNA, 20 bp, mouse
gggctcccttgagaccaggt

SEQ ID NO: 477775 - DNA, 20 bp, mouse
gccttggagggaagatttgg

SEQ ID NO: 477776 - DNA, 20 bp, mouse
gacgcgagcgcgcgaggaga

SEQ ID NO: 477777 - DNA, 20 bp, mouse
gacatggtgctgctgtacgg

SEQ ID NO: 477778 - DNA, 20 bp, mouse
gccagacactgcagcaccgg

SEQ ID NO: 477779 - DNA, 20 bp, mouse
gaccggcggacggaacccgc

SEQ ID NO: 477780 - DNA, 20 bp, mouse
gctggggagcctgagtgtca

SEQ ID NO: 477781 - DNA, 20 bp, mouse
gcgcgaggagacggagtgcg

SEQ ID NO: 477782 - DNA, 20 bp, mouse
gagacggagtgcgcggtaca

SEQ ID NO: 477783 - DNA, 20 bp, mouse
gcgctcgcgtcgcctcctgc

SEQ ID NO: 477784 - DNA, 20 bp, mouse
gggtacatggtgctgctgta

SEQ ID NO: 477785 - DNA, 20 bp, mouse
gtcgggacccggcctccccg

SEQ ID NO: 477786 - DNA, 20 bp, mouse
ggcgggccaagctggagact

SEQ ID NO: 477787 - DNA, 20 bp, mouse
gggagctgcttgccagaccc

SEQ ID NO: 477788 - DNA, 20 bp, mouse
gctggagactcggcagagcg

SEQ ID NO: 477789 - DNA, 20 bp, mouse
gtagtccgcagggctctcgg

SEQ ID NO: 477790 - DNA, 20 bp, mouse
gcggcgggccgcctcttcct

SEQ ID NO: 477791 - DNA, 20 bp, mouse
gcgacgcacgtacacaggcc

SEQ ID NO: 477792 - DNA, 20 bp, mouse
ggagactcggcagagcgcgg

SEQ ID NO: 477793 - DNA, 20 bp, mouse
gaagcagtggcgaagatagg

SEQ ID NO: 477794 - DNA, 20 bp, mouse
gcatggcgacgcacgtacac

SEQ ID NO: 477795 - DNA, 20 bp, mouse
ggcctgtattggagaactcc

SEQ ID NO: 477796 - DNA, 20 bp, mouse
gctgcgcagcccaggatccc

SEQ ID NO: 477797 - DNA, 20 bp, mouse
gtctgctgtcccgggatcct

SEQ ID NO: 477798 - DNA, 20 bp, mouse
gcggcctagagtacccacga

SEQ ID NO: 477799 - DNA, 20 bp, mouse
gtaagcgcctcgggagccgg

SEQ ID NO: 477800 - DNA, 20 bp, mouse
gtgaaactcgcccggaacag

SEQ ID NO: 477801 - DNA, 20 bp, mouse
gtgcgggacgctggtagcct

SEQ ID NO: 477802 - DNA, 20 bp, mouse
gatcctgggctgcgcagctg

SEQ ID NO: 477803 - DNA, 20 bp, mouse
gactcgcccggaacagggga

SEQ ID NO: 477804 - DNA, 20 bp, mouse
gcagcagacgagcttcgaat

SEQ ID NO: 477805 - DNA, 20 bp, mouse
gttggctccgccggctcccg

SEQ ID NO: 477806 - DNA, 20 bp, mouse
gctgcagtcctgcggagaga

SEQ ID NO: 477807 - DNA, 20 bp, mouse
ggacggcggcgccgggacag

SEQ ID NO: 477808 - DNA, 20 bp, mouse
gcaggactgcaggccgggga

SEQ ID NO: 477809 - DNA, 20 bp, mouse
gtgcgggacgacgggagcta

SEQ ID NO: 477810 - DNA, 20 bp, mouse
ggcggtgagtgcgggacgac

SEQ ID NO: 477811 - DNA, 20 bp, mouse
gcaggccggggacggtgagg

SEQ ID NO: 477812 - DNA, 20 bp, mouse
gtccgcaggactgcaggccg

SEQ ID NO: 477813 - DNA, 20 bp, mouse
gacctccgaggtcccacccg

SEQ ID NO: 477814 - DNA, 20 bp, mouse
gggcgccgccgtctctccgc

SEQ ID NO: 477815 - DNA, 20 bp, mouse
ggtccgatgccgagccagtc

SEQ ID NO: 477816 - DNA, 20 bp, mouse
gggaagcagatacgactggt

SEQ ID NO: 477817 - DNA, 20 bp, mouse
gaggaggaagcagatacgac

SEQ ID NO: 477818 - DNA, 20 bp, mouse
gccccagcacgagcagagaa

SEQ ID NO: 477819 - DNA, 20 bp, mouse
gatcagtgttgagccagtgg

SEQ ID NO: 477820 - DNA, 20 bp, mouse
gtttgtactttaggaattag

SEQ ID NO: 477821 - DNA, 20 bp, mouse
gggatggacagcagtgttgg

SEQ ID NO: 477822 - DNA, 20 bp, mouse
gctgtggccatgccaccccg

SEQ ID NO: 477823 - DNA, 20 bp, mouse
ggaagtcccaagaacatctg

SEQ ID NO: 477824 - DNA, 20 bp, mouse
gcagaggaagccaaaccccg

SEQ ID NO: 477825 - DNA, 20 bp, mouse
gtagtatgtatgcatcgttg

SEQ ID NO: 477826 - DNA, 20 bp, mouse
gcagtggggacacgctcagg

SEQ ID NO: 477827 - DNA, 20 bp, mouse
ggctcccaggtccaccccag

SEQ ID NO: 477828 - DNA, 20 bp, mouse
gggtggacctgggagctgac

SEQ ID NO: 477829 - DNA, 20 bp, mouse
ggacatgtgctcgagagctg

SEQ ID NO: 477830 - DNA, 20 bp, mouse
gctgtcagatggccactatc

SEQ ID NO: 477831 - DNA, 20 bp, mouse
gctgatgagacgtctcggga

SEQ ID NO: 477832 - DNA, 20 bp, mouse
gctgacacttgtctatggaa

SEQ ID NO: 477833 - DNA, 20 bp, mouse
gagtgtcaggaagcccaaac

SEQ ID NO: 477834 - DNA, 20 bp, mouse
gctagggcagctgcagaaca

SEQ ID NO: 477835 - DNA, 20 bp, mouse
gtagcctcaaccctcccctg

SEQ ID NO: 477836 - DNA, 20 bp, mouse
gcagaggccaagttcaggag

SEQ ID NO: 477837 - DNA, 20 bp, mouse
ggccaaagcgttatcatctg

SEQ ID NO: 477838 - DNA, 20 bp, mouse
gggttgagggaagacaggtc

SEQ ID NO: 477839 - DNA, 20 bp, mouse
gtggctcagaggccaagttc

SEQ ID NO: 477840 - DNA, 20 bp, mouse
gaccccagatgataacgctt

SEQ ID NO: 477841 - DNA, 20 bp, mouse
gttgtgaacatacatttaag

SEQ ID NO: 477842 - DNA, 20 bp, mouse
gtgggtgccgctcctgaact

SEQ ID NO: 477843 - DNA, 20 bp, mouse
gcgttatcatctggggttga

SEQ ID NO: 477844 - DNA, 20 bp, mouse
ggagtgtctttgagaagcca

SEQ ID NO: 477845 - DNA, 20 bp, mouse
gagaccaatgacagattcat

SEQ ID NO: 477846 - DNA, 20 bp, mouse
gtctgtggtagcgtcatcag

SEQ ID NO: 477847 - DNA, 20 bp, mouse
gaggctctcgacgcgtccta

SEQ ID NO: 477848 - DNA, 20 bp, mouse
gcgaccggctggctgccgag

SEQ ID NO: 477849 - DNA, 20 bp, mouse
gcgcggtagcgagcgcccct

SEQ ID NO: 477850 - DNA, 20 bp, mouse
gcaggggaacagacgacgac

SEQ ID NO: 477851 - DNA, 20 bp, mouse
gcggtggggccggggtctaa

SEQ ID NO: 477852 - DNA, 20 bp, mouse
gaaggacacacgcgcccggg

SEQ ID NO: 477853 - DNA, 20 bp, mouse
ggtgcagacagcatcagggt

SEQ ID NO: 477854 - DNA, 20 bp, mouse
gatcagggtagggacctaaa

SEQ ID NO: 477855 - DNA, 20 bp, mouse
gcaccgcgcgagtactactg

SEQ ID NO: 477856 - DNA, 20 bp, mouse
gacctgtgggccaggcggag

SEQ ID NO: 477857 - DNA, 20 bp, mouse
gcggctgcgactgactgtgt

SEQ ID NO: 477858 - DNA, 20 bp, mouse
gggccgagagagcagcggcg

SEQ ID NO: 477859 - DNA, 20 bp, mouse
gcccggcggctcctacctgt

SEQ ID NO: 477860 - DNA, 20 bp, mouse
ggcgggagccgatcgcccgg

SEQ ID NO: 477861 - DNA, 20 bp, mouse
gagagcagcggcgaggtagc

SEQ ID NO: 477862 - DNA, 20 bp, mouse
gccccctccgcctggcccac

SEQ ID NO: 477863 - DNA, 20 bp, mouse
gaccgggaccactccaacga

SEQ ID NO: 477864 - DNA, 20 bp, mouse
gggcccgagcacttcctcgg

SEQ ID NO: 477865 - DNA, 20 bp, mouse
gctctcggcccccctccgcc

SEQ ID NO: 477866 - DNA, 20 bp, mouse
gagcatgccgccctcctcag

SEQ ID NO: 477867 - DNA, 20 bp, mouse
gagcccctgggcgaaggaga

SEQ ID NO: 477868 - DNA, 20 bp, mouse
gggttgaagcccctgggcga

SEQ ID NO: 477869 - DNA, 20 bp, mouse
gccgggctcgagggaactaa

SEQ ID NO: 477870 - DNA, 20 bp, mouse
gcctgcccgtcactccctta

SEQ ID NO: 477871 - DNA, 20 bp, mouse
ggctaaaggttgaagcccct

SEQ ID NO: 477872 - DNA, 20 bp, mouse
gaggagggcggcatgctcgc

SEQ ID NO: 477873 - DNA, 20 bp, mouse
gagaacttctcccctgagga

SEQ ID NO: 477874 - DNA, 20 bp, mouse
gagggaactaacggttatgg

SEQ ID NO: 477875 - DNA, 20 bp, mouse
ggctgccctaagggagtgac

SEQ ID NO: 477876 - DNA, 20 bp, mouse
gtgagaactctgagtagtgt

SEQ ID NO: 477877 - DNA, 20 bp, mouse
gcaatcggtgtcagcacctg

SEQ ID NO: 477878 - DNA, 20 bp, mouse
gcccaccaaaaggaggagtt

SEQ ID NO: 477879 - DNA, 20 bp, mouse
ggatgtttcccaccaaaagg

SEQ ID NO: 477880 - DNA, 20 bp, mouse
ggctctacaaagaactccaa

SEQ ID NO: 477881 - DNA, 20 bp, mouse
ggaggagtttggaagctccc

SEQ ID NO: 477882 - DNA, 20 bp, mouse
ggaactgtctgggagtgatg

SEQ ID NO: 477883 - DNA, 20 bp, mouse
ggacttctgcctgggtcccc

SEQ ID NO: 477884 - DNA, 20 bp, mouse
gtgaggggaactcttacctt

SEQ ID NO: 477885 - DNA, 20 bp, mouse
gaacttagtggaaattctca

SEQ ID NO: 477886 - DNA, 20 bp, mouse
gggacacaagaggcgtccag

SEQ ID NO: 477887 - DNA, 20 bp, mouse
gggcgtccagcggtagccgg

SEQ ID NO: 477888 - DNA, 20 bp, mouse
gcagggatctgcgcactcag

SEQ ID NO: 477889 - DNA, 20 bp, mouse
gcatttgcaggggacacaag

SEQ ID NO: 477890 - DNA, 20 bp, mouse
ggaagttgcagcatttgcag

SEQ ID NO: 477891 - DNA, 20 bp, mouse
gctctgccaccggctaccgc

SEQ ID NO: 477892 - DNA, 20 bp, mouse
gccggtggcagagccatggc

SEQ ID NO: 477893 - DNA, 20 bp, mouse
gaagaggcgcccccaggagt

SEQ ID NO: 477894 - DNA, 20 bp, mouse
ggctctgcaccgactcctgg

SEQ ID NO: 477895 - DNA, 20 bp, mouse
gcgctcttcctcgcccgcca

SEQ ID NO: 477896 - DNA, 20 bp, mouse
ggagcccgcgagcctgctag

SEQ ID NO: 477897 - DNA, 20 bp, mouse
gcccgcgagcctgctagcgg

SEQ ID NO: 477898 - DNA, 20 bp, mouse
ggggctccgggtctgtgcgg

SEQ ID NO: 477899 - DNA, 20 bp, mouse
gccggggctccgggtctgtg

SEQ ID NO: 477900 - DNA, 20 bp, mouse
gcagcgggccgcgcaggccg

SEQ ID NO: 477901 - DNA, 20 bp, mouse
ggcgcgggccccagggtcag

SEQ ID NO: 477902 - DNA, 20 bp, mouse
gcctcgcggaatgtgaacag

SEQ ID NO: 477903 - DNA, 20 bp, mouse
ggcccagagccaggtcctcg

SEQ ID NO: 477904 - DNA, 20 bp, mouse
gaagaaccggcgggataggt

SEQ ID NO: 477905 - DNA, 20 bp, mouse
gctcgcgggctcgcaggcaa

SEQ ID NO: 477906 - DNA, 20 bp, mouse
gtcacacgcagcctagctgg

SEQ ID NO: 477907 - DNA, 20 bp, mouse
gcactcgcaggaggtcccct

SEQ ID NO: 477908 - DNA, 20 bp, mouse
gcctcggtgccggggatccg

SEQ ID NO: 477909 - DNA, 20 bp, mouse
gacgagcggtggaagaccgt

SEQ ID NO: 477910 - DNA, 20 bp, mouse
gcggtgccggggatccgggg

SEQ ID NO: 477911 - DNA, 20 bp, mouse
gatccggggtggcccgggag

SEQ ID NO: 477912 - DNA, 20 bp, mouse
gcggggtggcccgggagcgg

SEQ ID NO: 477913 - DNA, 20 bp, mouse
gacaaaccgcaggtacccac

SEQ ID NO: 477914 - DNA, 20 bp, mouse
gccgggccaccccggatccc

SEQ ID NO: 477915 - DNA, 20 bp, mouse
ggcaagggcgagtgcaaagg

SEQ ID NO: 477916 - DNA, 20 bp, mouse
gagacggagctagtagctaa

SEQ ID NO: 477917 - DNA, 20 bp, mouse
ggcattcccacccagtccag

SEQ ID NO: 477918 - DNA, 20 bp, mouse
gccgtctccctggagccaga

SEQ ID NO: 477919 - DNA, 20 bp, mouse
ggagccagagggaactccga

SEQ ID NO: 477920 - DNA, 20 bp, mouse
gcgaagccgctgacacccgg

SEQ ID NO: 477921 - DNA, 20 bp, mouse
gatgtggctctacgcagcag

SEQ ID NO: 477922 - DNA, 20 bp, mouse
ggagaggatcagggacgctg

SEQ ID NO: 477923 - DNA, 20 bp, mouse
gccagcctctcagtagagag

SEQ ID NO: 477924 - DNA, 20 bp, mouse
gtcaccttcggagttccctc

SEQ ID NO: 477925 - DNA, 20 bp, mouse
gtgatcctctctctactgag

SEQ ID NO: 477926 - DNA, 20 bp, mouse
gcttcgggcgaacccggccc

SEQ ID NO: 477927 - DNA, 20 bp, mouse
gccgaagctggagcttgtac

SEQ ID NO: 477928 - DNA, 20 bp, mouse
ggaccctagaggccctccag

SEQ ID NO: 477929 - DNA, 20 bp, mouse
ggcttgtacgggccccggcc

SEQ ID NO: 477930 - DNA, 20 bp, mouse
gactcccggaagtcgctctg

SEQ ID NO: 477931 - DNA, 20 bp, mouse
gagcagacgggagccaccac

SEQ ID NO: 477932 - DNA, 20 bp, mouse
ggacagactgcgggaagtcg

SEQ ID NO: 477933 - DNA, 20 bp, mouse
gctccagcttcgggcgaacc

SEQ ID NO: 477934 - DNA, 20 bp, mouse
ggtcatgacgatgcccgggc

SEQ ID NO: 477935 - DNA, 20 bp, mouse
ggctggtcatgacgatgccc

SEQ ID NO: 477936 - DNA, 20 bp, mouse
ggcgagctcccgctacgaac

SEQ ID NO: 477937 - DNA, 20 bp, mouse
ggccctgggccggttcgtag

SEQ ID NO: 477938 - DNA, 20 bp, mouse
gccggcgccgcctgtcagaa

SEQ ID NO: 477939 - DNA, 20 bp, mouse
ggcgggcacgagccctgggc

SEQ ID NO: 477940 - DNA, 20 bp, mouse
ggttcgccctcgctgaggta

SEQ ID NO: 477941 - DNA, 20 bp, mouse
ggctcgagcccagcagactt

SEQ ID NO: 477942 - DNA, 20 bp, mouse
ggctcccggtttacagatga

SEQ ID NO: 477943 - DNA, 20 bp, mouse
gtctgtaaaccgggagctac

SEQ ID NO: 477944 - DNA, 20 bp, mouse
ggggatgacgccgttctgac

SEQ ID NO: 477945 - DNA, 20 bp, mouse
ggccgcgcgggtttggatgc

SEQ ID NO: 477946 - DNA, 20 bp, mouse
gtggaccgagctgatgatgg

SEQ ID NO: 477947 - DNA, 20 bp, mouse
ggcggcccaggtcgtgacag

SEQ ID NO: 477948 - DNA, 20 bp, mouse
ggagcccgctgctgaacgtt

SEQ ID NO: 477949 - DNA, 20 bp, mouse
ggaggagaggagggagtacg

SEQ ID NO: 477950 - DNA, 20 bp, mouse
gtgggcatggctccagccaa

SEQ ID NO: 477951 - DNA, 20 bp, mouse
gacagcggcggggttccccc

SEQ ID NO: 477952 - DNA, 20 bp, mouse
gtcttcccgacgaccccaca

SEQ ID NO: 477953 - DNA, 20 bp, mouse
gccacaacgacgggacgggg

SEQ ID NO: 477954 - DNA, 20 bp, mouse
ggcccaggtcgtgacagcgg

SEQ ID NO: 477955 - DNA, 20 bp, mouse
ggggatcggggcaccctgtg

SEQ ID NO: 477956 - DNA, 20 bp, mouse
gtagctgctttataaggagg

SEQ ID NO: 477957 - DNA, 20 bp, mouse
gaggttctagctgctttata

SEQ ID NO: 477958 - DNA, 20 bp, mouse
gttctagctgctttataagg

SEQ ID NO: 477959 - DNA, 20 bp, mouse
ggaaccttgagcgtagggtg

SEQ ID NO: 477960 - DNA, 20 bp, mouse
gcagctagaaccttgagcgt

SEQ ID NO: 477961 - DNA, 20 bp, mouse
gaatgacttgagtaagtcaa

SEQ ID NO: 477962 - DNA, 20 bp, mouse
gtcacacacaatcttagtat

SEQ ID NO: 477963 - DNA, 20 bp, mouse
gattgtgtgtgaggcagtga

SEQ ID NO: 477964 - DNA, 20 bp, mouse
gaaaccccaccctacgctca

SEQ ID NO: 477965 - DNA, 20 bp, mouse
ggaaacaactgcttagtcat

SEQ ID NO: 477966 - DNA, 20 bp, mouse
gccatggtggtcaagaccac

SEQ ID NO: 477967 - DNA, 20 bp, mouse
ggcaggtgctgtatccatgg

SEQ ID NO: 477968 - DNA, 20 bp, mouse
gtcaagaccacgggcagcag

SEQ ID NO: 477969 - DNA, 20 bp, mouse
ggcatccccagagcccttcc

SEQ ID NO: 477970 - DNA, 20 bp, mouse
gcgcttgagcctacagatgg

SEQ ID NO: 477971 - DNA, 20 bp, mouse
gcaggtgcctctgctgcccg

SEQ ID NO: 477972 - DNA, 20 bp, mouse
ggagtgaccaggaagggctc

SEQ ID NO: 477973 - DNA, 20 bp, mouse
gactccgcaggctgaggtgc

SEQ ID NO: 477974 - DNA, 20 bp, mouse
ggtgaacgggtgaggaccca

SEQ ID NO: 477975 - DNA, 20 bp, mouse
gccggctcgccgccatctgt

SEQ ID NO: 477976 - DNA, 20 bp, mouse
ggaaggagccagcatgccag

SEQ ID NO: 477977 - DNA, 20 bp, mouse
gtgggtttgaaattccaaca

SEQ ID NO: 477978 - DNA, 20 bp, mouse
gatcattccaagtttttgaa

SEQ ID NO: 477979 - DNA, 20 bp, mouse
gcgctctgcgcgtccaggta

SEQ ID NO: 477980 - DNA, 20 bp, mouse
gggaagctagggttaagtga

SEQ ID NO: 477981 - DNA, 20 bp, mouse
gactgcagcctctgccatgt

SEQ ID NO: 477982 - DNA, 20 bp, mouse
gcgcagagcgagctcccgat

SEQ ID NO: 477983 - DNA, 20 bp, mouse
gcaagtttttgaagggaaga

SEQ ID NO: 477984 - DNA, 20 bp, mouse
gcaagacctgtagtgagaag

SEQ ID NO: 477985 - DNA, 20 bp, mouse
gcccaaaacagctgcttgga

SEQ ID NO: 477986 - DNA, 20 bp, mouse
gagcacaggtgggccccggt

SEQ ID NO: 477987 - DNA, 20 bp, mouse
gggcgaacagcagcctaccg

SEQ ID NO: 477988 - DNA, 20 bp, mouse
gggtggctgcggtcccggca

SEQ ID NO: 477989 - DNA, 20 bp, mouse
ggaagcccgcggccagacgg

SEQ ID NO: 477990 - DNA, 20 bp, mouse
gcgcgcaggcgcacttcgaa

SEQ ID NO: 477991 - DNA, 20 bp, mouse
gcgaaaggcgcgcttttcgg

SEQ ID NO: 477992 - DNA, 20 bp, mouse
gcctccgcccgccggcttag

SEQ ID NO: 477993 - DNA, 20 bp, mouse
ggtgcgcctgcgcgaagtga

SEQ ID NO: 477994 - DNA, 20 bp, mouse
gtcccagcagtcctagcggg

SEQ ID NO: 477995 - DNA, 20 bp, mouse
gtcctagcggggggtagctg

SEQ ID NO: 477996 - DNA, 20 bp, mouse
gtgagccggcgacggagtgg

SEQ ID NO: 477997 - DNA, 20 bp, mouse
gagtggtggaggagacgtcc

SEQ ID NO: 477998 - DNA, 20 bp, mouse
gttgtgagccggcgacggag

SEQ ID NO: 477999 - DNA, 20 bp, mouse
gagcgctggcgaccccctgg

SEQ ID NO: 478000 - DNA, 20 bp, mouse
gcgcccagcccctaaaccag

SEQ ID NO: 478001 - DNA, 20 bp, mouse
ggccggcgacggagtggtgg

SEQ ID NO: 478002 - DNA, 20 bp, mouse
ggctctggccactggtttag

SEQ ID NO: 478003 - DNA, 20 bp, mouse
gcaggtgctgctctggccac

SEQ ID NO: 478004 - DNA, 20 bp, mouse
gccgtcgccggctcacaagt

SEQ ID NO: 478005 - DNA, 20 bp, mouse
gagacgtccaggtgctgctc

SEQ ID NO: 478006 - DNA, 20 bp, mouse
gccagtagctgaagtcatac

SEQ ID NO: 478007 - DNA, 20 bp, mouse
gtggctagtcccagcagagt

SEQ ID NO: 478008 - DNA, 20 bp, mouse
ggctgaagtcatacaggaaa

SEQ ID NO: 478009 - DNA, 20 bp, mouse
gagtgtgcggggaacagcag

SEQ ID NO: 478010 - DNA, 20 bp, mouse
gcagtaagtagctacttggg

SEQ ID NO: 478011 - DNA, 20 bp, mouse
gtatcccttgaagaacccag

SEQ ID NO: 478012 - DNA, 20 bp, mouse
gtcctgctgatcctgactga

SEQ ID NO: 478013 - DNA, 20 bp, mouse
gagtcaggatcagcaggaat

SEQ ID NO: 478014 - DNA, 20 bp, mouse
gccagcccaaaagaagactg

SEQ ID NO: 478015 - DNA, 20 bp, mouse
gctacttggggggcaaggga

SEQ ID NO: 478016 - DNA, 20 bp, mouse
ggtccacagcagacaagtag

SEQ ID NO: 478017 - DNA, 20 bp, mouse
gagggagcccagcactgagt

SEQ ID NO: 478018 - DNA, 20 bp, mouse
gagtatgtaaccagggacca

SEQ ID NO: 478019 - DNA, 20 bp, mouse
gtgtaaccagggaccaggga

SEQ ID NO: 478020 - DNA, 20 bp, mouse
gagaggcaggtaatcgctct

SEQ ID NO: 478021 - DNA, 20 bp, mouse
gcagtctccactgaagaaag

SEQ ID NO: 478022 - DNA, 20 bp, mouse
gcttgtgggtctcaaagtca

SEQ ID NO: 478023 - DNA, 20 bp, mouse
gcacaaggcaaatagcgaga

SEQ ID NO: 478024 - DNA, 20 bp, mouse
gcagggacggttctacaaaa

SEQ ID NO: 478025 - DNA, 20 bp, mouse
ggcccttctcaagcagtaca

SEQ ID NO: 478026 - DNA, 20 bp, mouse
gaatctggggccaacctcgg

SEQ ID NO: 478027 - DNA, 20 bp, mouse
gccagggcgcgagaatggga

SEQ ID NO: 478028 - DNA, 20 bp, mouse
gggaaggccagagagaaccg

SEQ ID NO: 478029 - DNA, 20 bp, mouse
gagcgcgagactcaaatctg

SEQ ID NO: 478030 - DNA, 20 bp, mouse
gggcgcatgcgcagacggat

SEQ ID NO: 478031 - DNA, 20 bp, mouse
ggggccaacctcggtggagg

SEQ ID NO: 478032 - DNA, 20 bp, mouse
gctggggccaacctcggtgg

SEQ ID NO: 478033 - DNA, 20 bp, mouse
gtcgccgcctccaccgaggt

SEQ ID NO: 478034 - DNA, 20 bp, mouse
gagaatgggagggaagccgc

SEQ ID NO: 478035 - DNA, 20 bp, mouse
gctcttcgttcgcttaccgg

SEQ ID NO: 478036 - DNA, 20 bp, mouse
gcttagtgtgaggctttcag

SEQ ID NO: 478037 - DNA, 20 bp, mouse
gcatggtccagtagcagggg

SEQ ID NO: 478038 - DNA, 20 bp, mouse
gtccagtagcaggggcggag

SEQ ID NO: 478039 - DNA, 20 bp, mouse
gtactggaccatggagactg

SEQ ID NO: 478040 - DNA, 20 bp, mouse
gctccatggtccagtagcag

SEQ ID NO: 478041 - DNA, 20 bp, mouse
gtactgggccacagtctcca

SEQ ID NO: 478042 - DNA, 20 bp, mouse
gtcacactaaggtctctact

SEQ ID NO: 478043 - DNA, 20 bp, mouse
gtcctgaggagagctgactg

SEQ ID NO: 478044 - DNA, 20 bp, mouse
ggcctctccgcccctgctac

SEQ ID NO: 478045 - DNA, 20 bp, mouse
gttcttggcaagctgaacta

SEQ ID NO: 478046 - DNA, 20 bp, mouse
gccccgaggctgtcctaaga

SEQ ID NO: 478047 - DNA, 20 bp, mouse
gcgttactccttctaccccg

SEQ ID NO: 478048 - DNA, 20 bp, mouse
gagcacgctagggtccctct

SEQ ID NO: 478049 - DNA, 20 bp, mouse
ggggtagaaggagtaacggc

SEQ ID NO: 478050 - DNA, 20 bp, mouse
ggccctcttaggacagcctc

SEQ ID NO: 478051 - DNA, 20 bp, mouse
gaggacagcctcggggtaga

SEQ ID NO: 478052 - DNA, 20 bp, mouse
gcctagagacgtccccaagg

SEQ ID NO: 478053 - DNA, 20 bp, mouse
gggaagcctgaacttccggg

SEQ ID NO: 478054 - DNA, 20 bp, mouse
gcgttacagaaagcacgcta

SEQ ID NO: 478055 - DNA, 20 bp, mouse
gtccccaaggaggcaccacc

SEQ ID NO: 478056 - DNA, 20 bp, mouse
ggcagacagttagtggggag

SEQ ID NO: 478057 - DNA, 20 bp, mouse
ggggagggaacatggaacgg

SEQ ID NO: 478058 - DNA, 20 bp, mouse
ggcagagcagacagttagtg

SEQ ID NO: 478059 - DNA, 20 bp, mouse
ggtagaggcgccgtaagcaa

SEQ ID NO: 478060 - DNA, 20 bp, mouse
ggggatcccagggtgtagag

SEQ ID NO: 478061 - DNA, 20 bp, mouse
ggacaggtgtggtagacaca

SEQ ID NO: 478062 - DNA, 20 bp, mouse
ggaacgggggccgacggtgg

SEQ ID NO: 478063 - DNA, 20 bp, mouse
gtgccaaccaagcatggtag

SEQ ID NO: 478064 - DNA, 20 bp, mouse
gccagccctgcccccaccgt

SEQ ID NO: 478065 - DNA, 20 bp, mouse
gaacaagccgcccgcctcct

SEQ ID NO: 478066 - DNA, 20 bp, mouse
ggacggtagccgagaaggac

SEQ ID NO: 478067 - DNA, 20 bp, mouse
gtggccgagaaggctctgga

SEQ ID NO: 478068 - DNA, 20 bp, mouse
gcgggcgaagggtaagacgg

SEQ ID NO: 478069 - DNA, 20 bp, mouse
gacggtggccgagaaggctc

SEQ ID NO: 478070 - DNA, 20 bp, mouse
ggctcgggcgaagggtaaga

SEQ ID NO: 478071 - DNA, 20 bp, mouse
gtagccgagaaggaccggca

SEQ ID NO: 478072 - DNA, 20 bp, mouse
gggtaagacggtggccgaga

SEQ ID NO: 478073 - DNA, 20 bp, mouse
gggcaagcgcctaactctgg

SEQ ID NO: 478074 - DNA, 20 bp, mouse
gggcaggcgagtcatcggga

SEQ ID NO: 478075 - DNA, 20 bp, mouse
gggacgcgcctgtcaagaca

SEQ ID NO: 478076 - DNA, 20 bp, mouse
gaatgtcggcgcccagaggg

SEQ ID NO: 478077 - DNA, 20 bp, mouse
ggaccaggcaggcctccggg

SEQ ID NO: 478078 - DNA, 20 bp, mouse
gattacttacacctccctct

SEQ ID NO: 478079 - DNA, 20 bp, mouse
gccgagactgcaccttgtag

SEQ ID NO: 478080 - DNA, 20 bp, mouse
gacaccgtagggcgcaggag

SEQ ID NO: 478081 - DNA, 20 bp, mouse
ggaggtgtaagtaattaaac

SEQ ID NO: 478082 - DNA, 20 bp, mouse
gcaaaatgtcggcgcccaga

SEQ ID NO: 478083 - DNA, 20 bp, mouse
ggcagggagaggggtacaaa

SEQ ID NO: 478084 - DNA, 20 bp, mouse
gccctctccctgcccctaca

SEQ ID NO: 478085 - DNA, 20 bp, mouse
gggctgcaccagacaccgta

SEQ ID NO: 478086 - DNA, 20 bp, mouse
gctgctgggaagccacgggg

SEQ ID NO: 478087 - DNA, 20 bp, mouse
gaggcgagttcccagcgccg

SEQ ID NO: 478088 - DNA, 20 bp, mouse
gaaagctgctgggaagccac

SEQ ID NO: 478089 - DNA, 20 bp, mouse
gctgggaactcgcctccccg

SEQ ID NO: 478090 - DNA, 20 bp, mouse
gagcagccagagccccgcgg

SEQ ID NO: 478091 - DNA, 20 bp, mouse
ggcgctccgcggccgcgatg

SEQ ID NO: 478092 - DNA, 20 bp, mouse
ggggtgccggagccccatcg

SEQ ID NO: 478093 - DNA, 20 bp, mouse
gtcgctgtgagaccctccgg

SEQ ID NO: 478094 - DNA, 20 bp, mouse
gccgcgggcgtcccatacta

SEQ ID NO: 478095 - DNA, 20 bp, mouse
ggcccgggcttggcttgaag

SEQ ID NO: 478096 - DNA, 20 bp, mouse
gctgccggcgtccctggtct

SEQ ID NO: 478097 - DNA, 20 bp, mouse
ggaggaccccacaaggaaca

SEQ ID NO: 478098 - DNA, 20 bp, mouse
gcagtatgcggagccgatgg

SEQ ID NO: 478099 - DNA, 20 bp, mouse
ggcggagccgatggagggtg

SEQ ID NO: 478100 - DNA, 20 bp, mouse
ggtggctggaggaccccaca

SEQ ID NO: 478101 - DNA, 20 bp, mouse
ggggacgccggcagtgagag

SEQ ID NO: 478102 - DNA, 20 bp, mouse
ggtgcccagaccagggacgc

SEQ ID NO: 478103 - DNA, 20 bp, mouse
gtgggcaccatgttccttgt

SEQ ID NO: 478104 - DNA, 20 bp, mouse
gcaacagcaacggcagtatg

SEQ ID NO: 478105 - DNA, 20 bp, mouse
gccccgagaagtgcagatgg

SEQ ID NO: 478106 - DNA, 20 bp, mouse
gtcagagcaccaggatacca

SEQ ID NO: 478107 - DNA, 20 bp, mouse
gggagtgagggaacccgtcc

SEQ ID NO: 478108 - DNA, 20 bp, mouse
gagcaccaggataccagggc

SEQ ID NO: 478109 - DNA, 20 bp, mouse
ggggtgcacgcgaccaggac

SEQ ID NO: 478110 - DNA, 20 bp, mouse
gctcagggtcatgattggac

SEQ ID NO: 478111 - DNA, 20 bp, mouse
gcagtaacagctggagtggt

SEQ ID NO: 478112 - DNA, 20 bp, mouse
ggaccctggtgaggagactg

SEQ ID NO: 478113 - DNA, 20 bp, mouse
gccagtctggcctggagtga

SEQ ID NO: 478114 - DNA, 20 bp, mouse
gataccagggcaggctgttc

SEQ ID NO: 478115 - DNA, 20 bp, mouse
ggtatcctggtgctctgacc

SEQ ID NO: 478116 - DNA, 20 bp, mouse
gacacactcccaggaagacg

SEQ ID NO: 478117 - DNA, 20 bp, mouse
ggcttaggccaagcaagttc

SEQ ID NO: 478118 - DNA, 20 bp, mouse
gtcctgggagtgtgtctgtt

SEQ ID NO: 478119 - DNA, 20 bp, mouse
gtgtgggtcacggttctgag

SEQ ID NO: 478120 - DNA, 20 bp, mouse
gaaaagtgccacgtcttcct

SEQ ID NO: 478121 - DNA, 20 bp, mouse
gtcttgcgatggcagatgaa

SEQ ID NO: 478122 - DNA, 20 bp, mouse
gccatcgcaagaccaaggga

SEQ ID NO: 478123 - DNA, 20 bp, mouse
ggttaaaaatgtgccaaaag

SEQ ID NO: 478124 - DNA, 20 bp, mouse
gtctgccatcgcaagaccaa

SEQ ID NO: 478125 - DNA, 20 bp, mouse
gacttacgtggaatgaaaca

SEQ ID NO: 478126 - DNA, 20 bp, mouse
gtcgcccagctgaagggagg

SEQ ID NO: 478127 - DNA, 20 bp, mouse
gccggcaccgaacatcacgt

SEQ ID NO: 478128 - DNA, 20 bp, mouse
gcggctttcgcccagctgaa

SEQ ID NO: 478129 - DNA, 20 bp, mouse
gtcggtgtcatcctcgtctc

SEQ ID NO: 478130 - DNA, 20 bp, mouse
gccgcttggcgagaggaagt

SEQ ID NO: 478131 - DNA, 20 bp, mouse
gaccggcggtgacaggccct

SEQ ID NO: 478132 - DNA, 20 bp, mouse
gcccagaggagacccagcgg

SEQ ID NO: 478133 - DNA, 20 bp, mouse
gaggaagttggatgttccca

SEQ ID NO: 478134 - DNA, 20 bp, mouse
gctgtctagacccggaagtt

SEQ ID NO: 478135 - DNA, 20 bp, mouse
gtcagaatgcgaaggctgag

SEQ ID NO: 478136 - DNA, 20 bp, mouse
ggtgcgcaggagccacgaga

SEQ ID NO: 478137 - DNA, 20 bp, mouse
gaggaggaaaaggacgcggg

SEQ ID NO: 478138 - DNA, 20 bp, mouse
gaccgccgccaggtccgctc

SEQ ID NO: 478139 - DNA, 20 bp, mouse
gggagccggagcggacctgg

SEQ ID NO: 478140 - DNA, 20 bp, mouse
gcgggtggcggcgcgacggg

SEQ ID NO: 478141 - DNA, 20 bp, mouse
gcgtggagccggagcggacc

SEQ ID NO: 478142 - DNA, 20 bp, mouse
gggacctggcggcggttcag

SEQ ID NO: 478143 - DNA, 20 bp, mouse
gacctgcgtggtgcactaca

SEQ ID NO: 478144 - DNA, 20 bp, mouse
gacgcgggtggcggcgcgac

SEQ ID NO: 478145 - DNA, 20 bp, mouse
gtggcggcggttcagaggtt

SEQ ID NO: 478146 - DNA, 20 bp, mouse
gacctcctccggctctgcag

SEQ ID NO: 478147 - DNA, 20 bp, mouse
gctctgcagtggcggcaaga

SEQ ID NO: 478148 - DNA, 20 bp, mouse
gtcctccggctctgcagtgg

SEQ ID NO: 478149 - DNA, 20 bp, mouse
gtggcggcaagaaggcgagc

SEQ ID NO: 478150 - DNA, 20 bp, mouse
ggccgccactgcagagccgg

SEQ ID NO: 478151 - DNA, 20 bp, mouse
gcagccgcagcctaggacag

SEQ ID NO: 478152 - DNA, 20 bp, mouse
gcccaggagacggtaccggg

SEQ ID NO: 478153 - DNA, 20 bp, mouse
gcagagcggagccggggtcg

SEQ ID NO: 478154 - DNA, 20 bp, mouse
ggcgagcgggagtgcctgcg

SEQ ID NO: 478155 - DNA, 20 bp, mouse
gtgcggggtccgcgccagag

SEQ ID NO: 478156 - DNA, 20 bp, mouse
gcgagcgggattggctccgg

SEQ ID NO: 478157 - DNA, 20 bp, mouse
ggtgacagcacgagcgggat

SEQ ID NO: 478158 - DNA, 20 bp, mouse
gggcgcggcgaggaggtgag

SEQ ID NO: 478159 - DNA, 20 bp, mouse
gggtgcaggagggcaacctg

SEQ ID NO: 478160 - DNA, 20 bp, mouse
ggcacgagcgggattggctc

SEQ ID NO: 478161 - DNA, 20 bp, mouse
gcgtgagagcccgccccctg

SEQ ID NO: 478162 - DNA, 20 bp, mouse
gcgtcttcgtcgctacaggg

SEQ ID NO: 478163 - DNA, 20 bp, mouse
gcggggcgcggaacagcggt

SEQ ID NO: 478164 - DNA, 20 bp, mouse
gagtggcccatagctggagt

SEQ ID NO: 478165 - DNA, 20 bp, mouse
gcgggctctcacgccgtacg

SEQ ID NO: 478166 - DNA, 20 bp, mouse
gccacggtccatgcacgctg

SEQ ID NO: 478167 - DNA, 20 bp, mouse
gcaccggccacagagggcga

SEQ ID NO: 478168 - DNA, 20 bp, mouse
gggccagcaccggccacaga

SEQ ID NO: 478169 - DNA, 20 bp, mouse
gacttgataatgtccttctt

SEQ ID NO: 478170 - DNA, 20 bp, mouse
gcggccacagagggcgaggg

SEQ ID NO: 478171 - DNA, 20 bp, mouse
gggcctgccctaggaaataa

SEQ ID NO: 478172 - DNA, 20 bp, mouse
gggaccgcgccggattgagg

SEQ ID NO: 478173 - DNA, 20 bp, mouse
gccgaaccccgcggaatctg

SEQ ID NO: 478174 - DNA, 20 bp, mouse
gggagagtgggagctcacgc

SEQ ID NO: 478175 - DNA, 20 bp, mouse
ggagccagcccgcctcaatc

SEQ ID NO: 478176 - DNA, 20 bp, mouse
gctggagcgcggttcgaggt

SEQ ID NO: 478177 - DNA, 20 bp, mouse
gaccggagtgagcgacgggg

SEQ ID NO: 478178 - DNA, 20 bp, mouse
gccgaccggagtgagcgacg

SEQ ID NO: 478179 - DNA, 20 bp, mouse
gaccgccgaggagatgaagg

SEQ ID NO: 478180 - DNA, 20 bp, mouse
ggccgccccgtcgctcactc

SEQ ID NO: 478181 - DNA, 20 bp, mouse
gcagtgcagccggatcgagt

SEQ ID NO: 478182 - DNA, 20 bp, mouse
gcggcgcccctgcctctcga

SEQ ID NO: 478183 - DNA, 20 bp, mouse
gagtgtggcaagcgcgagca

SEQ ID NO: 478184 - DNA, 20 bp, mouse
ggagcctggagcgcggttcg

SEQ ID NO: 478185 - DNA, 20 bp, mouse
gccactccttcgagaggcag

SEQ ID NO: 478186 - DNA, 20 bp, mouse
gaccgagcgtgcggacggag

SEQ ID NO: 478187 - DNA, 20 bp, mouse
gggacaccgccgccggagac

SEQ ID NO: 478188 - DNA, 20 bp, mouse
ggagcgaccgagcgtgcgga

SEQ ID NO: 478189 - DNA, 20 bp, mouse
ggagcgtgcggacggagcgg

SEQ ID NO: 478190 - DNA, 20 bp, mouse
ggacggagcggcggcctgct

SEQ ID NO: 478191 - DNA, 20 bp, mouse
gtcccgtccacgccatcccg

SEQ ID NO: 478192 - DNA, 20 bp, mouse
gcccggggaagccgcgcgag

SEQ ID NO: 478193 - DNA, 20 bp, mouse
ggcgcgccggacaccgccgc

SEQ ID NO: 478194 - DNA, 20 bp, mouse
gccccgcgtgggaggtggag

SEQ ID NO: 478195 - DNA, 20 bp, mouse
gcgctgccagtctccggcgg

SEQ ID NO: 478196 - DNA, 20 bp, mouse
gatgtgtagacgctcaggct

SEQ ID NO: 478197 - DNA, 20 bp, mouse
gggctgagagaaataaatga

SEQ ID NO: 478198 - DNA, 20 bp, mouse
gcacagttctctctttggag

SEQ ID NO: 478199 - DNA, 20 bp, mouse
ggatgttgtctttgcagatc

SEQ ID NO: 478200 - DNA, 20 bp, mouse
ggccctctctccagacgcat

SEQ ID NO: 478201 - DNA, 20 bp, mouse
gacagtgcacagaaacgtgg

SEQ ID NO: 478202 - DNA, 20 bp, mouse
ggttccatgtgtagacgctc

SEQ ID NO: 478203 - DNA, 20 bp, mouse
gtaggtggctgaccactacc

SEQ ID NO: 478204 - DNA, 20 bp, mouse
gcacatggaacgctctgggg

SEQ ID NO: 478205 - DNA, 20 bp, mouse
gtcctatgcgtctggagaga

SEQ ID NO: 478206 - DNA, 20 bp, mouse
gtcttctcgcgcctcaggaa

SEQ ID NO: 478207 - DNA, 20 bp, mouse
ggcctttggagacagttgtg

SEQ ID NO: 478208 - DNA, 20 bp, mouse
ggcgagacgactgccaggta

SEQ ID NO: 478209 - DNA, 20 bp, mouse
ggcgctggcctgaggcgatg

SEQ ID NO: 478210 - DNA, 20 bp, mouse
gcggtgggattccgttcctg

SEQ ID NO: 478211 - DNA, 20 bp, mouse
gtcgctcatagggagactgg

SEQ ID NO: 478212 - DNA, 20 bp, mouse
gcctggcagtcgtctcgcga

SEQ ID NO: 478213 - DNA, 20 bp, mouse
ggcagtcgtctcgcgacggt

SEQ ID NO: 478214 - DNA, 20 bp, mouse
gaggatgccagccccttcca

SEQ ID NO: 478215 - DNA, 20 bp, mouse
ggccgcacaactgtctccaa

SEQ ID NO: 478216 - DNA, 20 bp, mouse
gagcctgctgacactctgtg

SEQ ID NO: 478217 - DNA, 20 bp, mouse
gcactctgtggggcttacac

SEQ ID NO: 478218 - DNA, 20 bp, mouse
gagccccacagagtgtcagc

SEQ ID NO: 478219 - DNA, 20 bp, mouse
ggccaagtagccatcgtaat

SEQ ID NO: 478220 - DNA, 20 bp, mouse
gttcccaaagcagcactccc

SEQ ID NO: 478221 - DNA, 20 bp, mouse
gtggggcttacactgggcct

SEQ ID NO: 478222 - DNA, 20 bp, mouse
gaggctgatcagactgaatt

SEQ ID NO: 478223 - DNA, 20 bp, mouse
gcagactgaattgggacgcg

SEQ ID NO: 478224 - DNA, 20 bp, mouse
gggaacaacaccacaggcta

SEQ ID NO: 478225 - DNA, 20 bp, mouse
ggaaaactgctagtctgaat

SEQ ID NO: 478226 - DNA, 20 bp, mouse
gagagggcctgataggacgt

SEQ ID NO: 478227 - DNA, 20 bp, mouse
gcccgcaggtgagggtcgca

SEQ ID NO: 478228 - DNA, 20 bp, mouse
ggaaggagccccgcaggtga

SEQ ID NO: 478229 - DNA, 20 bp, mouse
gggcgcgcggggcattgtgg

SEQ ID NO: 478230 - DNA, 20 bp, mouse
gcttaaggagagggcctgat

SEQ ID NO: 478231 - DNA, 20 bp, mouse
gggctcggggaccccgctcg

SEQ ID NO: 478232 - DNA, 20 bp, mouse
gagggctccggggcttcctg

SEQ ID NO: 478233 - DNA, 20 bp, mouse
ggctgtttcccgaggcgcgg

SEQ ID NO: 478234 - DNA, 20 bp, mouse
gacagccaatgggtgcgcgg

SEQ ID NO: 478235 - DNA, 20 bp, mouse
ggtcggggccggatcccgga

SEQ ID NO: 478236 - DNA, 20 bp, mouse
gtggactccggggaggcgag

SEQ ID NO: 478237 - DNA, 20 bp, mouse
gtcgcgcggcctggactccg

SEQ ID NO: 478238 - DNA, 20 bp, mouse
ggtccgcgcacggtgcacag

SEQ ID NO: 478239 - DNA, 20 bp, mouse
gcgccgcggcgatgcaaacg

SEQ ID NO: 478240 - DNA, 20 bp, mouse
gggccgcgcgatggcattag

SEQ ID NO: 478241 - DNA, 20 bp, mouse
gtccggggaggcgaggggca

SEQ ID NO: 478242 - DNA, 20 bp, mouse
gccgtgcgcggacactcatc

SEQ ID NO: 478243 - DNA, 20 bp, mouse
ggggaggcgaggggcaaggc

SEQ ID NO: 478244 - DNA, 20 bp, mouse
gcaaacgtggaaaggtctcc

SEQ ID NO: 478245 - DNA, 20 bp, mouse
gggcccctaatgccatcgcg

SEQ ID NO: 478246 - DNA, 20 bp, mouse
gcccaagctagaatccaccc

SEQ ID NO: 478247 - DNA, 20 bp, mouse
gtgtgtatgatgttgaggcc

SEQ ID NO: 478248 - DNA, 20 bp, mouse
ggattctagcttgggaaggg

SEQ ID NO: 478249 - DNA, 20 bp, mouse
gaccaaggagcatagcagga

SEQ ID NO: 478250 - DNA, 20 bp, mouse
gggcgactacccgaaccatg

SEQ ID NO: 478251 - DNA, 20 bp, mouse
ggggtagtcgccccaactat

SEQ ID NO: 478252 - DNA, 20 bp, mouse
ggttctaaactagacctggg

SEQ ID NO: 478253 - DNA, 20 bp, mouse
gaagggatcaggagatccaa

SEQ ID NO: 478254 - DNA, 20 bp, mouse
ggccaatcaggagcacgaag

SEQ ID NO: 478255 - DNA, 20 bp, mouse
gactagcttctccgtctctg

SEQ ID NO: 478256 - DNA, 20 bp, mouse
gggatccccggcaggctgag

SEQ ID NO: 478257 - DNA, 20 bp, mouse
gggcggccattgctccaaga

SEQ ID NO: 478258 - DNA, 20 bp, mouse
gccggcccggtaggaaaagg

SEQ ID NO: 478259 - DNA, 20 bp, mouse
gcgtgcccgagcccagaggg

SEQ ID NO: 478260 - DNA, 20 bp, mouse
gtctgccgggagccgcgagt

SEQ ID NO: 478261 - DNA, 20 bp, mouse
gggcccggcccggtaggaaa

SEQ ID NO: 478262 - DNA, 20 bp, mouse
gtcgcccagacaggctctct

SEQ ID NO: 478263 - DNA, 20 bp, mouse
gaagcccagagagcctgtct

SEQ ID NO: 478264 - DNA, 20 bp, mouse
gggcggcggcgggtgaggcg

SEQ ID NO: 478265 - DNA, 20 bp, mouse
ggcaggcgcgcgaggtacag

SEQ ID NO: 478266 - DNA, 20 bp, mouse
gctagagttaggtaagatga

SEQ ID NO: 478267 - DNA, 20 bp, mouse
gccgccgcagctctagagtt

SEQ ID NO: 478268 - DNA, 20 bp, mouse
gggtagccgagcctgggcgt

SEQ ID NO: 478269 - DNA, 20 bp, mouse
gaggtaagatgagggcaccg

SEQ ID NO: 478270 - DNA, 20 bp, mouse
gcgcgggtcaggacgatcaa

SEQ ID NO: 478271 - DNA, 20 bp, mouse
gaggctcggctacccggccc

SEQ ID NO: 478272 - DNA, 20 bp, mouse
gacccgcccacgcccaggct

SEQ ID NO: 478273 - DNA, 20 bp, mouse
ggaccagcgacagtgcctga

SEQ ID NO: 478274 - DNA, 20 bp, mouse
gagccgagcctgggcgtggg

SEQ ID NO: 478275 - DNA, 20 bp, mouse
gggtggacgaccgctactca

SEQ ID NO: 478276 - DNA, 20 bp, mouse
gtgtcctaggacatgcggaa

SEQ ID NO: 478277 - DNA, 20 bp, mouse
ggaccctaaggcccagaata

SEQ ID NO: 478278 - DNA, 20 bp, mouse
ggagcgaatgaccctgtgca

SEQ ID NO: 478279 - DNA, 20 bp, mouse
gtgcagatatacccaagata

SEQ ID NO: 478280 - DNA, 20 bp, mouse
gagagatctcgggatagaaa

SEQ ID NO: 478281 - DNA, 20 bp, mouse
gctccctccgccaatgacca

SEQ ID NO: 478282 - DNA, 20 bp, mouse
ggttaaagaggccggagtaa

SEQ ID NO: 478283 - DNA, 20 bp, mouse
gggtgagaaaaagagatctc

SEQ ID NO: 478284 - DNA, 20 bp, mouse
gcagacggagatatctaaag

SEQ ID NO: 478285 - DNA, 20 bp, mouse
gccctcaaccccggaactca

SEQ ID NO: 478286 - DNA, 20 bp, mouse
gttgccgaggggcagaacag

SEQ ID NO: 478287 - DNA, 20 bp, mouse
gcccgctcgcaactgtcctg

SEQ ID NO: 478288 - DNA, 20 bp, mouse
gagtgcaagggcctgcggaa

SEQ ID NO: 478289 - DNA, 20 bp, mouse
gcgggctagcacttgccgag

SEQ ID NO: 478290 - DNA, 20 bp, mouse
gcccagcatccgggagacgg

SEQ ID NO: 478291 - DNA, 20 bp, mouse
ggaacagtggcgacagcccc

SEQ ID NO: 478292 - DNA, 20 bp, mouse
gggatggccgtctgaggaca

SEQ ID NO: 478293 - DNA, 20 bp, mouse
ggccccaggacagttgcgag

SEQ ID NO: 478294 - DNA, 20 bp, mouse
ggggccacttgtgacctcaa

SEQ ID NO: 478295 - DNA, 20 bp, mouse
ggtaaacacctgggagaggg

SEQ ID NO: 478296 - DNA, 20 bp, mouse
gctctcacctggttcaccaa

SEQ ID NO: 478297 - DNA, 20 bp, mouse
ggttcaccaaaggaacaagt

SEQ ID NO: 478298 - DNA, 20 bp, mouse
gcaaaggaacaagtaggata

SEQ ID NO: 478299 - DNA, 20 bp, mouse
gaggcctgacgcagcttgca

SEQ ID NO: 478300 - DNA, 20 bp, mouse
ggatttcaattcctctcacc

SEQ ID NO: 478301 - DNA, 20 bp, mouse
gtgcagggtgttgatggatc

SEQ ID NO: 478302 - DNA, 20 bp, mouse
gttggtcaggaccccttcaa

SEQ ID NO: 478303 - DNA, 20 bp, mouse
ggcagcttgcagggtgttga

SEQ ID NO: 478304 - DNA, 20 bp, mouse
gacaccctgcaagctgcgtc

SEQ ID NO: 478305 - DNA, 20 bp, mouse
ggataaatgaccccttgaag

SEQ ID NO: 478306 - DNA, 20 bp, mouse
gaacgtgcacaggggagcga

SEQ ID NO: 478307 - DNA, 20 bp, mouse
gagggcagggcgctcgcagg

SEQ ID NO: 478308 - DNA, 20 bp, mouse
gtgcacaggggagcgagggc

SEQ ID NO: 478309 - DNA, 20 bp, mouse
gagcctgcgggattccacag

SEQ ID NO: 478310 - DNA, 20 bp, mouse
gtcgcagggggcactcagag

SEQ ID NO: 478311 - DNA, 20 bp, mouse
gcaacaacaaacgtgcacag

SEQ ID NO: 478312 - DNA, 20 bp, mouse
gagccggggcgcggaaggaa

SEQ ID NO: 478313 - DNA, 20 bp, mouse
ggcgccgggctaatctgaag

SEQ ID NO: 478314 - DNA, 20 bp, mouse
gggcactcagagagggccca

SEQ ID NO: 478315 - DNA, 20 bp, mouse
gagggcccagggcgccaaag

SEQ ID NO: 478316 - DNA, 20 bp, mouse
gaccccggtggcctccatgg

SEQ ID NO: 478317 - DNA, 20 bp, mouse
gggtccacgccgcgcacgaa

SEQ ID NO: 478318 - DNA, 20 bp, mouse
gtgcgcggcgtggacctcag

SEQ ID NO: 478319 - DNA, 20 bp, mouse
gggtggcgcagctctcttac

SEQ ID NO: 478320 - DNA, 20 bp, mouse
gacgaacggcagcaccccgg

SEQ ID NO: 478321 - DNA, 20 bp, mouse
gagcaccccggtggcctcca

SEQ ID NO: 478322 - DNA, 20 bp, mouse
gcgcacgaacggcagcaccc

SEQ ID NO: 478323 - DNA, 20 bp, mouse
ggccaccatggaggccaccg

SEQ ID NO: 478324 - DNA, 20 bp, mouse
gtacgggcagggaggacgcg

SEQ ID NO: 478325 - DNA, 20 bp, mouse
gcgcccggggcggaagacct

SEQ ID NO: 478326 - DNA, 20 bp, mouse
gcggcggttgcgtctccggg

SEQ ID NO: 478327 - DNA, 20 bp, mouse
gggaggcagtatcgattcac

SEQ ID NO: 478328 - DNA, 20 bp, mouse
gcgctgtggccagagtgcgg

SEQ ID NO: 478329 - DNA, 20 bp, mouse
ggtgcggcggttgcgtctcc

SEQ ID NO: 478330 - DNA, 20 bp, mouse
gtcacgggacgcggagatgc

SEQ ID NO: 478331 - DNA, 20 bp, mouse
ggcagctagggaagacaact

SEQ ID NO: 478332 - DNA, 20 bp, mouse
ggtagctctcactcccgctg

SEQ ID NO: 478333 - DNA, 20 bp, mouse
gagtatcgattcacgggacg

SEQ ID NO: 478334 - DNA, 20 bp, mouse
gagctcgtgtccataggtga

SEQ ID NO: 478335 - DNA, 20 bp, mouse
gcctagcagaagatgcaccg

SEQ ID NO: 478336 - DNA, 20 bp, mouse
gaaggggaactgaggcaagt

SEQ ID NO: 478337 - DNA, 20 bp, mouse
gcgcgcccggggacggacga

SEQ ID NO: 478338 - DNA, 20 bp, mouse
gtactagccgcaacaggatc

SEQ ID NO: 478339 - DNA, 20 bp, mouse
gtccgtcaccggcatcctgg

SEQ ID NO: 478340 - DNA, 20 bp, mouse
gctgagatgaaaagccccaa

SEQ ID NO: 478341 - DNA, 20 bp, mouse
ggctacttcgcgcccgggga

SEQ ID NO: 478342 - DNA, 20 bp, mouse
ggaaaagccccaagggcccg

SEQ ID NO: 478343 - DNA, 20 bp, mouse
ggccccaagggcccggggaa

SEQ ID NO: 478344 - DNA, 20 bp, mouse
gcctggaggcagagagtacg

SEQ ID NO: 478345 - DNA, 20 bp, mouse
gcgtagcccgtcgctcaggt

SEQ ID NO: 478346 - DNA, 20 bp, mouse
gacttcgttagcgctctggg

SEQ ID NO: 478347 - DNA, 20 bp, mouse
gtctctctcccggggcggag

SEQ ID NO: 478348 - DNA, 20 bp, mouse
gtccacggagaaggacctag

SEQ ID NO: 478349 - DNA, 20 bp, mouse
gcgctctgacgtggaccctg

SEQ ID NO: 478350 - DNA, 20 bp, mouse
gcggggctcgctggcctctt

SEQ ID NO: 478351 - DNA, 20 bp, mouse
gcccgagcaccgctccgccc

SEQ ID NO: 478352 - DNA, 20 bp, mouse
ggagcggtgctcgggaagtg

SEQ ID NO: 478353 - DNA, 20 bp, mouse
ggctgctgggctgtccggct

SEQ ID NO: 478354 - DNA, 20 bp, mouse
gctcggcctggttgacgagg

SEQ ID NO: 478355 - DNA, 20 bp, mouse
gtcaaccaggccgaggccgg

SEQ ID NO: 478356 - DNA, 20 bp, mouse
gcccgcagaaccccagaacg

SEQ ID NO: 478357 - DNA, 20 bp, mouse
gcccgtaagcaaccccaccg

SEQ ID NO: 478358 - DNA, 20 bp, mouse
ggcttctcaagaccccggtg

SEQ ID NO: 478359 - DNA, 20 bp, mouse
gcagctggagaggaatagag

SEQ ID NO: 478360 - DNA, 20 bp, mouse
gggggtcttgagaagcgcgg

SEQ ID NO: 478361 - DNA, 20 bp, mouse
gggcgcgggagagctttgtg

SEQ ID NO: 478362 - DNA, 20 bp, mouse
gcaacagggtgcggccgggt

SEQ ID NO: 478363 - DNA, 20 bp, mouse
gggaactgctgcagacccct

SEQ ID NO: 478364 - DNA, 20 bp, mouse
ggctcggacacccggcttag

SEQ ID NO: 478365 - DNA, 20 bp, mouse
gacagaggaagaagtccggg

SEQ ID NO: 478366 - DNA, 20 bp, mouse
ggggtccgcagcgaccggga

SEQ ID NO: 478367 - DNA, 20 bp, mouse
gggacccgccacagccctcc

SEQ ID NO: 478368 - DNA, 20 bp, mouse
ggccttgggtccgcagcgac

SEQ ID NO: 478369 - DNA, 20 bp, mouse
ggcagcgaccgggagggctg

SEQ ID NO: 478370 - DNA, 20 bp, mouse
gctcgttggggcccaccgtg

SEQ ID NO: 478371 - DNA, 20 bp, mouse
ggccatgggcaactgccaca

SEQ ID NO: 478372 - DNA, 20 bp, mouse
gcagttgcccatggcgccgt

SEQ ID NO: 478373 - DNA, 20 bp, mouse
gaggcctgctggcctgccaa

SEQ ID NO: 478374 - DNA, 20 bp, mouse
ggcgctggtggtctcaggtg

SEQ ID NO: 478375 - DNA, 20 bp, mouse
gggccccgccggaagtgtag

SEQ ID NO: 478376 - DNA, 20 bp, mouse
gggcaggaatactgagtctt

SEQ ID NO: 478377 - DNA, 20 bp, mouse
ggcccagagccagtccccgg

SEQ ID NO: 478378 - DNA, 20 bp, mouse
gatactgagtctttggagag

SEQ ID NO: 478379 - DNA, 20 bp, mouse
gggactggctctgggctgta

SEQ ID NO: 478380 - DNA, 20 bp, mouse
gcctaggccacaggcaccga

SEQ ID NO: 478381 - DNA, 20 bp, mouse
gagagctgtggtggacgtgg

SEQ ID NO: 478382 - DNA, 20 bp, mouse
ggagcacacaaccttcactt

SEQ ID NO: 478383 - DNA, 20 bp, mouse
gggagaggccacatcccccg

SEQ ID NO: 478384 - DNA, 20 bp, mouse
gtagggtgccgaagatgcag

SEQ ID NO: 478385 - DNA, 20 bp, mouse
gcccggctcaggagtccccg

SEQ ID NO: 478386 - DNA, 20 bp, mouse
gcccagcgcacattccttgg

SEQ ID NO: 478387 - DNA, 20 bp, mouse
gcgctgggagataacaccaa

SEQ ID NO: 478388 - DNA, 20 bp, mouse
gcattccttggtggtgacaa

SEQ ID NO: 478389 - DNA, 20 bp, mouse
gtctcccagcgcacattcct

SEQ ID NO: 478390 - DNA, 20 bp, mouse
ggtctggtcctgaggttcag

SEQ ID NO: 478391 - DNA, 20 bp, mouse
gtcatccattgtcaccacca

SEQ ID NO: 478392 - DNA, 20 bp, mouse
ggaaagggaagaagctagag

SEQ ID NO: 478393 - DNA, 20 bp, mouse
gcgggtccgggaggtggaaa

SEQ ID NO: 478394 - DNA, 20 bp, mouse
gggccatgtaaagaaagcta

SEQ ID NO: 478395 - DNA, 20 bp, mouse
gcgatgggcaggagggacct

SEQ ID NO: 478396 - DNA, 20 bp, mouse
gccagaacacgagggaccga

SEQ ID NO: 478397 - DNA, 20 bp, mouse
gggagcgcgccagaacacga

SEQ ID NO: 478398 - DNA, 20 bp, mouse
gacacgagggaccgagggag

SEQ ID NO: 478399 - DNA, 20 bp, mouse
gcgaccgggtcagctaatgt

SEQ ID NO: 478400 - DNA, 20 bp, mouse
gtgaattcgcggagtcggct

SEQ ID NO: 478401 - DNA, 20 bp, mouse
ggggcgcccctcctctccct

SEQ ID NO: 478402 - DNA, 20 bp, mouse
gtggcgccccgacaaaagta

SEQ ID NO: 478403 - DNA, 20 bp, mouse
gcggactgccgagagaccca

SEQ ID NO: 478404 - DNA, 20 bp, mouse
ggtagggcgatctaagaggg

SEQ ID NO: 478405 - DNA, 20 bp, mouse
gggagggaagaccggagctg

SEQ ID NO: 478406 - DNA, 20 bp, mouse
gtccagtgcacacaaagcca

SEQ ID NO: 478407 - DNA, 20 bp, mouse
gacggcagctgcagcctgag

SEQ ID NO: 478408 - DNA, 20 bp, mouse
gatctgaagcaggaccgctc

SEQ ID NO: 478409 - DNA, 20 bp, mouse
gtgggctgcgcgcagtcaac

SEQ ID NO: 478410 - DNA, 20 bp, mouse
gcgcaggagtgatctgaagc

SEQ ID NO: 478411 - DNA, 20 bp, mouse
gtgcgtgcaagccagctcta

SEQ ID NO: 478412 - DNA, 20 bp, mouse
gtgccgcgctccggagacgg

SEQ ID NO: 478413 - DNA, 20 bp, mouse
gaaacttcagacttggaggt

SEQ ID NO: 478414 - DNA, 20 bp, mouse
gctgtagcagcagggtataa

SEQ ID NO: 478415 - DNA, 20 bp, mouse
gtcagatcactcctgcgctg

SEQ ID NO: 478416 - DNA, 20 bp, mouse
gtgagaggctcggagcgcgg

SEQ ID NO: 478417 - DNA, 20 bp, mouse
gcgggaggtagtgctagtgg

SEQ ID NO: 478418 - DNA, 20 bp, mouse
gtcccgggaggtagtgctag

SEQ ID NO: 478419 - DNA, 20 bp, mouse
gcgcggtggcggacactccc

SEQ ID NO: 478420 - DNA, 20 bp, mouse
gggtggcggacactcccggg

SEQ ID NO: 478421 - DNA, 20 bp, mouse
ggaggctcggagcgcggtgg

SEQ ID NO: 478422 - DNA, 20 bp, mouse
gtggtggctgctgctcggag

SEQ ID NO: 478423 - DNA, 20 bp, mouse
ggcgcggagaagggctctcg

SEQ ID NO: 478424 - DNA, 20 bp, mouse
gaggaggggaccggctcgag

SEQ ID NO: 478425 - DNA, 20 bp, mouse
ggtgtcccagcagctgacca

SEQ ID NO: 478426 - DNA, 20 bp, mouse
ggccgctgggaccgcatcac

SEQ ID NO: 478427 - DNA, 20 bp, mouse
ggcctgtgatgcggtcccag

SEQ ID NO: 478428 - DNA, 20 bp, mouse
ggccggcccagcctgtgatg

SEQ ID NO: 478429 - DNA, 20 bp, mouse
gccggaggccatgcgggcgt

SEQ ID NO: 478430 - DNA, 20 bp, mouse
ggcctggctaccgcgcgctc

SEQ ID NO: 478431 - DNA, 20 bp, mouse
ggcatggcctccggagcgcg

SEQ ID NO: 478432 - DNA, 20 bp, mouse
gagttcaccgcttgaaaggg

SEQ ID NO: 478433 - DNA, 20 bp, mouse
gtggctaccgcgcgctccgg

SEQ ID NO: 478434 - DNA, 20 bp, mouse
gaaagaggggagtgatgcgg

SEQ ID NO: 478435 - DNA, 20 bp, mouse
ggagcgcgcggtgggtatga

SEQ ID NO: 478436 - DNA, 20 bp, mouse
gaacctgtcacaggcatgag

SEQ ID NO: 478437 - DNA, 20 bp, mouse
gccggcagagatgacagtgc

SEQ ID NO: 478438 - DNA, 20 bp, mouse
gacttccaagaacctgtcac

SEQ ID NO: 478439 - DNA, 20 bp, mouse
ggttcttggaagtgacagga

SEQ ID NO: 478440 - DNA, 20 bp, mouse
ggacccctcatgcctgtgac

SEQ ID NO: 478441 - DNA, 20 bp, mouse
gctcaggtatacgcacattt

SEQ ID NO: 478442 - DNA, 20 bp, mouse
gtcccaaggtccccactccc

SEQ ID NO: 478443 - DNA, 20 bp, mouse
gccgggcggagaagggaaat

SEQ ID NO: 478444 - DNA, 20 bp, mouse
gtaaggacccagcacagtat

SEQ ID NO: 478445 - DNA, 20 bp, mouse
ggagcagggtgcgagacctg

SEQ ID NO: 478446 - DNA, 20 bp, mouse
gcctgcgcggccgcagctct

SEQ ID NO: 478447 - DNA, 20 bp, mouse
ggcggccgcagctctaggct

SEQ ID NO: 478448 - DNA, 20 bp, mouse
gctggaggatcgggacccag

SEQ ID NO: 478449 - DNA, 20 bp, mouse
gagcgggcgtcctcatacct

SEQ ID NO: 478450 - DNA, 20 bp, mouse
gtctgcctcggactcctcca

SEQ ID NO: 478451 - DNA, 20 bp, mouse
gtaagaacccgaaggatcca

SEQ ID NO: 478452 - DNA, 20 bp, mouse
gagccgggtcacgaacaggg

SEQ ID NO: 478453 - DNA, 20 bp, mouse
gacccgaaggatccagggta

SEQ ID NO: 478454 - DNA, 20 bp, mouse
ggcccgggcgctcaccttgg

SEQ ID NO: 478455 - DNA, 20 bp, mouse
ggctagggaccgggaccgcg

SEQ ID NO: 478456 - DNA, 20 bp, mouse
gcacgggctcgctccccagg

SEQ ID NO: 478457 - DNA, 20 bp, mouse
gtagcagccggggctgctct

SEQ ID NO: 478458 - DNA, 20 bp, mouse
gcgccgccaactgccccctg

SEQ ID NO: 478459 - DNA, 20 bp, mouse
gctccccagggggcagttgg

SEQ ID NO: 478460 - DNA, 20 bp, mouse
ggcctggtccggctatcctg

SEQ ID NO: 478461 - DNA, 20 bp, mouse
gccaagcaggcgtctcgcgg

SEQ ID NO: 478462 - DNA, 20 bp, mouse
gaccccaggatagccggacc

SEQ ID NO: 478463 - DNA, 20 bp, mouse
gactcacacgaaggatcggg

SEQ ID NO: 478464 - DNA, 20 bp, mouse
ggctaggccggcgcctgcgt

SEQ ID NO: 478465 - DNA, 20 bp, mouse
gcccctgcgggcgggagggt

SEQ ID NO: 478466 - DNA, 20 bp, mouse
ggaggctgagggacccgcca

SEQ ID NO: 478467 - DNA, 20 bp, mouse
gcacggctccgtcgtccgag

SEQ ID NO: 478468 - DNA, 20 bp, mouse
gctccgtcgtccgagaggca

SEQ ID NO: 478469 - DNA, 20 bp, mouse
gggccctgcctctcggacga

SEQ ID NO: 478470 - DNA, 20 bp, mouse
gggaccctcccgcccgctgg

SEQ ID NO: 478471 - DNA, 20 bp, mouse
ggaaagcggccagaatctgg

SEQ ID NO: 478472 - DNA, 20 bp, mouse
gcggatggccgacaagaaag

SEQ ID NO: 478473 - DNA, 20 bp, mouse
gggtgaggacgggcccccag

SEQ ID NO: 478474 - DNA, 20 bp, mouse
gacctcaagctagggtcacg

SEQ ID NO: 478475 - DNA, 20 bp, mouse
gccctggacacccccaatct

SEQ ID NO: 478476 - DNA, 20 bp, mouse
gttactacacatgggcaggt

SEQ ID NO: 478477 - DNA, 20 bp, mouse
gtgcacaccttactacacat

SEQ ID NO: 478478 - DNA, 20 bp, mouse
gttgtcctggggagtaaata

SEQ ID NO: 478479 - DNA, 20 bp, mouse
gagggcaacttgttaaggct

SEQ ID NO: 478480 - DNA, 20 bp, mouse
gggagcgacaggaccgggga

SEQ ID NO: 478481 - DNA, 20 bp, mouse
gacagggagcgacaggaccg

SEQ ID NO: 478482 - DNA, 20 bp, mouse
gtacccagggcaacttgtta

SEQ ID NO: 478483 - DNA, 20 bp, mouse
ggctggatgcggcgtaccca

SEQ ID NO: 478484 - DNA, 20 bp, mouse
ggagctcctcctgaagtcct

SEQ ID NO: 478485 - DNA, 20 bp, mouse
ggggcactgcggggacatgg

SEQ ID NO: 478486 - DNA, 20 bp, mouse
ggcagccacagccgcaggga

SEQ ID NO: 478487 - DNA, 20 bp, mouse
gtaatgcgcggtggctctcc

SEQ ID NO: 478488 - DNA, 20 bp, mouse
gggccgcagccacagccgca

SEQ ID NO: 478489 - DNA, 20 bp, mouse
gagccgcagggacggcagcc

SEQ ID NO: 478490 - DNA, 20 bp, mouse
gcgctttgcataatgcgcgg

SEQ ID NO: 478491 - DNA, 20 bp, mouse
ggcgcggcggcgcagcagtg

SEQ ID NO: 478492 - DNA, 20 bp, mouse
ggtgatgcctcccacgaagg

SEQ ID NO: 478493 - DNA, 20 bp, mouse
gactcccctggccctctcca

SEQ ID NO: 478494 - DNA, 20 bp, mouse
gaaacatggggaaccaggat

SEQ ID NO: 478495 - DNA, 20 bp, mouse
gcgcaggttggaaaacaccg

SEQ ID NO: 478496 - DNA, 20 bp, mouse
gtaggtggctctcggctcag

SEQ ID NO: 478497 - DNA, 20 bp, mouse
gccgggagcctggaagcgaa

SEQ ID NO: 478498 - DNA, 20 bp, mouse
gccgcccgctccctcggacg

SEQ ID NO: 478499 - DNA, 20 bp, mouse
ggcgcggcgtcccatcgcgg

SEQ ID NO: 478500 - DNA, 20 bp, mouse
gggggcgcggcgtcccatcg

SEQ ID NO: 478501 - DNA, 20 bp, mouse
ggcggccccgtccgagggag

SEQ ID NO: 478502 - DNA, 20 bp, mouse
gtcgcggcggccccgtccga

SEQ ID NO: 478503 - DNA, 20 bp, mouse
ggctgggtggggaccaccat

SEQ ID NO: 478504 - DNA, 20 bp, mouse
ggggcggcgaccgaggctcg

SEQ ID NO: 478505 - DNA, 20 bp, mouse
gagggagcgggcggcgaccg

SEQ ID NO: 478506 - DNA, 20 bp, mouse
gtgaggtgtcagcgccgctg

SEQ ID NO: 478507 - DNA, 20 bp, mouse
gtccgctcgctgtggggccg

SEQ ID NO: 478508 - DNA, 20 bp, mouse
ggctcgtccgcctctcgccc

SEQ ID NO: 478509 - DNA, 20 bp, mouse
gccgcccccgccggcacccg

SEQ ID NO: 478510 - DNA, 20 bp, mouse
ggcgaacgtccgctcgctgt

SEQ ID NO: 478511 - DNA, 20 bp, mouse
gcgggcatcggcagcttcaa

SEQ ID NO: 478512 - DNA, 20 bp, mouse
ggacccctcgcgaggcagag

SEQ ID NO: 478513 - DNA, 20 bp, mouse
gccgagagggggcattgtgt

SEQ ID NO: 478514 - DNA, 20 bp, mouse
gacgagcaggagcgcgcaag

SEQ ID NO: 478515 - DNA, 20 bp, mouse
ggcgggagcaccatgcggat

SEQ ID NO: 478516 - DNA, 20 bp, mouse
gctgcgaggcgccccctgag

SEQ ID NO: 478517 - DNA, 20 bp, mouse
ggattcctccgcccctcagg

SEQ ID NO: 478518 - DNA, 20 bp, mouse
ggcagcagcagcgggacgga

SEQ ID NO: 478519 - DNA, 20 bp, mouse
ggggaggagccaggtcggag

SEQ ID NO: 478520 - DNA, 20 bp, mouse
ggccctcagccgctccgacc

SEQ ID NO: 478521 - DNA, 20 bp, mouse
ggccggtctcaccagcacta

SEQ ID NO: 478522 - DNA, 20 bp, mouse
ggcagcagcgggacggaggg

SEQ ID NO: 478523 - DNA, 20 bp, mouse
ggcaacctggagagcaccga

SEQ ID NO: 478524 - DNA, 20 bp, mouse
ggctgagggccctggcgagg

SEQ ID NO: 478525 - DNA, 20 bp, mouse
ggggcgcctcgcagtccggc

SEQ ID NO: 478526 - DNA, 20 bp, mouse
gtgaagcgagtggcaattgt

SEQ ID NO: 478527 - DNA, 20 bp, mouse
gtcttccaggcagcacttga

SEQ ID NO: 478528 - DNA, 20 bp, mouse
gtgctcctctcgaagcaggt

SEQ ID NO: 478529 - DNA, 20 bp, mouse
gagaaacatggtgaagcgag

SEQ ID NO: 478530 - DNA, 20 bp, mouse
gttccctctgcagagaaaca

SEQ ID NO: 478531 - DNA, 20 bp, mouse
ggcagcacttgatggaggcc

SEQ ID NO: 478532 - DNA, 20 bp, mouse
gggcttaaagacccccagaa

SEQ ID NO: 478533 - DNA, 20 bp, mouse
gggagctggggtcagcggcc

SEQ ID NO: 478534 - DNA, 20 bp, mouse
gccacgagaaacccacaaag

SEQ ID NO: 478535 - DNA, 20 bp, mouse
gtgctgcctggaagaggggc

SEQ ID NO: 478536 - DNA, 20 bp, mouse
gagaagcacaaataaaggta

SEQ ID NO: 478537 - DNA, 20 bp, mouse
gtgacttaccacaggatggg

SEQ ID NO: 478538 - DNA, 20 bp, mouse
gctctccgcacacaaccctc

SEQ ID NO: 478539 - DNA, 20 bp, mouse
ggcagaagagttccccctga

SEQ ID NO: 478540 - DNA, 20 bp, mouse
gaagctgaggaggaagttct

SEQ ID NO: 478541 - DNA, 20 bp, mouse
gagtcagttacctgaccaca

SEQ ID NO: 478542 - DNA, 20 bp, mouse
ggggttgtgtgcggagagat

SEQ ID NO: 478543 - DNA, 20 bp, mouse
gaactattgacaggagacaa

SEQ ID NO: 478544 - DNA, 20 bp, mouse
gaaaggactgaagatatagg

SEQ ID NO: 478545 - DNA, 20 bp, mouse
gtccccctgagggttgtgtg

SEQ ID NO: 478546 - DNA, 20 bp, mouse
ggtttaaacacagagaagaa

SEQ ID NO: 478547 - DNA, 20 bp, mouse
gtcagagtccccagaagact

SEQ ID NO: 478548 - DNA, 20 bp, mouse
gttaaacccctagtcttctg

SEQ ID NO: 478549 - DNA, 20 bp, mouse
ggaatgggaaagcaacatag

SEQ ID NO: 478550 - DNA, 20 bp, mouse
gagtggtaaaacataaggat

SEQ ID NO: 478551 - DNA, 20 bp, mouse
gatcatgttgtataattccc

SEQ ID NO: 478552 - DNA, 20 bp, mouse
gaaaaagtgtagaaaggtag

SEQ ID NO: 478553 - DNA, 20 bp, mouse
ggatggatctacatttagtg

SEQ ID NO: 478554 - DNA, 20 bp, mouse
gggttgagaatgggtaagag

SEQ ID NO: 478555 - DNA, 20 bp, mouse
gaaattccttagctctgcaa

SEQ ID NO: 478556 - DNA, 20 bp, mouse
gtgccaggctatggacaaca

SEQ ID NO: 478557 - DNA, 20 bp, mouse
gtgatcaggtgagaagccaa

SEQ ID NO: 478558 - DNA, 20 bp, mouse
gagtttaacacaaaaaccgg

SEQ ID NO: 478559 - DNA, 20 bp, mouse
gctccctgttgtccatagcc

SEQ ID NO: 478560 - DNA, 20 bp, mouse
gccacaatctcggggtgcgg

SEQ ID NO: 478561 - DNA, 20 bp, mouse
gggcttcttctgccaggcta

SEQ ID NO: 478562 - DNA, 20 bp, mouse
gttcccaagagcagtttcta

SEQ ID NO: 478563 - DNA, 20 bp, mouse
gggttaaaggagatagaaag

SEQ ID NO: 478564 - DNA, 20 bp, mouse
ggtgagaagccaaaggtgag

SEQ ID NO: 478565 - DNA, 20 bp, mouse
gctgtgtgtgaccgacacgg

SEQ ID NO: 478566 - DNA, 20 bp, mouse
ggcggggaggtaccagctca

SEQ ID NO: 478567 - DNA, 20 bp, mouse
gaagaggtgtgtggggaccg

SEQ ID NO: 478568 - DNA, 20 bp, mouse
ggggcgctgctacactagtt

SEQ ID NO: 478569 - DNA, 20 bp, mouse
ggtgtagcagcgccctgagc

SEQ ID NO: 478570 - DNA, 20 bp, mouse
gatgtaacaagaggtgtgtg

SEQ ID NO: 478571 - DNA, 20 bp, mouse
gttgcaggcagcctacagag

SEQ ID NO: 478572 - DNA, 20 bp, mouse
gctggtacctccccgcgcca

SEQ ID NO: 478573 - DNA, 20 bp, mouse
gcaggccacagaaaagatct

SEQ ID NO: 478574 - DNA, 20 bp, mouse
gaggttccaagccctcttcc

SEQ ID NO: 478575 - DNA, 20 bp, mouse
gcccaaccagagaagcactc

SEQ ID NO: 478576 - DNA, 20 bp, mouse
gtctctgggaaggggaacaa

SEQ ID NO: 478577 - DNA, 20 bp, mouse
gacaaaggtgggtagttacg

SEQ ID NO: 478578 - DNA, 20 bp, mouse
gatgcaagggggtccacgta

SEQ ID NO: 478579 - DNA, 20 bp, mouse
gagggggtccacgtagggag

SEQ ID NO: 478580 - DNA, 20 bp, mouse
gacggtgctgtctggaggaa

SEQ ID NO: 478581 - DNA, 20 bp, mouse
gggaaaactgttggttctct

SEQ ID NO: 478582 - DNA, 20 bp, mouse
gcgctgagtgcctgatgctc

SEQ ID NO: 478583 - DNA, 20 bp, mouse
ggaagtggtggtccccgact

SEQ ID NO: 478584 - DNA, 20 bp, mouse
ggcaagaaagtggccatcgt

SEQ ID NO: 478585 - DNA, 20 bp, mouse
gagaatgaagtaatcaaaaa

SEQ ID NO: 478586 - DNA, 20 bp, mouse
gaaggtaccaacccttggga

SEQ ID NO: 478587 - DNA, 20 bp, mouse
gagtgaaggtaccaaccctt

SEQ ID NO: 478588 - DNA, 20 bp, mouse
gagtttggacttctggatga

SEQ ID NO: 478589 - DNA, 20 bp, mouse
ggtaccaacccttgggaagg

SEQ ID NO: 478590 - DNA, 20 bp, mouse
gtcagtttcctccttcccaa

SEQ ID NO: 478591 - DNA, 20 bp, mouse
gctcagaggacacctaacac

SEQ ID NO: 478592 - DNA, 20 bp, mouse
gaggaaactgaagtttagtt

SEQ ID NO: 478593 - DNA, 20 bp, mouse
gtttcctccttcccaagggt

SEQ ID NO: 478594 - DNA, 20 bp, mouse
gcacagaactgaatattgta

SEQ ID NO: 478595 - DNA, 20 bp, mouse
gaaatctaataaatgtctat

SEQ ID NO: 478596 - DNA, 20 bp, mouse
gcccaaggagaccagacaga

SEQ ID NO: 478597 - DNA, 20 bp, mouse
gcagggagctgtaggagaca

SEQ ID NO: 478598 - DNA, 20 bp, mouse
gatagggctgcacttacctt

SEQ ID NO: 478599 - DNA, 20 bp, mouse
gtgccacattctccaaccca

SEQ ID NO: 478600 - DNA, 20 bp, mouse
gtccttctgtctggtctcct

SEQ ID NO: 478601 - DNA, 20 bp, mouse
ggtgaccacgtccttctgtc

SEQ ID NO: 478602 - DNA, 20 bp, mouse
gagacttgcacactctccgt

SEQ ID NO: 478603 - DNA, 20 bp, mouse
gtgaagagatgcaacggcag

SEQ ID NO: 478604 - DNA, 20 bp, mouse
gaatacccacagggagctgt

SEQ ID NO: 478605 - DNA, 20 bp, mouse
gagaggcccccaatacccac

SEQ ID NO: 478606 - DNA, 20 bp, mouse
ggggccgcgcctgagagggc

SEQ ID NO: 478607 - DNA, 20 bp, mouse
ggggcagtgaagcaaacgga

SEQ ID NO: 478608 - DNA, 20 bp, mouse
gcctgcagcccacctcccgg

SEQ ID NO: 478609 - DNA, 20 bp, mouse
ggggcgggcagtgaagcaaa

SEQ ID NO: 478610 - DNA, 20 bp, mouse
gaggacggacgagaagatgg

SEQ ID NO: 478611 - DNA, 20 bp, mouse
gccgggagcccgcctccggg

SEQ ID NO: 478612 - DNA, 20 bp, mouse
gctcagtcagtcaggcgctg

SEQ ID NO: 478613 - DNA, 20 bp, mouse
gaccgcacgccccccggcag

SEQ ID NO: 478614 - DNA, 20 bp, mouse
ggagcccgcctccgggaggt

SEQ ID NO: 478615 - DNA, 20 bp, mouse
gcccttggcctcagtcagtc

SEQ ID NO: 478616 - DNA, 20 bp, mouse
gcgtcactatcacctcaggt

SEQ ID NO: 478617 - DNA, 20 bp, mouse
ggagcagtccagaacctcct

SEQ ID NO: 478618 - DNA, 20 bp, mouse
gtctctaaccagccaacctg

SEQ ID NO: 478619 - DNA, 20 bp, mouse
gctggactgctcgcaagcgg

SEQ ID NO: 478620 - DNA, 20 bp, mouse
gggtgcgtcactatcacctc

SEQ ID NO: 478621 - DNA, 20 bp, mouse
ggcctccgagtgccgaccag

SEQ ID NO: 478622 - DNA, 20 bp, mouse
gcgatccgaaggcatgttgg

SEQ ID NO: 478623 - DNA, 20 bp, mouse
gcttcgatccgaaggcatgt

SEQ ID NO: 478624 - DNA, 20 bp, mouse
gggcccctgatacatactga

SEQ ID NO: 478625 - DNA, 20 bp, mouse
ggtccagaagccaaaccgag

SEQ ID NO: 478626 - DNA, 20 bp, mouse
gacgccggtaaggagatgga

SEQ ID NO: 478627 - DNA, 20 bp, mouse
gcacccgctgcgctgcacag

SEQ ID NO: 478628 - DNA, 20 bp, mouse
ggttgtccggctcacaccct

SEQ ID NO: 478629 - DNA, 20 bp, mouse
ggagaggaccagaagttgtc

SEQ ID NO: 478630 - DNA, 20 bp, mouse
gggttgagccccaagagcag

SEQ ID NO: 478631 - DNA, 20 bp, mouse
gcaggggtccgggacccggg

SEQ ID NO: 478632 - DNA, 20 bp, mouse
gcgctgcacagggggagaaa

SEQ ID NO: 478633 - DNA, 20 bp, mouse
gaggagcccagggtgtgagc

SEQ ID NO: 478634 - DNA, 20 bp, mouse
ggcctgcgggaaaagtcctg

SEQ ID NO: 478635 - DNA, 20 bp, mouse
ggtgtgagccggacaacttc

SEQ ID NO: 478636 - DNA, 20 bp, mouse
gccccctccggagctcccaa

SEQ ID NO: 478637 - DNA, 20 bp, mouse
gtctgcacctcaactctcca

SEQ ID NO: 478638 - DNA, 20 bp, mouse
gccaaaggcccgcagtgttg

SEQ ID NO: 478639 - DNA, 20 bp, mouse
gcagagcagagaccagacat

SEQ ID NO: 478640 - DNA, 20 bp, mouse
gtgaggtgcagaatgcggtc

SEQ ID NO: 478641 - DNA, 20 bp, mouse
gatgcggtcaggtgacgcag

SEQ ID NO: 478642 - DNA, 20 bp, mouse
ggtcaggtgacgcagaggag

SEQ ID NO: 478643 - DNA, 20 bp, mouse
gtcgctgatgcagccccctc

SEQ ID NO: 478644 - DNA, 20 bp, mouse
ggggccactgtcagtgtagt

SEQ ID NO: 478645 - DNA, 20 bp, mouse
ggtggtggaggaactagacc

SEQ ID NO: 478646 - DNA, 20 bp, mouse
gctccaggcctgaactgggt

SEQ ID NO: 478647 - DNA, 20 bp, mouse
ggcctgaactgggtcggctg

SEQ ID NO: 478648 - DNA, 20 bp, mouse
gtctgctccaggcctgaact

SEQ ID NO: 478649 - DNA, 20 bp, mouse
gggagcagaagcgggtacag

SEQ ID NO: 478650 - DNA, 20 bp, mouse
gggctggggaactgctctca

SEQ ID NO: 478651 - DNA, 20 bp, mouse
gatggagaccctgcttaagc

SEQ ID NO: 478652 - DNA, 20 bp, mouse
gaagctacgggtcactcggg

SEQ ID NO: 478653 - DNA, 20 bp, mouse
gtgcagctcggtcaaagcta

SEQ ID NO: 478654 - DNA, 20 bp, mouse
ggcagaagcgggtacagggg

SEQ ID NO: 478655 - DNA, 20 bp, mouse
gttgacccgaggctaaaatg

SEQ ID NO: 478656 - DNA, 20 bp, mouse
gctccgcgcggagcgacgag

SEQ ID NO: 478657 - DNA, 20 bp, mouse
ggacgagaggttgcgagctc

SEQ ID NO: 478658 - DNA, 20 bp, mouse
gtgcgagctcgggctagagg

SEQ ID NO: 478659 - DNA, 20 bp, mouse
ggtccctgcaccatgagctg

SEQ ID NO: 478660 - DNA, 20 bp, mouse
gcgctccgcgcggagcaaaa

SEQ ID NO: 478661 - DNA, 20 bp, mouse
gtgagctctgggtgagtgag

SEQ ID NO: 478662 - DNA, 20 bp, mouse
gcgcggagcaaaatggcccg

SEQ ID NO: 478663 - DNA, 20 bp, mouse
gctcgggctagaggaggcgc

SEQ ID NO: 478664 - DNA, 20 bp, mouse
gggttgcgagctcgggctag

SEQ ID NO: 478665 - DNA, 20 bp, mouse
ggccccgcaccggagctgag

SEQ ID NO: 478666 - DNA, 20 bp, mouse
gcgaggcagacgctgaggag

SEQ ID NO: 478667 - DNA, 20 bp, mouse
gacgctgaggaggggaaagt

SEQ ID NO: 478668 - DNA, 20 bp, mouse
gtcactggggaacccggtgg

SEQ ID NO: 478669 - DNA, 20 bp, mouse
gctggggaacccggtggtgg

SEQ ID NO: 478670 - DNA, 20 bp, mouse
ggggctctcgcggcacaaag

SEQ ID NO: 478671 - DNA, 20 bp, mouse
ggtggtggcggcagctttcg

SEQ ID NO: 478672 - DNA, 20 bp, mouse
gtctcactcactggggaacc

SEQ ID NO: 478673 - DNA, 20 bp, mouse
gcgtccgcaaagtcaggcag

SEQ ID NO: 478674 - DNA, 20 bp, mouse
gccgagctgtgggtgagtgt

SEQ ID NO: 478675 - DNA, 20 bp, mouse
ggggaaagtcgggacgagag

SEQ ID NO: 478676 - DNA, 20 bp, mouse
ggagcgcgagcagcgaacga

SEQ ID NO: 478677 - DNA, 20 bp, mouse
gatggggaagaagtcccggg

SEQ ID NO: 478678 - DNA, 20 bp, mouse
gtctgaaggcgagtcctctg

SEQ ID NO: 478679 - DNA, 20 bp, mouse
gtgctgctccgaggacccgg

SEQ ID NO: 478680 - DNA, 20 bp, mouse
gcgcgctccggctcatgatg

SEQ ID NO: 478681 - DNA, 20 bp, mouse
ggagctgcaggataggcctg

SEQ ID NO: 478682 - DNA, 20 bp, mouse
gctgcggccgggtaccgccc

SEQ ID NO: 478683 - DNA, 20 bp, mouse
ggaacgacggcagattagtg

SEQ ID NO: 478684 - DNA, 20 bp, mouse
ggagtcctctggggcagcgg

SEQ ID NO: 478685 - DNA, 20 bp, mouse
gacccggtggagagagctgc

SEQ ID NO: 478686 - DNA, 20 bp, mouse
ggatgcagcataaaaaggtt

SEQ ID NO: 478687 - DNA, 20 bp, mouse
gctctggatgcagcataaaa

SEQ ID NO: 478688 - DNA, 20 bp, mouse
gatgacaataagatcatctc

SEQ ID NO: 478689 - DNA, 20 bp, mouse
ggattgcagagtccaagatt

SEQ ID NO: 478690 - DNA, 20 bp, mouse
gagacagttggagaattcat

SEQ ID NO: 478691 - DNA, 20 bp, mouse
gtcatgggtgaacagcaagt

SEQ ID NO: 478692 - DNA, 20 bp, mouse
gtgtcttaggataggaaatt

SEQ ID NO: 478693 - DNA, 20 bp, mouse
gtcagtccagacacacggca

SEQ ID NO: 478694 - DNA, 20 bp, mouse
ggaaattcggtctagtatat

SEQ ID NO: 478695 - DNA, 20 bp, mouse
gattggcagaagaaggttgt

SEQ ID NO: 478696 - DNA, 20 bp, mouse
ggccaggagcggtcgcctag

SEQ ID NO: 478697 - DNA, 20 bp, mouse
ggggcagcgggtggcctcag

SEQ ID NO: 478698 - DNA, 20 bp, mouse
gcggtgtcctgtgcgagcgg

SEQ ID NO: 478699 - DNA, 20 bp, mouse
gcccagagtgacaagcgggt

SEQ ID NO: 478700 - DNA, 20 bp, mouse
gtggcctcagtggcagagcg

SEQ ID NO: 478701 - DNA, 20 bp, mouse
gacaccggacacccagccac

SEQ ID NO: 478702 - DNA, 20 bp, mouse
gccgcgcctgctgctcaggg

SEQ ID NO: 478703 - DNA, 20 bp, mouse
ggtcagggcgtgctaggtgt

SEQ ID NO: 478704 - DNA, 20 bp, mouse
gcgctcctggccacgcaccg

SEQ ID NO: 478705 - DNA, 20 bp, mouse
ggctgcaccgccgctcgcac

SEQ ID NO: 478706 - DNA, 20 bp, mouse
gggctccgtagtaatcatgg

SEQ ID NO: 478707 - DNA, 20 bp, mouse
ggccgccgccatgattacta

SEQ ID NO: 478708 - DNA, 20 bp, mouse
gcccggctccgtagtaatca

SEQ ID NO: 478709 - DNA, 20 bp, mouse
gtccgtagtaatcatggcgg

SEQ ID NO: 478710 - DNA, 20 bp, mouse
gtcggagcggcgggattcgg

SEQ ID NO: 478711 - DNA, 20 bp, mouse
gttactacggagccgggagg

SEQ ID NO: 478712 - DNA, 20 bp, mouse
ggcggcattcgcggtccctc

SEQ ID NO: 478713 - DNA, 20 bp, mouse
gacagaaagcgggagctacg

SEQ ID NO: 478714 - DNA, 20 bp, mouse
gaagcgggagctacgcggag

SEQ ID NO: 478715 - DNA, 20 bp, mouse
gcactgggcgcgccgactcc

SEQ ID NO: 478716 - DNA, 20 bp, mouse
gaggaggcggcggagagcag

SEQ ID NO: 478717 - DNA, 20 bp, mouse
ggggacccgagagcgactgt

SEQ ID NO: 478718 - DNA, 20 bp, mouse
gacccgagagcgactgtggg

SEQ ID NO: 478719 - DNA, 20 bp, mouse
gctggtagttatttgagcag

SEQ ID NO: 478720 - DNA, 20 bp, mouse
gctaccaggagggtttgatg

SEQ ID NO: 478721 - DNA, 20 bp, mouse
ggttatttgagcagcggcgg

SEQ ID NO: 478722 - DNA, 20 bp, mouse
gctcccctcaggctgaaacg

SEQ ID NO: 478723 - DNA, 20 bp, mouse
ggaggtaaggcgtgcgggag

SEQ ID NO: 478724 - DNA, 20 bp, mouse
gcgctcgctcgggaagaaag

SEQ ID NO: 478725 - DNA, 20 bp, mouse
ggcacgccttacctcccctc

SEQ ID NO: 478726 - DNA, 20 bp, mouse
gtgctggggccgactcgagg

SEQ ID NO: 478727 - DNA, 20 bp, mouse
gggagctggcgggacctatg

SEQ ID NO: 478728 - DNA, 20 bp, mouse
ggccgactcgaggaggtgag

SEQ ID NO: 478729 - DNA, 20 bp, mouse
ggagcagtagaaggtccatg

SEQ ID NO: 478730 - DNA, 20 bp, mouse
ggctgggatgctgatggata

SEQ ID NO: 478731 - DNA, 20 bp, mouse
gaggtccatgcggcacccaa

SEQ ID NO: 478732 - DNA, 20 bp, mouse
gtcccctcacctcctcgagt

SEQ ID NO: 478733 - DNA, 20 bp, mouse
ggccaccggacgcgaggcac

SEQ ID NO: 478734 - DNA, 20 bp, mouse
gcgctgctggggccgactcg

SEQ ID NO: 478735 - DNA, 20 bp, mouse
gggcacaggagagcagtaga

SEQ ID NO: 478736 - DNA, 20 bp, mouse
gccagctctgcagaaggcgg

SEQ ID NO: 478737 - DNA, 20 bp, mouse
ggccgagctgcgggcagaga

SEQ ID NO: 478738 - DNA, 20 bp, mouse
gcagcgggatgtgaccgtcc

SEQ ID NO: 478739 - DNA, 20 bp, mouse
gcgtcccagcccggctgcag

SEQ ID NO: 478740 - DNA, 20 bp, mouse
gaggccagcgcgtcccagcc

SEQ ID NO: 478741 - DNA, 20 bp, mouse
ggcgggccggtgtcagaatg

SEQ ID NO: 478742 - DNA, 20 bp, mouse
ggccttctgcagagctggcc

SEQ ID NO: 478743 - DNA, 20 bp, mouse
gccgccaaggcgggcagcga

SEQ ID NO: 478744 - DNA, 20 bp, mouse
gccgaccacgaggacccggg

SEQ ID NO: 478745 - DNA, 20 bp, mouse
gggtgcagaggacagtgcgg

SEQ ID NO: 478746 - DNA, 20 bp, mouse
ggacagcgactcccgcgcgg

SEQ ID NO: 478747 - DNA, 20 bp, mouse
ggcagacgcagcctagccac

SEQ ID NO: 478748 - DNA, 20 bp, mouse
ggcggacagcgactcccgcg

SEQ ID NO: 478749 - DNA, 20 bp, mouse
ggaggcgctagggtcaggtt

SEQ ID NO: 478750 - DNA, 20 bp, mouse
ggccccccaggcgcccgacg

SEQ ID NO: 478751 - DNA, 20 bp, mouse
gccccgcgccgcctgcatat

SEQ ID NO: 478752 - DNA, 20 bp, mouse
ggccaggcgcacggccctgg

SEQ ID NO: 478753 - DNA, 20 bp, mouse
gcaggcgcccgacgtggacg

SEQ ID NO: 478754 - DNA, 20 bp, mouse
gtccacgtcgggcgcctggg

SEQ ID NO: 478755 - DNA, 20 bp, mouse
ggacgcagcctagccacagg

SEQ ID NO: 478756 - DNA, 20 bp, mouse
ggagcgctggtgctctccaa

SEQ ID NO: 478757 - DNA, 20 bp, mouse
gagcgctcacctgtaactag

SEQ ID NO: 478758 - DNA, 20 bp, mouse
gccccagtgcccctagttac

SEQ ID NO: 478759 - DNA, 20 bp, mouse
gtgaaagctgtagagtgaag

SEQ ID NO: 478760 - DNA, 20 bp, mouse
gaaggctgcggctaacaaga

SEQ ID NO: 478761 - DNA, 20 bp, mouse
gagtgaagtggccgcaaagc

SEQ ID NO: 478762 - DNA, 20 bp, mouse
ggaagaccaaagactcctgg

SEQ ID NO: 478763 - DNA, 20 bp, mouse
gcacctgtaactaggggcac

SEQ ID NO: 478764 - DNA, 20 bp, mouse
gctgcggctaacaagatggc

SEQ ID NO: 478765 - DNA, 20 bp, mouse
ggtacagcacaaaaacacag

SEQ ID NO: 478766 - DNA, 20 bp, mouse
gtggttgtcctggagggtgg

SEQ ID NO: 478767 - DNA, 20 bp, mouse
ggccagctggttgtcctgga

SEQ ID NO: 478768 - DNA, 20 bp, mouse
gtaccgtcgccatctggtgt

SEQ ID NO: 478769 - DNA, 20 bp, mouse
gagcttggccagcttctcag

SEQ ID NO: 478770 - DNA, 20 bp, mouse
ggtcgccatctggtgtgggt

SEQ ID NO: 478771 - DNA, 20 bp, mouse
gctggtgtgggtggggcgca

SEQ ID NO: 478772 - DNA, 20 bp, mouse
gaccggtccatggctaccaa

SEQ ID NO: 478773 - DNA, 20 bp, mouse
gcactgtggtgggtccttca

SEQ ID NO: 478774 - DNA, 20 bp, mouse
gcggtattctgtaaagtggg

SEQ ID NO: 478775 - DNA, 20 bp, mouse
gaggaaggtcagctagaatg

SEQ ID NO: 478776 - DNA, 20 bp, mouse
gcgacagtgggattactcag

SEQ ID NO: 478777 - DNA, 20 bp, mouse
gcatcaaggagagcctggtg

SEQ ID NO: 478778 - DNA, 20 bp, mouse
gtggtgagtgagaaacatca

SEQ ID NO: 478779 - DNA, 20 bp, mouse
ggagagcctggtgcggagga

SEQ ID NO: 478780 - DNA, 20 bp, mouse
gccggagcggaccggatccc

SEQ ID NO: 478781 - DNA, 20 bp, mouse
gggtccgctccggctcagag

SEQ ID NO: 478782 - DNA, 20 bp, mouse
gggactggatagctaaaaat

SEQ ID NO: 478783 - DNA, 20 bp, mouse
gagggagaagctcgtcacct

SEQ ID NO: 478784 - DNA, 20 bp, mouse
gcacagcctggcccctctcc

SEQ ID NO: 478785 - DNA, 20 bp, mouse
gtcacactctgcctggagag

SEQ ID NO: 478786 - DNA, 20 bp, mouse
gatgactgaggcgcccatgg

SEQ ID NO: 478787 - DNA, 20 bp, mouse
ggctggccgccgcaagactg

SEQ ID NO: 478788 - DNA, 20 bp, mouse
gtcggctgggagctcgcagg

SEQ ID NO: 478789 - DNA, 20 bp, mouse
gagactggggtcgctcggct

SEQ ID NO: 478790 - DNA, 20 bp, mouse
gagcctagcgaagagggcag

SEQ ID NO: 478791 - DNA, 20 bp, mouse
gactgaggcgcccatggggg

SEQ ID NO: 478792 - DNA, 20 bp, mouse
gccgagggctgcggatcaca

SEQ ID NO: 478793 - DNA, 20 bp, mouse
gccgcaagactggggtcgct

SEQ ID NO: 478794 - DNA, 20 bp, mouse
gcgaggccgcgacccctcgg

SEQ ID NO: 478795 - DNA, 20 bp, mouse
gcatatgactgaggcgccca

SEQ ID NO: 478796 - DNA, 20 bp, mouse
gcgtgttgggaggaatacaa

SEQ ID NO: 478797 - DNA, 20 bp, mouse
gagagaggagtgggcgatgg

SEQ ID NO: 478798 - DNA, 20 bp, mouse
gtgggaggaatacaagggag

SEQ ID NO: 478799 - DNA, 20 bp, mouse
ggaggagtgggcgatggagg

SEQ ID NO: 478800 - DNA, 20 bp, mouse
gatacaagggagtgggagag

SEQ ID NO: 478801 - DNA, 20 bp, mouse
ggagcgcaggcgatgaagag

SEQ ID NO: 478802 - DNA, 20 bp, mouse
gcgcggagagggcagcacga

SEQ ID NO: 478803 - DNA, 20 bp, mouse
gcctccctacgagcctctcc

SEQ ID NO: 478804 - DNA, 20 bp, mouse
ggaggctcgtagggaggagt

SEQ ID NO: 478805 - DNA, 20 bp, mouse
gctgcagcggacggaaggtg

SEQ ID NO: 478806 - DNA, 20 bp, mouse
ggattccccgaccccctcgg

SEQ ID NO: 478807 - DNA, 20 bp, mouse
gcgagatggcggccaccgag

SEQ ID NO: 478808 - DNA, 20 bp, mouse
ggagggggtcggggaatctg

SEQ ID NO: 478809 - DNA, 20 bp, mouse
ggctgcggacggaggcgaga

SEQ ID NO: 478810 - DNA, 20 bp, mouse
ggcggacggaggcgagatgg

SEQ ID NO: 478811 - DNA, 20 bp, mouse
gccaccacctctgctgcgga

SEQ ID NO: 478812 - DNA, 20 bp, mouse
gacctgtacaagacataggt

SEQ ID NO: 478813 - DNA, 20 bp, mouse
gcctccgtccgcagcagagg

SEQ ID NO: 478814 - DNA, 20 bp, mouse
gtccaccaccacctctgctg

SEQ ID NO: 478815 - DNA, 20 bp, mouse
ggcggccaccgagggggtcg

SEQ ID NO: 478816 - DNA, 20 bp, mouse
gagagctgcgagcgctgtat

SEQ ID NO: 478817 - DNA, 20 bp, mouse
gaactcgaagaagccatgat

SEQ ID NO: 478818 - DNA, 20 bp, mouse
gctcgcagctctcccgatca

SEQ ID NO: 478819 - DNA, 20 bp, mouse
gagcggttctgaccaaacag

SEQ ID NO: 478820 - DNA, 20 bp, mouse
ggaagatggaggacaataat

SEQ ID NO: 478821 - DNA, 20 bp, mouse
gcaggtgaggtggcaggact

SEQ ID NO: 478822 - DNA, 20 bp, mouse
gcggttgcaagacgactcag

SEQ ID NO: 478823 - DNA, 20 bp, mouse
ggctctaggcgcccagactg

SEQ ID NO: 478824 - DNA, 20 bp, mouse
gggttctgaccaaacagggg

SEQ ID NO: 478825 - DNA, 20 bp, mouse
gggaggacaataataggtga

SEQ ID NO: 478826 - DNA, 20 bp, mouse
gcgtgggacacgtcaggcac

SEQ ID NO: 478827 - DNA, 20 bp, mouse
gcccgcggcggagcatgtgg

SEQ ID NO: 478828 - DNA, 20 bp, mouse
gagaagtgaggtaagccatg

SEQ ID NO: 478829 - DNA, 20 bp, mouse
ggcggtgcgtgggacacgtc

SEQ ID NO: 478830 - DNA, 20 bp, mouse
ggtggctgaccgtccaccgg

SEQ ID NO: 478831 - DNA, 20 bp, mouse
gggcgtggctgaccgtccac

SEQ ID NO: 478832 - DNA, 20 bp, mouse
gttcgctggaccagcaatag

SEQ ID NO: 478833 - DNA, 20 bp, mouse
ggctgcagccggacccgatg

SEQ ID NO: 478834 - DNA, 20 bp, mouse
ggacaggacccgcctccgag

SEQ ID NO: 478835 - DNA, 20 bp, mouse
gcagcgaccgggttaaggag

SEQ ID NO: 478836 - DNA, 20 bp, mouse
gacccgcagaatctctgcag

SEQ ID NO: 478837 - DNA, 20 bp, mouse
gcggtgtcccaggacctccg

SEQ ID NO: 478838 - DNA, 20 bp, mouse
gctgcaggacagagactccg

SEQ ID NO: 478839 - DNA, 20 bp, mouse
gcaggacagagactccgcgg

SEQ ID NO: 478840 - DNA, 20 bp, mouse
gttcccaggggaatagcagt

SEQ ID NO: 478841 - DNA, 20 bp, mouse
gccaggggaatagcagtggg

SEQ ID NO: 478842 - DNA, 20 bp, mouse
ggagatgtggaacgcactgc

SEQ ID NO: 478843 - DNA, 20 bp, mouse
ggtgcagaagcgaaggaaca

SEQ ID NO: 478844 - DNA, 20 bp, mouse
gtacaagagtgcagaagcga

SEQ ID NO: 478845 - DNA, 20 bp, mouse
gtccactgcagagattctgc

SEQ ID NO: 478846 - DNA, 20 bp, mouse
gtgaagatcacaacaggttg

SEQ ID NO: 478847 - DNA, 20 bp, mouse
gacagaaccagggacctcct

SEQ ID NO: 478848 - DNA, 20 bp, mouse
gagagagacaggctcccagg

SEQ ID NO: 478849 - DNA, 20 bp, mouse
gtccagatcagcctgctgac

SEQ ID NO: 478850 - DNA, 20 bp, mouse
gcgtgtgtggccccagagga

SEQ ID NO: 478851 - DNA, 20 bp, mouse
gtcagcctgctgactgggga

SEQ ID NO: 478852 - DNA, 20 bp, mouse
ggggtagcaagacagaacca

SEQ ID NO: 478853 - DNA, 20 bp, mouse
ggtctactgaagatcacaac

SEQ ID NO: 478854 - DNA, 20 bp, mouse
gtggcagtggccagggcgaa

SEQ ID NO: 478855 - DNA, 20 bp, mouse
gtgtgcgtgtgtggccccag

SEQ ID NO: 478856 - DNA, 20 bp, mouse
ggagccatgtcagaccctga

SEQ ID NO: 478857 - DNA, 20 bp, mouse
gctgccttcagggtctgaca

SEQ ID NO: 478858 - DNA, 20 bp, mouse
gtaggacgaagggtgatgtg

SEQ ID NO: 478859 - DNA, 20 bp, mouse
ggtgatgtgtggctgactaa

SEQ ID NO: 478860 - DNA, 20 bp, mouse
gtggctgactaagggctcgt

SEQ ID NO: 478861 - DNA, 20 bp, mouse
gcaacaactgcacagtcatc

SEQ ID NO: 478862 - DNA, 20 bp, mouse
gacgcctctgggagtctcag

SEQ ID NO: 478863 - DNA, 20 bp, mouse
gaccgaaggtctcctcaggt

SEQ ID NO: 478864 - DNA, 20 bp, mouse
gttcggccatccacatcacc

SEQ ID NO: 478865 - DNA, 20 bp, mouse
gcacgaccaggtaggacgaa

SEQ ID NO: 478866 - DNA, 20 bp, mouse
gcttctgggagcgcacatag

SEQ ID NO: 478867 - DNA, 20 bp, mouse
gcacataggggtatccgagt

SEQ ID NO: 478868 - DNA, 20 bp, mouse
gacctagggagaggccaact

SEQ ID NO: 478869 - DNA, 20 bp, mouse
gtcattcaataatataatgt

SEQ ID NO: 478870 - DNA, 20 bp, mouse
gcagccccacatagaagctt

SEQ ID NO: 478871 - DNA, 20 bp, mouse
gccagaagctaaggacattg

SEQ ID NO: 478872 - DNA, 20 bp, mouse
gtattgaatgaatagttgat

SEQ ID NO: 478873 - DNA, 20 bp, mouse
gcaaggacatatagggtact

SEQ ID NO: 478874 - DNA, 20 bp, mouse
ggaggtaagatcttccaagt

SEQ ID NO: 478875 - DNA, 20 bp, mouse
gatagaagctttggtaagca

SEQ ID NO: 478876 - DNA, 20 bp, mouse
ggcaggtcatggcacagtgg

SEQ ID NO: 478877 - DNA, 20 bp, mouse
gttctctctgtggcaggtca

SEQ ID NO: 478878 - DNA, 20 bp, mouse
ggtggcaggtcatggcacag

SEQ ID NO: 478879 - DNA, 20 bp, mouse
ggactgcccacaaccccaag

SEQ ID NO: 478880 - DNA, 20 bp, mouse
gtaccatgggcttctctctg

SEQ ID NO: 478881 - DNA, 20 bp, mouse
ggtggtggcagatcctcttg

SEQ ID NO: 478882 - DNA, 20 bp, mouse
ggtttgtcccctgccaaggt

SEQ ID NO: 478883 - DNA, 20 bp, mouse
gtgggcagtcctacccacct

SEQ ID NO: 478884 - DNA, 20 bp, mouse
gagcgctggcccaggggcta

SEQ ID NO: 478885 - DNA, 20 bp, mouse
ggtcctacccaccttggcag

SEQ ID NO: 478886 - DNA, 20 bp, mouse
gtctgaagacaatgctgagg

SEQ ID NO: 478887 - DNA, 20 bp, mouse
gcaggagggccctgccttga

SEQ ID NO: 478888 - DNA, 20 bp, mouse
gtcacctctttggcatcagg

SEQ ID NO: 478889 - DNA, 20 bp, mouse
gggcaaacccggcttcagga

SEQ ID NO: 478890 - DNA, 20 bp, mouse
gctgaggtagactactactc

SEQ ID NO: 478891 - DNA, 20 bp, mouse
ggctaaactgctgatgtgta

SEQ ID NO: 478892 - DNA, 20 bp, mouse
gctcactgccaggacttcat

SEQ ID NO: 478893 - DNA, 20 bp, mouse
gcgcccctctgctagaacaa

SEQ ID NO: 478894 - DNA, 20 bp, mouse
gctattctgaaagaccggga

SEQ ID NO: 478895 - DNA, 20 bp, mouse
gaaagaggtgagcgggctga

SEQ ID NO: 478896 - DNA, 20 bp, mouse
gagctggtgagtgcattgag

SEQ ID NO: 478897 - DNA, 20 bp, mouse
gcgtacgcactggagaggcg

SEQ ID NO: 478898 - DNA, 20 bp, mouse
gaccagcagccgttgaaaaa

SEQ ID NO: 478899 - DNA, 20 bp, mouse
ggggtggcagggcccaccag

SEQ ID NO: 478900 - DNA, 20 bp, mouse
ggtcccttcctccagctcaa

SEQ ID NO: 478901 - DNA, 20 bp, mouse
gccgtgcgtacgcactggag

SEQ ID NO: 478902 - DNA, 20 bp, mouse
gctgttacggaactgaaagc

SEQ ID NO: 478903 - DNA, 20 bp, mouse
ggagagccgtgcgtacgcac

SEQ ID NO: 478904 - DNA, 20 bp, mouse
ggggcgctgtctgctcagta

SEQ ID NO: 478905 - DNA, 20 bp, mouse
gttgtcccctcaggacctct

SEQ ID NO: 478906 - DNA, 20 bp, mouse
ggaagactggatagagccgg

SEQ ID NO: 478907 - DNA, 20 bp, mouse
gagcccggcaaggggtccag

SEQ ID NO: 478908 - DNA, 20 bp, mouse
gcagtcgcggttggagtagt

SEQ ID NO: 478909 - DNA, 20 bp, mouse
gccacggaggagaccagagt

SEQ ID NO: 478910 - DNA, 20 bp, mouse
gagcgagcaactgagaagac

SEQ ID NO: 478911 - DNA, 20 bp, mouse
ggaggcgctactgcagcggg

SEQ ID NO: 478912 - DNA, 20 bp, mouse
gggggtccaggggtagacac

SEQ ID NO: 478913 - DNA, 20 bp, mouse
ggaaggagtcggctggggaa

SEQ ID NO: 478914 - DNA, 20 bp, mouse
gaccctcagcgcggacctgg

SEQ ID NO: 478915 - DNA, 20 bp, mouse
gctggagaaggagtcggctg

SEQ ID NO: 478916 - DNA, 20 bp, mouse
ggcttgctggacttgactac

SEQ ID NO: 478917 - DNA, 20 bp, mouse
gccggggacacgcggagccg

SEQ ID NO: 478918 - DNA, 20 bp, mouse
ggaagcgtcccaagaaatga

SEQ ID NO: 478919 - DNA, 20 bp, mouse
ggactggagcggctacgccg

SEQ ID NO: 478920 - DNA, 20 bp, mouse
gttcattcataagactggag

SEQ ID NO: 478921 - DNA, 20 bp, mouse
ggtacagcggcggtctgaag

SEQ ID NO: 478922 - DNA, 20 bp, mouse
gtgggacgcttcgacaggat

SEQ ID NO: 478923 - DNA, 20 bp, mouse
gtgaagcgcacgctgcaccg

SEQ ID NO: 478924 - DNA, 20 bp, mouse
gctttcaggaggtacagcgg

SEQ ID NO: 478925 - DNA, 20 bp, mouse
gggcggtctgaaggggatct

SEQ ID NO: 478926 - DNA, 20 bp, mouse
gggcatgtaccgagactacg

SEQ ID NO: 478927 - DNA, 20 bp, mouse
gctaccgaacatccagccca

SEQ ID NO: 478928 - DNA, 20 bp, mouse
gtagtctcggtacatgccct

SEQ ID NO: 478929 - DNA, 20 bp, mouse
gcagtcagctagggagatac

SEQ ID NO: 478930 - DNA, 20 bp, mouse
ggaccgtaacggagacggag

SEQ ID NO: 478931 - DNA, 20 bp, mouse
ggaaccgggaccgagctccg

SEQ ID NO: 478932 - DNA, 20 bp, mouse
gctgcgcggggcgaccgtac

SEQ ID NO: 478933 - DNA, 20 bp, mouse
gagaaccgcagccgccaacg

SEQ ID NO: 478934 - DNA, 20 bp, mouse
gtcggtagggtccgcgttgg

SEQ ID NO: 478935 - DNA, 20 bp, mouse
gtcccggttccccgtagtct

SEQ ID NO: 478936 - DNA, 20 bp, mouse
gccgggatgtcccctaacca

SEQ ID NO: 478937 - DNA, 20 bp, mouse
gtgcggtgcgcggcgatcgg

SEQ ID NO: 478938 - DNA, 20 bp, mouse
gtcccctaaccaaggcagac

SEQ ID NO: 478939 - DNA, 20 bp, mouse
ggacaggaggcagcgacact

SEQ ID NO: 478940 - DNA, 20 bp, mouse
ggcagagcagaaacgaagtg

SEQ ID NO: 478941 - DNA, 20 bp, mouse
ggtgggagcaagaagagggt

SEQ ID NO: 478942 - DNA, 20 bp, mouse
ggggggccggagaggaaaca

SEQ ID NO: 478943 - DNA, 20 bp, mouse
gccaccgctggagtaggact

SEQ ID NO: 478944 - DNA, 20 bp, mouse
gtcctctccggcccccaccg

SEQ ID NO: 478945 - DNA, 20 bp, mouse
gcggtggacaaccggttccg

SEQ ID NO: 478946 - DNA, 20 bp, mouse
ggggcagcgccggggacagg

SEQ ID NO: 478947 - DNA, 20 bp, mouse
ggcctccgcgggaagtgagc

SEQ ID NO: 478948 - DNA, 20 bp, mouse
ggccgcccgctcacttcccg

SEQ ID NO: 478949 - DNA, 20 bp, mouse
ggcccgctcacttcccgcgg

SEQ ID NO: 478950 - DNA, 20 bp, mouse
gttcccgcggaggcgctgcc

SEQ ID NO: 478951 - DNA, 20 bp, mouse
gagcgctccggtgaccgcag

SEQ ID NO: 478952 - DNA, 20 bp, mouse
gccctgtgcggagcgacggg

SEQ ID NO: 478953 - DNA, 20 bp, mouse
ggacgaggaggtgggcactc

SEQ ID NO: 478954 - DNA, 20 bp, mouse
gaggtgcgagcgtctttgtg

SEQ ID NO: 478955 - DNA, 20 bp, mouse
gcaaccctgtgcggagcgac

SEQ ID NO: 478956 - DNA, 20 bp, mouse
gcagggcaagagcttacctc

SEQ ID NO: 478957 - DNA, 20 bp, mouse
gagggcacgagccatccgac

SEQ ID NO: 478958 - DNA, 20 bp, mouse
ggcgtagtagctgctccagt

SEQ ID NO: 478959 - DNA, 20 bp, mouse
gagtagctgctccagtcgga

SEQ ID NO: 478960 - DNA, 20 bp, mouse
gtgggagccgtgaagatgga

SEQ ID NO: 478961 - DNA, 20 bp, mouse
gatgctgggagccgtgaaga

SEQ ID NO: 478962 - DNA, 20 bp, mouse
gagctactacgcggagcccg

SEQ ID NO: 478963 - DNA, 20 bp, mouse
gctggaagccgagtgcatgg

SEQ ID NO: 478964 - DNA, 20 bp, mouse
gttcacggctcccagcatac

SEQ ID NO: 478965 - DNA, 20 bp, mouse
gctgtcaccccacttctccc

SEQ ID NO: 478966 - DNA, 20 bp, mouse
ggctgcagccaatacccggg

SEQ ID NO: 478967 - DNA, 20 bp, mouse
gaccgaggccctcatgccag

SEQ ID NO: 478968 - DNA, 20 bp, mouse
gtctccaggccgactgaggt

SEQ ID NO: 478969 - DNA, 20 bp, mouse
gttagctgcagccaataccc

SEQ ID NO: 478970 - DNA, 20 bp, mouse
gggtctctccaggccgactg

SEQ ID NO: 478971 - DNA, 20 bp, mouse
gatcgctgcctcccgggtat

SEQ ID NO: 478972 - DNA, 20 bp, mouse
ggaggtgggtagccagaaag

SEQ ID NO: 478973 - DNA, 20 bp, mouse
gtctggctacccacctcagt

SEQ ID NO: 478974 - DNA, 20 bp, mouse
gcagctaaacgggtctctcc

SEQ ID NO: 478975 - DNA, 20 bp, mouse
gctacccacctcagtcggcc

SEQ ID NO: 478976 - DNA, 20 bp, mouse
gcaggctgaggcccccctgg

SEQ ID NO: 478977 - DNA, 20 bp, mouse
gtgcctcaggtcggaactcg

SEQ ID NO: 478978 - DNA, 20 bp, mouse
gctgggccagcgggactccc

SEQ ID NO: 478979 - DNA, 20 bp, mouse
gagtgcttcggtctctctac

SEQ ID NO: 478980 - DNA, 20 bp, mouse
gggtgggaaccggagctcta

SEQ ID NO: 478981 - DNA, 20 bp, mouse
gtggcggagcgggaaatggg

SEQ ID NO: 478982 - DNA, 20 bp, mouse
gcgggctgtgtgcctcaggt

SEQ ID NO: 478983 - DNA, 20 bp, mouse
ggagtggagctactacccgg

SEQ ID NO: 478984 - DNA, 20 bp, mouse
gaagcactcggttcccccag

SEQ ID NO: 478985 - DNA, 20 bp, mouse
ggccgagtggagctactacc

SEQ ID NO: 478986 - DNA, 20 bp, mouse
gggttcgagggtggacatgg

SEQ ID NO: 478987 - DNA, 20 bp, mouse
gaggcagccacctagctcag

SEQ ID NO: 478988 - DNA, 20 bp, mouse
ggatggttcgagggtggaca

SEQ ID NO: 478989 - DNA, 20 bp, mouse
gcgcggagaggagctctacc

SEQ ID NO: 478990 - DNA, 20 bp, mouse
gagcgtcctctggatccctg

SEQ ID NO: 478991 - DNA, 20 bp, mouse
ggtcctctggatccctgagg

SEQ ID NO: 478992 - DNA, 20 bp, mouse
ggatccagaggacgctgctg

SEQ ID NO: 478993 - DNA, 20 bp, mouse
gaggtaggacctggattcag

SEQ ID NO: 478994 - DNA, 20 bp, mouse
gctatcagatggttcgaggg

SEQ ID NO: 478995 - DNA, 20 bp, mouse
gaaactatcagatggttcga

SEQ ID NO: 478996 - DNA, 20 bp, mouse
gccccgaaggaggaggacca

SEQ ID NO: 478997 - DNA, 20 bp, mouse
gaggaggaccaaggcaaaag

SEQ ID NO: 478998 - DNA, 20 bp, mouse
gggcagctccccgaaggagg

SEQ ID NO: 478999 - DNA, 20 bp, mouse
gacccggggcagctccccga

SEQ ID NO: 479000 - DNA, 20 bp, mouse
gcggggcagctccccgaagg

SEQ ID NO: 479001 - DNA, 20 bp, mouse
gtcagtgagatgtaagagta

SEQ ID NO: 479002 - DNA, 20 bp, mouse
gccaaggcaaaaggggtctg

SEQ ID NO: 479003 - DNA, 20 bp, mouse
gcaggtggagagagaattag

SEQ ID NO: 479004 - DNA, 20 bp, mouse
gagagcctgggaagatgcca

SEQ ID NO: 479005 - DNA, 20 bp, mouse
gactgtgggccggacggaag

SEQ ID NO: 479006 - DNA, 20 bp, mouse
gacccggagagggccagacc

SEQ ID NO: 479007 - DNA, 20 bp, mouse
ggccgcctcggaggaacgtt

SEQ ID NO: 479008 - DNA, 20 bp, mouse
gacgctgcaagccgcctcgg

SEQ ID NO: 479009 - DNA, 20 bp, mouse
gtccgaacgttcctccgagg

SEQ ID NO: 479010 - DNA, 20 bp, mouse
gcaacttccaggcgcagtcg

SEQ ID NO: 479011 - DNA, 20 bp, mouse
gagggtcgctgcacccggag

SEQ ID NO: 479012 - DNA, 20 bp, mouse
gtgatccgaacgttcctccg

SEQ ID NO: 479013 - DNA, 20 bp, mouse
gaggacgctgcaagccgcct

SEQ ID NO: 479014 - DNA, 20 bp, mouse
ggcccgcgcgggaactgagt

SEQ ID NO: 479015 - DNA, 20 bp, mouse
gggcccagggcgcaaggagg

SEQ ID NO: 479016 - DNA, 20 bp, mouse
gagcgagctagggtccggag

SEQ ID NO: 479017 - DNA, 20 bp, mouse
ggcgtcagcgagctagggtc

SEQ ID NO: 479018 - DNA, 20 bp, mouse
gccgcagcgtcagcgagcta

SEQ ID NO: 479019 - DNA, 20 bp, mouse
gctcggccgcgcagcctctc

SEQ ID NO: 479020 - DNA, 20 bp, mouse
gagggtccggagaggctgcg

SEQ ID NO: 479021 - DNA, 20 bp, mouse
gggcggatcggcatcctgaa

SEQ ID NO: 479022 - DNA, 20 bp, mouse
gcgtctgtgccgccagctca

SEQ ID NO: 479023 - DNA, 20 bp, mouse
gttcagccgaccgggcggat

SEQ ID NO: 479024 - DNA, 20 bp, mouse
gtgcaggcagccccgactcg

SEQ ID NO: 479025 - DNA, 20 bp, mouse
gctgcgggctgcagttctcc

SEQ ID NO: 479026 - DNA, 20 bp, mouse
gcggtgtcgggcgcccagaa

SEQ ID NO: 479027 - DNA, 20 bp, mouse
ggcccggttagtccaggagg

SEQ ID NO: 479028 - DNA, 20 bp, mouse
gacggagctcggcaaggcca

SEQ ID NO: 479029 - DNA, 20 bp, mouse
gagccctgctcgccaagtag

SEQ ID NO: 479030 - DNA, 20 bp, mouse
gccagggctgagtccagaag

SEQ ID NO: 479031 - DNA, 20 bp, mouse
ggtggcgcggcggcacatag

SEQ ID NO: 479032 - DNA, 20 bp, mouse
gtggcgggccagtcggtgtc

SEQ ID NO: 479033 - DNA, 20 bp, mouse
gtgctcgccaagtagcggag

SEQ ID NO: 479034 - DNA, 20 bp, mouse
gctgggcgcccgacaccgac

SEQ ID NO: 479035 - DNA, 20 bp, mouse
gactcctcccgcgcccttct

SEQ ID NO: 479036 - DNA, 20 bp, mouse
ggagcggagccggagagcgg

SEQ ID NO: 479037 - DNA, 20 bp, mouse
gcaaaacacactggtcggag

SEQ ID NO: 479038 - DNA, 20 bp, mouse
ggcccgcgcgcaaaacacac

SEQ ID NO: 479039 - DNA, 20 bp, mouse
gctcctccgccgccgctctc

SEQ ID NO: 479040 - DNA, 20 bp, mouse
ggcggcggcaccatgaccct

SEQ ID NO: 479041 - DNA, 20 bp, mouse
gtgagggagcacgtcccgag

SEQ ID NO: 479042 - DNA, 20 bp, mouse
gacgcagacatagacgtggt

SEQ ID NO: 479043 - DNA, 20 bp, mouse
gcccgacgcagacatagacg

SEQ ID NO: 479044 - DNA, 20 bp, mouse
gagaggcagcacggcggagc

SEQ ID NO: 479045 - DNA, 20 bp, mouse
gacatagacgtggtgggcgg

SEQ ID NO: 479046 - DNA, 20 bp, mouse
gggctccaagcagctctgga

SEQ ID NO: 479047 - DNA, 20 bp, mouse
gcggcgtggagaaacctccg

SEQ ID NO: 479048 - DNA, 20 bp, mouse
gctctggagggcgcgggcat

SEQ ID NO: 479049 - DNA, 20 bp, mouse
gacgggactttcgactaccc

SEQ ID NO: 479050 - DNA, 20 bp, mouse
gactttcgactacccaggct

SEQ ID NO: 479051 - DNA, 20 bp, mouse
gaagcagctctggagggcgc

SEQ ID NO: 479052 - DNA, 20 bp, mouse
gctactgctcgcgaccccgg

SEQ ID NO: 479053 - DNA, 20 bp, mouse
ggcgggcatgggcgaccgcg

SEQ ID NO: 479054 - DNA, 20 bp, mouse
ggccgggctccaagcagctc

SEQ ID NO: 479055 - DNA, 20 bp, mouse
gtcctcgacgcttctctacg

SEQ ID NO: 479056 - DNA, 20 bp, mouse
gactggagcgctcctaggtt

SEQ ID NO: 479057 - DNA, 20 bp, mouse
ggaacaaggaagcctaacct

SEQ ID NO: 479058 - DNA, 20 bp, mouse
gttttctttctaacaccctt

SEQ ID NO: 479059 - DNA, 20 bp, mouse
gtgctgagttcatggaggat

SEQ ID NO: 479060 - DNA, 20 bp, mouse
ggaggaggggacggacgtgg

SEQ ID NO: 479061 - DNA, 20 bp, mouse
gcatcctggtcggaacttag

SEQ ID NO: 479062 - DNA, 20 bp, mouse
gggtcggaacttagaggact

SEQ ID NO: 479063 - DNA, 20 bp, mouse
ggggcggtggagtggaacga

SEQ ID NO: 479064 - DNA, 20 bp, mouse
gagaggactgggcggtggag

SEQ ID NO: 479065 - DNA, 20 bp, mouse
gtttctaacaccctttggca

SEQ ID NO: 479066 - DNA, 20 bp, mouse
ggcggctctgaactccagca

SEQ ID NO: 479067 - DNA, 20 bp, mouse
gctccagcacggagtccggc

SEQ ID NO: 479068 - DNA, 20 bp, mouse
ggagcaagtgctccgttctg

SEQ ID NO: 479069 - DNA, 20 bp, mouse
gggagttcagagccgcagaa

SEQ ID NO: 479070 - DNA, 20 bp, mouse
ggtgccagggccttcagtgg

SEQ ID NO: 479071 - DNA, 20 bp, mouse
ggagggcagagaggcgagac

SEQ ID NO: 479072 - DNA, 20 bp, mouse
gcgctctcctgcacacacct

SEQ ID NO: 479073 - DNA, 20 bp, mouse
gggtctgaggatgaccgtcg

SEQ ID NO: 479074 - DNA, 20 bp, mouse
gcgccggccggactccgtgc

SEQ ID NO: 479075 - DNA, 20 bp, mouse
ggaggcggtgcgcgtagagg

SEQ ID NO: 479076 - DNA, 20 bp, mouse
gcgtgagcgagggcaaggcc

SEQ ID NO: 479077 - DNA, 20 bp, mouse
ggcagggactccgcatccct

SEQ ID NO: 479078 - DNA, 20 bp, mouse
ggcgaaccggaggaagtggt

SEQ ID NO: 479079 - DNA, 20 bp, mouse
gtggcccggggaagcgacgg

SEQ ID NO: 479080 - DNA, 20 bp, mouse
gctcgcgccccggagagcgg

SEQ ID NO: 479081 - DNA, 20 bp, mouse
ggcctggcccggggaagcga

SEQ ID NO: 479082 - DNA, 20 bp, mouse
ggcggcggccactacagcgt

SEQ ID NO: 479083 - DNA, 20 bp, mouse
gcgacttgcgcatccatgtg

SEQ ID NO: 479084 - DNA, 20 bp, mouse
ggggcgcgaaccggaggaag

SEQ ID NO: 479085 - DNA, 20 bp, mouse
ggctctccggggcgcgagca

SEQ ID NO: 479086 - DNA, 20 bp, mouse
gcggcagcgcagagcagcgg

SEQ ID NO: 479087 - DNA, 20 bp, mouse
ggtcgggcgcggacatcggg

SEQ ID NO: 479088 - DNA, 20 bp, mouse
gctgtgcccccgccgtgcgg

SEQ ID NO: 479089 - DNA, 20 bp, mouse
gcttgtcgggcgcggacatc

SEQ ID NO: 479090 - DNA, 20 bp, mouse
gagcagccgccgcacggcgg

SEQ ID NO: 479091 - DNA, 20 bp, mouse
gagcagcagccgccgcacgg

SEQ ID NO: 479092 - DNA, 20 bp, mouse
gctcctgtgcccccgccgtg

SEQ ID NO: 479093 - DNA, 20 bp, mouse
ggtaggcgccgcggaagaag

SEQ ID NO: 479094 - DNA, 20 bp, mouse
gacaagcagcagccgccgca

SEQ ID NO: 479095 - DNA, 20 bp, mouse
gaaactggtagatctcgctg

SEQ ID NO: 479096 - DNA, 20 bp, mouse
gactcctgaaagaagacgac

SEQ ID NO: 479097 - DNA, 20 bp, mouse
gagacctcagcccggacccc

SEQ ID NO: 479098 - DNA, 20 bp, mouse
ggggctagtccccggggtcc

SEQ ID NO: 479099 - DNA, 20 bp, mouse
gggctgaggtcttggctcga

SEQ ID NO: 479100 - DNA, 20 bp, mouse
gaggcgacgctgcccagagc

SEQ ID NO: 479101 - DNA, 20 bp, mouse
ggacgacgggctagtccccg

SEQ ID NO: 479102 - DNA, 20 bp, mouse
gccgccgcccgaagccccag

SEQ ID NO: 479103 - DNA, 20 bp, mouse
gcgaagccccagaggagctg

SEQ ID NO: 479104 - DNA, 20 bp, mouse
gccgccctcggtgctcatct

SEQ ID NO: 479105 - DNA, 20 bp, mouse
gcagcgcggccggcgcagta

SEQ ID NO: 479106 - DNA, 20 bp, mouse
gggccgtagccagagaggag

SEQ ID NO: 479107 - DNA, 20 bp, mouse
gcagggattggaatttagtg

SEQ ID NO: 479108 - DNA, 20 bp, mouse
ggcagaggccgtagccagag

SEQ ID NO: 479109 - DNA, 20 bp, mouse
gacggcctctgcttacaacg

SEQ ID NO: 479110 - DNA, 20 bp, mouse
gacagatcacaaatcctcac

SEQ ID NO: 479111 - DNA, 20 bp, mouse
gccaaggcccagcatttccc

SEQ ID NO: 479112 - DNA, 20 bp, mouse
gggcgcgctttgagccagtg

SEQ ID NO: 479113 - DNA, 20 bp, mouse
gaagatcgcggccagggcca

SEQ ID NO: 479114 - DNA, 20 bp, mouse
gcgcgccacgttgtaagcag

SEQ ID NO: 479115 - DNA, 20 bp, mouse
gtggggaggttgaaacgagt

SEQ ID NO: 479116 - DNA, 20 bp, mouse
gcggagccagggctaactgg

SEQ ID NO: 479117 - DNA, 20 bp, mouse
ggtcgcgaggccccatacaa

SEQ ID NO: 479118 - DNA, 20 bp, mouse
gtagccctgggccggagcca

SEQ ID NO: 479119 - DNA, 20 bp, mouse
ggtagtcggagtgtaagttg

SEQ ID NO: 479120 - DNA, 20 bp, mouse
gcccgaggccatgctgggac

SEQ ID NO: 479121 - DNA, 20 bp, mouse
gtggccaagtaggtgtaggg

SEQ ID NO: 479122 - DNA, 20 bp, mouse
ggcgaggccccatacaaggg

SEQ ID NO: 479123 - DNA, 20 bp, mouse
gcccagcccgaggccatgct

SEQ ID NO: 479124 - DNA, 20 bp, mouse
gatacaagggaggtagccct

SEQ ID NO: 479125 - DNA, 20 bp, mouse
gttcagcctgcggaagggtg

SEQ ID NO: 479126 - DNA, 20 bp, mouse
ggggcagctccagagaacac

SEQ ID NO: 479127 - DNA, 20 bp, mouse
gctctggagctgcccctgac

SEQ ID NO: 479128 - DNA, 20 bp, mouse
gagaacacaggtgcggccgg

SEQ ID NO: 479129 - DNA, 20 bp, mouse
ggaaggcgctgggaggtcga

SEQ ID NO: 479130 - DNA, 20 bp, mouse
ggactgcaccgaggtggtga

SEQ ID NO: 479131 - DNA, 20 bp, mouse
gactggggactgcaccgagg

SEQ ID NO: 479132 - DNA, 20 bp, mouse
gaggttgggcgctgaggact

SEQ ID NO: 479133 - DNA, 20 bp, mouse
ggctggcttcgggtagccac

SEQ ID NO: 479134 - DNA, 20 bp, mouse
gcaacctccttcgaaggtgg

SEQ ID NO: 479135 - DNA, 20 bp, mouse
gcagagaacacaggtgcggc

SEQ ID NO: 479136 - DNA, 20 bp, mouse
ggctccgtgctgaagctcat

SEQ ID NO: 479137 - DNA, 20 bp, mouse
ggccatgtccagctctcccc

SEQ ID NO: 479138 - DNA, 20 bp, mouse
gagtgtgaggacagggtgaa

SEQ ID NO: 479139 - DNA, 20 bp, mouse
gggtcaggagtgtgaggaca

SEQ ID NO: 479140 - DNA, 20 bp, mouse
gtccagctctcccccggcct

SEQ ID NO: 479141 - DNA, 20 bp, mouse
gccaagaagcgaacccggga

SEQ ID NO: 479142 - DNA, 20 bp, mouse
gtcagtgctgagtaggagta

SEQ ID NO: 479143 - DNA, 20 bp, mouse
ggctctcccccggcctgggc

SEQ ID NO: 479144 - DNA, 20 bp, mouse
gcacctgcaccggcccaggc

SEQ ID NO: 479145 - DNA, 20 bp, mouse
gtacgcgacgggaccagggc

SEQ ID NO: 479146 - DNA, 20 bp, mouse
gcttcggagagagcatccct

SEQ ID NO: 479147 - DNA, 20 bp, mouse
ggtagtcgcagcggaggcca

SEQ ID NO: 479148 - DNA, 20 bp, mouse
gcgtagggttggtccgccaa

SEQ ID NO: 479149 - DNA, 20 bp, mouse
gtccaagtcggtagtcgcag

SEQ ID NO: 479150 - DNA, 20 bp, mouse
gccagggcgggccgtagggt

SEQ ID NO: 479151 - DNA, 20 bp, mouse
gagggtgccctggaggtcgg

SEQ ID NO: 479152 - DNA, 20 bp, mouse
ggctcctcagcgctccaagt

SEQ ID NO: 479153 - DNA, 20 bp, mouse
ggaggccagggcgggccgta

SEQ ID NO: 479154 - DNA, 20 bp, mouse
gggtgcgcccccgacctcca

SEQ ID NO: 479155 - DNA, 20 bp, mouse
ggacctccagggcaccctat

SEQ ID NO: 479156 - DNA, 20 bp, mouse
gcggtcgcccacagaagtag

SEQ ID NO: 479157 - DNA, 20 bp, mouse
gcccagctcgagggctgtgc

SEQ ID NO: 479158 - DNA, 20 bp, mouse
gttctctgtccccagctcga

SEQ ID NO: 479159 - DNA, 20 bp, mouse
ggtggccccactacttctgt

SEQ ID NO: 479160 - DNA, 20 bp, mouse
gtgcgctctgagccaggtaa

SEQ ID NO: 479161 - DNA, 20 bp, mouse
gcgctcagagaagcgccgtc

SEQ ID NO: 479162 - DNA, 20 bp, mouse
ggaagcgccgtcgggcgagg

SEQ ID NO: 479163 - DNA, 20 bp, mouse
ggccagccagaggaaggttc

SEQ ID NO: 479164 - DNA, 20 bp, mouse
gacagagaaccgcgggaggt

SEQ ID NO: 479165 - DNA, 20 bp, mouse
gtggccaacaaacccttcaa

SEQ ID NO: 479166 - DNA, 20 bp, mouse
gctgaggctccgaccggtcg

SEQ ID NO: 479167 - DNA, 20 bp, mouse
gccggtcggagcctcagagg

SEQ ID NO: 479168 - DNA, 20 bp, mouse
gccaggagccggcaggcgga

SEQ ID NO: 479169 - DNA, 20 bp, mouse
ggcgcgtcggggctcggctc

SEQ ID NO: 479170 - DNA, 20 bp, mouse
gggctcctggctgccccgac

SEQ ID NO: 479171 - DNA, 20 bp, mouse
gaggcggacggagcgcgtcg

SEQ ID NO: 479172 - DNA, 20 bp, mouse
gctggacagcagggtcccgg

SEQ ID NO: 479173 - DNA, 20 bp, mouse
gtctccgctggagccaccgt

SEQ ID NO: 479174 - DNA, 20 bp, mouse
gcacagggtgtcccgagggt

SEQ ID NO: 479175 - DNA, 20 bp, mouse
gcctggctgccccgaccggt

SEQ ID NO: 479176 - DNA, 20 bp, mouse
ggagcggcccaggcccggag

SEQ ID NO: 479177 - DNA, 20 bp, mouse
gcccggagcggcgccgagag

SEQ ID NO: 479178 - DNA, 20 bp, mouse
gggagcggcgccgagagtgg

SEQ ID NO: 479179 - DNA, 20 bp, mouse
gtccccgcgaaaggtcccaa

SEQ ID NO: 479180 - DNA, 20 bp, mouse
ggcggcgccgagagtggcgg

SEQ ID NO: 479181 - DNA, 20 bp, mouse
gcgggagcagccaacatccg

SEQ ID NO: 479182 - DNA, 20 bp, mouse
gagggagcgtgcgccgagga

SEQ ID NO: 479183 - DNA, 20 bp, mouse
gcgtcgccagggtctcgtcg

SEQ ID NO: 479184 - DNA, 20 bp, mouse
gcgcgcggcgtcgggctgag

SEQ ID NO: 479185 - DNA, 20 bp, mouse
ggcagcgcgggcccacctgg

SEQ ID NO: 479186 - DNA, 20 bp, mouse
ggcgcgaacatggccgaagt

SEQ ID NO: 479187 - DNA, 20 bp, mouse
gccgaagtcggcgaggacag

SEQ ID NO: 479188 - DNA, 20 bp, mouse
ggccgagcgcagcgccagca

SEQ ID NO: 479189 - DNA, 20 bp, mouse
gaacatggccgaagtcggcg

SEQ ID NO: 479190 - DNA, 20 bp, mouse
gcagccgcggcgcatagcac

SEQ ID NO: 479191 - DNA, 20 bp, mouse
ggctcggagctgcgcgaaca

SEQ ID NO: 479192 - DNA, 20 bp, mouse
gcagctccgagcggctccgg

SEQ ID NO: 479193 - DNA, 20 bp, mouse
ggcagcggccgcggccacca

SEQ ID NO: 479194 - DNA, 20 bp, mouse
gtggcagtggcgacggtgga

SEQ ID NO: 479195 - DNA, 20 bp, mouse
gctccgagcggctccggtgg

SEQ ID NO: 479196 - DNA, 20 bp, mouse
gcgcgagccgagcacggtcg

SEQ ID NO: 479197 - DNA, 20 bp, mouse
ggaggcccgggcgcggtcgt

SEQ ID NO: 479198 - DNA, 20 bp, mouse
gagctctcctcgccggccgg

SEQ ID NO: 479199 - DNA, 20 bp, mouse
gccctcgcagctctcctcgc

SEQ ID NO: 479200 - DNA, 20 bp, mouse
gatccgcgcgggcgccctag

SEQ ID NO: 479201 - DNA, 20 bp, mouse
gggtcgcggagaccgccggc

SEQ ID NO: 479202 - DNA, 20 bp, mouse
ggcacggtcgcggagaccgc

SEQ ID NO: 479203 - DNA, 20 bp, mouse
ggcggcccacgaccgcgccc

SEQ ID NO: 479204 - DNA, 20 bp, mouse
gaggcctggccgatccgcgc

SEQ ID NO: 479205 - DNA, 20 bp, mouse
gcggagaccgccggccggcg

SEQ ID NO: 479206 - DNA, 20 bp, mouse
gtgcaggctgcggggaccgg

SEQ ID NO: 479207 - DNA, 20 bp, mouse
gcccgcagaccgctccccgg

SEQ ID NO: 479208 - DNA, 20 bp, mouse
ggcagactcccgatggccag

SEQ ID NO: 479209 - DNA, 20 bp, mouse
gcccgagcccgaagacacgg

SEQ ID NO: 479210 - DNA, 20 bp, mouse
gctgttgggcagactcccga

SEQ ID NO: 479211 - DNA, 20 bp, mouse
ggagtctgcccaacagcgag

SEQ ID NO: 479212 - DNA, 20 bp, mouse
gccctgctggctccggagag

SEQ ID NO: 479213 - DNA, 20 bp, mouse
gaagggaggcgggacaacac

SEQ ID NO: 479214 - DNA, 20 bp, mouse
ggcgccacgtacgagtacgg

SEQ ID NO: 479215 - DNA, 20 bp, mouse
gctcccttgccgggactcgg

SEQ ID NO: 479216 - DNA, 20 bp, mouse
gtccagggagggctcggagt

SEQ ID NO: 479217 - DNA, 20 bp, mouse
ggcgctgcgggacccacccc

SEQ ID NO: 479218 - DNA, 20 bp, mouse
gcgggacccacccccggccc

SEQ ID NO: 479219 - DNA, 20 bp, mouse
gtgctcggagaacacggcgg

SEQ ID NO: 479220 - DNA, 20 bp, mouse
ggccccgcgtggagcagacg

SEQ ID NO: 479221 - DNA, 20 bp, mouse
ggcggcctgtgaggtgagtg

SEQ ID NO: 479222 - DNA, 20 bp, mouse
gccgccccgggctcccaccc

SEQ ID NO: 479223 - DNA, 20 bp, mouse
gctgcaaatgcagactccga

SEQ ID NO: 479224 - DNA, 20 bp, mouse
ggcccggggcggggtgacgg

SEQ ID NO: 479225 - DNA, 20 bp, mouse
gcggcgccaatttcaaacag

SEQ ID NO: 479226 - DNA, 20 bp, mouse
gcagccgtggaggccaacag

SEQ ID NO: 479227 - DNA, 20 bp, mouse
ggatcagggtgagtacctgg

SEQ ID NO: 479228 - DNA, 20 bp, mouse
gtgacggactgacagacggt

SEQ ID NO: 479229 - DNA, 20 bp, mouse
gcagtgaagcaggtcggcgt

SEQ ID NO: 479230 - DNA, 20 bp, mouse
gccagggagactcaggatca

SEQ ID NO: 479231 - DNA, 20 bp, mouse
ggctgacatcaggtgagggg

SEQ ID NO: 479232 - DNA, 20 bp, mouse
gctgggctgacatcaggtga

SEQ ID NO: 479233 - DNA, 20 bp, mouse
gtgagtacctggaggctgag

SEQ ID NO: 479234 - DNA, 20 bp, mouse
gttccctgccgaggactgag

SEQ ID NO: 479235 - DNA, 20 bp, mouse
ggagtctcattgtctctcca

SEQ ID NO: 479236 - DNA, 20 bp, mouse
gtcgcgcctgggtgtcccgg

SEQ ID NO: 479237 - DNA, 20 bp, mouse
gtgctcgcgcctgggtgtcc

SEQ ID NO: 479238 - DNA, 20 bp, mouse
gagcaccgcagctgctcccg

SEQ ID NO: 479239 - DNA, 20 bp, mouse
ggcgcagtcggagccacaga

SEQ ID NO: 479240 - DNA, 20 bp, mouse
gcagagggcagaggacgccc

SEQ ID NO: 479241 - DNA, 20 bp, mouse
ggttcgcggcggctgagtga

SEQ ID NO: 479242 - DNA, 20 bp, mouse
gccactgcctgctcgcgcct

SEQ ID NO: 479243 - DNA, 20 bp, mouse
gcccgaggtaatgaccgtac

SEQ ID NO: 479244 - DNA, 20 bp, mouse
ggtaatgaccgtaccggagg

SEQ ID NO: 479245 - DNA, 20 bp, mouse
gtccccgggagtgaggagtt

SEQ ID NO: 479246 - DNA, 20 bp, mouse
ggctggtgagccttgagcag

SEQ ID NO: 479247 - DNA, 20 bp, mouse
ggtgggtggccattctctgg

SEQ ID NO: 479248 - DNA, 20 bp, mouse
ggtgagccttgagcagtggg

SEQ ID NO: 479249 - DNA, 20 bp, mouse
gggatggccgcaaccaccaa

SEQ ID NO: 479250 - DNA, 20 bp, mouse
gtccagacacctccagagaa

SEQ ID NO: 479251 - DNA, 20 bp, mouse
ggccgcaaccaccaagggag

SEQ ID NO: 479252 - DNA, 20 bp, mouse
gcagccggctgcctttggtg

SEQ ID NO: 479253 - DNA, 20 bp, mouse
gcccggcaagaggtacatgg

SEQ ID NO: 479254 - DNA, 20 bp, mouse
gctgctttcatcctcaccaa

SEQ ID NO: 479255 - DNA, 20 bp, mouse
gaggttgccttggcttcgga

SEQ ID NO: 479256 - DNA, 20 bp, mouse
gatcgctccagaaaggacaa

SEQ ID NO: 479257 - DNA, 20 bp, mouse
gggtcagcatcgctccagaa

SEQ ID NO: 479258 - DNA, 20 bp, mouse
gtgattacctgagtcagaat

SEQ ID NO: 479259 - DNA, 20 bp, mouse
gtcgatctactgaggtttgg

SEQ ID NO: 479260 - DNA, 20 bp, mouse
gaggtgtcttcataatcact

SEQ ID NO: 479261 - DNA, 20 bp, mouse
gaaggtggtcaatccagctt

SEQ ID NO: 479262 - DNA, 20 bp, mouse
gcgctgctgatagactgaca

SEQ ID NO: 479263 - DNA, 20 bp, mouse
gtgatttcctcgatctactg

SEQ ID NO: 479264 - DNA, 20 bp, mouse
gaggggggagacaatcaact

SEQ ID NO: 479265 - DNA, 20 bp, mouse
ggcttaggcattaagataat

SEQ ID NO: 479266 - DNA, 20 bp, mouse
gatcgctcggggtcccgcag

SEQ ID NO: 479267 - DNA, 20 bp, mouse
gagggctcgagcgtccactg

SEQ ID NO: 479268 - DNA, 20 bp, mouse
ggtcggggcaggaaactcct

SEQ ID NO: 479269 - DNA, 20 bp, mouse
gctcccgctcgcctccgctg

SEQ ID NO: 479270 - DNA, 20 bp, mouse
ggcccagcgggcatcgctcg

SEQ ID NO: 479271 - DNA, 20 bp, mouse
gagaagcagccagcacgtcg

SEQ ID NO: 479272 - DNA, 20 bp, mouse
gcctccgctgcggcgcgtcg

SEQ ID NO: 479273 - DNA, 20 bp, mouse
gggcgccagcgaaactttgt

SEQ ID NO: 479274 - DNA, 20 bp, mouse
gagcgtgctcggctagggag

SEQ ID NO: 479275 - DNA, 20 bp, mouse
gtggacgctcgagccctggg

SEQ ID NO: 479276 - DNA, 20 bp, mouse
gggtggcgctgcggtagggg

SEQ ID NO: 479277 - DNA, 20 bp, mouse
gcagcgaggggcgagcgaaa

SEQ ID NO: 479278 - DNA, 20 bp, mouse
gtcctgggttggctggctgg

SEQ ID NO: 479279 - DNA, 20 bp, mouse
gcgcagcccgggcagcaccg

SEQ ID NO: 479280 - DNA, 20 bp, mouse
gggcgggtggcgctgcggta

SEQ ID NO: 479281 - DNA, 20 bp, mouse
ggccaaattgcagacagcga

SEQ ID NO: 479282 - DNA, 20 bp, mouse
gtccctaagggtcagttaca

SEQ ID NO: 479283 - DNA, 20 bp, mouse
gaaccacgggggcttcacca

SEQ ID NO: 479284 - DNA, 20 bp, mouse
gaacaggcgagctgaatgat

SEQ ID NO: 479285 - DNA, 20 bp, mouse
gtggtacctggagcaggtcc

SEQ ID NO: 479286 - DNA, 20 bp, mouse
gcgcggacgccaaggcagac

SEQ ID NO: 479287 - DNA, 20 bp, mouse
ggggccgctctagctctccg

SEQ ID NO: 479288 - DNA, 20 bp, mouse
gcccgtaagacgggagtctg

SEQ ID NO: 479289 - DNA, 20 bp, mouse
gcgccgccgccacattcaac

SEQ ID NO: 479290 - DNA, 20 bp, mouse
gtgctgcctgttgaatgtgg

SEQ ID NO: 479291 - DNA, 20 bp, mouse
ggtcctaggcacgaactcgg

SEQ ID NO: 479292 - DNA, 20 bp, mouse
gacaagggccgcggacgcca

SEQ ID NO: 479293 - DNA, 20 bp, mouse
gtgcctgttgaatgtggcgg

SEQ ID NO: 479294 - DNA, 20 bp, mouse
gtcggaggctccttagacac

SEQ ID NO: 479295 - DNA, 20 bp, mouse
ggccgaagcgccccaggtgg

SEQ ID NO: 479296 - DNA, 20 bp, mouse
gggccgccctgctcgtggaa

SEQ ID NO: 479297 - DNA, 20 bp, mouse
gcctgctcgtggaagggagg

SEQ ID NO: 479298 - DNA, 20 bp, mouse
ggccgcggccgccctgctcg

SEQ ID NO: 479299 - DNA, 20 bp, mouse
gcgcagcacaggctgacagg

SEQ ID NO: 479300 - DNA, 20 bp, mouse
gtcctgaagggaaggagccg

SEQ ID NO: 479301 - DNA, 20 bp, mouse
gcggcgcagcacaggctgac

SEQ ID NO: 479302 - DNA, 20 bp, mouse
gggagcaaggaggtgatgaa

SEQ ID NO: 479303 - DNA, 20 bp, mouse
gcccagctcggaaacagatc

SEQ ID NO: 479304 - DNA, 20 bp, mouse
gagatccggagtcactggaa

SEQ ID NO: 479305 - DNA, 20 bp, mouse
gcccagggcaccgcgacgag

SEQ ID NO: 479306 - DNA, 20 bp, mouse
gaaacagagacgtctggcgg

SEQ ID NO: 479307 - DNA, 20 bp, mouse
gagatggctgccccagcgag

SEQ ID NO: 479308 - DNA, 20 bp, mouse
ggctaggcggaggttacagg

SEQ ID NO: 479309 - DNA, 20 bp, mouse
ggcctcagagcgctactctg

SEQ ID NO: 479310 - DNA, 20 bp, mouse
gtgcagcccggactccggag

SEQ ID NO: 479311 - DNA, 20 bp, mouse
ggcctcagagtagcgctctg

SEQ ID NO: 479312 - DNA, 20 bp, mouse
gggtaaacagagacgtctgg

SEQ ID NO: 479313 - DNA, 20 bp, mouse
gacctggagggaagaggcga

SEQ ID NO: 479314 - DNA, 20 bp, mouse
gctctgtttaccactcgctg

SEQ ID NO: 479315 - DNA, 20 bp, mouse
gtgtaacctccgcctagcga

SEQ ID NO: 479316 - DNA, 20 bp, mouse
ggagcggcggcggcattcac

SEQ ID NO: 479317 - DNA, 20 bp, mouse
gggcggcggcattcacgggg

SEQ ID NO: 479318 - DNA, 20 bp, mouse
gggctgcgggcacagacagg

SEQ ID NO: 479319 - DNA, 20 bp, mouse
ggccggctgcacctcgggat

SEQ ID NO: 479320 - DNA, 20 bp, mouse
gcaggcgcgggagctggcgc

SEQ ID NO: 479321 - DNA, 20 bp, mouse
gcggagggaggcaaagaccc

SEQ ID NO: 479322 - DNA, 20 bp, mouse
gggcggcattcacggggcgg

SEQ ID NO: 479323 - DNA, 20 bp, mouse
gccgcgggaggggtccctgg

SEQ ID NO: 479324 - DNA, 20 bp, mouse
gggcaggaggctggacaaac

SEQ ID NO: 479325 - DNA, 20 bp, mouse
ggcgcgggccccgctctccc

SEQ ID NO: 479326 - DNA, 20 bp, mouse
gggtccggcggcctcggtgc

SEQ ID NO: 479327 - DNA, 20 bp, mouse
gccggcggcctcggtgcagg

SEQ ID NO: 479328 - DNA, 20 bp, mouse
gccgaggtccccggaacccc

SEQ ID NO: 479329 - DNA, 20 bp, mouse
gaggcgcgcgcagccggctc

SEQ ID NO: 479330 - DNA, 20 bp, mouse
ggtgcatagcccgggatgat

SEQ ID NO: 479331 - DNA, 20 bp, mouse
ggtgcagtccgcctgcaccg

SEQ ID NO: 479332 - DNA, 20 bp, mouse
gaggcggactgcacgcgcaa

SEQ ID NO: 479333 - DNA, 20 bp, mouse
gggttccggggacctcggca

SEQ ID NO: 479334 - DNA, 20 bp, mouse
ggcgaagcgagcaaagacgg

SEQ ID NO: 479335 - DNA, 20 bp, mouse
gagagcgcaacagagagcga

SEQ ID NO: 479336 - DNA, 20 bp, mouse
ggtgcagagcgtctgagtga

SEQ ID NO: 479337 - DNA, 20 bp, mouse
ggctgtgcttgggacagggt

SEQ ID NO: 479338 - DNA, 20 bp, mouse
ggtgtctcgcgctttctcgg

SEQ ID NO: 479339 - DNA, 20 bp, mouse
gtggcacccgctgtgcaccc

SEQ ID NO: 479340 - DNA, 20 bp, mouse
ggctgccgggactcgagcgt

SEQ ID NO: 479341 - DNA, 20 bp, mouse
gagttcggggacaccagggg

SEQ ID NO: 479342 - DNA, 20 bp, mouse
gacagcgggtgccacctcct

SEQ ID NO: 479343 - DNA, 20 bp, mouse
ggccgcggcataaatgccct

SEQ ID NO: 479344 - DNA, 20 bp, mouse
ggagaaagcgcgagacacgc

SEQ ID NO: 479345 - DNA, 20 bp, mouse
gcagagatccgggttgtggg

SEQ ID NO: 479346 - DNA, 20 bp, mouse
gtgaagtggactgctagagg

SEQ ID NO: 479347 - DNA, 20 bp, mouse
gcagcagagctgtgtctggt

SEQ ID NO: 479348 - DNA, 20 bp, mouse
ggcagttggtccttagacag

SEQ ID NO: 479349 - DNA, 20 bp, mouse
gtcgccagcagagctgtgtc

SEQ ID NO: 479350 - DNA, 20 bp, mouse
gacagctctgctggcgaaag

SEQ ID NO: 479351 - DNA, 20 bp, mouse
gtggtgaagtggactgctag

SEQ ID NO: 479352 - DNA, 20 bp, mouse
ggagactgggcactgatgga

SEQ ID NO: 479353 - DNA, 20 bp, mouse
ggcagagaggtattgagggt

SEQ ID NO: 479354 - DNA, 20 bp, mouse
gtgctagagggggatcagcc

SEQ ID NO: 479355 - DNA, 20 bp, mouse
gtggcagtttcccacaagcc

SEQ ID NO: 479356 - DNA, 20 bp, mouse
ggagcccggggaaggacgat

SEQ ID NO: 479357 - DNA, 20 bp, mouse
gggcatcgcactttggagga

SEQ ID NO: 479358 - DNA, 20 bp, mouse
ggcggccgggccggacaggt

SEQ ID NO: 479359 - DNA, 20 bp, mouse
gagatcgcttcggagcgcag

SEQ ID NO: 479360 - DNA, 20 bp, mouse
gcaaagtgcgatgcccccaa

SEQ ID NO: 479361 - DNA, 20 bp, mouse
gggcactgtccggtccgtag

SEQ ID NO: 479362 - DNA, 20 bp, mouse
gaccggctccggactccgag

SEQ ID NO: 479363 - DNA, 20 bp, mouse
gggccggagcccgcactgag

SEQ ID NO: 479364 - DNA, 20 bp, mouse
gccggagccggagcgagctc

SEQ ID NO: 479365 - DNA, 20 bp, mouse
ggcccccacccggatccctg

SEQ ID NO: 479366 - DNA, 20 bp, mouse
gatgctgcccgggaagccgg

SEQ ID NO: 479367 - DNA, 20 bp, mouse
gtgggccggaccgaaggtgg

SEQ ID NO: 479368 - DNA, 20 bp, mouse
gtattgggccggaccgaagg

SEQ ID NO: 479369 - DNA, 20 bp, mouse
ggccgccgcagggttatatt

SEQ ID NO: 479370 - DNA, 20 bp, mouse
gtggaggcgagattctgctg

SEQ ID NO: 479371 - DNA, 20 bp, mouse
gctcccagcacgaaatccta

SEQ ID NO: 479372 - DNA, 20 bp, mouse
gcgtgctgggaggaccgagc

SEQ ID NO: 479373 - DNA, 20 bp, mouse
gggcaaggcggctgcgggtg

SEQ ID NO: 479374 - DNA, 20 bp, mouse
gccatagaaaggagtcttcg

SEQ ID NO: 479375 - DNA, 20 bp, mouse
gctgcccgggaagccggggg

SEQ ID NO: 479376 - DNA, 20 bp, mouse
gcctgtaatcagacactcgg

SEQ ID NO: 479377 - DNA, 20 bp, mouse
gaggcgcgtagctcaaaatc

SEQ ID NO: 479378 - DNA, 20 bp, mouse
gcaatcctgagtatctgcag

SEQ ID NO: 479379 - DNA, 20 bp, mouse
gttgtgcggggtgcaagaga

SEQ ID NO: 479380 - DNA, 20 bp, mouse
gaatctggttctaggaggtg

SEQ ID NO: 479381 - DNA, 20 bp, mouse
gcagagaccttggctcgagg

SEQ ID NO: 479382 - DNA, 20 bp, mouse
ggatttgcttgtgtagttta

SEQ ID NO: 479383 - DNA, 20 bp, mouse
gaccgcgggcaatcgcaggt

SEQ ID NO: 479384 - DNA, 20 bp, mouse
gctcaaaatctggttctagg

SEQ ID NO: 479385 - DNA, 20 bp, mouse
ggcagtccgcccactcgatg

SEQ ID NO: 479386 - DNA, 20 bp, mouse
ggcactccctgggaacccaa

SEQ ID NO: 479387 - DNA, 20 bp, mouse
gagtagtgggagcattccca

SEQ ID NO: 479388 - DNA, 20 bp, mouse
gaatggcctttgggttccca

SEQ ID NO: 479389 - DNA, 20 bp, mouse
gtgggataaagcaatgactg

SEQ ID NO: 479390 - DNA, 20 bp, mouse
ggcaataaagcaatgagtaa

SEQ ID NO: 479391 - DNA, 20 bp, mouse
ggcttccttggccagagtag

SEQ ID NO: 479392 - DNA, 20 bp, mouse
gaataggaagcgaagatcag

SEQ ID NO: 479393 - DNA, 20 bp, mouse
ggccagctggagtcagacgc

SEQ ID NO: 479394 - DNA, 20 bp, mouse
gagctgaggatgtgaccagg

SEQ ID NO: 479395 - DNA, 20 bp, mouse
ggaagatcagtgggatccat

SEQ ID NO: 479396 - DNA, 20 bp, mouse
gctatctagaaaagacaccc

SEQ ID NO: 479397 - DNA, 20 bp, mouse
ggaagactaggaatagtaag

SEQ ID NO: 479398 - DNA, 20 bp, mouse
gttttaccttggcaagtcct

SEQ ID NO: 479399 - DNA, 20 bp, mouse
gtgaataatgctagaagact

SEQ ID NO: 479400 - DNA, 20 bp, mouse
ggaactgagtgtggtaggtt

SEQ ID NO: 479401 - DNA, 20 bp, mouse
gctaggaatagtaagaggtc

SEQ ID NO: 479402 - DNA, 20 bp, mouse
gatattgaactgagtgtggt

SEQ ID NO: 479403 - DNA, 20 bp, mouse
gattggtacacataataatc

SEQ ID NO: 479404 - DNA, 20 bp, mouse
gtagtaagaggtcaggataa

SEQ ID NO: 479405 - DNA, 20 bp, mouse
gatgaaacgctgctattaaa

SEQ ID NO: 479406 - DNA, 20 bp, mouse
gaggacagagtcggcttgag

SEQ ID NO: 479407 - DNA, 20 bp, mouse
gcggctctttgacctttagt

SEQ ID NO: 479408 - DNA, 20 bp, mouse
gcgtggcgcggaccgatgac

SEQ ID NO: 479409 - DNA, 20 bp, mouse
ggcgcggaccgatgacagga

SEQ ID NO: 479410 - DNA, 20 bp, mouse
gcccgggcctcccataccgg

SEQ ID NO: 479411 - DNA, 20 bp, mouse
ggtgtgcgtagcccccggta

SEQ ID NO: 479412 - DNA, 20 bp, mouse
gtgaaagaagccgggctcta

SEQ ID NO: 479413 - DNA, 20 bp, mouse
gcgcagcgctctgcgaaaca

SEQ ID NO: 479414 - DNA, 20 bp, mouse
ggaaacatggccttagagcc

SEQ ID NO: 479415 - DNA, 20 bp, mouse
gcctcaagctgaaagaagcc

SEQ ID NO: 479416 - DNA, 20 bp, mouse
gagcatcgctgggctaccgg

SEQ ID NO: 479417 - DNA, 20 bp, mouse
gctgtcgtgggagcatcgct

SEQ ID NO: 479418 - DNA, 20 bp, mouse
gacctctgaagggtccacct

SEQ ID NO: 479419 - DNA, 20 bp, mouse
gctccactgcagcctgtcgt

SEQ ID NO: 479420 - DNA, 20 bp, mouse
gatcgctgggctaccggtgg

SEQ ID NO: 479421 - DNA, 20 bp, mouse
ggggtacgggaccctgaagg

SEQ ID NO: 479422 - DNA, 20 bp, mouse
gtggcgcgtgcgcggtcccc

SEQ ID NO: 479423 - DNA, 20 bp, mouse
gactgaaccccgggacctag

SEQ ID NO: 479424 - DNA, 20 bp, mouse
gaccaaccagaacctctgaa

SEQ ID NO: 479425 - DNA, 20 bp, mouse
ggtggcggcagcgtgcgggt

SEQ ID NO: 479426 - DNA, 20 bp, mouse
ggtcagcgggccaccctcag

SEQ ID NO: 479427 - DNA, 20 bp, mouse
ggagccaaggattctggtga

SEQ ID NO: 479428 - DNA, 20 bp, mouse
ggttgagagacaggttatgg

SEQ ID NO: 479429 - DNA, 20 bp, mouse
gcagagctggcgatctgcac

SEQ ID NO: 479430 - DNA, 20 bp, mouse
gttgctgacaccgcaaagcc

SEQ ID NO: 479431 - DNA, 20 bp, mouse
gctcgttgagagacaggtta

SEQ ID NO: 479432 - DNA, 20 bp, mouse
ggcatctaccgctacatcat

SEQ ID NO: 479433 - DNA, 20 bp, mouse
gcaaccatcaccagaatcct

SEQ ID NO: 479434 - DNA, 20 bp, mouse
gcaggcacggtattcagagc

SEQ ID NO: 479435 - DNA, 20 bp, mouse
gaaagcggcccatgatgtag

SEQ ID NO: 479436 - DNA, 20 bp, mouse
gggacagagtcgagcacagt

SEQ ID NO: 479437 - DNA, 20 bp, mouse
ggcccaggcctagcttgcgg

SEQ ID NO: 479438 - DNA, 20 bp, mouse
gggcattaagactatgtcgt

SEQ ID NO: 479439 - DNA, 20 bp, mouse
gcggtcccgtactgacacgt

SEQ ID NO: 479440 - DNA, 20 bp, mouse
gcgcgcagaaacagctgcca

SEQ ID NO: 479441 - DNA, 20 bp, mouse
gcccagcagctggcggagag

SEQ ID NO: 479442 - DNA, 20 bp, mouse
gccggcccaggcctagcttg

SEQ ID NO: 479443 - DNA, 20 bp, mouse
gcggtgcccccagcagctgg

SEQ ID NO: 479444 - DNA, 20 bp, mouse
ggccaccgcaagctaggcct

SEQ ID NO: 479445 - DNA, 20 bp, mouse
gtaagactatgtcgtgggcg

SEQ ID NO: 479446 - DNA, 20 bp, mouse
gccaggagtgtttacctgag

SEQ ID NO: 479447 - DNA, 20 bp, mouse
gaagttactggactgtgcac

SEQ ID NO: 479448 - DNA, 20 bp, mouse
gggagctcctacctgaaagg

SEQ ID NO: 479449 - DNA, 20 bp, mouse
gatggaaatgcgaacctctc

SEQ ID NO: 479450 - DNA, 20 bp, mouse
gtcctggtgtagagggtgag

SEQ ID NO: 479451 - DNA, 20 bp, mouse
gggagtggaaggacccatca

SEQ ID NO: 479452 - DNA, 20 bp, mouse
ggtaaacactcctggtgtag

SEQ ID NO: 479453 - DNA, 20 bp, mouse
gagctctgcccagctggact

SEQ ID NO: 479454 - DNA, 20 bp, mouse
gcaggtgcctgcctatgtcc

SEQ ID NO: 479455 - DNA, 20 bp, mouse
gcacaggccaggacataggc

SEQ ID NO: 479456 - DNA, 20 bp, mouse
gtctgagctgagaggtacca

SEQ ID NO: 479457 - DNA, 20 bp, mouse
gtctccgcgaagccaccctg

SEQ ID NO: 479458 - DNA, 20 bp, mouse
ggcttcgcggagagacgcca

SEQ ID NO: 479459 - DNA, 20 bp, mouse
gaggcgctctccgtgcaggg

SEQ ID NO: 479460 - DNA, 20 bp, mouse
gttaggctcgcacagagagg

SEQ ID NO: 479461 - DNA, 20 bp, mouse
gagagaactcagttccgcct

SEQ ID NO: 479462 - DNA, 20 bp, mouse
gtggcctggccaggacggag

SEQ ID NO: 479463 - DNA, 20 bp, mouse
gtttccgcagggtggcttcg

SEQ ID NO: 479464 - DNA, 20 bp, mouse
gtaccaacgggaagtaacac

SEQ ID NO: 479465 - DNA, 20 bp, mouse
gtaagtgtgctcccggaagt

SEQ ID NO: 479466 - DNA, 20 bp, mouse
gccactgaatggctcagaag

SEQ ID NO: 479467 - DNA, 20 bp, mouse
gttcagtgggatggaggagt

SEQ ID NO: 479468 - DNA, 20 bp, mouse
gggagagaactatcactgag

SEQ ID NO: 479469 - DNA, 20 bp, mouse
ggagccattcagtgggatgg

SEQ ID NO: 479470 - DNA, 20 bp, mouse
gtctgagccattcagtggga

SEQ ID NO: 479471 - DNA, 20 bp, mouse
gacaccaaggacaaaggtta

SEQ ID NO: 479472 - DNA, 20 bp, mouse
gaggttcagataacagatgg

SEQ ID NO: 479473 - DNA, 20 bp, mouse
ggtgattctgaacccatact

SEQ ID NO: 479474 - DNA, 20 bp, mouse
gtggccaggaaagtgattgt

SEQ ID NO: 479475 - DNA, 20 bp, mouse
gttgtgtcctgcacccagta

SEQ ID NO: 479476 - DNA, 20 bp, mouse
gaaagagaaccactaatgag

SEQ ID NO: 479477 - DNA, 20 bp, mouse
ggtgattctgagaccatact

SEQ ID NO: 479478 - DNA, 20 bp, mouse
gacatttcaatgcctctgaa

SEQ ID NO: 479479 - DNA, 20 bp, mouse
gaagttcagataagagacag

SEQ ID NO: 479480 - DNA, 20 bp, mouse
gctatggatcctctcattag

SEQ ID NO: 479481 - DNA, 20 bp, mouse
gcatggcaataagagtgatt

SEQ ID NO: 479482 - DNA, 20 bp, mouse
gcccattacctagaacaccg

SEQ ID NO: 479483 - DNA, 20 bp, mouse
gttgtgtcctgtgcccagta

SEQ ID NO: 479484 - DNA, 20 bp, mouse
gctgagaccatactgggcac

SEQ ID NO: 479485 - DNA, 20 bp, mouse
gtttttaggtgctgacaaga

SEQ ID NO: 479486 - DNA, 20 bp, mouse
gtggcaacgaaagtgatctt

SEQ ID NO: 479487 - DNA, 20 bp, mouse
gtagtcacgaagatacaatg

SEQ ID NO: 479488 - DNA, 20 bp, mouse
ggaaagtgatctttggagct

SEQ ID NO: 479489 - DNA, 20 bp, mouse
gatacatataactctggagg

SEQ ID NO: 479490 - DNA, 20 bp, mouse
gaagatacatataactctgg

SEQ ID NO: 479491 - DNA, 20 bp, mouse
gccacttctgatccattctg

SEQ ID NO: 479492 - DNA, 20 bp, mouse
gacttctccatacctcagaa

SEQ ID NO: 479493 - DNA, 20 bp, mouse
gtctgatccattctgaggta

SEQ ID NO: 479494 - DNA, 20 bp, mouse
gaagaagatacatataactc

SEQ ID NO: 479495 - DNA, 20 bp, mouse
gaaggagaaaggttatagag

SEQ ID NO: 479496 - DNA, 20 bp, mouse
gtcgaactgtgaatctggca

SEQ ID NO: 479497 - DNA, 20 bp, mouse
gctggcaaggaaagtgattt

SEQ ID NO: 479498 - DNA, 20 bp, mouse
ggaaagtgattttgggatct

SEQ ID NO: 479499 - DNA, 20 bp, mouse
gaatcatcgaactgtgaatc

SEQ ID NO: 479500 - DNA, 20 bp, mouse
gccacttctgatccattctg

SEQ ID NO: 479501 - DNA, 20 bp, mouse
gacttctccatacctcagaa

SEQ ID NO: 479502 - DNA, 20 bp, mouse
gtctgatccattctgaggta

SEQ ID NO: 479503 - DNA, 20 bp, mouse
gatacatataactctggatg

SEQ ID NO: 479504 - DNA, 20 bp, mouse
gaagaagatacatataactc

SEQ ID NO: 479505 - DNA, 20 bp, mouse
gaaggagaaaggttatagag

SEQ ID NO: 479506 - DNA, 20 bp, mouse
gcagagctgttggaaagttc

SEQ ID NO: 479507 - DNA, 20 bp, mouse
gtagatctgtccagagctgt

SEQ ID NO: 479508 - DNA, 20 bp, mouse
gtcaagttgtgcaggtttct

SEQ ID NO: 479509 - DNA, 20 bp, mouse
gtaccacattaactgcacag

SEQ ID NO: 479510 - DNA, 20 bp, mouse
gctcaacattggagatgtac

SEQ ID NO: 479511 - DNA, 20 bp, mouse
gtgccactgtgcagttaatg

SEQ ID NO: 479512 - DNA, 20 bp, mouse
ggagacaggcttctttcttc

SEQ ID NO: 479513 - DNA, 20 bp, mouse
gcatcctgcagattggagat

SEQ ID NO: 479514 - DNA, 20 bp, mouse
gcaaggattaccttaatatt

SEQ ID NO: 479515 - DNA, 20 bp, mouse
gggtgtggttggtaattaaa

SEQ ID NO: 479516 - DNA, 20 bp, mouse
gggaaccgaagagtgtaaga

SEQ ID NO: 479517 - DNA, 20 bp, mouse
gttacactcttcggttcctg

SEQ ID NO: 479518 - DNA, 20 bp, mouse
ggtggtgtaaatgaagtact

SEQ ID NO: 479519 - DNA, 20 bp, mouse
ggtaagaaggagacctcagc

SEQ ID NO: 479520 - DNA, 20 bp, mouse
gcaagaactcagcagccatc

SEQ ID NO: 479521 - DNA, 20 bp, mouse
ggaatggctgttatatgtga

SEQ ID NO: 479522 - DNA, 20 bp, mouse
gacaattatagcataatggg

SEQ ID NO: 479523 - DNA, 20 bp, mouse
gccaacaattatagcataat

SEQ ID NO: 479524 - DNA, 20 bp, mouse
gctgtgccatgggaggtatc

SEQ ID NO: 479525 - DNA, 20 bp, mouse
gtgatttcagaagaaagcag

SEQ ID NO: 479526 - DNA, 20 bp, mouse
gggaaccgaagagtgtaaga

SEQ ID NO: 479527 - DNA, 20 bp, mouse
ggtaagaaggagacctcagc

SEQ ID NO: 479528 - DNA, 20 bp, mouse
gttacactcttcggttcctg

SEQ ID NO: 479529 - DNA, 20 bp, mouse
ggtggtgtaaatgaagtact

SEQ ID NO: 479530 - DNA, 20 bp, mouse
ggaatggctgttatatgtga

SEQ ID NO: 479531 - DNA, 20 bp, mouse
gtgatttcagaagaaagcag

SEQ ID NO: 479532 - DNA, 20 bp, mouse
gctgtgccatgggaggtatc

SEQ ID NO: 479533 - DNA, 20 bp, mouse
gcaagaactcagcagccatc

SEQ ID NO: 479534 - DNA, 20 bp, mouse
gacaattatagcataatggg

SEQ ID NO: 479535 - DNA, 20 bp, mouse
gccaacaattatagcataat

SEQ ID NO: 479536 - DNA, 20 bp, mouse
ggtgcagcgtgcggtgacag

SEQ ID NO: 479537 - DNA, 20 bp, mouse
ggctgcacgcctggccctac

SEQ ID NO: 479538 - DNA, 20 bp, mouse
ggggccaggcgtgcagcgtg

SEQ ID NO: 479539 - DNA, 20 bp, mouse
ggttcccagccggtacccgt

SEQ ID NO: 479540 - DNA, 20 bp, mouse
gtggcgtcggagcagagaag

SEQ ID NO: 479541 - DNA, 20 bp, mouse
gcagacagagaagagcggaa

SEQ ID NO: 479542 - DNA, 20 bp, mouse
gcggcgctgcgtggctctgg

SEQ ID NO: 479543 - DNA, 20 bp, mouse
gcgtgcggtgacagtggcgc

SEQ ID NO: 479544 - DNA, 20 bp, mouse
gcagctgtcaggactcttgg

SEQ ID NO: 479545 - DNA, 20 bp, mouse
gagccggtacccgtagggcc

SEQ ID NO: 479546 - DNA, 20 bp, mouse
gcaggagctccgggactcgg

SEQ ID NO: 479547 - DNA, 20 bp, mouse
ggagtcccggagctcctgca

SEQ ID NO: 479548 - DNA, 20 bp, mouse
ggcagccgggcggcgtggtg

SEQ ID NO: 479549 - DNA, 20 bp, mouse
ggcaggagcaggttcctcct

SEQ ID NO: 479550 - DNA, 20 bp, mouse
gctgcagcgcccccgagtcc

SEQ ID NO: 479551 - DNA, 20 bp, mouse
gtcctccggaggtccccaac

SEQ ID NO: 479552 - DNA, 20 bp, mouse
ggagaacccagtgagcctcg

SEQ ID NO: 479553 - DNA, 20 bp, mouse
ggctagaccagttcctccgg

SEQ ID NO: 479554 - DNA, 20 bp, mouse
gggtggaccgcagaaggatg

SEQ ID NO: 479555 - DNA, 20 bp, mouse
ggccagttggggacctccgg

SEQ ID NO: 479556 - DNA, 20 bp, mouse
gtgcggaagccgggaccacc

SEQ ID NO: 479557 - DNA, 20 bp, mouse
gatctctgggcagacagtgt

SEQ ID NO: 479558 - DNA, 20 bp, mouse
ggcgcggtacctctgcccgg

SEQ ID NO: 479559 - DNA, 20 bp, mouse
gtcccggcttccgcatcccc

SEQ ID NO: 479560 - DNA, 20 bp, mouse
gtacctctgcccggtggtcc

SEQ ID NO: 479561 - DNA, 20 bp, mouse
gggcgcgcggtacctctgcc

SEQ ID NO: 479562 - DNA, 20 bp, mouse
gggcccaagccgggccagga

SEQ ID NO: 479563 - DNA, 20 bp, mouse
gcgttcgctagaagacttag

SEQ ID NO: 479564 - DNA, 20 bp, mouse
gagcctggggatgcggaagc

SEQ ID NO: 479565 - DNA, 20 bp, mouse
gccaccgcgcgcgaccgtgg

SEQ ID NO: 479566 - DNA, 20 bp, mouse
gagcgccacagcggcattgg

SEQ ID NO: 479567 - DNA, 20 bp, mouse
gggccacccttggaagtaga

SEQ ID NO: 479568 - DNA, 20 bp, mouse
gttaacccgcacaaacaaat

SEQ ID NO: 479569 - DNA, 20 bp, mouse
gttcagcgccacagcggcat

SEQ ID NO: 479570 - DNA, 20 bp, mouse
ggtctcctccaatgccgctg

SEQ ID NO: 479571 - DNA, 20 bp, mouse
gccgcaggggcactcatcaa

SEQ ID NO: 479572 - DNA, 20 bp, mouse
ggacctgcaaacagtgtgtt

SEQ ID NO: 479573 - DNA, 20 bp, mouse
gtgtgagcggcagtgagaga

SEQ ID NO: 479574 - DNA, 20 bp, mouse
gacccttggaagtagagggc

SEQ ID NO: 479575 - DNA, 20 bp, mouse
ggctgagagccaacaaccgc

SEQ ID NO: 479576 - DNA, 20 bp, mouse
gtcccgggcgtgtagcagtc

SEQ ID NO: 479577 - DNA, 20 bp, mouse
gtccttggagccgcaatcca

SEQ ID NO: 479578 - DNA, 20 bp, mouse
gtacccgccgggtgaactgt

SEQ ID NO: 479579 - DNA, 20 bp, mouse
gggcagcctgcataccacaa

SEQ ID NO: 479580 - DNA, 20 bp, mouse
gacttcgggagtccctacag

SEQ ID NO: 479581 - DNA, 20 bp, mouse
gggctcctagagagcacggt

SEQ ID NO: 479582 - DNA, 20 bp, mouse
ggtgaactgtcggaactcta

SEQ ID NO: 479583 - DNA, 20 bp, mouse
gtcccgggacctgggacgta

SEQ ID NO: 479584 - DNA, 20 bp, mouse
gctacacgcccgggacgcgc

SEQ ID NO: 479585 - DNA, 20 bp, mouse
gaccacaagggctcccggga

SEQ ID NO: 479586 - DNA, 20 bp, mouse
gtttctctgggagccacaag

SEQ ID NO: 479587 - DNA, 20 bp, mouse
ggggccactgacaccagctc

SEQ ID NO: 479588 - DNA, 20 bp, mouse
gaccagctcaggtggagact

SEQ ID NO: 479589 - DNA, 20 bp, mouse
gacaagaggattgttcctcg

SEQ ID NO: 479590 - DNA, 20 bp, mouse
gctgcagggacatcccagga

SEQ ID NO: 479591 - DNA, 20 bp, mouse
gtctcactttcccagccccg

SEQ ID NO: 479592 - DNA, 20 bp, mouse
ggcagctgcagggacatccc

SEQ ID NO: 479593 - DNA, 20 bp, mouse
gtagaggatgcccactccag

SEQ ID NO: 479594 - DNA, 20 bp, mouse
gccactgacaccagctcagg

SEQ ID NO: 479595 - DNA, 20 bp, mouse
gctgcagcaactaacagcaa

SEQ ID NO: 479596 - DNA, 20 bp, mouse
ggagcttccgtaggactggg

SEQ ID NO: 479597 - DNA, 20 bp, mouse
gcctctggcagagcttccgt

SEQ ID NO: 479598 - DNA, 20 bp, mouse
ggaagaccgagagttcctcg

SEQ ID NO: 479599 - DNA, 20 bp, mouse
ggcagagcttccgtaggact

SEQ ID NO: 479600 - DNA, 20 bp, mouse
gagtttggtggactttacat

SEQ ID NO: 479601 - DNA, 20 bp, mouse
ggtgcccttgagcacgagtt

SEQ ID NO: 479602 - DNA, 20 bp, mouse
gcagctaagaagtgtcgggg

SEQ ID NO: 479603 - DNA, 20 bp, mouse
gctcggtcttcttcaaccca

SEQ ID NO: 479604 - DNA, 20 bp, mouse
gctaaagccaagaggtgagg

SEQ ID NO: 479605 - DNA, 20 bp, mouse
gggtgaggcggcgctcggga

SEQ ID NO: 479606 - DNA, 20 bp, mouse
gactgagctggaggtccagt

SEQ ID NO: 479607 - DNA, 20 bp, mouse
gcctgaggcaaaaccaagag

SEQ ID NO: 479608 - DNA, 20 bp, mouse
gtcagctgcaggcttgaagc

SEQ ID NO: 479609 - DNA, 20 bp, mouse
gcgggctgggagcttgttcc

SEQ ID NO: 479610 - DNA, 20 bp, mouse
gtaagctagaacaacaccat

SEQ ID NO: 479611 - DNA, 20 bp, mouse
gagagccacggtcctccacc

SEQ ID NO: 479612 - DNA, 20 bp, mouse
gagctggaggtccagtggga

SEQ ID NO: 479613 - DNA, 20 bp, mouse
gtcctctctccggcagatct

SEQ ID NO: 479614 - DNA, 20 bp, mouse
gagatccgaagcgggaggta

SEQ ID NO: 479615 - DNA, 20 bp, mouse
gctcccgtgctggtctcaag

SEQ ID NO: 479616 - DNA, 20 bp, mouse
gctgcgctgccacggtctcc

SEQ ID NO: 479617 - DNA, 20 bp, mouse
ggtgagagggctctgagggt

SEQ ID NO: 479618 - DNA, 20 bp, mouse
ggggcgcctgcggccaccag

SEQ ID NO: 479619 - DNA, 20 bp, mouse
ggagcccagggaacacgtca

SEQ ID NO: 479620 - DNA, 20 bp, mouse
gctccgggcggagctgcacc

SEQ ID NO: 479621 - DNA, 20 bp, mouse
ggagtcgtccagcagtcgaa

SEQ ID NO: 479622 - DNA, 20 bp, mouse
gcgactgctggacgactcgg

SEQ ID NO: 479623 - DNA, 20 bp, mouse
ggtgccaccgcacctggata

SEQ ID NO: 479624 - DNA, 20 bp, mouse
gtagggctcgcggttggagg

SEQ ID NO: 479625 - DNA, 20 bp, mouse
gccaaccgcgagccctagga

SEQ ID NO: 479626 - DNA, 20 bp, mouse
ggttagctcggagaccagag

SEQ ID NO: 479627 - DNA, 20 bp, mouse
gagcgcttaaggagatgcta

SEQ ID NO: 479628 - DNA, 20 bp, mouse
gctggctcgcagggtaggag

SEQ ID NO: 479629 - DNA, 20 bp, mouse
ggccggattgggcgctaggg

SEQ ID NO: 479630 - DNA, 20 bp, mouse
ggcttaaggagatgctaagg

SEQ ID NO: 479631 - DNA, 20 bp, mouse
ggaggatgattgtgatctgg

SEQ ID NO: 479632 - DNA, 20 bp, mouse
gattctctggctcgcagggt

SEQ ID NO: 479633 - DNA, 20 bp, mouse
gggtgcgcggcaccatgcgg

SEQ ID NO: 479634 - DNA, 20 bp, mouse
gaggagagggcttgcggcat

SEQ ID NO: 479635 - DNA, 20 bp, mouse
gggtgtcttgtaatgaaaag

SEQ ID NO: 479636 - DNA, 20 bp, mouse
gggcagtgtacatgtggtac

SEQ ID NO: 479637 - DNA, 20 bp, mouse
gatcagaacgctcacagaac

SEQ ID NO: 479638 - DNA, 20 bp, mouse
gccccgcagggctgatactt

SEQ ID NO: 479639 - DNA, 20 bp, mouse
ggtacatgtggtacaggcag

SEQ ID NO: 479640 - DNA, 20 bp, mouse
ggccggcagagctccccgca

SEQ ID NO: 479641 - DNA, 20 bp, mouse
ggctctgccggcagtctact

SEQ ID NO: 479642 - DNA, 20 bp, mouse
ggtgtctggcagtgtacatg

SEQ ID NO: 479643 - DNA, 20 bp, mouse
ggctaaagcaagtatctggg

SEQ ID NO: 479644 - DNA, 20 bp, mouse
gtgagcagtcactggagatc

SEQ ID NO: 479645 - DNA, 20 bp, mouse
ggccggcagtctacttggag

SEQ ID NO: 479646 - DNA, 20 bp, mouse
gaggctccgagggaaagcag

SEQ ID NO: 479647 - DNA, 20 bp, mouse
gttgggtgcccgccagccaa

SEQ ID NO: 479648 - DNA, 20 bp, mouse
gtgtcccggccaggttgggg

SEQ ID NO: 479649 - DNA, 20 bp, mouse
ggtgtgtcccggccaggttg

SEQ ID NO: 479650 - DNA, 20 bp, mouse
gggtcaagttccacacgaag

SEQ ID NO: 479651 - DNA, 20 bp, mouse
gggccgggacacacagtgaa

SEQ ID NO: 479652 - DNA, 20 bp, mouse
gacggctgcgactggcacgg

SEQ ID NO: 479653 - DNA, 20 bp, mouse
gcagtgaaaggcgagttcag

SEQ ID NO: 479654 - DNA, 20 bp, mouse
gctggcgggcacccaatccc

SEQ ID NO: 479655 - DNA, 20 bp, mouse
ggccagccaacggctgcgac

SEQ ID NO: 479656 - DNA, 20 bp, mouse
gcgccccatgagctgggcac

SEQ ID NO: 479657 - DNA, 20 bp, mouse
gagcaagctgggttctctcc

SEQ ID NO: 479658 - DNA, 20 bp, mouse
ggtcctcgggagcgacgcgg

SEQ ID NO: 479659 - DNA, 20 bp, mouse
gtgcccgtgcccagctcatg

SEQ ID NO: 479660 - DNA, 20 bp, mouse
gcccaaaccccaagcaagct

SEQ ID NO: 479661 - DNA, 20 bp, mouse
gcccgtcctcgggagcgacg

SEQ ID NO: 479662 - DNA, 20 bp, mouse
gatggggcggggcctaggta

SEQ ID NO: 479663 - DNA, 20 bp, mouse
gggcgcggcgctgacctgga

SEQ ID NO: 479664 - DNA, 20 bp, mouse
gttagagctggagcgacccc

SEQ ID NO: 479665 - DNA, 20 bp, mouse
gtgagctgggcacgggcagt

SEQ ID NO: 479666 - DNA, 20 bp, mouse
gagtgctgggagctgcgagt

SEQ ID NO: 479667 - DNA, 20 bp, mouse
ggcagacgccggttgtgagt

SEQ ID NO: 479668 - DNA, 20 bp, mouse
ggcgccgctggagcagacgc

SEQ ID NO: 479669 - DNA, 20 bp, mouse
gcaaccggcgtctgctccag

SEQ ID NO: 479670 - DNA, 20 bp, mouse
gcaggcttccgactcacaac

SEQ ID NO: 479671 - DNA, 20 bp, mouse
gagcctggcgctgtcgactt

SEQ ID NO: 479672 - DNA, 20 bp, mouse
gtgggagctgcgagtaggct

SEQ ID NO: 479673 - DNA, 20 bp, mouse
ggtgggcgagctccaactcg

SEQ ID NO: 479674 - DNA, 20 bp, mouse
ggcgcgccgtcccagaaagg

SEQ ID NO: 479675 - DNA, 20 bp, mouse
gagctgcagcgttggtctgg

SEQ ID NO: 479676 - DNA, 20 bp, mouse
gcagcccaacggcctcgctg

SEQ ID NO: 479677 - DNA, 20 bp, mouse
gctacttgctcgcagcccaa

SEQ ID NO: 479678 - DNA, 20 bp, mouse
gcatcctcagcgaggccgtt

SEQ ID NO: 479679 - DNA, 20 bp, mouse
gaaatggagcatcctcagcg

SEQ ID NO: 479680 - DNA, 20 bp, mouse
gagtagattcagatggctgt

SEQ ID NO: 479681 - DNA, 20 bp, mouse
gtcaaccacaaaaatcttct

SEQ ID NO: 479682 - DNA, 20 bp, mouse
gaggttctgagggaaatgag

SEQ ID NO: 479683 - DNA, 20 bp, mouse
gttagttctactacccaata

SEQ ID NO: 479684 - DNA, 20 bp, mouse
ggattcccagaagatttttg

SEQ ID NO: 479685 - DNA, 20 bp, mouse
gtcactcccggaggttctga

SEQ ID NO: 479686 - DNA, 20 bp, mouse
gacgcctgcgaatcgaccct

SEQ ID NO: 479687 - DNA, 20 bp, mouse
gaatcgaccctgggcaggac

SEQ ID NO: 479688 - DNA, 20 bp, mouse
gcctcccgcggcagcttctg

SEQ ID NO: 479689 - DNA, 20 bp, mouse
ggggtctccggtcctgccca

SEQ ID NO: 479690 - DNA, 20 bp, mouse
gagccgagtgcagatcgggt

SEQ ID NO: 479691 - DNA, 20 bp, mouse
ggcaggaccggagaccccgc

SEQ ID NO: 479692 - DNA, 20 bp, mouse
gtctggacccaccaccacac

SEQ ID NO: 479693 - DNA, 20 bp, mouse
ggacccaccaccacaccggc

SEQ ID NO: 479694 - DNA, 20 bp, mouse
gaagtgaccgtcaggtgcag

SEQ ID NO: 479695 - DNA, 20 bp, mouse
gctgcccagggtcgattcgc

SEQ ID NO: 479696 - DNA, 20 bp, mouse
ggcccggcctctcccccctc

SEQ ID NO: 479697 - DNA, 20 bp, mouse
gccgcggctgcagcccgagg

SEQ ID NO: 479698 - DNA, 20 bp, mouse
gctgcgcccgcgccgtctgg

SEQ ID NO: 479699 - DNA, 20 bp, mouse
ggcgcctcctcctcaggtaa

SEQ ID NO: 479700 - DNA, 20 bp, mouse
gctggcggcggcaggtgctg

SEQ ID NO: 479701 - DNA, 20 bp, mouse
gccggcgggagcagtagctg

SEQ ID NO: 479702 - DNA, 20 bp, mouse
gcgcccgcgccgtctggcgg

SEQ ID NO: 479703 - DNA, 20 bp, mouse
gctcccagagacgcaggcct

SEQ ID NO: 479704 - DNA, 20 bp, mouse
gtcgcccttacctgaggagg

SEQ ID NO: 479705 - DNA, 20 bp, mouse
ggcctcgcccttacctgagg

SEQ ID NO: 479706 - DNA, 20 bp, mouse
gaatcagtgactgaaatcac

SEQ ID NO: 479707 - DNA, 20 bp, mouse
gaggaggaccccgaagttca

SEQ ID NO: 479708 - DNA, 20 bp, mouse
ggaaattggatagtggagtt

SEQ ID NO: 479709 - DNA, 20 bp, mouse
gattggatagtggagttagg

SEQ ID NO: 479710 - DNA, 20 bp, mouse
ggtatgtctgaagagagctt

SEQ ID NO: 479711 - DNA, 20 bp, mouse
gctacataaaagatatttat

SEQ ID NO: 479712 - DNA, 20 bp, mouse
gtaaaagatatttattggac

SEQ ID NO: 479713 - DNA, 20 bp, mouse
gggcctcatagagcccagac

SEQ ID NO: 479714 - DNA, 20 bp, mouse
ggaggtcctgagcaaccaca

SEQ ID NO: 479715 - DNA, 20 bp, mouse
gggcctgtctgggctctatg

SEQ ID NO: 479716 - DNA, 20 bp, mouse
gccccttctcacaccagcaa

SEQ ID NO: 479717 - DNA, 20 bp, mouse
gtcaaaccccaggcgcactg

SEQ ID NO: 479718 - DNA, 20 bp, mouse
gctgctgccactcaaacccc

SEQ ID NO: 479719 - DNA, 20 bp, mouse
gcaggcgccctgaggaccag

SEQ ID NO: 479720 - DNA, 20 bp, mouse
ggatcgcagactgaaccagg

SEQ ID NO: 479721 - DNA, 20 bp, mouse
gggctgggcacaaggagcgg

SEQ ID NO: 479722 - DNA, 20 bp, mouse
gcccaagcaggaccattgat

SEQ ID NO: 479723 - DNA, 20 bp, mouse
gcctcagcagccccatggcc

SEQ ID NO: 479724 - DNA, 20 bp, mouse
gaccaaaagaaaaggacccg

SEQ ID NO: 479725 - DNA, 20 bp, mouse
gcgcactgaggtcctggcca

SEQ ID NO: 479726 - DNA, 20 bp, mouse
ggccaagccggaagttgctc

SEQ ID NO: 479727 - DNA, 20 bp, mouse
gaggcagcctgagcaacttc

SEQ ID NO: 479728 - DNA, 20 bp, mouse
ggtacccgccggagccaagc

SEQ ID NO: 479729 - DNA, 20 bp, mouse
ggtaccgcggagctgcaact

SEQ ID NO: 479730 - DNA, 20 bp, mouse
gccgcggagctgcaactagg

SEQ ID NO: 479731 - DNA, 20 bp, mouse
gcaaagtcacgaggcatatt

SEQ ID NO: 479732 - DNA, 20 bp, mouse
ggcagctccgcggtacccgc

SEQ ID NO: 479733 - DNA, 20 bp, mouse
gttggctccggcgggtaccg

SEQ ID NO: 479734 - DNA, 20 bp, mouse
gatcagagctagctgggcga

SEQ ID NO: 479735 - DNA, 20 bp, mouse
ggcgtggtctggcagtcagg

SEQ ID NO: 479736 - DNA, 20 bp, mouse
gcttacctcagagcactctt

SEQ ID NO: 479737 - DNA, 20 bp, mouse
ggcactcttaggaagctgtt

SEQ ID NO: 479738 - DNA, 20 bp, mouse
gaagctaaaaagtctatgaa

SEQ ID NO: 479739 - DNA, 20 bp, mouse
ggaagtgataggtctggcaa

SEQ ID NO: 479740 - DNA, 20 bp, mouse
gaagctctggggacctccag

SEQ ID NO: 479741 - DNA, 20 bp, mouse
gatacctggagctgagacag

SEQ ID NO: 479742 - DNA, 20 bp, mouse
ggacagttactccaagatag

SEQ ID NO: 479743 - DNA, 20 bp, mouse
ggctccttgcaggatattcc

SEQ ID NO: 479744 - DNA, 20 bp, mouse
gtcatgatcgccgaaaaaag

SEQ ID NO: 479745 - DNA, 20 bp, mouse
gtttttagcttactgttggt

SEQ ID NO: 479746 - DNA, 20 bp, mouse
gtcccgcagccaggccgctc

SEQ ID NO: 479747 - DNA, 20 bp, mouse
ggtccccgctgcggccggag

SEQ ID NO: 479748 - DNA, 20 bp, mouse
gtcgctggcgaaggtgccgt

SEQ ID NO: 479749 - DNA, 20 bp, mouse
gggtgccgtaggaggagtcg

SEQ ID NO: 479750 - DNA, 20 bp, mouse
gggtgtcagtggaggcagat

SEQ ID NO: 479751 - DNA, 20 bp, mouse
ggctgcgcggcgcgtgctgg

SEQ ID NO: 479752 - DNA, 20 bp, mouse
gcgcgccacgactcctccta

SEQ ID NO: 479753 - DNA, 20 bp, mouse
gtgcgcagagcgaggcaggg

SEQ ID NO: 479754 - DNA, 20 bp, mouse
gagcctgtaggagggaagtc

SEQ ID NO: 479755 - DNA, 20 bp, mouse
gctgcgctacctgtcagagg

SEQ ID NO: 479756 - DNA, 20 bp, mouse
ggcgccgaggctccgagcag

SEQ ID NO: 479757 - DNA, 20 bp, mouse
gtagggttcgggctggagag

SEQ ID NO: 479758 - DNA, 20 bp, mouse
gccccggaagtgcttgtcta

SEQ ID NO: 479759 - DNA, 20 bp, mouse
gctcggcgcctgtgtctaca

SEQ ID NO: 479760 - DNA, 20 bp, mouse
gtcaggtcgcggggagagtg

SEQ ID NO: 479761 - DNA, 20 bp, mouse
gcgagcagggggtcaggtcg

SEQ ID NO: 479762 - DNA, 20 bp, mouse
gcccttccccggatccccga

SEQ ID NO: 479763 - DNA, 20 bp, mouse
gttcagccgtcggggatccg

SEQ ID NO: 479764 - DNA, 20 bp, mouse
ggcttgtctagggttcgggc

SEQ ID NO: 479765 - DNA, 20 bp, mouse
gatccggggaaggggttcgt

SEQ ID NO: 479766 - DNA, 20 bp, mouse
gctgcagcgggacccgggag

SEQ ID NO: 479767 - DNA, 20 bp, mouse
gcgcggggcgatgtgagtcg

SEQ ID NO: 479768 - DNA, 20 bp, mouse
ggcccgcttggagctttcta

SEQ ID NO: 479769 - DNA, 20 bp, mouse
gatacccagacggaacgcgg

SEQ ID NO: 479770 - DNA, 20 bp, mouse
gggaggccttagctgcgggc

SEQ ID NO: 479771 - DNA, 20 bp, mouse
gcatcgccccgcggcccagg

SEQ ID NO: 479772 - DNA, 20 bp, mouse
gggccttagctgcgggcggg

SEQ ID NO: 479773 - DNA, 20 bp, mouse
gggctgctgcagcgggaccc

SEQ ID NO: 479774 - DNA, 20 bp, mouse
gagaagccgagactgcggtg

SEQ ID NO: 479775 - DNA, 20 bp, mouse
gggctgggaggccttagctg

SEQ ID NO: 479776 - DNA, 20 bp, mouse
gcccctagcgagctgggagg

SEQ ID NO: 479777 - DNA, 20 bp, mouse
gcctcccctagcgagctggg

SEQ ID NO: 479778 - DNA, 20 bp, mouse
gtgggagctcaggttgagaa

SEQ ID NO: 479779 - DNA, 20 bp, mouse
gctcccttgcaagccttcag

SEQ ID NO: 479780 - DNA, 20 bp, mouse
gaagccagccctggccccgg

SEQ ID NO: 479781 - DNA, 20 bp, mouse
ggctcgctaggggagggact

SEQ ID NO: 479782 - DNA, 20 bp, mouse
gtccacctcccagctcgcta

SEQ ID NO: 479783 - DNA, 20 bp, mouse
ggcagccccccgctgaggga

SEQ ID NO: 479784 - DNA, 20 bp, mouse
ggtcagctctgaaatgaaag

SEQ ID NO: 479785 - DNA, 20 bp, mouse
gccagccctggccccggagg

SEQ ID NO: 479786 - DNA, 20 bp, mouse
ggcactgccgggcgcccgtc

SEQ ID NO: 479787 - DNA, 20 bp, mouse
gcggttaaaatcagagtcgg

SEQ ID NO: 479788 - DNA, 20 bp, mouse
ggtctctcccagagcccgac

SEQ ID NO: 479789 - DNA, 20 bp, mouse
gcgactggggaggctcctaa

SEQ ID NO: 479790 - DNA, 20 bp, mouse
gcggcggcgctggaggaacg

SEQ ID NO: 479791 - DNA, 20 bp, mouse
gtccgatcgggaccgattcg

SEQ ID NO: 479792 - DNA, 20 bp, mouse
gtcgcggctcgcagcaagaa

SEQ ID NO: 479793 - DNA, 20 bp, mouse
gtaaaatcagagtcggaggg

SEQ ID NO: 479794 - DNA, 20 bp, mouse
gaccacgaatcggtcccgat

SEQ ID NO: 479795 - DNA, 20 bp, mouse
ggcgggcatcccggatccta

SEQ ID NO: 479796 - DNA, 20 bp, mouse
ggccggcgcagcgaggcacc

SEQ ID NO: 479797 - DNA, 20 bp, mouse
gaagagcagccggcgcagcg

SEQ ID NO: 479798 - DNA, 20 bp, mouse
gcctagaggcttagacgctt

SEQ ID NO: 479799 - DNA, 20 bp, mouse
gaagctagtggaccggacct

SEQ ID NO: 479800 - DNA, 20 bp, mouse
gcccgggccgcagcagacca

SEQ ID NO: 479801 - DNA, 20 bp, mouse
gccgggctccgccaagctag

SEQ ID NO: 479802 - DNA, 20 bp, mouse
gatccaagtgctcccaggtc

SEQ ID NO: 479803 - DNA, 20 bp, mouse
gggaggactaatgggagcgg

SEQ ID NO: 479804 - DNA, 20 bp, mouse
ggcagggcgcagccgagcga

SEQ ID NO: 479805 - DNA, 20 bp, mouse
gtagatgctgcctcgcctag

SEQ ID NO: 479806 - DNA, 20 bp, mouse
gggccgaagctggcaatctg

SEQ ID NO: 479807 - DNA, 20 bp, mouse
gaaaagaacaatggtaggaa

SEQ ID NO: 479808 - DNA, 20 bp, mouse
ggccctgagctgtgcgagga

SEQ ID NO: 479809 - DNA, 20 bp, mouse
gagacaggagccacatacag

SEQ ID NO: 479810 - DNA, 20 bp, mouse
gcttaattccaaaagaacaa

SEQ ID NO: 479811 - DNA, 20 bp, mouse
ggccctcctcgcacagctca

SEQ ID NO: 479812 - DNA, 20 bp, mouse
gaagccagagcccaagagat

SEQ ID NO: 479813 - DNA, 20 bp, mouse
ggagcccaccaagcaagtca

SEQ ID NO: 479814 - DNA, 20 bp, mouse
ggtaggccctgagctgtgcg

SEQ ID NO: 479815 - DNA, 20 bp, mouse
gtgctgcaatagctcctgtt

SEQ ID NO: 479816 - DNA, 20 bp, mouse
gtccttgactacactcctgt

SEQ ID NO: 479817 - DNA, 20 bp, mouse
ggaagatgaatgagtaaggt

SEQ ID NO: 479818 - DNA, 20 bp, mouse
ggagtaaggttggatccaac

SEQ ID NO: 479819 - DNA, 20 bp, mouse
gagacgacccagccaaccaa

SEQ ID NO: 479820 - DNA, 20 bp, mouse
gaggaaggcaggaatataga

SEQ ID NO: 479821 - DNA, 20 bp, mouse
gctgaagagcctatatcatt

SEQ ID NO: 479822 - DNA, 20 bp, mouse
gatatcatcagtcatagaaa

SEQ ID NO: 479823 - DNA, 20 bp, mouse
gcctgccttcctaatgatat

SEQ ID NO: 479824 - DNA, 20 bp, mouse
gggacttatctaccattggt

SEQ ID NO: 479825 - DNA, 20 bp, mouse
gggaggttgtactgaagcca

SEQ ID NO: 479826 - DNA, 20 bp, mouse
ggtgttgaacaaaggaggtc

SEQ ID NO: 479827 - DNA, 20 bp, mouse
ggtgccgttggcggtcatgg

SEQ ID NO: 479828 - DNA, 20 bp, mouse
gaagccgtgttgaacaaagg

SEQ ID NO: 479829 - DNA, 20 bp, mouse
gggccaggtagcgacccagg

SEQ ID NO: 479830 - DNA, 20 bp, mouse
gaccgccaacggcacggcag

SEQ ID NO: 479831 - DNA, 20 bp, mouse
gccgccaccatgaccgccaa

SEQ ID NO: 479832 - DNA, 20 bp, mouse
ggctttgtggagaactgcag

SEQ ID NO: 479833 - DNA, 20 bp, mouse
ggcgagcgcgaggtgcccga

SEQ ID NO: 479834 - DNA, 20 bp, mouse
gctggagcaacctcccgatg

SEQ ID NO: 479835 - DNA, 20 bp, mouse
gaggtggctgcgcagacaca

SEQ ID NO: 479836 - DNA, 20 bp, mouse
gggccgaggccacaagacag

SEQ ID NO: 479837 - DNA, 20 bp, mouse
gagacagagggaggcagcat

SEQ ID NO: 479838 - DNA, 20 bp, mouse
gccaagcctagccagcgaca

SEQ ID NO: 479839 - DNA, 20 bp, mouse
gggctaggcttgggagccaa

SEQ ID NO: 479840 - DNA, 20 bp, mouse
gcaggtagcgtccatgtcgc

SEQ ID NO: 479841 - DNA, 20 bp, mouse
ggctctctgcagtcaggtag

SEQ ID NO: 479842 - DNA, 20 bp, mouse
gtctgcagtcaggtagcggt

SEQ ID NO: 479843 - DNA, 20 bp, mouse
gggccatgtaagatctgcct

SEQ ID NO: 479844 - DNA, 20 bp, mouse
gagatctgcctgggtggccg

SEQ ID NO: 479845 - DNA, 20 bp, mouse
gacagatctgggcctcaggg

SEQ ID NO: 479846 - DNA, 20 bp, mouse
gcagcttctggtgggtacta

SEQ ID NO: 479847 - DNA, 20 bp, mouse
gtaaggtcccacaggccata

SEQ ID NO: 479848 - DNA, 20 bp, mouse
gcccagtggtaaggtcccac

SEQ ID NO: 479849 - DNA, 20 bp, mouse
gtctgggaacagcttctggt

SEQ ID NO: 479850 - DNA, 20 bp, mouse
gtcccggccatatggcctgt

SEQ ID NO: 479851 - DNA, 20 bp, mouse
gaggcttccccccagtggta

SEQ ID NO: 479852 - DNA, 20 bp, mouse
ggcctgtgggaccttaccac

SEQ ID NO: 479853 - DNA, 20 bp, mouse
gtcccacaggccatatggcc

SEQ ID NO: 479854 - DNA, 20 bp, mouse
gccaaaggcggaggacctaa

SEQ ID NO: 479855 - DNA, 20 bp, mouse
gaggcggaggacctaagggt

SEQ ID NO: 479856 - DNA, 20 bp, mouse
ggagggcacggaaggctagt

SEQ ID NO: 479857 - DNA, 20 bp, mouse
ggaggcggcgagggcacgga

SEQ ID NO: 479858 - DNA, 20 bp, mouse
ggcacgggccgcccgcacag

SEQ ID NO: 479859 - DNA, 20 bp, mouse
gatgacgagatgctgaggga

SEQ ID NO: 479860 - DNA, 20 bp, mouse
gtgcgtagtacatgtagtga

SEQ ID NO: 479861 - DNA, 20 bp, mouse
gtgcgtccaaggaactttaa

SEQ ID NO: 479862 - DNA, 20 bp, mouse
gaccagctgaaggggacccg

SEQ ID NO: 479863 - DNA, 20 bp, mouse
gtggctgctgtctgcgtcca

SEQ ID NO: 479864 - DNA, 20 bp, mouse
gaagaccagagggtaggacc

SEQ ID NO: 479865 - DNA, 20 bp, mouse
ggcagggattgggaacaggg

SEQ ID NO: 479866 - DNA, 20 bp, mouse
ggacgggacaaggctgacgg

SEQ ID NO: 479867 - DNA, 20 bp, mouse
gggcaaccgcggctcggtag

SEQ ID NO: 479868 - DNA, 20 bp, mouse
gcggacgggcgggatctctg

SEQ ID NO: 479869 - DNA, 20 bp, mouse
gatctctgcgggacgggaca

SEQ ID NO: 479870 - DNA, 20 bp, mouse
gcagaggtagcgggtctcta

SEQ ID NO: 479871 - DNA, 20 bp, mouse
ggggcgggatctctgcggga

SEQ ID NO: 479872 - DNA, 20 bp, mouse
gacaaggctgacggcggcag

SEQ ID NO: 479873 - DNA, 20 bp, mouse
ggcctagcgcccgcagaggg

SEQ ID NO: 479874 - DNA, 20 bp, mouse
gggagccaagagcaggacag

SEQ ID NO: 479875 - DNA, 20 bp, mouse
gactcgcagaaagtaagcgg

SEQ ID NO: 479876 - DNA, 20 bp, mouse
gcagcttgcagcgcactcag

SEQ ID NO: 479877 - DNA, 20 bp, mouse
gcagcgcactcagaggtcac

SEQ ID NO: 479878 - DNA, 20 bp, mouse
gctcagaggtcaccgggaag

SEQ ID NO: 479879 - DNA, 20 bp, mouse
gagctgggtgaggattacat

SEQ ID NO: 479880 - DNA, 20 bp, mouse
ggccatgcctagttcaccct

SEQ ID NO: 479881 - DNA, 20 bp, mouse
gtcccagggtgaactaggca

SEQ ID NO: 479882 - DNA, 20 bp, mouse
gtagttcaccctgggaagta

SEQ ID NO: 479883 - DNA, 20 bp, mouse
gtttggcaccctacttccca

SEQ ID NO: 479884 - DNA, 20 bp, mouse
gggccctgtgctagaaacac

SEQ ID NO: 479885 - DNA, 20 bp, mouse
ggtaatcctcacccagctaa

SEQ ID NO: 479886 - DNA, 20 bp, mouse
gaagagacagctgactgcac

SEQ ID NO: 479887 - DNA, 20 bp, mouse
gagcagcacttgatgcaaca

SEQ ID NO: 479888 - DNA, 20 bp, mouse
gtggtctgcaattttcaaag

SEQ ID NO: 479889 - DNA, 20 bp, mouse
ggcagtcagctgtctcttct

SEQ ID NO: 479890 - DNA, 20 bp, mouse
gccattaaggatttaaagaa

SEQ ID NO: 479891 - DNA, 20 bp, mouse
gtggtcaatgtacagttata

SEQ ID NO: 479892 - DNA, 20 bp, mouse
gtaatgaaatggcaaatata

SEQ ID NO: 479893 - DNA, 20 bp, mouse
gtgaaaattgcagaccatta

SEQ ID NO: 479894 - DNA, 20 bp, mouse
gtaacttggcttcttgaata

SEQ ID NO: 479895 - DNA, 20 bp, mouse
gccatctgtatatactgctt

SEQ ID NO: 479896 - DNA, 20 bp, mouse
ggagcctggggaatccgtgg

SEQ ID NO: 479897 - DNA, 20 bp, mouse
ggaggagcctggggaatccg

SEQ ID NO: 479898 - DNA, 20 bp, mouse
gccagcagcgaaaacctcca

SEQ ID NO: 479899 - DNA, 20 bp, mouse
gctcttatccggacagtgtg

SEQ ID NO: 479900 - DNA, 20 bp, mouse
gaaacctccacggattcccc

SEQ ID NO: 479901 - DNA, 20 bp, mouse
gacagtgtgtggaggagcct

SEQ ID NO: 479902 - DNA, 20 bp, mouse
gttatccggacagtgtgtgg

SEQ ID NO: 479903 - DNA, 20 bp, mouse
gtggcgttccgggggaggtc

SEQ ID NO: 479904 - DNA, 20 bp, mouse
gcggataagagagatctgct

SEQ ID NO: 479905 - DNA, 20 bp, mouse
ggggatctggatgtcatcac

SEQ ID NO: 479906 - DNA, 20 bp, mouse
gatcttcacagaggaggcgg

SEQ ID NO: 479907 - DNA, 20 bp, mouse
gctctccacttcccttcgaa

SEQ ID NO: 479908 - DNA, 20 bp, mouse
gggtccccttcgaagggaag

SEQ ID NO: 479909 - DNA, 20 bp, mouse
gaggcggtggcgggaaaaac

SEQ ID NO: 479910 - DNA, 20 bp, mouse
gttcacagaggaggcggtgg

SEQ ID NO: 479911 - DNA, 20 bp, mouse
gaaaaccggtccccttcgaa

SEQ ID NO: 479912 - DNA, 20 bp, mouse
ggaggggccgcacgcaccac

SEQ ID NO: 479913 - DNA, 20 bp, mouse
gacggcagagggcgaggtgg

SEQ ID NO: 479914 - DNA, 20 bp, mouse
gtccccaccgagaagttgag

SEQ ID NO: 479915 - DNA, 20 bp, mouse
ggtctcagaagctactgccc

SEQ ID NO: 479916 - DNA, 20 bp, mouse
gggaagccaggaagcatcaa

SEQ ID NO: 479917 - DNA, 20 bp, mouse
gagccaggaagcatcaaggg

SEQ ID NO: 479918 - DNA, 20 bp, mouse
ggaccacggcgaaggaagcc

SEQ ID NO: 479919 - DNA, 20 bp, mouse
gacctgagggaccacggcga

SEQ ID NO: 479920 - DNA, 20 bp, mouse
gcaagggaggatttgagccc

SEQ ID NO: 479921 - DNA, 20 bp, mouse
ggtacagctccatgccgcct

SEQ ID NO: 479922 - DNA, 20 bp, mouse
gtccttcgccgtggtccctc

SEQ ID NO: 479923 - DNA, 20 bp, mouse
gaccggtcattcggacctga

SEQ ID NO: 479924 - DNA, 20 bp, mouse
ggatttgagcccaggcggca

SEQ ID NO: 479925 - DNA, 20 bp, mouse
gtccctcaggtccgaatgac

SEQ ID NO: 479926 - DNA, 20 bp, mouse
gcgcagaggcgagcggcgga

SEQ ID NO: 479927 - DNA, 20 bp, mouse
ggcggagggcgcagcgatcc

SEQ ID NO: 479928 - DNA, 20 bp, mouse
gggccgcccgcgcgattcaa

SEQ ID NO: 479929 - DNA, 20 bp, mouse
gcgagcggcgcgcgtcgcag

SEQ ID NO: 479930 - DNA, 20 bp, mouse
gtggaggaccgcagcgccca

SEQ ID NO: 479931 - DNA, 20 bp, mouse
ggaggtgcccgaaatcaaag

SEQ ID NO: 479932 - DNA, 20 bp, mouse
ggtggaagggatgcgcccag

SEQ ID NO: 479933 - DNA, 20 bp, mouse
ggcagccccgcgctcgccac

SEQ ID NO: 479934 - DNA, 20 bp, mouse
gccgcagcgcccagggtgag

SEQ ID NO: 479935 - DNA, 20 bp, mouse
gctactcctgtagaacggaa

SEQ ID NO: 479936 - DNA, 20 bp, mouse
gcgggactccggaggacact

SEQ ID NO: 479937 - DNA, 20 bp, mouse
ggcgagttagaggcgaaggt

SEQ ID NO: 479938 - DNA, 20 bp, mouse
gggcagcgagttagaggcga

SEQ ID NO: 479939 - DNA, 20 bp, mouse
gggtggcggcagcgagttag

SEQ ID NO: 479940 - DNA, 20 bp, mouse
gatctgcggaagagagaaga

SEQ ID NO: 479941 - DNA, 20 bp, mouse
ggtgctcgggtccgggactc

SEQ ID NO: 479942 - DNA, 20 bp, mouse
gcggtcgagtgtgcactcta

SEQ ID NO: 479943 - DNA, 20 bp, mouse
gctccgaggaagtccgacct

SEQ ID NO: 479944 - DNA, 20 bp, mouse
gggacccgaagaagtttcta

SEQ ID NO: 479945 - DNA, 20 bp, mouse
gagcccaggtcggacttcct

SEQ ID NO: 479946 - DNA, 20 bp, mouse
ggatcccactgtccagacca

SEQ ID NO: 479947 - DNA, 20 bp, mouse
gccagggctccccaaagcag

SEQ ID NO: 479948 - DNA, 20 bp, mouse
ggaatcctcggagcccatca

SEQ ID NO: 479949 - DNA, 20 bp, mouse
gtctggacagtgggatccgt

SEQ ID NO: 479950 - DNA, 20 bp, mouse
gcacagtgccccagaacgca

SEQ ID NO: 479951 - DNA, 20 bp, mouse
gacactcgccatgcgttctg

SEQ ID NO: 479952 - DNA, 20 bp, mouse
gccacgtggcctgaggaatg

SEQ ID NO: 479953 - DNA, 20 bp, mouse
gtcaccgggcacagaatcct

SEQ ID NO: 479954 - DNA, 20 bp, mouse
ggctttggggagccctggtc

SEQ ID NO: 479955 - DNA, 20 bp, mouse
ggccctagagagacatctct

SEQ ID NO: 479956 - DNA, 20 bp, mouse
ggagagttggcgctacacag

SEQ ID NO: 479957 - DNA, 20 bp, mouse
gcctggacacgcccgagagt

SEQ ID NO: 479958 - DNA, 20 bp, mouse
gggtagagcttggtagactg

SEQ ID NO: 479959 - DNA, 20 bp, mouse
ggtcaagtgcgaaccaaaga

SEQ ID NO: 479960 - DNA, 20 bp, mouse
gggcagggctcgaagagtgg

SEQ ID NO: 479961 - DNA, 20 bp, mouse
gtcgggcgtgtccaggagca

SEQ ID NO: 479962 - DNA, 20 bp, mouse
gctggggcggggcttaacag

SEQ ID NO: 479963 - DNA, 20 bp, mouse
ggttggcgctacacaggggc

SEQ ID NO: 479964 - DNA, 20 bp, mouse
gctttgcagcctgccttctt

SEQ ID NO: 479965 - DNA, 20 bp, mouse
gggtaggtggactcacaggg

SEQ ID NO: 479966 - DNA, 20 bp, mouse
gcgcggcagcggtggcacag

SEQ ID NO: 479967 - DNA, 20 bp, mouse
gggcagcggtggcacagcgg

SEQ ID NO: 479968 - DNA, 20 bp, mouse
ggcggtggcacagcggcggg

SEQ ID NO: 479969 - DNA, 20 bp, mouse
gaatagggcagccgcggcag

SEQ ID NO: 479970 - DNA, 20 bp, mouse
gcggtcccggcggcagaaat

SEQ ID NO: 479971 - DNA, 20 bp, mouse
gggcagaaatagggcagccg

SEQ ID NO: 479972 - DNA, 20 bp, mouse
gactatctctagcacgccag

SEQ ID NO: 479973 - DNA, 20 bp, mouse
gtcctcggctgggtcgtctc

SEQ ID NO: 479974 - DNA, 20 bp, mouse
ggctgcgacccgcttaccta

SEQ ID NO: 479975 - DNA, 20 bp, mouse
gcccgtggcggcgacagagg

SEQ ID NO: 479976 - DNA, 20 bp, mouse
ggttcagcaccgacactctg

SEQ ID NO: 479977 - DNA, 20 bp, mouse
gggaggcgcgagaatcatcc

SEQ ID NO: 479978 - DNA, 20 bp, mouse
gaggcgatcccttacacccg

SEQ ID NO: 479979 - DNA, 20 bp, mouse
gaggagtgcgactcggacgt

SEQ ID NO: 479980 - DNA, 20 bp, mouse
gtgctgaaccccgggtgtaa

SEQ ID NO: 479981 - DNA, 20 bp, mouse
gcgcctgcttgggcacctgg

SEQ ID NO: 479982 - DNA, 20 bp, mouse
ggcaatctgggcgcccactc

SEQ ID NO: 479983 - DNA, 20 bp, mouse
gagtgtcggtgctgaacccc

SEQ ID NO: 479984 - DNA, 20 bp, mouse
ggcgcccagattgcaaacat

SEQ ID NO: 479985 - DNA, 20 bp, mouse
gtggcttttgcggagggagg

SEQ ID NO: 479986 - DNA, 20 bp, mouse
ggcctcttgagaggaacctc

SEQ ID NO: 479987 - DNA, 20 bp, mouse
gggccagcacctgagtccag

SEQ ID NO: 479988 - DNA, 20 bp, mouse
gccctctacagcctcttgag

SEQ ID NO: 479989 - DNA, 20 bp, mouse
ggagaggaacctctggactc

SEQ ID NO: 479990 - DNA, 20 bp, mouse
gtcctctcaagaggctgtag

SEQ ID NO: 479991 - DNA, 20 bp, mouse
gtcctgagagggatccaaca

SEQ ID NO: 479992 - DNA, 20 bp, mouse
gtccagaggttcctctcaag

SEQ ID NO: 479993 - DNA, 20 bp, mouse
ggtgctggccatgtctcagt

SEQ ID NO: 479994 - DNA, 20 bp, mouse
gtcagaggggaacaaccagg

SEQ ID NO: 479995 - DNA, 20 bp, mouse
gcagctctggaacactctgg

SEQ ID NO: 479996 - DNA, 20 bp, mouse
gaggaaaccgcggcgactct

SEQ ID NO: 479997 - DNA, 20 bp, mouse
gatagacagatagacgtagg

SEQ ID NO: 479998 - DNA, 20 bp, mouse
gcagaactaccaccaggacg

SEQ ID NO: 479999 - DNA, 20 bp, mouse
gggtcggaggggtcgagcac

SEQ ID NO: 480000 - DNA, 20 bp, mouse
ggtgcgccagaactaccacc

SEQ ID NO: 480001 - DNA, 20 bp, mouse
gcgcacttgcgagggagacg

SEQ ID NO: 480002 - DNA, 20 bp, mouse
gaccatagacagatagacgt

SEQ ID NO: 480003 - DNA, 20 bp, mouse
ggactctgggcgagaacgtc

SEQ ID NO: 480004 - DNA, 20 bp, mouse
gcggccggcgggggtcggag

SEQ ID NO: 480005 - DNA, 20 bp, mouse
gggctcgaagcggccggcgg

SEQ ID NO: 480006 - DNA, 20 bp, mouse
gaggcgctgctctaagtccc

SEQ ID NO: 480007 - DNA, 20 bp, mouse
gagcatgttgaccctccgga

SEQ ID NO: 480008 - DNA, 20 bp, mouse
gaaaggagcgctccttgccc

SEQ ID NO: 480009 - DNA, 20 bp, mouse
gacgtcttggaagggagtgg

SEQ ID NO: 480010 - DNA, 20 bp, mouse
gtacacagcgcgcagggaga

SEQ ID NO: 480011 - DNA, 20 bp, mouse
gctgctctaagtcccgggca

SEQ ID NO: 480012 - DNA, 20 bp, mouse
gcctggggcacccctccctc

SEQ ID NO: 480013 - DNA, 20 bp, mouse
gagggtcaacatgctataaa

SEQ ID NO: 480014 - DNA, 20 bp, mouse
gagtacgtgtgagatttcga

SEQ ID NO: 480015 - DNA, 20 bp, mouse
gggcccgcgcatgcgcagga

SEQ ID NO: 480016 - DNA, 20 bp, mouse
gggtctagtggagtcctgag

SEQ ID NO: 480017 - DNA, 20 bp, mouse
ggtcgaggggaggccagtag

SEQ ID NO: 480018 - DNA, 20 bp, mouse
ggactcctgtttgaaaggag

SEQ ID NO: 480019 - DNA, 20 bp, mouse
gcggaccctggaaggtctag

SEQ ID NO: 480020 - DNA, 20 bp, mouse
gagcatgactcctgtttgaa

SEQ ID NO: 480021 - DNA, 20 bp, mouse
gcgagtccgggtgaaagttc

SEQ ID NO: 480022 - DNA, 20 bp, mouse
gaggccagtaggggacctaa

SEQ ID NO: 480023 - DNA, 20 bp, mouse
ggactccactagaccttcca

SEQ ID NO: 480024 - DNA, 20 bp, mouse
ggatagcagcctccgagtcc

SEQ ID NO: 480025 - DNA, 20 bp, mouse
ggaagtagtaagccatggac

SEQ ID NO: 480026 - DNA, 20 bp, mouse
gaagcgcgtccagaccgcgg

SEQ ID NO: 480027 - DNA, 20 bp, mouse
gatgaagcgcgtccagaccg

SEQ ID NO: 480028 - DNA, 20 bp, mouse
ggaccgcggaggaacgagag

SEQ ID NO: 480029 - DNA, 20 bp, mouse
ggggggaacacggcccacgg

SEQ ID NO: 480030 - DNA, 20 bp, mouse
ggaacgagagcgggaagcta

SEQ ID NO: 480031 - DNA, 20 bp, mouse
gcgggaagctaaggtatgtg

SEQ ID NO: 480032 - DNA, 20 bp, mouse
gacacggcccacggtggcga

SEQ ID NO: 480033 - DNA, 20 bp, mouse
gacacaggaggcggggtcca

SEQ ID NO: 480034 - DNA, 20 bp, mouse
gggcggggtccagggcgagg

SEQ ID NO: 480035 - DNA, 20 bp, mouse
gaagccgccttcgccaccgt

SEQ ID NO: 480036 - DNA, 20 bp, mouse
gccgcgtggcgacaacctct

SEQ ID NO: 480037 - DNA, 20 bp, mouse
ggttccacggagatccagac

SEQ ID NO: 480038 - DNA, 20 bp, mouse
ggctccggtctggatctccg

SEQ ID NO: 480039 - DNA, 20 bp, mouse
ggcctgtcgtacacgcctag

SEQ ID NO: 480040 - DNA, 20 bp, mouse
gtgaaagggaccgagactgg

SEQ ID NO: 480041 - DNA, 20 bp, mouse
gcatacgttgtgctccggtc

SEQ ID NO: 480042 - DNA, 20 bp, mouse
ggtgttcggagtggacccga

SEQ ID NO: 480043 - DNA, 20 bp, mouse
ggtaaaacagttcagttcca

SEQ ID NO: 480044 - DNA, 20 bp, mouse
gagcagggaactagattgtt

SEQ ID NO: 480045 - DNA, 20 bp, mouse
gacctctaggcgtgtacgac

SEQ ID NO: 480046 - DNA, 20 bp, mouse
gtggccgggtgagtgagtta

SEQ ID NO: 480047 - DNA, 20 bp, mouse
gaccagcaagcagcaatggc

SEQ ID NO: 480048 - DNA, 20 bp, mouse
gggcgtctgcctgcgctaaa

SEQ ID NO: 480049 - DNA, 20 bp, mouse
gacgccgtaactcactcacc

SEQ ID NO: 480050 - DNA, 20 bp, mouse
gggagtggatgacagtagta

SEQ ID NO: 480051 - DNA, 20 bp, mouse
gtttgcatacaggaacggag

SEQ ID NO: 480052 - DNA, 20 bp, mouse
gacgtctttgcatacaggaa

SEQ ID NO: 480053 - DNA, 20 bp, mouse
gactttggacccccatacac

SEQ ID NO: 480054 - DNA, 20 bp, mouse
gagggcgggacttccggcgg

SEQ ID NO: 480055 - DNA, 20 bp, mouse
gaggcttgcaacatagaaat

SEQ ID NO: 480056 - DNA, 20 bp, mouse
gcttaggaagcagcacatgt

SEQ ID NO: 480057 - DNA, 20 bp, mouse
gtaagggctatctaacgtct

SEQ ID NO: 480058 - DNA, 20 bp, mouse
gctcgcttcggttcctcagg

SEQ ID NO: 480059 - DNA, 20 bp, mouse
ggcttcggttcctcaggcgg

SEQ ID NO: 480060 - DNA, 20 bp, mouse
gtgaaaacctgcggagttaa

SEQ ID NO: 480061 - DNA, 20 bp, mouse
gccgcaggttttcaactctt

SEQ ID NO: 480062 - DNA, 20 bp, mouse
gacagtggctgtattagtag

SEQ ID NO: 480063 - DNA, 20 bp, mouse
gatcccgccatgggcaagaa

SEQ ID NO: 480064 - DNA, 20 bp, mouse
gtaggaaacgcgcgcagaag

SEQ ID NO: 480065 - DNA, 20 bp, mouse
ggccaaggagactggtgagt

SEQ ID NO: 480066 - DNA, 20 bp, mouse
ggcctccctccgcgaggaaa

SEQ ID NO: 480067 - DNA, 20 bp, mouse
gcgccagccgagccagacga

SEQ ID NO: 480068 - DNA, 20 bp, mouse
gcagccgagccagacgacgg

SEQ ID NO: 480069 - DNA, 20 bp, mouse
gctcggttaactgctaagaa

SEQ ID NO: 480070 - DNA, 20 bp, mouse
ggaatgtgatagagcctcga

SEQ ID NO: 480071 - DNA, 20 bp, mouse
gggaagtggaggccacgctc

SEQ ID NO: 480072 - DNA, 20 bp, mouse
gtaagcgtggaccgaccgcg

SEQ ID NO: 480073 - DNA, 20 bp, mouse
gagatgccctgcagagagcg

SEQ ID NO: 480074 - DNA, 20 bp, mouse
gagagcgcggcaggtaagcg

SEQ ID NO: 480075 - DNA, 20 bp, mouse
ggccgtttcctcgcggaggg

SEQ ID NO: 480076 - DNA, 20 bp, mouse
gacgggtcccggagcggagt

SEQ ID NO: 480077 - DNA, 20 bp, mouse
gccggctacgggtcccggag

SEQ ID NO: 480078 - DNA, 20 bp, mouse
ggaccgggggagccgagcga

SEQ ID NO: 480079 - DNA, 20 bp, mouse
ggagtgggaggccggaccgg

SEQ ID NO: 480080 - DNA, 20 bp, mouse
gagccgagcgacggcggtgg

SEQ ID NO: 480081 - DNA, 20 bp, mouse
ggcggagtgggaggccggac

SEQ ID NO: 480082 - DNA, 20 bp, mouse
gcgggggagccgagcgacgg

SEQ ID NO: 480083 - DNA, 20 bp, mouse
gccggcggaagggaagcgaa

SEQ ID NO: 480084 - DNA, 20 bp, mouse
gagcgctccggtgggcatga

SEQ ID NO: 480085 - DNA, 20 bp, mouse
gggccctaggcgcccaccgg

SEQ ID NO: 480086 - DNA, 20 bp, mouse
gggagctgaacttgagtggt

SEQ ID NO: 480087 - DNA, 20 bp, mouse
gtgtaggagctgaacttgag

SEQ ID NO: 480088 - DNA, 20 bp, mouse
ggtggtgggctgtggactct

SEQ ID NO: 480089 - DNA, 20 bp, mouse
gggagccagggccactgcct

SEQ ID NO: 480090 - DNA, 20 bp, mouse
ggggcagtgaatggttctgg

SEQ ID NO: 480091 - DNA, 20 bp, mouse
gctgccagtccggagtgaag

SEQ ID NO: 480092 - DNA, 20 bp, mouse
ggcgccgcttcactccggac

SEQ ID NO: 480093 - DNA, 20 bp, mouse
gtgttctcggtgcccgcctg

SEQ ID NO: 480094 - DNA, 20 bp, mouse
gcgcttgcgtgttaagaggg

SEQ ID NO: 480095 - DNA, 20 bp, mouse
gcggtgcgggcccggaagca

SEQ ID NO: 480096 - DNA, 20 bp, mouse
gaactgggagtctggctctg

SEQ ID NO: 480097 - DNA, 20 bp, mouse
ggcttgtagctggaacacat

SEQ ID NO: 480098 - DNA, 20 bp, mouse
gctagtccagtcttacggac

SEQ ID NO: 480099 - DNA, 20 bp, mouse
gggtaggtaggctgtagcag

SEQ ID NO: 480100 - DNA, 20 bp, mouse
gacgatagccctgtcaaggt

SEQ ID NO: 480101 - DNA, 20 bp, mouse
gtcatgacctcacatgtgat

SEQ ID NO: 480102 - DNA, 20 bp, mouse
gggagtgtcctgacacgtac

SEQ ID NO: 480103 - DNA, 20 bp, mouse
gagtctcagctggggtaggt

SEQ ID NO: 480104 - DNA, 20 bp, mouse
gtacaacgatagccctgtca

SEQ ID NO: 480105 - DNA, 20 bp, mouse
gcaaattagaactgggagtc

SEQ ID NO: 480106 - DNA, 20 bp, mouse
ggccagcctgggatcctcgg

SEQ ID NO: 480107 - DNA, 20 bp, mouse
gggggaaccgccagtcacca

SEQ ID NO: 480108 - DNA, 20 bp, mouse
gaagccggaaggccagcgct

SEQ ID NO: 480109 - DNA, 20 bp, mouse
gcgcgccagcctgggatcct

SEQ ID NO: 480110 - DNA, 20 bp, mouse
gggctgacagagaaggttcc

SEQ ID NO: 480111 - DNA, 20 bp, mouse
gccccccaaggcctcaggag

SEQ ID NO: 480112 - DNA, 20 bp, mouse
gagaaggttcccggcttccc

SEQ ID NO: 480113 - DNA, 20 bp, mouse
gggttcgaccaggccaagtt

SEQ ID NO: 480114 - DNA, 20 bp, mouse
gcacggagaacactccccag

SEQ ID NO: 480115 - DNA, 20 bp, mouse
gcggttcccccgaggatccc

SEQ ID NO: 480116 - DNA, 20 bp, mouse
gaaggcgccccaaactacag

SEQ ID NO: 480117 - DNA, 20 bp, mouse
gagtggaactgaagaccccg

SEQ ID NO: 480118 - DNA, 20 bp, mouse
gtgggcggacgcaggtatgt

SEQ ID NO: 480119 - DNA, 20 bp, mouse
gctagagctccctggctcaa

SEQ ID NO: 480120 - DNA, 20 bp, mouse
gcagagccggctctttaacg

SEQ ID NO: 480121 - DNA, 20 bp, mouse
gcgcaggtatgtgggtccgc

SEQ ID NO: 480122 - DNA, 20 bp, mouse
gagccggctctgcgagcgct

SEQ ID NO: 480123 - DNA, 20 bp, mouse
gatctgggaaacccgcagga

SEQ ID NO: 480124 - DNA, 20 bp, mouse
gaggtgtccgcaagtcgtgg

SEQ ID NO: 480125 - DNA, 20 bp, mouse
gcgcagccgcgttaaagagc

SEQ ID NO: 480126 - DNA, 20 bp, mouse
gctggccgctggcggtatca

SEQ ID NO: 480127 - DNA, 20 bp, mouse
gaccgccagcggccagttgg

SEQ ID NO: 480128 - DNA, 20 bp, mouse
gagggcccgaagtagtctct

SEQ ID NO: 480129 - DNA, 20 bp, mouse
gctggctgctcaccttgggg

SEQ ID NO: 480130 - DNA, 20 bp, mouse
ggcgtcccagagactacttc

SEQ ID NO: 480131 - DNA, 20 bp, mouse
gtctagccttggttaggtgt

SEQ ID NO: 480132 - DNA, 20 bp, mouse
ggacagagccccagaaacac

SEQ ID NO: 480133 - DNA, 20 bp, mouse
ggatgccatgataccgccag

SEQ ID NO: 480134 - DNA, 20 bp, mouse
ggctcacctacacctaacca

SEQ ID NO: 480135 - DNA, 20 bp, mouse
gccttggggaggggggttcc

SEQ ID NO: 480136 - DNA, 20 bp, mouse
gcgcgcgcaagggccagggg

SEQ ID NO: 480137 - DNA, 20 bp, mouse
gccgctaacagtcaaggtaa

SEQ ID NO: 480138 - DNA, 20 bp, mouse
ggcacgcgcgcaagggccag

SEQ ID NO: 480139 - DNA, 20 bp, mouse
gctgttagcggccatttcgg

SEQ ID NO: 480140 - DNA, 20 bp, mouse
gaaatggccgctaacagtca

SEQ ID NO: 480141 - DNA, 20 bp, mouse
gggcgggagcacgcgcgcaa

SEQ ID NO: 480142 - DNA, 20 bp, mouse
gaggcagagataacatccct

SEQ ID NO: 480143 - DNA, 20 bp, mouse
gcggtaggggcggcactgaa

SEQ ID NO: 480144 - DNA, 20 bp, mouse
gcctagggacacctcggtag

SEQ ID NO: 480145 - DNA, 20 bp, mouse
gctgaaaggctagaagagct

SEQ ID NO: 480146 - DNA, 20 bp, mouse
gcggccatggttgcgctcaa

SEQ ID NO: 480147 - DNA, 20 bp, mouse
ggctcaggagacagcacctt

SEQ ID NO: 480148 - DNA, 20 bp, mouse
gatgcccttgagcgcaacca

SEQ ID NO: 480149 - DNA, 20 bp, mouse
ggcaaggcgggaaaacacag

SEQ ID NO: 480150 - DNA, 20 bp, mouse
gcagcgcggccctctgacag

SEQ ID NO: 480151 - DNA, 20 bp, mouse
gcatggccgcaggattggta

SEQ ID NO: 480152 - DNA, 20 bp, mouse
gacaggggtgcgatcctcgt

SEQ ID NO: 480153 - DNA, 20 bp, mouse
gtccgtggtcaggtgctcta

SEQ ID NO: 480154 - DNA, 20 bp, mouse
gcctcgtaggagcccttaac

SEQ ID NO: 480155 - DNA, 20 bp, mouse
gaatagcttcctgctccgaa

SEQ ID NO: 480156 - DNA, 20 bp, mouse
ggccgccgccgctgtgacag

SEQ ID NO: 480157 - DNA, 20 bp, mouse
gccggccggcgaccagggca

SEQ ID NO: 480158 - DNA, 20 bp, mouse
gactcgggccgctgtcacag

SEQ ID NO: 480159 - DNA, 20 bp, mouse
gcggcgaccagggcaaggct

SEQ ID NO: 480160 - DNA, 20 bp, mouse
gcggccgaggggtacccgag

SEQ ID NO: 480161 - DNA, 20 bp, mouse
gtcggcccggccggcgacca

SEQ ID NO: 480162 - DNA, 20 bp, mouse
gtaaacaagccgcgccgccg

SEQ ID NO: 480163 - DNA, 20 bp, mouse
gcgggccgctgtcacagcgg

SEQ ID NO: 480164 - DNA, 20 bp, mouse
gcccaggccgagccttgccc

SEQ ID NO: 480165 - DNA, 20 bp, mouse
gcggccgctcgggtacccct

SEQ ID NO: 480166 - DNA, 20 bp, mouse
gcgatgccgcgaggactgag

SEQ ID NO: 480167 - DNA, 20 bp, mouse
gcggggccgctcagtcctcg

SEQ ID NO: 480168 - DNA, 20 bp, mouse
gtcctcgcggcatcgcttcg

SEQ ID NO: 480169 - DNA, 20 bp, mouse
gggtatgtgggagcgcgagg

SEQ ID NO: 480170 - DNA, 20 bp, mouse
gacctctggcgggaagcagc

SEQ ID NO: 480171 - DNA, 20 bp, mouse
ggcatcgcttcgcggtcgtc

SEQ ID NO: 480172 - DNA, 20 bp, mouse
gccaggggagccaaacaaaa

SEQ ID NO: 480173 - DNA, 20 bp, mouse
gtctggcgggaagcagcggg

SEQ ID NO: 480174 - DNA, 20 bp, mouse
ggacaaagcgaggccgggaa

SEQ ID NO: 480175 - DNA, 20 bp, mouse
gcctttggcgcggagaccgt

SEQ ID NO: 480176 - DNA, 20 bp, mouse
ggaaggctcagagaccggtg

SEQ ID NO: 480177 - DNA, 20 bp, mouse
gccttcagtcagtttcagga

SEQ ID NO: 480178 - DNA, 20 bp, mouse
gagcttgaagcggagggcta

SEQ ID NO: 480179 - DNA, 20 bp, mouse
gggaaggaagcttgaagcgg

SEQ ID NO: 480180 - DNA, 20 bp, mouse
gtcggccgcgcttggaagtc

SEQ ID NO: 480181 - DNA, 20 bp, mouse
gaagcggagggctacggagc

SEQ ID NO: 480182 - DNA, 20 bp, mouse
gttccaagcgcggccgatga

SEQ ID NO: 480183 - DNA, 20 bp, mouse
ggcaaggagctcaggttagt

SEQ ID NO: 480184 - DNA, 20 bp, mouse
gcgcccagggatgagtattt

SEQ ID NO: 480185 - DNA, 20 bp, mouse
gggctcctgacttccaagcg

SEQ ID NO: 480186 - DNA, 20 bp, mouse
gtcctccaacaatcctcggg

SEQ ID NO: 480187 - DNA, 20 bp, mouse
gaatagaaagtgaggactct

SEQ ID NO: 480188 - DNA, 20 bp, mouse
ggcatccccccgaggattgt

SEQ ID NO: 480189 - DNA, 20 bp, mouse
gtccccccgaggattgttgg

SEQ ID NO: 480190 - DNA, 20 bp, mouse
gagactcaccttaggcatca

SEQ ID NO: 480191 - DNA, 20 bp, mouse
gagcgtcccgcatccccccg

SEQ ID NO: 480192 - DNA, 20 bp, mouse
ggattgttggaggattgttg

SEQ ID NO: 480193 - DNA, 20 bp, mouse
gcgggtcttcgcaagagctc

SEQ ID NO: 480194 - DNA, 20 bp, mouse
gctgctgccggtggagactg

SEQ ID NO: 480195 - DNA, 20 bp, mouse
gcaatcctccaacaatcctc

SEQ ID NO: 480196 - DNA, 20 bp, mouse
gacactgagcacccccaggg

SEQ ID NO: 480197 - DNA, 20 bp, mouse
gcagacactgagcaccccca

SEQ ID NO: 480198 - DNA, 20 bp, mouse
ggctgctcgctgtaccgagg

SEQ ID NO: 480199 - DNA, 20 bp, mouse
gatggctgctcgctgtaccg

SEQ ID NO: 480200 - DNA, 20 bp, mouse
gagggcggccagcaccgcct

SEQ ID NO: 480201 - DNA, 20 bp, mouse
gagggggtccggtgtggaca

SEQ ID NO: 480202 - DNA, 20 bp, mouse
gggtttcgtgctgtccgagg

SEQ ID NO: 480203 - DNA, 20 bp, mouse
ggaagtgcggaaacagacct

SEQ ID NO: 480204 - DNA, 20 bp, mouse
gggctccaccacagcaacac

SEQ ID NO: 480205 - DNA, 20 bp, mouse
ggggtccgaggcttccgggg

SEQ ID NO: 480206 - DNA, 20 bp, mouse
gcgtggctctgcggactgga

SEQ ID NO: 480207 - DNA, 20 bp, mouse
gagtccgcagagccacgctg

SEQ ID NO: 480208 - DNA, 20 bp, mouse
gcagggaaatgacctaggaa

SEQ ID NO: 480209 - DNA, 20 bp, mouse
ggaaccgcagcgtggctctg

SEQ ID NO: 480210 - DNA, 20 bp, mouse
gcctgaacgaagagccaagc

SEQ ID NO: 480211 - DNA, 20 bp, mouse
gcgggagcttgggagaccca

SEQ ID NO: 480212 - DNA, 20 bp, mouse
gggctgggactccagagtct

SEQ ID NO: 480213 - DNA, 20 bp, mouse
ggaatggacgaaccgcagcg

SEQ ID NO: 480214 - DNA, 20 bp, mouse
gcaccccagggctctctgga

SEQ ID NO: 480215 - DNA, 20 bp, mouse
gaccccaccccagggctctc

SEQ ID NO: 480216 - DNA, 20 bp, mouse
ggtccaccgtccgtgagggg

SEQ ID NO: 480217 - DNA, 20 bp, mouse
ggagccggtgccgcccctca

SEQ ID NO: 480218 - DNA, 20 bp, mouse
gcggtgccgcccctcacgga

SEQ ID NO: 480219 - DNA, 20 bp, mouse
gcgtccacgagtggccaccg

SEQ ID NO: 480220 - DNA, 20 bp, mouse
gcgcgtccaccgtccgtgag

SEQ ID NO: 480221 - DNA, 20 bp, mouse
ggcatcggcggacccacggg

SEQ ID NO: 480222 - DNA, 20 bp, mouse
gtccatgtggcgtccacgag

SEQ ID NO: 480223 - DNA, 20 bp, mouse
gcccctccatggctccggcc

SEQ ID NO: 480224 - DNA, 20 bp, mouse
ggagccgcggtggccactcg

SEQ ID NO: 480225 - DNA, 20 bp, mouse
gagagctacagcatgagagc

SEQ ID NO: 480226 - DNA, 20 bp, mouse
gagatggtgaggagccccag

SEQ ID NO: 480227 - DNA, 20 bp, mouse
gcagggtgcctctgttggag

SEQ ID NO: 480228 - DNA, 20 bp, mouse
gagggtaccaccccaccagg

SEQ ID NO: 480229 - DNA, 20 bp, mouse
gccctgagcctagggtgaca

SEQ ID NO: 480230 - DNA, 20 bp, mouse
gctcaccttggtagatggtg

SEQ ID NO: 480231 - DNA, 20 bp, mouse
gccttctggaattgtcacca

SEQ ID NO: 480232 - DNA, 20 bp, mouse
ggctccggttagcactcaga

SEQ ID NO: 480233 - DNA, 20 bp, mouse
gccgcagcctcctggtgggg

SEQ ID NO: 480234 - DNA, 20 bp, mouse
gggccagtgccagataagga

SEQ ID NO: 480235 - DNA, 20 bp, mouse
gttcagggtaccaccccacc

SEQ ID NO: 480236 - DNA, 20 bp, mouse
ggacagcagtgccatggcca

SEQ ID NO: 480237 - DNA, 20 bp, mouse
ggaggcgagtgcaggctgat

SEQ ID NO: 480238 - DNA, 20 bp, mouse
gccagggcagaggcgagtgc

SEQ ID NO: 480239 - DNA, 20 bp, mouse
ggatgggcagggcacttctg

SEQ ID NO: 480240 - DNA, 20 bp, mouse
ggaaactgacagcagtgcca

SEQ ID NO: 480241 - DNA, 20 bp, mouse
ggtcgggcagagcgaagtgt

SEQ ID NO: 480242 - DNA, 20 bp, mouse
ggccttgtcacgtgagacta

SEQ ID NO: 480243 - DNA, 20 bp, mouse
ggccatagtctcacgtgaca

SEQ ID NO: 480244 - DNA, 20 bp, mouse
gagtgacatagggtcgggtc

SEQ ID NO: 480245 - DNA, 20 bp, mouse
gttataccctgcgaggggat

SEQ ID NO: 480246 - DNA, 20 bp, mouse
gggcggcgcgagccaggcag

SEQ ID NO: 480247 - DNA, 20 bp, mouse
gctggccgcggcgggagagt

SEQ ID NO: 480248 - DNA, 20 bp, mouse
gcgccggagtggctccgacc

SEQ ID NO: 480249 - DNA, 20 bp, mouse
gtactcccgactgaagggag

SEQ ID NO: 480250 - DNA, 20 bp, mouse
gccccgcctgcgctcccggt

SEQ ID NO: 480251 - DNA, 20 bp, mouse
ggcgcaggcggggaagccgc

SEQ ID NO: 480252 - DNA, 20 bp, mouse
gcttcggcgccactgactga

SEQ ID NO: 480253 - DNA, 20 bp, mouse
gcctcgctcgcgccggccgg

SEQ ID NO: 480254 - DNA, 20 bp, mouse
gagcaggctgggacgccgag

SEQ ID NO: 480255 - DNA, 20 bp, mouse
gtccgaccgggagcgcaggc

SEQ ID NO: 480256 - DNA, 20 bp, mouse
gccgggtgaggaaagatcca

SEQ ID NO: 480257 - DNA, 20 bp, mouse
gcctcggcagcccgggagat

SEQ ID NO: 480258 - DNA, 20 bp, mouse
ggcagcaacctcggcagccc

SEQ ID NO: 480259 - DNA, 20 bp, mouse
gggtagccaagaggcgagag

SEQ ID NO: 480260 - DNA, 20 bp, mouse
gtagcgtagccggagtccgg

SEQ ID NO: 480261 - DNA, 20 bp, mouse
gagccaagaggcgagagcgg

SEQ ID NO: 480262 - DNA, 20 bp, mouse
gcggcggggtctcaaggcac

SEQ ID NO: 480263 - DNA, 20 bp, mouse
gggtctcaaggcaccgggtg

SEQ ID NO: 480264 - DNA, 20 bp, mouse
ggagatgggaagagagcgcg

SEQ ID NO: 480265 - DNA, 20 bp, mouse
ggagtaccagagactctagg

SEQ ID NO: 480266 - DNA, 20 bp, mouse
ggccctctggcggctccaaa

SEQ ID NO: 480267 - DNA, 20 bp, mouse
gcagagggcgagaagccgga

SEQ ID NO: 480268 - DNA, 20 bp, mouse
gggaggggctgagttgatga

SEQ ID NO: 480269 - DNA, 20 bp, mouse
gacaccgagagtctccaggg

SEQ ID NO: 480270 - DNA, 20 bp, mouse
ggcgggtagtgaaagcaagt

SEQ ID NO: 480271 - DNA, 20 bp, mouse
ggccgtttggagccgccaga

SEQ ID NO: 480272 - DNA, 20 bp, mouse
gccctcccgtcaacaggtgg

SEQ ID NO: 480273 - DNA, 20 bp, mouse
gaacaggggaaccccgctag

SEQ ID NO: 480274 - DNA, 20 bp, mouse
gtgctactccgacaaaacag

SEQ ID NO: 480275 - DNA, 20 bp, mouse
gtgtggatctaggagcatgc

SEQ ID NO: 480276 - DNA, 20 bp, mouse
gtccctggcaaaagcactct

SEQ ID NO: 480277 - DNA, 20 bp, mouse
gctggggagttgctagtgtg

SEQ ID NO: 480278 - DNA, 20 bp, mouse
gtaatggcagtggataggtg

SEQ ID NO: 480279 - DNA, 20 bp, mouse
ggcttttgccagggacgaac

SEQ ID NO: 480280 - DNA, 20 bp, mouse
gacgcagtagccgagttcta

SEQ ID NO: 480281 - DNA, 20 bp, mouse
gtatccggagagtcattatc

SEQ ID NO: 480282 - DNA, 20 bp, mouse
gtactgcgtcctacaagcct

SEQ ID NO: 480283 - DNA, 20 bp, mouse
gccccagagtgcttttgcca

SEQ ID NO: 480284 - DNA, 20 bp, mouse
gccagggacgaactggaatt

SEQ ID NO: 480285 - DNA, 20 bp, mouse
ggaacttgccgaggactctc

SEQ ID NO: 480286 - DNA, 20 bp, mouse
ggtccggggcagcaagccca

SEQ ID NO: 480287 - DNA, 20 bp, mouse
gcggagctggagtagcatgt

SEQ ID NO: 480288 - DNA, 20 bp, mouse
ggtagcatgtgggcgttcgg

SEQ ID NO: 480289 - DNA, 20 bp, mouse
gtcggaggtcgcgcagccgt

SEQ ID NO: 480290 - DNA, 20 bp, mouse
gcgcgggttcccgacccagg

SEQ ID NO: 480291 - DNA, 20 bp, mouse
ggggttcccgacccaggcgg

SEQ ID NO: 480292 - DNA, 20 bp, mouse
gctgcgcgtccccggcatag

SEQ ID NO: 480293 - DNA, 20 bp, mouse
gggagtagcatgtgggcgtt

SEQ ID NO: 480294 - DNA, 20 bp, mouse
gtcagggcgtgagactaatg

SEQ ID NO: 480295 - DNA, 20 bp, mouse
ggcgcgcaaccagagcgact

SEQ ID NO: 480296 - DNA, 20 bp, mouse
gaacatggcggagctgacgg

SEQ ID NO: 480297 - DNA, 20 bp, mouse
gagctgacggtggaggttcg

SEQ ID NO: 480298 - DNA, 20 bp, mouse
gatggcggagctgacggtgg

SEQ ID NO: 480299 - DNA, 20 bp, mouse
gagcctttgcggttccaaca

SEQ ID NO: 480300 - DNA, 20 bp, mouse
gcgccatgttggaaccgcaa

SEQ ID NO: 480301 - DNA, 20 bp, mouse
gcaggacgctccgggacagg

SEQ ID NO: 480302 - DNA, 20 bp, mouse
gtggaggttcgcggctccaa

SEQ ID NO: 480303 - DNA, 20 bp, mouse
gcaaggtacgggccgcgggg

SEQ ID NO: 480304 - DNA, 20 bp, mouse
ggaccccgggggccgaggag

SEQ ID NO: 480305 - DNA, 20 bp, mouse
gtaaaccgcgccgagggcag

SEQ ID NO: 480306 - DNA, 20 bp, mouse
ggcggcgggtcccgggaccg

SEQ ID NO: 480307 - DNA, 20 bp, mouse
gtgtgcgcctgcgcagtagg

SEQ ID NO: 480308 - DNA, 20 bp, mouse
gacccgccgctgccgctcca

SEQ ID NO: 480309 - DNA, 20 bp, mouse
ggcggaagctgaggtgacga

SEQ ID NO: 480310 - DNA, 20 bp, mouse
ggaagctgaggtgacgaagg

SEQ ID NO: 480311 - DNA, 20 bp, mouse
gggaggccgtggagcggcag

SEQ ID NO: 480312 - DNA, 20 bp, mouse
ggccccggccccctgctcgt

SEQ ID NO: 480313 - DNA, 20 bp, mouse
ggcagagaggcgaccaggag

SEQ ID NO: 480314 - DNA, 20 bp, mouse
ggtggcggagaccaaggcag

SEQ ID NO: 480315 - DNA, 20 bp, mouse
gccgctgctgcctcggtccc

SEQ ID NO: 480316 - DNA, 20 bp, mouse
gctgggtacagagagaccac

SEQ ID NO: 480317 - DNA, 20 bp, mouse
gcgcagtggccgctgaaaaa

SEQ ID NO: 480318 - DNA, 20 bp, mouse
gcctgccaggggtctcgcag

SEQ ID NO: 480319 - DNA, 20 bp, mouse
ggggggtcttctgtcaacag

SEQ ID NO: 480320 - DNA, 20 bp, mouse
ggacaggggttgcacagggg

SEQ ID NO: 480321 - DNA, 20 bp, mouse
gcaggcaggcctgacccaag

SEQ ID NO: 480322 - DNA, 20 bp, mouse
ggtgcacagctggacatttg

SEQ ID NO: 480323 - DNA, 20 bp, mouse
gacaggggacagcgtgaatg

SEQ ID NO: 480324 - DNA, 20 bp, mouse
ggcggccactgcgagacccc

SEQ ID NO: 480325 - DNA, 20 bp, mouse
gcactggttgaggtgtgtag

SEQ ID NO: 480326 - DNA, 20 bp, mouse
gggccacaggaagaccgtcg

SEQ ID NO: 480327 - DNA, 20 bp, mouse
gcgtcgtggagaagccccga

SEQ ID NO: 480328 - DNA, 20 bp, mouse
ggacactgtccccatagtag

SEQ ID NO: 480329 - DNA, 20 bp, mouse
ggcccaccagagccagtccc

SEQ ID NO: 480330 - DNA, 20 bp, mouse
gtccccatagtagaggccac

SEQ ID NO: 480331 - DNA, 20 bp, mouse
gcagatctgtcagcgaacag

SEQ ID NO: 480332 - DNA, 20 bp, mouse
gtcctgtggcctctactatg

SEQ ID NO: 480333 - DNA, 20 bp, mouse
gctccacgacggtcttcctg

SEQ ID NO: 480334 - DNA, 20 bp, mouse
gtggagaagccccgatggct

SEQ ID NO: 480335 - DNA, 20 bp, mouse
gcgtggccagggcagaggtg

SEQ ID NO: 480336 - DNA, 20 bp, mouse
gctgaggtacgcaggagcca

SEQ ID NO: 480337 - DNA, 20 bp, mouse
gccaagccccaggcaagggc

SEQ ID NO: 480338 - DNA, 20 bp, mouse
gccttgcctggggcttggat

SEQ ID NO: 480339 - DNA, 20 bp, mouse
gccatggtaggagctgctgg

SEQ ID NO: 480340 - DNA, 20 bp, mouse
gggaggtgtctgaggtacgc

SEQ ID NO: 480341 - DNA, 20 bp, mouse
gggtaccacctgtccatggt

SEQ ID NO: 480342 - DNA, 20 bp, mouse
gaggcttgggagactcaccc

SEQ ID NO: 480343 - DNA, 20 bp, mouse
ggaggtccccgtccctatta

SEQ ID NO: 480344 - DNA, 20 bp, mouse
ggagacaggctgccctaata

SEQ ID NO: 480345 - DNA, 20 bp, mouse
gctggatgaggaggctgata

SEQ ID NO: 480346 - DNA, 20 bp, mouse
gagtagctcaacaggctgag

SEQ ID NO: 480347 - DNA, 20 bp, mouse
gctcacctgagtagctcaac

SEQ ID NO: 480348 - DNA, 20 bp, mouse
gcaggctgagaggtggttcc

SEQ ID NO: 480349 - DNA, 20 bp, mouse
ggtataatccagtcccacag

SEQ ID NO: 480350 - DNA, 20 bp, mouse
gtgggacaatcagctgacag

SEQ ID NO: 480351 - DNA, 20 bp, mouse
gtccatactctgctttctcc

SEQ ID NO: 480352 - DNA, 20 bp, mouse
gccagatggctcacctctgt

SEQ ID NO: 480353 - DNA, 20 bp, mouse
gtctcagtggatgagagtag

SEQ ID NO: 480354 - DNA, 20 bp, mouse
gagagtagaggggtgtctag

SEQ ID NO: 480355 - DNA, 20 bp, mouse
ggataaaggctgtcccggct

SEQ ID NO: 480356 - DNA, 20 bp, mouse
gtgggcgagcccataactcc

SEQ ID NO: 480357 - DNA, 20 bp, mouse
gtccacctccagatggaacc

SEQ ID NO: 480358 - DNA, 20 bp, mouse
gcgagcccataactccagga

SEQ ID NO: 480359 - DNA, 20 bp, mouse
gtggaccttcctggagatac

SEQ ID NO: 480360 - DNA, 20 bp, mouse
gtctgcctggttccatctgg

SEQ ID NO: 480361 - DNA, 20 bp, mouse
gcaagtctcagggtcggggt

SEQ ID NO: 480362 - DNA, 20 bp, mouse
gaggaaggtccacctccaga

SEQ ID NO: 480363 - DNA, 20 bp, mouse
gcaagcctgtatctccagga

SEQ ID NO: 480364 - DNA, 20 bp, mouse
ggcctggttccatctggagg

SEQ ID NO: 480365 - DNA, 20 bp, mouse
gacctctgcctggttccatc

SEQ ID NO: 480366 - DNA, 20 bp, mouse
gctggctcgagtcatctccc

SEQ ID NO: 480367 - DNA, 20 bp, mouse
gggtgcagagaggaagtctg

SEQ ID NO: 480368 - DNA, 20 bp, mouse
ggtctgaggagagcctaggt

SEQ ID NO: 480369 - DNA, 20 bp, mouse
ggtgtgctccttagaagggg

SEQ ID NO: 480370 - DNA, 20 bp, mouse
gatgactcgagccaggggag

SEQ ID NO: 480371 - DNA, 20 bp, mouse
gcctctctgcaccactcccc

SEQ ID NO: 480372 - DNA, 20 bp, mouse
gtcaggactaggggaagtaa

SEQ ID NO: 480373 - DNA, 20 bp, mouse
gctttctgccaccccttcta

SEQ ID NO: 480374 - DNA, 20 bp, mouse
gtaagtgtgctccttagaag

SEQ ID NO: 480375 - DNA, 20 bp, mouse
ggtggcagaaagaccatctg

SEQ ID NO: 480376 - DNA, 20 bp, mouse
gaggcgctctagggagactg

SEQ ID NO: 480377 - DNA, 20 bp, mouse
gccgcgtgggagctgcctca

SEQ ID NO: 480378 - DNA, 20 bp, mouse
gagagcagcggggccaggag

SEQ ID NO: 480379 - DNA, 20 bp, mouse
gaagtgtcagagtaccgcgt

SEQ ID NO: 480380 - DNA, 20 bp, mouse
gtcctccactcaggaaccat

SEQ ID NO: 480381 - DNA, 20 bp, mouse
gccgcaatggaggcgctcta

SEQ ID NO: 480382 - DNA, 20 bp, mouse
ggctgtgtctgctccctcga

SEQ ID NO: 480383 - DNA, 20 bp, mouse
gcctctgctgggcagaatca

SEQ ID NO: 480384 - DNA, 20 bp, mouse
ggtactctgacacttcagtc

SEQ ID NO: 480385 - DNA, 20 bp, mouse
gcgcgcccagcacccgtgat

SEQ ID NO: 480386 - DNA, 20 bp, mouse
ggcgttgggtcccctccgag

SEQ ID NO: 480387 - DNA, 20 bp, mouse
gacgcctaggtgagcagcaa

SEQ ID NO: 480388 - DNA, 20 bp, mouse
gcggaggggacccaacgcct

SEQ ID NO: 480389 - DNA, 20 bp, mouse
gcctaggtgagcagcaaggg

SEQ ID NO: 480390 - DNA, 20 bp, mouse
gcctccgagcggatcccaga

SEQ ID NO: 480391 - DNA, 20 bp, mouse
gggtgagcagcaagggaggt

SEQ ID NO: 480392 - DNA, 20 bp, mouse
gggcgcgggcgacatcacag

SEQ ID NO: 480393 - DNA, 20 bp, mouse
ggagtccaagcagccgggag

SEQ ID NO: 480394 - DNA, 20 bp, mouse
gggactctgctagtccttct

SEQ ID NO: 480395 - DNA, 20 bp, mouse
gctcttcgcaaagggaagtg

SEQ ID NO: 480396 - DNA, 20 bp, mouse
gctgaatgctgaggcagcga

SEQ ID NO: 480397 - DNA, 20 bp, mouse
gtgctgaggcagcgaaggcg

SEQ ID NO: 480398 - DNA, 20 bp, mouse
ggggcctccgcccatgatag

SEQ ID NO: 480399 - DNA, 20 bp, mouse
ggagaatctgcccctatcat

SEQ ID NO: 480400 - DNA, 20 bp, mouse
gtacggaaaggaagacgaag

SEQ ID NO: 480401 - DNA, 20 bp, mouse
gataggcccccactctacca

SEQ ID NO: 480402 - DNA, 20 bp, mouse
gattcagcaaccccctgctc

SEQ ID NO: 480403 - DNA, 20 bp, mouse
gatgtaggaagaatcccata

SEQ ID NO: 480404 - DNA, 20 bp, mouse
gggaagaatcccatacggaa

SEQ ID NO: 480405 - DNA, 20 bp, mouse
gcaggacagactgatgtggt

SEQ ID NO: 480406 - DNA, 20 bp, mouse
gctcatggcgaagttcaaca

SEQ ID NO: 480407 - DNA, 20 bp, mouse
gacggggagtaacccgacag

SEQ ID NO: 480408 - DNA, 20 bp, mouse
ggggagtaacccgacagagg

SEQ ID NO: 480409 - DNA, 20 bp, mouse
gacagatgtaaaatccctca

SEQ ID NO: 480410 - DNA, 20 bp, mouse
gttctcaggcttctcctcgt

SEQ ID NO: 480411 - DNA, 20 bp, mouse
gtttccatcctacaagcaca

SEQ ID NO: 480412 - DNA, 20 bp, mouse
gtggtggcggcctcctctgt

SEQ ID NO: 480413 - DNA, 20 bp, mouse
gttgaagggcctgctgctgg

SEQ ID NO: 480414 - DNA, 20 bp, mouse
ggcagcgaaacctacctacg

SEQ ID NO: 480415 - DNA, 20 bp, mouse
gctggagggagcccaagatt

SEQ ID NO: 480416 - DNA, 20 bp, mouse
gtagggccgagcggaagagt

SEQ ID NO: 480417 - DNA, 20 bp, mouse
ggcagaaacgaaactttcta

SEQ ID NO: 480418 - DNA, 20 bp, mouse
gcgctcgtgggtcctccgct

SEQ ID NO: 480419 - DNA, 20 bp, mouse
gctcccgaggcgccctgtgt

SEQ ID NO: 480420 - DNA, 20 bp, mouse
ggaaactttctagggccgag

SEQ ID NO: 480421 - DNA, 20 bp, mouse
gcggcgcggaagcttcgtgg

SEQ ID NO: 480422 - DNA, 20 bp, mouse
ggcgcgcggactacaactcc

SEQ ID NO: 480423 - DNA, 20 bp, mouse
gggtcgtcccctcccacaca

SEQ ID NO: 480424 - DNA, 20 bp, mouse
gtggagagagggttctcccg

SEQ ID NO: 480425 - DNA, 20 bp, mouse
gggggctactgggcgcttca

SEQ ID NO: 480426 - DNA, 20 bp, mouse
gtagctgcgagaagccgcgg

SEQ ID NO: 480427 - DNA, 20 bp, mouse
ggagtagctgcgagaagccg

SEQ ID NO: 480428 - DNA, 20 bp, mouse
gcgagaagccgcggcggtgg

SEQ ID NO: 480429 - DNA, 20 bp, mouse
gagcgtttcgaggactcccc

SEQ ID NO: 480430 - DNA, 20 bp, mouse
gccgccacccgcgccaggga

SEQ ID NO: 480431 - DNA, 20 bp, mouse
ggaaacgctccggctagagg

SEQ ID NO: 480432 - DNA, 20 bp, mouse
gggctgctccggatcccgag

SEQ ID NO: 480433 - DNA, 20 bp, mouse
gacccgcgccagggagggac

SEQ ID NO: 480434 - DNA, 20 bp, mouse
gagggggctccgcagagagg

SEQ ID NO: 480435 - DNA, 20 bp, mouse
ggcgtctccgcagcatcccg

SEQ ID NO: 480436 - DNA, 20 bp, mouse
ggtctgcgtgcgtgagtggg

SEQ ID NO: 480437 - DNA, 20 bp, mouse
gctagtctgcgtgcgtgagt

SEQ ID NO: 480438 - DNA, 20 bp, mouse
gccgggaaggccagagtcgc

SEQ ID NO: 480439 - DNA, 20 bp, mouse
gtcggagcagtcagccggga

SEQ ID NO: 480440 - DNA, 20 bp, mouse
gccccagtcatgaaccggtt

SEQ ID NO: 480441 - DNA, 20 bp, mouse
gacccggttggtaggagcca

SEQ ID NO: 480442 - DNA, 20 bp, mouse
ggccgtggctcctaccaacc

SEQ ID NO: 480443 - DNA, 20 bp, mouse
gacgcgcgaccaaaccggac

SEQ ID NO: 480444 - DNA, 20 bp, mouse
ggccaaaccggttcatgact

SEQ ID NO: 480445 - DNA, 20 bp, mouse
gcaccctggtctctcaccca

SEQ ID NO: 480446 - DNA, 20 bp, mouse
ggaggcgcaggggggaccca

SEQ ID NO: 480447 - DNA, 20 bp, mouse
ggacacaaatggtcaggcgg

SEQ ID NO: 480448 - DNA, 20 bp, mouse
gagcagaggctgcgagttga

SEQ ID NO: 480449 - DNA, 20 bp, mouse
gacaaatggtcaggcggcgg

SEQ ID NO: 480450 - DNA, 20 bp, mouse
gattgacacaaatggtcagg

SEQ ID NO: 480451 - DNA, 20 bp, mouse
gtcggcagcctagccgccct

SEQ ID NO: 480452 - DNA, 20 bp, mouse
ggacgcggagcagaatcccg

SEQ ID NO: 480453 - DNA, 20 bp, mouse
gcagctctcccggatcacag

SEQ ID NO: 480454 - DNA, 20 bp, mouse
ggttgagggattgacacaaa

SEQ ID NO: 480455 - DNA, 20 bp, mouse
gcccgttggagggcgcgcga

SEQ ID NO: 480456 - DNA, 20 bp, mouse
gggaggagctccagggccca

SEQ ID NO: 480457 - DNA, 20 bp, mouse
gagcagctgcgggcgccggg

SEQ ID NO: 480458 - DNA, 20 bp, mouse
gcggcctcagcggagtcggg

SEQ ID NO: 480459 - DNA, 20 bp, mouse
ggcttccagcacggcgtccc

SEQ ID NO: 480460 - DNA, 20 bp, mouse
gcgctccggccagactggat

SEQ ID NO: 480461 - DNA, 20 bp, mouse
gagcggcgctgggacattga

SEQ ID NO: 480462 - DNA, 20 bp, mouse
gtcatcccgggacgccgtgc

SEQ ID NO: 480463 - DNA, 20 bp, mouse
ggcgatcgcggaccgcggtg

SEQ ID NO: 480464 - DNA, 20 bp, mouse
gggtgggcgcgcggcctcag

SEQ ID NO: 480465 - DNA, 20 bp, mouse
gcccgcagctgcttccagca

SEQ ID NO: 480466 - DNA, 20 bp, mouse
gccgaggtgagggctgaagg

SEQ ID NO: 480467 - DNA, 20 bp, mouse
gaggagtcgctgggtagagg

SEQ ID NO: 480468 - DNA, 20 bp, mouse
gaggcggccgggcagctagg

SEQ ID NO: 480469 - DNA, 20 bp, mouse
gcaaaggagtcgctgggtag

SEQ ID NO: 480470 - DNA, 20 bp, mouse
gccgcagagttggggagatt

SEQ ID NO: 480471 - DNA, 20 bp, mouse
ggatcggagaggccgaggtg

SEQ ID NO: 480472 - DNA, 20 bp, mouse
gggactgagggtcggagacg

SEQ ID NO: 480473 - DNA, 20 bp, mouse
gcgactaattgggatcggag

SEQ ID NO: 480474 - DNA, 20 bp, mouse
gccgcggtcggactgagggt

SEQ ID NO: 480475 - DNA, 20 bp, mouse
ggcgcccaggagccgagtgg

SEQ ID NO: 480476 - DNA, 20 bp, mouse
gggccgctcggggaacctga

SEQ ID NO: 480477 - DNA, 20 bp, mouse
gccgagcggccgaggaccgc

SEQ ID NO: 480478 - DNA, 20 bp, mouse
ggtccctcaggttccccgag

SEQ ID NO: 480479 - DNA, 20 bp, mouse
ggcgagcgccgcctgacgag

SEQ ID NO: 480480 - DNA, 20 bp, mouse
gaggcagccgcgcgtccctc

SEQ ID NO: 480481 - DNA, 20 bp, mouse
gccggccccggaggaaacgt

SEQ ID NO: 480482 - DNA, 20 bp, mouse
gagcgccgcctgacgagggg

SEQ ID NO: 480483 - DNA, 20 bp, mouse
ggccggagccgggtcggagt

SEQ ID NO: 480484 - DNA, 20 bp, mouse
gctcgacgctcgcgaaggct

SEQ ID NO: 480485 - DNA, 20 bp, mouse
gcgcgcctcgacgctcgcga

SEQ ID NO: 480486 - DNA, 20 bp, mouse
gcgcggcgtagagtgcaggc

SEQ ID NO: 480487 - DNA, 20 bp, mouse
gtggggcggtgagaacagcg

SEQ ID NO: 480488 - DNA, 20 bp, mouse
gacagcgcggcgtagagtgc

SEQ ID NO: 480489 - DNA, 20 bp, mouse
ggcgccacagagcgctgggg

SEQ ID NO: 480490 - DNA, 20 bp, mouse
ggccgcgctgctcccaactc

SEQ ID NO: 480491 - DNA, 20 bp, mouse
gggatggactgctagggtca

SEQ ID NO: 480492 - DNA, 20 bp, mouse
gcggagcccgggccgaggga

SEQ ID NO: 480493 - DNA, 20 bp, mouse
gccgaaaagccggactcggc

SEQ ID NO: 480494 - DNA, 20 bp, mouse
gcgatcccagaactcggcgc

SEQ ID NO: 480495 - DNA, 20 bp, mouse
gctgctcccaactccggata

SEQ ID NO: 480496 - DNA, 20 bp, mouse
gacagctcggagctccctgg

SEQ ID NO: 480497 - DNA, 20 bp, mouse
gagctccgagctgtgcgcga

SEQ ID NO: 480498 - DNA, 20 bp, mouse
gctcggagctccctggaggt

SEQ ID NO: 480499 - DNA, 20 bp, mouse
gactctttcgcccacctcca

SEQ ID NO: 480500 - DNA, 20 bp, mouse
ggagctgtgcgcgacggcag

SEQ ID NO: 480501 - DNA, 20 bp, mouse
gcgcacagctcggagctccc

SEQ ID NO: 480502 - DNA, 20 bp, mouse
gaaagagtgcgagagcgcgg

SEQ ID NO: 480503 - DNA, 20 bp, mouse
gcgctccagcagactccggg

SEQ ID NO: 480504 - DNA, 20 bp, mouse
gtgaactgcgcggaggggtg

SEQ ID NO: 480505 - DNA, 20 bp, mouse
ggcgagcagccagcgctggt

SEQ ID NO: 480506 - DNA, 20 bp, mouse
ggccggggcgagctttcggt

SEQ ID NO: 480507 - DNA, 20 bp, mouse
gagctcgccccggctgtctg

SEQ ID NO: 480508 - DNA, 20 bp, mouse
gctccccgttgcggccccgg

SEQ ID NO: 480509 - DNA, 20 bp, mouse
gcccggaggcggtcgaggcc

SEQ ID NO: 480510 - DNA, 20 bp, mouse
gaccgcctccggggccgcaa

SEQ ID NO: 480511 - DNA, 20 bp, mouse
ggcccgacgcgggaccccgg

SEQ ID NO: 480512 - DNA, 20 bp, mouse
gaggtccccctaggaagagt

SEQ ID NO: 480513 - DNA, 20 bp, mouse
ggcctcacctcgggcggcag

SEQ ID NO: 480514 - DNA, 20 bp, mouse
gtcgccccggctgtctgggg

SEQ ID NO: 480515 - DNA, 20 bp, mouse
gggggacgcctcacctcggg

SEQ ID NO: 480516 - DNA, 20 bp, mouse
gcagcaccgcccgccaggga

SEQ ID NO: 480517 - DNA, 20 bp, mouse
gcgtccagcaccgcccgcca

SEQ ID NO: 480518 - DNA, 20 bp, mouse
gggagcgcggagtaacgcct

SEQ ID NO: 480519 - DNA, 20 bp, mouse
gcgcctgggagccgcactgg

SEQ ID NO: 480520 - DNA, 20 bp, mouse
gtgctggacgcggagagtcg

SEQ ID NO: 480521 - DNA, 20 bp, mouse
ggcccgccagggaaggagcg

SEQ ID NO: 480522 - DNA, 20 bp, mouse
gctccgcgctccttccctgg

SEQ ID NO: 480523 - DNA, 20 bp, mouse
ggcggggcctcaaggagaga

SEQ ID NO: 480524 - DNA, 20 bp, mouse
gaggcggagcagcaccaccg

SEQ ID NO: 480525 - DNA, 20 bp, mouse
gcccggggctcgagaaactt

SEQ ID NO: 480526 - DNA, 20 bp, mouse
gctggcgtgccaagagatca

SEQ ID NO: 480527 - DNA, 20 bp, mouse
gcaacggcaccgtgatctct

SEQ ID NO: 480528 - DNA, 20 bp, mouse
gcacacacagagcgacaagg

SEQ ID NO: 480529 - DNA, 20 bp, mouse
gcggtgctacagcgctctag

SEQ ID NO: 480530 - DNA, 20 bp, mouse
gaaccgatgcctttgcacaa

SEQ ID NO: 480531 - DNA, 20 bp, mouse
gtcacggtgccgttgtgcaa

SEQ ID NO: 480532 - DNA, 20 bp, mouse
gagctccttggccgaagccg

SEQ ID NO: 480533 - DNA, 20 bp, mouse
gtcttggcacgccagctcct

SEQ ID NO: 480534 - DNA, 20 bp, mouse
ggagcgctgtagcaccgcca

SEQ ID NO: 480535 - DNA, 20 bp, mouse
gtgtggccgctgccagaggg

SEQ ID NO: 480536 - DNA, 20 bp, mouse
gggagtggcggcggcatcgg

SEQ ID NO: 480537 - DNA, 20 bp, mouse
gccggctctggctggagtgg

SEQ ID NO: 480538 - DNA, 20 bp, mouse
gctggcggcggagaccacgc

SEQ ID NO: 480539 - DNA, 20 bp, mouse
gcgcgctccgggacacacgt

SEQ ID NO: 480540 - DNA, 20 bp, mouse
ggctggagtggcggcggcat

SEQ ID NO: 480541 - DNA, 20 bp, mouse
ggagcgcgtggcgccttcgg

SEQ ID NO: 480542 - DNA, 20 bp, mouse
ggcagcgccccgcggagcag

SEQ ID NO: 480543 - DNA, 20 bp, mouse
ggctccgggacacacgtggg

SEQ ID NO: 480544 - DNA, 20 bp, mouse
gacgtgtggcccagtaggtt

SEQ ID NO: 480545 - DNA, 20 bp, mouse
ggcggagaccacgccggctc

SEQ ID NO: 480546 - DNA, 20 bp, mouse
gctaatatggcggaactcag

SEQ ID NO: 480547 - DNA, 20 bp, mouse
ggcctccgcggtagctaata

SEQ ID NO: 480548 - DNA, 20 bp, mouse
gtccgcggtagctaatatgg

SEQ ID NO: 480549 - DNA, 20 bp, mouse
gggcctgcgggacagattgg

SEQ ID NO: 480550 - DNA, 20 bp, mouse
gtagctaccgcggaggccgg

SEQ ID NO: 480551 - DNA, 20 bp, mouse
gccccgccgccgctgctcac

SEQ ID NO: 480552 - DNA, 20 bp, mouse
ggctgctcacgggaatcccc

SEQ ID NO: 480553 - DNA, 20 bp, mouse
ggggaatcccccggcctccg

SEQ ID NO: 480554 - DNA, 20 bp, mouse
gtggaggtcgctgggatgtg

SEQ ID NO: 480555 - DNA, 20 bp, mouse
gcgcactggagccccagaga

SEQ ID NO: 480556 - DNA, 20 bp, mouse
gaggcgtccttgcgtcagac

SEQ ID NO: 480557 - DNA, 20 bp, mouse
gaggcccgggaaccgagggt

SEQ ID NO: 480558 - DNA, 20 bp, mouse
gccttgcgtcagactggctt

SEQ ID NO: 480559 - DNA, 20 bp, mouse
gctccaggcccgggaaccga

SEQ ID NO: 480560 - DNA, 20 bp, mouse
gaggctcacctagggtgcag

SEQ ID NO: 480561 - DNA, 20 bp, mouse
ggggggtggctgctgactag

SEQ ID NO: 480562 - DNA, 20 bp, mouse
gcgggcctggaggctcacct

SEQ ID NO: 480563 - DNA, 20 bp, mouse
ggcctgcagagttagcagag

SEQ ID NO: 480564 - DNA, 20 bp, mouse
ggaggaatggggttgagttc

SEQ ID NO: 480565 - DNA, 20 bp, mouse
ggcttcactagcttccctcg

SEQ ID NO: 480566 - DNA, 20 bp, mouse
ggcagctcggggctcgacag

SEQ ID NO: 480567 - DNA, 20 bp, mouse
ggtcgacgtgagcggtaacg

SEQ ID NO: 480568 - DNA, 20 bp, mouse
ggcgctgcggtcgacgtgag

SEQ ID NO: 480569 - DNA, 20 bp, mouse
gtgggcgtacggcagcgctg

SEQ ID NO: 480570 - DNA, 20 bp, mouse
gggacagacggaggtgtcac

SEQ ID NO: 480571 - DNA, 20 bp, mouse
gagacgtgcccggggacaga

SEQ ID NO: 480572 - DNA, 20 bp, mouse
gggcgcggggcacaagtccc

SEQ ID NO: 480573 - DNA, 20 bp, mouse
gccccgggcacgtcttcacc

SEQ ID NO: 480574 - DNA, 20 bp, mouse
ggacacctccgtctgtcccc

SEQ ID NO: 480575 - DNA, 20 bp, mouse
gttgtgcgagccgttggatg

SEQ ID NO: 480576 - DNA, 20 bp, mouse
gagcgcggctatatagcggg

SEQ ID NO: 480577 - DNA, 20 bp, mouse
ggtgccgcggcatcgcgcga

SEQ ID NO: 480578 - DNA, 20 bp, mouse
gcgtccctcgcgcgatgccg

SEQ ID NO: 480579 - DNA, 20 bp, mouse
gaagtacctgcgcggctgag

SEQ ID NO: 480580 - DNA, 20 bp, mouse
gtggtccaccgcaccaacgg

SEQ ID NO: 480581 - DNA, 20 bp, mouse
ggcggctatatagcgggcgg

SEQ ID NO: 480582 - DNA, 20 bp, mouse
ggcgggcccaagtacctgcg

SEQ ID NO: 480583 - DNA, 20 bp, mouse
ggcctccgttctgcaaccct

SEQ ID NO: 480584 - DNA, 20 bp, mouse
gccgcgccggccgttggtgg

SEQ ID NO: 480585 - DNA, 20 bp, mouse
gggcgccccgggagaccgcg

SEQ ID NO: 480586 - DNA, 20 bp, mouse
gctaggctctcgggaagagg

SEQ ID NO: 480587 - DNA, 20 bp, mouse
gcctccctcgaagcaacccg

SEQ ID NO: 480588 - DNA, 20 bp, mouse
ggctctaggctctcgggaag

SEQ ID NO: 480589 - DNA, 20 bp, mouse
gaccaagcgcacacaccgga

SEQ ID NO: 480590 - DNA, 20 bp, mouse
ggcgcgcgtggtgcagagga

SEQ ID NO: 480591 - DNA, 20 bp, mouse
gccggagagccgcgagctcg

SEQ ID NO: 480592 - DNA, 20 bp, mouse
gcgacaccaagcgcacacac

SEQ ID NO: 480593 - DNA, 20 bp, mouse
gcggcggacagggtaccccc

SEQ ID NO: 480594 - DNA, 20 bp, mouse
ggggcgacgaccgggaacta

SEQ ID NO: 480595 - DNA, 20 bp, mouse
gtggagctcgttgcagctct

SEQ ID NO: 480596 - DNA, 20 bp, mouse
gttcactcgagtgtcgaata

SEQ ID NO: 480597 - DNA, 20 bp, mouse
ggcgcagacagagaaacagt

SEQ ID NO: 480598 - DNA, 20 bp, mouse
gcgacactcgagtgaagtgt

SEQ ID NO: 480599 - DNA, 20 bp, mouse
gacgactgccctccggacaa

SEQ ID NO: 480600 - DNA, 20 bp, mouse
gcccccatttggttattagg

SEQ ID NO: 480601 - DNA, 20 bp, mouse
gggtcaagtggcgccagacg

SEQ ID NO: 480602 - DNA, 20 bp, mouse
gacgaggtacgactgccctc

SEQ ID NO: 480603 - DNA, 20 bp, mouse
ggtcgaatacggatgtcggg

SEQ ID NO: 480604 - DNA, 20 bp, mouse
gaacggattaaggattaaag

SEQ ID NO: 480605 - DNA, 20 bp, mouse
ggcgccagacgtggagcacg

SEQ ID NO: 480606 - DNA, 20 bp, mouse
ggagaggcatggcagataca

SEQ ID NO: 480607 - DNA, 20 bp, mouse
gagcacccatctggcagcaa

SEQ ID NO: 480608 - DNA, 20 bp, mouse
gtcttctgtaggacgcgaca

SEQ ID NO: 480609 - DNA, 20 bp, mouse
gtctaagccaggaggcccca

SEQ ID NO: 480610 - DNA, 20 bp, mouse
gtctgtaggacgcgacaggg

SEQ ID NO: 480611 - DNA, 20 bp, mouse
gttccgcctcagcacccatc

SEQ ID NO: 480612 - DNA, 20 bp, mouse
gaagcagggaggcccagatt

SEQ ID NO: 480613 - DNA, 20 bp, mouse
ggacaaggctcaccatgaaa

SEQ ID NO: 480614 - DNA, 20 bp, mouse
gcaggcctttgctgccagat

SEQ ID NO: 480615 - DNA, 20 bp, mouse
ggcaggagggccaggttccc

SEQ ID NO: 480616 - DNA, 20 bp, mouse
ggcacagtcctaacggacaa

SEQ ID NO: 480617 - DNA, 20 bp, mouse
ggagagagcccttgtccgtt

SEQ ID NO: 480618 - DNA, 20 bp, mouse
gtcgtcagggctgggatggt

SEQ ID NO: 480619 - DNA, 20 bp, mouse
gaatgaggccatgaaggtag

SEQ ID NO: 480620 - DNA, 20 bp, mouse
ggtgcctgtgtaggaagaag

SEQ ID NO: 480621 - DNA, 20 bp, mouse
gtgtgaccacagcttcgtca

SEQ ID NO: 480622 - DNA, 20 bp, mouse
gagaaggggtgaagccaggt

SEQ ID NO: 480623 - DNA, 20 bp, mouse
gcccagccctgacgaagctg

SEQ ID NO: 480624 - DNA, 20 bp, mouse
gtaggtgtgaggtgccaacc

SEQ ID NO: 480625 - DNA, 20 bp, mouse
gtacacaggcacagtcctaa

SEQ ID NO: 480626 - DNA, 20 bp, mouse
gggcactaggcggaacctac

SEQ ID NO: 480627 - DNA, 20 bp, mouse
gggaacctaccggatctaga

SEQ ID NO: 480628 - DNA, 20 bp, mouse
gcctggggcaaggtggcact

SEQ ID NO: 480629 - DNA, 20 bp, mouse
gacgtccttctagatccggt

SEQ ID NO: 480630 - DNA, 20 bp, mouse
gaaggcggcatacaggacca

SEQ ID NO: 480631 - DNA, 20 bp, mouse
ggcggcatacaggaccacgg

SEQ ID NO: 480632 - DNA, 20 bp, mouse
gggggcaaggtggcactagg

SEQ ID NO: 480633 - DNA, 20 bp, mouse
gagcttttcggcaaactctc

SEQ ID NO: 480634 - DNA, 20 bp, mouse
gttgccgaaaagctcggcag

SEQ ID NO: 480635 - DNA, 20 bp, mouse
gttggcgactccaggctact

SEQ ID NO: 480636 - DNA, 20 bp, mouse
gctctgctggcagcttcctg

SEQ ID NO: 480637 - DNA, 20 bp, mouse
gcgggctggactcactgcac

SEQ ID NO: 480638 - DNA, 20 bp, mouse
gcttcctgaggtaccaaggg

SEQ ID NO: 480639 - DNA, 20 bp, mouse
gcttcctcccttggtacctc

SEQ ID NO: 480640 - DNA, 20 bp, mouse
gaggcacagactgatagcag

SEQ ID NO: 480641 - DNA, 20 bp, mouse
ggcagtgagtccagcccggt

SEQ ID NO: 480642 - DNA, 20 bp, mouse
ggacctacagactgaatcca

SEQ ID NO: 480643 - DNA, 20 bp, mouse
gggatcaaggccaaccgggc

SEQ ID NO: 480644 - DNA, 20 bp, mouse
gggcatcaatctcctctggg

SEQ ID NO: 480645 - DNA, 20 bp, mouse
gtccgaccactgccacccag

SEQ ID NO: 480646 - DNA, 20 bp, mouse
ggcttagacctgcatcaaga

SEQ ID NO: 480647 - DNA, 20 bp, mouse
gtggatttccttcataggag

SEQ ID NO: 480648 - DNA, 20 bp, mouse
gatctgggtagcggtcatag

SEQ ID NO: 480649 - DNA, 20 bp, mouse
gcaagatggatttccttcat

SEQ ID NO: 480650 - DNA, 20 bp, mouse
gaagcactccactcctatga

SEQ ID NO: 480651 - DNA, 20 bp, mouse
gaggactaccggacttacta

SEQ ID NO: 480652 - DNA, 20 bp, mouse
gtgaagcaggtggaactgca

SEQ ID NO: 480653 - DNA, 20 bp, mouse
ggcaggtctaagcatgaagc

SEQ ID NO: 480654 - DNA, 20 bp, mouse
ggtgtcccactgtctctata

SEQ ID NO: 480655 - DNA, 20 bp, mouse
gaggaaatccatcttgatgc

SEQ ID NO: 480656 - DNA, 20 bp, mouse
ggaggaaacagtaccagcta

SEQ ID NO: 480657 - DNA, 20 bp, mouse
gggccgaggaagaaagccgg

SEQ ID NO: 480658 - DNA, 20 bp, mouse
gccagtagagaggaaggccg

SEQ ID NO: 480659 - DNA, 20 bp, mouse
gcgcgtgtcagggactgcgg

SEQ ID NO: 480660 - DNA, 20 bp, mouse
gtagcctggagcccgttgta

SEQ ID NO: 480661 - DNA, 20 bp, mouse
ggtccctgacacgcgcgagt

SEQ ID NO: 480662 - DNA, 20 bp, mouse
gcgttgtagggtgcaagtcg

SEQ ID NO: 480663 - DNA, 20 bp, mouse
gtctctactggacagcggag

SEQ ID NO: 480664 - DNA, 20 bp, mouse
gggcctaaggggataagaat

SEQ ID NO: 480665 - DNA, 20 bp, mouse
ggccgggggctagaaagggt

SEQ ID NO: 480666 - DNA, 20 bp, mouse
gaagccggacccaagtgtgt

SEQ ID NO: 480667 - DNA, 20 bp, mouse
gggaacagccaccagatggt

SEQ ID NO: 480668 - DNA, 20 bp, mouse
ggatctatcccaccatctgg

SEQ ID NO: 480669 - DNA, 20 bp, mouse
gctggagtggccttaaagaa

SEQ ID NO: 480670 - DNA, 20 bp, mouse
gtcatactggccaactacat

SEQ ID NO: 480671 - DNA, 20 bp, mouse
gcccacaatgaaggtttctt

SEQ ID NO: 480672 - DNA, 20 bp, mouse
ggaagatctatcccaccatc

SEQ ID NO: 480673 - DNA, 20 bp, mouse
gatgggtgcatcgggtgacc

SEQ ID NO: 480674 - DNA, 20 bp, mouse
gccagaagaaagacccaagc

SEQ ID NO: 480675 - DNA, 20 bp, mouse
gatccactgtgagttgtgag

SEQ ID NO: 480676 - DNA, 20 bp, mouse
ggcgcacagccagtttccgg

SEQ ID NO: 480677 - DNA, 20 bp, mouse
gggcagcggcaactaaactc

SEQ ID NO: 480678 - DNA, 20 bp, mouse
gctaaactcaggtaaagggg

SEQ ID NO: 480679 - DNA, 20 bp, mouse
ggggtggtctgatggcatgt

SEQ ID NO: 480680 - DNA, 20 bp, mouse
gtggtctgatggcatgtcgg

SEQ ID NO: 480681 - DNA, 20 bp, mouse
gcgcgcatcaaagggactcg

SEQ ID NO: 480682 - DNA, 20 bp, mouse
ggcaactaaactcaggtaaa

SEQ ID NO: 480683 - DNA, 20 bp, mouse
gtcctcatgggcccaatgcg

SEQ ID NO: 480684 - DNA, 20 bp, mouse
gagaagagaagggactttcg

SEQ ID NO: 480685 - DNA, 20 bp, mouse
ggtgcgggatacaaagggat

SEQ ID NO: 480686 - DNA, 20 bp, mouse
gtagccccaatacctcccgt

SEQ ID NO: 480687 - DNA, 20 bp, mouse
gtacctcccgtgggacgggt

SEQ ID NO: 480688 - DNA, 20 bp, mouse
ggcgtccccacccgtcccac

SEQ ID NO: 480689 - DNA, 20 bp, mouse
ggcaggcgcagagcgtcatc

SEQ ID NO: 480690 - DNA, 20 bp, mouse
gcgtcccacgggaggtattg

SEQ ID NO: 480691 - DNA, 20 bp, mouse
gagttcgaaggggtcagatt

SEQ ID NO: 480692 - DNA, 20 bp, mouse
gagaggaggatgttccggtg

SEQ ID NO: 480693 - DNA, 20 bp, mouse
gggacgggtggggacgctcc

SEQ ID NO: 480694 - DNA, 20 bp, mouse
ggccatggcaacgctgacta

SEQ ID NO: 480695 - DNA, 20 bp, mouse
ggtcagattgggttcggctc

SEQ ID NO: 480696 - DNA, 20 bp, mouse
gtcggtaccgaggacgccga

SEQ ID NO: 480697 - DNA, 20 bp, mouse
gggctgggcgcgtctgagaa

SEQ ID NO: 480698 - DNA, 20 bp, mouse
ggagctctcgcagcgagctg

SEQ ID NO: 480699 - DNA, 20 bp, mouse
gggcgtcctcggtaccgagg

SEQ ID NO: 480700 - DNA, 20 bp, mouse
gggtgggcgagcggagccat

SEQ ID NO: 480701 - DNA, 20 bp, mouse
gctgatgcaatactaagcaa

SEQ ID NO: 480702 - DNA, 20 bp, mouse
gtagttcccggagaccggtt

SEQ ID NO: 480703 - DNA, 20 bp, mouse
ggcgagcggagccatgggct

SEQ ID NO: 480704 - DNA, 20 bp, mouse
gaccggctcggacagtgagt

SEQ ID NO: 480705 - DNA, 20 bp, mouse
gctcagacgcgcccagccca

SEQ ID NO: 480706 - DNA, 20 bp, mouse
ggatttttcactgacttcat

SEQ ID NO: 480707 - DNA, 20 bp, mouse
gctgtcgtcagaatgtgctg

SEQ ID NO: 480708 - DNA, 20 bp, mouse
ggtgtgtggtaaacaacatt

SEQ ID NO: 480709 - DNA, 20 bp, mouse
gtgtggtaaacaacattcgg

SEQ ID NO: 480710 - DNA, 20 bp, mouse
ggaaggtggatgccaaggga

SEQ ID NO: 480711 - DNA, 20 bp, mouse
gcacattctgacgacaggca

SEQ ID NO: 480712 - DNA, 20 bp, mouse
gctggtttcatttaagtgtg

SEQ ID NO: 480713 - DNA, 20 bp, mouse
ggatataaatatctggcata

SEQ ID NO: 480714 - DNA, 20 bp, mouse
gacgcagtcaacccctcctg

SEQ ID NO: 480715 - DNA, 20 bp, mouse
gtctggaaggtggatgccaa

SEQ ID NO: 480716 - DNA, 20 bp, mouse
ggccaccctggaacatgctc

SEQ ID NO: 480717 - DNA, 20 bp, mouse
gtgctcaggctcggtcctct

SEQ ID NO: 480718 - DNA, 20 bp, mouse
gcgagcctgagcatgttcca

SEQ ID NO: 480719 - DNA, 20 bp, mouse
ggaccaggaaggcccccccg

SEQ ID NO: 480720 - DNA, 20 bp, mouse
gactagccagctgaccagga

SEQ ID NO: 480721 - DNA, 20 bp, mouse
gatcatgcttcagtccacgg

SEQ ID NO: 480722 - DNA, 20 bp, mouse
gctccactagccagctgacc

SEQ ID NO: 480723 - DNA, 20 bp, mouse
gtgccaagggtcagccaccc

SEQ ID NO: 480724 - DNA, 20 bp, mouse
ggacctctggagccagcggt

SEQ ID NO: 480725 - DNA, 20 bp, mouse
gctccagaggtcacatctgt

SEQ ID NO: 480726 - DNA, 20 bp, mouse
gctccaggccgaagaccccc

SEQ ID NO: 480727 - DNA, 20 bp, mouse
gtaggtgagacccccgaccc

SEQ ID NO: 480728 - DNA, 20 bp, mouse
gccggccccagagcctccgg

SEQ ID NO: 480729 - DNA, 20 bp, mouse
ggtgattgcgcaggtgagct

SEQ ID NO: 480730 - DNA, 20 bp, mouse
ggcctggagggtgattgcgc

SEQ ID NO: 480731 - DNA, 20 bp, mouse
gacctgcgcaatcaccctcc

SEQ ID NO: 480732 - DNA, 20 bp, mouse
gcgctcctccggaggctctg

SEQ ID NO: 480733 - DNA, 20 bp, mouse
gcgtgggtcacgtggtctgt

SEQ ID NO: 480734 - DNA, 20 bp, mouse
gagaatcgagcagagacacg

SEQ ID NO: 480735 - DNA, 20 bp, mouse
gagcctgggggtcttcggcc

SEQ ID NO: 480736 - DNA, 20 bp, mouse
ggctagaggcgaccgatcgt

SEQ ID NO: 480737 - DNA, 20 bp, mouse
ggaccgatcgtgggaagggg

SEQ ID NO: 480738 - DNA, 20 bp, mouse
gggcgaccgatcgtgggaag

SEQ ID NO: 480739 - DNA, 20 bp, mouse
gaggcagaaaggctaggagg

SEQ ID NO: 480740 - DNA, 20 bp, mouse
ggggaggcagaaaggctagg

SEQ ID NO: 480741 - DNA, 20 bp, mouse
gtgcctccccttcccacgat

SEQ ID NO: 480742 - DNA, 20 bp, mouse
gcgggtggcagccggcacag

SEQ ID NO: 480743 - DNA, 20 bp, mouse
ggcgcgcggcgggttcgggg

SEQ ID NO: 480744 - DNA, 20 bp, mouse
gacagggacgaggcgcaggg

SEQ ID NO: 480745 - DNA, 20 bp, mouse
gtgatccccgccctcatccg

SEQ ID NO: 480746 - DNA, 20 bp, mouse
gtagccggcgacatgagcgg

SEQ ID NO: 480747 - DNA, 20 bp, mouse
gtcccccgcgagccgcgcac

SEQ ID NO: 480748 - DNA, 20 bp, mouse
ggctcgcgcggacaagggcg

SEQ ID NO: 480749 - DNA, 20 bp, mouse
gcccgcggcctcggagatgg

SEQ ID NO: 480750 - DNA, 20 bp, mouse
ggtttagccggcgacatgag

SEQ ID NO: 480751 - DNA, 20 bp, mouse
gccttgtccgcgcgagccgg

SEQ ID NO: 480752 - DNA, 20 bp, mouse
gcggcctccgagggcgagag

SEQ ID NO: 480753 - DNA, 20 bp, mouse
gcgcgggctgctgggtcagc

SEQ ID NO: 480754 - DNA, 20 bp, mouse
ggaggccgcgggacagcccc

SEQ ID NO: 480755 - DNA, 20 bp, mouse
gggcgagcgaggagttctcg

SEQ ID NO: 480756 - DNA, 20 bp, mouse
gaggcggccagcccagctgg

SEQ ID NO: 480757 - DNA, 20 bp, mouse
gcggcggccaggatgagcac

SEQ ID NO: 480758 - DNA, 20 bp, mouse
gtgtaggtaggaacgcccca

SEQ ID NO: 480759 - DNA, 20 bp, mouse
gcccacgagcagagaaccga

SEQ ID NO: 480760 - DNA, 20 bp, mouse
gcgcaggcggccagcccagc

SEQ ID NO: 480761 - DNA, 20 bp, mouse
ggctgcagcttcctctcggg

SEQ ID NO: 480762 - DNA, 20 bp, mouse
gtgcagcgctatgtgagtag

SEQ ID NO: 480763 - DNA, 20 bp, mouse
gacgaaggccagggttgagt

SEQ ID NO: 480764 - DNA, 20 bp, mouse
gcatcaagtcgcctcccgag

SEQ ID NO: 480765 - DNA, 20 bp, mouse
ggaacgccccatggcatccc

SEQ ID NO: 480766 - DNA, 20 bp, mouse
ggggctgagggaacccaggg

SEQ ID NO: 480767 - DNA, 20 bp, mouse
gctgtcccggccccccccct

SEQ ID NO: 480768 - DNA, 20 bp, mouse
gcggcttcgacgaacagact

SEQ ID NO: 480769 - DNA, 20 bp, mouse
gaaccgggctggaccgagct

SEQ ID NO: 480770 - DNA, 20 bp, mouse
gcttcgacgaacagacttgg

SEQ ID NO: 480771 - DNA, 20 bp, mouse
gagagctggggactaagatg

SEQ ID NO: 480772 - DNA, 20 bp, mouse
gcccagaccgggtcccggta

SEQ ID NO: 480773 - DNA, 20 bp, mouse
gccggtaaggacagtagcca

SEQ ID NO: 480774 - DNA, 20 bp, mouse
gattctcccgagaaccgggc

SEQ ID NO: 480775 - DNA, 20 bp, mouse
gacaggctatgcttgagtct

SEQ ID NO: 480776 - DNA, 20 bp, mouse
gtctcgcggcctgaaggtaa

SEQ ID NO: 480777 - DNA, 20 bp, mouse
gaccaccaggtaaagaaata

SEQ ID NO: 480778 - DNA, 20 bp, mouse
gttcaggccgcgagatctcc

SEQ ID NO: 480779 - DNA, 20 bp, mouse
gaccaggtaaagaaataggg

SEQ ID NO: 480780 - DNA, 20 bp, mouse
ggtggctaaacgtccagaga

SEQ ID NO: 480781 - DNA, 20 bp, mouse
gctgaaggtaaaggaccacc

SEQ ID NO: 480782 - DNA, 20 bp, mouse
ggatggacctcaggatgtag

SEQ ID NO: 480783 - DNA, 20 bp, mouse
gcgccagtcgccgcactacg

SEQ ID NO: 480784 - DNA, 20 bp, mouse
ggccaccctatttctttacc

SEQ ID NO: 480785 - DNA, 20 bp, mouse
gggggagcccctacatcctg

SEQ ID NO: 480786 - DNA, 20 bp, mouse
ggaagcgaccacaacaacaa

SEQ ID NO: 480787 - DNA, 20 bp, mouse
ggcgaccacaacaacaacgg

SEQ ID NO: 480788 - DNA, 20 bp, mouse
gaccacaacaacaacggagg

SEQ ID NO: 480789 - DNA, 20 bp, mouse
ggcagcgacgactactccac

SEQ ID NO: 480790 - DNA, 20 bp, mouse
gacaacaacaacggaggcgg

SEQ ID NO: 480791 - DNA, 20 bp, mouse
gggcgacacgggtccgtggg

SEQ ID NO: 480792 - DNA, 20 bp, mouse
gtagggcgacacgggtccgt

SEQ ID NO: 480793 - DNA, 20 bp, mouse
gtcccagcgagatccacgta

SEQ ID NO: 480794 - DNA, 20 bp, mouse
gtctgtggcgagggactccg

SEQ ID NO: 480795 - DNA, 20 bp, mouse
gcgacccagcgggcccggca

SEQ ID NO: 480796 - DNA, 20 bp, mouse
gcgagagcacggtgccggga

SEQ ID NO: 480797 - DNA, 20 bp, mouse
gagcacggtgccgggaggga

SEQ ID NO: 480798 - DNA, 20 bp, mouse
ggacggcggccgcgagagca

SEQ ID NO: 480799 - DNA, 20 bp, mouse
ggaccggggaagctctcggg

SEQ ID NO: 480800 - DNA, 20 bp, mouse
gtccttccccggggcgacgg

SEQ ID NO: 480801 - DNA, 20 bp, mouse
gggaagctggaggaccggga

SEQ ID NO: 480802 - DNA, 20 bp, mouse
gaggaccgggagggagaacg

SEQ ID NO: 480803 - DNA, 20 bp, mouse
gcgagagcttccccggtccc

SEQ ID NO: 480804 - DNA, 20 bp, mouse
gggccgcgagagcacggtgc

SEQ ID NO: 480805 - DNA, 20 bp, mouse
ggagggtgcaggggaagacg

SEQ ID NO: 480806 - DNA, 20 bp, mouse
gccggggaaggcagagacgt

SEQ ID NO: 480807 - DNA, 20 bp, mouse
gcagagacgtgggcttccta

SEQ ID NO: 480808 - DNA, 20 bp, mouse
gcggcgaggagagtccgcgg

SEQ ID NO: 480809 - DNA, 20 bp, mouse
ggactgaccgaccgacagaa

SEQ ID NO: 480810 - DNA, 20 bp, mouse
gtgaggccgcgggagatgag

SEQ ID NO: 480811 - DNA, 20 bp, mouse
gtgaccgaccgacagaaggg

SEQ ID NO: 480812 - DNA, 20 bp, mouse
gccgccatcaccagcagaag

SEQ ID NO: 480813 - DNA, 20 bp, mouse
gggcgggagcgagcgtctct

SEQ ID NO: 480814 - DNA, 20 bp, mouse
gccgggcccatggcgaggag

SEQ ID NO: 480815 - DNA, 20 bp, mouse
ggggagtgagaggcccacac

SEQ ID NO: 480816 - DNA, 20 bp, mouse
gtcgctcagaacggccgcgg

SEQ ID NO: 480817 - DNA, 20 bp, mouse
gggcttctgctcgctcagaa

SEQ ID NO: 480818 - DNA, 20 bp, mouse
gggcgtgattgatccgtcac

SEQ ID NO: 480819 - DNA, 20 bp, mouse
gtgctcgctcagaacggccg

SEQ ID NO: 480820 - DNA, 20 bp, mouse
gaatcacgccgggaaggggt

SEQ ID NO: 480821 - DNA, 20 bp, mouse
ggcggcggcggcgcccgtga

SEQ ID NO: 480822 - DNA, 20 bp, mouse
ggagcgagcgagcgccgagg

SEQ ID NO: 480823 - DNA, 20 bp, mouse
gagcggcatgaggcccatga

SEQ ID NO: 480824 - DNA, 20 bp, mouse
gggctcgggaggcgaaggca

SEQ ID NO: 480825 - DNA, 20 bp, mouse
gcaggaggctcgggaggcga

SEQ ID NO: 480826 - DNA, 20 bp, mouse
gtcccgcgagtagcagggta

SEQ ID NO: 480827 - DNA, 20 bp, mouse
gccaggtacagcgcctctcc

SEQ ID NO: 480828 - DNA, 20 bp, mouse
gagtagcagggtaaggtccc

SEQ ID NO: 480829 - DNA, 20 bp, mouse
gcacagccggctgggaacgg

SEQ ID NO: 480830 - DNA, 20 bp, mouse
gtccttagcgccgattccac

SEQ ID NO: 480831 - DNA, 20 bp, mouse
ggccgctcccgcgagtagca

SEQ ID NO: 480832 - DNA, 20 bp, mouse
gaccttaccctgctactcgc

SEQ ID NO: 480833 - DNA, 20 bp, mouse
gtgcctgggaggcgggagag

SEQ ID NO: 480834 - DNA, 20 bp, mouse
gagcgccgattccacgggaa

SEQ ID NO: 480835 - DNA, 20 bp, mouse
gggacaggaagcgcctcgaa

SEQ ID NO: 480836 - DNA, 20 bp, mouse
gcggcgcctcggagccgtca

SEQ ID NO: 480837 - DNA, 20 bp, mouse
gggagccgtcagggcagacg

SEQ ID NO: 480838 - DNA, 20 bp, mouse
ggccaggagccccggaaacc

SEQ ID NO: 480839 - DNA, 20 bp, mouse
ggcttggcttctgggagggg

SEQ ID NO: 480840 - DNA, 20 bp, mouse
gtttgggcgccgagcagacg

SEQ ID NO: 480841 - DNA, 20 bp, mouse
gtcggcgcggagggacacgg

SEQ ID NO: 480842 - DNA, 20 bp, mouse
gcagagcgcttcgctgcaca

SEQ ID NO: 480843 - DNA, 20 bp, mouse
gaagcgctctgtgtgtggcg

SEQ ID NO: 480844 - DNA, 20 bp, mouse
ggggatgatctgggttccgg

SEQ ID NO: 480845 - DNA, 20 bp, mouse
gggaggggcggcagacatgg

SEQ ID NO: 480846 - DNA, 20 bp, mouse
gataccgcgggcatcctgag

SEQ ID NO: 480847 - DNA, 20 bp, mouse
gccccctcacggagaaatgg

SEQ ID NO: 480848 - DNA, 20 bp, mouse
ggtcccgctcaggatgcccg

SEQ ID NO: 480849 - DNA, 20 bp, mouse
gtgagcgggactacttagcg

SEQ ID NO: 480850 - DNA, 20 bp, mouse
gctggaaaaacgtataccgc

SEQ ID NO: 480851 - DNA, 20 bp, mouse
gaggaaggagtcggactcag

SEQ ID NO: 480852 - DNA, 20 bp, mouse
gtgggagccccagtctgtag

SEQ ID NO: 480853 - DNA, 20 bp, mouse
ggggctgccactacagactg

SEQ ID NO: 480854 - DNA, 20 bp, mouse
gcagcccggccaggacctgt

SEQ ID NO: 480855 - DNA, 20 bp, mouse
ggcgctgtgactatacgtcc

SEQ ID NO: 480856 - DNA, 20 bp, mouse
gagacccgggagaaaagtgt

SEQ ID NO: 480857 - DNA, 20 bp, mouse
gagtgtgggagagaggatcg

SEQ ID NO: 480858 - DNA, 20 bp, mouse
gaccggatcgctccagaccc

SEQ ID NO: 480859 - DNA, 20 bp, mouse
gttacctcggggccccctct

SEQ ID NO: 480860 - DNA, 20 bp, mouse
gtcccgggtctggagcgatc

SEQ ID NO: 480861 - DNA, 20 bp, mouse
gagagaggatcgcggtgagt

SEQ ID NO: 480862 - DNA, 20 bp, mouse
ggcgatccggtgcccagagg

SEQ ID NO: 480863 - DNA, 20 bp, mouse
gcaggacaggagctgaagct

SEQ ID NO: 480864 - DNA, 20 bp, mouse
gcagggaagcgagcaggagc

SEQ ID NO: 480865 - DNA, 20 bp, mouse
gcccgaggtaagtgagactt

SEQ ID NO: 480866 - DNA, 20 bp, mouse
gtggccgcgcgaggagtagg

SEQ ID NO: 480867 - DNA, 20 bp, mouse
gcagagagcttgaggagtcg

SEQ ID NO: 480868 - DNA, 20 bp, mouse
gtcgtggccgcgcgaggagt

SEQ ID NO: 480869 - DNA, 20 bp, mouse
gctgcagcagcctaaagacc

SEQ ID NO: 480870 - DNA, 20 bp, mouse
gagaccaggcagcaaacgaa

SEQ ID NO: 480871 - DNA, 20 bp, mouse
gccgtagtggcggtgatggg

SEQ ID NO: 480872 - DNA, 20 bp, mouse
ggtagggtcgcagacgttgg

SEQ ID NO: 480873 - DNA, 20 bp, mouse
ggcatgctggcgaagcagag

SEQ ID NO: 480874 - DNA, 20 bp, mouse
ggcggcgaaggcgtccgtag

SEQ ID NO: 480875 - DNA, 20 bp, mouse
gcaggtagggtcgcagacgt

SEQ ID NO: 480876 - DNA, 20 bp, mouse
gacagactgagatagggact

SEQ ID NO: 480877 - DNA, 20 bp, mouse
gtcgcctcccgaccaaccca

SEQ ID NO: 480878 - DNA, 20 bp, mouse
gccaaggagactctccttaa

SEQ ID NO: 480879 - DNA, 20 bp, mouse
gagagagatgctatctggaa

SEQ ID NO: 480880 - DNA, 20 bp, mouse
ggagtctccttgggttggtc

SEQ ID NO: 480881 - DNA, 20 bp, mouse
gaagcccagaggcggcatct

SEQ ID NO: 480882 - DNA, 20 bp, mouse
ggaggcgctggggtaaaacc

SEQ ID NO: 480883 - DNA, 20 bp, mouse
gtatcgtgggttccccagtg

SEQ ID NO: 480884 - DNA, 20 bp, mouse
gaaggagagtctccttgggt

SEQ ID NO: 480885 - DNA, 20 bp, mouse
gtcacttccccgaagcagag

SEQ ID NO: 480886 - DNA, 20 bp, mouse
gctgcccagggcatctcgag

SEQ ID NO: 480887 - DNA, 20 bp, mouse
gctgggcagggtgcgaggag

SEQ ID NO: 480888 - DNA, 20 bp, mouse
gcccatatggcactgaagaa

SEQ ID NO: 480889 - DNA, 20 bp, mouse
gcggcttggtgagttcggtg

SEQ ID NO: 480890 - DNA, 20 bp, mouse
gtcaccaagccgccaggcac

SEQ ID NO: 480891 - DNA, 20 bp, mouse
ggggagggtcgtagcatagg

SEQ ID NO: 480892 - DNA, 20 bp, mouse
gcgcgagtgtgcgcacgccg

SEQ ID NO: 480893 - DNA, 20 bp, mouse
ggagaccactgggaagagtc

SEQ ID NO: 480894 - DNA, 20 bp, mouse
gagtagactcagagaccact

SEQ ID NO: 480895 - DNA, 20 bp, mouse
gcgccaggcacaggaagtgc

SEQ ID NO: 480896 - DNA, 20 bp, mouse
ggcggaacagagccgcaagg

SEQ ID NO: 480897 - DNA, 20 bp, mouse
gcaacgcgcggcctcaggcg

SEQ ID NO: 480898 - DNA, 20 bp, mouse
gaggccggcgagctccacga

SEQ ID NO: 480899 - DNA, 20 bp, mouse
gggcgcggaacagagccgca

SEQ ID NO: 480900 - DNA, 20 bp, mouse
gcgcgtagggtaaggagctg

SEQ ID NO: 480901 - DNA, 20 bp, mouse
ggaggccggggtgcccgcaa

SEQ ID NO: 480902 - DNA, 20 bp, mouse
gcggaggccaccagcacgga

SEQ ID NO: 480903 - DNA, 20 bp, mouse
ggcagggctccggggctcct

SEQ ID NO: 480904 - DNA, 20 bp, mouse
gtctgcagcggggcaacgcg

SEQ ID NO: 480905 - DNA, 20 bp, mouse
ggacatgtggcgctttggag

SEQ ID NO: 480906 - DNA, 20 bp, mouse
ggatctgaaccagtcagagg

SEQ ID NO: 480907 - DNA, 20 bp, mouse
ggaggaggctgggtatctgc

SEQ ID NO: 480908 - DNA, 20 bp, mouse
gatacccagcctcctctgac

SEQ ID NO: 480909 - DNA, 20 bp, mouse
gtttgatctgaaccagtcag

SEQ ID NO: 480910 - DNA, 20 bp, mouse
gtgctgactggtcacagagt

SEQ ID NO: 480911 - DNA, 20 bp, mouse
gcaaaggagatctgtctgag

SEQ ID NO: 480912 - DNA, 20 bp, mouse
ggagaagcaagaccatccta

SEQ ID NO: 480913 - DNA, 20 bp, mouse
gtaaaaacaggagggtgacc

SEQ ID NO: 480914 - DNA, 20 bp, mouse
ggactggttcagatcaaaag

SEQ ID NO: 480915 - DNA, 20 bp, mouse
gctggctcttcattattcta

SEQ ID NO: 480916 - DNA, 20 bp, mouse
gaggaatgcaacttagtcgg

SEQ ID NO: 480917 - DNA, 20 bp, mouse
gtcaaggaatgcaacttagt

SEQ ID NO: 480918 - DNA, 20 bp, mouse
gcgcatgcgcaggtccattc

SEQ ID NO: 480919 - DNA, 20 bp, mouse
gtacatgatccagcaggcac

SEQ ID NO: 480920 - DNA, 20 bp, mouse
gcaattctttcatcagagtt

SEQ ID NO: 480921 - DNA, 20 bp, mouse
gtcttttctgcgaagattca

SEQ ID NO: 480922 - DNA, 20 bp, mouse
gctgggcagtaattcccgaa

SEQ ID NO: 480923 - DNA, 20 bp, mouse
gtgacagaaaaggtgaacta

SEQ ID NO: 480924 - DNA, 20 bp, mouse
ggaaaaggtgaactagggat

SEQ ID NO: 480925 - DNA, 20 bp, mouse
gcagacataaaaaaagatcc

SEQ ID NO: 480926 - DNA, 20 bp, mouse
gtgcactgggcagactaagt

SEQ ID NO: 480927 - DNA, 20 bp, mouse
gtgagggattcactgaagag

SEQ ID NO: 480928 - DNA, 20 bp, mouse
gtaggttctggtgggattga

SEQ ID NO: 480929 - DNA, 20 bp, mouse
gaccagaacctaaagggatg

SEQ ID NO: 480930 - DNA, 20 bp, mouse
gggactctccacatcccttt

SEQ ID NO: 480931 - DNA, 20 bp, mouse
gaatcccaccagaacctaaa

SEQ ID NO: 480932 - DNA, 20 bp, mouse
gaacagccctgctcacagag

SEQ ID NO: 480933 - DNA, 20 bp, mouse
gacattagaattactgcact

SEQ ID NO: 480934 - DNA, 20 bp, mouse
gtgtggagagtccggaaaag

SEQ ID NO: 480935 - DNA, 20 bp, mouse
gtcgctggttaaagagacgg

SEQ ID NO: 480936 - DNA, 20 bp, mouse
gccgctccgggccagcgcgg

SEQ ID NO: 480937 - DNA, 20 bp, mouse
gccgtcgcgacccgcagccg

SEQ ID NO: 480938 - DNA, 20 bp, mouse
ggcgaccgcggacccatagg

SEQ ID NO: 480939 - DNA, 20 bp, mouse
ggcaccggcaccagggacat

SEQ ID NO: 480940 - DNA, 20 bp, mouse
gcagaggtagggtcgctggt

SEQ ID NO: 480941 - DNA, 20 bp, mouse
gtcgccgcgccccggcacgg

SEQ ID NO: 480942 - DNA, 20 bp, mouse
ggggtcgctggtgggttgac

SEQ ID NO: 480943 - DNA, 20 bp, mouse
ggggtccaggaaagccagat

SEQ ID NO: 480944 - DNA, 20 bp, mouse
gggcccggagtgcaacgcac

SEQ ID NO: 480945 - DNA, 20 bp, mouse
gtttgctgcgctcagaggta

SEQ ID NO: 480946 - DNA, 20 bp, mouse
gccgcgcggcggcaccagaa

SEQ ID NO: 480947 - DNA, 20 bp, mouse
gcgcggcggcaccagaaggg

SEQ ID NO: 480948 - DNA, 20 bp, mouse
gcagaagggcgggagcgcga

SEQ ID NO: 480949 - DNA, 20 bp, mouse
ggtgggccagggatgatgtg

SEQ ID NO: 480950 - DNA, 20 bp, mouse
ggcgggagcgcgaaggagag

SEQ ID NO: 480951 - DNA, 20 bp, mouse
gttggcgggcaccctcggtg

SEQ ID NO: 480952 - DNA, 20 bp, mouse
ggcaggcgcaaagcacaaca

SEQ ID NO: 480953 - DNA, 20 bp, mouse
gcacaacagggtggacctag

SEQ ID NO: 480954 - DNA, 20 bp, mouse
gcgccaggtgagcagctcgt

SEQ ID NO: 480955 - DNA, 20 bp, mouse
ggcgcgaaggagagtggaac

SEQ ID NO: 480956 - DNA, 20 bp, mouse
gtgcgctgcgacctctacac

SEQ ID NO: 480957 - DNA, 20 bp, mouse
gactttaggcaacatctcgg

SEQ ID NO: 480958 - DNA, 20 bp, mouse
gggcacgaccacctgtgtag

SEQ ID NO: 480959 - DNA, 20 bp, mouse
gcgaggagcgaggctaggga

SEQ ID NO: 480960 - DNA, 20 bp, mouse
ggaagcatcaggagaacttt

SEQ ID NO: 480961 - DNA, 20 bp, mouse
gctcctgtgggcccccctgt

SEQ ID NO: 480962 - DNA, 20 bp, mouse
gagaggtcgcagcgcaggtc

SEQ ID NO: 480963 - DNA, 20 bp, mouse
ggagactcacctccactgaa

SEQ ID NO: 480964 - DNA, 20 bp, mouse
ggaacatgttgagaagcatc

SEQ ID NO: 480965 - DNA, 20 bp, mouse
ggcatgcgtcgaagggacaa

SEQ ID NO: 480966 - DNA, 20 bp, mouse
gttggggactgagctagtgg

SEQ ID NO: 480967 - DNA, 20 bp, mouse
gacacagtgagtacaaggag

SEQ ID NO: 480968 - DNA, 20 bp, mouse
gggactgagctagtggagga

SEQ ID NO: 480969 - DNA, 20 bp, mouse
gtgcttggggactgagctag

SEQ ID NO: 480970 - DNA, 20 bp, mouse
ggtgtggttgctgaggcttg

SEQ ID NO: 480971 - DNA, 20 bp, mouse
gtcctgtggagtcaaactag

SEQ ID NO: 480972 - DNA, 20 bp, mouse
gaaactggtgagtaaattca

SEQ ID NO: 480973 - DNA, 20 bp, mouse
gcgcatcctacctgcttcgg

SEQ ID NO: 480974 - DNA, 20 bp, mouse
gggctttcccagaacccatc

SEQ ID NO: 480975 - DNA, 20 bp, mouse
gtttgactccacaggagaga

SEQ ID NO: 480976 - DNA, 20 bp, mouse
gccctgggtagagcgatagc

SEQ ID NO: 480977 - DNA, 20 bp, mouse
gaaacggcccatcttaccct

SEQ ID NO: 480978 - DNA, 20 bp, mouse
gatatagggtagcagagaga

SEQ ID NO: 480979 - DNA, 20 bp, mouse
gtagggaagagtgactatat

SEQ ID NO: 480980 - DNA, 20 bp, mouse
ggctctacccagggtaagat

SEQ ID NO: 480981 - DNA, 20 bp, mouse
gtggctctagagagatgtgg

SEQ ID NO: 480982 - DNA, 20 bp, mouse
ggatgagttcgccaaataca

SEQ ID NO: 480983 - DNA, 20 bp, mouse
gttcacagaaaatgacgctg

SEQ ID NO: 480984 - DNA, 20 bp, mouse
gagagtgtctcaaatctggg

SEQ ID NO: 480985 - DNA, 20 bp, mouse
gtcctgctatcgctctaccc

SEQ ID NO: 480986 - DNA, 20 bp, mouse
gcggccggcgggcaccaccg

SEQ ID NO: 480987 - DNA, 20 bp, mouse
gcagcccgtgggagtctagt

SEQ ID NO: 480988 - DNA, 20 bp, mouse
ggcgcctactagactcccac

SEQ ID NO: 480989 - DNA, 20 bp, mouse
gctcgggagcgatcagcacg

SEQ ID NO: 480990 - DNA, 20 bp, mouse
gccgcagagccggaccgtcg

SEQ ID NO: 480991 - DNA, 20 bp, mouse
gtaacacgcttggcaatgcc

SEQ ID NO: 480992 - DNA, 20 bp, mouse
gagcatgcaagcccgagaac

SEQ ID NO: 480993 - DNA, 20 bp, mouse
gttgccaagcgtgttaattg

SEQ ID NO: 480994 - DNA, 20 bp, mouse
gtgctgatcgctcccgagag

SEQ ID NO: 480995 - DNA, 20 bp, mouse
ggcttggcaatgccaggcga

SEQ ID NO: 480996 - DNA, 20 bp, mouse
gcgccactccatcggagact

SEQ ID NO: 480997 - DNA, 20 bp, mouse
gagagagcgcgccactccat

SEQ ID NO: 480998 - DNA, 20 bp, mouse
ggtatgcacccagtctccga

SEQ ID NO: 480999 - DNA, 20 bp, mouse
gcacccagtctccgatggag

SEQ ID NO: 481000 - DNA, 20 bp, mouse
ggagtggcgcgctctctctc

SEQ ID NO: 481001 - DNA, 20 bp, mouse
gatctcagtcctgactcttt

SEQ ID NO: 481002 - DNA, 20 bp, mouse
ggagctgctgaaccaggtat

SEQ ID NO: 481003 - DNA, 20 bp, mouse
gactgagatgaaaaggaccc

SEQ ID NO: 481004 - DNA, 20 bp, mouse
gggcagggtagtgccaacct

SEQ ID NO: 481005 - DNA, 20 bp, mouse
gacttaacacccaaagagtc

SEQ ID NO: 481006 - DNA, 20 bp, mouse
ggacgaagcgcaccttgcag

SEQ ID NO: 481007 - DNA, 20 bp, mouse
gccccccgcagcggtccaca

SEQ ID NO: 481008 - DNA, 20 bp, mouse
gcacagggcgtgccactgca

SEQ ID NO: 481009 - DNA, 20 bp, mouse
gcacgccctgtggaccgctg

SEQ ID NO: 481010 - DNA, 20 bp, mouse
gcttcgtctggcaccgctca

SEQ ID NO: 481011 - DNA, 20 bp, mouse
gtgagactgggtgtcaagta

SEQ ID NO: 481012 - DNA, 20 bp, mouse
ggtgctcttggggaccgcag

SEQ ID NO: 481013 - DNA, 20 bp, mouse
gaccctaaggagagacctga

SEQ ID NO: 481014 - DNA, 20 bp, mouse
gctgcagccatgggcatccg

SEQ ID NO: 481015 - DNA, 20 bp, mouse
ggtgggagcgagtcagaacc

SEQ ID NO: 481016 - DNA, 20 bp, mouse
ggcaatgatgccttaagaga

SEQ ID NO: 481017 - DNA, 20 bp, mouse
ggcgggcggcaactcctcac

SEQ ID NO: 481018 - DNA, 20 bp, mouse
gtgatgccttaagagagggc

SEQ ID NO: 481019 - DNA, 20 bp, mouse
gtgccttaagagagggcggg

SEQ ID NO: 481020 - DNA, 20 bp, mouse
gtgccgcccgccctctctta

SEQ ID NO: 481021 - DNA, 20 bp, mouse
gagaagccgtgagaaggagc

SEQ ID NO: 481022 - DNA, 20 bp, mouse
gcagtcagtaatctggccag

SEQ ID NO: 481023 - DNA, 20 bp, mouse
ggaagctgcagtcagtaatc

SEQ ID NO: 481024 - DNA, 20 bp, mouse
gtgctgtgtttgttattaga

SEQ ID NO: 481025 - DNA, 20 bp, mouse
gctcccaagaagccgtgaga

SEQ ID NO: 481026 - DNA, 20 bp, mouse
gggaaccccagtattccagg

SEQ ID NO: 481027 - DNA, 20 bp, mouse
gggccaatctctaagcagag

SEQ ID NO: 481028 - DNA, 20 bp, mouse
gaagctgttctagggttcag

SEQ ID NO: 481029 - DNA, 20 bp, mouse
gtcagagaagcgctgaccag

SEQ ID NO: 481030 - DNA, 20 bp, mouse
gggactgacttcttgactaa

SEQ ID NO: 481031 - DNA, 20 bp, mouse
gagaggaaccccagtattcc

SEQ ID NO: 481032 - DNA, 20 bp, mouse
gagcgctgaccagaggctgg

SEQ ID NO: 481033 - DNA, 20 bp, mouse
ggaggctgtaagggcatggt

SEQ ID NO: 481034 - DNA, 20 bp, mouse
ggtcatggtcaggtgtgtgg

SEQ ID NO: 481035 - DNA, 20 bp, mouse
gatgccccctggcttaacca

SEQ ID NO: 481036 - DNA, 20 bp, mouse
gtgggaagagggcaaacgga

SEQ ID NO: 481037 - DNA, 20 bp, mouse
gtccctgggaagagggcaaa

SEQ ID NO: 481038 - DNA, 20 bp, mouse
gagagggtccgaggcagcta

SEQ ID NO: 481039 - DNA, 20 bp, mouse
gtgcgaccaagaactgtccc

SEQ ID NO: 481040 - DNA, 20 bp, mouse
gcagctgagagtttattgag

SEQ ID NO: 481041 - DNA, 20 bp, mouse
ggtagattggcatcactcac

SEQ ID NO: 481042 - DNA, 20 bp, mouse
gtagattagcagagggtccg

SEQ ID NO: 481043 - DNA, 20 bp, mouse
gtttctttacattgccaatg

SEQ ID NO: 481044 - DNA, 20 bp, mouse
gaccatgtcttccaggagga

SEQ ID NO: 481045 - DNA, 20 bp, mouse
gtgctgatggggtttcttga

SEQ ID NO: 481046 - DNA, 20 bp, mouse
gcgtgctgggtgtcacccca

SEQ ID NO: 481047 - DNA, 20 bp, mouse
gagaagggagagatccggag

SEQ ID NO: 481048 - DNA, 20 bp, mouse
ggctctcccgtgccggacca

SEQ ID NO: 481049 - DNA, 20 bp, mouse
gctgggctcggctctgtcac

SEQ ID NO: 481050 - DNA, 20 bp, mouse
gacgatccctggtccggcac

SEQ ID NO: 481051 - DNA, 20 bp, mouse
gctgtcacaggagtacgtgc

SEQ ID NO: 481052 - DNA, 20 bp, mouse
gacaagaagccgcaggctga

SEQ ID NO: 481053 - DNA, 20 bp, mouse
gcattcgggaggacacataa

SEQ ID NO: 481054 - DNA, 20 bp, mouse
ggcacgggagagcctgaaga

SEQ ID NO: 481055 - DNA, 20 bp, mouse
gatacgcgcctgggtagcag

SEQ ID NO: 481056 - DNA, 20 bp, mouse
gttacagaggaagggaccgt

SEQ ID NO: 481057 - DNA, 20 bp, mouse
ggcgcatccgagcccagcag

SEQ ID NO: 481058 - DNA, 20 bp, mouse
gtccattagttacagaggaa

SEQ ID NO: 481059 - DNA, 20 bp, mouse
gcccagcaggggatacttcc

SEQ ID NO: 481060 - DNA, 20 bp, mouse
gagcaggggatacttcctgg

SEQ ID NO: 481061 - DNA, 20 bp, mouse
gctctctccattagttacag

SEQ ID NO: 481062 - DNA, 20 bp, mouse
gtacttcctggaggaatctc

SEQ ID NO: 481063 - DNA, 20 bp, mouse
gcacccagcgcgtacacctg

SEQ ID NO: 481064 - DNA, 20 bp, mouse
gttcctggaggaatctctgg

SEQ ID NO: 481065 - DNA, 20 bp, mouse
gaaaaaagttgtgtcaccca

SEQ ID NO: 481066 - DNA, 20 bp, mouse
gtcgtgcagggtcgaggcaa

SEQ ID NO: 481067 - DNA, 20 bp, mouse
ggcactctcgtgcagggtcg

SEQ ID NO: 481068 - DNA, 20 bp, mouse
gagtacgtgtggcgggagaa

SEQ ID NO: 481069 - DNA, 20 bp, mouse
ggtgcgtgtgcgagtacgtg

SEQ ID NO: 481070 - DNA, 20 bp, mouse
gggcgctggtcgcctccaag

SEQ ID NO: 481071 - DNA, 20 bp, mouse
gacgcacgcactctcgtgca

SEQ ID NO: 481072 - DNA, 20 bp, mouse
gcgtgtgcgagtacgtgtgg

SEQ ID NO: 481073 - DNA, 20 bp, mouse
gccggagccaggagacgcca

SEQ ID NO: 481074 - DNA, 20 bp, mouse
gtgagaacccgggcacaggt

SEQ ID NO: 481075 - DNA, 20 bp, mouse
ggcggcagcgcgacgagggt

SEQ ID NO: 481076 - DNA, 20 bp, mouse
gagcagccggccggccggag

SEQ ID NO: 481077 - DNA, 20 bp, mouse
gagagttccccagcgaggct

SEQ ID NO: 481078 - DNA, 20 bp, mouse
gtgctcgcctagcctcgctg

SEQ ID NO: 481079 - DNA, 20 bp, mouse
gggccggccggagcggagaa

SEQ ID NO: 481080 - DNA, 20 bp, mouse
gcggccggagcggagaaggg

SEQ ID NO: 481081 - DNA, 20 bp, mouse
gcccggacgcgaggcgggag

SEQ ID NO: 481082 - DNA, 20 bp, mouse
gaggcgagcagccggccggc

SEQ ID NO: 481083 - DNA, 20 bp, mouse
gagtgcagagttccccagcg

SEQ ID NO: 481084 - DNA, 20 bp, mouse
gactctgcactgctgcctcg

SEQ ID NO: 481085 - DNA, 20 bp, mouse
gggggcggcggccaccgagt

SEQ ID NO: 481086 - DNA, 20 bp, mouse
gctcactccgcagcaaccct

SEQ ID NO: 481087 - DNA, 20 bp, mouse
gagagatgaacgcagaccca

SEQ ID NO: 481088 - DNA, 20 bp, mouse
gcttcccaagaaaaaagtag

SEQ ID NO: 481089 - DNA, 20 bp, mouse
gcgcagacccagggttgctg

SEQ ID NO: 481090 - DNA, 20 bp, mouse
gactccacagcggaccccca

SEQ ID NO: 481091 - DNA, 20 bp, mouse
gtcagaagtgagtacaacag

SEQ ID NO: 481092 - DNA, 20 bp, mouse
gagtgtcggaggccttccgg

SEQ ID NO: 481093 - DNA, 20 bp, mouse
gcccgtgcgaccagaagtgt

SEQ ID NO: 481094 - DNA, 20 bp, mouse
gtcttggattaatttcgagg

SEQ ID NO: 481095 - DNA, 20 bp, mouse
ggccgcctcgtacaccccca

SEQ ID NO: 481096 - DNA, 20 bp, mouse
gtgggcgcgcatcggactct

SEQ ID NO: 481097 - DNA, 20 bp, mouse
gaccagacaaggccaactct

SEQ ID NO: 481098 - DNA, 20 bp, mouse
gtggcgcactcgctggtggt

SEQ ID NO: 481099 - DNA, 20 bp, mouse
gtgactctggaagaagtccg

SEQ ID NO: 481100 - DNA, 20 bp, mouse
ggggcgccagatcagaagta

SEQ ID NO: 481101 - DNA, 20 bp, mouse
ggtgggagccgtgcactgtc

SEQ ID NO: 481102 - DNA, 20 bp, mouse
ggcggagggaacccgagcgc

SEQ ID NO: 481103 - DNA, 20 bp, mouse
gtggtcttacagggtcctct

SEQ ID NO: 481104 - DNA, 20 bp, mouse
ggttatccaaaagagtgcgg

SEQ ID NO: 481105 - DNA, 20 bp, mouse
gagcctggcgcactcgctgg

SEQ ID NO: 481106 - DNA, 20 bp, mouse
gcggcgctcgcaatgcggag

SEQ ID NO: 481107 - DNA, 20 bp, mouse
gtatctcctgcggctctctg

SEQ ID NO: 481108 - DNA, 20 bp, mouse
ggcggagtggctatctcctg

SEQ ID NO: 481109 - DNA, 20 bp, mouse
gtcttggctgtgggtcctcg

SEQ ID NO: 481110 - DNA, 20 bp, mouse
gcacggtagctgcgggacct

SEQ ID NO: 481111 - DNA, 20 bp, mouse
ggatggcggcgctcgcaatg

SEQ ID NO: 481112 - DNA, 20 bp, mouse
ggaacctgctgaccccgcga

SEQ ID NO: 481113 - DNA, 20 bp, mouse
gtgctctggggtgggccaca

SEQ ID NO: 481114 - DNA, 20 bp, mouse
ggggatccgcgtgcctacta

SEQ ID NO: 481115 - DNA, 20 bp, mouse
ggctatgtggccaagcagtt

SEQ ID NO: 481116 - DNA, 20 bp, mouse
ggcacctgtgtgatccagaa

SEQ ID NO: 481117 - DNA, 20 bp, mouse
ggcgccgttctggatcacac

SEQ ID NO: 481118 - DNA, 20 bp, mouse
gtcgcgggcgtggctcatct

SEQ ID NO: 481119 - DNA, 20 bp, mouse
gtggcaaggcagagcagtgg

SEQ ID NO: 481120 - DNA, 20 bp, mouse
gggcagagacactagagacc

SEQ ID NO: 481121 - DNA, 20 bp, mouse
gacgcccgcgacgaccacca

SEQ ID NO: 481122 - DNA, 20 bp, mouse
gagcagtggcgggcttgtcc

SEQ ID NO: 481123 - DNA, 20 bp, mouse
ggcgggcactgcagcctggg

SEQ ID NO: 481124 - DNA, 20 bp, mouse
gttctagttggttaacccag

SEQ ID NO: 481125 - DNA, 20 bp, mouse
gcgcctccggaggcagcctg

SEQ ID NO: 481126 - DNA, 20 bp, mouse
gcagctgcgggcgaacaacc

SEQ ID NO: 481127 - DNA, 20 bp, mouse
gtcgcccgcagctgctaacc

SEQ ID NO: 481128 - DNA, 20 bp, mouse
ggctccagctccgcactgcc

SEQ ID NO: 481129 - DNA, 20 bp, mouse
gcatggcgtcggccgctccg

SEQ ID NO: 481130 - DNA, 20 bp, mouse
gactgccgggttagcagctg

SEQ ID NO: 481131 - DNA, 20 bp, mouse
gtgcagcagcgacatggcgt

SEQ ID NO: 481132 - DNA, 20 bp, mouse
gtaacccggcagtgcggagc

SEQ ID NO: 481133 - DNA, 20 bp, mouse
ggacttcgtggggcagacag

SEQ ID NO: 481134 - DNA, 20 bp, mouse
gccccagcagcgaccctcct

SEQ ID NO: 481135 - DNA, 20 bp, mouse
gcggtcaccgctttaagcag

SEQ ID NO: 481136 - DNA, 20 bp, mouse
gactgcacggcgcagctcag

SEQ ID NO: 481137 - DNA, 20 bp, mouse
gcctgccacggacacgtcga

SEQ ID NO: 481138 - DNA, 20 bp, mouse
gtggatggtcgcttactgca

SEQ ID NO: 481139 - DNA, 20 bp, mouse
gggtcgggcgtggtgaagag

SEQ ID NO: 481140 - DNA, 20 bp, mouse
ggggtgcaggggcaacgatg

SEQ ID NO: 481141 - DNA, 20 bp, mouse
gcggcatggggaagcgcacg

SEQ ID NO: 481142 - DNA, 20 bp, mouse
gcgggcgtggtgaagagtgg

SEQ ID NO: 481143 - DNA, 20 bp, mouse
gtgcaggggcaacgatgggg

SEQ ID NO: 481144 - DNA, 20 bp, mouse
gaggctctctcggtccgggt

SEQ ID NO: 481145 - DNA, 20 bp, mouse
gactgcgatggtatcagtgt

SEQ ID NO: 481146 - DNA, 20 bp, mouse
gcggggtgcggcagccgctg

SEQ ID NO: 481147 - DNA, 20 bp, mouse
gcgccgtggcgctcactggg

SEQ ID NO: 481148 - DNA, 20 bp, mouse
gacctggcgagtgttgagag

SEQ ID NO: 481149 - DNA, 20 bp, mouse
gatgttcaggaagtaggctg

SEQ ID NO: 481150 - DNA, 20 bp, mouse
gggtgcggcagccgctgcgg

SEQ ID NO: 481151 - DNA, 20 bp, mouse
ggagtgttgagagcggggtg

SEQ ID NO: 481152 - DNA, 20 bp, mouse
gaggaggggcacccagagca

SEQ ID NO: 481153 - DNA, 20 bp, mouse
ggggcgcactcgccgggacc

SEQ ID NO: 481154 - DNA, 20 bp, mouse
gtccagtaggcaagatgttc

SEQ ID NO: 481155 - DNA, 20 bp, mouse
gggcaagatgttcaggaagt

SEQ ID NO: 481156 - DNA, 20 bp, mouse
gcttcttgaactattgtaga

SEQ ID NO: 481157 - DNA, 20 bp, mouse
ggggctgaagatttttttgc

SEQ ID NO: 481158 - DNA, 20 bp, mouse
gatttttttgctgggggcac

SEQ ID NO: 481159 - DNA, 20 bp, mouse
gttgaactattgtagaaggc

SEQ ID NO: 481160 - DNA, 20 bp, mouse
gctgaagatttttttgctgg

SEQ ID NO: 481161 - DNA, 20 bp, mouse
gcatcctgagaggcacacag

SEQ ID NO: 481162 - DNA, 20 bp, mouse
gccatctcctggcagctctg

SEQ ID NO: 481163 - DNA, 20 bp, mouse
gggataatgtccatcctgag

SEQ ID NO: 481164 - DNA, 20 bp, mouse
gtgagaggcacacagaggta

SEQ ID NO: 481165 - DNA, 20 bp, mouse
ggaggcacacagaggtaagg

SEQ ID NO: 481166 - DNA, 20 bp, mouse
gctgccacctgatcccatcc

SEQ ID NO: 481167 - DNA, 20 bp, mouse
ggcgcagcaaagcaagctat

SEQ ID NO: 481168 - DNA, 20 bp, mouse
gccgggtcttagggcaacgg

SEQ ID NO: 481169 - DNA, 20 bp, mouse
gtgctttgctgcgcctggat

SEQ ID NO: 481170 - DNA, 20 bp, mouse
gtactgcagtagccagcccg

SEQ ID NO: 481171 - DNA, 20 bp, mouse
ggctactgcagtactcacgc

SEQ ID NO: 481172 - DNA, 20 bp, mouse
gaccctcaggaagctggcaa

SEQ ID NO: 481173 - DNA, 20 bp, mouse
gtagccagcccggggctgga

SEQ ID NO: 481174 - DNA, 20 bp, mouse
gcgcccccggtgtgagatgg

SEQ ID NO: 481175 - DNA, 20 bp, mouse
gctgccgggtcttagggcaa

SEQ ID NO: 481176 - DNA, 20 bp, mouse
gaggcactcaccaggccata

SEQ ID NO: 481177 - DNA, 20 bp, mouse
gaagctgaggctggaaccgg

SEQ ID NO: 481178 - DNA, 20 bp, mouse
ggatccaaggagccgggcgg

SEQ ID NO: 481179 - DNA, 20 bp, mouse
ggttgatccaaggagccggg

SEQ ID NO: 481180 - DNA, 20 bp, mouse
ggtggctggggagcctgacc

SEQ ID NO: 481181 - DNA, 20 bp, mouse
gtgtggggcaagttgatcca

SEQ ID NO: 481182 - DNA, 20 bp, mouse
gagtcagaaaaaaccaggtc

SEQ ID NO: 481183 - DNA, 20 bp, mouse
gggagctcgaggtggatggt

SEQ ID NO: 481184 - DNA, 20 bp, mouse
gtgagtgcctaaagaagctg

SEQ ID NO: 481185 - DNA, 20 bp, mouse
gagagcagtcagaaaaaacc

SEQ ID NO: 481186 - DNA, 20 bp, mouse
gttgctgggaagccttaggt

SEQ ID NO: 481187 - DNA, 20 bp, mouse
gatggctaacagccaaccta

SEQ ID NO: 481188 - DNA, 20 bp, mouse
gagtcgcgtgacccgcacaa

SEQ ID NO: 481189 - DNA, 20 bp, mouse
gcaataagggcaccgcaaca

SEQ ID NO: 481190 - DNA, 20 bp, mouse
ggcatcggcgcagtcagcgg

SEQ ID NO: 481191 - DNA, 20 bp, mouse
ggcgactgtggcgcccgggg

SEQ ID NO: 481192 - DNA, 20 bp, mouse
gggctgggccgggagttcga

SEQ ID NO: 481193 - DNA, 20 bp, mouse
ggccggggtgagatgaaccc

SEQ ID NO: 481194 - DNA, 20 bp, mouse
ggggaggcaggagtgcggtg

SEQ ID NO: 481195 - DNA, 20 bp, mouse
gggctcggcgagccgtgttg

SEQ ID NO: 481196 - DNA, 20 bp, mouse
ggttcggccggtagaatgaa

SEQ ID NO: 481197 - DNA, 20 bp, mouse
gattctaccggccgaacctg

SEQ ID NO: 481198 - DNA, 20 bp, mouse
ggggcttagtgagctcggaa

SEQ ID NO: 481199 - DNA, 20 bp, mouse
gtcagcgctggagcttccgc

SEQ ID NO: 481200 - DNA, 20 bp, mouse
ggagcttccgcaggttcggc

SEQ ID NO: 481201 - DNA, 20 bp, mouse
ggctggagcttccgcaggtt

SEQ ID NO: 481202 - DNA, 20 bp, mouse
gactaagcccttcattctac

SEQ ID NO: 481203 - DNA, 20 bp, mouse
ggagcgaggaggttccaaga

SEQ ID NO: 481204 - DNA, 20 bp, mouse
ggaggaggttccaagagggt

SEQ ID NO: 481205 - DNA, 20 bp, mouse
ggctcgggtggcccccgcta

SEQ ID NO: 481206 - DNA, 20 bp, mouse
gcagctgcagacgagcgtca

SEQ ID NO: 481207 - DNA, 20 bp, mouse
ggcagctcctcgacccgggg

SEQ ID NO: 481208 - DNA, 20 bp, mouse
ggccagcagctcctcgaccc

SEQ ID NO: 481209 - DNA, 20 bp, mouse
ggctgcttggagaccgcccc

SEQ ID NO: 481210 - DNA, 20 bp, mouse
gcaatgcggcccctcaccat

SEQ ID NO: 481211 - DNA, 20 bp, mouse
gggccgggccagcacacaca

SEQ ID NO: 481212 - DNA, 20 bp, mouse
gtggagaccgccccgggtcg

SEQ ID NO: 481213 - DNA, 20 bp, mouse
ggcccgccgggccttcatgg

SEQ ID NO: 481214 - DNA, 20 bp, mouse
gccgccccgcgggatgctgg

SEQ ID NO: 481215 - DNA, 20 bp, mouse
ggggccagcacacacaagga

SEQ ID NO: 481216 - DNA, 20 bp, mouse
gaagcatcacgagattaaag

SEQ ID NO: 481217 - DNA, 20 bp, mouse
gagagggatctagcaaaata

SEQ ID NO: 481218 - DNA, 20 bp, mouse
ggccactcgacgagtccagg

SEQ ID NO: 481219 - DNA, 20 bp, mouse
gggcagaacatcccaggtgg

SEQ ID NO: 481220 - DNA, 20 bp, mouse
ggccacctggactcgtcgag

SEQ ID NO: 481221 - DNA, 20 bp, mouse
ggaggcgtggccgggatccc

SEQ ID NO: 481222 - DNA, 20 bp, mouse
gcacttctggaaactgcaga

SEQ ID NO: 481223 - DNA, 20 bp, mouse
gccaggtggcagaacatccc

SEQ ID NO: 481224 - DNA, 20 bp, mouse
gatctagcaaaatatggctg

SEQ ID NO: 481225 - DNA, 20 bp, mouse
gatcacgagattaaagtggc

SEQ ID NO: 481226 - DNA, 20 bp, mouse
ggagggcagctctccaaaca

SEQ ID NO: 481227 - DNA, 20 bp, mouse
gcaggggaaagcctcagacg

SEQ ID NO: 481228 - DNA, 20 bp, mouse
gacaccctgaactttcccaa

SEQ ID NO: 481229 - DNA, 20 bp, mouse
gttggagagctgccctcggg

SEQ ID NO: 481230 - DNA, 20 bp, mouse
gttctggtcaccgaaaccat

SEQ ID NO: 481231 - DNA, 20 bp, mouse
gggctagagtttgaacagca

SEQ ID NO: 481232 - DNA, 20 bp, mouse
gcactcacgggacctgactg

SEQ ID NO: 481233 - DNA, 20 bp, mouse
gaagccaagcaccacgtctg

SEQ ID NO: 481234 - DNA, 20 bp, mouse
gcggtgaccagaaccgtgtt

SEQ ID NO: 481235 - DNA, 20 bp, mouse
ggaaaccattgggaaagttc

SEQ ID NO: 481236 - DNA, 20 bp, mouse
gctgggtcttgactcctcag

SEQ ID NO: 481237 - DNA, 20 bp, mouse
gcctgcggccaagagtccta

SEQ ID NO: 481238 - DNA, 20 bp, mouse
gtacagtccaaaaggaaccg

SEQ ID NO: 481239 - DNA, 20 bp, mouse
ggcaaaccaagctcccgctg

SEQ ID NO: 481240 - DNA, 20 bp, mouse
gaaggaaccgcggcaggctt

SEQ ID NO: 481241 - DNA, 20 bp, mouse
ggcgggagcttggtttgcta

SEQ ID NO: 481242 - DNA, 20 bp, mouse
gccgcggcaggcttgggact

SEQ ID NO: 481243 - DNA, 20 bp, mouse
gcggatgagcagtgacccga

SEQ ID NO: 481244 - DNA, 20 bp, mouse
ggccctggcggcagaatgag

SEQ ID NO: 481245 - DNA, 20 bp, mouse
gcgctctcgggaggggaagt

SEQ ID NO: 481246 - DNA, 20 bp, mouse
gccgctggcagaggccgagg

SEQ ID NO: 481247 - DNA, 20 bp, mouse
gcagcgcgggcgctcctctc

SEQ ID NO: 481248 - DNA, 20 bp, mouse
ggcgccgctggcagaggccg

SEQ ID NO: 481249 - DNA, 20 bp, mouse
gctcccgcgggccgcagcgc

SEQ ID NO: 481250 - DNA, 20 bp, mouse
gctgccagcggcgcccccgt

SEQ ID NO: 481251 - DNA, 20 bp, mouse
ggaggcggcgcggcggactg

SEQ ID NO: 481252 - DNA, 20 bp, mouse
gcggccacaaagggccgagg

SEQ ID NO: 481253 - DNA, 20 bp, mouse
gccggccgcgcggccacaaa

SEQ ID NO: 481254 - DNA, 20 bp, mouse
gtagggtcagcccggtaccg

SEQ ID NO: 481255 - DNA, 20 bp, mouse
gcgggcccgcctgcccacgg

SEQ ID NO: 481256 - DNA, 20 bp, mouse
gcgtccgcccgtccacccgg

SEQ ID NO: 481257 - DNA, 20 bp, mouse
gaccgcgagcggcagcccga

SEQ ID NO: 481258 - DNA, 20 bp, mouse
ggagcccaaagccccacgtt

SEQ ID NO: 481259 - DNA, 20 bp, mouse
gtgcagggtgggagcgaagt

SEQ ID NO: 481260 - DNA, 20 bp, mouse
gcccggcggcggcagcagtt

SEQ ID NO: 481261 - DNA, 20 bp, mouse
gctgccgccgccgggtggac

SEQ ID NO: 481262 - DNA, 20 bp, mouse
ggcgcgtccgcccgtccacc

SEQ ID NO: 481263 - DNA, 20 bp, mouse
gacgttgggcagcaggacca

SEQ ID NO: 481264 - DNA, 20 bp, mouse
gggcggacgcgcaaagccgg

SEQ ID NO: 481265 - DNA, 20 bp, mouse
gcagagcagacacgaaggat

SEQ ID NO: 481266 - DNA, 20 bp, mouse
gccgcaaggctgcgtgtcgt

SEQ ID NO: 481267 - DNA, 20 bp, mouse
gtagcggcgctccagggcac

SEQ ID NO: 481268 - DNA, 20 bp, mouse
ggtgacgcgagggctccgca

SEQ ID NO: 481269 - DNA, 20 bp, mouse
gtcgcgcgccgcggctcgtg

SEQ ID NO: 481270 - DNA, 20 bp, mouse
gtacgtcggcgcctgagcgt

SEQ ID NO: 481271 - DNA, 20 bp, mouse
gccgggatagcggcgctcca

SEQ ID NO: 481272 - DNA, 20 bp, mouse
ggacgcgtgccgtgacgcga

SEQ ID NO: 481273 - DNA, 20 bp, mouse
ggcgtgggctgcggcctgaa

SEQ ID NO: 481274 - DNA, 20 bp, mouse
gcacccgcaggccgggatag

SEQ ID NO: 481275 - DNA, 20 bp, mouse
gcggattcaacagcagtgat

SEQ ID NO: 481276 - DNA, 20 bp, mouse
ggagtgttctaggtctaaca

SEQ ID NO: 481277 - DNA, 20 bp, mouse
gtggacctcgagtgaaacgt

SEQ ID NO: 481278 - DNA, 20 bp, mouse
ggctatgctaggtctataat

SEQ ID NO: 481279 - DNA, 20 bp, mouse
ggctgattgaggagtgttct

SEQ ID NO: 481280 - DNA, 20 bp, mouse
gtaggaatgtgcccatcaag

SEQ ID NO: 481281 - DNA, 20 bp, mouse
gggggcccagaccccttgat

SEQ ID NO: 481282 - DNA, 20 bp, mouse
gggtagggtggtttgggaat

SEQ ID NO: 481283 - DNA, 20 bp, mouse
gctgttacttatgggaacaa

SEQ ID NO: 481284 - DNA, 20 bp, mouse
gccaggtagcagatgtaaaa

SEQ ID NO: 481285 - DNA, 20 bp, mouse
ggattacttacctagttcag

SEQ ID NO: 481286 - DNA, 20 bp, mouse
gcagctagcgggtgcatgtg

SEQ ID NO: 481287 - DNA, 20 bp, mouse
gggccgcggggtgcagctag

SEQ ID NO: 481288 - DNA, 20 bp, mouse
gtcggcggtgcagcgagata

SEQ ID NO: 481289 - DNA, 20 bp, mouse
ggcggcggcctgggcagcac

SEQ ID NO: 481290 - DNA, 20 bp, mouse
ggcgctcccagagcatcggc

SEQ ID NO: 481291 - DNA, 20 bp, mouse
ggcgggctcgaagcaggtcg

SEQ ID NO: 481292 - DNA, 20 bp, mouse
gccagcgctcgggcagtcgg

SEQ ID NO: 481293 - DNA, 20 bp, mouse
gacccgctagctgcaccccg

SEQ ID NO: 481294 - DNA, 20 bp, mouse
gcccgcggactcctctcccc

SEQ ID NO: 481295 - DNA, 20 bp, mouse
ggctcgaagcaggtcgggga

SEQ ID NO: 481296 - DNA, 20 bp, mouse
gcaaggaggcgcaggagaca

SEQ ID NO: 481297 - DNA, 20 bp, mouse
gaggcgcaggagacacggag

SEQ ID NO: 481298 - DNA, 20 bp, mouse
gccaggaggcgcccaggcca

SEQ ID NO: 481299 - DNA, 20 bp, mouse
ggcccaggccaaggaggcgc

SEQ ID NO: 481300 - DNA, 20 bp, mouse
gctccgagagcgctgccagg

SEQ ID NO: 481301 - DNA, 20 bp, mouse
gccaagtgaccaggcggtgg

SEQ ID NO: 481302 - DNA, 20 bp, mouse
ggccgaggtgacaatgtgct

SEQ ID NO: 481303 - DNA, 20 bp, mouse
gctatgagggagcatctccg

SEQ ID NO: 481304 - DNA, 20 bp, mouse
gaggctccgagagcgctgcc

SEQ ID NO: 481305 - DNA, 20 bp, mouse
gctggatccagcccgaccag

SEQ ID NO: 481306 - DNA, 20 bp, mouse
ggcgcacagcagcatcgcag

SEQ ID NO: 481307 - DNA, 20 bp, mouse
gtcgcggcagcagcgggcaa

SEQ ID NO: 481308 - DNA, 20 bp, mouse
gagcatcgcagcggccgccg

SEQ ID NO: 481309 - DNA, 20 bp, mouse
gcgctccaaacggagagccg

SEQ ID NO: 481310 - DNA, 20 bp, mouse
ggcccggcgcccgctccaaa

SEQ ID NO: 481311 - DNA, 20 bp, mouse
ggcggccgggcagggacgag

SEQ ID NO: 481312 - DNA, 20 bp, mouse
ggccgggaaggtggaatccg

SEQ ID NO: 481313 - DNA, 20 bp, mouse
ggcgatgctgctgtgcgccg

SEQ ID NO: 481314 - DNA, 20 bp, mouse
gctcgagtcagtttccctcg

SEQ ID NO: 481315 - DNA, 20 bp, mouse
gctgactcgagcagccggga

SEQ ID NO: 481316 - DNA, 20 bp, mouse
gaagccggcaggcacggtcg

SEQ ID NO: 481317 - DNA, 20 bp, mouse
ggatgtaaagccggcaggca

SEQ ID NO: 481318 - DNA, 20 bp, mouse
gccttgggatgccttgagtc

SEQ ID NO: 481319 - DNA, 20 bp, mouse
gagagcaacagatgtaaagc

SEQ ID NO: 481320 - DNA, 20 bp, mouse
gcgaggaagcgacccaggag

SEQ ID NO: 481321 - DNA, 20 bp, mouse
gcaacagatgtaaagccggc

SEQ ID NO: 481322 - DNA, 20 bp, mouse
gaggttctacaagctgtctg

SEQ ID NO: 481323 - DNA, 20 bp, mouse
gcttggctccctgtcctatc

SEQ ID NO: 481324 - DNA, 20 bp, mouse
gagatgacagacatcctcct

SEQ ID NO: 481325 - DNA, 20 bp, mouse
gctgaccactcatgcagagg

SEQ ID NO: 481326 - DNA, 20 bp, mouse
gcggcgcaagcgacaacaaa

SEQ ID NO: 481327 - DNA, 20 bp, mouse
ggctctcggagcccgagcag

SEQ ID NO: 481328 - DNA, 20 bp, mouse
gaagcgacaacaaacggctg

SEQ ID NO: 481329 - DNA, 20 bp, mouse
gggagggtgacagcatgtgg

SEQ ID NO: 481330 - DNA, 20 bp, mouse
ggtgcccaggatccaggcta

SEQ ID NO: 481331 - DNA, 20 bp, mouse
gccgctggaggatgctgcat

SEQ ID NO: 481332 - DNA, 20 bp, mouse
gtgaccgtagcctggatcct

SEQ ID NO: 481333 - DNA, 20 bp, mouse
gaacctcggctaacagcggg

SEQ ID NO: 481334 - DNA, 20 bp, mouse
gtgcgcgccgcggccgctgg

SEQ ID NO: 481335 - DNA, 20 bp, mouse
ggttcgcggggcccgaccgg

SEQ ID NO: 481336 - DNA, 20 bp, mouse
gcagccgcggttctcctgag

SEQ ID NO: 481337 - DNA, 20 bp, mouse
gagggctggtggcatctccc

SEQ ID NO: 481338 - DNA, 20 bp, mouse
gtcgccgctcaggagaaccg

SEQ ID NO: 481339 - DNA, 20 bp, mouse
ggcggcgagcggagggctgg

SEQ ID NO: 481340 - DNA, 20 bp, mouse
gcggctgtggctgcgaccag

SEQ ID NO: 481341 - DNA, 20 bp, mouse
gtggcgagacgagacctgca

SEQ ID NO: 481342 - DNA, 20 bp, mouse
gctggagatggaaagcaacg

SEQ ID NO: 481343 - DNA, 20 bp, mouse
gccccgggtgctctatatgg

SEQ ID NO: 481344 - DNA, 20 bp, mouse
gtccacaaagaaaacgaggt

SEQ ID NO: 481345 - DNA, 20 bp, mouse
ggaccccagacgtgccaagg

SEQ ID NO: 481346 - DNA, 20 bp, mouse
ggcggcggcgcgggaagacg

SEQ ID NO: 481347 - DNA, 20 bp, mouse
ggccgcccagagcgaggatg

SEQ ID NO: 481348 - DNA, 20 bp, mouse
ggccgcgggtgagccggaca

SEQ ID NO: 481349 - DNA, 20 bp, mouse
ggcgccgccaggctgcccgg

SEQ ID NO: 481350 - DNA, 20 bp, mouse
gtcgcgctgctctgggtcct

SEQ ID NO: 481351 - DNA, 20 bp, mouse
ggctcggggcagcagatgtg

SEQ ID NO: 481352 - DNA, 20 bp, mouse
ggccctgtccggctcacccg

SEQ ID NO: 481353 - DNA, 20 bp, mouse
ggcctactacatgtactcgg

SEQ ID NO: 481354 - DNA, 20 bp, mouse
gcggccgccgggcagcctgg

SEQ ID NO: 481355 - DNA, 20 bp, mouse
ggtgcaccgagagtgctccc

SEQ ID NO: 481356 - DNA, 20 bp, mouse
ggccaagcgaggccacgccg

SEQ ID NO: 481357 - DNA, 20 bp, mouse
ggcaacgcgggaggcccggc

SEQ ID NO: 481358 - DNA, 20 bp, mouse
gcagccccagagcctcaccg

SEQ ID NO: 481359 - DNA, 20 bp, mouse
ggccggcttacctggcaggt

SEQ ID NO: 481360 - DNA, 20 bp, mouse
gtcgccggcgggagctcacc

SEQ ID NO: 481361 - DNA, 20 bp, mouse
ggctcccgcagtcccagcaa

SEQ ID NO: 481362 - DNA, 20 bp, mouse
gacccggcgacaggagtgat

SEQ ID NO: 481363 - DNA, 20 bp, mouse
gtcctgtcgccgggtcccct

SEQ ID NO: 481364 - DNA, 20 bp, mouse
ggagctcccgccggcgacgt

SEQ ID NO: 481365 - DNA, 20 bp, mouse
ggtggcctcgcttggcaacg

SEQ ID NO: 481366 - DNA, 20 bp, mouse
gcgacaccggagtttcccag

SEQ ID NO: 481367 - DNA, 20 bp, mouse
gaccagaggccggggagcga

SEQ ID NO: 481368 - DNA, 20 bp, mouse
gctggtggtgctcaactggt

SEQ ID NO: 481369 - DNA, 20 bp, mouse
ggcctctggtggtgctcaac

SEQ ID NO: 481370 - DNA, 20 bp, mouse
gaagttctgagacgagcagg

SEQ ID NO: 481371 - DNA, 20 bp, mouse
gctcccggaccttgatacaa

SEQ ID NO: 481372 - DNA, 20 bp, mouse
ggagttcccggctcaggtag

SEQ ID NO: 481373 - DNA, 20 bp, mouse
gttgagaccccctcgctccc

SEQ ID NO: 481374 - DNA, 20 bp, mouse
gaggagggtggagtattggc

SEQ ID NO: 481375 - DNA, 20 bp, mouse
gcgacccgtgaggatccgga

SEQ ID NO: 481376 - DNA, 20 bp, mouse
gggagcaaggcccctctcgt

SEQ ID NO: 481377 - DNA, 20 bp, mouse
gctggagccagtgtatacta

SEQ ID NO: 481378 - DNA, 20 bp, mouse
ggctaaaccctagtatacac

SEQ ID NO: 481379 - DNA, 20 bp, mouse
ggcaggaaatagctgtccaa

SEQ ID NO: 481380 - DNA, 20 bp, mouse
gcgaggaagtgggcgagtct

SEQ ID NO: 481381 - DNA, 20 bp, mouse
gcaagaaaacaagaaaacgt

SEQ ID NO: 481382 - DNA, 20 bp, mouse
gcactgcatcttgtctcaca

SEQ ID NO: 481383 - DNA, 20 bp, mouse
gtgcttggttccgacgagag

SEQ ID NO: 481384 - DNA, 20 bp, mouse
gagctgcagctgactgctcc

SEQ ID NO: 481385 - DNA, 20 bp, mouse
ggactgctccgggagccacc

SEQ ID NO: 481386 - DNA, 20 bp, mouse
gacgagcagctcggcggcag

SEQ ID NO: 481387 - DNA, 20 bp, mouse
gccaggtccgagggcaccat

SEQ ID NO: 481388 - DNA, 20 bp, mouse
gcgcggtaggtaagcagcaa

SEQ ID NO: 481389 - DNA, 20 bp, mouse
gcagcggctttgcctcggcg

SEQ ID NO: 481390 - DNA, 20 bp, mouse
gacggggctgccaggtccga

SEQ ID NO: 481391 - DNA, 20 bp, mouse
ggaggagaagagggattccg

SEQ ID NO: 481392 - DNA, 20 bp, mouse
ggggagtcccggaggagcac

SEQ ID NO: 481393 - DNA, 20 bp, mouse
gctgcttacctaccgcgccg

SEQ ID NO: 481394 - DNA, 20 bp, mouse
gaggcacacagtaggcaccg

SEQ ID NO: 481395 - DNA, 20 bp, mouse
gctgcggttaagaagctgag

SEQ ID NO: 481396 - DNA, 20 bp, mouse
gtcgccgccggaggaagatg

SEQ ID NO: 481397 - DNA, 20 bp, mouse
gcagcctcatcttcctccgg

SEQ ID NO: 481398 - DNA, 20 bp, mouse
ggaagatgaggctgaagatc

SEQ ID NO: 481399 - DNA, 20 bp, mouse
gtgacccgcctggccccctc

SEQ ID NO: 481400 - DNA, 20 bp, mouse
gagcccactgagcaggatga

SEQ ID NO: 481401 - DNA, 20 bp, mouse
gtgtatgtggcgggagcaag

SEQ ID NO: 481402 - DNA, 20 bp, mouse
gtcgtcgggccgcgaggaca

SEQ ID NO: 481403 - DNA, 20 bp, mouse
ggtgtgtctctcgccgccgg

SEQ ID NO: 481404 - DNA, 20 bp, mouse
ggctgtgtgtctctcgccgc

SEQ ID NO: 481405 - DNA, 20 bp, mouse
gatcttacgcagtttgctgg

SEQ ID NO: 481406 - DNA, 20 bp, mouse
ggggcgcgcaggagcgatcg

SEQ ID NO: 481407 - DNA, 20 bp, mouse
gggagccgagcgcacaggag

SEQ ID NO: 481408 - DNA, 20 bp, mouse
ggagcgggacgcagcagcta

SEQ ID NO: 481409 - DNA, 20 bp, mouse
ggcgcaggagccgagcgcac

SEQ ID NO: 481410 - DNA, 20 bp, mouse
gctgcgcgctgaagaagggc

SEQ ID NO: 481411 - DNA, 20 bp, mouse
ggtttctgcgcgctgaagaa

SEQ ID NO: 481412 - DNA, 20 bp, mouse
ggtccgagccgcgctcatgg

SEQ ID NO: 481413 - DNA, 20 bp, mouse
gaaggcctcgcgctgcctcc

SEQ ID NO: 481414 - DNA, 20 bp, mouse
gggcccaggaagctcccggc

SEQ ID NO: 481415 - DNA, 20 bp, mouse
gccggccgcggtggggacca

SEQ ID NO: 481416 - DNA, 20 bp, mouse
gtctgagagccagcctgtgg

SEQ ID NO: 481417 - DNA, 20 bp, mouse
gggtggtactagatcatgct

SEQ ID NO: 481418 - DNA, 20 bp, mouse
gtgacaaccagagtcataag

SEQ ID NO: 481419 - DNA, 20 bp, mouse
ggtgttcagcaggccaccac

SEQ ID NO: 481420 - DNA, 20 bp, mouse
gtctagaccagtgcaagcag

SEQ ID NO: 481421 - DNA, 20 bp, mouse
gcagagtcataagtggaatc

SEQ ID NO: 481422 - DNA, 20 bp, mouse
gtggactctgccgagcagca

SEQ ID NO: 481423 - DNA, 20 bp, mouse
gtgaacactctgttgctgta

SEQ ID NO: 481424 - DNA, 20 bp, mouse
gaggccagagttagagactc

SEQ ID NO: 481425 - DNA, 20 bp, mouse
gtgaaaagatgtaattttct

SEQ ID NO: 481426 - DNA, 20 bp, mouse
gtgggaagcaccagaaactg

SEQ ID NO: 481427 - DNA, 20 bp, mouse
gaccaatctgcagggttcag

SEQ ID NO: 481428 - DNA, 20 bp, mouse
gccctctgaaccctgcagat

SEQ ID NO: 481429 - DNA, 20 bp, mouse
gtgcagggttcagagggagt

SEQ ID NO: 481430 - DNA, 20 bp, mouse
gatcaggtaagtaccagtca

SEQ ID NO: 481431 - DNA, 20 bp, mouse
gggcaggaaaattaaagcca

SEQ ID NO: 481432 - DNA, 20 bp, mouse
ggcaagggggccaggagaat

SEQ ID NO: 481433 - DNA, 20 bp, mouse
gcctcataggactgaataca

SEQ ID NO: 481434 - DNA, 20 bp, mouse
gaaagaccagagaccaatgt

SEQ ID NO: 481435 - DNA, 20 bp, mouse
gtaagtaccagtcagggcaa

SEQ ID NO: 481436 - DNA, 20 bp, mouse
ggacctgccagcaatggctg

SEQ ID NO: 481437 - DNA, 20 bp, mouse
gggagtgtgaggtcagacaa

SEQ ID NO: 481438 - DNA, 20 bp, mouse
ggtcagacaaaggtgccttg

SEQ ID NO: 481439 - DNA, 20 bp, mouse
gggtgctgccagctccacac

SEQ ID NO: 481440 - DNA, 20 bp, mouse
gaagcagagaggaggagcgt

SEQ ID NO: 481441 - DNA, 20 bp, mouse
gtctctgccacagccattgc

SEQ ID NO: 481442 - DNA, 20 bp, mouse
gagactggcagggccatgac

SEQ ID NO: 481443 - DNA, 20 bp, mouse
gcagttaaggaactctgaag

SEQ ID NO: 481444 - DNA, 20 bp, mouse
gtggggcatcgagcatgggt

SEQ ID NO: 481445 - DNA, 20 bp, mouse
gtggcagcaccggctgggct

SEQ ID NO: 481446 - DNA, 20 bp, mouse
ggccttctcagccggatagg

SEQ ID NO: 481447 - DNA, 20 bp, mouse
gagcggggcagcacgtagag

SEQ ID NO: 481448 - DNA, 20 bp, mouse
gagggaccagagtggcagcg

SEQ ID NO: 481449 - DNA, 20 bp, mouse
gtgtgccttctcagccggat

SEQ ID NO: 481450 - DNA, 20 bp, mouse
gagaggacccgggactaaga

SEQ ID NO: 481451 - DNA, 20 bp, mouse
gcccatttccagcaaggagg

SEQ ID NO: 481452 - DNA, 20 bp, mouse
gaggtgggctgccacctatc

SEQ ID NO: 481453 - DNA, 20 bp, mouse
gagccccatttccagcaagg

SEQ ID NO: 481454 - DNA, 20 bp, mouse
gcgccagcgccagcgaggca

SEQ ID NO: 481455 - DNA, 20 bp, mouse
gggagcttggcgggaagaag

SEQ ID NO: 481456 - DNA, 20 bp, mouse
ggctcccgcgctcaagtcct

SEQ ID NO: 481457 - DNA, 20 bp, mouse
ggcgctcaccaagacccgga

SEQ ID NO: 481458 - DNA, 20 bp, mouse
gctaaagcagagcgggtccc

SEQ ID NO: 481459 - DNA, 20 bp, mouse
gctgctccctccaccaatcc

SEQ ID NO: 481460 - DNA, 20 bp, mouse
ggagcgagcacccagagtat

SEQ ID NO: 481461 - DNA, 20 bp, mouse
gctacgcgctcaccaagacc

SEQ ID NO: 481462 - DNA, 20 bp, mouse
gagggtgcgtgtgggacatg

SEQ ID NO: 481463 - DNA, 20 bp, mouse
gtggtgagcgcgtagctccc

SEQ ID NO: 481464 - DNA, 20 bp, mouse
gggtcccaggacttgagcgc

SEQ ID NO: 481465 - DNA, 20 bp, mouse
gcgggagccaaatggagtca

SEQ ID NO: 481466 - DNA, 20 bp, mouse
gtgctggcgctgctcaggat

SEQ ID NO: 481467 - DNA, 20 bp, mouse
gcgccagcaggcttcagagg

SEQ ID NO: 481468 - DNA, 20 bp, mouse
ggcttcagaggcggacgcca

SEQ ID NO: 481469 - DNA, 20 bp, mouse
ggtggcctcacgtcgcatag

SEQ ID NO: 481470 - DNA, 20 bp, mouse
gggctccgctatgcgacgtg

SEQ ID NO: 481471 - DNA, 20 bp, mouse
gctagtcccagagtcaaggt

SEQ ID NO: 481472 - DNA, 20 bp, mouse
gggccacacgaattgaccta

SEQ ID NO: 481473 - DNA, 20 bp, mouse
gcctagcaggcccaagtaca

SEQ ID NO: 481474 - DNA, 20 bp, mouse
gtaccttaggtcaattcgtg

SEQ ID NO: 481475 - DNA, 20 bp, mouse
ggccatggcagcgaccttcc

SEQ ID NO: 481476 - DNA, 20 bp, mouse
gcctcgccgggcgcgaagag

SEQ ID NO: 481477 - DNA, 20 bp, mouse
ggctagcgcatgcatatagg

SEQ ID NO: 481478 - DNA, 20 bp, mouse
gaaaccaggccgggagcgca

SEQ ID NO: 481479 - DNA, 20 bp, mouse
gcggcggctgctgcctccag

SEQ ID NO: 481480 - DNA, 20 bp, mouse
gaccttggtcgggaagggaa

SEQ ID NO: 481481 - DNA, 20 bp, mouse
gaggctgtgcaaaccaggcc

SEQ ID NO: 481482 - DNA, 20 bp, mouse
gcccgaccaaggtagcccca

SEQ ID NO: 481483 - DNA, 20 bp, mouse
gtatatgcatgcgctagcgg

SEQ ID NO: 481484 - DNA, 20 bp, mouse
ggacgcgtcataggccgcgg

SEQ ID NO: 481485 - DNA, 20 bp, mouse
gtggtgaggctgtgcaaacc

SEQ ID NO: 481486 - DNA, 20 bp, mouse
gccagagcttcactcagtcc

SEQ ID NO: 481487 - DNA, 20 bp, mouse
gagcttcactcagtccgggc

SEQ ID NO: 481488 - DNA, 20 bp, mouse
gtcactcagtccgggcgggc

SEQ ID NO: 481489 - DNA, 20 bp, mouse
gacgcgcatctggtcctcga

SEQ ID NO: 481490 - DNA, 20 bp, mouse
gctcgacggcgaggagatcc

SEQ ID NO: 481491 - DNA, 20 bp, mouse
gcgcgcggcgtgctgagggt

SEQ ID NO: 481492 - DNA, 20 bp, mouse
gccggtgcagaagaacatcc

SEQ ID NO: 481493 - DNA, 20 bp, mouse
ggtgcagaagaacatcctgg

SEQ ID NO: 481494 - DNA, 20 bp, mouse
gacgtgcgcgggactcgggc

SEQ ID NO: 481495 - DNA, 20 bp, mouse
ggtcccgcgcacgtccccgc

SEQ ID NO: 481496 - DNA, 20 bp, mouse
gtgaggagcccggaacccgg

SEQ ID NO: 481497 - DNA, 20 bp, mouse
gtacaagatggcggcaatag

SEQ ID NO: 481498 - DNA, 20 bp, mouse
gcggcgcgtaggaggcggtg

SEQ ID NO: 481499 - DNA, 20 bp, mouse
gagtggcggcgcgtaggagg

SEQ ID NO: 481500 - DNA, 20 bp, mouse
gatggcggcaatagcggcag

SEQ ID NO: 481501 - DNA, 20 bp, mouse
ggagcaaacccggtacaaga

SEQ ID NO: 481502 - DNA, 20 bp, mouse
gcaaacccggtacaagatgg

SEQ ID NO: 481503 - DNA, 20 bp, mouse
gggcagtggcggcgcgtagg

SEQ ID NO: 481504 - DNA, 20 bp, mouse
gatggggctcgggggatcta

SEQ ID NO: 481505 - DNA, 20 bp, mouse
gtcgggtcaaggagcaaacc

SEQ ID NO: 481506 - DNA, 20 bp, mouse
gacgatcgcagggaaacagg

SEQ ID NO: 481507 - DNA, 20 bp, mouse
ggccacgatcgcagggaaac

SEQ ID NO: 481508 - DNA, 20 bp, mouse
gcagagcctggaatgtgacg

SEQ ID NO: 481509 - DNA, 20 bp, mouse
gccctgcgatcgtggcctgg

SEQ ID NO: 481510 - DNA, 20 bp, mouse
gagtagactcaaagtttctg

SEQ ID NO: 481511 - DNA, 20 bp, mouse
gttgacttggaaaggatgag

SEQ ID NO: 481512 - DNA, 20 bp, mouse
gacctccaggccacgatcgc

SEQ ID NO: 481513 - DNA, 20 bp, mouse
ggattggcttctgcccgaag

SEQ ID NO: 481514 - DNA, 20 bp, mouse
gactctgctagttcacctcc

SEQ ID NO: 481515 - DNA, 20 bp, mouse
gggcctgagagttaggagtc

SEQ ID NO: 481516 - DNA, 20 bp, mouse
gaagccagagcatcatgcca

SEQ ID NO: 481517 - DNA, 20 bp, mouse
ggagcaagcgagcagaaaag

SEQ ID NO: 481518 - DNA, 20 bp, mouse
gctcaaaaccagagacctag

SEQ ID NO: 481519 - DNA, 20 bp, mouse
gccaaaaaccagatcatgaa

SEQ ID NO: 481520 - DNA, 20 bp, mouse
gtacagggtttcctcgtgaa

SEQ ID NO: 481521 - DNA, 20 bp, mouse
gctctggcttccttagcata

SEQ ID NO: 481522 - DNA, 20 bp, mouse
gaggggtgtggggacgatgt

SEQ ID NO: 481523 - DNA, 20 bp, mouse
gcatcagttaccgtatgcta

SEQ ID NO: 481524 - DNA, 20 bp, mouse
gctgctactaattagggtaa

SEQ ID NO: 481525 - DNA, 20 bp, mouse
gtaaggggagagaaatatgc

SEQ ID NO: 481526 - DNA, 20 bp, mouse
ggcgtggcccgaaggacacc

SEQ ID NO: 481527 - DNA, 20 bp, mouse
gcagtgccaggtgaaaatcg

SEQ ID NO: 481528 - DNA, 20 bp, mouse
ggggtcagcaagacctgcgt

SEQ ID NO: 481529 - DNA, 20 bp, mouse
gtgtgaacgggtgagttcca

SEQ ID NO: 481530 - DNA, 20 bp, mouse
gaggggagtgggcactgtac

SEQ ID NO: 481531 - DNA, 20 bp, mouse
gccggggacagtcggaaact

SEQ ID NO: 481532 - DNA, 20 bp, mouse
ggcaggaggccggggacagt

SEQ ID NO: 481533 - DNA, 20 bp, mouse
ggcaagacctgcgtaggcaa

SEQ ID NO: 481534 - DNA, 20 bp, mouse
ggcaggtcttgctgacccgg

SEQ ID NO: 481535 - DNA, 20 bp, mouse
ggcaaaggcggagttaccag

SEQ ID NO: 481536 - DNA, 20 bp, mouse
ggggaaccaggtccactgtg

SEQ ID NO: 481537 - DNA, 20 bp, mouse
gattgtaagatccacaggtc

SEQ ID NO: 481538 - DNA, 20 bp, mouse
gaggagcaggtggactgagg

SEQ ID NO: 481539 - DNA, 20 bp, mouse
gcagctgtcctatcatgttc

SEQ ID NO: 481540 - DNA, 20 bp, mouse
ggctcttctcaccaaggtgt

SEQ ID NO: 481541 - DNA, 20 bp, mouse
gcactctagataccagaagg

SEQ ID NO: 481542 - DNA, 20 bp, mouse
gtcctatgtaggactctcta

SEQ ID NO: 481543 - DNA, 20 bp, mouse
ggcaaggagcaggtggactg

SEQ ID NO: 481544 - DNA, 20 bp, mouse
gtccacacacaggggagtaa

SEQ ID NO: 481545 - DNA, 20 bp, mouse
gtggttcccagccaagatca

SEQ ID NO: 481546 - DNA, 20 bp, mouse
ggacagagttggacactccc

SEQ ID NO: 481547 - DNA, 20 bp, mouse
ggaaaagtgacagacagagt

SEQ ID NO: 481548 - DNA, 20 bp, mouse
gttcatgtgagtccaactga

SEQ ID NO: 481549 - DNA, 20 bp, mouse
gtcatgtaggcgttatacta

SEQ ID NO: 481550 - DNA, 20 bp, mouse
ggattcgggctcagtcatag

SEQ ID NO: 481551 - DNA, 20 bp, mouse
ggctttgcaaggtctactct

SEQ ID NO: 481552 - DNA, 20 bp, mouse
ggttggactcacatgaagcc

SEQ ID NO: 481553 - DNA, 20 bp, mouse
gacacttccttcaggtagaa

SEQ ID NO: 481554 - DNA, 20 bp, mouse
gttccttcaggtagaatggc

SEQ ID NO: 481555 - DNA, 20 bp, mouse
gtgtgtgttaatggatgatt

SEQ ID NO: 481556 - DNA, 20 bp, mouse
gaccgactggcgatctgtgg

SEQ ID NO: 481557 - DNA, 20 bp, mouse
gaggaggcagggaaaccgac

SEQ ID NO: 481558 - DNA, 20 bp, mouse
ggaaaccgactggcgatctg

SEQ ID NO: 481559 - DNA, 20 bp, mouse
gagcgccgccgcaggaggca

SEQ ID NO: 481560 - DNA, 20 bp, mouse
gcgcacgcgcactgctgagg

SEQ ID NO: 481561 - DNA, 20 bp, mouse
gcaggtacacggagacgtga

SEQ ID NO: 481562 - DNA, 20 bp, mouse
gcagttcgcagcgagggcga

SEQ ID NO: 481563 - DNA, 20 bp, mouse
gctgccccggacgcccacag

SEQ ID NO: 481564 - DNA, 20 bp, mouse
ggccgccacagatcgccagt

SEQ ID NO: 481565 - DNA, 20 bp, mouse
gacctggtgctagagaagac

SEQ ID NO: 481566 - DNA, 20 bp, mouse
ggctaggctggagacgcacg

SEQ ID NO: 481567 - DNA, 20 bp, mouse
gcgctcaggccaccaagaag

SEQ ID NO: 481568 - DNA, 20 bp, mouse
gtgcggcggagggcgagcga

SEQ ID NO: 481569 - DNA, 20 bp, mouse
ggctggagacgcacgtggcg

SEQ ID NO: 481570 - DNA, 20 bp, mouse
ggcgcggtgagtgcggcgga

SEQ ID NO: 481571 - DNA, 20 bp, mouse
gcggagggcgagcgagggtg

SEQ ID NO: 481572 - DNA, 20 bp, mouse
gcttggtggcctgagcgagg

SEQ ID NO: 481573 - DNA, 20 bp, mouse
ggcgcgcggagggacacttc

SEQ ID NO: 481574 - DNA, 20 bp, mouse
gccgcggtgaccgggaggag

SEQ ID NO: 481575 - DNA, 20 bp, mouse
gccggcctggcgaaatagac

SEQ ID NO: 481576 - DNA, 20 bp, mouse
gccgcctcgagcccagtgtg

SEQ ID NO: 481577 - DNA, 20 bp, mouse
gtcgaggcggaggctaggag

SEQ ID NO: 481578 - DNA, 20 bp, mouse
gagtgccgggagcgctgcta

SEQ ID NO: 481579 - DNA, 20 bp, mouse
gccagtgtgaggtggagccg

SEQ ID NO: 481580 - DNA, 20 bp, mouse
gaggtggagccgcgggtccg

SEQ ID NO: 481581 - DNA, 20 bp, mouse
gggctaggagagggccgagg

SEQ ID NO: 481582 - DNA, 20 bp, mouse
ggccggacagcgaggcacag

SEQ ID NO: 481583 - DNA, 20 bp, mouse
gcggcactgactaatcaaca

SEQ ID NO: 481584 - DNA, 20 bp, mouse
gatggcgttcctcggacccg

SEQ ID NO: 481585 - DNA, 20 bp, mouse
ggcgctgctatggcgttcct

SEQ ID NO: 481586 - DNA, 20 bp, mouse
gcgccgtcccgggaccccga

SEQ ID NO: 481587 - DNA, 20 bp, mouse
gggccagtcccgcgcagctc

SEQ ID NO: 481588 - DNA, 20 bp, mouse
gacctcctcctgggccgaag

SEQ ID NO: 481589 - DNA, 20 bp, mouse
gtctagaggggagacggagg

SEQ ID NO: 481590 - DNA, 20 bp, mouse
gcccgggacggcgaaccccg

SEQ ID NO: 481591 - DNA, 20 bp, mouse
gaggtacccggtgtctagag

SEQ ID NO: 481592 - DNA, 20 bp, mouse
ggtccgaggcaggcgagcgt

SEQ ID NO: 481593 - DNA, 20 bp, mouse
gggccgtcggggtcccggga

SEQ ID NO: 481594 - DNA, 20 bp, mouse
gagcgccgcttcggcccagg

SEQ ID NO: 481595 - DNA, 20 bp, mouse
gccggtgtctagaggggaga

SEQ ID NO: 481596 - DNA, 20 bp, mouse
ggactgtcgcatgcagagac

SEQ ID NO: 481597 - DNA, 20 bp, mouse
gtgccaggacactgtttgat

SEQ ID NO: 481598 - DNA, 20 bp, mouse
gatgcagagacaggtgcact

SEQ ID NO: 481599 - DNA, 20 bp, mouse
gggatgctgaacatcagagt

SEQ ID NO: 481600 - DNA, 20 bp, mouse
gagcctatcaaacagtgtcc

SEQ ID NO: 481601 - DNA, 20 bp, mouse
gaaatgagattagagtctaa

SEQ ID NO: 481602 - DNA, 20 bp, mouse
gaaaatgtagctaccttgta

SEQ ID NO: 481603 - DNA, 20 bp, mouse
gcttgctgaatgtgccagga

SEQ ID NO: 481604 - DNA, 20 bp, mouse
gaaaaactgttggtactggg

SEQ ID NO: 481605 - DNA, 20 bp, mouse
gcagtccgaccagttggaat

SEQ ID NO: 481606 - DNA, 20 bp, mouse
gggtggctctgagcagcgag

SEQ ID NO: 481607 - DNA, 20 bp, mouse
gacgctgcgaccactcgggg

SEQ ID NO: 481608 - DNA, 20 bp, mouse
gctgaggagccgctgagacg

SEQ ID NO: 481609 - DNA, 20 bp, mouse
ggccgccctgcgcaccgcct

SEQ ID NO: 481610 - DNA, 20 bp, mouse
ggcctaggcggtgcgcaggg

SEQ ID NO: 481611 - DNA, 20 bp, mouse
gagcagcgaggggagcagac

SEQ ID NO: 481612 - DNA, 20 bp, mouse
gcggacgctgcgaccactcg

SEQ ID NO: 481613 - DNA, 20 bp, mouse
gcgacgcagcgcggggacag

SEQ ID NO: 481614 - DNA, 20 bp, mouse
gcgcagggcggctacggaag

SEQ ID NO: 481615 - DNA, 20 bp, mouse
gggacaggggaaggacggac

SEQ ID NO: 481616 - DNA, 20 bp, mouse
gttccggcgggtgcgagtgg

SEQ ID NO: 481617 - DNA, 20 bp, mouse
ggcgagccggagctgcgtgg

SEQ ID NO: 481618 - DNA, 20 bp, mouse
gtccccgggccaacttccgg

SEQ ID NO: 481619 - DNA, 20 bp, mouse
gaacttccggcgggtgcgag

SEQ ID NO: 481620 - DNA, 20 bp, mouse
ggattccccgggccaacttc

SEQ ID NO: 481621 - DNA, 20 bp, mouse
gaagccccgccacgcagctc

SEQ ID NO: 481622 - DNA, 20 bp, mouse
gacctggccgacctccatca

SEQ ID NO: 481623 - DNA, 20 bp, mouse
gaagctgggaaagaactacc

SEQ ID NO: 481624 - DNA, 20 bp, mouse
gcccatgggtcaaagcgttt

SEQ ID NO: 481625 - DNA, 20 bp, mouse
gtacagggtctgtctttaca

SEQ ID NO: 481626 - DNA, 20 bp, mouse
gcagggaggaccccgaaact

SEQ ID NO: 481627 - DNA, 20 bp, mouse
gccgcgctccgggaagttct

SEQ ID NO: 481628 - DNA, 20 bp, mouse
gagcttggggagcggatccg

SEQ ID NO: 481629 - DNA, 20 bp, mouse
ggcgccgcggcaccacacgg

SEQ ID NO: 481630 - DNA, 20 bp, mouse
gagacccggagcttggggag

SEQ ID NO: 481631 - DNA, 20 bp, mouse
gtcctcggttcccggctcag

SEQ ID NO: 481632 - DNA, 20 bp, mouse
gtcgccgcgtccccccggaa

SEQ ID NO: 481633 - DNA, 20 bp, mouse
gcgctcagtgccgttccggg

SEQ ID NO: 481634 - DNA, 20 bp, mouse
gtccgggtccggtagacggt

SEQ ID NO: 481635 - DNA, 20 bp, mouse
ggccccgcggctggtaaagg

SEQ ID NO: 481636 - DNA, 20 bp, mouse
gggaggaccaggcgcgactg

SEQ ID NO: 481637 - DNA, 20 bp, mouse
gcgtgcgggaggcgctcgag

SEQ ID NO: 481638 - DNA, 20 bp, mouse
gacgtcgtctcggtggtccg

SEQ ID NO: 481639 - DNA, 20 bp, mouse
gctcgcgcctcgggatgtca

SEQ ID NO: 481640 - DNA, 20 bp, mouse
ggggtcgctggtgagcacgt

SEQ ID NO: 481641 - DNA, 20 bp, mouse
gctgttcccgggccccgccg

SEQ ID NO: 481642 - DNA, 20 bp, mouse
gtgcacaagcggctccatgg

SEQ ID NO: 481643 - DNA, 20 bp, mouse
gggcccgggaacagcaagct

SEQ ID NO: 481644 - DNA, 20 bp, mouse
gctgcggcacgtcgtctcgg

SEQ ID NO: 481645 - DNA, 20 bp, mouse
ggccgcggcccgcgaagcgt

SEQ ID NO: 481646 - DNA, 20 bp, mouse
ggcctggaagcagcgatctc

SEQ ID NO: 481647 - DNA, 20 bp, mouse
ggccccggggagcatcgccc

SEQ ID NO: 481648 - DNA, 20 bp, mouse
ggggccgcgccgccgcacac

SEQ ID NO: 481649 - DNA, 20 bp, mouse
ggggcgacgcctgtgtgcgg

SEQ ID NO: 481650 - DNA, 20 bp, mouse
gctcgggcgacgcctgtgtg

SEQ ID NO: 481651 - DNA, 20 bp, mouse
ggccggggcgatgctccccg

SEQ ID NO: 481652 - DNA, 20 bp, mouse
ggagggtgagtgcccagtca

SEQ ID NO: 481653 - DNA, 20 bp, mouse
ggcactgcggaggctcgcgg

SEQ ID NO: 481654 - DNA, 20 bp, mouse
ggaccaggcctcgagcactg

SEQ ID NO: 481655 - DNA, 20 bp, mouse
gctctggctagggctcctgg

SEQ ID NO: 481656 - DNA, 20 bp, mouse
gccctggacggtgacggtga

SEQ ID NO: 481657 - DNA, 20 bp, mouse
gctggctccctggacggtga

SEQ ID NO: 481658 - DNA, 20 bp, mouse
gcttgttctggctccctgga

SEQ ID NO: 481659 - DNA, 20 bp, mouse
ggggtactcctctcttccca

SEQ ID NO: 481660 - DNA, 20 bp, mouse
gggagccagaacaagcaagt

SEQ ID NO: 481661 - DNA, 20 bp, mouse
gggtgatggtggcggtccgg

SEQ ID NO: 481662 - DNA, 20 bp, mouse
gagcaagccgcagagcccct

SEQ ID NO: 481663 - DNA, 20 bp, mouse
gaccatcaccgtcaccgtcc

SEQ ID NO: 481664 - DNA, 20 bp, mouse
ggcagtagatgacctgccct

SEQ ID NO: 481665 - DNA, 20 bp, mouse
ggacggtgatggtggcggtc

SEQ ID NO: 481666 - DNA, 20 bp, mouse
gggagcgagatcacttctcc

SEQ ID NO: 481667 - DNA, 20 bp, mouse
ggtcccggtggagttcaggt

SEQ ID NO: 481668 - DNA, 20 bp, mouse
gcgcgctgggcgacgaactg

SEQ ID NO: 481669 - DNA, 20 bp, mouse
ggctgggcgacgaactgcgg

SEQ ID NO: 481670 - DNA, 20 bp, mouse
gtcacttctccgggcgactc

SEQ ID NO: 481671 - DNA, 20 bp, mouse
gaccgggacgctatagactg

SEQ ID NO: 481672 - DNA, 20 bp, mouse
gctcagagcaggacaggtcg

SEQ ID NO: 481673 - DNA, 20 bp, mouse
gagattgagcccgagtcgcc

SEQ ID NO: 481674 - DNA, 20 bp, mouse
ggacaggcaacggaaagtta

SEQ ID NO: 481675 - DNA, 20 bp, mouse
gcggttggttgcaggcttgc

SEQ ID NO: 481676 - DNA, 20 bp, mouse
gccgcagcgagcgccgggtg

SEQ ID NO: 481677 - DNA, 20 bp, mouse
gcgcggacgccgcgagacac

SEQ ID NO: 481678 - DNA, 20 bp, mouse
gcggttctgggccgtgaagg

SEQ ID NO: 481679 - DNA, 20 bp, mouse
gtgcggtcagagcacccggg

SEQ ID NO: 481680 - DNA, 20 bp, mouse
gacacgggctccggtcatcc

SEQ ID NO: 481681 - DNA, 20 bp, mouse
gcagaaccgcagcgagcgcc

SEQ ID NO: 481682 - DNA, 20 bp, mouse
gtcacccgctgcctccttca

SEQ ID NO: 481683 - DNA, 20 bp, mouse
gctcacagtgagtaccgcag

SEQ ID NO: 481684 - DNA, 20 bp, mouse
gtactcactgtgagaagact

SEQ ID NO: 481685 - DNA, 20 bp, mouse
gagcgcagtgcccagggcgg

SEQ ID NO: 481686 - DNA, 20 bp, mouse
gaagccccaggctcaggact

SEQ ID NO: 481687 - DNA, 20 bp, mouse
gtgctatggaagagatgcca

SEQ ID NO: 481688 - DNA, 20 bp, mouse
ggagcccagtcctgagcctg

SEQ ID NO: 481689 - DNA, 20 bp, mouse
gccaggcaacttgttctgca

SEQ ID NO: 481690 - DNA, 20 bp, mouse
gtgtggaccctgtgccaaga

SEQ ID NO: 481691 - DNA, 20 bp, mouse
gacctgagacaggtagttaa

SEQ ID NO: 481692 - DNA, 20 bp, mouse
gctcctctctgcactatgaa

SEQ ID NO: 481693 - DNA, 20 bp, mouse
gtgtgagattggatagtact

SEQ ID NO: 481694 - DNA, 20 bp, mouse
gtgggcagagagtaaacgat

SEQ ID NO: 481695 - DNA, 20 bp, mouse
gcagccacactttcctcaga

SEQ ID NO: 481696 - DNA, 20 bp, mouse
gcgggatgggcgctggtcag

SEQ ID NO: 481697 - DNA, 20 bp, mouse
gagcacaggccgactcacca

SEQ ID NO: 481698 - DNA, 20 bp, mouse
gagcgcccatcccggattag

SEQ ID NO: 481699 - DNA, 20 bp, mouse
gacttccactaatccgggat

SEQ ID NO: 481700 - DNA, 20 bp, mouse
gccagcacttccactaatcc

SEQ ID NO: 481701 - DNA, 20 bp, mouse
gccggaggcctccctaccaa

SEQ ID NO: 481702 - DNA, 20 bp, mouse
gcactggacactccgagcac

SEQ ID NO: 481703 - DNA, 20 bp, mouse
gaaccagcacgggatctagt

SEQ ID NO: 481704 - DNA, 20 bp, mouse
gagaaaccccgagaactcgg

SEQ ID NO: 481705 - DNA, 20 bp, mouse
gctccccaaccgggaccaca

SEQ ID NO: 481706 - DNA, 20 bp, mouse
gaagcaagggaccccatctc

SEQ ID NO: 481707 - DNA, 20 bp, mouse
ggaaaggcaggcgggaatca

SEQ ID NO: 481708 - DNA, 20 bp, mouse
gggaatcacggacaacagtg

SEQ ID NO: 481709 - DNA, 20 bp, mouse
ggaactgagtcgcagttcta

SEQ ID NO: 481710 - DNA, 20 bp, mouse
gggtagcactggcctaggaa

SEQ ID NO: 481711 - DNA, 20 bp, mouse
gtggagcctctaaaggcagg

SEQ ID NO: 481712 - DNA, 20 bp, mouse
gcatggtgtctccagagatg

SEQ ID NO: 481713 - DNA, 20 bp, mouse
gccgtcgcaagccctttcct

SEQ ID NO: 481714 - DNA, 20 bp, mouse
gctctggagacaccatggcc

SEQ ID NO: 481715 - DNA, 20 bp, mouse
gaatttctcacccacagagc

SEQ ID NO: 481716 - DNA, 20 bp, mouse
ggagttcagggtgatcccaa

SEQ ID NO: 481717 - DNA, 20 bp, mouse
gatcccaagggagtcctcac

SEQ ID NO: 481718 - DNA, 20 bp, mouse
ggaggattcagccaccttag

SEQ ID NO: 481719 - DNA, 20 bp, mouse
gtgaactcgtcataccacta

SEQ ID NO: 481720 - DNA, 20 bp, mouse
gactcgtcataccactaagg

SEQ ID NO: 481721 - DNA, 20 bp, mouse
gggccagtgaggactccctt

SEQ ID NO: 481722 - DNA, 20 bp, mouse
gtgggaatcaagactgacct

SEQ ID NO: 481723 - DNA, 20 bp, mouse
gcctgggcttgttgatgcag

SEQ ID NO: 481724 - DNA, 20 bp, mouse
gcagaagtctggggatccgt

SEQ ID NO: 481725 - DNA, 20 bp, mouse
ggcctgctactcagacccat

SEQ ID NO: 481726 - DNA, 20 bp, mouse
gtcggcagctggcgccaggg

SEQ ID NO: 481727 - DNA, 20 bp, mouse
ggagtcggcagctggcgcca

SEQ ID NO: 481728 - DNA, 20 bp, mouse
gccggcccctctgcatcctc

SEQ ID NO: 481729 - DNA, 20 bp, mouse
gggcggccggaggatgcaga

SEQ ID NO: 481730 - DNA, 20 bp, mouse
gctggcgccagggcggccgg

SEQ ID NO: 481731 - DNA, 20 bp, mouse
gggattcacgggataggggt

SEQ ID NO: 481732 - DNA, 20 bp, mouse
gctcgcagccccaggaactg

SEQ ID NO: 481733 - DNA, 20 bp, mouse
gctgcacagacgtgaagcgg

SEQ ID NO: 481734 - DNA, 20 bp, mouse
gcaccaggagagcccgggta

SEQ ID NO: 481735 - DNA, 20 bp, mouse
gtctcggcctccggcccgcc

SEQ ID NO: 481736 - DNA, 20 bp, mouse
gcagccagaaccaagagagg

SEQ ID NO: 481737 - DNA, 20 bp, mouse
gctatggttgaggtgatctt

SEQ ID NO: 481738 - DNA, 20 bp, mouse
gttgaggtgatcttaggcca

SEQ ID NO: 481739 - DNA, 20 bp, mouse
gtcggttcccggccgcagag

SEQ ID NO: 481740 - DNA, 20 bp, mouse
gctcactgctcaggtctccc

SEQ ID NO: 481741 - DNA, 20 bp, mouse
gtgtcccccgagaccggcta

SEQ ID NO: 481742 - DNA, 20 bp, mouse
gctggcctggccacctctct

SEQ ID NO: 481743 - DNA, 20 bp, mouse
gagggaggcagcggtgtgag

SEQ ID NO: 481744 - DNA, 20 bp, mouse
gggaggcccagcctgagacc

SEQ ID NO: 481745 - DNA, 20 bp, mouse
ggagaccgggaggctcggga

SEQ ID NO: 481746 - DNA, 20 bp, mouse
ggcaaggagcgtagaggagg

SEQ ID NO: 481747 - DNA, 20 bp, mouse
gtgagtagcaaggagcgtag

SEQ ID NO: 481748 - DNA, 20 bp, mouse
ggtagcaaggagcgtagagg

SEQ ID NO: 481749 - DNA, 20 bp, mouse
gcagtgttcgcagacagctg

SEQ ID NO: 481750 - DNA, 20 bp, mouse
gaaacagtccctccaagagg

SEQ ID NO: 481751 - DNA, 20 bp, mouse
gggcgcgacgcaacttaagg

SEQ ID NO: 481752 - DNA, 20 bp, mouse
gacgcacgcgaagacccgga

SEQ ID NO: 481753 - DNA, 20 bp, mouse
gtgtggcgcgacgcaactta

SEQ ID NO: 481754 - DNA, 20 bp, mouse
gcgctccttgctactcaggt

SEQ ID NO: 481755 - DNA, 20 bp, mouse
gaaactatcaagacggcgcc

SEQ ID NO: 481756 - DNA, 20 bp, mouse
gatctgaaggtagaaatgac

SEQ ID NO: 481757 - DNA, 20 bp, mouse
gtcagaggcagctatcccca

SEQ ID NO: 481758 - DNA, 20 bp, mouse
ggaggcagctatccccatgg

SEQ ID NO: 481759 - DNA, 20 bp, mouse
gtcccatggcgagaattaag

SEQ ID NO: 481760 - DNA, 20 bp, mouse
gtcaaggagaaggataacag

SEQ ID NO: 481761 - DNA, 20 bp, mouse
gcatggcgagaattaagagg

SEQ ID NO: 481762 - DNA, 20 bp, mouse
gtccttctccttgattccca

SEQ ID NO: 481763 - DNA, 20 bp, mouse
gagatctccagcaaggcggg

SEQ ID NO: 481764 - DNA, 20 bp, mouse
gctggttcactttctttcag

SEQ ID NO: 481765 - DNA, 20 bp, mouse
gaagcagccgccgctgctgt

SEQ ID NO: 481766 - DNA, 20 bp, mouse
ggtccgcggagctgcaactg

SEQ ID NO: 481767 - DNA, 20 bp, mouse
gaagccggaggcccgcagag

SEQ ID NO: 481768 - DNA, 20 bp, mouse
gcccgcagagtggccgcccg

SEQ ID NO: 481769 - DNA, 20 bp, mouse
gttgcagctccgcggactca

SEQ ID NO: 481770 - DNA, 20 bp, mouse
gcgcgatctccgtgagtccg

SEQ ID NO: 481771 - DNA, 20 bp, mouse
gccgggagcaggggacaagc

SEQ ID NO: 481772 - DNA, 20 bp, mouse
gggactcggggaaccctacc

SEQ ID NO: 481773 - DNA, 20 bp, mouse
ggcctcgggcggccactctg

SEQ ID NO: 481774 - DNA, 20 bp, mouse
gagccgcagttgcagctccg

SEQ ID NO: 481775 - DNA, 20 bp, mouse
gggaggtaggtagctgggaa

SEQ ID NO: 481776 - DNA, 20 bp, mouse
gggaggtgactcaccctagg

SEQ ID NO: 481777 - DNA, 20 bp, mouse
gcagggacagatcagcctct

SEQ ID NO: 481778 - DNA, 20 bp, mouse
gtgttggaggccagctttca

SEQ ID NO: 481779 - DNA, 20 bp, mouse
gttggaagagcttccaccta

SEQ ID NO: 481780 - DNA, 20 bp, mouse
gcctcccacccggctcaaac

SEQ ID NO: 481781 - DNA, 20 bp, mouse
gcaaacaggctggaatctct

SEQ ID NO: 481782 - DNA, 20 bp, mouse
gtgacaggagggccatttgg

SEQ ID NO: 481783 - DNA, 20 bp, mouse
ggaagctcttccaagcttgt

SEQ ID NO: 481784 - DNA, 20 bp, mouse
ggctcttccaagcttgttgg

SEQ ID NO: 481785 - DNA, 20 bp, mouse
gtttggaggtgactcaccct

SEQ ID NO: 481786 - DNA, 20 bp, mouse
gcgcggcgttggcccaggga

SEQ ID NO: 481787 - DNA, 20 bp, mouse
gcccagggagggtgaccggt

SEQ ID NO: 481788 - DNA, 20 bp, mouse
ggacccagtctacaacccac

SEQ ID NO: 481789 - DNA, 20 bp, mouse
gagccaaagccctcacagga

SEQ ID NO: 481790 - DNA, 20 bp, mouse
gcgccagccaaagccctcac

SEQ ID NO: 481791 - DNA, 20 bp, mouse
gaagccctcacaggaaggcg

SEQ ID NO: 481792 - DNA, 20 bp, mouse
gcccgggattccctacagag

SEQ ID NO: 481793 - DNA, 20 bp, mouse
gtccctacagagcggctctg

SEQ ID NO: 481794 - DNA, 20 bp, mouse
ggaccggtgggttgtagact

SEQ ID NO: 481795 - DNA, 20 bp, mouse
gacccaccggtcaccctccc

SEQ ID NO: 481796 - DNA, 20 bp, mouse
gcgcgaccgagggtgctccg

SEQ ID NO: 481797 - DNA, 20 bp, mouse
ggagcgatgtgcgagaagaa

SEQ ID NO: 481798 - DNA, 20 bp, mouse
gcgggagcccgtagtccagt

SEQ ID NO: 481799 - DNA, 20 bp, mouse
ggcgggagagcgagagtccg

SEQ ID NO: 481800 - DNA, 20 bp, mouse
gagcagcgactagcagaccc

SEQ ID NO: 481801 - DNA, 20 bp, mouse
gagaagaacggccgcgaccg

SEQ ID NO: 481802 - DNA, 20 bp, mouse
gtgggcagataagcactggg

SEQ ID NO: 481803 - DNA, 20 bp, mouse
gagggcccgcgaagggagaa

SEQ ID NO: 481804 - DNA, 20 bp, mouse
gtcgctgctggtgaataaaa

SEQ ID NO: 481805 - DNA, 20 bp, mouse
gggctggtccggagtatccc

SEQ ID NO: 481806 - DNA, 20 bp, mouse
gcatcgccggaagccccggt

SEQ ID NO: 481807 - DNA, 20 bp, mouse
gccctaggggacgctatccg

SEQ ID NO: 481808 - DNA, 20 bp, mouse
ggtcgccctggggaccccgg

SEQ ID NO: 481809 - DNA, 20 bp, mouse
gtaggggacgctatccgggg

SEQ ID NO: 481810 - DNA, 20 bp, mouse
ggagccccaaagcctaggtc

SEQ ID NO: 481811 - DNA, 20 bp, mouse
ggggcgcagcgacacgggaa

SEQ ID NO: 481812 - DNA, 20 bp, mouse
gaccctgcctccgcccaccg

SEQ ID NO: 481813 - DNA, 20 bp, mouse
ggcgatgggcggagctcccg

SEQ ID NO: 481814 - DNA, 20 bp, mouse
gagcggccaccgctgacccc

SEQ ID NO: 481815 - DNA, 20 bp, mouse
ggccccggcccgtgcagtga

SEQ ID NO: 481816 - DNA, 20 bp, mouse
gctccatgtgtgcggccgag

SEQ ID NO: 481817 - DNA, 20 bp, mouse
gctggtgcgcatgtcccggg

SEQ ID NO: 481818 - DNA, 20 bp, mouse
ggcgccgggctccatgtgtg

SEQ ID NO: 481819 - DNA, 20 bp, mouse
gggccgaggggcgcattatc

SEQ ID NO: 481820 - DNA, 20 bp, mouse
gcggccgcacacatggagcc

SEQ ID NO: 481821 - DNA, 20 bp, mouse
gggccagataatgcgcccct

SEQ ID NO: 481822 - DNA, 20 bp, mouse
ggcgcgccgaccgggcccag

SEQ ID NO: 481823 - DNA, 20 bp, mouse
ggacctggtgcgcatgtccc

SEQ ID NO: 481824 - DNA, 20 bp, mouse
gatgtcccgggcggtgacgc

SEQ ID NO: 481825 - DNA, 20 bp, mouse
ggcggtggggaactttccag

SEQ ID NO: 481826 - DNA, 20 bp, mouse
gggcggtggcgacaggacga

SEQ ID NO: 481827 - DNA, 20 bp, mouse
ggcccgcgcagtcggtccgt

SEQ ID NO: 481828 - DNA, 20 bp, mouse
ggggcgcgctcaggcagcga

SEQ ID NO: 481829 - DNA, 20 bp, mouse
gcaggacgacggacgaccga

SEQ ID NO: 481830 - DNA, 20 bp, mouse
gccacggcgacggctccctc

SEQ ID NO: 481831 - DNA, 20 bp, mouse
gcggcgacggctccctcggg

SEQ ID NO: 481832 - DNA, 20 bp, mouse
gctccctcgggtggcgcctg

SEQ ID NO: 481833 - DNA, 20 bp, mouse
ggaccgacggaccgactgcg

SEQ ID NO: 481834 - DNA, 20 bp, mouse
ggcgcggagccgagcaactt

SEQ ID NO: 481835 - DNA, 20 bp, mouse
ggggcactctcagacccgag

SEQ ID NO: 481836 - DNA, 20 bp, mouse
gggggcatgaggccatggaa

SEQ ID NO: 481837 - DNA, 20 bp, mouse
gaagatggcagtggtgtcaa

SEQ ID NO: 481838 - DNA, 20 bp, mouse
gtgagtgctagacggaggta

SEQ ID NO: 481839 - DNA, 20 bp, mouse
ggatgagcgagatgatgttc

SEQ ID NO: 481840 - DNA, 20 bp, mouse
gctactaagcaagatggcag

SEQ ID NO: 481841 - DNA, 20 bp, mouse
gaagacgacccaatccctaa

SEQ ID NO: 481842 - DNA, 20 bp, mouse
ggcgcctgaatcttttgaag

SEQ ID NO: 481843 - DNA, 20 bp, mouse
gtgtcattctatccatccta

SEQ ID NO: 481844 - DNA, 20 bp, mouse
gactcctcttcaaaagattc

SEQ ID NO: 481845 - DNA, 20 bp, mouse
ggcctcatggagacaacaac

SEQ ID NO: 481846 - DNA, 20 bp, mouse
gcccgtagggacagacggta

SEQ ID NO: 481847 - DNA, 20 bp, mouse
gagcttcggcccgcgtccag

SEQ ID NO: 481848 - DNA, 20 bp, mouse
gccgagaagcaaaagaaatg

SEQ ID NO: 481849 - DNA, 20 bp, mouse
ggcccgaaatcgcacactcg

SEQ ID NO: 481850 - DNA, 20 bp, mouse
gcggcccccgtagggacaga

SEQ ID NO: 481851 - DNA, 20 bp, mouse
ggccctaccgtctgtcccta

SEQ ID NO: 481852 - DNA, 20 bp, mouse
gttgcttctcggcccccgta

SEQ ID NO: 481853 - DNA, 20 bp, mouse
ggcgtgcagctgatccgcaa

SEQ ID NO: 481854 - DNA, 20 bp, mouse
gcagccgcgaggcggtggac

SEQ ID NO: 481855 - DNA, 20 bp, mouse
gtagccggtccaccgcctcg

SEQ ID NO: 481856 - DNA, 20 bp, mouse
gacgcggagcagcagagacg

SEQ ID NO: 481857 - DNA, 20 bp, mouse
gcagagacggggcgatgcta

SEQ ID NO: 481858 - DNA, 20 bp, mouse
gcggggcgatgctacgggtg

SEQ ID NO: 481859 - DNA, 20 bp, mouse
gtctgggaagatgcatgtga

SEQ ID NO: 481860 - DNA, 20 bp, mouse
gggcagccgaggtgccgagg

SEQ ID NO: 481861 - DNA, 20 bp, mouse
gccgaggcggtgcactacat

SEQ ID NO: 481862 - DNA, 20 bp, mouse
ggggtgcggtgtctgcgcgg

SEQ ID NO: 481863 - DNA, 20 bp, mouse
ggaggtcccgaggcagcgta

SEQ ID NO: 481864 - DNA, 20 bp, mouse
gggacaccccggtaacaggg

SEQ ID NO: 481865 - DNA, 20 bp, mouse
gagggagggtctgcaggcat

SEQ ID NO: 481866 - DNA, 20 bp, mouse
gcggggtgcagcaagctacg

SEQ ID NO: 481867 - DNA, 20 bp, mouse
gtccgcccagggctcctcca

SEQ ID NO: 481868 - DNA, 20 bp, mouse
gtggacaagcaaacagcgcc

SEQ ID NO: 481869 - DNA, 20 bp, mouse
gcacgggcccggcgtttgag

SEQ ID NO: 481870 - DNA, 20 bp, mouse
gctccacggcggatcatccg

SEQ ID NO: 481871 - DNA, 20 bp, mouse
gcaccccgcaggtcctcccc

SEQ ID NO: 481872 - DNA, 20 bp, mouse
gccctgggccggttgcccca

SEQ ID NO: 481873 - DNA, 20 bp, mouse
ggctcgagtacgaatcaacc

SEQ ID NO: 481874 - DNA, 20 bp, mouse
gtgaggccgtaggtgaagag

SEQ ID NO: 481875 - DNA, 20 bp, mouse
gctgtgcgccccaagccgtg

SEQ ID NO: 481876 - DNA, 20 bp, mouse
gctggccgccagcgagacct

SEQ ID NO: 481877 - DNA, 20 bp, mouse
gacctaggcaggaggcgatg

SEQ ID NO: 481878 - DNA, 20 bp, mouse
gtagagccagaggcccggac

SEQ ID NO: 481879 - DNA, 20 bp, mouse
gtgaagttccatcgcagata

SEQ ID NO: 481880 - DNA, 20 bp, mouse
gcctgcctaggtctcgctgg

SEQ ID NO: 481881 - DNA, 20 bp, mouse
gtactcgcacccggtgctct

SEQ ID NO: 481882 - DNA, 20 bp, mouse
gaagcagcgggtaccgggtg

SEQ ID NO: 481883 - DNA, 20 bp, mouse
gggggctgccgtatctgcga

SEQ ID NO: 481884 - DNA, 20 bp, mouse
gcctcctgcctaggtctcgc

SEQ ID NO: 481885 - DNA, 20 bp, mouse
ggtgcgcaccgactgcgaca

SEQ ID NO: 481886 - DNA, 20 bp, mouse
gggacgcctccagggtctac

SEQ ID NO: 481887 - DNA, 20 bp, mouse
gagttccttccggcttaaag

SEQ ID NO: 481888 - DNA, 20 bp, mouse
gagacagatatcatagctct

SEQ ID NO: 481889 - DNA, 20 bp, mouse
gcagtgcccgtagaccctgg

SEQ ID NO: 481890 - DNA, 20 bp, mouse
gcgaattccataatctagat

SEQ ID NO: 481891 - DNA, 20 bp, mouse
gtccttccggcttaaagggg

SEQ ID NO: 481892 - DNA, 20 bp, mouse
ggagtgaagagagtcttctt

SEQ ID NO: 481893 - DNA, 20 bp, mouse
gctatgctgtgagcatccac

SEQ ID NO: 481894 - DNA, 20 bp, mouse
gtcccgaagcaagattgaca

SEQ ID NO: 481895 - DNA, 20 bp, mouse
gctggagaggtaagcgggca

SEQ ID NO: 481896 - DNA, 20 bp, mouse
gctgcgggtcaccttcccag

SEQ ID NO: 481897 - DNA, 20 bp, mouse
gagcggtggcacctgagcgt

SEQ ID NO: 481898 - DNA, 20 bp, mouse
gcgggtcaccttcccagcgg

SEQ ID NO: 481899 - DNA, 20 bp, mouse
gcggccggaaagggatccgg

SEQ ID NO: 481900 - DNA, 20 bp, mouse
ggaaggtgacccgcagaccc

SEQ ID NO: 481901 - DNA, 20 bp, mouse
gcgagggccgaccagctcca

SEQ ID NO: 481902 - DNA, 20 bp, mouse
gcacctgagcgtgggcgcgg

SEQ ID NO: 481903 - DNA, 20 bp, mouse
gtcaggtgccaccgctggga

SEQ ID NO: 481904 - DNA, 20 bp, mouse
ggctcctgggcgggtcccag

SEQ ID NO: 481905 - DNA, 20 bp, mouse
ggatctagagacgcgaccca

SEQ ID NO: 481906 - DNA, 20 bp, mouse
gaggctccggagcaagatgg

SEQ ID NO: 481907 - DNA, 20 bp, mouse
gttcaggctccggagcaaga

SEQ ID NO: 481908 - DNA, 20 bp, mouse
gggcaggaagccgctctggg

SEQ ID NO: 481909 - DNA, 20 bp, mouse
gggcggcgtcagcgacaccg

SEQ ID NO: 481910 - DNA, 20 bp, mouse
gtcagcgacaccgaggcggt

SEQ ID NO: 481911 - DNA, 20 bp, mouse
gcccggcaggaagccgctct

SEQ ID NO: 481912 - DNA, 20 bp, mouse
gcggtaggagcttcaggctc

SEQ ID NO: 481913 - DNA, 20 bp, mouse
gccgaggcggtaggagcttc

SEQ ID NO: 481914 - DNA, 20 bp, mouse
gcggtcgcctgggactcggg

SEQ ID NO: 481915 - DNA, 20 bp, mouse
gtgcggccagccgcccagag

SEQ ID NO: 481916 - DNA, 20 bp, mouse
ggagtagccgaggcccgaga

SEQ ID NO: 481917 - DNA, 20 bp, mouse
gaggcccgagagggtcgagt

SEQ ID NO: 481918 - DNA, 20 bp, mouse
ggctgctgcggcgaagatgg

SEQ ID NO: 481919 - DNA, 20 bp, mouse
gcggcccactcgaccctctc

SEQ ID NO: 481920 - DNA, 20 bp, mouse
gtacctgcgctggaagtccg

SEQ ID NO: 481921 - DNA, 20 bp, mouse
ggagggtcgagtgggccgag

SEQ ID NO: 481922 - DNA, 20 bp, mouse
ggagtggagtgcgagcggca

SEQ ID NO: 481923 - DNA, 20 bp, mouse
ggcagcagcccgagtagccg

SEQ ID NO: 481924 - DNA, 20 bp, mouse
gcggcgaagggcttcaggta

SEQ ID NO: 481925 - DNA, 20 bp, mouse
ggggccgagtggagtgcgag

SEQ ID NO: 481926 - DNA, 20 bp, mouse
ggtcagtgagctgacaggga

SEQ ID NO: 481927 - DNA, 20 bp, mouse
gagtgggccgggacgctcgg

SEQ ID NO: 481928 - DNA, 20 bp, mouse
gactgcaggctggagtaagt

SEQ ID NO: 481929 - DNA, 20 bp, mouse
gcagggtgagacctcactgc

SEQ ID NO: 481930 - DNA, 20 bp, mouse
gggcctagtcccagaaccgg

SEQ ID NO: 481931 - DNA, 20 bp, mouse
gagctgacagggaaggtagc

SEQ ID NO: 481932 - DNA, 20 bp, mouse
gccggcaccaccgagcgtcc

SEQ ID NO: 481933 - DNA, 20 bp, mouse
gaccacgtcagtgagctgac

SEQ ID NO: 481934 - DNA, 20 bp, mouse
ggtaagtgggccgggacgct

SEQ ID NO: 481935 - DNA, 20 bp, mouse
ggaaggcaaccctaacttca

SEQ ID NO: 481936 - DNA, 20 bp, mouse
ggcaaggacccagtcgggta

SEQ ID NO: 481937 - DNA, 20 bp, mouse
gacggtgcaaggacccagtc

SEQ ID NO: 481938 - DNA, 20 bp, mouse
gcagcggctgcggtggggta

SEQ ID NO: 481939 - DNA, 20 bp, mouse
gtgctctgccctacccgact

SEQ ID NO: 481940 - DNA, 20 bp, mouse
gtcctcctcctcagcggctg

SEQ ID NO: 481941 - DNA, 20 bp, mouse
gcctcctcagcggctgcggt

SEQ ID NO: 481942 - DNA, 20 bp, mouse
gaacgctccaggccaaggag

SEQ ID NO: 481943 - DNA, 20 bp, mouse
gtgcggtggggtacggtgca

SEQ ID NO: 481944 - DNA, 20 bp, mouse
gcctccaggactccagatct

SEQ ID NO: 481945 - DNA, 20 bp, mouse
gaggcagagccctaacctcc

SEQ ID NO: 481946 - DNA, 20 bp, mouse
gtggggaccaggtatatttt

SEQ ID NO: 481947 - DNA, 20 bp, mouse
ggcaacttagtctggatctc

SEQ ID NO: 481948 - DNA, 20 bp, mouse
gcacttggacctgtactgtg

SEQ ID NO: 481949 - DNA, 20 bp, mouse
gtacctggtccccacagtac

SEQ ID NO: 481950 - DNA, 20 bp, mouse
gtcagctgcttctctctcct

SEQ ID NO: 481951 - DNA, 20 bp, mouse
ggacctgtactgtggggacc

SEQ ID NO: 481952 - DNA, 20 bp, mouse
ggttgctcctaaaatatacc

SEQ ID NO: 481953 - DNA, 20 bp, mouse
gaattcaaagtggcacctgg

SEQ ID NO: 481954 - DNA, 20 bp, mouse
gcctcccttccccttccccc

SEQ ID NO: 481955 - DNA, 20 bp, mouse
ggttgatttccaattcaaag

SEQ ID NO: 481956 - DNA, 20 bp, mouse
ggtaggcagaggaaagtctg

SEQ ID NO: 481957 - DNA, 20 bp, mouse
gggcagaggaaagtctgtgg

SEQ ID NO: 481958 - DNA, 20 bp, mouse
gaggcaggttctgctctctc

SEQ ID NO: 481959 - DNA, 20 bp, mouse
gaaggggaaactgagggaag

SEQ ID NO: 481960 - DNA, 20 bp, mouse
gaagtcaaaggggaaactga

SEQ ID NO: 481961 - DNA, 20 bp, mouse
gcacactatgggaggagccc

SEQ ID NO: 481962 - DNA, 20 bp, mouse
gctgttagacacactatggg

SEQ ID NO: 481963 - DNA, 20 bp, mouse
gcctggtcctgcctcagctg

SEQ ID NO: 481964 - DNA, 20 bp, mouse
ggctctgttagacacactat

SEQ ID NO: 481965 - DNA, 20 bp, mouse
gaaggaaaagtaaatatacc

SEQ ID NO: 481966 - DNA, 20 bp, mouse
gaacttcccgggttactaca

SEQ ID NO: 481967 - DNA, 20 bp, mouse
ggaactcctcacaagttctc

SEQ ID NO: 481968 - DNA, 20 bp, mouse
gatagaccctgtagtaaccc

SEQ ID NO: 481969 - DNA, 20 bp, mouse
ggtagggacagggacatcta

SEQ ID NO: 481970 - DNA, 20 bp, mouse
gaagttctctggcaaaaatc

SEQ ID NO: 481971 - DNA, 20 bp, mouse
gggtttaccctaaccagagg

SEQ ID NO: 481972 - DNA, 20 bp, mouse
gactctgcagccagcctcag

SEQ ID NO: 481973 - DNA, 20 bp, mouse
ggatgtccctgtccctacta

SEQ ID NO: 481974 - DNA, 20 bp, mouse
gttcaggtaagacagaggca

SEQ ID NO: 481975 - DNA, 20 bp, mouse
ggctggtttaccctaaccag

SEQ ID NO: 481976 - DNA, 20 bp, mouse
gcaggcagtggagtccacag

SEQ ID NO: 481977 - DNA, 20 bp, mouse
gcttacctttggataaaatt

SEQ ID NO: 481978 - DNA, 20 bp, mouse
gggagggacaataaaacacc

SEQ ID NO: 481979 - DNA, 20 bp, mouse
gtacaaactggcaacagagt

SEQ ID NO: 481980 - DNA, 20 bp, mouse
ggaccgccccagaaattgga

SEQ ID NO: 481981 - DNA, 20 bp, mouse
gtctggaccgccccagaaat

SEQ ID NO: 481982 - DNA, 20 bp, mouse
ggaaggggaggggtcagtgt

SEQ ID NO: 481983 - DNA, 20 bp, mouse
gtcacctccagagtccacag

SEQ ID NO: 481984 - DNA, 20 bp, mouse
gctctcaccttccttacctt

SEQ ID NO: 481985 - DNA, 20 bp, mouse
gcctgagcaacagcctcctg

SEQ ID NO: 481986 - DNA, 20 bp, mouse
ggagcagccactgttagaag

SEQ ID NO: 481987 - DNA, 20 bp, mouse
gtctaacagtggctgctcca

SEQ ID NO: 481988 - DNA, 20 bp, mouse
gactttgccacttctaacag

SEQ ID NO: 481989 - DNA, 20 bp, mouse
gccaaggagcctggagcagt

SEQ ID NO: 481990 - DNA, 20 bp, mouse
gtggagcagtaggaagctca

SEQ ID NO: 481991 - DNA, 20 bp, mouse
ggtggcagactcaccctggt

SEQ ID NO: 481992 - DNA, 20 bp, mouse
gatggccacaagaccctgtg

SEQ ID NO: 481993 - DNA, 20 bp, mouse
gccaggacatctccattctg

SEQ ID NO: 481994 - DNA, 20 bp, mouse
gaggcactggctctgtaaca

SEQ ID NO: 481995 - DNA, 20 bp, mouse
gggctctcaccaccaaggat

SEQ ID NO: 481996 - DNA, 20 bp, mouse
gtgttgtcaaaggaacatgt

SEQ ID NO: 481997 - DNA, 20 bp, mouse
gcacaggcaactgttgtcaa

SEQ ID NO: 481998 - DNA, 20 bp, mouse
gaacatgtaggaaccttgtg

SEQ ID NO: 481999 - DNA, 20 bp, mouse
gcacactatgggaagagctc

SEQ ID NO: 482000 - DNA, 20 bp, mouse
gaaaattcagcacttgacct

SEQ ID NO: 482001 - DNA, 20 bp, mouse
ggaccttggcaaatattttt

SEQ ID NO: 482002 - DNA, 20 bp, mouse
gagtaaatattaaatatacc

SEQ ID NO: 482003 - DNA, 20 bp, mouse
ggtgctgaattttccgcaca

SEQ ID NO: 482004 - DNA, 20 bp, mouse
ggcaaagagagcaggaagtg

SEQ ID NO: 482005 - DNA, 20 bp, mouse
gaggcaggttctgtgctctc

SEQ ID NO: 482006 - DNA, 20 bp, mouse
gcattaacaggaaacaataa

SEQ ID NO: 482007 - DNA, 20 bp, mouse
gggggtgggaagagactgtt

SEQ ID NO: 482008 - DNA, 20 bp, mouse
gaccaagcacagataaataa

SEQ ID NO: 482009 - DNA, 20 bp, mouse
gtaaggtaagacctggagca

SEQ ID NO: 482010 - DNA, 20 bp, mouse
gtaagaacactgcttcaaac

SEQ ID NO: 482011 - DNA, 20 bp, mouse
gtttttcttaaggtaagacc

SEQ ID NO: 482012 - DNA, 20 bp, mouse
gacactcggactgctggaca

SEQ ID NO: 482013 - DNA, 20 bp, mouse
gaaactgaagagcgggagca

SEQ ID NO: 482014 - DNA, 20 bp, mouse
gcgctcttcagtttttctta

SEQ ID NO: 482015 - DNA, 20 bp, mouse
gacaagcggagataaacagt

SEQ ID NO: 482016 - DNA, 20 bp, mouse
gaggcagaggaaagtctctg

SEQ ID NO: 482017 - DNA, 20 bp, mouse
gtggtcagcttacataaaag

SEQ ID NO: 482018 - DNA, 20 bp, mouse
gctggttcacaggcaactgt

SEQ ID NO: 482019 - DNA, 20 bp, mouse
ggctctgttagacaaactat

SEQ ID NO: 482020 - DNA, 20 bp, mouse
gcaggagggaggagagcaga

SEQ ID NO: 482021 - DNA, 20 bp, mouse
gaggcagattatgagctctc

SEQ ID NO: 482022 - DNA, 20 bp, mouse
gcagaggaaagtctctgtgg

SEQ ID NO: 482023 - DNA, 20 bp, mouse
gagtggcagcctgacactgc

SEQ ID NO: 482024 - DNA, 20 bp, mouse
gcacaggcaactgtaggcag

SEQ ID NO: 482025 - DNA, 20 bp, mouse
gaaggggcaactgagggagg

SEQ ID NO: 482026 - DNA, 20 bp, mouse
gggcgcagcagcaagcctaa

SEQ ID NO: 482027 - DNA, 20 bp, mouse
ggcctaaaggtgctgaatcc

SEQ ID NO: 482028 - DNA, 20 bp, mouse
ggagctttcaggaggaatcg

SEQ ID NO: 482029 - DNA, 20 bp, mouse
gctttcaggaggaatcgggg

SEQ ID NO: 482030 - DNA, 20 bp, mouse
gacctggattcagcaccttt

SEQ ID NO: 482031 - DNA, 20 bp, mouse
gggaactcaccagcctgcac

SEQ ID NO: 482032 - DNA, 20 bp, mouse
gtgtggtggctgctcgagag

SEQ ID NO: 482033 - DNA, 20 bp, mouse
gggacgaccgcgatcagaga

SEQ ID NO: 482034 - DNA, 20 bp, mouse
gggacagcgttgctcagtgt

SEQ ID NO: 482035 - DNA, 20 bp, mouse
gtggtgcaagatgacaccgg

SEQ ID NO: 482036 - DNA, 20 bp, mouse
gacacatctgctataaaagt

SEQ ID NO: 482037 - DNA, 20 bp, mouse
gtctatagatactaatgatg

SEQ ID NO: 482038 - DNA, 20 bp, mouse
gaacaaaatcaccagtaaaa

SEQ ID NO: 482039 - DNA, 20 bp, mouse
gagattaagtacctttttac

SEQ ID NO: 482040 - DNA, 20 bp, mouse
gtaaaaacgagtatttatat

SEQ ID NO: 482041 - DNA, 20 bp, mouse
ggtgtatctcattgtttcta

SEQ ID NO: 482042 - DNA, 20 bp, mouse
gaatatatgcattttagagt

SEQ ID NO: 482043 - DNA, 20 bp, mouse
ggaattaaggtcactgggaa

SEQ ID NO: 482044 - DNA, 20 bp, mouse
gagagggaattaaggtcact

SEQ ID NO: 482045 - DNA, 20 bp, mouse
gtttttaattatatatacaa

SEQ ID NO: 482046 - DNA, 20 bp, mouse
gacaggcagctgtagtcaga

SEQ ID NO: 482047 - DNA, 20 bp, mouse
gggctggctttaggtctaag

SEQ ID NO: 482048 - DNA, 20 bp, mouse
ggctctgttggagaagctgt

SEQ ID NO: 482049 - DNA, 20 bp, mouse
gctgaaagtaaagtaagcca

SEQ ID NO: 482050 - DNA, 20 bp, mouse
gaggcagattatgagctctc

SEQ ID NO: 482051 - DNA, 20 bp, mouse
gtggtcagcgcacataaaag

SEQ ID NO: 482052 - DNA, 20 bp, mouse
gaaggggcaactgagggagg

SEQ ID NO: 482053 - DNA, 20 bp, mouse
gtcaaaggggcaactgaggg

SEQ ID NO: 482054 - DNA, 20 bp, mouse
gagggcaggagctgtagctg

SEQ ID NO: 482055 - DNA, 20 bp, mouse
gaaggaaaagtaaatatacc

SEQ ID NO: 482056 - DNA, 20 bp, mouse
gcgcgcccggggccactcgt

SEQ ID NO: 482057 - DNA, 20 bp, mouse
gatccctaggagccccgatg

SEQ ID NO: 482058 - DNA, 20 bp, mouse
ggcaccgagtggcgatccct

SEQ ID NO: 482059 - DNA, 20 bp, mouse
ggaaagcggtcgcccacgag

SEQ ID NO: 482060 - DNA, 20 bp, mouse
gggacgccaggagcgactcg

SEQ ID NO: 482061 - DNA, 20 bp, mouse
gcgactcggggcgcaccgag

SEQ ID NO: 482062 - DNA, 20 bp, mouse
ggggctcggcgcggctcgaa

SEQ ID NO: 482063 - DNA, 20 bp, mouse
ggctgccccgcgccgcatcg

SEQ ID NO: 482064 - DNA, 20 bp, mouse
gggagccccgatgcggcgcg

SEQ ID NO: 482065 - DNA, 20 bp, mouse
ggtcgcccacgagtggcccc

SEQ ID NO: 482066 - DNA, 20 bp, mouse
gagccgcccgtgggagacga

SEQ ID NO: 482067 - DNA, 20 bp, mouse
ggcagtccgtcgtctcccac

SEQ ID NO: 482068 - DNA, 20 bp, mouse
ggtccgtcgtctcccacggg

SEQ ID NO: 482069 - DNA, 20 bp, mouse
gaagccggcgcacttgtctc

SEQ ID NO: 482070 - DNA, 20 bp, mouse
gacgcgttcgggagaagcca

SEQ ID NO: 482071 - DNA, 20 bp, mouse
ggagacgacggactgcagga

SEQ ID NO: 482072 - DNA, 20 bp, mouse
gcgtgcgcccgggatggaga

SEQ ID NO: 482073 - DNA, 20 bp, mouse
gcggcgcacttgtctctggc

SEQ ID NO: 482074 - DNA, 20 bp, mouse
ggctggggagcgcgcgaagc

SEQ ID NO: 482075 - DNA, 20 bp, mouse
gtgaggccgtgcgcccggga

SEQ ID NO: 482076 - DNA, 20 bp, mouse
ggaggtgctgcaagactctc

SEQ ID NO: 482077 - DNA, 20 bp, mouse
gctctggtcgcagaatgaag

SEQ ID NO: 482078 - DNA, 20 bp, mouse
ggtggtggccggcaggtgag

SEQ ID NO: 482079 - DNA, 20 bp, mouse
gcacgctctagagagaggta

SEQ ID NO: 482080 - DNA, 20 bp, mouse
gctctctagagcgtgcccaa

SEQ ID NO: 482081 - DNA, 20 bp, mouse
gagagcgtgcccaaaggcta

SEQ ID NO: 482082 - DNA, 20 bp, mouse
gctgccggccaccacgcaaa

SEQ ID NO: 482083 - DNA, 20 bp, mouse
ggtgagagtgggaggatctt

SEQ ID NO: 482084 - DNA, 20 bp, mouse
gcggccaccacgcaaaaggc

SEQ ID NO: 482085 - DNA, 20 bp, mouse
gctatgcagccagttcacca

SEQ ID NO: 482086 - DNA, 20 bp, mouse
gcaagtgcgtgcgacaggtg

SEQ ID NO: 482087 - DNA, 20 bp, mouse
ggcgtcagcgcggcttagag

SEQ ID NO: 482088 - DNA, 20 bp, mouse
gcagagccggctcaccggag

SEQ ID NO: 482089 - DNA, 20 bp, mouse
gcggcgtcgcctggtaccag

SEQ ID NO: 482090 - DNA, 20 bp, mouse
ggcgacgccgggacaccgta

SEQ ID NO: 482091 - DNA, 20 bp, mouse
gtcccgggtaggccatgacc

SEQ ID NO: 482092 - DNA, 20 bp, mouse
ggcctacccgggatacggag

SEQ ID NO: 482093 - DNA, 20 bp, mouse
gcgtaaggtgctagaagcta

SEQ ID NO: 482094 - DNA, 20 bp, mouse
gtgcgtgcgacaggtgcgga

SEQ ID NO: 482095 - DNA, 20 bp, mouse
gtcaccggagcggaggtgcg

SEQ ID NO: 482096 - DNA, 20 bp, mouse
gtagcctgtgggcgcgatgt

SEQ ID NO: 482097 - DNA, 20 bp, mouse
ggtacgaggactctcaggag

SEQ ID NO: 482098 - DNA, 20 bp, mouse
gaccaggtacgaggactctc

SEQ ID NO: 482099 - DNA, 20 bp, mouse
ggaatgtgcgcggcggccag

SEQ ID NO: 482100 - DNA, 20 bp, mouse
gtgaatggaggccctagggt

SEQ ID NO: 482101 - DNA, 20 bp, mouse
ggcgtggacggcatctcggg

SEQ ID NO: 482102 - DNA, 20 bp, mouse
gtccgcgtggacggcatctc

SEQ ID NO: 482103 - DNA, 20 bp, mouse
gtcacatgcaagccttggaa

SEQ ID NO: 482104 - DNA, 20 bp, mouse
gcagcgctgaatgtgcgcgg

SEQ ID NO: 482105 - DNA, 20 bp, mouse
gtggcccacatcgcgcccac

SEQ ID NO: 482106 - DNA, 20 bp, mouse
gtaaaccctgggcttatcgt

SEQ ID NO: 482107 - DNA, 20 bp, mouse
gtccgcccacgataagccca

SEQ ID NO: 482108 - DNA, 20 bp, mouse
gccgggtctcctggaagtga

SEQ ID NO: 482109 - DNA, 20 bp, mouse
gagttgttgggaaatcgtga

SEQ ID NO: 482110 - DNA, 20 bp, mouse
gcaggagccaggccgaaggt

SEQ ID NO: 482111 - DNA, 20 bp, mouse
gcttccaggagacccggaag

SEQ ID NO: 482112 - DNA, 20 bp, mouse
gccggcttagtgtaaaccct

SEQ ID NO: 482113 - DNA, 20 bp, mouse
gaccctgggcttatcgtggg

SEQ ID NO: 482114 - DNA, 20 bp, mouse
ggggaaatcgtgatggaacc

SEQ ID NO: 482115 - DNA, 20 bp, mouse
ggcttatcgtgggcggaggg

SEQ ID NO: 482116 - DNA, 20 bp, mouse
ggcagccgagactcctgaag

SEQ ID NO: 482117 - DNA, 20 bp, mouse
gccgcgctcggcagcctcgg

SEQ ID NO: 482118 - DNA, 20 bp, mouse
ggagactcctgaagaggcgg

SEQ ID NO: 482119 - DNA, 20 bp, mouse
gccgcgatggaggtaacggt

SEQ ID NO: 482120 - DNA, 20 bp, mouse
gtgcgctacagggaaccagg

SEQ ID NO: 482121 - DNA, 20 bp, mouse
ggcacagcgggccagcgggg

SEQ ID NO: 482122 - DNA, 20 bp, mouse
gtccgggaccccgaaatcca

SEQ ID NO: 482123 - DNA, 20 bp, mouse
gcgggtcgcagccgcgatgg

SEQ ID NO: 482124 - DNA, 20 bp, mouse
ggaccccgaaatccaaggtg

SEQ ID NO: 482125 - DNA, 20 bp, mouse
gtagccttggagacgcgggg

SEQ ID NO: 482126 - DNA, 20 bp, mouse
gcgcaagcaccaggtatgaa

SEQ ID NO: 482127 - DNA, 20 bp, mouse
gggtatgaagggtatggggt

SEQ ID NO: 482128 - DNA, 20 bp, mouse
gaccaggtatgaagggtatg

SEQ ID NO: 482129 - DNA, 20 bp, mouse
gtgcaaggctctggatgggt

SEQ ID NO: 482130 - DNA, 20 bp, mouse
gagcacactaggcctaatag

SEQ ID NO: 482131 - DNA, 20 bp, mouse
gcaggaaccataacctggaa

SEQ ID NO: 482132 - DNA, 20 bp, mouse
ggctcggcggccgcccacac

SEQ ID NO: 482133 - DNA, 20 bp, mouse
gcattgcaggaaccataacc

SEQ ID NO: 482134 - DNA, 20 bp, mouse
ggctccgggaccagcacact

SEQ ID NO: 482135 - DNA, 20 bp, mouse
ggttctgggaggaaccaagg

SEQ ID NO: 482136 - DNA, 20 bp, mouse
ggccgcctgaaagtcctctg

SEQ ID NO: 482137 - DNA, 20 bp, mouse
ggagacgcgccaatcctact

SEQ ID NO: 482138 - DNA, 20 bp, mouse
ggccccagaggactttcagg

SEQ ID NO: 482139 - DNA, 20 bp, mouse
ggctatcgctggactcgacc

SEQ ID NO: 482140 - DNA, 20 bp, mouse
ggccatgttccaagtaggat

SEQ ID NO: 482141 - DNA, 20 bp, mouse
gtgagagccatgttccaagt

SEQ ID NO: 482142 - DNA, 20 bp, mouse
gggattggcgcgtctcctta

SEQ ID NO: 482143 - DNA, 20 bp, mouse
gcccgcggggagcagctccc

SEQ ID NO: 482144 - DNA, 20 bp, mouse
gcaggccccagaggactttc

SEQ ID NO: 482145 - DNA, 20 bp, mouse
gggcggccgaacagagggag

SEQ ID NO: 482146 - DNA, 20 bp, mouse
gagacagagggagtcccctt

SEQ ID NO: 482147 - DNA, 20 bp, mouse
ggtgagcctgagctgcgaac

SEQ ID NO: 482148 - DNA, 20 bp, mouse
gctcaggctcacaaggtaag

SEQ ID NO: 482149 - DNA, 20 bp, mouse
gcacactcaaagttcccaag

SEQ ID NO: 482150 - DNA, 20 bp, mouse
gaagggcagagcttgggccc

SEQ ID NO: 482151 - DNA, 20 bp, mouse
ggctctgcccttctgcacca

SEQ ID NO: 482152 - DNA, 20 bp, mouse
gttattgataggacgatgaa

SEQ ID NO: 482153 - DNA, 20 bp, mouse
gtaagaggcacactgtgcgg

SEQ ID NO: 482154 - DNA, 20 bp, mouse
gctgtgcggcggggactgtc

SEQ ID NO: 482155 - DNA, 20 bp, mouse
gggaactttgagtgtgtcct

SEQ ID NO: 482156 - DNA, 20 bp, mouse
gggccgaggcgagcagtcgc

SEQ ID NO: 482157 - DNA, 20 bp, mouse
gacctgggcgcacagaagag

SEQ ID NO: 482158 - DNA, 20 bp, mouse
ggccgaccccgatcacagcg

SEQ ID NO: 482159 - DNA, 20 bp, mouse
gaggagcgcagccctagccc

SEQ ID NO: 482160 - DNA, 20 bp, mouse
gctcgagcgtactcggatct

SEQ ID NO: 482161 - DNA, 20 bp, mouse
ggctagggctgcgctcctcg

SEQ ID NO: 482162 - DNA, 20 bp, mouse
gagtacgctcgaggaccgcg

SEQ ID NO: 482163 - DNA, 20 bp, mouse
gcgccggcgactgctcgcct

SEQ ID NO: 482164 - DNA, 20 bp, mouse
ggccgcgctgtgatcggggt

SEQ ID NO: 482165 - DNA, 20 bp, mouse
gtgctcagtcgccggggcta

SEQ ID NO: 482166 - DNA, 20 bp, mouse
gagactccgagagtgtccct

SEQ ID NO: 482167 - DNA, 20 bp, mouse
gcagcacctagggacactct

SEQ ID NO: 482168 - DNA, 20 bp, mouse
gccgctcccgagacacccta

SEQ ID NO: 482169 - DNA, 20 bp, mouse
ggtggccgtcacccggactg

SEQ ID NO: 482170 - DNA, 20 bp, mouse
gagggtgctaacaagcgctg

SEQ ID NO: 482171 - DNA, 20 bp, mouse
ggggtgacggccacaggtta

SEQ ID NO: 482172 - DNA, 20 bp, mouse
gtcccgctcggagaacccat

SEQ ID NO: 482173 - DNA, 20 bp, mouse
gtgagccccagtccgggtga

SEQ ID NO: 482174 - DNA, 20 bp, mouse
ggctgggcgaggacccccag

SEQ ID NO: 482175 - DNA, 20 bp, mouse
gcgacgcctggaaggcaggg

SEQ ID NO: 482176 - DNA, 20 bp, mouse
gctgatgagcagatagggca

SEQ ID NO: 482177 - DNA, 20 bp, mouse
gcggacagagcagggagtaa

SEQ ID NO: 482178 - DNA, 20 bp, mouse
gtatggtgagtacctggagt

SEQ ID NO: 482179 - DNA, 20 bp, mouse
gcagggtcaggcgactggat

SEQ ID NO: 482180 - DNA, 20 bp, mouse
gatcagcactcagatccgta

SEQ ID NO: 482181 - DNA, 20 bp, mouse
ggcagggagtaacgggactg

SEQ ID NO: 482182 - DNA, 20 bp, mouse
ggcagatagggcatggtgcg

SEQ ID NO: 482183 - DNA, 20 bp, mouse
gagtaacgggactgtggtcg

SEQ ID NO: 482184 - DNA, 20 bp, mouse
ggcggacaccaggcagggtc

SEQ ID NO: 482185 - DNA, 20 bp, mouse
gtgtcgctgtcacccactcc

SEQ ID NO: 482186 - DNA, 20 bp, mouse
gctctgggctcagtcacagt

SEQ ID NO: 482187 - DNA, 20 bp, mouse
ggaagaaagctgaggcgtga

SEQ ID NO: 482188 - DNA, 20 bp, mouse
gggaactggtggcctctaga

SEQ ID NO: 482189 - DNA, 20 bp, mouse
ggctgctgcggaacactgag

SEQ ID NO: 482190 - DNA, 20 bp, mouse
gcatctactccacacctggt

SEQ ID NO: 482191 - DNA, 20 bp, mouse
gaaaaggtctctccctccag

SEQ ID NO: 482192 - DNA, 20 bp, mouse
gtcaaccagcctgaggtgga

SEQ ID NO: 482193 - DNA, 20 bp, mouse
ggagtagatgtctcctgtca

SEQ ID NO: 482194 - DNA, 20 bp, mouse
gaggcccagcggtcttcagg

SEQ ID NO: 482195 - DNA, 20 bp, mouse
ggagctctgccgtccacctc

SEQ ID NO: 482196 - DNA, 20 bp, mouse
gagtgcagaggcaggcgggt

SEQ ID NO: 482197 - DNA, 20 bp, mouse
ggaccatgccaagcaccaag

SEQ ID NO: 482198 - DNA, 20 bp, mouse
gacagattgcgtgagtgcag

SEQ ID NO: 482199 - DNA, 20 bp, mouse
gattgcgtgagtgcagaggc

SEQ ID NO: 482200 - DNA, 20 bp, mouse
gatcgagacccctgagcctg

SEQ ID NO: 482201 - DNA, 20 bp, mouse
ggttctgagcctattaggaa

SEQ ID NO: 482202 - DNA, 20 bp, mouse
gatcacatgctgataccgct

SEQ ID NO: 482203 - DNA, 20 bp, mouse
gtaccgcttggtgcttggca

SEQ ID NO: 482204 - DNA, 20 bp, mouse
ggctgataccgcttggtgct

SEQ ID NO: 482205 - DNA, 20 bp, mouse
gttaggaaaggaagatcata

SEQ ID NO: 482206 - DNA, 20 bp, mouse
gggaagcccgtgcacgacac

SEQ ID NO: 482207 - DNA, 20 bp, mouse
gagcccgtgcacgacaccgg

SEQ ID NO: 482208 - DNA, 20 bp, mouse
gtacttgcgacccaaagctg

SEQ ID NO: 482209 - DNA, 20 bp, mouse
ggagcggcaggcgcggaact

SEQ ID NO: 482210 - DNA, 20 bp, mouse
gtggagcgcggcgcacggag

SEQ ID NO: 482211 - DNA, 20 bp, mouse
ggccgcggcagcgctccact

SEQ ID NO: 482212 - DNA, 20 bp, mouse
gagccggagcgggaacggac

SEQ ID NO: 482213 - DNA, 20 bp, mouse
gcccgagggcgcccccagag

SEQ ID NO: 482214 - DNA, 20 bp, mouse
ggtccgagccggagcgggaa

SEQ ID NO: 482215 - DNA, 20 bp, mouse
gcgccgccggtgtcgtgcac

SEQ ID NO: 482216 - DNA, 20 bp, mouse
ggcggtgccccaggccccag

SEQ ID NO: 482217 - DNA, 20 bp, mouse
ggccgccgccgctgaaacga

SEQ ID NO: 482218 - DNA, 20 bp, mouse
gccggcgcggacggtcgctg

SEQ ID NO: 482219 - DNA, 20 bp, mouse
gagaggcggtcccggaggga

SEQ ID NO: 482220 - DNA, 20 bp, mouse
gacggagaggcggtcccgga

SEQ ID NO: 482221 - DNA, 20 bp, mouse
ggctctgtccagccagacag

SEQ ID NO: 482222 - DNA, 20 bp, mouse
ggctacccggtcccctccgg

SEQ ID NO: 482223 - DNA, 20 bp, mouse
gaacagctccctcgtttcag

SEQ ID NO: 482224 - DNA, 20 bp, mouse
gccgggaacctgctcaactg

SEQ ID NO: 482225 - DNA, 20 bp, mouse
gcgctctcctctggggcctg

SEQ ID NO: 482226 - DNA, 20 bp, mouse
gacagactcgggagcactga

SEQ ID NO: 482227 - DNA, 20 bp, mouse
gggagcactgaaggcggaca

SEQ ID NO: 482228 - DNA, 20 bp, mouse
gtcttgtcagcttcttgtcc

SEQ ID NO: 482229 - DNA, 20 bp, mouse
gttccccaggattaaaataa

SEQ ID NO: 482230 - DNA, 20 bp, mouse
gagttctgttcatttctaag

SEQ ID NO: 482231 - DNA, 20 bp, mouse
gagggtgagttgtgtagcca

SEQ ID NO: 482232 - DNA, 20 bp, mouse
gatggaagctgaacacgcct

SEQ ID NO: 482233 - DNA, 20 bp, mouse
gtcatggtctgtaaaaatga

SEQ ID NO: 482234 - DNA, 20 bp, mouse
gcaaataaagcctgtggcca

SEQ ID NO: 482235 - DNA, 20 bp, mouse
ggtaaactcaatctttcccc

SEQ ID NO: 482236 - DNA, 20 bp, mouse
ggcagacagcacgcaggacg

SEQ ID NO: 482237 - DNA, 20 bp, mouse
gcctgactagagagaactag

SEQ ID NO: 482238 - DNA, 20 bp, mouse
gaggatgctgtgctctccta

SEQ ID NO: 482239 - DNA, 20 bp, mouse
gcacgtgagtttcatcccgt

SEQ ID NO: 482240 - DNA, 20 bp, mouse
gcccacagatgcctcaggta

SEQ ID NO: 482241 - DNA, 20 bp, mouse
gacacatcttcggatatgta

SEQ ID NO: 482242 - DNA, 20 bp, mouse
gtccttacctgaggcatctg

SEQ ID NO: 482243 - DNA, 20 bp, mouse
ggcagtgtcttccttacctg

SEQ ID NO: 482244 - DNA, 20 bp, mouse
gtgaaagagagataaagctg

SEQ ID NO: 482245 - DNA, 20 bp, mouse
gagagtctggctgactactt

SEQ ID NO: 482246 - DNA, 20 bp, mouse
gctgggcgccggcaggatgg

SEQ ID NO: 482247 - DNA, 20 bp, mouse
ggacacgcaggtgaggcggg

SEQ ID NO: 482248 - DNA, 20 bp, mouse
gggcggacacgcaggtgagg

SEQ ID NO: 482249 - DNA, 20 bp, mouse
gggcggcggacacgcaggtg

SEQ ID NO: 482250 - DNA, 20 bp, mouse
gaggatggcggcggacacgc

SEQ ID NO: 482251 - DNA, 20 bp, mouse
ggctgcggcggccaacgcgg

SEQ ID NO: 482252 - DNA, 20 bp, mouse
gcccggaagcgctccggaag

SEQ ID NO: 482253 - DNA, 20 bp, mouse
gatcctgccggcgcccagtc

SEQ ID NO: 482254 - DNA, 20 bp, mouse
gcggagggcgcagacggaag

SEQ ID NO: 482255 - DNA, 20 bp, mouse
ggtgtgggcacagagtcggg

SEQ ID NO: 482256 - DNA, 20 bp, mouse
gtggcccagcctaggttacc

SEQ ID NO: 482257 - DNA, 20 bp, mouse
ggagcgcgccagtatccgct

SEQ ID NO: 482258 - DNA, 20 bp, mouse
gtgggacgcggatacacacg

SEQ ID NO: 482259 - DNA, 20 bp, mouse
ggctccaggtaacctaggct

SEQ ID NO: 482260 - DNA, 20 bp, mouse
gggactggtgcaatgagtga

SEQ ID NO: 482261 - DNA, 20 bp, mouse
ggtcccaccgaaggaccgga

SEQ ID NO: 482262 - DNA, 20 bp, mouse
gccgcgtcccaccgaaggac

SEQ ID NO: 482263 - DNA, 20 bp, mouse
gcggctcgccaagcggatac

SEQ ID NO: 482264 - DNA, 20 bp, mouse
gctccttccggtccttcggt

SEQ ID NO: 482265 - DNA, 20 bp, mouse
gctcggtcggcgctctaaca

SEQ ID NO: 482266 - DNA, 20 bp, mouse
gagactcaggaggatgtgga

SEQ ID NO: 482267 - DNA, 20 bp, mouse
gagtcccaaagggaaactgg

SEQ ID NO: 482268 - DNA, 20 bp, mouse
ggccctccagtcctctataa

SEQ ID NO: 482269 - DNA, 20 bp, mouse
gacagacttaccatgctaaa

SEQ ID NO: 482270 - DNA, 20 bp, mouse
gtgtaggagtggagagaatg

SEQ ID NO: 482271 - DNA, 20 bp, mouse
gcccttcatggctgtaggag

SEQ ID NO: 482272 - DNA, 20 bp, mouse
gaccccgctgcactgcgtat

SEQ ID NO: 482273 - DNA, 20 bp, mouse
gactgctggtctctgagcta

SEQ ID NO: 482274 - DNA, 20 bp, mouse
gtggtatcactagtcccaaa

SEQ ID NO: 482275 - DNA, 20 bp, mouse
ggttggttcgatcatccctt

SEQ ID NO: 482276 - DNA, 20 bp, mouse
gcttccactgggagaagacg

SEQ ID NO: 482277 - DNA, 20 bp, mouse
gccagctgaaagcttcaatt

SEQ ID NO: 482278 - DNA, 20 bp, mouse
gcgaggacaggtagggtcat

SEQ ID NO: 482279 - DNA, 20 bp, mouse
gaaaatgccccaccccaggg

SEQ ID NO: 482280 - DNA, 20 bp, mouse
gggaacatgtgaatactgcc

SEQ ID NO: 482281 - DNA, 20 bp, mouse
gcaaggcagcaatgagagat

SEQ ID NO: 482282 - DNA, 20 bp, mouse
gaagcctcgtcttctcccag

SEQ ID NO: 482283 - DNA, 20 bp, mouse
gcagttaacagccttccact

SEQ ID NO: 482284 - DNA, 20 bp, mouse
gagagcgatgcctggccgaa

SEQ ID NO: 482285 - DNA, 20 bp, mouse
gttggttataagttacttgg

SEQ ID NO: 482286 - DNA, 20 bp, mouse
gcattgcctggaggagccaa

SEQ ID NO: 482287 - DNA, 20 bp, mouse
ggagtttggacttactgcca

SEQ ID NO: 482288 - DNA, 20 bp, mouse
ggaaaatatccagatacatc

SEQ ID NO: 482289 - DNA, 20 bp, mouse
gtgcggatgtgaaagctcca

SEQ ID NO: 482290 - DNA, 20 bp, mouse
gtcggcaccaacgtatgcaa

SEQ ID NO: 482291 - DNA, 20 bp, mouse
ggttatgttgcattgcctgg

SEQ ID NO: 482292 - DNA, 20 bp, mouse
ggtgctcatcctctttataa

SEQ ID NO: 482293 - DNA, 20 bp, mouse
gtcaggagacagaggctgtc

SEQ ID NO: 482294 - DNA, 20 bp, mouse
gataaagaggatgagcacct

SEQ ID NO: 482295 - DNA, 20 bp, mouse
gtatatatatgctatcattt

SEQ ID NO: 482296 - DNA, 20 bp, mouse
ggagccgcgccaggaaactt

SEQ ID NO: 482297 - DNA, 20 bp, mouse
ggggtccccgcaccgcactg

SEQ ID NO: 482298 - DNA, 20 bp, mouse
ggaaacttcggtccccagtg

SEQ ID NO: 482299 - DNA, 20 bp, mouse
gtggccaagccgacctaccg

SEQ ID NO: 482300 - DNA, 20 bp, mouse
ggagaagcgggtagcccggc

SEQ ID NO: 482301 - DNA, 20 bp, mouse
gcctcccgcaagacacaact

SEQ ID NO: 482302 - DNA, 20 bp, mouse
ggcaagacacaactaggcgt

SEQ ID NO: 482303 - DNA, 20 bp, mouse
gctggcgcggctctccggcc

SEQ ID NO: 482304 - DNA, 20 bp, mouse
ggagctcacgggtcccccgg

SEQ ID NO: 482305 - DNA, 20 bp, mouse
gcgtgtggcccggagcaccg

SEQ ID NO: 482306 - DNA, 20 bp, mouse
gcattcgtccgtcagaggag

SEQ ID NO: 482307 - DNA, 20 bp, mouse
gggaagcattcgtccgtcag

SEQ ID NO: 482308 - DNA, 20 bp, mouse
gagtggccttaagtaagtcg

SEQ ID NO: 482309 - DNA, 20 bp, mouse
gtaccataatcgctaaaact

SEQ ID NO: 482310 - DNA, 20 bp, mouse
gcagctgtgcttgctccagg

SEQ ID NO: 482311 - DNA, 20 bp, mouse
gtgactgtaaacacagcaac

SEQ ID NO: 482312 - DNA, 20 bp, mouse
gcttcttagagttgcctggc

SEQ ID NO: 482313 - DNA, 20 bp, mouse
gcctgcttctgaagatgatc

SEQ ID NO: 482314 - DNA, 20 bp, mouse
gctcaaccccgacttactta

SEQ ID NO: 482315 - DNA, 20 bp, mouse
gctgtcacatgctgtggaaa

SEQ ID NO: 482316 - DNA, 20 bp, mouse
gcgcagcggctgtggagcaa

SEQ ID NO: 482317 - DNA, 20 bp, mouse
ggggtgcccgcgctgctccg

SEQ ID NO: 482318 - DNA, 20 bp, mouse
ggtctgagcctcccccgcgt

SEQ ID NO: 482319 - DNA, 20 bp, mouse
ggcggctgtggagcaagggc

SEQ ID NO: 482320 - DNA, 20 bp, mouse
ggctcagacactagaagcta

SEQ ID NO: 482321 - DNA, 20 bp, mouse
gccggggcaggataagcgtg

SEQ ID NO: 482322 - DNA, 20 bp, mouse
gtccagagggagggtcactg

SEQ ID NO: 482323 - DNA, 20 bp, mouse
gccgcctcgggagcatccag

SEQ ID NO: 482324 - DNA, 20 bp, mouse
gctcccgaggcgggaagaga

SEQ ID NO: 482325 - DNA, 20 bp, mouse
ggccccatctgtagggatgt

SEQ ID NO: 482326 - DNA, 20 bp, mouse
gagagcacagtgccagacca

SEQ ID NO: 482327 - DNA, 20 bp, mouse
gaggaagtggagactaccag

SEQ ID NO: 482328 - DNA, 20 bp, mouse
ggccggcttgcaccttggtc

SEQ ID NO: 482329 - DNA, 20 bp, mouse
gtctcagccggcttgcacct

SEQ ID NO: 482330 - DNA, 20 bp, mouse
ggccagaccaaggtgcaagc

SEQ ID NO: 482331 - DNA, 20 bp, mouse
ggtggagactaccagaggga

SEQ ID NO: 482332 - DNA, 20 bp, mouse
gtggcactgtgctctgtaac

SEQ ID NO: 482333 - DNA, 20 bp, mouse
gaaagactccccgaaagggt

SEQ ID NO: 482334 - DNA, 20 bp, mouse
gctctgaagctactgtcagt

SEQ ID NO: 482335 - DNA, 20 bp, mouse
gtctccacttccttctcagc

SEQ ID NO: 482336 - DNA, 20 bp, mouse
gcgcggcgagcagaaggtca

SEQ ID NO: 482337 - DNA, 20 bp, mouse
gctccgccaccgggccggtg

SEQ ID NO: 482338 - DNA, 20 bp, mouse
ggcggagcacccaggcccgg

SEQ ID NO: 482339 - DNA, 20 bp, mouse
gcaccgggccggtggggacg

SEQ ID NO: 482340 - DNA, 20 bp, mouse
ggccaggaggcttgggagta

SEQ ID NO: 482341 - DNA, 20 bp, mouse
gggggtgggtccagagtaag

SEQ ID NO: 482342 - DNA, 20 bp, mouse
gcgtgggtagggctataggt

SEQ ID NO: 482343 - DNA, 20 bp, mouse
gggcgagcagaaggtcaggg

SEQ ID NO: 482344 - DNA, 20 bp, mouse
gtcccaagagcgagaagcgt

SEQ ID NO: 482345 - DNA, 20 bp, mouse
gtaagtaggcgggagagtac

SEQ ID NO: 482346 - DNA, 20 bp, mouse
gccaaggagggcgcaccggg

SEQ ID NO: 482347 - DNA, 20 bp, mouse
ggggcgcagagcggttcctg

SEQ ID NO: 482348 - DNA, 20 bp, mouse
gcagggcagcgcgagttcac

SEQ ID NO: 482349 - DNA, 20 bp, mouse
ggcaccgggcgggcgcagag

SEQ ID NO: 482350 - DNA, 20 bp, mouse
gctggccaaggagggcgcac

SEQ ID NO: 482351 - DNA, 20 bp, mouse
gcgcacacatggctgcagca

SEQ ID NO: 482352 - DNA, 20 bp, mouse
gcgatcgcctggggaagcgg

SEQ ID NO: 482353 - DNA, 20 bp, mouse
gggcgtccgagccgcacaca

SEQ ID NO: 482354 - DNA, 20 bp, mouse
ggcgagttcactggccaagg

SEQ ID NO: 482355 - DNA, 20 bp, mouse
gggttcctgcggctgcggag

SEQ ID NO: 482356 - DNA, 20 bp, mouse
ggcaagtgtctgcagagagc

SEQ ID NO: 482357 - DNA, 20 bp, mouse
gagggggccttgagaaacca

SEQ ID NO: 482358 - DNA, 20 bp, mouse
gttcatgcgaaatggctcgg

SEQ ID NO: 482359 - DNA, 20 bp, mouse
gggtaacggcctgtagtcaa

SEQ ID NO: 482360 - DNA, 20 bp, mouse
gctcaggcagctttatgggt

SEQ ID NO: 482361 - DNA, 20 bp, mouse
gatggctcggaggcaggacg

SEQ ID NO: 482362 - DNA, 20 bp, mouse
gttgctgcagcaagcatcct

SEQ ID NO: 482363 - DNA, 20 bp, mouse
gaggactcaggcagctttat

SEQ ID NO: 482364 - DNA, 20 bp, mouse
ggaagccagttcgaccgtag

SEQ ID NO: 482365 - DNA, 20 bp, mouse
gaggcccacaaggcacgccc

SEQ ID NO: 482366 - DNA, 20 bp, mouse
gacagcccgcgatccgagga

SEQ ID NO: 482367 - DNA, 20 bp, mouse
ggcccgcgatccgaggaagg

SEQ ID NO: 482368 - DNA, 20 bp, mouse
gcatgacagcccgcgatccg

SEQ ID NO: 482369 - DNA, 20 bp, mouse
gggtccagtggtacagaacc

SEQ ID NO: 482370 - DNA, 20 bp, mouse
gtgcagctggtggcccatct

SEQ ID NO: 482371 - DNA, 20 bp, mouse
gaaggaggaaggaggcggct

SEQ ID NO: 482372 - DNA, 20 bp, mouse
ggccaccagctgcagttggt

SEQ ID NO: 482373 - DNA, 20 bp, mouse
gcgctctccagtgccgagat

SEQ ID NO: 482374 - DNA, 20 bp, mouse
ggagaggcaggtagcaccgg

SEQ ID NO: 482375 - DNA, 20 bp, mouse
gctctccttgggccaatggg

SEQ ID NO: 482376 - DNA, 20 bp, mouse
ggaagcgaaccggtctccag

SEQ ID NO: 482377 - DNA, 20 bp, mouse
gggcggaggctgaagcgaac

SEQ ID NO: 482378 - DNA, 20 bp, mouse
gagaagggcgaagccgggaa

SEQ ID NO: 482379 - DNA, 20 bp, mouse
ggacagcgatctgacagcga

SEQ ID NO: 482380 - DNA, 20 bp, mouse
gtcgctgtcgccagtcaccc

SEQ ID NO: 482381 - DNA, 20 bp, mouse
gcgcagctcactcagatccg

SEQ ID NO: 482382 - DNA, 20 bp, mouse
gagggcgacacagtcgggtg

SEQ ID NO: 482383 - DNA, 20 bp, mouse
gctctggcaagcaaagtgta

SEQ ID NO: 482384 - DNA, 20 bp, mouse
gcccgagcgctgtgagagaa

SEQ ID NO: 482385 - DNA, 20 bp, mouse
gaccttctaggcggaagtga

SEQ ID NO: 482386 - DNA, 20 bp, mouse
gtgtgcagcgctgctcccag

SEQ ID NO: 482387 - DNA, 20 bp, mouse
gccggctgtggccagtacct

SEQ ID NO: 482388 - DNA, 20 bp, mouse
ggggcgacgcgtagacgccg

SEQ ID NO: 482389 - DNA, 20 bp, mouse
ggaaccgcagcaggatgtag

SEQ ID NO: 482390 - DNA, 20 bp, mouse
ggcgtcgcccggcaggtccg

SEQ ID NO: 482391 - DNA, 20 bp, mouse
gcagcgctgctcccagcgga

SEQ ID NO: 482392 - DNA, 20 bp, mouse
gcgcgtagacgccgaggtac

SEQ ID NO: 482393 - DNA, 20 bp, mouse
gcgcctgcaccggcacggac

SEQ ID NO: 482394 - DNA, 20 bp, mouse
gacagccggaaccctccgct

SEQ ID NO: 482395 - DNA, 20 bp, mouse
gccggagccccggacctgcc

SEQ ID NO: 482396 - DNA, 20 bp, mouse
gggaccggtgcaggcaacag

SEQ ID NO: 482397 - DNA, 20 bp, mouse
gggcgcgcggcgactcggac

SEQ ID NO: 482398 - DNA, 20 bp, mouse
gagcggagacagcggagaat

SEQ ID NO: 482399 - DNA, 20 bp, mouse
ggctgcggcgcgtgacgcga

SEQ ID NO: 482400 - DNA, 20 bp, mouse
ggcgagggcgcgcggcgact

SEQ ID NO: 482401 - DNA, 20 bp, mouse
gtcgagcctgggggtcgccg

SEQ ID NO: 482402 - DNA, 20 bp, mouse
gcctgaggccccaacatcct

SEQ ID NO: 482403 - DNA, 20 bp, mouse
gtctggcgcctcgagcctgg

SEQ ID NO: 482404 - DNA, 20 bp, mouse
gcagcggccaccatggacat

SEQ ID NO: 482405 - DNA, 20 bp, mouse
gcggcgactcggaccggtgc

SEQ ID NO: 482406 - DNA, 20 bp, mouse
gtgcagcgcgaggccgtcaa

SEQ ID NO: 482407 - DNA, 20 bp, mouse
ggagcccaggagaacagaca

SEQ ID NO: 482408 - DNA, 20 bp, mouse
gacgcggctcaggatagccg

SEQ ID NO: 482409 - DNA, 20 bp, mouse
gtggagccatggctgagtaa

SEQ ID NO: 482410 - DNA, 20 bp, mouse
ggacaaggagggctcagtgt

SEQ ID NO: 482411 - DNA, 20 bp, mouse
ggcaggagcagcggcaccat

SEQ ID NO: 482412 - DNA, 20 bp, mouse
gggccgtcaagggagcgcgc

SEQ ID NO: 482413 - DNA, 20 bp, mouse
gcccaggagaacagacaagg

SEQ ID NO: 482414 - DNA, 20 bp, mouse
gcgccggcgcgctcccttga

SEQ ID NO: 482415 - DNA, 20 bp, mouse
gagccatggctgagtaacgg

SEQ ID NO: 482416 - DNA, 20 bp, mouse
ggggccgcagctccagggcg

SEQ ID NO: 482417 - DNA, 20 bp, mouse
gcagctccagggcgaggagc

SEQ ID NO: 482418 - DNA, 20 bp, mouse
gggcttcctgctcctcgccc

SEQ ID NO: 482419 - DNA, 20 bp, mouse
ggagcaccatgctgcagggg

SEQ ID NO: 482420 - DNA, 20 bp, mouse
gcgcgagcaccatgctgcag

SEQ ID NO: 482421 - DNA, 20 bp, mouse
gatggcccaggagagtaagt

SEQ ID NO: 482422 - DNA, 20 bp, mouse
gagcaaactgcggctcaagg

SEQ ID NO: 482423 - DNA, 20 bp, mouse
gcctggagctgcggccccgg

SEQ ID NO: 482424 - DNA, 20 bp, mouse
gctgcagcctgaggacttct

SEQ ID NO: 482425 - DNA, 20 bp, mouse
ggctctctaggcgcagctcg

SEQ ID NO: 482426 - DNA, 20 bp, mouse
gtccaggcggctctcaactg

SEQ ID NO: 482427 - DNA, 20 bp, mouse
ggaggctgggcctggagcgc

SEQ ID NO: 482428 - DNA, 20 bp, mouse
gtgagagccgcctggaggct

SEQ ID NO: 482429 - DNA, 20 bp, mouse
gactcaggacacaagcgaca

SEQ ID NO: 482430 - DNA, 20 bp, mouse
ggctccagaggtcacagcag

SEQ ID NO: 482431 - DNA, 20 bp, mouse
gccgctgctggcagctccag

SEQ ID NO: 482432 - DNA, 20 bp, mouse
gacctcagttgagagccgcc

SEQ ID NO: 482433 - DNA, 20 bp, mouse
ggagtcctctcggctctggt

SEQ ID NO: 482434 - DNA, 20 bp, mouse
gcatgccaaccagagccgag

SEQ ID NO: 482435 - DNA, 20 bp, mouse
gttaactcaaagacacactc

SEQ ID NO: 482436 - DNA, 20 bp, mouse
gcgaggagcccgggaggaat

SEQ ID NO: 482437 - DNA, 20 bp, mouse
ggtgcaacgaggagcccggg

SEQ ID NO: 482438 - DNA, 20 bp, mouse
gttggtgcaacgaggagccc

SEQ ID NO: 482439 - DNA, 20 bp, mouse
gatgtgggcctattcctccc

SEQ ID NO: 482440 - DNA, 20 bp, mouse
ggctgctgtggtctatcact

SEQ ID NO: 482441 - DNA, 20 bp, mouse
ggacaatcccagggagctgt

SEQ ID NO: 482442 - DNA, 20 bp, mouse
gtctatcacttggtgcaacg

SEQ ID NO: 482443 - DNA, 20 bp, mouse
gcgtgagacagccaaagtct

SEQ ID NO: 482444 - DNA, 20 bp, mouse
gccagctccagacaatccca

SEQ ID NO: 482445 - DNA, 20 bp, mouse
gcagaagccgctgcagaact

SEQ ID NO: 482446 - DNA, 20 bp, mouse
ggaccatgcagccttatcaa

SEQ ID NO: 482447 - DNA, 20 bp, mouse
gtgcatggtcgtctgagcca

SEQ ID NO: 482448 - DNA, 20 bp, mouse
ggcgccagaagccgttgata

SEQ ID NO: 482449 - DNA, 20 bp, mouse
gcccagaggctgctctaccc

SEQ ID NO: 482450 - DNA, 20 bp, mouse
gactcggatgtctggcccca

SEQ ID NO: 482451 - DNA, 20 bp, mouse
ggaaggagctgggtgttcgt

SEQ ID NO: 482452 - DNA, 20 bp, mouse
gaccagggtaaggaacccga

SEQ ID NO: 482453 - DNA, 20 bp, mouse
gtaagacgcgaggcacaggt

SEQ ID NO: 482454 - DNA, 20 bp, mouse
gggatgtctggccccagggc

SEQ ID NO: 482455 - DNA, 20 bp, mouse
gccaagatcagcccagagga

SEQ ID NO: 482456 - DNA, 20 bp, mouse
gacggtgcacgtctggacac

SEQ ID NO: 482457 - DNA, 20 bp, mouse
gcacgggagcacttccacta

SEQ ID NO: 482458 - DNA, 20 bp, mouse
gtctgtatccagtcccatag

SEQ ID NO: 482459 - DNA, 20 bp, mouse
ggatacagacacacgcccgg

SEQ ID NO: 482460 - DNA, 20 bp, mouse
gtctctgtggtgtcattcag

SEQ ID NO: 482461 - DNA, 20 bp, mouse
gactggagacggtgcacgtc

SEQ ID NO: 482462 - DNA, 20 bp, mouse
gttcagctgctgactggaga

SEQ ID NO: 482463 - DNA, 20 bp, mouse
ggagtgtcttgaagtccgcc

SEQ ID NO: 482464 - DNA, 20 bp, mouse
gaaccccaggggccaagcca

SEQ ID NO: 482465 - DNA, 20 bp, mouse
gcagggccaccggatctggg

SEQ ID NO: 482466 - DNA, 20 bp, mouse
ggggcgcgaaaggcacggag

SEQ ID NO: 482467 - DNA, 20 bp, mouse
ggcgccgggcgcgaaaggca

SEQ ID NO: 482468 - DNA, 20 bp, mouse
ggccgcccggacaacatcag

SEQ ID NO: 482469 - DNA, 20 bp, mouse
gcggctgcgccgggcgcgaa

SEQ ID NO: 482470 - DNA, 20 bp, mouse
gaagttactcggagaggcgg

SEQ ID NO: 482471 - DNA, 20 bp, mouse
ggtggctaagttactcggag

SEQ ID NO: 482472 - DNA, 20 bp, mouse
ggctaagttactcggagagg

SEQ ID NO: 482473 - DNA, 20 bp, mouse
gtcgcccagagaaggaccct

SEQ ID NO: 482474 - DNA, 20 bp, mouse
gagcgagtggctaagttact

SEQ ID NO: 482475 - DNA, 20 bp, mouse
gcgcactcgtagtctgcagg

SEQ ID NO: 482476 - DNA, 20 bp, mouse
gagccagagacacagcgcgg

SEQ ID NO: 482477 - DNA, 20 bp, mouse
gcggcagcgctcaggtccat

SEQ ID NO: 482478 - DNA, 20 bp, mouse
gccggccggccgcgcgacac

SEQ ID NO: 482479 - DNA, 20 bp, mouse
gccgcgcgacacgggctccg

SEQ ID NO: 482480 - DNA, 20 bp, mouse
gggcgtgtggacacaatcac

SEQ ID NO: 482481 - DNA, 20 bp, mouse
ggctgaagggcctggagccc

SEQ ID NO: 482482 - DNA, 20 bp, mouse
gcgcgcggccggccggccca

SEQ ID NO: 482483 - DNA, 20 bp, mouse
gcccgccgctcggagcaccg

SEQ ID NO: 482484 - DNA, 20 bp, mouse
gtatgttcaaaaggcgtcgg

SEQ ID NO: 482485 - DNA, 20 bp, mouse
ggaccagcctggagccccgg

SEQ ID NO: 482486 - DNA, 20 bp, mouse
gaggcagcagcaaggaccag

SEQ ID NO: 482487 - DNA, 20 bp, mouse
gtgacttgggagaactaaga

SEQ ID NO: 482488 - DNA, 20 bp, mouse
gacctgtcagtcccatctac

SEQ ID NO: 482489 - DNA, 20 bp, mouse
gagtagaagcctgagagcta

SEQ ID NO: 482490 - DNA, 20 bp, mouse
ggcctgtagatgggactgac

SEQ ID NO: 482491 - DNA, 20 bp, mouse
gaaagcagcaaacccccaac

SEQ ID NO: 482492 - DNA, 20 bp, mouse
ggagccggacggtattgtag

SEQ ID NO: 482493 - DNA, 20 bp, mouse
gcagcaaccaggtgacaggt

SEQ ID NO: 482494 - DNA, 20 bp, mouse
gtagaaagaagactggcacg

SEQ ID NO: 482495 - DNA, 20 bp, mouse
ggagcaggcacccagcaacc

SEQ ID NO: 482496 - DNA, 20 bp, mouse
gagtagtgaacgcacgggag

SEQ ID NO: 482497 - DNA, 20 bp, mouse
gcggtaagtagtgaacgcac

SEQ ID NO: 482498 - DNA, 20 bp, mouse
gacgtgggtggggcttatag

SEQ ID NO: 482499 - DNA, 20 bp, mouse
gggcttatagaggtgcttgt

SEQ ID NO: 482500 - DNA, 20 bp, mouse
ggagaggttgatgttgccaa

SEQ ID NO: 482501 - DNA, 20 bp, mouse
gggaggggtgccaagcaagt

SEQ ID NO: 482502 - DNA, 20 bp, mouse
gggttgatgttgccaagggg

SEQ ID NO: 482503 - DNA, 20 bp, mouse
gagcacctgggtgttccaag

SEQ ID NO: 482504 - DNA, 20 bp, mouse
ggcgtggcttaggagcacct

SEQ ID NO: 482505 - DNA, 20 bp, mouse
gtagccaccctggggatctt

SEQ ID NO: 482506 - DNA, 20 bp, mouse
ggcagcagtagcaatagtag

SEQ ID NO: 482507 - DNA, 20 bp, mouse
gagtgacagaagcagcggca

SEQ ID NO: 482508 - DNA, 20 bp, mouse
ggggctggagctaggatgat

SEQ ID NO: 482509 - DNA, 20 bp, mouse
ggggctatgagagcctgaag

SEQ ID NO: 482510 - DNA, 20 bp, mouse
ggagcctgaagtggcactta

SEQ ID NO: 482511 - DNA, 20 bp, mouse
gcacctcggtgatagagata

SEQ ID NO: 482512 - DNA, 20 bp, mouse
gcgccatctttggttcagtg

SEQ ID NO: 482513 - DNA, 20 bp, mouse
ggggccctctacagagaatt

SEQ ID NO: 482514 - DNA, 20 bp, mouse
ggtgagcccagaaaaatacg

SEQ ID NO: 482515 - DNA, 20 bp, mouse
gaactggaatcgacatccta

SEQ ID NO: 482516 - DNA, 20 bp, mouse
gcaacgggaagagaagagca

SEQ ID NO: 482517 - DNA, 20 bp, mouse
gcgacccccggggcccagag

SEQ ID NO: 482518 - DNA, 20 bp, mouse
gtcgcgagaggggaacgagg

SEQ ID NO: 482519 - DNA, 20 bp, mouse
gcccaagggggcgcagacac

SEQ ID NO: 482520 - DNA, 20 bp, mouse
gccctctcgcgagagaaggg

SEQ ID NO: 482521 - DNA, 20 bp, mouse
gtaccacaggagcacaagac

SEQ ID NO: 482522 - DNA, 20 bp, mouse
gcggccgctctgggccccgg

SEQ ID NO: 482523 - DNA, 20 bp, mouse
gcgacggcgccgtcagtcaa

SEQ ID NO: 482524 - DNA, 20 bp, mouse
ggaggctcgtgcacaccgat

SEQ ID NO: 482525 - DNA, 20 bp, mouse
gcgttgagtctgggataggg

SEQ ID NO: 482526 - DNA, 20 bp, mouse
gccggatccgaggtaagaga

SEQ ID NO: 482527 - DNA, 20 bp, mouse
gtctacggagaccggatccg

SEQ ID NO: 482528 - DNA, 20 bp, mouse
gtcctgcccgaggtccggat

SEQ ID NO: 482529 - DNA, 20 bp, mouse
gcactcctcagccaaggcag

SEQ ID NO: 482530 - DNA, 20 bp, mouse
gagagggaaacgtgctggag

SEQ ID NO: 482531 - DNA, 20 bp, mouse
gggctagacttgcggaggat

SEQ ID NO: 482532 - DNA, 20 bp, mouse
gtccaggactgtacagagcg

SEQ ID NO: 482533 - DNA, 20 bp, mouse
gaaacgtgctggaggggaca

SEQ ID NO: 482534 - DNA, 20 bp, mouse
ggcaagagcacgcaatccag

SEQ ID NO: 482535 - DNA, 20 bp, mouse
gaggccggtgtgcgaggtgt

SEQ ID NO: 482536 - DNA, 20 bp, mouse
gtgtgctgtgatggtagcaa

SEQ ID NO: 482537 - DNA, 20 bp, mouse
ggggtctcaggcccagaagg

SEQ ID NO: 482538 - DNA, 20 bp, mouse
ggaccccgactgtgctgtga

SEQ ID NO: 482539 - DNA, 20 bp, mouse
gtaccatcacagcacagtcg

SEQ ID NO: 482540 - DNA, 20 bp, mouse
gccgcggtggacgacatcct

SEQ ID NO: 482541 - DNA, 20 bp, mouse
ggagagaaggcaaaaagccg

SEQ ID NO: 482542 - DNA, 20 bp, mouse
gtcggggtctcaggcccaga

SEQ ID NO: 482543 - DNA, 20 bp, mouse
ggtgagagatgtgcctactg

SEQ ID NO: 482544 - DNA, 20 bp, mouse
gagagacgcccaccaggact

SEQ ID NO: 482545 - DNA, 20 bp, mouse
gacgccgagggcaccggctg

SEQ ID NO: 482546 - DNA, 20 bp, mouse
gggaggcagacaactcggag

SEQ ID NO: 482547 - DNA, 20 bp, mouse
gaaggtgtgagggctcggga

SEQ ID NO: 482548 - DNA, 20 bp, mouse
gagggaggaggcagacaact

SEQ ID NO: 482549 - DNA, 20 bp, mouse
gagggactgcaagagggagg

SEQ ID NO: 482550 - DNA, 20 bp, mouse
ggccagggactgcaagaggg

SEQ ID NO: 482551 - DNA, 20 bp, mouse
gttgcttcccggctccccag

SEQ ID NO: 482552 - DNA, 20 bp, mouse
gtgagccagggactgcaaga

SEQ ID NO: 482553 - DNA, 20 bp, mouse
gcactgtgtaaaaggtgtga

SEQ ID NO: 482554 - DNA, 20 bp, mouse
gggagcagggaatctgacag

SEQ ID NO: 482555 - DNA, 20 bp, mouse
ggacaactcggagaggagct

SEQ ID NO: 482556 - DNA, 20 bp, mouse
gtgacgtaactgcccagggt

SEQ ID NO: 482557 - DNA, 20 bp, mouse
gggatcatagcctcgctcca

SEQ ID NO: 482558 - DNA, 20 bp, mouse
gggtgggcagaacaaagtac

SEQ ID NO: 482559 - DNA, 20 bp, mouse
gaagggctggaatccatgta

SEQ ID NO: 482560 - DNA, 20 bp, mouse
ggcagaacaaagtacaggag

SEQ ID NO: 482561 - DNA, 20 bp, mouse
gacaagacaggtgtcagggt

SEQ ID NO: 482562 - DNA, 20 bp, mouse
gatcagagccctttgggaca

SEQ ID NO: 482563 - DNA, 20 bp, mouse
ggcctggctgcccaccgtgg

SEQ ID NO: 482564 - DNA, 20 bp, mouse
ggtgggcagccaggcggata

SEQ ID NO: 482565 - DNA, 20 bp, mouse
gcatagcctcgctccacggc

SEQ ID NO: 482566 - DNA, 20 bp, mouse
ggagagacgctagtcttcac

SEQ ID NO: 482567 - DNA, 20 bp, mouse
gctagcgtctctcaagatgg

SEQ ID NO: 482568 - DNA, 20 bp, mouse
ggagatggaaacactactta

SEQ ID NO: 482569 - DNA, 20 bp, mouse
gagatggaggacaggcacga

SEQ ID NO: 482570 - DNA, 20 bp, mouse
gagactagcgtctctcaaga

SEQ ID NO: 482571 - DNA, 20 bp, mouse
ggacttcagggtgaccgtct

SEQ ID NO: 482572 - DNA, 20 bp, mouse
gcagtctagctagtgaatgg

SEQ ID NO: 482573 - DNA, 20 bp, mouse
gctgcacccgtgctcaggtc

SEQ ID NO: 482574 - DNA, 20 bp, mouse
gccttagagccgtggaaaca

SEQ ID NO: 482575 - DNA, 20 bp, mouse
gcacggctctaaggaaaaaa

SEQ ID NO: 482576 - DNA, 20 bp, mouse
ggcggggagccggtaagagg

SEQ ID NO: 482577 - DNA, 20 bp, mouse
gtgagcggggagccggtaag

SEQ ID NO: 482578 - DNA, 20 bp, mouse
gggctcggacaagcagggca

SEQ ID NO: 482579 - DNA, 20 bp, mouse
gtgcggggctcggacaagca

SEQ ID NO: 482580 - DNA, 20 bp, mouse
gcacggggctaggaaagtcc

SEQ ID NO: 482581 - DNA, 20 bp, mouse
gcccagcagctccagaccac

SEQ ID NO: 482582 - DNA, 20 bp, mouse
gagggcaggcggagcgccag

SEQ ID NO: 482583 - DNA, 20 bp, mouse
ggtgagcggcgtcgggacct

SEQ ID NO: 482584 - DNA, 20 bp, mouse
gagtccaggcgcggaatgcg

SEQ ID NO: 482585 - DNA, 20 bp, mouse
ggaactccggatcaaggccg

SEQ ID NO: 482586 - DNA, 20 bp, mouse
gtcagtgcacagacgggtcc

SEQ ID NO: 482587 - DNA, 20 bp, mouse
gggtcttctgcacttgattt

SEQ ID NO: 482588 - DNA, 20 bp, mouse
gtctggaagaattggcacgg

SEQ ID NO: 482589 - DNA, 20 bp, mouse
ggcagactgcgcctgcgtcg

SEQ ID NO: 482590 - DNA, 20 bp, mouse
gggactgaccctatccgcag

SEQ ID NO: 482591 - DNA, 20 bp, mouse
gcttcaagagccacttcaag

SEQ ID NO: 482592 - DNA, 20 bp, mouse
gagaattggcacggtggcag

SEQ ID NO: 482593 - DNA, 20 bp, mouse
gtcttctggaagaattggca

SEQ ID NO: 482594 - DNA, 20 bp, mouse
gctggaagctcgcaatttgt

SEQ ID NO: 482595 - DNA, 20 bp, mouse
gaagcttcttctggaagaat

SEQ ID NO: 482596 - DNA, 20 bp, mouse
gatgcgggctccgcagtccg

SEQ ID NO: 482597 - DNA, 20 bp, mouse
ggttgcagcaggcggatcga

SEQ ID NO: 482598 - DNA, 20 bp, mouse
gtacagacctagggagtcta

SEQ ID NO: 482599 - DNA, 20 bp, mouse
gcaggaggcggcactgccag

SEQ ID NO: 482600 - DNA, 20 bp, mouse
gatcacacagcctcggactg

SEQ ID NO: 482601 - DNA, 20 bp, mouse
gaacccccggtacagaccta

SEQ ID NO: 482602 - DNA, 20 bp, mouse
gagcccgcatcgcagacgtc

SEQ ID NO: 482603 - DNA, 20 bp, mouse
gacgcctgacgtctgcgatg

SEQ ID NO: 482604 - DNA, 20 bp, mouse
gtcccagtgggagcctctgt

SEQ ID NO: 482605 - DNA, 20 bp, mouse
gagcggacatcacacagcct

SEQ ID NO: 482606 - DNA, 20 bp, mouse
gctcaatcggcgcccagagt

SEQ ID NO: 482607 - DNA, 20 bp, mouse
ggcaccagggctgtacacag

SEQ ID NO: 482608 - DNA, 20 bp, mouse
gctggcgggagcgagaacca

SEQ ID NO: 482609 - DNA, 20 bp, mouse
ggggcgccgattgagactgg

SEQ ID NO: 482610 - DNA, 20 bp, mouse
gggagcgagaaccatggcgt

SEQ ID NO: 482611 - DNA, 20 bp, mouse
gtcggcgcccagagtaggca

SEQ ID NO: 482612 - DNA, 20 bp, mouse
gtctgggcgccgattgagac

SEQ ID NO: 482613 - DNA, 20 bp, mouse
gtcggctggaacccacgcca

SEQ ID NO: 482614 - DNA, 20 bp, mouse
gcctgcgccgtgcctactct

SEQ ID NO: 482615 - DNA, 20 bp, mouse
ggttccagccgagtctgcgg

SEQ ID NO: 482616 - DNA, 20 bp, mouse
gaacccacctaggtccatgg

SEQ ID NO: 482617 - DNA, 20 bp, mouse
gcgcggccttggactaggag

SEQ ID NO: 482618 - DNA, 20 bp, mouse
ggggaagtgggaacccacct

SEQ ID NO: 482619 - DNA, 20 bp, mouse
ggcgttcgcggccttggact

SEQ ID NO: 482620 - DNA, 20 bp, mouse
gtcgccgccatggacctagg

SEQ ID NO: 482621 - DNA, 20 bp, mouse
ggaccgcccctcctagtcca

SEQ ID NO: 482622 - DNA, 20 bp, mouse
ggggaacccacctaggtcca

SEQ ID NO: 482623 - DNA, 20 bp, mouse
ggcgtcgccgccatggacct

SEQ ID NO: 482624 - DNA, 20 bp, mouse
gcggcccaggggccggagta

SEQ ID NO: 482625 - DNA, 20 bp, mouse
gcgcgccacggcacaaaggg

SEQ ID NO: 482626 - DNA, 20 bp, mouse
gagagctcgacgagtggcca

SEQ ID NO: 482627 - DNA, 20 bp, mouse
ggctagcgcgagaccccgat

SEQ ID NO: 482628 - DNA, 20 bp, mouse
gccaaaccgggaaggatcgt

SEQ ID NO: 482629 - DNA, 20 bp, mouse
gaagtgcagagctcgacgag

SEQ ID NO: 482630 - DNA, 20 bp, mouse
gaggggagggaagacgccgt

SEQ ID NO: 482631 - DNA, 20 bp, mouse
gttcccaacccgaaagaggg

SEQ ID NO: 482632 - DNA, 20 bp, mouse
gcgtagacaacacagctggt

SEQ ID NO: 482633 - DNA, 20 bp, mouse
gcgtggcaacgcggagtcta

SEQ ID NO: 482634 - DNA, 20 bp, mouse
gagcgcgagaccccgatggg

SEQ ID NO: 482635 - DNA, 20 bp, mouse
gaaaaccgagttccaggcag

SEQ ID NO: 482636 - DNA, 20 bp, mouse
gcagaggagctctgggacgg

SEQ ID NO: 482637 - DNA, 20 bp, mouse
gggctccggcttcatctccg

SEQ ID NO: 482638 - DNA, 20 bp, mouse
ggcggccgcggagatgaagc

SEQ ID NO: 482639 - DNA, 20 bp, mouse
gcgtgagcagtaccagttgg

SEQ ID NO: 482640 - DNA, 20 bp, mouse
ggactgcgccgacccgtgag

SEQ ID NO: 482641 - DNA, 20 bp, mouse
gaggtgagcccctcacgggt

SEQ ID NO: 482642 - DNA, 20 bp, mouse
gcagaactcccccaagagga

SEQ ID NO: 482643 - DNA, 20 bp, mouse
gttcgaggtgagcccctcac

SEQ ID NO: 482644 - DNA, 20 bp, mouse
gagtaccagttgggggacgg

SEQ ID NO: 482645 - DNA, 20 bp, mouse
gacgcggacgaggaagacgg

SEQ ID NO: 482646 - DNA, 20 bp, mouse
gctcactgaaggtactgacc

SEQ ID NO: 482647 - DNA, 20 bp, mouse
gcaaaggctctcctgagcac

SEQ ID NO: 482648 - DNA, 20 bp, mouse
gagccagctaaagagaaacc

SEQ ID NO: 482649 - DNA, 20 bp, mouse
gtcggaaggaccacaggtgt

SEQ ID NO: 482650 - DNA, 20 bp, mouse
ggcgctccacgcttccgcaa

SEQ ID NO: 482651 - DNA, 20 bp, mouse
ggacagatcggaaggaccac

SEQ ID NO: 482652 - DNA, 20 bp, mouse
gaaagccacctcactgaaaa

SEQ ID NO: 482653 - DNA, 20 bp, mouse
ggaacacataccagccagtg

SEQ ID NO: 482654 - DNA, 20 bp, mouse
gtggggtgtaaaagctgtct

SEQ ID NO: 482655 - DNA, 20 bp, mouse
ggccttgctcaagaagagga

SEQ ID NO: 482656 - DNA, 20 bp, mouse
gccgactcaagcccgctcgg

SEQ ID NO: 482657 - DNA, 20 bp, mouse
gcagaactctgcacgactca

SEQ ID NO: 482658 - DNA, 20 bp, mouse
gtagctcacacgccgccgag

SEQ ID NO: 482659 - DNA, 20 bp, mouse
gggtatggcggcctctggac

SEQ ID NO: 482660 - DNA, 20 bp, mouse
gtcatctagaaagagtaggt

SEQ ID NO: 482661 - DNA, 20 bp, mouse
ggggccgactcaagcccgct

SEQ ID NO: 482662 - DNA, 20 bp, mouse
gaaggaaagcggaacggaag

SEQ ID NO: 482663 - DNA, 20 bp, mouse
ggcggcctctggacaggacc

SEQ ID NO: 482664 - DNA, 20 bp, mouse
gttatctaaggaaagcggaa

SEQ ID NO: 482665 - DNA, 20 bp, mouse
gaaagcatgctgggctcagg

SEQ ID NO: 482666 - DNA, 20 bp, mouse
gtgtaggagcagcgcctgca

SEQ ID NO: 482667 - DNA, 20 bp, mouse
gggcggaaactaggcagtcg

SEQ ID NO: 482668 - DNA, 20 bp, mouse
gggttgcgcgggcggaaact

SEQ ID NO: 482669 - DNA, 20 bp, mouse
gggccttggtgagttctccg

SEQ ID NO: 482670 - DNA, 20 bp, mouse
gtgtactctgacgcagggag

SEQ ID NO: 482671 - DNA, 20 bp, mouse
ggctccaatgccacccggag

SEQ ID NO: 482672 - DNA, 20 bp, mouse
gactctgacgcagggagggg

SEQ ID NO: 482673 - DNA, 20 bp, mouse
gaggacgctaggaggccagg

SEQ ID NO: 482674 - DNA, 20 bp, mouse
gagaatgtccatccgctccg

SEQ ID NO: 482675 - DNA, 20 bp, mouse
ggcccgcgcaacctcagcag

SEQ ID NO: 482676 - DNA, 20 bp, mouse
ggcccccgaagtcacctcgt

SEQ ID NO: 482677 - DNA, 20 bp, mouse
ggcccacgaggtgacttcgg

SEQ ID NO: 482678 - DNA, 20 bp, mouse
ggaaggggcgggagaagtgg

SEQ ID NO: 482679 - DNA, 20 bp, mouse
gatcacccggcagcacgagg

SEQ ID NO: 482680 - DNA, 20 bp, mouse
gtgccagctgcgtgcccacg

SEQ ID NO: 482681 - DNA, 20 bp, mouse
gtcaggggttgggactctca

SEQ ID NO: 482682 - DNA, 20 bp, mouse
gagaagtgaggctcaagcat

SEQ ID NO: 482683 - DNA, 20 bp, mouse
gaccatcacccggcagcacg

SEQ ID NO: 482684 - DNA, 20 bp, mouse
ggaagtgggggagtgacaca

SEQ ID NO: 482685 - DNA, 20 bp, mouse
gcaaggattaggaagcacat

SEQ ID NO: 482686 - DNA, 20 bp, mouse
gtgctagggagagcagcggg

SEQ ID NO: 482687 - DNA, 20 bp, mouse
gttagtgctagggagagcag

SEQ ID NO: 482688 - DNA, 20 bp, mouse
gctccctagcactaagctcc

SEQ ID NO: 482689 - DNA, 20 bp, mouse
gtgccgggagcttagtgcta

SEQ ID NO: 482690 - DNA, 20 bp, mouse
gccggaaggggcgggactaa

SEQ ID NO: 482691 - DNA, 20 bp, mouse
gggaggctcccccagccctt

SEQ ID NO: 482692 - DNA, 20 bp, mouse
gtctagaagccggtaggacc

SEQ ID NO: 482693 - DNA, 20 bp, mouse
gagaacactggctcccgaga

SEQ ID NO: 482694 - DNA, 20 bp, mouse
gggggcgggactaatggaga

SEQ ID NO: 482695 - DNA, 20 bp, mouse
gagaagccggtaggaccggg

SEQ ID NO: 482696 - DNA, 20 bp, mouse
gacgctgtcgcaggcgcggt

SEQ ID NO: 482697 - DNA, 20 bp, mouse
gagcaggagggcgcccgcaa

SEQ ID NO: 482698 - DNA, 20 bp, mouse
ggcggaacgccggcccatgg

SEQ ID NO: 482699 - DNA, 20 bp, mouse
gggccaccgtagaaggagtg

SEQ ID NO: 482700 - DNA, 20 bp, mouse
gcaccgtagaaggagtgcgg

SEQ ID NO: 482701 - DNA, 20 bp, mouse
gctgtcgcggagcagagcgg

SEQ ID NO: 482702 - DNA, 20 bp, mouse
gggccgccgcactccttcta

SEQ ID NO: 482703 - DNA, 20 bp, mouse
gctgtcgcaggcgcggtcgg

SEQ ID NO: 482704 - DNA, 20 bp, mouse
ggagaagggcgactactacg

SEQ ID NO: 482705 - DNA, 20 bp, mouse
gtgcgtgctagcgtcgagaa

SEQ ID NO: 482706 - DNA, 20 bp, mouse
gcccctgaccaccgtctcgg

SEQ ID NO: 482707 - DNA, 20 bp, mouse
gaggcccctgaccaccgtct

SEQ ID NO: 482708 - DNA, 20 bp, mouse
ggcataggagcggcgcgcag

SEQ ID NO: 482709 - DNA, 20 bp, mouse
ggccagggagaagtccaccc

SEQ ID NO: 482710 - DNA, 20 bp, mouse
ggctggcttcaaggagacac

SEQ ID NO: 482711 - DNA, 20 bp, mouse
gtcctatgcctccgagacgg

SEQ ID NO: 482712 - DNA, 20 bp, mouse
gcgctcctatgcctccgaga

SEQ ID NO: 482713 - DNA, 20 bp, mouse
gacaggacctcggcaccctg

SEQ ID NO: 482714 - DNA, 20 bp, mouse
gcagttgtcgactaggaccg

SEQ ID NO: 482715 - DNA, 20 bp, mouse
gagcgagcgtgcagagatga

SEQ ID NO: 482716 - DNA, 20 bp, mouse
gagccggcgggcttccctcg

SEQ ID NO: 482717 - DNA, 20 bp, mouse
gggagaagcgactgccgcga

SEQ ID NO: 482718 - DNA, 20 bp, mouse
gtgcccgcacgccagcaaga

SEQ ID NO: 482719 - DNA, 20 bp, mouse
ggcgggcagcggggccaaga

SEQ ID NO: 482720 - DNA, 20 bp, mouse
gggaagcccgccggctcgct

SEQ ID NO: 482721 - DNA, 20 bp, mouse
gcgtgccggcgacagttcgg

SEQ ID NO: 482722 - DNA, 20 bp, mouse
gagtccacgcaggcccggca

SEQ ID NO: 482723 - DNA, 20 bp, mouse
gatggcggcgcccagcgagc

SEQ ID NO: 482724 - DNA, 20 bp, mouse
gtgagcctaacggtgtgtgt

SEQ ID NO: 482725 - DNA, 20 bp, mouse
ggggcgtgccggcgacagtt

SEQ ID NO: 482726 - DNA, 20 bp, mouse
ggcccgcgccctgaccccga

SEQ ID NO: 482727 - DNA, 20 bp, mouse
gggttctggagccacccaag

SEQ ID NO: 482728 - DNA, 20 bp, mouse
gtctggagccacccaagcgg

SEQ ID NO: 482729 - DNA, 20 bp, mouse
ggttcagcaaacctaccttc

SEQ ID NO: 482730 - DNA, 20 bp, mouse
gcgaaagatctggaatagag

SEQ ID NO: 482731 - DNA, 20 bp, mouse
gacatctggtgggcatgtgg

SEQ ID NO: 482732 - DNA, 20 bp, mouse
gggtggcctcgaggactggt

SEQ ID NO: 482733 - DNA, 20 bp, mouse
ggaggccacccccgcctgag

SEQ ID NO: 482734 - DNA, 20 bp, mouse
gtaccttcggggtcagggcg

SEQ ID NO: 482735 - DNA, 20 bp, mouse
gccacccccgcctgagcggg

SEQ ID NO: 482736 - DNA, 20 bp, mouse
ggcagtccccagggacagtg

SEQ ID NO: 482737 - DNA, 20 bp, mouse
gctggcagcactcaccgtca

SEQ ID NO: 482738 - DNA, 20 bp, mouse
gggtgagaggaagaatactg

SEQ ID NO: 482739 - DNA, 20 bp, mouse
gaagagggacagctccctga

SEQ ID NO: 482740 - DNA, 20 bp, mouse
gaacctccacactgtccctg

SEQ ID NO: 482741 - DNA, 20 bp, mouse
gcgagccgagagcagtcccc

SEQ ID NO: 482742 - DNA, 20 bp, mouse
ggtggaggttcgtggctctc

SEQ ID NO: 482743 - DNA, 20 bp, mouse
gtgtccctggggactgctct

SEQ ID NO: 482744 - DNA, 20 bp, mouse
ggggacagtgtggaggttcg

SEQ ID NO: 482745 - DNA, 20 bp, mouse
gatcaccaggggagagaaga

SEQ ID NO: 482746 - DNA, 20 bp, mouse
gtcagcgccggcagcagagc

SEQ ID NO: 482747 - DNA, 20 bp, mouse
gcctggaacagccacttcca

SEQ ID NO: 482748 - DNA, 20 bp, mouse
gtggcaggggaagcaggtac

SEQ ID NO: 482749 - DNA, 20 bp, mouse
gcttccagagcagggcaggt

SEQ ID NO: 482750 - DNA, 20 bp, mouse
gcctcccggaagtgctcctg

SEQ ID NO: 482751 - DNA, 20 bp, mouse
gcaggactgcagggacccga

SEQ ID NO: 482752 - DNA, 20 bp, mouse
gctggcatgcggatacccaa

SEQ ID NO: 482753 - DNA, 20 bp, mouse
ggaagagctcaaagtcacgc

SEQ ID NO: 482754 - DNA, 20 bp, mouse
gggatacccaagggcttacg

SEQ ID NO: 482755 - DNA, 20 bp, mouse
gggacggccagaggaagaca

SEQ ID NO: 482756 - DNA, 20 bp, mouse
gaccggaactgcttagaggg

SEQ ID NO: 482757 - DNA, 20 bp, mouse
gtacccgcagaaggaacccg

SEQ ID NO: 482758 - DNA, 20 bp, mouse
gtgtaagctgggagatccgc

SEQ ID NO: 482759 - DNA, 20 bp, mouse
ggcagctacgaggtcagcag

SEQ ID NO: 482760 - DNA, 20 bp, mouse
ggccaccggaactgcttaga

SEQ ID NO: 482761 - DNA, 20 bp, mouse
gagagggcggaaggtgctta

SEQ ID NO: 482762 - DNA, 20 bp, mouse
ggaactgcttagagggcgga

SEQ ID NO: 482763 - DNA, 20 bp, mouse
gtggcagaccagcaagaccg

SEQ ID NO: 482764 - DNA, 20 bp, mouse
gtgagggtgtctgaggtggt

SEQ ID NO: 482765 - DNA, 20 bp, mouse
ggatccgcgggttccttctg

SEQ ID NO: 482766 - DNA, 20 bp, mouse
ggaacccagaggccacccgg

SEQ ID NO: 482767 - DNA, 20 bp, mouse
gcgctgcgagcgagcgaata

SEQ ID NO: 482768 - DNA, 20 bp, mouse
ggctcgcagcgcgccttggg

SEQ ID NO: 482769 - DNA, 20 bp, mouse
ggaagatccgcagcccacag

SEQ ID NO: 482770 - DNA, 20 bp, mouse
gcgggatcccgcgggtacga

SEQ ID NO: 482771 - DNA, 20 bp, mouse
gccgagcagcagcaccgcag

SEQ ID NO: 482772 - DNA, 20 bp, mouse
gtccggctccgggatcccgc

SEQ ID NO: 482773 - DNA, 20 bp, mouse
gcgcagcggcggacaccacc

SEQ ID NO: 482774 - DNA, 20 bp, mouse
gcggaggccgactaaggatg

SEQ ID NO: 482775 - DNA, 20 bp, mouse
ggatcccgcgggtacgaggg

SEQ ID NO: 482776 - DNA, 20 bp, mouse
gtccgcactagcctccctca

SEQ ID NO: 482777 - DNA, 20 bp, mouse
ggccctgagggaggctagtg

SEQ ID NO: 482778 - DNA, 20 bp, mouse
gggcgggcgagggtgaaaga

SEQ ID NO: 482779 - DNA, 20 bp, mouse
gctgttccttagaaaccagg

SEQ ID NO: 482780 - DNA, 20 bp, mouse
gagagaccatggatccggag

SEQ ID NO: 482781 - DNA, 20 bp, mouse
gggccgtccgcctgccctga

SEQ ID NO: 482782 - DNA, 20 bp, mouse
gacacgccgcctggtttcta

SEQ ID NO: 482783 - DNA, 20 bp, mouse
gggcggcgtgttcccggtat

SEQ ID NO: 482784 - DNA, 20 bp, mouse
gaggggtctctggtacggag

SEQ ID NO: 482785 - DNA, 20 bp, mouse
gtccaacctccggagccggg

SEQ ID NO: 482786 - DNA, 20 bp, mouse
gcggagagcttcagaagcga

SEQ ID NO: 482787 - DNA, 20 bp, mouse
gcgagggtgagctcgggccg

SEQ ID NO: 482788 - DNA, 20 bp, mouse
gagcgctgagtcggactgtc

SEQ ID NO: 482789 - DNA, 20 bp, mouse
gcgcgcagtgaagccagagg

SEQ ID NO: 482790 - DNA, 20 bp, mouse
gggggtcctgaagagaaggg

SEQ ID NO: 482791 - DNA, 20 bp, mouse
gtgggggccctaggagtcag

SEQ ID NO: 482792 - DNA, 20 bp, mouse
gagcgaagcgagcgctgagt

SEQ ID NO: 482793 - DNA, 20 bp, mouse
gtcagaagcgagggtgagct

SEQ ID NO: 482794 - DNA, 20 bp, mouse
gagtcagaggctacttaaag

SEQ ID NO: 482795 - DNA, 20 bp, mouse
gggcatcccgaggagattga

SEQ ID NO: 482796 - DNA, 20 bp, mouse
ggtgcactcaccgcacatgg

SEQ ID NO: 482797 - DNA, 20 bp, mouse
gcgatcggagccaccatgtg

SEQ ID NO: 482798 - DNA, 20 bp, mouse
gagggcaggagaccgagcgg

SEQ ID NO: 482799 - DNA, 20 bp, mouse
gtctgagcgtctggagcgat

SEQ ID NO: 482800 - DNA, 20 bp, mouse
gtgacgtctcggggacatgg

SEQ ID NO: 482801 - DNA, 20 bp, mouse
gagcggcgggagcctgagcc

SEQ ID NO: 482802 - DNA, 20 bp, mouse
gaaggagccccgcaacacag

SEQ ID NO: 482803 - DNA, 20 bp, mouse
ggccagtagccctccgagag

SEQ ID NO: 482804 - DNA, 20 bp, mouse
gctccgagcccggaatgatg

SEQ ID NO: 482805 - DNA, 20 bp, mouse
gcagccccacccctctcgga

SEQ ID NO: 482806 - DNA, 20 bp, mouse
gctctcacggggcagtggtg

SEQ ID NO: 482807 - DNA, 20 bp, mouse
gcctacctgccgctcatcct

SEQ ID NO: 482808 - DNA, 20 bp, mouse
gtgtggatgcacaggagttc

SEQ ID NO: 482809 - DNA, 20 bp, mouse
gggcagtggtgtggatgcac

SEQ ID NO: 482810 - DNA, 20 bp, mouse
ggtcgggcgagagccaggga

SEQ ID NO: 482811 - DNA, 20 bp, mouse
gggactagctcgctctcacg

SEQ ID NO: 482812 - DNA, 20 bp, mouse
gtgagcggcaggtaggagta

SEQ ID NO: 482813 - DNA, 20 bp, mouse
gtgggaagagaggctcgtcc

SEQ ID NO: 482814 - DNA, 20 bp, mouse
gcccggagtcggagcctcgg

SEQ ID NO: 482815 - DNA, 20 bp, mouse
gctcggagctgagtccctgg

SEQ ID NO: 482816 - DNA, 20 bp, mouse
gtccagtagagcttctagga

SEQ ID NO: 482817 - DNA, 20 bp, mouse
gtcccggccgcgagagcgaa

SEQ ID NO: 482818 - DNA, 20 bp, mouse
gtcccaggaggggactggag

SEQ ID NO: 482819 - DNA, 20 bp, mouse
ggagaccagagtcgcttctt

SEQ ID NO: 482820 - DNA, 20 bp, mouse
ggccgcgagagcgaagggct

SEQ ID NO: 482821 - DNA, 20 bp, mouse
gggaaggcgcgagtccccgt

SEQ ID NO: 482822 - DNA, 20 bp, mouse
gcgcatgcccagcttccagt

SEQ ID NO: 482823 - DNA, 20 bp, mouse
gaagaaagcagcgagggagg

SEQ ID NO: 482824 - DNA, 20 bp, mouse
gtaggaaagaaatccaccga

SEQ ID NO: 482825 - DNA, 20 bp, mouse
gagccagcagcgagaatccc

SEQ ID NO: 482826 - DNA, 20 bp, mouse
gctccaggagagccccatgg

SEQ ID NO: 482827 - DNA, 20 bp, mouse
gggaacgcggcgcccagcgc

SEQ ID NO: 482828 - DNA, 20 bp, mouse
gccatggcgggtggacgccc

SEQ ID NO: 482829 - DNA, 20 bp, mouse
gaggagagccccatggcggg

SEQ ID NO: 482830 - DNA, 20 bp, mouse
gaggttgctgatgctgagaa

SEQ ID NO: 482831 - DNA, 20 bp, mouse
gcagagcgctgtcgcatccc

SEQ ID NO: 482832 - DNA, 20 bp, mouse
gagtcctgtgcaccaaggca

SEQ ID NO: 482833 - DNA, 20 bp, mouse
ggtagcaggatcatcagcag

SEQ ID NO: 482834 - DNA, 20 bp, mouse
ggggctccaggagagcccca

SEQ ID NO: 482835 - DNA, 20 bp, mouse
gtcatcagcagtggaggtcg

SEQ ID NO: 482836 - DNA, 20 bp, mouse
gagagggcggcaccaacccc

SEQ ID NO: 482837 - DNA, 20 bp, mouse
gccaggggctccaggcaaga

SEQ ID NO: 482838 - DNA, 20 bp, mouse
gcccgggccggagaacgcgc

SEQ ID NO: 482839 - DNA, 20 bp, mouse
gggagcgcatgaggcctgga

SEQ ID NO: 482840 - DNA, 20 bp, mouse
gacgcgggcccccctcctcc

SEQ ID NO: 482841 - DNA, 20 bp, mouse
gggccggagaacgcgcaggc

SEQ ID NO: 482842 - DNA, 20 bp, mouse
gtgcgctcgcagcgctccag

SEQ ID NO: 482843 - DNA, 20 bp, mouse
gacgcacgcaccggcacagg

SEQ ID NO: 482844 - DNA, 20 bp, mouse
gcctggaaggcaaggagacg

SEQ ID NO: 482845 - DNA, 20 bp, mouse
ggcaggcgggcgcgaaagtc

SEQ ID NO: 482846 - DNA, 20 bp, mouse
gtaatattgcaacaaattca

SEQ ID NO: 482847 - DNA, 20 bp, mouse
gatctagagtaagcttatgg

SEQ ID NO: 482848 - DNA, 20 bp, mouse
gcagcacagttgacttaccc

SEQ ID NO: 482849 - DNA, 20 bp, mouse
gaactcaagatggtctccct

SEQ ID NO: 482850 - DNA, 20 bp, mouse
gtacaagttagtaacatagt

SEQ ID NO: 482851 - DNA, 20 bp, mouse
ggaagctgactctaattggc

SEQ ID NO: 482852 - DNA, 20 bp, mouse
gcttcagttgggatgttggt

SEQ ID NO: 482853 - DNA, 20 bp, mouse
gttcatccgcctttctccca

SEQ ID NO: 482854 - DNA, 20 bp, mouse
gcatgttggacaactcaaga

SEQ ID NO: 482855 - DNA, 20 bp, mouse
gctcctcagcttgcgaaccc

SEQ ID NO: 482856 - DNA, 20 bp, mouse
gatggagccggagactctgg

SEQ ID NO: 482857 - DNA, 20 bp, mouse
ggcgatggagccggagactc

SEQ ID NO: 482858 - DNA, 20 bp, mouse
ggcagctgccagggtccgag

SEQ ID NO: 482859 - DNA, 20 bp, mouse
gatcagtgagtgtccgggag

SEQ ID NO: 482860 - DNA, 20 bp, mouse
gccccgccgggagagagaga

SEQ ID NO: 482861 - DNA, 20 bp, mouse
gtggcggatggagcccgcga

SEQ ID NO: 482862 - DNA, 20 bp, mouse
gatggagcccgcgatggagc

SEQ ID NO: 482863 - DNA, 20 bp, mouse
gcccgccccccgacccggag

SEQ ID NO: 482864 - DNA, 20 bp, mouse
gcaacaggcagggccttcgg

SEQ ID NO: 482865 - DNA, 20 bp, mouse
gccgagcggagcgacagact

SEQ ID NO: 482866 - DNA, 20 bp, mouse
gccgccgcggaggacaacca

SEQ ID NO: 482867 - DNA, 20 bp, mouse
gtggagcgaaggctaggcgg

SEQ ID NO: 482868 - DNA, 20 bp, mouse
gggcagctggagcgaaggct

SEQ ID NO: 482869 - DNA, 20 bp, mouse
gccgcggaggacaaccaggg

SEQ ID NO: 482870 - DNA, 20 bp, mouse
gcgacgcggcagacactgag

SEQ ID NO: 482871 - DNA, 20 bp, mouse
ggcgtcggcagctggagcga

SEQ ID NO: 482872 - DNA, 20 bp, mouse
ggctgggcagatggcagcga

SEQ ID NO: 482873 - DNA, 20 bp, mouse
gcgggaagcaggatcacgtg

SEQ ID NO: 482874 - DNA, 20 bp, mouse
gcagatggcagcgacggcag

SEQ ID NO: 482875 - DNA, 20 bp, mouse
gggcggtggctgcagctttt

SEQ ID NO: 482876 - DNA, 20 bp, mouse
gccgggcggctgcaatatgg

SEQ ID NO: 482877 - DNA, 20 bp, mouse
gggaccgggcggctgcaata

SEQ ID NO: 482878 - DNA, 20 bp, mouse
ggagggcgcagggccggacc

SEQ ID NO: 482879 - DNA, 20 bp, mouse
gcaatatggcggaggcggaa

SEQ ID NO: 482880 - DNA, 20 bp, mouse
gggcggctgcaatatggcgg

SEQ ID NO: 482881 - DNA, 20 bp, mouse
gggctgcaatatggcggagg

SEQ ID NO: 482882 - DNA, 20 bp, mouse
gctggctgagtgagtatccg

SEQ ID NO: 482883 - DNA, 20 bp, mouse
ggaagggccgctgctcgcaa

SEQ ID NO: 482884 - DNA, 20 bp, mouse
gagaacctcgcgaggcttga

SEQ ID NO: 482885 - DNA, 20 bp, mouse
ggaggaggcaggcccgtggt

SEQ ID NO: 482886 - DNA, 20 bp, mouse
ggcgcgcccggaccacggag

SEQ ID NO: 482887 - DNA, 20 bp, mouse
gcctcacctgcagcggtcgg

SEQ ID NO: 482888 - DNA, 20 bp, mouse
gagcggtcgggggaatcacg

SEQ ID NO: 482889 - DNA, 20 bp, mouse
ggtcacagcacgggccgccc

SEQ ID NO: 482890 - DNA, 20 bp, mouse
gcgggacagacagctccaac

SEQ ID NO: 482891 - DNA, 20 bp, mouse
ggctgtgactgctaccggag

SEQ ID NO: 482892 - DNA, 20 bp, mouse
gtgcaggtgaggcgccgagg

SEQ ID NO: 482893 - DNA, 20 bp, mouse
gaggtagcttaagatcctaa

SEQ ID NO: 482894 - DNA, 20 bp, mouse
gccgcccgggcagctttccg

SEQ ID NO: 482895 - DNA, 20 bp, mouse
ggagtccctaagccgccccc

SEQ ID NO: 482896 - DNA, 20 bp, mouse
gcccgcatggccctcacagt

SEQ ID NO: 482897 - DNA, 20 bp, mouse
gtggcgtggataagtggaca

SEQ ID NO: 482898 - DNA, 20 bp, mouse
gcgctgctggcgtggataag

SEQ ID NO: 482899 - DNA, 20 bp, mouse
ggggttgcgaactccgacgg

SEQ ID NO: 482900 - DNA, 20 bp, mouse
gtggcgagctccgactgtga

SEQ ID NO: 482901 - DNA, 20 bp, mouse
gctccaggtcgcccgcacaa

SEQ ID NO: 482902 - DNA, 20 bp, mouse
ggcgtcaagcacagagaagc

SEQ ID NO: 482903 - DNA, 20 bp, mouse
ggctgccgtaggcgaagtac

SEQ ID NO: 482904 - DNA, 20 bp, mouse
gggagggttgcgaactccga

SEQ ID NO: 482905 - DNA, 20 bp, mouse
gtccgactgtgagggccatg

SEQ ID NO: 482906 - DNA, 20 bp, mouse
gcagccatgactgcagggac

SEQ ID NO: 482907 - DNA, 20 bp, mouse
ggtccgacctggctgcagag

SEQ ID NO: 482908 - DNA, 20 bp, mouse
ggcagccaggtcggacccag

SEQ ID NO: 482909 - DNA, 20 bp, mouse
ggtgcacagccatgactgca

SEQ ID NO: 482910 - DNA, 20 bp, mouse
gggttccactgggtccgacc

SEQ ID NO: 482911 - DNA, 20 bp, mouse
gacagcaagtctaagtctgg

SEQ ID NO: 482912 - DNA, 20 bp, mouse
gcagtcatggctgtgcaccg

SEQ ID NO: 482913 - DNA, 20 bp, mouse
gggttgctcccgcctcaggt

SEQ ID NO: 482914 - DNA, 20 bp, mouse
gagcaaccagtgcggagccg

SEQ ID NO: 482915 - DNA, 20 bp, mouse
gatcagtggaagaacccagt

SEQ ID NO: 482916 - DNA, 20 bp, mouse
ggctccgagaggcccatcat

SEQ ID NO: 482917 - DNA, 20 bp, mouse
ggcgcccggcggccaggttg

SEQ ID NO: 482918 - DNA, 20 bp, mouse
ggcgagaccgcgccccaacc

SEQ ID NO: 482919 - DNA, 20 bp, mouse
gcgatcgcgatggcgaacct

SEQ ID NO: 482920 - DNA, 20 bp, mouse
gtgtagggtctggacatccc

SEQ ID NO: 482921 - DNA, 20 bp, mouse
gcctccgcccccacttaaaa

SEQ ID NO: 482922 - DNA, 20 bp, mouse
ggagaggcccatcatcggta

SEQ ID NO: 482923 - DNA, 20 bp, mouse
gagagcgcctcgcagactac

SEQ ID NO: 482924 - DNA, 20 bp, mouse
gtgggcggtgccaagctcga

SEQ ID NO: 482925 - DNA, 20 bp, mouse
gtggcacccaaagcagctag

SEQ ID NO: 482926 - DNA, 20 bp, mouse
gcagtgatctgatctttggt

SEQ ID NO: 482927 - DNA, 20 bp, mouse
gtgctggctaggaagaggga

SEQ ID NO: 482928 - DNA, 20 bp, mouse
gagagacggtgggtgatcgg

SEQ ID NO: 482929 - DNA, 20 bp, mouse
ggccccgtgggcccaaggca

SEQ ID NO: 482930 - DNA, 20 bp, mouse
gatcgacacagagagacggt

SEQ ID NO: 482931 - DNA, 20 bp, mouse
gcccagctccgcctcttaag

SEQ ID NO: 482932 - DNA, 20 bp, mouse
gtgagttgggtccacttaag

SEQ ID NO: 482933 - DNA, 20 bp, mouse
ggtgggcccaaggcagggcg

SEQ ID NO: 482934 - DNA, 20 bp, mouse
gggggcagtgatctgatctt

SEQ ID NO: 482935 - DNA, 20 bp, mouse
gtttggtcggctggaggagt

SEQ ID NO: 482936 - DNA, 20 bp, mouse
gcggttgaggtgctccgacg

SEQ ID NO: 482937 - DNA, 20 bp, mouse
gggccggccaggcgcactgg

SEQ ID NO: 482938 - DNA, 20 bp, mouse
gtccggccggccaggcgcac

SEQ ID NO: 482939 - DNA, 20 bp, mouse
gaccgcacgcgcgaccgcgt

SEQ ID NO: 482940 - DNA, 20 bp, mouse
gttggcgtccggcggaactg

SEQ ID NO: 482941 - DNA, 20 bp, mouse
ggcggaagctaaggagggaa

SEQ ID NO: 482942 - DNA, 20 bp, mouse
gccaggcgcactggcggttg

SEQ ID NO: 482943 - DNA, 20 bp, mouse
gaactgcggtagcttccggc

SEQ ID NO: 482944 - DNA, 20 bp, mouse
gtagcttccgctgggcctgg

SEQ ID NO: 482945 - DNA, 20 bp, mouse
gggcccagcggaagctaagg

SEQ ID NO: 482946 - DNA, 20 bp, mouse
gtcagactgtggtctcaacg

SEQ ID NO: 482947 - DNA, 20 bp, mouse
gcaacgtcgaggcaactctc

SEQ ID NO: 482948 - DNA, 20 bp, mouse
gatttaggtgaacaacgtcg

SEQ ID NO: 482949 - DNA, 20 bp, mouse
ggggctgcccgagttcaagg

SEQ ID NO: 482950 - DNA, 20 bp, mouse
gaccacagtctgaaggtgag

SEQ ID NO: 482951 - DNA, 20 bp, mouse
ggtgtgcccacaggtactgg

SEQ ID NO: 482952 - DNA, 20 bp, mouse
gacctggaggcaggacgaga

SEQ ID NO: 482953 - DNA, 20 bp, mouse
gagtgggctgcccgagttca

SEQ ID NO: 482954 - DNA, 20 bp, mouse
gtcaccggccaccttgaact

SEQ ID NO: 482955 - DNA, 20 bp, mouse
gtgtgggcacacagaaggca

SEQ ID NO: 482956 - DNA, 20 bp, mouse
gcagggtcgacccctcccag

SEQ ID NO: 482957 - DNA, 20 bp, mouse
ggctgacgaggcccgcgtca

SEQ ID NO: 482958 - DNA, 20 bp, mouse
gagccggtaacggggagcag

SEQ ID NO: 482959 - DNA, 20 bp, mouse
gactctgcagagccgaggca

SEQ ID NO: 482960 - DNA, 20 bp, mouse
ggccaccccgcccctgggag

SEQ ID NO: 482961 - DNA, 20 bp, mouse
gcccgcgtcagggccggcct

SEQ ID NO: 482962 - DNA, 20 bp, mouse
ggggcctcgtcagccggtaa

SEQ ID NO: 482963 - DNA, 20 bp, mouse
gcagtcagggtccaaaggag

SEQ ID NO: 482964 - DNA, 20 bp, mouse
gacactccccgtggcgcgag

SEQ ID NO: 482965 - DNA, 20 bp, mouse
ggcccaggccggccctgacg

SEQ ID NO: 482966 - DNA, 20 bp, mouse
gctgcgcagtgtgataggga

SEQ ID NO: 482967 - DNA, 20 bp, mouse
gacgcctgcgcagtgtgata

SEQ ID NO: 482968 - DNA, 20 bp, mouse
ggcgcggccatgaggcagag

SEQ ID NO: 482969 - DNA, 20 bp, mouse
gaccgtgagcaacagcgcgg

SEQ ID NO: 482970 - DNA, 20 bp, mouse
gggcactgctagtctcgtac

SEQ ID NO: 482971 - DNA, 20 bp, mouse
ggatttctgtgtgaaatagt

SEQ ID NO: 482972 - DNA, 20 bp, mouse
gaaaagaaagggctccacac

SEQ ID NO: 482973 - DNA, 20 bp, mouse
gcaacagcgcggtggcaggg

SEQ ID NO: 482974 - DNA, 20 bp, mouse
gggccgggtgctgggatgag

SEQ ID NO: 482975 - DNA, 20 bp, mouse
ggccaccgcgctgttgctca

SEQ ID NO: 482976 - DNA, 20 bp, mouse
ggggcatctgacacagcggg

SEQ ID NO: 482977 - DNA, 20 bp, mouse
ggttaggacttgttgacctt

SEQ ID NO: 482978 - DNA, 20 bp, mouse
gacagcgggtggctcagact

SEQ ID NO: 482979 - DNA, 20 bp, mouse
ggctggtagaggtttgtgga

SEQ ID NO: 482980 - DNA, 20 bp, mouse
gtaagtcgcagggaggttgt

SEQ ID NO: 482981 - DNA, 20 bp, mouse
gcacagcctcctggaccaca

SEQ ID NO: 482982 - DNA, 20 bp, mouse
gcttgggcatctgacacagc

SEQ ID NO: 482983 - DNA, 20 bp, mouse
gagtgaggagaccaggacat

SEQ ID NO: 482984 - DNA, 20 bp, mouse
gccaggacatgggtaagaca

SEQ ID NO: 482985 - DNA, 20 bp, mouse
ggtcgcagggaggttgtggg

SEQ ID NO: 482986 - DNA, 20 bp, mouse
gcgcaagtgtggagctgaga

SEQ ID NO: 482987 - DNA, 20 bp, mouse
gcagcagctcagagacgatg

SEQ ID NO: 482988 - DNA, 20 bp, mouse
gagctcagagacgatgagga

SEQ ID NO: 482989 - DNA, 20 bp, mouse
ggaacgcagcagcacgtgtc

SEQ ID NO: 482990 - DNA, 20 bp, mouse
ggtggctacacagagactct

SEQ ID NO: 482991 - DNA, 20 bp, mouse
gcccctgggttcacacaggt

SEQ ID NO: 482992 - DNA, 20 bp, mouse
gacactccaggataacgggg

SEQ ID NO: 482993 - DNA, 20 bp, mouse
gaccacactccaggataacg

SEQ ID NO: 482994 - DNA, 20 bp, mouse
gtgtgaacccagggggacca

SEQ ID NO: 482995 - DNA, 20 bp, mouse
gctgtcccatgccattccag

SEQ ID NO: 482996 - DNA, 20 bp, mouse
gctgctacactctcctccag

SEQ ID NO: 482997 - DNA, 20 bp, mouse
gatagacagacggcaggctg

SEQ ID NO: 482998 - DNA, 20 bp, mouse
gggaggcaactggacacaca

SEQ ID NO: 482999 - DNA, 20 bp, mouse
gacctacacccagcaggacc

SEQ ID NO: 483000 - DNA, 20 bp, mouse
gttatggatagacagacggc

SEQ ID NO: 483001 - DNA, 20 bp, mouse
gagctacacagggtgatctc

SEQ ID NO: 483002 - DNA, 20 bp, mouse
ggcctggccacctatctgta

SEQ ID NO: 483003 - DNA, 20 bp, mouse
gacagaggggaaagatcgat

SEQ ID NO: 483004 - DNA, 20 bp, mouse
gtctgtctatccataaaccc

SEQ ID NO: 483005 - DNA, 20 bp, mouse
ggaccacaagaggcttgacg

SEQ ID NO: 483006 - DNA, 20 bp, mouse
gagctatagactaagaggtg

SEQ ID NO: 483007 - DNA, 20 bp, mouse
gggctctcggcaaagatctg

SEQ ID NO: 483008 - DNA, 20 bp, mouse
gtccttagggagaggaccag

SEQ ID NO: 483009 - DNA, 20 bp, mouse
gctcaggtctctaggaatcg

SEQ ID NO: 483010 - DNA, 20 bp, mouse
gactatagctatagactaag

SEQ ID NO: 483011 - DNA, 20 bp, mouse
gcaaagctactcaggtctct

SEQ ID NO: 483012 - DNA, 20 bp, mouse
gagagccccgagtcctaacg

SEQ ID NO: 483013 - DNA, 20 bp, mouse
gtagtgcacaggtcctgtgg

SEQ ID NO: 483014 - DNA, 20 bp, mouse
ggactgagccagtcagtcag

SEQ ID NO: 483015 - DNA, 20 bp, mouse
gtgagatcccaaagctactc

SEQ ID NO: 483016 - DNA, 20 bp, mouse
gaggatggcggctgagaacg

SEQ ID NO: 483017 - DNA, 20 bp, mouse
gctagccaggagagcgccct

SEQ ID NO: 483018 - DNA, 20 bp, mouse
gggggttagggcgaggatgg

SEQ ID NO: 483019 - DNA, 20 bp, mouse
gactggtgagtaggcgccta

SEQ ID NO: 483020 - DNA, 20 bp, mouse
ggcaggcgctgcgctgctgg

SEQ ID NO: 483021 - DNA, 20 bp, mouse
gctgggggttagggcgagga

SEQ ID NO: 483022 - DNA, 20 bp, mouse
gaacagggctgaggaagaag

SEQ ID NO: 483023 - DNA, 20 bp, mouse
gggatgctcagaacaggagg

SEQ ID NO: 483024 - DNA, 20 bp, mouse
gcgctgcgctgctgggggtt

SEQ ID NO: 483025 - DNA, 20 bp, mouse
ggccggaagtggcagtgaag

SEQ ID NO: 483026 - DNA, 20 bp, mouse
ggcacccgcagcgaccgcaa

SEQ ID NO: 483027 - DNA, 20 bp, mouse
gcccgcagcgaccgcaacgg

SEQ ID NO: 483028 - DNA, 20 bp, mouse
ggcgaccgcaacggcggaca

SEQ ID NO: 483029 - DNA, 20 bp, mouse
ggtgccggggcggggaaaac

SEQ ID NO: 483030 - DNA, 20 bp, mouse
gacccgaggccccgcctcta

SEQ ID NO: 483031 - DNA, 20 bp, mouse
ggaaaacaggtcgaccctag

SEQ ID NO: 483032 - DNA, 20 bp, mouse
gccgaggagcggcgcaagag

SEQ ID NO: 483033 - DNA, 20 bp, mouse
gaacaggtcgaccctagagg

SEQ ID NO: 483034 - DNA, 20 bp, mouse
gcgctgaagacaaggggtaa

SEQ ID NO: 483035 - DNA, 20 bp, mouse
ggcggtcgctgcgggtgccg

SEQ ID NO: 483036 - DNA, 20 bp, mouse
ggcgctctcaggctctgggt

SEQ ID NO: 483037 - DNA, 20 bp, mouse
gtcaggctctgggtaggcaa

SEQ ID NO: 483038 - DNA, 20 bp, mouse
gtgggtaggcaaaggcgagg

SEQ ID NO: 483039 - DNA, 20 bp, mouse
ggtgtcagccagctaagaaa

SEQ ID NO: 483040 - DNA, 20 bp, mouse
gacctccgggcgaatgaaag

SEQ ID NO: 483041 - DNA, 20 bp, mouse
ggcgaggtcttcagcagaat

SEQ ID NO: 483042 - DNA, 20 bp, mouse
gccctggacaacccgagcca

SEQ ID NO: 483043 - DNA, 20 bp, mouse
gcattcgcccggaggtagat

SEQ ID NO: 483044 - DNA, 20 bp, mouse
gcccgcacgcggctcccatc

SEQ ID NO: 483045 - DNA, 20 bp, mouse
ggccccaaatggcctaggag

SEQ ID NO: 483046 - DNA, 20 bp, mouse
gcaagcagtgatctgtccac

SEQ ID NO: 483047 - DNA, 20 bp, mouse
gacagatcactgcttggcaa

SEQ ID NO: 483048 - DNA, 20 bp, mouse
ggcccctgaagatggatctg

SEQ ID NO: 483049 - DNA, 20 bp, mouse
gggtcccaaaccacacccag

SEQ ID NO: 483050 - DNA, 20 bp, mouse
gcgtttgtggaagcaggaag

SEQ ID NO: 483051 - DNA, 20 bp, mouse
ggcagagcaggctgacggtc

SEQ ID NO: 483052 - DNA, 20 bp, mouse
ggatctctcccaatccccat

SEQ ID NO: 483053 - DNA, 20 bp, mouse
gtagaaaacagactggacaa

SEQ ID NO: 483054 - DNA, 20 bp, mouse
ggccatgttgggaatactct

SEQ ID NO: 483055 - DNA, 20 bp, mouse
ggaatactctgggtccctat

SEQ ID NO: 483056 - DNA, 20 bp, mouse
gagcaccccgggacccctca

SEQ ID NO: 483057 - DNA, 20 bp, mouse
gctgcgaccagacacactga

SEQ ID NO: 483058 - DNA, 20 bp, mouse
ggacacactgagggaccctg

SEQ ID NO: 483059 - DNA, 20 bp, mouse
gccctccttcgtaagaggag

SEQ ID NO: 483060 - DNA, 20 bp, mouse
ggggaccctgaggggtcccg

SEQ ID NO: 483061 - DNA, 20 bp, mouse
gctactgggaaacgggacca

SEQ ID NO: 483062 - DNA, 20 bp, mouse
gcctgactgggaggacccgg

SEQ ID NO: 483063 - DNA, 20 bp, mouse
gcagccctctcctcttacga

SEQ ID NO: 483064 - DNA, 20 bp, mouse
gtgcttactttcagcacccc

SEQ ID NO: 483065 - DNA, 20 bp, mouse
gaatctggcatcctactaac

SEQ ID NO: 483066 - DNA, 20 bp, mouse
ggagtttcggtgacccggaa

SEQ ID NO: 483067 - DNA, 20 bp, mouse
ggaagggagccccgtggtag

SEQ ID NO: 483068 - DNA, 20 bp, mouse
gctccggtcacctctaccac

SEQ ID NO: 483069 - DNA, 20 bp, mouse
gcgcgcggttgcggaggagc

SEQ ID NO: 483070 - DNA, 20 bp, mouse
gttgcggaggagcgggcaga

SEQ ID NO: 483071 - DNA, 20 bp, mouse
ggtagaggtgaccggagctg

SEQ ID NO: 483072 - DNA, 20 bp, mouse
gggtcgcacactctgagttt

SEQ ID NO: 483073 - DNA, 20 bp, mouse
ggtgagtcgcgcggttgcgg

SEQ ID NO: 483074 - DNA, 20 bp, mouse
ggccccgtggtagaggtgac

SEQ ID NO: 483075 - DNA, 20 bp, mouse
gctcaaggaagcgttaggaa

SEQ ID NO: 483076 - DNA, 20 bp, mouse
ggaggaggcggtctagggag

SEQ ID NO: 483077 - DNA, 20 bp, mouse
ggcggcggcactggcagagg

SEQ ID NO: 483078 - DNA, 20 bp, mouse
gccaagcagggcgcagccat

SEQ ID NO: 483079 - DNA, 20 bp, mouse
ggaggcggctgctacagcgg

SEQ ID NO: 483080 - DNA, 20 bp, mouse
gagggcgcagccatgggaag

SEQ ID NO: 483081 - DNA, 20 bp, mouse
gtgggaagaggaggcggtct

SEQ ID NO: 483082 - DNA, 20 bp, mouse
ggtctagggagcggcggcac

SEQ ID NO: 483083 - DNA, 20 bp, mouse
ggagacctgggagtagaccc

SEQ ID NO: 483084 - DNA, 20 bp, mouse
gacccacgagctgccaagca

SEQ ID NO: 483085 - DNA, 20 bp, mouse
gctcccgaggcgaaactccg

SEQ ID NO: 483086 - DNA, 20 bp, mouse
gtgagcagggagccgcaacc

SEQ ID NO: 483087 - DNA, 20 bp, mouse
gccaggagagacctgcgacc

SEQ ID NO: 483088 - DNA, 20 bp, mouse
ggtcagggcctgggcatcac

SEQ ID NO: 483089 - DNA, 20 bp, mouse
gcatcactggtgatccaggc

SEQ ID NO: 483090 - DNA, 20 bp, mouse
gtgggcatcactggtgatcc

SEQ ID NO: 483091 - DNA, 20 bp, mouse
gccttaagatgagatcgtca

SEQ ID NO: 483092 - DNA, 20 bp, mouse
gggatattgtccctcagtag

SEQ ID NO: 483093 - DNA, 20 bp, mouse
gggaactgcatagcctgggt

SEQ ID NO: 483094 - DNA, 20 bp, mouse
gccgtgcacttcacaaggaa

SEQ ID NO: 483095 - DNA, 20 bp, mouse
gggccggctctccaggtcgc

SEQ ID NO: 483096 - DNA, 20 bp, mouse
ggccatggatggcctgatgt

SEQ ID NO: 483097 - DNA, 20 bp, mouse
ggcccacatcaggccatcca

SEQ ID NO: 483098 - DNA, 20 bp, mouse
gatcaggccatccatggcaa

SEQ ID NO: 483099 - DNA, 20 bp, mouse
gttccctcccaggctgtctc

SEQ ID NO: 483100 - DNA, 20 bp, mouse
gctccctggcctgtgtatag

SEQ ID NO: 483101 - DNA, 20 bp, mouse
gctaatgttaggaccatgtg

SEQ ID NO: 483102 - DNA, 20 bp, mouse
gccaccacccaagagaacaa

SEQ ID NO: 483103 - DNA, 20 bp, mouse
gatggtcctaacattagtca

SEQ ID NO: 483104 - DNA, 20 bp, mouse
ggatacgggtagcccacatc

SEQ ID NO: 483105 - DNA, 20 bp, mouse
gtcccagtagcaactggtgt

SEQ ID NO: 483106 - DNA, 20 bp, mouse
gggatgtggtgcctgctcac

SEQ ID NO: 483107 - DNA, 20 bp, mouse
gatcaggctcctgagggcaa

SEQ ID NO: 483108 - DNA, 20 bp, mouse
gacagctaagagagcttacc

SEQ ID NO: 483109 - DNA, 20 bp, mouse
gccacatccccaggcattcc

SEQ ID NO: 483110 - DNA, 20 bp, mouse
gtctgtcatcaggctcctga

SEQ ID NO: 483111 - DNA, 20 bp, mouse
gacagagcctgatgtgatag

SEQ ID NO: 483112 - DNA, 20 bp, mouse
gctagcctgagcaaattcta

SEQ ID NO: 483113 - DNA, 20 bp, mouse
gtgaacatgcaagctcaccg

SEQ ID NO: 483114 - DNA, 20 bp, mouse
gtaagtgtcagtgagctcac

SEQ ID NO: 483115 - DNA, 20 bp, mouse
gtggtgaggacagatgacct

SEQ ID NO: 483116 - DNA, 20 bp, mouse
gacgctgtggggagcacgac

SEQ ID NO: 483117 - DNA, 20 bp, mouse
ggcgccgccgatagagtgac

SEQ ID NO: 483118 - DNA, 20 bp, mouse
gcctaggaggacctcctcag

SEQ ID NO: 483119 - DNA, 20 bp, mouse
gggaggaacggaaggaaata

SEQ ID NO: 483120 - DNA, 20 bp, mouse
gttacctgtcactctatcgg

SEQ ID NO: 483121 - DNA, 20 bp, mouse
ggggagcacgacaggctgct

SEQ ID NO: 483122 - DNA, 20 bp, mouse
gcggcgccaccagcagtgcc

SEQ ID NO: 483123 - DNA, 20 bp, mouse
gccacgcactcggacgctgt

SEQ ID NO: 483124 - DNA, 20 bp, mouse
gtccgagtgcgtgggctctg

SEQ ID NO: 483125 - DNA, 20 bp, mouse
gcctaggcgcggaagagtgg

SEQ ID NO: 483126 - DNA, 20 bp, mouse
gtgtacccgcgagggcaagt

SEQ ID NO: 483127 - DNA, 20 bp, mouse
ggcaggtctccgggtccagg

SEQ ID NO: 483128 - DNA, 20 bp, mouse
gggagacccagctcaggtct

SEQ ID NO: 483129 - DNA, 20 bp, mouse
ggggaagggagacccagctc

SEQ ID NO: 483130 - DNA, 20 bp, mouse
gacccggagacctgcaagca

SEQ ID NO: 483131 - DNA, 20 bp, mouse
ggccctgcttgcaggtctcc

SEQ ID NO: 483132 - DNA, 20 bp, mouse
gccaccagcttgctctacag

SEQ ID NO: 483133 - DNA, 20 bp, mouse
gtggcgcgggcgcgctggag

SEQ ID NO: 483134 - DNA, 20 bp, mouse
gtgtgtgtgtgtacccgcga

SEQ ID NO: 483135 - DNA, 20 bp, mouse
gctgcggggagggcggaccc

SEQ ID NO: 483136 - DNA, 20 bp, mouse
ggagactgcggagatagagg

SEQ ID NO: 483137 - DNA, 20 bp, mouse
gctcgcgagaggtgtctgag

SEQ ID NO: 483138 - DNA, 20 bp, mouse
gggagcggaggtagctacac

SEQ ID NO: 483139 - DNA, 20 bp, mouse
ggcagagactgcggagatag

SEQ ID NO: 483140 - DNA, 20 bp, mouse
ggtgtctgaggggccgacgc

SEQ ID NO: 483141 - DNA, 20 bp, mouse
ggaggtagctacaccggcgt

SEQ ID NO: 483142 - DNA, 20 bp, mouse
gggaggggcggcagagactg

SEQ ID NO: 483143 - DNA, 20 bp, mouse
gtgcgacagtgtctgggtgg

SEQ ID NO: 483144 - DNA, 20 bp, mouse
gccacggccgggccccggag

SEQ ID NO: 483145 - DNA, 20 bp, mouse
ggcaagagcggggatcgggg

SEQ ID NO: 483146 - DNA, 20 bp, mouse
gaaggagcagacccctccag

SEQ ID NO: 483147 - DNA, 20 bp, mouse
ggttcgtggaaagggagacg

SEQ ID NO: 483148 - DNA, 20 bp, mouse
gaagaggtggacataagaca

SEQ ID NO: 483149 - DNA, 20 bp, mouse
gagggagacgtggacaggca

SEQ ID NO: 483150 - DNA, 20 bp, mouse
gcacagcccagagaacactt

SEQ ID NO: 483151 - DNA, 20 bp, mouse
ggacgtggacaggcatggct

SEQ ID NO: 483152 - DNA, 20 bp, mouse
ggaggaacagcagtcactat

SEQ ID NO: 483153 - DNA, 20 bp, mouse
gtagcaaacactagtgttcg

SEQ ID NO: 483154 - DNA, 20 bp, mouse
gaggtggacataagacaggg

SEQ ID NO: 483155 - DNA, 20 bp, mouse
gacactagtgttcgtggaaa

SEQ ID NO: 483156 - DNA, 20 bp, mouse
gaagcatcgaagctccacaa

SEQ ID NO: 483157 - DNA, 20 bp, mouse
ggagcttcgatgcttctcaa

SEQ ID NO: 483158 - DNA, 20 bp, mouse
gtcctccgggacctgggatg

SEQ ID NO: 483159 - DNA, 20 bp, mouse
gacgctgccaccactcgaaa

SEQ ID NO: 483160 - DNA, 20 bp, mouse
ggacttgtctgtgaccctac

SEQ ID NO: 483161 - DNA, 20 bp, mouse
gggctgagagccctttcgag

SEQ ID NO: 483162 - DNA, 20 bp, mouse
gtatttggacagtactctcc

SEQ ID NO: 483163 - DNA, 20 bp, mouse
gactcaactttgggcctgag

SEQ ID NO: 483164 - DNA, 20 bp, mouse
gtgagagccctttcgagtgg

SEQ ID NO: 483165 - DNA, 20 bp, mouse
gtactgtccaaatacctgta

SEQ ID NO: 483166 - DNA, 20 bp, mouse
gccggaccgcaggtaaccag

SEQ ID NO: 483167 - DNA, 20 bp, mouse
gtgaggctgaggattgactt

SEQ ID NO: 483168 - DNA, 20 bp, mouse
gccgagccactggttacctg

SEQ ID NO: 483169 - DNA, 20 bp, mouse
ggttacctgcggtccgggac

SEQ ID NO: 483170 - DNA, 20 bp, mouse
ggagacacacaccgagccac

SEQ ID NO: 483171 - DNA, 20 bp, mouse
gcagcctcaacaacacaaga

SEQ ID NO: 483172 - DNA, 20 bp, mouse
gcggccgcatggacacactc

SEQ ID NO: 483173 - DNA, 20 bp, mouse
gactgccgggaccctcgcac

SEQ ID NO: 483174 - DNA, 20 bp, mouse
gcgagggtcccggcagtcca

SEQ ID NO: 483175 - DNA, 20 bp, mouse
gttctgagagactcctgtcc

SEQ ID NO: 483176 - DNA, 20 bp, mouse
gcacaagcgaagggaaggcg

SEQ ID NO: 483177 - DNA, 20 bp, mouse
ggcactcacaagcgaaggga

SEQ ID NO: 483178 - DNA, 20 bp, mouse
ggcttctctgggtcacttca

SEQ ID NO: 483179 - DNA, 20 bp, mouse
ggcgaagggaaggcgaggcc

SEQ ID NO: 483180 - DNA, 20 bp, mouse
gcgtgcatcacaggcaaggg

SEQ ID NO: 483181 - DNA, 20 bp, mouse
gttctgcactcacaagcgaa

SEQ ID NO: 483182 - DNA, 20 bp, mouse
gccgagcgagcgtgcatcac

SEQ ID NO: 483183 - DNA, 20 bp, mouse
ggagcgtgcatcacaggcaa

SEQ ID NO: 483184 - DNA, 20 bp, mouse
ggcttccggatgcgttagga

SEQ ID NO: 483185 - DNA, 20 bp, mouse
gggatgcgttaggatggcct

SEQ ID NO: 483186 - DNA, 20 bp, mouse
gggaagacggtgtctcctga

SEQ ID NO: 483187 - DNA, 20 bp, mouse
ggtctcctgaggggtgggaa

SEQ ID NO: 483188 - DNA, 20 bp, mouse
ggacggtgtctcctgagggg

SEQ ID NO: 483189 - DNA, 20 bp, mouse
gctggaaggtagctccacag

SEQ ID NO: 483190 - DNA, 20 bp, mouse
gaccactgaggactcaggag

SEQ ID NO: 483191 - DNA, 20 bp, mouse
gtcaccctttcccacccctc

SEQ ID NO: 483192 - DNA, 20 bp, mouse
ggaggctgcctaggcctgga

SEQ ID NO: 483193 - DNA, 20 bp, mouse
gaaagtacaagagctacaag

SEQ ID NO: 483194 - DNA, 20 bp, mouse
gcactgaagaaggcagccag

SEQ ID NO: 483195 - DNA, 20 bp, mouse
gccaggtaacagggatcttg

SEQ ID NO: 483196 - DNA, 20 bp, mouse
gagaatagggatggatgatg

SEQ ID NO: 483197 - DNA, 20 bp, mouse
gcgaaatcagagaaggtcaa

SEQ ID NO: 483198 - DNA, 20 bp, mouse
gttctcttacctgaaaatct

SEQ ID NO: 483199 - DNA, 20 bp, mouse
gattttcaggtaagagaata

SEQ ID NO: 483200 - DNA, 20 bp, mouse
gatgatgtgggtgttgaatt

SEQ ID NO: 483201 - DNA, 20 bp, mouse
gctagacacagctagtagag

SEQ ID NO: 483202 - DNA, 20 bp, mouse
gagggttcgctgctttgagg

SEQ ID NO: 483203 - DNA, 20 bp, mouse
ggatgcggaggatccctaac

SEQ ID NO: 483204 - DNA, 20 bp, mouse
gtcccaagagcaggtctgtc

SEQ ID NO: 483205 - DNA, 20 bp, mouse
gtcaaaggacccagattttc

SEQ ID NO: 483206 - DNA, 20 bp, mouse
ggtcggcgacagcatagagt

SEQ ID NO: 483207 - DNA, 20 bp, mouse
gccatgaatccagagtccga

SEQ ID NO: 483208 - DNA, 20 bp, mouse
gagagcagtgaattgagggt

SEQ ID NO: 483209 - DNA, 20 bp, mouse
gcgaggggatatagtctgca

SEQ ID NO: 483210 - DNA, 20 bp, mouse
ggtgtgtattccgtcaccat

SEQ ID NO: 483211 - DNA, 20 bp, mouse
ggcccaccgcatacctgtaa

SEQ ID NO: 483212 - DNA, 20 bp, mouse
gacccttacaggtatgcggt

SEQ ID NO: 483213 - DNA, 20 bp, mouse
ggaatccagagtccgaaggc

SEQ ID NO: 483214 - DNA, 20 bp, mouse
gggtaaagaggaacccgcca

SEQ ID NO: 483215 - DNA, 20 bp, mouse
gagggagccgctgtgcactc

SEQ ID NO: 483216 - DNA, 20 bp, mouse
gggctggctgacaggcaaga

SEQ ID NO: 483217 - DNA, 20 bp, mouse
gaccagtgctactgaagtcg

SEQ ID NO: 483218 - DNA, 20 bp, mouse
gcagcgagctgctattttga

SEQ ID NO: 483219 - DNA, 20 bp, mouse
gcatactgggacttaccact

SEQ ID NO: 483220 - DNA, 20 bp, mouse
gctttcaatccatattttgt

SEQ ID NO: 483221 - DNA, 20 bp, mouse
ggaaaaacactcgggtccat

SEQ ID NO: 483222 - DNA, 20 bp, mouse
gcttcagtagcactggtctc

SEQ ID NO: 483223 - DNA, 20 bp, mouse
gctgggacttaccactgggc

SEQ ID NO: 483224 - DNA, 20 bp, mouse
gtcgctgtgcaatgagaaac

SEQ ID NO: 483225 - DNA, 20 bp, mouse
gtctgaaagaatgaatagaa

SEQ ID NO: 483226 - DNA, 20 bp, mouse
gagaaggtgtgagaactcaa

SEQ ID NO: 483227 - DNA, 20 bp, mouse
gccctacccggcatgctctg

SEQ ID NO: 483228 - DNA, 20 bp, mouse
gacccagcttacctcctgca

SEQ ID NO: 483229 - DNA, 20 bp, mouse
ggagaactcaaaggccctgc

SEQ ID NO: 483230 - DNA, 20 bp, mouse
gaccacccccatcccctacc

SEQ ID NO: 483231 - DNA, 20 bp, mouse
gcaacagcttctaatgacat

SEQ ID NO: 483232 - DNA, 20 bp, mouse
ggtgctcagggtttgcagaa

SEQ ID NO: 483233 - DNA, 20 bp, mouse
gagcatgccgggtaggggat

SEQ ID NO: 483234 - DNA, 20 bp, mouse
gcagtcagattctttgaaga

SEQ ID NO: 483235 - DNA, 20 bp, mouse
gagatctgcctcagggacag

SEQ ID NO: 483236 - DNA, 20 bp, mouse
ggtgctctgagctccttctc

SEQ ID NO: 483237 - DNA, 20 bp, mouse
gagagcacataggatgaaca

SEQ ID NO: 483238 - DNA, 20 bp, mouse
gcataggatgaacacggaag

SEQ ID NO: 483239 - DNA, 20 bp, mouse
ggaagctgtgaagcatcagt

SEQ ID NO: 483240 - DNA, 20 bp, mouse
gtcctcctgccagggagact

SEQ ID NO: 483241 - DNA, 20 bp, mouse
gtggcgacttcatcccacca

SEQ ID NO: 483242 - DNA, 20 bp, mouse
gcctgcagctgctccttggt

SEQ ID NO: 483243 - DNA, 20 bp, mouse
gcacggaaggggcttaggga

SEQ ID NO: 483244 - DNA, 20 bp, mouse
ggtgaagcatcagtaggaca

SEQ ID NO: 483245 - DNA, 20 bp, mouse
ggcctgccaggaggtctgtg

SEQ ID NO: 483246 - DNA, 20 bp, mouse
gccctgacaggaagttctat

SEQ ID NO: 483247 - DNA, 20 bp, mouse
gacttcctgtcagggaatga

SEQ ID NO: 483248 - DNA, 20 bp, mouse
ggagcgagggagctgtgaga

SEQ ID NO: 483249 - DNA, 20 bp, mouse
gcagggaggaagctgctggg

SEQ ID NO: 483250 - DNA, 20 bp, mouse
gtgacaggaagttctatggg

SEQ ID NO: 483251 - DNA, 20 bp, mouse
ggtggaggctaagagatata

SEQ ID NO: 483252 - DNA, 20 bp, mouse
ggcgaatggagcatctatgg

SEQ ID NO: 483253 - DNA, 20 bp, mouse
gccaaggaaccaatttgacc

SEQ ID NO: 483254 - DNA, 20 bp, mouse
gaggcaggttcgttagagtt

SEQ ID NO: 483255 - DNA, 20 bp, mouse
gaacttgaaccaggtcaaat

SEQ ID NO: 483256 - DNA, 20 bp, mouse
gaagtggtcctaagtgcaaa

SEQ ID NO: 483257 - DNA, 20 bp, mouse
ggaacgaccactcaccgaag

SEQ ID NO: 483258 - DNA, 20 bp, mouse
ggcaccagataaatcgcgag

SEQ ID NO: 483259 - DNA, 20 bp, mouse
gtatctggtgctaccggaag

SEQ ID NO: 483260 - DNA, 20 bp, mouse
gggtcctaagtgcaaacggc

SEQ ID NO: 483261 - DNA, 20 bp, mouse
ggtccttagagcagtcgaag

SEQ ID NO: 483262 - DNA, 20 bp, mouse
gagcgggacctagccctcag

SEQ ID NO: 483263 - DNA, 20 bp, mouse
gaggactgttgggctcaggg

SEQ ID NO: 483264 - DNA, 20 bp, mouse
gttaggaccacttcggtgag

SEQ ID NO: 483265 - DNA, 20 bp, mouse
gggacgggtttgactagcgg

SEQ ID NO: 483266 - DNA, 20 bp, mouse
ggcaacaaccggacggacag

SEQ ID NO: 483267 - DNA, 20 bp, mouse
gccggtgttgtccaagatgg

SEQ ID NO: 483268 - DNA, 20 bp, mouse
gtgttgtccaagatggaggg

SEQ ID NO: 483269 - DNA, 20 bp, mouse
gatgaacagcaacaaccgga

SEQ ID NO: 483270 - DNA, 20 bp, mouse
ggacaggccgccctccatct

SEQ ID NO: 483271 - DNA, 20 bp, mouse
ggggccggtgttgtccaaga

SEQ ID NO: 483272 - DNA, 20 bp, mouse
gccgccgggagagaaagggg

SEQ ID NO: 483273 - DNA, 20 bp, mouse
gcgctatgaacagcaacaac

SEQ ID NO: 483274 - DNA, 20 bp, mouse
gttggtggtcagccatcccg

SEQ ID NO: 483275 - DNA, 20 bp, mouse
ggctgtccacctgcgggagg

SEQ ID NO: 483276 - DNA, 20 bp, mouse
gaatagaagtgccgcggcct

SEQ ID NO: 483277 - DNA, 20 bp, mouse
gagcaaccagctcctcgctt

SEQ ID NO: 483278 - DNA, 20 bp, mouse
gctgaacaatagaagtgccg

SEQ ID NO: 483279 - DNA, 20 bp, mouse
gcaaacggtcgctagttccc

SEQ ID NO: 483280 - DNA, 20 bp, mouse
gtggcgccaaagcgaggagc

SEQ ID NO: 483281 - DNA, 20 bp, mouse
gtgaaacggggccaaatcgt

SEQ ID NO: 483282 - DNA, 20 bp, mouse
ggttacaccgcgcgccggaa

SEQ ID NO: 483283 - DNA, 20 bp, mouse
gagcaagcaacagcaggcat

SEQ ID NO: 483284 - DNA, 20 bp, mouse
gtggcagttgacgggaccac

SEQ ID NO: 483285 - DNA, 20 bp, mouse
gcctatttggcgccaaagcg

SEQ ID NO: 483286 - DNA, 20 bp, mouse
gggccgcctactcttcaaca

SEQ ID NO: 483287 - DNA, 20 bp, mouse
gctgcctctgagtcgcggag

SEQ ID NO: 483288 - DNA, 20 bp, mouse
gcgcatccatgttgaagagt

SEQ ID NO: 483289 - DNA, 20 bp, mouse
gtcggccaaaaactccacct

SEQ ID NO: 483290 - DNA, 20 bp, mouse
gaacatggatgcggccgagg

SEQ ID NO: 483291 - DNA, 20 bp, mouse
gccattccggaggtaacagg

SEQ ID NO: 483292 - DNA, 20 bp, mouse
ggccctggctcaccccgatc

SEQ ID NO: 483293 - DNA, 20 bp, mouse
gccgcccctccgcgactcag

SEQ ID NO: 483294 - DNA, 20 bp, mouse
gaggcgctgcctctgagtcg

SEQ ID NO: 483295 - DNA, 20 bp, mouse
gttcaacatggatgcggccg

SEQ ID NO: 483296 - DNA, 20 bp, mouse
ggcagctcgcagcacagtca

SEQ ID NO: 483297 - DNA, 20 bp, mouse
ggcgccacctcagcgaacta

SEQ ID NO: 483298 - DNA, 20 bp, mouse
ggggaaatacgcctcggaca

SEQ ID NO: 483299 - DNA, 20 bp, mouse
gagccggccctagttcgctg

SEQ ID NO: 483300 - DNA, 20 bp, mouse
gtccgaggcgtatttcccag

SEQ ID NO: 483301 - DNA, 20 bp, mouse
gctgcgagctgccatgtccg

SEQ ID NO: 483302 - DNA, 20 bp, mouse
gaggcggtgggagtcctcgg

SEQ ID NO: 483303 - DNA, 20 bp, mouse
gtccactgggaaatacgcct

SEQ ID NO: 483304 - DNA, 20 bp, mouse
gcggccctagttcgctgagg

SEQ ID NO: 483305 - DNA, 20 bp, mouse
gggtgaggcgagcccggccg

SEQ ID NO: 483306 - DNA, 20 bp, mouse
gccacagacccgaccagcag

SEQ ID NO: 483307 - DNA, 20 bp, mouse
gcgtgccggctaggagagaa

SEQ ID NO: 483308 - DNA, 20 bp, mouse
ggagctgtaccgctgctggt

SEQ ID NO: 483309 - DNA, 20 bp, mouse
gagatcgcgcggaaagcccg

SEQ ID NO: 483310 - DNA, 20 bp, mouse
gctgaggctccccgagcggt

SEQ ID NO: 483311 - DNA, 20 bp, mouse
ggcacgctcgggggacacca

SEQ ID NO: 483312 - DNA, 20 bp, mouse
ggtgggcgccggagatcgcg

SEQ ID NO: 483313 - DNA, 20 bp, mouse
gcggactgaggctccccgag

SEQ ID NO: 483314 - DNA, 20 bp, mouse
gccatgcagcgggaaagatt

SEQ ID NO: 483315 - DNA, 20 bp, mouse
gcccgggtcagttgcagctg

SEQ ID NO: 483316 - DNA, 20 bp, mouse
gctgagagccaacaggtagg

SEQ ID NO: 483317 - DNA, 20 bp, mouse
gttagctcttccaggagggc

SEQ ID NO: 483318 - DNA, 20 bp, mouse
gtcttcttagctcttccagg

SEQ ID NO: 483319 - DNA, 20 bp, mouse
gcaagatcctgagagccaac

SEQ ID NO: 483320 - DNA, 20 bp, mouse
ggaagactagagctggccca

SEQ ID NO: 483321 - DNA, 20 bp, mouse
gagacctcatcctgccctcc

SEQ ID NO: 483322 - DNA, 20 bp, mouse
gagagctaagaagaactgtt

SEQ ID NO: 483323 - DNA, 20 bp, mouse
gacaccaagacagggtcttg

SEQ ID NO: 483324 - DNA, 20 bp, mouse
gagttcttcttagctcttcc

SEQ ID NO: 483325 - DNA, 20 bp, mouse
gggttggcccaggacgaagt

SEQ ID NO: 483326 - DNA, 20 bp, mouse
gagccgggcggagtttcgag

SEQ ID NO: 483327 - DNA, 20 bp, mouse
ggccctggaggccgcccccc

SEQ ID NO: 483328 - DNA, 20 bp, mouse
gctggaggccgccccccggg

SEQ ID NO: 483329 - DNA, 20 bp, mouse
gtgagtgtcccccgcccggg

SEQ ID NO: 483330 - DNA, 20 bp, mouse
gcggaggcccagggagaagc

SEQ ID NO: 483331 - DNA, 20 bp, mouse
gcccaagtcccggaggccca

SEQ ID NO: 483332 - DNA, 20 bp, mouse
gccgccacggctccacgccc

SEQ ID NO: 483333 - DNA, 20 bp, mouse
gctcccaggacgctccctgt

SEQ ID NO: 483334 - DNA, 20 bp, mouse
gggccccgcccaagtcccgg

SEQ ID NO: 483335 - DNA, 20 bp, mouse
gcaccaacagggagcgtcct

SEQ ID NO: 483336 - DNA, 20 bp, mouse
gcggcatcttgcaggtccca

SEQ ID NO: 483337 - DNA, 20 bp, mouse
gtcttcccgcgcagtccaag

SEQ ID NO: 483338 - DNA, 20 bp, mouse
gccatccgaggtaagcacag

SEQ ID NO: 483339 - DNA, 20 bp, mouse
gcgcaggtggtccacgccct

SEQ ID NO: 483340 - DNA, 20 bp, mouse
gaagaaggcggccaagtcca

SEQ ID NO: 483341 - DNA, 20 bp, mouse
gggctccgcgcaggtgacag

SEQ ID NO: 483342 - DNA, 20 bp, mouse
ggatgccgcttggactgcgc

SEQ ID NO: 483343 - DNA, 20 bp, mouse
gcccacaagccggatctgag

SEQ ID NO: 483344 - DNA, 20 bp, mouse
gtgagcgcccagattctgaa

SEQ ID NO: 483345 - DNA, 20 bp, mouse
gctcgcggcctccttggact

SEQ ID NO: 483346 - DNA, 20 bp, mouse
ggccggaggtcccgcgacag

SEQ ID NO: 483347 - DNA, 20 bp, mouse
gcagcggagccgggcgtaag

SEQ ID NO: 483348 - DNA, 20 bp, mouse
ggggaacccgagccgcccgg

SEQ ID NO: 483349 - DNA, 20 bp, mouse
gcggcgggaggctcaggacg

SEQ ID NO: 483350 - DNA, 20 bp, mouse
ggtccgaccggcaggatcga

SEQ ID NO: 483351 - DNA, 20 bp, mouse
gtccgctgtcgcgggacctc

SEQ ID NO: 483352 - DNA, 20 bp, mouse
ggccgggcgtaagcggatcc

SEQ ID NO: 483353 - DNA, 20 bp, mouse
gtggcgcacggcagtccgac

SEQ ID NO: 483354 - DNA, 20 bp, mouse
gggtttcaccttcccccggg

SEQ ID NO: 483355 - DNA, 20 bp, mouse
gtgggtagagcagtcaccta

SEQ ID NO: 483356 - DNA, 20 bp, mouse
gggcagggcagctgtgtcag

SEQ ID NO: 483357 - DNA, 20 bp, mouse
gcagagctctctggcaggcg

SEQ ID NO: 483358 - DNA, 20 bp, mouse
gcaggactccgtgcaggtaa

SEQ ID NO: 483359 - DNA, 20 bp, mouse
gtgccagagagctctggaag

SEQ ID NO: 483360 - DNA, 20 bp, mouse
ggagctctggaagaggtgac

SEQ ID NO: 483361 - DNA, 20 bp, mouse
ggtcagtggagattgcgaac

SEQ ID NO: 483362 - DNA, 20 bp, mouse
gtgcgaacaggactccgtgc

SEQ ID NO: 483363 - DNA, 20 bp, mouse
ggagatagggggacagtcaa

SEQ ID NO: 483364 - DNA, 20 bp, mouse
ggctctctggcaggcgaggc

SEQ ID NO: 483365 - DNA, 20 bp, mouse
gagacaaagattgagatagg

SEQ ID NO: 483366 - DNA, 20 bp, mouse
gcgcgcgcggagcctcgccg

SEQ ID NO: 483367 - DNA, 20 bp, mouse
gctcccgcaaggccccggcg

SEQ ID NO: 483368 - DNA, 20 bp, mouse
gccctctgggccagcgtggg

SEQ ID NO: 483369 - DNA, 20 bp, mouse
gccttccgggacatcctcag

SEQ ID NO: 483370 - DNA, 20 bp, mouse
ggcccggcccggctcccgca

SEQ ID NO: 483371 - DNA, 20 bp, mouse
ggtaagcggcgggatcgggt

SEQ ID NO: 483372 - DNA, 20 bp, mouse
gttggagccggtgaacggga

SEQ ID NO: 483373 - DNA, 20 bp, mouse
gtggatgccgcgatggaggt

SEQ ID NO: 483374 - DNA, 20 bp, mouse
gggttccgggccagccccgg

SEQ ID NO: 483375 - DNA, 20 bp, mouse
gcagcgctccgggtaagcgg

SEQ ID NO: 483376 - DNA, 20 bp, mouse
gaccccgcgagcgacggcag

SEQ ID NO: 483377 - DNA, 20 bp, mouse
gctgggaaccccgcgagcga

SEQ ID NO: 483378 - DNA, 20 bp, mouse
gctccggagccgcttcgaca

SEQ ID NO: 483379 - DNA, 20 bp, mouse
ggcccggggacccgttagag

SEQ ID NO: 483380 - DNA, 20 bp, mouse
ggcccgggcgagcacagagg

SEQ ID NO: 483381 - DNA, 20 bp, mouse
gagcgggcaccatgtcgaag

SEQ ID NO: 483382 - DNA, 20 bp, mouse
gtccgctctaacgggtcccc

SEQ ID NO: 483383 - DNA, 20 bp, mouse
ggcggctgacaggcccggga

SEQ ID NO: 483384 - DNA, 20 bp, mouse
gggagggcccgggaccggac

SEQ ID NO: 483385 - DNA, 20 bp, mouse
gctctcccggccgggacccc

SEQ ID NO: 483386 - DNA, 20 bp, mouse
gagacgctactaggtaaagt

SEQ ID NO: 483387 - DNA, 20 bp, mouse
gaagtggtggaactccttgg

SEQ ID NO: 483388 - DNA, 20 bp, mouse
gagccggcacgccaaagtgg

SEQ ID NO: 483389 - DNA, 20 bp, mouse
gcaaaggaaaaggagagttc

SEQ ID NO: 483390 - DNA, 20 bp, mouse
ggttaaaaaacgcttttacg

SEQ ID NO: 483391 - DNA, 20 bp, mouse
gtcattgggggaaaggcgtg

SEQ ID NO: 483392 - DNA, 20 bp, mouse
gtgaagccggcacgccaaag

SEQ ID NO: 483393 - DNA, 20 bp, mouse
gtacagaaagagacgctact

SEQ ID NO: 483394 - DNA, 20 bp, mouse
ggtccttccttcactctagt

SEQ ID NO: 483395 - DNA, 20 bp, mouse
gcagcacttttctttcattg

SEQ ID NO: 483396 - DNA, 20 bp, mouse
ggtgctagatgtgagatgaa

SEQ ID NO: 483397 - DNA, 20 bp, mouse
gagaaaaataagcaagactg

SEQ ID NO: 483398 - DNA, 20 bp, mouse
gagggacgtcacttataaag

SEQ ID NO: 483399 - DNA, 20 bp, mouse
gtgggtatcctagaatgaaa

SEQ ID NO: 483400 - DNA, 20 bp, mouse
gtacaaatacggaaactaat

SEQ ID NO: 483401 - DNA, 20 bp, mouse
gatttttctatttatctgag

SEQ ID NO: 483402 - DNA, 20 bp, mouse
gttactgggtggcatcctag

SEQ ID NO: 483403 - DNA, 20 bp, mouse
ggtgggagtggacttcctct

SEQ ID NO: 483404 - DNA, 20 bp, mouse
gaggaggctaataaaacaga

SEQ ID NO: 483405 - DNA, 20 bp, mouse
gaaactgagttagattatag

SEQ ID NO: 483406 - DNA, 20 bp, mouse
ggagcaggccgagcccgact

SEQ ID NO: 483407 - DNA, 20 bp, mouse
gcctagcgcggggcgctcgt

SEQ ID NO: 483408 - DNA, 20 bp, mouse
gggggacccgacagcaccag

SEQ ID NO: 483409 - DNA, 20 bp, mouse
gacgcggcgctgtcacccct

SEQ ID NO: 483410 - DNA, 20 bp, mouse
gcgtaccgcggtggtgggga

SEQ ID NO: 483411 - DNA, 20 bp, mouse
gggtgcgtaccgcggtggtg

SEQ ID NO: 483412 - DNA, 20 bp, mouse
gcggcgtggggcgccaagtg

SEQ ID NO: 483413 - DNA, 20 bp, mouse
gtgctgtcgggtccccaata

SEQ ID NO: 483414 - DNA, 20 bp, mouse
gagtgcggtgcgtaccgcgg

SEQ ID NO: 483415 - DNA, 20 bp, mouse
ggagttccagggccatattg

SEQ ID NO: 483416 - DNA, 20 bp, mouse
gagcaggcggtgagttcggg

SEQ ID NO: 483417 - DNA, 20 bp, mouse
gcaggtagaggggacgaccg

SEQ ID NO: 483418 - DNA, 20 bp, mouse
gacccttaaggagagaccga

SEQ ID NO: 483419 - DNA, 20 bp, mouse
gacgcgactgaagccaccag

SEQ ID NO: 483420 - DNA, 20 bp, mouse
gattcccgcaggcgcagctt

SEQ ID NO: 483421 - DNA, 20 bp, mouse
gggttcactccactgcggga

SEQ ID NO: 483422 - DNA, 20 bp, mouse
ggccctcggtctctccttaa

SEQ ID NO: 483423 - DNA, 20 bp, mouse
ggagggaagtgagctaggac

SEQ ID NO: 483424 - DNA, 20 bp, mouse
ggcaagcaggcggtgagttc

SEQ ID NO: 483425 - DNA, 20 bp, mouse
gctgggccagccgggcaagc

SEQ ID NO: 483426 - DNA, 20 bp, mouse
gcctgaagaagccaactcca

SEQ ID NO: 483427 - DNA, 20 bp, mouse
ggaagaagccaactccaggg

SEQ ID NO: 483428 - DNA, 20 bp, mouse
gctcaagagcaaataacagt

SEQ ID NO: 483429 - DNA, 20 bp, mouse
gctatggcaggaatagagag

SEQ ID NO: 483430 - DNA, 20 bp, mouse
ggtgggcgggagcaactaac

SEQ ID NO: 483431 - DNA, 20 bp, mouse
ggaagccaactccagggagg

SEQ ID NO: 483432 - DNA, 20 bp, mouse
gggaggaaaggaagcaggta

SEQ ID NO: 483433 - DNA, 20 bp, mouse
ggcaggaatagagaggggta

SEQ ID NO: 483434 - DNA, 20 bp, mouse
ggaaaggaagcaggtaaggg

SEQ ID NO: 483435 - DNA, 20 bp, mouse
gtgcaaacgcagtgctctgg

SEQ ID NO: 483436 - DNA, 20 bp, mouse
gcttgtggaagagcgctcca

SEQ ID NO: 483437 - DNA, 20 bp, mouse
gcacccaagacacttacctg

SEQ ID NO: 483438 - DNA, 20 bp, mouse
gccaagctgcaagagtagga

SEQ ID NO: 483439 - DNA, 20 bp, mouse
gtaggagggtctcttctcct

SEQ ID NO: 483440 - DNA, 20 bp, mouse
ggctggtctcacttagcact

SEQ ID NO: 483441 - DNA, 20 bp, mouse
gctagagaagcgaggacaca

SEQ ID NO: 483442 - DNA, 20 bp, mouse
ggctgacttgaaagttgcta

SEQ ID NO: 483443 - DNA, 20 bp, mouse
gtgcctcaggtaagtgtctt

SEQ ID NO: 483444 - DNA, 20 bp, mouse
gatctaagctccgcatgtgt

SEQ ID NO: 483445 - DNA, 20 bp, mouse
gaattttaaactataaacgt

SEQ ID NO: 483446 - DNA, 20 bp, mouse
gtagcgtcccacggagaaac

SEQ ID NO: 483447 - DNA, 20 bp, mouse
gccgtgggacgctactcaga

SEQ ID NO: 483448 - DNA, 20 bp, mouse
gtatagtctaaggccaccca

SEQ ID NO: 483449 - DNA, 20 bp, mouse
gacagcaccagtttctccgt

SEQ ID NO: 483450 - DNA, 20 bp, mouse
gagtttgcagaggtttggaa

SEQ ID NO: 483451 - DNA, 20 bp, mouse
ggagagtgctaggatacgtt

SEQ ID NO: 483452 - DNA, 20 bp, mouse
gaagggaaggttatagtcta

SEQ ID NO: 483453 - DNA, 20 bp, mouse
gtcagcccaatgatagacct

SEQ ID NO: 483454 - DNA, 20 bp, mouse
gcagtcgtgcagcacattag

SEQ ID NO: 483455 - DNA, 20 bp, mouse
gtcgtgcagcacattagggg

SEQ ID NO: 483456 - DNA, 20 bp, mouse
gaggcagttgcaaccaggtg

SEQ ID NO: 483457 - DNA, 20 bp, mouse
gtccctggcactgccacacc

SEQ ID NO: 483458 - DNA, 20 bp, mouse
gaccaggtgtggcagtgcca

SEQ ID NO: 483459 - DNA, 20 bp, mouse
gacgcctgcatacattccct

SEQ ID NO: 483460 - DNA, 20 bp, mouse
ggggctttgacagtacctag

SEQ ID NO: 483461 - DNA, 20 bp, mouse
gtctgaaagaaggtgagagt

SEQ ID NO: 483462 - DNA, 20 bp, mouse
gtccaagcaggcaggtcacc

SEQ ID NO: 483463 - DNA, 20 bp, mouse
gggaaaaggcagttgcaacc

SEQ ID NO: 483464 - DNA, 20 bp, mouse
gctgtcaaagcccaacccag

SEQ ID NO: 483465 - DNA, 20 bp, mouse
ggaacttggagtctgaaaga

SEQ ID NO: 483466 - DNA, 20 bp, mouse
gccaactcgcagccagtcgg

SEQ ID NO: 483467 - DNA, 20 bp, mouse
gtggtcgccgcgggtcccgg

SEQ ID NO: 483468 - DNA, 20 bp, mouse
gtcgccgcgggtcccggtgg

SEQ ID NO: 483469 - DNA, 20 bp, mouse
gggactggagcgccgccgac

SEQ ID NO: 483470 - DNA, 20 bp, mouse
ggaggctgcgctcagtggac

SEQ ID NO: 483471 - DNA, 20 bp, mouse
gctcccaactcgcagccagt

SEQ ID NO: 483472 - DNA, 20 bp, mouse
gcagcctccaccgggacccg

SEQ ID NO: 483473 - DNA, 20 bp, mouse
gctccagggtgagagaggcg

SEQ ID NO: 483474 - DNA, 20 bp, mouse
gcgaggcgctgtccccggta

SEQ ID NO: 483475 - DNA, 20 bp, mouse
gcgaccgcaacgccccacgg

SEQ ID NO: 483476 - DNA, 20 bp, mouse
gagccaggctcccacggtgg

SEQ ID NO: 483477 - DNA, 20 bp, mouse
gctggccaggagcctcaccg

SEQ ID NO: 483478 - DNA, 20 bp, mouse
gtcccggtacttacagtcag

SEQ ID NO: 483479 - DNA, 20 bp, mouse
gtggagccaggctcccacgg

SEQ ID NO: 483480 - DNA, 20 bp, mouse
ggagctctgtggcctcggtg

SEQ ID NO: 483481 - DNA, 20 bp, mouse
gggagccaagccgagctctg

SEQ ID NO: 483482 - DNA, 20 bp, mouse
ggtgctcgcctgtggaatgg

SEQ ID NO: 483483 - DNA, 20 bp, mouse
ggggaaggggcgacaatcca

SEQ ID NO: 483484 - DNA, 20 bp, mouse
gtctatggggatcccctggg

SEQ ID NO: 483485 - DNA, 20 bp, mouse
gctcgttcctcctctgctgt

SEQ ID NO: 483486 - DNA, 20 bp, mouse
gaggacacggggacccaaga

SEQ ID NO: 483487 - DNA, 20 bp, mouse
gttcggtcctcacccttctt

SEQ ID NO: 483488 - DNA, 20 bp, mouse
gcggggacccaagaagggtg

SEQ ID NO: 483489 - DNA, 20 bp, mouse
gaccggagagtgaggacacg

SEQ ID NO: 483490 - DNA, 20 bp, mouse
gaggtccccggggaaaccta

SEQ ID NO: 483491 - DNA, 20 bp, mouse
gcagacagacaagccggcac

SEQ ID NO: 483492 - DNA, 20 bp, mouse
gctgcctgaggccgtcctgg

SEQ ID NO: 483493 - DNA, 20 bp, mouse
gagctggagacggctgtggg

SEQ ID NO: 483494 - DNA, 20 bp, mouse
gggagaatccagaagagatt

SEQ ID NO: 483495 - DNA, 20 bp, mouse
gtgtctgcctgaggccgtcc

SEQ ID NO: 483496 - DNA, 20 bp, mouse
gctcctggaagccagcagtt

SEQ ID NO: 483497 - DNA, 20 bp, mouse
gtggccaacaggacacgcct

SEQ ID NO: 483498 - DNA, 20 bp, mouse
gttccaggagcgggtactaa

SEQ ID NO: 483499 - DNA, 20 bp, mouse
gtctggtaaagctcattctt

SEQ ID NO: 483500 - DNA, 20 bp, mouse
ggaggaagagcccagaatac

SEQ ID NO: 483501 - DNA, 20 bp, mouse
gaagagcccagaatacagga

SEQ ID NO: 483502 - DNA, 20 bp, mouse
ggggtactaagggagcccta

SEQ ID NO: 483503 - DNA, 20 bp, mouse
ggtcctaggaacacccaggg

SEQ ID NO: 483504 - DNA, 20 bp, mouse
gggagtcgctgctcaggtaa

SEQ ID NO: 483505 - DNA, 20 bp, mouse
gcagagaactcggtccggtt

SEQ ID NO: 483506 - DNA, 20 bp, mouse
gtccaacctacgctcagggt

SEQ ID NO: 483507 - DNA, 20 bp, mouse
ggagctcctaccctgagcgt

SEQ ID NO: 483508 - DNA, 20 bp, mouse
gaggcgccggcggttcacag

SEQ ID NO: 483509 - DNA, 20 bp, mouse
gtaggagagactccaggtgt

SEQ ID NO: 483510 - DNA, 20 bp, mouse
gcctgagcgtaggttggatc

SEQ ID NO: 483511 - DNA, 20 bp, mouse
gcacagcgggaatggaatcg

SEQ ID NO: 483512 - DNA, 20 bp, mouse
gaggttggatcaggcgccgg

SEQ ID NO: 483513 - DNA, 20 bp, mouse
gcgtaggttggatcaggcgc

SEQ ID NO: 483514 - DNA, 20 bp, mouse
gaaggcgggatgccgatggg

SEQ ID NO: 483515 - DNA, 20 bp, mouse
gaagccacaggtggaaaccg

SEQ ID NO: 483516 - DNA, 20 bp, mouse
ggccgaggctgaagccgctc

SEQ ID NO: 483517 - DNA, 20 bp, mouse
gcgcggccgggcgaactctg

SEQ ID NO: 483518 - DNA, 20 bp, mouse
gttgaaggctgaggcgaagg

SEQ ID NO: 483519 - DNA, 20 bp, mouse
gcgcctcagccttcaagccg

SEQ ID NO: 483520 - DNA, 20 bp, mouse
gcgacgcggggcccatgagg

SEQ ID NO: 483521 - DNA, 20 bp, mouse
ggccggagcggcttcagcct

SEQ ID NO: 483522 - DNA, 20 bp, mouse
gggcttcagcctcggcttga

SEQ ID NO: 483523 - DNA, 20 bp, mouse
gtgaggcgcctcgaaagcgg

SEQ ID NO: 483524 - DNA, 20 bp, mouse
gctagcgcacgagataacgg

SEQ ID NO: 483525 - DNA, 20 bp, mouse
ggacctagcgcacgagataa

SEQ ID NO: 483526 - DNA, 20 bp, mouse
gatccagccggcaggtggag

SEQ ID NO: 483527 - DNA, 20 bp, mouse
gagcctggagaaggtaggga

SEQ ID NO: 483528 - DNA, 20 bp, mouse
gggatgctgatcctctctaa

SEQ ID NO: 483529 - DNA, 20 bp, mouse
gtctctaagggcatactgtg

SEQ ID NO: 483530 - DNA, 20 bp, mouse
gggctggaaatgcaaacctt

SEQ ID NO: 483531 - DNA, 20 bp, mouse
gggtagggagggtactgctg

SEQ ID NO: 483532 - DNA, 20 bp, mouse
gggatcagcatccagccggc

SEQ ID NO: 483533 - DNA, 20 bp, mouse
gagactcagtgagtcttcca

SEQ ID NO: 483534 - DNA, 20 bp, mouse
gctggtgccagatgccaccc

SEQ ID NO: 483535 - DNA, 20 bp, mouse
gtcccctctcaggctctgtg

SEQ ID NO: 483536 - DNA, 20 bp, mouse
gcaagtgcaggtaaattcat

SEQ ID NO: 483537 - DNA, 20 bp, mouse
gtccagagatcgcggcttga

SEQ ID NO: 483538 - DNA, 20 bp, mouse
gggtcctctggtccttcagt

SEQ ID NO: 483539 - DNA, 20 bp, mouse
gattccaactgaaggaccag

SEQ ID NO: 483540 - DNA, 20 bp, mouse
ggcttgagggcagggtcctc

SEQ ID NO: 483541 - DNA, 20 bp, mouse
gagatcgcggcttgagggca

SEQ ID NO: 483542 - DNA, 20 bp, mouse
gtcaaagcctggccatgaag

SEQ ID NO: 483543 - DNA, 20 bp, mouse
gatcacaggaagttaaggag

SEQ ID NO: 483544 - DNA, 20 bp, mouse
ggatctctggaaagtgactc

SEQ ID NO: 483545 - DNA, 20 bp, mouse
gaaagagaaggcgaaagggt

SEQ ID NO: 483546 - DNA, 20 bp, mouse
gggaccccggcgcctgtcac

SEQ ID NO: 483547 - DNA, 20 bp, mouse
gaggtgcccgctccagtgac

SEQ ID NO: 483548 - DNA, 20 bp, mouse
gcggcgcgcagagctagctg

SEQ ID NO: 483549 - DNA, 20 bp, mouse
gtgcggggctggggaatccg

SEQ ID NO: 483550 - DNA, 20 bp, mouse
gagtccatctgacccccgga

SEQ ID NO: 483551 - DNA, 20 bp, mouse
ggatcttgcggtctgaggga

SEQ ID NO: 483552 - DNA, 20 bp, mouse
ggcccctcgccgggagactg

SEQ ID NO: 483553 - DNA, 20 bp, mouse
gccggcgcctgtcactggag

SEQ ID NO: 483554 - DNA, 20 bp, mouse
gcttaagggcggattagagg

SEQ ID NO: 483555 - DNA, 20 bp, mouse
ggaggcagcagacaaagact

SEQ ID NO: 483556 - DNA, 20 bp, mouse
ggccagagacgacccacgag

SEQ ID NO: 483557 - DNA, 20 bp, mouse
gctaggctccctgctggacg

SEQ ID NO: 483558 - DNA, 20 bp, mouse
gcgtggccagcaccaggatg

SEQ ID NO: 483559 - DNA, 20 bp, mouse
ggccgctcgtgggtcgtctc

SEQ ID NO: 483560 - DNA, 20 bp, mouse
gagctacagtcgccgctcgt

SEQ ID NO: 483561 - DNA, 20 bp, mouse
gcgctggggacgaggaaagg

SEQ ID NO: 483562 - DNA, 20 bp, mouse
gtgggggagtgggcgttcct

SEQ ID NO: 483563 - DNA, 20 bp, mouse
gagctgcaccgcgtccagca

SEQ ID NO: 483564 - DNA, 20 bp, mouse
gcggtagtgggacaccggga

SEQ ID NO: 483565 - DNA, 20 bp, mouse
ggaagcggtagtgggacacc

SEQ ID NO: 483566 - DNA, 20 bp, mouse
gtccgggctcgtgtactcca

SEQ ID NO: 483567 - DNA, 20 bp, mouse
gaagatgtgctcccaggcct

SEQ ID NO: 483568 - DNA, 20 bp, mouse
gacaaggtatggccccagtg

SEQ ID NO: 483569 - DNA, 20 bp, mouse
gactgtaacgtgaccatcat

SEQ ID NO: 483570 - DNA, 20 bp, mouse
ggccttggcaagcctcactg

SEQ ID NO: 483571 - DNA, 20 bp, mouse
ggtacacgagcccggacctg

SEQ ID NO: 483572 - DNA, 20 bp, mouse
gtcaacatcggagattgtgg

SEQ ID NO: 483573 - DNA, 20 bp, mouse
gtggcctacctccagaagaa

SEQ ID NO: 483574 - DNA, 20 bp, mouse
ggtagtgggagcatcacttt

SEQ ID NO: 483575 - DNA, 20 bp, mouse
ggccccagtgaggcttgcca

SEQ ID NO: 483576 - DNA, 20 bp, mouse
ggttatcctggcatccccgt

SEQ ID NO: 483577 - DNA, 20 bp, mouse
gagttcagcaacagcccacg

SEQ ID NO: 483578 - DNA, 20 bp, mouse
gctttcaggaggtgttatcc

SEQ ID NO: 483579 - DNA, 20 bp, mouse
gtttagagacatctttcagg

SEQ ID NO: 483580 - DNA, 20 bp, mouse
gaacagcccacggggatgcc

SEQ ID NO: 483581 - DNA, 20 bp, mouse
gtaatttagagacatctttc

SEQ ID NO: 483582 - DNA, 20 bp, mouse
gacatcaagaacttctatga

SEQ ID NO: 483583 - DNA, 20 bp, mouse
ggaatgtaaaagtttgattc

SEQ ID NO: 483584 - DNA, 20 bp, mouse
gattctgaattctaaattac

SEQ ID NO: 483585 - DNA, 20 bp, mouse
gagctactttaaagcatcaa

SEQ ID NO: 483586 - DNA, 20 bp, mouse
gggaccaccgctcctaccaa

SEQ ID NO: 483587 - DNA, 20 bp, mouse
gcctctgcgggaccgttggt

SEQ ID NO: 483588 - DNA, 20 bp, mouse
gggaccgttggtaggagcgg

SEQ ID NO: 483589 - DNA, 20 bp, mouse
ggcctcgaagcaaacctctg

SEQ ID NO: 483590 - DNA, 20 bp, mouse
ggcgggaccgttggtaggag

SEQ ID NO: 483591 - DNA, 20 bp, mouse
gcaaacctctgcgggaccgt

SEQ ID NO: 483592 - DNA, 20 bp, mouse
gagtccactgaccagtttca

SEQ ID NO: 483593 - DNA, 20 bp, mouse
ggcgagtggagttggttccc

SEQ ID NO: 483594 - DNA, 20 bp, mouse
gcccgcagaggtttgcttcg

SEQ ID NO: 483595 - DNA, 20 bp, mouse
gactagaaagcgagtggagt

SEQ ID NO: 483596 - DNA, 20 bp, mouse
ggccggcccgagccccccag

SEQ ID NO: 483597 - DNA, 20 bp, mouse
ggttcggggtcgcgatgtca

SEQ ID NO: 483598 - DNA, 20 bp, mouse
ggctataaacgccagacccc

SEQ ID NO: 483599 - DNA, 20 bp, mouse
ggcagcaggagcgtgcagag

SEQ ID NO: 483600 - DNA, 20 bp, mouse
gataaacgccagaccccggg

SEQ ID NO: 483601 - DNA, 20 bp, mouse
gcagcgcgcagaaggtgact

SEQ ID NO: 483602 - DNA, 20 bp, mouse
gacagggcgcggtgtaggag

SEQ ID NO: 483603 - DNA, 20 bp, mouse
ggtggcgactgcagtgttcg

SEQ ID NO: 483604 - DNA, 20 bp, mouse
ggccccagcacgaagcggga

SEQ ID NO: 483605 - DNA, 20 bp, mouse
gcactgcagtcgccacgggc

SEQ ID NO: 483606 - DNA, 20 bp, mouse
ggcccgcgcccaacgcccgg

SEQ ID NO: 483607 - DNA, 20 bp, mouse
gccgctcccgcgctaccccc

SEQ ID NO: 483608 - DNA, 20 bp, mouse
ggacgggagcggccgcaccg

SEQ ID NO: 483609 - DNA, 20 bp, mouse
ggggaggcccggtgagtcta

SEQ ID NO: 483610 - DNA, 20 bp, mouse
gctccgcgggcccgttactg

SEQ ID NO: 483611 - DNA, 20 bp, mouse
ggcgggagtgacagcaggtg

SEQ ID NO: 483612 - DNA, 20 bp, mouse
gtcccccgcggacctctcct

SEQ ID NO: 483613 - DNA, 20 bp, mouse
gcgaggctccgtagactcac

SEQ ID NO: 483614 - DNA, 20 bp, mouse
gggcctccctcgccgcggtg

SEQ ID NO: 483615 - DNA, 20 bp, mouse
ggccccggggagccccgaac

SEQ ID NO: 483616 - DNA, 20 bp, mouse
gggtggagcagaggatcagg

SEQ ID NO: 483617 - DNA, 20 bp, mouse
gtgtggtggagcagaggatc

SEQ ID NO: 483618 - DNA, 20 bp, mouse
gtgacttactgtgagcttca

SEQ ID NO: 483619 - DNA, 20 bp, mouse
gcctgtgacaggctcttccg

SEQ ID NO: 483620 - DNA, 20 bp, mouse
ggtatggtgctgcattgaaa

SEQ ID NO: 483621 - DNA, 20 bp, mouse
gatacaacattaatagtcag

SEQ ID NO: 483622 - DNA, 20 bp, mouse
gtagagaagaagaattgccc

SEQ ID NO: 483623 - DNA, 20 bp, mouse
gaccggaacatgcccagaac

SEQ ID NO: 483624 - DNA, 20 bp, mouse
gttaatagtcaggggtgagg

SEQ ID NO: 483625 - DNA, 20 bp, mouse
gcttaagacgagcagtctct

SEQ ID NO: 483626 - DNA, 20 bp, mouse
gacgaacgcatactcacgag

SEQ ID NO: 483627 - DNA, 20 bp, mouse
gtaaaggccggacgctgcac

SEQ ID NO: 483628 - DNA, 20 bp, mouse
gctcgacatccgaagcacgt

SEQ ID NO: 483629 - DNA, 20 bp, mouse
gctatcggcacaacaagcag

SEQ ID NO: 483630 - DNA, 20 bp, mouse
gtccgttgtctacatttctt

SEQ ID NO: 483631 - DNA, 20 bp, mouse
gcctcacaaagtgatgagaa

SEQ ID NO: 483632 - DNA, 20 bp, mouse
gtcacccatgagaaaagctt

SEQ ID NO: 483633 - DNA, 20 bp, mouse
gaatacctggtctacactat

SEQ ID NO: 483634 - DNA, 20 bp, mouse
ggcagcgtccggcctttata

SEQ ID NO: 483635 - DNA, 20 bp, mouse
ggcttgtagccaacgtgctt

SEQ ID NO: 483636 - DNA, 20 bp, mouse
gctctctccagcgaatgcaa

SEQ ID NO: 483637 - DNA, 20 bp, mouse
gtatcatagtgagacctgag

SEQ ID NO: 483638 - DNA, 20 bp, mouse
gagttaaagatgtactcaca

SEQ ID NO: 483639 - DNA, 20 bp, mouse
gtgcatgccgttgcattcgc

SEQ ID NO: 483640 - DNA, 20 bp, mouse
gtgggtgtgcaatcttctgt

SEQ ID NO: 483641 - DNA, 20 bp, mouse
gccagtcagaccagccaagg

SEQ ID NO: 483642 - DNA, 20 bp, mouse
ggaactgttcaaatcaaccc

SEQ ID NO: 483643 - DNA, 20 bp, mouse
ggtctatataaactagactt

SEQ ID NO: 483644 - DNA, 20 bp, mouse
gcagaccagccaaggaggtc

SEQ ID NO: 483645 - DNA, 20 bp, mouse
ggggaggatccagacctcct

SEQ ID NO: 483646 - DNA, 20 bp, mouse
ggcttttgagcagagatacg

SEQ ID NO: 483647 - DNA, 20 bp, mouse
gactcgggaaactgaaccaa

SEQ ID NO: 483648 - DNA, 20 bp, mouse
gctgaaccaaaggatttcta

SEQ ID NO: 483649 - DNA, 20 bp, mouse
gcatggccatagaaatcctt

SEQ ID NO: 483650 - DNA, 20 bp, mouse
gtaaaagcccagcttaactc

SEQ ID NO: 483651 - DNA, 20 bp, mouse
gtggcgcggactcctactat

SEQ ID NO: 483652 - DNA, 20 bp, mouse
gttgagcagagatacgcggc

SEQ ID NO: 483653 - DNA, 20 bp, mouse
gagacagtctagatctcggg

SEQ ID NO: 483654 - DNA, 20 bp, mouse
ggagcttgcgctttgtcccc

SEQ ID NO: 483655 - DNA, 20 bp, mouse
gagagcctgatgcctgcata

SEQ ID NO: 483656 - DNA, 20 bp, mouse
ggcgggagcggcgtacacag

SEQ ID NO: 483657 - DNA, 20 bp, mouse
gtaacggagagaccccatcg

SEQ ID NO: 483658 - DNA, 20 bp, mouse
gcagagcgcccactgcctaa

SEQ ID NO: 483659 - DNA, 20 bp, mouse
ggcatgatcgcgccacgatg

SEQ ID NO: 483660 - DNA, 20 bp, mouse
ggttgcagcagtgccaggag

SEQ ID NO: 483661 - DNA, 20 bp, mouse
gcagaggccgaggaaagccg

SEQ ID NO: 483662 - DNA, 20 bp, mouse
ggctctgagcgggtgatcga

SEQ ID NO: 483663 - DNA, 20 bp, mouse
ggcctctgcccgcttcccag

SEQ ID NO: 483664 - DNA, 20 bp, mouse
ggggtctctccgttaggcag

SEQ ID NO: 483665 - DNA, 20 bp, mouse
gacaacccccggaggtgcag

SEQ ID NO: 483666 - DNA, 20 bp, mouse
ggcagggaaggcaggtcggg

SEQ ID NO: 483667 - DNA, 20 bp, mouse
gcgaccctttgggtttacct

SEQ ID NO: 483668 - DNA, 20 bp, mouse
gggtcggcccacagaaccgg

SEQ ID NO: 483669 - DNA, 20 bp, mouse
ggcagacagtccgacccttt

SEQ ID NO: 483670 - DNA, 20 bp, mouse
gcctggggaaccccattcta

SEQ ID NO: 483671 - DNA, 20 bp, mouse
gccggagtaaggatcagtgt

SEQ ID NO: 483672 - DNA, 20 bp, mouse
gcaggctgccagaaacatag

SEQ ID NO: 483673 - DNA, 20 bp, mouse
gggactgtctgcctgggtgt

SEQ ID NO: 483674 - DNA, 20 bp, mouse
ggaccacaagccgcagcagc

SEQ ID NO: 483675 - DNA, 20 bp, mouse
gtcagcagaggtccggagta

SEQ ID NO: 483676 - DNA, 20 bp, mouse
ggtggggacccggaagtgag

SEQ ID NO: 483677 - DNA, 20 bp, mouse
gctggggcccggctagacct

SEQ ID NO: 483678 - DNA, 20 bp, mouse
gagggccaagtgggaaccct

SEQ ID NO: 483679 - DNA, 20 bp, mouse
ggtatcctagcaacaagagg

SEQ ID NO: 483680 - DNA, 20 bp, mouse
gagaggcggcaagaggatgt

SEQ ID NO: 483681 - DNA, 20 bp, mouse
gcccttactgagggccaagt

SEQ ID NO: 483682 - DNA, 20 bp, mouse
gacccggaagtgagaggctg

SEQ ID NO: 483683 - DNA, 20 bp, mouse
gggctagacctggggtgtat

SEQ ID NO: 483684 - DNA, 20 bp, mouse
gagagaaaccaatacacccc

SEQ ID NO: 483685 - DNA, 20 bp, mouse
ggctgtatcctagcaacaag

SEQ ID NO: 483686 - DNA, 20 bp, mouse
gtccgccgcagactccactt

SEQ ID NO: 483687 - DNA, 20 bp, mouse
ggatgcccaagtggagtctg

SEQ ID NO: 483688 - DNA, 20 bp, mouse
gacgctgctggtagacaccc

SEQ ID NO: 483689 - DNA, 20 bp, mouse
ggcccaagtggagtctgcgg

SEQ ID NO: 483690 - DNA, 20 bp, mouse
gcagcaggagtccgagtgtg

SEQ ID NO: 483691 - DNA, 20 bp, mouse
gtgacccctagggactgaca

SEQ ID NO: 483692 - DNA, 20 bp, mouse
gcgtttgcaagatgcccaag

SEQ ID NO: 483693 - DNA, 20 bp, mouse
gggaggctcgaagggactcc

SEQ ID NO: 483694 - DNA, 20 bp, mouse
gtgtggcagaccagaacctg

SEQ ID NO: 483695 - DNA, 20 bp, mouse
gctctgagtgttgctggagt

SEQ ID NO: 483696 - DNA, 20 bp, mouse
gtagcaggctctgctgtaca

SEQ ID NO: 483697 - DNA, 20 bp, mouse
gcagccagcatctagatcca

SEQ ID NO: 483698 - DNA, 20 bp, mouse
gcacaagaagctattgtctc

SEQ ID NO: 483699 - DNA, 20 bp, mouse
gtggactctagcaatgtcag

SEQ ID NO: 483700 - DNA, 20 bp, mouse
gagttgggggaattcaggac

SEQ ID NO: 483701 - DNA, 20 bp, mouse
gttggggacaaagggaggcc

SEQ ID NO: 483702 - DNA, 20 bp, mouse
gcagccatcggcactacatc

SEQ ID NO: 483703 - DNA, 20 bp, mouse
gaggcccgatgtagtgccga

SEQ ID NO: 483704 - DNA, 20 bp, mouse
gagaccctggatctagatgc

SEQ ID NO: 483705 - DNA, 20 bp, mouse
gcagtgccgagaggcatttg

SEQ ID NO: 483706 - DNA, 20 bp, mouse
gagtgagaagcgggtcgagg

SEQ ID NO: 483707 - DNA, 20 bp, mouse
ggagaagcgggtcgaggtgg

SEQ ID NO: 483708 - DNA, 20 bp, mouse
gccgagtgagaagcgggtcg

SEQ ID NO: 483709 - DNA, 20 bp, mouse
ggccattccgagtgagaagc

SEQ ID NO: 483710 - DNA, 20 bp, mouse
gtagcctcggaggagagaaa

SEQ ID NO: 483711 - DNA, 20 bp, mouse
gacccgcttctcactcggaa

SEQ ID NO: 483712 - DNA, 20 bp, mouse
gcccgggcatcgcgctgaca

SEQ ID NO: 483713 - DNA, 20 bp, mouse
ggcagcggcggcggcgtttg

SEQ ID NO: 483714 - DNA, 20 bp, mouse
ggtgcgtgcgatgtgtacgg

SEQ ID NO: 483715 - DNA, 20 bp, mouse
gcgcagcgcgaggcgcctcg

SEQ ID NO: 483716 - DNA, 20 bp, mouse
ggccaaacagcagtcagaag

SEQ ID NO: 483717 - DNA, 20 bp, mouse
gatctgtgcgctattcactt

SEQ ID NO: 483718 - DNA, 20 bp, mouse
gcattaaagggagacgagag

SEQ ID NO: 483719 - DNA, 20 bp, mouse
gcatattcagaccataccta

SEQ ID NO: 483720 - DNA, 20 bp, mouse
gcttcttacctccataggta

SEQ ID NO: 483721 - DNA, 20 bp, mouse
gggtctgaatatgcgttgtt

SEQ ID NO: 483722 - DNA, 20 bp, mouse
gtcagaagaggcatttcctc

SEQ ID NO: 483723 - DNA, 20 bp, mouse
gaggcaccccctgttgttgg

SEQ ID NO: 483724 - DNA, 20 bp, mouse
gggggcttcaatagcaacgg

SEQ ID NO: 483725 - DNA, 20 bp, mouse
gatgcgttgtttggcagctc

SEQ ID NO: 483726 - DNA, 20 bp, mouse
gaccactgcgggcaatgaat

SEQ ID NO: 483727 - DNA, 20 bp, mouse
ggagcaggtgcctgctgagg

SEQ ID NO: 483728 - DNA, 20 bp, mouse
ggaaggggatccagggactg

SEQ ID NO: 483729 - DNA, 20 bp, mouse
gtgcccgcagtggtcgggaa

SEQ ID NO: 483730 - DNA, 20 bp, mouse
gggtgccccgagccaggcgg

SEQ ID NO: 483731 - DNA, 20 bp, mouse
gcggggcaccggcttgagtt

SEQ ID NO: 483732 - DNA, 20 bp, mouse
ggaagccgggacagcagcgg

SEQ ID NO: 483733 - DNA, 20 bp, mouse
gtccccttcccgaccactgc

SEQ ID NO: 483734 - DNA, 20 bp, mouse
gacccattcattgcccgcag

SEQ ID NO: 483735 - DNA, 20 bp, mouse
gcggccccggagacaaagac

SEQ ID NO: 483736 - DNA, 20 bp, mouse
ggccgcagagcgaggccaag

SEQ ID NO: 483737 - DNA, 20 bp, mouse
gactgggcctcctcccgcag

SEQ ID NO: 483738 - DNA, 20 bp, mouse
gagcagcgctatggccacca

SEQ ID NO: 483739 - DNA, 20 bp, mouse
ggggcgctggaggctcaacg

SEQ ID NO: 483740 - DNA, 20 bp, mouse
gtctgcgtgctcaggccggg

SEQ ID NO: 483741 - DNA, 20 bp, mouse
ggccccttggcctcgctctg

SEQ ID NO: 483742 - DNA, 20 bp, mouse
ggccaaggggctacaggctg

SEQ ID NO: 483743 - DNA, 20 bp, mouse
gggacaggcgggcagcaagg

SEQ ID NO: 483744 - DNA, 20 bp, mouse
ggcaacaagcgcagccacaa

SEQ ID NO: 483745 - DNA, 20 bp, mouse
gtcggccagaaaggcgcgta

SEQ ID NO: 483746 - DNA, 20 bp, mouse
ggaaggcggcgccacctcgg

SEQ ID NO: 483747 - DNA, 20 bp, mouse
gacctcggcggcggattcga

SEQ ID NO: 483748 - DNA, 20 bp, mouse
gcagcgaccatcggacggca

SEQ ID NO: 483749 - DNA, 20 bp, mouse
gtcctccaccgcggtcacta

SEQ ID NO: 483750 - DNA, 20 bp, mouse
ggacatgccatgccgtccga

SEQ ID NO: 483751 - DNA, 20 bp, mouse
ggtttcccagcagcgaccat

SEQ ID NO: 483752 - DNA, 20 bp, mouse
gacaccccggaagcggaagg

SEQ ID NO: 483753 - DNA, 20 bp, mouse
gaccgggagtgggaacggga

SEQ ID NO: 483754 - DNA, 20 bp, mouse
gggctccctagtgaccgcgg

SEQ ID NO: 483755 - DNA, 20 bp, mouse
gcggcgcagcctctccgtaa

SEQ ID NO: 483756 - DNA, 20 bp, mouse
gcgccgcgaacccaagatgg

SEQ ID NO: 483757 - DNA, 20 bp, mouse
gggtgtgtggacgtgtacgg

SEQ ID NO: 483758 - DNA, 20 bp, mouse
gcggcaacgccgccgacaag

SEQ ID NO: 483759 - DNA, 20 bp, mouse
ggctcgccgcgaacccaaga

SEQ ID NO: 483760 - DNA, 20 bp, mouse
gggcggtgtgtggacgtgta

SEQ ID NO: 483761 - DNA, 20 bp, mouse
ggtccacacaccgccatctt

SEQ ID NO: 483762 - DNA, 20 bp, mouse
ggggatgttccgcttgtcgg

SEQ ID NO: 483763 - DNA, 20 bp, mouse
gaacccaagatggcggtgtg

SEQ ID NO: 483764 - DNA, 20 bp, mouse
ggctgctgctgcgataactg

SEQ ID NO: 483765 - DNA, 20 bp, mouse
gcaggggcccagaatggtca

SEQ ID NO: 483766 - DNA, 20 bp, mouse
gccgaaggaaggatatacga

SEQ ID NO: 483767 - DNA, 20 bp, mouse
gttctagaagatgagctggg

SEQ ID NO: 483768 - DNA, 20 bp, mouse
gtctagaacggtccgaagga

SEQ ID NO: 483769 - DNA, 20 bp, mouse
gatatacgagggaagtgagc

SEQ ID NO: 483770 - DNA, 20 bp, mouse
gatcttctagaacggtccga

SEQ ID NO: 483771 - DNA, 20 bp, mouse
gccgttctagaagatgagct

SEQ ID NO: 483772 - DNA, 20 bp, mouse
ggcagtatagggtccctcaa

SEQ ID NO: 483773 - DNA, 20 bp, mouse
gggcaggcgggagaccacct

SEQ ID NO: 483774 - DNA, 20 bp, mouse
gtgttgccacccgcacgcta

SEQ ID NO: 483775 - DNA, 20 bp, mouse
gccccgacggaggtgagagg

SEQ ID NO: 483776 - DNA, 20 bp, mouse
gagcatgcaggtggcctctc

SEQ ID NO: 483777 - DNA, 20 bp, mouse
ggccccactccagccaagtt

SEQ ID NO: 483778 - DNA, 20 bp, mouse
ggcagggccccatcccaact

SEQ ID NO: 483779 - DNA, 20 bp, mouse
gccactgcccggcgcccgag

SEQ ID NO: 483780 - DNA, 20 bp, mouse
gctccagccaagttgggatg

SEQ ID NO: 483781 - DNA, 20 bp, mouse
ggggccctgcaaccactgcc

SEQ ID NO: 483782 - DNA, 20 bp, mouse
ggcttcgccaccaagagtaa

SEQ ID NO: 483783 - DNA, 20 bp, mouse
ggcgccgggcagtggttgca

SEQ ID NO: 483784 - DNA, 20 bp, mouse
gtggaccagggcactaatca

SEQ ID NO: 483785 - DNA, 20 bp, mouse
ggtggggctgccgagtgcgg

SEQ ID NO: 483786 - DNA, 20 bp, mouse
gaacgactaagggcccgtcc

SEQ ID NO: 483787 - DNA, 20 bp, mouse
gccgtccaggccgagcgccc

SEQ ID NO: 483788 - DNA, 20 bp, mouse
ggccgccgggaagctcgaca

SEQ ID NO: 483789 - DNA, 20 bp, mouse
gctcagggccggtgactcag

SEQ ID NO: 483790 - DNA, 20 bp, mouse
gagtcgacttgacggtcggg

SEQ ID NO: 483791 - DNA, 20 bp, mouse
gcggcgggagggagcggacc

SEQ ID NO: 483792 - DNA, 20 bp, mouse
gtccctgtcgagcttcccgg

SEQ ID NO: 483793 - DNA, 20 bp, mouse
ggcagcacttggcgagaagt

SEQ ID NO: 483794 - DNA, 20 bp, mouse
gttcaggcgggacgtacctg

SEQ ID NO: 483795 - DNA, 20 bp, mouse
ggccgctgccccgctctcca

SEQ ID NO: 483796 - DNA, 20 bp, mouse
gtggagctcggattaaccca

SEQ ID NO: 483797 - DNA, 20 bp, mouse
gaaacccagcatgctgaaga

SEQ ID NO: 483798 - DNA, 20 bp, mouse
gacttctgggtaaccctgag

SEQ ID NO: 483799 - DNA, 20 bp, mouse
gatggtgagttcactagcaa

SEQ ID NO: 483800 - DNA, 20 bp, mouse
gcttgctgtgatagtctgga

SEQ ID NO: 483801 - DNA, 20 bp, mouse
gttgccagatataacaaacg

SEQ ID NO: 483802 - DNA, 20 bp, mouse
gcaaataagaaaaccactca

SEQ ID NO: 483803 - DNA, 20 bp, mouse
gctgtttccctgttggagct

SEQ ID NO: 483804 - DNA, 20 bp, mouse
gacagcaaggatgacctgca

SEQ ID NO: 483805 - DNA, 20 bp, mouse
ggctccatcttcagcatgct

SEQ ID NO: 483806 - DNA, 20 bp, mouse
gacacattccccaggctaat

SEQ ID NO: 483807 - DNA, 20 bp, mouse
gcctagggtgccaactatca

SEQ ID NO: 483808 - DNA, 20 bp, mouse
gcagagattacactttaaac

SEQ ID NO: 483809 - DNA, 20 bp, mouse
gttcggcaaagatcttccta

SEQ ID NO: 483810 - DNA, 20 bp, mouse
gtctgtcttcccattagcct

SEQ ID NO: 483811 - DNA, 20 bp, mouse
ggcagctgatatgaatcaac

SEQ ID NO: 483812 - DNA, 20 bp, mouse
gatagccagcagactgccca

SEQ ID NO: 483813 - DNA, 20 bp, mouse
gatttcggatccgtgatagt

SEQ ID NO: 483814 - DNA, 20 bp, mouse
gagaacaatgagtttatgca

SEQ ID NO: 483815 - DNA, 20 bp, mouse
ggggccatggaaggatgtcg

SEQ ID NO: 483816 - DNA, 20 bp, mouse
gcacgccatactacagacca

SEQ ID NO: 483817 - DNA, 20 bp, mouse
gtgtccgccggtgaccatga

SEQ ID NO: 483818 - DNA, 20 bp, mouse
gagccgtacgtaattcgact

SEQ ID NO: 483819 - DNA, 20 bp, mouse
ggagaggccttcatggtcac

SEQ ID NO: 483820 - DNA, 20 bp, mouse
gaggccttcatggtcaccgg

SEQ ID NO: 483821 - DNA, 20 bp, mouse
gcaaggcagagaggccttca

SEQ ID NO: 483822 - DNA, 20 bp, mouse
gtctgccttggtctgtagta

SEQ ID NO: 483823 - DNA, 20 bp, mouse
gtgcccagtcgaattacgta

SEQ ID NO: 483824 - DNA, 20 bp, mouse
ggtagattggcaggtcacag

SEQ ID NO: 483825 - DNA, 20 bp, mouse
gaggcacggtcttcccccca

SEQ ID NO: 483826 - DNA, 20 bp, mouse
ggcgctcctccgctccgctg

SEQ ID NO: 483827 - DNA, 20 bp, mouse
gcagcgcaacgcagccgcag

SEQ ID NO: 483828 - DNA, 20 bp, mouse
gccccggagggccgtatggg

SEQ ID NO: 483829 - DNA, 20 bp, mouse
ggctccccggagggccgtat

SEQ ID NO: 483830 - DNA, 20 bp, mouse
gagcaggccatgggcaaatc

SEQ ID NO: 483831 - DNA, 20 bp, mouse
ggagcgcacacagcaggcca

SEQ ID NO: 483832 - DNA, 20 bp, mouse
ggaggtagcggtaagaacac

SEQ ID NO: 483833 - DNA, 20 bp, mouse
ggctgcaatgcgggatccct

SEQ ID NO: 483834 - DNA, 20 bp, mouse
gtctggaccgccctagccag

SEQ ID NO: 483835 - DNA, 20 bp, mouse
gatcaggtgagccacccata

SEQ ID NO: 483836 - DNA, 20 bp, mouse
gcccgcggcgaggtgagaag

SEQ ID NO: 483837 - DNA, 20 bp, mouse
gggtgtcgccccgtaggacg

SEQ ID NO: 483838 - DNA, 20 bp, mouse
gccgcgagagcgaggcctca

SEQ ID NO: 483839 - DNA, 20 bp, mouse
gacggccgccgcgtcctacg

SEQ ID NO: 483840 - DNA, 20 bp, mouse
ggtcgccccgtaggacgcgg

SEQ ID NO: 483841 - DNA, 20 bp, mouse
gcacctcgccgcgggcgcag

SEQ ID NO: 483842 - DNA, 20 bp, mouse
gggctccggcgtgagacttg

SEQ ID NO: 483843 - DNA, 20 bp, mouse
gtgccacacaccccattcac

SEQ ID NO: 483844 - DNA, 20 bp, mouse
gctacggggcgacaccccgg

SEQ ID NO: 483845 - DNA, 20 bp, mouse
ggcgggcgcagcggctcgcg

SEQ ID NO: 483846 - DNA, 20 bp, mouse
gccggggcgcgaggcttacg

SEQ ID NO: 483847 - DNA, 20 bp, mouse
gagctgcagatgtggcggag

SEQ ID NO: 483848 - DNA, 20 bp, mouse
gctgccccgagctgcagatg

SEQ ID NO: 483849 - DNA, 20 bp, mouse
gccgccacatctgcagctcg

SEQ ID NO: 483850 - DNA, 20 bp, mouse
gtacggggcacgggctcccc

SEQ ID NO: 483851 - DNA, 20 bp, mouse
gtcagcccggcagccgaggt

SEQ ID NO: 483852 - DNA, 20 bp, mouse
ggccgaggtaggaagccccc

SEQ ID NO: 483853 - DNA, 20 bp, mouse
gccagggagccggcgagaaa

SEQ ID NO: 483854 - DNA, 20 bp, mouse
gcctcagcgagggctcacaa

SEQ ID NO: 483855 - DNA, 20 bp, mouse
gcgcggggcagcgtaaccag

SEQ ID NO: 483856 - DNA, 20 bp, mouse
ggaggccagaaagtgcttac

SEQ ID NO: 483857 - DNA, 20 bp, mouse
ggacgtgcacaagagaagcc

SEQ ID NO: 483858 - DNA, 20 bp, mouse
gaagtcctcaagtggcagcg

SEQ ID NO: 483859 - DNA, 20 bp, mouse
gggacttagaggactgtgga

SEQ ID NO: 483860 - DNA, 20 bp, mouse
gcagatgacccagcccccaa

SEQ ID NO: 483861 - DNA, 20 bp, mouse
gtgcagacgcgtcactttca

SEQ ID NO: 483862 - DNA, 20 bp, mouse
gtcggagttcaaggacttac

SEQ ID NO: 483863 - DNA, 20 bp, mouse
gtgggcttgactttttgaac

SEQ ID NO: 483864 - DNA, 20 bp, mouse
gctgaaggttgaagagttca

SEQ ID NO: 483865 - DNA, 20 bp, mouse
gctggcctcgctgccacttg

SEQ ID NO: 483866 - DNA, 20 bp, mouse
gcggcctgcgctacctgaag

SEQ ID NO: 483867 - DNA, 20 bp, mouse
gaggcaggcgcgtggatcgg

SEQ ID NO: 483868 - DNA, 20 bp, mouse
ggcgctacctgaagtggaga

SEQ ID NO: 483869 - DNA, 20 bp, mouse
gggcgcgtggatcggcgggt

SEQ ID NO: 483870 - DNA, 20 bp, mouse
gaagaggcaggcgcgtggat

SEQ ID NO: 483871 - DNA, 20 bp, mouse
ggcctcagccaggcgcggta

SEQ ID NO: 483872 - DNA, 20 bp, mouse
gtaggtagacatgctgggtc

SEQ ID NO: 483873 - DNA, 20 bp, mouse
ggtgcggcgcaggtcctgtt

SEQ ID NO: 483874 - DNA, 20 bp, mouse
ggtagacatgctgggtcggg

SEQ ID NO: 483875 - DNA, 20 bp, mouse
ggcgggtaggtagacatgct

SEQ ID NO: 483876 - DNA, 20 bp, mouse
gcacgctccacaaggcccgg

SEQ ID NO: 483877 - DNA, 20 bp, mouse
gcggcggctggagcgacctg

SEQ ID NO: 483878 - DNA, 20 bp, mouse
gtgcaagcagcggccagacc

SEQ ID NO: 483879 - DNA, 20 bp, mouse
gaccgggttaggattccgtc

SEQ ID NO: 483880 - DNA, 20 bp, mouse
ggtcactcagccgactgcaa

SEQ ID NO: 483881 - DNA, 20 bp, mouse
ggctggaaagagggcgatgg

SEQ ID NO: 483882 - DNA, 20 bp, mouse
ggcagcggccagaccgggtt

SEQ ID NO: 483883 - DNA, 20 bp, mouse
gagcaccaaggtgggtgaca

SEQ ID NO: 483884 - DNA, 20 bp, mouse
gcagaccctagcaccaaggt

SEQ ID NO: 483885 - DNA, 20 bp, mouse
ggactgcaaaggcgtccccc

SEQ ID NO: 483886 - DNA, 20 bp, mouse
gagagctcgacgagtggcca

SEQ ID NO: 483887 - DNA, 20 bp, mouse
gaagtgcagagctcgacgag

SEQ ID NO: 483888 - DNA, 20 bp, mouse
gttcccaacccgaaagaggg

SEQ ID NO: 483889 - DNA, 20 bp, mouse
ggctagcgcgagaccccgat

SEQ ID NO: 483890 - DNA, 20 bp, mouse
gaggggagggaagacgccgt

SEQ ID NO: 483891 - DNA, 20 bp, mouse
gcgtggcaacgcggagtcta

SEQ ID NO: 483892 - DNA, 20 bp, mouse
gcgtagacaacacagctggt

SEQ ID NO: 483893 - DNA, 20 bp, mouse
gtaggtgagtcccctttcaa

SEQ ID NO: 483894 - DNA, 20 bp, mouse
gccaaaccgggaaggatcgt

SEQ ID NO: 483895 - DNA, 20 bp, mouse
gcaacgcggagtctagggcc

SEQ ID NO: 483896 - DNA, 20 bp, mouse
gactggaaggcaggtaggtt

SEQ ID NO: 483897 - DNA, 20 bp, mouse
gtctttcctggtagactgga

SEQ ID NO: 483898 - DNA, 20 bp, mouse
gacctgccttccagtctacc

SEQ ID NO: 483899 - DNA, 20 bp, mouse
gggcagcagaagccctgctt

SEQ ID NO: 483900 - DNA, 20 bp, mouse
gaagtcagcagacccaggtt

SEQ ID NO: 483901 - DNA, 20 bp, mouse
gctctctgggtgcttcactg

SEQ ID NO: 483902 - DNA, 20 bp, mouse
gctctgtgcctggagatcaa

SEQ ID NO: 483903 - DNA, 20 bp, mouse
gtcctggtagactggaaggc

SEQ ID NO: 483904 - DNA, 20 bp, mouse
gagggctcgggtttaagggt

SEQ ID NO: 483905 - DNA, 20 bp, mouse
gttacctgactttcagatgt

SEQ ID NO: 483906 - DNA, 20 bp, mouse
ggcccggcagggatcagtcg

SEQ ID NO: 483907 - DNA, 20 bp, mouse
gatggctgggcgctcaggac

SEQ ID NO: 483908 - DNA, 20 bp, mouse
gcgccaggcgcaggaggctt

SEQ ID NO: 483909 - DNA, 20 bp, mouse
gtcagagcagggcaaccctg

SEQ ID NO: 483910 - DNA, 20 bp, mouse
gggcacaagagctagcggag

SEQ ID NO: 483911 - DNA, 20 bp, mouse
gctgcgggcacaagagctag

SEQ ID NO: 483912 - DNA, 20 bp, mouse
gcagctggagccgagaagtg

SEQ ID NO: 483913 - DNA, 20 bp, mouse
gcggcgcgcggttccgcagg

SEQ ID NO: 483914 - DNA, 20 bp, mouse
gtggccatggctgggcgctc

SEQ ID NO: 483915 - DNA, 20 bp, mouse
gcagcaggagcgccaggcgc

SEQ ID NO: 483916 - DNA, 20 bp, mouse
ggagcaactcagacagtcgg

SEQ ID NO: 483917 - DNA, 20 bp, mouse
ggacagtcggcggcctgaag

SEQ ID NO: 483918 - DNA, 20 bp, mouse
gcagagccgacgcatcccgt

SEQ ID NO: 483919 - DNA, 20 bp, mouse
gcaagatgtactgcaggcgg

SEQ ID NO: 483920 - DNA, 20 bp, mouse
ggtagagcaactcagacagt

SEQ ID NO: 483921 - DNA, 20 bp, mouse
gacttcctctctggacaagg

SEQ ID NO: 483922 - DNA, 20 bp, mouse
gcagccagtgggcatccctg

SEQ ID NO: 483923 - DNA, 20 bp, mouse
gcattcctccttgtccagag

SEQ ID NO: 483924 - DNA, 20 bp, mouse
gtggagagactcaggcccct

SEQ ID NO: 483925 - DNA, 20 bp, mouse
gcgtgggagtggagagactc

SEQ ID NO: 483926 - DNA, 20 bp, mouse
gccaggcagctaaggtaccg

SEQ ID NO: 483927 - DNA, 20 bp, mouse
gccgggctggacgctctccg

SEQ ID NO: 483928 - DNA, 20 bp, mouse
gtcgtgcaggttcagcacca

SEQ ID NO: 483929 - DNA, 20 bp, mouse
ggacgaggtgtcagagccgg

SEQ ID NO: 483930 - DNA, 20 bp, mouse
ggcacgactgccgctgtccg

SEQ ID NO: 483931 - DNA, 20 bp, mouse
gagggacgaggtgtcagagc

SEQ ID NO: 483932 - DNA, 20 bp, mouse
gagagcgtccagcccggctg

SEQ ID NO: 483933 - DNA, 20 bp, mouse
gccgggggagaattgcagcc

SEQ ID NO: 483934 - DNA, 20 bp, mouse
gaagccagagagcgccactg

SEQ ID NO: 483935 - DNA, 20 bp, mouse
gcgtccagcccggctgcggg

SEQ ID NO: 483936 - DNA, 20 bp, mouse
ggtagctctcattccagcac

SEQ ID NO: 483937 - DNA, 20 bp, mouse
gtcgcatcaccatgcaaagg

SEQ ID NO: 483938 - DNA, 20 bp, mouse
gcaatgccacgctggaagtc

SEQ ID NO: 483939 - DNA, 20 bp, mouse
gctctgtatattgaagtgtt

SEQ ID NO: 483940 - DNA, 20 bp, mouse
gtccgagtgctgaaatttat

SEQ ID NO: 483941 - DNA, 20 bp, mouse
gctgaggctttgtctctcct

SEQ ID NO: 483942 - DNA, 20 bp, mouse
gtaatcgcatcaccatgcaa

SEQ ID NO: 483943 - DNA, 20 bp, mouse
gttgagtctggacaataaat

SEQ ID NO: 483944 - DNA, 20 bp, mouse
gtctctcctgggctaactga

SEQ ID NO: 483945 - DNA, 20 bp, mouse
gtgaccatgatgcccaagac

SEQ ID NO: 483946 - DNA, 20 bp, mouse
gctccgtgggatttatgcaa

SEQ ID NO: 483947 - DNA, 20 bp, mouse
gttctggctcttggacctag

SEQ ID NO: 483948 - DNA, 20 bp, mouse
gaacagcagcagtcaaaatt

SEQ ID NO: 483949 - DNA, 20 bp, mouse
gttgggaatgctgctccact

SEQ ID NO: 483950 - DNA, 20 bp, mouse
ggcgcggcaaagacaggcgg

SEQ ID NO: 483951 - DNA, 20 bp, mouse
gcgtgggatttatgcaaagg

SEQ ID NO: 483952 - DNA, 20 bp, mouse
gagcggagcgcggcaaagac

SEQ ID NO: 483953 - DNA, 20 bp, mouse
gtctcacgtgggccatgata

SEQ ID NO: 483954 - DNA, 20 bp, mouse
ggtcctgcgggagctgtctg

SEQ ID NO: 483955 - DNA, 20 bp, mouse
gcgacgcgtcaggagtgcag

SEQ ID NO: 483956 - DNA, 20 bp, mouse
gttcagagggtgcatctagg

SEQ ID NO: 483957 - DNA, 20 bp, mouse
gggaaccccactccagctac

SEQ ID NO: 483958 - DNA, 20 bp, mouse
gaggcacagtcgccagtagc

SEQ ID NO: 483959 - DNA, 20 bp, mouse
ggtcgccagtagctggagtg

SEQ ID NO: 483960 - DNA, 20 bp, mouse
gggtgcatctagggggatgt

SEQ ID NO: 483961 - DNA, 20 bp, mouse
gaccctgactgctaaggaca

SEQ ID NO: 483962 - DNA, 20 bp, mouse
gcaggttcagatctattcag

SEQ ID NO: 483963 - DNA, 20 bp, mouse
ggctttcagagggtgcatct

SEQ ID NO: 483964 - DNA, 20 bp, mouse
ggtgagagcaggtatcctgt

SEQ ID NO: 483965 - DNA, 20 bp, mouse
gtcccctccaggactctcca

SEQ ID NO: 483966 - DNA, 20 bp, mouse
gccctccgccgaggtgacgg

SEQ ID NO: 483967 - DNA, 20 bp, mouse
ggcaggcgcgtcaaactcgg

SEQ ID NO: 483968 - DNA, 20 bp, mouse
gcctggcggcgagctccctg

SEQ ID NO: 483969 - DNA, 20 bp, mouse
gtgcgccgccgtcacctcgg

SEQ ID NO: 483970 - DNA, 20 bp, mouse
gcacggcgcacgctcagggg

SEQ ID NO: 483971 - DNA, 20 bp, mouse
gacctcggcggagggctgag

SEQ ID NO: 483972 - DNA, 20 bp, mouse
gggagcaggcgcgtcaaact

SEQ ID NO: 483973 - DNA, 20 bp, mouse
gcgccacggcgcacgctcag

SEQ ID NO: 483974 - DNA, 20 bp, mouse
gcatcccagagtggtagagg

SEQ ID NO: 483975 - DNA, 20 bp, mouse
gatcgctccaggaggataag

SEQ ID NO: 483976 - DNA, 20 bp, mouse
gaacagaagaggacagacga

SEQ ID NO: 483977 - DNA, 20 bp, mouse
ggccccgtccagcctagagt

SEQ ID NO: 483978 - DNA, 20 bp, mouse
ggtttgaagacggggtcgtt

SEQ ID NO: 483979 - DNA, 20 bp, mouse
gctggtatgtggacgatcaa

SEQ ID NO: 483980 - DNA, 20 bp, mouse
ggtccacataccagttgtag

SEQ ID NO: 483981 - DNA, 20 bp, mouse
gggctgaacaccactacaac

SEQ ID NO: 483982 - DNA, 20 bp, mouse
gcaccactacaactggtatg

SEQ ID NO: 483983 - DNA, 20 bp, mouse
gtgtgtccagtttgaagacg

SEQ ID NO: 483984 - DNA, 20 bp, mouse
gttcagccctgacctgatct

SEQ ID NO: 483985 - DNA, 20 bp, mouse
gagggaggggaggatcggga

SEQ ID NO: 483986 - DNA, 20 bp, mouse
gtcaactgcacgttcctccc

SEQ ID NO: 483987 - DNA, 20 bp, mouse
gaacgtgcagttgaaagtaa

SEQ ID NO: 483988 - DNA, 20 bp, mouse
gttctgcagtaggggcaggt

SEQ ID NO: 483989 - DNA, 20 bp, mouse
gggcaacggcatcctagaaa

SEQ ID NO: 483990 - DNA, 20 bp, mouse
gagacactgctcaaatgagt

SEQ ID NO: 483991 - DNA, 20 bp, mouse
gcacaccctgcaaagtcctc

SEQ ID NO: 483992 - DNA, 20 bp, mouse
ggcagttgaaagtaatggtc

SEQ ID NO: 483993 - DNA, 20 bp, mouse
gtgtctacaaagctctggaa

SEQ ID NO: 483994 - DNA, 20 bp, mouse
gggaccagaaggcagaacgc

SEQ ID NO: 483995 - DNA, 20 bp, mouse
gcagaaggcagaacgctggt

SEQ ID NO: 483996 - DNA, 20 bp, mouse
gtcgcctgctgctctcccgg

SEQ ID NO: 483997 - DNA, 20 bp, mouse
gaaggtccccggcagcctcc

SEQ ID NO: 483998 - DNA, 20 bp, mouse
gggcgccaggacatagccaa

SEQ ID NO: 483999 - DNA, 20 bp, mouse
gggacatagccaaaggtccc

SEQ ID NO: 484000 - DNA, 20 bp, mouse
ggcgatcgcgaccacgacga

SEQ ID NO: 484001 - DNA, 20 bp, mouse
gcggagcgaggccgccggag

SEQ ID NO: 484002 - DNA, 20 bp, mouse
gcagcctccgggagagcagc

SEQ ID NO: 484003 - DNA, 20 bp, mouse
ggggcgggcttccatcgtcg

SEQ ID NO: 484004 - DNA, 20 bp, mouse
ggctctcccggaggctgccg

SEQ ID NO: 484005 - DNA, 20 bp, mouse
gcgatcgcctgctgctctcc

SEQ ID NO: 484006 - DNA, 20 bp, mouse
ggagcgccggaggctcgata

SEQ ID NO: 484007 - DNA, 20 bp, mouse
gaccagcagtcgagcgccgg

SEQ ID NO: 484008 - DNA, 20 bp, mouse
ggccggacggacacgcgagg

SEQ ID NO: 484009 - DNA, 20 bp, mouse
gagagggcccggggaccaga

SEQ ID NO: 484010 - DNA, 20 bp, mouse
ggacaccagcagtcgagcgc

SEQ ID NO: 484011 - DNA, 20 bp, mouse
gtccggccctatcgagcctc

SEQ ID NO: 484012 - DNA, 20 bp, mouse
gtaccgccgcggcccaagta

SEQ ID NO: 484013 - DNA, 20 bp, mouse
ggccggaggctcgatagggc

SEQ ID NO: 484014 - DNA, 20 bp, mouse
gccacatgcgggtctccgga

SEQ ID NO: 484015 - DNA, 20 bp, mouse
ggcctccggcgctcgactgc

SEQ ID NO: 484016 - DNA, 20 bp, mouse
ggaggcggtggacagcgagc

SEQ ID NO: 484017 - DNA, 20 bp, mouse
gcgcctctgcggccactcca

SEQ ID NO: 484018 - DNA, 20 bp, mouse
gtgggccggccggacaccac

SEQ ID NO: 484019 - DNA, 20 bp, mouse
ggcgctggtgaagaaggaca

SEQ ID NO: 484020 - DNA, 20 bp, mouse
gatgagcgcgtccctgagcc

SEQ ID NO: 484021 - DNA, 20 bp, mouse
gcgccgtggtgcagattctg

SEQ ID NO: 484022 - DNA, 20 bp, mouse
gagccgcagaatctgcacca

SEQ ID NO: 484023 - DNA, 20 bp, mouse
gctggtgaagaaggacaagg

SEQ ID NO: 484024 - DNA, 20 bp, mouse
gtgtccggccggcccaccag

SEQ ID NO: 484025 - DNA, 20 bp, mouse
gcgttgctgaagccgcactg

SEQ ID NO: 484026 - DNA, 20 bp, mouse
gcggccagagcaacttcggc

SEQ ID NO: 484027 - DNA, 20 bp, mouse
gcagccagccgaagttgctc

SEQ ID NO: 484028 - DNA, 20 bp, mouse
ggggcgccggcggtatgatg

SEQ ID NO: 484029 - DNA, 20 bp, mouse
gtgagactgacgctcaaggg

SEQ ID NO: 484030 - DNA, 20 bp, mouse
gcgcacggcggggagaggac

SEQ ID NO: 484031 - DNA, 20 bp, mouse
gcttcggctggctgcaggct

SEQ ID NO: 484032 - DNA, 20 bp, mouse
gttgagcgtcagtctcagtg

SEQ ID NO: 484033 - DNA, 20 bp, mouse
gcgccgcaggacggctccga

SEQ ID NO: 484034 - DNA, 20 bp, mouse
gcgcaggacggctccgacgg

SEQ ID NO: 484035 - DNA, 20 bp, mouse
gggcgcccgctcgtcagatg

SEQ ID NO: 484036 - DNA, 20 bp, mouse
gggcgctccagacgtgcgag

SEQ ID NO: 484037 - DNA, 20 bp, mouse
gagtaaggctcgcgggacag

SEQ ID NO: 484038 - DNA, 20 bp, mouse
ggctccagacgtgcgagcgg

SEQ ID NO: 484039 - DNA, 20 bp, mouse
gctggagcgcccgggccgag

SEQ ID NO: 484040 - DNA, 20 bp, mouse
ggcgttctgcagagccctca

SEQ ID NO: 484041 - DNA, 20 bp, mouse
gcgcgccacccgctcggccc

SEQ ID NO: 484042 - DNA, 20 bp, mouse
gctcatggagcgcatgcccc

SEQ ID NO: 484043 - DNA, 20 bp, mouse
gggcctcaccgaggtagtac

SEQ ID NO: 484044 - DNA, 20 bp, mouse
gctgcgctgcggcctcaccg

SEQ ID NO: 484045 - DNA, 20 bp, mouse
ggagctagcgagaacgacag

SEQ ID NO: 484046 - DNA, 20 bp, mouse
gctggtggcccagttcttgg

SEQ ID NO: 484047 - DNA, 20 bp, mouse
gtggcggtagcgacgacatg

SEQ ID NO: 484048 - DNA, 20 bp, mouse
gcctcagtactgccaggaac

SEQ ID NO: 484049 - DNA, 20 bp, mouse
ggacatgcggctcctgttcc

SEQ ID NO: 484050 - DNA, 20 bp, mouse
gggtccccgcaacataccgt

SEQ ID NO: 484051 - DNA, 20 bp, mouse
gtgaccgcgttgccagtgtg

SEQ ID NO: 484052 - DNA, 20 bp, mouse
ggtgaggcctcagtactgcc

SEQ ID NO: 484053 - DNA, 20 bp, mouse
ggcctctttgcggcatccta

SEQ ID NO: 484054 - DNA, 20 bp, mouse
ggtcgctaccgccaagaact

SEQ ID NO: 484055 - DNA, 20 bp, mouse
gccaccaggcccgggcggag

SEQ ID NO: 484056 - DNA, 20 bp, mouse
gacccagctagagaaggtcg

SEQ ID NO: 484057 - DNA, 20 bp, mouse
gccacagcccgcaccctccg

SEQ ID NO: 484058 - DNA, 20 bp, mouse
gagcgcacagggcacaacag

SEQ ID NO: 484059 - DNA, 20 bp, mouse
gacggagcttcgcaggtctc

SEQ ID NO: 484060 - DNA, 20 bp, mouse
ggccacctccctgcctcgga

SEQ ID NO: 484061 - DNA, 20 bp, mouse
gccagcacgtcagcgggtga

SEQ ID NO: 484062 - DNA, 20 bp, mouse
gtccctgcctcggagggtgc

SEQ ID NO: 484063 - DNA, 20 bp, mouse
gagcttcgcaggtctcgggc

SEQ ID NO: 484064 - DNA, 20 bp, mouse
ggcccgcaccctccgaggca

SEQ ID NO: 484065 - DNA, 20 bp, mouse
gaccgcgcccagacgcccga

SEQ ID NO: 484066 - DNA, 20 bp, mouse
gcttggatcagggtggtatt

SEQ ID NO: 484067 - DNA, 20 bp, mouse
gagacaggcaaaaatgtccg

SEQ ID NO: 484068 - DNA, 20 bp, mouse
gtcctagggaggatagctct

SEQ ID NO: 484069 - DNA, 20 bp, mouse
gtcccagagctatcctccct

SEQ ID NO: 484070 - DNA, 20 bp, mouse
gaccaccctgatccaaggta

SEQ ID NO: 484071 - DNA, 20 bp, mouse
gcagggtggtattgggagac

SEQ ID NO: 484072 - DNA, 20 bp, mouse
gcaggcaaaaatgtccgtgg

SEQ ID NO: 484073 - DNA, 20 bp, mouse
gggctccttaccttggatca

SEQ ID NO: 484074 - DNA, 20 bp, mouse
gggaggacatttgtttccta

SEQ ID NO: 484075 - DNA, 20 bp, mouse
gtgccaactgaagtacctgg

SEQ ID NO: 484076 - DNA, 20 bp, mouse
gccctcgtgagcagtgtaca

SEQ ID NO: 484077 - DNA, 20 bp, mouse
gcgccccgcgccatcgacaa

SEQ ID NO: 484078 - DNA, 20 bp, mouse
gcccgcgccatcgacaaggg

SEQ ID NO: 484079 - DNA, 20 bp, mouse
gggaagcggatgtctccgag

SEQ ID NO: 484080 - DNA, 20 bp, mouse
gacactgctcacgagggctg

SEQ ID NO: 484081 - DNA, 20 bp, mouse
ggagcagtgtacagggttct

SEQ ID NO: 484082 - DNA, 20 bp, mouse
ggacgtacctcccttgtcga

SEQ ID NO: 484083 - DNA, 20 bp, mouse
gctggctttctggcagaggg

SEQ ID NO: 484084 - DNA, 20 bp, mouse
gagctctgcagcagccacgt

SEQ ID NO: 484085 - DNA, 20 bp, mouse
gaggcgcagcaggcgccacg

SEQ ID NO: 484086 - DNA, 20 bp, mouse
gactcagagaagtaactcgg

SEQ ID NO: 484087 - DNA, 20 bp, mouse
gcagagaagtaactcggagg

SEQ ID NO: 484088 - DNA, 20 bp, mouse
ggcagcttagtggtcccgcg

SEQ ID NO: 484089 - DNA, 20 bp, mouse
ggccatttgggatttccaat

SEQ ID NO: 484090 - DNA, 20 bp, mouse
gaaactgcggctggcctcgc

SEQ ID NO: 484091 - DNA, 20 bp, mouse
gcagggctcgcaagccattt

SEQ ID NO: 484092 - DNA, 20 bp, mouse
gtgaactcagagaagtaact

SEQ ID NO: 484093 - DNA, 20 bp, mouse
gacaagtggtgtagacagaa

SEQ ID NO: 484094 - DNA, 20 bp, mouse
gatttacctgatggatgtga

SEQ ID NO: 484095 - DNA, 20 bp, mouse
ggggatttccaatgggatct

SEQ ID NO: 484096 - DNA, 20 bp, mouse
gcgggctggggcatcaccaa

SEQ ID NO: 484097 - DNA, 20 bp, mouse
ggcgacgctggcgtcccggg

SEQ ID NO: 484098 - DNA, 20 bp, mouse
gaagggcccgggtgcatctg

SEQ ID NO: 484099 - DNA, 20 bp, mouse
gcccgggactcaccaaagaa

SEQ ID NO: 484100 - DNA, 20 bp, mouse
gggccagcagcgccatttcg

SEQ ID NO: 484101 - DNA, 20 bp, mouse
ggcccgggcgcggacgccct

SEQ ID NO: 484102 - DNA, 20 bp, mouse
gatctgaggaagagggatct

SEQ ID NO: 484103 - DNA, 20 bp, mouse
gaagggcctcgaccccgaaa

SEQ ID NO: 484104 - DNA, 20 bp, mouse
gatgccccagcccgcgccga

SEQ ID NO: 484105 - DNA, 20 bp, mouse
gagagggatctgggcaggtg

SEQ ID NO: 484106 - DNA, 20 bp, mouse
gcgcaggctccgagcttgag

SEQ ID NO: 484107 - DNA, 20 bp, mouse
gctgcggttgagcagaaacc

SEQ ID NO: 484108 - DNA, 20 bp, mouse
gcaccatcggaacccatctc

SEQ ID NO: 484109 - DNA, 20 bp, mouse
ggagcttgaggggaaagcat

SEQ ID NO: 484110 - DNA, 20 bp, mouse
ggcgtagcagcaagccaggg

SEQ ID NO: 484111 - DNA, 20 bp, mouse
gtggcacccagcatacacct

SEQ ID NO: 484112 - DNA, 20 bp, mouse
gcacctgagatgggttccga

SEQ ID NO: 484113 - DNA, 20 bp, mouse
gttacctgacgtgaaccagg

SEQ ID NO: 484114 - DNA, 20 bp, mouse
ggcagcagaggccagcgatg

SEQ ID NO: 484115 - DNA, 20 bp, mouse
gcagaggccagcgatgggga

SEQ ID NO: 484116 - DNA, 20 bp, mouse
ggcaccagcgatggtcatgg

SEQ ID NO: 484117 - DNA, 20 bp, mouse
gtggcggaaccagcgtccca

SEQ ID NO: 484118 - DNA, 20 bp, mouse
ggatagcgaagggaattgca

SEQ ID NO: 484119 - DNA, 20 bp, mouse
gtaagcagggagccgaggac

SEQ ID NO: 484120 - DNA, 20 bp, mouse
ggaaccagcgtcccagggct

SEQ ID NO: 484121 - DNA, 20 bp, mouse
ggccaccaactagctaggtg

SEQ ID NO: 484122 - DNA, 20 bp, mouse
ggaaaggccaccaactagct

SEQ ID NO: 484123 - DNA, 20 bp, mouse
gagcgaagggaattgcatgg

SEQ ID NO: 484124 - DNA, 20 bp, mouse
gggtgcaccagcgatggtca

SEQ ID NO: 484125 - DNA, 20 bp, mouse
gctgcacctctggacaccac

SEQ ID NO: 484126 - DNA, 20 bp, mouse
ggccctgtgtagacctggag

SEQ ID NO: 484127 - DNA, 20 bp, mouse
ggccactccaggtctacaca

SEQ ID NO: 484128 - DNA, 20 bp, mouse
gtccacagctggccccacaa

SEQ ID NO: 484129 - DNA, 20 bp, mouse
ggctatgaacgaatcatgaa

SEQ ID NO: 484130 - DNA, 20 bp, mouse
gcatgaagggaagggtgcgg

SEQ ID NO: 484131 - DNA, 20 bp, mouse
gagggtgcggtggccactcc

SEQ ID NO: 484132 - DNA, 20 bp, mouse
ggaacgaatcatgaagggaa

SEQ ID NO: 484133 - DNA, 20 bp, mouse
ggctctgtacatggggatgt

SEQ ID NO: 484134 - DNA, 20 bp, mouse
gttcatagcacaggtaacca

SEQ ID NO: 484135 - DNA, 20 bp, mouse
gatggggatgtaggctggag

SEQ ID NO: 484136 - DNA, 20 bp, mouse
gtagtcctggccactcaggt

SEQ ID NO: 484137 - DNA, 20 bp, mouse
gggtaggactcagtaaggaa

SEQ ID NO: 484138 - DNA, 20 bp, mouse
gaaccttgtcatgtaggcaa

SEQ ID NO: 484139 - DNA, 20 bp, mouse
gggcctcaaccttgtcatgt

SEQ ID NO: 484140 - DNA, 20 bp, mouse
gtacccttgcctacatgaca

SEQ ID NO: 484141 - DNA, 20 bp, mouse
gactcaggtaggactcagta

SEQ ID NO: 484142 - DNA, 20 bp, mouse
gccaagcaagccagacacac

SEQ ID NO: 484143 - DNA, 20 bp, mouse
gtggcaaacaccttgatccc

SEQ ID NO: 484144 - DNA, 20 bp, mouse
ggcagtgagtcggagcaggg

SEQ ID NO: 484145 - DNA, 20 bp, mouse
gagcagggcggccagcaata

SEQ ID NO: 484146 - DNA, 20 bp, mouse
ggcgcacgaccgggtacgtg

SEQ ID NO: 484147 - DNA, 20 bp, mouse
gggtcgacctctaaccccag

SEQ ID NO: 484148 - DNA, 20 bp, mouse
ggctacaggagcgcacgacc

SEQ ID NO: 484149 - DNA, 20 bp, mouse
gtgttaaagatactattgat

SEQ ID NO: 484150 - DNA, 20 bp, mouse
gacctggtgctagacggacc

SEQ ID NO: 484151 - DNA, 20 bp, mouse
gaagcgcacggccacgccac

SEQ ID NO: 484152 - DNA, 20 bp, mouse
ggggcatcccggctcggtgt

SEQ ID NO: 484153 - DNA, 20 bp, mouse
ggggctgcggccgacctcgg

SEQ ID NO: 484154 - DNA, 20 bp, mouse
gctagacggaccgggcatcc

SEQ ID NO: 484155 - DNA, 20 bp, mouse
gcacgaccgggtacgtgggg

SEQ ID NO: 484156 - DNA, 20 bp, mouse
gcccagacggcggtacatgg

SEQ ID NO: 484157 - DNA, 20 bp, mouse
gcctggaccgcggggaggaa

SEQ ID NO: 484158 - DNA, 20 bp, mouse
gcggcgggagctgtaaagac

SEQ ID NO: 484159 - DNA, 20 bp, mouse
gaccgcggggaggaagggct

SEQ ID NO: 484160 - DNA, 20 bp, mouse
gcagcgcttcgcccagacgg

SEQ ID NO: 484161 - DNA, 20 bp, mouse
gagacggcggtacatggcgg

SEQ ID NO: 484162 - DNA, 20 bp, mouse
ggcaggcctggaccgcgggg

SEQ ID NO: 484163 - DNA, 20 bp, mouse
gagctcgcaggcctggaccg

SEQ ID NO: 484164 - DNA, 20 bp, mouse
gtcgcccagacggcggtaca

SEQ ID NO: 484165 - DNA, 20 bp, mouse
gcgggctgaggcgagtgcgg

SEQ ID NO: 484166 - DNA, 20 bp, mouse
gagcgaggcggagaggagat

SEQ ID NO: 484167 - DNA, 20 bp, mouse
gaccctgcagagcggagaat

SEQ ID NO: 484168 - DNA, 20 bp, mouse
gtcaggagagcgaggcggag

SEQ ID NO: 484169 - DNA, 20 bp, mouse
ggagaggccgcgccaagcgg

SEQ ID NO: 484170 - DNA, 20 bp, mouse
gtgaacaggtcaggagagcg

SEQ ID NO: 484171 - DNA, 20 bp, mouse
ggagcccgccggccactccg

SEQ ID NO: 484172 - DNA, 20 bp, mouse
gaggcgcctgcgcccaccta

SEQ ID NO: 484173 - DNA, 20 bp, mouse
gagtcagctgctgtacggag

SEQ ID NO: 484174 - DNA, 20 bp, mouse
gcacgctgcaaacacgcggg

SEQ ID NO: 484175 - DNA, 20 bp, mouse
gctcccagggggccataccc

SEQ ID NO: 484176 - DNA, 20 bp, mouse
gcagcaggcttggtgagaac

SEQ ID NO: 484177 - DNA, 20 bp, mouse
ggaatcggctctgcaagatg

SEQ ID NO: 484178 - DNA, 20 bp, mouse
gacaccctggcctgggacaa

SEQ ID NO: 484179 - DNA, 20 bp, mouse
gcggaagagtgagtgagctt

SEQ ID NO: 484180 - DNA, 20 bp, mouse
ggcatgagatcagcaaagga

SEQ ID NO: 484181 - DNA, 20 bp, mouse
gatggttgtgtgagatgcat

SEQ ID NO: 484182 - DNA, 20 bp, mouse
gtcagaaattaactgaactg

SEQ ID NO: 484183 - DNA, 20 bp, mouse
gtctgagacaaatccttacc

SEQ ID NO: 484184 - DNA, 20 bp, mouse
gggaactctagatcataaaa

SEQ ID NO: 484185 - DNA, 20 bp, mouse
ggcccacttgtgaaggatag

SEQ ID NO: 484186 - DNA, 20 bp, mouse
gtccagtatgaataatttgg

SEQ ID NO: 484187 - DNA, 20 bp, mouse
gtccaccaaattattcatac

SEQ ID NO: 484188 - DNA, 20 bp, mouse
gcactttcctgaatcactca

SEQ ID NO: 484189 - DNA, 20 bp, mouse
gttctctagagggctcttta

SEQ ID NO: 484190 - DNA, 20 bp, mouse
gaggatgatgggagcagact

SEQ ID NO: 484191 - DNA, 20 bp, mouse
gaaaacttagtagaattatc

SEQ ID NO: 484192 - DNA, 20 bp, mouse
ggtaatcagaaggtaccctt

SEQ ID NO: 484193 - DNA, 20 bp, mouse
gccatcaatcaaaaacccaa

SEQ ID NO: 484194 - DNA, 20 bp, mouse
gctggcatggagtaatcaga

SEQ ID NO: 484195 - DNA, 20 bp, mouse
gtagaagactgtgaatgtag

SEQ ID NO: 484196 - DNA, 20 bp, mouse
gaggacagtgaagaatttca

SEQ ID NO: 484197 - DNA, 20 bp, mouse
gaacaaggtcagctttccct

SEQ ID NO: 484198 - DNA, 20 bp, mouse
gcatggcctgtaggagacta

SEQ ID NO: 484199 - DNA, 20 bp, mouse
gctagactgaacccataaca

SEQ ID NO: 484200 - DNA, 20 bp, mouse
gaagaatttcatggtggcac

SEQ ID NO: 484201 - DNA, 20 bp, mouse
gctgacagcccatggcctgt

SEQ ID NO: 484202 - DNA, 20 bp, mouse
gtagcctctgaacccagcct

SEQ ID NO: 484203 - DNA, 20 bp, mouse
gaaaggtgcacttaccaggc

SEQ ID NO: 484204 - DNA, 20 bp, mouse
gtgatcaagcctctggtgat

SEQ ID NO: 484205 - DNA, 20 bp, mouse
gctatggatagcacttgatg

SEQ ID NO: 484206 - DNA, 20 bp, mouse
gggtgtgtggtctacagaag

SEQ ID NO: 484207 - DNA, 20 bp, mouse
gcatagctgcctagagaggg

SEQ ID NO: 484208 - DNA, 20 bp, mouse
gatggggctcggaggagaca

SEQ ID NO: 484209 - DNA, 20 bp, mouse
gtacagaagaggacgtggct

SEQ ID NO: 484210 - DNA, 20 bp, mouse
gtcagggctggtgtaagatc

SEQ ID NO: 484211 - DNA, 20 bp, mouse
ggtccatagctgcctagaga

SEQ ID NO: 484212 - DNA, 20 bp, mouse
gcagtcctgagccctcggag

SEQ ID NO: 484213 - DNA, 20 bp, mouse
gctaggcagctatggacacg

SEQ ID NO: 484214 - DNA, 20 bp, mouse
gatcatggccacccctccga

SEQ ID NO: 484215 - DNA, 20 bp, mouse
gtgtctgccactaggatcca

SEQ ID NO: 484216 - DNA, 20 bp, mouse
ggcggctcggcgacttggtg

SEQ ID NO: 484217 - DNA, 20 bp, mouse
gcggtggttgggtggtaaga

SEQ ID NO: 484218 - DNA, 20 bp, mouse
gagtctgcggctcggcgact

SEQ ID NO: 484219 - DNA, 20 bp, mouse
gcggctgtgagtctgcggct

SEQ ID NO: 484220 - DNA, 20 bp, mouse
gggtgtgaacgacgcttgag

SEQ ID NO: 484221 - DNA, 20 bp, mouse
gagcgtcgttcacaccgcgg

SEQ ID NO: 484222 - DNA, 20 bp, mouse
gggaggtccggagagaccct

SEQ ID NO: 484223 - DNA, 20 bp, mouse
gaccagcgctgaacgaaaga

SEQ ID NO: 484224 - DNA, 20 bp, mouse
gtgcggcggcggtggttggg

SEQ ID NO: 484225 - DNA, 20 bp, mouse
gttcccggctgcccgtgcgg

SEQ ID NO: 484226 - DNA, 20 bp, mouse
ggccgccagcgcgcagatct

SEQ ID NO: 484227 - DNA, 20 bp, mouse
gggaaggtaggcgaccctct

SEQ ID NO: 484228 - DNA, 20 bp, mouse
gggcacggccgaaccgcggg

SEQ ID NO: 484229 - DNA, 20 bp, mouse
ggggcgacctgcgggaaggt

SEQ ID NO: 484230 - DNA, 20 bp, mouse
gccaggagagacctgggtag

SEQ ID NO: 484231 - DNA, 20 bp, mouse
gggctgggcgacctgcggga

SEQ ID NO: 484232 - DNA, 20 bp, mouse
ggcggttcggccgtgcctca

SEQ ID NO: 484233 - DNA, 20 bp, mouse
gagctactccaggagagacc

SEQ ID NO: 484234 - DNA, 20 bp, mouse
gatttgcgggattctccgtg

SEQ ID NO: 484235 - DNA, 20 bp, mouse
gtcatcacggccgcccgcag

SEQ ID NO: 484236 - DNA, 20 bp, mouse
ggctcggagagcgcaggtgg

SEQ ID NO: 484237 - DNA, 20 bp, mouse
gtctcaggaaaagttgctgg

SEQ ID NO: 484238 - DNA, 20 bp, mouse
gccatccgctcggagagcgc

SEQ ID NO: 484239 - DNA, 20 bp, mouse
gggtgaggtgaggaccgcag

SEQ ID NO: 484240 - DNA, 20 bp, mouse
gtccgctcggagagcgcagg

SEQ ID NO: 484241 - DNA, 20 bp, mouse
gaaatcgggagcttattctc

SEQ ID NO: 484242 - DNA, 20 bp, mouse
gctccgagcctgggcctgga

SEQ ID NO: 484243 - DNA, 20 bp, mouse
gagttgctttcacagacggt

SEQ ID NO: 484244 - DNA, 20 bp, mouse
ggctctccgagcggatggct

SEQ ID NO: 484245 - DNA, 20 bp, mouse
gttctctctcacggagacag

SEQ ID NO: 484246 - DNA, 20 bp, mouse
gaccggcagtgagcttccac

SEQ ID NO: 484247 - DNA, 20 bp, mouse
gaggagcgctggcacgtggg

SEQ ID NO: 484248 - DNA, 20 bp, mouse
ggagaggagcgctggcacgt

SEQ ID NO: 484249 - DNA, 20 bp, mouse
ggcttccactgggtaggggt

SEQ ID NO: 484250 - DNA, 20 bp, mouse
gtcggccgtagagaccccgt

SEQ ID NO: 484251 - DNA, 20 bp, mouse
gagcgctgggagaggagcgc

SEQ ID NO: 484252 - DNA, 20 bp, mouse
ggtgagcttccactgggtag

SEQ ID NO: 484253 - DNA, 20 bp, mouse
ggagtccgacggggtctcta

SEQ ID NO: 484254 - DNA, 20 bp, mouse
gaaaggggttccgctccgag

SEQ ID NO: 484255 - DNA, 20 bp, mouse
gcactgtcagccgctcggag

SEQ ID NO: 484256 - DNA, 20 bp, mouse
gctggaacctatgtaaagta

SEQ ID NO: 484257 - DNA, 20 bp, mouse
ggtaaagtagggcggcaggg

SEQ ID NO: 484258 - DNA, 20 bp, mouse
gtatgtaaagtagggcggca

SEQ ID NO: 484259 - DNA, 20 bp, mouse
gtggagagggtgagccaaga

SEQ ID NO: 484260 - DNA, 20 bp, mouse
ggaacctatgtaaagtaggg

SEQ ID NO: 484261 - DNA, 20 bp, mouse
gctcactaggcgctcgtgca

SEQ ID NO: 484262 - DNA, 20 bp, mouse
gacaggattcgtgtccgcag

SEQ ID NO: 484263 - DNA, 20 bp, mouse
gggattcgtgtccgcagtgg

SEQ ID NO: 484264 - DNA, 20 bp, mouse
gtagggtcgccggggtcgga

SEQ ID NO: 484265 - DNA, 20 bp, mouse
ggtgcaaggcagaaactccg

SEQ ID NO: 484266 - DNA, 20 bp, mouse
gaggaggggttacaggtcac

SEQ ID NO: 484267 - DNA, 20 bp, mouse
gcagcagcaggaggggttac

SEQ ID NO: 484268 - DNA, 20 bp, mouse
gcaggtctgcagactacagt

SEQ ID NO: 484269 - DNA, 20 bp, mouse
gctgcagactacagttggac

SEQ ID NO: 484270 - DNA, 20 bp, mouse
gaggggttgccatgatagat

SEQ ID NO: 484271 - DNA, 20 bp, mouse
gagactacagttggacagga

SEQ ID NO: 484272 - DNA, 20 bp, mouse
gtctctgtcctctgtgactg

SEQ ID NO: 484273 - DNA, 20 bp, mouse
gaacccctgtttagagacac

SEQ ID NO: 484274 - DNA, 20 bp, mouse
gctgaccagtgtctctaaac

SEQ ID NO: 484275 - DNA, 20 bp, mouse
gtacagttggacaggatggt

SEQ ID NO: 484276 - DNA, 20 bp, mouse
gtgagtccacatgcaaggaa

SEQ ID NO: 484277 - DNA, 20 bp, mouse
ggtagctcacctcctcttct

SEQ ID NO: 484278 - DNA, 20 bp, mouse
ggggcgaccatgcccagaag

SEQ ID NO: 484279 - DNA, 20 bp, mouse
gagaggaggtgagctactat

SEQ ID NO: 484280 - DNA, 20 bp, mouse
ggaggtgagctactataggt

SEQ ID NO: 484281 - DNA, 20 bp, mouse
gtgcatgtggactcagagcc

SEQ ID NO: 484282 - DNA, 20 bp, mouse
gaggtgtgagtgtgtaggat

SEQ ID NO: 484283 - DNA, 20 bp, mouse
gtgtgagtgtgtaggatggg

SEQ ID NO: 484284 - DNA, 20 bp, mouse
ggcaagctcatcaccagatg

SEQ ID NO: 484285 - DNA, 20 bp, mouse
ggattctcagggcttaatgg

SEQ ID NO: 484286 - DNA, 20 bp, mouse
gagcaaggtgatgactcagt

SEQ ID NO: 484287 - DNA, 20 bp, mouse
ggtacaggctcccagcgata

SEQ ID NO: 484288 - DNA, 20 bp, mouse
gcaggctcccagcgataagg

SEQ ID NO: 484289 - DNA, 20 bp, mouse
ggacaggggtggacccccag

SEQ ID NO: 484290 - DNA, 20 bp, mouse
ggtacttcacagattaggtt

SEQ ID NO: 484291 - DNA, 20 bp, mouse
gaagccctatgctagagggg

SEQ ID NO: 484292 - DNA, 20 bp, mouse
ggttttgggaatccagaccc

SEQ ID NO: 484293 - DNA, 20 bp, mouse
gtgtaagccctatgctagag

SEQ ID NO: 484294 - DNA, 20 bp, mouse
ggctagccagagaccgctgg

SEQ ID NO: 484295 - DNA, 20 bp, mouse
gaggtggagagccattaaag

SEQ ID NO: 484296 - DNA, 20 bp, mouse
ggaagtggtgtaggagctgg

SEQ ID NO: 484297 - DNA, 20 bp, mouse
gtctgaagtggtgtaggagc

SEQ ID NO: 484298 - DNA, 20 bp, mouse
gcgagggagggcccaccaca

SEQ ID NO: 484299 - DNA, 20 bp, mouse
gccaagctatggtgagccag

SEQ ID NO: 484300 - DNA, 20 bp, mouse
gcgactgtctggggacgagt

SEQ ID NO: 484301 - DNA, 20 bp, mouse
gaagcttggaggccaagcta

SEQ ID NO: 484302 - DNA, 20 bp, mouse
gagtactcgcgcaagcttgg

SEQ ID NO: 484303 - DNA, 20 bp, mouse
gcttgcgcgagtacttttct

SEQ ID NO: 484304 - DNA, 20 bp, mouse
gttattcaggggcctccaca

SEQ ID NO: 484305 - DNA, 20 bp, mouse
ggcccgcctcaccttctgag

SEQ ID NO: 484306 - DNA, 20 bp, mouse
ggagtaccagaatacatata

SEQ ID NO: 484307 - DNA, 20 bp, mouse
gtctcctattagaaattcaa

SEQ ID NO: 484308 - DNA, 20 bp, mouse
gcaggaaatgctatcattta

SEQ ID NO: 484309 - DNA, 20 bp, mouse
gaccttgtaaaatgtcttat

SEQ ID NO: 484310 - DNA, 20 bp, mouse
gatgctatcatttagggatg

SEQ ID NO: 484311 - DNA, 20 bp, mouse
gttagaaattcaagggcatg

SEQ ID NO: 484312 - DNA, 20 bp, mouse
gcaacaacctaattttttta

SEQ ID NO: 484313 - DNA, 20 bp, mouse
gtatgtccctatatgtattc

SEQ ID NO: 484314 - DNA, 20 bp, mouse
ggattctaagttttatttaa

SEQ ID NO: 484315 - DNA, 20 bp, mouse
gcttgtaaacactactttaa

SEQ ID NO: 484316 - DNA, 20 bp, mouse
gtgcctgaggtaagacaaaa

SEQ ID NO: 484317 - DNA, 20 bp, mouse
ggtaagacaaaagggtgaaa

SEQ ID NO: 484318 - DNA, 20 bp, mouse
gcacccttttgtcttacctc

SEQ ID NO: 484319 - DNA, 20 bp, mouse
gagaacgtccgttcagtctg

SEQ ID NO: 484320 - DNA, 20 bp, mouse
gagccaaaggaggtttgtgc

SEQ ID NO: 484321 - DNA, 20 bp, mouse
gggatgtcttatacagccaa

SEQ ID NO: 484322 - DNA, 20 bp, mouse
ggggcgattagtcatagcga

SEQ ID NO: 484323 - DNA, 20 bp, mouse
ggatgaacaaagaataatta

SEQ ID NO: 484324 - DNA, 20 bp, mouse
gaaccagcacaaacctcctt

SEQ ID NO: 484325 - DNA, 20 bp, mouse
gtatcatgtgacagacagac

SEQ ID NO: 484326 - DNA, 20 bp, mouse
ggtgaaatgggaaagaatac

SEQ ID NO: 484327 - DNA, 20 bp, mouse
gaaatctttgaggaataata

SEQ ID NO: 484328 - DNA, 20 bp, mouse
gtcctcaaagatttaaatta

SEQ ID NO: 484329 - DNA, 20 bp, mouse
gagtaccttctacaacagag

SEQ ID NO: 484330 - DNA, 20 bp, mouse
gccacccactctgttgtaga

SEQ ID NO: 484331 - DNA, 20 bp, mouse
gcaaagatttaaattaaggt

SEQ ID NO: 484332 - DNA, 20 bp, mouse
gaatgggaaagaatacaggc

SEQ ID NO: 484333 - DNA, 20 bp, mouse
gaagcacttttatgtgaaat

SEQ ID NO: 484334 - DNA, 20 bp, mouse
gatggtgacacccagactca

SEQ ID NO: 484335 - DNA, 20 bp, mouse
gcatctgaaatgaagaaatt

SEQ ID NO: 484336 - DNA, 20 bp, mouse
ggaggaccaagaagttcccc

SEQ ID NO: 484337 - DNA, 20 bp, mouse
gtcagaccgatatgtcacag

SEQ ID NO: 484338 - DNA, 20 bp, mouse
gatcggtctgactggtgcct

SEQ ID NO: 484339 - DNA, 20 bp, mouse
gacagtggagcgaaactggt

SEQ ID NO: 484340 - DNA, 20 bp, mouse
gcaatcccaacaccaggctg

SEQ ID NO: 484341 - DNA, 20 bp, mouse
gaccgtgctgagattgctca

SEQ ID NO: 484342 - DNA, 20 bp, mouse
ggaagaagtaatgagtaggt

SEQ ID NO: 484343 - DNA, 20 bp, mouse
gtcgctccactgtgacatat

SEQ ID NO: 484344 - DNA, 20 bp, mouse
gttcctctgtgctgcctaca

SEQ ID NO: 484345 - DNA, 20 bp, mouse
gcaatccgcagcctggtgtt

SEQ ID NO: 484346 - DNA, 20 bp, mouse
gacgctcggtctgcagaaga

SEQ ID NO: 484347 - DNA, 20 bp, mouse
gtggtgacccagagcacgag

SEQ ID NO: 484348 - DNA, 20 bp, mouse
ggagggcactgggcttctag

SEQ ID NO: 484349 - DNA, 20 bp, mouse
gctagtggtgaaagtggaac

SEQ ID NO: 484350 - DNA, 20 bp, mouse
gccagagcacgaggggaggg

SEQ ID NO: 484351 - DNA, 20 bp, mouse
gtgacccagagcacgagggg

SEQ ID NO: 484352 - DNA, 20 bp, mouse
ggccattctgtgccaactcc

SEQ ID NO: 484353 - DNA, 20 bp, mouse
gacagaatggctagagaacc

SEQ ID NO: 484354 - DNA, 20 bp, mouse
gagatacagcttgtagctag

SEQ ID NO: 484355 - DNA, 20 bp, mouse
ggtccgcagccctaaacgct

SEQ ID NO: 484356 - DNA, 20 bp, mouse
gaaatgactgcaagcgctct

SEQ ID NO: 484357 - DNA, 20 bp, mouse
gatttttgaatcataattgg

SEQ ID NO: 484358 - DNA, 20 bp, mouse
gaatacatttgagactcttg

SEQ ID NO: 484359 - DNA, 20 bp, mouse
gtgtatttttgaatcataat

SEQ ID NO: 484360 - DNA, 20 bp, mouse
ggcgtcgtaggtgcacaggc

SEQ ID NO: 484361 - DNA, 20 bp, mouse
gtactgagactcattaccga

SEQ ID NO: 484362 - DNA, 20 bp, mouse
gcgcggcgaggtgatgttcc

SEQ ID NO: 484363 - DNA, 20 bp, mouse
gcagggcagagggactgttt

SEQ ID NO: 484364 - DNA, 20 bp, mouse
gagtgagggatgctgagggc

SEQ ID NO: 484365 - DNA, 20 bp, mouse
gtaatgagtctcagtagacc

SEQ ID NO: 484366 - DNA, 20 bp, mouse
gtctagcaccatgacatgga

SEQ ID NO: 484367 - DNA, 20 bp, mouse
gctacagtgtcatggactag

SEQ ID NO: 484368 - DNA, 20 bp, mouse
gccagctggctacagtgtca

SEQ ID NO: 484369 - DNA, 20 bp, mouse
gatacacaccctccatgtca

SEQ ID NO: 484370 - DNA, 20 bp, mouse
gtggagggtgtgtatccagc

SEQ ID NO: 484371 - DNA, 20 bp, mouse
gggcattttagtctctgtgg

SEQ ID NO: 484372 - DNA, 20 bp, mouse
gagtggcattttagtctctg

SEQ ID NO: 484373 - DNA, 20 bp, mouse
gaacaaggaacatgagaaat

SEQ ID NO: 484374 - DNA, 20 bp, mouse
gggctgtgatgtcttatgat

SEQ ID NO: 484375 - DNA, 20 bp, mouse
gatgcaggcaaatcagacac

SEQ ID NO: 484376 - DNA, 20 bp, mouse
gttcgggagcgcggaatcgg

SEQ ID NO: 484377 - DNA, 20 bp, mouse
ggcggaatcgggggacttta

SEQ ID NO: 484378 - DNA, 20 bp, mouse
gccgcagcccgacggagcgg

SEQ ID NO: 484379 - DNA, 20 bp, mouse
ggcaccacgcgcgtcagggg

SEQ ID NO: 484380 - DNA, 20 bp, mouse
gaccccgcagcccgacggag

SEQ ID NO: 484381 - DNA, 20 bp, mouse
gggcaaggaggagcatctag

SEQ ID NO: 484382 - DNA, 20 bp, mouse
gcggtctgggaaggggtccg

SEQ ID NO: 484383 - DNA, 20 bp, mouse
gcgccgccaggaggctcccc

SEQ ID NO: 484384 - DNA, 20 bp, mouse
ggcggcactcacccaagcag

SEQ ID NO: 484385 - DNA, 20 bp, mouse
gctttagggcacttggaacg

SEQ ID NO: 484386 - DNA, 20 bp, mouse
gaaattatgaggaactcctg

SEQ ID NO: 484387 - DNA, 20 bp, mouse
gtggagacatgacacctaca

SEQ ID NO: 484388 - DNA, 20 bp, mouse
gttgaagatagataggagtt

SEQ ID NO: 484389 - DNA, 20 bp, mouse
gagagctaagatgtcttatg

SEQ ID NO: 484390 - DNA, 20 bp, mouse
gaagatagataggagttggg

SEQ ID NO: 484391 - DNA, 20 bp, mouse
ggctggggccttgaagatga

SEQ ID NO: 484392 - DNA, 20 bp, mouse
gagacatgacacctacatgg

SEQ ID NO: 484393 - DNA, 20 bp, mouse
gtcatgcctgtccaccatgt

SEQ ID NO: 484394 - DNA, 20 bp, mouse
gccaacaagcgaaaattatg

SEQ ID NO: 484395 - DNA, 20 bp, mouse
gaactgatggaggaacttct

SEQ ID NO: 484396 - DNA, 20 bp, mouse
gggctctgaatttttcatat

SEQ ID NO: 484397 - DNA, 20 bp, mouse
gcacactgacttcttaccat

SEQ ID NO: 484398 - DNA, 20 bp, mouse
gataaatctcaagtcgtagc

SEQ ID NO: 484399 - DNA, 20 bp, mouse
ggtattcactagataaaaca

SEQ ID NO: 484400 - DNA, 20 bp, mouse
gagaaatgatactacagttg

SEQ ID NO: 484401 - DNA, 20 bp, mouse
gtaattaagacacttggaat

SEQ ID NO: 484402 - DNA, 20 bp, mouse
gaggttttctctttgagctg

SEQ ID NO: 484403 - DNA, 20 bp, mouse
gacttgtcaaccaatggatt

SEQ ID NO: 484404 - DNA, 20 bp, mouse
gtcacaacagtgcttgaggg

SEQ ID NO: 484405 - DNA, 20 bp, mouse
gaacagtgcttgagggaggt

SEQ ID NO: 484406 - DNA, 20 bp, mouse
gactactacgacggggatgt

SEQ ID NO: 484407 - DNA, 20 bp, mouse
ggattcggtgaggcttcatg

SEQ ID NO: 484408 - DNA, 20 bp, mouse
ggagtcatgcggattcggtg

SEQ ID NO: 484409 - DNA, 20 bp, mouse
gagatgcagagattcaatgt

SEQ ID NO: 484410 - DNA, 20 bp, mouse
gagtctgttactactacgac

SEQ ID NO: 484411 - DNA, 20 bp, mouse
gatgttggaaactactatta

SEQ ID NO: 484412 - DNA, 20 bp, mouse
gcttgcgacagagcctcctg

SEQ ID NO: 484413 - DNA, 20 bp, mouse
gaaatatctaatggggcggg

SEQ ID NO: 484414 - DNA, 20 bp, mouse
gattgtgagtcatgcggatt

SEQ ID NO: 484415 - DNA, 20 bp, mouse
gagcattggctttgtgagga

SEQ ID NO: 484416 - DNA, 20 bp, mouse
gctgcagatctacacctgga

SEQ ID NO: 484417 - DNA, 20 bp, mouse
gtgatttgaaaaggtgtcac

SEQ ID NO: 484418 - DNA, 20 bp, mouse
gaggtcttctcgcggtcgat

SEQ ID NO: 484419 - DNA, 20 bp, mouse
gagacctggatatcgagtta

SEQ ID NO: 484420 - DNA, 20 bp, mouse
ggcaccatgtctggcaggaa

SEQ ID NO: 484421 - DNA, 20 bp, mouse
gagattggcagcaccatgtc

SEQ ID NO: 484422 - DNA, 20 bp, mouse
ggtgcccttcctgccagaca

SEQ ID NO: 484423 - DNA, 20 bp, mouse
ggatatcgagttaaggagat

SEQ ID NO: 484424 - DNA, 20 bp, mouse
gtggcagcaccatgtctggc

SEQ ID NO: 484425 - DNA, 20 bp, mouse
ggagcgggcaggtcttctcg

SEQ ID NO: 484426 - DNA, 20 bp, mouse
gagggttcctgagacagcca

SEQ ID NO: 484427 - DNA, 20 bp, mouse
gggttacggctcaaaagaaa

SEQ ID NO: 484428 - DNA, 20 bp, mouse
ggcgtctgtgcctgcagccg

SEQ ID NO: 484429 - DNA, 20 bp, mouse
gtgccagcaagagcaggtta

SEQ ID NO: 484430 - DNA, 20 bp, mouse
gctgcagccgtggctgtctc

SEQ ID NO: 484431 - DNA, 20 bp, mouse
gggccgactgaccgggagag

SEQ ID NO: 484432 - DNA, 20 bp, mouse
gctgtgctggccgactgacc

SEQ ID NO: 484433 - DNA, 20 bp, mouse
gacaaaggtcctataagtgg

SEQ ID NO: 484434 - DNA, 20 bp, mouse
gagaagggctggatactctg

SEQ ID NO: 484435 - DNA, 20 bp, mouse
gtgagtaagaggaggttaag

SEQ ID NO: 484436 - DNA, 20 bp, mouse
gcctgcagacgatagttccg

SEQ ID NO: 484437 - DNA, 20 bp, mouse
gctatcgtctgcagggtaag

SEQ ID NO: 484438 - DNA, 20 bp, mouse
gtcatggcgacgctgtgagt

SEQ ID NO: 484439 - DNA, 20 bp, mouse
ggcagacgatagttccgggg

SEQ ID NO: 484440 - DNA, 20 bp, mouse
gtgactcgagtgtcccaagg

SEQ ID NO: 484441 - DNA, 20 bp, mouse
gagtagcttggcgaccacct

SEQ ID NO: 484442 - DNA, 20 bp, mouse
gtaaagcagcgggaaccccc

SEQ ID NO: 484443 - DNA, 20 bp, mouse
ggaaagcgtccgcgttgtca

SEQ ID NO: 484444 - DNA, 20 bp, mouse
ggcgtcccccagcacatctt

SEQ ID NO: 484445 - DNA, 20 bp, mouse
gtagggatcgggtccgggtg

SEQ ID NO: 484446 - DNA, 20 bp, mouse
gtgtctgggactccttcccg

SEQ ID NO: 484447 - DNA, 20 bp, mouse
gatggtggaggttgacagtc

SEQ ID NO: 484448 - DNA, 20 bp, mouse
ggagaaggttggggatgtct

SEQ ID NO: 484449 - DNA, 20 bp, mouse
gttgacagtctggagaaggt

SEQ ID NO: 484450 - DNA, 20 bp, mouse
gccatggtcaagaataggat

SEQ ID NO: 484451 - DNA, 20 bp, mouse
gtcaatggaggcaggtggtt

SEQ ID NO: 484452 - DNA, 20 bp, mouse
gaagtatccatcttcaatgg

SEQ ID NO: 484453 - DNA, 20 bp, mouse
gtgaatccatggtcaagaat

SEQ ID NO: 484454 - DNA, 20 bp, mouse
gacaaagtatccatcttcaa

SEQ ID NO: 484455 - DNA, 20 bp, mouse
gctgcctcttgctgaatcca

SEQ ID NO: 484456 - DNA, 20 bp, mouse
gtttgggctaagggatgaca

SEQ ID NO: 484457 - DNA, 20 bp, mouse
gccaatgagagtgaattcag

SEQ ID NO: 484458 - DNA, 20 bp, mouse
ggggacatgctcaggagatt

SEQ ID NO: 484459 - DNA, 20 bp, mouse
gctgggatgggagaaaatga

SEQ ID NO: 484460 - DNA, 20 bp, mouse
ggggatcaggggacatgctc

SEQ ID NO: 484461 - DNA, 20 bp, mouse
gtgaagtggccagctgggat

SEQ ID NO: 484462 - DNA, 20 bp, mouse
gctctaatgccaaagcctca

SEQ ID NO: 484463 - DNA, 20 bp, mouse
gagggttaagactagggcgt

SEQ ID NO: 484464 - DNA, 20 bp, mouse
gttcagaggccttgaggctt

SEQ ID NO: 484465 - DNA, 20 bp, mouse
ggcaagtcttgagaagagtc

SEQ ID NO: 484466 - DNA, 20 bp, mouse
gaggcactttcacccatggg

SEQ ID NO: 484467 - DNA, 20 bp, mouse
gtgtaaagatatccccccat

SEQ ID NO: 484468 - DNA, 20 bp, mouse
gctggacacaggttaagcta

SEQ ID NO: 484469 - DNA, 20 bp, mouse
gagtggacttgaaatacttc

SEQ ID NO: 484470 - DNA, 20 bp, mouse
ggaatcttccaaacataccg

SEQ ID NO: 484471 - DNA, 20 bp, mouse
gaggcattcgaggtccttgt

SEQ ID NO: 484472 - DNA, 20 bp, mouse
ggatctaggaatatcttgtt

SEQ ID NO: 484473 - DNA, 20 bp, mouse
ggtacactggcctagttccc

SEQ ID NO: 484474 - DNA, 20 bp, mouse
ggtatttcaagtccactcgc

SEQ ID NO: 484475 - DNA, 20 bp, mouse
gggcttacctgctcgatgtg

SEQ ID NO: 484476 - DNA, 20 bp, mouse
ggtgtctaagacaactaagt

SEQ ID NO: 484477 - DNA, 20 bp, mouse
gtgctcaaggatgtagtatt

SEQ ID NO: 484478 - DNA, 20 bp, mouse
ggatgtagtattaggaagga

SEQ ID NO: 484479 - DNA, 20 bp, mouse
gcggagaactcgctgagtca

SEQ ID NO: 484480 - DNA, 20 bp, mouse
gtctgagcttgggtgatcag

SEQ ID NO: 484481 - DNA, 20 bp, mouse
ggagaagtcttccaagggaa

SEQ ID NO: 484482 - DNA, 20 bp, mouse
gttggccgcactcagaccac

SEQ ID NO: 484483 - DNA, 20 bp, mouse
ggaaccagagaagtcttcca

SEQ ID NO: 484484 - DNA, 20 bp, mouse
ggtgatcagaggtgagtctg

SEQ ID NO: 484485 - DNA, 20 bp, mouse
gctacatccttgagcaagca

SEQ ID NO: 484486 - DNA, 20 bp, mouse
gtcacagcccccaagcacgt

SEQ ID NO: 484487 - DNA, 20 bp, mouse
gatttttttgtaagtagttt

SEQ ID NO: 484488 - DNA, 20 bp, mouse
gtgtctatctggaggcttag

SEQ ID NO: 484489 - DNA, 20 bp, mouse
gatggagctttaatgaagat

SEQ ID NO: 484490 - DNA, 20 bp, mouse
gtggttttggttagaattgt

SEQ ID NO: 484491 - DNA, 20 bp, mouse
gcttcagtcttacatgcggt

SEQ ID NO: 484492 - DNA, 20 bp, mouse
gaaaacaactctaaagtcac

SEQ ID NO: 484493 - DNA, 20 bp, mouse
gatgctgtacagtgtctatc

SEQ ID NO: 484494 - DNA, 20 bp, mouse
gttaaagctccatatttcca

SEQ ID NO: 484495 - DNA, 20 bp, mouse
gtattgtttggggtaaattt

SEQ ID NO: 484496 - DNA, 20 bp, mouse
gagccatgaaggagaacata

SEQ ID NO: 484497 - DNA, 20 bp, mouse
ggcaagaagagataattcat

SEQ ID NO: 484498 - DNA, 20 bp, mouse
gagttgagcggtagccatga

SEQ ID NO: 484499 - DNA, 20 bp, mouse
gaaaaaaaagatacaagata

SEQ ID NO: 484500 - DNA, 20 bp, mouse
gtggggagaatggtaaatgc

SEQ ID NO: 484501 - DNA, 20 bp, mouse
gttcacaggattgtttagga

SEQ ID NO: 484502 - DNA, 20 bp, mouse
gtacaacagtagctaaagcc

SEQ ID NO: 484503 - DNA, 20 bp, mouse
ggacatgaatgtatcttcac

SEQ ID NO: 484504 - DNA, 20 bp, mouse
gcttgttttagatagttgag

SEQ ID NO: 484505 - DNA, 20 bp, mouse
gcagagctgatggccggtga

SEQ ID NO: 484506 - DNA, 20 bp, mouse
ggtggcggttagagcagatg

SEQ ID NO: 484507 - DNA, 20 bp, mouse
gtcttgccttcagacgcccg

SEQ ID NO: 484508 - DNA, 20 bp, mouse
ggtactgcctgaagcattgg

SEQ ID NO: 484509 - DNA, 20 bp, mouse
gaaggtgcttatacaacctt

SEQ ID NO: 484510 - DNA, 20 bp, mouse
ggcttatacaaccttaggtg

SEQ ID NO: 484511 - DNA, 20 bp, mouse
gtaaaagctatcctcaccta

SEQ ID NO: 484512 - DNA, 20 bp, mouse
gcgcgtactgcctgaagcat

SEQ ID NO: 484513 - DNA, 20 bp, mouse
gctgtggagtccataaagtt

SEQ ID NO: 484514 - DNA, 20 bp, mouse
gggttgtataagcacctttc

SEQ ID NO: 484515 - DNA, 20 bp, mouse
gtatcacaaaacactttgct

SEQ ID NO: 484516 - DNA, 20 bp, mouse
gccattgctcccctacacag

SEQ ID NO: 484517 - DNA, 20 bp, mouse
gcgcttctaggatagaagag

SEQ ID NO: 484518 - DNA, 20 bp, mouse
gggaccgtgggaccctgcgt

SEQ ID NO: 484519 - DNA, 20 bp, mouse
ggagcctacgcagggtccca

SEQ ID NO: 484520 - DNA, 20 bp, mouse
gctcccctacacagtggagg

SEQ ID NO: 484521 - DNA, 20 bp, mouse
gccctgcgtaggctcacggt

SEQ ID NO: 484522 - DNA, 20 bp, mouse
ggtggaaaagagccgcttct

SEQ ID NO: 484523 - DNA, 20 bp, mouse
gaaccaggaaacccaggtct

SEQ ID NO: 484524 - DNA, 20 bp, mouse
gagaagagaggtgaggaccg

SEQ ID NO: 484525 - DNA, 20 bp, mouse
gttgggactgagctaggtgg

SEQ ID NO: 484526 - DNA, 20 bp, mouse
gactgataaaaaatatgcct

SEQ ID NO: 484527 - DNA, 20 bp, mouse
gggttttaaaaaaggcaaca

SEQ ID NO: 484528 - DNA, 20 bp, mouse
gagtttaagttactaacttc

SEQ ID NO: 484529 - DNA, 20 bp, mouse
gatagcaccgctttaagttg

SEQ ID NO: 484530 - DNA, 20 bp, mouse
gaaattttaatatgtcctgc

SEQ ID NO: 484531 - DNA, 20 bp, mouse
ggtaatttctgttgagaatg

SEQ ID NO: 484532 - DNA, 20 bp, mouse
gcatattaaaatttcttcca

SEQ ID NO: 484533 - DNA, 20 bp, mouse
gtgttagactattggaaatt

SEQ ID NO: 484534 - DNA, 20 bp, mouse
gtgccttttttaaaacctgc

SEQ ID NO: 484535 - DNA, 20 bp, mouse
gacgtgcctgggatatttta

SEQ ID NO: 484536 - DNA, 20 bp, mouse
gaactggaataagcaatctg

SEQ ID NO: 484537 - DNA, 20 bp, mouse
gtggggctgagggaacaatg

SEQ ID NO: 484538 - DNA, 20 bp, mouse
gagttctgggagcctgggta

SEQ ID NO: 484539 - DNA, 20 bp, mouse
gtccagcttgcagccgggtg

SEQ ID NO: 484540 - DNA, 20 bp, mouse
gccccagggcatacaagagg

SEQ ID NO: 484541 - DNA, 20 bp, mouse
gcagccccagggcatacaag

SEQ ID NO: 484542 - DNA, 20 bp, mouse
ggatttcaaacaatcaatgt

SEQ ID NO: 484543 - DNA, 20 bp, mouse
gaattctggggaatacaagc

SEQ ID NO: 484544 - DNA, 20 bp, mouse
gtgggtaaggcggggtcctg

SEQ ID NO: 484545 - DNA, 20 bp, mouse
gcattgctaccctctaggtg

SEQ ID NO: 484546 - DNA, 20 bp, mouse
gcctagtgctcggtcatcgt

SEQ ID NO: 484547 - DNA, 20 bp, mouse
ggagatccaaggtcaatcta

SEQ ID NO: 484548 - DNA, 20 bp, mouse
gtgtgaactgggtagtttct

SEQ ID NO: 484549 - DNA, 20 bp, mouse
gtggttccctccgaaaacac

SEQ ID NO: 484550 - DNA, 20 bp, mouse
gggaggtggtttgtgtgaac

SEQ ID NO: 484551 - DNA, 20 bp, mouse
gtgaaagcgtttagtaacca

SEQ ID NO: 484552 - DNA, 20 bp, mouse
gactgtatgcggaacagcaa

SEQ ID NO: 484553 - DNA, 20 bp, mouse
ggtgcagcaccacagggacc

SEQ ID NO: 484554 - DNA, 20 bp, mouse
gggatcccccaagaggaagg

SEQ ID NO: 484555 - DNA, 20 bp, mouse
ggtaccctggatcccccaag

SEQ ID NO: 484556 - DNA, 20 bp, mouse
gagggggccacacacacagt

SEQ ID NO: 484557 - DNA, 20 bp, mouse
gtgcaggcccactgtgtgtg

SEQ ID NO: 484558 - DNA, 20 bp, mouse
gatagtcacaactgagacac

SEQ ID NO: 484559 - DNA, 20 bp, mouse
gtggctgctgattcagcatg

SEQ ID NO: 484560 - DNA, 20 bp, mouse
gtcagcagccaggagctaca

SEQ ID NO: 484561 - DNA, 20 bp, mouse
gagctgagtcccatctacac

SEQ ID NO: 484562 - DNA, 20 bp, mouse
gtgactatcccagtgtagat

SEQ ID NO: 484563 - DNA, 20 bp, mouse
ggctgttcccatgtagctcc

SEQ ID NO: 484564 - DNA, 20 bp, mouse
gcaggagctggacatgcagc

SEQ ID NO: 484565 - DNA, 20 bp, mouse
gggaggaaggtgaggatgtc

SEQ ID NO: 484566 - DNA, 20 bp, mouse
gagggtggccgggaagccag

SEQ ID NO: 484567 - DNA, 20 bp, mouse
gatttattaatttggacgtg

SEQ ID NO: 484568 - DNA, 20 bp, mouse
gcaggataccgctggcttcc

SEQ ID NO: 484569 - DNA, 20 bp, mouse
gcttatcgatgtacttggag

SEQ ID NO: 484570 - DNA, 20 bp, mouse
gcatagaaggaagatccctg

SEQ ID NO: 484571 - DNA, 20 bp, mouse
gaagccagcggtatcctgaa

SEQ ID NO: 484572 - DNA, 20 bp, mouse
ggtatgtcgtggcacctcgg

SEQ ID NO: 484573 - DNA, 20 bp, mouse
gccattcgggtgaagttcca

SEQ ID NO: 484574 - DNA, 20 bp, mouse
gggaggacactcggcagctg

SEQ ID NO: 484575 - DNA, 20 bp, mouse
ggggcagatgagcaccaccg

SEQ ID NO: 484576 - DNA, 20 bp, mouse
gagggaagccgacctgaagg

SEQ ID NO: 484577 - DNA, 20 bp, mouse
gcaggccaattggagtccca

SEQ ID NO: 484578 - DNA, 20 bp, mouse
gtccagggaagccgacctga

SEQ ID NO: 484579 - DNA, 20 bp, mouse
ggtcccagggcacctctgta

SEQ ID NO: 484580 - DNA, 20 bp, mouse
ggacccctctgcttgctcca

SEQ ID NO: 484581 - DNA, 20 bp, mouse
ggtcactccacatcattatc

SEQ ID NO: 484582 - DNA, 20 bp, mouse
gttagaccccgataatgatg

SEQ ID NO: 484583 - DNA, 20 bp, mouse
gcagatgaccagcatggcat

SEQ ID NO: 484584 - DNA, 20 bp, mouse
gctgtccagctgcagaggga

SEQ ID NO: 484585 - DNA, 20 bp, mouse
ggtaggcacatgggctcctg

SEQ ID NO: 484586 - DNA, 20 bp, mouse
ggtaccaatacagccaggtg

SEQ ID NO: 484587 - DNA, 20 bp, mouse
gaagaagtaccaatacagcc

SEQ ID NO: 484588 - DNA, 20 bp, mouse
gggtgcatctgagttacaga

SEQ ID NO: 484589 - DNA, 20 bp, mouse
gcattcacagcttataggat

SEQ ID NO: 484590 - DNA, 20 bp, mouse
gttgacacttggaatcagtc

SEQ ID NO: 484591 - DNA, 20 bp, mouse
gtttagcattcacagcttat

SEQ ID NO: 484592 - DNA, 20 bp, mouse
gctggcatgtaaaagtttta

SEQ ID NO: 484593 - DNA, 20 bp, mouse
gttggaatcagtctggtgtt

SEQ ID NO: 484594 - DNA, 20 bp, mouse
gccaccacacctggctgtat

SEQ ID NO: 484595 - DNA, 20 bp, mouse
gtgccagaagagggaggcaa

SEQ ID NO: 484596 - DNA, 20 bp, mouse
gtgagaggtgctcctgagag

SEQ ID NO: 484597 - DNA, 20 bp, mouse
gcagcagcttggcggtccgg

SEQ ID NO: 484598 - DNA, 20 bp, mouse
ggatcaggagcacctctctc

SEQ ID NO: 484599 - DNA, 20 bp, mouse
gggcgctggtttggaaactg

SEQ ID NO: 484600 - DNA, 20 bp, mouse
ggctggggctgcgacagttg

SEQ ID NO: 484601 - DNA, 20 bp, mouse
gcctcagcagcttggcggtc

SEQ ID NO: 484602 - DNA, 20 bp, mouse
gagtcgtccgctgtctgcag

SEQ ID NO: 484603 - DNA, 20 bp, mouse
gggggctgcgacagttgggg

SEQ ID NO: 484604 - DNA, 20 bp, mouse
gatgtcccttgaaatggcgc

SEQ ID NO: 484605 - DNA, 20 bp, mouse
gtctcatcattggctatgcc

SEQ ID NO: 484606 - DNA, 20 bp, mouse
gagtcgaacagggacctgtg

SEQ ID NO: 484607 - DNA, 20 bp, mouse
gcagcccagagaggcgaagg

SEQ ID NO: 484608 - DNA, 20 bp, mouse
gtggccgcacaggcaagatg

SEQ ID NO: 484609 - DNA, 20 bp, mouse
ggcgcttgcgcagcccagag

SEQ ID NO: 484610 - DNA, 20 bp, mouse
gggaggcagggatcggacat

SEQ ID NO: 484611 - DNA, 20 bp, mouse
ggccccgcacagcgacaacc

SEQ ID NO: 484612 - DNA, 20 bp, mouse
gtcgctgtgcggggctcaca

SEQ ID NO: 484613 - DNA, 20 bp, mouse
gtgggaggcagtccaaccgt

SEQ ID NO: 484614 - DNA, 20 bp, mouse
gctgtgcggggctcacacgg

SEQ ID NO: 484615 - DNA, 20 bp, mouse
gagtaggattggaaactcta

SEQ ID NO: 484616 - DNA, 20 bp, mouse
gccaagcatgtgcacaggtg

SEQ ID NO: 484617 - DNA, 20 bp, mouse
gtttctatatggctaagtag

SEQ ID NO: 484618 - DNA, 20 bp, mouse
gccatagcaaagcaagaggt

SEQ ID NO: 484619 - DNA, 20 bp, mouse
gctgtgcacatgcttggaag

SEQ ID NO: 484620 - DNA, 20 bp, mouse
gggagcatgtcagaagagat

SEQ ID NO: 484621 - DNA, 20 bp, mouse
ggtatgtcagccatgaaacg

SEQ ID NO: 484622 - DNA, 20 bp, mouse
ggttacctgacctgaatcct

SEQ ID NO: 484623 - DNA, 20 bp, mouse
gtgctaagaccccaagaagg

SEQ ID NO: 484624 - DNA, 20 bp, mouse
gtgttcctaggattcaggtc

SEQ ID NO: 484625 - DNA, 20 bp, mouse
ggacatgctccctccttctt

SEQ ID NO: 484626 - DNA, 20 bp, mouse
gtctgtccagaagacacggg

SEQ ID NO: 484627 - DNA, 20 bp, mouse
gcatctcctgggagtcccct

SEQ ID NO: 484628 - DNA, 20 bp, mouse
gtatctcacgaacatctcct

SEQ ID NO: 484629 - DNA, 20 bp, mouse
ggctttggagaccagtgggt

SEQ ID NO: 484630 - DNA, 20 bp, mouse
gcattaggtgctgtttccct

SEQ ID NO: 484631 - DNA, 20 bp, mouse
gagcagagctcgggacctca

SEQ ID NO: 484632 - DNA, 20 bp, mouse
ggggctcccaggggactccc

SEQ ID NO: 484633 - DNA, 20 bp, mouse
ggagctcgggacctcacgga

SEQ ID NO: 484634 - DNA, 20 bp, mouse
gtgttcgtgagatatattat

SEQ ID NO: 484635 - DNA, 20 bp, mouse
ggagggccacccgtgtcttc

SEQ ID NO: 484636 - DNA, 20 bp, mouse
gcgtcgccggcgagcagcag

SEQ ID NO: 484637 - DNA, 20 bp, mouse
gccggcgacgtggcgctctt

SEQ ID NO: 484638 - DNA, 20 bp, mouse
ggctacgaggagttcgagta

SEQ ID NO: 484639 - DNA, 20 bp, mouse
gacgtggcgctcttgggcag

SEQ ID NO: 484640 - DNA, 20 bp, mouse
gtgcgcggcctccagcttgt

SEQ ID NO: 484641 - DNA, 20 bp, mouse
gacgaggagttcgagtacgg

SEQ ID NO: 484642 - DNA, 20 bp, mouse
gagcggcgcctacaagctgg

SEQ ID NO: 484643 - DNA, 20 bp, mouse
gaggcgccgctgctgctcgc

SEQ ID NO: 484644 - DNA, 20 bp, mouse
gagcagcggcgcctacaagc

SEQ ID NO: 484645 - DNA, 20 bp, mouse
gcttcgccatggaggccgag

SEQ ID NO: 484646 - DNA, 20 bp, mouse
gaagtccagaaccacagtca

SEQ ID NO: 484647 - DNA, 20 bp, mouse
gcaaagggttgtaaaatgaa

SEQ ID NO: 484648 - DNA, 20 bp, mouse
gacaagtgtcagagtttcaa

SEQ ID NO: 484649 - DNA, 20 bp, mouse
gtgtaccctgactgtggttc

SEQ ID NO: 484650 - DNA, 20 bp, mouse
gctggacttgtttatgatat

SEQ ID NO: 484651 - DNA, 20 bp, mouse
gttcatgtcaaatgcagcct

SEQ ID NO: 484652 - DNA, 20 bp, mouse
ggttttttgtaaaaaataac

SEQ ID NO: 484653 - DNA, 20 bp, mouse
gtctctgtgtaccctgactg

SEQ ID NO: 484654 - DNA, 20 bp, mouse
gttctgtatttaccagacaa

SEQ ID NO: 484655 - DNA, 20 bp, mouse
ggcgaggctatgccattgtc

SEQ ID NO: 484656 - DNA, 20 bp, mouse
gagagtgtcgggagtgacga

SEQ ID NO: 484657 - DNA, 20 bp, mouse
ggctgggtcctaggacgcga

SEQ ID NO: 484658 - DNA, 20 bp, mouse
ggcgaaggagagtttgacac

SEQ ID NO: 484659 - DNA, 20 bp, mouse
gagcatggcctaacagtgca

SEQ ID NO: 484660 - DNA, 20 bp, mouse
gcccgcagaggagattgaag

SEQ ID NO: 484661 - DNA, 20 bp, mouse
ggagagtttgacactggcac

SEQ ID NO: 484662 - DNA, 20 bp, mouse
gtgcagggcggagcgctcac

SEQ ID NO: 484663 - DNA, 20 bp, mouse
gttaggccatgctgggtcct

SEQ ID NO: 484664 - DNA, 20 bp, mouse
ggtgggaggtctagacggac

SEQ ID NO: 484665 - DNA, 20 bp, mouse
gcgctccgccctgcactgtt

SEQ ID NO: 484666 - DNA, 20 bp, mouse
ggaaagaaaacctaggctgg

SEQ ID NO: 484667 - DNA, 20 bp, mouse
gtccaacagctggaaggtgc

SEQ ID NO: 484668 - DNA, 20 bp, mouse
ggctgggggcacagcttatc

SEQ ID NO: 484669 - DNA, 20 bp, mouse
gggctagagtcagaaattct

SEQ ID NO: 484670 - DNA, 20 bp, mouse
gacacctccaaaacaaatct

SEQ ID NO: 484671 - DNA, 20 bp, mouse
ggtcagcatctttattaatg

SEQ ID NO: 484672 - DNA, 20 bp, mouse
gagagttcctagatttgttt

SEQ ID NO: 484673 - DNA, 20 bp, mouse
gtgcctagctagcacttttg

SEQ ID NO: 484674 - DNA, 20 bp, mouse
gcattctcaatacatatttc

SEQ ID NO: 484675 - DNA, 20 bp, mouse
gtgcttgcaattccaacagc

SEQ ID NO: 484676 - DNA, 20 bp, mouse
gtagtgtgggaccagagtga

SEQ ID NO: 484677 - DNA, 20 bp, mouse
gtcaatcactgaaaccagaa

SEQ ID NO: 484678 - DNA, 20 bp, mouse
gctggggactaaccaaagtt

SEQ ID NO: 484679 - DNA, 20 bp, mouse
gtgcaaaactaggaagaact

SEQ ID NO: 484680 - DNA, 20 bp, mouse
gctagtataagaggcttatt

SEQ ID NO: 484681 - DNA, 20 bp, mouse
gaactgcttgttgggaaact

SEQ ID NO: 484682 - DNA, 20 bp, mouse
gggtacatcttggcatggcc

SEQ ID NO: 484683 - DNA, 20 bp, mouse
gaggttagaaatttctagtg

SEQ ID NO: 484684 - DNA, 20 bp, mouse
gtcattggtaactgcttgtt

SEQ ID NO: 484685 - DNA, 20 bp, mouse
gtagaaatttctaacctttc

SEQ ID NO: 484686 - DNA, 20 bp, mouse
gaccccagcctacccaccag

SEQ ID NO: 484687 - DNA, 20 bp, mouse
gatcactgtgatggtctcac

SEQ ID NO: 484688 - DNA, 20 bp, mouse
ggcctctggtgggtaggctg

SEQ ID NO: 484689 - DNA, 20 bp, mouse
gagagtggccggtacactgg

SEQ ID NO: 484690 - DNA, 20 bp, mouse
ggtaggctggggtttatgtt

SEQ ID NO: 484691 - DNA, 20 bp, mouse
gcacagagtggccggtacac

SEQ ID NO: 484692 - DNA, 20 bp, mouse
gtacactggtggaagtccat

SEQ ID NO: 484693 - DNA, 20 bp, mouse
gaatcatgatggagctccct

SEQ ID NO: 484694 - DNA, 20 bp, mouse
gcaggctgtcttgcctctgg

SEQ ID NO: 484695 - DNA, 20 bp, mouse
gatgatggagctccctcggc

SEQ ID NO: 484696 - DNA, 20 bp, mouse
gtgaaggctaggcaacaagg

SEQ ID NO: 484697 - DNA, 20 bp, mouse
gtatgagagggtaccaggag

SEQ ID NO: 484698 - DNA, 20 bp, mouse
gagatgagaggcaccagggt

SEQ ID NO: 484699 - DNA, 20 bp, mouse
gacccccacatcacaggata

SEQ ID NO: 484700 - DNA, 20 bp, mouse
gacacccaggagaggtgaag

SEQ ID NO: 484701 - DNA, 20 bp, mouse
gcccatcaagaaaagatgag

SEQ ID NO: 484702 - DNA, 20 bp, mouse
ggactctatgagagggtacc

SEQ ID NO: 484703 - DNA, 20 bp, mouse
gtccatatcctgtgatgtgg

SEQ ID NO: 484704 - DNA, 20 bp, mouse
gcaccaaatgaaactttgga

SEQ ID NO: 484705 - DNA, 20 bp, mouse
gatagcaccaaatgaaactt

SEQ ID NO: 484706 - DNA, 20 bp, mouse
gtgagtacagatttatttgg

SEQ ID NO: 484707 - DNA, 20 bp, mouse
gtagtgagaaggctatggtg

SEQ ID NO: 484708 - DNA, 20 bp, mouse
ggcaactagaattagcgtta

SEQ ID NO: 484709 - DNA, 20 bp, mouse
gtagacgtgcagagcttgta

SEQ ID NO: 484710 - DNA, 20 bp, mouse
gttctgagtacagatttatt

SEQ ID NO: 484711 - DNA, 20 bp, mouse
gaatgaagataacagtgtac

SEQ ID NO: 484712 - DNA, 20 bp, mouse
ggctatggtgaggttgaaga

SEQ ID NO: 484713 - DNA, 20 bp, mouse
gggtcgaatccgcattcata

SEQ ID NO: 484714 - DNA, 20 bp, mouse
ggctataattattatagtag

SEQ ID NO: 484715 - DNA, 20 bp, mouse
gagtgatagtgagaaggcta

SEQ ID NO: 484716 - DNA, 20 bp, mouse
gttgtaagctaagataatac

SEQ ID NO: 484717 - DNA, 20 bp, mouse
gtcttctgagatttgaaatc

SEQ ID NO: 484718 - DNA, 20 bp, mouse
gtatacgtaatagaaacata

SEQ ID NO: 484719 - DNA, 20 bp, mouse
gatgtcttctaagatttgaa

SEQ ID NO: 484720 - DNA, 20 bp, mouse
gttctattacgtataatgtt

SEQ ID NO: 484721 - DNA, 20 bp, mouse
gcacattctgtacatctata

SEQ ID NO: 484722 - DNA, 20 bp, mouse
gagatttgagttatgagtaa

SEQ ID NO: 484723 - DNA, 20 bp, mouse
gtcttctaagatttgaaagg

SEQ ID NO: 484724 - DNA, 20 bp, mouse
gagatttgaaaggtggataa

SEQ ID NO: 484725 - DNA, 20 bp, mouse
gtatgtcacatgatttacat

SEQ ID NO: 484726 - DNA, 20 bp, mouse
gctgatggtctgaaatacat

SEQ ID NO: 484727 - DNA, 20 bp, mouse
gactactactgagaaactca

SEQ ID NO: 484728 - DNA, 20 bp, mouse
gataaaactggaatagtatg

SEQ ID NO: 484729 - DNA, 20 bp, mouse
gatgtgatactgccaggtcg

SEQ ID NO: 484730 - DNA, 20 bp, mouse
gtctttgcatcatacatgag

SEQ ID NO: 484731 - DNA, 20 bp, mouse
gatcatacatgaggggaaag

SEQ ID NO: 484732 - DNA, 20 bp, mouse
gaggtcgtgggatttaaagc

SEQ ID NO: 484733 - DNA, 20 bp, mouse
gatacagatggtattgatag

SEQ ID NO: 484734 - DNA, 20 bp, mouse
gagtggatgctggtcataaa

SEQ ID NO: 484735 - DNA, 20 bp, mouse
gagttttatgtgatactgcc

SEQ ID NO: 484736 - DNA, 20 bp, mouse
gagcggttacaggtaacact

SEQ ID NO: 484737 - DNA, 20 bp, mouse
gtgtgggtgggacccactat

SEQ ID NO: 484738 - DNA, 20 bp, mouse
gaatggcacaagcccatagt

SEQ ID NO: 484739 - DNA, 20 bp, mouse
gaagcatctattacaaatca

SEQ ID NO: 484740 - DNA, 20 bp, mouse
gcaacaatgtaagcggttac

SEQ ID NO: 484741 - DNA, 20 bp, mouse
gcatttttgatagcttcagt

SEQ ID NO: 484742 - DNA, 20 bp, mouse
gctggtatgcaaatagacac

SEQ ID NO: 484743 - DNA, 20 bp, mouse
gttacaatttaaaaagacac

SEQ ID NO: 484744 - DNA, 20 bp, mouse
gacactgagagaatataaaa

SEQ ID NO: 484745 - DNA, 20 bp, mouse
gcattatacaacaatgtaag

SEQ ID NO: 484746 - DNA, 20 bp, mouse
gtcccagaacaggagttcag

SEQ ID NO: 484747 - DNA, 20 bp, mouse
gtctgggacccagacattaa

SEQ ID NO: 484748 - DNA, 20 bp, mouse
gccagagaccctagtcccaa

SEQ ID NO: 484749 - DNA, 20 bp, mouse
gtcctctgaactcctgttct

SEQ ID NO: 484750 - DNA, 20 bp, mouse
ggacccagcccttgggacta

SEQ ID NO: 484751 - DNA, 20 bp, mouse
gtgggtgaagtagaatgtga

SEQ ID NO: 484752 - DNA, 20 bp, mouse
gctgccaaagagcaacctct

SEQ ID NO: 484753 - DNA, 20 bp, mouse
ggaagtggctgttagggagt

SEQ ID NO: 484754 - DNA, 20 bp, mouse
gctgggctacagttataccc

SEQ ID NO: 484755 - DNA, 20 bp, mouse
gtagcccagaggttgctctt

SEQ ID NO: 484756 - DNA, 20 bp, mouse
gagtggcaagttctcagatg

SEQ ID NO: 484757 - DNA, 20 bp, mouse
gagagcccagggatgggact

SEQ ID NO: 484758 - DNA, 20 bp, mouse
gggactgggggtctattaac

SEQ ID NO: 484759 - DNA, 20 bp, mouse
gctgggctctcattcagctc

SEQ ID NO: 484760 - DNA, 20 bp, mouse
ggagatggaaaataggagag

SEQ ID NO: 484761 - DNA, 20 bp, mouse
gagacccccagtcccatccc

SEQ ID NO: 484762 - DNA, 20 bp, mouse
gttccttgggaaaagctggt

SEQ ID NO: 484763 - DNA, 20 bp, mouse
gaagatggcaaaggacatca

SEQ ID NO: 484764 - DNA, 20 bp, mouse
gcagaaaaggatgagcacac

SEQ ID NO: 484765 - DNA, 20 bp, mouse
gccagtgcccaaggtgtcct

SEQ ID NO: 484766 - DNA, 20 bp, mouse
gctaaacttatagtacacgt

SEQ ID NO: 484767 - DNA, 20 bp, mouse
gtgtaacccctgcggagtat

SEQ ID NO: 484768 - DNA, 20 bp, mouse
gttatagtacacgttggctg

SEQ ID NO: 484769 - DNA, 20 bp, mouse
ggctctagccaacttctgcg

SEQ ID NO: 484770 - DNA, 20 bp, mouse
gtgcaaggccatgtagagtc

SEQ ID NO: 484771 - DNA, 20 bp, mouse
gttcactctcgccttttcta

SEQ ID NO: 484772 - DNA, 20 bp, mouse
ggaaagcctatactccgcag

SEQ ID NO: 484773 - DNA, 20 bp, mouse
gaaaccagctgtaacccctg

SEQ ID NO: 484774 - DNA, 20 bp, mouse
gggcctcctttcaggtgaat

SEQ ID NO: 484775 - DNA, 20 bp, mouse
gcacaggcaagcaagtttct

SEQ ID NO: 484776 - DNA, 20 bp, mouse
gggcggcggctggacgaaac

SEQ ID NO: 484777 - DNA, 20 bp, mouse
ggctcggagacgcggtgaca

SEQ ID NO: 484778 - DNA, 20 bp, mouse
gtacgtgcgccaccagccat

SEQ ID NO: 484779 - DNA, 20 bp, mouse
gggactggcgcagagctctc

SEQ ID NO: 484780 - DNA, 20 bp, mouse
gtgtgtgggataaacagtaa

SEQ ID NO: 484781 - DNA, 20 bp, mouse
gcacgcaacgtcctacctgc

SEQ ID NO: 484782 - DNA, 20 bp, mouse
gaggagaagacagcgaaggg

SEQ ID NO: 484783 - DNA, 20 bp, mouse
gagaaggagaagacagcgaa

SEQ ID NO: 484784 - DNA, 20 bp, mouse
ggcagcgactgtggggatag

SEQ ID NO: 484785 - DNA, 20 bp, mouse
gacctgagcgctcggagacg

SEQ ID NO: 484786 - DNA, 20 bp, mouse
gtctccagcaagcaagaaac

SEQ ID NO: 484787 - DNA, 20 bp, mouse
gggtcccgtttcttgcttgc

SEQ ID NO: 484788 - DNA, 20 bp, mouse
ggagtacaagatagaaaatg

SEQ ID NO: 484789 - DNA, 20 bp, mouse
gatactcctggatcctgagc

SEQ ID NO: 484790 - DNA, 20 bp, mouse
gatctcattcaagtcatcaa

SEQ ID NO: 484791 - DNA, 20 bp, mouse
gcaagtcatcaatggtcatc

SEQ ID NO: 484792 - DNA, 20 bp, mouse
ggctggagagagcactccgc

SEQ ID NO: 484793 - DNA, 20 bp, mouse
gcagactagccaacctggcg

SEQ ID NO: 484794 - DNA, 20 bp, mouse
gccaattgccttctgatttt

SEQ ID NO: 484795 - DNA, 20 bp, mouse
gtgtgtctggatcccagctc

SEQ ID NO: 484796 - DNA, 20 bp, mouse
gggagaggagaaatcactct

SEQ ID NO: 484797 - DNA, 20 bp, mouse
gaggactcgacatctcctca

SEQ ID NO: 484798 - DNA, 20 bp, mouse
gcgccactgagaccaggtcg

SEQ ID NO: 484799 - DNA, 20 bp, mouse
gaagagaggaggggtcattg

SEQ ID NO: 484800 - DNA, 20 bp, mouse
gaacagtgtgtccccggggt

SEQ ID NO: 484801 - DNA, 20 bp, mouse
gaccaggtcggggctttcct

SEQ ID NO: 484802 - DNA, 20 bp, mouse
gagccccgacctggtctcag

SEQ ID NO: 484803 - DNA, 20 bp, mouse
ggtcaaagcctcaagaacag

SEQ ID NO: 484804 - DNA, 20 bp, mouse
gtgacgcttgtgactgacag

SEQ ID NO: 484805 - DNA, 20 bp, mouse
gggtccagcccaggactata

SEQ ID NO: 484806 - DNA, 20 bp, mouse
gggggaaaagcgctttcatt

SEQ ID NO: 484807 - DNA, 20 bp, mouse
gagtcggagttgttgcagga

SEQ ID NO: 484808 - DNA, 20 bp, mouse
gccccgccaggctactaata

SEQ ID NO: 484809 - DNA, 20 bp, mouse
gtcctaaggtataaaattgt

SEQ ID NO: 484810 - DNA, 20 bp, mouse
ggaaaaacgaatggctatga

SEQ ID NO: 484811 - DNA, 20 bp, mouse
gataccttaggaaaaacgaa

SEQ ID NO: 484812 - DNA, 20 bp, mouse
gttggagtcggagttgttgc

SEQ ID NO: 484813 - DNA, 20 bp, mouse
gtagccattcgtttttccta

SEQ ID NO: 484814 - DNA, 20 bp, mouse
gtgccatattagtagcctgg

SEQ ID NO: 484815 - DNA, 20 bp, mouse
gggaacatgtatggacgtaa

SEQ ID NO: 484816 - DNA, 20 bp, mouse
gaagtggtgtacaagaggaa

SEQ ID NO: 484817 - DNA, 20 bp, mouse
gcagcagagaaatactataa

SEQ ID NO: 484818 - DNA, 20 bp, mouse
gagaaaggtggtgggtacca

SEQ ID NO: 484819 - DNA, 20 bp, mouse
gacgtaactatcaaaagcat

SEQ ID NO: 484820 - DNA, 20 bp, mouse
gcttttaagtggtgtacaag

SEQ ID NO: 484821 - DNA, 20 bp, mouse
gtccagaggcactacgacac

SEQ ID NO: 484822 - DNA, 20 bp, mouse
gacaccacttaaaaggcaga

SEQ ID NO: 484823 - DNA, 20 bp, mouse
gctaccttctgccttttaag

SEQ ID NO: 484824 - DNA, 20 bp, mouse
gagtgttgtggtaagaaagg

SEQ ID NO: 484825 - DNA, 20 bp, mouse
gttgtggtaagaaaggtggt

SEQ ID NO: 484826 - DNA, 20 bp, mouse
gcaacacaggcagggtactg

SEQ ID NO: 484827 - DNA, 20 bp, mouse
gaccaactcctagccaacac

SEQ ID NO: 484828 - DNA, 20 bp, mouse
ggcctgtgttggctaggagt

SEQ ID NO: 484829 - DNA, 20 bp, mouse
gactgtatgagcactccagt

SEQ ID NO: 484830 - DNA, 20 bp, mouse
ggagtcaaaagtttctattt

SEQ ID NO: 484831 - DNA, 20 bp, mouse
gtaccctgcctgtgttggct

SEQ ID NO: 484832 - DNA, 20 bp, mouse
gcttctcacacaccagactt

SEQ ID NO: 484833 - DNA, 20 bp, mouse
ggtttctattttgattgaac

SEQ ID NO: 484834 - DNA, 20 bp, mouse
gactggggcgagcatgtgtg

SEQ ID NO: 484835 - DNA, 20 bp, mouse
gagactttgggaatgcccac

SEQ ID NO: 484836 - DNA, 20 bp, mouse
gatggccagaataaaggcaa

SEQ ID NO: 484837 - DNA, 20 bp, mouse
gccagaataaaggcaaagga

SEQ ID NO: 484838 - DNA, 20 bp, mouse
ggcctttattctggccatga

SEQ ID NO: 484839 - DNA, 20 bp, mouse
ggtggttgtcttttccatca

SEQ ID NO: 484840 - DNA, 20 bp, mouse
gtccatcatggccagaataa

SEQ ID NO: 484841 - DNA, 20 bp, mouse
gcatgccaaaatgaataaaa

SEQ ID NO: 484842 - DNA, 20 bp, mouse
ggtgtccattttattcattt

SEQ ID NO: 484843 - DNA, 20 bp, mouse
gatgctgggatgtggattgt

SEQ ID NO: 484844 - DNA, 20 bp, mouse
ggaagattgctcaactcaat

SEQ ID NO: 484845 - DNA, 20 bp, mouse
gaaatcgtgtttgatgaaat

SEQ ID NO: 484846 - DNA, 20 bp, mouse
gaggtagcccttgacttaca

SEQ ID NO: 484847 - DNA, 20 bp, mouse
gaacatgccctgtaagtcaa

SEQ ID NO: 484848 - DNA, 20 bp, mouse
gttaaaattacaacagtgga

SEQ ID NO: 484849 - DNA, 20 bp, mouse
gttacaacagtggatggctt

SEQ ID NO: 484850 - DNA, 20 bp, mouse
gtaagaaccacagccccaat

SEQ ID NO: 484851 - DNA, 20 bp, mouse
ggagaataaacctattaccc

SEQ ID NO: 484852 - DNA, 20 bp, mouse
gagaagtttaaagagagtgg

SEQ ID NO: 484853 - DNA, 20 bp, mouse
gcagtggatggctttggctt

SEQ ID NO: 484854 - DNA, 20 bp, mouse
gttctaaaatattcagggag

SEQ ID NO: 484855 - DNA, 20 bp, mouse
gtagtattgaaaaagcaaat

SEQ ID NO: 484856 - DNA, 20 bp, mouse
ggtcaagggagcacccagtg

SEQ ID NO: 484857 - DNA, 20 bp, mouse
gtttgtgtgaggtaggtcaa

SEQ ID NO: 484858 - DNA, 20 bp, mouse
gacacaagtatactcctcac

SEQ ID NO: 484859 - DNA, 20 bp, mouse
gtccacccaggaccctcagt

SEQ ID NO: 484860 - DNA, 20 bp, mouse
gtcctactgagggtcctggg

SEQ ID NO: 484861 - DNA, 20 bp, mouse
gtttaggaaggacactaacg

SEQ ID NO: 484862 - DNA, 20 bp, mouse
gcattcctactgagggtcct

SEQ ID NO: 484863 - DNA, 20 bp, mouse
gggtcataaaatgtaaccat

SEQ ID NO: 484864 - DNA, 20 bp, mouse
gtctaaaatatgattcaaca

SEQ ID NO: 484865 - DNA, 20 bp, mouse
gactacactgttattatttt

SEQ ID NO: 484866 - DNA, 20 bp, mouse
gcagagcaggtggaagatga

SEQ ID NO: 484867 - DNA, 20 bp, mouse
ggagcagatggaagacggag

SEQ ID NO: 484868 - DNA, 20 bp, mouse
gagtcgatagcaacacagag

SEQ ID NO: 484869 - DNA, 20 bp, mouse
gctgggtcagcaatgcagga

SEQ ID NO: 484870 - DNA, 20 bp, mouse
gtcacctgggccacagtcca

SEQ ID NO: 484871 - DNA, 20 bp, mouse
gtggagggtaccgggagcct

SEQ ID NO: 484872 - DNA, 20 bp, mouse
gtaaacggtggtcttgtgga

SEQ ID NO: 484873 - DNA, 20 bp, mouse
gactcacctacttcaaaagg

SEQ ID NO: 484874 - DNA, 20 bp, mouse
ggagcctgggtcagcaatgc

SEQ ID NO: 484875 - DNA, 20 bp, mouse
gtcacaaatatggagaaatg

SEQ ID NO: 484876 - DNA, 20 bp, mouse
gaggtctgcagaccagggtg

SEQ ID NO: 484877 - DNA, 20 bp, mouse
gacacatggtggaggctggt

SEQ ID NO: 484878 - DNA, 20 bp, mouse
gggtggaggctggttggtct

SEQ ID NO: 484879 - DNA, 20 bp, mouse
gctggagctcctacctgaag

SEQ ID NO: 484880 - DNA, 20 bp, mouse
gaccaccaccacagagggag

SEQ ID NO: 484881 - DNA, 20 bp, mouse
ggggagaaggtgagaatgtc

SEQ ID NO: 484882 - DNA, 20 bp, mouse
gagggggtactgcaggtcac

SEQ ID NO: 484883 - DNA, 20 bp, mouse
gtgcagaaccaccaccacag

SEQ ID NO: 484884 - DNA, 20 bp, mouse
gaagcacacctagctcaccc

SEQ ID NO: 484885 - DNA, 20 bp, mouse
ggcagctggtttggaaacac

SEQ ID NO: 484886 - DNA, 20 bp, mouse
ggaagggatagatatcaaga

SEQ ID NO: 484887 - DNA, 20 bp, mouse
gctgaaactggtgctcgctg

SEQ ID NO: 484888 - DNA, 20 bp, mouse
ggctgaggagttagtctggc

SEQ ID NO: 484889 - DNA, 20 bp, mouse
gccagttcttcttttcatca

SEQ ID NO: 484890 - DNA, 20 bp, mouse
ggcctctggcctgcacacac

SEQ ID NO: 484891 - DNA, 20 bp, mouse
gcacatacatgcagagagta

SEQ ID NO: 484892 - DNA, 20 bp, mouse
gcatgcagagagtaaggaga

SEQ ID NO: 484893 - DNA, 20 bp, mouse
gtgctgctcatggaggccgg

SEQ ID NO: 484894 - DNA, 20 bp, mouse
gtgtagtgcacatacaaatg

SEQ ID NO: 484895 - DNA, 20 bp, mouse
gtgctcatggaggccggagg

SEQ ID NO: 484896 - DNA, 20 bp, mouse
gcattccttggcagagaata

SEQ ID NO: 484897 - DNA, 20 bp, mouse
ggagtccttattctctgcca

SEQ ID NO: 484898 - DNA, 20 bp, mouse
gtaaaattcattgcattcct

SEQ ID NO: 484899 - DNA, 20 bp, mouse
gttgagatcctgaggtgtgg

SEQ ID NO: 484900 - DNA, 20 bp, mouse
gtgggggcagggggttaggt

SEQ ID NO: 484901 - DNA, 20 bp, mouse
gtgcttgtggaataagaccc

SEQ ID NO: 484902 - DNA, 20 bp, mouse
gtctgttatgatctttgtca

SEQ ID NO: 484903 - DNA, 20 bp, mouse
gaatgaattttaaaggacgt

SEQ ID NO: 484904 - DNA, 20 bp, mouse
ggcaagcactcactctatta

SEQ ID NO: 484905 - DNA, 20 bp, mouse
gaggtgagtgattttataca

SEQ ID NO: 484906 - DNA, 20 bp, mouse
gacagtgaggcgcctgagca

SEQ ID NO: 484907 - DNA, 20 bp, mouse
ggatgcctgcacaaaaggac

SEQ ID NO: 484908 - DNA, 20 bp, mouse
gtcaaaatctaaacattcca

SEQ ID NO: 484909 - DNA, 20 bp, mouse
gccgaataggagacacaccg

SEQ ID NO: 484910 - DNA, 20 bp, mouse
gggagagatgcctgcacaaa

SEQ ID NO: 484911 - DNA, 20 bp, mouse
gtgcacaaaaggactggccc

SEQ ID NO: 484912 - DNA, 20 bp, mouse
gcggatgggaaatcagagag

SEQ ID NO: 484913 - DNA, 20 bp, mouse
gtgatgaaaggcgagtaagt

SEQ ID NO: 484914 - DNA, 20 bp, mouse
ggaaaggaaaacctccggat

SEQ ID NO: 484915 - DNA, 20 bp, mouse
ggtgtctagatctgatacca

SEQ ID NO: 484916 - DNA, 20 bp, mouse
gaccctgaccggcagagcta

SEQ ID NO: 484917 - DNA, 20 bp, mouse
gactcaagggccaccctgac

SEQ ID NO: 484918 - DNA, 20 bp, mouse
ggccctagctctgccggtca

SEQ ID NO: 484919 - DNA, 20 bp, mouse
gcgtccgggcggtgactcaa

SEQ ID NO: 484920 - DNA, 20 bp, mouse
ggcgagtgcgtgcgtccggg

SEQ ID NO: 484921 - DNA, 20 bp, mouse
gacccagagggcggtaggag

SEQ ID NO: 484922 - DNA, 20 bp, mouse
gggacctggagtcctgtcgt

SEQ ID NO: 484923 - DNA, 20 bp, mouse
ggagctagggccgcagctcg

SEQ ID NO: 484924 - DNA, 20 bp, mouse
ggccgcagctcgcgggtccc

SEQ ID NO: 484925 - DNA, 20 bp, mouse
gcgcagctcccggaacgatc

SEQ ID NO: 484926 - DNA, 20 bp, mouse
gtacttaaaagtagacttaa

SEQ ID NO: 484927 - DNA, 20 bp, mouse
gctcttgaccagaagggaat

SEQ ID NO: 484928 - DNA, 20 bp, mouse
gggcattgttggtagtctga

SEQ ID NO: 484929 - DNA, 20 bp, mouse
ggtcagagcagatgctcaga

SEQ ID NO: 484930 - DNA, 20 bp, mouse
gcattccaagaatgtttgct

SEQ ID NO: 484931 - DNA, 20 bp, mouse
gtggtcaatgtggatattgg

SEQ ID NO: 484932 - DNA, 20 bp, mouse
gtgttgtctcttgaccagaa

SEQ ID NO: 484933 - DNA, 20 bp, mouse
gtatcattgtggcttgaaat

SEQ ID NO: 484934 - DNA, 20 bp, mouse
gagcaacataggggcattgt

SEQ ID NO: 484935 - DNA, 20 bp, mouse
gctacttttaagtatcattg

SEQ ID NO: 484936 - DNA, 20 bp, mouse
gagccaaggagaaaatggat

SEQ ID NO: 484937 - DNA, 20 bp, mouse
gtttggctgggactttagat

SEQ ID NO: 484938 - DNA, 20 bp, mouse
gtgctccagaaaaagaattt

SEQ ID NO: 484939 - DNA, 20 bp, mouse
ggctgaaagccggcagacaa

SEQ ID NO: 484940 - DNA, 20 bp, mouse
gtggtgggaaaggcattatg

SEQ ID NO: 484941 - DNA, 20 bp, mouse
gtgctgccttcagggaaaga

SEQ ID NO: 484942 - DNA, 20 bp, mouse
gagagggactcataatcccg

SEQ ID NO: 484943 - DNA, 20 bp, mouse
gaaagccggcagacaatggt

SEQ ID NO: 484944 - DNA, 20 bp, mouse
gaccctatccattttctcct

SEQ ID NO: 484945 - DNA, 20 bp, mouse
gaatgagaattaagcagcca

SEQ ID NO: 484946 - DNA, 20 bp, mouse
gcagcgcgaggaccatgacg

SEQ ID NO: 484947 - DNA, 20 bp, mouse
gcgggtgggtgcgggagcgg

SEQ ID NO: 484948 - DNA, 20 bp, mouse
gtcgctcgcagccccggacc

SEQ ID NO: 484949 - DNA, 20 bp, mouse
gcagcacgggcaccaggtcc

SEQ ID NO: 484950 - DNA, 20 bp, mouse
gtccggggctgcgagcgacg

SEQ ID NO: 484951 - DNA, 20 bp, mouse
gacagcagcgccggccgcta

SEQ ID NO: 484952 - DNA, 20 bp, mouse
ggccggcggcgggacgagtg

SEQ ID NO: 484953 - DNA, 20 bp, mouse
gctgttgctgcagagacggt

SEQ ID NO: 484954 - DNA, 20 bp, mouse
gcgcaagcggagcgggcagg

SEQ ID NO: 484955 - DNA, 20 bp, mouse
ggtcctcgcgctgcaaccat

SEQ ID NO: 484956 - DNA, 20 bp, mouse
gtgttcagcgggctcttcgt

SEQ ID NO: 484957 - DNA, 20 bp, mouse
gccgcggcgcgcagttcggg

SEQ ID NO: 484958 - DNA, 20 bp, mouse
gtccaagcgcagggacatga

SEQ ID NO: 484959 - DNA, 20 bp, mouse
ggggacatgacggtgttcag

SEQ ID NO: 484960 - DNA, 20 bp, mouse
gagcgtgagcttgagggccg

SEQ ID NO: 484961 - DNA, 20 bp, mouse
ggaggccagcgtgagcttga

SEQ ID NO: 484962 - DNA, 20 bp, mouse
gcgcgccgaggccaagtggg

SEQ ID NO: 484963 - DNA, 20 bp, mouse
ggggccgcggcgcgcagttc

SEQ ID NO: 484964 - DNA, 20 bp, mouse
gtcagcgggctcttcgtggg

SEQ ID NO: 484965 - DNA, 20 bp, mouse
ggcgggctcggcgcagaaga

SEQ ID NO: 484966 - DNA, 20 bp, mouse
gttgtctgactgctccgagg

SEQ ID NO: 484967 - DNA, 20 bp, mouse
ggaattcaaactcacttagt

SEQ ID NO: 484968 - DNA, 20 bp, mouse
gctgactgctccgaggagga

SEQ ID NO: 484969 - DNA, 20 bp, mouse
gatgttgtctgactgctccg

SEQ ID NO: 484970 - DNA, 20 bp, mouse
gctttagactccatcctcct

SEQ ID NO: 484971 - DNA, 20 bp, mouse
gagttcagaacgttggagag

SEQ ID NO: 484972 - DNA, 20 bp, mouse
gtcctcttcagggccagccc

SEQ ID NO: 484973 - DNA, 20 bp, mouse
gcatggagccgtgtgagcgt

SEQ ID NO: 484974 - DNA, 20 bp, mouse
gtacactgcccccaaggagt

SEQ ID NO: 484975 - DNA, 20 bp, mouse
ggagagaggcatcttctagg

SEQ ID NO: 484976 - DNA, 20 bp, mouse
ggaattcagtgcagagggac

SEQ ID NO: 484977 - DNA, 20 bp, mouse
gctctgcactgaattcacat

SEQ ID NO: 484978 - DNA, 20 bp, mouse
gactctgagctcatgaagaa

SEQ ID NO: 484979 - DNA, 20 bp, mouse
gtgcactgaattcacattgg

SEQ ID NO: 484980 - DNA, 20 bp, mouse
gcagctcaagaccataagtg

SEQ ID NO: 484981 - DNA, 20 bp, mouse
gaaccaagaacacaacaaag

SEQ ID NO: 484982 - DNA, 20 bp, mouse
ggctgatatagcacatctct

SEQ ID NO: 484983 - DNA, 20 bp, mouse
gacatgggcgtgtgtagaga

SEQ ID NO: 484984 - DNA, 20 bp, mouse
gtctgtgaagacaacagagc

SEQ ID NO: 484985 - DNA, 20 bp, mouse
gcactctgtcagccccaaga

SEQ ID NO: 484986 - DNA, 20 bp, mouse
gtctatgaatatagacaatg

SEQ ID NO: 484987 - DNA, 20 bp, mouse
gcctatgagtctaagcaaag

SEQ ID NO: 484988 - DNA, 20 bp, mouse
gattcatagagtttatcttc

SEQ ID NO: 484989 - DNA, 20 bp, mouse
ggtcatgaaagaattcgtgc

SEQ ID NO: 484990 - DNA, 20 bp, mouse
ggaaagaattcgtgctggag

SEQ ID NO: 484991 - DNA, 20 bp, mouse
gttacattgattacattcac

SEQ ID NO: 484992 - DNA, 20 bp, mouse
gtcttgcctgcaaagataaa

SEQ ID NO: 484993 - DNA, 20 bp, mouse
gagactgctgcaacaggcaa

SEQ ID NO: 484994 - DNA, 20 bp, mouse
gtcatctccaaatacataca

SEQ ID NO: 484995 - DNA, 20 bp, mouse
gacatgccatttatctttgc

SEQ ID NO: 484996 - DNA, 20 bp, mouse
gacacaagcacctcacctac

SEQ ID NO: 484997 - DNA, 20 bp, mouse
gaaagcccaggggacagcac

SEQ ID NO: 484998 - DNA, 20 bp, mouse
gatgagcttgccggtaggtg

SEQ ID NO: 484999 - DNA, 20 bp, mouse
ggaggaagatgtgctaaggt

SEQ ID NO: 485000 - DNA, 20 bp, mouse
ggataccagtgctgtcccct

SEQ ID NO: 485001 - DNA, 20 bp, mouse
gaataaatgataaagcccag

SEQ ID NO: 485002 - DNA, 20 bp, mouse
gtcacatgacatgagcttgc

SEQ ID NO: 485003 - DNA, 20 bp, mouse
gttacaggtcgggatttcaa

SEQ ID NO: 485004 - DNA, 20 bp, mouse
gaagtagctccctggatgac

SEQ ID NO: 485005 - DNA, 20 bp, mouse
gtctcacttccagtcatcca

SEQ ID NO: 485006 - DNA, 20 bp, mouse
gagcaccccgggaccccagg

SEQ ID NO: 485007 - DNA, 20 bp, mouse
gcctgacacaccggcaaccg

SEQ ID NO: 485008 - DNA, 20 bp, mouse
ggagagcaccccgggacccc

SEQ ID NO: 485009 - DNA, 20 bp, mouse
ggacgctccaacccgcccag

SEQ ID NO: 485010 - DNA, 20 bp, mouse
gtgtccccggagagcacccc

SEQ ID NO: 485011 - DNA, 20 bp, mouse
gcaggcgctgaaggacacgg

SEQ ID NO: 485012 - DNA, 20 bp, mouse
gccggcaaccgcggcaactc

SEQ ID NO: 485013 - DNA, 20 bp, mouse
gggagcgtccggagttgccg

SEQ ID NO: 485014 - DNA, 20 bp, mouse
ggagggaccgagcccggagg

SEQ ID NO: 485015 - DNA, 20 bp, mouse
gccttctcacctcctctggg

SEQ ID NO: 485016 - DNA, 20 bp, mouse
gagaatacaatatctgtgtc

SEQ ID NO: 485017 - DNA, 20 bp, mouse
gttttgcttttcaaactaag

SEQ ID NO: 485018 - DNA, 20 bp, mouse
gctgtaaatattcacagctg

SEQ ID NO: 485019 - DNA, 20 bp, mouse
gagtcttacctatagaagta

SEQ ID NO: 485020 - DNA, 20 bp, mouse
gttgtatcatacacatttct

SEQ ID NO: 485021 - DNA, 20 bp, mouse
gtaaggggacaaatgtgttt

SEQ ID NO: 485022 - DNA, 20 bp, mouse
gttttctgttgctgtatttt

SEQ ID NO: 485023 - DNA, 20 bp, mouse
gatttccttctaaaaagaca

SEQ ID NO: 485024 - DNA, 20 bp, mouse
gaaagaagaatggaatttga

SEQ ID NO: 485025 - DNA, 20 bp, mouse
gatcaccatgtctttttaga

SEQ ID NO: 485026 - DNA, 20 bp, mouse
gtatagagacaataactttg

SEQ ID NO: 485027 - DNA, 20 bp, mouse
gaaatataaaaaaaacatac

SEQ ID NO: 485028 - DNA, 20 bp, mouse
gatcataaaagaatccataa

SEQ ID NO: 485029 - DNA, 20 bp, mouse
gagaggagtgggatatgcac

SEQ ID NO: 485030 - DNA, 20 bp, mouse
gctaaggtttctctccatta

SEQ ID NO: 485031 - DNA, 20 bp, mouse
gagacaataactttgtggaa

SEQ ID NO: 485032 - DNA, 20 bp, mouse
gaatgttaaagattccacac

SEQ ID NO: 485033 - DNA, 20 bp, mouse
gattgtctctataatcataa

SEQ ID NO: 485034 - DNA, 20 bp, mouse
gatgaggtttctttccagtg

SEQ ID NO: 485035 - DNA, 20 bp, mouse
gataaggtttctatcgaata

SEQ ID NO: 485036 - DNA, 20 bp, mouse
ggtgagtttcgtgctttcta

SEQ ID NO: 485037 - DNA, 20 bp, mouse
gtgaacatcagagagagcta

SEQ ID NO: 485038 - DNA, 20 bp, mouse
gagggctaaatgttgattag

SEQ ID NO: 485039 - DNA, 20 bp, mouse
gtgttgattagaggctgaaa

SEQ ID NO: 485040 - DNA, 20 bp, mouse
gcatgtcaatgttgaattaa

SEQ ID NO: 485041 - DNA, 20 bp, mouse
gtgattagaggctgaaatgg

SEQ ID NO: 485042 - DNA, 20 bp, mouse
gaggaatagaggacaagtaa

SEQ ID NO: 485043 - DNA, 20 bp, mouse
gcaagtaatgggattctagt

SEQ ID NO: 485044 - DNA, 20 bp, mouse
gttcctgatcctggccctgg

SEQ ID NO: 485045 - DNA, 20 bp, mouse
gtctaattaattagaaaaac

SEQ ID NO: 485046 - DNA, 20 bp, mouse
ggcaggaacagtagcctgga

SEQ ID NO: 485047 - DNA, 20 bp, mouse
gggactgccactgggaagaa

SEQ ID NO: 485048 - DNA, 20 bp, mouse
ggtccatcccttcttcccag

SEQ ID NO: 485049 - DNA, 20 bp, mouse
gtggccaggctgccatgggt

SEQ ID NO: 485050 - DNA, 20 bp, mouse
ggttcctgcaaaggacatct

SEQ ID NO: 485051 - DNA, 20 bp, mouse
gaatgaacctgtgtctgaga

SEQ ID NO: 485052 - DNA, 20 bp, mouse
gcgtgtaggtcacctaccca

SEQ ID NO: 485053 - DNA, 20 bp, mouse
ggatggggtatggaaggatg

SEQ ID NO: 485054 - DNA, 20 bp, mouse
gctttgcaggaacagtagcc

SEQ ID NO: 485055 - DNA, 20 bp, mouse
gggaagaagggatggactta

SEQ ID NO: 485056 - DNA, 20 bp, mouse
gcagaagcttaagcaaggac

SEQ ID NO: 485057 - DNA, 20 bp, mouse
gggagttctgtgatgtgcag

SEQ ID NO: 485058 - DNA, 20 bp, mouse
gtgggccagaagcttaagca

SEQ ID NO: 485059 - DNA, 20 bp, mouse
gagaaggcacatgctaattt

SEQ ID NO: 485060 - DNA, 20 bp, mouse
ggagatgcttccgaaccagg

SEQ ID NO: 485061 - DNA, 20 bp, mouse
gatgcctgctaactccggga

SEQ ID NO: 485062 - DNA, 20 bp, mouse
gcagcatgagatccagaact

SEQ ID NO: 485063 - DNA, 20 bp, mouse
gcaggcatctgcaatcctca

SEQ ID NO: 485064 - DNA, 20 bp, mouse
ggcagatgcctgctaactcc

SEQ ID NO: 485065 - DNA, 20 bp, mouse
ggaagccactgaggccctcc

SEQ ID NO: 485066 - DNA, 20 bp, mouse
gcctgtgaatgtgagcaacg

SEQ ID NO: 485067 - DNA, 20 bp, mouse
gtcatcatgactatttatac

SEQ ID NO: 485068 - DNA, 20 bp, mouse
gtgtatgttttctttgcatc

SEQ ID NO: 485069 - DNA, 20 bp, mouse
gggattattgtgatgtgcat

SEQ ID NO: 485070 - DNA, 20 bp, mouse
gatcatgaaactattcatag

SEQ ID NO: 485071 - DNA, 20 bp, mouse
gaatagtttcatgatcatga

SEQ ID NO: 485072 - DNA, 20 bp, mouse
gtgactacagaaatgtgcaa

SEQ ID NO: 485073 - DNA, 20 bp, mouse
gcttatgaatgggctcactg

SEQ ID NO: 485074 - DNA, 20 bp, mouse
ggtagagaaaccttatgaat

SEQ ID NO: 485075 - DNA, 20 bp, mouse
gactatttatactggagaga

SEQ ID NO: 485076 - DNA, 20 bp, mouse
ggctgccccggtgtcacagc

SEQ ID NO: 485077 - DNA, 20 bp, mouse
ggagacctgctgtgacaccg

SEQ ID NO: 485078 - DNA, 20 bp, mouse
ggacatcctttgctacctgc

SEQ ID NO: 485079 - DNA, 20 bp, mouse
ggcccctgtagggaggatgg

SEQ ID NO: 485080 - DNA, 20 bp, mouse
gcggaggtcactcacatcaa

SEQ ID NO: 485081 - DNA, 20 bp, mouse
ggcccacgtgcagggcgaag

SEQ ID NO: 485082 - DNA, 20 bp, mouse
gacagtggacagtttctgtt

SEQ ID NO: 485083 - DNA, 20 bp, mouse
gggacgttggccgggtgcag

SEQ ID NO: 485084 - DNA, 20 bp, mouse
ggccgcttcgccctgcacgt

SEQ ID NO: 485085 - DNA, 20 bp, mouse
ggagctgcaggcccacgtgc

SEQ ID NO: 485086 - DNA, 20 bp, mouse
gctcctgagtccacacccgt

SEQ ID NO: 485087 - DNA, 20 bp, mouse
gagtccacacccgtaggaac

SEQ ID NO: 485088 - DNA, 20 bp, mouse
gcgtaggaacaggcatgcag

SEQ ID NO: 485089 - DNA, 20 bp, mouse
ggagctttctcacccagggt

SEQ ID NO: 485090 - DNA, 20 bp, mouse
gcatgacactggggagtgat

SEQ ID NO: 485091 - DNA, 20 bp, mouse
gggaagtagttacctagtag

SEQ ID NO: 485092 - DNA, 20 bp, mouse
ggagcagctacatcccaccc

SEQ ID NO: 485093 - DNA, 20 bp, mouse
ggaaggagtgatgagagagt

SEQ ID NO: 485094 - DNA, 20 bp, mouse
gatgcctgttcctacgggtg

SEQ ID NO: 485095 - DNA, 20 bp, mouse
gcgagctggtaagcaagtcg

SEQ ID NO: 485096 - DNA, 20 bp, mouse
gagctgaggctgaggtactt

SEQ ID NO: 485097 - DNA, 20 bp, mouse
gggctgaggtacttgggctg

SEQ ID NO: 485098 - DNA, 20 bp, mouse
gggggccagcggggagctga

SEQ ID NO: 485099 - DNA, 20 bp, mouse
gtgatacttcattaaggctg

SEQ ID NO: 485100 - DNA, 20 bp, mouse
gagctccctcagctccccgc

SEQ ID NO: 485101 - DNA, 20 bp, mouse
gaagctattaccttccaaca

SEQ ID NO: 485102 - DNA, 20 bp, mouse
gtttaagtctgcttagtctg

SEQ ID NO: 485103 - DNA, 20 bp, mouse
gtaatagttaccatgttgga

SEQ ID NO: 485104 - DNA, 20 bp, mouse
gttacatttgataaaatcgc

SEQ ID NO: 485105 - DNA, 20 bp, mouse
gctttagtgtctgccgctcc

SEQ ID NO: 485106 - DNA, 20 bp, mouse
gatgtttagtgatggtggat

SEQ ID NO: 485107 - DNA, 20 bp, mouse
gttgttgtatgagggaatca

SEQ ID NO: 485108 - DNA, 20 bp, mouse
gcccaagatagtaaagaagt

SEQ ID NO: 485109 - DNA, 20 bp, mouse
gccttcctaaatgaccctgt

SEQ ID NO: 485110 - DNA, 20 bp, mouse
ggaatgagaaaagaatcaag

SEQ ID NO: 485111 - DNA, 20 bp, mouse
gggaatcctggccaagtaca

SEQ ID NO: 485112 - DNA, 20 bp, mouse
ggagaaaagaatcaagaggt

SEQ ID NO: 485113 - DNA, 20 bp, mouse
gatgagagagacattctcca

SEQ ID NO: 485114 - DNA, 20 bp, mouse
gaatcagggcttaacaggaa

SEQ ID NO: 485115 - DNA, 20 bp, mouse
gtctacctacagggtcattt

SEQ ID NO: 485116 - DNA, 20 bp, mouse
ggatgacacactccattcat

SEQ ID NO: 485117 - DNA, 20 bp, mouse
gcattcatgggagaaaatgt

SEQ ID NO: 485118 - DNA, 20 bp, mouse
gacctcaaggccaagtacaa

SEQ ID NO: 485119 - DNA, 20 bp, mouse
gaaatgtgggtcaacagaga

SEQ ID NO: 485120 - DNA, 20 bp, mouse
gtcaaggccaagtacaaagg

SEQ ID NO: 485121 - DNA, 20 bp, mouse
gtcagactccaagcacctca

SEQ ID NO: 485122 - DNA, 20 bp, mouse
gtaaggcagctattgtgacc

SEQ ID NO: 485123 - DNA, 20 bp, mouse
gttagtgatgttgcaatttt

SEQ ID NO: 485124 - DNA, 20 bp, mouse
gcgatatgaaattttatatc

SEQ ID NO: 485125 - DNA, 20 bp, mouse
gatctatcttcagtgtctgc

SEQ ID NO: 485126 - DNA, 20 bp, mouse
gcgggccagcccaatatcca

SEQ ID NO: 485127 - DNA, 20 bp, mouse
gtgtgagagccgtggatatt

SEQ ID NO: 485128 - DNA, 20 bp, mouse
gccgggccaatcgacctctc

SEQ ID NO: 485129 - DNA, 20 bp, mouse
ggctggcccgagaggtcgat

SEQ ID NO: 485130 - DNA, 20 bp, mouse
gacggaagtgcgatcgagac

SEQ ID NO: 485131 - DNA, 20 bp, mouse
gggactgggcggcaagatgg

SEQ ID NO: 485132 - DNA, 20 bp, mouse
gtgacgcgcaggacgaggtt

SEQ ID NO: 485133 - DNA, 20 bp, mouse
gccgtctttcagcaaacgaa

SEQ ID NO: 485134 - DNA, 20 bp, mouse
ggatattgggctggcccgag

SEQ ID NO: 485135 - DNA, 20 bp, mouse
gagaggactgggcggcaaga

SEQ ID NO: 485136 - DNA, 20 bp, mouse
gcatttgaaagggcaagcgg

SEQ ID NO: 485137 - DNA, 20 bp, mouse
gttcctttcggcccttactt

SEQ ID NO: 485138 - DNA, 20 bp, mouse
ggtgttgccggacagtccag

SEQ ID NO: 485139 - DNA, 20 bp, mouse
gttcccaagtaagggccgaa

SEQ ID NO: 485140 - DNA, 20 bp, mouse
gggcacttcctcatttgaaa

SEQ ID NO: 485141 - DNA, 20 bp, mouse
gcaaatgaggaagtgccaca

SEQ ID NO: 485142 - DNA, 20 bp, mouse
gcctcatttgaaagggcaag

SEQ ID NO: 485143 - DNA, 20 bp, mouse
gaggaggcctttcccaagta

SEQ ID NO: 485144 - DNA, 20 bp, mouse
gtaggtgtgcgaggtgtgcg

SEQ ID NO: 485145 - DNA, 20 bp, mouse
gtcactttctcaaggccatg

SEQ ID NO: 485146 - DNA, 20 bp, mouse
gacttgtgagagtcaatggg

SEQ ID NO: 485147 - DNA, 20 bp, mouse
gtcccacataaatatcatct

SEQ ID NO: 485148 - DNA, 20 bp, mouse
gctcaaggtagcgtagcaca

SEQ ID NO: 485149 - DNA, 20 bp, mouse
gggagccacttggtacagaa

SEQ ID NO: 485150 - DNA, 20 bp, mouse
gcacttggtacagaaaggac

SEQ ID NO: 485151 - DNA, 20 bp, mouse
ggacaggaaatagtggccca

SEQ ID NO: 485152 - DNA, 20 bp, mouse
gcaccaagatgatatttatg

SEQ ID NO: 485153 - DNA, 20 bp, mouse
gtggtctatggacttcgcca

SEQ ID NO: 485154 - DNA, 20 bp, mouse
gtcgctgtgataccttgtgg

SEQ ID NO: 485155 - DNA, 20 bp, mouse
ggtgactctatgtctcgagc

SEQ ID NO: 485156 - DNA, 20 bp, mouse
gtgcggcaggacccaccgag

SEQ ID NO: 485157 - DNA, 20 bp, mouse
gctcctcccggtcaaggtgg

SEQ ID NO: 485158 - DNA, 20 bp, mouse
ggccctcctcccggtcaagg

SEQ ID NO: 485159 - DNA, 20 bp, mouse
gtcgcacaaggccctcctcc

SEQ ID NO: 485160 - DNA, 20 bp, mouse
gaaggccctcctcccggtca

SEQ ID NO: 485161 - DNA, 20 bp, mouse
gggcgggcaaagccagaaca

SEQ ID NO: 485162 - DNA, 20 bp, mouse
gcgctacctcccaggccccg

SEQ ID NO: 485163 - DNA, 20 bp, mouse
gaacttcctccaccttgacc

SEQ ID NO: 485164 - DNA, 20 bp, mouse
gttcctccaccttgaccggg

SEQ ID NO: 485165 - DNA, 20 bp, mouse
gtggccccctcccgcctctc

SEQ ID NO: 485166 - DNA, 20 bp, mouse
gaaccgcacgcgactctcaa

SEQ ID NO: 485167 - DNA, 20 bp, mouse
gtcagaaagcacaaagacac

SEQ ID NO: 485168 - DNA, 20 bp, mouse
ggctgaactgatagacttgt

SEQ ID NO: 485169 - DNA, 20 bp, mouse
gtgctacactgatcaaaagg

SEQ ID NO: 485170 - DNA, 20 bp, mouse
ggatagacttgtgggctgtg

SEQ ID NO: 485171 - DNA, 20 bp, mouse
gtcccatgacagcaagcccc

SEQ ID NO: 485172 - DNA, 20 bp, mouse
gtgatcagtgtagcaaatta

SEQ ID NO: 485173 - DNA, 20 bp, mouse
gcacgccatgcagctgccgg

SEQ ID NO: 485174 - DNA, 20 bp, mouse
ggttggcagtgagcaggacg

SEQ ID NO: 485175 - DNA, 20 bp, mouse
ggcagtgagcaggacgcggt

SEQ ID NO: 485176 - DNA, 20 bp, mouse
gtgtctgacaagatgcatcc

SEQ ID NO: 485177 - DNA, 20 bp, mouse
ggtcaggagcctgcaaacag

SEQ ID NO: 485178 - DNA, 20 bp, mouse
ggcaggggttggaaccagga

SEQ ID NO: 485179 - DNA, 20 bp, mouse
gcttccttccgacaaaactg

SEQ ID NO: 485180 - DNA, 20 bp, mouse
gccgtggggatcctctgcag

SEQ ID NO: 485181 - DNA, 20 bp, mouse
gacaggacaaccgtcgatgt

SEQ ID NO: 485182 - DNA, 20 bp, mouse
gaagagaagtcctacatcga

SEQ ID NO: 485183 - DNA, 20 bp, mouse
ggtgagtaaaagaaagtgcc

SEQ ID NO: 485184 - DNA, 20 bp, mouse
gtagcctgcacacagagcct

SEQ ID NO: 485185 - DNA, 20 bp, mouse
gccttacttgggcagtaaca

SEQ ID NO: 485186 - DNA, 20 bp, mouse
ggaatgtaatgaattcggaa

SEQ ID NO: 485187 - DNA, 20 bp, mouse
gtaaaaaaccctatagatgt

SEQ ID NO: 485188 - DNA, 20 bp, mouse
gctgctcattcaacatgaag

SEQ ID NO: 485189 - DNA, 20 bp, mouse
gcccgagtcagagactagta

SEQ ID NO: 485190 - DNA, 20 bp, mouse
gagtcagagactagtaagga

SEQ ID NO: 485191 - DNA, 20 bp, mouse
gaacaacgccgaacacatga

SEQ ID NO: 485192 - DNA, 20 bp, mouse
gggcctatggggctccagaa

SEQ ID NO: 485193 - DNA, 20 bp, mouse
gagcgatgaagacgcaaaga

SEQ ID NO: 485194 - DNA, 20 bp, mouse
ggaatggaaggcctgagaag

SEQ ID NO: 485195 - DNA, 20 bp, mouse
gttgggggaggtaatcgtca

SEQ ID NO: 485196 - DNA, 20 bp, mouse
gcccagctccgaggacaaag

SEQ ID NO: 485197 - DNA, 20 bp, mouse
gtcctcggagctgggctcgg

SEQ ID NO: 485198 - DNA, 20 bp, mouse
gccccccgagcccagctccg

SEQ ID NO: 485199 - DNA, 20 bp, mouse
gtagagtggggaccttctta

SEQ ID NO: 485200 - DNA, 20 bp, mouse
gcaagggtccttcctccgta

SEQ ID NO: 485201 - DNA, 20 bp, mouse
ggggttaagaggcgccatat

SEQ ID NO: 485202 - DNA, 20 bp, mouse
gtaaaaggataggtagagtg

SEQ ID NO: 485203 - DNA, 20 bp, mouse
gatgcagtatgggaaagtgg

SEQ ID NO: 485204 - DNA, 20 bp, mouse
gaaagtggaacacagcgtgt

SEQ ID NO: 485205 - DNA, 20 bp, mouse
gtttgggacataccatacgg

SEQ ID NO: 485206 - DNA, 20 bp, mouse
ggctatttcaatagaagcgt

SEQ ID NO: 485207 - DNA, 20 bp, mouse
ggttggaactcaagtctacc

SEQ ID NO: 485208 - DNA, 20 bp, mouse
gagctccatacttcctgtca

SEQ ID NO: 485209 - DNA, 20 bp, mouse
gtacaaagataccaaaatct

SEQ ID NO: 485210 - DNA, 20 bp, mouse
gctattgaaatagccatgac

SEQ ID NO: 485211 - DNA, 20 bp, mouse
ggcaggaatggccagatcta

SEQ ID NO: 485212 - DNA, 20 bp, mouse
gtttgcagcatcaaaaggcc

SEQ ID NO: 485213 - DNA, 20 bp, mouse
ggatctaaggctgaaggcga

SEQ ID NO: 485214 - DNA, 20 bp, mouse
gaggctgaaggcgagggtcg

SEQ ID NO: 485215 - DNA, 20 bp, mouse
gtggaagtagtccgggtccc

SEQ ID NO: 485216 - DNA, 20 bp, mouse
ggcagagaactcgagccgga

SEQ ID NO: 485217 - DNA, 20 bp, mouse
gcaagcactgccggatccgc

SEQ ID NO: 485218 - DNA, 20 bp, mouse
ggatccgcaggcaagactta

SEQ ID NO: 485219 - DNA, 20 bp, mouse
gaatctagtactccacaggg

SEQ ID NO: 485220 - DNA, 20 bp, mouse
gtgcggtggttagaggtcca

SEQ ID NO: 485221 - DNA, 20 bp, mouse
gaccctcccggaggcaacaa

SEQ ID NO: 485222 - DNA, 20 bp, mouse
gtggaatctagtactccaca

SEQ ID NO: 485223 - DNA, 20 bp, mouse
gggtccataagtcttgcctg

SEQ ID NO: 485224 - DNA, 20 bp, mouse
gtgtacgtggccctagtccc

SEQ ID NO: 485225 - DNA, 20 bp, mouse
ggcctttgttgcctccggga

SEQ ID NO: 485226 - DNA, 20 bp, mouse
ggaccagtaaccaggagaca

SEQ ID NO: 485227 - DNA, 20 bp, mouse
gaaccagctgaccagtaacc

SEQ ID NO: 485228 - DNA, 20 bp, mouse
gcccagagcagtgagtgctc

SEQ ID NO: 485229 - DNA, 20 bp, mouse
gcagaggtaacgctaagact

SEQ ID NO: 485230 - DNA, 20 bp, mouse
gtggtggtaactacagcaga

SEQ ID NO: 485231 - DNA, 20 bp, mouse
gttactggtcagctggttgg

SEQ ID NO: 485232 - DNA, 20 bp, mouse
gtccagctttccatgtctcc

SEQ ID NO: 485233 - DNA, 20 bp, mouse
ggtataccctaaaatcacag

SEQ ID NO: 485234 - DNA, 20 bp, mouse
gcctttcatttcattcacac

SEQ ID NO: 485235 - DNA, 20 bp, mouse
gtatctaacccacacacagt

SEQ ID NO: 485236 - DNA, 20 bp, mouse
gggaggggcaacgagagcag

SEQ ID NO: 485237 - DNA, 20 bp, mouse
gactgtgtaatccaggaagt

SEQ ID NO: 485238 - DNA, 20 bp, mouse
gcagtagccagtgaagtagg

SEQ ID NO: 485239 - DNA, 20 bp, mouse
gcaccagtagccagtgaagt

SEQ ID NO: 485240 - DNA, 20 bp, mouse
gatttcagcgacccacttcc

SEQ ID NO: 485241 - DNA, 20 bp, mouse
gtgggtcgctgaaattgaga

SEQ ID NO: 485242 - DNA, 20 bp, mouse
ggttgcccctcctacttcac

SEQ ID NO: 485243 - DNA, 20 bp, mouse
gtaatgtgctccaagcggtg

SEQ ID NO: 485244 - DNA, 20 bp, mouse
ggctccaagcggtggggatg

SEQ ID NO: 485245 - DNA, 20 bp, mouse
gaggtcaagggagtccatct

SEQ ID NO: 485246 - DNA, 20 bp, mouse
ggccggggcgcaccaaaggg

SEQ ID NO: 485247 - DNA, 20 bp, mouse
gcgggccggggcgcaccaaa

SEQ ID NO: 485248 - DNA, 20 bp, mouse
gcaagtcgccggcctccctt

SEQ ID NO: 485249 - DNA, 20 bp, mouse
gttcagtcccgtggcaccag

SEQ ID NO: 485250 - DNA, 20 bp, mouse
ggggcgcaccaaagggaggc

SEQ ID NO: 485251 - DNA, 20 bp, mouse
gtcaagggagaccagtgtcc

SEQ ID NO: 485252 - DNA, 20 bp, mouse
gcgtgggaagacatacctgg

SEQ ID NO: 485253 - DNA, 20 bp, mouse
gcagggatcaaagcgctctc

SEQ ID NO: 485254 - DNA, 20 bp, mouse
gagcgctctcaggcgggccg

SEQ ID NO: 485255 - DNA, 20 bp, mouse
gggtaggcagactcagtcag

SEQ ID NO: 485256 - DNA, 20 bp, mouse
gcccaggcgggaggccctcg

SEQ ID NO: 485257 - DNA, 20 bp, mouse
gtgacagctggccggacgtg

SEQ ID NO: 485258 - DNA, 20 bp, mouse
gcctcgaggcctggagacag

SEQ ID NO: 485259 - DNA, 20 bp, mouse
ggcgtgatcgtgtccccagg

SEQ ID NO: 485260 - DNA, 20 bp, mouse
gaaccctggcaagatcccta

SEQ ID NO: 485261 - DNA, 20 bp, mouse
gggcctagagcgacgtagag

SEQ ID NO: 485262 - DNA, 20 bp, mouse
ggcctcgagggcctcccgcc

SEQ ID NO: 485263 - DNA, 20 bp, mouse
gacagcgtgatcgtgtcccc

SEQ ID NO: 485264 - DNA, 20 bp, mouse
ggaaagagggtggcgcccct

SEQ ID NO: 485265 - DNA, 20 bp, mouse
ggatcgtgtccccaggcggg

SEQ ID NO: 485266 - DNA, 20 bp, mouse
ggccatgcttcccacataca

SEQ ID NO: 485267 - DNA, 20 bp, mouse
ggcagtgtgatgcaaagcag

SEQ ID NO: 485268 - DNA, 20 bp, mouse
gactgcacatgccatgtatg

SEQ ID NO: 485269 - DNA, 20 bp, mouse
ggaagaagtgcaaggacctg

SEQ ID NO: 485270 - DNA, 20 bp, mouse
gccagggactgagagactca

SEQ ID NO: 485271 - DNA, 20 bp, mouse
ggcaaggacctgtggaagtc

SEQ ID NO: 485272 - DNA, 20 bp, mouse
gaaggtgggtgcagacgtgt

SEQ ID NO: 485273 - DNA, 20 bp, mouse
ggcagtggttgagtgaggag

SEQ ID NO: 485274 - DNA, 20 bp, mouse
ggagttctccatcaaggagg

SEQ ID NO: 485275 - DNA, 20 bp, mouse
gggccctcacctgatagtga

SEQ ID NO: 485276 - DNA, 20 bp, mouse
ggcgccggggcgcggattgc

SEQ ID NO: 485277 - DNA, 20 bp, mouse
gcaaaggagaccagacgcga

SEQ ID NO: 485278 - DNA, 20 bp, mouse
ggcctcccgcggaaaggaaa

SEQ ID NO: 485279 - DNA, 20 bp, mouse
ggactgtgcgccctcgcgtc

SEQ ID NO: 485280 - DNA, 20 bp, mouse
gccgggccctttcctttccg

SEQ ID NO: 485281 - DNA, 20 bp, mouse
ggcgccaccaagccactctc

SEQ ID NO: 485282 - DNA, 20 bp, mouse
gcgggaggcgtcccggagag

SEQ ID NO: 485283 - DNA, 20 bp, mouse
gtgcagctcccggagaacag

SEQ ID NO: 485284 - DNA, 20 bp, mouse
gagctctgcccgctgttctc

SEQ ID NO: 485285 - DNA, 20 bp, mouse
ggccaccgggcgtcccgcga

SEQ ID NO: 485286 - DNA, 20 bp, mouse
gtgattctcactggagcaga

SEQ ID NO: 485287 - DNA, 20 bp, mouse
gagatatgctgctgtcaacc

SEQ ID NO: 485288 - DNA, 20 bp, mouse
gcaggaggtcagaatccttt

SEQ ID NO: 485289 - DNA, 20 bp, mouse
gtgaaacgttttgaacacgg

SEQ ID NO: 485290 - DNA, 20 bp, mouse
gaactgaaacgttttgaaca

SEQ ID NO: 485291 - DNA, 20 bp, mouse
gctgtacggccgcagcacca

SEQ ID NO: 485292 - DNA, 20 bp, mouse
gcggacatctggaggctgta

SEQ ID NO: 485293 - DNA, 20 bp, mouse
ggcagagggcaaaagtaatg

SEQ ID NO: 485294 - DNA, 20 bp, mouse
gacagaaaacggacatctgg

SEQ ID NO: 485295 - DNA, 20 bp, mouse
gtgctccagtgagaatcagg

SEQ ID NO: 485296 - DNA, 20 bp, mouse
gtagccttgtcttaatataa

SEQ ID NO: 485297 - DNA, 20 bp, mouse
gccttgtcttaatataaagg

SEQ ID NO: 485298 - DNA, 20 bp, mouse
gtctaaggaatgttcattgt

SEQ ID NO: 485299 - DNA, 20 bp, mouse
gctagacgcccagctgccag

SEQ ID NO: 485300 - DNA, 20 bp, mouse
gtggaagttagagtagatgg

SEQ ID NO: 485301 - DNA, 20 bp, mouse
gctggtaaataaaggaagta

SEQ ID NO: 485302 - DNA, 20 bp, mouse
gcagctatactggtaaataa

SEQ ID NO: 485303 - DNA, 20 bp, mouse
gcacacatcactagtttcta

SEQ ID NO: 485304 - DNA, 20 bp, mouse
gcagtatagctggctacctc

SEQ ID NO: 485305 - DNA, 20 bp, mouse
gccaaagcaggtcccctaaa

SEQ ID NO: 485306 - DNA, 20 bp, mouse
gttgaggagagggaaagtat

SEQ ID NO: 485307 - DNA, 20 bp, mouse
gggggtcatatgccatatag

SEQ ID NO: 485308 - DNA, 20 bp, mouse
gaaagtatgggaaagatccc

SEQ ID NO: 485309 - DNA, 20 bp, mouse
gacaatgcttatcccatcca

SEQ ID NO: 485310 - DNA, 20 bp, mouse
gtacacagaatgtcagaacc

SEQ ID NO: 485311 - DNA, 20 bp, mouse
ggtgtaaacccttccatgga

SEQ ID NO: 485312 - DNA, 20 bp, mouse
gaaaacaaattggagccagg

SEQ ID NO: 485313 - DNA, 20 bp, mouse
gtaagcattgtctctaccgg

SEQ ID NO: 485314 - DNA, 20 bp, mouse
gggataagcattgtctctac

SEQ ID NO: 485315 - DNA, 20 bp, mouse
gtcacccttaaaaaacaaat

SEQ ID NO: 485316 - DNA, 20 bp, mouse
ggagctgtaatacggccaca

SEQ ID NO: 485317 - DNA, 20 bp, mouse
gtcctggtacaggctccccg

SEQ ID NO: 485318 - DNA, 20 bp, mouse
ggttctctgagtaacagccg

SEQ ID NO: 485319 - DNA, 20 bp, mouse
gagtctacagagcttatccc

SEQ ID NO: 485320 - DNA, 20 bp, mouse
gctgcagaccctcctggtac

SEQ ID NO: 485321 - DNA, 20 bp, mouse
ggcgtgcacgaagcatgtct

SEQ ID NO: 485322 - DNA, 20 bp, mouse
gtcggcctctgtgctgctct

SEQ ID NO: 485323 - DNA, 20 bp, mouse
gaacatactgcagaccctcc

SEQ ID NO: 485324 - DNA, 20 bp, mouse
gactaccacgcccagggcaa

SEQ ID NO: 485325 - DNA, 20 bp, mouse
gtcgaaaacaaaagtccatg

SEQ ID NO: 485326 - DNA, 20 bp, mouse
ggtgtgtgacaaatccttta

SEQ ID NO: 485327 - DNA, 20 bp, mouse
gagagttgaattcaccgtaa

SEQ ID NO: 485328 - DNA, 20 bp, mouse
gtgatggcttttaagtacgg

SEQ ID NO: 485329 - DNA, 20 bp, mouse
gcatcagaaaatgcatactg

SEQ ID NO: 485330 - DNA, 20 bp, mouse
gttctgatggcttttaagta

SEQ ID NO: 485331 - DNA, 20 bp, mouse
ggtcctaaaactggaagagt

SEQ ID NO: 485332 - DNA, 20 bp, mouse
gactgtagttgtccagaatg

SEQ ID NO: 485333 - DNA, 20 bp, mouse
ggagtctgtaatgttttcta

SEQ ID NO: 485334 - DNA, 20 bp, mouse
gggcattccagaatccatac

SEQ ID NO: 485335 - DNA, 20 bp, mouse
gagttgtccagaatgtggca

SEQ ID NO: 485336 - DNA, 20 bp, mouse
gggcgctggagtcccctcag

SEQ ID NO: 485337 - DNA, 20 bp, mouse
ggattgggccccggactcgg

SEQ ID NO: 485338 - DNA, 20 bp, mouse
gggcgtcccggtccgctgag

SEQ ID NO: 485339 - DNA, 20 bp, mouse
gaaagccgcgtcccggagac

SEQ ID NO: 485340 - DNA, 20 bp, mouse
ggcggagccaaggcacggga

SEQ ID NO: 485341 - DNA, 20 bp, mouse
ggagcggagcgccaaccggg

SEQ ID NO: 485342 - DNA, 20 bp, mouse
gggagtcccctcagcggacc

SEQ ID NO: 485343 - DNA, 20 bp, mouse
gccgacctgttgcgaggcag

SEQ ID NO: 485344 - DNA, 20 bp, mouse
gcccaaggcttgaggtaagg

SEQ ID NO: 485345 - DNA, 20 bp, mouse
gccgggacgccaccgagtcc

SEQ ID NO: 485346 - DNA, 20 bp, mouse
gtggcccgcgggctcaggta

SEQ ID NO: 485347 - DNA, 20 bp, mouse
gccgcgggccaggccgccaa

SEQ ID NO: 485348 - DNA, 20 bp, mouse
ggatgctgtgacggaccgca

SEQ ID NO: 485349 - DNA, 20 bp, mouse
gcacggaagcagcgacgccg

SEQ ID NO: 485350 - DNA, 20 bp, mouse
ggtccgtcacagcatctccc

SEQ ID NO: 485351 - DNA, 20 bp, mouse
ggcgccgggccgtgtctccc

SEQ ID NO: 485352 - DNA, 20 bp, mouse
ggccaggccgccaagggccc

SEQ ID NO: 485353 - DNA, 20 bp, mouse
ggcgacgccggggcccttgg

SEQ ID NO: 485354 - DNA, 20 bp, mouse
gcgcgggctcaggtagggtg

SEQ ID NO: 485355 - DNA, 20 bp, mouse
gcagcatctcccgggagaca

SEQ ID NO: 485356 - DNA, 20 bp, mouse
gtctaggtctggttgaggag

SEQ ID NO: 485357 - DNA, 20 bp, mouse
gctgtttctaggtctggttg

SEQ ID NO: 485358 - DNA, 20 bp, mouse
ggaattctcagtacatggag

SEQ ID NO: 485359 - DNA, 20 bp, mouse
gaccagacctagaaacagtc

SEQ ID NO: 485360 - DNA, 20 bp, mouse
gggggggggattcagagatc

SEQ ID NO: 485361 - DNA, 20 bp, mouse
gtttttattgtcaacatgtt

SEQ ID NO: 485362 - DNA, 20 bp, mouse
ggacaaagaggatgagatcg

SEQ ID NO: 485363 - DNA, 20 bp, mouse
gctggtgctagaatcttcta

SEQ ID NO: 485364 - DNA, 20 bp, mouse
gtgcctcatctgttagacaa

SEQ ID NO: 485365 - DNA, 20 bp, mouse
gcaataagaaaaggagcata

SEQ ID NO: 485366 - DNA, 20 bp, mouse
gggttgaagccgctggaaga

SEQ ID NO: 485367 - DNA, 20 bp, mouse
gtccggggcctcagtaaggt

SEQ ID NO: 485368 - DNA, 20 bp, mouse
gtggttcccggcctttccca

SEQ ID NO: 485369 - DNA, 20 bp, mouse
gcggttccggggcctcagta

SEQ ID NO: 485370 - DNA, 20 bp, mouse
gccgcagggctcccaggaaa

SEQ ID NO: 485371 - DNA, 20 bp, mouse
gatgtgcagtgaatgcagag

SEQ ID NO: 485372 - DNA, 20 bp, mouse
ggcctagatgaagaaatcac

SEQ ID NO: 485373 - DNA, 20 bp, mouse
gcccaggaaagggaagcctc

SEQ ID NO: 485374 - DNA, 20 bp, mouse
gcatggcagaaggagactgg

SEQ ID NO: 485375 - DNA, 20 bp, mouse
gctggtgggtatcctttctg

SEQ ID NO: 485376 - DNA, 20 bp, mouse
gtttctggtttcaggtagga

SEQ ID NO: 485377 - DNA, 20 bp, mouse
gaatcaacaagacacactat

SEQ ID NO: 485378 - DNA, 20 bp, mouse
gactctataaataaaggacc

SEQ ID NO: 485379 - DNA, 20 bp, mouse
gcttattctcccaatccagg

SEQ ID NO: 485380 - DNA, 20 bp, mouse
gttggcttagaaaagactct

SEQ ID NO: 485381 - DNA, 20 bp, mouse
ggaacttattctcccaatcc

SEQ ID NO: 485382 - DNA, 20 bp, mouse
gaaagggatctgacccatat

SEQ ID NO: 485383 - DNA, 20 bp, mouse
gtatttccttgctctacaag

SEQ ID NO: 485384 - DNA, 20 bp, mouse
gtatttccttcaacggactg

SEQ ID NO: 485385 - DNA, 20 bp, mouse
gaggctccccagtccgttga

SEQ ID NO: 485386 - DNA, 20 bp, mouse
ggtttctggaggtctcgact

SEQ ID NO: 485387 - DNA, 20 bp, mouse
gctgctcctcacaacctggg

SEQ ID NO: 485388 - DNA, 20 bp, mouse
gcaggaggcaccgggatcct

SEQ ID NO: 485389 - DNA, 20 bp, mouse
ggtacacacgcagaaagata

SEQ ID NO: 485390 - DNA, 20 bp, mouse
ggtggaaatctagtttctgg

SEQ ID NO: 485391 - DNA, 20 bp, mouse
ggcaatcacgatgtttttgt

SEQ ID NO: 485392 - DNA, 20 bp, mouse
gctagtggaaatctagtttc

SEQ ID NO: 485393 - DNA, 20 bp, mouse
ggcaaagcggcccaggatcc

SEQ ID NO: 485394 - DNA, 20 bp, mouse
gttcctgctcctcacaacct

SEQ ID NO: 485395 - DNA, 20 bp, mouse
ggaacgagagcaggaggcac

SEQ ID NO: 485396 - DNA, 20 bp, mouse
gtcaggacaggcacataaaa

SEQ ID NO: 485397 - DNA, 20 bp, mouse
gtttctgctatgctcaggac

SEQ ID NO: 485398 - DNA, 20 bp, mouse
gcgcgtcctgatgctgccgt

SEQ ID NO: 485399 - DNA, 20 bp, mouse
ggagggaaccgggacaacca

SEQ ID NO: 485400 - DNA, 20 bp, mouse
gtagcagaaaatggtgccca

SEQ ID NO: 485401 - DNA, 20 bp, mouse
gcataaaagggaaggcggca

SEQ ID NO: 485402 - DNA, 20 bp, mouse
gcccgaaccagctaggataa

SEQ ID NO: 485403 - DNA, 20 bp, mouse
gaaggaaagttgctctacag

SEQ ID NO: 485404 - DNA, 20 bp, mouse
gggcagggccgtggttgtcc

SEQ ID NO: 485405 - DNA, 20 bp, mouse
gcggggagcccgaaccagct

SEQ ID NO: 485406 - DNA, 20 bp, mouse
gtggaggtgcttcagtctgt

SEQ ID NO: 485407 - DNA, 20 bp, mouse
gacagcgacgaatagtaagc

SEQ ID NO: 485408 - DNA, 20 bp, mouse
gttggaaggcagcccagctt

SEQ ID NO: 485409 - DNA, 20 bp, mouse
gtctgggatttggagaaagt

SEQ ID NO: 485410 - DNA, 20 bp, mouse
ggaggcagttgggtcatgtg

SEQ ID NO: 485411 - DNA, 20 bp, mouse
gctccaaatcccagagccag

SEQ ID NO: 485412 - DNA, 20 bp, mouse
gcccagagccagaggcagtt

SEQ ID NO: 485413 - DNA, 20 bp, mouse
gcgaagtgcagagcatccca

SEQ ID NO: 485414 - DNA, 20 bp, mouse
gctggagggatagacatcac

SEQ ID NO: 485415 - DNA, 20 bp, mouse
gaagtagacacacctaagct

SEQ ID NO: 485416 - DNA, 20 bp, mouse
gggtgtgagaaacaaaactt

SEQ ID NO: 485417 - DNA, 20 bp, mouse
gtcgatgagtgagctttatg

SEQ ID NO: 485418 - DNA, 20 bp, mouse
gatggctcacaattactgtc

SEQ ID NO: 485419 - DNA, 20 bp, mouse
gatctgtaggaaatctcaat

SEQ ID NO: 485420 - DNA, 20 bp, mouse
gtaggaaatctcaataggat

SEQ ID NO: 485421 - DNA, 20 bp, mouse
gttgtttctcacacctatgt

SEQ ID NO: 485422 - DNA, 20 bp, mouse
gaattaatataatattctct

SEQ ID NO: 485423 - DNA, 20 bp, mouse
ggaagactatgcaaaagcac

SEQ ID NO: 485424 - DNA, 20 bp, mouse
gaaacaaaacttaggccatc

SEQ ID NO: 485425 - DNA, 20 bp, mouse
ggtcaggagtcatctaggat

SEQ ID NO: 485426 - DNA, 20 bp, mouse
gggcattgctccagaatcca

SEQ ID NO: 485427 - DNA, 20 bp, mouse
gaaggcatcaagaggatcat

SEQ ID NO: 485428 - DNA, 20 bp, mouse
gagggcattagcgagccagg

SEQ ID NO: 485429 - DNA, 20 bp, mouse
gttgatgccttaccatggaa

SEQ ID NO: 485430 - DNA, 20 bp, mouse
ggcacactggtacctttcca

SEQ ID NO: 485431 - DNA, 20 bp, mouse
gaaggtaccagtgtgcctcc

SEQ ID NO: 485432 - DNA, 20 bp, mouse
gtcctcttgatgccttacca

SEQ ID NO: 485433 - DNA, 20 bp, mouse
gtccagggcattagcgagcc

SEQ ID NO: 485434 - DNA, 20 bp, mouse
gcttagaggcccaggacccc

SEQ ID NO: 485435 - DNA, 20 bp, mouse
gtcaccagccagcatagaga

SEQ ID NO: 485436 - DNA, 20 bp, mouse
gtgcaggcccgtatgagcag

SEQ ID NO: 485437 - DNA, 20 bp, mouse
gtgtgtggtgcagcaagaaa

SEQ ID NO: 485438 - DNA, 20 bp, mouse
gctatccaggctgggaaaag

SEQ ID NO: 485439 - DNA, 20 bp, mouse
ggcagaggctcaggagacac

SEQ ID NO: 485440 - DNA, 20 bp, mouse
gtccagatagaaaatgtata

SEQ ID NO: 485441 - DNA, 20 bp, mouse
ggggcagctggttcatcaag

SEQ ID NO: 485442 - DNA, 20 bp, mouse
gcctggctgcctaactatcc

SEQ ID NO: 485443 - DNA, 20 bp, mouse
gcccgtatgagcagaggctc

SEQ ID NO: 485444 - DNA, 20 bp, mouse
gtattgactaacctcttgaa

SEQ ID NO: 485445 - DNA, 20 bp, mouse
ggtgtctgtagactctctca

SEQ ID NO: 485446 - DNA, 20 bp, mouse
gctggctaggagcttgcggg

SEQ ID NO: 485447 - DNA, 20 bp, mouse
ggagcttgcgggaggcacat

SEQ ID NO: 485448 - DNA, 20 bp, mouse
gctcctagccagtccagaca

SEQ ID NO: 485449 - DNA, 20 bp, mouse
ggtcaggagggccggcaagg

SEQ ID NO: 485450 - DNA, 20 bp, mouse
ggatctagggtcaggagggc

SEQ ID NO: 485451 - DNA, 20 bp, mouse
ggcaggatctagggtcagga

SEQ ID NO: 485452 - DNA, 20 bp, mouse
ggacagggaatactgaggtg

SEQ ID NO: 485453 - DNA, 20 bp, mouse
gacgaacggcgcaggatcta

SEQ ID NO: 485454 - DNA, 20 bp, mouse
gcactcggtgagcgaacgaa

SEQ ID NO: 485455 - DNA, 20 bp, mouse
gcggcgcaggatctagggtc

SEQ ID NO: 485456 - DNA, 20 bp, mouse
gagctgaggggacagctgga

SEQ ID NO: 485457 - DNA, 20 bp, mouse
gagaccctcgagtgagctga

SEQ ID NO: 485458 - DNA, 20 bp, mouse
gtcttgcttgtgaagcacca

SEQ ID NO: 485459 - DNA, 20 bp, mouse
gcaccagggaagctttgggc

SEQ ID NO: 485460 - DNA, 20 bp, mouse
gagaagtcttcaggggactg

SEQ ID NO: 485461 - DNA, 20 bp, mouse
gtgaagcaccagggaagctt

SEQ ID NO: 485462 - DNA, 20 bp, mouse
gaaatactgacaagtcctgg

SEQ ID NO: 485463 - DNA, 20 bp, mouse
gtcctggtggcagtgactac

SEQ ID NO: 485464 - DNA, 20 bp, mouse
gcccatgctgtgaaggatca

SEQ ID NO: 485465 - DNA, 20 bp, mouse
ggagacagaaagtggatacc

SEQ ID NO: 485466 - DNA, 20 bp, mouse
gtggggctggaggctggtcc

SEQ ID NO: 485467 - DNA, 20 bp, mouse
gggctggaggctggtccagg

SEQ ID NO: 485468 - DNA, 20 bp, mouse
gccggggctttgtttccctg

SEQ ID NO: 485469 - DNA, 20 bp, mouse
gggctttgtttccctggggc

SEQ ID NO: 485470 - DNA, 20 bp, mouse
gtttccctggggctggaggc

SEQ ID NO: 485471 - DNA, 20 bp, mouse
ggaaacaaagccccggctgc

SEQ ID NO: 485472 - DNA, 20 bp, mouse
gtgcaaaccctgaggaaggc

SEQ ID NO: 485473 - DNA, 20 bp, mouse
gctggtccaggcggcgcatc

SEQ ID NO: 485474 - DNA, 20 bp, mouse
gtttgtttccctggggctgg

SEQ ID NO: 485475 - DNA, 20 bp, mouse
gcagaacctgatgcgccgcc

SEQ ID NO: 485476 - DNA, 20 bp, mouse
ggatggggtactggaaggag

SEQ ID NO: 485477 - DNA, 20 bp, mouse
gggcgaatgagcatattagg

SEQ ID NO: 485478 - DNA, 20 bp, mouse
gcatattagggggatcctac

SEQ ID NO: 485479 - DNA, 20 bp, mouse
gcgtggcgaatgagcatatt

SEQ ID NO: 485480 - DNA, 20 bp, mouse
gccgagtctgtgattcctgt

SEQ ID NO: 485481 - DNA, 20 bp, mouse
gaaggtcatgaacctggctg

SEQ ID NO: 485482 - DNA, 20 bp, mouse
gtcacagactcggtgctcta

SEQ ID NO: 485483 - DNA, 20 bp, mouse
gtggagtgagagttagtggg

SEQ ID NO: 485484 - DNA, 20 bp, mouse
gatcgagacaaagagttacg

SEQ ID NO: 485485 - DNA, 20 bp, mouse
gactcagccatccacaaagt

SEQ ID NO: 485486 - DNA, 20 bp, mouse
ggtgagcgcagggctcaagt

SEQ ID NO: 485487 - DNA, 20 bp, mouse
ggagttccagcctggagcag

SEQ ID NO: 485488 - DNA, 20 bp, mouse
gttgggtagggtctgcatgg

SEQ ID NO: 485489 - DNA, 20 bp, mouse
gtgcgctcacgatgacagtg

SEQ ID NO: 485490 - DNA, 20 bp, mouse
gttccagcctggagcagagg

SEQ ID NO: 485491 - DNA, 20 bp, mouse
gttgagtcagagcatttgat

SEQ ID NO: 485492 - DNA, 20 bp, mouse
ggcatcttctctctgagtct

SEQ ID NO: 485493 - DNA, 20 bp, mouse
gtggagcagaggcggacaga

SEQ ID NO: 485494 - DNA, 20 bp, mouse
gcttctctctgagtctaggt

SEQ ID NO: 485495 - DNA, 20 bp, mouse
gggtagggtctgcatggggg

SEQ ID NO: 485496 - DNA, 20 bp, mouse
gaaatcacttgcaaactcac

SEQ ID NO: 485497 - DNA, 20 bp, mouse
gtatagcttttcctcaagat

SEQ ID NO: 485498 - DNA, 20 bp, mouse
gatgcaattgttgttatgta

SEQ ID NO: 485499 - DNA, 20 bp, mouse
gatgggatagaatcatgcga

SEQ ID NO: 485500 - DNA, 20 bp, mouse
ggtgtgtagtacatatacat

SEQ ID NO: 485501 - DNA, 20 bp, mouse
gtagcagctgcactttttta

SEQ ID NO: 485502 - DNA, 20 bp, mouse
gctctcagcagtaggattta

SEQ ID NO: 485503 - DNA, 20 bp, mouse
gccctaactcaaaagtaata

SEQ ID NO: 485504 - DNA, 20 bp, mouse
gaacaccaggcaaaaacact

SEQ ID NO: 485505 - DNA, 20 bp, mouse
ggtaggatttatgggtctgc

SEQ ID NO: 485506 - DNA, 20 bp, mouse
ggcactcagaaggttcaagg

SEQ ID NO: 485507 - DNA, 20 bp, mouse
gcaagtgcatatgcaggtca

SEQ ID NO: 485508 - DNA, 20 bp, mouse
gacagtgtctcgagcatctt

SEQ ID NO: 485509 - DNA, 20 bp, mouse
gctcagaaggttcaaggggg

SEQ ID NO: 485510 - DNA, 20 bp, mouse
ggcccaccagacagcacaga

SEQ ID NO: 485511 - DNA, 20 bp, mouse
gaattgaaagatgaaaagtt

SEQ ID NO: 485512 - DNA, 20 bp, mouse
gtgcatatgcaggtcaaggc

SEQ ID NO: 485513 - DNA, 20 bp, mouse
gcattctcaagtgcatatgc

SEQ ID NO: 485514 - DNA, 20 bp, mouse
ggccctctgtgctgtctggt

SEQ ID NO: 485515 - DNA, 20 bp, mouse
gttctgagtgctgggttgca

SEQ ID NO: 485516 - DNA, 20 bp, mouse
ggtcactcagctaaccttca

SEQ ID NO: 485517 - DNA, 20 bp, mouse
gtaagaggcaggttgactga

SEQ ID NO: 485518 - DNA, 20 bp, mouse
gcctttgtcttgttcctaag

SEQ ID NO: 485519 - DNA, 20 bp, mouse
gaggcactcctcttccttga

SEQ ID NO: 485520 - DNA, 20 bp, mouse
gtgttagagacacttgacgg

SEQ ID NO: 485521 - DNA, 20 bp, mouse
gtgtgctggagacagtcgaa

SEQ ID NO: 485522 - DNA, 20 bp, mouse
gtatttgagagtcaagaggg

SEQ ID NO: 485523 - DNA, 20 bp, mouse
gtgtcttgttcctaagaggc

SEQ ID NO: 485524 - DNA, 20 bp, mouse
gtgctgttagagacacttga

SEQ ID NO: 485525 - DNA, 20 bp, mouse
gatttgcaaagtgtgtagtc

SEQ ID NO: 485526 - DNA, 20 bp, mouse
gggaacactagagacaacct

SEQ ID NO: 485527 - DNA, 20 bp, mouse
gatcgcgagccccaaggcag

SEQ ID NO: 485528 - DNA, 20 bp, mouse
ggaacccatcgcgagcccca

SEQ ID NO: 485529 - DNA, 20 bp, mouse
ggccaggccgaacagagccg

SEQ ID NO: 485530 - DNA, 20 bp, mouse
gtcggcctggctctctgtgc

SEQ ID NO: 485531 - DNA, 20 bp, mouse
gctgcggccccggctctgtt

SEQ ID NO: 485532 - DNA, 20 bp, mouse
gcggctgtagccccagacac

SEQ ID NO: 485533 - DNA, 20 bp, mouse
gcggctctcgccggctccca

SEQ ID NO: 485534 - DNA, 20 bp, mouse
ggcgatgggttcggctgcct

SEQ ID NO: 485535 - DNA, 20 bp, mouse
gactgactgtctcgcgctgt

SEQ ID NO: 485536 - DNA, 20 bp, mouse
gcggcagaatccacagtcct

SEQ ID NO: 485537 - DNA, 20 bp, mouse
gtgcgtttgaggggaagtga

SEQ ID NO: 485538 - DNA, 20 bp, mouse
gtttgaggggaagtgacgga

SEQ ID NO: 485539 - DNA, 20 bp, mouse
ggggcaggtgtgcgtttgag

SEQ ID NO: 485540 - DNA, 20 bp, mouse
gacacagcaaagctccaaga

SEQ ID NO: 485541 - DNA, 20 bp, mouse
gcggggcctgcaaagaagaa

SEQ ID NO: 485542 - DNA, 20 bp, mouse
gaatccacagtcctaggcaa

SEQ ID NO: 485543 - DNA, 20 bp, mouse
gactattcacctggcccccg

SEQ ID NO: 485544 - DNA, 20 bp, mouse
gtgagtccaggagatagcag

SEQ ID NO: 485545 - DNA, 20 bp, mouse
gcagggataatagctatccc

SEQ ID NO: 485546 - DNA, 20 bp, mouse
gcgtgtccgcgcgaagaccg

SEQ ID NO: 485547 - DNA, 20 bp, mouse
gtctcttgaggctagaccag

SEQ ID NO: 485548 - DNA, 20 bp, mouse
gcagtggcgtcgggcgtgac

SEQ ID NO: 485549 - DNA, 20 bp, mouse
gtcgcctggagcgcccagaa

SEQ ID NO: 485550 - DNA, 20 bp, mouse
gaggctagaccagtggcgtc

SEQ ID NO: 485551 - DNA, 20 bp, mouse
gccggtcgcacgtctctgcg

SEQ ID NO: 485552 - DNA, 20 bp, mouse
gggtctagcctcaagagagg

SEQ ID NO: 485553 - DNA, 20 bp, mouse
gtagctccccgagaggtcgg

SEQ ID NO: 485554 - DNA, 20 bp, mouse
gaaagggcctccccgcgcgt

SEQ ID NO: 485555 - DNA, 20 bp, mouse
gggacacggaacccacgcgc

SEQ ID NO: 485556 - DNA, 20 bp, mouse
gctgaggtgaggcaactaca

SEQ ID NO: 485557 - DNA, 20 bp, mouse
gtagttgcctcacctcagaa

SEQ ID NO: 485558 - DNA, 20 bp, mouse
gcatatgcccttctgaggtg

SEQ ID NO: 485559 - DNA, 20 bp, mouse
gcaagccatatgcccttctg

SEQ ID NO: 485560 - DNA, 20 bp, mouse
gctatgactgagaccaataa

SEQ ID NO: 485561 - DNA, 20 bp, mouse
gcaagaggaaagagtgataa

SEQ ID NO: 485562 - DNA, 20 bp, mouse
gcaccaggcagtgactacat

SEQ ID NO: 485563 - DNA, 20 bp, mouse
gaatctgctgcccatcggta

SEQ ID NO: 485564 - DNA, 20 bp, mouse
gcactctttcctcttgtttt

SEQ ID NO: 485565 - DNA, 20 bp, mouse
gtttaaggctatatttccta

SEQ ID NO: 485566 - DNA, 20 bp, mouse
gcggtgtacggccaacatgg

SEQ ID NO: 485567 - DNA, 20 bp, mouse
gccgaggcaaggcccgaccg

SEQ ID NO: 485568 - DNA, 20 bp, mouse
ggcccggtgtacggccaaca

SEQ ID NO: 485569 - DNA, 20 bp, mouse
gccgcggcccgcgaagcgcg

SEQ ID NO: 485570 - DNA, 20 bp, mouse
gcggctgacctccgccatgt

SEQ ID NO: 485571 - DNA, 20 bp, mouse
gcgcttcgcgggccgcggtc

SEQ ID NO: 485572 - DNA, 20 bp, mouse
gcccggagaggccgagacaa

SEQ ID NO: 485573 - DNA, 20 bp, mouse
gaggccgcccgcttacctgt

SEQ ID NO: 485574 - DNA, 20 bp, mouse
gtgttgtgtggcccggtgta

SEQ ID NO: 485575 - DNA, 20 bp, mouse
gaataaaggcgcgggtccgg

SEQ ID NO: 485576 - DNA, 20 bp, mouse
gtaaggtaaattcttaccca

SEQ ID NO: 485577 - DNA, 20 bp, mouse
gccaaaagaaggaatagtgg

SEQ ID NO: 485578 - DNA, 20 bp, mouse
gaaaaaagaaaggacagaag

SEQ ID NO: 485579 - DNA, 20 bp, mouse
gggaatagtggaggagcaat

SEQ ID NO: 485580 - DNA, 20 bp, mouse
ggagggaggaagggaccggg

SEQ ID NO: 485581 - DNA, 20 bp, mouse
gatagtggaggagcaatagg

SEQ ID NO: 485582 - DNA, 20 bp, mouse
ggggagggagaaccaaaaga

SEQ ID NO: 485583 - DNA, 20 bp, mouse
ggaaccaaaagaaggaatag

SEQ ID NO: 485584 - DNA, 20 bp, mouse
gtgtgcacgatactttagta

SEQ ID NO: 485585 - DNA, 20 bp, mouse
gaggagcaataggtgggtac

SEQ ID NO: 485586 - DNA, 20 bp, mouse
gagggtccccgaggacgtgg

SEQ ID NO: 485587 - DNA, 20 bp, mouse
gtccccaccccacaagctgt

SEQ ID NO: 485588 - DNA, 20 bp, mouse
gcattgaggatggccagcaa

SEQ ID NO: 485589 - DNA, 20 bp, mouse
gggcgagaagcaaaacattg

SEQ ID NO: 485590 - DNA, 20 bp, mouse
gaccagggtccccgaggacg

SEQ ID NO: 485591 - DNA, 20 bp, mouse
gaggatggccagcaaagggc

SEQ ID NO: 485592 - DNA, 20 bp, mouse
ggcacctctatgcaaagagg

SEQ ID NO: 485593 - DNA, 20 bp, mouse
gagcgagccgagcccccctg

SEQ ID NO: 485594 - DNA, 20 bp, mouse
gagaagcaaaacattgagga

SEQ ID NO: 485595 - DNA, 20 bp, mouse
gatagaggtgcagccctggg

SEQ ID NO: 485596 - DNA, 20 bp, mouse
gacctagtagaaggaaggcc

SEQ ID NO: 485597 - DNA, 20 bp, mouse
gttaacaacagctctcacat

SEQ ID NO: 485598 - DNA, 20 bp, mouse
gccactctgcagtccaaggc

SEQ ID NO: 485599 - DNA, 20 bp, mouse
gacaaaacctagtagaagga

SEQ ID NO: 485600 - DNA, 20 bp, mouse
gcaccacaaaacctagtaga

SEQ ID NO: 485601 - DNA, 20 bp, mouse
ggccacagatagagcctgta

SEQ ID NO: 485602 - DNA, 20 bp, mouse
gagcctgtatggtagacttc

SEQ ID NO: 485603 - DNA, 20 bp, mouse
gcaacagctctcacataggc

SEQ ID NO: 485604 - DNA, 20 bp, mouse
gacataaaagtaagaggaag

SEQ ID NO: 485605 - DNA, 20 bp, mouse
gcctcaaaatgtggggcgtg

SEQ ID NO: 485606 - DNA, 20 bp, mouse
gagagtggcctgggcggttt

SEQ ID NO: 485607 - DNA, 20 bp, mouse
ggtggcctgggcggtttagg

SEQ ID NO: 485608 - DNA, 20 bp, mouse
ggatggcgtagcgatgagag

SEQ ID NO: 485609 - DNA, 20 bp, mouse
gcaaaggtaggaacccctca

SEQ ID NO: 485610 - DNA, 20 bp, mouse
gacagccgcctaaaccgccc

SEQ ID NO: 485611 - DNA, 20 bp, mouse
gctggttcgtggacagacca

SEQ ID NO: 485612 - DNA, 20 bp, mouse
gctcacagtgaaaagcttta

SEQ ID NO: 485613 - DNA, 20 bp, mouse
gcagcaggtgagcgtttctg

SEQ ID NO: 485614 - DNA, 20 bp, mouse
gggtgggcgtgaggaacgcc

SEQ ID NO: 485615 - DNA, 20 bp, mouse
ggatcacccctgagacaaga

SEQ ID NO: 485616 - DNA, 20 bp, mouse
gaccatgtgggtgaatccgg

SEQ ID NO: 485617 - DNA, 20 bp, mouse
ggcggccaccaggaccatgt

SEQ ID NO: 485618 - DNA, 20 bp, mouse
gtcgttgcagaatgaagtag

SEQ ID NO: 485619 - DNA, 20 bp, mouse
gatgtgggtgaatccggagg

SEQ ID NO: 485620 - DNA, 20 bp, mouse
gtggcgagcgaggagccgta

SEQ ID NO: 485621 - DNA, 20 bp, mouse
gcgagcgaggagccgtaggg

SEQ ID NO: 485622 - DNA, 20 bp, mouse
gaatccggaggaggtactgc

SEQ ID NO: 485623 - DNA, 20 bp, mouse
gaggaccatgtgggtgaatc

SEQ ID NO: 485624 - DNA, 20 bp, mouse
gtcggtgatccacagcgcgt

SEQ ID NO: 485625 - DNA, 20 bp, mouse
ggcccgcgacaaagacccag

SEQ ID NO: 485626 - DNA, 20 bp, mouse
ggagagtcagctttcctcga

SEQ ID NO: 485627 - DNA, 20 bp, mouse
gcaatattctagcgcagagt

SEQ ID NO: 485628 - DNA, 20 bp, mouse
gcccagaagccatgccctcg

SEQ ID NO: 485629 - DNA, 20 bp, mouse
gtgggaagcgattgacagct

SEQ ID NO: 485630 - DNA, 20 bp, mouse
gataagatgcaaacactgac

SEQ ID NO: 485631 - DNA, 20 bp, mouse
gaggcaaacagggctgctct

SEQ ID NO: 485632 - DNA, 20 bp, mouse
gcatcttgtgtaggcaaaca

SEQ ID NO: 485633 - DNA, 20 bp, mouse
gcatcatagaagtgatggta

SEQ ID NO: 485634 - DNA, 20 bp, mouse
gaaacagtgtcttctagatt

SEQ ID NO: 485635 - DNA, 20 bp, mouse
gcgcccccttacacaactca

SEQ ID NO: 485636 - DNA, 20 bp, mouse
gggccttcctcggcaaccaa

SEQ ID NO: 485637 - DNA, 20 bp, mouse
gagttcatagaggccttcct

SEQ ID NO: 485638 - DNA, 20 bp, mouse
gaataagccccacaccaaaa

SEQ ID NO: 485639 - DNA, 20 bp, mouse
gcacagtgaggaacttacag

SEQ ID NO: 485640 - DNA, 20 bp, mouse
ggaccaaaggaaagccaaca

SEQ ID NO: 485641 - DNA, 20 bp, mouse
gaaccaaaggcaacacattt

SEQ ID NO: 485642 - DNA, 20 bp, mouse
ggtgttgcctttggttgccg

SEQ ID NO: 485643 - DNA, 20 bp, mouse
gagcaagccagactgtgggc

SEQ ID NO: 485644 - DNA, 20 bp, mouse
gtgcctttggttgccgagga

SEQ ID NO: 485645 - DNA, 20 bp, mouse
gcagcaagacgcttcgatgg

SEQ ID NO: 485646 - DNA, 20 bp, mouse
gactagccctatgagatcta

SEQ ID NO: 485647 - DNA, 20 bp, mouse
gctctgccctagatctcata

SEQ ID NO: 485648 - DNA, 20 bp, mouse
gatatccccacctctccccc

SEQ ID NO: 485649 - DNA, 20 bp, mouse
gagggcatgatagccgagga

SEQ ID NO: 485650 - DNA, 20 bp, mouse
gcaccactgtgaggccactg

SEQ ID NO: 485651 - DNA, 20 bp, mouse
gggcctcacagtggtggaca

SEQ ID NO: 485652 - DNA, 20 bp, mouse
gaaggagggcatgatagccg

SEQ ID NO: 485653 - DNA, 20 bp, mouse
gtgcactacaccttcctcag

SEQ ID NO: 485654 - DNA, 20 bp, mouse
ggacctgctagaggacattc

SEQ ID NO: 485655 - DNA, 20 bp, mouse
gccacctggaacttaaagcc

SEQ ID NO: 485656 - DNA, 20 bp, mouse
gcagcctgcgcgctcctagg

SEQ ID NO: 485657 - DNA, 20 bp, mouse
gccgctggtgactttcgctt

SEQ ID NO: 485658 - DNA, 20 bp, mouse
ggcaatcaggccctacccgc

SEQ ID NO: 485659 - DNA, 20 bp, mouse
gcaggctggagagcaccgga

SEQ ID NO: 485660 - DNA, 20 bp, mouse
gtcggttaattcctgatgtg

SEQ ID NO: 485661 - DNA, 20 bp, mouse
gcgcgcaggctggagagcac

SEQ ID NO: 485662 - DNA, 20 bp, mouse
ggcgaaagtcaccagcgggt

SEQ ID NO: 485663 - DNA, 20 bp, mouse
ggagtcccgtggccccacgt

SEQ ID NO: 485664 - DNA, 20 bp, mouse
gaacctgtggctggtagtaa

SEQ ID NO: 485665 - DNA, 20 bp, mouse
gccctaatgagattagaggg

SEQ ID NO: 485666 - DNA, 20 bp, mouse
gggagggagcggccaagcag

SEQ ID NO: 485667 - DNA, 20 bp, mouse
gggtctcagccccccgagga

SEQ ID NO: 485668 - DNA, 20 bp, mouse
ggatgaccgctggggctcta

SEQ ID NO: 485669 - DNA, 20 bp, mouse
gtgatccacgatgaccgctg

SEQ ID NO: 485670 - DNA, 20 bp, mouse
gagcgggtctcagccccccg

SEQ ID NO: 485671 - DNA, 20 bp, mouse
gttggccgctccctcctcgg

SEQ ID NO: 485672 - DNA, 20 bp, mouse
gcaggcgccgccgcacacaa

SEQ ID NO: 485673 - DNA, 20 bp, mouse
gagctgagagcacccctgct

SEQ ID NO: 485674 - DNA, 20 bp, mouse
ggccctgcggcgagatccga

SEQ ID NO: 485675 - DNA, 20 bp, mouse
gcagatcccacaaatcccag

SEQ ID NO: 485676 - DNA, 20 bp, mouse
gcgcatgcgtggcagtcaca

SEQ ID NO: 485677 - DNA, 20 bp, mouse
ggtaaactctagctcagtaa

SEQ ID NO: 485678 - DNA, 20 bp, mouse
gatgtgtgaaggcgcatgcg

SEQ ID NO: 485679 - DNA, 20 bp, mouse
gggcagtcacagggcaatct

SEQ ID NO: 485680 - DNA, 20 bp, mouse
ggataccctgatagaaagtg

SEQ ID NO: 485681 - DNA, 20 bp, mouse
gatgtcctcactttctatca

SEQ ID NO: 485682 - DNA, 20 bp, mouse
gtcaataacatagatcacaa

SEQ ID NO: 485683 - DNA, 20 bp, mouse
gacaggagcgtctcaaggtg

SEQ ID NO: 485684 - DNA, 20 bp, mouse
gtttagcctggtctttgaag

SEQ ID NO: 485685 - DNA, 20 bp, mouse
ggcgcatgcgcctttcacac

SEQ ID NO: 485686 - DNA, 20 bp, mouse
ggttcacgcccagatcggtc

SEQ ID NO: 485687 - DNA, 20 bp, mouse
ggaagcctgcggctgtgaag

SEQ ID NO: 485688 - DNA, 20 bp, mouse
ggaccgcaggcaggatcgac

SEQ ID NO: 485689 - DNA, 20 bp, mouse
gcaggcccattatggagctg

SEQ ID NO: 485690 - DNA, 20 bp, mouse
ggtaggaggtcagtgctgtc

SEQ ID NO: 485691 - DNA, 20 bp, mouse
gtaaagccccagctccataa

SEQ ID NO: 485692 - DNA, 20 bp, mouse
gggcgtgaacaacgcactgt

SEQ ID NO: 485693 - DNA, 20 bp, mouse
gttcgaccgctagtacacaa

SEQ ID NO: 485694 - DNA, 20 bp, mouse
ggcatcgccaccaaaatcaa

SEQ ID NO: 485695 - DNA, 20 bp, mouse
gaaacacgcctgaccgatct

SEQ ID NO: 485696 - DNA, 20 bp, mouse
gaaactgatatatcaaacaa

SEQ ID NO: 485697 - DNA, 20 bp, mouse
gtacagaggaagtgatgcac

SEQ ID NO: 485698 - DNA, 20 bp, mouse
gaggctgaggaaagagaaag

SEQ ID NO: 485699 - DNA, 20 bp, mouse
gggaaagagaaagtggcaca

SEQ ID NO: 485700 - DNA, 20 bp, mouse
gggtgagagagacaaccttt

SEQ ID NO: 485701 - DNA, 20 bp, mouse
gtagaaataacatatgtggg

SEQ ID NO: 485702 - DNA, 20 bp, mouse
gtgcattagtctgtgcccaa

SEQ ID NO: 485703 - DNA, 20 bp, mouse
gagactaatgcagtgcctca

SEQ ID NO: 485704 - DNA, 20 bp, mouse
gttttagaaataacatatgt

SEQ ID NO: 485705 - DNA, 20 bp, mouse
gcaaacaagcttaggatgct

SEQ ID NO: 485706 - DNA, 20 bp, mouse
gaagctgaggaaatagaaag

SEQ ID NO: 485707 - DNA, 20 bp, mouse
gccagagtacacatatcgac

SEQ ID NO: 485708 - DNA, 20 bp, mouse
gtaaaaattctcactgatta

SEQ ID NO: 485709 - DNA, 20 bp, mouse
gtttctcataagcacagata

SEQ ID NO: 485710 - DNA, 20 bp, mouse
gttagaacaacatgtgtgag

SEQ ID NO: 485711 - DNA, 20 bp, mouse
gggaatggttcaatttgtac

SEQ ID NO: 485712 - DNA, 20 bp, mouse
gtttctactcccttgtatga

SEQ ID NO: 485713 - DNA, 20 bp, mouse
ggtgcagatgtgattaaaga

SEQ ID NO: 485714 - DNA, 20 bp, mouse
gacatttataaaggaaagag

SEQ ID NO: 485715 - DNA, 20 bp, mouse
gtaaagatggtgttgtggaa

SEQ ID NO: 485716 - DNA, 20 bp, mouse
gctaggaagtgagggcaggt

SEQ ID NO: 485717 - DNA, 20 bp, mouse
gggccaccccggttgaaccg

SEQ ID NO: 485718 - DNA, 20 bp, mouse
gtcctaggacattagtgagt

SEQ ID NO: 485719 - DNA, 20 bp, mouse
gaggagccccggttcaaccg

SEQ ID NO: 485720 - DNA, 20 bp, mouse
gaccaactcactaatgtcct

SEQ ID NO: 485721 - DNA, 20 bp, mouse
gtcctaggagctcagggtat

SEQ ID NO: 485722 - DNA, 20 bp, mouse
gactaatgtcctaggagccc

SEQ ID NO: 485723 - DNA, 20 bp, mouse
gattggaaggaggagagtag

SEQ ID NO: 485724 - DNA, 20 bp, mouse
gctcacttcctaggagctca

SEQ ID NO: 485725 - DNA, 20 bp, mouse
ggacagaacccgaagaaagg

SEQ ID NO: 485726 - DNA, 20 bp, mouse
gcccaggccgagcccagtag

SEQ ID NO: 485727 - DNA, 20 bp, mouse
gccagtagcggagctgagtt

SEQ ID NO: 485728 - DNA, 20 bp, mouse
gctgcgctgcgcctatggag

SEQ ID NO: 485729 - DNA, 20 bp, mouse
ggagcggaggagccccgacg

SEQ ID NO: 485730 - DNA, 20 bp, mouse
ggaggtcgccgaccacacca

SEQ ID NO: 485731 - DNA, 20 bp, mouse
gcagatcccgatgctcccta

SEQ ID NO: 485732 - DNA, 20 bp, mouse
gcaacccgggggtaaatcat

SEQ ID NO: 485733 - DNA, 20 bp, mouse
gcgctgcgcctatggagcgg

SEQ ID NO: 485734 - DNA, 20 bp, mouse
ggggccgcggggttgggcag

SEQ ID NO: 485735 - DNA, 20 bp, mouse
ggcccagagcagttcagagc

SEQ ID NO: 485736 - DNA, 20 bp, mouse
gggtagaatgtggttcccaa

SEQ ID NO: 485737 - DNA, 20 bp, mouse
gagaatgtggttcccaatgg

SEQ ID NO: 485738 - DNA, 20 bp, mouse
gcaagtaatgaggtagaatg

SEQ ID NO: 485739 - DNA, 20 bp, mouse
gtggttcccaatggaggatt

SEQ ID NO: 485740 - DNA, 20 bp, mouse
gcaaaggcttccttactcaa

SEQ ID NO: 485741 - DNA, 20 bp, mouse
gtccctgaacacaagtaatg

SEQ ID NO: 485742 - DNA, 20 bp, mouse
gagaaggcagatttgtctct

SEQ ID NO: 485743 - DNA, 20 bp, mouse
gatgaaattaactcaaacaa

SEQ ID NO: 485744 - DNA, 20 bp, mouse
gttacttgtgttcagggaaa

SEQ ID NO: 485745 - DNA, 20 bp, mouse
gtcactatttgcagctgata

SEQ ID NO: 485746 - DNA, 20 bp, mouse
gggagagaaatatcaaagta

SEQ ID NO: 485747 - DNA, 20 bp, mouse
ggaaatatcaaagtatggag

SEQ ID NO: 485748 - DNA, 20 bp, mouse
gtgtatctaacaggatcaaa

SEQ ID NO: 485749 - DNA, 20 bp, mouse
gatctataattgtatctaac

SEQ ID NO: 485750 - DNA, 20 bp, mouse
gtttttcatggatggaacta

SEQ ID NO: 485751 - DNA, 20 bp, mouse
gacaagcccaaaattctcac

SEQ ID NO: 485752 - DNA, 20 bp, mouse
gagcccaaaattctcactgg

SEQ ID NO: 485753 - DNA, 20 bp, mouse
gttacaacttctgctacaag

SEQ ID NO: 485754 - DNA, 20 bp, mouse
gtttcttcatcacttccgtt

SEQ ID NO: 485755 - DNA, 20 bp, mouse
gcaaagtggaatggtgtttg

SEQ ID NO: 485756 - DNA, 20 bp, mouse
gacatggaagtcacgaactg

SEQ ID NO: 485757 - DNA, 20 bp, mouse
gctgctatgtgtggactatt

SEQ ID NO: 485758 - DNA, 20 bp, mouse
gggcctctaacgagaagact

SEQ ID NO: 485759 - DNA, 20 bp, mouse
gttgagagcacacccaaatg

SEQ ID NO: 485760 - DNA, 20 bp, mouse
gaccttgcatagatggaatt

SEQ ID NO: 485761 - DNA, 20 bp, mouse
gagagatgaggaaatctcca

SEQ ID NO: 485762 - DNA, 20 bp, mouse
gccgacgtggatgagagatg

SEQ ID NO: 485763 - DNA, 20 bp, mouse
gtctgctggaggtagattgg

SEQ ID NO: 485764 - DNA, 20 bp, mouse
gtctggatcacaacttccca

SEQ ID NO: 485765 - DNA, 20 bp, mouse
gatttctgctggaggtagat

SEQ ID NO: 485766 - DNA, 20 bp, mouse
gtggcccacgtccatcacag

SEQ ID NO: 485767 - DNA, 20 bp, mouse
ggtgggccaagacacagctg

SEQ ID NO: 485768 - DNA, 20 bp, mouse
ggcctctaggagcctggctc

SEQ ID NO: 485769 - DNA, 20 bp, mouse
ggcggtacaactggcagacg

SEQ ID NO: 485770 - DNA, 20 bp, mouse
gaactggcagacgtggtgag

SEQ ID NO: 485771 - DNA, 20 bp, mouse
gagccgtgcagcggtacaac

SEQ ID NO: 485772 - DNA, 20 bp, mouse
gcaatgtcaacagggaacaa

SEQ ID NO: 485773 - DNA, 20 bp, mouse
gttgcccctgtgatggacgt

SEQ ID NO: 485774 - DNA, 20 bp, mouse
gagcatctccagccgtgcag

SEQ ID NO: 485775 - DNA, 20 bp, mouse
gccacaggagcagagctttc

SEQ ID NO: 485776 - DNA, 20 bp, mouse
gggagctcgccggaactcac

SEQ ID NO: 485777 - DNA, 20 bp, mouse
ggcggagcagctgggaacct

SEQ ID NO: 485778 - DNA, 20 bp, mouse
gcacacagggcggcgagttc

SEQ ID NO: 485779 - DNA, 20 bp, mouse
gcgagctccagaacaatccc

SEQ ID NO: 485780 - DNA, 20 bp, mouse
gcattagcagagccgcagag

SEQ ID NO: 485781 - DNA, 20 bp, mouse
gtggctagaacctctgcaca

SEQ ID NO: 485782 - DNA, 20 bp, mouse
ggcagagcggcggagcagct

SEQ ID NO: 485783 - DNA, 20 bp, mouse
gagggagactgggactggaa

SEQ ID NO: 485784 - DNA, 20 bp, mouse
ggacacactgccacacacag

SEQ ID NO: 485785 - DNA, 20 bp, mouse
gcaaagcaccagtgtctacc

SEQ ID NO: 485786 - DNA, 20 bp, mouse
gccacagactggggaaagtt

SEQ ID NO: 485787 - DNA, 20 bp, mouse
gcttaaggcaattcgcattt

SEQ ID NO: 485788 - DNA, 20 bp, mouse
gagggcttacctgttgcttt

SEQ ID NO: 485789 - DNA, 20 bp, mouse
ggataacgctgaaaaataca

SEQ ID NO: 485790 - DNA, 20 bp, mouse
gggacttagtacctgataac

SEQ ID NO: 485791 - DNA, 20 bp, mouse
gtagctgttagacttgaata

SEQ ID NO: 485792 - DNA, 20 bp, mouse
gttacatccaagttgatcag

SEQ ID NO: 485793 - DNA, 20 bp, mouse
ggttcaggaacgtctaacac

SEQ ID NO: 485794 - DNA, 20 bp, mouse
ggcagagccactgatcaact

SEQ ID NO: 485795 - DNA, 20 bp, mouse
gatggcctggacggctacta

SEQ ID NO: 485796 - DNA, 20 bp, mouse
gtctctgagggcgcccaccc

SEQ ID NO: 485797 - DNA, 20 bp, mouse
ggcccacccaggcgactacg

SEQ ID NO: 485798 - DNA, 20 bp, mouse
ggccacgtagtcgcctgggt

SEQ ID NO: 485799 - DNA, 20 bp, mouse
ggtgggcgccctcagagacc

SEQ ID NO: 485800 - DNA, 20 bp, mouse
gacctggaccgcacctccct

SEQ ID NO: 485801 - DNA, 20 bp, mouse
gaccgagggaggtgcggtcc

SEQ ID NO: 485802 - DNA, 20 bp, mouse
gtgctcttcctcaccgaggg

SEQ ID NO: 485803 - DNA, 20 bp, mouse
gtcgagccacgtagtcgcct

SEQ ID NO: 485804 - DNA, 20 bp, mouse
gacctgctcttcctcaccga

SEQ ID NO: 485805 - DNA, 20 bp, mouse
gtctttctctgggtcaccgt

SEQ ID NO: 485806 - DNA, 20 bp, mouse
gagacacagtagcaccctcc

SEQ ID NO: 485807 - DNA, 20 bp, mouse
gcaggcctaggggatagaat

SEQ ID NO: 485808 - DNA, 20 bp, mouse
gagttgacaaaactgagcaa

SEQ ID NO: 485809 - DNA, 20 bp, mouse
gtgtgcggcgggtggatgaa

SEQ ID NO: 485810 - DNA, 20 bp, mouse
ggaggtcgtagtcctgggga

SEQ ID NO: 485811 - DNA, 20 bp, mouse
gagttttgtcaactgcccgg

SEQ ID NO: 485812 - DNA, 20 bp, mouse
gctcctgggtgtggcaccac

SEQ ID NO: 485813 - DNA, 20 bp, mouse
gacacacacagagtaaggac

SEQ ID NO: 485814 - DNA, 20 bp, mouse
gactggggttcagcacctac

SEQ ID NO: 485815 - DNA, 20 bp, mouse
gcggactgagtgagggcaac

SEQ ID NO: 485816 - DNA, 20 bp, mouse
ggcctggagcttgagaagtt

SEQ ID NO: 485817 - DNA, 20 bp, mouse
gctgtaggactcaaacccag

SEQ ID NO: 485818 - DNA, 20 bp, mouse
gtgtagagcattgtgagtgc

SEQ ID NO: 485819 - DNA, 20 bp, mouse
ggtagcatgaaactccctct

SEQ ID NO: 485820 - DNA, 20 bp, mouse
gacgatgctaggatgttatt

SEQ ID NO: 485821 - DNA, 20 bp, mouse
gtcaggtgtggtataatctt

SEQ ID NO: 485822 - DNA, 20 bp, mouse
gcctagcatcgttgcctgaa

SEQ ID NO: 485823 - DNA, 20 bp, mouse
ggcgccgaagatgctacccg

SEQ ID NO: 485824 - DNA, 20 bp, mouse
gggtttgagtcctacagccc

SEQ ID NO: 485825 - DNA, 20 bp, mouse
gtgtgcgcatgcgcatatgg

SEQ ID NO: 485826 - DNA, 20 bp, mouse
ggaggaggaagagccaatgt

SEQ ID NO: 485827 - DNA, 20 bp, mouse
gtcgaaacggagtcaatcac

SEQ ID NO: 485828 - DNA, 20 bp, mouse
gaatcacaggttacctacat

SEQ ID NO: 485829 - DNA, 20 bp, mouse
gatttacaattgggcagagg

SEQ ID NO: 485830 - DNA, 20 bp, mouse
gaatacagccatttacaatt

SEQ ID NO: 485831 - DNA, 20 bp, mouse
gtgtcttcattgggtcgaaa

SEQ ID NO: 485832 - DNA, 20 bp, mouse
ggagcagtgcccattaaagg

SEQ ID NO: 485833 - DNA, 20 bp, mouse
gaccttcacttgtcttcatt

SEQ ID NO: 485834 - DNA, 20 bp, mouse
ggccatttacaattgggcag

SEQ ID NO: 485835 - DNA, 20 bp, mouse
ggaagagcagtgcccattaa

SEQ ID NO: 485836 - DNA, 20 bp, mouse
gagagcgctaggcctaccca

SEQ ID NO: 485837 - DNA, 20 bp, mouse
ggggtttgggcagttagcag

SEQ ID NO: 485838 - DNA, 20 bp, mouse
ggcggaggcctcaggggttt

SEQ ID NO: 485839 - DNA, 20 bp, mouse
gagacgaccgtccacagtgt

SEQ ID NO: 485840 - DNA, 20 bp, mouse
gggacaccaggcgtccggag

SEQ ID NO: 485841 - DNA, 20 bp, mouse
gccagggtctacgagaacgt

SEQ ID NO: 485842 - DNA, 20 bp, mouse
gcaccaggcgtccggagagg

SEQ ID NO: 485843 - DNA, 20 bp, mouse
gggccaatgactgccaggag

SEQ ID NO: 485844 - DNA, 20 bp, mouse
gagctttcagcgccctgggt

SEQ ID NO: 485845 - DNA, 20 bp, mouse
gttgggcagttagcagcggc

SEQ ID NO: 485846 - DNA, 20 bp, mouse
gacattgtcattgcaaggag

SEQ ID NO: 485847 - DNA, 20 bp, mouse
gatgacaatgtgccaaatct

SEQ ID NO: 485848 - DNA, 20 bp, mouse
gagtcccccgctaaagcata

SEQ ID NO: 485849 - DNA, 20 bp, mouse
gtttccatatgctttagcgg

SEQ ID NO: 485850 - DNA, 20 bp, mouse
gttggcacattgtcattgca

SEQ ID NO: 485851 - DNA, 20 bp, mouse
ggacaatagtacagatatac

SEQ ID NO: 485852 - DNA, 20 bp, mouse
gttgggaacttaaatcagat

SEQ ID NO: 485853 - DNA, 20 bp, mouse
gttgaggacattccctacaa

SEQ ID NO: 485854 - DNA, 20 bp, mouse
gaaaagccagcaccattgta

SEQ ID NO: 485855 - DNA, 20 bp, mouse
gagttaacgtgtaagagaaa

SEQ ID NO: 485856 - DNA, 20 bp, mouse
gttagaagtcctgtaaatgt

SEQ ID NO: 485857 - DNA, 20 bp, mouse
gaacggcttcccacatttac

SEQ ID NO: 485858 - DNA, 20 bp, mouse
ggaactgccttgcccagata

SEQ ID NO: 485859 - DNA, 20 bp, mouse
gccagcctttgtccatatct

SEQ ID NO: 485860 - DNA, 20 bp, mouse
gtgacactagttttggcatg

SEQ ID NO: 485861 - DNA, 20 bp, mouse
gggacttctaagctagactt

SEQ ID NO: 485862 - DNA, 20 bp, mouse
gacccagagcaggctactgc

SEQ ID NO: 485863 - DNA, 20 bp, mouse
gtgcccactggtaggagatg

SEQ ID NO: 485864 - DNA, 20 bp, mouse
ggggtctgtggaacctagga

SEQ ID NO: 485865 - DNA, 20 bp, mouse
gtcctgcagtagcctgctct

SEQ ID NO: 485866 - DNA, 20 bp, mouse
gaagcttgagagtacctcta

SEQ ID NO: 485867 - DNA, 20 bp, mouse
gtattcacatatccatggaa

SEQ ID NO: 485868 - DNA, 20 bp, mouse
gcagatatttctgtgagagg

SEQ ID NO: 485869 - DNA, 20 bp, mouse
gggccatattcacatatcca

SEQ ID NO: 485870 - DNA, 20 bp, mouse
gctgaagtcattccattcca

SEQ ID NO: 485871 - DNA, 20 bp, mouse
gtacacatgagtacaacttc

SEQ ID NO: 485872 - DNA, 20 bp, mouse
gtcatgtgtaaatgtcccca

SEQ ID NO: 485873 - DNA, 20 bp, mouse
gaattatacaagcaaggttc

SEQ ID NO: 485874 - DNA, 20 bp, mouse
gtgtcagatatttctgtgag

SEQ ID NO: 485875 - DNA, 20 bp, mouse
gatgagtaactgtaagttaa

SEQ ID NO: 485876 - DNA, 20 bp, mouse
gtgcagagcctggggttcgg

SEQ ID NO: 485877 - DNA, 20 bp, mouse
gcccccgcagaaccggcccg

SEQ ID NO: 485878 - DNA, 20 bp, mouse
ggttcggcgggaccccgggc

SEQ ID NO: 485879 - DNA, 20 bp, mouse
gagcaggcagagccgagcaa

SEQ ID NO: 485880 - DNA, 20 bp, mouse
ggcgccaccccccgcagaac

SEQ ID NO: 485881 - DNA, 20 bp, mouse
ggcggagtgacgcctcctgg

SEQ ID NO: 485882 - DNA, 20 bp, mouse
gcgacagccacagggacagg

SEQ ID NO: 485883 - DNA, 20 bp, mouse
gctgctccgcctggctccag

SEQ ID NO: 485884 - DNA, 20 bp, mouse
gtggccacctggcactcacc

SEQ ID NO: 485885 - DNA, 20 bp, mouse
gggacgcggtcccccctcgg

SEQ ID NO: 485886 - DNA, 20 bp, mouse
ggcgagagcgacggcgaccc

SEQ ID NO: 485887 - DNA, 20 bp, mouse
ggccgcttcggcctcccccg

SEQ ID NO: 485888 - DNA, 20 bp, mouse
gatgcagggcacgacaggtc

SEQ ID NO: 485889 - DNA, 20 bp, mouse
gttctgtcggatgagaggag

SEQ ID NO: 485890 - DNA, 20 bp, mouse
gcgacggcgaccccggctcc

SEQ ID NO: 485891 - DNA, 20 bp, mouse
ggtccaccgccgctgcctgc

SEQ ID NO: 485892 - DNA, 20 bp, mouse
gctgcctgccggccgccgcg

SEQ ID NO: 485893 - DNA, 20 bp, mouse
gtggacgaaggtgcgcgtca

SEQ ID NO: 485894 - DNA, 20 bp, mouse
gccgccgacaggtgacgaag

SEQ ID NO: 485895 - DNA, 20 bp, mouse
gcgtctctgtgtggctccat

SEQ ID NO: 485896 - DNA, 20 bp, mouse
ggtgtgtgtccaccctgcat

SEQ ID NO: 485897 - DNA, 20 bp, mouse
ggaagagagggtaaagagtg

SEQ ID NO: 485898 - DNA, 20 bp, mouse
gtcaaaactaaggatacatg

SEQ ID NO: 485899 - DNA, 20 bp, mouse
gtaaaggagatgtgtaaagg

SEQ ID NO: 485900 - DNA, 20 bp, mouse
gagtgaggtagtcaaaacta

SEQ ID NO: 485901 - DNA, 20 bp, mouse
gaagtgaggacagggggtcg

SEQ ID NO: 485902 - DNA, 20 bp, mouse
ggatgtgtaaaggaggctaa

SEQ ID NO: 485903 - DNA, 20 bp, mouse
gttttaaaggagatgtgtaa

SEQ ID NO: 485904 - DNA, 20 bp, mouse
ggatacatgaggtagcctta

SEQ ID NO: 485905 - DNA, 20 bp, mouse
gaaaggtttaagtgaggaca

SEQ ID NO: 485906 - DNA, 20 bp, mouse
ggagtgaccctcggacccgg

SEQ ID NO: 485907 - DNA, 20 bp, mouse
gcgggtgagacgtccctaaa

SEQ ID NO: 485908 - DNA, 20 bp, mouse
ggcgcctggagagtgaccct

SEQ ID NO: 485909 - DNA, 20 bp, mouse
gggagagtgaccctcggacc

SEQ ID NO: 485910 - DNA, 20 bp, mouse
gaggagggctcggggaatca

SEQ ID NO: 485911 - DNA, 20 bp, mouse
ggctgcaccgccgggtccga

SEQ ID NO: 485912 - DNA, 20 bp, mouse
gggagaggcacggtcaggtg

SEQ ID NO: 485913 - DNA, 20 bp, mouse
ggccgggcctctcaggacaa

SEQ ID NO: 485914 - DNA, 20 bp, mouse
gcgcacctatcacagcccag

SEQ ID NO: 485915 - DNA, 20 bp, mouse
ggaccaaggaagctgcccct

SEQ ID NO: 485916 - DNA, 20 bp, mouse
gtaatgtgtggagtccattc

SEQ ID NO: 485917 - DNA, 20 bp, mouse
gaaaagatcagcctaatgtg

SEQ ID NO: 485918 - DNA, 20 bp, mouse
gttactctttcctacctgaa

SEQ ID NO: 485919 - DNA, 20 bp, mouse
gcaggcgtcctggatacttt

SEQ ID NO: 485920 - DNA, 20 bp, mouse
gggggatgctaggacgctag

SEQ ID NO: 485921 - DNA, 20 bp, mouse
ggtcctggatactttaggaa

SEQ ID NO: 485922 - DNA, 20 bp, mouse
gtgtggtagactcaatctat

SEQ ID NO: 485923 - DNA, 20 bp, mouse
gggatactttaggaagggga

SEQ ID NO: 485924 - DNA, 20 bp, mouse
gaagaatgttttttgtaaca

SEQ ID NO: 485925 - DNA, 20 bp, mouse
gcattcttcgcgacacaatg

SEQ ID NO: 485926 - DNA, 20 bp, mouse
gggcggttcaggcagcttca

SEQ ID NO: 485927 - DNA, 20 bp, mouse
gggagagtccccacttaaat

SEQ ID NO: 485928 - DNA, 20 bp, mouse
gggcacaatcataaaagacc

SEQ ID NO: 485929 - DNA, 20 bp, mouse
ggacttgtaagtcacaaacc

SEQ ID NO: 485930 - DNA, 20 bp, mouse
gagtccaaagcaggcggttc

SEQ ID NO: 485931 - DNA, 20 bp, mouse
gagtgctacctatttaagtg

SEQ ID NO: 485932 - DNA, 20 bp, mouse
gcaagactcagggttatcaa

SEQ ID NO: 485933 - DNA, 20 bp, mouse
ggagagagtatagctaacgt

SEQ ID NO: 485934 - DNA, 20 bp, mouse
gcgccagggcaagcgagaga

SEQ ID NO: 485935 - DNA, 20 bp, mouse
gtgtcctatattattgacag

SEQ ID NO: 485936 - DNA, 20 bp, mouse
ggccataaaagagttcatcc

SEQ ID NO: 485937 - DNA, 20 bp, mouse
gcacgtaaaagaatccatac

SEQ ID NO: 485938 - DNA, 20 bp, mouse
gccagagtgatgacactcat

SEQ ID NO: 485939 - DNA, 20 bp, mouse
gaagtgttattttatgaatc

SEQ ID NO: 485940 - DNA, 20 bp, mouse
ggttttcaatgttatcaatg

SEQ ID NO: 485941 - DNA, 20 bp, mouse
gataaaaaaaaaacgcatac

SEQ ID NO: 485942 - DNA, 20 bp, mouse
gagactactactttgtgcaa

SEQ ID NO: 485943 - DNA, 20 bp, mouse
gaaaaaaaacgcatacagga

SEQ ID NO: 485944 - DNA, 20 bp, mouse
gtcctggatgaactctttta

SEQ ID NO: 485945 - DNA, 20 bp, mouse
gaacactttgcacatcagta

SEQ ID NO: 485946 - DNA, 20 bp, mouse
ggacatcctgattttctaaa

SEQ ID NO: 485947 - DNA, 20 bp, mouse
gtgaataaaatttgatgtgt

SEQ ID NO: 485948 - DNA, 20 bp, mouse
ggttggctttacattacaac

SEQ ID NO: 485949 - DNA, 20 bp, mouse
gtagcacgacaggctgcccg

SEQ ID NO: 485950 - DNA, 20 bp, mouse
gtagccacagggccacagcc

SEQ ID NO: 485951 - DNA, 20 bp, mouse
gagtttgaacatagcacgac

SEQ ID NO: 485952 - DNA, 20 bp, mouse
gatcttccctttagaaaatc

SEQ ID NO: 485953 - DNA, 20 bp, mouse
gtggctaagtcctgttaccc

SEQ ID NO: 485954 - DNA, 20 bp, mouse
gcaggctgcccgtggccagc

SEQ ID NO: 485955 - DNA, 20 bp, mouse
ggtaacaggacttagccaca

SEQ ID NO: 485956 - DNA, 20 bp, mouse
gacagatatgcaggacctcc

SEQ ID NO: 485957 - DNA, 20 bp, mouse
gccttctccccgctgacttg

SEQ ID NO: 485958 - DNA, 20 bp, mouse
gcagaggcgaggggtggata

SEQ ID NO: 485959 - DNA, 20 bp, mouse
gtcctgctgcctcaagtcag

SEQ ID NO: 485960 - DNA, 20 bp, mouse
gaggcggagagaaggccgac

SEQ ID NO: 485961 - DNA, 20 bp, mouse
gaggcccgcggaccccaccc

SEQ ID NO: 485962 - DNA, 20 bp, mouse
gggtccgtgagagccacact

SEQ ID NO: 485963 - DNA, 20 bp, mouse
ggacgtgcgcacaccccatg

SEQ ID NO: 485964 - DNA, 20 bp, mouse
ggtgccactcggaggacgtg

SEQ ID NO: 485965 - DNA, 20 bp, mouse
ggcgccccacgtcctccgag

SEQ ID NO: 485966 - DNA, 20 bp, mouse
gtctcgaggcagctgagtgg

SEQ ID NO: 485967 - DNA, 20 bp, mouse
gcttccggtccgccattctc

SEQ ID NO: 485968 - DNA, 20 bp, mouse
gcgaggcagctgagtggagg

SEQ ID NO: 485969 - DNA, 20 bp, mouse
gaaacctgagaatggcggac

SEQ ID NO: 485970 - DNA, 20 bp, mouse
ggctgcctcgagactctgat

SEQ ID NO: 485971 - DNA, 20 bp, mouse
gacacgtgactggaccatcg

SEQ ID NO: 485972 - DNA, 20 bp, mouse
gtcgcgtgtggatgccacga

SEQ ID NO: 485973 - DNA, 20 bp, mouse
ggagtctcgaggcagctgag

SEQ ID NO: 485974 - DNA, 20 bp, mouse
gggtttgactgcgagtctga

SEQ ID NO: 485975 - DNA, 20 bp, mouse
gcggtcacagctcaaagcac

SEQ ID NO: 485976 - DNA, 20 bp, mouse
gggtccttgcccagagaggt

SEQ ID NO: 485977 - DNA, 20 bp, mouse
gtctgggcaaggacccatcg

SEQ ID NO: 485978 - DNA, 20 bp, mouse
gggagtctgaggagtcttag

SEQ ID NO: 485979 - DNA, 20 bp, mouse
gggtatcagctggcccttat

SEQ ID NO: 485980 - DNA, 20 bp, mouse
gatcccttctctacaacctc

SEQ ID NO: 485981 - DNA, 20 bp, mouse
gctttggggagtctaaataa

SEQ ID NO: 485982 - DNA, 20 bp, mouse
gaaataaggggtgcctataa

SEQ ID NO: 485983 - DNA, 20 bp, mouse
gctaccagaggttgtagaga

SEQ ID NO: 485984 - DNA, 20 bp, mouse
gaggacccatcggggtgcaa

SEQ ID NO: 485985 - DNA, 20 bp, mouse
ggcaccctttgcaccccgat

SEQ ID NO: 485986 - DNA, 20 bp, mouse
gcaaggttggaggagccgag

SEQ ID NO: 485987 - DNA, 20 bp, mouse
gcaaggtagacaggtcacat

SEQ ID NO: 485988 - DNA, 20 bp, mouse
gatacactcacagctatctg

SEQ ID NO: 485989 - DNA, 20 bp, mouse
gcactgtggcgcctcagcag

SEQ ID NO: 485990 - DNA, 20 bp, mouse
gcaggagctacaggcccctg

SEQ ID NO: 485991 - DNA, 20 bp, mouse
ggctaggcgcgtggcagcca

SEQ ID NO: 485992 - DNA, 20 bp, mouse
gtgcagcgttagatgaagca

SEQ ID NO: 485993 - DNA, 20 bp, mouse
gcgtggcagccaaggtagac

SEQ ID NO: 485994 - DNA, 20 bp, mouse
gcgtctcaggaaatgagtct

SEQ ID NO: 485995 - DNA, 20 bp, mouse
ggattgtcaagaatgaagat

SEQ ID NO: 485996 - DNA, 20 bp, mouse
gagcacagagatgcacagca

SEQ ID NO: 485997 - DNA, 20 bp, mouse
gggaattagtggattcggag

SEQ ID NO: 485998 - DNA, 20 bp, mouse
ggaacagaccagggaattag

SEQ ID NO: 485999 - DNA, 20 bp, mouse
gttgagcttactattgtcaa

SEQ ID NO: 486000 - DNA, 20 bp, mouse
gttgtagatcagatcatcag

SEQ ID NO: 486001 - DNA, 20 bp, mouse
gaccagggaattagtggatt

SEQ ID NO: 486002 - DNA, 20 bp, mouse
ggtcaatggcactctcatca

SEQ ID NO: 486003 - DNA, 20 bp, mouse
ggtggattcggagaggagtc

SEQ ID NO: 486004 - DNA, 20 bp, mouse
gctgtgcatctctgtgctgc

SEQ ID NO: 486005 - DNA, 20 bp, mouse
gataggtaaaggctaggaaa

SEQ ID NO: 486006 - DNA, 20 bp, mouse
gctctgatgggcaatactga

SEQ ID NO: 486007 - DNA, 20 bp, mouse
ggacaccagaggccaacact

SEQ ID NO: 486008 - DNA, 20 bp, mouse
gcagtgagcattactctgat

SEQ ID NO: 486009 - DNA, 20 bp, mouse
gaatctggaaacggtctgta

SEQ ID NO: 486010 - DNA, 20 bp, mouse
gctcatcatcaccccagtgt

SEQ ID NO: 486011 - DNA, 20 bp, mouse
gtgtccgtgcgagcggagta

SEQ ID NO: 486012 - DNA, 20 bp, mouse
gcgagcggagtatggcatcc

SEQ ID NO: 486013 - DNA, 20 bp, mouse
gtcgatcctgccacagaaag

SEQ ID NO: 486014 - DNA, 20 bp, mouse
ggtaggattgggacccggag

SEQ ID NO: 486015 - DNA, 20 bp, mouse
gatgatgaaggttgcgggag

SEQ ID NO: 486016 - DNA, 20 bp, mouse
ggctgaacagtagcttgtac

SEQ ID NO: 486017 - DNA, 20 bp, mouse
gcagtgcattgatggtacaa

SEQ ID NO: 486018 - DNA, 20 bp, mouse
gaaagcattactgaggaggg

SEQ ID NO: 486019 - DNA, 20 bp, mouse
gcatagctaaagcattactg

SEQ ID NO: 486020 - DNA, 20 bp, mouse
ggcactgagatgcaagaaat

SEQ ID NO: 486021 - DNA, 20 bp, mouse
gcccctgacctccacagata

SEQ ID NO: 486022 - DNA, 20 bp, mouse
gctgggcctcaggaccaagt

SEQ ID NO: 486023 - DNA, 20 bp, mouse
gtctgtcacagggggacctg

SEQ ID NO: 486024 - DNA, 20 bp, mouse
gcctaagagtgagtaaggat

SEQ ID NO: 486025 - DNA, 20 bp, mouse
gaaaggcctaagagtgagta

SEQ ID NO: 486026 - DNA, 20 bp, mouse
gctttcaccctgtaaatggt

SEQ ID NO: 486027 - DNA, 20 bp, mouse
gatttacagggtgaaagctg

SEQ ID NO: 486028 - DNA, 20 bp, mouse
ggcccctgcccagccaacgc

SEQ ID NO: 486029 - DNA, 20 bp, mouse
gcttctccctctgcctgcgt

SEQ ID NO: 486030 - DNA, 20 bp, mouse
gtccctctgcctgcgttggc

SEQ ID NO: 486031 - DNA, 20 bp, mouse
ggggcacagagtaccctact

SEQ ID NO: 486032 - DNA, 20 bp, mouse
gttcaggaccaagcccagta

SEQ ID NO: 486033 - DNA, 20 bp, mouse
gttgatttctaggatgggat

SEQ ID NO: 486034 - DNA, 20 bp, mouse
gagcagcatggcctgaggag

SEQ ID NO: 486035 - DNA, 20 bp, mouse
gacctcctcaggagcagaag

SEQ ID NO: 486036 - DNA, 20 bp, mouse
gaaatgtccagtgcaggacg

SEQ ID NO: 486037 - DNA, 20 bp, mouse
gcatattccacgtcctgcac

SEQ ID NO: 486038 - DNA, 20 bp, mouse
gtctaatacgttctgcagtg

SEQ ID NO: 486039 - DNA, 20 bp, mouse
gtctaatatgttctacagtg

SEQ ID NO: 486040 - DNA, 20 bp, mouse
gatttagaaatgtccagtgc

SEQ ID NO: 486041 - DNA, 20 bp, mouse
gtgagttacaatgaaaaaca

SEQ ID NO: 486042 - DNA, 20 bp, mouse
gcactgaaaaacacattcgt

SEQ ID NO: 486043 - DNA, 20 bp, mouse
gcaatgaaaaacacattcgt

SEQ ID NO: 486044 - DNA, 20 bp, mouse
gaaacacattcgttggaaac

SEQ ID NO: 486045 - DNA, 20 bp, mouse
gaaacacattcgttggaaac

SEQ ID NO: 486046 - DNA, 20 bp, mouse
ggccttgcgataggaagcca

SEQ ID NO: 486047 - DNA, 20 bp, mouse
gtggctggcctggcgaccac

SEQ ID NO: 486048 - DNA, 20 bp, mouse
ggggtgtgaggccttgcgat

SEQ ID NO: 486049 - DNA, 20 bp, mouse
gagatgtgacaggcgtatac

SEQ ID NO: 486050 - DNA, 20 bp, mouse
gaacaaagtaggcatgaaag

SEQ ID NO: 486051 - DNA, 20 bp, mouse
gaccctggcttcctatcgca

SEQ ID NO: 486052 - DNA, 20 bp, mouse
gggtcaggagaaacataaca

SEQ ID NO: 486053 - DNA, 20 bp, mouse
gtcagctcagtaggagagaa

SEQ ID NO: 486054 - DNA, 20 bp, mouse
ggtgcactcagatacaaatg

SEQ ID NO: 486055 - DNA, 20 bp, mouse
gacctttcaataaacaaagt

SEQ ID NO: 486056 - DNA, 20 bp, mouse
gagccgtcggttctgcacag

SEQ ID NO: 486057 - DNA, 20 bp, mouse
gctcctctgtgcagaaccga

SEQ ID NO: 486058 - DNA, 20 bp, mouse
gctctccgcggtagcatcta

SEQ ID NO: 486059 - DNA, 20 bp, mouse
ggagccgcgcagcgcagcga

SEQ ID NO: 486060 - DNA, 20 bp, mouse
gctcccagaaggaagtgtga

SEQ ID NO: 486061 - DNA, 20 bp, mouse
ggcagctgcgaagcgcggta

SEQ ID NO: 486062 - DNA, 20 bp, mouse
gtcgcagctgccggacccca

SEQ ID NO: 486063 - DNA, 20 bp, mouse
gtcggtgctcggctggaggt

SEQ ID NO: 486064 - DNA, 20 bp, mouse
ggctttcaactctggaagtg

SEQ ID NO: 486065 - DNA, 20 bp, mouse
gttgaaagctggaaagccgt

SEQ ID NO: 486066 - DNA, 20 bp, mouse
ggctcgtggagaagggacga

SEQ ID NO: 486067 - DNA, 20 bp, mouse
gcagccacggagtcctacag

SEQ ID NO: 486068 - DNA, 20 bp, mouse
gcgtggagaagggacgacgg

SEQ ID NO: 486069 - DNA, 20 bp, mouse
gggaccgaatcgcagatctc

SEQ ID NO: 486070 - DNA, 20 bp, mouse
gactcgggaggcaggtccac

SEQ ID NO: 486071 - DNA, 20 bp, mouse
gcacgagcggcagaggaggt

SEQ ID NO: 486072 - DNA, 20 bp, mouse
gccgaatcgcagatctcggg

SEQ ID NO: 486073 - DNA, 20 bp, mouse
gtctccacgagcggcagagg

SEQ ID NO: 486074 - DNA, 20 bp, mouse
ggcctcccgagtccccacag

SEQ ID NO: 486075 - DNA, 20 bp, mouse
gcttcctctgtaggactccg

SEQ ID NO: 486076 - DNA, 20 bp, mouse
gttgaaaattctgacctggg

SEQ ID NO: 486077 - DNA, 20 bp, mouse
gtctgggtgacgacttccag

SEQ ID NO: 486078 - DNA, 20 bp, mouse
gtgtttgagctatacccccc

SEQ ID NO: 486079 - DNA, 20 bp, mouse
gttgaatacagtctccaagt

SEQ ID NO: 486080 - DNA, 20 bp, mouse
gaagaggtgacgtcaaccga

SEQ ID NO: 486081 - DNA, 20 bp, mouse
gccttgcagagcacaatgct

SEQ ID NO: 486082 - DNA, 20 bp, mouse
gaagtgtctaaaaagtacac

SEQ ID NO: 486083 - DNA, 20 bp, mouse
gagagagtgcacttcccact

SEQ ID NO: 486084 - DNA, 20 bp, mouse
gtagattatgggctgtttgg

SEQ ID NO: 486085 - DNA, 20 bp, mouse
ggtgacgtcaaccgagggtc

SEQ ID NO: 486086 - DNA, 20 bp, mouse
gtataactctcatcccaaca

SEQ ID NO: 486087 - DNA, 20 bp, mouse
gctctgcccgatgccgtgtt

SEQ ID NO: 486088 - DNA, 20 bp, mouse
ggaggtgagttgccatggat

SEQ ID NO: 486089 - DNA, 20 bp, mouse
gaaggtcctacttcccccag

SEQ ID NO: 486090 - DNA, 20 bp, mouse
gctcatcccaacacggcatc

SEQ ID NO: 486091 - DNA, 20 bp, mouse
gagagttataacagtctgta

SEQ ID NO: 486092 - DNA, 20 bp, mouse
gactgatggaccatgaagac

SEQ ID NO: 486093 - DNA, 20 bp, mouse
ggagcaactgacaaaactga

SEQ ID NO: 486094 - DNA, 20 bp, mouse
ggggcagaggtgagttgcca

SEQ ID NO: 486095 - DNA, 20 bp, mouse
gtggcagaaaaaatagaaca

SEQ ID NO: 486096 - DNA, 20 bp, mouse
ggctattgacgctagagatg

SEQ ID NO: 486097 - DNA, 20 bp, mouse
gatgtagatgctgtctatac

SEQ ID NO: 486098 - DNA, 20 bp, mouse
ggaattgtggagggcttggg

SEQ ID NO: 486099 - DNA, 20 bp, mouse
gttatgcgcaacttcccagt

SEQ ID NO: 486100 - DNA, 20 bp, mouse
gagttactagctataatcaa

SEQ ID NO: 486101 - DNA, 20 bp, mouse
gttctatagtacaaaaagag

SEQ ID NO: 486102 - DNA, 20 bp, mouse
gtagtactagtgttgaatcc

SEQ ID NO: 486103 - DNA, 20 bp, mouse
gaagagatggccttgacctc

SEQ ID NO: 486104 - DNA, 20 bp, mouse
gaagacaactgaattgtgga

SEQ ID NO: 486105 - DNA, 20 bp, mouse
gactgaattgtggagggctt

SEQ ID NO: 486106 - DNA, 20 bp, mouse
gggctggctacgtcatgacg

SEQ ID NO: 486107 - DNA, 20 bp, mouse
gcaccccagaaggaccgcag

SEQ ID NO: 486108 - DNA, 20 bp, mouse
gtaggaaaagacggcttctg

SEQ ID NO: 486109 - DNA, 20 bp, mouse
gcacactgcaagccacatgg

SEQ ID NO: 486110 - DNA, 20 bp, mouse
gctgacacaattgcttatct

SEQ ID NO: 486111 - DNA, 20 bp, mouse
ggtcccctgcggtccttctg

SEQ ID NO: 486112 - DNA, 20 bp, mouse
gcctctttccggctccatct

SEQ ID NO: 486113 - DNA, 20 bp, mouse
gataagcaattgtgtcaggc

SEQ ID NO: 486114 - DNA, 20 bp, mouse
gccacatctgtgaggagcgc

SEQ ID NO: 486115 - DNA, 20 bp, mouse
ggccataaaaatccattaag

SEQ ID NO: 486116 - DNA, 20 bp, mouse
gcagtttgctccacaccagg

SEQ ID NO: 486117 - DNA, 20 bp, mouse
ggtagagcctcacgtaatag

SEQ ID NO: 486118 - DNA, 20 bp, mouse
gattacgtgaggctctaccg

SEQ ID NO: 486119 - DNA, 20 bp, mouse
gaactcgctcctcgaaagag

SEQ ID NO: 486120 - DNA, 20 bp, mouse
gttacagcctctattacgtg

SEQ ID NO: 486121 - DNA, 20 bp, mouse
gctgccctacctctctttcg

SEQ ID NO: 486122 - DNA, 20 bp, mouse
gctcgtgagcgtcatgtgca

SEQ ID NO: 486123 - DNA, 20 bp, mouse
ggttgctgagttgtgcaccg

SEQ ID NO: 486124 - DNA, 20 bp, mouse
ggaagtggcaacagacctgt

SEQ ID NO: 486125 - DNA, 20 bp, mouse
ggctcctcgaaagagaggta

SEQ ID NO: 486126 - DNA, 20 bp, mouse
gtgggtccataccaagagag

SEQ ID NO: 486127 - DNA, 20 bp, mouse
ggacacgcccaggtcagaca

SEQ ID NO: 486128 - DNA, 20 bp, mouse
ggactgctgaaggaaaaatc

SEQ ID NO: 486129 - DNA, 20 bp, mouse
ggaactaatggctctaacgt

SEQ ID NO: 486130 - DNA, 20 bp, mouse
gacccaagtacatgaactgt

SEQ ID NO: 486131 - DNA, 20 bp, mouse
ggaaatagcccaaggcagcc

SEQ ID NO: 486132 - DNA, 20 bp, mouse
gcgaatggaatcaggtatga

SEQ ID NO: 486133 - DNA, 20 bp, mouse
gggccataactcattatctc

SEQ ID NO: 486134 - DNA, 20 bp, mouse
ggaagcagtttcatcccgaa

SEQ ID NO: 486135 - DNA, 20 bp, mouse
gataatcccctctcttggta

SEQ ID NO: 486136 - DNA, 20 bp, mouse
gaggagggttcgtttctcag

SEQ ID NO: 486137 - DNA, 20 bp, mouse
gggtggctaggaggaatgag

SEQ ID NO: 486138 - DNA, 20 bp, mouse
gcaaaaaggcgtggaagagg

SEQ ID NO: 486139 - DNA, 20 bp, mouse
gaggaaaacccaaaaaggcg

SEQ ID NO: 486140 - DNA, 20 bp, mouse
ggctaggaggaatgaggggt

SEQ ID NO: 486141 - DNA, 20 bp, mouse
gggtactgacccctacagtc

SEQ ID NO: 486142 - DNA, 20 bp, mouse
gtttagaggaaaacccaaaa

SEQ ID NO: 486143 - DNA, 20 bp, mouse
ggatggccatggggtgtgta

SEQ ID NO: 486144 - DNA, 20 bp, mouse
gacccaaaaaggcgtggaag

SEQ ID NO: 486145 - DNA, 20 bp, mouse
gcgcttcctcctgactgtag

SEQ ID NO: 486146 - DNA, 20 bp, mouse
gtaattgcgagtaaaatgag

SEQ ID NO: 486147 - DNA, 20 bp, mouse
gagagtcaggacagtcttcc

SEQ ID NO: 486148 - DNA, 20 bp, mouse
gttcctggtgaccggtagat

SEQ ID NO: 486149 - DNA, 20 bp, mouse
gctgctttctgttactgtcc

SEQ ID NO: 486150 - DNA, 20 bp, mouse
ggtaaaatgagtggctaccg

SEQ ID NO: 486151 - DNA, 20 bp, mouse
gggctaccgtggagccagcc

SEQ ID NO: 486152 - DNA, 20 bp, mouse
gaagcaggaggccaagagtc

SEQ ID NO: 486153 - DNA, 20 bp, mouse
gaggaagaagagacttacag

SEQ ID NO: 486154 - DNA, 20 bp, mouse
gtcatagcgtttaaagatgt

SEQ ID NO: 486155 - DNA, 20 bp, mouse
ggcttttagaacagggacag

SEQ ID NO: 486156 - DNA, 20 bp, mouse
ggctagagccctacacggaa

SEQ ID NO: 486157 - DNA, 20 bp, mouse
ggcgctgcggtggcctggct

SEQ ID NO: 486158 - DNA, 20 bp, mouse
gggttgagtcttagagtcgt

SEQ ID NO: 486159 - DNA, 20 bp, mouse
gccagcgctagagccctaca

SEQ ID NO: 486160 - DNA, 20 bp, mouse
gtcagctgagggcgctgcgg

SEQ ID NO: 486161 - DNA, 20 bp, mouse
gctttcagctgagggcgctg

SEQ ID NO: 486162 - DNA, 20 bp, mouse
gagtacaaccaggagagctt

SEQ ID NO: 486163 - DNA, 20 bp, mouse
gggtgcgctatttgtcccga

SEQ ID NO: 486164 - DNA, 20 bp, mouse
gcgagcagcttaggagtcag

SEQ ID NO: 486165 - DNA, 20 bp, mouse
gtagagtcgtcggctttgcg

SEQ ID NO: 486166 - DNA, 20 bp, mouse
gacatgcacacggggatcag

SEQ ID NO: 486167 - DNA, 20 bp, mouse
ggctaagagataacttgagt

SEQ ID NO: 486168 - DNA, 20 bp, mouse
gaaaatgacttactgggtta

SEQ ID NO: 486169 - DNA, 20 bp, mouse
gctatgcctgctgttagtct

SEQ ID NO: 486170 - DNA, 20 bp, mouse
gtaactcctagactaacagc

SEQ ID NO: 486171 - DNA, 20 bp, mouse
gtatgtgggacatgcacacg

SEQ ID NO: 486172 - DNA, 20 bp, mouse
gattagaaggaattattgta

SEQ ID NO: 486173 - DNA, 20 bp, mouse
gcttactgggttacggtgct

SEQ ID NO: 486174 - DNA, 20 bp, mouse
gtgaaagatgacaaattaga

SEQ ID NO: 486175 - DNA, 20 bp, mouse
gctgaagatggtgtacttta

SEQ ID NO: 486176 - DNA, 20 bp, mouse
gtatctgagggttcctgaaa

SEQ ID NO: 486177 - DNA, 20 bp, mouse
gcaaggctttcaatatctga

SEQ ID NO: 486178 - DNA, 20 bp, mouse
gcctgaaagggttttgctga

SEQ ID NO: 486179 - DNA, 20 bp, mouse
gagacaagagggtccgccaa

SEQ ID NO: 486180 - DNA, 20 bp, mouse
gccagtgctctgaccaaagg

SEQ ID NO: 486181 - DNA, 20 bp, mouse
gcccagctgtgaaggctcac

SEQ ID NO: 486182 - DNA, 20 bp, mouse
gaggaccagaaatatttcat

SEQ ID NO: 486183 - DNA, 20 bp, mouse
gtggaagtcttgtcaggaag

SEQ ID NO: 486184 - DNA, 20 bp, mouse
gtcacaatttaggtgtcatt

SEQ ID NO: 486185 - DNA, 20 bp, mouse
ggagctattaggaaattata

SEQ ID NO: 486186 - DNA, 20 bp, mouse
gtttgtttattgttcattct

SEQ ID NO: 486187 - DNA, 20 bp, mouse
ggagtcttgctatatcgtta

SEQ ID NO: 486188 - DNA, 20 bp, mouse
gtaaccctctgacccaataa

SEQ ID NO: 486189 - DNA, 20 bp, mouse
gagggttcacacagtccttc

SEQ ID NO: 486190 - DNA, 20 bp, mouse
gtctgtttaggcaataacac

SEQ ID NO: 486191 - DNA, 20 bp, mouse
gacatttttgtctagcatat

SEQ ID NO: 486192 - DNA, 20 bp, mouse
gtcttgctatatcgttaggg

SEQ ID NO: 486193 - DNA, 20 bp, mouse
gaaagagccacgtctttctg

SEQ ID NO: 486194 - DNA, 20 bp, mouse
gtctccattattgggtcaga

SEQ ID NO: 486195 - DNA, 20 bp, mouse
gagctgctttttctgtgtgt

SEQ ID NO: 486196 - DNA, 20 bp, mouse
ggcttcccgacggcttgaca

SEQ ID NO: 486197 - DNA, 20 bp, mouse
ggcccagccgggcttcccga

SEQ ID NO: 486198 - DNA, 20 bp, mouse
gttcctccccggggctgtgg

SEQ ID NO: 486199 - DNA, 20 bp, mouse
gggcagccgccacagccccg

SEQ ID NO: 486200 - DNA, 20 bp, mouse
gagccgccacagccccgggg

SEQ ID NO: 486201 - DNA, 20 bp, mouse
gaccgggcgggtgacagagg

SEQ ID NO: 486202 - DNA, 20 bp, mouse
ggggaaccgtgcagttagct

SEQ ID NO: 486203 - DNA, 20 bp, mouse
gtgggagctgtcactttacc

SEQ ID NO: 486204 - DNA, 20 bp, mouse
gaccgtgcagttagctaggc

SEQ ID NO: 486205 - DNA, 20 bp, mouse
gccaggaggaggctgcgcgg

SEQ ID NO: 486206 - DNA, 20 bp, mouse
gacttgtgaggggtctgact

SEQ ID NO: 486207 - DNA, 20 bp, mouse
ggttagaaatcacttgtgag

SEQ ID NO: 486208 - DNA, 20 bp, mouse
gaggggtctgactgggtgct

SEQ ID NO: 486209 - DNA, 20 bp, mouse
gcgcagagctgtccctaaag

SEQ ID NO: 486210 - DNA, 20 bp, mouse
gtctgtgttaggacatggag

SEQ ID NO: 486211 - DNA, 20 bp, mouse
gtgggtatgcaccctgcagc

SEQ ID NO: 486212 - DNA, 20 bp, mouse
gtttcaaggggtcagagtca

SEQ ID NO: 486213 - DNA, 20 bp, mouse
gcatggaggggactgacatg

SEQ ID NO: 486214 - DNA, 20 bp, mouse
gatgcttaggcacttcaaag

SEQ ID NO: 486215 - DNA, 20 bp, mouse
gtgcaatgcatcaataaaat

SEQ ID NO: 486216 - DNA, 20 bp, mouse
gttgatttgaataactgtgt

SEQ ID NO: 486217 - DNA, 20 bp, mouse
gtcttattaatccatatatg

SEQ ID NO: 486218 - DNA, 20 bp, mouse
ggaaaaagacttacagttta

SEQ ID NO: 486219 - DNA, 20 bp, mouse
gcagcagtgtaaggtcagag

SEQ ID NO: 486220 - DNA, 20 bp, mouse
gtagggatttctggatccag

SEQ ID NO: 486221 - DNA, 20 bp, mouse
gggatgtgcccaggccacag

SEQ ID NO: 486222 - DNA, 20 bp, mouse
gaaggtcagagtggcagaca

SEQ ID NO: 486223 - DNA, 20 bp, mouse
gtggcagggcacctcatata

SEQ ID NO: 486224 - DNA, 20 bp, mouse
gttgataaacaaacttcagg

SEQ ID NO: 486225 - DNA, 20 bp, mouse
gcttacactgctggtgtcag

SEQ ID NO: 486226 - DNA, 20 bp, mouse
ggaagggaggatatgagtca

SEQ ID NO: 486227 - DNA, 20 bp, mouse
gggccttgagagcacagctg

SEQ ID NO: 486228 - DNA, 20 bp, mouse
gagcctgaggctgttcaccc

SEQ ID NO: 486229 - DNA, 20 bp, mouse
gtgctctcaaggcctgaagc

SEQ ID NO: 486230 - DNA, 20 bp, mouse
gagggcaaaaaaggccaagg

SEQ ID NO: 486231 - DNA, 20 bp, mouse
ggtctcaaatatgcagcctg

SEQ ID NO: 486232 - DNA, 20 bp, mouse
gagcttcagatagcttgtct

SEQ ID NO: 486233 - DNA, 20 bp, mouse
gagcacagctggggcattct

SEQ ID NO: 486234 - DNA, 20 bp, mouse
gtgccccagctgtgctctca

SEQ ID NO: 486235 - DNA, 20 bp, mouse
gggcattcttgggatatttg

SEQ ID NO: 486236 - DNA, 20 bp, mouse
gctgtcggttggatgaagga

SEQ ID NO: 486237 - DNA, 20 bp, mouse
gtacttggtacttcccttac

SEQ ID NO: 486238 - DNA, 20 bp, mouse
gttcactgtcggttggatga

SEQ ID NO: 486239 - DNA, 20 bp, mouse
gaattttcttcactgtcggt

SEQ ID NO: 486240 - DNA, 20 bp, mouse
gttgaaaaaaggtgtgtact

SEQ ID NO: 486241 - DNA, 20 bp, mouse
gtatatcaatggaatttgga

SEQ ID NO: 486242 - DNA, 20 bp, mouse
gtgatgaatatttatatcaa

SEQ ID NO: 486243 - DNA, 20 bp, mouse
gatcttattttgctcaaatt

SEQ ID NO: 486244 - DNA, 20 bp, mouse
gataaattagtactgagcgc

SEQ ID NO: 486245 - DNA, 20 bp, mouse
ggagacaaaataattcaatg

SEQ ID NO: 486246 - DNA, 20 bp, mouse
gcacagactaaccccaacac

SEQ ID NO: 486247 - DNA, 20 bp, mouse
gtcagttacttgattcgggg

SEQ ID NO: 486248 - DNA, 20 bp, mouse
ggatgaatgctattatgatc

SEQ ID NO: 486249 - DNA, 20 bp, mouse
gatacattgtccccacctgt

SEQ ID NO: 486250 - DNA, 20 bp, mouse
gtttgactgtcccacaggtg

SEQ ID NO: 486251 - DNA, 20 bp, mouse
gtgtgggcaaacatatcttg

SEQ ID NO: 486252 - DNA, 20 bp, mouse
gttgaggctcttcttgttgt

SEQ ID NO: 486253 - DNA, 20 bp, mouse
gaagggagaagcaaccataa

SEQ ID NO: 486254 - DNA, 20 bp, mouse
gttatcagttacttgattcg

SEQ ID NO: 486255 - DNA, 20 bp, mouse
gtcatggtccatctccatta

SEQ ID NO: 486256 - DNA, 20 bp, mouse
gcgtatatgtgaattgtgta

SEQ ID NO: 486257 - DNA, 20 bp, mouse
ggccagtaggcgggacttcg

SEQ ID NO: 486258 - DNA, 20 bp, mouse
gcgggacttcggggttggag

SEQ ID NO: 486259 - DNA, 20 bp, mouse
gaataaagggaaccaatcac

SEQ ID NO: 486260 - DNA, 20 bp, mouse
gccatcccctaatgaataaa

SEQ ID NO: 486261 - DNA, 20 bp, mouse
gatgataattctgctttcct

SEQ ID NO: 486262 - DNA, 20 bp, mouse
gataattctgctttcctggg

SEQ ID NO: 486263 - DNA, 20 bp, mouse
gcacatatacatacatgttg

SEQ ID NO: 486264 - DNA, 20 bp, mouse
gtaaaaataaaagcaacccc

SEQ ID NO: 486265 - DNA, 20 bp, mouse
gttggttccctttattcatt

SEQ ID NO: 486266 - DNA, 20 bp, mouse
gtggtcacactcacatacgt

SEQ ID NO: 486267 - DNA, 20 bp, mouse
gagccctccgcagcatttgg

SEQ ID NO: 486268 - DNA, 20 bp, mouse
gtgagtgtgaccaaaaggca

SEQ ID NO: 486269 - DNA, 20 bp, mouse
ggagtctccgccaaatgctg

SEQ ID NO: 486270 - DNA, 20 bp, mouse
ggtatgtgagtgtgaccaaa

SEQ ID NO: 486271 - DNA, 20 bp, mouse
gctccgccaaatgctgcgga

SEQ ID NO: 486272 - DNA, 20 bp, mouse
gcccagccctccgcagcatt

SEQ ID NO: 486273 - DNA, 20 bp, mouse
gcattgcctcttgctccaca

SEQ ID NO: 486274 - DNA, 20 bp, mouse
gaacgcgtgacttttgcaga

SEQ ID NO: 486275 - DNA, 20 bp, mouse
gacacaggactgctgccgag

SEQ ID NO: 486276 - DNA, 20 bp, mouse
ggatatggccacaagactaa

SEQ ID NO: 486277 - DNA, 20 bp, mouse
gtgttgaggttggatgacta

SEQ ID NO: 486278 - DNA, 20 bp, mouse
gcaaagagtcattcaagtag

SEQ ID NO: 486279 - DNA, 20 bp, mouse
gtctgagactcaaagtatgc

SEQ ID NO: 486280 - DNA, 20 bp, mouse
gaatgaagactgccctcaat

SEQ ID NO: 486281 - DNA, 20 bp, mouse
gctttaaccagtgttgaggt

SEQ ID NO: 486282 - DNA, 20 bp, mouse
ggagtctcagaattgatttg

SEQ ID NO: 486283 - DNA, 20 bp, mouse
gcctggctcccttagtcttg

SEQ ID NO: 486284 - DNA, 20 bp, mouse
gatctgtttatctaacttcc

SEQ ID NO: 486285 - DNA, 20 bp, mouse
gaagcacatgagcctattga

SEQ ID NO: 486286 - DNA, 20 bp, mouse
ggccacacggagaaggtact

SEQ ID NO: 486287 - DNA, 20 bp, mouse
gccctagagccacacggaga

SEQ ID NO: 486288 - DNA, 20 bp, mouse
ggcaggcccctagagccaca

SEQ ID NO: 486289 - DNA, 20 bp, mouse
gtggttgcgtaaatggagtt

SEQ ID NO: 486290 - DNA, 20 bp, mouse
gggctgcctccatcacaagt

SEQ ID NO: 486291 - DNA, 20 bp, mouse
gggcacgcggcaatgtgcta

SEQ ID NO: 486292 - DNA, 20 bp, mouse
ggctccccacggcagttgaa

SEQ ID NO: 486293 - DNA, 20 bp, mouse
gaacattgctcagtcggaga

SEQ ID NO: 486294 - DNA, 20 bp, mouse
gtctcgggtaatcagcccgg

SEQ ID NO: 486295 - DNA, 20 bp, mouse
ggggagccactgaaaaacct

SEQ ID NO: 486296 - DNA, 20 bp, mouse
gctgagggtgacagacatat

SEQ ID NO: 486297 - DNA, 20 bp, mouse
gtcacaagcaaggttcagag

SEQ ID NO: 486298 - DNA, 20 bp, mouse
gaaagctaggatgtagactg

SEQ ID NO: 486299 - DNA, 20 bp, mouse
gcatctataggatcagtctg

SEQ ID NO: 486300 - DNA, 20 bp, mouse
ggaccacacagctagcaggg

SEQ ID NO: 486301 - DNA, 20 bp, mouse
ggtgacagacatattggatg

SEQ ID NO: 486302 - DNA, 20 bp, mouse
gtgtggaagaggtctgtgag

SEQ ID NO: 486303 - DNA, 20 bp, mouse
gaaattacattaccatctat

SEQ ID NO: 486304 - DNA, 20 bp, mouse
gttgaatgtgtccacaggtg

SEQ ID NO: 486305 - DNA, 20 bp, mouse
gctagcaggggggaaaagct

SEQ ID NO: 486306 - DNA, 20 bp, mouse
ggtcccctgacactaatcct

SEQ ID NO: 486307 - DNA, 20 bp, mouse
ggtatgataacagaattgtt

SEQ ID NO: 486308 - DNA, 20 bp, mouse
gtgccgaggattagtgtcag

SEQ ID NO: 486309 - DNA, 20 bp, mouse
gagaaaattaaatcatagag

SEQ ID NO: 486310 - DNA, 20 bp, mouse
gattaaatcatagagaggca

SEQ ID NO: 486311 - DNA, 20 bp, mouse
ggtgtctctcttggagataa

SEQ ID NO: 486312 - DNA, 20 bp, mouse
gcaggcttgctcaaaagtga

SEQ ID NO: 486313 - DNA, 20 bp, mouse
gtttaaagctcagtctctat

SEQ ID NO: 486314 - DNA, 20 bp, mouse
gtgataacagaattgttagg

SEQ ID NO: 486315 - DNA, 20 bp, mouse
gagctcagtctctataggcc

SEQ ID NO: 486316 - DNA, 20 bp, mouse
gctctttcccataagaaaac

SEQ ID NO: 486317 - DNA, 20 bp, mouse
gcacaccaaactgtatacac

SEQ ID NO: 486318 - DNA, 20 bp, mouse
gtatgcctgtgtatacagtt

SEQ ID NO: 486319 - DNA, 20 bp, mouse
gttggaaacctgttttctta

SEQ ID NO: 486320 - DNA, 20 bp, mouse
gttttttgtgtgcaagtttt

SEQ ID NO: 486321 - DNA, 20 bp, mouse
ggaacttgtgtgtgcatgcg

SEQ ID NO: 486322 - DNA, 20 bp, mouse
gtgcgtggacatgtgagtgt

SEQ ID NO: 486323 - DNA, 20 bp, mouse
gtactccctagtagtaatat

SEQ ID NO: 486324 - DNA, 20 bp, mouse
gcacaccaatattactacta

SEQ ID NO: 486325 - DNA, 20 bp, mouse
gtggtgtgcatgaatgtctg

SEQ ID NO: 486326 - DNA, 20 bp, mouse
gccaatctctggttcttctc

SEQ ID NO: 486327 - DNA, 20 bp, mouse
ggcagagagcccatcagctt

SEQ ID NO: 486328 - DNA, 20 bp, mouse
gcctagagcgttcaaaggac

SEQ ID NO: 486329 - DNA, 20 bp, mouse
gggacctctaagttatcaca

SEQ ID NO: 486330 - DNA, 20 bp, mouse
gtaacttagaggtcctgggg

SEQ ID NO: 486331 - DNA, 20 bp, mouse
gatcctgttagagaatttga

SEQ ID NO: 486332 - DNA, 20 bp, mouse
gtttgaaggtgtccaatctc

SEQ ID NO: 486333 - DNA, 20 bp, mouse
gattgtcctagagcgttcaa

SEQ ID NO: 486334 - DNA, 20 bp, mouse
gagtccttgtgataacttag

SEQ ID NO: 486335 - DNA, 20 bp, mouse
ggcttctgatgttgtataaa

SEQ ID NO: 486336 - DNA, 20 bp, mouse
gaagtgtacagataaagcta

SEQ ID NO: 486337 - DNA, 20 bp, mouse
gacaggggtaacaggatgat

SEQ ID NO: 486338 - DNA, 20 bp, mouse
gtgccagaagtaagccacag

SEQ ID NO: 486339 - DNA, 20 bp, mouse
ggctaaggttgctcaattcg

SEQ ID NO: 486340 - DNA, 20 bp, mouse
gggcttccacagcagttagg

SEQ ID NO: 486341 - DNA, 20 bp, mouse
gtggcactgttctacggctg

SEQ ID NO: 486342 - DNA, 20 bp, mouse
gcacgaatgaggtgaaggag

SEQ ID NO: 486343 - DNA, 20 bp, mouse
gtaggaattgcttttagcgt

SEQ ID NO: 486344 - DNA, 20 bp, mouse
gggtaggagaagttatacac

SEQ ID NO: 486345 - DNA, 20 bp, mouse
gagtaagccacaggggtaac

SEQ ID NO: 486346 - DNA, 20 bp, mouse
gagtagaaagattatctcac

SEQ ID NO: 486347 - DNA, 20 bp, mouse
gtgagttatagatggcctaa

SEQ ID NO: 486348 - DNA, 20 bp, mouse
gttaaggtcacttgtcatca

SEQ ID NO: 486349 - DNA, 20 bp, mouse
gaaatggcttaattcagttc

SEQ ID NO: 486350 - DNA, 20 bp, mouse
gagaatgcttgagttataga

SEQ ID NO: 486351 - DNA, 20 bp, mouse
gagtcagaacattcaaagag

SEQ ID NO: 486352 - DNA, 20 bp, mouse
gaacattcaaagagtggaga

SEQ ID NO: 486353 - DNA, 20 bp, mouse
gatcaataaactagaataat

SEQ ID NO: 486354 - DNA, 20 bp, mouse
gagtaagaaaaacaactcac

SEQ ID NO: 486355 - DNA, 20 bp, mouse
gtcacaggaatatacaatta

SEQ ID NO: 486356 - DNA, 20 bp, mouse
gtaggtggcttcacattaac

SEQ ID NO: 486357 - DNA, 20 bp, mouse
gatctggcaattgttcaggt

SEQ ID NO: 486358 - DNA, 20 bp, mouse
gtctggcctcaactaaacaa

SEQ ID NO: 486359 - DNA, 20 bp, mouse
gcagttcttacagatatccc

SEQ ID NO: 486360 - DNA, 20 bp, mouse
ggatatctgtaagaactgat

SEQ ID NO: 486361 - DNA, 20 bp, mouse
ggaaggtacacagttatgac

SEQ ID NO: 486362 - DNA, 20 bp, mouse
gaagtgtatataaagtttaa

SEQ ID NO: 486363 - DNA, 20 bp, mouse
gccaagctcattcaacaaca

SEQ ID NO: 486364 - DNA, 20 bp, mouse
gaaatgggatatcaatgatc

SEQ ID NO: 486365 - DNA, 20 bp, mouse
gttcaacaacagggctgtga

SEQ ID NO: 486366 - DNA, 20 bp, mouse
ggagatacggactaacataa

SEQ ID NO: 486367 - DNA, 20 bp, mouse
gattccccaaaaacgagata

SEQ ID NO: 486368 - DNA, 20 bp, mouse
ggaattgagaccatttatgt

SEQ ID NO: 486369 - DNA, 20 bp, mouse
gtcaagctaaactaatcata

SEQ ID NO: 486370 - DNA, 20 bp, mouse
gacagacagacatcacttct

SEQ ID NO: 486371 - DNA, 20 bp, mouse
gtattgcaatatggtcgtgg

SEQ ID NO: 486372 - DNA, 20 bp, mouse
gtcacttctaggtaaaaaga

SEQ ID NO: 486373 - DNA, 20 bp, mouse
gagtccgtatctcgtttttg

SEQ ID NO: 486374 - DNA, 20 bp, mouse
gaagtattgcaatatggtcg

SEQ ID NO: 486375 - DNA, 20 bp, mouse
gacatgtaagtattgcaata

SEQ ID NO: 486376 - DNA, 20 bp, mouse
gtgtgggcacaggacctcgt

SEQ ID NO: 486377 - DNA, 20 bp, mouse
gtgcccacaggccgagagaa

SEQ ID NO: 486378 - DNA, 20 bp, mouse
ggaagggcttcggggacacg

SEQ ID NO: 486379 - DNA, 20 bp, mouse
gggccgagagaagggcttcg

SEQ ID NO: 486380 - DNA, 20 bp, mouse
gaggctgcagtggttgggaa

SEQ ID NO: 486381 - DNA, 20 bp, mouse
gacaggacctcgtgggtgga

SEQ ID NO: 486382 - DNA, 20 bp, mouse
gcaggtcctcgctggaagat

SEQ ID NO: 486383 - DNA, 20 bp, mouse
gagcccttctctcggcctgt

SEQ ID NO: 486384 - DNA, 20 bp, mouse
gtgcaggcttgaccaggaca

SEQ ID NO: 486385 - DNA, 20 bp, mouse
gggaaaggctcgcagtgttg

SEQ ID NO: 486386 - DNA, 20 bp, mouse
gggtaagaaagagtccccta

SEQ ID NO: 486387 - DNA, 20 bp, mouse
gaggctcatctcatccctag

SEQ ID NO: 486388 - DNA, 20 bp, mouse
ggtgcagcgatgcttccaga

SEQ ID NO: 486389 - DNA, 20 bp, mouse
gaagcatcgctgcaccgaca

SEQ ID NO: 486390 - DNA, 20 bp, mouse
gcaacactacacaacaggtg

SEQ ID NO: 486391 - DNA, 20 bp, mouse
ggctcggtgcgggtgaagat

SEQ ID NO: 486392 - DNA, 20 bp, mouse
ggaggagcgccgcatccgag

SEQ ID NO: 486393 - DNA, 20 bp, mouse
gcagccaatgtgggaaacag

SEQ ID NO: 486394 - DNA, 20 bp, mouse
gtaggccatagagctttggg

SEQ ID NO: 486395 - DNA, 20 bp, mouse
gggcgctcctcagagatacc

SEQ ID NO: 486396 - DNA, 20 bp, mouse
gagactaagaaccctgaaga

SEQ ID NO: 486397 - DNA, 20 bp, mouse
gaattctaggggccccaacc

SEQ ID NO: 486398 - DNA, 20 bp, mouse
ggagggagcaccaatttcta

SEQ ID NO: 486399 - DNA, 20 bp, mouse
ggtaatgtggtactccaggt

SEQ ID NO: 486400 - DNA, 20 bp, mouse
gttgttaccagaaattctag

SEQ ID NO: 486401 - DNA, 20 bp, mouse
ggcttcccagctagctgcta

SEQ ID NO: 486402 - DNA, 20 bp, mouse
gtatggtaatgtggtactcc

SEQ ID NO: 486403 - DNA, 20 bp, mouse
gaccacattaccatagaaat

SEQ ID NO: 486404 - DNA, 20 bp, mouse
gctgtgttagctgtgaggtt

SEQ ID NO: 486405 - DNA, 20 bp, mouse
gccctgagtcataaggacca

SEQ ID NO: 486406 - DNA, 20 bp, mouse
gcagggctcagggaatggac

SEQ ID NO: 486407 - DNA, 20 bp, mouse
ggatgtaggctcagggctca

SEQ ID NO: 486408 - DNA, 20 bp, mouse
gaaataggatcaaaagatgt

SEQ ID NO: 486409 - DNA, 20 bp, mouse
gatcaaaagatgtaggctca

SEQ ID NO: 486410 - DNA, 20 bp, mouse
gggttctcaaacataatagt

SEQ ID NO: 486411 - DNA, 20 bp, mouse
ggtactgggggatgaatctt

SEQ ID NO: 486412 - DNA, 20 bp, mouse
ggaagaggacagtagctggg

SEQ ID NO: 486413 - DNA, 20 bp, mouse
gttagaagaggacagtagct

SEQ ID NO: 486414 - DNA, 20 bp, mouse
gtcagggaatggactggtga

SEQ ID NO: 486415 - DNA, 20 bp, mouse
gtctctctcatttttagtag

SEQ ID NO: 486416 - DNA, 20 bp, mouse
gatctagttagaatatatgt

SEQ ID NO: 486417 - DNA, 20 bp, mouse
gtaccaccctatatacagtg

SEQ ID NO: 486418 - DNA, 20 bp, mouse
ggatttatgcctacatacac

SEQ ID NO: 486419 - DNA, 20 bp, mouse
gtgccccactgtatataggg

SEQ ID NO: 486420 - DNA, 20 bp, mouse
gtcgatgccccactgtatat

SEQ ID NO: 486421 - DNA, 20 bp, mouse
ggtatatagggtggtatatt

SEQ ID NO: 486422 - DNA, 20 bp, mouse
ggtggtatattagggtagtg

SEQ ID NO: 486423 - DNA, 20 bp, mouse
gaccctaatatagctagatg

SEQ ID NO: 486424 - DNA, 20 bp, mouse
gtccacatctagctatatta

SEQ ID NO: 486425 - DNA, 20 bp, mouse
gatctccctttgctcctatg

SEQ ID NO: 486426 - DNA, 20 bp, mouse
gtttcactatagctattatc

SEQ ID NO: 486427 - DNA, 20 bp, mouse
ggaatctacctttagacagt

SEQ ID NO: 486428 - DNA, 20 bp, mouse
gattctgcaagtttgtagtt

SEQ ID NO: 486429 - DNA, 20 bp, mouse
gtgtgtaaaaacagagtcct

SEQ ID NO: 486430 - DNA, 20 bp, mouse
gggatgtacaagcataatta

SEQ ID NO: 486431 - DNA, 20 bp, mouse
gtaagaaactgcattgtatt

SEQ ID NO: 486432 - DNA, 20 bp, mouse
gctgactatcttagattgtt

SEQ ID NO: 486433 - DNA, 20 bp, mouse
gctgcctctttttattctca

SEQ ID NO: 486434 - DNA, 20 bp, mouse
gagacagtaggctagaagtg

SEQ ID NO: 486435 - DNA, 20 bp, mouse
gcttctagcctactgtctaa

SEQ ID NO: 486436 - DNA, 20 bp, mouse
gccgaagcctggcctggata

SEQ ID NO: 486437 - DNA, 20 bp, mouse
ggccaggcttcggggagcct

SEQ ID NO: 486438 - DNA, 20 bp, mouse
ggacctcctctcaatgggca

SEQ ID NO: 486439 - DNA, 20 bp, mouse
gagctacttttccttttcta

SEQ ID NO: 486440 - DNA, 20 bp, mouse
gcgccttttctcagagcccc

SEQ ID NO: 486441 - DNA, 20 bp, mouse
gccctggccccgacccaagc

SEQ ID NO: 486442 - DNA, 20 bp, mouse
gcactcactcttgcccgctt

SEQ ID NO: 486443 - DNA, 20 bp, mouse
gactcttgcccgcttgggtc

SEQ ID NO: 486444 - DNA, 20 bp, mouse
gaccgaggctccccgaagcc

SEQ ID NO: 486445 - DNA, 20 bp, mouse
gcagaagcaggagaagtaga

SEQ ID NO: 486446 - DNA, 20 bp, mouse
ggtgagagaatagagagtcg

SEQ ID NO: 486447 - DNA, 20 bp, mouse
gtagagagtcgaggctggga

SEQ ID NO: 486448 - DNA, 20 bp, mouse
gctttcagctctgtgatacc

SEQ ID NO: 486449 - DNA, 20 bp, mouse
gagaatagagagtcgaggct

SEQ ID NO: 486450 - DNA, 20 bp, mouse
gttctttggatggcatttgg

SEQ ID NO: 486451 - DNA, 20 bp, mouse
gatgtggtgtccccagctac

SEQ ID NO: 486452 - DNA, 20 bp, mouse
ggttgttccacaccttaata

SEQ ID NO: 486453 - DNA, 20 bp, mouse
gccaccctgaatccccagaa

SEQ ID NO: 486454 - DNA, 20 bp, mouse
gagtgtgccatattaaggtg

SEQ ID NO: 486455 - DNA, 20 bp, mouse
gggttctagcagattttctt

SEQ ID NO: 486456 - DNA, 20 bp, mouse
gaaatcaggggttcattcaa

SEQ ID NO: 486457 - DNA, 20 bp, mouse
gatgaaaattcacagaacat

SEQ ID NO: 486458 - DNA, 20 bp, mouse
gatatgcagatgagtaggat

SEQ ID NO: 486459 - DNA, 20 bp, mouse
gaggtgtacatctactagga

SEQ ID NO: 486460 - DNA, 20 bp, mouse
ggatgagtaggatggggatt

SEQ ID NO: 486461 - DNA, 20 bp, mouse
gattaattgcatgacaagtt

SEQ ID NO: 486462 - DNA, 20 bp, mouse
gttgatatcagcagaaacta

SEQ ID NO: 486463 - DNA, 20 bp, mouse
gcctgaatgtgtggtatacg

SEQ ID NO: 486464 - DNA, 20 bp, mouse
gtcacagaacatggggcctt

SEQ ID NO: 486465 - DNA, 20 bp, mouse
gacaaatgctatacattaga

SEQ ID NO: 486466 - DNA, 20 bp, mouse
gtttttccaactcagctcta

SEQ ID NO: 486467 - DNA, 20 bp, mouse
gagcagccctagagctgagt

SEQ ID NO: 486468 - DNA, 20 bp, mouse
gaaaaatacatcatgttcaa

SEQ ID NO: 486469 - DNA, 20 bp, mouse
gtgtccatgtactttctaaa

SEQ ID NO: 486470 - DNA, 20 bp, mouse
gtagaaattctaaagagcaa

SEQ ID NO: 486471 - DNA, 20 bp, mouse
gatgtagctttctcaccaca

SEQ ID NO: 486472 - DNA, 20 bp, mouse
ggttccctttagaaagtaca

SEQ ID NO: 486473 - DNA, 20 bp, mouse
gactgaaattgtagacagct

SEQ ID NO: 486474 - DNA, 20 bp, mouse
ggtgtgggggggtgctcttc

SEQ ID NO: 486475 - DNA, 20 bp, mouse
gtgatagtttcatcttcctt

SEQ ID NO: 486476 - DNA, 20 bp, mouse
gagagccagatagcgatagg

SEQ ID NO: 486477 - DNA, 20 bp, mouse
gacagcaggcacagtcacca

SEQ ID NO: 486478 - DNA, 20 bp, mouse
gattagagccagatagcgat

SEQ ID NO: 486479 - DNA, 20 bp, mouse
ggccttgtaggacatcatcc

SEQ ID NO: 486480 - DNA, 20 bp, mouse
gggaggacttgccttgtcca

SEQ ID NO: 486481 - DNA, 20 bp, mouse
gtaggactcggggaatagtg

SEQ ID NO: 486482 - DNA, 20 bp, mouse
gcaacctgcagaggccttgt

SEQ ID NO: 486483 - DNA, 20 bp, mouse
ggtctcgtctggagaagaac

SEQ ID NO: 486484 - DNA, 20 bp, mouse
gctgctgtccaagaacttaa

SEQ ID NO: 486485 - DNA, 20 bp, mouse
ggcctggatgatgtcctaca

SEQ ID NO: 486486 - DNA, 20 bp, mouse
ggcttcagaggaaccagaca

SEQ ID NO: 486487 - DNA, 20 bp, mouse
gcatgtgtgagtcctagcaa

SEQ ID NO: 486488 - DNA, 20 bp, mouse
gggcaaggactctctctggt

SEQ ID NO: 486489 - DNA, 20 bp, mouse
gctgcagtggtgagaaggta

SEQ ID NO: 486490 - DNA, 20 bp, mouse
gattacacagggatctgcag

SEQ ID NO: 486491 - DNA, 20 bp, mouse
gtgatagagatagagctgtg

SEQ ID NO: 486492 - DNA, 20 bp, mouse
gtgagggcttcttcctgtta

SEQ ID NO: 486493 - DNA, 20 bp, mouse
gctggttcctctgaagctga

SEQ ID NO: 486494 - DNA, 20 bp, mouse
gggagcagcctccagtagga

SEQ ID NO: 486495 - DNA, 20 bp, mouse
gggtttgtccttcctactgg

SEQ ID NO: 486496 - DNA, 20 bp, mouse
gctggcagccgctgttgacg

SEQ ID NO: 486497 - DNA, 20 bp, mouse
gctgccccagcaccaggtcc

SEQ ID NO: 486498 - DNA, 20 bp, mouse
gtgctcgcgcagcaggctgg

SEQ ID NO: 486499 - DNA, 20 bp, mouse
gggctcagtacgccgggacc

SEQ ID NO: 486500 - DNA, 20 bp, mouse
ggacacgcaagaacgcatca

SEQ ID NO: 486501 - DNA, 20 bp, mouse
gacgcaagaacgcatcaagg

SEQ ID NO: 486502 - DNA, 20 bp, mouse
gagcctgctgcgcgagcagg

SEQ ID NO: 486503 - DNA, 20 bp, mouse
gcgagtctcgaaagagtccg

SEQ ID NO: 486504 - DNA, 20 bp, mouse
gtacgccgggacctggtgct

SEQ ID NO: 486505 - DNA, 20 bp, mouse
gccaggcgcggtggatgcgg

SEQ ID NO: 486506 - DNA, 20 bp, mouse
gatgaccttggccaggtggc

SEQ ID NO: 486507 - DNA, 20 bp, mouse
gttcttgatgtaatcataca

SEQ ID NO: 486508 - DNA, 20 bp, mouse
gtgagtttcccttttggctc

SEQ ID NO: 486509 - DNA, 20 bp, mouse
gcagccttggcagcaccagt

SEQ ID NO: 486510 - DNA, 20 bp, mouse
gctcccccgccacctggcca

SEQ ID NO: 486511 - DNA, 20 bp, mouse
gggtcatcccagagccaaaa

SEQ ID NO: 486512 - DNA, 20 bp, mouse
gtttggggtaggaaaatgaa

SEQ ID NO: 486513 - DNA, 20 bp, mouse
gtgatgtaatcatacatggc

SEQ ID NO: 486514 - DNA, 20 bp, mouse
gacatcatccctgcacccac

SEQ ID NO: 486515 - DNA, 20 bp, mouse
gcaacagatacatttggggt

SEQ ID NO: 486516 - DNA, 20 bp, mouse
gaagcccagcagaaacacca

SEQ ID NO: 486517 - DNA, 20 bp, mouse
gccccactggacagccacca

SEQ ID NO: 486518 - DNA, 20 bp, mouse
gcctggcgctgcagccccac

SEQ ID NO: 486519 - DNA, 20 bp, mouse
gcaccatggtggctgtccag

SEQ ID NO: 486520 - DNA, 20 bp, mouse
gagcttccctaggaatcgat

SEQ ID NO: 486521 - DNA, 20 bp, mouse
gtggtgccaatcgattccta

SEQ ID NO: 486522 - DNA, 20 bp, mouse
gagagtgacagctgagttcc

SEQ ID NO: 486523 - DNA, 20 bp, mouse
gagcaggagttaggagtgga

SEQ ID NO: 486524 - DNA, 20 bp, mouse
gcttacccgtgactccacac

SEQ ID NO: 486525 - DNA, 20 bp, mouse
gccaggcagctcccttgcag

SEQ ID NO: 486526 - DNA, 20 bp, mouse
ggagctccagcctaagaggg

SEQ ID NO: 486527 - DNA, 20 bp, mouse
ggaggcagaggcatggacct

SEQ ID NO: 486528 - DNA, 20 bp, mouse
gaagtgagctccagcctaag

SEQ ID NO: 486529 - DNA, 20 bp, mouse
ggtgttcccccaactctcag

SEQ ID NO: 486530 - DNA, 20 bp, mouse
gctctcccaaaggcaaaggt

SEQ ID NO: 486531 - DNA, 20 bp, mouse
gttcattcatgactgctccc

SEQ ID NO: 486532 - DNA, 20 bp, mouse
gccctgatagtagagcacat

SEQ ID NO: 486533 - DNA, 20 bp, mouse
gattctcttggaagaagact

SEQ ID NO: 486534 - DNA, 20 bp, mouse
gcatgcccaggcttctcatc

SEQ ID NO: 486535 - DNA, 20 bp, mouse
gaggtctttaaactactgat

SEQ ID NO: 486536 - DNA, 20 bp, mouse
gaaggcagcttcgggcacca

SEQ ID NO: 486537 - DNA, 20 bp, mouse
gtcagcaacaagagaatagt

SEQ ID NO: 486538 - DNA, 20 bp, mouse
ggtcagcgatgccccaactg

SEQ ID NO: 486539 - DNA, 20 bp, mouse
gatgggaggagccagtgcaa

SEQ ID NO: 486540 - DNA, 20 bp, mouse
ggatggatgggactagatta

SEQ ID NO: 486541 - DNA, 20 bp, mouse
gactagattagggtcttcct

SEQ ID NO: 486542 - DNA, 20 bp, mouse
gtacaatatgctacctccaa

SEQ ID NO: 486543 - DNA, 20 bp, mouse
gggtggtgtccctactgatg

SEQ ID NO: 486544 - DNA, 20 bp, mouse
gtgatgaggagcaggctact

SEQ ID NO: 486545 - DNA, 20 bp, mouse
gtagcctgctcctcatcagt

SEQ ID NO: 486546 - DNA, 20 bp, mouse
ggccctgaccgcagcacagg

SEQ ID NO: 486547 - DNA, 20 bp, mouse
gacagacaagctgatgcagg

SEQ ID NO: 486548 - DNA, 20 bp, mouse
gttgagggccgcctgtgctg

SEQ ID NO: 486549 - DNA, 20 bp, mouse
gccagccctgaccgcagcac

SEQ ID NO: 486550 - DNA, 20 bp, mouse
gcagaaacagaaatactgtg

SEQ ID NO: 486551 - DNA, 20 bp, mouse
gacaaggtagtaagtcaagc

SEQ ID NO: 486552 - DNA, 20 bp, mouse
gcagatcatccacctgcatc

SEQ ID NO: 486553 - DNA, 20 bp, mouse
gaaagccattgctgacaaaa

SEQ ID NO: 486554 - DNA, 20 bp, mouse
gcacccaggaagtggagctg

SEQ ID NO: 486555 - DNA, 20 bp, mouse
gaagcttgtcacccaggaag

SEQ ID NO: 486556 - DNA, 20 bp, mouse
gatactctatctcaagccaa

SEQ ID NO: 486557 - DNA, 20 bp, mouse
ggctcttgtgcatgtgacaa

SEQ ID NO: 486558 - DNA, 20 bp, mouse
gagcaccttcaaaagatgga

SEQ ID NO: 486559 - DNA, 20 bp, mouse
gttcaaaagatggatggcaa

SEQ ID NO: 486560 - DNA, 20 bp, mouse
gtctaggagcaagtagccta

SEQ ID NO: 486561 - DNA, 20 bp, mouse
gacagagcaccttcaaaaga

SEQ ID NO: 486562 - DNA, 20 bp, mouse
gtgtgcatgtgacaagggta

SEQ ID NO: 486563 - DNA, 20 bp, mouse
gttagcacccaagagaacca

SEQ ID NO: 486564 - DNA, 20 bp, mouse
gagaaccatggctagagcag

SEQ ID NO: 486565 - DNA, 20 bp, mouse
gttcatgatgcagtgtctgg

SEQ ID NO: 486566 - DNA, 20 bp, mouse
gagtatccgaagaatcctgt

SEQ ID NO: 486567 - DNA, 20 bp, mouse
gaagcgcccacaggattctt

SEQ ID NO: 486568 - DNA, 20 bp, mouse
gcagtcgacatgccacccaa

SEQ ID NO: 486569 - DNA, 20 bp, mouse
gtagccttcttccccttggg

SEQ ID NO: 486570 - DNA, 20 bp, mouse
gaaaagtgtgaagcgcccac

SEQ ID NO: 486571 - DNA, 20 bp, mouse
gtccttgccaggagagaggt

SEQ ID NO: 486572 - DNA, 20 bp, mouse
gcctgggatgagactatcaa

SEQ ID NO: 486573 - DNA, 20 bp, mouse
gcttggcaagaagggcagaa

SEQ ID NO: 486574 - DNA, 20 bp, mouse
ggagtctctgcctaccccag

SEQ ID NO: 486575 - DNA, 20 bp, mouse
gggcttgggataggactcct

SEQ ID NO: 486576 - DNA, 20 bp, mouse
gaggctccgaagcccgccgg

SEQ ID NO: 486577 - DNA, 20 bp, mouse
gggaaggctccgaagcccgc

SEQ ID NO: 486578 - DNA, 20 bp, mouse
gcgccggcggcgaaccctgc

SEQ ID NO: 486579 - DNA, 20 bp, mouse
gggcttgcaagtgtacgatt

SEQ ID NO: 486580 - DNA, 20 bp, mouse
ggaatggggacagcgaggaa

SEQ ID NO: 486581 - DNA, 20 bp, mouse
ggcacgcaatacctggccag

SEQ ID NO: 486582 - DNA, 20 bp, mouse
ggttcgccgccggcgggctt

SEQ ID NO: 486583 - DNA, 20 bp, mouse
gaaaaggactaaaaattcaa

SEQ ID NO: 486584 - DNA, 20 bp, mouse
gtattgcgtgcagagtgaat

SEQ ID NO: 486585 - DNA, 20 bp, mouse
gagacagaaggtggattaga

SEQ ID NO: 486586 - DNA, 20 bp, mouse
gaagagggtacagcttgaag

SEQ ID NO: 486587 - DNA, 20 bp, mouse
gtaggggtggggacctgata

SEQ ID NO: 486588 - DNA, 20 bp, mouse
gcttgaagaggccctttctc

SEQ ID NO: 486589 - DNA, 20 bp, mouse
gtctggtataagtgagacca

SEQ ID NO: 486590 - DNA, 20 bp, mouse
ggaaggcaagacacaggtaa

SEQ ID NO: 486591 - DNA, 20 bp, mouse
gcctctttggtataggttag

SEQ ID NO: 486592 - DNA, 20 bp, mouse
gccggacccaatctcagaca

SEQ ID NO: 486593 - DNA, 20 bp, mouse
gctgggttcagcaaatccat

SEQ ID NO: 486594 - DNA, 20 bp, mouse
gtctccatcctctttggtat

SEQ ID NO: 486595 - DNA, 20 bp, mouse
ggtgcttgagtgtgtctccc

SEQ ID NO: 486596 - DNA, 20 bp, mouse
ggctatgacagagtgacagt

SEQ ID NO: 486597 - DNA, 20 bp, mouse
gcgagaggcaaggctgtaag

SEQ ID NO: 486598 - DNA, 20 bp, mouse
gggacagtaaaagcaacgag

SEQ ID NO: 486599 - DNA, 20 bp, mouse
ggtaaaagcaacgagaggca

SEQ ID NO: 486600 - DNA, 20 bp, mouse
gagtgctcatgagcttgggt

SEQ ID NO: 486601 - DNA, 20 bp, mouse
ggagtcccttccatcagatg

SEQ ID NO: 486602 - DNA, 20 bp, mouse
gacgtccccatctgatggaa

SEQ ID NO: 486603 - DNA, 20 bp, mouse
ggtgacagtaggctgtaagc

SEQ ID NO: 486604 - DNA, 20 bp, mouse
gtggctacgtccccatctga

SEQ ID NO: 486605 - DNA, 20 bp, mouse
gccctgggcttactgtcaag

SEQ ID NO: 486606 - DNA, 20 bp, mouse
ggagccagaaggcgagcacc

SEQ ID NO: 486607 - DNA, 20 bp, mouse
gacaagagtctgatcgccat

SEQ ID NO: 486608 - DNA, 20 bp, mouse
gaaggtccgcagggagtgca

SEQ ID NO: 486609 - DNA, 20 bp, mouse
gtgccctgtgaaggtgacag

SEQ ID NO: 486610 - DNA, 20 bp, mouse
ggtctgatcgccatgggcac

SEQ ID NO: 486611 - DNA, 20 bp, mouse
gtccaggtcttgctgataaa

SEQ ID NO: 486612 - DNA, 20 bp, mouse
gccaatggagaagtctgcta

SEQ ID NO: 486613 - DNA, 20 bp, mouse
gaaggtgacagtggaggacc

SEQ ID NO: 486614 - DNA, 20 bp, mouse
ggtacacctgggacactgca

SEQ ID NO: 486615 - DNA, 20 bp, mouse
gggtcagtgtgccccagcaa

SEQ ID NO: 486616 - DNA, 20 bp, mouse
gacagctgccacttccaagg

SEQ ID NO: 486617 - DNA, 20 bp, mouse
ggcagctctgaaaacaatga

SEQ ID NO: 486618 - DNA, 20 bp, mouse
gtctctgtcccccttggaag

SEQ ID NO: 486619 - DNA, 20 bp, mouse
gtgtccccgctgaggagtgg

SEQ ID NO: 486620 - DNA, 20 bp, mouse
gccatgtccccgctgaggag

SEQ ID NO: 486621 - DNA, 20 bp, mouse
gttctctgggatggaagagg

SEQ ID NO: 486622 - DNA, 20 bp, mouse
ggacagcagcagtagctcgc

SEQ ID NO: 486623 - DNA, 20 bp, mouse
gtcttcgcacagaggggcag

SEQ ID NO: 486624 - DNA, 20 bp, mouse
gctcttctctgggatggaag

SEQ ID NO: 486625 - DNA, 20 bp, mouse
gcaagcccgctgacaaaaca

SEQ ID NO: 486626 - DNA, 20 bp, mouse
ggtctaatgagtggcttcat

SEQ ID NO: 486627 - DNA, 20 bp, mouse
ggcccagcaacaaggatctg

SEQ ID NO: 486628 - DNA, 20 bp, mouse
gagtgaccaagtctaatgag

SEQ ID NO: 486629 - DNA, 20 bp, mouse
gctgggggtcctgcagatgg

SEQ ID NO: 486630 - DNA, 20 bp, mouse
ggtggggcatcttgaaggta

SEQ ID NO: 486631 - DNA, 20 bp, mouse
gcaggacccccagccaagac

SEQ ID NO: 486632 - DNA, 20 bp, mouse
gcaaagtcctgaaagtcgtg

SEQ ID NO: 486633 - DNA, 20 bp, mouse
ggatccttgttgctgggctt

SEQ ID NO: 486634 - DNA, 20 bp, mouse
gaagtcgtggggcatcttga

SEQ ID NO: 486635 - DNA, 20 bp, mouse
gcgtggcagatgccccctgg

SEQ ID NO: 486636 - DNA, 20 bp, mouse
gaccatggcgtcagaggtag

SEQ ID NO: 486637 - DNA, 20 bp, mouse
gtaggggttttgagtagtac

SEQ ID NO: 486638 - DNA, 20 bp, mouse
gagcaactaggaaatcctct

SEQ ID NO: 486639 - DNA, 20 bp, mouse
gtaggaaatcctctaggcca

SEQ ID NO: 486640 - DNA, 20 bp, mouse
gtgctgtgaccctggcctag

SEQ ID NO: 486641 - DNA, 20 bp, mouse
ggctaagggtgctgtgaccc

SEQ ID NO: 486642 - DNA, 20 bp, mouse
gcaagatggttgacagcagt

SEQ ID NO: 486643 - DNA, 20 bp, mouse
ggagctgaccatggcgtcag

SEQ ID NO: 486644 - DNA, 20 bp, mouse
gacccctacctctgacgcca

SEQ ID NO: 486645 - DNA, 20 bp, mouse
gggggcggcagcagcttgac

SEQ ID NO: 486646 - DNA, 20 bp, mouse
ggtcatggtgtcaggagtag

SEQ ID NO: 486647 - DNA, 20 bp, mouse
gggtatgctgcaccaactag

SEQ ID NO: 486648 - DNA, 20 bp, mouse
gagggtgatattctgttctc

SEQ ID NO: 486649 - DNA, 20 bp, mouse
gctggtcatcagcggcaggt

SEQ ID NO: 486650 - DNA, 20 bp, mouse
gacacaggtgggtttaaaag

SEQ ID NO: 486651 - DNA, 20 bp, mouse
gcaggtgggtttaaaagagg

SEQ ID NO: 486652 - DNA, 20 bp, mouse
ggatgaccagctcccaaaaa

SEQ ID NO: 486653 - DNA, 20 bp, mouse
gggagctggtcatcagcggc

SEQ ID NO: 486654 - DNA, 20 bp, mouse
gtggtggacagcacagctgg

SEQ ID NO: 486655 - DNA, 20 bp, mouse
ggagctgctggtggtcttgc

SEQ ID NO: 486656 - DNA, 20 bp, mouse
gtcacccccaatctagaggg

SEQ ID NO: 486657 - DNA, 20 bp, mouse
gggctcacccccaatctaga

SEQ ID NO: 486658 - DNA, 20 bp, mouse
gggtgagcctagtccctgtc

SEQ ID NO: 486659 - DNA, 20 bp, mouse
gatctagagggaggagagcg

SEQ ID NO: 486660 - DNA, 20 bp, mouse
gtctcctccctctagattgg

SEQ ID NO: 486661 - DNA, 20 bp, mouse
gtttcgaccggacagggact

SEQ ID NO: 486662 - DNA, 20 bp, mouse
gtgccgagggcgccccctag

SEQ ID NO: 486663 - DNA, 20 bp, mouse
gacttcgcaggcctcgagga

SEQ ID NO: 486664 - DNA, 20 bp, mouse
gctcacatttcgaccggaca

SEQ ID NO: 486665 - DNA, 20 bp, mouse
gccagtacaggagaagtcag

SEQ ID NO: 486666 - DNA, 20 bp, mouse
gcaggtgctcaccagctcag

SEQ ID NO: 486667 - DNA, 20 bp, mouse
ggccgggctggacacttcag

SEQ ID NO: 486668 - DNA, 20 bp, mouse
gggaggcttgaagcactgga

SEQ ID NO: 486669 - DNA, 20 bp, mouse
gcgcctcctggaaaacgctg

SEQ ID NO: 486670 - DNA, 20 bp, mouse
ggcacctggagcatcctgtg

SEQ ID NO: 486671 - DNA, 20 bp, mouse
ggccactgaagtgtccagcc

SEQ ID NO: 486672 - DNA, 20 bp, mouse
ggcgggcagggagcgtgagt

SEQ ID NO: 486673 - DNA, 20 bp, mouse
ggggacacgagggcaatggt

SEQ ID NO: 486674 - DNA, 20 bp, mouse
gatccctcaggcggttccat

SEQ ID NO: 486675 - DNA, 20 bp, mouse
ggtgcttcaagcctcctcac

SEQ ID NO: 486676 - DNA, 20 bp, mouse
gcggacagcacggagcgcga

SEQ ID NO: 486677 - DNA, 20 bp, mouse
gggagaagacctacgtgaag

SEQ ID NO: 486678 - DNA, 20 bp, mouse
gcggcgagtagggtgactcg

SEQ ID NO: 486679 - DNA, 20 bp, mouse
gacgcagcccgggaagcaca

SEQ ID NO: 486680 - DNA, 20 bp, mouse
gcgcgcgctggtcgaagtcc

SEQ ID NO: 486681 - DNA, 20 bp, mouse
gatccgcatctgcttcagga

SEQ ID NO: 486682 - DNA, 20 bp, mouse
gcccctccaagagggaagtg

SEQ ID NO: 486683 - DNA, 20 bp, mouse
gcgggctgcgtgctgacgaa

SEQ ID NO: 486684 - DNA, 20 bp, mouse
gctggtcgaagtcctggccg

SEQ ID NO: 486685 - DNA, 20 bp, mouse
gcgaagggaccagggcaaca

SEQ ID NO: 486686 - DNA, 20 bp, mouse
gcagtaatgaatacttacag

SEQ ID NO: 486687 - DNA, 20 bp, mouse
gaaccccagcactcagcggg

SEQ ID NO: 486688 - DNA, 20 bp, mouse
gtgtcaactaaagctcacaa

SEQ ID NO: 486689 - DNA, 20 bp, mouse
gactaaagctcacaatggaa

SEQ ID NO: 486690 - DNA, 20 bp, mouse
gtacttacaggggctgaacg

SEQ ID NO: 486691 - DNA, 20 bp, mouse
gctcacaatggaacgggaga

SEQ ID NO: 486692 - DNA, 20 bp, mouse
ggaagaggatgagcagagca

SEQ ID NO: 486693 - DNA, 20 bp, mouse
gggttgagaaacaaatgata

SEQ ID NO: 486694 - DNA, 20 bp, mouse
gcggaggatcacaagttcag

SEQ ID NO: 486695 - DNA, 20 bp, mouse
gctccacccgctgagtgctg

SEQ ID NO: 486696 - DNA, 20 bp, mouse
gctgtccttggtggcaacag

SEQ ID NO: 486697 - DNA, 20 bp, mouse
gggttgagaaacacattgga

SEQ ID NO: 486698 - DNA, 20 bp, mouse
gttacaggggctggacgtgg

SEQ ID NO: 486699 - DNA, 20 bp, mouse
gctgtcctctgttgccacca

SEQ ID NO: 486700 - DNA, 20 bp, mouse
gactcactcatcagctttca

SEQ ID NO: 486701 - DNA, 20 bp, mouse
gaatgaatacttacaggggc

SEQ ID NO: 486702 - DNA, 20 bp, mouse
gtttaaattgattttggttt

SEQ ID NO: 486703 - DNA, 20 bp, mouse
gctacttacctgggaggaaa

SEQ ID NO: 486704 - DNA, 20 bp, mouse
gtacttacaggggctggacg

SEQ ID NO: 486705 - DNA, 20 bp, mouse
gctaaagctcacaatggaat

SEQ ID NO: 486706 - DNA, 20 bp, mouse
gcccaggtggcttccagcat

SEQ ID NO: 486707 - DNA, 20 bp, mouse
gcacagggccacccacaagg

SEQ ID NO: 486708 - DNA, 20 bp, mouse
gtcccggcttcccacagaag

SEQ ID NO: 486709 - DNA, 20 bp, mouse
gcaagctctggggtcccagg

SEQ ID NO: 486710 - DNA, 20 bp, mouse
gatccagcactgcctcgtgc

SEQ ID NO: 486711 - DNA, 20 bp, mouse
ggagtgtgcggcaagctctg

SEQ ID NO: 486712 - DNA, 20 bp, mouse
gcagccaccctggtcccagt

SEQ ID NO: 486713 - DNA, 20 bp, mouse
gtgcctgcacgaggcagtgc

SEQ ID NO: 486714 - DNA, 20 bp, mouse
gcgaggtcacaccaccttgt

SEQ ID NO: 486715 - DNA, 20 bp, mouse
gaagactcatccgtaatgac

SEQ ID NO: 486716 - DNA, 20 bp, mouse
gcagggccggggagccacaa

SEQ ID NO: 486717 - DNA, 20 bp, mouse
ggccctgtggccttcttcag

SEQ ID NO: 486718 - DNA, 20 bp, mouse
ggaagaaggccacagggccg

SEQ ID NO: 486719 - DNA, 20 bp, mouse
gagaggtaggctggccattg

SEQ ID NO: 486720 - DNA, 20 bp, mouse
gacttcaggaaacacagcgg

SEQ ID NO: 486721 - DNA, 20 bp, mouse
ggagtggacgggacagtcgt

SEQ ID NO: 486722 - DNA, 20 bp, mouse
gggaaacacagcggtggctt

SEQ ID NO: 486723 - DNA, 20 bp, mouse
ggccaagctgaacaggaaga

SEQ ID NO: 486724 - DNA, 20 bp, mouse
gcttcagcggagttggtcgt

SEQ ID NO: 486725 - DNA, 20 bp, mouse
ggaaccgtgagaaactgatg

SEQ ID NO: 486726 - DNA, 20 bp, mouse
ggacatggagatagagcgta

SEQ ID NO: 486727 - DNA, 20 bp, mouse
gggagatagagcgtagggag

SEQ ID NO: 486728 - DNA, 20 bp, mouse
gaggagcgaggagctgtccg

SEQ ID NO: 486729 - DNA, 20 bp, mouse
ggagaaagtgccgggcgaca

SEQ ID NO: 486730 - DNA, 20 bp, mouse
gagcgaggagctgtccgagg

SEQ ID NO: 486731 - DNA, 20 bp, mouse
gtgctcatggagaaagtgcc

SEQ ID NO: 486732 - DNA, 20 bp, mouse
gtccgaggcggagaggaagg

SEQ ID NO: 486733 - DNA, 20 bp, mouse
gggagctgtccgaggcggag

SEQ ID NO: 486734 - DNA, 20 bp, mouse
ggagtagagcgccggaggga

SEQ ID NO: 486735 - DNA, 20 bp, mouse
gcgccgagcgaagctgcgct

SEQ ID NO: 486736 - DNA, 20 bp, mouse
gcgggccaatggggacgata

SEQ ID NO: 486737 - DNA, 20 bp, mouse
gggtggtggccgggccaatg

SEQ ID NO: 486738 - DNA, 20 bp, mouse
ggtcatggtgacagtgaacc

SEQ ID NO: 486739 - DNA, 20 bp, mouse
gatacggcatccttgcagat

SEQ ID NO: 486740 - DNA, 20 bp, mouse
gcgtgttggctgctcaacaa

SEQ ID NO: 486741 - DNA, 20 bp, mouse
gagatccttaaggcaaggta

SEQ ID NO: 486742 - DNA, 20 bp, mouse
gagccaacacgatgacacat

SEQ ID NO: 486743 - DNA, 20 bp, mouse
ggttcctcagcaacaaaacc

SEQ ID NO: 486744 - DNA, 20 bp, mouse
gtcaggcacacagcaggatg

SEQ ID NO: 486745 - DNA, 20 bp, mouse
gccctccaagggcaactttg

SEQ ID NO: 486746 - DNA, 20 bp, mouse
ggaccagacagaatactaat

SEQ ID NO: 486747 - DNA, 20 bp, mouse
gctaataggagatggggtca

SEQ ID NO: 486748 - DNA, 20 bp, mouse
gccagagggaagcatcactt

SEQ ID NO: 486749 - DNA, 20 bp, mouse
ggaagatgtggagtcagatg

SEQ ID NO: 486750 - DNA, 20 bp, mouse
gctcctattagtattctgtc

SEQ ID NO: 486751 - DNA, 20 bp, mouse
gcagaatactaataggagat

SEQ ID NO: 486752 - DNA, 20 bp, mouse
gagaaactcctagagttcat

SEQ ID NO: 486753 - DNA, 20 bp, mouse
gcagtggccttcccaatcat

SEQ ID NO: 486754 - DNA, 20 bp, mouse
gactccacatcttcaacctt

SEQ ID NO: 486755 - DNA, 20 bp, mouse
ggaaatacttgactgcccag

SEQ ID NO: 486756 - DNA, 20 bp, mouse
ggctgaacttcgtaccaaga

SEQ ID NO: 486757 - DNA, 20 bp, mouse
gtacgaagttcagctacagg

SEQ ID NO: 486758 - DNA, 20 bp, mouse
gaacttcgtaccaagagggc

SEQ ID NO: 486759 - DNA, 20 bp, mouse
gtaagcggggtaaacagcaa

SEQ ID NO: 486760 - DNA, 20 bp, mouse
gaagagtttggagtcggtct

SEQ ID NO: 486761 - DNA, 20 bp, mouse
gacagtagcacgcgtctcca

SEQ ID NO: 486762 - DNA, 20 bp, mouse
gcaagcgggtagacagcacc

SEQ ID NO: 486763 - DNA, 20 bp, mouse
gccgcttgccggatccccta

SEQ ID NO: 486764 - DNA, 20 bp, mouse
gccaaactcttagagagacg

SEQ ID NO: 486765 - DNA, 20 bp, mouse
gtggtacgaagttcagctac

SEQ ID NO: 486766 - DNA, 20 bp, mouse
gttgtaggatgcccttcagt

SEQ ID NO: 486767 - DNA, 20 bp, mouse
gctagaaagctgtggtgtgt

SEQ ID NO: 486768 - DNA, 20 bp, mouse
ggcccccagtgtatccgttg

SEQ ID NO: 486769 - DNA, 20 bp, mouse
gctcttccacctttgatatt

SEQ ID NO: 486770 - DNA, 20 bp, mouse
gatcaaaaaggtattgaagc

SEQ ID NO: 486771 - DNA, 20 bp, mouse
gtccacaacggatacactgg

SEQ ID NO: 486772 - DNA, 20 bp, mouse
gatgccagccccaatatcaa

SEQ ID NO: 486773 - DNA, 20 bp, mouse
gccagccccaatatcaaagg

SEQ ID NO: 486774 - DNA, 20 bp, mouse
gtgatgtcttcatactgggc

SEQ ID NO: 486775 - DNA, 20 bp, mouse
gctttttgatgtcttcatac

SEQ ID NO: 486776 - DNA, 20 bp, mouse
gtgctgaggagaaagagtca

SEQ ID NO: 486777 - DNA, 20 bp, mouse
gcacatggtaccgacagtgt

SEQ ID NO: 486778 - DNA, 20 bp, mouse
gcttcatccatgaagagctt

SEQ ID NO: 486779 - DNA, 20 bp, mouse
ggtaccatgtggaattacat

SEQ ID NO: 486780 - DNA, 20 bp, mouse
gattacattggagataatgt

SEQ ID NO: 486781 - DNA, 20 bp, mouse
gtctatgtagccgtatgctg

SEQ ID NO: 486782 - DNA, 20 bp, mouse
gtctccaatgtaattccaca

SEQ ID NO: 486783 - DNA, 20 bp, mouse
gaaacaatgatgattgagcc

SEQ ID NO: 486784 - DNA, 20 bp, mouse
ggcagcagcagaggacctga

SEQ ID NO: 486785 - DNA, 20 bp, mouse
gactcttccaaagctcttca

SEQ ID NO: 486786 - DNA, 20 bp, mouse
gagagtgtaaggaaaaactt

SEQ ID NO: 486787 - DNA, 20 bp, mouse
gacacttccggcgttgaggg

SEQ ID NO: 486788 - DNA, 20 bp, mouse
gtggacacttccggcgttga

SEQ ID NO: 486789 - DNA, 20 bp, mouse
gggccatcattgaagagttg

SEQ ID NO: 486790 - DNA, 20 bp, mouse
gtaggctacacccagggaac

SEQ ID NO: 486791 - DNA, 20 bp, mouse
gttccccaactcttcaatga

SEQ ID NO: 486792 - DNA, 20 bp, mouse
gagtaaatatgcagagctgc

SEQ ID NO: 486793 - DNA, 20 bp, mouse
gcgggccgcgccggcaacta

SEQ ID NO: 486794 - DNA, 20 bp, mouse
ggagggacggccatagttgc

SEQ ID NO: 486795 - DNA, 20 bp, mouse
gcttccggcgttgagggcgg

SEQ ID NO: 486796 - DNA, 20 bp, mouse
gtagaaaggaagagaccgtg

SEQ ID NO: 486797 - DNA, 20 bp, mouse
ggatccgactgtccacccca

SEQ ID NO: 486798 - DNA, 20 bp, mouse
gaaaggaagagaccgtgggg

SEQ ID NO: 486799 - DNA, 20 bp, mouse
gtctatgtgtagttcttctt

SEQ ID NO: 486800 - DNA, 20 bp, mouse
gtgctgaggtaagggtgtct

SEQ ID NO: 486801 - DNA, 20 bp, mouse
gtggcccctgacaccaggaa

SEQ ID NO: 486802 - DNA, 20 bp, mouse
gaggagtggcccctgacacc

SEQ ID NO: 486803 - DNA, 20 bp, mouse
gtctcctttcctggtgtcag

SEQ ID NO: 486804 - DNA, 20 bp, mouse
gggtcaccactgctgaggta

SEQ ID NO: 486805 - DNA, 20 bp, mouse
gaccaggaaaggagaactca

SEQ ID NO: 486806 - DNA, 20 bp, mouse
gcaggcaagtcttcagaagg

SEQ ID NO: 486807 - DNA, 20 bp, mouse
gggaatgaaggactccgggt

SEQ ID NO: 486808 - DNA, 20 bp, mouse
gaaaagctcacactcactcg

SEQ ID NO: 486809 - DNA, 20 bp, mouse
gttgtgggtggggtgatcaa

SEQ ID NO: 486810 - DNA, 20 bp, mouse
ggcctacaatctaacgcagg

SEQ ID NO: 486811 - DNA, 20 bp, mouse
gagccaggataagtccccag

SEQ ID NO: 486812 - DNA, 20 bp, mouse
ggcagggaatgaaggactcc

SEQ ID NO: 486813 - DNA, 20 bp, mouse
gcgggcctccttgtgatgtc

SEQ ID NO: 486814 - DNA, 20 bp, mouse
ggcctcctgcgttagattgt

SEQ ID NO: 486815 - DNA, 20 bp, mouse
ggctcacactcactcggggc

SEQ ID NO: 486816 - DNA, 20 bp, mouse
ggcccacagcgcccgcccgt

SEQ ID NO: 486817 - DNA, 20 bp, mouse
gagcgaacacagcccacggg

SEQ ID NO: 486818 - DNA, 20 bp, mouse
gatgagcgaacacagcccac

SEQ ID NO: 486819 - DNA, 20 bp, mouse
gcgacgggtgatgggctcgg

SEQ ID NO: 486820 - DNA, 20 bp, mouse
ggttcgctcatggtgcgctc

SEQ ID NO: 486821 - DNA, 20 bp, mouse
gagagcggccgcctgaaccc

SEQ ID NO: 486822 - DNA, 20 bp, mouse
ggacggtcgactgtcacgac

SEQ ID NO: 486823 - DNA, 20 bp, mouse
gtgtgggcccggggttcagg

SEQ ID NO: 486824 - DNA, 20 bp, mouse
gcaggtggccaacgcaccac

SEQ ID NO: 486825 - DNA, 20 bp, mouse
gattgcagtcctgggtccag

SEQ ID NO: 486826 - DNA, 20 bp, mouse
gctacacagcaggccagtca

SEQ ID NO: 486827 - DNA, 20 bp, mouse
gtgtgtagacttgagaccac

SEQ ID NO: 486828 - DNA, 20 bp, mouse
ggaggtcagacttacagcag

SEQ ID NO: 486829 - DNA, 20 bp, mouse
gggccagtcagggatacact

SEQ ID NO: 486830 - DNA, 20 bp, mouse
gggctgtcacctactgccag

SEQ ID NO: 486831 - DNA, 20 bp, mouse
gacttgagaccactggcagt

SEQ ID NO: 486832 - DNA, 20 bp, mouse
gagctgaggaagctgagata

SEQ ID NO: 486833 - DNA, 20 bp, mouse
gacttcgattaacctcagct

SEQ ID NO: 486834 - DNA, 20 bp, mouse
gtaatcgaagtctcatccta

SEQ ID NO: 486835 - DNA, 20 bp, mouse
gagattcaagggggtcccag

SEQ ID NO: 486836 - DNA, 20 bp, mouse
gttcggtgaaaggcaccggg

SEQ ID NO: 486837 - DNA, 20 bp, mouse
gaggctgacatctggcaccg

SEQ ID NO: 486838 - DNA, 20 bp, mouse
gccagaagctgcactcacct

SEQ ID NO: 486839 - DNA, 20 bp, mouse
gagccaggggcggacctcgg

SEQ ID NO: 486840 - DNA, 20 bp, mouse
gaggtccgcccctggctatt

SEQ ID NO: 486841 - DNA, 20 bp, mouse
ggtatttcggtgaaaggcac

SEQ ID NO: 486842 - DNA, 20 bp, mouse
gttggttctacgctgtattt

SEQ ID NO: 486843 - DNA, 20 bp, mouse
gtcagcctggtcctgcccca

SEQ ID NO: 486844 - DNA, 20 bp, mouse
ggagatggatgcaggaatca

SEQ ID NO: 486845 - DNA, 20 bp, mouse
gtacgctgtatttcggtgaa

SEQ ID NO: 486846 - DNA, 20 bp, mouse
gaagcttgctgcgttctggt

SEQ ID NO: 486847 - DNA, 20 bp, mouse
gtctggttggtaaaagccaa

SEQ ID NO: 486848 - DNA, 20 bp, mouse
gcaaaaagcttgctgcgttc

SEQ ID NO: 486849 - DNA, 20 bp, mouse
gcatttgatgatagtcacta

SEQ ID NO: 486850 - DNA, 20 bp, mouse
gctgcaggggagtaagattg

SEQ ID NO: 486851 - DNA, 20 bp, mouse
gcactcatggtaaagtgtaa

SEQ ID NO: 486852 - DNA, 20 bp, mouse
gacagtgtatatctcatcag

SEQ ID NO: 486853 - DNA, 20 bp, mouse
ggcagcaagcagcttccagc

SEQ ID NO: 486854 - DNA, 20 bp, mouse
gggcagataggctttctttc

SEQ ID NO: 486855 - DNA, 20 bp, mouse
ggacagggtgtggagggtta

SEQ ID NO: 486856 - DNA, 20 bp, mouse
ggcgccatttcgtgacaccg

SEQ ID NO: 486857 - DNA, 20 bp, mouse
gtaaaccttacaatccaaac

SEQ ID NO: 486858 - DNA, 20 bp, mouse
ggattcctgtttggattgta

SEQ ID NO: 486859 - DNA, 20 bp, mouse
gtggcgccatctttcctttc

SEQ ID NO: 486860 - DNA, 20 bp, mouse
gatgcatcgtgattcctgtt

SEQ ID NO: 486861 - DNA, 20 bp, mouse
gcgcgggaccgagcatctgt

SEQ ID NO: 486862 - DNA, 20 bp, mouse
ggggaagcgggtgggcctga

SEQ ID NO: 486863 - DNA, 20 bp, mouse
gcaaatcctaacgctccgtc

SEQ ID NO: 486864 - DNA, 20 bp, mouse
gttcttggggatctgcaccg

SEQ ID NO: 486865 - DNA, 20 bp, mouse
gttggggatctgcaccgagg

SEQ ID NO: 486866 - DNA, 20 bp, mouse
gcattgaggcaaactctggt

SEQ ID NO: 486867 - DNA, 20 bp, mouse
gtaagaccttcttgacacaa

SEQ ID NO: 486868 - DNA, 20 bp, mouse
ggccaagctctgccaagaga

SEQ ID NO: 486869 - DNA, 20 bp, mouse
ggccacattgaggcaaactc

SEQ ID NO: 486870 - DNA, 20 bp, mouse
gatcttctttgaaatagaat

SEQ ID NO: 486871 - DNA, 20 bp, mouse
gtgacttgcttaccctctct

SEQ ID NO: 486872 - DNA, 20 bp, mouse
gacaaaggcatgtcagcttc

SEQ ID NO: 486873 - DNA, 20 bp, mouse
gagctttcaaggttaagaaa

SEQ ID NO: 486874 - DNA, 20 bp, mouse
ggtggcagcttgccacattg

SEQ ID NO: 486875 - DNA, 20 bp, mouse
gtgggcaactctctgccctg

SEQ ID NO: 486876 - DNA, 20 bp, mouse
gggaggctgggtcttgtctg

SEQ ID NO: 486877 - DNA, 20 bp, mouse
gagtgtacaggcagagcgac

SEQ ID NO: 486878 - DNA, 20 bp, mouse
gcctgggtcgggtgataagt

SEQ ID NO: 486879 - DNA, 20 bp, mouse
gagtcccgcgtggaccagga

SEQ ID NO: 486880 - DNA, 20 bp, mouse
ggacaggaagagtaggaggc

SEQ ID NO: 486881 - DNA, 20 bp, mouse
gcctaggagacagcttctgc

SEQ ID NO: 486882 - DNA, 20 bp, mouse
gtaagtgtgtggcgcgtgtg

SEQ ID NO: 486883 - DNA, 20 bp, mouse
gttgggaaaattccactgac

SEQ ID NO: 486884 - DNA, 20 bp, mouse
gcactgagaagcgggaagga

SEQ ID NO: 486885 - DNA, 20 bp, mouse
gcggctcctagaagggtcca

SEQ ID NO: 486886 - DNA, 20 bp, mouse
gctgctgggtcagctcttgt

SEQ ID NO: 486887 - DNA, 20 bp, mouse
gggtcagctcttgtaggaca

SEQ ID NO: 486888 - DNA, 20 bp, mouse
gagctcttgtaggacaggga

SEQ ID NO: 486889 - DNA, 20 bp, mouse
gacccaggaagactacctgc

SEQ ID NO: 486890 - DNA, 20 bp, mouse
gtggatcttgcagatgttgc

SEQ ID NO: 486891 - DNA, 20 bp, mouse
gctgtgtgatgcaggaggtg

SEQ ID NO: 486892 - DNA, 20 bp, mouse
gaaagcctgtgtgatgcagg

SEQ ID NO: 486893 - DNA, 20 bp, mouse
gacatctgcaagatccacaa

SEQ ID NO: 486894 - DNA, 20 bp, mouse
gcatcactagcagggtcatc

SEQ ID NO: 486895 - DNA, 20 bp, mouse
gccagtagctcatcactagc

SEQ ID NO: 486896 - DNA, 20 bp, mouse
gagtctactggggatcctaa

SEQ ID NO: 486897 - DNA, 20 bp, mouse
gctactcgtaaggaagggat

SEQ ID NO: 486898 - DNA, 20 bp, mouse
gccccagtagacttgtaatg

SEQ ID NO: 486899 - DNA, 20 bp, mouse
gttgaggtaagtacttctgt

SEQ ID NO: 486900 - DNA, 20 bp, mouse
ggctggattgagagagtatt

SEQ ID NO: 486901 - DNA, 20 bp, mouse
gagagagtatttgggaaatg

SEQ ID NO: 486902 - DNA, 20 bp, mouse
gccacaaaggcaaatccctt

SEQ ID NO: 486903 - DNA, 20 bp, mouse
gcaactcctgtaataaatca

SEQ ID NO: 486904 - DNA, 20 bp, mouse
gaccagctactcgtaaggaa

SEQ ID NO: 486905 - DNA, 20 bp, mouse
gtctaggtgcttcttctggt

SEQ ID NO: 486906 - DNA, 20 bp, mouse
ggcagtgctgaaatcagcag

SEQ ID NO: 486907 - DNA, 20 bp, mouse
gaaatcagcagcggcaggag

SEQ ID NO: 486908 - DNA, 20 bp, mouse
ggccgctctggaaaatacct

SEQ ID NO: 486909 - DNA, 20 bp, mouse
gtttacagcgggaacgctcc

SEQ ID NO: 486910 - DNA, 20 bp, mouse
gggagcaccagggtcgggaa

SEQ ID NO: 486911 - DNA, 20 bp, mouse
gcaccacctcccagaactgg

SEQ ID NO: 486912 - DNA, 20 bp, mouse
ggcagcatctctatttacag

SEQ ID NO: 486913 - DNA, 20 bp, mouse
gggagtgttttaatgtacta

SEQ ID NO: 486914 - DNA, 20 bp, mouse
ggatggagtcaagacaaggg

SEQ ID NO: 486915 - DNA, 20 bp, mouse
gccccaccacctcccagaac

SEQ ID NO: 486916 - DNA, 20 bp, mouse
gaactttgcgaggtcttcca

SEQ ID NO: 486917 - DNA, 20 bp, mouse
gagggaccatgtcttcacct

SEQ ID NO: 486918 - DNA, 20 bp, mouse
ggatctgacaagatttggag

SEQ ID NO: 486919 - DNA, 20 bp, mouse
gctaaggatctgacaagatt

SEQ ID NO: 486920 - DNA, 20 bp, mouse
gattggcactgaactttgcg

SEQ ID NO: 486921 - DNA, 20 bp, mouse
gtcactatcatttccggcat

SEQ ID NO: 486922 - DNA, 20 bp, mouse
gtggcttaatttagtaaaga

SEQ ID NO: 486923 - DNA, 20 bp, mouse
gaaatgatagtgaaaattgt

SEQ ID NO: 486924 - DNA, 20 bp, mouse
ggtattagaaaaattgttca

SEQ ID NO: 486925 - DNA, 20 bp, mouse
ggagaagaaacttacttcat

SEQ ID NO: 486926 - DNA, 20 bp, mouse
gactgagcaaccagaaggtg

SEQ ID NO: 486927 - DNA, 20 bp, mouse
gacgacattcaagtccccta

SEQ ID NO: 486928 - DNA, 20 bp, mouse
gaagagtgatattactgagg

SEQ ID NO: 486929 - DNA, 20 bp, mouse
gggaagggagtgctcttcag

SEQ ID NO: 486930 - DNA, 20 bp, mouse
gctaggatgcatctatgcag

SEQ ID NO: 486931 - DNA, 20 bp, mouse
gcctctctttgaggacaggt

SEQ ID NO: 486932 - DNA, 20 bp, mouse
gtgtctcagctgtcaaagat

SEQ ID NO: 486933 - DNA, 20 bp, mouse
gaggcaaagtccacaccttc

SEQ ID NO: 486934 - DNA, 20 bp, mouse
gtcagtatccatggtcagat

SEQ ID NO: 486935 - DNA, 20 bp, mouse
gggtgtggactttgccttag

SEQ ID NO: 486936 - DNA, 20 bp, mouse
gctgaggagagaggtaagac

SEQ ID NO: 486937 - DNA, 20 bp, mouse
gaggagagaggtaagactgg

SEQ ID NO: 486938 - DNA, 20 bp, mouse
gtggttggcgctgaggagag

SEQ ID NO: 486939 - DNA, 20 bp, mouse
gagagaggtaagactggcgg

SEQ ID NO: 486940 - DNA, 20 bp, mouse
ggtaagactggcggaggatt

SEQ ID NO: 486941 - DNA, 20 bp, mouse
gacccgggcagcataaatct

SEQ ID NO: 486942 - DNA, 20 bp, mouse
gctggcaacaaactacaggt

SEQ ID NO: 486943 - DNA, 20 bp, mouse
gcgggcagcataaatctagg

SEQ ID NO: 486944 - DNA, 20 bp, mouse
gctccctgtctcctgcaagt

SEQ ID NO: 486945 - DNA, 20 bp, mouse
gtgatggatggttggcgctg

SEQ ID NO: 486946 - DNA, 20 bp, mouse
ggatctccgtcttactcttc

SEQ ID NO: 486947 - DNA, 20 bp, mouse
gtatgcataaaggagttgag

SEQ ID NO: 486948 - DNA, 20 bp, mouse
gtctcagatgatcctgaact

SEQ ID NO: 486949 - DNA, 20 bp, mouse
gggattccagaagagtaaga

SEQ ID NO: 486950 - DNA, 20 bp, mouse
gcatataaggacattaaaga

SEQ ID NO: 486951 - DNA, 20 bp, mouse
gagggggtttgcaaacccat

SEQ ID NO: 486952 - DNA, 20 bp, mouse
gtaaggacattaaagaagga

SEQ ID NO: 486953 - DNA, 20 bp, mouse
ggacggagatctccgagttc

SEQ ID NO: 486954 - DNA, 20 bp, mouse
gtgcatatatatatgcataa

SEQ ID NO: 486955 - DNA, 20 bp, mouse
gaacaatacctgtattagtc

SEQ ID NO: 486956 - DNA, 20 bp, mouse
gagtaggatgagcctttttg

SEQ ID NO: 486957 - DNA, 20 bp, mouse
ggagtacaagtagctacagt

SEQ ID NO: 486958 - DNA, 20 bp, mouse
gaggtaagcaaggcctaagg

SEQ ID NO: 486959 - DNA, 20 bp, mouse
gctcaggtaagcaaggccta

SEQ ID NO: 486960 - DNA, 20 bp, mouse
gttttaagcagtgtccccac

SEQ ID NO: 486961 - DNA, 20 bp, mouse
gctggacggggtgctgagga

SEQ ID NO: 486962 - DNA, 20 bp, mouse
gggcactggacggggtgctg

SEQ ID NO: 486963 - DNA, 20 bp, mouse
gtaaatgacagtcataggtc

SEQ ID NO: 486964 - DNA, 20 bp, mouse
gtgatctaaatgacagtcat

SEQ ID NO: 486965 - DNA, 20 bp, mouse
gaggccagaaggggaatcat

SEQ ID NO: 486966 - DNA, 20 bp, mouse
gcagctggcactggacgagg

SEQ ID NO: 486967 - DNA, 20 bp, mouse
gctggacgaggtggtgaaga

SEQ ID NO: 486968 - DNA, 20 bp, mouse
gataaaagctcatcatacta

SEQ ID NO: 486969 - DNA, 20 bp, mouse
gctcaggtaagcaaggtcca

SEQ ID NO: 486970 - DNA, 20 bp, mouse
gtgctgcaagctgtgctcga

SEQ ID NO: 486971 - DNA, 20 bp, mouse
gaggtaagcaaggtccaagg

SEQ ID NO: 486972 - DNA, 20 bp, mouse
gaggcctttatgaacagtgg

SEQ ID NO: 486973 - DNA, 20 bp, mouse
gatagacttctctgatctgg

SEQ ID NO: 486974 - DNA, 20 bp, mouse
gtagaagacagtcatagatc

SEQ ID NO: 486975 - DNA, 20 bp, mouse
gaggccagaaggggaatcat

SEQ ID NO: 486976 - DNA, 20 bp, mouse
gtggtggagagcggaaggga

SEQ ID NO: 486977 - DNA, 20 bp, mouse
gcgaccaggagggtgctcag

SEQ ID NO: 486978 - DNA, 20 bp, mouse
ggggttggtggagagcggaa

SEQ ID NO: 486979 - DNA, 20 bp, mouse
gacctcgagacctggcgggt

SEQ ID NO: 486980 - DNA, 20 bp, mouse
gagtcttgaggtcgagaggt

SEQ ID NO: 486981 - DNA, 20 bp, mouse
gaccaacccgccaggtctcg

SEQ ID NO: 486982 - DNA, 20 bp, mouse
ggtgcctctgagcaccctcc

SEQ ID NO: 486983 - DNA, 20 bp, mouse
gtgcaggcggcggggaccat

SEQ ID NO: 486984 - DNA, 20 bp, mouse
gaacgacctcgagacctggc

SEQ ID NO: 486985 - DNA, 20 bp, mouse
gctaagtctggagtaccggg

SEQ ID NO: 486986 - DNA, 20 bp, mouse
gaatggggtcaacaggacag

SEQ ID NO: 486987 - DNA, 20 bp, mouse
gcaggaagaatggggtcaac

SEQ ID NO: 486988 - DNA, 20 bp, mouse
gaggggaatcatagagttag

SEQ ID NO: 486989 - DNA, 20 bp, mouse
gtaaagacacccatgagtgc

SEQ ID NO: 486990 - DNA, 20 bp, mouse
gcccattcttcctgcactca

SEQ ID NO: 486991 - DNA, 20 bp, mouse
gcagctggcactggaggggg

SEQ ID NO: 486992 - DNA, 20 bp, mouse
gtgctgcaagctgtgctcaa

SEQ ID NO: 486993 - DNA, 20 bp, mouse
gtccatagacttctctaatc

SEQ ID NO: 486994 - DNA, 20 bp, mouse
gatagacttctctaatctgg

SEQ ID NO: 486995 - DNA, 20 bp, mouse
gaggcccaaggaggcgagaa

SEQ ID NO: 486996 - DNA, 20 bp, mouse
gagcaatcgcagccgcccgg

SEQ ID NO: 486997 - DNA, 20 bp, mouse
gggcggcctgggcctcatta

SEQ ID NO: 486998 - DNA, 20 bp, mouse
gataagggccggccataatg

SEQ ID NO: 486999 - DNA, 20 bp, mouse
ggcgatgcacgccgcgataa

SEQ ID NO: 487000 - DNA, 20 bp, mouse
gttatggccggcccttatcg

SEQ ID NO: 487001 - DNA, 20 bp, mouse
gcccattagggccctctcac

SEQ ID NO: 487002 - DNA, 20 bp, mouse
gtgcacgccgcgataagggc

SEQ ID NO: 487003 - DNA, 20 bp, mouse
gtaagcggtctcggctacaa

SEQ ID NO: 487004 - DNA, 20 bp, mouse
gcgcgtgaggtaatgaaata

SEQ ID NO: 487005 - DNA, 20 bp, mouse
ggagggaggcgcacacgtgg

SEQ ID NO: 487006 - DNA, 20 bp, mouse
gatatgaatccacaacaaag

SEQ ID NO: 487007 - DNA, 20 bp, mouse
gtccacaacaaagaggaaga

SEQ ID NO: 487008 - DNA, 20 bp, mouse
gagtacacacctttccctga

SEQ ID NO: 487009 - DNA, 20 bp, mouse
gctgttgcagtcttgagcac

SEQ ID NO: 487010 - DNA, 20 bp, mouse
gtcttgagcactggaggttt

SEQ ID NO: 487011 - DNA, 20 bp, mouse
ggggaaaggtgtgtactgct

SEQ ID NO: 487012 - DNA, 20 bp, mouse
gaacaagatcgcctgtgaaa

SEQ ID NO: 487013 - DNA, 20 bp, mouse
gaggtgagtaaggagtagat

SEQ ID NO: 487014 - DNA, 20 bp, mouse
gagactgcaacaggtgagta

SEQ ID NO: 487015 - DNA, 20 bp, mouse
gaccctcttcctctttgttg

SEQ ID NO: 487016 - DNA, 20 bp, mouse
gtccatgcagagctccctca

SEQ ID NO: 487017 - DNA, 20 bp, mouse
gcttcctgagggctcagaaa

SEQ ID NO: 487018 - DNA, 20 bp, mouse
gaggtgagtaaggaatatat

SEQ ID NO: 487019 - DNA, 20 bp, mouse
gcatatacagctcttcctga

SEQ ID NO: 487020 - DNA, 20 bp, mouse
gcagtgatcaagattcaagt

SEQ ID NO: 487021 - DNA, 20 bp, mouse
ggccaggaattggtatttga

SEQ ID NO: 487022 - DNA, 20 bp, mouse
ggatatgaatccacaacagg

SEQ ID NO: 487023 - DNA, 20 bp, mouse
gcttgatcactggatgttgt

SEQ ID NO: 487024 - DNA, 20 bp, mouse
gagggctcagaaaaggcata

SEQ ID NO: 487025 - DNA, 20 bp, mouse
gtaaggaatatattggcaca

SEQ ID NO: 487026 - DNA, 20 bp, mouse
gatatgaatgcacaccaaag

SEQ ID NO: 487027 - DNA, 20 bp, mouse
ggactacagtaggtgagtga

SEQ ID NO: 487028 - DNA, 20 bp, mouse
ggcaaggtaccctgattgcc

SEQ ID NO: 487029 - DNA, 20 bp, mouse
gcttgtgcaatggatgttgt

SEQ ID NO: 487030 - DNA, 20 bp, mouse
ggagcattgcagcgacaaga

SEQ ID NO: 487031 - DNA, 20 bp, mouse
gagtacacagctctccctga

SEQ ID NO: 487032 - DNA, 20 bp, mouse
gcattgcacaagactacagt

SEQ ID NO: 487033 - DNA, 20 bp, mouse
gaagcaactctcttcctctt

SEQ ID NO: 487034 - DNA, 20 bp, mouse
ggactgcttgtgtgcctgcc

SEQ ID NO: 487035 - DNA, 20 bp, mouse
gtgtgcctgcctggcaatca

SEQ ID NO: 487036 - DNA, 20 bp, mouse
gctgtcggttcagccccggt

SEQ ID NO: 487037 - DNA, 20 bp, mouse
gagaagctgcataccgaccg

SEQ ID NO: 487038 - DNA, 20 bp, mouse
gaccgacagacccaggtaag

SEQ ID NO: 487039 - DNA, 20 bp, mouse
gcacagagtgaggcggaggt

SEQ ID NO: 487040 - DNA, 20 bp, mouse
ggggcgggacccacagagtg

SEQ ID NO: 487041 - DNA, 20 bp, mouse
gggctctcgtccgcttacct

SEQ ID NO: 487042 - DNA, 20 bp, mouse
gcgggacccacagagtgagg

SEQ ID NO: 487043 - DNA, 20 bp, mouse
ggagtgaggcggaggtgggt

SEQ ID NO: 487044 - DNA, 20 bp, mouse
gctatggggccggaactcta

SEQ ID NO: 487045 - DNA, 20 bp, mouse
ggacccacagagtgaggcgg

SEQ ID NO: 487046 - DNA, 20 bp, mouse
gctgctatgtcgttcagggt

SEQ ID NO: 487047 - DNA, 20 bp, mouse
gtagggaggaagagtcgtcc

SEQ ID NO: 487048 - DNA, 20 bp, mouse
ggaagagtcgtccaggaagg

SEQ ID NO: 487049 - DNA, 20 bp, mouse
gggcgctgctatgtcgttca

SEQ ID NO: 487050 - DNA, 20 bp, mouse
gcgactgtagtcttccggta

SEQ ID NO: 487051 - DNA, 20 bp, mouse
gctgtagtcttccggtaggg

SEQ ID NO: 487052 - DNA, 20 bp, mouse
ggttcagggtaggcgtgttg

SEQ ID NO: 487053 - DNA, 20 bp, mouse
ggtgccctcccacctggaga

SEQ ID NO: 487054 - DNA, 20 bp, mouse
gacaccttctccaggtggga

SEQ ID NO: 487055 - DNA, 20 bp, mouse
ggcgtgttgcgggttctgct

SEQ ID NO: 487056 - DNA, 20 bp, mouse
gggtgataagaaagatgtgg

SEQ ID NO: 487057 - DNA, 20 bp, mouse
gggtatggagtgtctcccag

SEQ ID NO: 487058 - DNA, 20 bp, mouse
ggtacaatatggtccaccaa

SEQ ID NO: 487059 - DNA, 20 bp, mouse
gtaagaaagatgtggaggcg

SEQ ID NO: 487060 - DNA, 20 bp, mouse
gtactgtgtcaggcaggcga

SEQ ID NO: 487061 - DNA, 20 bp, mouse
gtgtgtcaggcaggcgacgg

SEQ ID NO: 487062 - DNA, 20 bp, mouse
gtggaccatattgtacccaa

SEQ ID NO: 487063 - DNA, 20 bp, mouse
gcagggtgataagaaagatg

SEQ ID NO: 487064 - DNA, 20 bp, mouse
gctgatgcagcaaggtgaca

SEQ ID NO: 487065 - DNA, 20 bp, mouse
gccttctgtagaagcaggta

SEQ ID NO: 487066 - DNA, 20 bp, mouse
gcgtggcagggaagcgtggt

SEQ ID NO: 487067 - DNA, 20 bp, mouse
gaagccccacacctccgtca

SEQ ID NO: 487068 - DNA, 20 bp, mouse
ggtgtatgtatccttgacgg

SEQ ID NO: 487069 - DNA, 20 bp, mouse
ggagatgctggaatccatcg

SEQ ID NO: 487070 - DNA, 20 bp, mouse
gtgtatccttgacggaggtg

SEQ ID NO: 487071 - DNA, 20 bp, mouse
gagcttcattatggaaccaa

SEQ ID NO: 487072 - DNA, 20 bp, mouse
gccatcgtggcagggaagcg

SEQ ID NO: 487073 - DNA, 20 bp, mouse
gtttgatagtcacagagaag

SEQ ID NO: 487074 - DNA, 20 bp, mouse
gaatgtgtatgtatccttga

SEQ ID NO: 487075 - DNA, 20 bp, mouse
gagaattcctggtgatctcg

SEQ ID NO: 487076 - DNA, 20 bp, mouse
gttaatggacatttgttgac

SEQ ID NO: 487077 - DNA, 20 bp, mouse
gtggagtcaaagtagatcag

SEQ ID NO: 487078 - DNA, 20 bp, mouse
gcaaggcttcattcttcgcc

SEQ ID NO: 487079 - DNA, 20 bp, mouse
ggtgtagacatgcagctgac

SEQ ID NO: 487080 - DNA, 20 bp, mouse
gcatctgggctcatggaaat

SEQ ID NO: 487081 - DNA, 20 bp, mouse
gttgaagagctgcagtgtcc

SEQ ID NO: 487082 - DNA, 20 bp, mouse
gtggcttatatttaagtgta

SEQ ID NO: 487083 - DNA, 20 bp, mouse
gagctgtacttcatacttaa

SEQ ID NO: 487084 - DNA, 20 bp, mouse
ggacaggaaattttcaccca

SEQ ID NO: 487085 - DNA, 20 bp, mouse
gttcattgtacagattcatc

SEQ ID NO: 487086 - DNA, 20 bp, mouse
gcaggaggcctcccacagcc

SEQ ID NO: 487087 - DNA, 20 bp, mouse
gcttaaaatgtccaggctgt

SEQ ID NO: 487088 - DNA, 20 bp, mouse
gcagagtagctgagacaggt

SEQ ID NO: 487089 - DNA, 20 bp, mouse
gccagcatcttaaaatgtcc

SEQ ID NO: 487090 - DNA, 20 bp, mouse
gtctcagctactctgtgaac

SEQ ID NO: 487091 - DNA, 20 bp, mouse
gaaaatgtccaggctgtggg

SEQ ID NO: 487092 - DNA, 20 bp, mouse
gtgagaaacctacatagcac

SEQ ID NO: 487093 - DNA, 20 bp, mouse
gagatgcggatatcctgatc

SEQ ID NO: 487094 - DNA, 20 bp, mouse
gcagaagaatctgaagatca

SEQ ID NO: 487095 - DNA, 20 bp, mouse
gatcagtgacttacctgatc

SEQ ID NO: 487096 - DNA, 20 bp, mouse
gcactgtccgatctcggcac

SEQ ID NO: 487097 - DNA, 20 bp, mouse
gcattatccatgatgctact

SEQ ID NO: 487098 - DNA, 20 bp, mouse
gagagtgcctgtgccgagat

SEQ ID NO: 487099 - DNA, 20 bp, mouse
gctctcacactgtccgatct

SEQ ID NO: 487100 - DNA, 20 bp, mouse
gatcatggataatgagaaaa

SEQ ID NO: 487101 - DNA, 20 bp, mouse
gagtgtgagagtggccgtcc

SEQ ID NO: 487102 - DNA, 20 bp, mouse
gtttctaccgagtagcatca

SEQ ID NO: 487103 - DNA, 20 bp, mouse
gctgaacggccgcacccgga

SEQ ID NO: 487104 - DNA, 20 bp, mouse
ggtgctgatgagctacccta

SEQ ID NO: 487105 - DNA, 20 bp, mouse
gatggactgacctggctgaa

SEQ ID NO: 487106 - DNA, 20 bp, mouse
gtcgaatggagtgtctggat

SEQ ID NO: 487107 - DNA, 20 bp, mouse
gctccaatctcagcacgatc

SEQ ID NO: 487108 - DNA, 20 bp, mouse
gaccagtacagggaacacct

SEQ ID NO: 487109 - DNA, 20 bp, mouse
gtggatagggaactatcgaa

SEQ ID NO: 487110 - DNA, 20 bp, mouse
gtgcctgatcgtgctgagat

SEQ ID NO: 487111 - DNA, 20 bp, mouse
gtgggtaggagagtcggtgc

SEQ ID NO: 487112 - DNA, 20 bp, mouse
ggagtcggtgcgggaggtta

SEQ ID NO: 487113 - DNA, 20 bp, mouse
gaactatcgaatggagtgtc

SEQ ID NO: 487114 - DNA, 20 bp, mouse
gaaagatcaaatgttggata

SEQ ID NO: 487115 - DNA, 20 bp, mouse
ggtaggagagtcggtgcggg

SEQ ID NO: 487116 - DNA, 20 bp, mouse
gatcagaggcttctgtttta

SEQ ID NO: 487117 - DNA, 20 bp, mouse
gctgatgaagatacctcacc

SEQ ID NO: 487118 - DNA, 20 bp, mouse
gatgataaggaaataaccaa

SEQ ID NO: 487119 - DNA, 20 bp, mouse
gttcagatatgcagatgata

SEQ ID NO: 487120 - DNA, 20 bp, mouse
ggatgagagcaagtgaatag

SEQ ID NO: 487121 - DNA, 20 bp, mouse
ggagtccaaggtagcatgga

SEQ ID NO: 487122 - DNA, 20 bp, mouse
gccatcaagcacagctttaa

SEQ ID NO: 487123 - DNA, 20 bp, mouse
gacatccctccatgctacct

SEQ ID NO: 487124 - DNA, 20 bp, mouse
gatcagggctcccacaggaa

SEQ ID NO: 487125 - DNA, 20 bp, mouse
gggctcccacaggaagggtt

SEQ ID NO: 487126 - DNA, 20 bp, mouse
gcttatatctacttaacaat

SEQ ID NO: 487127 - DNA, 20 bp, mouse
gatgacatgcatgatatttt

SEQ ID NO: 487128 - DNA, 20 bp, mouse
ggttacacatcatcatattc

SEQ ID NO: 487129 - DNA, 20 bp, mouse
gaggggaaagctgcaactcc

SEQ ID NO: 487130 - DNA, 20 bp, mouse
gcatcatcatattcaggcag

SEQ ID NO: 487131 - DNA, 20 bp, mouse
gcaaagagtacaaaatacct

SEQ ID NO: 487132 - DNA, 20 bp, mouse
gtacaaaatacctaggatac

SEQ ID NO: 487133 - DNA, 20 bp, mouse
gatagcgctcaattgaagag

SEQ ID NO: 487134 - DNA, 20 bp, mouse
gtgtgagataagcatcctta

SEQ ID NO: 487135 - DNA, 20 bp, mouse
gtttgcctgacctgtatcct

SEQ ID NO: 487136 - DNA, 20 bp, mouse
gtcactggtaaaggattacc

SEQ ID NO: 487137 - DNA, 20 bp, mouse
gctctggctgcaatacgatg

SEQ ID NO: 487138 - DNA, 20 bp, mouse
gaggccagtccaagcatatc

SEQ ID NO: 487139 - DNA, 20 bp, mouse
ggcccacagagggaagtttg

SEQ ID NO: 487140 - DNA, 20 bp, mouse
gaatccagatatgcttggac

SEQ ID NO: 487141 - DNA, 20 bp, mouse
gtgtctaatccagatatgct

SEQ ID NO: 487142 - DNA, 20 bp, mouse
ggatgtggcttttgggaaat

SEQ ID NO: 487143 - DNA, 20 bp, mouse
gtttgctttctttgtgggcc

SEQ ID NO: 487144 - DNA, 20 bp, mouse
gaacagcttcctaaatttca

SEQ ID NO: 487145 - DNA, 20 bp, mouse
gatcatctaacaactgactg

SEQ ID NO: 487146 - DNA, 20 bp, mouse
ggcaacagatcactatattc

SEQ ID NO: 487147 - DNA, 20 bp, mouse
gagatcactatattctggca

SEQ ID NO: 487148 - DNA, 20 bp, mouse
gagggaaaagctgtaactgc

SEQ ID NO: 487149 - DNA, 20 bp, mouse
ggactgctaggaatagagat

SEQ ID NO: 487150 - DNA, 20 bp, mouse
ggcgagaactcatcttaaaa

SEQ ID NO: 487151 - DNA, 20 bp, mouse
gggatataagctcaaaatta

SEQ ID NO: 487152 - DNA, 20 bp, mouse
gaattttgcagtcaaactta

SEQ ID NO: 487153 - DNA, 20 bp, mouse
gatatctatgatacaggtca

SEQ ID NO: 487154 - DNA, 20 bp, mouse
gtacacaatggaatacaatc

SEQ ID NO: 487155 - DNA, 20 bp, mouse
gatgcatggtatgtactaac

SEQ ID NO: 487156 - DNA, 20 bp, mouse
ggtgtgtgaccagagtgcgt

SEQ ID NO: 487157 - DNA, 20 bp, mouse
gtgtgcttgcacgcaggatg

SEQ ID NO: 487158 - DNA, 20 bp, mouse
gcacacacgcaggaagaatc

SEQ ID NO: 487159 - DNA, 20 bp, mouse
gtggggtcctcttactcctg

SEQ ID NO: 487160 - DNA, 20 bp, mouse
ggttcccgcggcactgagga

SEQ ID NO: 487161 - DNA, 20 bp, mouse
gcttactcctgtggcatgtc

SEQ ID NO: 487162 - DNA, 20 bp, mouse
gaagaatccggacatgccac

SEQ ID NO: 487163 - DNA, 20 bp, mouse
gcacggagctgagatacgtc

SEQ ID NO: 487164 - DNA, 20 bp, mouse
gaacatggcaccgatgactt

SEQ ID NO: 487165 - DNA, 20 bp, mouse
ggcctgaggcaagccgtgaa

SEQ ID NO: 487166 - DNA, 20 bp, mouse
gtctgtacaatgaatagacc

SEQ ID NO: 487167 - DNA, 20 bp, mouse
gttgaagagctacactgtcc

SEQ ID NO: 487168 - DNA, 20 bp, mouse
gacatttacgcgtaaggaga

SEQ ID NO: 487169 - DNA, 20 bp, mouse
gcagcttacatttacgcgta

SEQ ID NO: 487170 - DNA, 20 bp, mouse
gcctttgacctctttttcca

SEQ ID NO: 487171 - DNA, 20 bp, mouse
gtatttctggatgcttcacc

SEQ ID NO: 487172 - DNA, 20 bp, mouse
gagaaggacatctgggccca

SEQ ID NO: 487173 - DNA, 20 bp, mouse
gtctgggcccatggaaaaag

SEQ ID NO: 487174 - DNA, 20 bp, mouse
ggtgtagacaagcagatgac

SEQ ID NO: 487175 - DNA, 20 bp, mouse
gttgcaatactgtcatgtca

SEQ ID NO: 487176 - DNA, 20 bp, mouse
gagctcccacaggaaggact

SEQ ID NO: 487177 - DNA, 20 bp, mouse
gctcattgtagctttcaggt

SEQ ID NO: 487178 - DNA, 20 bp, mouse
gatgctaaggaaacatccaa

SEQ ID NO: 487179 - DNA, 20 bp, mouse
gtcctgtgggagctctgtgt

SEQ ID NO: 487180 - DNA, 20 bp, mouse
gtcccacacagagctcccac

SEQ ID NO: 487181 - DNA, 20 bp, mouse
gaagatcctgagcctgatgg

SEQ ID NO: 487182 - DNA, 20 bp, mouse
gtgggtccaaggtgaatcag

SEQ ID NO: 487183 - DNA, 20 bp, mouse
gtgagtctaaggtagcaagg

SEQ ID NO: 487184 - DNA, 20 bp, mouse
gccacaggaaggactgggaa

SEQ ID NO: 487185 - DNA, 20 bp, mouse
gaggaatgtgtgtggatgag

SEQ ID NO: 487186 - DNA, 20 bp, mouse
gaccataatcagacagagtt

SEQ ID NO: 487187 - DNA, 20 bp, mouse
ggtctcagtctcttggagct

SEQ ID NO: 487188 - DNA, 20 bp, mouse
ggactaggttctatcagatg

SEQ ID NO: 487189 - DNA, 20 bp, mouse
gagaggtagtctcagtctct

SEQ ID NO: 487190 - DNA, 20 bp, mouse
gatcagatgaggtatcctta

SEQ ID NO: 487191 - DNA, 20 bp, mouse
gacctaactctgtctgatta

SEQ ID NO: 487192 - DNA, 20 bp, mouse
gagtgagggccaggctttgg

SEQ ID NO: 487193 - DNA, 20 bp, mouse
gtgtatagccttggctctcg

SEQ ID NO: 487194 - DNA, 20 bp, mouse
gaacaaaaaatttcaagtga

SEQ ID NO: 487195 - DNA, 20 bp, mouse
gtcaagtgagggccaggctt

SEQ ID NO: 487196 - DNA, 20 bp, mouse
gccacagggaggcaaagtaa

SEQ ID NO: 487197 - DNA, 20 bp, mouse
gtatttcaagatgcttcaac

SEQ ID NO: 487198 - DNA, 20 bp, mouse
ggtagatcagaggcttatgt

SEQ ID NO: 487199 - DNA, 20 bp, mouse
gcttgcaatattgacatgtc

SEQ ID NO: 487200 - DNA, 20 bp, mouse
gtggagtcaaagtagatcag

SEQ ID NO: 487201 - DNA, 20 bp, mouse
gcaaggcttcattcttcact

SEQ ID NO: 487202 - DNA, 20 bp, mouse
gagaactatgtaatactaaa

SEQ ID NO: 487203 - DNA, 20 bp, mouse
ggtgtagacatgcagctgac

SEQ ID NO: 487204 - DNA, 20 bp, mouse
gcatctgggctcatggaaat

SEQ ID NO: 487205 - DNA, 20 bp, mouse
gttgaagagctgcagtgtcc

SEQ ID NO: 487206 - DNA, 20 bp, mouse
gctaactgtagcttacacat

SEQ ID NO: 487207 - DNA, 20 bp, mouse
gtgagaaacccacattgcat

SEQ ID NO: 487208 - DNA, 20 bp, mouse
gtgggcttaaaataaaaata

SEQ ID NO: 487209 - DNA, 20 bp, mouse
gtccgcatctattctctgca

SEQ ID NO: 487210 - DNA, 20 bp, mouse
gatagttaaagcaatttcaa

SEQ ID NO: 487211 - DNA, 20 bp, mouse
gagatgcggatatcctgatc

SEQ ID NO: 487212 - DNA, 20 bp, mouse
ggactgtgtcccaaatggaa

SEQ ID NO: 487213 - DNA, 20 bp, mouse
gtttgggactgtgtcccaaa

SEQ ID NO: 487214 - DNA, 20 bp, mouse
gaagactagcctttccattt

SEQ ID NO: 487215 - DNA, 20 bp, mouse
gatcagtgacttacctgatc

SEQ ID NO: 487216 - DNA, 20 bp, mouse
gccaggagataggtcttctt

SEQ ID NO: 487217 - DNA, 20 bp, mouse
gaaggcacctggatctgtgg

SEQ ID NO: 487218 - DNA, 20 bp, mouse
gaggaccaggaaggttgcag

SEQ ID NO: 487219 - DNA, 20 bp, mouse
gtgtcagctggaagaagtag

SEQ ID NO: 487220 - DNA, 20 bp, mouse
gcttcttcggcttattctga

SEQ ID NO: 487221 - DNA, 20 bp, mouse
gtaagctctttccaggagat

SEQ ID NO: 487222 - DNA, 20 bp, mouse
gtcggggatagagagaatcc

SEQ ID NO: 487223 - DNA, 20 bp, mouse
gtacactgacccccaggacc

SEQ ID NO: 487224 - DNA, 20 bp, mouse
gagtgttatcatcaagatca

SEQ ID NO: 487225 - DNA, 20 bp, mouse
gagttctataagctctttcc

SEQ ID NO: 487226 - DNA, 20 bp, mouse
ggctcttggagtgtgagtaa

SEQ ID NO: 487227 - DNA, 20 bp, mouse
gccccaggcaaggaagactt

SEQ ID NO: 487228 - DNA, 20 bp, mouse
gagctccaagaggaaggcga

SEQ ID NO: 487229 - DNA, 20 bp, mouse
gcaagaggaaggcgagggaa

SEQ ID NO: 487230 - DNA, 20 bp, mouse
ggatgaaggggagtcaggtg

SEQ ID NO: 487231 - DNA, 20 bp, mouse
gaagaagagaacaccctact

SEQ ID NO: 487232 - DNA, 20 bp, mouse
ggttgtggtaagaatagttc

SEQ ID NO: 487233 - DNA, 20 bp, mouse
gttacaagttgtcttagagg

SEQ ID NO: 487234 - DNA, 20 bp, mouse
gtatccaggaggttcacccc

SEQ ID NO: 487235 - DNA, 20 bp, mouse
gaggcttgcttcaacagttg

SEQ ID NO: 487236 - DNA, 20 bp, mouse
ggtggtgaaaagtagattag

SEQ ID NO: 487237 - DNA, 20 bp, mouse
gaatcccagatttccctacc

SEQ ID NO: 487238 - DNA, 20 bp, mouse
gcagctgcaggagagtgggt

SEQ ID NO: 487239 - DNA, 20 bp, mouse
gctgacatgctgggaggtga

SEQ ID NO: 487240 - DNA, 20 bp, mouse
gctgatagataaacccaact

SEQ ID NO: 487241 - DNA, 20 bp, mouse
gcagccagctgcaggagagt

SEQ ID NO: 487242 - DNA, 20 bp, mouse
gggctgcacagtgcacagtg

SEQ ID NO: 487243 - DNA, 20 bp, mouse
gaggttctgcagaacagaga

SEQ ID NO: 487244 - DNA, 20 bp, mouse
gcagcctccttgaatagtgg

SEQ ID NO: 487245 - DNA, 20 bp, mouse
ggcactgtgcagccagctgc

SEQ ID NO: 487246 - DNA, 20 bp, mouse
gcacaacagaattgtgagaa

SEQ ID NO: 487247 - DNA, 20 bp, mouse
gaatgtcctaggaggagcaa

SEQ ID NO: 487248 - DNA, 20 bp, mouse
gtaggaacccggcaggagct

SEQ ID NO: 487249 - DNA, 20 bp, mouse
gcaggagctgggcagcggtg

SEQ ID NO: 487250 - DNA, 20 bp, mouse
gaccagctcctggatgtcct

SEQ ID NO: 487251 - DNA, 20 bp, mouse
gagctgttggactaggaacc

SEQ ID NO: 487252 - DNA, 20 bp, mouse
gctggcctcctaggacatcc

SEQ ID NO: 487253 - DNA, 20 bp, mouse
gctctaacctggaagatgac

SEQ ID NO: 487254 - DNA, 20 bp, mouse
ggttggactaggaacccggc

SEQ ID NO: 487255 - DNA, 20 bp, mouse
gagctgccgttgctcctcct

SEQ ID NO: 487256 - DNA, 20 bp, mouse
gttcaggttccccacacact

SEQ ID NO: 487257 - DNA, 20 bp, mouse
ggagactagtgcctagtgtg

SEQ ID NO: 487258 - DNA, 20 bp, mouse
gtaggagcgggacaggtgtg

SEQ ID NO: 487259 - DNA, 20 bp, mouse
gcccaacagcacctctgatc

SEQ ID NO: 487260 - DNA, 20 bp, mouse
gaacaacagaattgtaaggg

SEQ ID NO: 487261 - DNA, 20 bp, mouse
gctgtcatctgccagatcag

SEQ ID NO: 487262 - DNA, 20 bp, mouse
gtatcaacaacagaattgta

SEQ ID NO: 487263 - DNA, 20 bp, mouse
gaaatgggtaggagcgggac

SEQ ID NO: 487264 - DNA, 20 bp, mouse
ggccagatcagaggtgctgt

SEQ ID NO: 487265 - DNA, 20 bp, mouse
gctttgtatactataccggg

SEQ ID NO: 487266 - DNA, 20 bp, mouse
gtgagggtatataattctct

SEQ ID NO: 487267 - DNA, 20 bp, mouse
gttccttttcatgcatatag

SEQ ID NO: 487268 - DNA, 20 bp, mouse
gcctcaaaatataaaactca

SEQ ID NO: 487269 - DNA, 20 bp, mouse
gatatgtggaatgttatcta

SEQ ID NO: 487270 - DNA, 20 bp, mouse
gacaagaatgagtgtgtttc

SEQ ID NO: 487271 - DNA, 20 bp, mouse
gatgttttaatctctatatg

SEQ ID NO: 487272 - DNA, 20 bp, mouse
gtgctcaaagaacatattaa

SEQ ID NO: 487273 - DNA, 20 bp, mouse
gttttttttttaaagaaatg

SEQ ID NO: 487274 - DNA, 20 bp, mouse
gaaccatccataagaagatc

SEQ ID NO: 487275 - DNA, 20 bp, mouse
gtttttaaagaaatgtggaa

SEQ ID NO: 487276 - DNA, 20 bp, mouse
ggttgggctggaaataaggt

SEQ ID NO: 487277 - DNA, 20 bp, mouse
ggagatacatccgaaatgct

SEQ ID NO: 487278 - DNA, 20 bp, mouse
gagctcaggctcatggagca

SEQ ID NO: 487279 - DNA, 20 bp, mouse
ggggaactgagtaggcatcc

SEQ ID NO: 487280 - DNA, 20 bp, mouse
gtaggagcagctcaggctca

SEQ ID NO: 487281 - DNA, 20 bp, mouse
gagctgttgggctggaaata

SEQ ID NO: 487282 - DNA, 20 bp, mouse
gtggatatcttaccatcatc

SEQ ID NO: 487283 - DNA, 20 bp, mouse
gaactcaaacttcctgatga

SEQ ID NO: 487284 - DNA, 20 bp, mouse
gtactcagttccctgaagaa

SEQ ID NO: 487285 - DNA, 20 bp, mouse
gtttcatttccctttcttca

SEQ ID NO: 487286 - DNA, 20 bp, mouse
gcagccaagatacatggaga

SEQ ID NO: 487287 - DNA, 20 bp, mouse
gttgggaaatgggtaggata

SEQ ID NO: 487288 - DNA, 20 bp, mouse
gatggagaaggctggaatcg

SEQ ID NO: 487289 - DNA, 20 bp, mouse
ggaaatgggtaggatagggc

SEQ ID NO: 487290 - DNA, 20 bp, mouse
gatgaatgaatctgaaatcg

SEQ ID NO: 487291 - DNA, 20 bp, mouse
gcaagatacatggagaaggc

SEQ ID NO: 487292 - DNA, 20 bp, mouse
ggtaggatagggcaggcatg

SEQ ID NO: 487293 - DNA, 20 bp, mouse
ggggagggttgtctttgcta

SEQ ID NO: 487294 - DNA, 20 bp, mouse
gatcctgtaaattgagttta

SEQ ID NO: 487295 - DNA, 20 bp, mouse
ggtcagaggagctcttgggt

SEQ ID NO: 487296 - DNA, 20 bp, mouse
gtggggaacaggcaggaact

SEQ ID NO: 487297 - DNA, 20 bp, mouse
gcaggaactgggcaggcgtg

SEQ ID NO: 487298 - DNA, 20 bp, mouse
ggctgctcaatgtcctagga

SEQ ID NO: 487299 - DNA, 20 bp, mouse
gagctgcagttgcccctcct

SEQ ID NO: 487300 - DNA, 20 bp, mouse
gaggggcaactgcagcttaa

SEQ ID NO: 487301 - DNA, 20 bp, mouse
ggaacaggcaggaactgggc

SEQ ID NO: 487302 - DNA, 20 bp, mouse
gaaacactgaattgtgagag

SEQ ID NO: 487303 - DNA, 20 bp, mouse
gcactgaattgtgagagggg

SEQ ID NO: 487304 - DNA, 20 bp, mouse
gcagaggagctgttggactg

SEQ ID NO: 487305 - DNA, 20 bp, mouse
gcagaggagctgttggactg

SEQ ID NO: 487306 - DNA, 20 bp, mouse
gcagtaccatggctatcccg

SEQ ID NO: 487307 - DNA, 20 bp, mouse
gaccagccacgggatagcca

SEQ ID NO: 487308 - DNA, 20 bp, mouse
gttctcaaggaatatcttca

SEQ ID NO: 487309 - DNA, 20 bp, mouse
gctggtgagtctgctcttgg

SEQ ID NO: 487310 - DNA, 20 bp, mouse
gaccatggctatcccgtggc

SEQ ID NO: 487311 - DNA, 20 bp, mouse
gtcccagataaaaggtagac

SEQ ID NO: 487312 - DNA, 20 bp, mouse
gttatctgggagtcttcata

SEQ ID NO: 487313 - DNA, 20 bp, mouse
ggcctgtctaccttttatct

SEQ ID NO: 487314 - DNA, 20 bp, mouse
gatagttgctcatactggta

SEQ ID NO: 487315 - DNA, 20 bp, mouse
gctggtagggaatctagtta

SEQ ID NO: 487316 - DNA, 20 bp, mouse
gcctaggaatggctgtcctg

SEQ ID NO: 487317 - DNA, 20 bp, mouse
ggttcagaggtaaggtcctc

SEQ ID NO: 487318 - DNA, 20 bp, mouse
ggctctttccacaagttcag

SEQ ID NO: 487319 - DNA, 20 bp, mouse
gctctggagcatctggatca

SEQ ID NO: 487320 - DNA, 20 bp, mouse
gttccacaagttcagaggta

SEQ ID NO: 487321 - DNA, 20 bp, mouse
ggaacttgtggaaagagcac

SEQ ID NO: 487322 - DNA, 20 bp, mouse
gaattcatggtgtggcccaa

SEQ ID NO: 487323 - DNA, 20 bp, mouse
ggaagcatccagtcaagcta

SEQ ID NO: 487324 - DNA, 20 bp, mouse
gttggctggtgctgatagga

SEQ ID NO: 487325 - DNA, 20 bp, mouse
gcagccattcctagggcctc

SEQ ID NO: 487326 - DNA, 20 bp, mouse
ggtgagtgaaggactgctag

SEQ ID NO: 487327 - DNA, 20 bp, mouse
gcacaagtactgggagactc

SEQ ID NO: 487328 - DNA, 20 bp, mouse
gtatgcgtgtggagcactaa

SEQ ID NO: 487329 - DNA, 20 bp, mouse
gaaggactgctagtggcaga

SEQ ID NO: 487330 - DNA, 20 bp, mouse
gggtttgaccggaagacctt

SEQ ID NO: 487331 - DNA, 20 bp, mouse
gggagcctcatcagagaaac

SEQ ID NO: 487332 - DNA, 20 bp, mouse
gttgggaagaagagtaatgg

SEQ ID NO: 487333 - DNA, 20 bp, mouse
ggctctgtaagtaggcgatg

SEQ ID NO: 487334 - DNA, 20 bp, mouse
gagtgagctgtgggtttgac

SEQ ID NO: 487335 - DNA, 20 bp, mouse
gaatgaatagcacaagtact

SEQ ID NO: 487336 - DNA, 20 bp, mouse
gcacaacaaaattgggagag

SEQ ID NO: 487337 - DNA, 20 bp, mouse
gaagatatccacaacaaaat

SEQ ID NO: 487338 - DNA, 20 bp, mouse
gcactgaattgtgagaggga

SEQ ID NO: 487339 - DNA, 20 bp, mouse
ggcaaacactgaattgtgag

SEQ ID NO: 487340 - DNA, 20 bp, mouse
gaacaaaattgggagagtgg

SEQ ID NO: 487341 - DNA, 20 bp, mouse
gcagaggagctgttggactg

SEQ ID NO: 487342 - DNA, 20 bp, mouse
gaacgggcaggagctgggca

SEQ ID NO: 487343 - DNA, 20 bp, mouse
gagctgttggactggggaac

SEQ ID NO: 487344 - DNA, 20 bp, mouse
ggttggactggggaacgggc

SEQ ID NO: 487345 - DNA, 20 bp, mouse
gtgggcaggggcgtggagca

SEQ ID NO: 487346 - DNA, 20 bp, mouse
gtgctcctcaccaagaatct

SEQ ID NO: 487347 - DNA, 20 bp, mouse
gtctctggaaaacactgcac

SEQ ID NO: 487348 - DNA, 20 bp, mouse
gtgttcttctcccagattct

SEQ ID NO: 487349 - DNA, 20 bp, mouse
ggtaattcccatagaactgt

SEQ ID NO: 487350 - DNA, 20 bp, mouse
gttaaaaaagaaatgaagac

SEQ ID NO: 487351 - DNA, 20 bp, mouse
gaaaagaatgagtgcttctc

SEQ ID NO: 487352 - DNA, 20 bp, mouse
gtgtatgtgtaatattacct

SEQ ID NO: 487353 - DNA, 20 bp, mouse
gtattagtatggaggaagta

SEQ ID NO: 487354 - DNA, 20 bp, mouse
gggtgtcaaagagcatctat

SEQ ID NO: 487355 - DNA, 20 bp, mouse
gtgatgaaaatataacaatt

SEQ ID NO: 487356 - DNA, 20 bp, mouse
ggaacctgaaaacttcctta

SEQ ID NO: 487357 - DNA, 20 bp, mouse
ggacttcctgaccacgaggc

SEQ ID NO: 487358 - DNA, 20 bp, mouse
gctttatatactatactggg

SEQ ID NO: 487359 - DNA, 20 bp, mouse
gtagtatataaagcccagag

SEQ ID NO: 487360 - DNA, 20 bp, mouse
ggggctttatatactatact

SEQ ID NO: 487361 - DNA, 20 bp, mouse
gtagatccttggccctctct

SEQ ID NO: 487362 - DNA, 20 bp, mouse
ggcacagcaactgcacctta

SEQ ID NO: 487363 - DNA, 20 bp, mouse
gtggatatcttactattatc

SEQ ID NO: 487364 - DNA, 20 bp, mouse
gatgtatttcgcctgcctcg

SEQ ID NO: 487365 - DNA, 20 bp, mouse
ggtcagaggagctcttgggt

SEQ ID NO: 487366 - DNA, 20 bp, mouse
gtatgtagaatgttttctaa

SEQ ID NO: 487367 - DNA, 20 bp, mouse
gcctgtctccgtgggcgcag

SEQ ID NO: 487368 - DNA, 20 bp, mouse
ggacaggaacgacatggaca

SEQ ID NO: 487369 - DNA, 20 bp, mouse
gtggacacggataccaagtt

SEQ ID NO: 487370 - DNA, 20 bp, mouse
gacctcatctgcatcaaaaa

SEQ ID NO: 487371 - DNA, 20 bp, mouse
gagtaagagaagctgttgta

SEQ ID NO: 487372 - DNA, 20 bp, mouse
gtacaactagcttctactta

SEQ ID NO: 487373 - DNA, 20 bp, mouse
gatgtcgttcctgtctccgt

SEQ ID NO: 487374 - DNA, 20 bp, mouse
gctgctgtcctctgcgccca

SEQ ID NO: 487375 - DNA, 20 bp, mouse
gtataagaaaagctgcaaga

SEQ ID NO: 487376 - DNA, 20 bp, mouse
gcggcgctaggcagaaagaa

SEQ ID NO: 487377 - DNA, 20 bp, mouse
gaatgtcctaggaggagcaa

SEQ ID NO: 487378 - DNA, 20 bp, mouse
gtaggaacccggcaggagct

SEQ ID NO: 487379 - DNA, 20 bp, mouse
gcaggagctgggcagcggtg

SEQ ID NO: 487380 - DNA, 20 bp, mouse
gaccagctcctggatgtcct

SEQ ID NO: 487381 - DNA, 20 bp, mouse
gagctgttggactaggaacc

SEQ ID NO: 487382 - DNA, 20 bp, mouse
gctctaacctggaagatgac

SEQ ID NO: 487383 - DNA, 20 bp, mouse
gctggcctcctaggacatcc

SEQ ID NO: 487384 - DNA, 20 bp, mouse
ggttggactaggaacccggc

SEQ ID NO: 487385 - DNA, 20 bp, mouse
gagctgccgttgctcctcct

SEQ ID NO: 487386 - DNA, 20 bp, mouse
ggccccaagcaccgacttaa

SEQ ID NO: 487387 - DNA, 20 bp, mouse
gtggagctggtgtgtggatc

SEQ ID NO: 487388 - DNA, 20 bp, mouse
gagtctggaagcttacctaa

SEQ ID NO: 487389 - DNA, 20 bp, mouse
gggtgttctgagactccctt

SEQ ID NO: 487390 - DNA, 20 bp, mouse
ggcctgctccacccagatgt

SEQ ID NO: 487391 - DNA, 20 bp, mouse
gaagcttccagactgctaca

SEQ ID NO: 487392 - DNA, 20 bp, mouse
ggaagtcccaaggtgtgaag

SEQ ID NO: 487393 - DNA, 20 bp, mouse
gtactcaccatgtagcagtc

SEQ ID NO: 487394 - DNA, 20 bp, mouse
gagaaggggaagtgcaaact

SEQ ID NO: 487395 - DNA, 20 bp, mouse
gagggtcattgcccacatct

SEQ ID NO: 487396 - DNA, 20 bp, mouse
ggacctagaggggaaggagc

SEQ ID NO: 487397 - DNA, 20 bp, mouse
gggtcttcagaagacctaga

SEQ ID NO: 487398 - DNA, 20 bp, mouse
ggggtcacctcacttaggac

SEQ ID NO: 487399 - DNA, 20 bp, mouse
ggccatccctgtcctaagtg

SEQ ID NO: 487400 - DNA, 20 bp, mouse
ggacactcttgatacaaatg

SEQ ID NO: 487401 - DNA, 20 bp, mouse
ggtcattacaaaatgtatct

SEQ ID NO: 487402 - DNA, 20 bp, mouse
gttacaaaatgtatctagga

SEQ ID NO: 487403 - DNA, 20 bp, mouse
gctgcactagacaggcttgc

SEQ ID NO: 487404 - DNA, 20 bp, mouse
gcatcacagccagaaccatc

SEQ ID NO: 487405 - DNA, 20 bp, mouse
gctgctgggtcacctcactt

SEQ ID NO: 487406 - DNA, 20 bp, mouse
gcagaggatttaagatccat

SEQ ID NO: 487407 - DNA, 20 bp, mouse
gtggagcttcagcaaaccag

SEQ ID NO: 487408 - DNA, 20 bp, mouse
gcagaaaatgtgcaaaacca

SEQ ID NO: 487409 - DNA, 20 bp, mouse
gtatctcagcaacataaagt

SEQ ID NO: 487410 - DNA, 20 bp, mouse
gttgaatattggaagtacac

SEQ ID NO: 487411 - DNA, 20 bp, mouse
gctcctcggtgtttccaact

SEQ ID NO: 487412 - DNA, 20 bp, mouse
gtttacaacttttacaacaa

SEQ ID NO: 487413 - DNA, 20 bp, mouse
gtaaagtgagtacttatccc

SEQ ID NO: 487414 - DNA, 20 bp, mouse
gcataaagtcggtatacttc

SEQ ID NO: 487415 - DNA, 20 bp, mouse
gtcattcaatttgtagattt

SEQ ID NO: 487416 - DNA, 20 bp, mouse
gctggggtcagggctggaca

SEQ ID NO: 487417 - DNA, 20 bp, mouse
ggccctgaccccaggcgggg

SEQ ID NO: 487418 - DNA, 20 bp, mouse
gtcccccccgcctggggtca

SEQ ID NO: 487419 - DNA, 20 bp, mouse
gaccccttcccccccgcctg

SEQ ID NO: 487420 - DNA, 20 bp, mouse
gctccttgcaagacgagttg

SEQ ID NO: 487421 - DNA, 20 bp, mouse
gaccccaggcgggggggaag

SEQ ID NO: 487422 - DNA, 20 bp, mouse
gagacaagtgagtgagcagg

SEQ ID NO: 487423 - DNA, 20 bp, mouse
gccagccctgaccccaggcg

SEQ ID NO: 487424 - DNA, 20 bp, mouse
ggcacagcaaccgataccaa

SEQ ID NO: 487425 - DNA, 20 bp, mouse
gagcaggtggctagttttca

SEQ ID NO: 487426 - DNA, 20 bp, mouse
gctgagtgagcatgatggag

SEQ ID NO: 487427 - DNA, 20 bp, mouse
gaaggaaggaagaaacctct

SEQ ID NO: 487428 - DNA, 20 bp, mouse
gctaggctgagtgagcatga

SEQ ID NO: 487429 - DNA, 20 bp, mouse
gaagcaacagtaacagcggg

SEQ ID NO: 487430 - DNA, 20 bp, mouse
ggcaaggctggagaacaata

SEQ ID NO: 487431 - DNA, 20 bp, mouse
gtcagaagcaacagtaacag

SEQ ID NO: 487432 - DNA, 20 bp, mouse
gtacagcagctagtgctgga

SEQ ID NO: 487433 - DNA, 20 bp, mouse
gatagggccacacttcagag

SEQ ID NO: 487434 - DNA, 20 bp, mouse
gagtaacagcgggaggctgc

SEQ ID NO: 487435 - DNA, 20 bp, mouse
gggactgagggcagagttag

SEQ ID NO: 487436 - DNA, 20 bp, mouse
gaagtcatcttcaggatctt

SEQ ID NO: 487437 - DNA, 20 bp, mouse
gggtattacacaagcaccgc

SEQ ID NO: 487438 - DNA, 20 bp, mouse
gctctgctcaagccttcagt

SEQ ID NO: 487439 - DNA, 20 bp, mouse
gcatttataaatgttcttgt

SEQ ID NO: 487440 - DNA, 20 bp, mouse
ggagattcggaccacacacc

SEQ ID NO: 487441 - DNA, 20 bp, mouse
ggcaattttgaaacaacttc

SEQ ID NO: 487442 - DNA, 20 bp, mouse
gatgacttggattggagcat

SEQ ID NO: 487443 - DNA, 20 bp, mouse
gtaactactgaaaggttaaa

SEQ ID NO: 487444 - DNA, 20 bp, mouse
ggtagcataattcctactga

SEQ ID NO: 487445 - DNA, 20 bp, mouse
gtttgttactaaagagtcat

SEQ ID NO: 487446 - DNA, 20 bp, mouse
gggcgtacaccgggtcccag

SEQ ID NO: 487447 - DNA, 20 bp, mouse
gacaccgggtcccagaggaa

SEQ ID NO: 487448 - DNA, 20 bp, mouse
ggtgtctggtcccttcctct

SEQ ID NO: 487449 - DNA, 20 bp, mouse
gagccagctcagttcacccg

SEQ ID NO: 487450 - DNA, 20 bp, mouse
gtgaactgagctggctgcgg

SEQ ID NO: 487451 - DNA, 20 bp, mouse
gactgtgtgagaaccctgcg

SEQ ID NO: 487452 - DNA, 20 bp, mouse
ggactcggcccagaaccgag

SEQ ID NO: 487453 - DNA, 20 bp, mouse
gcagggttctcacacagtcc

SEQ ID NO: 487454 - DNA, 20 bp, mouse
gcgccccgggtgaactgagc

SEQ ID NO: 487455 - DNA, 20 bp, mouse
gaagagcgcggccaggacgc

SEQ ID NO: 487456 - DNA, 20 bp, mouse
ggtctggcagatgtctctcg

SEQ ID NO: 487457 - DNA, 20 bp, mouse
gactcccgctaggacagaga

SEQ ID NO: 487458 - DNA, 20 bp, mouse
gcgggtctcctccttcagca

SEQ ID NO: 487459 - DNA, 20 bp, mouse
ggaggcctgtttccttcgtc

SEQ ID NO: 487460 - DNA, 20 bp, mouse
ggtactaacatcatggccag

SEQ ID NO: 487461 - DNA, 20 bp, mouse
ggcctcagccctgctgaagg

SEQ ID NO: 487462 - DNA, 20 bp, mouse
gagagacatctgccagacga

SEQ ID NO: 487463 - DNA, 20 bp, mouse
gtcagacagtgactcccgct

SEQ ID NO: 487464 - DNA, 20 bp, mouse
gaaggaggagacccgagtga

SEQ ID NO: 487465 - DNA, 20 bp, mouse
ggtgccacctctgagctgac

SEQ ID NO: 487466 - DNA, 20 bp, mouse
gcccagtgctcaaccttgaa

SEQ ID NO: 487467 - DNA, 20 bp, mouse
gtggctgtatgtctaaagaa

SEQ ID NO: 487468 - DNA, 20 bp, mouse
gtaaataagtcatcatgatt

SEQ ID NO: 487469 - DNA, 20 bp, mouse
ggcctttcaaggttgagcac

SEQ ID NO: 487470 - DNA, 20 bp, mouse
gttaatgctagacactggga

SEQ ID NO: 487471 - DNA, 20 bp, mouse
gagggtggtggcagtggtaa

SEQ ID NO: 487472 - DNA, 20 bp, mouse
gaaagctggagggcggtcca

SEQ ID NO: 487473 - DNA, 20 bp, mouse
gtcaagactctactagagcc

SEQ ID NO: 487474 - DNA, 20 bp, mouse
gatactcacaaagatatctt

SEQ ID NO: 487475 - DNA, 20 bp, mouse
gttactctttggcagggtgg

SEQ ID NO: 487476 - DNA, 20 bp, mouse
gcggaagatgagaagaactt

SEQ ID NO: 487477 - DNA, 20 bp, mouse
gatgagaagaacttgggcaa

SEQ ID NO: 487478 - DNA, 20 bp, mouse
gataggccatcatcatgagc

SEQ ID NO: 487479 - DNA, 20 bp, mouse
gatgttcctgctcatgatga

SEQ ID NO: 487480 - DNA, 20 bp, mouse
gcacaaaggagagggagctg

SEQ ID NO: 487481 - DNA, 20 bp, mouse
gcacccaaattgctccccta

SEQ ID NO: 487482 - DNA, 20 bp, mouse
gagccataggggagcaattt

SEQ ID NO: 487483 - DNA, 20 bp, mouse
gttgtgtatgtcagccatag

SEQ ID NO: 487484 - DNA, 20 bp, mouse
gaggtgtgtacagtccttgt

SEQ ID NO: 487485 - DNA, 20 bp, mouse
gtaggaatggcatggatggg

SEQ ID NO: 487486 - DNA, 20 bp, mouse
gtctaattcacgagaaggtg

SEQ ID NO: 487487 - DNA, 20 bp, mouse
gaggccacttatggaccccg

SEQ ID NO: 487488 - DNA, 20 bp, mouse
gctcgcatttccaagtccat

SEQ ID NO: 487489 - DNA, 20 bp, mouse
ggctgcaaagctcacaccag

SEQ ID NO: 487490 - DNA, 20 bp, mouse
gtacgcggaactacagacta

SEQ ID NO: 487491 - DNA, 20 bp, mouse
gttatttctaattcacgaga

SEQ ID NO: 487492 - DNA, 20 bp, mouse
gtggttccacagagttgtct

SEQ ID NO: 487493 - DNA, 20 bp, mouse
gacagacccagacaactctg

SEQ ID NO: 487494 - DNA, 20 bp, mouse
gtctgtactagactttgggt

SEQ ID NO: 487495 - DNA, 20 bp, mouse
ggggaagtcatcatgagcca

SEQ ID NO: 487496 - DNA, 20 bp, mouse
ggctagacacctaggcaggg

SEQ ID NO: 487497 - DNA, 20 bp, mouse
gctgaactgcggaccagggc

SEQ ID NO: 487498 - DNA, 20 bp, mouse
gaggcacactgctcctgcaa

SEQ ID NO: 487499 - DNA, 20 bp, mouse
ggctcctgcaaagggggtga

SEQ ID NO: 487500 - DNA, 20 bp, mouse
gtgcaactgaactgcggacc

SEQ ID NO: 487501 - DNA, 20 bp, mouse
gttgggaggggacatgtctt

SEQ ID NO: 487502 - DNA, 20 bp, mouse
gaccctgcagtggcttctct

SEQ ID NO: 487503 - DNA, 20 bp, mouse
gggagcagtgtgcctcctgc

SEQ ID NO: 487504 - DNA, 20 bp, mouse
gcacactgctcctgcaaagg

SEQ ID NO: 487505 - DNA, 20 bp, mouse
ggttcagttgcatctctgag

SEQ ID NO: 487506 - DNA, 20 bp, mouse
gggttaagtttatgactcat

SEQ ID NO: 487507 - DNA, 20 bp, mouse
gtgcttcagacaggtattgt

SEQ ID NO: 487508 - DNA, 20 bp, mouse
gggacacaaaaggaattata

SEQ ID NO: 487509 - DNA, 20 bp, mouse
ggcttggtcagatatctatg

SEQ ID NO: 487510 - DNA, 20 bp, mouse
gtggtcagatatctatgtgg

SEQ ID NO: 487511 - DNA, 20 bp, mouse
gaattatatggaaaattgct

SEQ ID NO: 487512 - DNA, 20 bp, mouse
gacctgtctgaagcagagca

SEQ ID NO: 487513 - DNA, 20 bp, mouse
gctttgtgattttacaatgt

SEQ ID NO: 487514 - DNA, 20 bp, mouse
ggatgagtgatcagtgttcg

SEQ ID NO: 487515 - DNA, 20 bp, mouse
gcaagcatttgtacttttgg

SEQ ID NO: 487516 - DNA, 20 bp, mouse
gggcaaagctgaacagtcat

SEQ ID NO: 487517 - DNA, 20 bp, mouse
gggtcctacaatacagaaca

SEQ ID NO: 487518 - DNA, 20 bp, mouse
gcttccctcggggacgactt

SEQ ID NO: 487519 - DNA, 20 bp, mouse
gggaccaaagtcgtccccga

SEQ ID NO: 487520 - DNA, 20 bp, mouse
gaagatggactcttccctcg

SEQ ID NO: 487521 - DNA, 20 bp, mouse
gcagcaggtaatgtctccgt

SEQ ID NO: 487522 - DNA, 20 bp, mouse
gtggccctgttctgtattgt

SEQ ID NO: 487523 - DNA, 20 bp, mouse
gctccaccgagatgagcaga

SEQ ID NO: 487524 - DNA, 20 bp, mouse
gtgccatctgctcatctcgg

SEQ ID NO: 487525 - DNA, 20 bp, mouse
ggcccattaccctgacagat

SEQ ID NO: 487526 - DNA, 20 bp, mouse
ggttccttacctccattgta

SEQ ID NO: 487527 - DNA, 20 bp, mouse
gggtggagggactaaggaat

SEQ ID NO: 487528 - DNA, 20 bp, mouse
gtggagatatcccactgaac

SEQ ID NO: 487529 - DNA, 20 bp, mouse
gaactctttccctacaatgg

SEQ ID NO: 487530 - DNA, 20 bp, mouse
ggagttgttgtagtttccct

SEQ ID NO: 487531 - DNA, 20 bp, mouse
gttgaactctttccctacaa

SEQ ID NO: 487532 - DNA, 20 bp, mouse
ggttcaatttcatttggtct

SEQ ID NO: 487533 - DNA, 20 bp, mouse
gcaatgccttcactcttgaa

SEQ ID NO: 487534 - DNA, 20 bp, mouse
ggcattcttggtcctttact

SEQ ID NO: 487535 - DNA, 20 bp, mouse
gcaacagagcataagctttt

SEQ ID NO: 487536 - DNA, 20 bp, mouse
gtagaaaactgcggttctca

SEQ ID NO: 487537 - DNA, 20 bp, mouse
gtacagaaaatagaaaactg

SEQ ID NO: 487538 - DNA, 20 bp, mouse
ggcagctggactgtaagcag

SEQ ID NO: 487539 - DNA, 20 bp, mouse
gggagagactagaaccacaa

SEQ ID NO: 487540 - DNA, 20 bp, mouse
gtgttctgagtgcctctgct

SEQ ID NO: 487541 - DNA, 20 bp, mouse
gtgaatctgagcctgaaaga

SEQ ID NO: 487542 - DNA, 20 bp, mouse
gagcagcggccagacagata

SEQ ID NO: 487543 - DNA, 20 bp, mouse
ggaggccaccgccaggtaca

SEQ ID NO: 487544 - DNA, 20 bp, mouse
ggattcagacaggaacttac

SEQ ID NO: 487545 - DNA, 20 bp, mouse
gttcaggctcagattcagac

SEQ ID NO: 487546 - DNA, 20 bp, mouse
gagagagcacagtcctacac

SEQ ID NO: 487547 - DNA, 20 bp, mouse
gtcgatcttctggccggtgt

SEQ ID NO: 487548 - DNA, 20 bp, mouse
ggggcacacactccttccac

SEQ ID NO: 487549 - DNA, 20 bp, mouse
gagcaggagggaggttgtct

SEQ ID NO: 487550 - DNA, 20 bp, mouse
gacagccaggctctccaggt

SEQ ID NO: 487551 - DNA, 20 bp, mouse
gtggctgtggaaaaccccaa

SEQ ID NO: 487552 - DNA, 20 bp, mouse
gggaagtagcagtactcaca

SEQ ID NO: 487553 - DNA, 20 bp, mouse
gtgagtttcgatcttctggc

SEQ ID NO: 487554 - DNA, 20 bp, mouse
gatctggggactctgattag

SEQ ID NO: 487555 - DNA, 20 bp, mouse
gtcttctctcaccaccccag

SEQ ID NO: 487556 - DNA, 20 bp, mouse
ggcctctgctgggtgctctg

SEQ ID NO: 487557 - DNA, 20 bp, mouse
gtgaatctgagccggaaaga

SEQ ID NO: 487558 - DNA, 20 bp, mouse
ggaggccaccgccaggttca

SEQ ID NO: 487559 - DNA, 20 bp, mouse
ggcacccagcagaggcactc

SEQ ID NO: 487560 - DNA, 20 bp, mouse
gagagaaactgcggttctca

SEQ ID NO: 487561 - DNA, 20 bp, mouse
gacagaaaatagagaaactg

SEQ ID NO: 487562 - DNA, 20 bp, mouse
gcggaaagaaggtttctctg

SEQ ID NO: 487563 - DNA, 20 bp, mouse
gtgtcctgagtgcctctgct

SEQ ID NO: 487564 - DNA, 20 bp, mouse
gggagagactagaaccacaa

SEQ ID NO: 487565 - DNA, 20 bp, mouse
gagcagcagccagacagata

SEQ ID NO: 487566 - DNA, 20 bp, mouse
gaacagccatgaaaattagt

SEQ ID NO: 487567 - DNA, 20 bp, mouse
gtcagattctggcaaaggtt

SEQ ID NO: 487568 - DNA, 20 bp, mouse
ggcttgaggtttgcaggtac

SEQ ID NO: 487569 - DNA, 20 bp, mouse
gaaagaagaaagaagggact

SEQ ID NO: 487570 - DNA, 20 bp, mouse
gaaagaagggactgggatac

SEQ ID NO: 487571 - DNA, 20 bp, mouse
gggaacgtaaagaagaaaga

SEQ ID NO: 487572 - DNA, 20 bp, mouse
gtttactgcttgaggtttgc

SEQ ID NO: 487573 - DNA, 20 bp, mouse
gttctacctactaattttca

SEQ ID NO: 487574 - DNA, 20 bp, mouse
ggtttgggagacgtggactg

SEQ ID NO: 487575 - DNA, 20 bp, mouse
gtttggtgtggagagtggtt

SEQ ID NO: 487576 - DNA, 20 bp, mouse
ggttaaggcagcttcttcaa

SEQ ID NO: 487577 - DNA, 20 bp, mouse
gatcagcgaagatgaagaga

SEQ ID NO: 487578 - DNA, 20 bp, mouse
gaagagatggcaagtatgtc

SEQ ID NO: 487579 - DNA, 20 bp, mouse
gttctcatgacaatactgga

SEQ ID NO: 487580 - DNA, 20 bp, mouse
gcatctcgtcacccagacta

SEQ ID NO: 487581 - DNA, 20 bp, mouse
gagcagaggtggagtgccac

SEQ ID NO: 487582 - DNA, 20 bp, mouse
gtcttggccaaggaacattt

SEQ ID NO: 487583 - DNA, 20 bp, mouse
gtcttcgctgataggtcagt

SEQ ID NO: 487584 - DNA, 20 bp, mouse
gtacatccccaaatgttcct

SEQ ID NO: 487585 - DNA, 20 bp, mouse
gaatttcaggttggacaagg

SEQ ID NO: 487586 - DNA, 20 bp, mouse
gaacagccatgaaaattagt

SEQ ID NO: 487587 - DNA, 20 bp, mouse
gtcagattctggcaaaggtt

SEQ ID NO: 487588 - DNA, 20 bp, mouse
ggcttgaggtttgcaggtac

SEQ ID NO: 487589 - DNA, 20 bp, mouse
gaaagaagaaagaagggact

SEQ ID NO: 487590 - DNA, 20 bp, mouse
gaaagaagggactgggatac

SEQ ID NO: 487591 - DNA, 20 bp, mouse
gggaacgtaaagaagaaaga

SEQ ID NO: 487592 - DNA, 20 bp, mouse
gtttactgcttgaggtttgc

SEQ ID NO: 487593 - DNA, 20 bp, mouse
gttctacctactaattttca

SEQ ID NO: 487594 - DNA, 20 bp, mouse
ggtttgggagacgtggactg

SEQ ID NO: 487595 - DNA, 20 bp, mouse
gtttggtgtggagagtggtt

SEQ ID NO: 487596 - DNA, 20 bp, mouse
gacaggacccggtgtgtcac

SEQ ID NO: 487597 - DNA, 20 bp, mouse
gtgtaccagagcagattcta

SEQ ID NO: 487598 - DNA, 20 bp, mouse
ggtttcccaagtgtagagaa

SEQ ID NO: 487599 - DNA, 20 bp, mouse
ggaacagattagacaggacc

SEQ ID NO: 487600 - DNA, 20 bp, mouse
gcagagcagattctatggaa

SEQ ID NO: 487601 - DNA, 20 bp, mouse
gatgttctaggagaaaagag

SEQ ID NO: 487602 - DNA, 20 bp, mouse
gacagctgccagtgacacac

SEQ ID NO: 487603 - DNA, 20 bp, mouse
gcatcaaatagagctcatgt

SEQ ID NO: 487604 - DNA, 20 bp, mouse
gctatgagaacagattagac

SEQ ID NO: 487605 - DNA, 20 bp, mouse
gagtttaagtttcacagaag

SEQ ID NO: 487606 - DNA, 20 bp, mouse
gcatggtgtcagaggttgaa

SEQ ID NO: 487607 - DNA, 20 bp, mouse
gatgggtgatcatggcccag

SEQ ID NO: 487608 - DNA, 20 bp, mouse
gtcaggaacaggtgtgtcga

SEQ ID NO: 487609 - DNA, 20 bp, mouse
gagagaagggatgcaaggtg

SEQ ID NO: 487610 - DNA, 20 bp, mouse
gggacaagaatgggtgatca

SEQ ID NO: 487611 - DNA, 20 bp, mouse
ggaagaagacttataagaac

SEQ ID NO: 487612 - DNA, 20 bp, mouse
gggtacaaatgatctacaag

SEQ ID NO: 487613 - DNA, 20 bp, mouse
gggtctatttgatgctctag

SEQ ID NO: 487614 - DNA, 20 bp, mouse
gtggaccaaagcatatcagt

SEQ ID NO: 487615 - DNA, 20 bp, mouse
gttataagtcttcttcctct

SEQ ID NO: 487616 - DNA, 20 bp, mouse
gccgagctgcttatacagga

SEQ ID NO: 487617 - DNA, 20 bp, mouse
gtactccgagctgcttatac

SEQ ID NO: 487618 - DNA, 20 bp, mouse
ggctgcaggttgatgtagca

SEQ ID NO: 487619 - DNA, 20 bp, mouse
gtgcttcttctcttgcttat

SEQ ID NO: 487620 - DNA, 20 bp, mouse
ggtagatccctctgagccag

SEQ ID NO: 487621 - DNA, 20 bp, mouse
ggatggctctttgctgctgc

SEQ ID NO: 487622 - DNA, 20 bp, mouse
gttgtttgagaaaagaactt

SEQ ID NO: 487623 - DNA, 20 bp, mouse
ggtcaataccaacaccacct

SEQ ID NO: 487624 - DNA, 20 bp, mouse
gaggaaaaccactggctcag

SEQ ID NO: 487625 - DNA, 20 bp, mouse
gagtggtgaatgttttcctg

SEQ ID NO: 487626 - DNA, 20 bp, mouse
gacacagaaagaacagacat

SEQ ID NO: 487627 - DNA, 20 bp, mouse
gcggctaacccacagacccc

SEQ ID NO: 487628 - DNA, 20 bp, mouse
gcttggaggccagcccaacc

SEQ ID NO: 487629 - DNA, 20 bp, mouse
gtctgtgggttagccgggtt

SEQ ID NO: 487630 - DNA, 20 bp, mouse
gtgagccagaagagtatgag

SEQ ID NO: 487631 - DNA, 20 bp, mouse
gattgcgaaggagggcacag

SEQ ID NO: 487632 - DNA, 20 bp, mouse
gtagcggggagtccttcagc

SEQ ID NO: 487633 - DNA, 20 bp, mouse
ggcactcagcgtctcagagc

SEQ ID NO: 487634 - DNA, 20 bp, mouse
ggaaggactccccgctatct

SEQ ID NO: 487635 - DNA, 20 bp, mouse
gtgggttagccgggttgggc

SEQ ID NO: 487636 - DNA, 20 bp, mouse
gtccatctataataaaccac

SEQ ID NO: 487637 - DNA, 20 bp, mouse
gtatagatcaggtatgcccg

SEQ ID NO: 487638 - DNA, 20 bp, mouse
gattaaatgacattttagcg

SEQ ID NO: 487639 - DNA, 20 bp, mouse
gatgacattttagcgaggca

SEQ ID NO: 487640 - DNA, 20 bp, mouse
gggagatgactcactcacca

SEQ ID NO: 487641 - DNA, 20 bp, mouse
gcttccgtgagcggcggaag

SEQ ID NO: 487642 - DNA, 20 bp, mouse
gccggatcgtaatttctaat

SEQ ID NO: 487643 - DNA, 20 bp, mouse
ggccttcatcaaaggcttaa

SEQ ID NO: 487644 - DNA, 20 bp, mouse
gggacatacatcgtaaaaaa

SEQ ID NO: 487645 - DNA, 20 bp, mouse
gaacatttcaaaagcagtga

SEQ ID NO: 487646 - DNA, 20 bp, mouse
gctggacaggccgccatggt

SEQ ID NO: 487647 - DNA, 20 bp, mouse
ggtgcttactggaggtccca

SEQ ID NO: 487648 - DNA, 20 bp, mouse
ggaacctggacaggccgcca

SEQ ID NO: 487649 - DNA, 20 bp, mouse
gggtctggagcactcgaacc

SEQ ID NO: 487650 - DNA, 20 bp, mouse
gggtgtaccgtgcttactgg

SEQ ID NO: 487651 - DNA, 20 bp, mouse
gtacccagccctctaggtgt

SEQ ID NO: 487652 - DNA, 20 bp, mouse
gagagagcaccaagaggtaa

SEQ ID NO: 487653 - DNA, 20 bp, mouse
gtacaccacgtggtacgtag

SEQ ID NO: 487654 - DNA, 20 bp, mouse
ggtaagcacggtacaccacg

SEQ ID NO: 487655 - DNA, 20 bp, mouse
gacacaatgcccccaccccg

SEQ ID NO: 487656 - DNA, 20 bp, mouse
ggagctcagtcttcataact

SEQ ID NO: 487657 - DNA, 20 bp, mouse
gttatgaagactgagctctc

SEQ ID NO: 487658 - DNA, 20 bp, mouse
ggcaatgatgggtttgagaa

SEQ ID NO: 487659 - DNA, 20 bp, mouse
gggggtgggagaggcgagaa

SEQ ID NO: 487660 - DNA, 20 bp, mouse
ggacctaggctgttagaata

SEQ ID NO: 487661 - DNA, 20 bp, mouse
gggccagccaggttccaggt

SEQ ID NO: 487662 - DNA, 20 bp, mouse
gacccagtgaagccaaggtt

SEQ ID NO: 487663 - DNA, 20 bp, mouse
gttatattaataagattagg

SEQ ID NO: 487664 - DNA, 20 bp, mouse
gtgttagaatatggcaatga

SEQ ID NO: 487665 - DNA, 20 bp, mouse
gtcttgagcttggggcgggt

SEQ ID NO: 487666 - DNA, 20 bp, mouse
gctggagttctgagcttgct

SEQ ID NO: 487667 - DNA, 20 bp, mouse
gcacaaaacatttgcaggag

SEQ ID NO: 487668 - DNA, 20 bp, mouse
gttctgtggaatgtgttttg

SEQ ID NO: 487669 - DNA, 20 bp, mouse
gatctgcacaaaacatttgc

SEQ ID NO: 487670 - DNA, 20 bp, mouse
gccacaaaaacaattccaaa

SEQ ID NO: 487671 - DNA, 20 bp, mouse
gccctcacatcactcagtag

SEQ ID NO: 487672 - DNA, 20 bp, mouse
ggcctctactgagtgatgtg

SEQ ID NO: 487673 - DNA, 20 bp, mouse
ggcttgctcctcctctctgt

SEQ ID NO: 487674 - DNA, 20 bp, mouse
gggtccacaaagctcctcac

SEQ ID NO: 487675 - DNA, 20 bp, mouse
gccacaaagctcctcacagg

SEQ ID NO: 487676 - DNA, 20 bp, mouse
ggttacagagaggaactcgg

SEQ ID NO: 487677 - DNA, 20 bp, mouse
gaagcgtcagccaggaatat

SEQ ID NO: 487678 - DNA, 20 bp, mouse
ggcaggtggtcccatattcc

SEQ ID NO: 487679 - DNA, 20 bp, mouse
gccacaaaggcgcacgcagg

SEQ ID NO: 487680 - DNA, 20 bp, mouse
gggtccacaaaggcgcacgc

SEQ ID NO: 487681 - DNA, 20 bp, mouse
gcctagtctcttcttggtcc

SEQ ID NO: 487682 - DNA, 20 bp, mouse
ggtggagaaatatacttgac

SEQ ID NO: 487683 - DNA, 20 bp, mouse
gtgagttacagagaggaact

SEQ ID NO: 487684 - DNA, 20 bp, mouse
gtggagaaggacctgattca

SEQ ID NO: 487685 - DNA, 20 bp, mouse
gtttgtggcaggggcttgcg

SEQ ID NO: 487686 - DNA, 20 bp, mouse
ggtagaatgtagctgaggta

SEQ ID NO: 487687 - DNA, 20 bp, mouse
gagaagacattttatgttct

SEQ ID NO: 487688 - DNA, 20 bp, mouse
ggaggagactaggcccacaa

SEQ ID NO: 487689 - DNA, 20 bp, mouse
gattaagccctgatgtacaa

SEQ ID NO: 487690 - DNA, 20 bp, mouse
gcacctgtgaggtcctttgt

SEQ ID NO: 487691 - DNA, 20 bp, mouse
gactctacccttgtacatca

SEQ ID NO: 487692 - DNA, 20 bp, mouse
gctggagttttgagtttgtg

SEQ ID NO: 487693 - DNA, 20 bp, mouse
ggtacatcagggcttaatat

SEQ ID NO: 487694 - DNA, 20 bp, mouse
gactaagtagaatgtagctg

SEQ ID NO: 487695 - DNA, 20 bp, mouse
gtatggattcatcaatgctt

SEQ ID NO: 487696 - DNA, 20 bp, mouse
gaaactccttgggacatata

SEQ ID NO: 487697 - DNA, 20 bp, mouse
gtgcatagcataataacctt

SEQ ID NO: 487698 - DNA, 20 bp, mouse
gtaataaccttaggccttgt

SEQ ID NO: 487699 - DNA, 20 bp, mouse
gtaaccttaggccttgtggg

SEQ ID NO: 487700 - DNA, 20 bp, mouse
gcctcctcccacaaggccta

SEQ ID NO: 487701 - DNA, 20 bp, mouse
gttggaagcatctcttggcc

SEQ ID NO: 487702 - DNA, 20 bp, mouse
gggagtttctctagagttgg

SEQ ID NO: 487703 - DNA, 20 bp, mouse
gagggagattctttaagtct

SEQ ID NO: 487704 - DNA, 20 bp, mouse
gtttcacagtctgctgagtg

SEQ ID NO: 487705 - DNA, 20 bp, mouse
gcaaggagtttctctagagt

SEQ ID NO: 487706 - DNA, 20 bp, mouse
gagcctttacctcacgttgc

SEQ ID NO: 487707 - DNA, 20 bp, mouse
gttaggccttgtgggaggaa

SEQ ID NO: 487708 - DNA, 20 bp, mouse
ggccttgtgggaggaaggga

SEQ ID NO: 487709 - DNA, 20 bp, mouse
gaaactccttgggacatata

SEQ ID NO: 487710 - DNA, 20 bp, mouse
gtgcatagcataataacctt

SEQ ID NO: 487711 - DNA, 20 bp, mouse
gttggaagcatctcttggcc

SEQ ID NO: 487712 - DNA, 20 bp, mouse
gtaaccttaggccttgtggg

SEQ ID NO: 487713 - DNA, 20 bp, mouse
gtaataaccttaggccttgt

SEQ ID NO: 487714 - DNA, 20 bp, mouse
gggagtttctctagagttgg

SEQ ID NO: 487715 - DNA, 20 bp, mouse
gcccttcccttcctcccaca

SEQ ID NO: 487716 - DNA, 20 bp, mouse
ggagctcactgtttccatat

SEQ ID NO: 487717 - DNA, 20 bp, mouse
gctcatggggcatttatgca

SEQ ID NO: 487718 - DNA, 20 bp, mouse
gcagtaatctgaagtgctca

SEQ ID NO: 487719 - DNA, 20 bp, mouse
gctgaagtgctcagggaggc

SEQ ID NO: 487720 - DNA, 20 bp, mouse
ggaatcaacacaatcgaaac

SEQ ID NO: 487721 - DNA, 20 bp, mouse
gaggctggagaaggactcat

SEQ ID NO: 487722 - DNA, 20 bp, mouse
gtgctcagggaggctggaga

SEQ ID NO: 487723 - DNA, 20 bp, mouse
gtttcaaaataacaccaata

SEQ ID NO: 487724 - DNA, 20 bp, mouse
gtaatctgaagtgctcaggg

SEQ ID NO: 487725 - DNA, 20 bp, mouse
gggtgagggggccaatagtg

SEQ ID NO: 487726 - DNA, 20 bp, mouse
gttgctcgcacgaggtccag

SEQ ID NO: 487727 - DNA, 20 bp, mouse
gcactcttgcctaacatctt

SEQ ID NO: 487728 - DNA, 20 bp, mouse
gcagccactcctaagatgtt

SEQ ID NO: 487729 - DNA, 20 bp, mouse
gttgcctaacatcttaggag

SEQ ID NO: 487730 - DNA, 20 bp, mouse
gatgagaggcagctgcatag

SEQ ID NO: 487731 - DNA, 20 bp, mouse
ggctgcatagtggcaaggta

SEQ ID NO: 487732 - DNA, 20 bp, mouse
ggttaggcaagagtggcact

SEQ ID NO: 487733 - DNA, 20 bp, mouse
gcctccctaggccactcccc

SEQ ID NO: 487734 - DNA, 20 bp, mouse
gatcttaggagtggctgtcc

SEQ ID NO: 487735 - DNA, 20 bp, mouse
gataggcagcttagatctac

SEQ ID NO: 487736 - DNA, 20 bp, mouse
gctccaaaagcaaattggtt

SEQ ID NO: 487737 - DNA, 20 bp, mouse
gggttcttaaagttacaggg

SEQ ID NO: 487738 - DNA, 20 bp, mouse
gaggcttatcaattgcccaa

SEQ ID NO: 487739 - DNA, 20 bp, mouse
gatgctccagttcacaagac

SEQ ID NO: 487740 - DNA, 20 bp, mouse
gattgtccagtcttgtgaac

SEQ ID NO: 487741 - DNA, 20 bp, mouse
gagactcaacagagagaatc

SEQ ID NO: 487742 - DNA, 20 bp, mouse
gtaatatagtttataatttt

SEQ ID NO: 487743 - DNA, 20 bp, mouse
ggatataataattaattttc

SEQ ID NO: 487744 - DNA, 20 bp, mouse
gcaagatgagagaaaatttt

SEQ ID NO: 487745 - DNA, 20 bp, mouse
gtagctgtatacacaagctg

SEQ ID NO: 487746 - DNA, 20 bp, mouse
gtatacagaggaaggatccg

SEQ ID NO: 487747 - DNA, 20 bp, mouse
gctctactaagccaaaggac

SEQ ID NO: 487748 - DNA, 20 bp, mouse
gggaaggatccgtggattct

SEQ ID NO: 487749 - DNA, 20 bp, mouse
gccaatctctactaagccaa

SEQ ID NO: 487750 - DNA, 20 bp, mouse
gaagtcaaaccaagaatcca

SEQ ID NO: 487751 - DNA, 20 bp, mouse
ggggatccccaggtatacag

SEQ ID NO: 487752 - DNA, 20 bp, mouse
gcaccgagttctcatggagg

SEQ ID NO: 487753 - DNA, 20 bp, mouse
gaatcaccgagttctcatgg

SEQ ID NO: 487754 - DNA, 20 bp, mouse
gatccttcctctgtatacct

SEQ ID NO: 487755 - DNA, 20 bp, mouse
gtcatggagggggtcaaccg

SEQ ID NO: 487756 - DNA, 20 bp, mouse
ggcaattgcccagtaagggt

SEQ ID NO: 487757 - DNA, 20 bp, mouse
ggaacgcaattgcccagtaa

SEQ ID NO: 487758 - DNA, 20 bp, mouse
gatacagtaatcctaatagt

SEQ ID NO: 487759 - DNA, 20 bp, mouse
gcacgtacttgcctactatt

SEQ ID NO: 487760 - DNA, 20 bp, mouse
gggcaagtacgtggatacac

SEQ ID NO: 487761 - DNA, 20 bp, mouse
gacacaggctatctggccta

SEQ ID NO: 487762 - DNA, 20 bp, mouse
gtttgatgcctacccttact

SEQ ID NO: 487763 - DNA, 20 bp, mouse
gtagttattaaggtttcatt

SEQ ID NO: 487764 - DNA, 20 bp, mouse
gtggcagtacacagtaaata

SEQ ID NO: 487765 - DNA, 20 bp, mouse
gaccattagaaaggggaagg

SEQ ID NO: 487766 - DNA, 20 bp, mouse
ggcatcagcgcaggccttat

SEQ ID NO: 487767 - DNA, 20 bp, mouse
ggtacctcccaggtgagtcc

SEQ ID NO: 487768 - DNA, 20 bp, mouse
gagactgtccactgggtagg

SEQ ID NO: 487769 - DNA, 20 bp, mouse
gagcttgcagactgtccact

SEQ ID NO: 487770 - DNA, 20 bp, mouse
gcagcagccagtccacatat

SEQ ID NO: 487771 - DNA, 20 bp, mouse
gtgagctcctgtcgtttagt

SEQ ID NO: 487772 - DNA, 20 bp, mouse
ggatctgcccactaaacgac

SEQ ID NO: 487773 - DNA, 20 bp, mouse
gcccctgcacaacccatatg

SEQ ID NO: 487774 - DNA, 20 bp, mouse
gctgctgcccttaactgacc

SEQ ID NO: 487775 - DNA, 20 bp, mouse
ggttcaaatgtgactgggat

SEQ ID NO: 487776 - DNA, 20 bp, mouse
gtgagctggagggtgtcccc

SEQ ID NO: 487777 - DNA, 20 bp, mouse
ggctgtttcttcaactgtgt

SEQ ID NO: 487778 - DNA, 20 bp, mouse
gacccaactcatgggtacct

SEQ ID NO: 487779 - DNA, 20 bp, mouse
gtctggcctctttccacaga

SEQ ID NO: 487780 - DNA, 20 bp, mouse
gtcctcagtggccattgagc

SEQ ID NO: 487781 - DNA, 20 bp, mouse
gtgcatgaaacacctcagaa

SEQ ID NO: 487782 - DNA, 20 bp, mouse
gttgtgctcatagcttgcta

SEQ ID NO: 487783 - DNA, 20 bp, mouse
gaacctctgccaaattctct

SEQ ID NO: 487784 - DNA, 20 bp, mouse
gcaatgggatgtgccatctg

SEQ ID NO: 487785 - DNA, 20 bp, mouse
gctggatgttgtgaccccca

SEQ ID NO: 487786 - DNA, 20 bp, mouse
gtaggaggtgtacttaccta

SEQ ID NO: 487787 - DNA, 20 bp, mouse
ggaggtgtacttacctaggg

SEQ ID NO: 487788 - DNA, 20 bp, mouse
gcctagggtggcaaggtatc

SEQ ID NO: 487789 - DNA, 20 bp, mouse
gtcaaccttgataccagcca

SEQ ID NO: 487790 - DNA, 20 bp, mouse
ggctgggaagaacctcccca

SEQ ID NO: 487791 - DNA, 20 bp, mouse
ggacacagaccgccttgggg

SEQ ID NO: 487792 - DNA, 20 bp, mouse
ggtacttacctagggtggca

SEQ ID NO: 487793 - DNA, 20 bp, mouse
gtgtccgtacccactctgga

SEQ ID NO: 487794 - DNA, 20 bp, mouse
gttgcagaagtgactgctga

SEQ ID NO: 487795 - DNA, 20 bp, mouse
gtttgccctggctggtatca

SEQ ID NO: 487796 - DNA, 20 bp, mouse
gtcattgccaaactgaaagg

SEQ ID NO: 487797 - DNA, 20 bp, mouse
gttctctcactactactgtt

SEQ ID NO: 487798 - DNA, 20 bp, mouse
gtcagctctcacacacaagc

SEQ ID NO: 487799 - DNA, 20 bp, mouse
gcaatcattgccaaactgaa

SEQ ID NO: 487800 - DNA, 20 bp, mouse
gtggacacctcctttcagtt

SEQ ID NO: 487801 - DNA, 20 bp, mouse
gctgctagctttatcttttc

SEQ ID NO: 487802 - DNA, 20 bp, mouse
gctctcacacacaagcaggt

SEQ ID NO: 487803 - DNA, 20 bp, mouse
gagcaagcggcaactatcca

SEQ ID NO: 487804 - DNA, 20 bp, mouse
gacacaagcaggttggctgc

SEQ ID NO: 487805 - DNA, 20 bp, mouse
gatctgtaaccaggaaagaa

SEQ ID NO: 487806 - DNA, 20 bp, mouse
gagtatccgaagaatcctgt

SEQ ID NO: 487807 - DNA, 20 bp, mouse
gaagcgcccacaggattctt

SEQ ID NO: 487808 - DNA, 20 bp, mouse
gcagtcgacatgccacccaa

SEQ ID NO: 487809 - DNA, 20 bp, mouse
gtagccttcttccccttggg

SEQ ID NO: 487810 - DNA, 20 bp, mouse
gaaaagtgtgaagcgcccac

SEQ ID NO: 487811 - DNA, 20 bp, mouse
gtccttgccaggagagaggt

SEQ ID NO: 487812 - DNA, 20 bp, mouse
gcctgggatgagactatcaa

SEQ ID NO: 487813 - DNA, 20 bp, mouse
gcttggcaagaagggcagaa

SEQ ID NO: 487814 - DNA, 20 bp, mouse
ggagtctctgcctaccccag

SEQ ID NO: 487815 - DNA, 20 bp, mouse
gggcttgggataggactcct

SEQ ID NO: 487816 - DNA, 20 bp, mouse
gaatacaggaggccggatcc

SEQ ID NO: 487817 - DNA, 20 bp, mouse
gccctcagagagccgggatc

SEQ ID NO: 487818 - DNA, 20 bp, mouse
gcaaagacgacgccgaggag

SEQ ID NO: 487819 - DNA, 20 bp, mouse
gatagggtaagtccactcct

SEQ ID NO: 487820 - DNA, 20 bp, mouse
gatgggcctaagaacaatcc

SEQ ID NO: 487821 - DNA, 20 bp, mouse
gcctatgagacgagagatgc

SEQ ID NO: 487822 - DNA, 20 bp, mouse
gtttcatagcagaagagtat

SEQ ID NO: 487823 - DNA, 20 bp, mouse
gtacctatacttcagaaaca

SEQ ID NO: 487824 - DNA, 20 bp, mouse
gtgccatgtttctgaagtat

SEQ ID NO: 487825 - DNA, 20 bp, mouse
gttaaagaaatacaggaggc

SEQ ID NO: 487826 - DNA, 20 bp, mouse
gagatcattaaaatgtgtgt

SEQ ID NO: 487827 - DNA, 20 bp, mouse
gtgatcatgagcatggacat

SEQ ID NO: 487828 - DNA, 20 bp, mouse
gtctccagaggagcaaattt

SEQ ID NO: 487829 - DNA, 20 bp, mouse
gtgctgctggcattggtatt

SEQ ID NO: 487830 - DNA, 20 bp, mouse
gcatgctcatgatcatcctg

SEQ ID NO: 487831 - DNA, 20 bp, mouse
gaagtttctgctgctggcat

SEQ ID NO: 487832 - DNA, 20 bp, mouse
gctggcattggtatttggac

SEQ ID NO: 487833 - DNA, 20 bp, mouse
ggcaaatttaggaatcatga

SEQ ID NO: 487834 - DNA, 20 bp, mouse
gagtgaaataaagaaaataa

SEQ ID NO: 487835 - DNA, 20 bp, mouse
gacctgagagaaaggcataa

SEQ ID NO: 487836 - DNA, 20 bp, mouse
gtggcattacatattatatg

SEQ ID NO: 487837 - DNA, 20 bp, mouse
gaaagagttgaaaatacact

SEQ ID NO: 487838 - DNA, 20 bp, mouse
gtaatgcaagcgcaattagc

SEQ ID NO: 487839 - DNA, 20 bp, mouse
gattagcaggaacttcacca

SEQ ID NO: 487840 - DNA, 20 bp, mouse
gcttcggaaggagagaatcc

SEQ ID NO: 487841 - DNA, 20 bp, mouse
ggagaatccaggctctacca

SEQ ID NO: 487842 - DNA, 20 bp, mouse
ggtctctgaactccttcgga

SEQ ID NO: 487843 - DNA, 20 bp, mouse
gcttggtctctgaactcctt

SEQ ID NO: 487844 - DNA, 20 bp, mouse
gagagaccaagggcaggtga

SEQ ID NO: 487845 - DNA, 20 bp, mouse
ggagttcagagaccaagggc

SEQ ID NO: 487846 - DNA, 20 bp, mouse
gctctactacgtttgtccag

SEQ ID NO: 487847 - DNA, 20 bp, mouse
gtgaatctatccagatgata

SEQ ID NO: 487848 - DNA, 20 bp, mouse
gctcagtacctggagagatg

SEQ ID NO: 487849 - DNA, 20 bp, mouse
gtggcctactcattcagttt

SEQ ID NO: 487850 - DNA, 20 bp, mouse
gtccagccttggggagataa

SEQ ID NO: 487851 - DNA, 20 bp, mouse
gggatagattcagtgtcctc

SEQ ID NO: 487852 - DNA, 20 bp, mouse
gcatactcactcttcagaag

SEQ ID NO: 487853 - DNA, 20 bp, mouse
gccaaggctggagtgataag

SEQ ID NO: 487854 - DNA, 20 bp, mouse
ggatgattctccctatcatc

SEQ ID NO: 487855 - DNA, 20 bp, mouse
gaacctgtaccagacatgaa

SEQ ID NO: 487856 - DNA, 20 bp, mouse
gggctaagaatctcactgag

SEQ ID NO: 487857 - DNA, 20 bp, mouse
gcctggccagcatgaggtac

SEQ ID NO: 487858 - DNA, 20 bp, mouse
gaatacaaggtaagcatcat

SEQ ID NO: 487859 - DNA, 20 bp, mouse
gtgggagcaagggcttcgaa

SEQ ID NO: 487860 - DNA, 20 bp, mouse
gtattaaaaagtgggagcaa

SEQ ID NO: 487861 - DNA, 20 bp, mouse
ggaactccagtacctcatgc

SEQ ID NO: 487862 - DNA, 20 bp, mouse
ggagcaagggcttcgaatgg

SEQ ID NO: 487863 - DNA, 20 bp, mouse
gtgggcaaagggttccatac

SEQ ID NO: 487864 - DNA, 20 bp, mouse
ggtcacagtgtctatccgaa

SEQ ID NO: 487865 - DNA, 20 bp, mouse
gaagaatctcaagatagtac

SEQ ID NO: 487866 - DNA, 20 bp, mouse
gggagattagccgtgcctgg

SEQ ID NO: 487867 - DNA, 20 bp, mouse
gtctggaggtgcgggagcga

SEQ ID NO: 487868 - DNA, 20 bp, mouse
gggtgcgggagcgacggtgg

SEQ ID NO: 487869 - DNA, 20 bp, mouse
gggaggtgcgggagcgacgg

SEQ ID NO: 487870 - DNA, 20 bp, mouse
gtcccacagacagccctgaa

SEQ ID NO: 487871 - DNA, 20 bp, mouse
gactgtcttcgagagtcttc

SEQ ID NO: 487872 - DNA, 20 bp, mouse
gtcaggagtgatgcgcctct

SEQ ID NO: 487873 - DNA, 20 bp, mouse
gtccagcaacctgcgggtga

SEQ ID NO: 487874 - DNA, 20 bp, mouse
gcctggagtccctcacccgc

SEQ ID NO: 487875 - DNA, 20 bp, mouse
ggatatggtgcccatcttcc

SEQ ID NO: 487876 - DNA, 20 bp, mouse
ggactgtaatttaataattt

SEQ ID NO: 487877 - DNA, 20 bp, mouse
gctgggaacggaaagagagc

SEQ ID NO: 487878 - DNA, 20 bp, mouse
gttgatgggaaaatcaggac

SEQ ID NO: 487879 - DNA, 20 bp, mouse
gtggtttcatctaccctgct

SEQ ID NO: 487880 - DNA, 20 bp, mouse
gcttggtgtcatagatgaga

SEQ ID NO: 487881 - DNA, 20 bp, mouse
gcatcatgggtcactagatg

SEQ ID NO: 487882 - DNA, 20 bp, mouse
gccatgatgctcgtactact

SEQ ID NO: 487883 - DNA, 20 bp, mouse
gtggagcagctacgcgcttc

SEQ ID NO: 487884 - DNA, 20 bp, mouse
ggttcatcgtattacaccgg

SEQ ID NO: 487885 - DNA, 20 bp, mouse
gcatcgtattacaccggagg

SEQ ID NO: 487886 - DNA, 20 bp, mouse
gaaggaagatcttaagaggt

SEQ ID NO: 487887 - DNA, 20 bp, mouse
gtgagagaagagaccccata

SEQ ID NO: 487888 - DNA, 20 bp, mouse
gccataaggaagatcttaag

SEQ ID NO: 487889 - DNA, 20 bp, mouse
gttctttaggcattctcatt

SEQ ID NO: 487890 - DNA, 20 bp, mouse
gtgttagtggatcaaggatt

SEQ ID NO: 487891 - DNA, 20 bp, mouse
ggtcatggctgcacgtggta

SEQ ID NO: 487892 - DNA, 20 bp, mouse
gaggagaaataccctcagct

SEQ ID NO: 487893 - DNA, 20 bp, mouse
gttcatggcacccacttcag

SEQ ID NO: 487894 - DNA, 20 bp, mouse
gatggctgcacgtggtaggg

SEQ ID NO: 487895 - DNA, 20 bp, mouse
gggtcataattcttaagtga

SEQ ID NO: 487896 - DNA, 20 bp, mouse
gggagacctctgcataacag

SEQ ID NO: 487897 - DNA, 20 bp, mouse
gggatctctggtctttgagg

SEQ ID NO: 487898 - DNA, 20 bp, mouse
gtaggaaactgttgagtcag

SEQ ID NO: 487899 - DNA, 20 bp, mouse
gtaacaggggctgctcaaaa

SEQ ID NO: 487900 - DNA, 20 bp, mouse
ggaagacaaacctcagcatg

SEQ ID NO: 487901 - DNA, 20 bp, mouse
gagcagcccctgttatgcag

SEQ ID NO: 487902 - DNA, 20 bp, mouse
gtgtggatctctggtctttg

SEQ ID NO: 487903 - DNA, 20 bp, mouse
gggtgtggagatttcccaag

SEQ ID NO: 487904 - DNA, 20 bp, mouse
ggggaaatctccacacctgc

SEQ ID NO: 487905 - DNA, 20 bp, mouse
gtgctcaaaatggcgcctgc

SEQ ID NO: 487906 - DNA, 20 bp, mouse
ggggcaagtctgggagagtg

SEQ ID NO: 487907 - DNA, 20 bp, mouse
gtttttaggagggcaagtct

SEQ ID NO: 487908 - DNA, 20 bp, mouse
gatcatgtgctatgcccttc

SEQ ID NO: 487909 - DNA, 20 bp, mouse
gcacatgattttttttagga

SEQ ID NO: 487910 - DNA, 20 bp, mouse
gatagcacatgatttttttt

SEQ ID NO: 487911 - DNA, 20 bp, mouse
gagtctgggagagtgtggga

SEQ ID NO: 487912 - DNA, 20 bp, mouse
gggagacctctgcataacag

SEQ ID NO: 487913 - DNA, 20 bp, mouse
gagcagcccctgttatgcag

SEQ ID NO: 487914 - DNA, 20 bp, mouse
gtaacaggggctgctcaaaa

SEQ ID NO: 487915 - DNA, 20 bp, mouse
gggtgtggagatttcccaag

SEQ ID NO: 487916 - DNA, 20 bp, mouse
gggagacctctgcataacag

SEQ ID NO: 487917 - DNA, 20 bp, mouse
gggatctctggtctttgagg

SEQ ID NO: 487918 - DNA, 20 bp, mouse
gtaggaaactgttgagtcag

SEQ ID NO: 487919 - DNA, 20 bp, mouse
gtaacaggggctgctcaaaa

SEQ ID NO: 487920 - DNA, 20 bp, mouse
ggaagacaaacctcagcatg

SEQ ID NO: 487921 - DNA, 20 bp, mouse
gagcagcccctgttatgcag

SEQ ID NO: 487922 - DNA, 20 bp, mouse
gtgtggatctctggtctttg

SEQ ID NO: 487923 - DNA, 20 bp, mouse
gggtgtggagatttcccaag

SEQ ID NO: 487924 - DNA, 20 bp, mouse
ggggaaatctccacacctgc

SEQ ID NO: 487925 - DNA, 20 bp, mouse
gtgctcaaaatggcgcctgc

SEQ ID NO: 487926 - DNA, 20 bp, mouse
gtttttagagagatgtggct

SEQ ID NO: 487927 - DNA, 20 bp, mouse
ggacctcttcataatcctag

SEQ ID NO: 487928 - DNA, 20 bp, mouse
gaaggcaatccctaggctcg

SEQ ID NO: 487929 - DNA, 20 bp, mouse
gccaatatccatcaatcact

SEQ ID NO: 487930 - DNA, 20 bp, mouse
gttttttttttagagagatg

SEQ ID NO: 487931 - DNA, 20 bp, mouse
gagccgctaggattatgaag

SEQ ID NO: 487932 - DNA, 20 bp, mouse
gtgccagaagggtataacag

SEQ ID NO: 487933 - DNA, 20 bp, mouse
gtgtcctcactcaaaaacaa

SEQ ID NO: 487934 - DNA, 20 bp, mouse
gtagagagatgtggctggga

SEQ ID NO: 487935 - DNA, 20 bp, mouse
ggatgtggctgggagggtgt

SEQ ID NO: 487936 - DNA, 20 bp, mouse
gcaaatggcacatagaggag

SEQ ID NO: 487937 - DNA, 20 bp, mouse
gcagttcaaatggcacatag

SEQ ID NO: 487938 - DNA, 20 bp, mouse
gataacccaggcagttcaaa

SEQ ID NO: 487939 - DNA, 20 bp, mouse
gtgtgccatttgaactgcct

SEQ ID NO: 487940 - DNA, 20 bp, mouse
gacggtgttattttcgagtg

SEQ ID NO: 487941 - DNA, 20 bp, mouse
gaactgcctgggttatgcag

SEQ ID NO: 487942 - DNA, 20 bp, mouse
ggagtggagatttccagagc

SEQ ID NO: 487943 - DNA, 20 bp, mouse
ggaggttgatggggtagaga

SEQ ID NO: 487944 - DNA, 20 bp, mouse
gtaatttccagatacctaga

SEQ ID NO: 487945 - DNA, 20 bp, mouse
ggtgaggacagggggcttgc

SEQ ID NO: 487946 - DNA, 20 bp, mouse
gacagaggatttcatttagg

SEQ ID NO: 487947 - DNA, 20 bp, mouse
gctaataaccatcgatcacc

SEQ ID NO: 487948 - DNA, 20 bp, mouse
gataacagaggatttcattt

SEQ ID NO: 487949 - DNA, 20 bp, mouse
gcatttagggggatgtggct

SEQ ID NO: 487950 - DNA, 20 bp, mouse
ggatttcatttagggggatg

SEQ ID NO: 487951 - DNA, 20 bp, mouse
ggaggggcttttagatgttt

SEQ ID NO: 487952 - DNA, 20 bp, mouse
gtgccagaagggtataacag

SEQ ID NO: 487953 - DNA, 20 bp, mouse
gaccttcacggttcgccatc

SEQ ID NO: 487954 - DNA, 20 bp, mouse
ggatgtggctgggagggtgt

SEQ ID NO: 487955 - DNA, 20 bp, mouse
ggatcgatggttattagatg

SEQ ID NO: 487956 - DNA, 20 bp, mouse
ggtgatgaaagtacaataaa

SEQ ID NO: 487957 - DNA, 20 bp, mouse
gaagtacaataaatggccaa

SEQ ID NO: 487958 - DNA, 20 bp, mouse
gcaagtgactttatgccata

SEQ ID NO: 487959 - DNA, 20 bp, mouse
ggaaattgaagaggagtgtg

SEQ ID NO: 487960 - DNA, 20 bp, mouse
ggagagtactattacagaaa

SEQ ID NO: 487961 - DNA, 20 bp, mouse
gggctgggcaaggcagccta

SEQ ID NO: 487962 - DNA, 20 bp, mouse
gtttagaggtaatttttact

SEQ ID NO: 487963 - DNA, 20 bp, mouse
gaatctattttcaattgaag

SEQ ID NO: 487964 - DNA, 20 bp, mouse
gctattttcaattgaagagg

SEQ ID NO: 487965 - DNA, 20 bp, mouse
gaaattcagttatgctttag

SEQ ID NO: 487966 - DNA, 20 bp, mouse
gcccgaggggaagtgcgagg

SEQ ID NO: 487967 - DNA, 20 bp, mouse
gagtggctgcctgctagcta

SEQ ID NO: 487968 - DNA, 20 bp, mouse
gtcggcctgggacagacctg

SEQ ID NO: 487969 - DNA, 20 bp, mouse
gtctcccgaggggaagtgcg

SEQ ID NO: 487970 - DNA, 20 bp, mouse
gtctcgggaaatctcccgag

SEQ ID NO: 487971 - DNA, 20 bp, mouse
gtgcgccagccatagctagc

SEQ ID NO: 487972 - DNA, 20 bp, mouse
gctgaaggcttggcaaagtt

SEQ ID NO: 487973 - DNA, 20 bp, mouse
gtccccctcgcacttcccct

SEQ ID NO: 487974 - DNA, 20 bp, mouse
ggccgccgcaggtctgtccc

SEQ ID NO: 487975 - DNA, 20 bp, mouse
ggggagatttcccgagaagg

SEQ ID NO: 487976 - DNA, 20 bp, mouse
gagagttccccactcagcag

SEQ ID NO: 487977 - DNA, 20 bp, mouse
gtcccggagggtacaggatg

SEQ ID NO: 487978 - DNA, 20 bp, mouse
gaccctccgggaagtaccaa

SEQ ID NO: 487979 - DNA, 20 bp, mouse
ggttccccactcagcagagg

SEQ ID NO: 487980 - DNA, 20 bp, mouse
ggcagagggggaaaagtgtc

SEQ ID NO: 487981 - DNA, 20 bp, mouse
gtttagaaaagatgtttgag

SEQ ID NO: 487982 - DNA, 20 bp, mouse
gcacagcagcacaacacaca

SEQ ID NO: 487983 - DNA, 20 bp, mouse
gctcaccatgaggcctacgt

SEQ ID NO: 487984 - DNA, 20 bp, mouse
ggccagcatcagaagaccat

SEQ ID NO: 487985 - DNA, 20 bp, mouse
gtgatccaaggagcacggtt

SEQ ID NO: 487986 - DNA, 20 bp, mouse
gataatttatagtctttgac

SEQ ID NO: 487987 - DNA, 20 bp, mouse
gagatcaaagctagtttaca

SEQ ID NO: 487988 - DNA, 20 bp, mouse
gaaacaaagttatgactacc

SEQ ID NO: 487989 - DNA, 20 bp, mouse
gccgaactggagactgctgt

SEQ ID NO: 487990 - DNA, 20 bp, mouse
gtaggcactaaataccgaac

SEQ ID NO: 487991 - DNA, 20 bp, mouse
gaagcatcctcagacttcag

SEQ ID NO: 487992 - DNA, 20 bp, mouse
gagcaaaccactgaagtctg

SEQ ID NO: 487993 - DNA, 20 bp, mouse
gaaattattgcttttcttct

SEQ ID NO: 487994 - DNA, 20 bp, mouse
gtttacacatacctttacag

SEQ ID NO: 487995 - DNA, 20 bp, mouse
gcctatcctggacatgtgag

SEQ ID NO: 487996 - DNA, 20 bp, mouse
ggctgtggcgtgaaggctgt

SEQ ID NO: 487997 - DNA, 20 bp, mouse
gacggatacattccgataca

SEQ ID NO: 487998 - DNA, 20 bp, mouse
gggcagggccttccgtgtat

SEQ ID NO: 487999 - DNA, 20 bp, mouse
gtatcggaatgtatccgtta

SEQ ID NO: 488000 - DNA, 20 bp, mouse
ggcattaaagttagaagaat

SEQ ID NO: 488001 - DNA, 20 bp, mouse
gatacattccgatacacgga

SEQ ID NO: 488002 - DNA, 20 bp, mouse
gatatttggcagatttcttc

SEQ ID NO: 488003 - DNA, 20 bp, mouse
gcatgacaactttgacaatg

SEQ ID NO: 488004 - DNA, 20 bp, mouse
gacaactttgacaatgtgga

SEQ ID NO: 488005 - DNA, 20 bp, mouse
gctaactttaatgctgggtc

SEQ ID NO: 488006 - DNA, 20 bp, mouse
gcagtttcttggacaagaaa

SEQ ID NO: 488007 - DNA, 20 bp, mouse
gaaaaatagatgaaacttca

SEQ ID NO: 488008 - DNA, 20 bp, mouse
gtaagacaagaataaaatat

SEQ ID NO: 488009 - DNA, 20 bp, mouse
gtatagtaatggagttgggg

SEQ ID NO: 488010 - DNA, 20 bp, mouse
gtattggagtatgaacccac

SEQ ID NO: 488011 - DNA, 20 bp, mouse
gaacagaaacagttactagg

SEQ ID NO: 488012 - DNA, 20 bp, mouse
ggtaactgtttctgttatag

SEQ ID NO: 488013 - DNA, 20 bp, mouse
ggaaggttataatacatagt

SEQ ID NO: 488014 - DNA, 20 bp, mouse
gacaatattaacaggtaata

SEQ ID NO: 488015 - DNA, 20 bp, mouse
gtctagagtacttatagtaa

SEQ ID NO: 488016 - DNA, 20 bp, mouse
gggccctaggctaaatggaa

SEQ ID NO: 488017 - DNA, 20 bp, mouse
gacggaggccctaggctaaa

SEQ ID NO: 488018 - DNA, 20 bp, mouse
ggatccagcctgaatataga

SEQ ID NO: 488019 - DNA, 20 bp, mouse
gagggcctccgtctatattc

SEQ ID NO: 488020 - DNA, 20 bp, mouse
gctcctttccatttagccta

SEQ ID NO: 488021 - DNA, 20 bp, mouse
gtagcatgccgcctttggaa

SEQ ID NO: 488022 - DNA, 20 bp, mouse
gctctgaagttcccttccaa

SEQ ID NO: 488023 - DNA, 20 bp, mouse
gaaggcatgacagctgatcg

SEQ ID NO: 488024 - DNA, 20 bp, mouse
gggccaaacccaggattgag

SEQ ID NO: 488025 - DNA, 20 bp, mouse
gcctccgtctatattcaggc

SEQ ID NO: 488026 - DNA, 20 bp, mouse
gtacgtgcctctctgcgtgg

SEQ ID NO: 488027 - DNA, 20 bp, mouse
ggctggccgtgggaacctgg

SEQ ID NO: 488028 - DNA, 20 bp, mouse
gtctagaagctaggccttct

SEQ ID NO: 488029 - DNA, 20 bp, mouse
gtcctcgggttcccacctgg

SEQ ID NO: 488030 - DNA, 20 bp, mouse
gtgggggagtggggaatgct

SEQ ID NO: 488031 - DNA, 20 bp, mouse
gcccactcccccacgcagag

SEQ ID NO: 488032 - DNA, 20 bp, mouse
ggcgggtgcaaatctctctg

SEQ ID NO: 488033 - DNA, 20 bp, mouse
gcccacggccagctccacgt

SEQ ID NO: 488034 - DNA, 20 bp, mouse
gagcagcggttctagaagct

SEQ ID NO: 488035 - DNA, 20 bp, mouse
ggcggtgccagactgtgcag

SEQ ID NO: 488036 - DNA, 20 bp, mouse
ggccgtcacagagggacagg

SEQ ID NO: 488037 - DNA, 20 bp, mouse
ggtgtctacacggcacgggg

SEQ ID NO: 488038 - DNA, 20 bp, mouse
gccacccagggccgtcacag

SEQ ID NO: 488039 - DNA, 20 bp, mouse
gtctacacggcacggggtgg

SEQ ID NO: 488040 - DNA, 20 bp, mouse
gagggccgtcacagagggac

SEQ ID NO: 488041 - DNA, 20 bp, mouse
gtgtagagggtgacgaactc

SEQ ID NO: 488042 - DNA, 20 bp, mouse
ggggcccagacaggatagag

SEQ ID NO: 488043 - DNA, 20 bp, mouse
gagcaagaaaccggacacat

SEQ ID NO: 488044 - DNA, 20 bp, mouse
gatgagtgtctacacggcac

SEQ ID NO: 488045 - DNA, 20 bp, mouse
ggatgagtcagggcccagac

SEQ ID NO: 488046 - DNA, 20 bp, mouse
gatcagccagcggccatgtg

SEQ ID NO: 488047 - DNA, 20 bp, mouse
gggacaccgcacatggccgc

SEQ ID NO: 488048 - DNA, 20 bp, mouse
ggggtttttccgggtacctt

SEQ ID NO: 488049 - DNA, 20 bp, mouse
ggaagccggcccaaggtacc

SEQ ID NO: 488050 - DNA, 20 bp, mouse
gctcattgggaatcagccag

SEQ ID NO: 488051 - DNA, 20 bp, mouse
gctgtcctgccgctggatgc

SEQ ID NO: 488052 - DNA, 20 bp, mouse
gcaaagatctcgctacaaac

SEQ ID NO: 488053 - DNA, 20 bp, mouse
gcaccctccccagcatccag

SEQ ID NO: 488054 - DNA, 20 bp, mouse
ggacagagagcacagcataa

SEQ ID NO: 488055 - DNA, 20 bp, mouse
gactaagtgaagccggccca

SEQ ID NO: 488056 - DNA, 20 bp, mouse
gtatgatctagatgacgtgt

SEQ ID NO: 488057 - DNA, 20 bp, mouse
ggagcaagctagatgttctt

SEQ ID NO: 488058 - DNA, 20 bp, mouse
gacactgtttagggcttcag

SEQ ID NO: 488059 - DNA, 20 bp, mouse
gagctagatgttctttggag

SEQ ID NO: 488060 - DNA, 20 bp, mouse
gtcatcattagggtctgcag

SEQ ID NO: 488061 - DNA, 20 bp, mouse
gaaaaactcaatatcaattt

SEQ ID NO: 488062 - DNA, 20 bp, mouse
gccctaaacagtgtttggag

SEQ ID NO: 488063 - DNA, 20 bp, mouse
gcatttaaacaggtatacac

SEQ ID NO: 488064 - DNA, 20 bp, mouse
gattatcagtagacgtgtat

SEQ ID NO: 488065 - DNA, 20 bp, mouse
gaacaggtatacacaggatt

SEQ ID NO: 488066 - DNA, 20 bp, mouse
gagaaggagctgggcccgat

SEQ ID NO: 488067 - DNA, 20 bp, mouse
gtaggccccaatggaacaga

SEQ ID NO: 488068 - DNA, 20 bp, mouse
gagctccttctgttccattg

SEQ ID NO: 488069 - DNA, 20 bp, mouse
gcattttggagacttgatta

SEQ ID NO: 488070 - DNA, 20 bp, mouse
gaccctacttacactctcaa

SEQ ID NO: 488071 - DNA, 20 bp, mouse
gattcttccaaaggcctatc

SEQ ID NO: 488072 - DNA, 20 bp, mouse
gggactccacccccactcct

SEQ ID NO: 488073 - DNA, 20 bp, mouse
gctttggttcccaggagtgg

SEQ ID NO: 488074 - DNA, 20 bp, mouse
gtggggttagaggtgaacac

SEQ ID NO: 488075 - DNA, 20 bp, mouse
gtgaagcctcagggggtagg

SEQ ID NO: 488076 - DNA, 20 bp, mouse
gtctgggatgaagttaacac

SEQ ID NO: 488077 - DNA, 20 bp, mouse
gttggtttttaccagctgga

SEQ ID NO: 488078 - DNA, 20 bp, mouse
gttttaccagctggacggca

SEQ ID NO: 488079 - DNA, 20 bp, mouse
gacactggatacgagtgtgc

SEQ ID NO: 488080 - DNA, 20 bp, mouse
gtggaatgccataggaagct

SEQ ID NO: 488081 - DNA, 20 bp, mouse
gaaatcatctgcacattaca

SEQ ID NO: 488082 - DNA, 20 bp, mouse
gaaattccagaagaatcaca

SEQ ID NO: 488083 - DNA, 20 bp, mouse
gagaaattagagtcacggtg

SEQ ID NO: 488084 - DNA, 20 bp, mouse
ggctagccatgtgattcttc

SEQ ID NO: 488085 - DNA, 20 bp, mouse
gatttttggtttttaccagc

SEQ ID NO: 488086 - DNA, 20 bp, mouse
gctcctggcagcgccgacgg

SEQ ID NO: 488087 - DNA, 20 bp, mouse
gggcgcggggagcaatgtaa

SEQ ID NO: 488088 - DNA, 20 bp, mouse
gcaggagccgctctgtgggt

SEQ ID NO: 488089 - DNA, 20 bp, mouse
gcggctcctggcagcgccga

SEQ ID NO: 488090 - DNA, 20 bp, mouse
ggctgccaggagccgctctg

SEQ ID NO: 488091 - DNA, 20 bp, mouse
gcccccatggaggtgagcgg

SEQ ID NO: 488092 - DNA, 20 bp, mouse
gccgagacggtgcgacgaag

SEQ ID NO: 488093 - DNA, 20 bp, mouse
gtcctcagcgtctctcccgg

SEQ ID NO: 488094 - DNA, 20 bp, mouse
gaacagctcccggggtacgg

SEQ ID NO: 488095 - DNA, 20 bp, mouse
ggcccccgggagagacgctg

SEQ ID NO: 488096 - DNA, 20 bp, mouse
ggccattcagttatacccag

SEQ ID NO: 488097 - DNA, 20 bp, mouse
gtctagaagagtaccttgca

SEQ ID NO: 488098 - DNA, 20 bp, mouse
gaaagctttaggaccctgca

SEQ ID NO: 488099 - DNA, 20 bp, mouse
gataactgataaactgaggt

SEQ ID NO: 488100 - DNA, 20 bp, mouse
ggcccctgggtataactgaa

SEQ ID NO: 488101 - DNA, 20 bp, mouse
gataggagctgtttccttct

SEQ ID NO: 488102 - DNA, 20 bp, mouse
ggtgtgccaccaagccaggc

SEQ ID NO: 488103 - DNA, 20 bp, mouse
gagaagccagcctggcttgg

SEQ ID NO: 488104 - DNA, 20 bp, mouse
gtataataactgataaactg

SEQ ID NO: 488105 - DNA, 20 bp, mouse
gaggtataaaagaaagcttt

SEQ ID NO: 488106 - DNA, 20 bp, mouse
gggtccagcatcctaatcat

SEQ ID NO: 488107 - DNA, 20 bp, mouse
gtccagcacatgggactcag

SEQ ID NO: 488108 - DNA, 20 bp, mouse
ggattctcaacccgatgatt

SEQ ID NO: 488109 - DNA, 20 bp, mouse
gctttttgaaatggtagatg

SEQ ID NO: 488110 - DNA, 20 bp, mouse
ggaattggaccagaatgtct

SEQ ID NO: 488111 - DNA, 20 bp, mouse
gcccacagaggctcaccccg

SEQ ID NO: 488112 - DNA, 20 bp, mouse
gcaaatgtagtcagatcaaa

SEQ ID NO: 488113 - DNA, 20 bp, mouse
ggggcaaggtaactctggaa

SEQ ID NO: 488114 - DNA, 20 bp, mouse
ggagagagtgcacgtcccct

SEQ ID NO: 488115 - DNA, 20 bp, mouse
ggcagatgtaattctccccg

SEQ ID NO: 488116 - DNA, 20 bp, mouse
gaggcggatcctgctcgtca

SEQ ID NO: 488117 - DNA, 20 bp, mouse
gcggatcctgctcgtcaggg

SEQ ID NO: 488118 - DNA, 20 bp, mouse
gatggcgtcttactgacagt

SEQ ID NO: 488119 - DNA, 20 bp, mouse
gtcttactgacagttggctg

SEQ ID NO: 488120 - DNA, 20 bp, mouse
ggggaaccccgcccccaaga

SEQ ID NO: 488121 - DNA, 20 bp, mouse
gcgagcccatggctaagaga

SEQ ID NO: 488122 - DNA, 20 bp, mouse
gatcctgctcgtcagggcgg

SEQ ID NO: 488123 - DNA, 20 bp, mouse
gcagtaagacgccatcttgg

SEQ ID NO: 488124 - DNA, 20 bp, mouse
gggtcggccatgggttgctg

SEQ ID NO: 488125 - DNA, 20 bp, mouse
ggccgcggccgacgagccca

SEQ ID NO: 488126 - DNA, 20 bp, mouse
ggcagcagctggcccccagt

SEQ ID NO: 488127 - DNA, 20 bp, mouse
ggaacctgtaccagcccact

SEQ ID NO: 488128 - DNA, 20 bp, mouse
gcacctggcggtgcaggtag

SEQ ID NO: 488129 - DNA, 20 bp, mouse
gtggtgatcatactcggtca

SEQ ID NO: 488130 - DNA, 20 bp, mouse
gaggtagtggtgatcatact

SEQ ID NO: 488131 - DNA, 20 bp, mouse
gcagctggcccccagtgggc

SEQ ID NO: 488132 - DNA, 20 bp, mouse
ggtcagaccctaggaaaaca

SEQ ID NO: 488133 - DNA, 20 bp, mouse
gttctgcagcagggcggcca

SEQ ID NO: 488134 - DNA, 20 bp, mouse
gacctccgcagcagagagaa

SEQ ID NO: 488135 - DNA, 20 bp, mouse
ggtgtctgagggagaccccg

SEQ ID NO: 488136 - DNA, 20 bp, mouse
ggcactccagaaggcctcaa

SEQ ID NO: 488137 - DNA, 20 bp, mouse
gggtgtgaggaaaataatgg

SEQ ID NO: 488138 - DNA, 20 bp, mouse
gtttggcctttcccaagtgg

SEQ ID NO: 488139 - DNA, 20 bp, mouse
gatatcacagggactaaggt

SEQ ID NO: 488140 - DNA, 20 bp, mouse
gacgtaatcagatcatcaca

SEQ ID NO: 488141 - DNA, 20 bp, mouse
gcaaacatatccctccctgg

SEQ ID NO: 488142 - DNA, 20 bp, mouse
gagacatcaagcccttccaa

SEQ ID NO: 488143 - DNA, 20 bp, mouse
gagccatatcacagggacta

SEQ ID NO: 488144 - DNA, 20 bp, mouse
ggccactcttctgccttggc

SEQ ID NO: 488145 - DNA, 20 bp, mouse
gcaagaatagccatatcaca

SEQ ID NO: 488146 - DNA, 20 bp, mouse
gtcggccagaggaaggcgaa

SEQ ID NO: 488147 - DNA, 20 bp, mouse
gccccacctcggccagagga

SEQ ID NO: 488148 - DNA, 20 bp, mouse
gggcagcagcattcatccca

SEQ ID NO: 488149 - DNA, 20 bp, mouse
gcagaccccacctcggccag

SEQ ID NO: 488150 - DNA, 20 bp, mouse
ggaacaggtagtcttcagag

SEQ ID NO: 488151 - DNA, 20 bp, mouse
gcgccttcctctggccgagg

SEQ ID NO: 488152 - DNA, 20 bp, mouse
ggaaggaccagaactcactg

SEQ ID NO: 488153 - DNA, 20 bp, mouse
gacagtccagtgggaagggg

SEQ ID NO: 488154 - DNA, 20 bp, mouse
gggctggttattcagtctga

SEQ ID NO: 488155 - DNA, 20 bp, mouse
gacatcaaagaataaatagg

SEQ ID NO: 488156 - DNA, 20 bp, mouse
ggtggaggcgggacttagag

SEQ ID NO: 488157 - DNA, 20 bp, mouse
gggcgttccggaagtcactg

SEQ ID NO: 488158 - DNA, 20 bp, mouse
gagtcactggggccgaaacc

SEQ ID NO: 488159 - DNA, 20 bp, mouse
gcactggggccgaaacccgg

SEQ ID NO: 488160 - DNA, 20 bp, mouse
ggcgggacttagaggggcgg

SEQ ID NO: 488161 - DNA, 20 bp, mouse
gtgggacccgggatctggag

SEQ ID NO: 488162 - DNA, 20 bp, mouse
gtcaaggcttccggaagtac

SEQ ID NO: 488163 - DNA, 20 bp, mouse
ggaggcgggacttagagggg

SEQ ID NO: 488164 - DNA, 20 bp, mouse
gcgacggttcagccctcggg

SEQ ID NO: 488165 - DNA, 20 bp, mouse
gcggaacgccgcgcgtcact

SEQ ID NO: 488166 - DNA, 20 bp, mouse
gcggcgtgatgggatgtcag

SEQ ID NO: 488167 - DNA, 20 bp, mouse
ggccaggctggagcagagag

SEQ ID NO: 488168 - DNA, 20 bp, mouse
gctggagcagagagtgggaa

SEQ ID NO: 488169 - DNA, 20 bp, mouse
ggtggaacccatggagacag

SEQ ID NO: 488170 - DNA, 20 bp, mouse
gtaagaaagtaaataaacac

SEQ ID NO: 488171 - DNA, 20 bp, mouse
gtttactctgtcagacgcaa

SEQ ID NO: 488172 - DNA, 20 bp, mouse
gagatctccagtgctggcaa

SEQ ID NO: 488173 - DNA, 20 bp, mouse
gtgccaagcagccagagaat

SEQ ID NO: 488174 - DNA, 20 bp, mouse
ggagacagaggtgagcacgg

SEQ ID NO: 488175 - DNA, 20 bp, mouse
gagaggtgagcacggaggag

SEQ ID NO: 488176 - DNA, 20 bp, mouse
gctccttcagcacagctcgt

SEQ ID NO: 488177 - DNA, 20 bp, mouse
ggaccaacgagctgtgctga

SEQ ID NO: 488178 - DNA, 20 bp, mouse
gcatgaagcgtgctgaaagg

SEQ ID NO: 488179 - DNA, 20 bp, mouse
ggctgccacaggcacacaaa

SEQ ID NO: 488180 - DNA, 20 bp, mouse
gtgacaaaaggagtacttca

SEQ ID NO: 488181 - DNA, 20 bp, mouse
ggcataccacacgctgccac

SEQ ID NO: 488182 - DNA, 20 bp, mouse
gcacagctcgttggtctctg

SEQ ID NO: 488183 - DNA, 20 bp, mouse
gacaaacggaaagatttatg

SEQ ID NO: 488184 - DNA, 20 bp, mouse
ggtgccaactagttgacaaa

SEQ ID NO: 488185 - DNA, 20 bp, mouse
gctgcatgaagcgtgctgaa

SEQ ID NO: 488186 - DNA, 20 bp, mouse
gcggttcagggcctgagaaa

SEQ ID NO: 488187 - DNA, 20 bp, mouse
gtgggagctgggccgagtga

SEQ ID NO: 488188 - DNA, 20 bp, mouse
gaagccctcaagtgacccta

SEQ ID NO: 488189 - DNA, 20 bp, mouse
gattccctagggtcacttga

SEQ ID NO: 488190 - DNA, 20 bp, mouse
gagggcagaacacccacgag

SEQ ID NO: 488191 - DNA, 20 bp, mouse
ggcttctgcgtggcggttca

SEQ ID NO: 488192 - DNA, 20 bp, mouse
gcagctcccaggtctcaatc

SEQ ID NO: 488193 - DNA, 20 bp, mouse
gtcacttgagggcttctgcg

SEQ ID NO: 488194 - DNA, 20 bp, mouse
gcttgagggcttctgcgtgg

SEQ ID NO: 488195 - DNA, 20 bp, mouse
gggttcttgcttattcccta

SEQ ID NO: 488196 - DNA, 20 bp, mouse
gacacctgtagatcacctga

SEQ ID NO: 488197 - DNA, 20 bp, mouse
gctgccatcaggtgatctac

SEQ ID NO: 488198 - DNA, 20 bp, mouse
gtgtggagttgtagccccag

SEQ ID NO: 488199 - DNA, 20 bp, mouse
gtctgtctccagaatctctg

SEQ ID NO: 488200 - DNA, 20 bp, mouse
ggctctcctccaaaacctct

SEQ ID NO: 488201 - DNA, 20 bp, mouse
gagagcgtactggactcaca

SEQ ID NO: 488202 - DNA, 20 bp, mouse
gcagaatctctgtggaaaag

SEQ ID NO: 488203 - DNA, 20 bp, mouse
ggtactggactcacagggta

SEQ ID NO: 488204 - DNA, 20 bp, mouse
gaccattgtttggtacatgt

SEQ ID NO: 488205 - DNA, 20 bp, mouse
ggtgagaagcaaacattggg

SEQ ID NO: 488206 - DNA, 20 bp, mouse
gatcttccaggaagtaagga

SEQ ID NO: 488207 - DNA, 20 bp, mouse
gtgttatcttccaggaagta

SEQ ID NO: 488208 - DNA, 20 bp, mouse
gaagccaggggccgggagag

SEQ ID NO: 488209 - DNA, 20 bp, mouse
gggctaacttaattccacaa

SEQ ID NO: 488210 - DNA, 20 bp, mouse
gggaggaagggagtgattta

SEQ ID NO: 488211 - DNA, 20 bp, mouse
gggacactcagctctaagag

SEQ ID NO: 488212 - DNA, 20 bp, mouse
ggtaggcggtgttatcttcc

SEQ ID NO: 488213 - DNA, 20 bp, mouse
gctggagagcccactttgaa

SEQ ID NO: 488214 - DNA, 20 bp, mouse
gtcactccactttggggagg

SEQ ID NO: 488215 - DNA, 20 bp, mouse
gaaaggctagggtagtctgt

SEQ ID NO: 488216 - DNA, 20 bp, mouse
ggacgccgcgagctacctgt

SEQ ID NO: 488217 - DNA, 20 bp, mouse
gcgtctggtgtggccccatg

SEQ ID NO: 488218 - DNA, 20 bp, mouse
ggcgagccgaggccctgtat

SEQ ID NO: 488219 - DNA, 20 bp, mouse
gggccgcgtgggctcacacg

SEQ ID NO: 488220 - DNA, 20 bp, mouse
gtgggctcacacgaggttag

SEQ ID NO: 488221 - DNA, 20 bp, mouse
ggaaaagcgtcagcgcgtga

SEQ ID NO: 488222 - DNA, 20 bp, mouse
gacagggcctcggctcgcac

SEQ ID NO: 488223 - DNA, 20 bp, mouse
gctgtgggtagaaagagcag

SEQ ID NO: 488224 - DNA, 20 bp, mouse
gcagcgcgtgacggcgcggg

SEQ ID NO: 488225 - DNA, 20 bp, mouse
gcacgaggttagaggtcgtc

SEQ ID NO: 488226 - DNA, 20 bp, mouse
gtgcttcagtgtctcccagg

SEQ ID NO: 488227 - DNA, 20 bp, mouse
gagctctggcgtctctgatg

SEQ ID NO: 488228 - DNA, 20 bp, mouse
gaggccagccagggtgtcat

SEQ ID NO: 488229 - DNA, 20 bp, mouse
gtctgatgtggacctcactt

SEQ ID NO: 488230 - DNA, 20 bp, mouse
gcactgcaaaacctgcctcc

SEQ ID NO: 488231 - DNA, 20 bp, mouse
ggcgctggttcattattcac

SEQ ID NO: 488232 - DNA, 20 bp, mouse
gcacatgcacaaagagtcac

SEQ ID NO: 488233 - DNA, 20 bp, mouse
gacaaggcaggacctgtgac

SEQ ID NO: 488234 - DNA, 20 bp, mouse
ggaagagaagcccagtgctg

SEQ ID NO: 488235 - DNA, 20 bp, mouse
gaccagctggcagagaaagg

SEQ ID NO: 488236 - DNA, 20 bp, mouse
ggaggggccgccaggatcag

SEQ ID NO: 488237 - DNA, 20 bp, mouse
gcgttaggctcggatcttcg

SEQ ID NO: 488238 - DNA, 20 bp, mouse
gaggtggcagcaagaccctc

SEQ ID NO: 488239 - DNA, 20 bp, mouse
ggcagcaagaccctcgggtc

SEQ ID NO: 488240 - DNA, 20 bp, mouse
gtaggctcggatcttcgcgg

SEQ ID NO: 488241 - DNA, 20 bp, mouse
gcttcgcggcggggtctgtg

SEQ ID NO: 488242 - DNA, 20 bp, mouse
gtcctggcgcagtcctaggt

SEQ ID NO: 488243 - DNA, 20 bp, mouse
gcctaacgcaaccggacccg

SEQ ID NO: 488244 - DNA, 20 bp, mouse
gcaagacagggcccctacgc

SEQ ID NO: 488245 - DNA, 20 bp, mouse
gtctgtgtggaggcgtgagg

SEQ ID NO: 488246 - DNA, 20 bp, mouse
gccgacgacaccgtgttctt

SEQ ID NO: 488247 - DNA, 20 bp, mouse
gatcccggatcgcgacgcga

SEQ ID NO: 488248 - DNA, 20 bp, mouse
gtctttgtgttaatagtggg

SEQ ID NO: 488249 - DNA, 20 bp, mouse
gaggcagtgaaggactgtgc

SEQ ID NO: 488250 - DNA, 20 bp, mouse
gcacttgctgagggaggagt

SEQ ID NO: 488251 - DNA, 20 bp, mouse
gtgtcatgtttccttgcggt

SEQ ID NO: 488252 - DNA, 20 bp, mouse
gcagctgtcatgtttccttg

SEQ ID NO: 488253 - DNA, 20 bp, mouse
ggtgttttaggagcggaaga

SEQ ID NO: 488254 - DNA, 20 bp, mouse
gtggactcgtgcctaccgca

SEQ ID NO: 488255 - DNA, 20 bp, mouse
ggctggcagctacgtcttga

SEQ ID NO: 488256 - DNA, 20 bp, mouse
gccatgcccaagcggagctg

SEQ ID NO: 488257 - DNA, 20 bp, mouse
gtgttctgtgaaccacctac

SEQ ID NO: 488258 - DNA, 20 bp, mouse
gagggcccgctcgctcgcac

SEQ ID NO: 488259 - DNA, 20 bp, mouse
gaccatgtcagttggccatc

SEQ ID NO: 488260 - DNA, 20 bp, mouse
gtgcagccagtgcgagcgag

SEQ ID NO: 488261 - DNA, 20 bp, mouse
ggcaaacccgcagctccgct

SEQ ID NO: 488262 - DNA, 20 bp, mouse
gaaagaaccgcagccctagc

SEQ ID NO: 488263 - DNA, 20 bp, mouse
ggagtgagtgctttgatctg

SEQ ID NO: 488264 - DNA, 20 bp, mouse
ggtgtgtatacacacctgct

SEQ ID NO: 488265 - DNA, 20 bp, mouse
gtgtcccctcgcaggttgag

SEQ ID NO: 488266 - DNA, 20 bp, mouse
gagttgatccttgcaagcag

SEQ ID NO: 488267 - DNA, 20 bp, mouse
gaagagactactgaggacaa

SEQ ID NO: 488268 - DNA, 20 bp, mouse
gtcaactggacttctgtaga

SEQ ID NO: 488269 - DNA, 20 bp, mouse
gggccttgttagaggaagtg

SEQ ID NO: 488270 - DNA, 20 bp, mouse
gaagacaaaagagactactg

SEQ ID NO: 488271 - DNA, 20 bp, mouse
ggacttcgtttctatgataa

SEQ ID NO: 488272 - DNA, 20 bp, mouse
ggtaaaataatgtgtctctt

SEQ ID NO: 488273 - DNA, 20 bp, mouse
gacttcttccactgcttgca

SEQ ID NO: 488274 - DNA, 20 bp, mouse
gcaccaacaaaacaaactaa

SEQ ID NO: 488275 - DNA, 20 bp, mouse
gtgataattcttggtacagg

SEQ ID NO: 488276 - DNA, 20 bp, mouse
gcgggataaacagtgagagg

SEQ ID NO: 488277 - DNA, 20 bp, mouse
ggataaacagtgagaggtgg

SEQ ID NO: 488278 - DNA, 20 bp, mouse
gcgaggcagtagagtcgaca

SEQ ID NO: 488279 - DNA, 20 bp, mouse
gctcagaagtaaaactagtc

SEQ ID NO: 488280 - DNA, 20 bp, mouse
ggtccgggataaacagtgag

SEQ ID NO: 488281 - DNA, 20 bp, mouse
ggtcagtgaggattggaatt

SEQ ID NO: 488282 - DNA, 20 bp, mouse
gggtggtggtgaagctagca

SEQ ID NO: 488283 - DNA, 20 bp, mouse
ggtagagtcgacaaggaaat

SEQ ID NO: 488284 - DNA, 20 bp, mouse
ggttgctagggcccagagta

SEQ ID NO: 488285 - DNA, 20 bp, mouse
gcaaagtatacagtaaggat

SEQ ID NO: 488286 - DNA, 20 bp, mouse
gcaacagagcgagctcccgg

SEQ ID NO: 488287 - DNA, 20 bp, mouse
gggcagcggagcaaaggtac

SEQ ID NO: 488288 - DNA, 20 bp, mouse
gggcggcagcttgtagggaa

SEQ ID NO: 488289 - DNA, 20 bp, mouse
gtccggactacaggactcag

SEQ ID NO: 488290 - DNA, 20 bp, mouse
gggtctggcggcagcttgta

SEQ ID NO: 488291 - DNA, 20 bp, mouse
ggggaaaggcagcggagcaa

SEQ ID NO: 488292 - DNA, 20 bp, mouse
gaggagggcgccgggtctgg

SEQ ID NO: 488293 - DNA, 20 bp, mouse
gcctgagaaggggggaaggt

SEQ ID NO: 488294 - DNA, 20 bp, mouse
gctgcagctactgcttcctc

SEQ ID NO: 488295 - DNA, 20 bp, mouse
gggcgacggcggattcctgg

SEQ ID NO: 488296 - DNA, 20 bp, mouse
gtctagccgggtcctcatac

SEQ ID NO: 488297 - DNA, 20 bp, mouse
ggctcccgggagacgctgtc

SEQ ID NO: 488298 - DNA, 20 bp, mouse
ggtctacgacgtggtgagtg

SEQ ID NO: 488299 - DNA, 20 bp, mouse
gtggtgagtgaggcacctgg

SEQ ID NO: 488300 - DNA, 20 bp, mouse
gcctgcgtcttgaggttctc

SEQ ID NO: 488301 - DNA, 20 bp, mouse
gacgtggtgagtgaggcacc

SEQ ID NO: 488302 - DNA, 20 bp, mouse
gtggcagcgtctccgccccg

SEQ ID NO: 488303 - DNA, 20 bp, mouse
gtgagcccgcctgcgtcttg

SEQ ID NO: 488304 - DNA, 20 bp, mouse
ggagcggctggagaacgagg

SEQ ID NO: 488305 - DNA, 20 bp, mouse
gaccgagcggctggagaacg

SEQ ID NO: 488306 - DNA, 20 bp, mouse
ggctctgaacaccacactcc

SEQ ID NO: 488307 - DNA, 20 bp, mouse
gggttcatctaccaggagtg

SEQ ID NO: 488308 - DNA, 20 bp, mouse
gatctcagagttgccccggg

SEQ ID NO: 488309 - DNA, 20 bp, mouse
ggactgctggttcatctacc

SEQ ID NO: 488310 - DNA, 20 bp, mouse
gactactaagtgctgattct

SEQ ID NO: 488311 - DNA, 20 bp, mouse
ggccatgcaaaataatgtat

SEQ ID NO: 488312 - DNA, 20 bp, mouse
gagcacttagtagtggtgtg

SEQ ID NO: 488313 - DNA, 20 bp, mouse
gaactcctgaataaaagcag

SEQ ID NO: 488314 - DNA, 20 bp, mouse
gtggaaaggacttaccaaca

SEQ ID NO: 488315 - DNA, 20 bp, mouse
gtttcagcgctagaattgag

SEQ ID NO: 488316 - DNA, 20 bp, mouse
gtctatgtttgcataatgac

SEQ ID NO: 488317 - DNA, 20 bp, mouse
gtggtgctttgattgactgt

SEQ ID NO: 488318 - DNA, 20 bp, mouse
gcctcaattagttgacatct

SEQ ID NO: 488319 - DNA, 20 bp, mouse
gcacagaaccgaaatgatgg

SEQ ID NO: 488320 - DNA, 20 bp, mouse
gtggaggctacatggtttag

SEQ ID NO: 488321 - DNA, 20 bp, mouse
ggtagtttcagagttaaacc

SEQ ID NO: 488322 - DNA, 20 bp, mouse
ggaacacagaaccgaaatga

SEQ ID NO: 488323 - DNA, 20 bp, mouse
gatttcattgttctaattgg

SEQ ID NO: 488324 - DNA, 20 bp, mouse
gatttctcatgttgttgacc

SEQ ID NO: 488325 - DNA, 20 bp, mouse
gagttacctatttaagtata

SEQ ID NO: 488326 - DNA, 20 bp, mouse
gtggcgccaaggctaagaag

SEQ ID NO: 488327 - DNA, 20 bp, mouse
gttactaaggagcttctgga

SEQ ID NO: 488328 - DNA, 20 bp, mouse
gggcggcatggcgaaactca

SEQ ID NO: 488329 - DNA, 20 bp, mouse
ggtctctcggagaccatgga

SEQ ID NO: 488330 - DNA, 20 bp, mouse
gcgagagactgaagattccc

SEQ ID NO: 488331 - DNA, 20 bp, mouse
gccagctgctggtgaagaac

SEQ ID NO: 488332 - DNA, 20 bp, mouse
gagcaaagttcgggacaagt

SEQ ID NO: 488333 - DNA, 20 bp, mouse
ggtaaataaatctggcgcca

SEQ ID NO: 488334 - DNA, 20 bp, mouse
gaagcttattactccatcca

SEQ ID NO: 488335 - DNA, 20 bp, mouse
gctgtttgacaatctctgta

SEQ ID NO: 488336 - DNA, 20 bp, mouse
ggagcagtcgcgtaacccgg

SEQ ID NO: 488337 - DNA, 20 bp, mouse
gcaggcggcgcagtatggaa

SEQ ID NO: 488338 - DNA, 20 bp, mouse
gtcaggcaggcggcgcagta

SEQ ID NO: 488339 - DNA, 20 bp, mouse
gctgtatgcgaggcatacac

SEQ ID NO: 488340 - DNA, 20 bp, mouse
gcaaagcttgcccaacaccc

SEQ ID NO: 488341 - DNA, 20 bp, mouse
gtatgagaatcccgggtgtt

SEQ ID NO: 488342 - DNA, 20 bp, mouse
gccacaggggcttatatctg

SEQ ID NO: 488343 - DNA, 20 bp, mouse
gcccgggattctcataaata

SEQ ID NO: 488344 - DNA, 20 bp, mouse
gtgacgccagcagccggaaa

SEQ ID NO: 488345 - DNA, 20 bp, mouse
gacggcctgcgggagctagg

SEQ ID NO: 488346 - DNA, 20 bp, mouse
gggcatggtggcgctgaaca

SEQ ID NO: 488347 - DNA, 20 bp, mouse
ggcgggcttggtctgtccgg

SEQ ID NO: 488348 - DNA, 20 bp, mouse
gatggatatacagtgcgtgc

SEQ ID NO: 488349 - DNA, 20 bp, mouse
gcggcgtcgactttcccctt

SEQ ID NO: 488350 - DNA, 20 bp, mouse
gtatacagtgcgtgcgggct

SEQ ID NO: 488351 - DNA, 20 bp, mouse
ggggaaagtcgacgccggta

SEQ ID NO: 488352 - DNA, 20 bp, mouse
gcgtgcgggcttggtctgtc

SEQ ID NO: 488353 - DNA, 20 bp, mouse
gagcagcgaggacaaacccc

SEQ ID NO: 488354 - DNA, 20 bp, mouse
gtaattaagaaatgcaagtt

SEQ ID NO: 488355 - DNA, 20 bp, mouse
gaaaatgcacacacgacact

SEQ ID NO: 488356 - DNA, 20 bp, mouse
gcccagacggtggaagtcga

SEQ ID NO: 488357 - DNA, 20 bp, mouse
gtgctcacctacagcctagg

SEQ ID NO: 488358 - DNA, 20 bp, mouse
gtctgagctgccccagacgg

SEQ ID NO: 488359 - DNA, 20 bp, mouse
gagacggtggaagtcgaagg

SEQ ID NO: 488360 - DNA, 20 bp, mouse
gtgtaggtgagcacgtcctg

SEQ ID NO: 488361 - DNA, 20 bp, mouse
gaagtcgaaggcggtgatgt

SEQ ID NO: 488362 - DNA, 20 bp, mouse
gagctcgctgcctagtcccc

SEQ ID NO: 488363 - DNA, 20 bp, mouse
ggccggcccagaagacgatc

SEQ ID NO: 488364 - DNA, 20 bp, mouse
gaccacgagccagaagcgca

SEQ ID NO: 488365 - DNA, 20 bp, mouse
gggtgatgaagttgccgcct

SEQ ID NO: 488366 - DNA, 20 bp, mouse
ggctagtaggacactggagc

SEQ ID NO: 488367 - DNA, 20 bp, mouse
ggtgaggtaacccacaccag

SEQ ID NO: 488368 - DNA, 20 bp, mouse
gtgtcaggtggtacagaaca

SEQ ID NO: 488369 - DNA, 20 bp, mouse
gcagccagtccaaggatgtt

SEQ ID NO: 488370 - DNA, 20 bp, mouse
gcctgagcatgtgtgtcagg

SEQ ID NO: 488371 - DNA, 20 bp, mouse
gagaatagattccctctcca

SEQ ID NO: 488372 - DNA, 20 bp, mouse
ggtactcgagcacacccaca

SEQ ID NO: 488373 - DNA, 20 bp, mouse
ggctatgcgcttcatgccac

SEQ ID NO: 488374 - DNA, 20 bp, mouse
gtacctcaccagccagtcca

SEQ ID NO: 488375 - DNA, 20 bp, mouse
gcgcttcatgccactggtgt

SEQ ID NO: 488376 - DNA, 20 bp, mouse
gcattggacatgtacttagg

SEQ ID NO: 488377 - DNA, 20 bp, mouse
gtccatgctatacagtgtgg

SEQ ID NO: 488378 - DNA, 20 bp, mouse
ggcatccatgctatacagtg

SEQ ID NO: 488379 - DNA, 20 bp, mouse
gtaccattggacatgtactt

SEQ ID NO: 488380 - DNA, 20 bp, mouse
gaaaatgtgaatttagggct

SEQ ID NO: 488381 - DNA, 20 bp, mouse
gggatgtcagtcattcggca

SEQ ID NO: 488382 - DNA, 20 bp, mouse
gtcccccacactgtatagca

SEQ ID NO: 488383 - DNA, 20 bp, mouse
gcacagaaggagtataacaa

SEQ ID NO: 488384 - DNA, 20 bp, mouse
ggataacaaacatcatctct

SEQ ID NO: 488385 - DNA, 20 bp, mouse
gaatgactgacatccaaatc

SEQ ID NO: 488386 - DNA, 20 bp, mouse
gacacgcctcggggacaccc

SEQ ID NO: 488387 - DNA, 20 bp, mouse
gcgcccgcgggcgaagaggt

SEQ ID NO: 488388 - DNA, 20 bp, mouse
ggaagagcggagtttcgcgg

SEQ ID NO: 488389 - DNA, 20 bp, mouse
gcttgcgcccgcgggcgaag

SEQ ID NO: 488390 - DNA, 20 bp, mouse
ggagcactcgcagaccagtg

SEQ ID NO: 488391 - DNA, 20 bp, mouse
gactcgcagaccagtgagga

SEQ ID NO: 488392 - DNA, 20 bp, mouse
gtggcttcaggctgccgacg

SEQ ID NO: 488393 - DNA, 20 bp, mouse
ggaccgacctcttcgcccgc

SEQ ID NO: 488394 - DNA, 20 bp, mouse
gggggaagagcggagtttcg

SEQ ID NO: 488395 - DNA, 20 bp, mouse
ggccaagatccctggctatg

SEQ ID NO: 488396 - DNA, 20 bp, mouse
gcagcgaactgactcttcgg

SEQ ID NO: 488397 - DNA, 20 bp, mouse
gatcgcgcgcgccgacactg

SEQ ID NO: 488398 - DNA, 20 bp, mouse
gccgcagcgaactgactctt

SEQ ID NO: 488399 - DNA, 20 bp, mouse
gcggcgcgggccggagaagg

SEQ ID NO: 488400 - DNA, 20 bp, mouse
gcccgcgcgcgcgcaaacaa

SEQ ID NO: 488401 - DNA, 20 bp, mouse
gcgccgagcgcactggagca

SEQ ID NO: 488402 - DNA, 20 bp, mouse
gcgccgacactggggaccgc

SEQ ID NO: 488403 - DNA, 20 bp, mouse
gaagcaaccgaacacccggg

SEQ ID NO: 488404 - DNA, 20 bp, mouse
gggctcccgaaccccccgac

SEQ ID NO: 488405 - DNA, 20 bp, mouse
ggtcagttcgctgcggcccg

SEQ ID NO: 488406 - DNA, 20 bp, mouse
gtccagaggacggatcttgg

SEQ ID NO: 488407 - DNA, 20 bp, mouse
gaagcttttcggctttcagc

SEQ ID NO: 488408 - DNA, 20 bp, mouse
gaaatccagaggacggatct

SEQ ID NO: 488409 - DNA, 20 bp, mouse
gtcttcggagacaaatccag

SEQ ID NO: 488410 - DNA, 20 bp, mouse
ggggtggaacttgggtggca

SEQ ID NO: 488411 - DNA, 20 bp, mouse
gagacagacccagattgagg

SEQ ID NO: 488412 - DNA, 20 bp, mouse
gaacagacagacccagattg

SEQ ID NO: 488413 - DNA, 20 bp, mouse
gcggagacaaatccagagga

SEQ ID NO: 488414 - DNA, 20 bp, mouse
gcacagactgtgtggtaccc

SEQ ID NO: 488415 - DNA, 20 bp, mouse
gtggaacttgggtggcatgg

SEQ ID NO: 488416 - DNA, 20 bp, mouse
ggtgtgtgagagtgagagac

SEQ ID NO: 488417 - DNA, 20 bp, mouse
gtgatgctacagaagtatgt

SEQ ID NO: 488418 - DNA, 20 bp, mouse
ggaagaaaatcaaagataca

SEQ ID NO: 488419 - DNA, 20 bp, mouse
gaagtttcactcgagcaatt

SEQ ID NO: 488420 - DNA, 20 bp, mouse
gtcaaagatacatggtgtac

SEQ ID NO: 488421 - DNA, 20 bp, mouse
gccagttgagcactgcagat

SEQ ID NO: 488422 - DNA, 20 bp, mouse
ggctgcaccaggcagttatc

SEQ ID NO: 488423 - DNA, 20 bp, mouse
gtccaagtcccagctgcacc

SEQ ID NO: 488424 - DNA, 20 bp, mouse
ggtgctcaactggtatgtac

SEQ ID NO: 488425 - DNA, 20 bp, mouse
gctgcagcctgataactgcc

SEQ ID NO: 488426 - DNA, 20 bp, mouse
ggctggagagcccttgactg

SEQ ID NO: 488427 - DNA, 20 bp, mouse
ggcaggaccgggctttgcag

SEQ ID NO: 488428 - DNA, 20 bp, mouse
gacggctcggccataaggaa

SEQ ID NO: 488429 - DNA, 20 bp, mouse
gcccttgactgaggctaaga

SEQ ID NO: 488430 - DNA, 20 bp, mouse
gcactagaaggggcaggacc

SEQ ID NO: 488431 - DNA, 20 bp, mouse
gtccttcttagcctcagtca

SEQ ID NO: 488432 - DNA, 20 bp, mouse
ggccctcaccgggaacaagt

SEQ ID NO: 488433 - DNA, 20 bp, mouse
gacttccacagggctactag

SEQ ID NO: 488434 - DNA, 20 bp, mouse
ggaagccactagtagccctg

SEQ ID NO: 488435 - DNA, 20 bp, mouse
gtcagaggcggtgaagcgag

SEQ ID NO: 488436 - DNA, 20 bp, mouse
gtgtgaaggtaagagtcggt

SEQ ID NO: 488437 - DNA, 20 bp, mouse
gttaccttcacaggagggtg

SEQ ID NO: 488438 - DNA, 20 bp, mouse
ggatcaagtattggtcagtg

SEQ ID NO: 488439 - DNA, 20 bp, mouse
ggactcttaccttcacagga

SEQ ID NO: 488440 - DNA, 20 bp, mouse
gcgaccgcaccctcctgtga

SEQ ID NO: 488441 - DNA, 20 bp, mouse
gtggggcccaaagacagtag

SEQ ID NO: 488442 - DNA, 20 bp, mouse
ggtcagtggggcagcgctct

SEQ ID NO: 488443 - DNA, 20 bp, mouse
gagtattacgggtctgcaga

SEQ ID NO: 488444 - DNA, 20 bp, mouse
ggagttgaatgaagtattac

SEQ ID NO: 488445 - DNA, 20 bp, mouse
gcaggtttagaaggacccgt

SEQ ID NO: 488446 - DNA, 20 bp, mouse
gatgcttcggggcacgagca

SEQ ID NO: 488447 - DNA, 20 bp, mouse
ggattcagccccagaagaaa

SEQ ID NO: 488448 - DNA, 20 bp, mouse
gtcagtgaacgatgtacagt

SEQ ID NO: 488449 - DNA, 20 bp, mouse
gcgagggagcctggtgtcac

SEQ ID NO: 488450 - DNA, 20 bp, mouse
gcaaagcagacgcacagatt

SEQ ID NO: 488451 - DNA, 20 bp, mouse
gtgcacacccatttcttctg

SEQ ID NO: 488452 - DNA, 20 bp, mouse
gatgaggagatggcccgtgc

SEQ ID NO: 488453 - DNA, 20 bp, mouse
gtctctgctcccgtgacacc

SEQ ID NO: 488454 - DNA, 20 bp, mouse
gacgagcagggaagacatca

SEQ ID NO: 488455 - DNA, 20 bp, mouse
ggaggcccaagatgaggaga

SEQ ID NO: 488456 - DNA, 20 bp, mouse
gcttgaaccgcggtaagggt

SEQ ID NO: 488457 - DNA, 20 bp, mouse
gcaccaccccacccttaccg

SEQ ID NO: 488458 - DNA, 20 bp, mouse
gttcgcggttccttgaaccg

SEQ ID NO: 488459 - DNA, 20 bp, mouse
ggttccttgaaccgcggtaa

SEQ ID NO: 488460 - DNA, 20 bp, mouse
ggtccacggggcccaaggca

SEQ ID NO: 488461 - DNA, 20 bp, mouse
gtgcagcgagtagcggtcag

SEQ ID NO: 488462 - DNA, 20 bp, mouse
ggccgccctgcagcgagtag

SEQ ID NO: 488463 - DNA, 20 bp, mouse
gcccaaggcagggtgggact

SEQ ID NO: 488464 - DNA, 20 bp, mouse
gcgcccgcgctgcttgttcg

SEQ ID NO: 488465 - DNA, 20 bp, mouse
ggaaccgcgaacaagcagcg

SEQ ID NO: 488466 - DNA, 20 bp, mouse
gcatgcatgggtaccctagg

SEQ ID NO: 488467 - DNA, 20 bp, mouse
gacacatgcatgggtaccct

SEQ ID NO: 488468 - DNA, 20 bp, mouse
gggaatgcaatccccaaagt

SEQ ID NO: 488469 - DNA, 20 bp, mouse
ggtttgtgtgctgctccatg

SEQ ID NO: 488470 - DNA, 20 bp, mouse
gcatagcatatcccttgaac

SEQ ID NO: 488471 - DNA, 20 bp, mouse
gtttgttcctaccaaccaca

SEQ ID NO: 488472 - DNA, 20 bp, mouse
gatctcagcttcagactgga

SEQ ID NO: 488473 - DNA, 20 bp, mouse
gaatcagaccccaagaaaca

SEQ ID NO: 488474 - DNA, 20 bp, mouse
gagctgacagtacagcatca

SEQ ID NO: 488475 - DNA, 20 bp, mouse
ggaaatgcctctaaattatg

SEQ ID NO: 488476 - DNA, 20 bp, mouse
gagcatgcaaagagtcattg

SEQ ID NO: 488477 - DNA, 20 bp, mouse
gcctgtgaatgcgagcgaca

SEQ ID NO: 488478 - DNA, 20 bp, mouse
gtgtatatgttctctgcatc

SEQ ID NO: 488479 - DNA, 20 bp, mouse
gttgtcatgactatttatat

SEQ ID NO: 488480 - DNA, 20 bp, mouse
ggactatttatattggagag

SEQ ID NO: 488481 - DNA, 20 bp, mouse
gatcatgaaagtatacatag

SEQ ID NO: 488482 - DNA, 20 bp, mouse
gcttatgaatgggctaactg

SEQ ID NO: 488483 - DNA, 20 bp, mouse
gaatattaaatatgttcata

SEQ ID NO: 488484 - DNA, 20 bp, mouse
gtatactttcatgatcatga

SEQ ID NO: 488485 - DNA, 20 bp, mouse
gtgattacagaaatgtgcaa

SEQ ID NO: 488486 - DNA, 20 bp, mouse
ggtcagagggactcttatgt

SEQ ID NO: 488487 - DNA, 20 bp, mouse
ggaagcatcgtcgctcgcaa

SEQ ID NO: 488488 - DNA, 20 bp, mouse
ggccaggtccagacacagca

SEQ ID NO: 488489 - DNA, 20 bp, mouse
gcgagcgacgatgcttcccc

SEQ ID NO: 488490 - DNA, 20 bp, mouse
gggccttcagtgagcagtac

SEQ ID NO: 488491 - DNA, 20 bp, mouse
gtcgtagatgggcataatgt

SEQ ID NO: 488492 - DNA, 20 bp, mouse
ggcagtacagggtactcctc

SEQ ID NO: 488493 - DNA, 20 bp, mouse
ggtacaaccagatgcatata

SEQ ID NO: 488494 - DNA, 20 bp, mouse
gcagctcattgtaaaaggta

SEQ ID NO: 488495 - DNA, 20 bp, mouse
gaccctgtactgctcactga

SEQ ID NO: 488496 - DNA, 20 bp, mouse
ggaaaactctcgggttgaag

SEQ ID NO: 488497 - DNA, 20 bp, mouse
gttgtgacccagaaaactct

SEQ ID NO: 488498 - DNA, 20 bp, mouse
gcatagaggttatagaagcc

SEQ ID NO: 488499 - DNA, 20 bp, mouse
gcatgcccatcaactttgtg

SEQ ID NO: 488500 - DNA, 20 bp, mouse
gccctagaaacagttctttt

SEQ ID NO: 488501 - DNA, 20 bp, mouse
gctctttttcccactctgcc

SEQ ID NO: 488502 - DNA, 20 bp, mouse
gttggccacacaaagttgat

SEQ ID NO: 488503 - DNA, 20 bp, mouse
ggatcacagagaggtcgtgg

SEQ ID NO: 488504 - DNA, 20 bp, mouse
ggaggtcgtggaggtagatc

SEQ ID NO: 488505 - DNA, 20 bp, mouse
gaaagttgatgggcatgtgg

SEQ ID NO: 488506 - DNA, 20 bp, mouse
gcatatctcaaggagtctga

SEQ ID NO: 488507 - DNA, 20 bp, mouse
gctgctctgtagttccttgt

SEQ ID NO: 488508 - DNA, 20 bp, mouse
ggtcaaggaggcatctactg

SEQ ID NO: 488509 - DNA, 20 bp, mouse
gtccaagttaacatatctca

SEQ ID NO: 488510 - DNA, 20 bp, mouse
gttgttacaacagaatgata

SEQ ID NO: 488511 - DNA, 20 bp, mouse
gcaggagatctagcagtgag

SEQ ID NO: 488512 - DNA, 20 bp, mouse
gtccttgagatatgttaact

SEQ ID NO: 488513 - DNA, 20 bp, mouse
ggaattcctagtgcactgag

SEQ ID NO: 488514 - DNA, 20 bp, mouse
gggctctgaccgctgctgtg

SEQ ID NO: 488515 - DNA, 20 bp, mouse
gctcctgctcgtctctgcta

SEQ ID NO: 488516 - DNA, 20 bp, mouse
ggtggcgagtggattagagt

SEQ ID NO: 488517 - DNA, 20 bp, mouse
gcttaaatcactccaggctg

SEQ ID NO: 488518 - DNA, 20 bp, mouse
gcactccaggctgtggcgag

SEQ ID NO: 488519 - DNA, 20 bp, mouse
gtcagagaaacggccttgtt

SEQ ID NO: 488520 - DNA, 20 bp, mouse
gccctgccttaaatcactcc

SEQ ID NO: 488521 - DNA, 20 bp, mouse
gcggctccaagtgcctaaca

SEQ ID NO: 488522 - DNA, 20 bp, mouse
gggaaacagggagcgacaga

SEQ ID NO: 488523 - DNA, 20 bp, mouse
ggactgatgagctctggtaa

SEQ ID NO: 488524 - DNA, 20 bp, mouse
ggggcgggcgtgaaataacc

SEQ ID NO: 488525 - DNA, 20 bp, mouse
gtaatccactcgccacagcc

SEQ ID NO: 488526 - DNA, 20 bp, mouse
ggtggggcagcgcaggtcgt

SEQ ID NO: 488527 - DNA, 20 bp, mouse
gcccggagctgggagcccga

SEQ ID NO: 488528 - DNA, 20 bp, mouse
ggggcagcgcaggtcgtggg

SEQ ID NO: 488529 - DNA, 20 bp, mouse
ggctgggagcccgatggctg

SEQ ID NO: 488530 - DNA, 20 bp, mouse
gagaaagaccaggtgcactt

SEQ ID NO: 488531 - DNA, 20 bp, mouse
gcgccatcttccacagccat

SEQ ID NO: 488532 - DNA, 20 bp, mouse
gtgctctgccaaagtgcacc

SEQ ID NO: 488533 - DNA, 20 bp, mouse
gggtggagggcgtcaaggat

SEQ ID NO: 488534 - DNA, 20 bp, mouse
gatgggtcgaccgtcatgct

SEQ ID NO: 488535 - DNA, 20 bp, mouse
ggtggtgtgctcctacctgg

SEQ ID NO: 488536 - DNA, 20 bp, mouse
gcaaatagcacagaaagatg

SEQ ID NO: 488537 - DNA, 20 bp, mouse
gatgaggcatctcagtaatt

SEQ ID NO: 488538 - DNA, 20 bp, mouse
gcctagaagctgtgaagtgg

SEQ ID NO: 488539 - DNA, 20 bp, mouse
gcagtgacctgatagtgtgt

SEQ ID NO: 488540 - DNA, 20 bp, mouse
gaagccctcttgctcaacgg

SEQ ID NO: 488541 - DNA, 20 bp, mouse
ggctcaacggaggaagtaga

SEQ ID NO: 488542 - DNA, 20 bp, mouse
gcagttggtgagctgtgtac

SEQ ID NO: 488543 - DNA, 20 bp, mouse
ggaaaggttcaggttaggac

SEQ ID NO: 488544 - DNA, 20 bp, mouse
gagcagagtgcagtgggcac

SEQ ID NO: 488545 - DNA, 20 bp, mouse
gggtggtaagcatgacacac

SEQ ID NO: 488546 - DNA, 20 bp, mouse
gggcatggggctcatcctag

SEQ ID NO: 488547 - DNA, 20 bp, mouse
gcctctccaccaaggtgatt

SEQ ID NO: 488548 - DNA, 20 bp, mouse
gaatgtccatctgaggtctg

SEQ ID NO: 488549 - DNA, 20 bp, mouse
gagatgcccaatcaccttgg

SEQ ID NO: 488550 - DNA, 20 bp, mouse
ggaaagatgcccaatcacct

SEQ ID NO: 488551 - DNA, 20 bp, mouse
gtgggagatggcttaaggta

SEQ ID NO: 488552 - DNA, 20 bp, mouse
gtgttctggaccgtgggaga

SEQ ID NO: 488553 - DNA, 20 bp, mouse
gacaaatagcctctccacca

SEQ ID NO: 488554 - DNA, 20 bp, mouse
gcatctgaggtctgtggcat

SEQ ID NO: 488555 - DNA, 20 bp, mouse
gagggacgtgtttcattcag

SEQ ID NO: 488556 - DNA, 20 bp, mouse
gacaggagagctgctaccag

SEQ ID NO: 488557 - DNA, 20 bp, mouse
gtgagggagtgggatgaact

SEQ ID NO: 488558 - DNA, 20 bp, mouse
gtgagagctggaagtagaga

SEQ ID NO: 488559 - DNA, 20 bp, mouse
gggtagcagctctcctgtct

SEQ ID NO: 488560 - DNA, 20 bp, mouse
gcacatggcgaagagcccca

SEQ ID NO: 488561 - DNA, 20 bp, mouse
ggcggctgctacagctggtg

SEQ ID NO: 488562 - DNA, 20 bp, mouse
gcacccctgaaaatgtatgc

SEQ ID NO: 488563 - DNA, 20 bp, mouse
gacaggaaaaggaccgtaca

SEQ ID NO: 488564 - DNA, 20 bp, mouse
gctctctgacttctctcccc

SEQ ID NO: 488565 - DNA, 20 bp, mouse
gggtggggtagctggctccg

SEQ ID NO: 488566 - DNA, 20 bp, mouse
gtactccccgcgaaatggag

SEQ ID NO: 488567 - DNA, 20 bp, mouse
gcctgggacgcgtgcagtaa

SEQ ID NO: 488568 - DNA, 20 bp, mouse
ggcgcttctaacgcagagtc

SEQ ID NO: 488569 - DNA, 20 bp, mouse
gaggtctactccccgcgaaa

SEQ ID NO: 488570 - DNA, 20 bp, mouse
gcgcgaaatggagcgggtgt

SEQ ID NO: 488571 - DNA, 20 bp, mouse
ggccaaggcggcacacgagg

SEQ ID NO: 488572 - DNA, 20 bp, mouse
ggcgcgcccagcaactcgcc

SEQ ID NO: 488573 - DNA, 20 bp, mouse
gtaacgcagagtcgggagcc

SEQ ID NO: 488574 - DNA, 20 bp, mouse
gaggccccgcgtgctccgag

SEQ ID NO: 488575 - DNA, 20 bp, mouse
ggggagcccggcgagttgct

SEQ ID NO: 488576 - DNA, 20 bp, mouse
ggtcacacgcgcacacacca

SEQ ID NO: 488577 - DNA, 20 bp, mouse
ggcacacaccacggcctctc

SEQ ID NO: 488578 - DNA, 20 bp, mouse
gactcagacgaagtcagatc

SEQ ID NO: 488579 - DNA, 20 bp, mouse
gtggcagtctgtgaggagct

SEQ ID NO: 488580 - DNA, 20 bp, mouse
gatatcaacttgtctactat

SEQ ID NO: 488581 - DNA, 20 bp, mouse
ggtgaagcttccaagttgat

SEQ ID NO: 488582 - DNA, 20 bp, mouse
gcaatggacaagctgcatta

SEQ ID NO: 488583 - DNA, 20 bp, mouse
gagggttgcctgttgaaaac

SEQ ID NO: 488584 - DNA, 20 bp, mouse
gttgcttgtgacatttagca

SEQ ID NO: 488585 - DNA, 20 bp, mouse
gcttactctcccaatcaact

SEQ ID NO: 488586 - DNA, 20 bp, mouse
gagagtggaggcagcgagta

SEQ ID NO: 488587 - DNA, 20 bp, mouse
ggtatggaactggaccaggt

SEQ ID NO: 488588 - DNA, 20 bp, mouse
gctcagagcgagatgagtac

SEQ ID NO: 488589 - DNA, 20 bp, mouse
ggcgagtatggaactggacc

SEQ ID NO: 488590 - DNA, 20 bp, mouse
ggcacactgtctactgaggg

SEQ ID NO: 488591 - DNA, 20 bp, mouse
gtccttcttcgtttccgacc

SEQ ID NO: 488592 - DNA, 20 bp, mouse
gaggaaggcagaggatttct

SEQ ID NO: 488593 - DNA, 20 bp, mouse
gtcaaataaactgtccagga

SEQ ID NO: 488594 - DNA, 20 bp, mouse
ggagatcaattgctggtcca

SEQ ID NO: 488595 - DNA, 20 bp, mouse
gtaccaggctagagaaagtg

SEQ ID NO: 488596 - DNA, 20 bp, mouse
gctccgtggacgcaccacgt

SEQ ID NO: 488597 - DNA, 20 bp, mouse
ggtcggtcgcttaacaagac

SEQ ID NO: 488598 - DNA, 20 bp, mouse
ggagcttgacaagctctccg

SEQ ID NO: 488599 - DNA, 20 bp, mouse
gtacggaacgcgacaagcgg

SEQ ID NO: 488600 - DNA, 20 bp, mouse
ggaccgacgtggtgcgtcca

SEQ ID NO: 488601 - DNA, 20 bp, mouse
gcgatcggtgaggagccccg

SEQ ID NO: 488602 - DNA, 20 bp, mouse
gcgcaccgcgtggacacgat

SEQ ID NO: 488603 - DNA, 20 bp, mouse
gcgcgtggacacgatcggtg

SEQ ID NO: 488604 - DNA, 20 bp, mouse
gtctctgagatgacaatacg

SEQ ID NO: 488605 - DNA, 20 bp, mouse
gcgctgcggaggcgacgcaa

SEQ ID NO: 488606 - DNA, 20 bp, mouse
gacattggtgacattcataa

SEQ ID NO: 488607 - DNA, 20 bp, mouse
gcaatgcggttatcttagtt

SEQ ID NO: 488608 - DNA, 20 bp, mouse
gtagtctccaagtgcataaa

SEQ ID NO: 488609 - DNA, 20 bp, mouse
gagactattgtgatatgaga

SEQ ID NO: 488610 - DNA, 20 bp, mouse
gagggtttactgctgggaac

SEQ ID NO: 488611 - DNA, 20 bp, mouse
gttagttagggtttactgct

SEQ ID NO: 488612 - DNA, 20 bp, mouse
gcgcattgattgcatccata

SEQ ID NO: 488613 - DNA, 20 bp, mouse
gaaaaagacaacactgcagc

SEQ ID NO: 488614 - DNA, 20 bp, mouse
gatgtgtccttttatgcact

SEQ ID NO: 488615 - DNA, 20 bp, mouse
gaacatgacagcatccatgc

SEQ ID NO: 488616 - DNA, 20 bp, mouse
gagagttggcagacacccta

SEQ ID NO: 488617 - DNA, 20 bp, mouse
gaggcacacatggtaacata

SEQ ID NO: 488618 - DNA, 20 bp, mouse
gcaccctaaggtccccttag

SEQ ID NO: 488619 - DNA, 20 bp, mouse
gggactctcaatgaattctt

SEQ ID NO: 488620 - DNA, 20 bp, mouse
gcattagaggaacctggatt

SEQ ID NO: 488621 - DNA, 20 bp, mouse
ggtacagcaaagttagagag

SEQ ID NO: 488622 - DNA, 20 bp, mouse
ggtcctctaaggggacctta

SEQ ID NO: 488623 - DNA, 20 bp, mouse
gtctaatgtatcaggctggt

SEQ ID NO: 488624 - DNA, 20 bp, mouse
gttcattgagagtcctctaa

SEQ ID NO: 488625 - DNA, 20 bp, mouse
gtaaaatgtcaccttccggt

SEQ ID NO: 488626 - DNA, 20 bp, mouse
ggttctcagaggatttataa

SEQ ID NO: 488627 - DNA, 20 bp, mouse
gtgttctagcaagttctcag

SEQ ID NO: 488628 - DNA, 20 bp, mouse
ggctgtgtcagggagctcag

SEQ ID NO: 488629 - DNA, 20 bp, mouse
ggcccagctccggaacagac

SEQ ID NO: 488630 - DNA, 20 bp, mouse
gggagctgggccattcacac

SEQ ID NO: 488631 - DNA, 20 bp, mouse
gaggccacccagaacactga

SEQ ID NO: 488632 - DNA, 20 bp, mouse
gcacggctgggacatcaaca

SEQ ID NO: 488633 - DNA, 20 bp, mouse
gatgcgcagcccccaagtat

SEQ ID NO: 488634 - DNA, 20 bp, mouse
ggtcaatccaggccagatgt

SEQ ID NO: 488635 - DNA, 20 bp, mouse
gcagatgtcggggtaaaaag

SEQ ID NO: 488636 - DNA, 20 bp, mouse
ggacttccgactgagaaggg

SEQ ID NO: 488637 - DNA, 20 bp, mouse
ggagaaccagagcctcctgt

SEQ ID NO: 488638 - DNA, 20 bp, mouse
ggtggccaggactgacttag

SEQ ID NO: 488639 - DNA, 20 bp, mouse
gcagagggcaaatgaatcac

SEQ ID NO: 488640 - DNA, 20 bp, mouse
gagcctcctgtgggtagtcc

SEQ ID NO: 488641 - DNA, 20 bp, mouse
ggcagccactaagtcagtcc

SEQ ID NO: 488642 - DNA, 20 bp, mouse
gagcccggactacccacagg

SEQ ID NO: 488643 - DNA, 20 bp, mouse
gaacagcccggactacccac

SEQ ID NO: 488644 - DNA, 20 bp, mouse
gatgtgttctgtccagataa

SEQ ID NO: 488645 - DNA, 20 bp, mouse
gtccgacttccgactgagaa

SEQ ID NO: 488646 - DNA, 20 bp, mouse
gcagtgagtgcaccagtaaa

SEQ ID NO: 488647 - DNA, 20 bp, mouse
gccggcccagttcacagaca

SEQ ID NO: 488648 - DNA, 20 bp, mouse
gtcccggtgtgacaaagcca

SEQ ID NO: 488649 - DNA, 20 bp, mouse
gcggacagtgaaataaccac

SEQ ID NO: 488650 - DNA, 20 bp, mouse
gagctttggtagactgacag

SEQ ID NO: 488651 - DNA, 20 bp, mouse
gcactgttctgaagacgttc

SEQ ID NO: 488652 - DNA, 20 bp, mouse
gcctgacaggcacagtcccg

SEQ ID NO: 488653 - DNA, 20 bp, mouse
gagccacactgtgagacggt

SEQ ID NO: 488654 - DNA, 20 bp, mouse
gcacggtctttgccgtttac

SEQ ID NO: 488655 - DNA, 20 bp, mouse
gcagagatctaagcaattgt

SEQ ID NO: 488656 - DNA, 20 bp, mouse
ggccaagtgatggcagtcaa

SEQ ID NO: 488657 - DNA, 20 bp, mouse
gtggccagtgctctagacgt

SEQ ID NO: 488658 - DNA, 20 bp, mouse
gagcatcgcccattaagcta

SEQ ID NO: 488659 - DNA, 20 bp, mouse
gcagtgctctagacgtgggt

SEQ ID NO: 488660 - DNA, 20 bp, mouse
ggcacatgccatagcttaat

SEQ ID NO: 488661 - DNA, 20 bp, mouse
ggctctagacgtgggtggga

SEQ ID NO: 488662 - DNA, 20 bp, mouse
gaacatgtttctgtgatacc

SEQ ID NO: 488663 - DNA, 20 bp, mouse
gcattcttcacgccaagtga

SEQ ID NO: 488664 - DNA, 20 bp, mouse
gcacttctcagattagcggt

SEQ ID NO: 488665 - DNA, 20 bp, mouse
gcactctgtgatgcggtcat

SEQ ID NO: 488666 - DNA, 20 bp, mouse
ggtggagtaaagctaggaag

SEQ ID NO: 488667 - DNA, 20 bp, mouse
gtaggaaggggtacaaacac

SEQ ID NO: 488668 - DNA, 20 bp, mouse
gtcttgtgtggagtaaagct

SEQ ID NO: 488669 - DNA, 20 bp, mouse
gtggacccagatgtcttgtg

SEQ ID NO: 488670 - DNA, 20 bp, mouse
gctgacaggaaagctagcaa

SEQ ID NO: 488671 - DNA, 20 bp, mouse
gctaggtctactaggctcca

SEQ ID NO: 488672 - DNA, 20 bp, mouse
gagcaaaggctaggtctact

SEQ ID NO: 488673 - DNA, 20 bp, mouse
gtgggatcaagggaactgaa

SEQ ID NO: 488674 - DNA, 20 bp, mouse
gtgaagctctctcctcaggg

SEQ ID NO: 488675 - DNA, 20 bp, mouse
gcccacaatgaagtagaaga

SEQ ID NO: 488676 - DNA, 20 bp, mouse
gagccgtcctcagtccacta

SEQ ID NO: 488677 - DNA, 20 bp, mouse
ggtgttaagggctcatactc

SEQ ID NO: 488678 - DNA, 20 bp, mouse
gggtattgtcaaagcaatct

SEQ ID NO: 488679 - DNA, 20 bp, mouse
gctgaggacggctcagttga

SEQ ID NO: 488680 - DNA, 20 bp, mouse
gtgctttgacaataccttag

SEQ ID NO: 488681 - DNA, 20 bp, mouse
gattcttcaagtattggggt

SEQ ID NO: 488682 - DNA, 20 bp, mouse
ggcctttatgttagcatggc

SEQ ID NO: 488683 - DNA, 20 bp, mouse
ggctttttcttcagtgttaa

SEQ ID NO: 488684 - DNA, 20 bp, mouse
gagataacattcaaagctga

SEQ ID NO: 488685 - DNA, 20 bp, mouse
gctgggattttttcatttat

SEQ ID NO: 488686 - DNA, 20 bp, mouse
gtattgtctgctgtggagta

SEQ ID NO: 488687 - DNA, 20 bp, mouse
ggttgctttggtatcctgaa

SEQ ID NO: 488688 - DNA, 20 bp, mouse
gattgagtggaaatgtaata

SEQ ID NO: 488689 - DNA, 20 bp, mouse
gtggctgatattgtctgctg

SEQ ID NO: 488690 - DNA, 20 bp, mouse
ggttgcttctacaaatgcag

SEQ ID NO: 488691 - DNA, 20 bp, mouse
gagaagggaactaaatgtca

SEQ ID NO: 488692 - DNA, 20 bp, mouse
gtgactgctgagaacataaa

SEQ ID NO: 488693 - DNA, 20 bp, mouse
ggagagccattccaccaacc

SEQ ID NO: 488694 - DNA, 20 bp, mouse
gtctgttaactggacctggt

SEQ ID NO: 488695 - DNA, 20 bp, mouse
ggttaactggacctggttgg

SEQ ID NO: 488696 - DNA, 20 bp, mouse
gatattattgatagagtcta

SEQ ID NO: 488697 - DNA, 20 bp, mouse
gttaaaaggtggcagggcgg

SEQ ID NO: 488698 - DNA, 20 bp, mouse
ggaattaaaaggtggcaggg

SEQ ID NO: 488699 - DNA, 20 bp, mouse
gtatcaataatatcaccagc

SEQ ID NO: 488700 - DNA, 20 bp, mouse
gtaactaaagaattaaaagg

SEQ ID NO: 488701 - DNA, 20 bp, mouse
ggagtctaggggtcttgatc

SEQ ID NO: 488702 - DNA, 20 bp, mouse
gaaaggtggcagggcggtgg

SEQ ID NO: 488703 - DNA, 20 bp, mouse
gtgctaactaaagaattaaa

SEQ ID NO: 488704 - DNA, 20 bp, mouse
gaaagaattaaaaggagaga

SEQ ID NO: 488705 - DNA, 20 bp, mouse
gtgttagatcttgttagaga

SEQ ID NO: 488706 - DNA, 20 bp, mouse
ggaggagatgatggcggcag

SEQ ID NO: 488707 - DNA, 20 bp, mouse
gggggtggaagtgctttcta

SEQ ID NO: 488708 - DNA, 20 bp, mouse
gtggcagcggctgcaacagg

SEQ ID NO: 488709 - DNA, 20 bp, mouse
ggccctgctgctgcacagga

SEQ ID NO: 488710 - DNA, 20 bp, mouse
gtcccttgaacttcacatag

SEQ ID NO: 488711 - DNA, 20 bp, mouse
gctggtgggagccgaggact

SEQ ID NO: 488712 - DNA, 20 bp, mouse
gcaacaggtggacttctgtg

SEQ ID NO: 488713 - DNA, 20 bp, mouse
ggatttagaagcctgaggtg

SEQ ID NO: 488714 - DNA, 20 bp, mouse
gggactaggatcctgagcta

SEQ ID NO: 488715 - DNA, 20 bp, mouse
gaggccagtaaggtttacat

SEQ ID NO: 488716 - DNA, 20 bp, mouse
gtcaaacacgaggcatactt

SEQ ID NO: 488717 - DNA, 20 bp, mouse
ggtagccacatgcttatcaa

SEQ ID NO: 488718 - DNA, 20 bp, mouse
gagagatgatcaaagagata

SEQ ID NO: 488719 - DNA, 20 bp, mouse
gtggctactacatagaggtg

SEQ ID NO: 488720 - DNA, 20 bp, mouse
ggcatgtggctactacatag

SEQ ID NO: 488721 - DNA, 20 bp, mouse
gaccatcacggggctgtaat

SEQ ID NO: 488722 - DNA, 20 bp, mouse
gtatacacttaatataattc

SEQ ID NO: 488723 - DNA, 20 bp, mouse
ggtatgcctcgtgtttgagg

SEQ ID NO: 488724 - DNA, 20 bp, mouse
gggtcaacatgaggtgtagt

SEQ ID NO: 488725 - DNA, 20 bp, mouse
gtggtgactgcaccatcacg

SEQ ID NO: 488726 - DNA, 20 bp, mouse
gaagcttgctgggtcttaag

SEQ ID NO: 488727 - DNA, 20 bp, mouse
ggcacctgcagactgacaag

SEQ ID NO: 488728 - DNA, 20 bp, mouse
gaatggggactactgctgta

SEQ ID NO: 488729 - DNA, 20 bp, mouse
gggtcttaagaggacactgc

SEQ ID NO: 488730 - DNA, 20 bp, mouse
ggcaggaaacactgcagatc

SEQ ID NO: 488731 - DNA, 20 bp, mouse
gtgttctcacagggctacca

SEQ ID NO: 488732 - DNA, 20 bp, mouse
gagtagtccccattgctgca

SEQ ID NO: 488733 - DNA, 20 bp, mouse
gtgagaaagccatgcagcaa

SEQ ID NO: 488734 - DNA, 20 bp, mouse
gcaggtgcagcaaagcttgc

SEQ ID NO: 488735 - DNA, 20 bp, mouse
gcactcttgaggactgctac

SEQ ID NO: 488736 - DNA, 20 bp, mouse
ggaaggagctgagatatgtg

SEQ ID NO: 488737 - DNA, 20 bp, mouse
gctggggtaggttagagcat

SEQ ID NO: 488738 - DNA, 20 bp, mouse
gagtgaggatgtggggacca

SEQ ID NO: 488739 - DNA, 20 bp, mouse
gaccagggtggatagctgtg

SEQ ID NO: 488740 - DNA, 20 bp, mouse
gctggggagctagggtagtt

SEQ ID NO: 488741 - DNA, 20 bp, mouse
gctgagatatgtggggttgt

SEQ ID NO: 488742 - DNA, 20 bp, mouse
gctggggttgttaggagtgt

SEQ ID NO: 488743 - DNA, 20 bp, mouse
gcccaggagagatgaaggta

SEQ ID NO: 488744 - DNA, 20 bp, mouse
gagctggggaggtggagcta

SEQ ID NO: 488745 - DNA, 20 bp, mouse
ggagggtgtagggaccagac

SEQ ID NO: 488746 - DNA, 20 bp, mouse
gaggtagggttggattttgg

SEQ ID NO: 488747 - DNA, 20 bp, mouse
gtgaatgctaggactcagag

SEQ ID NO: 488748 - DNA, 20 bp, mouse
gggactcagagaggtagggt

SEQ ID NO: 488749 - DNA, 20 bp, mouse
gtgctaggactcagagaggt

SEQ ID NO: 488750 - DNA, 20 bp, mouse
gtgttggtcactgttgctca

SEQ ID NO: 488751 - DNA, 20 bp, mouse
gaagaagaaagtagaagagg

SEQ ID NO: 488752 - DNA, 20 bp, mouse
ggcaaagaagaaagtagaag

SEQ ID NO: 488753 - DNA, 20 bp, mouse
gggttgctattggttgctgt

SEQ ID NO: 488754 - DNA, 20 bp, mouse
gggttgctgttggttgctat

SEQ ID NO: 488755 - DNA, 20 bp, mouse
gaggaagaggcggggcgtgg

SEQ ID NO: 488756 - DNA, 20 bp, mouse
gtactccaggaccaacggga

SEQ ID NO: 488757 - DNA, 20 bp, mouse
gatgaagtacgcaggcacca

SEQ ID NO: 488758 - DNA, 20 bp, mouse
gacacgggcggcactactcc

SEQ ID NO: 488759 - DNA, 20 bp, mouse
gcaacgggagcaggctatcg

SEQ ID NO: 488760 - DNA, 20 bp, mouse
ggcatctctatgaagtacgc

SEQ ID NO: 488761 - DNA, 20 bp, mouse
gcgcaccagtgatggctcga

SEQ ID NO: 488762 - DNA, 20 bp, mouse
ggggtagatcttgtacatgc

SEQ ID NO: 488763 - DNA, 20 bp, mouse
gtctggcttctgattccact

SEQ ID NO: 488764 - DNA, 20 bp, mouse
gaggaaagcccaacgggagc

SEQ ID NO: 488765 - DNA, 20 bp, mouse
gggcactactccaggaccaa

SEQ ID NO: 488766 - DNA, 20 bp, mouse
gagttgtcccaggagatccg

SEQ ID NO: 488767 - DNA, 20 bp, mouse
gaggatcacagccggaccac

SEQ ID NO: 488768 - DNA, 20 bp, mouse
ggagatccgaggtatgccag

SEQ ID NO: 488769 - DNA, 20 bp, mouse
gaggctctgctgcacaacat

SEQ ID NO: 488770 - DNA, 20 bp, mouse
gtggaggtctgtattctcag

SEQ ID NO: 488771 - DNA, 20 bp, mouse
gggcatacctcggatctcct

SEQ ID NO: 488772 - DNA, 20 bp, mouse
gccggaccactggcatacct

SEQ ID NO: 488773 - DNA, 20 bp, mouse
gaatacagacctccaagggt

SEQ ID NO: 488774 - DNA, 20 bp, mouse
gggaacttgggaggccgtga

SEQ ID NO: 488775 - DNA, 20 bp, mouse
ggaaggtgtgctcagattca

SEQ ID NO: 488776 - DNA, 20 bp, mouse
gggcacaactctccagtagg

SEQ ID NO: 488777 - DNA, 20 bp, mouse
gttaatgtctcggtgggtaa

SEQ ID NO: 488778 - DNA, 20 bp, mouse
gggcccaccccacagtcagg

SEQ ID NO: 488779 - DNA, 20 bp, mouse
gggtcagcggtctgtcatcc

SEQ ID NO: 488780 - DNA, 20 bp, mouse
gcaaggcacaactctccagt

SEQ ID NO: 488781 - DNA, 20 bp, mouse
gccaggaccatgatcatgtc

SEQ ID NO: 488782 - DNA, 20 bp, mouse
gaggacagaactgactcacc

SEQ ID NO: 488783 - DNA, 20 bp, mouse
gaaacaattaatgtctcggt

SEQ ID NO: 488784 - DNA, 20 bp, mouse
gcctcaaaatccaaggagga

SEQ ID NO: 488785 - DNA, 20 bp, mouse
gcaaggcccaccccacagtc

SEQ ID NO: 488786 - DNA, 20 bp, mouse
gcctcctgcgggcagacgtc

SEQ ID NO: 488787 - DNA, 20 bp, mouse
ggggcacgcgctaggggcgt

SEQ ID NO: 488788 - DNA, 20 bp, mouse
gcgcgccgggcacgcgctag

SEQ ID NO: 488789 - DNA, 20 bp, mouse
gggttgccgggacccatgag

SEQ ID NO: 488790 - DNA, 20 bp, mouse
gggaggccttgcctgcgctg

SEQ ID NO: 488791 - DNA, 20 bp, mouse
gaggtgagtctgacagaata

SEQ ID NO: 488792 - DNA, 20 bp, mouse
gtctgtcagactcacctctt

SEQ ID NO: 488793 - DNA, 20 bp, mouse
gactagcaggtgccacggga

SEQ ID NO: 488794 - DNA, 20 bp, mouse
gtccttcaaagcctcagcgc

SEQ ID NO: 488795 - DNA, 20 bp, mouse
gcaaagcctcagcgcaggca

SEQ ID NO: 488796 - DNA, 20 bp, mouse
gtgcttgtcaatggtttcaa

SEQ ID NO: 488797 - DNA, 20 bp, mouse
gcataaggacgagataatgt

SEQ ID NO: 488798 - DNA, 20 bp, mouse
gactcagtctacatgaccca

SEQ ID NO: 488799 - DNA, 20 bp, mouse
gtatgttattgagtatacca

SEQ ID NO: 488800 - DNA, 20 bp, mouse
gacttaagtcatacattcaa

SEQ ID NO: 488801 - DNA, 20 bp, mouse
gttagcgtaaaaagaaacta

SEQ ID NO: 488802 - DNA, 20 bp, mouse
ggtcaatggtttcaacggca

SEQ ID NO: 488803 - DNA, 20 bp, mouse
gtcgctggtcacatgagttc

SEQ ID NO: 488804 - DNA, 20 bp, mouse
ggtaattcttagaattttct

SEQ ID NO: 488805 - DNA, 20 bp, mouse
ggacctgatgctcactaaag

SEQ ID NO: 488806 - DNA, 20 bp, mouse
ggctagtagaacccaagcac

SEQ ID NO: 488807 - DNA, 20 bp, mouse
ggaaccagtacgaaagccta

SEQ ID NO: 488808 - DNA, 20 bp, mouse
gtttccataggctttcgtac

SEQ ID NO: 488809 - DNA, 20 bp, mouse
ggggaggggtacacccaggg

SEQ ID NO: 488810 - DNA, 20 bp, mouse
gtgggggaggggtacaccca

SEQ ID NO: 488811 - DNA, 20 bp, mouse
gggtagctgttgcctgtgct

SEQ ID NO: 488812 - DNA, 20 bp, mouse
gcaggaagggacagtaagcc

SEQ ID NO: 488813 - DNA, 20 bp, mouse
ggagaaacacaggactctga

SEQ ID NO: 488814 - DNA, 20 bp, mouse
gtcactccatgaaatccaca

SEQ ID NO: 488815 - DNA, 20 bp, mouse
gctggaaaatgaatctggtc

SEQ ID NO: 488816 - DNA, 20 bp, mouse
gaccggaagaggctcagtgg

SEQ ID NO: 488817 - DNA, 20 bp, mouse
ggggagggctctgggttcac

SEQ ID NO: 488818 - DNA, 20 bp, mouse
gagcggcaagggatgtcgtc

SEQ ID NO: 488819 - DNA, 20 bp, mouse
ggggatgtcgtcgggctgga

SEQ ID NO: 488820 - DNA, 20 bp, mouse
ggcccctgcgcgagcggcaa

SEQ ID NO: 488821 - DNA, 20 bp, mouse
gtctgtccaggaggtcgcta

SEQ ID NO: 488822 - DNA, 20 bp, mouse
gtgcgctgggagcgtctcgg

SEQ ID NO: 488823 - DNA, 20 bp, mouse
gggcgcaggcggctacggag

SEQ ID NO: 488824 - DNA, 20 bp, mouse
gcggctgagggcgatcccac

SEQ ID NO: 488825 - DNA, 20 bp, mouse
gcccgcggcccctgcgcgag

SEQ ID NO: 488826 - DNA, 20 bp, mouse
gggaagtctttcggatgcgt

SEQ ID NO: 488827 - DNA, 20 bp, mouse
ggtctagcagaagatggccc

SEQ ID NO: 488828 - DNA, 20 bp, mouse
ggaatctccagccccgtgtt

SEQ ID NO: 488829 - DNA, 20 bp, mouse
gtgcaacatcttccaaacac

SEQ ID NO: 488830 - DNA, 20 bp, mouse
gaggcactctgccacccaac

SEQ ID NO: 488831 - DNA, 20 bp, mouse
gtagagttatgtagggtagg

SEQ ID NO: 488832 - DNA, 20 bp, mouse
ggaggaaccttgaatttgtg

SEQ ID NO: 488833 - DNA, 20 bp, mouse
gtagaacatcttgggttgat

SEQ ID NO: 488834 - DNA, 20 bp, mouse
gtaatttccccacaaattca

SEQ ID NO: 488835 - DNA, 20 bp, mouse
gtcggatgcgtgggcagatg

SEQ ID NO: 488836 - DNA, 20 bp, mouse
gaacatagggtcagtgacaa

SEQ ID NO: 488837 - DNA, 20 bp, mouse
gccaggtagcttctaagtaa

SEQ ID NO: 488838 - DNA, 20 bp, mouse
gtccagaaaataataacata

SEQ ID NO: 488839 - DNA, 20 bp, mouse
gtctctagaaataacagaat

SEQ ID NO: 488840 - DNA, 20 bp, mouse
ggtctctgctagatgctgca

SEQ ID NO: 488841 - DNA, 20 bp, mouse
ggtttattaaatatgcagca

SEQ ID NO: 488842 - DNA, 20 bp, mouse
gcctggggtttatttttgta

SEQ ID NO: 488843 - DNA, 20 bp, mouse
gcattagattccagtttctt

SEQ ID NO: 488844 - DNA, 20 bp, mouse
ggtttatttttgtatggtat

SEQ ID NO: 488845 - DNA, 20 bp, mouse
ggagagtactaatttactcc

SEQ ID NO: 488846 - DNA, 20 bp, mouse
gtgaatgagcgcgcaggctt

SEQ ID NO: 488847 - DNA, 20 bp, mouse
gcactgcgggagtcacagcg

SEQ ID NO: 488848 - DNA, 20 bp, mouse
gctttgtgttgcagctgaag

SEQ ID NO: 488849 - DNA, 20 bp, mouse
gctttttatgttatactttg

SEQ ID NO: 488850 - DNA, 20 bp, mouse
gtggcggtgaatgagcgcgc

SEQ ID NO: 488851 - DNA, 20 bp, mouse
gaggatgaagaagtcacccg

SEQ ID NO: 488852 - DNA, 20 bp, mouse
gaggtggaagagattgaagc

SEQ ID NO: 488853 - DNA, 20 bp, mouse
ggaatttgatcttggagtca

SEQ ID NO: 488854 - DNA, 20 bp, mouse
gcgcagtacacaatctcccc

SEQ ID NO: 488855 - DNA, 20 bp, mouse
gaacacaaagtaccagaagt

SEQ ID NO: 488856 - DNA, 20 bp, mouse
ggcaccagcaacaaaatagt

SEQ ID NO: 488857 - DNA, 20 bp, mouse
gattaccttagggtataagg

SEQ ID NO: 488858 - DNA, 20 bp, mouse
ggttattaccttagggtata

SEQ ID NO: 488859 - DNA, 20 bp, mouse
gaacagctagtcacggggtg

SEQ ID NO: 488860 - DNA, 20 bp, mouse
gtgagccaccttatacccta

SEQ ID NO: 488861 - DNA, 20 bp, mouse
gaggtaataactgtccttgg

SEQ ID NO: 488862 - DNA, 20 bp, mouse
gctaaggtaataactgtcct

SEQ ID NO: 488863 - DNA, 20 bp, mouse
gttccaaaacagctagtcac

SEQ ID NO: 488864 - DNA, 20 bp, mouse
gtttggatgtggaataaaga

SEQ ID NO: 488865 - DNA, 20 bp, mouse
gccaaactgaattggaaaac

SEQ ID NO: 488866 - DNA, 20 bp, mouse
ggaactggctctgattctga

SEQ ID NO: 488867 - DNA, 20 bp, mouse
gaacgaaataaggtcaatga

SEQ ID NO: 488868 - DNA, 20 bp, mouse
gttaagtcctagggcttcag

SEQ ID NO: 488869 - DNA, 20 bp, mouse
gtcaacaacagcaccttctt

SEQ ID NO: 488870 - DNA, 20 bp, mouse
gggctcagtgtgctcgcttg

SEQ ID NO: 488871 - DNA, 20 bp, mouse
gacatgcatacagctgccca

SEQ ID NO: 488872 - DNA, 20 bp, mouse
ggtatgccctttaagtccta

SEQ ID NO: 488873 - DNA, 20 bp, mouse
gatagtctttatttatgaac

SEQ ID NO: 488874 - DNA, 20 bp, mouse
gtggtttactcaacccaaga

SEQ ID NO: 488875 - DNA, 20 bp, mouse
gatacttctgttccatttaa

SEQ ID NO: 488876 - DNA, 20 bp, mouse
gtgtcttcttaatttaacat

SEQ ID NO: 488877 - DNA, 20 bp, mouse
gctgtcaggcaaggacgtga

SEQ ID NO: 488878 - DNA, 20 bp, mouse
ggttcctatacaggcaatga

SEQ ID NO: 488879 - DNA, 20 bp, mouse
gtcccaaggaggttccgaga

SEQ ID NO: 488880 - DNA, 20 bp, mouse
gtggcatacttctctaacaa

SEQ ID NO: 488881 - DNA, 20 bp, mouse
gttctaaatttaaaacccag

SEQ ID NO: 488882 - DNA, 20 bp, mouse
gcatccatcattgcctgtat

SEQ ID NO: 488883 - DNA, 20 bp, mouse
ggccatctcggaacctcctt

SEQ ID NO: 488884 - DNA, 20 bp, mouse
gtccttgggactgctaaaga

SEQ ID NO: 488885 - DNA, 20 bp, mouse
ggctgctggtgacttataaa

SEQ ID NO: 488886 - DNA, 20 bp, mouse
gaatattagtaggataaaaa

SEQ ID NO: 488887 - DNA, 20 bp, mouse
gaaacacttgtgtaaattat

SEQ ID NO: 488888 - DNA, 20 bp, mouse
gagaatgtgggtataaagac

SEQ ID NO: 488889 - DNA, 20 bp, mouse
ggaggtcagactaaaaggaa

SEQ ID NO: 488890 - DNA, 20 bp, mouse
gaggtcttattcaagaatgt

SEQ ID NO: 488891 - DNA, 20 bp, mouse
gtgtgtcaggtcggaagaca

SEQ ID NO: 488892 - DNA, 20 bp, mouse
ggcacatgttaacaacccac

SEQ ID NO: 488893 - DNA, 20 bp, mouse
gagcctgtggcaccaacaat

SEQ ID NO: 488894 - DNA, 20 bp, mouse
gcagttgaggtcagactaaa

SEQ ID NO: 488895 - DNA, 20 bp, mouse
gacaggctttgaatgtaggg

SEQ ID NO: 488896 - DNA, 20 bp, mouse
gaactacacactgtaaccac

SEQ ID NO: 488897 - DNA, 20 bp, mouse
gttactcttcctagcatcca

SEQ ID NO: 488898 - DNA, 20 bp, mouse
gtagagatgtctaaaagtgt

SEQ ID NO: 488899 - DNA, 20 bp, mouse
gagagagagagcacttgcca

SEQ ID NO: 488900 - DNA, 20 bp, mouse
gagcacttgccatggatgct

SEQ ID NO: 488901 - DNA, 20 bp, mouse
gctcaagctccataatgtcc

SEQ ID NO: 488902 - DNA, 20 bp, mouse
gagtgtgggaactgtggtcc

SEQ ID NO: 488903 - DNA, 20 bp, mouse
gctgtttgctcttgaaaacc

SEQ ID NO: 488904 - DNA, 20 bp, mouse
ggttagagtgtgtcacagtg

SEQ ID NO: 488905 - DNA, 20 bp, mouse
gtggttacagtgtgtcacag

SEQ ID NO: 488906 - DNA, 20 bp, mouse
gatatggaaatggccagtag

SEQ ID NO: 488907 - DNA, 20 bp, mouse
gcatgagtctatgtagaatc

SEQ ID NO: 488908 - DNA, 20 bp, mouse
gatctgattgaccaaaaaaa

SEQ ID NO: 488909 - DNA, 20 bp, mouse
gtgagatcgtaccttttttt

SEQ ID NO: 488910 - DNA, 20 bp, mouse
ggtggctgtaaccttcactg

SEQ ID NO: 488911 - DNA, 20 bp, mouse
ggctgtaaccttcactgtgg

SEQ ID NO: 488912 - DNA, 20 bp, mouse
gaaccttcactgtggaggaa

SEQ ID NO: 488913 - DNA, 20 bp, mouse
gctgcacaaagatgtaatgg

SEQ ID NO: 488914 - DNA, 20 bp, mouse
gaagctgcacaaagatgtaa

SEQ ID NO: 488915 - DNA, 20 bp, mouse
gtctgtgagctttcaagatg

SEQ ID NO: 488916 - DNA, 20 bp, mouse
gtccagtcagggcaaatcag

SEQ ID NO: 488917 - DNA, 20 bp, mouse
gccacagtagcatccagtca

SEQ ID NO: 488918 - DNA, 20 bp, mouse
gtaccagtgtggctgctcag

SEQ ID NO: 488919 - DNA, 20 bp, mouse
gtataggcatggatatgaat

SEQ ID NO: 488920 - DNA, 20 bp, mouse
gggatgctactgtggcgtgg

SEQ ID NO: 488921 - DNA, 20 bp, mouse
gagaggcctagggacaccta

SEQ ID NO: 488922 - DNA, 20 bp, mouse
gactggatgctactgtggcg

SEQ ID NO: 488923 - DNA, 20 bp, mouse
ggggatggcagcatgaccct

SEQ ID NO: 488924 - DNA, 20 bp, mouse
gatgtcctccggcatgatag

SEQ ID NO: 488925 - DNA, 20 bp, mouse
gacaggcgccaataccagtg

SEQ ID NO: 488926 - DNA, 20 bp, mouse
gtcgctgaggagggcaataa

SEQ ID NO: 488927 - DNA, 20 bp, mouse
gcccacagcacacctcgctg

SEQ ID NO: 488928 - DNA, 20 bp, mouse
gcgaggtgtgctgtggggag

SEQ ID NO: 488929 - DNA, 20 bp, mouse
gaacaacccagaatactgta

SEQ ID NO: 488930 - DNA, 20 bp, mouse
gacagcacacctcgctgagg

SEQ ID NO: 488931 - DNA, 20 bp, mouse
gactttctctgttaatccgg

SEQ ID NO: 488932 - DNA, 20 bp, mouse
ggcaaaaagtggaggatgta

SEQ ID NO: 488933 - DNA, 20 bp, mouse
gagcgcatgctcaagaccgt

SEQ ID NO: 488934 - DNA, 20 bp, mouse
gcgttaggaaaacatgtcta

SEQ ID NO: 488935 - DNA, 20 bp, mouse
gtttattgagcaaaaagtgg

SEQ ID NO: 488936 - DNA, 20 bp, mouse
ggactggagcaggacttctg

SEQ ID NO: 488937 - DNA, 20 bp, mouse
gacactccagaggtccacag

SEQ ID NO: 488938 - DNA, 20 bp, mouse
gctccagaggtccacagggg

SEQ ID NO: 488939 - DNA, 20 bp, mouse
gagggacctagtcattactg

SEQ ID NO: 488940 - DNA, 20 bp, mouse
ggttgcaggtcgtcacgctg

SEQ ID NO: 488941 - DNA, 20 bp, mouse
ggaagcacacaggactccac

SEQ ID NO: 488942 - DNA, 20 bp, mouse
gggctgcctcagtaatgact

SEQ ID NO: 488943 - DNA, 20 bp, mouse
gtcctcgggccactcgagat

SEQ ID NO: 488944 - DNA, 20 bp, mouse
gtgacgacctgcaacagcaa

SEQ ID NO: 488945 - DNA, 20 bp, mouse
gaaatgggagcccagggtgt

SEQ ID NO: 488946 - DNA, 20 bp, mouse
gatctgaatggatccattac

SEQ ID NO: 488947 - DNA, 20 bp, mouse
gactcttgccacatgcaaag

SEQ ID NO: 488948 - DNA, 20 bp, mouse
gtgaatggatccattactgg

SEQ ID NO: 488949 - DNA, 20 bp, mouse
gggctagaagaggttagaga

SEQ ID NO: 488950 - DNA, 20 bp, mouse
gtcagattctaatacaacaa

SEQ ID NO: 488951 - DNA, 20 bp, mouse
gcttgtatatcacttttctg

SEQ ID NO: 488952 - DNA, 20 bp, mouse
gtgagcttactccctttcca

SEQ ID NO: 488953 - DNA, 20 bp, mouse
gaaaaatatccataagtttt

SEQ ID NO: 488954 - DNA, 20 bp, mouse
gggattttttccaccagtaa

SEQ ID NO: 488955 - DNA, 20 bp, mouse
gaatttttcccctttgcatg

SEQ ID NO: 488956 - DNA, 20 bp, mouse
ggaaaggagagcgggaaaag

SEQ ID NO: 488957 - DNA, 20 bp, mouse
gaaggggcagagaggcggaa

SEQ ID NO: 488958 - DNA, 20 bp, mouse
ggggtcgggaatcctcgcgg

SEQ ID NO: 488959 - DNA, 20 bp, mouse
ggcggccccggcgagaacaa

SEQ ID NO: 488960 - DNA, 20 bp, mouse
gcaagggagcgagacggagg

SEQ ID NO: 488961 - DNA, 20 bp, mouse
gcctcggtagtgccaggtaa

SEQ ID NO: 488962 - DNA, 20 bp, mouse
gtgcccccgggagccagcga

SEQ ID NO: 488963 - DNA, 20 bp, mouse
gctccgtcgctggctcccgg

SEQ ID NO: 488964 - DNA, 20 bp, mouse
gcccgggtcgggaatcctcg

SEQ ID NO: 488965 - DNA, 20 bp, mouse
gggctccgcctgccgaggag

SEQ ID NO: 488966 - DNA, 20 bp, mouse
ggctagggtccaggcttcat

SEQ ID NO: 488967 - DNA, 20 bp, mouse
gtaggcctcttcaggatcag

SEQ ID NO: 488968 - DNA, 20 bp, mouse
gtattgtgattgatcgacct

SEQ ID NO: 488969 - DNA, 20 bp, mouse
ggtagaagatgtgtgaaccg

SEQ ID NO: 488970 - DNA, 20 bp, mouse
gcgatcaatcacaatatatt

SEQ ID NO: 488971 - DNA, 20 bp, mouse
gtccaggcttcataggggtc

SEQ ID NO: 488972 - DNA, 20 bp, mouse
gctcttgaggattagcgaaa

SEQ ID NO: 488973 - DNA, 20 bp, mouse
gtcctgacccctatgaagcc

SEQ ID NO: 488974 - DNA, 20 bp, mouse
gtcgaccttggtcacaaatg

SEQ ID NO: 488975 - DNA, 20 bp, mouse
gtcagtgatctgtgcaggaa

SEQ ID NO: 488976 - DNA, 20 bp, mouse
ggaactgtatttgaaagtct

SEQ ID NO: 488977 - DNA, 20 bp, mouse
gtatttgaaagtctaggctt

SEQ ID NO: 488978 - DNA, 20 bp, mouse
ggcatttggtctaagagctg

SEQ ID NO: 488979 - DNA, 20 bp, mouse
gccagtctagaacagcaaca

SEQ ID NO: 488980 - DNA, 20 bp, mouse
gtgttactgcttaagcacgg

SEQ ID NO: 488981 - DNA, 20 bp, mouse
gtggaaataatacttataca

SEQ ID NO: 488982 - DNA, 20 bp, mouse
gtttatataagttcttggga

SEQ ID NO: 488983 - DNA, 20 bp, mouse
gaattgttactgcttaagca

SEQ ID NO: 488984 - DNA, 20 bp, mouse
ggaatgtatgttaagtttat

SEQ ID NO: 488985 - DNA, 20 bp, mouse
ggtaaacaataagctgcatt

SEQ ID NO: 488986 - DNA, 20 bp, mouse
gaggatcgcccactacacaa

SEQ ID NO: 488987 - DNA, 20 bp, mouse
gagtatcaacctcagccctg

SEQ ID NO: 488988 - DNA, 20 bp, mouse
gcactgggggccaactgtgt

SEQ ID NO: 488989 - DNA, 20 bp, mouse
gttgttattaaggacactgg

SEQ ID NO: 488990 - DNA, 20 bp, mouse
gggttctacagagagcaata

SEQ ID NO: 488991 - DNA, 20 bp, mouse
gaggaggcagttacctacaa

SEQ ID NO: 488992 - DNA, 20 bp, mouse
gtcttgaggaggtcaaggga

SEQ ID NO: 488993 - DNA, 20 bp, mouse
ggtacccaatgacactaaca

SEQ ID NO: 488994 - DNA, 20 bp, mouse
gagattgttattaaggacac

SEQ ID NO: 488995 - DNA, 20 bp, mouse
gttgggtaccaagtagagat

SEQ ID NO: 488996 - DNA, 20 bp, mouse
ggcctcgctggtcatacaca

SEQ ID NO: 488997 - DNA, 20 bp, mouse
gtcatcagaacagttctcac

SEQ ID NO: 488998 - DNA, 20 bp, mouse
gcatacacagggatcccata

SEQ ID NO: 488999 - DNA, 20 bp, mouse
gcacaggcaggtagcctcgc

SEQ ID NO: 489000 - DNA, 20 bp, mouse
gaggactatccgaggaactg

SEQ ID NO: 489001 - DNA, 20 bp, mouse
gtccctgtgtatgaccagcg

SEQ ID NO: 489002 - DNA, 20 bp, mouse
gcagaacagttctcacaggc

SEQ ID NO: 489003 - DNA, 20 bp, mouse
gggtccagattgtgccatat

SEQ ID NO: 489004 - DNA, 20 bp, mouse
gatccgaggaactgcggcct

SEQ ID NO: 489005 - DNA, 20 bp, mouse
gtggaattggggacctttaa

SEQ ID NO: 489006 - DNA, 20 bp, mouse
gtactcacagtagggcaaca

SEQ ID NO: 489007 - DNA, 20 bp, mouse
gaagacagcacgttgagctt

SEQ ID NO: 489008 - DNA, 20 bp, mouse
gggttgctatactcacagta

SEQ ID NO: 489009 - DNA, 20 bp, mouse
gtttggcagttatgctcctg

SEQ ID NO: 489010 - DNA, 20 bp, mouse
gttgagcttaggtttacctc

SEQ ID NO: 489011 - DNA, 20 bp, mouse
gtttctctctctcatttcaa

SEQ ID NO: 489012 - DNA, 20 bp, mouse
gacaaaagctgcgcaccttt

SEQ ID NO: 489013 - DNA, 20 bp, mouse
gaggtgcgcagcttttgtac

SEQ ID NO: 489014 - DNA, 20 bp, mouse
ggaaaagcatgagtgttgaa

SEQ ID NO: 489015 - DNA, 20 bp, mouse
gagagggcgttgtctgaaac

SEQ ID NO: 489016 - DNA, 20 bp, mouse
ggttcgtccgcaagctctct

SEQ ID NO: 489017 - DNA, 20 bp, mouse
gcgctgcaggaagtagccga

SEQ ID NO: 489018 - DNA, 20 bp, mouse
gacgcctttctggacaacgt

SEQ ID NO: 489019 - DNA, 20 bp, mouse
gtgtccagaaaggcgtggag

SEQ ID NO: 489020 - DNA, 20 bp, mouse
gcagcccacgttgtccagaa

SEQ ID NO: 489021 - DNA, 20 bp, mouse
ggtcaccgccgagggcctgt

SEQ ID NO: 489022 - DNA, 20 bp, mouse
ggccaccgacaggccctcgg

SEQ ID NO: 489023 - DNA, 20 bp, mouse
gtctgggctgctcatcctgc

SEQ ID NO: 489024 - DNA, 20 bp, mouse
gtgcgactcggccaacgcca

SEQ ID NO: 489025 - DNA, 20 bp, mouse
ggctcccgaggcggcgacag

SEQ ID NO: 489026 - DNA, 20 bp, mouse
gctgtcccttcatacatata

SEQ ID NO: 489027 - DNA, 20 bp, mouse
gacatccctatatgtatgaa

SEQ ID NO: 489028 - DNA, 20 bp, mouse
gctatcaagaggtataactt

SEQ ID NO: 489029 - DNA, 20 bp, mouse
gttttttgcaatctacataa

SEQ ID NO: 489030 - DNA, 20 bp, mouse
gcctaagaaaactacatcag

SEQ ID NO: 489031 - DNA, 20 bp, mouse
gatcttgtagtcaagtggag

SEQ ID NO: 489032 - DNA, 20 bp, mouse
gagaggtataactttggagt

SEQ ID NO: 489033 - DNA, 20 bp, mouse
gataaaatcttgtagtcaag

SEQ ID NO: 489034 - DNA, 20 bp, mouse
gcaggcaggcatagtgccgg

SEQ ID NO: 489035 - DNA, 20 bp, mouse
gcatatacaaaccatctcat

SEQ ID NO: 489036 - DNA, 20 bp, mouse
gaatgtaatcttaaagggtg

SEQ ID NO: 489037 - DNA, 20 bp, mouse
gagatgaccgtgtcgtgcaa

SEQ ID NO: 489038 - DNA, 20 bp, mouse
ggtaaagcctttgcacgaca

SEQ ID NO: 489039 - DNA, 20 bp, mouse
gaaacttgaaaatatagata

SEQ ID NO: 489040 - DNA, 20 bp, mouse
gagatgacttcattgtaaat

SEQ ID NO: 489041 - DNA, 20 bp, mouse
gaatgtaatcagtgtggtaa

SEQ ID NO: 489042 - DNA, 20 bp, mouse
gtacattgtttatattctta

SEQ ID NO: 489043 - DNA, 20 bp, mouse
ggtaatcttaaagggtgtgg

SEQ ID NO: 489044 - DNA, 20 bp, mouse
ggtatttggcccatggtaag

SEQ ID NO: 489045 - DNA, 20 bp, mouse
gatattcttagggttacttt

SEQ ID NO: 489046 - DNA, 20 bp, mouse
gggatgatatcgatcacggt

SEQ ID NO: 489047 - DNA, 20 bp, mouse
gtccaggatgatatcgatca

SEQ ID NO: 489048 - DNA, 20 bp, mouse
gtcgaagatgaagaactgga

SEQ ID NO: 489049 - DNA, 20 bp, mouse
gtttagaccggactcaacca

SEQ ID NO: 489050 - DNA, 20 bp, mouse
gtcgtagacagtgatccaga

SEQ ID NO: 489051 - DNA, 20 bp, mouse
ggaagccgatgtgtgtcatc

SEQ ID NO: 489052 - DNA, 20 bp, mouse
gtgcttgaccacgaagggca

SEQ ID NO: 489053 - DNA, 20 bp, mouse
ggttcttgtcgaggcagaag

SEQ ID NO: 489054 - DNA, 20 bp, mouse
gttgaccacgaagggcaggg

SEQ ID NO: 489055 - DNA, 20 bp, mouse
gctcatccacggcaccatca

SEQ ID NO: 489056 - DNA, 20 bp, mouse
gtccttggagcgacagattc

SEQ ID NO: 489057 - DNA, 20 bp, mouse
gaagtatgtgggatattctt

SEQ ID NO: 489058 - DNA, 20 bp, mouse
gacagattcgggaagcagtg

SEQ ID NO: 489059 - DNA, 20 bp, mouse
gcaaggaccatttgaaacac

SEQ ID NO: 489060 - DNA, 20 bp, mouse
gacatacttaagcttaactc

SEQ ID NO: 489061 - DNA, 20 bp, mouse
gagtccaagcccaatgaaaa

SEQ ID NO: 489062 - DNA, 20 bp, mouse
gggatcctgaaaatcagtca

SEQ ID NO: 489063 - DNA, 20 bp, mouse
gggcaagttctatccatcta

SEQ ID NO: 489064 - DNA, 20 bp, mouse
ggaacttgcctcaaatgtcg

SEQ ID NO: 489065 - DNA, 20 bp, mouse
gaagctacatcgctgtacta

SEQ ID NO: 489066 - DNA, 20 bp, mouse
gaactagactagaatggtgt

SEQ ID NO: 489067 - DNA, 20 bp, mouse
gagagagaactagactagaa

SEQ ID NO: 489068 - DNA, 20 bp, mouse
gaactatttgaggaaatatt

SEQ ID NO: 489069 - DNA, 20 bp, mouse
gcagcagaggatatccatca

SEQ ID NO: 489070 - DNA, 20 bp, mouse
gagtcatgacctctcatggt

SEQ ID NO: 489071 - DNA, 20 bp, mouse
gcagagctggaaattaccca

SEQ ID NO: 489072 - DNA, 20 bp, mouse
gttagagtcatgacctctca

SEQ ID NO: 489073 - DNA, 20 bp, mouse
gtcaaatagttcaaaacact

SEQ ID NO: 489074 - DNA, 20 bp, mouse
gttggagcctaacacatata

SEQ ID NO: 489075 - DNA, 20 bp, mouse
gtgactatcagggagatccc

SEQ ID NO: 489076 - DNA, 20 bp, mouse
gaagcagcagtacggcactt

SEQ ID NO: 489077 - DNA, 20 bp, mouse
gaaaccactgcagctttggt

SEQ ID NO: 489078 - DNA, 20 bp, mouse
gcatcccaccaaagctgcag

SEQ ID NO: 489079 - DNA, 20 bp, mouse
gtttggaacctaagcaacta

SEQ ID NO: 489080 - DNA, 20 bp, mouse
gctggggtctgcagtttata

SEQ ID NO: 489081 - DNA, 20 bp, mouse
ggagacccaactatgatcac

SEQ ID NO: 489082 - DNA, 20 bp, mouse
gtgtcaaaccactgcagctt

SEQ ID NO: 489083 - DNA, 20 bp, mouse
gaggttccaaagctgccagg

SEQ ID NO: 489084 - DNA, 20 bp, mouse
gctgaggtaatggagaagac

SEQ ID NO: 489085 - DNA, 20 bp, mouse
gtctgcagtttataaggtga

SEQ ID NO: 489086 - DNA, 20 bp, mouse
gctctgggcaggatgtgaaa

SEQ ID NO: 489087 - DNA, 20 bp, mouse
gggtattgtgatagactcag

SEQ ID NO: 489088 - DNA, 20 bp, mouse
gtgtaatggcagggaaacaa

SEQ ID NO: 489089 - DNA, 20 bp, mouse
gaagcagagctcttgggtat

SEQ ID NO: 489090 - DNA, 20 bp, mouse
gccagcatcatgattggaaa

SEQ ID NO: 489091 - DNA, 20 bp, mouse
gctcaggggggagttaggtg

SEQ ID NO: 489092 - DNA, 20 bp, mouse
gatgtccccagcatcatgat

SEQ ID NO: 489093 - DNA, 20 bp, mouse
ggggtgatacaaatcatcaa

SEQ ID NO: 489094 - DNA, 20 bp, mouse
gcagtattcaacaagtgctc

SEQ ID NO: 489095 - DNA, 20 bp, mouse
gagtagccagtccatgtgtt

SEQ ID NO: 489096 - DNA, 20 bp, mouse
ggaaacccaggtaagagaca

SEQ ID NO: 489097 - DNA, 20 bp, mouse
gctcttacctgggtttcctt

SEQ ID NO: 489098 - DNA, 20 bp, mouse
gagaaaccactggggaacac

SEQ ID NO: 489099 - DNA, 20 bp, mouse
ggcctagatgggaaagactc

SEQ ID NO: 489100 - DNA, 20 bp, mouse
gtcacttccagaaaccactg

SEQ ID NO: 489101 - DNA, 20 bp, mouse
gagtagggaccagcctagat

SEQ ID NO: 489102 - DNA, 20 bp, mouse
gaaggaccctgtctcttacc

SEQ ID NO: 489103 - DNA, 20 bp, mouse
gacttttcctaaggaaaccc

SEQ ID NO: 489104 - DNA, 20 bp, mouse
gaagtgatcattcaaaagta

SEQ ID NO: 489105 - DNA, 20 bp, mouse
gaggaaaagtattttggtga

SEQ ID NO: 489106 - DNA, 20 bp, mouse
gcggtaggtgggcctgagta

SEQ ID NO: 489107 - DNA, 20 bp, mouse
ggtctcatggccactgtcgg

SEQ ID NO: 489108 - DNA, 20 bp, mouse
gtagctacaggagaaggatt

SEQ ID NO: 489109 - DNA, 20 bp, mouse
gtggcctcagccaggacggt

SEQ ID NO: 489110 - DNA, 20 bp, mouse
gaagaaaaatacacactgct

SEQ ID NO: 489111 - DNA, 20 bp, mouse
gtgctctgccagttagtcat

SEQ ID NO: 489112 - DNA, 20 bp, mouse
gagaaggattgggctttgtg

SEQ ID NO: 489113 - DNA, 20 bp, mouse
gaggatttggctagtcacaa

SEQ ID NO: 489114 - DNA, 20 bp, mouse
gagaagtgccagctggctaa

SEQ ID NO: 489115 - DNA, 20 bp, mouse
gtcaggcccacctaccgtcc

SEQ ID NO: 489116 - DNA, 20 bp, mouse
gccaattgcagtgggatcct

SEQ ID NO: 489117 - DNA, 20 bp, mouse
ggccaagcaggagtatcaag

SEQ ID NO: 489118 - DNA, 20 bp, mouse
gcatcttgcaaatagcccac

SEQ ID NO: 489119 - DNA, 20 bp, mouse
gagggagaatgtatgagtat

SEQ ID NO: 489120 - DNA, 20 bp, mouse
gggtaacttgaagaaggaca

SEQ ID NO: 489121 - DNA, 20 bp, mouse
gtggcaaggagatgccaagc

SEQ ID NO: 489122 - DNA, 20 bp, mouse
gagttaggagctgttactgg

SEQ ID NO: 489123 - DNA, 20 bp, mouse
gaagccaatcacacatggat

SEQ ID NO: 489124 - DNA, 20 bp, mouse
gtgcaaatagcccactggca

SEQ ID NO: 489125 - DNA, 20 bp, mouse
gggtattttccaattgcagt

SEQ ID NO: 489126 - DNA, 20 bp, mouse
gtataaaggagaaaattcac

SEQ ID NO: 489127 - DNA, 20 bp, mouse
ggcagagggcggtaaagagt

SEQ ID NO: 489128 - DNA, 20 bp, mouse
ggtcccgcactgtatgagga

SEQ ID NO: 489129 - DNA, 20 bp, mouse
gcgcactgtatgaggaaggc

SEQ ID NO: 489130 - DNA, 20 bp, mouse
gagatgtcccgcactgtatg

SEQ ID NO: 489131 - DNA, 20 bp, mouse
gtctgaaaggaggcccgata

SEQ ID NO: 489132 - DNA, 20 bp, mouse
gctctgagcagtgtacaata

SEQ ID NO: 489133 - DNA, 20 bp, mouse
ggctgaggtcacagaatcgg

SEQ ID NO: 489134 - DNA, 20 bp, mouse
gatgtctaggtgactctctc

SEQ ID NO: 489135 - DNA, 20 bp, mouse
gtgttgatgaaaacgtataa

SEQ ID NO: 489136 - DNA, 20 bp, mouse
gtagccggctctattagcac

SEQ ID NO: 489137 - DNA, 20 bp, mouse
gtgtccggtgctaatagagc

SEQ ID NO: 489138 - DNA, 20 bp, mouse
gtgtagagggaatcctgtaa

SEQ ID NO: 489139 - DNA, 20 bp, mouse
gaagggtagagtctgatgag

SEQ ID NO: 489140 - DNA, 20 bp, mouse
gagaaatgaaaaacttcctg

SEQ ID NO: 489141 - DNA, 20 bp, mouse
gtgtctgtaagccaaaacat

SEQ ID NO: 489142 - DNA, 20 bp, mouse
gggtagagtctgatgagagg

SEQ ID NO: 489143 - DNA, 20 bp, mouse
gtagaggctggtcttttctc

SEQ ID NO: 489144 - DNA, 20 bp, mouse
gttcttcctacagcagataa

SEQ ID NO: 489145 - DNA, 20 bp, mouse
gttgctcccttatctgctgt

SEQ ID NO: 489146 - DNA, 20 bp, mouse
ggttaagaatatttagtccc

SEQ ID NO: 489147 - DNA, 20 bp, mouse
gtgaaatcacaaacattgga

SEQ ID NO: 489148 - DNA, 20 bp, mouse
ggtactgaaatcacaaacat

SEQ ID NO: 489149 - DNA, 20 bp, mouse
gactggacttgaatttgccc

SEQ ID NO: 489150 - DNA, 20 bp, mouse
gcacgtgttctaagcgtgat

SEQ ID NO: 489151 - DNA, 20 bp, mouse
gaacttagacactctcctcc

SEQ ID NO: 489152 - DNA, 20 bp, mouse
gccatggaaagcaggcctgg

SEQ ID NO: 489153 - DNA, 20 bp, mouse
gacagtggtcccagtacaaa

SEQ ID NO: 489154 - DNA, 20 bp, mouse
gagaacacgtgataaagaac

SEQ ID NO: 489155 - DNA, 20 bp, mouse
ggcgttccgataggatacaa

SEQ ID NO: 489156 - DNA, 20 bp, mouse
gggttctacccattagtcac

SEQ ID NO: 489157 - DNA, 20 bp, mouse
gatgttaacagacttaaaaa

SEQ ID NO: 489158 - DNA, 20 bp, mouse
gagtcacaggatgctacttc

SEQ ID NO: 489159 - DNA, 20 bp, mouse
ggctacttctggaacagagg

SEQ ID NO: 489160 - DNA, 20 bp, mouse
gtcctggtagacaaacagac

SEQ ID NO: 489161 - DNA, 20 bp, mouse
ggggctaattaccttatatc

SEQ ID NO: 489162 - DNA, 20 bp, mouse
gtcactataactaaccaaga

SEQ ID NO: 489163 - DNA, 20 bp, mouse
ggagtggctaatgagatacc

SEQ ID NO: 489164 - DNA, 20 bp, mouse
gaactgactacaacagtgtg

SEQ ID NO: 489165 - DNA, 20 bp, mouse
gttagttatagtgagagcct

SEQ ID NO: 489166 - DNA, 20 bp, mouse
gtgttctacgcaaggtgaca

SEQ ID NO: 489167 - DNA, 20 bp, mouse
ggctttctattgtccctggg

SEQ ID NO: 489168 - DNA, 20 bp, mouse
gccagtagtctctccgccca

SEQ ID NO: 489169 - DNA, 20 bp, mouse
gcaagctttctattgtccct

SEQ ID NO: 489170 - DNA, 20 bp, mouse
gccccacactgttctacgca

SEQ ID NO: 489171 - DNA, 20 bp, mouse
ggccgcggcagcttccctgg

SEQ ID NO: 489172 - DNA, 20 bp, mouse
gaccttgcgtagaacagtgt

SEQ ID NO: 489173 - DNA, 20 bp, mouse
gggggccttggccttggcca

SEQ ID NO: 489174 - DNA, 20 bp, mouse
gagccccgaggccttggcca

SEQ ID NO: 489175 - DNA, 20 bp, mouse
gtccaggagccccgaggcct

SEQ ID NO: 489176 - DNA, 20 bp, mouse
gacgctgacagcgccagccg

SEQ ID NO: 489177 - DNA, 20 bp, mouse
gatgcggcttcccccgcggc

SEQ ID NO: 489178 - DNA, 20 bp, mouse
gaaaaaaaagaatcaggcaa

SEQ ID NO: 489179 - DNA, 20 bp, mouse
ggattcattttggagtgtgg

SEQ ID NO: 489180 - DNA, 20 bp, mouse
gctgcttaaaagattcattt

SEQ ID NO: 489181 - DNA, 20 bp, mouse
gaaagattcattttggagtg

SEQ ID NO: 489182 - DNA, 20 bp, mouse
gtccggagcggcgacgcaga

SEQ ID NO: 489183 - DNA, 20 bp, mouse
ggatgaggggaccggcaatg

SEQ ID NO: 489184 - DNA, 20 bp, mouse
ggcgggggaagccgcattgc

SEQ ID NO: 489185 - DNA, 20 bp, mouse
gtgctctgcgttcttcgcag

SEQ ID NO: 489186 - DNA, 20 bp, mouse
gaactacaccgaggatcggg

SEQ ID NO: 489187 - DNA, 20 bp, mouse
gtgcagcaccgcccgatcct

SEQ ID NO: 489188 - DNA, 20 bp, mouse
gctttcccgaccaccttgat

SEQ ID NO: 489189 - DNA, 20 bp, mouse
ggatcaactacaccgaggat

SEQ ID NO: 489190 - DNA, 20 bp, mouse
gctctggagaaagaaattca

SEQ ID NO: 489191 - DNA, 20 bp, mouse
gagaggtgtggaggctgcac

SEQ ID NO: 489192 - DNA, 20 bp, mouse
ggtgatgccggaggtgaaca

SEQ ID NO: 489193 - DNA, 20 bp, mouse
gcacgggacaacatgttcag

SEQ ID NO: 489194 - DNA, 20 bp, mouse
gtccaacacacccatcaagg

SEQ ID NO: 489195 - DNA, 20 bp, mouse
gccagaaccctgttcacctc

SEQ ID NO: 489196 - DNA, 20 bp, mouse
gcgacggctaagagaagatg

SEQ ID NO: 489197 - DNA, 20 bp, mouse
gtccaatcaggtcatcctca

SEQ ID NO: 489198 - DNA, 20 bp, mouse
gcagccgacgctgctcattc

SEQ ID NO: 489199 - DNA, 20 bp, mouse
gtctttacggagggtggagg

SEQ ID NO: 489200 - DNA, 20 bp, mouse
gctgcctgaatgagcagcgt

SEQ ID NO: 489201 - DNA, 20 bp, mouse
gtggagtacagccggtatat

SEQ ID NO: 489202 - DNA, 20 bp, mouse
gaccagcatcgccaatatac

SEQ ID NO: 489203 - DNA, 20 bp, mouse
gtattgagtaccacacccac

SEQ ID NO: 489204 - DNA, 20 bp, mouse
gtgcaagcagcagtgacaca

SEQ ID NO: 489205 - DNA, 20 bp, mouse
ggaaagccttcaggtactgt

SEQ ID NO: 489206 - DNA, 20 bp, mouse
gctggcggcggtggaaggag

SEQ ID NO: 489207 - DNA, 20 bp, mouse
gccagtctgggcatgctctg

SEQ ID NO: 489208 - DNA, 20 bp, mouse
gcgcttggccaggctggcgg

SEQ ID NO: 489209 - DNA, 20 bp, mouse
gctgcgcttggccaggctgg

SEQ ID NO: 489210 - DNA, 20 bp, mouse
gccaggctggcggcggtgga

SEQ ID NO: 489211 - DNA, 20 bp, mouse
ggtgcgcatgcgcccagtct

SEQ ID NO: 489212 - DNA, 20 bp, mouse
gtctgggcatgctctggggt

SEQ ID NO: 489213 - DNA, 20 bp, mouse
gagcgcaggccgctgagacc

SEQ ID NO: 489214 - DNA, 20 bp, mouse
gcggcgctaagactagatgg

SEQ ID NO: 489215 - DNA, 20 bp, mouse
gtagctgcgcttggccaggc

SEQ ID NO: 489216 - DNA, 20 bp, mouse
ggacccgcctgtcatagctt

SEQ ID NO: 489217 - DNA, 20 bp, mouse
gctaccacacctgcccgcca

SEQ ID NO: 489218 - DNA, 20 bp, mouse
gagaatcacaggaaccgggc

SEQ ID NO: 489219 - DNA, 20 bp, mouse
gtacaagaatcacaggaacc

SEQ ID NO: 489220 - DNA, 20 bp, mouse
gagcagagggtcatacagca

SEQ ID NO: 489221 - DNA, 20 bp, mouse
gtgacctaagctatgacagg

SEQ ID NO: 489222 - DNA, 20 bp, mouse
gcagtgacctaagctatgac

SEQ ID NO: 489223 - DNA, 20 bp, mouse
gagtgtgaggggttggctct

SEQ ID NO: 489224 - DNA, 20 bp, mouse
gtctgcacacagtgtgttgt

SEQ ID NO: 489225 - DNA, 20 bp, mouse
gtcactggagcagacagaca

SEQ ID NO: 489226 - DNA, 20 bp, mouse
gggaagagccagatctgtag

SEQ ID NO: 489227 - DNA, 20 bp, mouse
gtcctggccggcgggtagag

SEQ ID NO: 489228 - DNA, 20 bp, mouse
gaaagagcccgggaagaagg

SEQ ID NO: 489229 - DNA, 20 bp, mouse
gaggctagcgggatacgaga

SEQ ID NO: 489230 - DNA, 20 bp, mouse
ggaggactcgagcctggcgg

SEQ ID NO: 489231 - DNA, 20 bp, mouse
gcctaagaagagcgatgtgt

SEQ ID NO: 489232 - DNA, 20 bp, mouse
gtggccggcgggtagagggg

SEQ ID NO: 489233 - DNA, 20 bp, mouse
gcgccgcagccagcttatcc

SEQ ID NO: 489234 - DNA, 20 bp, mouse
gccctccccccctcactcgt

SEQ ID NO: 489235 - DNA, 20 bp, mouse
ggatgcctacgagtgagggg

SEQ ID NO: 489236 - DNA, 20 bp, mouse
gagggaggccctgagcaaag

SEQ ID NO: 489237 - DNA, 20 bp, mouse
gtctcgcagaaggagctggt

SEQ ID NO: 489238 - DNA, 20 bp, mouse
gaaggctagcggctgcagag

SEQ ID NO: 489239 - DNA, 20 bp, mouse
ggcagaaggagctggttgga

SEQ ID NO: 489240 - DNA, 20 bp, mouse
gggctgcagagaggtgaaca

SEQ ID NO: 489241 - DNA, 20 bp, mouse
ggctgtctcgcagaaggagc

SEQ ID NO: 489242 - DNA, 20 bp, mouse
ggcccaggggatcaagacct

SEQ ID NO: 489243 - DNA, 20 bp, mouse
gagagaggtgaacaaggaac

SEQ ID NO: 489244 - DNA, 20 bp, mouse
ggagaaggctaggggcccag

SEQ ID NO: 489245 - DNA, 20 bp, mouse
gcctgggaggctaggagtgg

SEQ ID NO: 489246 - DNA, 20 bp, mouse
ggcaggtgtcagccatggtg

SEQ ID NO: 489247 - DNA, 20 bp, mouse
gtcccggtccaaccccacca

SEQ ID NO: 489248 - DNA, 20 bp, mouse
ggccatggtggggttggacc

SEQ ID NO: 489249 - DNA, 20 bp, mouse
gttactggagcagacagatg

SEQ ID NO: 489250 - DNA, 20 bp, mouse
gtggcaggcagacaattgtc

SEQ ID NO: 489251 - DNA, 20 bp, mouse
gggtgctgggagagcatatc

SEQ ID NO: 489252 - DNA, 20 bp, mouse
ggggtgtacagcaagaagat

SEQ ID NO: 489253 - DNA, 20 bp, mouse
gtgcctgccatgaggcacct

SEQ ID NO: 489254 - DNA, 20 bp, mouse
gcacctgcctaggtgcctca

SEQ ID NO: 489255 - DNA, 20 bp, mouse
gtgtgaggcgcccggccctg

SEQ ID NO: 489256 - DNA, 20 bp, mouse
gagcatccaaggccagctca

SEQ ID NO: 489257 - DNA, 20 bp, mouse
gggggtggctacagcatcca

SEQ ID NO: 489258 - DNA, 20 bp, mouse
ggaaatagaaacactctcgt

SEQ ID NO: 489259 - DNA, 20 bp, mouse
gtcgcagcgtgaggagttca

SEQ ID NO: 489260 - DNA, 20 bp, mouse
gagccacccccaaattttgg

SEQ ID NO: 489261 - DNA, 20 bp, mouse
gctggagcagcgttttcgag

SEQ ID NO: 489262 - DNA, 20 bp, mouse
gtatcaggcagggccagaac

SEQ ID NO: 489263 - DNA, 20 bp, mouse
gttatacctccaaaatttgg

SEQ ID NO: 489264 - DNA, 20 bp, mouse
gtgtagccacccccaaattt

SEQ ID NO: 489265 - DNA, 20 bp, mouse
ggagacttgaggaccacggg

SEQ ID NO: 489266 - DNA, 20 bp, mouse
gattgcctgggagggatttc

SEQ ID NO: 489267 - DNA, 20 bp, mouse
gactgcacaggccctctcat

SEQ ID NO: 489268 - DNA, 20 bp, mouse
ggctttttggaggaattcac

SEQ ID NO: 489269 - DNA, 20 bp, mouse
gcaggagaaaggatctcacc

SEQ ID NO: 489270 - DNA, 20 bp, mouse
ggggcctgtgcagtctcccc

SEQ ID NO: 489271 - DNA, 20 bp, mouse
gagttgactagctagcacta

SEQ ID NO: 489272 - DNA, 20 bp, mouse
gaatatatctcactggtctt

SEQ ID NO: 489273 - DNA, 20 bp, mouse
ggtcctgagagccattgcct

SEQ ID NO: 489274 - DNA, 20 bp, mouse
gacttccagaaatccctccc

SEQ ID NO: 489275 - DNA, 20 bp, mouse
gctgagagccattgcctggg

SEQ ID NO: 489276 - DNA, 20 bp, mouse
gctaaggtatttgtatgcat

SEQ ID NO: 489277 - DNA, 20 bp, mouse
gtatttgtatgcatgggatt

SEQ ID NO: 489278 - DNA, 20 bp, mouse
gtcacaaataatgactcaag

SEQ ID NO: 489279 - DNA, 20 bp, mouse
gttcatgaatctttcatcag

SEQ ID NO: 489280 - DNA, 20 bp, mouse
gttaaatttgagccagaata

SEQ ID NO: 489281 - DNA, 20 bp, mouse
gtctttaaatgttctgtcac

SEQ ID NO: 489282 - DNA, 20 bp, mouse
gaatgaaggagactggcaaa

SEQ ID NO: 489283 - DNA, 20 bp, mouse
gagtcattatttgtgaagaa

SEQ ID NO: 489284 - DNA, 20 bp, mouse
gggctgacaattattgcaat

SEQ ID NO: 489285 - DNA, 20 bp, mouse
gtcatatacactcagttttg

SEQ ID NO: 489286 - DNA, 20 bp, mouse
gtggctgcgacagaccatgg

SEQ ID NO: 489287 - DNA, 20 bp, mouse
gctgcgacagaccatggtgg

SEQ ID NO: 489288 - DNA, 20 bp, mouse
gttcagacaagcagagtgaa

SEQ ID NO: 489289 - DNA, 20 bp, mouse
gcacaccaatactaatactg

SEQ ID NO: 489290 - DNA, 20 bp, mouse
gcatcatccatacagcgaag

SEQ ID NO: 489291 - DNA, 20 bp, mouse
gctatgatgatcctgtactt

SEQ ID NO: 489292 - DNA, 20 bp, mouse
gacagaccctcttcgctgta

SEQ ID NO: 489293 - DNA, 20 bp, mouse
ggatgatgatggattgctgt

SEQ ID NO: 489294 - DNA, 20 bp, mouse
gccactatgaggaggatcca

SEQ ID NO: 489295 - DNA, 20 bp, mouse
gcggaggttcaccaccacca

SEQ ID NO: 489296 - DNA, 20 bp, mouse
gagaacagattgtcctagat

SEQ ID NO: 489297 - DNA, 20 bp, mouse
ggtagcctagtcaccaagga

SEQ ID NO: 489298 - DNA, 20 bp, mouse
gagtccttcgtcaaagaaga

SEQ ID NO: 489299 - DNA, 20 bp, mouse
ggtaccatcttctttgacga

SEQ ID NO: 489300 - DNA, 20 bp, mouse
gacgatgattgtttccttct

SEQ ID NO: 489301 - DNA, 20 bp, mouse
gaggaaggagagaggtaaga

SEQ ID NO: 489302 - DNA, 20 bp, mouse
gctgagtagcctagtcacca

SEQ ID NO: 489303 - DNA, 20 bp, mouse
gactaggctactcagaaact

SEQ ID NO: 489304 - DNA, 20 bp, mouse
gaggagagaggtaagaaggc

SEQ ID NO: 489305 - DNA, 20 bp, mouse
gttgaggattgtttaagcta

SEQ ID NO: 489306 - DNA, 20 bp, mouse
gggtgaactccaaggtctgg

SEQ ID NO: 489307 - DNA, 20 bp, mouse
gtatatcacagagcctagga

SEQ ID NO: 489308 - DNA, 20 bp, mouse
gtagctatggctcacaagac

SEQ ID NO: 489309 - DNA, 20 bp, mouse
ggacaggcactccctcattg

SEQ ID NO: 489310 - DNA, 20 bp, mouse
ggagtgtagcaagttatcct

SEQ ID NO: 489311 - DNA, 20 bp, mouse
gaagagggatttgccatcct

SEQ ID NO: 489312 - DNA, 20 bp, mouse
ggtgttaattctctgagaac

SEQ ID NO: 489313 - DNA, 20 bp, mouse
gttctctgagaactggaatc

SEQ ID NO: 489314 - DNA, 20 bp, mouse
gccaggcagtctcctggaaa

SEQ ID NO: 489315 - DNA, 20 bp, mouse
gtaggaaaatgttaagtctg

SEQ ID NO: 489316 - DNA, 20 bp, mouse
gctgtgcggcgagaagatgg

SEQ ID NO: 489317 - DNA, 20 bp, mouse
gatggcggcgacgggagacg

SEQ ID NO: 489318 - DNA, 20 bp, mouse
gtgtctgtgcggcgagaaga

SEQ ID NO: 489319 - DNA, 20 bp, mouse
ggcgagaagatggcggcgac

SEQ ID NO: 489320 - DNA, 20 bp, mouse
gatggcggcccgtctcaatg

SEQ ID NO: 489321 - DNA, 20 bp, mouse
gggggaagcgcggcactgag

SEQ ID NO: 489322 - DNA, 20 bp, mouse
ggagacgcggcgtgagaagc

SEQ ID NO: 489323 - DNA, 20 bp, mouse
ggggcggctgctccaggcga

SEQ ID NO: 489324 - DNA, 20 bp, mouse
gacgccgcctggctctcccg

SEQ ID NO: 489325 - DNA, 20 bp, mouse
gcacggcccgcgctacctgt

SEQ ID NO: 489326 - DNA, 20 bp, mouse
gtcatctgaaggggtaagag

SEQ ID NO: 489327 - DNA, 20 bp, mouse
gtgcgggcagtcgcagccgg

SEQ ID NO: 489328 - DNA, 20 bp, mouse
ggaactgcggccacggacaa

SEQ ID NO: 489329 - DNA, 20 bp, mouse
ggcgagccggacaggaactg

SEQ ID NO: 489330 - DNA, 20 bp, mouse
gtaaagccttgtcatctgaa

SEQ ID NO: 489331 - DNA, 20 bp, mouse
gggggtcaagttgagagtca

SEQ ID NO: 489332 - DNA, 20 bp, mouse
gggacaaaggcgagcccacg

SEQ ID NO: 489333 - DNA, 20 bp, mouse
ggccctgccgcgagccggac

SEQ ID NO: 489334 - DNA, 20 bp, mouse
gtcagcttgatacgccacgt

SEQ ID NO: 489335 - DNA, 20 bp, mouse
ggatgacaaggctttaccgc

SEQ ID NO: 489336 - DNA, 20 bp, mouse
gaatggagcaacccctcgtg

SEQ ID NO: 489337 - DNA, 20 bp, mouse
gacttcccgggagcgcggag

SEQ ID NO: 489338 - DNA, 20 bp, mouse
gttatcggccagaagatctg

SEQ ID NO: 489339 - DNA, 20 bp, mouse
ggcttctgattcctcacgag

SEQ ID NO: 489340 - DNA, 20 bp, mouse
ggagctacattattaattaa

SEQ ID NO: 489341 - DNA, 20 bp, mouse
gagtagctcagaaacttccc

SEQ ID NO: 489342 - DNA, 20 bp, mouse
gtggccgataatctcaaaca

SEQ ID NO: 489343 - DNA, 20 bp, mouse
gacctcgcggcgttcctcgt

SEQ ID NO: 489344 - DNA, 20 bp, mouse
gtcctcgtgggaaggtgcgg

SEQ ID NO: 489345 - DNA, 20 bp, mouse
ggcaagtgctcgcaggtgag

SEQ ID NO: 489346 - DNA, 20 bp, mouse
ggaaaatacatctaagactg

SEQ ID NO: 489347 - DNA, 20 bp, mouse
gatatacacacctatacggt

SEQ ID NO: 489348 - DNA, 20 bp, mouse
ggggccatactatctatcat

SEQ ID NO: 489349 - DNA, 20 bp, mouse
gggattactctgaaatgtat

SEQ ID NO: 489350 - DNA, 20 bp, mouse
gaaacacagaagcttgcaac

SEQ ID NO: 489351 - DNA, 20 bp, mouse
gtatctatcatgggaagatg

SEQ ID NO: 489352 - DNA, 20 bp, mouse
gtttttctagccaaccgtat

SEQ ID NO: 489353 - DNA, 20 bp, mouse
gtacaatgttaagattacag

SEQ ID NO: 489354 - DNA, 20 bp, mouse
gagaattaatctggtcaatt

SEQ ID NO: 489355 - DNA, 20 bp, mouse
gtgacacattatgtcaaatg

SEQ ID NO: 489356 - DNA, 20 bp, mouse
gttgattgaagagttactct

SEQ ID NO: 489357 - DNA, 20 bp, mouse
gcctgctattccaagcaaag

SEQ ID NO: 489358 - DNA, 20 bp, mouse
gtacagtgaaaaatttgcag

SEQ ID NO: 489359 - DNA, 20 bp, mouse
gcaaagaattagagaagcaa

SEQ ID NO: 489360 - DNA, 20 bp, mouse
gcctgtgaaacaatcaatcg

SEQ ID NO: 489361 - DNA, 20 bp, mouse
gtaatagggaattgcaggta

SEQ ID NO: 489362 - DNA, 20 bp, mouse
gaaaaatttgcagtggctag

SEQ ID NO: 489363 - DNA, 20 bp, mouse
gaattcactcctcaacatgg

SEQ ID NO: 489364 - DNA, 20 bp, mouse
gagcatgcacctcatcaagt

SEQ ID NO: 489365 - DNA, 20 bp, mouse
ggaaatatatataaagtaat

SEQ ID NO: 489366 - DNA, 20 bp, mouse
gcttagggtgaaggtagtca

SEQ ID NO: 489367 - DNA, 20 bp, mouse
gactatgaaggtatggtctt

SEQ ID NO: 489368 - DNA, 20 bp, mouse
gcgcatattatagactatga

SEQ ID NO: 489369 - DNA, 20 bp, mouse
gtgatgcttctattgaggtt

SEQ ID NO: 489370 - DNA, 20 bp, mouse
gtctattgaggttcggcata

SEQ ID NO: 489371 - DNA, 20 bp, mouse
gacttactggatgagcagga

SEQ ID NO: 489372 - DNA, 20 bp, mouse
gtgagagaactagaatcgta

SEQ ID NO: 489373 - DNA, 20 bp, mouse
gtgggagcgcacactgtgaa

SEQ ID NO: 489374 - DNA, 20 bp, mouse
gcaagtattcaaggacacat

SEQ ID NO: 489375 - DNA, 20 bp, mouse
ggatatgacatgcctattaa

SEQ ID NO: 489376 - DNA, 20 bp, mouse
gcaggccagcagggcaccca

SEQ ID NO: 489377 - DNA, 20 bp, mouse
gaggcggcgcagaagcgggt

SEQ ID NO: 489378 - DNA, 20 bp, mouse
gagggcagcgcaggccagca

SEQ ID NO: 489379 - DNA, 20 bp, mouse
gcacacacaccgagaggatg

SEQ ID NO: 489380 - DNA, 20 bp, mouse
gtcgccacacacacaccgag

SEQ ID NO: 489381 - DNA, 20 bp, mouse
gacggtgagcctcatcctct

SEQ ID NO: 489382 - DNA, 20 bp, mouse
gaggcgagcgggccacgggc

SEQ ID NO: 489383 - DNA, 20 bp, mouse
ggccccttgcttcttctctg

SEQ ID NO: 489384 - DNA, 20 bp, mouse
ggcgctggtggcttagacta

SEQ ID NO: 489385 - DNA, 20 bp, mouse
ggcgtgatgaggatagtgaa

SEQ ID NO: 489386 - DNA, 20 bp, mouse
gcaggcagagcgcagcgggc

SEQ ID NO: 489387 - DNA, 20 bp, mouse
gggatccagagggctcagat

SEQ ID NO: 489388 - DNA, 20 bp, mouse
ggcgccggccggtcattggg

SEQ ID NO: 489389 - DNA, 20 bp, mouse
gggcggcggccgcggaaccg

SEQ ID NO: 489390 - DNA, 20 bp, mouse
gtgcgctctgcctgcagcgg

SEQ ID NO: 489391 - DNA, 20 bp, mouse
ggccgggcgacgggccatgg

SEQ ID NO: 489392 - DNA, 20 bp, mouse
gggagggcctgcgatctgat

SEQ ID NO: 489393 - DNA, 20 bp, mouse
ggccccgaccgaaccccagg

SEQ ID NO: 489394 - DNA, 20 bp, mouse
ggccaggtaggacggatgga

SEQ ID NO: 489395 - DNA, 20 bp, mouse
gtgatatcgccgcggttccg

SEQ ID NO: 489396 - DNA, 20 bp, mouse
gccgcaacggcgagcaggaa

SEQ ID NO: 489397 - DNA, 20 bp, mouse
gctcgggtgaactgcctctg

SEQ ID NO: 489398 - DNA, 20 bp, mouse
gacggcgagcaggaacggct

SEQ ID NO: 489399 - DNA, 20 bp, mouse
ggacctcgggaactagcctc

SEQ ID NO: 489400 - DNA, 20 bp, mouse
gagctccgatcgaggctaag

SEQ ID NO: 489401 - DNA, 20 bp, mouse
ggtagccgctggcagacctc

SEQ ID NO: 489402 - DNA, 20 bp, mouse
gcgaggctaagaggcacttg

SEQ ID NO: 489403 - DNA, 20 bp, mouse
gagttcccgaggtctgccag

SEQ ID NO: 489404 - DNA, 20 bp, mouse
gacccacccgctgcagaggt

SEQ ID NO: 489405 - DNA, 20 bp, mouse
gaaaggcgccctggaagcta

SEQ ID NO: 489406 - DNA, 20 bp, mouse
gcttcagctctgtagcggag

SEQ ID NO: 489407 - DNA, 20 bp, mouse
gtgtgttgcaggagctggta

SEQ ID NO: 489408 - DNA, 20 bp, mouse
ggaagctgccgcaaggcacc

SEQ ID NO: 489409 - DNA, 20 bp, mouse
ggtgcagagccactgcccac

SEQ ID NO: 489410 - DNA, 20 bp, mouse
gttagaagtaaagagaaact

SEQ ID NO: 489411 - DNA, 20 bp, mouse
ggccactgcccacagggggg

SEQ ID NO: 489412 - DNA, 20 bp, mouse
gttagcaggatgtcaaactc

SEQ ID NO: 489413 - DNA, 20 bp, mouse
gtgtaaaaggcatttcatgt

SEQ ID NO: 489414 - DNA, 20 bp, mouse
gggcagcttcagctctgtag

SEQ ID NO: 489415 - DNA, 20 bp, mouse
gggatcttccgggtgccttg

SEQ ID NO: 489416 - DNA, 20 bp, mouse
gaggacccgccggcctagag

SEQ ID NO: 489417 - DNA, 20 bp, mouse
gagacaggaccatggagcgg

SEQ ID NO: 489418 - DNA, 20 bp, mouse
gcatggagcggaggacccgc

SEQ ID NO: 489419 - DNA, 20 bp, mouse
gtagagaggccgaatagctg

SEQ ID NO: 489420 - DNA, 20 bp, mouse
gtcggagcgcgaccggacct

SEQ ID NO: 489421 - DNA, 20 bp, mouse
ggccgtgggccgcagctatt

SEQ ID NO: 489422 - DNA, 20 bp, mouse
gtgacacagcgctgacagac

SEQ ID NO: 489423 - DNA, 20 bp, mouse
gtccggggacggcaaccgag

SEQ ID NO: 489424 - DNA, 20 bp, mouse
gctgcggcccacggcttcct

SEQ ID NO: 489425 - DNA, 20 bp, mouse
gatacctgcgggaagacaca

SEQ ID NO: 489426 - DNA, 20 bp, mouse
gccgcgccagccgggaacgt

SEQ ID NO: 489427 - DNA, 20 bp, mouse
gatcctggagaagggcacac

SEQ ID NO: 489428 - DNA, 20 bp, mouse
ggccgcgccggtggagacgg

SEQ ID NO: 489429 - DNA, 20 bp, mouse
ggcgaggcgcggagacgtca

SEQ ID NO: 489430 - DNA, 20 bp, mouse
ggtcgagttgagctccccac

SEQ ID NO: 489431 - DNA, 20 bp, mouse
ggcgctctcccggaggctcc

SEQ ID NO: 489432 - DNA, 20 bp, mouse
ggtgggccgccgggagcctc

SEQ ID NO: 489433 - DNA, 20 bp, mouse
ggtcacccaaggagataaaa

SEQ ID NO: 489434 - DNA, 20 bp, mouse
ggaccccggggacagcctaa

SEQ ID NO: 489435 - DNA, 20 bp, mouse
ggagataaaagggcacccgt

SEQ ID NO: 489436 - DNA, 20 bp, mouse
gtccgtcaggaggagatgaa

SEQ ID NO: 489437 - DNA, 20 bp, mouse
ggaggctgtggctaactccg

SEQ ID NO: 489438 - DNA, 20 bp, mouse
gaggtagtgtctgaccccat

SEQ ID NO: 489439 - DNA, 20 bp, mouse
gtcaggaggagatgaacggc

SEQ ID NO: 489440 - DNA, 20 bp, mouse
gatctcggcgtgttctgcca

SEQ ID NO: 489441 - DNA, 20 bp, mouse
gcatctgtggatgatgtggt

SEQ ID NO: 489442 - DNA, 20 bp, mouse
gtgaccccatcgggcgatct

SEQ ID NO: 489443 - DNA, 20 bp, mouse
gacgccgagatcgcccgatg

SEQ ID NO: 489444 - DNA, 20 bp, mouse
ggagatgaacggctggctgg

SEQ ID NO: 489445 - DNA, 20 bp, mouse
gtgtccacagtgcagagagg

SEQ ID NO: 489446 - DNA, 20 bp, mouse
gctgtctcctagccagcacc

SEQ ID NO: 489447 - DNA, 20 bp, mouse
gggctctcccggtgctggct

SEQ ID NO: 489448 - DNA, 20 bp, mouse
gctgctggctctcccggtgc

SEQ ID NO: 489449 - DNA, 20 bp, mouse
gttgattgcaggacaaacta

SEQ ID NO: 489450 - DNA, 20 bp, mouse
gagacagatatgtggccttg

SEQ ID NO: 489451 - DNA, 20 bp, mouse
gtcggggcccaggcgcccaa

SEQ ID NO: 489452 - DNA, 20 bp, mouse
gaggcgcccaagggagcctc

SEQ ID NO: 489453 - DNA, 20 bp, mouse
gtggctaggagacagatatg

SEQ ID NO: 489454 - DNA, 20 bp, mouse
gtcaggacccaccatcgagg

SEQ ID NO: 489455 - DNA, 20 bp, mouse
gtggaggacgagggtctcaa

SEQ ID NO: 489456 - DNA, 20 bp, mouse
gagcagaggcccttgagaaa

SEQ ID NO: 489457 - DNA, 20 bp, mouse
gcatgactggaggtaatgaa

SEQ ID NO: 489458 - DNA, 20 bp, mouse
gcacagaatgaaggatggac

SEQ ID NO: 489459 - DNA, 20 bp, mouse
gaactggtcccctttctcaa

SEQ ID NO: 489460 - DNA, 20 bp, mouse
gctggccacagaatgaagga

SEQ ID NO: 489461 - DNA, 20 bp, mouse
gagaaaggggaccagtttgt

SEQ ID NO: 489462 - DNA, 20 bp, mouse
gttacgggaataatcatgac

SEQ ID NO: 489463 - DNA, 20 bp, mouse
gcgggaataatcatgactgg

SEQ ID NO: 489464 - DNA, 20 bp, mouse
gtaatctggccacagaatga

SEQ ID NO: 489465 - DNA, 20 bp, mouse
gtagaagccggctctcacta

SEQ ID NO: 489466 - DNA, 20 bp, mouse
gcccggctccgccaaagcaa

SEQ ID NO: 489467 - DNA, 20 bp, mouse
ggacgagaggaccttcgggt

SEQ ID NO: 489468 - DNA, 20 bp, mouse
gctctccggccggaaacccc

SEQ ID NO: 489469 - DNA, 20 bp, mouse
gctggccacccgctgacccg

SEQ ID NO: 489470 - DNA, 20 bp, mouse
gcaggcaggccccgaccgag

SEQ ID NO: 489471 - DNA, 20 bp, mouse
ggggtaggcgcgggacatgg

SEQ ID NO: 489472 - DNA, 20 bp, mouse
gcacggagcaaagagtccat

SEQ ID NO: 489473 - DNA, 20 bp, mouse
ggtaatccgactggattatg

SEQ ID NO: 489474 - DNA, 20 bp, mouse
ggaaaccccgggtcagcggg

SEQ ID NO: 489475 - DNA, 20 bp, mouse
gggcttcccagaacgctatc

SEQ ID NO: 489476 - DNA, 20 bp, mouse
gccgcgctgcaaggagcgag

SEQ ID NO: 489477 - DNA, 20 bp, mouse
gggcgtggggagcttgtaca

SEQ ID NO: 489478 - DNA, 20 bp, mouse
ggtcctacgaggtgctgcgg

SEQ ID NO: 489479 - DNA, 20 bp, mouse
gctgctccggcggcaacccg

SEQ ID NO: 489480 - DNA, 20 bp, mouse
ggagcagagccggtcctacg

SEQ ID NO: 489481 - DNA, 20 bp, mouse
gggcggggcttacggcggaa

SEQ ID NO: 489482 - DNA, 20 bp, mouse
ggggagcttgtacagggcgg

SEQ ID NO: 489483 - DNA, 20 bp, mouse
gggcccgggcctctggttgt

SEQ ID NO: 489484 - DNA, 20 bp, mouse
gtgcctccgcagcacctcgt

SEQ ID NO: 489485 - DNA, 20 bp, mouse
ggtggggagcttgtacaggg

SEQ ID NO: 489486 - DNA, 20 bp, mouse
gcgccgctctgccagcacag

SEQ ID NO: 489487 - DNA, 20 bp, mouse
gggccgctgtgctggcagag

SEQ ID NO: 489488 - DNA, 20 bp, mouse
ggctcgcgggcgctgatggg

SEQ ID NO: 489489 - DNA, 20 bp, mouse
gtggtggaagggctgtactg

SEQ ID NO: 489490 - DNA, 20 bp, mouse
gcagtgtgctggggtcgtag

SEQ ID NO: 489491 - DNA, 20 bp, mouse
gcggcccgccgaggccctgg

SEQ ID NO: 489492 - DNA, 20 bp, mouse
ggcagccgcggccgctgtgc

SEQ ID NO: 489493 - DNA, 20 bp, mouse
gaccttgagcgtctcgtagg

SEQ ID NO: 489494 - DNA, 20 bp, mouse
gcggcgccagcagcagccat

SEQ ID NO: 489495 - DNA, 20 bp, mouse
ggggccggtagcgatctggg

SEQ ID NO: 489496 - DNA, 20 bp, mouse
gcggtgaaacgggtacacta

SEQ ID NO: 489497 - DNA, 20 bp, mouse
gagtttgcataggcttcctg

SEQ ID NO: 489498 - DNA, 20 bp, mouse
gaggcttcctgcggtgaaac

SEQ ID NO: 489499 - DNA, 20 bp, mouse
ggtctgaaacctcttcagag

SEQ ID NO: 489500 - DNA, 20 bp, mouse
gtaccttgtttgtgatccag

SEQ ID NO: 489501 - DNA, 20 bp, mouse
gtgcccctggatcacaaaca

SEQ ID NO: 489502 - DNA, 20 bp, mouse
gaagactgtacgtggaacct

SEQ ID NO: 489503 - DNA, 20 bp, mouse
ggaacgtgtggggccctgaa

SEQ ID NO: 489504 - DNA, 20 bp, mouse
gctgcagtcaaggtgtatac

SEQ ID NO: 489505 - DNA, 20 bp, mouse
gggctactggaaatcatgtt

SEQ ID NO: 489506 - DNA, 20 bp, mouse
gaaagtggctgtgcagtccc

SEQ ID NO: 489507 - DNA, 20 bp, mouse
gcactggcatggcgggacca

SEQ ID NO: 489508 - DNA, 20 bp, mouse
ggcacgcagacgccccgcaa

SEQ ID NO: 489509 - DNA, 20 bp, mouse
gtgaactcgctcactcgcac

SEQ ID NO: 489510 - DNA, 20 bp, mouse
ggcttcctagcgacgtaaag

SEQ ID NO: 489511 - DNA, 20 bp, mouse
gtcgctcactcgcactggca

SEQ ID NO: 489512 - DNA, 20 bp, mouse
gctcactcgcactggcatgg

SEQ ID NO: 489513 - DNA, 20 bp, mouse
ggccccgcaaaggcagcgac

SEQ ID NO: 489514 - DNA, 20 bp, mouse
ggcttccctagcaacccgat

SEQ ID NO: 489515 - DNA, 20 bp, mouse
ggcgagtgagcgagttcagc

SEQ ID NO: 489516 - DNA, 20 bp, mouse
gtacagtgcaaagattgcaa

SEQ ID NO: 489517 - DNA, 20 bp, mouse
gctttgcttctatgatactt

SEQ ID NO: 489518 - DNA, 20 bp, mouse
gttaataggaattgcaagta

SEQ ID NO: 489519 - DNA, 20 bp, mouse
gagttttctagtcatcagtg

SEQ ID NO: 489520 - DNA, 20 bp, mouse
gaagcaaaggagagtgaagc

SEQ ID NO: 489521 - DNA, 20 bp, mouse
gtaattggtccaccaagtag

SEQ ID NO: 489522 - DNA, 20 bp, mouse
ggaaatatacatagaagtaa

SEQ ID NO: 489523 - DNA, 20 bp, mouse
gtagtacttgctacttgatt

SEQ ID NO: 489524 - DNA, 20 bp, mouse
gcacatcagtgcctcagatt

SEQ ID NO: 489525 - DNA, 20 bp, mouse
gctcgaatagattgtttcac

SEQ ID NO: 489526 - DNA, 20 bp, mouse
gacggcggccccctaaacac

SEQ ID NO: 489527 - DNA, 20 bp, mouse
gcccatagcgaaggatcaaa

SEQ ID NO: 489528 - DNA, 20 bp, mouse
gatagcgaaggatcaaaagg

SEQ ID NO: 489529 - DNA, 20 bp, mouse
gctggagtctctgagttcga

SEQ ID NO: 489530 - DNA, 20 bp, mouse
gcgccgttcgcgtgaaggtc

SEQ ID NO: 489531 - DNA, 20 bp, mouse
gtctgagttcgagggtttgg

SEQ ID NO: 489532 - DNA, 20 bp, mouse
gctccagaccttcacgcgaa

SEQ ID NO: 489533 - DNA, 20 bp, mouse
gaggttctcggttcctcggg

SEQ ID NO: 489534 - DNA, 20 bp, mouse
ggctatgggagtgacgtggt

SEQ ID NO: 489535 - DNA, 20 bp, mouse
ggtctctgagttcgagggtt

SEQ ID NO: 489536 - DNA, 20 bp, mouse
gtagagtgcgcgcgagtcgg

SEQ ID NO: 489537 - DNA, 20 bp, mouse
ggcactctaggccgcaggag

SEQ ID NO: 489538 - DNA, 20 bp, mouse
ggcctagagtgcgcgcgagt

SEQ ID NO: 489539 - DNA, 20 bp, mouse
gcaggagcgggatgagattc

SEQ ID NO: 489540 - DNA, 20 bp, mouse
gctgccccggggacgatgaa

SEQ ID NO: 489541 - DNA, 20 bp, mouse
ggcaggcgagggatccagct

SEQ ID NO: 489542 - DNA, 20 bp, mouse
gtccggctcgcgcaagatgg

SEQ ID NO: 489543 - DNA, 20 bp, mouse
gggacctggccgagaggagt

SEQ ID NO: 489544 - DNA, 20 bp, mouse
gccccggggacgatgaacgg

SEQ ID NO: 489545 - DNA, 20 bp, mouse
gaaggccggactccgacctg

SEQ ID NO: 489546 - DNA, 20 bp, mouse
ggccaggttaaggaatctca

SEQ ID NO: 489547 - DNA, 20 bp, mouse
gccgcccgccagccaggtta

SEQ ID NO: 489548 - DNA, 20 bp, mouse
gtcaggccgcagccgggatc

SEQ ID NO: 489549 - DNA, 20 bp, mouse
ggcagccgggatccggaatc

SEQ ID NO: 489550 - DNA, 20 bp, mouse
gcacgggtcaggccgcagcc

SEQ ID NO: 489551 - DNA, 20 bp, mouse
gggggttggagaccagctaa

SEQ ID NO: 489552 - DNA, 20 bp, mouse
ggaatccggttgtttcctgg

SEQ ID NO: 489553 - DNA, 20 bp, mouse
gctctagccgggaggatgaa

SEQ ID NO: 489554 - DNA, 20 bp, mouse
ggaggtaggggcccagtccc

SEQ ID NO: 489555 - DNA, 20 bp, mouse
gttggagaccagctaagggt

SEQ ID NO: 489556 - DNA, 20 bp, mouse
ggagatagcccgggcaccag

SEQ ID NO: 489557 - DNA, 20 bp, mouse
ggtgagtgcggagatagccc

SEQ ID NO: 489558 - DNA, 20 bp, mouse
gggcaccaggggcgagggta

SEQ ID NO: 489559 - DNA, 20 bp, mouse
gtgtcgggtgccgagatcgg

SEQ ID NO: 489560 - DNA, 20 bp, mouse
gcccggcggctgcaggacct

SEQ ID NO: 489561 - DNA, 20 bp, mouse
ggcccgggcaccaggggcga

SEQ ID NO: 489562 - DNA, 20 bp, mouse
ggcccagcggtcctgagaaa

SEQ ID NO: 489563 - DNA, 20 bp, mouse
ggagggtatggaggcagccc

SEQ ID NO: 489564 - DNA, 20 bp, mouse
ggcactcaccgcgcggtccg

SEQ ID NO: 489565 - DNA, 20 bp, mouse
gtccctcccaggctccatgg

SEQ ID NO: 489566 - DNA, 20 bp, mouse
gcaagaggtcgagggcgtgg

SEQ ID NO: 489567 - DNA, 20 bp, mouse
ggtcgagggcgtggaggtag

SEQ ID NO: 489568 - DNA, 20 bp, mouse
gtcccccaacaagaggtcga

SEQ ID NO: 489569 - DNA, 20 bp, mouse
ggcgttcgcggtgcgagagg

SEQ ID NO: 489570 - DNA, 20 bp, mouse
ggtggccgcggtggaaatgt

SEQ ID NO: 489571 - DNA, 20 bp, mouse
ggaggccctggatcagcaag

SEQ ID NO: 489572 - DNA, 20 bp, mouse
gaggggtggtagaggagcaa

SEQ ID NO: 489573 - DNA, 20 bp, mouse
ggaggtgcccaacaacaaag

SEQ ID NO: 489574 - DNA, 20 bp, mouse
gaaccggctctaccacgggg

SEQ ID NO: 489575 - DNA, 20 bp, mouse
gaacgcctcttgctgatcca

SEQ ID NO: 489576 - DNA, 20 bp, mouse
gctagtggctgagaatgtgg

SEQ ID NO: 489577 - DNA, 20 bp, mouse
gaactctaggaagccaaact

SEQ ID NO: 489578 - DNA, 20 bp, mouse
gtgcatggaccagataaccg

SEQ ID NO: 489579 - DNA, 20 bp, mouse
gtccggtactgaacagtgaa

SEQ ID NO: 489580 - DNA, 20 bp, mouse
gatgtacatcaggaatcgtg

SEQ ID NO: 489581 - DNA, 20 bp, mouse
gatactcaccacaggctggt

SEQ ID NO: 489582 - DNA, 20 bp, mouse
gcacatgagatactcaccac

SEQ ID NO: 489583 - DNA, 20 bp, mouse
gagacttgagcactaactag

SEQ ID NO: 489584 - DNA, 20 bp, mouse
gaacttcactccctcaggaa

SEQ ID NO: 489585 - DNA, 20 bp, mouse
gaagtagccagtgccaagtt

SEQ ID NO: 489586 - DNA, 20 bp, mouse
gcagtagaacggagagctag

SEQ ID NO: 489587 - DNA, 20 bp, mouse
gaccaggccagatgagagag

SEQ ID NO: 489588 - DNA, 20 bp, mouse
gcagaggggccatggtctcc

SEQ ID NO: 489589 - DNA, 20 bp, mouse
ggcgggtgtgggaaagaacc

SEQ ID NO: 489590 - DNA, 20 bp, mouse
gagctctggctgacactggt

SEQ ID NO: 489591 - DNA, 20 bp, mouse
ggctctccgttctactgtcc

SEQ ID NO: 489592 - DNA, 20 bp, mouse
gcagccaggcctgcgggtgt

SEQ ID NO: 489593 - DNA, 20 bp, mouse
gggtccagttcacaagtcaa

SEQ ID NO: 489594 - DNA, 20 bp, mouse
gggcaaggggatggtaccag

SEQ ID NO: 489595 - DNA, 20 bp, mouse
gctcgctcgctagaggggag

SEQ ID NO: 489596 - DNA, 20 bp, mouse
gatatagcaacacatcatat

SEQ ID NO: 489597 - DNA, 20 bp, mouse
gaatgtcacacaaccacgac

SEQ ID NO: 489598 - DNA, 20 bp, mouse
gtaaaacattctggctactt

SEQ ID NO: 489599 - DNA, 20 bp, mouse
gcagctattgttgcagattc

SEQ ID NO: 489600 - DNA, 20 bp, mouse
gttgtcttactatcatgtac

SEQ ID NO: 489601 - DNA, 20 bp, mouse
gtgttacttcatacttgacc

SEQ ID NO: 489602 - DNA, 20 bp, mouse
gtgcttgcttaaagtgtcat

SEQ ID NO: 489603 - DNA, 20 bp, mouse
gaataaatacattgaaatgg

SEQ ID NO: 489604 - DNA, 20 bp, mouse
ggattcatttttccactctg

SEQ ID NO: 489605 - DNA, 20 bp, mouse
gagagatttgaagcctgtcg

SEQ ID NO: 489606 - DNA, 20 bp, mouse
gcacaagaaacaccatatga

SEQ ID NO: 489607 - DNA, 20 bp, mouse
gagaaacaccatatgaaggc

SEQ ID NO: 489608 - DNA, 20 bp, mouse
gaacatgaggttacaatcct

SEQ ID NO: 489609 - DNA, 20 bp, mouse
gatgaggttacaatcctagg

SEQ ID NO: 489610 - DNA, 20 bp, mouse
ggaattcattgagtcctcct

SEQ ID NO: 489611 - DNA, 20 bp, mouse
gctcattgaaagcaaacatg

SEQ ID NO: 489612 - DNA, 20 bp, mouse
gtaggataggccagcaactg

SEQ ID NO: 489613 - DNA, 20 bp, mouse
gaccattgagaggatctatg

SEQ ID NO: 489614 - DNA, 20 bp, mouse
gctgcttgtactcttctggt

SEQ ID NO: 489615 - DNA, 20 bp, mouse
gtctggtcggtggaggtaca

SEQ ID NO: 489616 - DNA, 20 bp, mouse
gccctctacccagttaaagg

SEQ ID NO: 489617 - DNA, 20 bp, mouse
gctgccctctacccagttaa

SEQ ID NO: 489618 - DNA, 20 bp, mouse
gacagagcaacttaccactc

SEQ ID NO: 489619 - DNA, 20 bp, mouse
gctgttcaacagcctcgaaa

SEQ ID NO: 489620 - DNA, 20 bp, mouse
gccctaaagaaagtgtcata

SEQ ID NO: 489621 - DNA, 20 bp, mouse
gacagcctcgaaaaggaaac

SEQ ID NO: 489622 - DNA, 20 bp, mouse
gttgtaattataggaatatg

SEQ ID NO: 489623 - DNA, 20 bp, mouse
gacaatattaaagattacag

SEQ ID NO: 489624 - DNA, 20 bp, mouse
gttcgtggacaacatctatt

SEQ ID NO: 489625 - DNA, 20 bp, mouse
gctaacctgtttccttttcg

SEQ ID NO: 489626 - DNA, 20 bp, mouse
gtggtgaagaagcagaactc

SEQ ID NO: 489627 - DNA, 20 bp, mouse
gaatgaagcacaaccatgtc

SEQ ID NO: 489628 - DNA, 20 bp, mouse
ggcaattcatgctaaaactt

SEQ ID NO: 489629 - DNA, 20 bp, mouse
gtggccttactatctctaag

SEQ ID NO: 489630 - DNA, 20 bp, mouse
gcgtgtttctaagatactct

SEQ ID NO: 489631 - DNA, 20 bp, mouse
gaaaaaataaatctggtcaa

SEQ ID NO: 489632 - DNA, 20 bp, mouse
gttattttttgaagattact

SEQ ID NO: 489633 - DNA, 20 bp, mouse
gttgccccttagagatagta

SEQ ID NO: 489634 - DNA, 20 bp, mouse
gaatgtgagtattgtttgga

SEQ ID NO: 489635 - DNA, 20 bp, mouse
gtttttcattgggtagaggc

SEQ ID NO: 489636 - DNA, 20 bp, mouse
gagcatgaatggctaaagga

SEQ ID NO: 489637 - DNA, 20 bp, mouse
ggactagcatgaatggctaa

SEQ ID NO: 489638 - DNA, 20 bp, mouse
ggaaactgaatacccgaaag

SEQ ID NO: 489639 - DNA, 20 bp, mouse
ggcttcaggcccaagactgc

SEQ ID NO: 489640 - DNA, 20 bp, mouse
ggatgcaagataatatactc

SEQ ID NO: 489641 - DNA, 20 bp, mouse
gcccttggttttctgtacat

SEQ ID NO: 489642 - DNA, 20 bp, mouse
gggtgtttctcacctctttc

SEQ ID NO: 489643 - DNA, 20 bp, mouse
ggcctatgtacagaaaacca

SEQ ID NO: 489644 - DNA, 20 bp, mouse
gtgattatgctacttttgca

SEQ ID NO: 489645 - DNA, 20 bp, mouse
gtagtgagagtaaatacact

SEQ ID NO: 489646 - DNA, 20 bp, mouse
gtcttgggcggtgggagaag

SEQ ID NO: 489647 - DNA, 20 bp, mouse
gccgcggccgggcccactca

SEQ ID NO: 489648 - DNA, 20 bp, mouse
gatgtgacatcccctctctc

SEQ ID NO: 489649 - DNA, 20 bp, mouse
gtccggaagccgaacctcac

SEQ ID NO: 489650 - DNA, 20 bp, mouse
gagtggagcgaagaatatct

SEQ ID NO: 489651 - DNA, 20 bp, mouse
ggcctgcagtgtaccatcag

SEQ ID NO: 489652 - DNA, 20 bp, mouse
gcggccgggcccactcacgg

SEQ ID NO: 489653 - DNA, 20 bp, mouse
gactagactacaggagtgtc

SEQ ID NO: 489654 - DNA, 20 bp, mouse
gcttaattagggaccagatg

SEQ ID NO: 489655 - DNA, 20 bp, mouse
gcggaaccgagggacagccc

SEQ ID NO: 489656 - DNA, 20 bp, mouse
gagccgccgagagcggatgg

SEQ ID NO: 489657 - DNA, 20 bp, mouse
gcggatggcggcagcagtag

SEQ ID NO: 489658 - DNA, 20 bp, mouse
gtgccgccatccgctctcgg

SEQ ID NO: 489659 - DNA, 20 bp, mouse
ggcagcttcctcacccccgg

SEQ ID NO: 489660 - DNA, 20 bp, mouse
gcaggtagaccaggagaccc

SEQ ID NO: 489661 - DNA, 20 bp, mouse
ggctccccctgcctgactga

SEQ ID NO: 489662 - DNA, 20 bp, mouse
gggtgccgtcagtcaggcag

SEQ ID NO: 489663 - DNA, 20 bp, mouse
gcgggcccactcgccgccgg

SEQ ID NO: 489664 - DNA, 20 bp, mouse
gctcacccccggcggcgagt

SEQ ID NO: 489665 - DNA, 20 bp, mouse
ggacttgtcagacatcaccc

SEQ ID NO: 489666 - DNA, 20 bp, mouse
ggagctaagggaggtcgctg

SEQ ID NO: 489667 - DNA, 20 bp, mouse
gctgctggacaggggtcctt

SEQ ID NO: 489668 - DNA, 20 bp, mouse
gggacaggggtccttgggac

SEQ ID NO: 489669 - DNA, 20 bp, mouse
ggatcctcgaacctgtccca

SEQ ID NO: 489670 - DNA, 20 bp, mouse
gggtccttgggacaggttcg

SEQ ID NO: 489671 - DNA, 20 bp, mouse
gtggtccacaaggcccagag

SEQ ID NO: 489672 - DNA, 20 bp, mouse
gcgctgcagtctgctggaca

SEQ ID NO: 489673 - DNA, 20 bp, mouse
gctgggagacctagccataa

SEQ ID NO: 489674 - DNA, 20 bp, mouse
gcctaagcgctaaagggaaa

SEQ ID NO: 489675 - DNA, 20 bp, mouse
gtcaaggacagccgagctaa

SEQ ID NO: 489676 - DNA, 20 bp, mouse
gtgtctatggagctcaccgg

SEQ ID NO: 489677 - DNA, 20 bp, mouse
gggaggcatgatggtcaacg

SEQ ID NO: 489678 - DNA, 20 bp, mouse
ggagctcaccggaggcatga

SEQ ID NO: 489679 - DNA, 20 bp, mouse
ggttgggccgacactctatg

SEQ ID NO: 489680 - DNA, 20 bp, mouse
gaagcggggccatgtctctt

SEQ ID NO: 489681 - DNA, 20 bp, mouse
ggtgtcaccccatagagtgt

SEQ ID NO: 489682 - DNA, 20 bp, mouse
gcagagcaccaggagaagcg

SEQ ID NO: 489683 - DNA, 20 bp, mouse
ggacatggccccgcttctcc

SEQ ID NO: 489684 - DNA, 20 bp, mouse
gtgatggtcaacgaggtacc

SEQ ID NO: 489685 - DNA, 20 bp, mouse
ggaacaagaacacgcagagg

SEQ ID NO: 489686 - DNA, 20 bp, mouse
gacggaactacaggatggag

SEQ ID NO: 489687 - DNA, 20 bp, mouse
gcacagcgggcaccttcagg

SEQ ID NO: 489688 - DNA, 20 bp, mouse
gctgcacagcgggcaccttc

SEQ ID NO: 489689 - DNA, 20 bp, mouse
gaccttcaggcggtcccaac

SEQ ID NO: 489690 - DNA, 20 bp, mouse
ggctacgaccggctcacctg

SEQ ID NO: 489691 - DNA, 20 bp, mouse
ggtgtgaggggcctaaaatg

SEQ ID NO: 489692 - DNA, 20 bp, mouse
gagaggaggagccgctctag

SEQ ID NO: 489693 - DNA, 20 bp, mouse
gtgacctgaaatggacctgt

SEQ ID NO: 489694 - DNA, 20 bp, mouse
gtcactgctggcccatctcc

SEQ ID NO: 489695 - DNA, 20 bp, mouse
gacctgttgggaccgcctga

SEQ ID NO: 489696 - DNA, 20 bp, mouse
gcctcagcaggatcctccgg

SEQ ID NO: 489697 - DNA, 20 bp, mouse
ggataggaacctacccccgg

SEQ ID NO: 489698 - DNA, 20 bp, mouse
gagagataggaacctacccc

SEQ ID NO: 489699 - DNA, 20 bp, mouse
ggtatgtaggctatcgaaga

SEQ ID NO: 489700 - DNA, 20 bp, mouse
gtggatgacactgccaacgt

SEQ ID NO: 489701 - DNA, 20 bp, mouse
gactggtgcagttctccttc

SEQ ID NO: 489702 - DNA, 20 bp, mouse
gtaggtggggaaacagactg

SEQ ID NO: 489703 - DNA, 20 bp, mouse
ggtggtctccatcatcggtg

SEQ ID NO: 489704 - DNA, 20 bp, mouse
ggactggaccccaccgatga

SEQ ID NO: 489705 - DNA, 20 bp, mouse
gtgggagtggtctccatcat

SEQ ID NO: 489706 - DNA, 20 bp, mouse
gacacccggcccaccgagta

SEQ ID NO: 489707 - DNA, 20 bp, mouse
gggtacaagagggcccgtgc

SEQ ID NO: 489708 - DNA, 20 bp, mouse
gtgttctctgccctactcgg

SEQ ID NO: 489709 - DNA, 20 bp, mouse
ggctccaaagggacaacacc

SEQ ID NO: 489710 - DNA, 20 bp, mouse
gctgctgcctgggaacggag

SEQ ID NO: 489711 - DNA, 20 bp, mouse
gggagtcagagggcaaatcg

SEQ ID NO: 489712 - DNA, 20 bp, mouse
gacacaggactgcctgctgg

SEQ ID NO: 489713 - DNA, 20 bp, mouse
gaatagaggtagcccccagc

SEQ ID NO: 489714 - DNA, 20 bp, mouse
gctcccctgctgcttgctag

SEQ ID NO: 489715 - DNA, 20 bp, mouse
gctggcccctctccgttccc

SEQ ID NO: 489716 - DNA, 20 bp, mouse
gcctgatgaccctctcacaa

SEQ ID NO: 489717 - DNA, 20 bp, mouse
gcggctgaccctggaaggtg

SEQ ID NO: 489718 - DNA, 20 bp, mouse
gtgaagcactctcttaccgg

SEQ ID NO: 489719 - DNA, 20 bp, mouse
gccctagctgcccttgtgag

SEQ ID NO: 489720 - DNA, 20 bp, mouse
ggaagaggaagcctgtggga

SEQ ID NO: 489721 - DNA, 20 bp, mouse
ggaccacgtggaccatcctg

SEQ ID NO: 489722 - DNA, 20 bp, mouse
gccccacacatcaggatata

SEQ ID NO: 489723 - DNA, 20 bp, mouse
gacatcctccagggcctgtg

SEQ ID NO: 489724 - DNA, 20 bp, mouse
ggcgtgagttgtaggctggt

SEQ ID NO: 489725 - DNA, 20 bp, mouse
gatgaccggctgaccctgga

SEQ ID NO: 489726 - DNA, 20 bp, mouse
ggagccgggaagccggacgt

SEQ ID NO: 489727 - DNA, 20 bp, mouse
ggaccgcgcagtcccacgtc

SEQ ID NO: 489728 - DNA, 20 bp, mouse
gagccggacgtgggactgcg

SEQ ID NO: 489729 - DNA, 20 bp, mouse
ggccgtcacggaaacaaact

SEQ ID NO: 489730 - DNA, 20 bp, mouse
gtcccggctgcggcccctgc

SEQ ID NO: 489731 - DNA, 20 bp, mouse
gcagattatgtaaccggcag

SEQ ID NO: 489732 - DNA, 20 bp, mouse
gggaaaacccggcctcccac

SEQ ID NO: 489733 - DNA, 20 bp, mouse
gccgcgacagattatgtaac

SEQ ID NO: 489734 - DNA, 20 bp, mouse
gggcagcggacggtgtctca

SEQ ID NO: 489735 - DNA, 20 bp, mouse
gcacctcggacgggagccgg

SEQ ID NO: 489736 - DNA, 20 bp, mouse
ggcctggccggcggagaaca

SEQ ID NO: 489737 - DNA, 20 bp, mouse
gctggcgccgggagactact

SEQ ID NO: 489738 - DNA, 20 bp, mouse
gagaggctcgttagccccgg

SEQ ID NO: 489739 - DNA, 20 bp, mouse
ggctaacgagcctctcgaca

SEQ ID NO: 489740 - DNA, 20 bp, mouse
gcccggctgccgcacccccc

SEQ ID NO: 489741 - DNA, 20 bp, mouse
gtgtccagccagaaggtcca

SEQ ID NO: 489742 - DNA, 20 bp, mouse
ggagaacatggcgctgcccc

SEQ ID NO: 489743 - DNA, 20 bp, mouse
ggctccggtccgcttgtccg

SEQ ID NO: 489744 - DNA, 20 bp, mouse
gaggccgcggacaagcggac

SEQ ID NO: 489745 - DNA, 20 bp, mouse
ggggagactactaggcgctc

SEQ ID NO: 489746 - DNA, 20 bp, mouse
gcctatggcgcggccaacgc

SEQ ID NO: 489747 - DNA, 20 bp, mouse
gtcgaaggagccgcccgcgt

SEQ ID NO: 489748 - DNA, 20 bp, mouse
gctcggtggcgaaagcgaca

SEQ ID NO: 489749 - DNA, 20 bp, mouse
gcgcagagcgcgacaggtgg

SEQ ID NO: 489750 - DNA, 20 bp, mouse
gcgaggcgcgtcaccacctg

SEQ ID NO: 489751 - DNA, 20 bp, mouse
ggcgaaagcgacatggagag

SEQ ID NO: 489752 - DNA, 20 bp, mouse
gacatggagagcggggccta

SEQ ID NO: 489753 - DNA, 20 bp, mouse
gaggggacagagacgcggag

SEQ ID NO: 489754 - DNA, 20 bp, mouse
gaggaagcgccgcaggtcga

SEQ ID NO: 489755 - DNA, 20 bp, mouse
gatggcgcggccaacgcggg

SEQ ID NO: 489756 - DNA, 20 bp, mouse
gtgtccttggtgctgaacca

SEQ ID NO: 489757 - DNA, 20 bp, mouse
gctgaaccacggtccataac

SEQ ID NO: 489758 - DNA, 20 bp, mouse
gacaacggctacgctatccg

SEQ ID NO: 489759 - DNA, 20 bp, mouse
gggaccgtggttcagcacca

SEQ ID NO: 489760 - DNA, 20 bp, mouse
ggtccacgtgcactgctctg

SEQ ID NO: 489761 - DNA, 20 bp, mouse
ggctctgtggttcagtacca

SEQ ID NO: 489762 - DNA, 20 bp, mouse
gcagctttgggcagtgtcca

SEQ ID NO: 489763 - DNA, 20 bp, mouse
gccaaaaggcacgctgtcct

SEQ ID NO: 489764 - DNA, 20 bp, mouse
gccacggttctgaaaccaaa

SEQ ID NO: 489765 - DNA, 20 bp, mouse
gggtgtcctgttatggaccg

SEQ ID NO: 489766 - DNA, 20 bp, mouse
ggccgtcatggcttccacgg

SEQ ID NO: 489767 - DNA, 20 bp, mouse
ggcctctcgcagagccgtca

SEQ ID NO: 489768 - DNA, 20 bp, mouse
ggcgaggagcggccctgcgg

SEQ ID NO: 489769 - DNA, 20 bp, mouse
ggccatgacggctctgcgag

SEQ ID NO: 489770 - DNA, 20 bp, mouse
gagagccgtcatggcttcca

SEQ ID NO: 489771 - DNA, 20 bp, mouse
gagactgcgactcgcccccg

SEQ ID NO: 489772 - DNA, 20 bp, mouse
ggccgcgagcaggctcggga

SEQ ID NO: 489773 - DNA, 20 bp, mouse
gcttctccgagaggtagaag

SEQ ID NO: 489774 - DNA, 20 bp, mouse
ggtcgcgaggagcggccctg

SEQ ID NO: 489775 - DNA, 20 bp, mouse
ggagcaggctcgggagggag

SEQ ID NO: 489776 - DNA, 20 bp, mouse
ggcagtcgttgaagacacgg

SEQ ID NO: 489777 - DNA, 20 bp, mouse
gacggcagtcgttgaagaca

SEQ ID NO: 489778 - DNA, 20 bp, mouse
gttcttagagcagctcgtat

SEQ ID NO: 489779 - DNA, 20 bp, mouse
gtactcgtgaggaggagtaa

SEQ ID NO: 489780 - DNA, 20 bp, mouse
gttggcggagatgcatgcgc

SEQ ID NO: 489781 - DNA, 20 bp, mouse
gttagagcagctcgtattgg

SEQ ID NO: 489782 - DNA, 20 bp, mouse
gtgactggagaatactcgtg

SEQ ID NO: 489783 - DNA, 20 bp, mouse
gcggtcaagcaaccctctcc

SEQ ID NO: 489784 - DNA, 20 bp, mouse
gcagttggtcacccaccata

SEQ ID NO: 489785 - DNA, 20 bp, mouse
gccacggcgcaggtaaagtg

SEQ ID NO: 489786 - DNA, 20 bp, mouse
gagcaactgcaccacatcgg

SEQ ID NO: 489787 - DNA, 20 bp, mouse
ggccacgaagagaaccacca

SEQ ID NO: 489788 - DNA, 20 bp, mouse
gggtccgcggcagcacgtcg

SEQ ID NO: 489789 - DNA, 20 bp, mouse
gccacccggccccgccgatg

SEQ ID NO: 489790 - DNA, 20 bp, mouse
gggcgtggcgctcgggtccg

SEQ ID NO: 489791 - DNA, 20 bp, mouse
gctgggctggcgtggcgctc

SEQ ID NO: 489792 - DNA, 20 bp, mouse
gttgatggtactggaggagg

SEQ ID NO: 489793 - DNA, 20 bp, mouse
gacgccgcgacgtgctgccg

SEQ ID NO: 489794 - DNA, 20 bp, mouse
ggcagcacgtcgcggcgtac

SEQ ID NO: 489795 - DNA, 20 bp, mouse
gcaggaagccttgatggtac

SEQ ID NO: 489796 - DNA, 20 bp, mouse
gctgggtgtggtattcccag

SEQ ID NO: 489797 - DNA, 20 bp, mouse
ggactccatcctgcagccag

SEQ ID NO: 489798 - DNA, 20 bp, mouse
gcatcctgcagccagtggct

SEQ ID NO: 489799 - DNA, 20 bp, mouse
gtttgaggctaccgagccac

SEQ ID NO: 489800 - DNA, 20 bp, mouse
gtcagtgtgattcagatctg

SEQ ID NO: 489801 - DNA, 20 bp, mouse
gaaagaatatgctaaaaact

SEQ ID NO: 489802 - DNA, 20 bp, mouse
ggtggtattcccaggggatg

SEQ ID NO: 489803 - DNA, 20 bp, mouse
gacgcatatgttgctacatt

SEQ ID NO: 489804 - DNA, 20 bp, mouse
gtttccacatacgtaaaact

SEQ ID NO: 489805 - DNA, 20 bp, mouse
gtcttatagcttctttgaaa

SEQ ID NO: 489806 - DNA, 20 bp, mouse
ggaggcccccaaatcaggag

SEQ ID NO: 489807 - DNA, 20 bp, mouse
gcaggaaatggctccaggag

SEQ ID NO: 489808 - DNA, 20 bp, mouse
gtacctgctgcagctcaggt

SEQ ID NO: 489809 - DNA, 20 bp, mouse
ggagcaggcagcctgccaac

SEQ ID NO: 489810 - DNA, 20 bp, mouse
gaaacagaggcccccaaatc

SEQ ID NO: 489811 - DNA, 20 bp, mouse
gaatggctccaggagtggcc

SEQ ID NO: 489812 - DNA, 20 bp, mouse
gaaggttgccaaataactag

SEQ ID NO: 489813 - DNA, 20 bp, mouse
gtgcagcaggtactgcctgt

SEQ ID NO: 489814 - DNA, 20 bp, mouse
gggtctgctggacggcagtg

SEQ ID NO: 489815 - DNA, 20 bp, mouse
gctttgaatacagccagcta

SEQ ID NO: 489816 - DNA, 20 bp, mouse
ggctggcaagacctgtgcat

SEQ ID NO: 489817 - DNA, 20 bp, mouse
gttggaacaccttgtactca

SEQ ID NO: 489818 - DNA, 20 bp, mouse
gcatgcactgcccaatgcac

SEQ ID NO: 489819 - DNA, 20 bp, mouse
gtccttgacaaaaccggaaa

SEQ ID NO: 489820 - DNA, 20 bp, mouse
gtggatcttgcaacctgtga

SEQ ID NO: 489821 - DNA, 20 bp, mouse
gagatgatgcagtccttttc

SEQ ID NO: 489822 - DNA, 20 bp, mouse
ggcctggaattatcagaaac

SEQ ID NO: 489823 - DNA, 20 bp, mouse
gtcctgtttctgataattcc

SEQ ID NO: 489824 - DNA, 20 bp, mouse
gcaatctgtggtaggatctc

SEQ ID NO: 489825 - DNA, 20 bp, mouse
gtccttttccggttttgtca

SEQ ID NO: 489826 - DNA, 20 bp, mouse
ggcctgctaagtggtagatg

SEQ ID NO: 489827 - DNA, 20 bp, mouse
gcatggccagctaaacagct

SEQ ID NO: 489828 - DNA, 20 bp, mouse
gtgcttcccagctgtttagc

SEQ ID NO: 489829 - DNA, 20 bp, mouse
gtccacatctaccacttagc

SEQ ID NO: 489830 - DNA, 20 bp, mouse
gcacaggctggcctgctaag

SEQ ID NO: 489831 - DNA, 20 bp, mouse
gaagcttccagccacattgg

SEQ ID NO: 489832 - DNA, 20 bp, mouse
ggaaacaaacacaaaactaa

SEQ ID NO: 489833 - DNA, 20 bp, mouse
gtgttaaggtacctccaatg

SEQ ID NO: 489834 - DNA, 20 bp, mouse
gccagcctgtgagctaacga

SEQ ID NO: 489835 - DNA, 20 bp, mouse
gcacaagcttccagccacat

SEQ ID NO: 489836 - DNA, 20 bp, mouse
gtagatgacttatgtgacat

SEQ ID NO: 489837 - DNA, 20 bp, mouse
gctttgatattcaacattgt

SEQ ID NO: 489838 - DNA, 20 bp, mouse
gtgatattcaacattgttgg

SEQ ID NO: 489839 - DNA, 20 bp, mouse
gatatttacaggtgcctaga

SEQ ID NO: 489840 - DNA, 20 bp, mouse
gtgaatatcaaagttatgtt

SEQ ID NO: 489841 - DNA, 20 bp, mouse
gaaggcaaagtgatgattaa

SEQ ID NO: 489842 - DNA, 20 bp, mouse
gagtgaatatgagtttcttc

SEQ ID NO: 489843 - DNA, 20 bp, mouse
gtatgtgacataggccttac

SEQ ID NO: 489844 - DNA, 20 bp, mouse
gaagcttatacacaaataaa

SEQ ID NO: 489845 - DNA, 20 bp, mouse
gtaatcagttcatagatgta

SEQ ID NO: 489846 - DNA, 20 bp, mouse
ggaaccgcgcagcatcatca

SEQ ID NO: 489847 - DNA, 20 bp, mouse
ggatgaggccactacacccg

SEQ ID NO: 489848 - DNA, 20 bp, mouse
ggaggccactacacccgggg

SEQ ID NO: 489849 - DNA, 20 bp, mouse
gggaaacagagctcacacaa

SEQ ID NO: 489850 - DNA, 20 bp, mouse
gaggcttggcctagacgtaa

SEQ ID NO: 489851 - DNA, 20 bp, mouse
gtgatgctgcgcggttcgtg

SEQ ID NO: 489852 - DNA, 20 bp, mouse
gtgtagtggcctcatccagg

SEQ ID NO: 489853 - DNA, 20 bp, mouse
ggaagggcacaaagtcctcc

SEQ ID NO: 489854 - DNA, 20 bp, mouse
gtgggccaccccgggtgtag

SEQ ID NO: 489855 - DNA, 20 bp, mouse
ggggcacggccagcaagagt

SEQ ID NO: 489856 - DNA, 20 bp, mouse
gttatttgccactgcaactc

SEQ ID NO: 489857 - DNA, 20 bp, mouse
gcagaccactgggaaaatag

SEQ ID NO: 489858 - DNA, 20 bp, mouse
gaatagtggacacaccttct

SEQ ID NO: 489859 - DNA, 20 bp, mouse
gagacactagaatgcctaga

SEQ ID NO: 489860 - DNA, 20 bp, mouse
gggaatagatgtgcaatcta

SEQ ID NO: 489861 - DNA, 20 bp, mouse
gtgcccctggccccaaacat

SEQ ID NO: 489862 - DNA, 20 bp, mouse
gctgtacagttactcagtgt

SEQ ID NO: 489863 - DNA, 20 bp, mouse
gtaaggacaatgaagagctt

SEQ ID NO: 489864 - DNA, 20 bp, mouse
gacagttactcagtgtggga

SEQ ID NO: 489865 - DNA, 20 bp, mouse
ggtgtccactattttcccag

SEQ ID NO: 489866 - DNA, 20 bp, mouse
gcaaggacaaagaggaactt

SEQ ID NO: 489867 - DNA, 20 bp, mouse
gacaagcacgaaaagccttt

SEQ ID NO: 489868 - DNA, 20 bp, mouse
gttcgtgcttgttctgtatc

SEQ ID NO: 489869 - DNA, 20 bp, mouse
gataatgaactcaccttcag

SEQ ID NO: 489870 - DNA, 20 bp, mouse
gaacgtgcacaaggacaaag

SEQ ID NO: 489871 - DNA, 20 bp, mouse
gaaacaataaagtaagacag

SEQ ID NO: 489872 - DNA, 20 bp, mouse
gtgtttattagctagggaga

SEQ ID NO: 489873 - DNA, 20 bp, mouse
ggaagcaatatcagcaatta

SEQ ID NO: 489874 - DNA, 20 bp, mouse
gatatcttctaacgtgcaca

SEQ ID NO: 489875 - DNA, 20 bp, mouse
gtttctcctgacccagcttc

SEQ ID NO: 489876 - DNA, 20 bp, mouse
gtgtccaacaaccctgatca

SEQ ID NO: 489877 - DNA, 20 bp, mouse
gcacacagaagggtgcggtt

SEQ ID NO: 489878 - DNA, 20 bp, mouse
gaagcacacacagaagggtg

SEQ ID NO: 489879 - DNA, 20 bp, mouse
gcacttacagctcatctaag

SEQ ID NO: 489880 - DNA, 20 bp, mouse
ggtcagggccatagagaatt

SEQ ID NO: 489881 - DNA, 20 bp, mouse
gcagaagggtgcggttggga

SEQ ID NO: 489882 - DNA, 20 bp, mouse
ggaaccagccacaggactgt

SEQ ID NO: 489883 - DNA, 20 bp, mouse
gctgccctgatcagggttgt

SEQ ID NO: 489884 - DNA, 20 bp, mouse
ggtgatagtctgccctgatc

SEQ ID NO: 489885 - DNA, 20 bp, mouse
gtgacagggtggggaatctc

SEQ ID NO: 489886 - DNA, 20 bp, mouse
ggtcaaagttccagaaaaca

SEQ ID NO: 489887 - DNA, 20 bp, mouse
gttttaaagatcagcaacag

SEQ ID NO: 489888 - DNA, 20 bp, mouse
gtttgctgaaccctacacag

SEQ ID NO: 489889 - DNA, 20 bp, mouse
ggtagagattcctctgtgta

SEQ ID NO: 489890 - DNA, 20 bp, mouse
gtgagaatgaggaagaatgg

SEQ ID NO: 489891 - DNA, 20 bp, mouse
ggaatgggggtgaataaatc

SEQ ID NO: 489892 - DNA, 20 bp, mouse
gctcagaagaaatgttaatg

SEQ ID NO: 489893 - DNA, 20 bp, mouse
gaaaatttaaaaaaggttcc

SEQ ID NO: 489894 - DNA, 20 bp, mouse
ggctgatctttaaaagttcc

SEQ ID NO: 489895 - DNA, 20 bp, mouse
gacaatattcttcagtgttt

SEQ ID NO: 489896 - DNA, 20 bp, mouse
gaatactttcatgatcacaa

SEQ ID NO: 489897 - DNA, 20 bp, mouse
gggtttgacacctgacaaca

SEQ ID NO: 489898 - DNA, 20 bp, mouse
gatcatctgactatttatac

SEQ ID NO: 489899 - DNA, 20 bp, mouse
gactatttatactggaatga

SEQ ID NO: 489900 - DNA, 20 bp, mouse
gcaaccacctccatgttgtc

SEQ ID NO: 489901 - DNA, 20 bp, mouse
gtcaggtgtcaaaccactca

SEQ ID NO: 489902 - DNA, 20 bp, mouse
gaacatggaggtggttgtca

SEQ ID NO: 489903 - DNA, 20 bp, mouse
gtacagagagccctggagta

SEQ ID NO: 489904 - DNA, 20 bp, mouse
gagggagggagccttaagtg

SEQ ID NO: 489905 - DNA, 20 bp, mouse
gtgaaagagaagtcactcta

SEQ ID NO: 489906 - DNA, 20 bp, mouse
gtcaaaaacattatcttaaa

SEQ ID NO: 489907 - DNA, 20 bp, mouse
gaaattacgttcttgagcaa

SEQ ID NO: 489908 - DNA, 20 bp, mouse
gtcaagaacgtaatttcaaa

SEQ ID NO: 489909 - DNA, 20 bp, mouse
gtgcataaaatagtacatac

SEQ ID NO: 489910 - DNA, 20 bp, mouse
ggccatcaaagaactcatac

SEQ ID NO: 489911 - DNA, 20 bp, mouse
gagagtattatgatatacaa

SEQ ID NO: 489912 - DNA, 20 bp, mouse
gtccatgaatgtaagcagtg

SEQ ID NO: 489913 - DNA, 20 bp, mouse
gagttctttgatggctttga

SEQ ID NO: 489914 - DNA, 20 bp, mouse
gtccagtatgagttctttga

SEQ ID NO: 489915 - DNA, 20 bp, mouse
ggtaaattctttgtctgtca

SEQ ID NO: 489916 - DNA, 20 bp, mouse
gcacagcatccttgcagaag

SEQ ID NO: 489917 - DNA, 20 bp, mouse
gggcgctgcggcagtctgtg

SEQ ID NO: 489918 - DNA, 20 bp, mouse
ggtcctggagacggctagct

SEQ ID NO: 489919 - DNA, 20 bp, mouse
ggtgcttgcgggtggcccgg

SEQ ID NO: 489920 - DNA, 20 bp, mouse
gttgcagaagcggaatcgga

SEQ ID NO: 489921 - DNA, 20 bp, mouse
gatccttgcagaagcggaat

SEQ ID NO: 489922 - DNA, 20 bp, mouse
gctgcgagcccgccggaaaa

SEQ ID NO: 489923 - DNA, 20 bp, mouse
gccgcggcagccacgtcccc

SEQ ID NO: 489924 - DNA, 20 bp, mouse
ggagtgcggcgtccgctctg

SEQ ID NO: 489925 - DNA, 20 bp, mouse
gcgagtgcccggcttccaga

SEQ ID NO: 489926 - DNA, 20 bp, mouse
ggaactgctgctcagagtgc

SEQ ID NO: 489927 - DNA, 20 bp, mouse
gtctggcatgagctacctca

SEQ ID NO: 489928 - DNA, 20 bp, mouse
gagatcgacgaaataatgtt

SEQ ID NO: 489929 - DNA, 20 bp, mouse
gactctgagcagcagttcta

SEQ ID NO: 489930 - DNA, 20 bp, mouse
gggtcattgaggacagaact

SEQ ID NO: 489931 - DNA, 20 bp, mouse
gtcatgaaggtgaacatcta

SEQ ID NO: 489932 - DNA, 20 bp, mouse
gcctgcaacaaggaaggccc

SEQ ID NO: 489933 - DNA, 20 bp, mouse
gagcagttctaaggtcattg

SEQ ID NO: 489934 - DNA, 20 bp, mouse
gaaacccagaaggtctggac

SEQ ID NO: 489935 - DNA, 20 bp, mouse
ggatgttcaccttcatgaga

SEQ ID NO: 489936 - DNA, 20 bp, mouse
gcagggccacatcctaatgg

SEQ ID NO: 489937 - DNA, 20 bp, mouse
gacaatgtaggggaccccag

SEQ ID NO: 489938 - DNA, 20 bp, mouse
gtttcagggccacatcctaa

SEQ ID NO: 489939 - DNA, 20 bp, mouse
ggaggagagatgtcatgctt

SEQ ID NO: 489940 - DNA, 20 bp, mouse
ggagcattaaacacaatgta

SEQ ID NO: 489941 - DNA, 20 bp, mouse
gcctaggacctgttgtttca

SEQ ID NO: 489942 - DNA, 20 bp, mouse
gtgtagtttgatcaaggcct

SEQ ID NO: 489943 - DNA, 20 bp, mouse
gcttagggtcatttccactg

SEQ ID NO: 489944 - DNA, 20 bp, mouse
gatgacatctctcctccatt

SEQ ID NO: 489945 - DNA, 20 bp, mouse
gctgttgtttcagggtatgc

SEQ ID NO: 489946 - DNA, 20 bp, mouse
gagttgcacactattcccaa

SEQ ID NO: 489947 - DNA, 20 bp, mouse
gtgaacaattccacaccctt

SEQ ID NO: 489948 - DNA, 20 bp, mouse
ggtgtggaattgttcagcac

SEQ ID NO: 489949 - DNA, 20 bp, mouse
gggtagtcagtgcccatgag

SEQ ID NO: 489950 - DNA, 20 bp, mouse
gacaggtgggaaggaggcac

SEQ ID NO: 489951 - DNA, 20 bp, mouse
ggagtgtggagttggagacc

SEQ ID NO: 489952 - DNA, 20 bp, mouse
gcacactattcccaagggtg

SEQ ID NO: 489953 - DNA, 20 bp, mouse
gacaggaagcacagactgga

SEQ ID NO: 489954 - DNA, 20 bp, mouse
gggagccatgctgaactcac

SEQ ID NO: 489955 - DNA, 20 bp, mouse
gatacctggacaggagagtg

SEQ ID NO: 489956 - DNA, 20 bp, mouse
gtggtagtcaccgccatcgt

SEQ ID NO: 489957 - DNA, 20 bp, mouse
gagatctcttccgacgatgg

SEQ ID NO: 489958 - DNA, 20 bp, mouse
ggcgagatctcttccgacga

SEQ ID NO: 489959 - DNA, 20 bp, mouse
gaccagagggacggaatccc

SEQ ID NO: 489960 - DNA, 20 bp, mouse
ggcctcttgcaccagaggga

SEQ ID NO: 489961 - DNA, 20 bp, mouse
ggtgcaagtgaagcaagcct

SEQ ID NO: 489962 - DNA, 20 bp, mouse
gggattcacgagcttctcca

SEQ ID NO: 489963 - DNA, 20 bp, mouse
ggcctaggaccggatagaaa

SEQ ID NO: 489964 - DNA, 20 bp, mouse
gagggagaggccagggaccg

SEQ ID NO: 489965 - DNA, 20 bp, mouse
ggctgggcctcttgcaccag

SEQ ID NO: 489966 - DNA, 20 bp, mouse
gtgtaaacaaattggatcac

SEQ ID NO: 489967 - DNA, 20 bp, mouse
gactagcagacatttctcac

SEQ ID NO: 489968 - DNA, 20 bp, mouse
ggacatttctcactggtcat

SEQ ID NO: 489969 - DNA, 20 bp, mouse
gttggtgagaagatcagtca

SEQ ID NO: 489970 - DNA, 20 bp, mouse
gtagaatcttgggggttcca

SEQ ID NO: 489971 - DNA, 20 bp, mouse
gactgatcttctcaccaaac

SEQ ID NO: 489972 - DNA, 20 bp, mouse
ggcagtaattcatgttacaa

SEQ ID NO: 489973 - DNA, 20 bp, mouse
gtaaatttatactaaagata

SEQ ID NO: 489974 - DNA, 20 bp, mouse
gtgaatagcacatttagttt

SEQ ID NO: 489975 - DNA, 20 bp, mouse
gattcatgttacaatggagc

SEQ ID NO: 489976 - DNA, 20 bp, mouse
gcctcggcacccttctgtcc

SEQ ID NO: 489977 - DNA, 20 bp, mouse
gaatatgacatttattgacc

SEQ ID NO: 489978 - DNA, 20 bp, mouse
ggataggcattacccatgag

SEQ ID NO: 489979 - DNA, 20 bp, mouse
gtgagagcacctggacagaa

SEQ ID NO: 489980 - DNA, 20 bp, mouse
gccagcatgtgggttaagat

SEQ ID NO: 489981 - DNA, 20 bp, mouse
gcccaaagttcacctttctt

SEQ ID NO: 489982 - DNA, 20 bp, mouse
gactggaagcactcatggaa

SEQ ID NO: 489983 - DNA, 20 bp, mouse
ggacactacactctcctccc

SEQ ID NO: 489984 - DNA, 20 bp, mouse
gtgctttctgtcccaaagaa

SEQ ID NO: 489985 - DNA, 20 bp, mouse
gcagggccagatttccacct

SEQ ID NO: 489986 - DNA, 20 bp, mouse
ggttgttgataatatagaaa

SEQ ID NO: 489987 - DNA, 20 bp, mouse
gaggtaggtaagcctaggaa

SEQ ID NO: 489988 - DNA, 20 bp, mouse
ggcctgcaagtgggataagt

SEQ ID NO: 489989 - DNA, 20 bp, mouse
gatcccacttgcaggccaca

SEQ ID NO: 489990 - DNA, 20 bp, mouse
gcaccctgtggcctgcaagt

SEQ ID NO: 489991 - DNA, 20 bp, mouse
gtgcaagtgggataagtagg

SEQ ID NO: 489992 - DNA, 20 bp, mouse
gtgagagagtggtgctcctg

SEQ ID NO: 489993 - DNA, 20 bp, mouse
gaacaaccaaaaatactttg

SEQ ID NO: 489994 - DNA, 20 bp, mouse
gcgcaacagtgctagccacc

SEQ ID NO: 489995 - DNA, 20 bp, mouse
gctagtgaacagtaagccac

SEQ ID NO: 489996 - DNA, 20 bp, mouse
gtactgtatctcatcctggg

SEQ ID NO: 489997 - DNA, 20 bp, mouse
gactttcccagtagaaaagt

SEQ ID NO: 489998 - DNA, 20 bp, mouse
gcttctgcctcccaagtcaa

SEQ ID NO: 489999 - DNA, 20 bp, mouse
gttgctgcctttgacttggg

SEQ ID NO: 490000 - DNA, 20 bp, mouse
gtccttgctgcctttgactt

SEQ ID NO: 490001 - DNA, 20 bp, mouse
ggactactgtatctcatcct

SEQ ID NO: 490002 - DNA, 20 bp, mouse
gaagatggagctccccaggt

SEQ ID NO: 490003 - DNA, 20 bp, mouse
gggtctgaagaaagagttct

SEQ ID NO: 490004 - DNA, 20 bp, mouse
gaccattccataaccaggac

SEQ ID NO: 490005 - DNA, 20 bp, mouse
gtccggtcctggttatggaa

SEQ ID NO: 490006 - DNA, 20 bp, mouse
gtggtagtcaccgccatcat

SEQ ID NO: 490007 - DNA, 20 bp, mouse
gagatctcttccgatgatgg

SEQ ID NO: 490008 - DNA, 20 bp, mouse
ggcgagatctcttccgatga

SEQ ID NO: 490009 - DNA, 20 bp, mouse
gaccagagggacggaatccc

SEQ ID NO: 490010 - DNA, 20 bp, mouse
ggcctcttgcaccagaggga

SEQ ID NO: 490011 - DNA, 20 bp, mouse
ggtgcaagtgaagcaagcct

SEQ ID NO: 490012 - DNA, 20 bp, mouse
gggattcacgagcttctcca

SEQ ID NO: 490013 - DNA, 20 bp, mouse
ggcctaggaccggatagaaa

SEQ ID NO: 490014 - DNA, 20 bp, mouse
gagggagaggccagggaccg

SEQ ID NO: 490015 - DNA, 20 bp, mouse
ggctgggcctcttgcaccag

SEQ ID NO: 490016 - DNA, 20 bp, mouse
gaatactgccagcctcgctg

SEQ ID NO: 490017 - DNA, 20 bp, mouse
ggccagcctcgctgtggaaa

SEQ ID NO: 490018 - DNA, 20 bp, mouse
gttgactgttggataatcac

SEQ ID NO: 490019 - DNA, 20 bp, mouse
gaaacagagcaattccggga

SEQ ID NO: 490020 - DNA, 20 bp, mouse
gaatgaaacagagcaattcc

SEQ ID NO: 490021 - DNA, 20 bp, mouse
gtgtgggtgggctgaaccca

SEQ ID NO: 490022 - DNA, 20 bp, mouse
gtccttttccacagcgaggc

SEQ ID NO: 490023 - DNA, 20 bp, mouse
gtttttcttcagacaaccgt

SEQ ID NO: 490024 - DNA, 20 bp, mouse
gtcgcaagaaatgagcaagc

SEQ ID NO: 490025 - DNA, 20 bp, mouse
gtccactgtgttcagataca

SEQ ID NO: 490026 - DNA, 20 bp, mouse
ggctggaatggcggaaatct

SEQ ID NO: 490027 - DNA, 20 bp, mouse
gtttgtgctgggaaacgggc

SEQ ID NO: 490028 - DNA, 20 bp, mouse
gtaagaaagcattgaattcg

SEQ ID NO: 490029 - DNA, 20 bp, mouse
ggtcagaggagcttttgtgc

SEQ ID NO: 490030 - DNA, 20 bp, mouse
gtagagaaagggaaattaaa

SEQ ID NO: 490031 - DNA, 20 bp, mouse
gcgtggtcaggaagtcgtgg

SEQ ID NO: 490032 - DNA, 20 bp, mouse
gcctcgtggtcaggaagtcg

SEQ ID NO: 490033 - DNA, 20 bp, mouse
gcaggagcagggcaggcgcg

SEQ ID NO: 490034 - DNA, 20 bp, mouse
ggagcttttgtgctgggaaa

SEQ ID NO: 490035 - DNA, 20 bp, mouse
gcagagggccaaggatgtac

SEQ ID NO: 490036 - DNA, 20 bp, mouse
gcagggacacagcacaccac

SEQ ID NO: 490037 - DNA, 20 bp, mouse
gacccagcctcaggattatt

SEQ ID NO: 490038 - DNA, 20 bp, mouse
gacacaatacagaaggccag

SEQ ID NO: 490039 - DNA, 20 bp, mouse
gaccaaataatcctgaggct

SEQ ID NO: 490040 - DNA, 20 bp, mouse
gtgttacctgacccagcctc

SEQ ID NO: 490041 - DNA, 20 bp, mouse
gtcaggtaacacaatacaga

SEQ ID NO: 490042 - DNA, 20 bp, mouse
gcagaccactgggaaaatag

SEQ ID NO: 490043 - DNA, 20 bp, mouse
gaaaagcttgaggaacaagt

SEQ ID NO: 490044 - DNA, 20 bp, mouse
gaatagtggacacaccttct

SEQ ID NO: 490045 - DNA, 20 bp, mouse
gtgcccctggccccaaacat

SEQ ID NO: 490046 - DNA, 20 bp, mouse
gggatggagctccgccgtgg

SEQ ID NO: 490047 - DNA, 20 bp, mouse
gctggttccccacgccgcca

SEQ ID NO: 490048 - DNA, 20 bp, mouse
gtacccggtggactccgtga

SEQ ID NO: 490049 - DNA, 20 bp, mouse
gcgcggatggagctccgccg

SEQ ID NO: 490050 - DNA, 20 bp, mouse
ggagtccaccgggtacatga

SEQ ID NO: 490051 - DNA, 20 bp, mouse
ggtcagccgccgcaacccgg

SEQ ID NO: 490052 - DNA, 20 bp, mouse
ggttccccacgccgccacgg

SEQ ID NO: 490053 - DNA, 20 bp, mouse
gctgcgggccggaggatgga

SEQ ID NO: 490054 - DNA, 20 bp, mouse
ggaagtgcaagactccctgg

SEQ ID NO: 490055 - DNA, 20 bp, mouse
gtcaccttcacggagtccac

SEQ ID NO: 490056 - DNA, 20 bp, mouse
ggaagtccattcctcaccag

SEQ ID NO: 490057 - DNA, 20 bp, mouse
gtcaccagtgggggaaactt

SEQ ID NO: 490058 - DNA, 20 bp, mouse
gctgtgactagtagtctcca

SEQ ID NO: 490059 - DNA, 20 bp, mouse
ggaatggacttctggtctgt

SEQ ID NO: 490060 - DNA, 20 bp, mouse
gagtcagactctagagaaaa

SEQ ID NO: 490061 - DNA, 20 bp, mouse
gctagagaaaagggtagagt

SEQ ID NO: 490062 - DNA, 20 bp, mouse
ggaatctcaagaggatcggg

SEQ ID NO: 490063 - DNA, 20 bp, mouse
gcttccaaagtttcccccac

SEQ ID NO: 490064 - DNA, 20 bp, mouse
gcttctggtctgtgggtgga

SEQ ID NO: 490065 - DNA, 20 bp, mouse
gctggcaccgagtgatgaca

SEQ ID NO: 490066 - DNA, 20 bp, mouse
gaggtgccctgcaagatccc

SEQ ID NO: 490067 - DNA, 20 bp, mouse
gcgccgcgtggctcccggaa

SEQ ID NO: 490068 - DNA, 20 bp, mouse
gccggccaccagctttccgg

SEQ ID NO: 490069 - DNA, 20 bp, mouse
ggtgaggcccgggtcccgag

SEQ ID NO: 490070 - DNA, 20 bp, mouse
ggggtcaggacgctccgaag

SEQ ID NO: 490071 - DNA, 20 bp, mouse
gcggaaaggagccgaacctc

SEQ ID NO: 490072 - DNA, 20 bp, mouse
gcaccagctttccggaggtt

SEQ ID NO: 490073 - DNA, 20 bp, mouse
gagctggtggccgggatgcg

SEQ ID NO: 490074 - DNA, 20 bp, mouse
ggcgagctgtgacgtgacgt

SEQ ID NO: 490075 - DNA, 20 bp, mouse
gccgggatgcggggcgctag

SEQ ID NO: 490076 - DNA, 20 bp, mouse
gcacggacagacaacatccc

SEQ ID NO: 490077 - DNA, 20 bp, mouse
gttgcttttgacaggtaccg

SEQ ID NO: 490078 - DNA, 20 bp, mouse
gtacatttctccaaaatctg

SEQ ID NO: 490079 - DNA, 20 bp, mouse
gagactgacaccacagattt

SEQ ID NO: 490080 - DNA, 20 bp, mouse
gatctacgtacagtggctca

SEQ ID NO: 490081 - DNA, 20 bp, mouse
gggtattcatctacgtacag

SEQ ID NO: 490082 - DNA, 20 bp, mouse
gagtctgagtgaagaactca

SEQ ID NO: 490083 - DNA, 20 bp, mouse
gaagatccagctcactaccg

SEQ ID NO: 490084 - DNA, 20 bp, mouse
gtcctctaattagtatttag

SEQ ID NO: 490085 - DNA, 20 bp, mouse
ggcccctaaatactaattag

SEQ ID NO: 490086 - DNA, 20 bp, mouse
ggcctctgccaccaaagtga

SEQ ID NO: 490087 - DNA, 20 bp, mouse
gagtcggagttgttgcagga

SEQ ID NO: 490088 - DNA, 20 bp, mouse
gccccgccaggctactaata

SEQ ID NO: 490089 - DNA, 20 bp, mouse
gtgggcgcgagtggtcattt

SEQ ID NO: 490090 - DNA, 20 bp, mouse
gttggagtcggagttgttgc

SEQ ID NO: 490091 - DNA, 20 bp, mouse
gtcctaaggtataaaattgt

SEQ ID NO: 490092 - DNA, 20 bp, mouse
ggttgcgacttgggcgcgag

SEQ ID NO: 490093 - DNA, 20 bp, mouse
gcgagtggtcattttggagt

SEQ ID NO: 490094 - DNA, 20 bp, mouse
ggaaaaacgaatggctatga

SEQ ID NO: 490095 - DNA, 20 bp, mouse
gtgccatattagtagcctgg

SEQ ID NO: 490096 - DNA, 20 bp, mouse
gtgtggatagcctcagaaag

SEQ ID NO: 490097 - DNA, 20 bp, mouse
gtgcagaggcggctgcaagg

SEQ ID NO: 490098 - DNA, 20 bp, mouse
gggtgctgctgggtgatcac

SEQ ID NO: 490099 - DNA, 20 bp, mouse
ggtgatcacaggagtaacaa

SEQ ID NO: 490100 - DNA, 20 bp, mouse
gatcaaacatgttccacctt

SEQ ID NO: 490101 - DNA, 20 bp, mouse
gcttagggaaccacccttaa

SEQ ID NO: 490102 - DNA, 20 bp, mouse
gtcttatgcagcttgtgcgt

SEQ ID NO: 490103 - DNA, 20 bp, mouse
gtggcaatgttgtcctttaa

SEQ ID NO: 490104 - DNA, 20 bp, mouse
gcttgcaggaaaggagtact

SEQ ID NO: 490105 - DNA, 20 bp, mouse
gaattgcagaggcggctgca

SEQ ID NO: 490106 - DNA, 20 bp, mouse
ggcagagcggtacaacacaa

SEQ ID NO: 490107 - DNA, 20 bp, mouse
gtacaacacaagggtaaaga

SEQ ID NO: 490108 - DNA, 20 bp, mouse
gtttgggaggcaaaatctta

SEQ ID NO: 490109 - DNA, 20 bp, mouse
gacaatattcctcaagacgt

SEQ ID NO: 490110 - DNA, 20 bp, mouse
gacctgaggaaatcttactt

SEQ ID NO: 490111 - DNA, 20 bp, mouse
gcctggatgactacaagaaa

SEQ ID NO: 490112 - DNA, 20 bp, mouse
ggaggaaatcttactttggg

SEQ ID NO: 490113 - DNA, 20 bp, mouse
gtggtcttccattgagtgac

SEQ ID NO: 490114 - DNA, 20 bp, mouse
ggtaagatttcctcaggtaa

SEQ ID NO: 490115 - DNA, 20 bp, mouse
ggctgatagaagtagagagc

SEQ ID NO: 490116 - DNA, 20 bp, mouse
gcagggtgttgggacaatgg

SEQ ID NO: 490117 - DNA, 20 bp, mouse
ggtgttgggacaatggaggt

SEQ ID NO: 490118 - DNA, 20 bp, mouse
gctgcagggtgttgggacaa

SEQ ID NO: 490119 - DNA, 20 bp, mouse
gtcaagagctgcagggtgtt

SEQ ID NO: 490120 - DNA, 20 bp, mouse
gtctctgtcaggctttatcg

SEQ ID NO: 490121 - DNA, 20 bp, mouse
gaaatacccttgcaaatata

SEQ ID NO: 490122 - DNA, 20 bp, mouse
gcattgccatatatttgcaa

SEQ ID NO: 490123 - DNA, 20 bp, mouse
ggaatttgatgatggagtag

SEQ ID NO: 490124 - DNA, 20 bp, mouse
gcgatgttcccaaggaaact

SEQ ID NO: 490125 - DNA, 20 bp, mouse
gctttatagcctgtttgacc

SEQ ID NO: 490126 - DNA, 20 bp, mouse
gggcttttggccagaagaag

SEQ ID NO: 490127 - DNA, 20 bp, mouse
ggctttcaagtacgcaggga

SEQ ID NO: 490128 - DNA, 20 bp, mouse
gcccagctttcaagtacgca

SEQ ID NO: 490129 - DNA, 20 bp, mouse
gatgtatcttggacaagaca

SEQ ID NO: 490130 - DNA, 20 bp, mouse
gctggaatatcgtggtctca

SEQ ID NO: 490131 - DNA, 20 bp, mouse
ggctcagacctggaatatcg

SEQ ID NO: 490132 - DNA, 20 bp, mouse
ggtctgcagtgcatgctctt

SEQ ID NO: 490133 - DNA, 20 bp, mouse
gaatatcgtggtctcagggc

SEQ ID NO: 490134 - DNA, 20 bp, mouse
ggtacgcagggaaggtagta

SEQ ID NO: 490135 - DNA, 20 bp, mouse
gggcacaattcaatccggag

SEQ ID NO: 490136 - DNA, 20 bp, mouse
gttggccgcttaaggagaat

SEQ ID NO: 490137 - DNA, 20 bp, mouse
ggtgcatctgaatcatgtgt

SEQ ID NO: 490138 - DNA, 20 bp, mouse
gaacttgagtgaggtagaga

SEQ ID NO: 490139 - DNA, 20 bp, mouse
gagagggccagtttctgtga

SEQ ID NO: 490140 - DNA, 20 bp, mouse
gaaaatgatgatccagttgc

SEQ ID NO: 490141 - DNA, 20 bp, mouse
gatcatgtgttggccgctta

SEQ ID NO: 490142 - DNA, 20 bp, mouse
gttgttcccctcacagaaac

SEQ ID NO: 490143 - DNA, 20 bp, mouse
gcttgcccattctccttaag

SEQ ID NO: 490144 - DNA, 20 bp, mouse
gatccctggagtcctcttta

SEQ ID NO: 490145 - DNA, 20 bp, mouse
gatagaaaaaaacttgagtg

SEQ ID NO: 490146 - DNA, 20 bp, mouse
gatggtgtactggagctcgt

SEQ ID NO: 490147 - DNA, 20 bp, mouse
gtcctctgaggtccagtgga

SEQ ID NO: 490148 - DNA, 20 bp, mouse
gtcagaggacgagttcagcg

SEQ ID NO: 490149 - DNA, 20 bp, mouse
gctcgtcctctgaggtccag

SEQ ID NO: 490150 - DNA, 20 bp, mouse
gagatactcactgacaacat

SEQ ID NO: 490151 - DNA, 20 bp, mouse
gtccagtacaccatattcac

SEQ ID NO: 490152 - DNA, 20 bp, mouse
ggtgatggtgtcataggaag

SEQ ID NO: 490153 - DNA, 20 bp, mouse
gtggacggtgatggtgtcat

SEQ ID NO: 490154 - DNA, 20 bp, mouse
gacagtcgtcgaacgcggaa

SEQ ID NO: 490155 - DNA, 20 bp, mouse
ggaggtccagtggacggtga

SEQ ID NO: 490156 - DNA, 20 bp, mouse
gtggatgccatggagagtct

SEQ ID NO: 490157 - DNA, 20 bp, mouse
gagataacccagactctcca

SEQ ID NO: 490158 - DNA, 20 bp, mouse
ggagtagcaaggatggatct

SEQ ID NO: 490159 - DNA, 20 bp, mouse
gcttgtgccagagagtagca

SEQ ID NO: 490160 - DNA, 20 bp, mouse
gaggcctctaccacaataga

SEQ ID NO: 490161 - DNA, 20 bp, mouse
ggaggactttctggatgcca

SEQ ID NO: 490162 - DNA, 20 bp, mouse
gatccatccttgctactctc

SEQ ID NO: 490163 - DNA, 20 bp, mouse
ggcaaggatggatcttggtc

SEQ ID NO: 490164 - DNA, 20 bp, mouse
ggaggcctcagaggggagtg

SEQ ID NO: 490165 - DNA, 20 bp, mouse
gacctgcataagtacagcag

SEQ ID NO: 490166 - DNA, 20 bp, mouse
gtcaagctgcagctgagtaa

SEQ ID NO: 490167 - DNA, 20 bp, mouse
ggtccatcttcagattgcag

SEQ ID NO: 490168 - DNA, 20 bp, mouse
gcagtttgggccatgattat

SEQ ID NO: 490169 - DNA, 20 bp, mouse
ggctagaggatagtaataaa

SEQ ID NO: 490170 - DNA, 20 bp, mouse
ggtaagtacggttgctgcag

SEQ ID NO: 490171 - DNA, 20 bp, mouse
gctcttagcgaagtccacat

SEQ ID NO: 490172 - DNA, 20 bp, mouse
ggattcccaaggtgccgatg

SEQ ID NO: 490173 - DNA, 20 bp, mouse
ggagtgagtgctacaaaaga

SEQ ID NO: 490174 - DNA, 20 bp, mouse
gctatcctctagctcctgaa

SEQ ID NO: 490175 - DNA, 20 bp, mouse
ggtttcctttcaggagctag

SEQ ID NO: 490176 - DNA, 20 bp, mouse
gtatctggctaaacagcctg

SEQ ID NO: 490177 - DNA, 20 bp, mouse
gcatctcctgacaaacataa

SEQ ID NO: 490178 - DNA, 20 bp, mouse
gacatcttattggcccacag

SEQ ID NO: 490179 - DNA, 20 bp, mouse
gcaagtactgtcacgagaaa

SEQ ID NO: 490180 - DNA, 20 bp, mouse
gaggagaaaaggactgccac

SEQ ID NO: 490181 - DNA, 20 bp, mouse
gtttgggtatataggagaaa

SEQ ID NO: 490182 - DNA, 20 bp, mouse
gatcagcaatgatgaagagg

SEQ ID NO: 490183 - DNA, 20 bp, mouse
gtttggcgaagtagctctaa

SEQ ID NO: 490184 - DNA, 20 bp, mouse
ggctacttcgccaaaggtgt

SEQ ID NO: 490185 - DNA, 20 bp, mouse
gcctatcagcaatgatgaag

SEQ ID NO: 490186 - DNA, 20 bp, mouse
ggctggcaagacctgtgcag

SEQ ID NO: 490187 - DNA, 20 bp, mouse
ggccatgaagaagggcacgg

SEQ ID NO: 490188 - DNA, 20 bp, mouse
gtggatcttgcaacctgtga

SEQ ID NO: 490189 - DNA, 20 bp, mouse
ggcctggaattatcagaaac

SEQ ID NO: 490190 - DNA, 20 bp, mouse
gtcctgtttctgataattcc

SEQ ID NO: 490191 - DNA, 20 bp, mouse
gtccttgacaaaactgggaa

SEQ ID NO: 490192 - DNA, 20 bp, mouse
gtccattcccagttttgtca

SEQ ID NO: 490193 - DNA, 20 bp, mouse
gctgataattccaggcacct

SEQ ID NO: 490194 - DNA, 20 bp, mouse
gctgctgggcatggcttcaa

SEQ ID NO: 490195 - DNA, 20 bp, mouse
gtttctccctgagcaagctt

SEQ ID NO: 490196 - DNA, 20 bp, mouse
gaacattgtgaactcaggga

SEQ ID NO: 490197 - DNA, 20 bp, mouse
gcattccatggataaagcca

SEQ ID NO: 490198 - DNA, 20 bp, mouse
gacttaccctcagcattcca

SEQ ID NO: 490199 - DNA, 20 bp, mouse
gctgggtggttcagaagcct

SEQ ID NO: 490200 - DNA, 20 bp, mouse
gcaagtgtcccggggagatg

SEQ ID NO: 490201 - DNA, 20 bp, mouse
gatccttgacaaaactgaga

SEQ ID NO: 490202 - DNA, 20 bp, mouse
gcaaattgtaccatgaaaaa

SEQ ID NO: 490203 - DNA, 20 bp, mouse
gtggaaccacttcattgcct

SEQ ID NO: 490204 - DNA, 20 bp, mouse
gcatggtacaatttgatctg

SEQ ID NO: 490205 - DNA, 20 bp, mouse
gctccaaacagagttctggg

SEQ ID NO: 490206 - DNA, 20 bp, mouse
gggttccaaaaagttcggta

SEQ ID NO: 490207 - DNA, 20 bp, mouse
gacaaccttaccgaactttt

SEQ ID NO: 490208 - DNA, 20 bp, mouse
gcatagtatagacatagata

SEQ ID NO: 490209 - DNA, 20 bp, mouse
gataaagtacacggaaggat

SEQ ID NO: 490210 - DNA, 20 bp, mouse
gtacagaaacgtaaacatat

SEQ ID NO: 490211 - DNA, 20 bp, mouse
gaagatggttccaaaaagtt

SEQ ID NO: 490212 - DNA, 20 bp, mouse
gttacctacaagaaggatcc

SEQ ID NO: 490213 - DNA, 20 bp, mouse
gaaacgtaaacatataggac

SEQ ID NO: 490214 - DNA, 20 bp, mouse
gtgaaacttgataaagtaca

SEQ ID NO: 490215 - DNA, 20 bp, mouse
gtttcaacttcaagaatctt

SEQ ID NO: 490216 - DNA, 20 bp, mouse
gggcactcagtatggtccag

SEQ ID NO: 490217 - DNA, 20 bp, mouse
ggcggttgacatactgtcaa

SEQ ID NO: 490218 - DNA, 20 bp, mouse
gcaacccttgcagtctgagt

SEQ ID NO: 490219 - DNA, 20 bp, mouse
ggcacacatggagcagctat

SEQ ID NO: 490220 - DNA, 20 bp, mouse
gaagcgcataaggactaccc

SEQ ID NO: 490221 - DNA, 20 bp, mouse
gcaattatctaagaagtcta

SEQ ID NO: 490222 - DNA, 20 bp, mouse
gtgtcttagacaagcgcata

SEQ ID NO: 490223 - DNA, 20 bp, mouse
gcagcttattgttctaagtt

SEQ ID NO: 490224 - DNA, 20 bp, mouse
gtgcttagaggcactcagta

SEQ ID NO: 490225 - DNA, 20 bp, mouse
gttgcctgctgtgagagcca

SEQ ID NO: 490226 - DNA, 20 bp, mouse
gagggccaggaccatccaag

SEQ ID NO: 490227 - DNA, 20 bp, mouse
gagaacaagagacacgcagg

SEQ ID NO: 490228 - DNA, 20 bp, mouse
gaatcttaggagagccctgg

SEQ ID NO: 490229 - DNA, 20 bp, mouse
gagagacacgcaggaggagc

SEQ ID NO: 490230 - DNA, 20 bp, mouse
ggaactgtccctactaatca

SEQ ID NO: 490231 - DNA, 20 bp, mouse
gtgcaacagctgcgcctcca

SEQ ID NO: 490232 - DNA, 20 bp, mouse
gaaggaagcatgtagctcct

SEQ ID NO: 490233 - DNA, 20 bp, mouse
gcagatggatggttaattct

SEQ ID NO: 490234 - DNA, 20 bp, mouse
gtcagagtgacttatatgat

SEQ ID NO: 490235 - DNA, 20 bp, mouse
gttgttcatgtcctcttgga

SEQ ID NO: 490236 - DNA, 20 bp, mouse
gattctgtgcctgggactga

SEQ ID NO: 490237 - DNA, 20 bp, mouse
ggccagcagggaactagagt

SEQ ID NO: 490238 - DNA, 20 bp, mouse
gccaggcacagaatgttcat

SEQ ID NO: 490239 - DNA, 20 bp, mouse
gaagggtctgctctagctaa

SEQ ID NO: 490240 - DNA, 20 bp, mouse
gctggccctacctgagacag

SEQ ID NO: 490241 - DNA, 20 bp, mouse
gaatgttcataggtgttgtt

SEQ ID NO: 490242 - DNA, 20 bp, mouse
gaagcagagacgtgaagtct

SEQ ID NO: 490243 - DNA, 20 bp, mouse
gatacagagacctctcacaa

SEQ ID NO: 490244 - DNA, 20 bp, mouse
gtgatcaaagcaggcccaga

SEQ ID NO: 490245 - DNA, 20 bp, mouse
ggagagcacaactttgactc

SEQ ID NO: 490246 - DNA, 20 bp, mouse
gtgcagctggatgaaaagga

SEQ ID NO: 490247 - DNA, 20 bp, mouse
ggagtttgggtagcttgggt

SEQ ID NO: 490248 - DNA, 20 bp, mouse
ggactgcggttgctggagaa

SEQ ID NO: 490249 - DNA, 20 bp, mouse
ggggagagtttgggtagctt

SEQ ID NO: 490250 - DNA, 20 bp, mouse
gaggcaacgcctactatgtg

SEQ ID NO: 490251 - DNA, 20 bp, mouse
ggctcggccatttcctccaa

SEQ ID NO: 490252 - DNA, 20 bp, mouse
gtcgcaacagcagccccagg

SEQ ID NO: 490253 - DNA, 20 bp, mouse
gagtgttccagggccttccc

SEQ ID NO: 490254 - DNA, 20 bp, mouse
gctgggctagcaagcctaca

SEQ ID NO: 490255 - DNA, 20 bp, mouse
ggcaggagactcgaaggcga

SEQ ID NO: 490256 - DNA, 20 bp, mouse
gcttcctcattctcaattga

SEQ ID NO: 490257 - DNA, 20 bp, mouse
gttttaaaacaagggaacga

SEQ ID NO: 490258 - DNA, 20 bp, mouse
ggaacttcacttgggaagaa

SEQ ID NO: 490259 - DNA, 20 bp, mouse
gtgggaagaatggtctttgc

SEQ ID NO: 490260 - DNA, 20 bp, mouse
gtgtattttaggctgcaatt

SEQ ID NO: 490261 - DNA, 20 bp, mouse
gccttcactttttaaaacaa

SEQ ID NO: 490262 - DNA, 20 bp, mouse
gcatattaaaacttcttcag

SEQ ID NO: 490263 - DNA, 20 bp, mouse
ggtacatgtgaacttcactt

SEQ ID NO: 490264 - DNA, 20 bp, mouse
gcttttttaaaaaactttct

SEQ ID NO: 490265 - DNA, 20 bp, mouse
gatagcagtgaggttgctgt

SEQ ID NO: 490266 - DNA, 20 bp, mouse
gtccctcagcaagcttgggg

SEQ ID NO: 490267 - DNA, 20 bp, mouse
gccctccccaagcttgctga

SEQ ID NO: 490268 - DNA, 20 bp, mouse
gttgctgagggagaaaggcc

SEQ ID NO: 490269 - DNA, 20 bp, mouse
ggcctggaactgtcagaaac

SEQ ID NO: 490270 - DNA, 20 bp, mouse
gatcacaggtcacaagatcc

SEQ ID NO: 490271 - DNA, 20 bp, mouse
gttctccctcagcaagcttg

SEQ ID NO: 490272 - DNA, 20 bp, mouse
gagaaacaggatcctggaca

SEQ ID NO: 490273 - DNA, 20 bp, mouse
gtcctgtttctgacagttcc

SEQ ID NO: 490274 - DNA, 20 bp, mouse
gcaatctgtggtaggatctc

SEQ ID NO: 490275 - DNA, 20 bp, mouse
gtccttgacaaaactgggaa

SEQ ID NO: 490276 - DNA, 20 bp, mouse
ggggtcccggaggctcttga

SEQ ID NO: 490277 - DNA, 20 bp, mouse
ggaattttctgtaagacttt

SEQ ID NO: 490278 - DNA, 20 bp, mouse
gtttccaaacagggtcccgg

SEQ ID NO: 490279 - DNA, 20 bp, mouse
gtgacctcttgggtgaaagg

SEQ ID NO: 490280 - DNA, 20 bp, mouse
gctatgacctcttgggtgaa

SEQ ID NO: 490281 - DNA, 20 bp, mouse
gttgttccctcaagagcctc

SEQ ID NO: 490282 - DNA, 20 bp, mouse
gcaggacacactagaaacac

SEQ ID NO: 490283 - DNA, 20 bp, mouse
ggagcctccgggaccctgtt

SEQ ID NO: 490284 - DNA, 20 bp, mouse
gaaagcctttttttccaaac

SEQ ID NO: 490285 - DNA, 20 bp, mouse
gtcttcaccacttagtccag

SEQ ID NO: 490286 - DNA, 20 bp, mouse
gaaggaggcactccaagaca

SEQ ID NO: 490287 - DNA, 20 bp, mouse
ggcaggctgtaatggcagag

SEQ ID NO: 490288 - DNA, 20 bp, mouse
gtaaagaacgaagatactgg

SEQ ID NO: 490289 - DNA, 20 bp, mouse
gatggagcttaggtcctctt

SEQ ID NO: 490290 - DNA, 20 bp, mouse
ggaagctctagaagcacaca

SEQ ID NO: 490291 - DNA, 20 bp, mouse
ggatggccttgggcatattt

SEQ ID NO: 490292 - DNA, 20 bp, mouse
gatactggtggcaaaggaga

SEQ ID NO: 490293 - DNA, 20 bp, mouse
gaaggacctaaatatgccca

SEQ ID NO: 490294 - DNA, 20 bp, mouse
ggcataaagaacgaagatac

SEQ ID NO: 490295 - DNA, 20 bp, mouse
gttacagcctgctgggtcct

SEQ ID NO: 490296 - DNA, 20 bp, mouse
gcttgtgacagagccacccg

SEQ ID NO: 490297 - DNA, 20 bp, mouse
ggtattcagacagattatcg

SEQ ID NO: 490298 - DNA, 20 bp, mouse
gtaccagcaagactgatggg

SEQ ID NO: 490299 - DNA, 20 bp, mouse
gcttcacaaagccaaagctg

SEQ ID NO: 490300 - DNA, 20 bp, mouse
gggttaccagcaagactgat

SEQ ID NO: 490301 - DNA, 20 bp, mouse
gcaagactgatgggaggtcc

SEQ ID NO: 490302 - DNA, 20 bp, mouse
gatctgttactactacaagg

SEQ ID NO: 490303 - DNA, 20 bp, mouse
gactactacaagggggacgt

SEQ ID NO: 490304 - DNA, 20 bp, mouse
gagatgcagagattcaacgc

SEQ ID NO: 490305 - DNA, 20 bp, mouse
gacgttggaaactattatta

SEQ ID NO: 490306 - DNA, 20 bp, mouse
gcatgaaacatgagtaacaa

SEQ ID NO: 490307 - DNA, 20 bp, mouse
gcctttacagtgtcattgaa

SEQ ID NO: 490308 - DNA, 20 bp, mouse
gtacataaaactacacatac

SEQ ID NO: 490309 - DNA, 20 bp, mouse
gaggtgacttgattatgaat

SEQ ID NO: 490310 - DNA, 20 bp, mouse
ggaactttccaagtacaaaa

SEQ ID NO: 490311 - DNA, 20 bp, mouse
gtgaaaggtgtgaatatact

SEQ ID NO: 490312 - DNA, 20 bp, mouse
gacatgttcttttatgtagt

SEQ ID NO: 490313 - DNA, 20 bp, mouse
gatgtgttcctttttgtact

SEQ ID NO: 490314 - DNA, 20 bp, mouse
ggacaggaaagaacacacac

SEQ ID NO: 490315 - DNA, 20 bp, mouse
gagatcatattgatgtacaa

SEQ ID NO: 490316 - DNA, 20 bp, mouse
gctggagaagaggaaaacta

SEQ ID NO: 490317 - DNA, 20 bp, mouse
gagtggatgcatagggagat

SEQ ID NO: 490318 - DNA, 20 bp, mouse
gaacataaaagtggatgcat

SEQ ID NO: 490319 - DNA, 20 bp, mouse
gacctacttaagactattgt

SEQ ID NO: 490320 - DNA, 20 bp, mouse
ggagaaaagctgcttctaaa

SEQ ID NO: 490321 - DNA, 20 bp, mouse
ggtcttccagggatttttgt

SEQ ID NO: 490322 - DNA, 20 bp, mouse
gaagaaaaattattgtgaat

SEQ ID NO: 490323 - DNA, 20 bp, mouse
gggcttttgtcgtgtcttcc

SEQ ID NO: 490324 - DNA, 20 bp, mouse
gatggacaaaatatattaca

SEQ ID NO: 490325 - DNA, 20 bp, mouse
gcctgggggtgctggagaag

SEQ ID NO: 490326 - DNA, 20 bp, mouse
gcactgggattcctgatgat

SEQ ID NO: 490327 - DNA, 20 bp, mouse
gtaactgaaatccaatcatc

SEQ ID NO: 490328 - DNA, 20 bp, mouse
gtctaacatcctgctgcact

SEQ ID NO: 490329 - DNA, 20 bp, mouse
gtggttcatactatgacata

SEQ ID NO: 490330 - DNA, 20 bp, mouse
ggtgataaatgaatacctgt

SEQ ID NO: 490331 - DNA, 20 bp, mouse
gtagaaattacattattcaa

SEQ ID NO: 490332 - DNA, 20 bp, mouse
ggtcatagtatgaaccaaca

SEQ ID NO: 490333 - DNA, 20 bp, mouse
gtcaggaatcccagtgcagc

SEQ ID NO: 490334 - DNA, 20 bp, mouse
gatattaacattaaactcat

SEQ ID NO: 490335 - DNA, 20 bp, mouse
gatatccttgaacatagggt

SEQ ID NO: 490336 - DNA, 20 bp, mouse
gttacccaaaggtgattctg

SEQ ID NO: 490337 - DNA, 20 bp, mouse
gcactaacaatattacccaa

SEQ ID NO: 490338 - DNA, 20 bp, mouse
gttctgaggtcagaatgagc

SEQ ID NO: 490339 - DNA, 20 bp, mouse
gaaaagtgctggctgatcag

SEQ ID NO: 490340 - DNA, 20 bp, mouse
gcttgcagggaaggagtaat

SEQ ID NO: 490341 - DNA, 20 bp, mouse
gctgatcagaggagtagcaa

SEQ ID NO: 490342 - DNA, 20 bp, mouse
gagtgattctgagtgaggca

SEQ ID NO: 490343 - DNA, 20 bp, mouse
ggacttgccactatacacac

SEQ ID NO: 490344 - DNA, 20 bp, mouse
gatgtatccagtgtgtatag

SEQ ID NO: 490345 - DNA, 20 bp, mouse
gcagtgttgtactttatggg

SEQ ID NO: 490346 - DNA, 20 bp, mouse
gggttccaaaaagttcagaa

SEQ ID NO: 490347 - DNA, 20 bp, mouse
gaacacaaatttgaggggaa

SEQ ID NO: 490348 - DNA, 20 bp, mouse
gacaacctttctgaactttt

SEQ ID NO: 490349 - DNA, 20 bp, mouse
ggatgtgttgatagttaact

SEQ ID NO: 490350 - DNA, 20 bp, mouse
gcatagtatagacatagata

SEQ ID NO: 490351 - DNA, 20 bp, mouse
gataaagtacacggaaggat

SEQ ID NO: 490352 - DNA, 20 bp, mouse
gtacagaaacgtaaacatat

SEQ ID NO: 490353 - DNA, 20 bp, mouse
gaaacgtaaacatataggac

SEQ ID NO: 490354 - DNA, 20 bp, mouse
gtgaaacttgataaagtaca

SEQ ID NO: 490355 - DNA, 20 bp, mouse
gtttcaacttcaagaatctt

SEQ ID NO: 490356 - DNA, 20 bp, mouse
gcaagaagaataaccgaaac

SEQ ID NO: 490357 - DNA, 20 bp, mouse
gtacctcgatggaactcccc

SEQ ID NO: 490358 - DNA, 20 bp, mouse
ggaggtaagaagggacaaaa

SEQ ID NO: 490359 - DNA, 20 bp, mouse
ggatggaactccccaggcag

SEQ ID NO: 490360 - DNA, 20 bp, mouse
gggccaaaactcagtcccca

SEQ ID NO: 490361 - DNA, 20 bp, mouse
gagttccatcgaggtaagaa

SEQ ID NO: 490362 - DNA, 20 bp, mouse
gttccgtggggactgagttt

SEQ ID NO: 490363 - DNA, 20 bp, mouse
gttgtcccttcttacctcga

SEQ ID NO: 490364 - DNA, 20 bp, mouse
gatattcttctgcttccgtg

SEQ ID NO: 490365 - DNA, 20 bp, mouse
gaggaaaactctagatgtct

SEQ ID NO: 490366 - DNA, 20 bp, mouse
gtcaagctgcagctgagtaa

SEQ ID NO: 490367 - DNA, 20 bp, mouse
ggtccatcttcagattgcag

SEQ ID NO: 490368 - DNA, 20 bp, mouse
gcagtttgggccatgattat

SEQ ID NO: 490369 - DNA, 20 bp, mouse
ggctagaggatagtaataaa

SEQ ID NO: 490370 - DNA, 20 bp, mouse
ggtaagtacggttgctgcag

SEQ ID NO: 490371 - DNA, 20 bp, mouse
gctcttagcgaagtccacat

SEQ ID NO: 490372 - DNA, 20 bp, mouse
ggattcccaaggtgccgatg

SEQ ID NO: 490373 - DNA, 20 bp, mouse
ggagtgagtgctacaaaaga

SEQ ID NO: 490374 - DNA, 20 bp, mouse
gctatcctctagctcctgaa

SEQ ID NO: 490375 - DNA, 20 bp, mouse
ggtttcctttcaggagctag

SEQ ID NO: 490376 - DNA, 20 bp, mouse
gcggtagctttgcccgcgcc

SEQ ID NO: 490377 - DNA, 20 bp, mouse
ggaagcctagccgggcccca

SEQ ID NO: 490378 - DNA, 20 bp, mouse
gtcggctgcagaatccgtgg

SEQ ID NO: 490379 - DNA, 20 bp, mouse
gaggctgcttggccaccttg

SEQ ID NO: 490380 - DNA, 20 bp, mouse
gtgagccctggggcccggct

SEQ ID NO: 490381 - DNA, 20 bp, mouse
gagctttgcccgcgccggga

SEQ ID NO: 490382 - DNA, 20 bp, mouse
ggagggaggctagggcctcg

SEQ ID NO: 490383 - DNA, 20 bp, mouse
gcaggcgcggaagcctagcc

SEQ ID NO: 490384 - DNA, 20 bp, mouse
gatccgtggcggctgcgagc

SEQ ID NO: 490385 - DNA, 20 bp, mouse
gtgccggaacaccgtggcgg

SEQ ID NO: 490386 - DNA, 20 bp, mouse
gtgtccaaggtaaggagtca

SEQ ID NO: 490387 - DNA, 20 bp, mouse
gtggtttaaaaatatctcta

SEQ ID NO: 490388 - DNA, 20 bp, mouse
gtctctagggctctttgtat

SEQ ID NO: 490389 - DNA, 20 bp, mouse
gaaaccagagaagatgtcca

SEQ ID NO: 490390 - DNA, 20 bp, mouse
gccaccatgactccttacct

SEQ ID NO: 490391 - DNA, 20 bp, mouse
ggtctgtcttcacgactctg

SEQ ID NO: 490392 - DNA, 20 bp, mouse
gaaggagtcatggtggagat

SEQ ID NO: 490393 - DNA, 20 bp, mouse
gttcttcccaagaataccag

SEQ ID NO: 490394 - DNA, 20 bp, mouse
gaccagaggtggtcaatatt

SEQ ID NO: 490395 - DNA, 20 bp, mouse
ggaccacctctggtattctt

SEQ ID NO: 490396 - DNA, 20 bp, mouse
gaaaaattctatgacttctt

SEQ ID NO: 490397 - DNA, 20 bp, mouse
ggactaagtggtgaagtagc

SEQ ID NO: 490398 - DNA, 20 bp, mouse
gcaggacacactagaaacac

SEQ ID NO: 490399 - DNA, 20 bp, mouse
gacttcaccacttagtccag

SEQ ID NO: 490400 - DNA, 20 bp, mouse
gtttccaaacagagtcctgg

SEQ ID NO: 490401 - DNA, 20 bp, mouse
ggagcctccaggactctgtt

SEQ ID NO: 490402 - DNA, 20 bp, mouse
gacacactagaaacacgggc

SEQ ID NO: 490403 - DNA, 20 bp, mouse
gttttttccaaacagagtcc

SEQ ID NO: 490404 - DNA, 20 bp, mouse
gctatgacttcttgggtgac

SEQ ID NO: 490405 - DNA, 20 bp, mouse
ggtttggaaaaaaaggcttt

SEQ ID NO: 490406 - DNA, 20 bp, mouse
gggtaacttaactcttgtct

SEQ ID NO: 490407 - DNA, 20 bp, mouse
gccgaaggcaccattctggt

SEQ ID NO: 490408 - DNA, 20 bp, mouse
ggtaggtcacataccaccga

SEQ ID NO: 490409 - DNA, 20 bp, mouse
gcagttgagagcagctcacc

SEQ ID NO: 490410 - DNA, 20 bp, mouse
gaccaccgaaggcaccattc

SEQ ID NO: 490411 - DNA, 20 bp, mouse
gatttatgggtgaccagagc

SEQ ID NO: 490412 - DNA, 20 bp, mouse
gtcaatgaagtcattttctc

SEQ ID NO: 490413 - DNA, 20 bp, mouse
ggtcacttcacccaccagaa

SEQ ID NO: 490414 - DNA, 20 bp, mouse
gagttaccacaacctactcc

SEQ ID NO: 490415 - DNA, 20 bp, mouse
gccttccggagcagtgtgtt

SEQ ID NO: 490416 - DNA, 20 bp, mouse
gtcactgaggagccgaccat

SEQ ID NO: 490417 - DNA, 20 bp, mouse
gactgaggcctgcagttagt

SEQ ID NO: 490418 - DNA, 20 bp, mouse
ggtaggtgctcataaaggcc

SEQ ID NO: 490419 - DNA, 20 bp, mouse
ggtgagcacctactaactgc

SEQ ID NO: 490420 - DNA, 20 bp, mouse
gatcaaggcctgaagacagt

SEQ ID NO: 490421 - DNA, 20 bp, mouse
gagacagtaggtgctcataa

SEQ ID NO: 490422 - DNA, 20 bp, mouse
gagacagtaggtgctcatag

SEQ ID NO: 490423 - DNA, 20 bp, mouse
gatgagcacctactgtcttc

SEQ ID NO: 490424 - DNA, 20 bp, mouse
gagacagtaggtgctcatca

SEQ ID NO: 490425 - DNA, 20 bp, mouse
gactagggcctgtaaatagt

SEQ ID NO: 490426 - DNA, 20 bp, mouse
gacgtcccgcggccaccggg

SEQ ID NO: 490427 - DNA, 20 bp, mouse
gacgtcacgggtcttcttga

SEQ ID NO: 490428 - DNA, 20 bp, mouse
ggtcccgagacgccgcccgg

SEQ ID NO: 490429 - DNA, 20 bp, mouse
ggaagacccgtgacgtcgca

SEQ ID NO: 490430 - DNA, 20 bp, mouse
ggacgtccctgcgacgtcac

SEQ ID NO: 490431 - DNA, 20 bp, mouse
gacgtcgcagggacgtcccg

SEQ ID NO: 490432 - DNA, 20 bp, mouse
gagggacgtcccgcggccac

SEQ ID NO: 490433 - DNA, 20 bp, mouse
gtcggtcccgagacgccgcc

SEQ ID NO: 490434 - DNA, 20 bp, mouse
gagacgccgcccggtggccg

SEQ ID NO: 490435 - DNA, 20 bp, mouse
gacgggtcttcttgaaggct

SEQ ID NO: 490436 - DNA, 20 bp, mouse
gggtggcggctggggatccc

SEQ ID NO: 490437 - DNA, 20 bp, mouse
gcgggcctcacgtcacgcgg

SEQ ID NO: 490438 - DNA, 20 bp, mouse
gctgcagccggggccccggg

SEQ ID NO: 490439 - DNA, 20 bp, mouse
ggccgccgccgcgtgacgtg

SEQ ID NO: 490440 - DNA, 20 bp, mouse
gcgggaagagaaggctcggt

SEQ ID NO: 490441 - DNA, 20 bp, mouse
ggcggcggcggcgggaaccg

SEQ ID NO: 490442 - DNA, 20 bp, mouse
ggcctcacgtcacgcggcgg

SEQ ID NO: 490443 - DNA, 20 bp, mouse
gggtcggagccgggaatgct

SEQ ID NO: 490444 - DNA, 20 bp, mouse
gccgtgcggacttaagatgg

SEQ ID NO: 490445 - DNA, 20 bp, mouse
ggggcgggcctcacgtcacg

SEQ ID NO: 490446 - DNA, 20 bp, mouse
gatgaagtgtgggaacccag

SEQ ID NO: 490447 - DNA, 20 bp, mouse
gtgcttcattagaggtcgaa

SEQ ID NO: 490448 - DNA, 20 bp, mouse
gatgaggacactctgctcag

SEQ ID NO: 490449 - DNA, 20 bp, mouse
gattagaggtcgaagggcag

SEQ ID NO: 490450 - DNA, 20 bp, mouse
gaaattcacacacacagaac

SEQ ID NO: 490451 - DNA, 20 bp, mouse
ggaggacaacgaggacaatg

SEQ ID NO: 490452 - DNA, 20 bp, mouse
gctgtgtggaggagattcga

SEQ ID NO: 490453 - DNA, 20 bp, mouse
gtaggatttgggataacgtg

SEQ ID NO: 490454 - DNA, 20 bp, mouse
gtgaatttgtgcttcattag

SEQ ID NO: 490455 - DNA, 20 bp, mouse
gcccagcattggttacgacg

SEQ ID NO: 490456 - DNA, 20 bp, mouse
gtgagtggactaaggctcgt

SEQ ID NO: 490457 - DNA, 20 bp, mouse
gtctccaggactctgatgag

SEQ ID NO: 490458 - DNA, 20 bp, mouse
gatgctgggcaaaattaaaa

SEQ ID NO: 490459 - DNA, 20 bp, mouse
ggcactcttgatataaatgt

SEQ ID NO: 490460 - DNA, 20 bp, mouse
gattttgcccagcattcagt

SEQ ID NO: 490461 - DNA, 20 bp, mouse
ggactctgatgagtggacta

SEQ ID NO: 490462 - DNA, 20 bp, mouse
gcaatattgacctacttcca

SEQ ID NO: 490463 - DNA, 20 bp, mouse
gactttaaccatgcttctcc

SEQ ID NO: 490464 - DNA, 20 bp, mouse
gattgaaaaaccctggaagt

SEQ ID NO: 490465 - DNA, 20 bp, mouse
gtgtctgtattgaaaaaccc

SEQ ID NO: 490466 - DNA, 20 bp, mouse
gtatcctcacgttctatcat

SEQ ID NO: 490467 - DNA, 20 bp, mouse
gcctcccatgatagaacgtg

SEQ ID NO: 490468 - DNA, 20 bp, mouse
gaacaagagggctaatgagg

SEQ ID NO: 490469 - DNA, 20 bp, mouse
gatagaacgtgaggatagcg

SEQ ID NO: 490470 - DNA, 20 bp, mouse
gtgaggaggcaacctaacta

SEQ ID NO: 490471 - DNA, 20 bp, mouse
gatggtacaacccaaaacgt

SEQ ID NO: 490472 - DNA, 20 bp, mouse
gttcctggaattctaactgt

SEQ ID NO: 490473 - DNA, 20 bp, mouse
ggaccaacagttagaattcc

SEQ ID NO: 490474 - DNA, 20 bp, mouse
gttatgccaagaaaaatcag

SEQ ID NO: 490475 - DNA, 20 bp, mouse
gggatgttagatcctcttcc

SEQ ID NO: 490476 - DNA, 20 bp, mouse
gctgcatggatagaaactct

SEQ ID NO: 490477 - DNA, 20 bp, mouse
gtatccatgcaggacaaatg

SEQ ID NO: 490478 - DNA, 20 bp, mouse
gagttcccaatactgctcac

SEQ ID NO: 490479 - DNA, 20 bp, mouse
gttcacctgtgagcagtatt

SEQ ID NO: 490480 - DNA, 20 bp, mouse
ggaggagactctggagacct

SEQ ID NO: 490481 - DNA, 20 bp, mouse
gtccatcacgagagaccacc

SEQ ID NO: 490482 - DNA, 20 bp, mouse
gtccaaggcccacaagaatt

SEQ ID NO: 490483 - DNA, 20 bp, mouse
gaaaacttcggggagtccag

SEQ ID NO: 490484 - DNA, 20 bp, mouse
gggtctctcgtgatggacat

SEQ ID NO: 490485 - DNA, 20 bp, mouse
gacaagaattgggaaatgtg

SEQ ID NO: 490486 - DNA, 20 bp, mouse
ggcacctcatgaaagacccc

SEQ ID NO: 490487 - DNA, 20 bp, mouse
gactggaattgtttaagcta

SEQ ID NO: 490488 - DNA, 20 bp, mouse
gaacaattccagtagaaaaa

SEQ ID NO: 490489 - DNA, 20 bp, mouse
gatattttccatttttctac

SEQ ID NO: 490490 - DNA, 20 bp, mouse
gactaggctgctcagaacct

SEQ ID NO: 490491 - DNA, 20 bp, mouse
gccacaagaggttgtagaca

SEQ ID NO: 490492 - DNA, 20 bp, mouse
ggagaaggagggaggtaaga

SEQ ID NO: 490493 - DNA, 20 bp, mouse
gtccttgcagagaaggaggg

SEQ ID NO: 490494 - DNA, 20 bp, mouse
gttctggttttggaaagtta

SEQ ID NO: 490495 - DNA, 20 bp, mouse
ggcaagaggacatctgatct

SEQ ID NO: 490496 - DNA, 20 bp, mouse
gaatttagattcctaatcat

SEQ ID NO: 490497 - DNA, 20 bp, mouse
gatattaagtaggcatcata

SEQ ID NO: 490498 - DNA, 20 bp, mouse
gtcctcatttgcccatgatt

SEQ ID NO: 490499 - DNA, 20 bp, mouse
gattcagccatatattaagt

SEQ ID NO: 490500 - DNA, 20 bp, mouse
ggtgaaaatccatggtgaag

SEQ ID NO: 490501 - DNA, 20 bp, mouse
gtgagaacaagaaaagcaca

SEQ ID NO: 490502 - DNA, 20 bp, mouse
gatacagcagagaaattgaa

SEQ ID NO: 490503 - DNA, 20 bp, mouse
gtgatagtggccatgaggga

SEQ ID NO: 490504 - DNA, 20 bp, mouse
gcttgatccatagtcttagc

SEQ ID NO: 490505 - DNA, 20 bp, mouse
gttcagttcaggtcagcttc

SEQ ID NO: 490506 - DNA, 20 bp, mouse
ggccactgccagatttgaag

SEQ ID NO: 490507 - DNA, 20 bp, mouse
gccctcttcaaatctggcag

SEQ ID NO: 490508 - DNA, 20 bp, mouse
gactattctgagggagtgct

SEQ ID NO: 490509 - DNA, 20 bp, mouse
ggttagtttgcaatttgaga

SEQ ID NO: 490510 - DNA, 20 bp, mouse
ggttttcccctcttcaaatc

SEQ ID NO: 490511 - DNA, 20 bp, mouse
gacaatacttcctgaaggaa

SEQ ID NO: 490512 - DNA, 20 bp, mouse
ggatgaagaaatacatcagt

SEQ ID NO: 490513 - DNA, 20 bp, mouse
gttccaacaatacttcctga

SEQ ID NO: 490514 - DNA, 20 bp, mouse
gttaaacttacccttccttc

SEQ ID NO: 490515 - DNA, 20 bp, mouse
ggactccaattagatactaa

SEQ ID NO: 490516 - DNA, 20 bp, mouse
gtagtcttagagcatatcaa

SEQ ID NO: 490517 - DNA, 20 bp, mouse
ggatcttataactgacagtg

SEQ ID NO: 490518 - DNA, 20 bp, mouse
gtaaagttaccacctgacac

SEQ ID NO: 490519 - DNA, 20 bp, mouse
gaagatccaccagtgtcagg

SEQ ID NO: 490520 - DNA, 20 bp, mouse
gactccaaagagtctgagag

SEQ ID NO: 490521 - DNA, 20 bp, mouse
gtagtatctaatgggaaatc

SEQ ID NO: 490522 - DNA, 20 bp, mouse
gtataagatccaccagtgtc

SEQ ID NO: 490523 - DNA, 20 bp, mouse
gagagcatatcaaagggtga

SEQ ID NO: 490524 - DNA, 20 bp, mouse
ggcaatttctcaaagttgtt

SEQ ID NO: 490525 - DNA, 20 bp, mouse
gcaggtggtaactttacaca

SEQ ID NO: 490526 - DNA, 20 bp, mouse
gagtcaactccgtaccccaa

SEQ ID NO: 490527 - DNA, 20 bp, mouse
gaagtttgtagtctttaagg

SEQ ID NO: 490528 - DNA, 20 bp, mouse
gagaatgactctaacccttg

SEQ ID NO: 490529 - DNA, 20 bp, mouse
gagactacaaacttggccta

SEQ ID NO: 490530 - DNA, 20 bp, mouse
ggactctaacccttggggta

SEQ ID NO: 490531 - DNA, 20 bp, mouse
ggccaagtttgtagtcttta

SEQ ID NO: 490532 - DNA, 20 bp, mouse
gatagtttggagggggctaa

SEQ ID NO: 490533 - DNA, 20 bp, mouse
gagcagagattaaatgaagt

SEQ ID NO: 490534 - DNA, 20 bp, mouse
gaatttgggaaattccctct

SEQ ID NO: 490535 - DNA, 20 bp, mouse
gctataatgataaacctaga

SEQ ID NO: 490536 - DNA, 20 bp, mouse
gggtcattgaggacagaact

SEQ ID NO: 490537 - DNA, 20 bp, mouse
gaaacccagaaggtctggac

SEQ ID NO: 490538 - DNA, 20 bp, mouse
gacgtgtggaggagtccctg

SEQ ID NO: 490539 - DNA, 20 bp, mouse
gtacaagctgctggtcttgt

SEQ ID NO: 490540 - DNA, 20 bp, mouse
gagcagttctaaggtcattg

SEQ ID NO: 490541 - DNA, 20 bp, mouse
gactctgagcagcagttcta

SEQ ID NO: 490542 - DNA, 20 bp, mouse
gaagaccagcagcttgtatt

SEQ ID NO: 490543 - DNA, 20 bp, mouse
ggaactgctgctcagagtgc

SEQ ID NO: 490544 - DNA, 20 bp, mouse
gccagaaggtctggacgggc

SEQ ID NO: 490545 - DNA, 20 bp, mouse
ggtgtcaagcttgggtccag

SEQ ID NO: 490546 - DNA, 20 bp, mouse
ggccaggcgctccagtagac

SEQ ID NO: 490547 - DNA, 20 bp, mouse
ggctgcctaggaaagtctca

SEQ ID NO: 490548 - DNA, 20 bp, mouse
gaggaggtggtaaccagggt

SEQ ID NO: 490549 - DNA, 20 bp, mouse
gcagtagacgggctgcacaa

SEQ ID NO: 490550 - DNA, 20 bp, mouse
ggcccgtctactggagcgcc

SEQ ID NO: 490551 - DNA, 20 bp, mouse
gatattggtgagcaccagcc

SEQ ID NO: 490552 - DNA, 20 bp, mouse
gttctccctgagactttcct

SEQ ID NO: 490553 - DNA, 20 bp, mouse
ggcctgagagcagagtgcag

SEQ ID NO: 490554 - DNA, 20 bp, mouse
ggggcggggcccacagctgt

SEQ ID NO: 490555 - DNA, 20 bp, mouse
ggagcagagtgcagaggagg

SEQ ID NO: 490556 - DNA, 20 bp, mouse
gagccgaacgagttccagtc

SEQ ID NO: 490557 - DNA, 20 bp, mouse
gtgccagactggaactcgtt

SEQ ID NO: 490558 - DNA, 20 bp, mouse
gaggacaccatcctccaggg

SEQ ID NO: 490559 - DNA, 20 bp, mouse
gtgcaggacaccatcctcca

SEQ ID NO: 490560 - DNA, 20 bp, mouse
gcgggaactcaacatcactg

SEQ ID NO: 490561 - DNA, 20 bp, mouse
gaccacgcccccctggagga

SEQ ID NO: 490562 - DNA, 20 bp, mouse
gattacagggtgcaacactg

SEQ ID NO: 490563 - DNA, 20 bp, mouse
gtgtagtcttcactgcttag

SEQ ID NO: 490564 - DNA, 20 bp, mouse
gctggctagttcatgaattg

SEQ ID NO: 490565 - DNA, 20 bp, mouse
gtgggaagaccacgcccccc

SEQ ID NO: 490566 - DNA, 20 bp, mouse
gtcagagttgggtggcatgt

SEQ ID NO: 490567 - DNA, 20 bp, mouse
ggttgttcctcagagttggg

SEQ ID NO: 490568 - DNA, 20 bp, mouse
gctccaccgcagcgcttcag

SEQ ID NO: 490569 - DNA, 20 bp, mouse
gacacgcccctgaagcgctg

SEQ ID NO: 490570 - DNA, 20 bp, mouse
gcgcccctgaagcgctgcgg

SEQ ID NO: 490571 - DNA, 20 bp, mouse
ggcttcaggggcgtgtacct

SEQ ID NO: 490572 - DNA, 20 bp, mouse
gggcgtgtacctaggtcgac

SEQ ID NO: 490573 - DNA, 20 bp, mouse
ggatgaatgaatgcacctac

SEQ ID NO: 490574 - DNA, 20 bp, mouse
ggtttataatccaagtctaa

SEQ ID NO: 490575 - DNA, 20 bp, mouse
gcccaaggtagtaatgatga

SEQ ID NO: 490576 - DNA, 20 bp, mouse
gggagagagtacaaggtggt

SEQ ID NO: 490577 - DNA, 20 bp, mouse
gagaggttgtcatgtcaagt

SEQ ID NO: 490578 - DNA, 20 bp, mouse
gcaggaaggtgatcagctag

SEQ ID NO: 490579 - DNA, 20 bp, mouse
ggagagagtaatctccaagg

SEQ ID NO: 490580 - DNA, 20 bp, mouse
gggggagagagtaatctcca

SEQ ID NO: 490581 - DNA, 20 bp, mouse
ggtaataaatgccatgagag

SEQ ID NO: 490582 - DNA, 20 bp, mouse
gattactctctcccctctca

SEQ ID NO: 490583 - DNA, 20 bp, mouse
gaatctccaaggaggaagtg

SEQ ID NO: 490584 - DNA, 20 bp, mouse
gaggcatatttaggtcagga

SEQ ID NO: 490585 - DNA, 20 bp, mouse
ggcagaattgaggcatattt

SEQ ID NO: 490586 - DNA, 20 bp, mouse
gacccgccaggaaccacatg

SEQ ID NO: 490587 - DNA, 20 bp, mouse
gctgcctcatccggaatggg

SEQ ID NO: 490588 - DNA, 20 bp, mouse
gcagcctcccattccggatg

SEQ ID NO: 490589 - DNA, 20 bp, mouse
ggggttggaactctccgtca

SEQ ID NO: 490590 - DNA, 20 bp, mouse
ggttgactcgcttcccgtga

SEQ ID NO: 490591 - DNA, 20 bp, mouse
gccactgcctcatccggaat

SEQ ID NO: 490592 - DNA, 20 bp, mouse
gtcaagcagaagtccccatg

SEQ ID NO: 490593 - DNA, 20 bp, mouse
ggtccccatgtggttcctgg

SEQ ID NO: 490594 - DNA, 20 bp, mouse
gcggagagttccaacccgcc

SEQ ID NO: 490595 - DNA, 20 bp, mouse
gtgtggcactggctatatca

SEQ ID NO: 490596 - DNA, 20 bp, mouse
gatactgacacagcttacga

SEQ ID NO: 490597 - DNA, 20 bp, mouse
ggatgcaggggatgagaaca

SEQ ID NO: 490598 - DNA, 20 bp, mouse
gattgcctgttggttcctga

SEQ ID NO: 490599 - DNA, 20 bp, mouse
gaaagccgtcaggaaccaac

SEQ ID NO: 490600 - DNA, 20 bp, mouse
ggagaacaaggattgcctgt

SEQ ID NO: 490601 - DNA, 20 bp, mouse
gcagtatggtaaaagccgtc

SEQ ID NO: 490602 - DNA, 20 bp, mouse
gagtagccgacagacttctt

SEQ ID NO: 490603 - DNA, 20 bp, mouse
ggtgatcggcatgtggtcgt

SEQ ID NO: 490604 - DNA, 20 bp, mouse
gtacaggtaagacatcagtg

SEQ ID NO: 490605 - DNA, 20 bp, mouse
gggaaaccgaagaagtctgt

SEQ ID NO: 490606 - DNA, 20 bp, mouse
ggatggggtactggaaggag

SEQ ID NO: 490607 - DNA, 20 bp, mouse
gggcgaatgagcatattagg

SEQ ID NO: 490608 - DNA, 20 bp, mouse
gcatattagggggatcctac

SEQ ID NO: 490609 - DNA, 20 bp, mouse
gcgtggcgaatgagcatatt

SEQ ID NO: 490610 - DNA, 20 bp, mouse
gccgagtctgtgattcctgt

SEQ ID NO: 490611 - DNA, 20 bp, mouse
gaaggtcatgaacctggctg

SEQ ID NO: 490612 - DNA, 20 bp, mouse
gtcacagactcggtgctcta

SEQ ID NO: 490613 - DNA, 20 bp, mouse
gtggagtgagagttagtggg

SEQ ID NO: 490614 - DNA, 20 bp, mouse
gatcgagacaaagagttacg

SEQ ID NO: 490615 - DNA, 20 bp, mouse
gactcagccatccacaaagt

SEQ ID NO: 490616 - DNA, 20 bp, mouse
gcttcttggctgttgcaggt

SEQ ID NO: 490617 - DNA, 20 bp, mouse
ggctcccaccagggaatccg

SEQ ID NO: 490618 - DNA, 20 bp, mouse
gcttggctgttgcaggtggg

SEQ ID NO: 490619 - DNA, 20 bp, mouse
gcgcatgaaccttcagacca

SEQ ID NO: 490620 - DNA, 20 bp, mouse
gatgaaccttcagaccatgg

SEQ ID NO: 490621 - DNA, 20 bp, mouse
gaggagagccctcaggtctt

SEQ ID NO: 490622 - DNA, 20 bp, mouse
ggcccccagcccaagacctg

SEQ ID NO: 490623 - DNA, 20 bp, mouse
gcaacaacaggagagccctc

SEQ ID NO: 490624 - DNA, 20 bp, mouse
gagccagagcgagcaacaac

SEQ ID NO: 490625 - DNA, 20 bp, mouse
ggcaggaggtaagagttccc

SEQ ID NO: 490626 - DNA, 20 bp, mouse
gcgccagaatttgagatcgt

SEQ ID NO: 490627 - DNA, 20 bp, mouse
gcaagaactgtgtaaggcca

SEQ ID NO: 490628 - DNA, 20 bp, mouse
gaactgtgtaaggccaggga

SEQ ID NO: 490629 - DNA, 20 bp, mouse
ggaccacataaacgtgacga

SEQ ID NO: 490630 - DNA, 20 bp, mouse
ggtcatcaaagaacagatag

SEQ ID NO: 490631 - DNA, 20 bp, mouse
gagccaacgatctcaaattc

SEQ ID NO: 490632 - DNA, 20 bp, mouse
gcaaattctggcggctcaag

SEQ ID NO: 490633 - DNA, 20 bp, mouse
gctttagacggcttgctcag

SEQ ID NO: 490634 - DNA, 20 bp, mouse
gacccaacattgcagaggga

SEQ ID NO: 490635 - DNA, 20 bp, mouse
gttccatcgtcacgtttatg

SEQ ID NO: 490636 - DNA, 20 bp, mouse
gtcacagattaataccccaa

SEQ ID NO: 490637 - DNA, 20 bp, mouse
ggctaagatggataacttac

SEQ ID NO: 490638 - DNA, 20 bp, mouse
gctgtgagactaggtaagac

SEQ ID NO: 490639 - DNA, 20 bp, mouse
gggtattaatctgtgagact

SEQ ID NO: 490640 - DNA, 20 bp, mouse
ggttatgcctgcccagctga

SEQ ID NO: 490641 - DNA, 20 bp, mouse
ggataacttactggtttaaa

SEQ ID NO: 490642 - DNA, 20 bp, mouse
gacggcaaatacagctaaga

SEQ ID NO: 490643 - DNA, 20 bp, mouse
gttggcttcataaagatcgt

SEQ ID NO: 490644 - DNA, 20 bp, mouse
gagagtgatcgccatctcct

SEQ ID NO: 490645 - DNA, 20 bp, mouse
gttaaaaggctggtatctgc

SEQ ID NO: 490646 - DNA, 20 bp, mouse
gaatctattgaaataccaaa

SEQ ID NO: 490647 - DNA, 20 bp, mouse
gaggcataaagcagacaggg

SEQ ID NO: 490648 - DNA, 20 bp, mouse
ggtttctgtattaatagcga

SEQ ID NO: 490649 - DNA, 20 bp, mouse
gatggatactggagtagatg

SEQ ID NO: 490650 - DNA, 20 bp, mouse
gagcccaaacactcaccatt

SEQ ID NO: 490651 - DNA, 20 bp, mouse
gggtaggcataaagcagaca

SEQ ID NO: 490652 - DNA, 20 bp, mouse
gttatactgtttataaatac

SEQ ID NO: 490653 - DNA, 20 bp, mouse
gtactggagtagatggggcc

SEQ ID NO: 490654 - DNA, 20 bp, mouse
gtatttcaatagatttctcc

SEQ ID NO: 490655 - DNA, 20 bp, mouse
gatgtcttccaaggactcac

SEQ ID NO: 490656 - DNA, 20 bp, mouse
gtgggctgtactgtcgacat

SEQ ID NO: 490657 - DNA, 20 bp, mouse
gtgcaagccgcacgagtcca

SEQ ID NO: 490658 - DNA, 20 bp, mouse
ggaggagccctggactcgtg

SEQ ID NO: 490659 - DNA, 20 bp, mouse
gagtacagcccagggacagg

SEQ ID NO: 490660 - DNA, 20 bp, mouse
ggtgcagtgcgtacagtgag

SEQ ID NO: 490661 - DNA, 20 bp, mouse
gcaccgagaggagaagacgc

SEQ ID NO: 490662 - DNA, 20 bp, mouse
gattcttccctcctgtccct

SEQ ID NO: 490663 - DNA, 20 bp, mouse
gcaggagggaagaatcgcca

SEQ ID NO: 490664 - DNA, 20 bp, mouse
gggtcgcagtgtccacagaa

SEQ ID NO: 490665 - DNA, 20 bp, mouse
gctctcggtgcgtgcagaca

SEQ ID NO: 490666 - DNA, 20 bp, mouse
gacatgtagttgagttgcag

SEQ ID NO: 490667 - DNA, 20 bp, mouse
gtagttgagttgcagcggaa

SEQ ID NO: 490668 - DNA, 20 bp, mouse
ggcaactcaactacatgtca

SEQ ID NO: 490669 - DNA, 20 bp, mouse
ggaggtggcttacgaagtga

SEQ ID NO: 490670 - DNA, 20 bp, mouse
gaacctgaacagttataagt

SEQ ID NO: 490671 - DNA, 20 bp, mouse
gacggctgggcgagctctga

SEQ ID NO: 490672 - DNA, 20 bp, mouse
gtcaggttagtagagaggaa

SEQ ID NO: 490673 - DNA, 20 bp, mouse
gtgaaggtaggtagcacatg

SEQ ID NO: 490674 - DNA, 20 bp, mouse
gaagaagagcagaactgagg

SEQ ID NO: 490675 - DNA, 20 bp, mouse
gctgaacagttataagtggg

SEQ ID NO: 490676 - DNA, 20 bp, mouse
ggcagatcggcaggaataaa

SEQ ID NO: 490677 - DNA, 20 bp, mouse
gtgcttatgagactgaacag

SEQ ID NO: 490678 - DNA, 20 bp, mouse
gtggcaaactgcagatcggc

SEQ ID NO: 490679 - DNA, 20 bp, mouse
gcggcaggaataaaaggtta

SEQ ID NO: 490680 - DNA, 20 bp, mouse
gtgtcagttagcctcccagg

SEQ ID NO: 490681 - DNA, 20 bp, mouse
gtaggtatgtacacactcaa

SEQ ID NO: 490682 - DNA, 20 bp, mouse
gtttgccacttctttttctg

SEQ ID NO: 490683 - DNA, 20 bp, mouse
ggaatgtcagttagcctccc

SEQ ID NO: 490684 - DNA, 20 bp, mouse
gacatacctagtcagagata

SEQ ID NO: 490685 - DNA, 20 bp, mouse
gttaaggaaaatgcactggg

SEQ ID NO: 490686 - DNA, 20 bp, mouse
gagaagggcacaggcaccgg

SEQ ID NO: 490687 - DNA, 20 bp, mouse
gctcagggcaagaagggcac

SEQ ID NO: 490688 - DNA, 20 bp, mouse
ggcacaggcaccggtggact

SEQ ID NO: 490689 - DNA, 20 bp, mouse
gatcgcgtagccaagtccac

SEQ ID NO: 490690 - DNA, 20 bp, mouse
gaggcgggtgcttcagaccg

SEQ ID NO: 490691 - DNA, 20 bp, mouse
gtgtgggtctcagggcaaga

SEQ ID NO: 490692 - DNA, 20 bp, mouse
ggaccgaggaaagcgcttgt

SEQ ID NO: 490693 - DNA, 20 bp, mouse
gccaagtggccctgacaagg

SEQ ID NO: 490694 - DNA, 20 bp, mouse
ggacccacaagcgctttcct

SEQ ID NO: 490695 - DNA, 20 bp, mouse
ggacttggctacgcgatgca

SEQ ID NO: 490696 - DNA, 20 bp, mouse
gactggggaccacaccatca

SEQ ID NO: 490697 - DNA, 20 bp, mouse
gagtgaagaacgaggtctct

SEQ ID NO: 490698 - DNA, 20 bp, mouse
gcgtaagagtcagggaacaa

SEQ ID NO: 490699 - DNA, 20 bp, mouse
ggatattcagcctggaagga

SEQ ID NO: 490700 - DNA, 20 bp, mouse
gtgtggtccccagtgctcct

SEQ ID NO: 490701 - DNA, 20 bp, mouse
gaatgaccaagtgaagaacg

SEQ ID NO: 490702 - DNA, 20 bp, mouse
gtcctggagggccacagcca

SEQ ID NO: 490703 - DNA, 20 bp, mouse
ggctgactggaagctgtgtg

SEQ ID NO: 490704 - DNA, 20 bp, mouse
ggtcaagaagcggcaatcag

SEQ ID NO: 490705 - DNA, 20 bp, mouse
gaatgcagccgtaagagtca

SEQ ID NO: 490706 - DNA, 20 bp, mouse
gcgacctcaaaaacatcggg

SEQ ID NO: 490707 - DNA, 20 bp, mouse
gctctcccaccagacccaag

SEQ ID NO: 490708 - DNA, 20 bp, mouse
gtgaggtcgataatccactt

SEQ ID NO: 490709 - DNA, 20 bp, mouse
gtaatccacttgggtctggt

SEQ ID NO: 490710 - DNA, 20 bp, mouse
gtatcaggtgaataccccac

SEQ ID NO: 490711 - DNA, 20 bp, mouse
gggtgaataccccacaggtc

SEQ ID NO: 490712 - DNA, 20 bp, mouse
gagctatctcccctggtcca

SEQ ID NO: 490713 - DNA, 20 bp, mouse
ggccctcagccctggaccag

SEQ ID NO: 490714 - DNA, 20 bp, mouse
gtgggacactcggcagataa

SEQ ID NO: 490715 - DNA, 20 bp, mouse
gtacctcatccggaccctgg

SEQ ID NO: 490716 - DNA, 20 bp, mouse
ggtcagtgcgtagcccggga

SEQ ID NO: 490717 - DNA, 20 bp, mouse
gacagacggctcagggtagt

SEQ ID NO: 490718 - DNA, 20 bp, mouse
gtagcccgggagggaagccc

SEQ ID NO: 490719 - DNA, 20 bp, mouse
gggctagcggccgccagtcc

SEQ ID NO: 490720 - DNA, 20 bp, mouse
gccagtcccggcatctttcc

SEQ ID NO: 490721 - DNA, 20 bp, mouse
gctcagggtagtcggagttt

SEQ ID NO: 490722 - DNA, 20 bp, mouse
ggagaggacagcggaactat

SEQ ID NO: 490723 - DNA, 20 bp, mouse
gagccgagctgctaaagccc

SEQ ID NO: 490724 - DNA, 20 bp, mouse
ggcctgcccggaaaccaaga

SEQ ID NO: 490725 - DNA, 20 bp, mouse
ggtcccccttcgattgactg

SEQ ID NO: 490726 - DNA, 20 bp, mouse
ggccatggagggcggaggta

SEQ ID NO: 490727 - DNA, 20 bp, mouse
gacaggagcgacgccatgga

SEQ ID NO: 490728 - DNA, 20 bp, mouse
gtgagcggagcacagaagcc

SEQ ID NO: 490729 - DNA, 20 bp, mouse
gtggagggcggaggtaggga

SEQ ID NO: 490730 - DNA, 20 bp, mouse
gggaggtagggagggatcgc

SEQ ID NO: 490731 - DNA, 20 bp, mouse
gcagcacaggagcgacgcca

SEQ ID NO: 490732 - DNA, 20 bp, mouse
gaccctggaaatgctaggac

SEQ ID NO: 490733 - DNA, 20 bp, mouse
gtcctgtcctagcatttcca

SEQ ID NO: 490734 - DNA, 20 bp, mouse
gggagcgacgccatggaggg

SEQ ID NO: 490735 - DNA, 20 bp, mouse
ggcctggggagtgatcatgt

SEQ ID NO: 490736 - DNA, 20 bp, mouse
gcggtcgccagccattcctg

SEQ ID NO: 490737 - DNA, 20 bp, mouse
gggacctctcctacagcgac

SEQ ID NO: 490738 - DNA, 20 bp, mouse
gccgcagtcctccacaggaa

SEQ ID NO: 490739 - DNA, 20 bp, mouse
gaggtcctgtctctccgaga

SEQ ID NO: 490740 - DNA, 20 bp, mouse
gtggaggactgcgggtcgtt

SEQ ID NO: 490741 - DNA, 20 bp, mouse
gttgcctgtcgctgtaggag

SEQ ID NO: 490742 - DNA, 20 bp, mouse
gctctccgagaaggcggttg

SEQ ID NO: 490743 - DNA, 20 bp, mouse
ggcgtccacggcgctcgaag

SEQ ID NO: 490744 - DNA, 20 bp, mouse
ggccgccgcaaccgccttct

SEQ ID NO: 490745 - DNA, 20 bp, mouse
gtcctgtctctccgagaagg

SEQ ID NO: 490746 - DNA, 20 bp, mouse
gtgtaaaacttactgtgttt

SEQ ID NO: 490747 - DNA, 20 bp, mouse
gatctcacaggtctctccaa

SEQ ID NO: 490748 - DNA, 20 bp, mouse
gggtctctccaaaggcataa

SEQ ID NO: 490749 - DNA, 20 bp, mouse
gaagtccttggatgtcaaag

SEQ ID NO: 490750 - DNA, 20 bp, mouse
gtagtccactttgacatcca

SEQ ID NO: 490751 - DNA, 20 bp, mouse
gatcaaagtattaaagtcct

SEQ ID NO: 490752 - DNA, 20 bp, mouse
ggtaaaacttttgcatgtca

SEQ ID NO: 490753 - DNA, 20 bp, mouse
gaaacttttgcatgtcaagg

SEQ ID NO: 490754 - DNA, 20 bp, mouse
gaagtgttgttttatgtatc

SEQ ID NO: 490755 - DNA, 20 bp, mouse
gcaatgttggacacctccat

SEQ ID NO: 490756 - DNA, 20 bp, mouse
gggtggcgctgcagcttgaa

SEQ ID NO: 490757 - DNA, 20 bp, mouse
gacattggcgcagagctcac

SEQ ID NO: 490758 - DNA, 20 bp, mouse
gggcatagagaggcacgtgt

SEQ ID NO: 490759 - DNA, 20 bp, mouse
gagtggtggcagtcacggga

SEQ ID NO: 490760 - DNA, 20 bp, mouse
gccgtgactgccaccactgt

SEQ ID NO: 490761 - DNA, 20 bp, mouse
gacacaggtagacgcgctgt

SEQ ID NO: 490762 - DNA, 20 bp, mouse
gtgggctgtgcaccgccagg

SEQ ID NO: 490763 - DNA, 20 bp, mouse
gctgcgggcaccggggacac

SEQ ID NO: 490764 - DNA, 20 bp, mouse
gctgcagcttgaagggcttg

SEQ ID NO: 490765 - DNA, 20 bp, mouse
ggggctcagggtagacctgc

SEQ ID NO: 490766 - DNA, 20 bp, mouse
gcagggccacatgtgagggt

SEQ ID NO: 490767 - DNA, 20 bp, mouse
ggatgctgagagggaaattc

SEQ ID NO: 490768 - DNA, 20 bp, mouse
gccacatgtgagggtgggtg

SEQ ID NO: 490769 - DNA, 20 bp, mouse
gacctgcctccacttcagac

SEQ ID NO: 490770 - DNA, 20 bp, mouse
gcttccggtctccctgctgc

SEQ ID NO: 490771 - DNA, 20 bp, mouse
gacaacatggaaccagcagc

SEQ ID NO: 490772 - DNA, 20 bp, mouse
ggtcaccttcatgctttctc

SEQ ID NO: 490773 - DNA, 20 bp, mouse
gtgaaacattcttggcaaaa

SEQ ID NO: 490774 - DNA, 20 bp, mouse
ggtagctgaggagaatggag

SEQ ID NO: 490775 - DNA, 20 bp, mouse
ggaaccagcagcagggagac

SEQ ID NO: 490776 - DNA, 20 bp, mouse
gcggtgcttgccaggaatgg

SEQ ID NO: 490777 - DNA, 20 bp, mouse
ggggcggtgcttgccaggaa

SEQ ID NO: 490778 - DNA, 20 bp, mouse
ggagcgcgctccgcaggcaa

SEQ ID NO: 490779 - DNA, 20 bp, mouse
gctgcgtgaggaggagagac

SEQ ID NO: 490780 - DNA, 20 bp, mouse
gcgcaggcgcacctccccgg

SEQ ID NO: 490781 - DNA, 20 bp, mouse
gtgcttgccaggaatggcgg

SEQ ID NO: 490782 - DNA, 20 bp, mouse
gtcggcccgcaggccccgct

SEQ ID NO: 490783 - DNA, 20 bp, mouse
gccaggaatggcggcggtca

SEQ ID NO: 490784 - DNA, 20 bp, mouse
gggccttgagcgcggaggaa

SEQ ID NO: 490785 - DNA, 20 bp, mouse
gcggccacgcccatcaccct

SEQ ID NO: 490786 - DNA, 20 bp, mouse
gtagcactcgaagtttaggg

SEQ ID NO: 490787 - DNA, 20 bp, mouse
gatagatgagtggatcccgg

SEQ ID NO: 490788 - DNA, 20 bp, mouse
ggggcgcgcgcatagatgag

SEQ ID NO: 490789 - DNA, 20 bp, mouse
gaggtccccagatcctggca

SEQ ID NO: 490790 - DNA, 20 bp, mouse
gcgcgccctgccaggatctg

SEQ ID NO: 490791 - DNA, 20 bp, mouse
gactcgaggtccccagatcc

SEQ ID NO: 490792 - DNA, 20 bp, mouse
gcgcatagatgagtggatcc

SEQ ID NO: 490793 - DNA, 20 bp, mouse
gtagggtggcatctgcctcc

SEQ ID NO: 490794 - DNA, 20 bp, mouse
gagaaggaaaactctactcg

SEQ ID NO: 490795 - DNA, 20 bp, mouse
gtctatgcgcgcgccctgcc

SEQ ID NO: 490796 - DNA, 20 bp, mouse
ggaataatgcagccagaacc

SEQ ID NO: 490797 - DNA, 20 bp, mouse
gtagtcattcttagacacag

SEQ ID NO: 490798 - DNA, 20 bp, mouse
gagaggcagaaggacagaac

SEQ ID NO: 490799 - DNA, 20 bp, mouse
ggtaatgtctctccaggttc

SEQ ID NO: 490800 - DNA, 20 bp, mouse
ggaagtcagggaaaaactgt

SEQ ID NO: 490801 - DNA, 20 bp, mouse
gtgtcttctagaccagtcca

SEQ ID NO: 490802 - DNA, 20 bp, mouse
ggaccagtccaaggagactc

SEQ ID NO: 490803 - DNA, 20 bp, mouse
ggccaatgttcaagagatga

SEQ ID NO: 490804 - DNA, 20 bp, mouse
gtgtaaaatcattaatgtag

SEQ ID NO: 490805 - DNA, 20 bp, mouse
gggccagagtctccttggac

SEQ ID NO: 490806 - DNA, 20 bp, mouse
gcaactctcaggaccccggg

SEQ ID NO: 490807 - DNA, 20 bp, mouse
gaggtactgcgcaggaccaa

SEQ ID NO: 490808 - DNA, 20 bp, mouse
gcaagtaaggccatccgccc

SEQ ID NO: 490809 - DNA, 20 bp, mouse
gtctgcgcaggcgtcaacga

SEQ ID NO: 490810 - DNA, 20 bp, mouse
gacgcgggcccccaactctc

SEQ ID NO: 490811 - DNA, 20 bp, mouse
ggtctggagagcagcaagta

SEQ ID NO: 490812 - DNA, 20 bp, mouse
gggcactgcaggattacccg

SEQ ID NO: 490813 - DNA, 20 bp, mouse
ggtcatccgtgaaacggaaa

SEQ ID NO: 490814 - DNA, 20 bp, mouse
ggagcagttgaggatttcca

SEQ ID NO: 490815 - DNA, 20 bp, mouse
gtgggaggggcgctccacag

SEQ ID NO: 490816 - DNA, 20 bp, mouse
gcccgcccggaccaagggac

SEQ ID NO: 490817 - DNA, 20 bp, mouse
gtcggtgcaaagtgtcgaga

SEQ ID NO: 490818 - DNA, 20 bp, mouse
ggtgcaaagtgtcgagaggg

SEQ ID NO: 490819 - DNA, 20 bp, mouse
gaaccgcccgcccggaccaa

SEQ ID NO: 490820 - DNA, 20 bp, mouse
ggcttcccgtcccttggtcc

SEQ ID NO: 490821 - DNA, 20 bp, mouse
ggccagcagatccgacgcct

SEQ ID NO: 490822 - DNA, 20 bp, mouse
gtcccgtcccttggtccggg

SEQ ID NO: 490823 - DNA, 20 bp, mouse
gcaaagtgtcgagagggcgg

SEQ ID NO: 490824 - DNA, 20 bp, mouse
gcaagggacgggaagcagcc

SEQ ID NO: 490825 - DNA, 20 bp, mouse
ggcagcgggtcggagatcga

SEQ ID NO: 490826 - DNA, 20 bp, mouse
gacagggaaaggagcacgaa

SEQ ID NO: 490827 - DNA, 20 bp, mouse
gggcccttgcaagcatccag

SEQ ID NO: 490828 - DNA, 20 bp, mouse
gtacccctggatgcttgcaa

SEQ ID NO: 490829 - DNA, 20 bp, mouse
gagagcgtcgagatcccggg

SEQ ID NO: 490830 - DNA, 20 bp, mouse
ggagatgtcacgaccggtgt

SEQ ID NO: 490831 - DNA, 20 bp, mouse
gtgaagctcaggccagtgcg

SEQ ID NO: 490832 - DNA, 20 bp, mouse
ggtctgtcaaatctagcccg

SEQ ID NO: 490833 - DNA, 20 bp, mouse
gtaagcggagatgtcacgac

SEQ ID NO: 490834 - DNA, 20 bp, mouse
gaaggagcacgaacggcctc

SEQ ID NO: 490835 - DNA, 20 bp, mouse
gggttcatctcggctacccc

SEQ ID NO: 490836 - DNA, 20 bp, mouse
ggacttgcaaggctgcaggt

SEQ ID NO: 490837 - DNA, 20 bp, mouse
gctctgggtaacggcgacat

SEQ ID NO: 490838 - DNA, 20 bp, mouse
gtgaaggtgtctctgggtaa

SEQ ID NO: 490839 - DNA, 20 bp, mouse
ggctccggcttctcccatga

SEQ ID NO: 490840 - DNA, 20 bp, mouse
gcccggggccgccgaaccaa

SEQ ID NO: 490841 - DNA, 20 bp, mouse
ggcgtagttccagacttgca

SEQ ID NO: 490842 - DNA, 20 bp, mouse
gtgcagctcgcagcgagctc

SEQ ID NO: 490843 - DNA, 20 bp, mouse
ggacagcccgggaccggagg

SEQ ID NO: 490844 - DNA, 20 bp, mouse
gaaggacgacagcccgggac

SEQ ID NO: 490845 - DNA, 20 bp, mouse
ggacgtcggtgtgcccagag

SEQ ID NO: 490846 - DNA, 20 bp, mouse
gcgcagcatcgagtccaggt

SEQ ID NO: 490847 - DNA, 20 bp, mouse
gagcatcgagtccaggtcgg

SEQ ID NO: 490848 - DNA, 20 bp, mouse
gcgcgcgctacgtcgatgga

SEQ ID NO: 490849 - DNA, 20 bp, mouse
gctacgaggacgtgcaattc

SEQ ID NO: 490850 - DNA, 20 bp, mouse
gcgccaggagccactcgaag

SEQ ID NO: 490851 - DNA, 20 bp, mouse
gcaggaccgcagctactacg

SEQ ID NO: 490852 - DNA, 20 bp, mouse
ggcgctacgtcgatggacgg

SEQ ID NO: 490853 - DNA, 20 bp, mouse
ggccggtagaagtggtccgg

SEQ ID NO: 490854 - DNA, 20 bp, mouse
ggtagcgcagcatcgagtcc

SEQ ID NO: 490855 - DNA, 20 bp, mouse
gatcgagtccaggtcggcgg

SEQ ID NO: 490856 - DNA, 20 bp, mouse
gagagggcgacacagtgacc

SEQ ID NO: 490857 - DNA, 20 bp, mouse
gtaatagagactggtccccg

SEQ ID NO: 490858 - DNA, 20 bp, mouse
gtgtgtcgccctctctcagg

SEQ ID NO: 490859 - DNA, 20 bp, mouse
gccaggacaataatagagac

SEQ ID NO: 490860 - DNA, 20 bp, mouse
gcactgtgtcgccctctctc

SEQ ID NO: 490861 - DNA, 20 bp, mouse
gagactggtccccgtggctt

SEQ ID NO: 490862 - DNA, 20 bp, mouse
gcggaggacgaggcccggag

SEQ ID NO: 490863 - DNA, 20 bp, mouse
ggcagacactgggagcgtga

SEQ ID NO: 490864 - DNA, 20 bp, mouse
ggatttcggcatccagccag

SEQ ID NO: 490865 - DNA, 20 bp, mouse
gcgcttgccggttaagatgg

SEQ ID NO: 490866 - DNA, 20 bp, mouse
gcccgccaaagactaccggg

SEQ ID NO: 490867 - DNA, 20 bp, mouse
gaccaccacccggtagtctt

SEQ ID NO: 490868 - DNA, 20 bp, mouse
ggctgcccagcaccaccacc

SEQ ID NO: 490869 - DNA, 20 bp, mouse
gagcgtggcggtgggtaaga

SEQ ID NO: 490870 - DNA, 20 bp, mouse
ggcccggacaaggggacgcg

SEQ ID NO: 490871 - DNA, 20 bp, mouse
ggccaaagactaccgggtgg

SEQ ID NO: 490872 - DNA, 20 bp, mouse
ggagcgctgcgagccgtcgg

SEQ ID NO: 490873 - DNA, 20 bp, mouse
gcagcttggggaggaccgga

SEQ ID NO: 490874 - DNA, 20 bp, mouse
gcactaagccctccatggcc

SEQ ID NO: 490875 - DNA, 20 bp, mouse
ggacaaggggacgcggggaa

SEQ ID NO: 490876 - DNA, 20 bp, mouse
gaccagggtggggagctaca

SEQ ID NO: 490877 - DNA, 20 bp, mouse
gctgggacatgaaggggcaa

SEQ ID NO: 490878 - DNA, 20 bp, mouse
ggggcaaggggattcctgaa

SEQ ID NO: 490879 - DNA, 20 bp, mouse
ggtgtgatctgggacatgaa

SEQ ID NO: 490880 - DNA, 20 bp, mouse
ggccttgtagctccccaccc

SEQ ID NO: 490881 - DNA, 20 bp, mouse
gtgctgacctggagggccgg

SEQ ID NO: 490882 - DNA, 20 bp, mouse
gcatcattgctggtccaggt

SEQ ID NO: 490883 - DNA, 20 bp, mouse
gaggcagacaacagaagctc

SEQ ID NO: 490884 - DNA, 20 bp, mouse
gtggaggcaggaaatccagg

SEQ ID NO: 490885 - DNA, 20 bp, mouse
gtgggtagggagacctaatg

SEQ ID NO: 490886 - DNA, 20 bp, mouse
ggaggagccggccgcggtaa

SEQ ID NO: 490887 - DNA, 20 bp, mouse
gcaggctcccgcccttaccg

SEQ ID NO: 490888 - DNA, 20 bp, mouse
gagccggccgcggtaagggc

SEQ ID NO: 490889 - DNA, 20 bp, mouse
gtaagggcgggagcctggcg

SEQ ID NO: 490890 - DNA, 20 bp, mouse
gctcccgcccttaccgcggc

SEQ ID NO: 490891 - DNA, 20 bp, mouse
gactgctcgaagtcctcctc

SEQ ID NO: 490892 - DNA, 20 bp, mouse
gcgggagcctggcggggcgt

SEQ ID NO: 490893 - DNA, 20 bp, mouse
gcggggcgtgggcgacggtg

SEQ ID NO: 490894 - DNA, 20 bp, mouse
gcctggcggggcgtgggcga

SEQ ID NO: 490895 - DNA, 20 bp, mouse
gggcgccgccggcaccctgc

SEQ ID NO: 490896 - DNA, 20 bp, mouse
gctgagaagccgccaaggaa

SEQ ID NO: 490897 - DNA, 20 bp, mouse
ggaggaggcccagagagcgg

SEQ ID NO: 490898 - DNA, 20 bp, mouse
gtggcggcttctcagacagg

SEQ ID NO: 490899 - DNA, 20 bp, mouse
gccttggcggcttctcagac

SEQ ID NO: 490900 - DNA, 20 bp, mouse
gaacgcacagggcccggaag

SEQ ID NO: 490901 - DNA, 20 bp, mouse
gcgagggagggtcttctcta

SEQ ID NO: 490902 - DNA, 20 bp, mouse
ggcggagactgtgtagacct

SEQ ID NO: 490903 - DNA, 20 bp, mouse
ggatggagacaggaacgcac

SEQ ID NO: 490904 - DNA, 20 bp, mouse
ggacaggaacgcacagggcc

SEQ ID NO: 490905 - DNA, 20 bp, mouse
ggccgggatggacctaaccg

SEQ ID NO: 490906 - DNA, 20 bp, mouse
gggccacgcagcgatccagg

SEQ ID NO: 490907 - DNA, 20 bp, mouse
ggagcgagcctggccgatga

SEQ ID NO: 490908 - DNA, 20 bp, mouse
ggcggaaccgggccatctga

SEQ ID NO: 490909 - DNA, 20 bp, mouse
ggtgagtgccacgtgcaggg

SEQ ID NO: 490910 - DNA, 20 bp, mouse
ggtccagcgccggcacgaag

SEQ ID NO: 490911 - DNA, 20 bp, mouse
gatcgctgcgtggccttcat

SEQ ID NO: 490912 - DNA, 20 bp, mouse
ggaaccgggccatctgaggg

SEQ ID NO: 490913 - DNA, 20 bp, mouse
ggaaggccacgcagcgatcc

SEQ ID NO: 490914 - DNA, 20 bp, mouse
gagcccgggccgcacttcca

SEQ ID NO: 490915 - DNA, 20 bp, mouse
gtcggccaggctcgctccga

SEQ ID NO: 490916 - DNA, 20 bp, mouse
gcagtacaaatgaacctaat

SEQ ID NO: 490917 - DNA, 20 bp, mouse
gtctttcagtgtgtctgaac

SEQ ID NO: 490918 - DNA, 20 bp, mouse
gttttcatgggtaaaacttt

SEQ ID NO: 490919 - DNA, 20 bp, mouse
gtgtgtctgaactgggcact

SEQ ID NO: 490920 - DNA, 20 bp, mouse
ggtatatattccatgttcaa

SEQ ID NO: 490921 - DNA, 20 bp, mouse
gggaaaaatgatattttcta

SEQ ID NO: 490922 - DNA, 20 bp, mouse
gatgttcaaggggctaaaag

SEQ ID NO: 490923 - DNA, 20 bp, mouse
gctatagcttagtagatgaa

SEQ ID NO: 490924 - DNA, 20 bp, mouse
gatcataattagaagagata

SEQ ID NO: 490925 - DNA, 20 bp, mouse
gtcttcttcttcacttttct

SEQ ID NO: 490926 - DNA, 20 bp, mouse
gatctacagcaagtgctaag

SEQ ID NO: 490927 - DNA, 20 bp, mouse
ggctaaggggcaggccccac

SEQ ID NO: 490928 - DNA, 20 bp, mouse
gccaggagacagccccacgg

SEQ ID NO: 490929 - DNA, 20 bp, mouse
gaggccccacaggcaaaagc

SEQ ID NO: 490930 - DNA, 20 bp, mouse
gtgcccaggagacagcccca

SEQ ID NO: 490931 - DNA, 20 bp, mouse
ggggagcagcggccaccgtg

SEQ ID NO: 490932 - DNA, 20 bp, mouse
ggggtgcaacccaccaggga

SEQ ID NO: 490933 - DNA, 20 bp, mouse
gctaacgtgctgctgtgcgg

SEQ ID NO: 490934 - DNA, 20 bp, mouse
gggtggccgctgctcccgag

SEQ ID NO: 490935 - DNA, 20 bp, mouse
ggtggctgcaccatgctgga

SEQ ID NO: 490936 - DNA, 20 bp, mouse
gtctgggcgtccctatgaag

SEQ ID NO: 490937 - DNA, 20 bp, mouse
gggagaagtggcccggccga

SEQ ID NO: 490938 - DNA, 20 bp, mouse
gggacagttactgcaaggaa

SEQ ID NO: 490939 - DNA, 20 bp, mouse
gccctatgaagaggatcttt

SEQ ID NO: 490940 - DNA, 20 bp, mouse
gctaggcgacggaaaaaagg

SEQ ID NO: 490941 - DNA, 20 bp, mouse
ggcgacggaaaaaaggaggt

SEQ ID NO: 490942 - DNA, 20 bp, mouse
gagagtgcacttgagttcgg

SEQ ID NO: 490943 - DNA, 20 bp, mouse
gggagctttccaaccaggaa

SEQ ID NO: 490944 - DNA, 20 bp, mouse
gaggaggaggcgccctcggc

SEQ ID NO: 490945 - DNA, 20 bp, mouse
gcgttgcttggcgacacagg

SEQ ID NO: 490946 - DNA, 20 bp, mouse
ggcctttcaagaccacatca

SEQ ID NO: 490947 - DNA, 20 bp, mouse
gaagctaaacagtattacca

SEQ ID NO: 490948 - DNA, 20 bp, mouse
gaccatgatgtggtcttgaa

SEQ ID NO: 490949 - DNA, 20 bp, mouse
ggcactttattttcagagaa

SEQ ID NO: 490950 - DNA, 20 bp, mouse
gttctatacttaccatgatg

SEQ ID NO: 490951 - DNA, 20 bp, mouse
gtcaaagtgcattaaagtaa

SEQ ID NO: 490952 - DNA, 20 bp, mouse
ggacctttaagaaaactaac

SEQ ID NO: 490953 - DNA, 20 bp, mouse
gcattttaagtctacagtat

SEQ ID NO: 490954 - DNA, 20 bp, mouse
gtgagaacatgtcatagctg

SEQ ID NO: 490955 - DNA, 20 bp, mouse
gcatgttctcattcatgctt

SEQ ID NO: 490956 - DNA, 20 bp, mouse
gttcagcttcatgccaagac

SEQ ID NO: 490957 - DNA, 20 bp, mouse
ggttgactctggggccatca

SEQ ID NO: 490958 - DNA, 20 bp, mouse
gtggtcaaagtgttgactct

SEQ ID NO: 490959 - DNA, 20 bp, mouse
ggttgagtcctaaggatcaa

SEQ ID NO: 490960 - DNA, 20 bp, mouse
ggtcctaaggatcaaaggct

SEQ ID NO: 490961 - DNA, 20 bp, mouse
gtcggttcaaatggataatt

SEQ ID NO: 490962 - DNA, 20 bp, mouse
gcaagcagagaaagttgttc

SEQ ID NO: 490963 - DNA, 20 bp, mouse
ggtgtgcacgttgagtccta

SEQ ID NO: 490964 - DNA, 20 bp, mouse
gggggccatcaaggcaaaat

SEQ ID NO: 490965 - DNA, 20 bp, mouse
gcagctgtaaaagctgctcg

SEQ ID NO: 490966 - DNA, 20 bp, mouse
gggagacccggccagaaact

SEQ ID NO: 490967 - DNA, 20 bp, mouse
gtgtcaacaggaaggagacc

SEQ ID NO: 490968 - DNA, 20 bp, mouse
gttcaactgttgagacgcag

SEQ ID NO: 490969 - DNA, 20 bp, mouse
gaagtggagggagtagaaca

SEQ ID NO: 490970 - DNA, 20 bp, mouse
gcagtgaccgaggaccacct

SEQ ID NO: 490971 - DNA, 20 bp, mouse
gtataccggagcctctgctg

SEQ ID NO: 490972 - DNA, 20 bp, mouse
gcctcacagcaggtgtcaac

SEQ ID NO: 490973 - DNA, 20 bp, mouse
gacagcaggtgtcaacagga

SEQ ID NO: 490974 - DNA, 20 bp, mouse
gatggcataggagctaggaa

SEQ ID NO: 490975 - DNA, 20 bp, mouse
gcagaggctaccctcacagc

SEQ ID NO: 490976 - DNA, 20 bp, mouse
gtccttaaatgttatgacac

SEQ ID NO: 490977 - DNA, 20 bp, mouse
gggcagagagttcttgcaaa

SEQ ID NO: 490978 - DNA, 20 bp, mouse
gtcttgaatctttcaacgca

SEQ ID NO: 490979 - DNA, 20 bp, mouse
ggtaaattagagctagatta

SEQ ID NO: 490980 - DNA, 20 bp, mouse
gacactggtgagctaaaaat

SEQ ID NO: 490981 - DNA, 20 bp, mouse
gaccagtgtcataacattta

SEQ ID NO: 490982 - DNA, 20 bp, mouse
gtaaaaataatatcacagat

SEQ ID NO: 490983 - DNA, 20 bp, mouse
gcatgaagtaatctattaaa

SEQ ID NO: 490984 - DNA, 20 bp, mouse
gagtcatattgaaaacatga

SEQ ID NO: 490985 - DNA, 20 bp, mouse
gttgaaaacatgaaggagaa

SEQ ID NO: 490986 - DNA, 20 bp, mouse
gggtgcactgaaggattgca

SEQ ID NO: 490987 - DNA, 20 bp, mouse
gtgcggaacccgggaggagg

SEQ ID NO: 490988 - DNA, 20 bp, mouse
gctgaaggattgcagggctt

SEQ ID NO: 490989 - DNA, 20 bp, mouse
ggctccctcccactcaccaa

SEQ ID NO: 490990 - DNA, 20 bp, mouse
ggcaaggaaggcctttggtg

SEQ ID NO: 490991 - DNA, 20 bp, mouse
gcctcccactcaccaagggg

SEQ ID NO: 490992 - DNA, 20 bp, mouse
gggcctttggtgcggaaccc

SEQ ID NO: 490993 - DNA, 20 bp, mouse
gctcccgggttccgcaccaa

SEQ ID NO: 490994 - DNA, 20 bp, mouse
gagacaggactacctactag

SEQ ID NO: 490995 - DNA, 20 bp, mouse
gagcttgcaaggaaggcctt

SEQ ID NO: 490996 - DNA, 20 bp, mouse
gcaccagcagcgccagaaag

SEQ ID NO: 490997 - DNA, 20 bp, mouse
gcagttgggaccgaaaccct

SEQ ID NO: 490998 - DNA, 20 bp, mouse
ggcgccagaaagcggtttca

SEQ ID NO: 490999 - DNA, 20 bp, mouse
gggtgagcgctggttgccga

SEQ ID NO: 491000 - DNA, 20 bp, mouse
ggcggtcatcgcaagcagtg

SEQ ID NO: 491001 - DNA, 20 bp, mouse
gcattccaagctgcacgtgg

SEQ ID NO: 491002 - DNA, 20 bp, mouse
ggtcatcgcaagcagtgcgg

SEQ ID NO: 491003 - DNA, 20 bp, mouse
ggaccttaggcccaacggac

SEQ ID NO: 491004 - DNA, 20 bp, mouse
ggacggcgcaggactgggga

SEQ ID NO: 491005 - DNA, 20 bp, mouse
ggctcaccggggagccccga

SEQ ID NO: 491006 - DNA, 20 bp, mouse
ggacacagcaccgctaactt

SEQ ID NO: 491007 - DNA, 20 bp, mouse
gcggagccgaggtggaccag

SEQ ID NO: 491008 - DNA, 20 bp, mouse
gccgatcgagagcgaggagc

SEQ ID NO: 491009 - DNA, 20 bp, mouse
gtgagcctggatgcaaatct

SEQ ID NO: 491010 - DNA, 20 bp, mouse
gagagatccgatcgagagcg

SEQ ID NO: 491011 - DNA, 20 bp, mouse
gaggcagggagaagccgagt

SEQ ID NO: 491012 - DNA, 20 bp, mouse
gctggatgcaaatctgggtg

SEQ ID NO: 491013 - DNA, 20 bp, mouse
gccgaggtggaccagaggca

SEQ ID NO: 491014 - DNA, 20 bp, mouse
gggaagtgcggttcgcagag

SEQ ID NO: 491015 - DNA, 20 bp, mouse
gaacgtctgcagacgggatg

SEQ ID NO: 491016 - DNA, 20 bp, mouse
gacttcaataacaatccaaa

SEQ ID NO: 491017 - DNA, 20 bp, mouse
gccacaagctgaccaagacc

SEQ ID NO: 491018 - DNA, 20 bp, mouse
ggcactggaagccaggtcta

SEQ ID NO: 491019 - DNA, 20 bp, mouse
gccatcctcggaatgggata

SEQ ID NO: 491020 - DNA, 20 bp, mouse
gatacatacagggaatttaa

SEQ ID NO: 491021 - DNA, 20 bp, mouse
gaaggtgtgtaccctagacc

SEQ ID NO: 491022 - DNA, 20 bp, mouse
gcccattccgaggatggtct

SEQ ID NO: 491023 - DNA, 20 bp, mouse
gaggtatctttcttgccctt

SEQ ID NO: 491024 - DNA, 20 bp, mouse
ggtactaaggactctaacca

SEQ ID NO: 491025 - DNA, 20 bp, mouse
gtgcagcctgacatacatac

SEQ ID NO: 491026 - DNA, 20 bp, mouse
gcggaggtgcgagagcgtca

SEQ ID NO: 491027 - DNA, 20 bp, mouse
ggtgcagcggagggtcgtgg

SEQ ID NO: 491028 - DNA, 20 bp, mouse
gagagcgtcacggcgtgcag

SEQ ID NO: 491029 - DNA, 20 bp, mouse
gcgtcacggcgtgcagcgga

SEQ ID NO: 491030 - DNA, 20 bp, mouse
ggcctcccgcctcagccggt

SEQ ID NO: 491031 - DNA, 20 bp, mouse
gtccggccgaccggctgagg

SEQ ID NO: 491032 - DNA, 20 bp, mouse
gcctggtggccgagaggcag

SEQ ID NO: 491033 - DNA, 20 bp, mouse
ggctctcgcacctccggccg

SEQ ID NO: 491034 - DNA, 20 bp, mouse
ggcagtccacgaagagcgtg

SEQ ID NO: 491035 - DNA, 20 bp, mouse
gctcgaccgcgagcttacca

SEQ ID NO: 491036 - DNA, 20 bp, mouse
gcgggatgagaaggacagtg

SEQ ID NO: 491037 - DNA, 20 bp, mouse
gactgagggaagcaatgacg

SEQ ID NO: 491038 - DNA, 20 bp, mouse
gctcctaccagctaacatgg

SEQ ID NO: 491039 - DNA, 20 bp, mouse
gcagcaaggagttgaaggtg

SEQ ID NO: 491040 - DNA, 20 bp, mouse
gcgagtggcaccaaaactga

SEQ ID NO: 491041 - DNA, 20 bp, mouse
gcgacgatgaaccatccctg

SEQ ID NO: 491042 - DNA, 20 bp, mouse
ggctggtgttctcttcaatg

SEQ ID NO: 491043 - DNA, 20 bp, mouse
ggtccacaggacctggcata

SEQ ID NO: 491044 - DNA, 20 bp, mouse
gccagctaacatggaggcag

SEQ ID NO: 491045 - DNA, 20 bp, mouse
gcctcatggattaggaggta

SEQ ID NO: 491046 - DNA, 20 bp, mouse
gcctcctaccatataaggag

SEQ ID NO: 491047 - DNA, 20 bp, mouse
gagctggagtcaccatggaa

SEQ ID NO: 491048 - DNA, 20 bp, mouse
gcagcggcttctacaaatgt

SEQ ID NO: 491049 - DNA, 20 bp, mouse
gcacagagacgtggagtctg

SEQ ID NO: 491050 - DNA, 20 bp, mouse
gtcctagaatctaaagatag

SEQ ID NO: 491051 - DNA, 20 bp, mouse
gtgggactccaaaagccacg

SEQ ID NO: 491052 - DNA, 20 bp, mouse
gggtgactccagctgccccg

SEQ ID NO: 491053 - DNA, 20 bp, mouse
gcccttcctcctaccatata

SEQ ID NO: 491054 - DNA, 20 bp, mouse
gtgtaggacctgtatgatgg

SEQ ID NO: 491055 - DNA, 20 bp, mouse
gctgcctctccttatatggt

SEQ ID NO: 491056 - DNA, 20 bp, mouse
gggaagcatggttgaatcaa

SEQ ID NO: 491057 - DNA, 20 bp, mouse
gatggttgaatcaagggctc

SEQ ID NO: 491058 - DNA, 20 bp, mouse
ggcagaaatgctgttccagt

SEQ ID NO: 491059 - DNA, 20 bp, mouse
gagcagtacaaagaagagct

SEQ ID NO: 491060 - DNA, 20 bp, mouse
gctagaaacaggtctcgata

SEQ ID NO: 491061 - DNA, 20 bp, mouse
gggaggtagattatccaatg

SEQ ID NO: 491062 - DNA, 20 bp, mouse
gatccaatgaggtacaaccc

SEQ ID NO: 491063 - DNA, 20 bp, mouse
gatcttagaagttagccaac

SEQ ID NO: 491064 - DNA, 20 bp, mouse
gtgctctagaacatttgatg

SEQ ID NO: 491065 - DNA, 20 bp, mouse
gagtcggagtgtcttcctct

SEQ ID NO: 491066 - DNA, 20 bp, mouse
gccagggacagaaagacggt

SEQ ID NO: 491067 - DNA, 20 bp, mouse
ggcctactctgtggagacca

SEQ ID NO: 491068 - DNA, 20 bp, mouse
gtgttccagagtcaatactg

SEQ ID NO: 491069 - DNA, 20 bp, mouse
gtggcccacagtattgactc

SEQ ID NO: 491070 - DNA, 20 bp, mouse
gattgcctatgcctactctg

SEQ ID NO: 491071 - DNA, 20 bp, mouse
ggttaaggcttcaacctagt

SEQ ID NO: 491072 - DNA, 20 bp, mouse
gaaggcttcaacctagtggg

SEQ ID NO: 491073 - DNA, 20 bp, mouse
gatatttaggcacttggtag

SEQ ID NO: 491074 - DNA, 20 bp, mouse
gggcaatgtgattggagcct

SEQ ID NO: 491075 - DNA, 20 bp, mouse
gatgtggaccgtggaacaca

SEQ ID NO: 491076 - DNA, 20 bp, mouse
ggtctaggcaatgcgactca

SEQ ID NO: 491077 - DNA, 20 bp, mouse
gtggcgatggtcctccgtgt

SEQ ID NO: 491078 - DNA, 20 bp, mouse
gcgcattgcctagaccgaca

SEQ ID NO: 491079 - DNA, 20 bp, mouse
gtggtcctccgtgtcggtct

SEQ ID NO: 491080 - DNA, 20 bp, mouse
gctctgcacccggaaaggat

SEQ ID NO: 491081 - DNA, 20 bp, mouse
ggtgggacaggacgattcgg

SEQ ID NO: 491082 - DNA, 20 bp, mouse
gggtccagactgtcctagaa

SEQ ID NO: 491083 - DNA, 20 bp, mouse
gtgggtgggacaggacgatt

SEQ ID NO: 491084 - DNA, 20 bp, mouse
ggcgacatcccgggactgat

SEQ ID NO: 491085 - DNA, 20 bp, mouse
gggtagacggtgcatggcga

SEQ ID NO: 491086 - DNA, 20 bp, mouse
gctggaactttacatatatg

SEQ ID NO: 491087 - DNA, 20 bp, mouse
gagaatataaggaacaatac

SEQ ID NO: 491088 - DNA, 20 bp, mouse
gtcagattgcaagcacccca

SEQ ID NO: 491089 - DNA, 20 bp, mouse
ggcacctcacaggatttatt

SEQ ID NO: 491090 - DNA, 20 bp, mouse
ggggttctgggacctttgat

SEQ ID NO: 491091 - DNA, 20 bp, mouse
gatgccaaataaatcctgtg

SEQ ID NO: 491092 - DNA, 20 bp, mouse
ggttgctgtaaacagttgga

SEQ ID NO: 491093 - DNA, 20 bp, mouse
ggattgttgctgtaaacagt

SEQ ID NO: 491094 - DNA, 20 bp, mouse
ggaggaaatgggtggaatcc

SEQ ID NO: 491095 - DNA, 20 bp, mouse
gagcaatgacatggaggaaa

SEQ ID NO: 491096 - DNA, 20 bp, mouse
ggtcgacgcggaggtgggtg

SEQ ID NO: 491097 - DNA, 20 bp, mouse
ggccatgtcgacgcggaggt

SEQ ID NO: 491098 - DNA, 20 bp, mouse
gtctcagcagcaatgtgtcg

SEQ ID NO: 491099 - DNA, 20 bp, mouse
ggagctccatcctctgtcaa

SEQ ID NO: 491100 - DNA, 20 bp, mouse
gaggctctgccatgtcgacg

SEQ ID NO: 491101 - DNA, 20 bp, mouse
gctctgccatgtcgacgcgg

SEQ ID NO: 491102 - DNA, 20 bp, mouse
ggtggaggatgaaagccagc

SEQ ID NO: 491103 - DNA, 20 bp, mouse
gcccagggagtgacagtaac

SEQ ID NO: 491104 - DNA, 20 bp, mouse
gtcttgtgggcaaggtactc

SEQ ID NO: 491105 - DNA, 20 bp, mouse
gacacacacgaagaccttgg

SEQ ID NO: 491106 - DNA, 20 bp, mouse
ggtataccaataaccaagaa

SEQ ID NO: 491107 - DNA, 20 bp, mouse
gtgctgaagaaaatataatg

SEQ ID NO: 491108 - DNA, 20 bp, mouse
gtggtttgtttagaacgtga

SEQ ID NO: 491109 - DNA, 20 bp, mouse
gaagttctagaagatataaa

SEQ ID NO: 491110 - DNA, 20 bp, mouse
gagcccaggtttaagtacaa

SEQ ID NO: 491111 - DNA, 20 bp, mouse
ggtaatttctgttgtcaaag

SEQ ID NO: 491112 - DNA, 20 bp, mouse
gaccaagaaaggcttgttct

SEQ ID NO: 491113 - DNA, 20 bp, mouse
gcaacagtgtgattaagccc

SEQ ID NO: 491114 - DNA, 20 bp, mouse
gatgtggtctgaagttttaa

SEQ ID NO: 491115 - DNA, 20 bp, mouse
gaccaagaacaagcctttct

SEQ ID NO: 491116 - DNA, 20 bp, mouse
gacatctgctcattaaacac

SEQ ID NO: 491117 - DNA, 20 bp, mouse
gactgtccgagtcctcggtc

SEQ ID NO: 491118 - DNA, 20 bp, mouse
gaaacacccgaccgaggact

SEQ ID NO: 491119 - DNA, 20 bp, mouse
gaaacccaaacacccgaccg

SEQ ID NO: 491120 - DNA, 20 bp, mouse
gagtaaactgtccgagtcct

SEQ ID NO: 491121 - DNA, 20 bp, mouse
ggttaaagcacagtataact

SEQ ID NO: 491122 - DNA, 20 bp, mouse
ggtttcaaggtaagagcctg

SEQ ID NO: 491123 - DNA, 20 bp, mouse
gataatattatacataccac

SEQ ID NO: 491124 - DNA, 20 bp, mouse
gatattgtgtagtattactc

SEQ ID NO: 491125 - DNA, 20 bp, mouse
gaagcacagtataacttggc

SEQ ID NO: 491126 - DNA, 20 bp, mouse
gagcatcgccgccttgaaga

SEQ ID NO: 491127 - DNA, 20 bp, mouse
gggccccctgcccggactga

SEQ ID NO: 491128 - DNA, 20 bp, mouse
gaaatttgcggccccctgcc

SEQ ID NO: 491129 - DNA, 20 bp, mouse
gagggggccgcaaattttct

SEQ ID NO: 491130 - DNA, 20 bp, mouse
gtttcttcctagaaaatttg

SEQ ID NO: 491131 - DNA, 20 bp, mouse
gtggaccaccttcttcaagg

SEQ ID NO: 491132 - DNA, 20 bp, mouse
gcctgcccggactgacgggt

SEQ ID NO: 491133 - DNA, 20 bp, mouse
ggccgggctcaaccacgtga

SEQ ID NO: 491134 - DNA, 20 bp, mouse
gaaccacgtgaaggtttccc

SEQ ID NO: 491135 - DNA, 20 bp, mouse
gctacctctctgaatttcat

SEQ ID NO: 491136 - DNA, 20 bp, mouse
gaacgctggacaccacctca

SEQ ID NO: 491137 - DNA, 20 bp, mouse
gagcaggccatgcaccagta

SEQ ID NO: 491138 - DNA, 20 bp, mouse
gtgatcttagcattcttcac

SEQ ID NO: 491139 - DNA, 20 bp, mouse
gctcatgtgaaagcatatgt

SEQ ID NO: 491140 - DNA, 20 bp, mouse
gtagatctacctgagagaca

SEQ ID NO: 491141 - DNA, 20 bp, mouse
gtcactggaaagtataacgc

SEQ ID NO: 491142 - DNA, 20 bp, mouse
gggccatgcaccagtaaggt

SEQ ID NO: 491143 - DNA, 20 bp, mouse
gaggttggtccttgtctctc

SEQ ID NO: 491144 - DNA, 20 bp, mouse
ggaatatcaaaatgaccatg

SEQ ID NO: 491145 - DNA, 20 bp, mouse
gaggtataaataagtcccag

SEQ ID NO: 491146 - DNA, 20 bp, mouse
gcgcgggcctccccaggcag

SEQ ID NO: 491147 - DNA, 20 bp, mouse
gtcccgaggaccgctgcctg

SEQ ID NO: 491148 - DNA, 20 bp, mouse
gcgaggaccgctgcctgggg

SEQ ID NO: 491149 - DNA, 20 bp, mouse
gtcccggccaggtttccttc

SEQ ID NO: 491150 - DNA, 20 bp, mouse
ggccaggtttccttccggaa

SEQ ID NO: 491151 - DNA, 20 bp, mouse
gttccttccggaaggggtcc

SEQ ID NO: 491152 - DNA, 20 bp, mouse
gatcccggaccccttccgga

SEQ ID NO: 491153 - DNA, 20 bp, mouse
gccccttccggaaggaaacc

SEQ ID NO: 491154 - DNA, 20 bp, mouse
gcctgcgctctgtaggtcag

SEQ ID NO: 491155 - DNA, 20 bp, mouse
gcagcctgggaggaaatggt

SEQ ID NO: 491156 - DNA, 20 bp, mouse
gagctcctccagagaggata

SEQ ID NO: 491157 - DNA, 20 bp, mouse
gggcctcttggaacagtggt

SEQ ID NO: 491158 - DNA, 20 bp, mouse
gtggccccacagggagatcg

SEQ ID NO: 491159 - DNA, 20 bp, mouse
ggctggcagctcctccagag

SEQ ID NO: 491160 - DNA, 20 bp, mouse
gccacagggagatcgtggaa

SEQ ID NO: 491161 - DNA, 20 bp, mouse
ggtggtgggaagaccacagc

SEQ ID NO: 491162 - DNA, 20 bp, mouse
gagactcaacaagctcataa

SEQ ID NO: 491163 - DNA, 20 bp, mouse
gaacaagctcataaaggcaa

SEQ ID NO: 491164 - DNA, 20 bp, mouse
gcttggatattgcttaccag

SEQ ID NO: 491165 - DNA, 20 bp, mouse
gttggccatatcctctctgg

SEQ ID NO: 491166 - DNA, 20 bp, mouse
ggcagcagagccagcgccag

SEQ ID NO: 491167 - DNA, 20 bp, mouse
gctggatgcaaggatgacgg

SEQ ID NO: 491168 - DNA, 20 bp, mouse
gcccctggatgcaaggatga

SEQ ID NO: 491169 - DNA, 20 bp, mouse
gggccaggcactgctaacct

SEQ ID NO: 491170 - DNA, 20 bp, mouse
ggaagtgtcccggaaaccac

SEQ ID NO: 491171 - DNA, 20 bp, mouse
gtgcaggaatggcgagctcg

SEQ ID NO: 491172 - DNA, 20 bp, mouse
gtggctgctgcccctggcgc

SEQ ID NO: 491173 - DNA, 20 bp, mouse
gtggcaccacgactcctaaa

SEQ ID NO: 491174 - DNA, 20 bp, mouse
gccctccaccagcctacccc

SEQ ID NO: 491175 - DNA, 20 bp, mouse
gcagcctacccctggatgca

SEQ ID NO: 491176 - DNA, 20 bp, mouse
gagaagataatgattgctac

SEQ ID NO: 491177 - DNA, 20 bp, mouse
ggacagcttattataagatc

SEQ ID NO: 491178 - DNA, 20 bp, mouse
gtcccttgaggcatgggttt

SEQ ID NO: 491179 - DNA, 20 bp, mouse
gtgagacccagcactaggca

SEQ ID NO: 491180 - DNA, 20 bp, mouse
gcaacatgagaagacaaagt

SEQ ID NO: 491181 - DNA, 20 bp, mouse
gtaataggagccctcccttg

SEQ ID NO: 491182 - DNA, 20 bp, mouse
ggagaagacaaagttggata

SEQ ID NO: 491183 - DNA, 20 bp, mouse
ggaattcagtgttcatcctg

SEQ ID NO: 491184 - DNA, 20 bp, mouse
gacagctgagacccagcact

SEQ ID NO: 491185 - DNA, 20 bp, mouse
gtaggaaacctgagtctaag

SEQ ID NO: 491186 - DNA, 20 bp, mouse
gaacgctggacaccacctca

SEQ ID NO: 491187 - DNA, 20 bp, mouse
gagcaggccatgcaccagta

SEQ ID NO: 491188 - DNA, 20 bp, mouse
gtgatcttagcattcttcac

SEQ ID NO: 491189 - DNA, 20 bp, mouse
gctcatgtgaaagcatatgt

SEQ ID NO: 491190 - DNA, 20 bp, mouse
gtagatctacctgagagaca

SEQ ID NO: 491191 - DNA, 20 bp, mouse
gtcactggaaagtataacgc

SEQ ID NO: 491192 - DNA, 20 bp, mouse
gggccatgcaccagtaaggt

SEQ ID NO: 491193 - DNA, 20 bp, mouse
gaggttggtccttgtctctc

SEQ ID NO: 491194 - DNA, 20 bp, mouse
ggaatatcaaaatgaccatg

SEQ ID NO: 491195 - DNA, 20 bp, mouse
gaggtataaataagtcccag

SEQ ID NO: 491196 - DNA, 20 bp, mouse
ggcttagaggggcaaaccac

SEQ ID NO: 491197 - DNA, 20 bp, mouse
gcagtgctaaaagcttagag

SEQ ID NO: 491198 - DNA, 20 bp, mouse
ggctttatcagaagagacgt

SEQ ID NO: 491199 - DNA, 20 bp, mouse
ggaaagcgtccagtgtaccg

SEQ ID NO: 491200 - DNA, 20 bp, mouse
gctgagaatactgaagaggg

SEQ ID NO: 491201 - DNA, 20 bp, mouse
gagaagagacgtgggactca

SEQ ID NO: 491202 - DNA, 20 bp, mouse
gctgtcttcagcatcctcac

SEQ ID NO: 491203 - DNA, 20 bp, mouse
gctgcagccagactttggac

SEQ ID NO: 491204 - DNA, 20 bp, mouse
gtggctgagaatactgaaga

SEQ ID NO: 491205 - DNA, 20 bp, mouse
gttccactgcagccagactt

SEQ ID NO: 491206 - DNA, 20 bp, mouse
gtatatacgccaagttcctc

SEQ ID NO: 491207 - DNA, 20 bp, mouse
gcgcaggttcccgaggaact

SEQ ID NO: 491208 - DNA, 20 bp, mouse
gctcagaacacgacaggtgt

SEQ ID NO: 491209 - DNA, 20 bp, mouse
gtggcgtatataagtggcta

SEQ ID NO: 491210 - DNA, 20 bp, mouse
gggaacttggcgtatataag

SEQ ID NO: 491211 - DNA, 20 bp, mouse
ggaggggtgggcgcgggcgt

SEQ ID NO: 491212 - DNA, 20 bp, mouse
gtcggcctctggatccagag

SEQ ID NO: 491213 - DNA, 20 bp, mouse
gtccggaatggaacatggcc

SEQ ID NO: 491214 - DNA, 20 bp, mouse
gccgcttccggaatggaaca

SEQ ID NO: 491215 - DNA, 20 bp, mouse
ggtcagcgggtgctgccagg

SEQ ID NO: 491216 - DNA, 20 bp, mouse
gcccggaagccggggaagag

SEQ ID NO: 491217 - DNA, 20 bp, mouse
ggaggcacgtgagtcatcag

SEQ ID NO: 491218 - DNA, 20 bp, mouse
gtcagatgccgcggagcaca

SEQ ID NO: 491219 - DNA, 20 bp, mouse
ggcgcgagccctgtgctccg

SEQ ID NO: 491220 - DNA, 20 bp, mouse
gccgttgggcagttacacgg

SEQ ID NO: 491221 - DNA, 20 bp, mouse
ggggccgttgggcagttaca

SEQ ID NO: 491222 - DNA, 20 bp, mouse
gagccgcgtcccggaagccg

SEQ ID NO: 491223 - DNA, 20 bp, mouse
ggcatctgagcagggccgtt

SEQ ID NO: 491224 - DNA, 20 bp, mouse
gtccgggacgcggctgcacg

SEQ ID NO: 491225 - DNA, 20 bp, mouse
gtcgagaaggagtcagtgag

SEQ ID NO: 491226 - DNA, 20 bp, mouse
gacagtgcttagacacttga

SEQ ID NO: 491227 - DNA, 20 bp, mouse
gtctacgcatagagctatta

SEQ ID NO: 491228 - DNA, 20 bp, mouse
ggccggaagcgatggaggta

SEQ ID NO: 491229 - DNA, 20 bp, mouse
ggctgcgggcctgccaggac

SEQ ID NO: 491230 - DNA, 20 bp, mouse
gctgttccaggagcccgtcc

SEQ ID NO: 491231 - DNA, 20 bp, mouse
gcccgagccggaagcgatgg

SEQ ID NO: 491232 - DNA, 20 bp, mouse
ggaacagcaactcagaataa

SEQ ID NO: 491233 - DNA, 20 bp, mouse
ggcaactcagaataagggat

SEQ ID NO: 491234 - DNA, 20 bp, mouse
gcgacccgagccggaagcga

SEQ ID NO: 491235 - DNA, 20 bp, mouse
ggcccagaagcaccgagtta

SEQ ID NO: 491236 - DNA, 20 bp, mouse
gacacatccatggaacggga

SEQ ID NO: 491237 - DNA, 20 bp, mouse
gctagcacacatccatggaa

SEQ ID NO: 491238 - DNA, 20 bp, mouse
gacaatggggaaatactgat

SEQ ID NO: 491239 - DNA, 20 bp, mouse
gaaagtctagcacacatcca

SEQ ID NO: 491240 - DNA, 20 bp, mouse
ggggataagagataatgaac

SEQ ID NO: 491241 - DNA, 20 bp, mouse
gatctctccatcccgttcca

SEQ ID NO: 491242 - DNA, 20 bp, mouse
gtccccattgttgttgtctt

SEQ ID NO: 491243 - DNA, 20 bp, mouse
gtgaggttactgttataacc

SEQ ID NO: 491244 - DNA, 20 bp, mouse
gtaaaagaggtcctcattaa

SEQ ID NO: 491245 - DNA, 20 bp, mouse
gcagcactcaagaaataaga

SEQ ID NO: 491246 - DNA, 20 bp, mouse
ggtataaactcactagaggt

SEQ ID NO: 491247 - DNA, 20 bp, mouse
gtatggtataaactcactag

SEQ ID NO: 491248 - DNA, 20 bp, mouse
gtactaaaattgcatttgta

SEQ ID NO: 491249 - DNA, 20 bp, mouse
gtacaactacttgataattc

SEQ ID NO: 491250 - DNA, 20 bp, mouse
gccgttgggcagttacacgg

SEQ ID NO: 491251 - DNA, 20 bp, mouse
ggggccgttgggcagttaca

SEQ ID NO: 491252 - DNA, 20 bp, mouse
gtgagccgatcaagatggag

SEQ ID NO: 491253 - DNA, 20 bp, mouse
gcccggtgagccgatcaaga

SEQ ID NO: 491254 - DNA, 20 bp, mouse
ggcagttacacggcggaggg

SEQ ID NO: 491255 - DNA, 20 bp, mouse
gttacacggcggagggcgga

SEQ ID NO: 491256 - DNA, 20 bp, mouse
ggtataaactcactagaggt

SEQ ID NO: 491257 - DNA, 20 bp, mouse
gtatggtataaactcactag

SEQ ID NO: 491258 - DNA, 20 bp, mouse
gtactaaaattgcatttgta

SEQ ID NO: 491259 - DNA, 20 bp, mouse
gtacaactacttgataattc

SEQ ID NO: 491260 - DNA, 20 bp, mouse
ggtaaatattaatgtgcata

SEQ ID NO: 491261 - DNA, 20 bp, mouse
gccgttgggcagttacacgg

SEQ ID NO: 491262 - DNA, 20 bp, mouse
gtgagccgatcaagatggag

SEQ ID NO: 491263 - DNA, 20 bp, mouse
ggggccgttgggcagttaca

SEQ ID NO: 491264 - DNA, 20 bp, mouse
gcccggtgagccgatcaaga

SEQ ID NO: 491265 - DNA, 20 bp, mouse
ggcagttacacggcggaggg

SEQ ID NO: 491266 - DNA, 20 bp, mouse
gacctatcaggagtgacaac

SEQ ID NO: 491267 - DNA, 20 bp, mouse
gggtattgtggatgttactt

SEQ ID NO: 491268 - DNA, 20 bp, mouse
gcaacgcctgccttagggaa

SEQ ID NO: 491269 - DNA, 20 bp, mouse
ggaaatggccagataccaac

SEQ ID NO: 491270 - DNA, 20 bp, mouse
gcagttccacattacaggaa

SEQ ID NO: 491271 - DNA, 20 bp, mouse
gagtacttttccattcccta

SEQ ID NO: 491272 - DNA, 20 bp, mouse
gctcctgagtcggacacaca

SEQ ID NO: 491273 - DNA, 20 bp, mouse
ggaccatgtgtgtccgactc

SEQ ID NO: 491274 - DNA, 20 bp, mouse
gtaacatccacaatacccag

SEQ ID NO: 491275 - DNA, 20 bp, mouse
gcacatggtcatctctgaaa

SEQ ID NO: 491276 - DNA, 20 bp, mouse
gcactctgaatgtgcctgga

SEQ ID NO: 491277 - DNA, 20 bp, mouse
ggccacaaggaggacagtgt

SEQ ID NO: 491278 - DNA, 20 bp, mouse
ggctctgtctcacaactgtg

SEQ ID NO: 491279 - DNA, 20 bp, mouse
ggcgtatgtcagggatccac

SEQ ID NO: 491280 - DNA, 20 bp, mouse
ggtccatcctgagactccag

SEQ ID NO: 491281 - DNA, 20 bp, mouse
ggcggtgatagtagctaaat

SEQ ID NO: 491282 - DNA, 20 bp, mouse
gggacaactggtgatacagt

SEQ ID NO: 491283 - DNA, 20 bp, mouse
gccttctcaagggcagtcat

SEQ ID NO: 491284 - DNA, 20 bp, mouse
gaccagagcaggtgctcaca

SEQ ID NO: 491285 - DNA, 20 bp, mouse
gaggacagtgtgggctactt

SEQ ID NO: 491286 - DNA, 20 bp, mouse
gtggagtgttgcagttaatt

SEQ ID NO: 491287 - DNA, 20 bp, mouse
ggaggctggagtaccttagg

SEQ ID NO: 491288 - DNA, 20 bp, mouse
ggagagctggcagtgttgca

SEQ ID NO: 491289 - DNA, 20 bp, mouse
gtaggaggctggagtacctt

SEQ ID NO: 491290 - DNA, 20 bp, mouse
gtggcagtgttgcagggtag

SEQ ID NO: 491291 - DNA, 20 bp, mouse
ggtatgcactgtaccaccta

SEQ ID NO: 491292 - DNA, 20 bp, mouse
gtataaagaatagagtaacg

SEQ ID NO: 491293 - DNA, 20 bp, mouse
gtctgaaagaggaatgtagg

SEQ ID NO: 491294 - DNA, 20 bp, mouse
gaatagagtaacggggaact

SEQ ID NO: 491295 - DNA, 20 bp, mouse
gtcccaccacacctggtata

SEQ ID NO: 491296 - DNA, 20 bp, mouse
gtgcgactgagtctcaagat

SEQ ID NO: 491297 - DNA, 20 bp, mouse
gggctggaagctgcgatctg

SEQ ID NO: 491298 - DNA, 20 bp, mouse
ggatcgctagcaatgcccta

SEQ ID NO: 491299 - DNA, 20 bp, mouse
gcagcttgcttgcaacggag

SEQ ID NO: 491300 - DNA, 20 bp, mouse
gtctttcagcttgcttgcaa

SEQ ID NO: 491301 - DNA, 20 bp, mouse
gggctaagtagctggagtgg

SEQ ID NO: 491302 - DNA, 20 bp, mouse
gggatacaggggaccagccc

SEQ ID NO: 491303 - DNA, 20 bp, mouse
ggaccagccctggccgttct

SEQ ID NO: 491304 - DNA, 20 bp, mouse
ggggggctaagtagctggag

SEQ ID NO: 491305 - DNA, 20 bp, mouse
gggagaggaacagagagcag

SEQ ID NO: 491306 - DNA, 20 bp, mouse
ggacacctactcctcaccgt

SEQ ID NO: 491307 - DNA, 20 bp, mouse
gacgccttccacggttccgg

SEQ ID NO: 491308 - DNA, 20 bp, mouse
gcgcagtgtcacgctcccca

SEQ ID NO: 491309 - DNA, 20 bp, mouse
ggctccccacggtgaggagt

SEQ ID NO: 491310 - DNA, 20 bp, mouse
gtcgcccccggaaccgtgga

SEQ ID NO: 491311 - DNA, 20 bp, mouse
gttcctgccacaggacccta

SEQ ID NO: 491312 - DNA, 20 bp, mouse
ggtgaggagtaggtgtcccg

SEQ ID NO: 491313 - DNA, 20 bp, mouse
gcacggttccgggggcgagg

SEQ ID NO: 491314 - DNA, 20 bp, mouse
gtttcggcccacgccttcca

SEQ ID NO: 491315 - DNA, 20 bp, mouse
ggcggagcttcgggacctgg

SEQ ID NO: 491316 - DNA, 20 bp, mouse
ggctttaagatgggtctcag

SEQ ID NO: 491317 - DNA, 20 bp, mouse
ggcctcaggaacaaccatcc

SEQ ID NO: 491318 - DNA, 20 bp, mouse
gtccaggatggttgttcctg

SEQ ID NO: 491319 - DNA, 20 bp, mouse
gggatgaccctcctcacagt

SEQ ID NO: 491320 - DNA, 20 bp, mouse
gccttcacgggctgaagtgg

SEQ ID NO: 491321 - DNA, 20 bp, mouse
gtcacccacccggccttcta

SEQ ID NO: 491322 - DNA, 20 bp, mouse
ggggccctagaaggccgggt

SEQ ID NO: 491323 - DNA, 20 bp, mouse
gaggaaatgaagcaatgagt

SEQ ID NO: 491324 - DNA, 20 bp, mouse
gtgaggagcgcgagaagaaa

SEQ ID NO: 491325 - DNA, 20 bp, mouse
gggtctcagtggtcgccgtg

SEQ ID NO: 491326 - DNA, 20 bp, mouse
gatagtcagctccaaagtca

SEQ ID NO: 491327 - DNA, 20 bp, mouse
gtcatggttagcacatacgt

SEQ ID NO: 491328 - DNA, 20 bp, mouse
gaaatggacagggctgtgta

SEQ ID NO: 491329 - DNA, 20 bp, mouse
ggtgctaaccatgagcactc

SEQ ID NO: 491330 - DNA, 20 bp, mouse
ggcggaagggccatagttgt

SEQ ID NO: 491331 - DNA, 20 bp, mouse
gatatgaagaggaaaattgc

SEQ ID NO: 491332 - DNA, 20 bp, mouse
gtggctgtgtgcttcaaccg

SEQ ID NO: 491333 - DNA, 20 bp, mouse
gctttttaaatccatgactt

SEQ ID NO: 491334 - DNA, 20 bp, mouse
gacagccacgcaagctatga

SEQ ID NO: 491335 - DNA, 20 bp, mouse
gggtttggggttccagaact

SEQ ID NO: 491336 - DNA, 20 bp, mouse
gaagatgaaggacagattag

SEQ ID NO: 491337 - DNA, 20 bp, mouse
gagaagagtctcttcggagt

SEQ ID NO: 491338 - DNA, 20 bp, mouse
gtgtgttgtaccacagagga

SEQ ID NO: 491339 - DNA, 20 bp, mouse
gagtctcacaggcatagtgg

SEQ ID NO: 491340 - DNA, 20 bp, mouse
ggcatggttgtcaaacatca

SEQ ID NO: 491341 - DNA, 20 bp, mouse
ggtcctgtgttgtaccacag

SEQ ID NO: 491342 - DNA, 20 bp, mouse
ggagctggctctgacgaatg

SEQ ID NO: 491343 - DNA, 20 bp, mouse
gttgaacacaccctcctctg

SEQ ID NO: 491344 - DNA, 20 bp, mouse
ggtggtggctgatgatgcca

SEQ ID NO: 491345 - DNA, 20 bp, mouse
gacagactgtaagtactgga

SEQ ID NO: 491346 - DNA, 20 bp, mouse
ggtaagcttgatacctggaa

SEQ ID NO: 491347 - DNA, 20 bp, mouse
gccagactggacaaagctgg

SEQ ID NO: 491348 - DNA, 20 bp, mouse
gctggtagttcatcctttcc

SEQ ID NO: 491349 - DNA, 20 bp, mouse
gtagaataatcaaaagtcaa

SEQ ID NO: 491350 - DNA, 20 bp, mouse
gaaaaagtaagcttgatacc

SEQ ID NO: 491351 - DNA, 20 bp, mouse
ggatatcctctactttccat

SEQ ID NO: 491352 - DNA, 20 bp, mouse
ggaaagtagaggatatcttt

SEQ ID NO: 491353 - DNA, 20 bp, mouse
gggtttctgaatctacatga

SEQ ID NO: 491354 - DNA, 20 bp, mouse
gtttaactgagtaattatat

SEQ ID NO: 491355 - DNA, 20 bp, mouse
gctttccatgggaatttact

SEQ ID NO: 491356 - DNA, 20 bp, mouse
ggaactgctgctcagagtgc

SEQ ID NO: 491357 - DNA, 20 bp, mouse
gtctggcatgagctacctca

SEQ ID NO: 491358 - DNA, 20 bp, mouse
gagatcgacgaaataatgtt

SEQ ID NO: 491359 - DNA, 20 bp, mouse
gactctgagcagcagttcta

SEQ ID NO: 491360 - DNA, 20 bp, mouse
gggtcattgaggacagaact

SEQ ID NO: 491361 - DNA, 20 bp, mouse
gtcatgaaggtgaacatcta

SEQ ID NO: 491362 - DNA, 20 bp, mouse
gcctgcaacaaggaaggccc

SEQ ID NO: 491363 - DNA, 20 bp, mouse
gagcagttctaaggtcattg

SEQ ID NO: 491364 - DNA, 20 bp, mouse
gaaacccagaaggtctggac

SEQ ID NO: 491365 - DNA, 20 bp, mouse
ggatgttcaccttcatgaga

SEQ ID NO: 491366 - DNA, 20 bp, mouse
gctagagagcgaatccatcc

SEQ ID NO: 491367 - DNA, 20 bp, mouse
ggcagagatgggcatgcgac

SEQ ID NO: 491368 - DNA, 20 bp, mouse
gatttggggctggcagagat

SEQ ID NO: 491369 - DNA, 20 bp, mouse
ggccagccccaaatgcaaaa

SEQ ID NO: 491370 - DNA, 20 bp, mouse
gggatgtgtgtcaggcgcaa

SEQ ID NO: 491371 - DNA, 20 bp, mouse
gatggattcgctctctaggt

SEQ ID NO: 491372 - DNA, 20 bp, mouse
gagaagctggctgtttttta

SEQ ID NO: 491373 - DNA, 20 bp, mouse
gcttctgagaaattcctgga

SEQ ID NO: 491374 - DNA, 20 bp, mouse
gcatcctgtactgcagaagc

SEQ ID NO: 491375 - DNA, 20 bp, mouse
gagctggctgttttttaggg

SEQ ID NO: 491376 - DNA, 20 bp, mouse
ggggcccaggaagtacaacc

SEQ ID NO: 491377 - DNA, 20 bp, mouse
ggtacaaccaggctccttgg

SEQ ID NO: 491378 - DNA, 20 bp, mouse
gcatggccaatgcaccccca

SEQ ID NO: 491379 - DNA, 20 bp, mouse
gtacttcctgggcccccctg

SEQ ID NO: 491380 - DNA, 20 bp, mouse
gatggcccgaacgcctgcaa

SEQ ID NO: 491381 - DNA, 20 bp, mouse
gtctggaaccaagagaccag

SEQ ID NO: 491382 - DNA, 20 bp, mouse
gaaaagcccctcccccaggg

SEQ ID NO: 491383 - DNA, 20 bp, mouse
gagagtcgtgccgagaacga

SEQ ID NO: 491384 - DNA, 20 bp, mouse
gtggccatggccctcgttct

SEQ ID NO: 491385 - DNA, 20 bp, mouse
gctgctgccagcggtacaga

SEQ ID NO: 491386 - DNA, 20 bp, mouse
gggcttccgcgcctggtgcc

SEQ ID NO: 491387 - DNA, 20 bp, mouse
gtgtggagtcatgtgactca

SEQ ID NO: 491388 - DNA, 20 bp, mouse
ggcagagtctgtggcggctg

SEQ ID NO: 491389 - DNA, 20 bp, mouse
ggcggaggacactgggtacc

SEQ ID NO: 491390 - DNA, 20 bp, mouse
gcggcatcgccagggctcca

SEQ ID NO: 491391 - DNA, 20 bp, mouse
gccagggctccagggcgcca

SEQ ID NO: 491392 - DNA, 20 bp, mouse
ggtgtcggaattcgtggccg

SEQ ID NO: 491393 - DNA, 20 bp, mouse
ggaggactacatggcaccca

SEQ ID NO: 491394 - DNA, 20 bp, mouse
gatgtagtcctcaagggcct

SEQ ID NO: 491395 - DNA, 20 bp, mouse
gggcgggaggctagagccgc

SEQ ID NO: 491396 - DNA, 20 bp, mouse
gatctcgctgcctttacctt

SEQ ID NO: 491397 - DNA, 20 bp, mouse
gtctggttataggaagttct

SEQ ID NO: 491398 - DNA, 20 bp, mouse
ggttctgtagaaaacgatcc

SEQ ID NO: 491399 - DNA, 20 bp, mouse
gggatttgggttctggttat

SEQ ID NO: 491400 - DNA, 20 bp, mouse
gtcaacatgaagcgcacaag

SEQ ID NO: 491401 - DNA, 20 bp, mouse
ggaaagaatcatcgttctaa

SEQ ID NO: 491402 - DNA, 20 bp, mouse
ggcacgtccctcttgctttt

SEQ ID NO: 491403 - DNA, 20 bp, mouse
gcctatgtctcccaaggtaa

SEQ ID NO: 491404 - DNA, 20 bp, mouse
gggaaggaggctggcaggga

SEQ ID NO: 491405 - DNA, 20 bp, mouse
gtgcggattgatataagctg

SEQ ID NO: 491406 - DNA, 20 bp, mouse
gtgctctagagagtaattgg

SEQ ID NO: 491407 - DNA, 20 bp, mouse
gtccaggttgctagaaccta

SEQ ID NO: 491408 - DNA, 20 bp, mouse
gtgttgctctagagagtaat

SEQ ID NO: 491409 - DNA, 20 bp, mouse
gtctagagagtaattggagg

SEQ ID NO: 491410 - DNA, 20 bp, mouse
gcaggacctacaaaaaaaga

SEQ ID NO: 491411 - DNA, 20 bp, mouse
gtgattgggaccatcatgga

SEQ ID NO: 491412 - DNA, 20 bp, mouse
gtcagttcttggaagtgtca

SEQ ID NO: 491413 - DNA, 20 bp, mouse
gcacatgattgggaccatca

SEQ ID NO: 491414 - DNA, 20 bp, mouse
gtctcacccatacaaacaaa

SEQ ID NO: 491415 - DNA, 20 bp, mouse
gtgaaacgtatggacattcg

SEQ ID NO: 491416 - DNA, 20 bp, mouse
ggttattattagttgtgagt

SEQ ID NO: 491417 - DNA, 20 bp, mouse
gtgtgtagaaatgctaggta

SEQ ID NO: 491418 - DNA, 20 bp, mouse
gtagcgctgaaactggtgta

SEQ ID NO: 491419 - DNA, 20 bp, mouse
gagtgtagtagcgctgaaac

SEQ ID NO: 491420 - DNA, 20 bp, mouse
gtcggaagcctcgccctcac

SEQ ID NO: 491421 - DNA, 20 bp, mouse
gacagatgtgtagaaatgct

SEQ ID NO: 491422 - DNA, 20 bp, mouse
gatatatttttagcaataga

SEQ ID NO: 491423 - DNA, 20 bp, mouse
gtggcattcctgtgagggcg

SEQ ID NO: 491424 - DNA, 20 bp, mouse
ggatttttttgatgtcgttt

SEQ ID NO: 491425 - DNA, 20 bp, mouse
ggatgtcttgttcgtctgcc

SEQ ID NO: 491426 - DNA, 20 bp, mouse
gaaggtcggtatcccagtgt

SEQ ID NO: 491427 - DNA, 20 bp, mouse
gacttgaaagagcattaaag

SEQ ID NO: 491428 - DNA, 20 bp, mouse
gcattaaagaggcatatcca

SEQ ID NO: 491429 - DNA, 20 bp, mouse
gaaagaggcatatccaaggt

SEQ ID NO: 491430 - DNA, 20 bp, mouse
gtgtctaggctgtcctacac

SEQ ID NO: 491431 - DNA, 20 bp, mouse
ggatgttgaagcacatacat

SEQ ID NO: 491432 - DNA, 20 bp, mouse
gataggatagagatatgatt

SEQ ID NO: 491433 - DNA, 20 bp, mouse
ggccatcaagcagatgataa

SEQ ID NO: 491434 - DNA, 20 bp, mouse
ggttgaagcacatacatcgg

SEQ ID NO: 491435 - DNA, 20 bp, mouse
gagaagataagtgcacaatg

SEQ ID NO: 491436 - DNA, 20 bp, mouse
gagcctcctggaacgacatt

SEQ ID NO: 491437 - DNA, 20 bp, mouse
gctccaaatgtcgttccagg

SEQ ID NO: 491438 - DNA, 20 bp, mouse
ggaactccaaatgtcgttcc

SEQ ID NO: 491439 - DNA, 20 bp, mouse
gcaaatcgcttatcaaataa

SEQ ID NO: 491440 - DNA, 20 bp, mouse
ggaagagctgcaagaatctg

SEQ ID NO: 491441 - DNA, 20 bp, mouse
gctcttcaggaaagacttga

SEQ ID NO: 491442 - DNA, 20 bp, mouse
gtctgaacttgatcaagatt

SEQ ID NO: 491443 - DNA, 20 bp, mouse
gtacattgaaagcttgccta

SEQ ID NO: 491444 - DNA, 20 bp, mouse
gcaggaaagacttgatggtc

SEQ ID NO: 491445 - DNA, 20 bp, mouse
gtattctttgttgtcaatgt

SEQ ID NO: 491446 - DNA, 20 bp, mouse
ggatgaaccaggatctgatg

SEQ ID NO: 491447 - DNA, 20 bp, mouse
gcactcagcgtgacagaatg

SEQ ID NO: 491448 - DNA, 20 bp, mouse
gttatttatgcgctactaca

SEQ ID NO: 491449 - DNA, 20 bp, mouse
gctgggtatcaaagcagaga

SEQ ID NO: 491450 - DNA, 20 bp, mouse
gggcgtctgtctatgggaga

SEQ ID NO: 491451 - DNA, 20 bp, mouse
gcagaatgagggggtacaga

SEQ ID NO: 491452 - DNA, 20 bp, mouse
gggggcaggcgtctgtctat

SEQ ID NO: 491453 - DNA, 20 bp, mouse
gcttttcaacttctttgtgg

SEQ ID NO: 491454 - DNA, 20 bp, mouse
gtgacttttcaacttctttg

SEQ ID NO: 491455 - DNA, 20 bp, mouse
gtcaacttctttgtgggggc

SEQ ID NO: 491456 - DNA, 20 bp, mouse
gtgttacttcctatttgact

SEQ ID NO: 491457 - DNA, 20 bp, mouse
gaaaacatgcttgattactg

SEQ ID NO: 491458 - DNA, 20 bp, mouse
gcataacaacctagtcaaat

SEQ ID NO: 491459 - DNA, 20 bp, mouse
ggtaatcaagcatgttttgt

SEQ ID NO: 491460 - DNA, 20 bp, mouse
gtagcaacacatcatatcga

SEQ ID NO: 491461 - DNA, 20 bp, mouse
gaagcaccagaacctgcaac

SEQ ID NO: 491462 - DNA, 20 bp, mouse
gcagctcctgttgcaggttc

SEQ ID NO: 491463 - DNA, 20 bp, mouse
gtatttcctggtccaccaag

SEQ ID NO: 491464 - DNA, 20 bp, mouse
gtgaagtatataggaaatta

SEQ ID NO: 491465 - DNA, 20 bp, mouse
gtgaattgtaaataaaacct

SEQ ID NO: 491466 - DNA, 20 bp, mouse
gttggttcagatcccaacgt

SEQ ID NO: 491467 - DNA, 20 bp, mouse
gagatcccaacgtgggcgcc

SEQ ID NO: 491468 - DNA, 20 bp, mouse
ggagatcacctttactagca

SEQ ID NO: 491469 - DNA, 20 bp, mouse
ggggagccccctgctagtaa

SEQ ID NO: 491470 - DNA, 20 bp, mouse
gatcgaggttgcggagtcac

SEQ ID NO: 491471 - DNA, 20 bp, mouse
gggcccttcagtaggagtaa

SEQ ID NO: 491472 - DNA, 20 bp, mouse
gaagggccactaattgatcg

SEQ ID NO: 491473 - DNA, 20 bp, mouse
gcaattagtggcccttcagt

SEQ ID NO: 491474 - DNA, 20 bp, mouse
gtaggtgaacccaacatcat

SEQ ID NO: 491475 - DNA, 20 bp, mouse
gaaaaatccaggcaagaact

SEQ ID NO: 491476 - DNA, 20 bp, mouse
gcctaggggcctcaggacca

SEQ ID NO: 491477 - DNA, 20 bp, mouse
gtcaggacagcaactcctag

SEQ ID NO: 491478 - DNA, 20 bp, mouse
ggtgtctgctactgctagtt

SEQ ID NO: 491479 - DNA, 20 bp, mouse
gagcaactcctaggggcctc

SEQ ID NO: 491480 - DNA, 20 bp, mouse
gttgctcttgctgggttcag

SEQ ID NO: 491481 - DNA, 20 bp, mouse
gttactgggagtctttatat

SEQ ID NO: 491482 - DNA, 20 bp, mouse
gcaggggagcaccatgaatt

SEQ ID NO: 491483 - DNA, 20 bp, mouse
gctaacaacaccccaattca

SEQ ID NO: 491484 - DNA, 20 bp, mouse
ggcatacacctgaacttgac

SEQ ID NO: 491485 - DNA, 20 bp, mouse
gatgctcttcataatggcct

SEQ ID NO: 491486 - DNA, 20 bp, mouse
gctggatcatgtctgttctg

SEQ ID NO: 491487 - DNA, 20 bp, mouse
gaagacccccaggaagaatg

SEQ ID NO: 491488 - DNA, 20 bp, mouse
gccaggacagcaactccttg

SEQ ID NO: 491489 - DNA, 20 bp, mouse
gctcctgtacctgataactc

SEQ ID NO: 491490 - DNA, 20 bp, mouse
ggagtatccacattcttcct

SEQ ID NO: 491491 - DNA, 20 bp, mouse
gggcccatacaaagaccccc

SEQ ID NO: 491492 - DNA, 20 bp, mouse
gtgtggctggtgcttctagc

SEQ ID NO: 491493 - DNA, 20 bp, mouse
gcttctgaagtaagttcccc

SEQ ID NO: 491494 - DNA, 20 bp, mouse
gtgaactccaatccatcatg

SEQ ID NO: 491495 - DNA, 20 bp, mouse
gatcatgtctgttctgtggc

SEQ ID NO: 491496 - DNA, 20 bp, mouse
ggcacggtggcgtctctccc

SEQ ID NO: 491497 - DNA, 20 bp, mouse
gaagagtaagctaaatgcca

SEQ ID NO: 491498 - DNA, 20 bp, mouse
gagcataatttctggcacgg

SEQ ID NO: 491499 - DNA, 20 bp, mouse
ggtgccacatgatttaggag

SEQ ID NO: 491500 - DNA, 20 bp, mouse
gcaggcttctgaaggtgctg

SEQ ID NO: 491501 - DNA, 20 bp, mouse
ggaggcatgatgactaatca

SEQ ID NO: 491502 - DNA, 20 bp, mouse
gagtgtggtaatccctaaaa

SEQ ID NO: 491503 - DNA, 20 bp, mouse
gcagaggtgccacatgattt

SEQ ID NO: 491504 - DNA, 20 bp, mouse
gatcttggtgactaatagtg

SEQ ID NO: 491505 - DNA, 20 bp, mouse
gagtcctctcctaaatcatg

SEQ ID NO: 491506 - DNA, 20 bp, mouse
gagactaatgcagtacctca

SEQ ID NO: 491507 - DNA, 20 bp, mouse
gaagctagagattgcatttc

SEQ ID NO: 491508 - DNA, 20 bp, mouse
gtacagaggaagtgatgcac

SEQ ID NO: 491509 - DNA, 20 bp, mouse
gagggtgcagatgtgatata

SEQ ID NO: 491510 - DNA, 20 bp, mouse
gacaggaatcagatagttga

SEQ ID NO: 491511 - DNA, 20 bp, mouse
ggtgatataaggtactcctg

SEQ ID NO: 491512 - DNA, 20 bp, mouse
gggattgattcaatgtgtac

SEQ ID NO: 491513 - DNA, 20 bp, mouse
gaggctgaggaaagagaaag

SEQ ID NO: 491514 - DNA, 20 bp, mouse
gggtgagagagacaaccttt

SEQ ID NO: 491515 - DNA, 20 bp, mouse
gggaaagagaaagtggcaca

SEQ ID NO: 491516 - DNA, 20 bp, mouse
gccatatctgaaaaggatga

SEQ ID NO: 491517 - DNA, 20 bp, mouse
ggaaggtagagaagccaatg

SEQ ID NO: 491518 - DNA, 20 bp, mouse
gatcagctgaagatgaggga

SEQ ID NO: 491519 - DNA, 20 bp, mouse
gaggatgaactctgacacaa

SEQ ID NO: 491520 - DNA, 20 bp, mouse
gcaggcaggcacagccacgg

SEQ ID NO: 491521 - DNA, 20 bp, mouse
gatgcgtgggatgatggcaa

SEQ ID NO: 491522 - DNA, 20 bp, mouse
gcaggtcagccaacatgcgt

SEQ ID NO: 491523 - DNA, 20 bp, mouse
gtggctggcacaggccagaa

SEQ ID NO: 491524 - DNA, 20 bp, mouse
gcccatgacggtgagtagaa

SEQ ID NO: 491525 - DNA, 20 bp, mouse
gcagatatggctgtcatgtt

SEQ ID NO: 491526 - DNA, 20 bp, mouse
gctccttggaaccccgacaa

SEQ ID NO: 491527 - DNA, 20 bp, mouse
gagggacgacgccattgtcg

SEQ ID NO: 491528 - DNA, 20 bp, mouse
gcgccattgtcggggttcca

SEQ ID NO: 491529 - DNA, 20 bp, mouse
gatgtgaagactgtctctcc

SEQ ID NO: 491530 - DNA, 20 bp, mouse
gtcttgcgtcagagttctcc

SEQ ID NO: 491531 - DNA, 20 bp, mouse
ggaactccactgagggtgaa

SEQ ID NO: 491532 - DNA, 20 bp, mouse
gagttctggagacccacagg

SEQ ID NO: 491533 - DNA, 20 bp, mouse
gagacccacaggaggctcct

SEQ ID NO: 491534 - DNA, 20 bp, mouse
gtctaaactttagaatctga

SEQ ID NO: 491535 - DNA, 20 bp, mouse
gtcccagagaactccactga

SEQ ID NO: 491536 - DNA, 20 bp, mouse
ggaggagtgagaactcatgt

SEQ ID NO: 491537 - DNA, 20 bp, mouse
gttgcttcttctgcaagagg

SEQ ID NO: 491538 - DNA, 20 bp, mouse
ggagccatgggagacttcgg

SEQ ID NO: 491539 - DNA, 20 bp, mouse
gagcgaccacaggagtgtgg

SEQ ID NO: 491540 - DNA, 20 bp, mouse
gtagcctccgaagtctccca

SEQ ID NO: 491541 - DNA, 20 bp, mouse
gataccaggacagcgaccac

SEQ ID NO: 491542 - DNA, 20 bp, mouse
gttgttccgcagaggcatgg

SEQ ID NO: 491543 - DNA, 20 bp, mouse
gaaggagccatgggagactt

SEQ ID NO: 491544 - DNA, 20 bp, mouse
gtggtggatttgttccgcag

SEQ ID NO: 491545 - DNA, 20 bp, mouse
gagcagcatgtggcgaaagg

SEQ ID NO: 491546 - DNA, 20 bp, mouse
gttcagcgggcagggctcag

SEQ ID NO: 491547 - DNA, 20 bp, mouse
ggtatctttaaagagattct

SEQ ID NO: 491548 - DNA, 20 bp, mouse
gtgcaacccttcagcgggca

SEQ ID NO: 491549 - DNA, 20 bp, mouse
gatgatggagtctctgctcc

SEQ ID NO: 491550 - DNA, 20 bp, mouse
gcccatagggttcaaaaaga

SEQ ID NO: 491551 - DNA, 20 bp, mouse
gatatttggaaaagtgagaa

SEQ ID NO: 491552 - DNA, 20 bp, mouse
gcccagtttaggggttttat

SEQ ID NO: 491553 - DNA, 20 bp, mouse
gtaattagagtcccagttta

SEQ ID NO: 491554 - DNA, 20 bp, mouse
gattttgactctcagttagc

SEQ ID NO: 491555 - DNA, 20 bp, mouse
ggggctcagtgggagagctg

SEQ ID NO: 491556 - DNA, 20 bp, mouse
gccaggctcttcctccgtaa

SEQ ID NO: 491557 - DNA, 20 bp, mouse
gtgaatccactcctttacgg

SEQ ID NO: 491558 - DNA, 20 bp, mouse
gctcttcctccgtaaaggag

SEQ ID NO: 491559 - DNA, 20 bp, mouse
gcaggtgacagtgttcactc

SEQ ID NO: 491560 - DNA, 20 bp, mouse
gcagtgaatccactccttta

SEQ ID NO: 491561 - DNA, 20 bp, mouse
ggttaaccaatctacacata

SEQ ID NO: 491562 - DNA, 20 bp, mouse
gagaagaagtaacaaaacca

SEQ ID NO: 491563 - DNA, 20 bp, mouse
gtgtttatggggcaattcaa

SEQ ID NO: 491564 - DNA, 20 bp, mouse
gacagcattataaatttacc

SEQ ID NO: 491565 - DNA, 20 bp, mouse
gatcttggagagtagcctgg

SEQ ID NO: 491566 - DNA, 20 bp, mouse
ggccattgtcaaagttcacg

SEQ ID NO: 491567 - DNA, 20 bp, mouse
gtggccaagaacaaattaaa

SEQ ID NO: 491568 - DNA, 20 bp, mouse
ggatgaagcgacacgactaa

SEQ ID NO: 491569 - DNA, 20 bp, mouse
gctgcacagatttaagagaa

SEQ ID NO: 491570 - DNA, 20 bp, mouse
gaatacaagttattggtgga

SEQ ID NO: 491571 - DNA, 20 bp, mouse
gatctaataaaaaatgatga

SEQ ID NO: 491572 - DNA, 20 bp, mouse
gcaatgaaaatacaagttat

SEQ ID NO: 491573 - DNA, 20 bp, mouse
gtgaaaatacaagttattgg

SEQ ID NO: 491574 - DNA, 20 bp, mouse
ggctagccacaaaactttca

SEQ ID NO: 491575 - DNA, 20 bp, mouse
gtgactttattgatctttgg

SEQ ID NO: 491576 - DNA, 20 bp, mouse
gtcagaggagcaggtggaaa

SEQ ID NO: 491577 - DNA, 20 bp, mouse
gtgagggatgagtaggtcag

SEQ ID NO: 491578 - DNA, 20 bp, mouse
ggtggaaagggaagatgtgt

SEQ ID NO: 491579 - DNA, 20 bp, mouse
gattggtttgagggatgagt

SEQ ID NO: 491580 - DNA, 20 bp, mouse
gcagctcatggttctggtat

SEQ ID NO: 491581 - DNA, 20 bp, mouse
gaaagggaagatgtgtaggt

SEQ ID NO: 491582 - DNA, 20 bp, mouse
ggttggaggctcctgagcct

SEQ ID NO: 491583 - DNA, 20 bp, mouse
gggttctggtattggtttga

SEQ ID NO: 491584 - DNA, 20 bp, mouse
ggggtggttgtagttcctgt

SEQ ID NO: 491585 - DNA, 20 bp, mouse
ggtggctgcaagggtggttg

SEQ ID NO: 491586 - DNA, 20 bp, mouse
gaagccagtggatacagaag

SEQ ID NO: 491587 - DNA, 20 bp, mouse
gcctctctggataaattcaa

SEQ ID NO: 491588 - DNA, 20 bp, mouse
ggcttgtcccttggagtctg

SEQ ID NO: 491589 - DNA, 20 bp, mouse
ggaggttgatccgggtccca

SEQ ID NO: 491590 - DNA, 20 bp, mouse
gagggcaaaggccggcacct

SEQ ID NO: 491591 - DNA, 20 bp, mouse
ggatacagaagaggttgatc

SEQ ID NO: 491592 - DNA, 20 bp, mouse
gctggggcctccaatgagag

SEQ ID NO: 491593 - DNA, 20 bp, mouse
gctgttccccaagggaggtt

SEQ ID NO: 491594 - DNA, 20 bp, mouse
gcaacctcttctgtatccac

SEQ ID NO: 491595 - DNA, 20 bp, mouse
gccttggagtctgaggcctt

SEQ ID NO: 491596 - DNA, 20 bp, mouse
ggttggcgagaggacctgtg

SEQ ID NO: 491597 - DNA, 20 bp, mouse
gtgaataggagcgaattgtt

SEQ ID NO: 491598 - DNA, 20 bp, mouse
gggaaaatcagactcttcgg

SEQ ID NO: 491599 - DNA, 20 bp, mouse
gtcatcaataagttctccaa

SEQ ID NO: 491600 - DNA, 20 bp, mouse
gatagagatgagtgctgaac

SEQ ID NO: 491601 - DNA, 20 bp, mouse
ggtgggaaaatcagactctt

SEQ ID NO: 491602 - DNA, 20 bp, mouse
gagactcttcggaggtgctg

SEQ ID NO: 491603 - DNA, 20 bp, mouse
gataatatcgctaaagccca

SEQ ID NO: 491604 - DNA, 20 bp, mouse
gaatcattgccctccagtgg

SEQ ID NO: 491605 - DNA, 20 bp, mouse
gataaatcattgccctccag

SEQ ID NO: 491606 - DNA, 20 bp, mouse
gccgatgtccgcgactttgt

SEQ ID NO: 491607 - DNA, 20 bp, mouse
ggagcagacgctgcacttca

SEQ ID NO: 491608 - DNA, 20 bp, mouse
gcggactggccgcctgggga

SEQ ID NO: 491609 - DNA, 20 bp, mouse
gagacgctgcacttcaagga

SEQ ID NO: 491610 - DNA, 20 bp, mouse
gacatcggactggccgcctg

SEQ ID NO: 491611 - DNA, 20 bp, mouse
gggcaatggcagccgctgca

SEQ ID NO: 491612 - DNA, 20 bp, mouse
gctgagttcatcagtcctag

SEQ ID NO: 491613 - DNA, 20 bp, mouse
gtgctggcggcgcttccgct

SEQ ID NO: 491614 - DNA, 20 bp, mouse
gggctgcctgcacatgaccg

SEQ ID NO: 491615 - DNA, 20 bp, mouse
gaaagtcgcggacatcggac

SEQ ID NO: 491616 - DNA, 20 bp, mouse
gagcagcagacagtacccac

SEQ ID NO: 491617 - DNA, 20 bp, mouse
ggcattcagtgacacctggt

SEQ ID NO: 491618 - DNA, 20 bp, mouse
gctggatctcacatatgtgg

SEQ ID NO: 491619 - DNA, 20 bp, mouse
gatctctcatcactgaccag

SEQ ID NO: 491620 - DNA, 20 bp, mouse
gatgctggatctcacatatg

SEQ ID NO: 491621 - DNA, 20 bp, mouse
gtccagcattcagtgacacc

SEQ ID NO: 491622 - DNA, 20 bp, mouse
gtgttggtgctatacttgtc

SEQ ID NO: 491623 - DNA, 20 bp, mouse
gatgactgatgagttccaca

SEQ ID NO: 491624 - DNA, 20 bp, mouse
ggcatacacaatgtgaatat

SEQ ID NO: 491625 - DNA, 20 bp, mouse
gattataaaagaggtttcca

SEQ ID NO: 491626 - DNA, 20 bp, mouse
ggtgaatgtctcctgcctgt

SEQ ID NO: 491627 - DNA, 20 bp, mouse
gctacctttcatcctcccac

SEQ ID NO: 491628 - DNA, 20 bp, mouse
gctaaaattgacctgtgtat

SEQ ID NO: 491629 - DNA, 20 bp, mouse
gaatgtctcctgcctgtggg

SEQ ID NO: 491630 - DNA, 20 bp, mouse
gccagaagaaaggagaatct

SEQ ID NO: 491631 - DNA, 20 bp, mouse
gctttcatcctcccacaggc

SEQ ID NO: 491632 - DNA, 20 bp, mouse
gcagtcttctgcctatacac

SEQ ID NO: 491633 - DNA, 20 bp, mouse
gtttaaggttgctatgtgaa

SEQ ID NO: 491634 - DNA, 20 bp, mouse
gatatagggagattaattta

SEQ ID NO: 491635 - DNA, 20 bp, mouse
ggaaaggtagagcctgtggg

SEQ ID NO: 491636 - DNA, 20 bp, mouse
gctaaaattgacctgtgtat

SEQ ID NO: 491637 - DNA, 20 bp, mouse
ggtgaatgtctcctgcctgt

SEQ ID NO: 491638 - DNA, 20 bp, mouse
gctacctttcatcctcccac

SEQ ID NO: 491639 - DNA, 20 bp, mouse
gaatgtctcctgcctgtggg

SEQ ID NO: 491640 - DNA, 20 bp, mouse
gctttcatcctcccacaggc

SEQ ID NO: 491641 - DNA, 20 bp, mouse
gcagtcttctgcctatacac

SEQ ID NO: 491642 - DNA, 20 bp, mouse
gtttcagagcatcaaatgtt

SEQ ID NO: 491643 - DNA, 20 bp, mouse
gtttaaggttgctatgtgaa

SEQ ID NO: 491644 - DNA, 20 bp, mouse
ggaaaggtagagcctgtggg

SEQ ID NO: 491645 - DNA, 20 bp, mouse
ggatgaaaggtagagcctgt

SEQ ID NO: 491646 - DNA, 20 bp, mouse
gatgcttggaggtacttcag

SEQ ID NO: 491647 - DNA, 20 bp, mouse
gtcatcatgatgatgcttgg

SEQ ID NO: 491648 - DNA, 20 bp, mouse
gatttctaatatggcaggtt

SEQ ID NO: 491649 - DNA, 20 bp, mouse
gaactcatcatgatgatgct

SEQ ID NO: 491650 - DNA, 20 bp, mouse
gcctgcaagcactaagactc

SEQ ID NO: 491651 - DNA, 20 bp, mouse
gcctggatttctaatatggc

SEQ ID NO: 491652 - DNA, 20 bp, mouse
ggtcttaaaatttctctaaa

SEQ ID NO: 491653 - DNA, 20 bp, mouse
gatctcctggatttctaata

SEQ ID NO: 491654 - DNA, 20 bp, mouse
ggaggctcctaaggtcgtta

SEQ ID NO: 491655 - DNA, 20 bp, mouse
gcaacttgtaaatccaatgt

SEQ ID NO: 491656 - DNA, 20 bp, mouse
ggtggagttaaggagcagcc

SEQ ID NO: 491657 - DNA, 20 bp, mouse
gtccacccacagctccatgc

SEQ ID NO: 491658 - DNA, 20 bp, mouse
gatctaaggacctaagaact

SEQ ID NO: 491659 - DNA, 20 bp, mouse
gttctcactggcatcatcta

SEQ ID NO: 491660 - DNA, 20 bp, mouse
gggattgtgttctttctcac

SEQ ID NO: 491661 - DNA, 20 bp, mouse
gaggagactcagggcctagg

SEQ ID NO: 491662 - DNA, 20 bp, mouse
ggccagcatggagctgtggg

SEQ ID NO: 491663 - DNA, 20 bp, mouse
gctggactagaggagactca

SEQ ID NO: 491664 - DNA, 20 bp, mouse
ggtggagagaagcccagcag

SEQ ID NO: 491665 - DNA, 20 bp, mouse
ggctccttaactccacatgt

SEQ ID NO: 491666 - DNA, 20 bp, mouse
ggtccaagttctagaggatg

SEQ ID NO: 491667 - DNA, 20 bp, mouse
gctattgagacatgattctc

SEQ ID NO: 491668 - DNA, 20 bp, mouse
gagcactgtccaagttctag

SEQ ID NO: 491669 - DNA, 20 bp, mouse
gaagttctagaggatgtgga

SEQ ID NO: 491670 - DNA, 20 bp, mouse
gaattttaagttaatatctt

SEQ ID NO: 491671 - DNA, 20 bp, mouse
ggacaatgtttcttggttat

SEQ ID NO: 491672 - DNA, 20 bp, mouse
gacaaggggacaatgtttct

SEQ ID NO: 491673 - DNA, 20 bp, mouse
ggaaattcactcatgaagag

SEQ ID NO: 491674 - DNA, 20 bp, mouse
gtgtgatgctggagacatgc

SEQ ID NO: 491675 - DNA, 20 bp, mouse
gtatatgtatgggctatttt

SEQ ID NO: 491676 - DNA, 20 bp, mouse
gtcgaggtctacaccaccat

SEQ ID NO: 491677 - DNA, 20 bp, mouse
gaggtctacaccaccatagg

SEQ ID NO: 491678 - DNA, 20 bp, mouse
gtccgcaagtccacctatgg

SEQ ID NO: 491679 - DNA, 20 bp, mouse
gccttccgcaagtccaccta

SEQ ID NO: 491680 - DNA, 20 bp, mouse
gctgctcataggacatgtcg

SEQ ID NO: 491681 - DNA, 20 bp, mouse
gaaggagacgccacctaagg

SEQ ID NO: 491682 - DNA, 20 bp, mouse
gtcatcctacccaagatggt

SEQ ID NO: 491683 - DNA, 20 bp, mouse
gttcaggcgccgcctctgga

SEQ ID NO: 491684 - DNA, 20 bp, mouse
gaccaccataggtggacttg

SEQ ID NO: 491685 - DNA, 20 bp, mouse
ggcatcttcgccaccttagg

SEQ ID NO: 491686 - DNA, 20 bp, mouse
gatctagtttgtcagttgtt

SEQ ID NO: 491687 - DNA, 20 bp, mouse
ggatgcacgaggaagaggca

SEQ ID NO: 491688 - DNA, 20 bp, mouse
gcagagcaggaagctggttt

SEQ ID NO: 491689 - DNA, 20 bp, mouse
gacaaactagatagctacga

SEQ ID NO: 491690 - DNA, 20 bp, mouse
gagctggtttcggtgacctg

SEQ ID NO: 491691 - DNA, 20 bp, mouse
gaccagcttcctgctctgta

SEQ ID NO: 491692 - DNA, 20 bp, mouse
gtcagcaagaagaacatcag

SEQ ID NO: 491693 - DNA, 20 bp, mouse
gctcttggccatggttcatt

SEQ ID NO: 491694 - DNA, 20 bp, mouse
ggcctgtcacttgaaaacca

SEQ ID NO: 491695 - DNA, 20 bp, mouse
ggcactggttgccataaaaa

SEQ ID NO: 491696 - DNA, 20 bp, mouse
gagttctctgatgggatgtt

SEQ ID NO: 491697 - DNA, 20 bp, mouse
gaactggctacactctctcc

SEQ ID NO: 491698 - DNA, 20 bp, mouse
ggtgagcacaagtagtgagg

SEQ ID NO: 491699 - DNA, 20 bp, mouse
gtcagtgagcacaagtagtg

SEQ ID NO: 491700 - DNA, 20 bp, mouse
gggaatgtggtccccaatga

SEQ ID NO: 491701 - DNA, 20 bp, mouse
gcaagtagtgaggtggaatg

SEQ ID NO: 491702 - DNA, 20 bp, mouse
gagaaggaatatttcattct

SEQ ID NO: 491703 - DNA, 20 bp, mouse
gctacttgtgctcactgaaa

SEQ ID NO: 491704 - DNA, 20 bp, mouse
gggatgtttggggtggctta

SEQ ID NO: 491705 - DNA, 20 bp, mouse
gagaaatgagctggctagtg

SEQ ID NO: 491706 - DNA, 20 bp, mouse
gtacaaccctgctaagtaaa

SEQ ID NO: 491707 - DNA, 20 bp, mouse
gcactagatacctgcactgg

SEQ ID NO: 491708 - DNA, 20 bp, mouse
gggagggccaaagtccaggt

SEQ ID NO: 491709 - DNA, 20 bp, mouse
ggagagcagagtgaggcaag

SEQ ID NO: 491710 - DNA, 20 bp, mouse
gctggggatgacaatttcag

SEQ ID NO: 491711 - DNA, 20 bp, mouse
gagagaagcgccatttgggt

SEQ ID NO: 491712 - DNA, 20 bp, mouse
gggtgggctacgggaacagc

SEQ ID NO: 491713 - DNA, 20 bp, mouse
gaggtagagaagcgccattt

SEQ ID NO: 491714 - DNA, 20 bp, mouse
gttcccgtagcccacccaaa

SEQ ID NO: 491715 - DNA, 20 bp, mouse
gctacactagatacctgcac

SEQ ID NO: 491716 - DNA, 20 bp, mouse
gttgaacttcagtgtgttac

SEQ ID NO: 491717 - DNA, 20 bp, mouse
ggagaaaaaaattgactaaa

SEQ ID NO: 491718 - DNA, 20 bp, mouse
gactttgatgtttaccaaac

SEQ ID NO: 491719 - DNA, 20 bp, mouse
ggtaaaaatgaattaaattt

SEQ ID NO: 491720 - DNA, 20 bp, mouse
gctaaattatgaaatatttt

SEQ ID NO: 491721 - DNA, 20 bp, mouse
gcttaaagctccagatgtgg

SEQ ID NO: 491722 - DNA, 20 bp, mouse
gcagatgtggtggtccttct

SEQ ID NO: 491723 - DNA, 20 bp, mouse
gtaatgacagggttcccaga

SEQ ID NO: 491724 - DNA, 20 bp, mouse
gaagcttaaagctccagatg

SEQ ID NO: 491725 - DNA, 20 bp, mouse
gcacagcattgttaatgaca

SEQ ID NO: 491726 - DNA, 20 bp, mouse
gtgtccttggagcctaatga

SEQ ID NO: 491727 - DNA, 20 bp, mouse
ggatatgtagactgctgaca

SEQ ID NO: 491728 - DNA, 20 bp, mouse
gccaggcttcgtccctcatt

SEQ ID NO: 491729 - DNA, 20 bp, mouse
gcgtccctcattaggctcca

SEQ ID NO: 491730 - DNA, 20 bp, mouse
ggctagaaaagtttctggga

SEQ ID NO: 491731 - DNA, 20 bp, mouse
gggtggggaattgaggtata

SEQ ID NO: 491732 - DNA, 20 bp, mouse
gcctccagaatgcacctatg

SEQ ID NO: 491733 - DNA, 20 bp, mouse
gactatatgcttctttaatg

SEQ ID NO: 491734 - DNA, 20 bp, mouse
gttgagctagaaaagtttct

SEQ ID NO: 491735 - DNA, 20 bp, mouse
gttcatctacttacacagcc

SEQ ID NO: 491736 - DNA, 20 bp, mouse
gaatagaacaagaggaccct

SEQ ID NO: 491737 - DNA, 20 bp, mouse
gtgtagacttctgatagtta

SEQ ID NO: 491738 - DNA, 20 bp, mouse
gggccaggctcaagtgccaa

SEQ ID NO: 491739 - DNA, 20 bp, mouse
gcgaatggacgagatctgta

SEQ ID NO: 491740 - DNA, 20 bp, mouse
gacggtgtaggagaatgcag

SEQ ID NO: 491741 - DNA, 20 bp, mouse
gaggggctgcccgagaacac

SEQ ID NO: 491742 - DNA, 20 bp, mouse
gacagaggcagtctgggtac

SEQ ID NO: 491743 - DNA, 20 bp, mouse
gactgggttcgcaggctcag

SEQ ID NO: 491744 - DNA, 20 bp, mouse
gggagtatcagtgacggtgt

SEQ ID NO: 491745 - DNA, 20 bp, mouse
gtgctatcatcagctgccta

SEQ ID NO: 491746 - DNA, 20 bp, mouse
ggaggagcgggccttcctca

SEQ ID NO: 491747 - DNA, 20 bp, mouse
ggagcgggccttcctcaagg

SEQ ID NO: 491748 - DNA, 20 bp, mouse
gggcggcgccaagaccccac

SEQ ID NO: 491749 - DNA, 20 bp, mouse
gaagctcggggtccaccttg

SEQ ID NO: 491750 - DNA, 20 bp, mouse
gcacggtaaccacaagctcg

SEQ ID NO: 491751 - DNA, 20 bp, mouse
gctgcccaagcgcgccaagg

SEQ ID NO: 491752 - DNA, 20 bp, mouse
gacagcgtcttggacatcag

SEQ ID NO: 491753 - DNA, 20 bp, mouse
gagaggcttgacctccgcat

SEQ ID NO: 491754 - DNA, 20 bp, mouse
gccaaaggtggctcaaccgg

SEQ ID NO: 491755 - DNA, 20 bp, mouse
gcagccgcggcggacggcag

SEQ ID NO: 491756 - DNA, 20 bp, mouse
gcaagtcaaggatatcacac

SEQ ID NO: 491757 - DNA, 20 bp, mouse
gatggatatagtgaaaaata

SEQ ID NO: 491758 - DNA, 20 bp, mouse
gaccatgtggaaactatata

SEQ ID NO: 491759 - DNA, 20 bp, mouse
gatttctaggtgactaatta

SEQ ID NO: 491760 - DNA, 20 bp, mouse
gttcagtcaggaagcccaag

SEQ ID NO: 491761 - DNA, 20 bp, mouse
gctattaggttcatccactt

SEQ ID NO: 491762 - DNA, 20 bp, mouse
gggtctttcatttttaaatg

SEQ ID NO: 491763 - DNA, 20 bp, mouse
gaaaccttctatcttcagtc

SEQ ID NO: 491764 - DNA, 20 bp, mouse
gatattagaacatattatgc

SEQ ID NO: 491765 - DNA, 20 bp, mouse
ggctggtcttttgtgttggt

SEQ ID NO: 491766 - DNA, 20 bp, mouse
gtttggcgcggaccctgagg

SEQ ID NO: 491767 - DNA, 20 bp, mouse
gcgaccaaggcggcacaggc

SEQ ID NO: 491768 - DNA, 20 bp, mouse
gggctttggcgcggaccctg

SEQ ID NO: 491769 - DNA, 20 bp, mouse
gcagggggggctgacaccgg

SEQ ID NO: 491770 - DNA, 20 bp, mouse
gggcgtggctcccccagagg

SEQ ID NO: 491771 - DNA, 20 bp, mouse
gacgggcccggtagtggcac

SEQ ID NO: 491772 - DNA, 20 bp, mouse
gctgcgcgggccagcttcgg

SEQ ID NO: 491773 - DNA, 20 bp, mouse
gacaggcgggcgccgcctca

SEQ ID NO: 491774 - DNA, 20 bp, mouse
ggcgggcacgggcccggtag

SEQ ID NO: 491775 - DNA, 20 bp, mouse
gtcactgcatctgggatcgt

SEQ ID NO: 491776 - DNA, 20 bp, mouse
ggtgccttgtgggtatgagg

SEQ ID NO: 491777 - DNA, 20 bp, mouse
gcaccaggacacggctgtaa

SEQ ID NO: 491778 - DNA, 20 bp, mouse
gtagccacagagtgccttgt

SEQ ID NO: 491779 - DNA, 20 bp, mouse
gatacccacaaggcactctg

SEQ ID NO: 491780 - DNA, 20 bp, mouse
gcactctgtggctattctct

SEQ ID NO: 491781 - DNA, 20 bp, mouse
gggcagctgtcactttttgg

SEQ ID NO: 491782 - DNA, 20 bp, mouse
gcgcccttacagccgtgtcc

SEQ ID NO: 491783 - DNA, 20 bp, mouse
gttcacaatggacttgaact

SEQ ID NO: 491784 - DNA, 20 bp, mouse
gtctgcagagaacaaagaca

SEQ ID NO: 491785 - DNA, 20 bp, mouse
gatgatgacagctttgtgtc

SEQ ID NO: 491786 - DNA, 20 bp, mouse
gtgccttcctgataaagcag

SEQ ID NO: 491787 - DNA, 20 bp, mouse
gttcctgataaagcaggggt

SEQ ID NO: 491788 - DNA, 20 bp, mouse
ggacccacccctgctttatc

SEQ ID NO: 491789 - DNA, 20 bp, mouse
gttactgtagttcagctgca

SEQ ID NO: 491790 - DNA, 20 bp, mouse
gtcttaagagaaaatggatg

SEQ ID NO: 491791 - DNA, 20 bp, mouse
gtatctcttcaatgtatatg

SEQ ID NO: 491792 - DNA, 20 bp, mouse
ggagcctggagcacagtgaa

SEQ ID NO: 491793 - DNA, 20 bp, mouse
gtcctaggaagaggagtaag

SEQ ID NO: 491794 - DNA, 20 bp, mouse
gttacaaccatcctaggaag

SEQ ID NO: 491795 - DNA, 20 bp, mouse
gcataggtaagaaggcattc

SEQ ID NO: 491796 - DNA, 20 bp, mouse
ggtgttactgggatattcat

SEQ ID NO: 491797 - DNA, 20 bp, mouse
gcgcttgcccaggaactgtg

SEQ ID NO: 491798 - DNA, 20 bp, mouse
gtactgggatattcatgggc

SEQ ID NO: 491799 - DNA, 20 bp, mouse
gtatttgggagggtctctca

SEQ ID NO: 491800 - DNA, 20 bp, mouse
gtatacagactcatgctatg

SEQ ID NO: 491801 - DNA, 20 bp, mouse
gcgggcagtatagcgcagga

SEQ ID NO: 491802 - DNA, 20 bp, mouse
gccgaaagaacaacctgtgt

SEQ ID NO: 491803 - DNA, 20 bp, mouse
gcacgctatttggctgctcc

SEQ ID NO: 491804 - DNA, 20 bp, mouse
gggcttctgtcatatttggg

SEQ ID NO: 491805 - DNA, 20 bp, mouse
gggctgagtgaattcaaact

SEQ ID NO: 491806 - DNA, 20 bp, mouse
gtccctgaggcaggacactt

SEQ ID NO: 491807 - DNA, 20 bp, mouse
gggagcaaaatcaagtttac

SEQ ID NO: 491808 - DNA, 20 bp, mouse
gggaggtctgtggagataca

SEQ ID NO: 491809 - DNA, 20 bp, mouse
gtaaaacagattgcaatcat

SEQ ID NO: 491810 - DNA, 20 bp, mouse
ggtgctggtgtcagtggact

SEQ ID NO: 491811 - DNA, 20 bp, mouse
gtcctccaagcagctcttaa

SEQ ID NO: 491812 - DNA, 20 bp, mouse
gctaaaattaatgggagatc

SEQ ID NO: 491813 - DNA, 20 bp, mouse
ggcaatctgttttacttcca

SEQ ID NO: 491814 - DNA, 20 bp, mouse
gctctgtcgctttcaggtct

SEQ ID NO: 491815 - DNA, 20 bp, mouse
gaaaagagcaatgacattgg

SEQ ID NO: 491816 - DNA, 20 bp, mouse
ggctgcccagctcctctaca

SEQ ID NO: 491817 - DNA, 20 bp, mouse
gctacagggagaagccaccc

SEQ ID NO: 491818 - DNA, 20 bp, mouse
gtccctgtggcccttttcct

SEQ ID NO: 491819 - DNA, 20 bp, mouse
gacccaggaaaagggccaca

SEQ ID NO: 491820 - DNA, 20 bp, mouse
ggcaggaagatctatggaag

SEQ ID NO: 491821 - DNA, 20 bp, mouse
gatgtacccaggtgtgcaca

SEQ ID NO: 491822 - DNA, 20 bp, mouse
ggtccttagtcccacaggtt

SEQ ID NO: 491823 - DNA, 20 bp, mouse
gcacacgaagcataatccct

SEQ ID NO: 491824 - DNA, 20 bp, mouse
gtacccaacctgtgggacta

SEQ ID NO: 491825 - DNA, 20 bp, mouse
ggttgggtatgtatgtaccc

SEQ ID NO: 491826 - DNA, 20 bp, mouse
ggcattggaagatgacgtag

SEQ ID NO: 491827 - DNA, 20 bp, mouse
gtactgcagtaccaggccct

SEQ ID NO: 491828 - DNA, 20 bp, mouse
gtctagaatactgcagtacc

SEQ ID NO: 491829 - DNA, 20 bp, mouse
gaaggttacaaggtgcgcat

SEQ ID NO: 491830 - DNA, 20 bp, mouse
ggataaacttttcaaatcca

SEQ ID NO: 491831 - DNA, 20 bp, mouse
gcttttcaaatccaagggcc

SEQ ID NO: 491832 - DNA, 20 bp, mouse
gagatgacgtaggggagctg

SEQ ID NO: 491833 - DNA, 20 bp, mouse
gaaccttgattgcaggtctt

SEQ ID NO: 491834 - DNA, 20 bp, mouse
gacctgcaatcaaggttaca

SEQ ID NO: 491835 - DNA, 20 bp, mouse
gaacccaagacctgcaatca

SEQ ID NO: 491836 - DNA, 20 bp, mouse
gcataggaaaggctctcggg

SEQ ID NO: 491837 - DNA, 20 bp, mouse
gaggaaaggctctcgggagg

SEQ ID NO: 491838 - DNA, 20 bp, mouse
gactcataggaaaggctctc

SEQ ID NO: 491839 - DNA, 20 bp, mouse
gcgatggtttatgaactcat

SEQ ID NO: 491840 - DNA, 20 bp, mouse
gacacagagcgagaccagac

SEQ ID NO: 491841 - DNA, 20 bp, mouse
ggtttatgaactcataggaa

SEQ ID NO: 491842 - DNA, 20 bp, mouse
gaagcaggcttaataaacga

SEQ ID NO: 491843 - DNA, 20 bp, mouse
gccgagaacatgagccagtc

SEQ ID NO: 491844 - DNA, 20 bp, mouse
gtgataggctgggaattgag

SEQ ID NO: 491845 - DNA, 20 bp, mouse
ggagactgggatgctgcaca

SEQ ID NO: 491846 - DNA, 20 bp, mouse
gcaagcgcttcaaggagaag

SEQ ID NO: 491847 - DNA, 20 bp, mouse
gtcattgccatcaagttcga

SEQ ID NO: 491848 - DNA, 20 bp, mouse
gtgctcataaccccagtcat

SEQ ID NO: 491849 - DNA, 20 bp, mouse
gggcgtgcagcatggcctgg

SEQ ID NO: 491850 - DNA, 20 bp, mouse
gacttgaactcaggacacat

SEQ ID NO: 491851 - DNA, 20 bp, mouse
gtgcacgccatcgaacttga

SEQ ID NO: 491852 - DNA, 20 bp, mouse
gacttgtggcagcgattcag

SEQ ID NO: 491853 - DNA, 20 bp, mouse
gcacataggtgccatggtct

SEQ ID NO: 491854 - DNA, 20 bp, mouse
gggcaatgaaggtatgcttg

SEQ ID NO: 491855 - DNA, 20 bp, mouse
ggggaatcttgcattcaagg

SEQ ID NO: 491856 - DNA, 20 bp, mouse
gagccacaagacagcggacc

SEQ ID NO: 491857 - DNA, 20 bp, mouse
gttcttcatggctatagacc

SEQ ID NO: 491858 - DNA, 20 bp, mouse
gtctacagctctgccaacaa

SEQ ID NO: 491859 - DNA, 20 bp, mouse
gatttcaccagatagaggga

SEQ ID NO: 491860 - DNA, 20 bp, mouse
gctctaagggtaactggagg

SEQ ID NO: 491861 - DNA, 20 bp, mouse
ggctctgccaacaatggagc

SEQ ID NO: 491862 - DNA, 20 bp, mouse
gacaatggagctggcgaggc

SEQ ID NO: 491863 - DNA, 20 bp, mouse
gagatggctctaagggtaac

SEQ ID NO: 491864 - DNA, 20 bp, mouse
gacaaacccatccctctatc

SEQ ID NO: 491865 - DNA, 20 bp, mouse
ggccaacaatggagctggcg

SEQ ID NO: 491866 - DNA, 20 bp, mouse
gcacaggccagcctatagca

SEQ ID NO: 491867 - DNA, 20 bp, mouse
gtgttaccttgggattcctg

SEQ ID NO: 491868 - DNA, 20 bp, mouse
gcttctggcatgcttcccac

SEQ ID NO: 491869 - DNA, 20 bp, mouse
gagggacctcgggagatcag

SEQ ID NO: 491870 - DNA, 20 bp, mouse
gcggtccccctgatctcccg

SEQ ID NO: 491871 - DNA, 20 bp, mouse
gcagagtagtaagtcaggga

SEQ ID NO: 491872 - DNA, 20 bp, mouse
gcccccagagtagtaagtca

SEQ ID NO: 491873 - DNA, 20 bp, mouse
gtgggggtgcttggaagaac

SEQ ID NO: 491874 - DNA, 20 bp, mouse
gtagcagggaaccttctcct

SEQ ID NO: 491875 - DNA, 20 bp, mouse
gggccaaggtcaccacgctt

SEQ ID NO: 491876 - DNA, 20 bp, mouse
gtggtggagagagcctaatt

SEQ ID NO: 491877 - DNA, 20 bp, mouse
ggtttcttgacaatggcggg

SEQ ID NO: 491878 - DNA, 20 bp, mouse
ggctcgtgctgaaaagaaag

SEQ ID NO: 491879 - DNA, 20 bp, mouse
gtgacaatggcggggggccg

SEQ ID NO: 491880 - DNA, 20 bp, mouse
gtcttctcttgcgtcatctc

SEQ ID NO: 491881 - DNA, 20 bp, mouse
ggccattgtcaagaaacaga

SEQ ID NO: 491882 - DNA, 20 bp, mouse
ggtgctgaaaagaaagcggc

SEQ ID NO: 491883 - DNA, 20 bp, mouse
gggcccaaaaacttcggcac

SEQ ID NO: 491884 - DNA, 20 bp, mouse
ggggcatcttgctcagatgg

SEQ ID NO: 491885 - DNA, 20 bp, mouse
gaaaagaaagcggctggcaa

SEQ ID NO: 491886 - DNA, 20 bp, mouse
ggcccctccttaaacatgtc

SEQ ID NO: 491887 - DNA, 20 bp, mouse
gtttaaggaggggctctgta

SEQ ID NO: 491888 - DNA, 20 bp, mouse
gttaaatctttagcatacca

SEQ ID NO: 491889 - DNA, 20 bp, mouse
gtacctgacatgtttaagga

SEQ ID NO: 491890 - DNA, 20 bp, mouse
gtgatactggacacacttgc

SEQ ID NO: 491891 - DNA, 20 bp, mouse
gctggacacacttgctggtt

SEQ ID NO: 491892 - DNA, 20 bp, mouse
gtccttacctgacatgttta

SEQ ID NO: 491893 - DNA, 20 bp, mouse
gctcactggtcactggtcac

SEQ ID NO: 491894 - DNA, 20 bp, mouse
gtttatccggctcaattgta

SEQ ID NO: 491895 - DNA, 20 bp, mouse
gatccggctcaattgtaggg

SEQ ID NO: 491896 - DNA, 20 bp, mouse
gagccacaaactcaaccgtc

SEQ ID NO: 491897 - DNA, 20 bp, mouse
gcgtgcaggagtcttttcaa

SEQ ID NO: 491898 - DNA, 20 bp, mouse
gtcctgcacgtgaagacaga

SEQ ID NO: 491899 - DNA, 20 bp, mouse
gtccatctgtcttcacgtgc

SEQ ID NO: 491900 - DNA, 20 bp, mouse
gccaaaaagcacatcaagaa

SEQ ID NO: 491901 - DNA, 20 bp, mouse
gctccagcccaggctcccga

SEQ ID NO: 491902 - DNA, 20 bp, mouse
gttcttccctttggcatctt

SEQ ID NO: 491903 - DNA, 20 bp, mouse
ggaggccaaagctccagccc

SEQ ID NO: 491904 - DNA, 20 bp, mouse
gggagcctgggctggagctt

SEQ ID NO: 491905 - DNA, 20 bp, mouse
ggtttgtggcttcttccctt

SEQ ID NO: 491906 - DNA, 20 bp, mouse
ggatctgctccgaagtccca

SEQ ID NO: 491907 - DNA, 20 bp, mouse
gagagaatattcgaggtctg

SEQ ID NO: 491908 - DNA, 20 bp, mouse
gcgaagtcccagggtccccc

SEQ ID NO: 491909 - DNA, 20 bp, mouse
gtccctgaggtcccatccat

SEQ ID NO: 491910 - DNA, 20 bp, mouse
gtattctctgcagacacatg

SEQ ID NO: 491911 - DNA, 20 bp, mouse
gacctatggatgggacctca

SEQ ID NO: 491912 - DNA, 20 bp, mouse
gacttcggagcagatccctg

SEQ ID NO: 491913 - DNA, 20 bp, mouse
gagcttagtcgagattatat

SEQ ID NO: 491914 - DNA, 20 bp, mouse
ggaaggacttacctatggat

SEQ ID NO: 491915 - DNA, 20 bp, mouse
gactcctgtaagacttcaca

SEQ ID NO: 491916 - DNA, 20 bp, mouse
ggaccaagggcctcatgtgt

SEQ ID NO: 491917 - DNA, 20 bp, mouse
ggaccggaatgatttccctc

SEQ ID NO: 491918 - DNA, 20 bp, mouse
gtaccagagggaaatcattc

SEQ ID NO: 491919 - DNA, 20 bp, mouse
gaagacagtgtggaatactc

SEQ ID NO: 491920 - DNA, 20 bp, mouse
ggtactcgagcacactatcg

SEQ ID NO: 491921 - DNA, 20 bp, mouse
ggcacactatcgaggattac

SEQ ID NO: 491922 - DNA, 20 bp, mouse
ggtgtgggagaatattcttg

SEQ ID NO: 491923 - DNA, 20 bp, mouse
gcgatgacaactgatgacca

SEQ ID NO: 491924 - DNA, 20 bp, mouse
gcaaacactgatgtagcacc

SEQ ID NO: 491925 - DNA, 20 bp, mouse
gtagatcgttttttaccaga

SEQ ID NO: 491926 - DNA, 20 bp, mouse
gacatcctgaatgattgaag

SEQ ID NO: 491927 - DNA, 20 bp, mouse
gagactgcctcaatctgtca

SEQ ID NO: 491928 - DNA, 20 bp, mouse
gctgcctcaatctgtcaagg

SEQ ID NO: 491929 - DNA, 20 bp, mouse
ggcataagctgtctaaacca

SEQ ID NO: 491930 - DNA, 20 bp, mouse
gatgctcccttcaacattag

SEQ ID NO: 491931 - DNA, 20 bp, mouse
gggagctcaaatcactttta

SEQ ID NO: 491932 - DNA, 20 bp, mouse
gcttaccacttccaggacaa

SEQ ID NO: 491933 - DNA, 20 bp, mouse
gcctggaagtggtaagtctg

SEQ ID NO: 491934 - DNA, 20 bp, mouse
gggtcctgagatattcgact

SEQ ID NO: 491935 - DNA, 20 bp, mouse
gtgaccaagtcgaatatctc

SEQ ID NO: 491936 - DNA, 20 bp, mouse
gcgagtatagagaggcagtg

SEQ ID NO: 491937 - DNA, 20 bp, mouse
gcatctctgcgagtatagag

SEQ ID NO: 491938 - DNA, 20 bp, mouse
gacacataggcggatccaag

SEQ ID NO: 491939 - DNA, 20 bp, mouse
ggtcaagagcctagcctata

SEQ ID NO: 491940 - DNA, 20 bp, mouse
gctatactcgcagagatgca

SEQ ID NO: 491941 - DNA, 20 bp, mouse
gagtaagacactgaaagttg

SEQ ID NO: 491942 - DNA, 20 bp, mouse
gaagcttatagaaagctact

SEQ ID NO: 491943 - DNA, 20 bp, mouse
gaagactgtttggtttaggt

SEQ ID NO: 491944 - DNA, 20 bp, mouse
gtagcctatatggcaaaaac

SEQ ID NO: 491945 - DNA, 20 bp, mouse
gactttcagtgtcttactaa

SEQ ID NO: 491946 - DNA, 20 bp, mouse
ggcacgaaagaagtcatacc

SEQ ID NO: 491947 - DNA, 20 bp, mouse
gagattattcttctgtgcaa

SEQ ID NO: 491948 - DNA, 20 bp, mouse
gagattactgtaacgcccaa

SEQ ID NO: 491949 - DNA, 20 bp, mouse
gcctgtgaatataatcaaag

SEQ ID NO: 491950 - DNA, 20 bp, mouse
ggtcatgaaagaagtcacac

SEQ ID NO: 491951 - DNA, 20 bp, mouse
gagtatggtctatttcatga

SEQ ID NO: 491952 - DNA, 20 bp, mouse
gtaccggggagaaaccttat

SEQ ID NO: 491953 - DNA, 20 bp, mouse
gtcacgaaagaaatctttct

SEQ ID NO: 491954 - DNA, 20 bp, mouse
gatataacagtcaacttcaa

SEQ ID NO: 491955 - DNA, 20 bp, mouse
gcgcccataaggtttctccc

SEQ ID NO: 491956 - DNA, 20 bp, mouse
gcttggcagtcagttatctg

SEQ ID NO: 491957 - DNA, 20 bp, mouse
gactaaacgctcagagctga

SEQ ID NO: 491958 - DNA, 20 bp, mouse
ggttgctagggcccattgta

SEQ ID NO: 491959 - DNA, 20 bp, mouse
gtcaaattatacagtaacaa

SEQ ID NO: 491960 - DNA, 20 bp, mouse
gagaagattgaaagtgctga

SEQ ID NO: 491961 - DNA, 20 bp, mouse
gcttccttagtccaatccaa

SEQ ID NO: 491962 - DNA, 20 bp, mouse
gctgtataatttgaaaagtg

SEQ ID NO: 491963 - DNA, 20 bp, mouse
gatctcaaataccattggat

SEQ ID NO: 491964 - DNA, 20 bp, mouse
gtactgttatattactgtag

SEQ ID NO: 491965 - DNA, 20 bp, mouse
gttttatttctccctacaat

SEQ ID NO: 491966 - DNA, 20 bp, mouse
gtccgggtccagagacagct

SEQ ID NO: 491967 - DNA, 20 bp, mouse
gtgccgactgccgcctcccc

SEQ ID NO: 491968 - DNA, 20 bp, mouse
ggaagcatttccgtggcgga

SEQ ID NO: 491969 - DNA, 20 bp, mouse
gcagtcggcagtgcaactgt

SEQ ID NO: 491970 - DNA, 20 bp, mouse
gctcagaagcatttccgtgg

SEQ ID NO: 491971 - DNA, 20 bp, mouse
gctcctcagaagcatttccg

SEQ ID NO: 491972 - DNA, 20 bp, mouse
gctccccaggccctccgcca

SEQ ID NO: 491973 - DNA, 20 bp, mouse
gtctaacctgggacctttcg

SEQ ID NO: 491974 - DNA, 20 bp, mouse
gttccgtggcggagggcctg

SEQ ID NO: 491975 - DNA, 20 bp, mouse
ggtagaggctcaatgaccca

SEQ ID NO: 491976 - DNA, 20 bp, mouse
gttggccatgtggtaaccca

SEQ ID NO: 491977 - DNA, 20 bp, mouse
gggagccgtgggttaccaca

SEQ ID NO: 491978 - DNA, 20 bp, mouse
ggttcttggacttggccatg

SEQ ID NO: 491979 - DNA, 20 bp, mouse
ggcagcgagtgcgcgtgtag

SEQ ID NO: 491980 - DNA, 20 bp, mouse
gattcgtagctttgcgacgg

SEQ ID NO: 491981 - DNA, 20 bp, mouse
gggcctttctctttcgcttc

SEQ ID NO: 491982 - DNA, 20 bp, mouse
gctgccttggtttggacatt

SEQ ID NO: 491983 - DNA, 20 bp, mouse
gaagcggattcgaagctgca

SEQ ID NO: 491984 - DNA, 20 bp, mouse
gaaggcccacagtgcagcat

SEQ ID NO: 491985 - DNA, 20 bp, mouse
ggagattcgtagctttgcga

SEQ ID NO: 491986 - DNA, 20 bp, mouse
gtgacggcccctccgttata

SEQ ID NO: 491987 - DNA, 20 bp, mouse
gattatgccctataacggag

SEQ ID NO: 491988 - DNA, 20 bp, mouse
gacctgtatatgctgaaaga

SEQ ID NO: 491989 - DNA, 20 bp, mouse
gaccttctttcagcatatac

SEQ ID NO: 491990 - DNA, 20 bp, mouse
gccatgctcatgagggtgaa

SEQ ID NO: 491991 - DNA, 20 bp, mouse
gtcgctgcagacaggtgttt

SEQ ID NO: 491992 - DNA, 20 bp, mouse
gggtgttctggatccatgtg

SEQ ID NO: 491993 - DNA, 20 bp, mouse
gttcgggatccaggcccaaa

SEQ ID NO: 491994 - DNA, 20 bp, mouse
ggaagtccgtggtcaccatt

SEQ ID NO: 491995 - DNA, 20 bp, mouse
gtccagaagatctttgccat

SEQ ID NO: 491996 - DNA, 20 bp, mouse
ggtgcttgctacccaatcac

SEQ ID NO: 491997 - DNA, 20 bp, mouse
gtgcacactcccctgtgatt

SEQ ID NO: 491998 - DNA, 20 bp, mouse
gttttgtactctgctgattt

SEQ ID NO: 491999 - DNA, 20 bp, mouse
gaccgagggctattcttctc

SEQ ID NO: 492000 - DNA, 20 bp, mouse
gttcctgttcttggaaatcc

SEQ ID NO: 492001 - DNA, 20 bp, mouse
gtcataacacatatccttca

SEQ ID NO: 492002 - DNA, 20 bp, mouse
gaatagtgctagcacttaac

SEQ ID NO: 492003 - DNA, 20 bp, mouse
gcagcagaagcaagaaaatt

SEQ ID NO: 492004 - DNA, 20 bp, mouse
gtgttatccacaggctcctt

SEQ ID NO: 492005 - DNA, 20 bp, mouse
ggagcagtgagtgcatccac

SEQ ID NO: 492006 - DNA, 20 bp, mouse
ggaggagcaacagtgataga

SEQ ID NO: 492007 - DNA, 20 bp, mouse
gatgatgaggagcttggatc

SEQ ID NO: 492008 - DNA, 20 bp, mouse
gcttctggagagactgacag

SEQ ID NO: 492009 - DNA, 20 bp, mouse
gacggtgatgatgaggagct

SEQ ID NO: 492010 - DNA, 20 bp, mouse
gcagactgctcggtatttga

SEQ ID NO: 492011 - DNA, 20 bp, mouse
ggagcttggatctggcttct

SEQ ID NO: 492012 - DNA, 20 bp, mouse
gggtgaggaccaggagaagc

SEQ ID NO: 492013 - DNA, 20 bp, mouse
gggaaagccaaaaggagatg

SEQ ID NO: 492014 - DNA, 20 bp, mouse
gccaggagaagctggcacgt

SEQ ID NO: 492015 - DNA, 20 bp, mouse
gcaatattcctgttggataa

SEQ ID NO: 492016 - DNA, 20 bp, mouse
ggcttactacaaggccagtg

SEQ ID NO: 492017 - DNA, 20 bp, mouse
gattaaaaattgcctacttg

SEQ ID NO: 492018 - DNA, 20 bp, mouse
gaaaattgcctacttggggc

SEQ ID NO: 492019 - DNA, 20 bp, mouse
gcctttgaccagatgtccat

SEQ ID NO: 492020 - DNA, 20 bp, mouse
gcgagtcaccaatggacatc

SEQ ID NO: 492021 - DNA, 20 bp, mouse
gatctcattcgagtcaccaa

SEQ ID NO: 492022 - DNA, 20 bp, mouse
gagtttacacccaaccatct

SEQ ID NO: 492023 - DNA, 20 bp, mouse
gctcaggcacaggaatcttt

SEQ ID NO: 492024 - DNA, 20 bp, mouse
gtctctctccagccccaagt

SEQ ID NO: 492025 - DNA, 20 bp, mouse
gcaattgccttctggtttgg

SEQ ID NO: 492026 - DNA, 20 bp, mouse
ggctcagactgaggggaact

SEQ ID NO: 492027 - DNA, 20 bp, mouse
gctctcagaaagagaaccag

SEQ ID NO: 492028 - DNA, 20 bp, mouse
ggaaatccttgtcgatcttt

SEQ ID NO: 492029 - DNA, 20 bp, mouse
gctcaacctaaagatcgaca

SEQ ID NO: 492030 - DNA, 20 bp, mouse
ggcagtgaatctgcactatc

SEQ ID NO: 492031 - DNA, 20 bp, mouse
gaagtgttttcagagagaga

SEQ ID NO: 492032 - DNA, 20 bp, mouse
ggcattcacagagaaagcag

SEQ ID NO: 492033 - DNA, 20 bp, mouse
gtcacagagaaagcaggggg

SEQ ID NO: 492034 - DNA, 20 bp, mouse
gaggagattacaaaatcctc

SEQ ID NO: 492035 - DNA, 20 bp, mouse
gagtggtatccagttttgca

SEQ ID NO: 492036 - DNA, 20 bp, mouse
gcgggaaaacaccaaaatgg

SEQ ID NO: 492037 - DNA, 20 bp, mouse
gcttcgggaaaacaccaaaa

SEQ ID NO: 492038 - DNA, 20 bp, mouse
gcaaaatggcggaatgacgc

SEQ ID NO: 492039 - DNA, 20 bp, mouse
gaggattcggcaatggtctt

SEQ ID NO: 492040 - DNA, 20 bp, mouse
gcaggattaggaggtcatgg

SEQ ID NO: 492041 - DNA, 20 bp, mouse
gcccgaagaagaagaagccc

SEQ ID NO: 492042 - DNA, 20 bp, mouse
gtgtacttaaaatggtacca

SEQ ID NO: 492043 - DNA, 20 bp, mouse
gaccagggcttcttcttctt

SEQ ID NO: 492044 - DNA, 20 bp, mouse
gtccacaagccccgtggcct

SEQ ID NO: 492045 - DNA, 20 bp, mouse
gccagtgcagaagcatactc

SEQ ID NO: 492046 - DNA, 20 bp, mouse
gcgcggctcgcggggtccca

SEQ ID NO: 492047 - DNA, 20 bp, mouse
ggaccgagcgaagaatggca

SEQ ID NO: 492048 - DNA, 20 bp, mouse
ggcgcagaccgagcgaagaa

SEQ ID NO: 492049 - DNA, 20 bp, mouse
gttcgacagtctgaaggctc

SEQ ID NO: 492050 - DNA, 20 bp, mouse
ggctcggtctgcgcgtcggg

SEQ ID NO: 492051 - DNA, 20 bp, mouse
ggcacgcggtctgcatccct

SEQ ID NO: 492052 - DNA, 20 bp, mouse
gctcaagccagctagagcca

SEQ ID NO: 492053 - DNA, 20 bp, mouse
gctgcgcgtcgggaggcacg

SEQ ID NO: 492054 - DNA, 20 bp, mouse
gcgacctagagctccctagg

SEQ ID NO: 492055 - DNA, 20 bp, mouse
gctgcggccgtgacccccta

SEQ ID NO: 492056 - DNA, 20 bp, mouse
ggaggtcctcaggcaagtgt

SEQ ID NO: 492057 - DNA, 20 bp, mouse
gtgcccagctaggagctcaa

SEQ ID NO: 492058 - DNA, 20 bp, mouse
gcacagctgaaggggtcgcc

SEQ ID NO: 492059 - DNA, 20 bp, mouse
gtgaaggggtcgccaggctg

SEQ ID NO: 492060 - DNA, 20 bp, mouse
gccaggagtagctgctgaga

SEQ ID NO: 492061 - DNA, 20 bp, mouse
gagaagggttcgggctccgc

SEQ ID NO: 492062 - DNA, 20 bp, mouse
ggggaattgtcgaggtcctc

SEQ ID NO: 492063 - DNA, 20 bp, mouse
gtagctttcaggtcagtatt

SEQ ID NO: 492064 - DNA, 20 bp, mouse
gtaggcttcgggaattgtcg

SEQ ID NO: 492065 - DNA, 20 bp, mouse
gagagaggcgctataagcta

SEQ ID NO: 492066 - DNA, 20 bp, mouse
gtgcagcctgatgtaggggg

SEQ ID NO: 492067 - DNA, 20 bp, mouse
gcagcatctttcttctcaac

SEQ ID NO: 492068 - DNA, 20 bp, mouse
gtgccactgcagcctgatgt

SEQ ID NO: 492069 - DNA, 20 bp, mouse
gagcctgatgtagggggggg

SEQ ID NO: 492070 - DNA, 20 bp, mouse
gtgggcctcttctcaaacat

SEQ ID NO: 492071 - DNA, 20 bp, mouse
gatccccccccccctacatc

SEQ ID NO: 492072 - DNA, 20 bp, mouse
gcccttggccttctgccctt

SEQ ID NO: 492073 - DNA, 20 bp, mouse
gttgacgacggcggggggcg

SEQ ID NO: 492074 - DNA, 20 bp, mouse
ggtttcttgacgacggcggg

SEQ ID NO: 492075 - DNA, 20 bp, mouse
gcaaccctatgtttgagaag

SEQ ID NO: 492076 - DNA, 20 bp, mouse
gtatggttctggcttcagta

SEQ ID NO: 492077 - DNA, 20 bp, mouse
gccatagtcacagacgaggg

SEQ ID NO: 492078 - DNA, 20 bp, mouse
gatggtggggaagacagcct

SEQ ID NO: 492079 - DNA, 20 bp, mouse
ggaaccatagtcacagacga

SEQ ID NO: 492080 - DNA, 20 bp, mouse
gccaggtcaccacagcacaa

SEQ ID NO: 492081 - DNA, 20 bp, mouse
gacagcaagggcagcatagg

SEQ ID NO: 492082 - DNA, 20 bp, mouse
gggcagctgcccatgctgga

SEQ ID NO: 492083 - DNA, 20 bp, mouse
gtaccagaatgacagagggt

SEQ ID NO: 492084 - DNA, 20 bp, mouse
gcattttcccgaggatggtg

SEQ ID NO: 492085 - DNA, 20 bp, mouse
ggagtcactatctgtgggag

SEQ ID NO: 492086 - DNA, 20 bp, mouse
gccggagcgcagggcgacga

SEQ ID NO: 492087 - DNA, 20 bp, mouse
gagggcgacgagggcagcga

SEQ ID NO: 492088 - DNA, 20 bp, mouse
ggaacagccgcggaagtcgg

SEQ ID NO: 492089 - DNA, 20 bp, mouse
gtcggagcccggaacagccg

SEQ ID NO: 492090 - DNA, 20 bp, mouse
gagtcggaggccggagcgca

SEQ ID NO: 492091 - DNA, 20 bp, mouse
gacgagggcagcgagggcgg

SEQ ID NO: 492092 - DNA, 20 bp, mouse
gtgatggctgggggctacag

SEQ ID NO: 492093 - DNA, 20 bp, mouse
ggcgacgagggcagcgaggg

SEQ ID NO: 492094 - DNA, 20 bp, mouse
gctccggcctccgacttccg

SEQ ID NO: 492095 - DNA, 20 bp, mouse
gccggaacagccgcggaagt

SEQ ID NO: 492096 - DNA, 20 bp, mouse
gggccagcacctaaaagtac

SEQ ID NO: 492097 - DNA, 20 bp, mouse
ggagctcggcgccacaggag

SEQ ID NO: 492098 - DNA, 20 bp, mouse
gcaggaagaactaggctcca

SEQ ID NO: 492099 - DNA, 20 bp, mouse
ggtttggcaggacttgcaag

SEQ ID NO: 492100 - DNA, 20 bp, mouse
gcctcaaagaggttcacctg

SEQ ID NO: 492101 - DNA, 20 bp, mouse
gaactaggctccagggtaca

SEQ ID NO: 492102 - DNA, 20 bp, mouse
gacaggaatcccggcagcgc

SEQ ID NO: 492103 - DNA, 20 bp, mouse
gggagctggcacttgagaca

SEQ ID NO: 492104 - DNA, 20 bp, mouse
gcttctagttgaaagctgat

SEQ ID NO: 492105 - DNA, 20 bp, mouse
ggagctgtggtgaggctatt

SEQ ID NO: 492106 - DNA, 20 bp, mouse
gtaggtcacaaacaaggact

SEQ ID NO: 492107 - DNA, 20 bp, mouse
gtgattgccaagctgaaatt

SEQ ID NO: 492108 - DNA, 20 bp, mouse
ggatactgttacctatgagt

SEQ ID NO: 492109 - DNA, 20 bp, mouse
gggtaacagtatcgatagag

SEQ ID NO: 492110 - DNA, 20 bp, mouse
gtggatttaggtcacaaaca

SEQ ID NO: 492111 - DNA, 20 bp, mouse
gtaaatccatctcttaagag

SEQ ID NO: 492112 - DNA, 20 bp, mouse
gctctttgggagacaatgca

SEQ ID NO: 492113 - DNA, 20 bp, mouse
gtcgatagaggggttcttct

SEQ ID NO: 492114 - DNA, 20 bp, mouse
gtccttcccctcttaagaga

SEQ ID NO: 492115 - DNA, 20 bp, mouse
gccaattcctggctctggac

SEQ ID NO: 492116 - DNA, 20 bp, mouse
gctcagaggcaagtgtagtt

SEQ ID NO: 492117 - DNA, 20 bp, mouse
ggtagtttggttgtgagaac

SEQ ID NO: 492118 - DNA, 20 bp, mouse
gaccccagcagtcagacagg

SEQ ID NO: 492119 - DNA, 20 bp, mouse
gactcacaatagcttttctt

SEQ ID NO: 492120 - DNA, 20 bp, mouse
gccctcctgtctgactgctg

SEQ ID NO: 492121 - DNA, 20 bp, mouse
ggactgagtgaaagctggtg

SEQ ID NO: 492122 - DNA, 20 bp, mouse
gcactacataaattcagtac

SEQ ID NO: 492123 - DNA, 20 bp, mouse
gtgaaacattggctttattg

SEQ ID NO: 492124 - DNA, 20 bp, mouse
gttttcttcggcttgaaccc

SEQ ID NO: 492125 - DNA, 20 bp, mouse
gattgaagaccagtcagcat

SEQ ID NO: 492126 - DNA, 20 bp, mouse
gactagacaccagcaaacct

SEQ ID NO: 492127 - DNA, 20 bp, mouse
ggctaaacaaagctgctggg

SEQ ID NO: 492128 - DNA, 20 bp, mouse
gcaccagcaaaccttggtcg

SEQ ID NO: 492129 - DNA, 20 bp, mouse
ggagctgctgagtgtcttgt

SEQ ID NO: 492130 - DNA, 20 bp, mouse
gacaagtacaccctctgctt

SEQ ID NO: 492131 - DNA, 20 bp, mouse
gtccctcgaccaaggtttgc

SEQ ID NO: 492132 - DNA, 20 bp, mouse
gtatctataaacgcacacag

SEQ ID NO: 492133 - DNA, 20 bp, mouse
gggtgtacttgtactacaat

SEQ ID NO: 492134 - DNA, 20 bp, mouse
ggtatattgcatatattgca

SEQ ID NO: 492135 - DNA, 20 bp, mouse
gaacgcaggagtaaattcac

SEQ ID NO: 492136 - DNA, 20 bp, mouse
ggagagaagcctaaactcca

SEQ ID NO: 492137 - DNA, 20 bp, mouse
gcccagtacaccatgcctag

SEQ ID NO: 492138 - DNA, 20 bp, mouse
gaagagcaagagccgatcca

SEQ ID NO: 492139 - DNA, 20 bp, mouse
ggccaaaaggcagcagatgc

SEQ ID NO: 492140 - DNA, 20 bp, mouse
gtcccctcctccttcccagt

SEQ ID NO: 492141 - DNA, 20 bp, mouse
ggccccagctcctctgatag

SEQ ID NO: 492142 - DNA, 20 bp, mouse
gtcttgctcttgttgcctct

SEQ ID NO: 492143 - DNA, 20 bp, mouse
ggagagatgctgaagctgat

SEQ ID NO: 492144 - DNA, 20 bp, mouse
gacgagctctagctgatagg

SEQ ID NO: 492145 - DNA, 20 bp, mouse
gtttaactcaggagagatat

SEQ ID NO: 492146 - DNA, 20 bp, mouse
ggtctttatctgacaagtac

SEQ ID NO: 492147 - DNA, 20 bp, mouse
gcaagtacaggtgcctgctt

SEQ ID NO: 492148 - DNA, 20 bp, mouse
gggtgatgtcatgccagctt

SEQ ID NO: 492149 - DNA, 20 bp, mouse
gttaggcagccaacatgaca

SEQ ID NO: 492150 - DNA, 20 bp, mouse
ggagctctctctggagaaat

SEQ ID NO: 492151 - DNA, 20 bp, mouse
gtgtttattccatgtcatgt

SEQ ID NO: 492152 - DNA, 20 bp, mouse
gttcccctcttccaggtatt

SEQ ID NO: 492153 - DNA, 20 bp, mouse
gctttcacagttttgacaca

SEQ ID NO: 492154 - DNA, 20 bp, mouse
gcactctggggacagaggaa

SEQ ID NO: 492155 - DNA, 20 bp, mouse
gtggtagtgagggaccaccc

SEQ ID NO: 492156 - DNA, 20 bp, mouse
gaggcctgggtaccagatgg

SEQ ID NO: 492157 - DNA, 20 bp, mouse
ggctttgcagggaggtcact

SEQ ID NO: 492158 - DNA, 20 bp, mouse
gcttcttgagatagcccagg

SEQ ID NO: 492159 - DNA, 20 bp, mouse
gatgtcttcacacctccatc

SEQ ID NO: 492160 - DNA, 20 bp, mouse
gagtaacctttcggagaaca

SEQ ID NO: 492161 - DNA, 20 bp, mouse
gtttgggcagacagccacct

SEQ ID NO: 492162 - DNA, 20 bp, mouse
gctaaacctgatactaataa

SEQ ID NO: 492163 - DNA, 20 bp, mouse
gaaaagatagtatattccca

SEQ ID NO: 492164 - DNA, 20 bp, mouse
gacataccttgttctccgaa

SEQ ID NO: 492165 - DNA, 20 bp, mouse
gatagtatattcccaaggcc

SEQ ID NO: 492166 - DNA, 20 bp, mouse
ggtgattggaaataagaaac

SEQ ID NO: 492167 - DNA, 20 bp, mouse
gtgtgcgtgaggcagaaggg

SEQ ID NO: 492168 - DNA, 20 bp, mouse
gtgaagctctcagtcagctg

SEQ ID NO: 492169 - DNA, 20 bp, mouse
ggtcgcccctcaaagagaag

SEQ ID NO: 492170 - DNA, 20 bp, mouse
ggatccttggatgtacacca

SEQ ID NO: 492171 - DNA, 20 bp, mouse
ggagaagagtccaaaaatcc

SEQ ID NO: 492172 - DNA, 20 bp, mouse
gtctatctagacaatgtgtg

SEQ ID NO: 492173 - DNA, 20 bp, mouse
gagcagccccaaaaacagaa

SEQ ID NO: 492174 - DNA, 20 bp, mouse
ggcaaccacttctctttgag

SEQ ID NO: 492175 - DNA, 20 bp, mouse
gaaaccgtggtgtacatcca

SEQ ID NO: 492176 - DNA, 20 bp, mouse
gaggctccggggaaactttg

SEQ ID NO: 492177 - DNA, 20 bp, mouse
gcgggcgcgcaatctgctcc

SEQ ID NO: 492178 - DNA, 20 bp, mouse
gggctgctggttggcaacag

SEQ ID NO: 492179 - DNA, 20 bp, mouse
ggatctggaccaatgtgcga

SEQ ID NO: 492180 - DNA, 20 bp, mouse
gtggtccagatcctgcgcgc

SEQ ID NO: 492181 - DNA, 20 bp, mouse
ggtctggagagcagcaaggg

SEQ ID NO: 492182 - DNA, 20 bp, mouse
gaggcacagccttcgcacat

SEQ ID NO: 492183 - DNA, 20 bp, mouse
ggggagagagggctggacat

SEQ ID NO: 492184 - DNA, 20 bp, mouse
gaaactttggggctgctggt

SEQ ID NO: 492185 - DNA, 20 bp, mouse
gactaatgtcctcatcacga

SEQ ID NO: 492186 - DNA, 20 bp, mouse
ggcctctccagagggatccc

SEQ ID NO: 492187 - DNA, 20 bp, mouse
gtcccgagggcctctccaga

SEQ ID NO: 492188 - DNA, 20 bp, mouse
ggcagccagccgactgctgg

SEQ ID NO: 492189 - DNA, 20 bp, mouse
gcgcgggcggtgggacacaa

SEQ ID NO: 492190 - DNA, 20 bp, mouse
gacccgggatccctctggag

SEQ ID NO: 492191 - DNA, 20 bp, mouse
gcccgctcttaaagagaccc

SEQ ID NO: 492192 - DNA, 20 bp, mouse
gtccctctggagaggccctc

SEQ ID NO: 492193 - DNA, 20 bp, mouse
ggctcctccgaaagacatcg

SEQ ID NO: 492194 - DNA, 20 bp, mouse
gtcccgggtctctttaagag

SEQ ID NO: 492195 - DNA, 20 bp, mouse
gtgtgcgctccgccagcagt

SEQ ID NO: 492196 - DNA, 20 bp, mouse
gggatgcgcggttcccgcaa

SEQ ID NO: 492197 - DNA, 20 bp, mouse
gtctgtctccgcagatattg

SEQ ID NO: 492198 - DNA, 20 bp, mouse
gtggacttctatgaggtact

SEQ ID NO: 492199 - DNA, 20 bp, mouse
gagctctgcctcaatatctg

SEQ ID NO: 492200 - DNA, 20 bp, mouse
gcttctatgaggtactgggt

SEQ ID NO: 492201 - DNA, 20 bp, mouse
gcttttaaaaggtggaggag

SEQ ID NO: 492202 - DNA, 20 bp, mouse
ggcacaaaataacttttaaa

SEQ ID NO: 492203 - DNA, 20 bp, mouse
gaataacttttaaaaggtgg

SEQ ID NO: 492204 - DNA, 20 bp, mouse
gaactttggttttggacttc

SEQ ID NO: 492205 - DNA, 20 bp, mouse
gggaaaaggagaaccccttg

SEQ ID NO: 492206 - DNA, 20 bp, mouse
gaaaatatcgagactttgct

SEQ ID NO: 492207 - DNA, 20 bp, mouse
ggctgatgaaggagacgcct

SEQ ID NO: 492208 - DNA, 20 bp, mouse
gactgcctcagggtgctcca

SEQ ID NO: 492209 - DNA, 20 bp, mouse
gctggcaagaaggccaagaa

SEQ ID NO: 492210 - DNA, 20 bp, mouse
gtgctccacggcagcttctg

SEQ ID NO: 492211 - DNA, 20 bp, mouse
gaagctgacgaactgcctca

SEQ ID NO: 492212 - DNA, 20 bp, mouse
ggaaaagaggggctatgtaa

SEQ ID NO: 492213 - DNA, 20 bp, mouse
ggacgttcgatccagctctg

SEQ ID NO: 492214 - DNA, 20 bp, mouse
gcggcagcttctggggtcca

SEQ ID NO: 492215 - DNA, 20 bp, mouse
ggaaaacagaggaaactatg

SEQ ID NO: 492216 - DNA, 20 bp, mouse
gagagcctcaagtctccgga

SEQ ID NO: 492217 - DNA, 20 bp, mouse
gaatggggagcggtcgagtg

SEQ ID NO: 492218 - DNA, 20 bp, mouse
gcaacatggagacaccatcc

SEQ ID NO: 492219 - DNA, 20 bp, mouse
gtcggcggtaagatcaattg

SEQ ID NO: 492220 - DNA, 20 bp, mouse
gctggcatatgctgcccgga

SEQ ID NO: 492221 - DNA, 20 bp, mouse
gttaattatttttataggcc

SEQ ID NO: 492222 - DNA, 20 bp, mouse
gctccatgttggagagatct

SEQ ID NO: 492223 - DNA, 20 bp, mouse
gctcaagtctccggagggtt

SEQ ID NO: 492224 - DNA, 20 bp, mouse
ggatacagccgaggtttgcc

SEQ ID NO: 492225 - DNA, 20 bp, mouse
gggagacttgaggctctagg

SEQ ID NO: 492226 - DNA, 20 bp, mouse
gggccctgcagaatcaccaa

SEQ ID NO: 492227 - DNA, 20 bp, mouse
ggtgattctgcagggcccag

SEQ ID NO: 492228 - DNA, 20 bp, mouse
gtcaccaaaggttctagcaa

SEQ ID NO: 492229 - DNA, 20 bp, mouse
gaaggttctagcaagggtcc

SEQ ID NO: 492230 - DNA, 20 bp, mouse
gtctcactgcggagattgag

SEQ ID NO: 492231 - DNA, 20 bp, mouse
gagcgtggtagaggattccc

SEQ ID NO: 492232 - DNA, 20 bp, mouse
gaagtcgcagaccaaggcct

SEQ ID NO: 492233 - DNA, 20 bp, mouse
gctgcgacttcttggtctgg

SEQ ID NO: 492234 - DNA, 20 bp, mouse
gtctcgggtggtcacactcc

SEQ ID NO: 492235 - DNA, 20 bp, mouse
gaccaagaagtcgcagacca

SEQ ID NO: 492236 - DNA, 20 bp, mouse
gggggagctggcggtaactt

SEQ ID NO: 492237 - DNA, 20 bp, mouse
gtactgcaagacttgttgtg

SEQ ID NO: 492238 - DNA, 20 bp, mouse
gactatctccagatctccct

SEQ ID NO: 492239 - DNA, 20 bp, mouse
gaggtgaattatgaccatcg

SEQ ID NO: 492240 - DNA, 20 bp, mouse
gctggcggtaacttaggcag

SEQ ID NO: 492241 - DNA, 20 bp, mouse
ggggagctgtggggagctgg

SEQ ID NO: 492242 - DNA, 20 bp, mouse
gaaccctgtgcttcatccaa

SEQ ID NO: 492243 - DNA, 20 bp, mouse
gctgtgcttcatccaatgga

SEQ ID NO: 492244 - DNA, 20 bp, mouse
ggctaaggtctgaaccccga

SEQ ID NO: 492245 - DNA, 20 bp, mouse
gaatgcctaccgtgtcatga

SEQ ID NO: 492246 - DNA, 20 bp, mouse
gatgctctggatgtcctctg

SEQ ID NO: 492247 - DNA, 20 bp, mouse
gcatctaagatgctaaccat

SEQ ID NO: 492248 - DNA, 20 bp, mouse
gtcagcccctacctttccaa

SEQ ID NO: 492249 - DNA, 20 bp, mouse
gctaaccattggaaaggtag

SEQ ID NO: 492250 - DNA, 20 bp, mouse
gactctgatcttctccacag

SEQ ID NO: 492251 - DNA, 20 bp, mouse
gatactgcacgggaaaggga

SEQ ID NO: 492252 - DNA, 20 bp, mouse
gcttcgcattcaagggacca

SEQ ID NO: 492253 - DNA, 20 bp, mouse
gtctgtccataaaaagaaga

SEQ ID NO: 492254 - DNA, 20 bp, mouse
ggacatccgatctccaccca

SEQ ID NO: 492255 - DNA, 20 bp, mouse
gccataaaaagaagagggct

SEQ ID NO: 492256 - DNA, 20 bp, mouse
gctgcttcagccaaaggtaa

SEQ ID NO: 492257 - DNA, 20 bp, mouse
gcgcatcctgcttcagccaa

SEQ ID NO: 492258 - DNA, 20 bp, mouse
gtaccttgggtctcagtaga

SEQ ID NO: 492259 - DNA, 20 bp, mouse
gtccccagaccatttacctt

SEQ ID NO: 492260 - DNA, 20 bp, mouse
gcgccttctactgagaccca

SEQ ID NO: 492261 - DNA, 20 bp, mouse
gtctggggagtactgaacgg

SEQ ID NO: 492262 - DNA, 20 bp, mouse
gtggtctggggagtactgaa

SEQ ID NO: 492263 - DNA, 20 bp, mouse
gttgatgaaacctttacctt

SEQ ID NO: 492264 - DNA, 20 bp, mouse
gtactgagacccaaggtaaa

SEQ ID NO: 492265 - DNA, 20 bp, mouse
gacccaaggtaaatggtctg

SEQ ID NO: 492266 - DNA, 20 bp, mouse
gtctggctcaattgtagggt

SEQ ID NO: 492267 - DNA, 20 bp, mouse
gagggggctagactctgtgg

SEQ ID NO: 492268 - DNA, 20 bp, mouse
ggcgccccccccaacatgtc

SEQ ID NO: 492269 - DNA, 20 bp, mouse
gaagagggggctagactctg

SEQ ID NO: 492270 - DNA, 20 bp, mouse
gccttacctgacatgttggg

SEQ ID NO: 492271 - DNA, 20 bp, mouse
gtttaaatctttacaatact

SEQ ID NO: 492272 - DNA, 20 bp, mouse
gctggacacactcgctgatt

SEQ ID NO: 492273 - DNA, 20 bp, mouse
gtggggggggcgctctgtat

SEQ ID NO: 492274 - DNA, 20 bp, mouse
gacagagctcactggtcaca

SEQ ID NO: 492275 - DNA, 20 bp, mouse
gtacaatactagggatgaca

SEQ ID NO: 492276 - DNA, 20 bp, mouse
gttcattgaagaacacgagg

SEQ ID NO: 492277 - DNA, 20 bp, mouse
ggcaataacgcaggagaccc

SEQ ID NO: 492278 - DNA, 20 bp, mouse
gggccacgcggttccacttc

SEQ ID NO: 492279 - DNA, 20 bp, mouse
gcgaaacgtgttgccagaag

SEQ ID NO: 492280 - DNA, 20 bp, mouse
gtgccagaagtggaaccgcg

SEQ ID NO: 492281 - DNA, 20 bp, mouse
gaggaatatgatcattccaa

SEQ ID NO: 492282 - DNA, 20 bp, mouse
gatcctttgtctctgctctt

SEQ ID NO: 492283 - DNA, 20 bp, mouse
gatcgaagtcactttcatct

SEQ ID NO: 492284 - DNA, 20 bp, mouse
ggaaagtgacttcgattctg

SEQ ID NO: 492285 - DNA, 20 bp, mouse
gaaagcagtggcaataacgc

SEQ ID NO: 492286 - DNA, 20 bp, mouse
gctacttacctggagaaagg

SEQ ID NO: 492287 - DNA, 20 bp, mouse
gcagactatagcaggttctg

SEQ ID NO: 492288 - DNA, 20 bp, mouse
gtgaggatccactacttacc

SEQ ID NO: 492289 - DNA, 20 bp, mouse
gaaaggaggtcaatggaaga

SEQ ID NO: 492290 - DNA, 20 bp, mouse
gtggctgtctaagtatggag

SEQ ID NO: 492291 - DNA, 20 bp, mouse
gtggagatgctctggaaaaa

SEQ ID NO: 492292 - DNA, 20 bp, mouse
gaaaaatggctgtctaagta

SEQ ID NO: 492293 - DNA, 20 bp, mouse
gtatcagtgtgttaagacat

SEQ ID NO: 492294 - DNA, 20 bp, mouse
ggtctagaattactcagagt

SEQ ID NO: 492295 - DNA, 20 bp, mouse
gctgataaacatattctaaa

SEQ ID NO: 492296 - DNA, 20 bp, mouse
gtcaagtccgacgcgcacgg

SEQ ID NO: 492297 - DNA, 20 bp, mouse
gtctcggagctgaggacggt

SEQ ID NO: 492298 - DNA, 20 bp, mouse
gagattctcggagctgagga

SEQ ID NO: 492299 - DNA, 20 bp, mouse
gtagcgttccggaagattct

SEQ ID NO: 492300 - DNA, 20 bp, mouse
gaggacggtgggattctgga

SEQ ID NO: 492301 - DNA, 20 bp, mouse
ggattctggagggtttacat

SEQ ID NO: 492302 - DNA, 20 bp, mouse
gggcgactgtagccgaacca

SEQ ID NO: 492303 - DNA, 20 bp, mouse
gcagcagcctccgtgcgcgt

SEQ ID NO: 492304 - DNA, 20 bp, mouse
gcgttagcttcagggccggg

SEQ ID NO: 492305 - DNA, 20 bp, mouse
ggcgtcggacttgatagcgc

SEQ ID NO: 492306 - DNA, 20 bp, mouse
gaccccgcggagagccacca

SEQ ID NO: 492307 - DNA, 20 bp, mouse
gtggctctccgcggggtcca

SEQ ID NO: 492308 - DNA, 20 bp, mouse
gaacgctgccatggaccccg

SEQ ID NO: 492309 - DNA, 20 bp, mouse
ggttccaggtgacgccatgg

SEQ ID NO: 492310 - DNA, 20 bp, mouse
gctggttccaggtgacgcca

SEQ ID NO: 492311 - DNA, 20 bp, mouse
ggccatggtggctctccgcg

SEQ ID NO: 492312 - DNA, 20 bp, mouse
gcctggaaccagagcaccct

SEQ ID NO: 492313 - DNA, 20 bp, mouse
gtggcagcgtttccgacaca

SEQ ID NO: 492314 - DNA, 20 bp, mouse
gtagggagcagggcaagcac

SEQ ID NO: 492315 - DNA, 20 bp, mouse
gcagcccgaaccctaaacaa

SEQ ID NO: 492316 - DNA, 20 bp, mouse
gagccctcctgcgaaccaca

SEQ ID NO: 492317 - DNA, 20 bp, mouse
ggaccttgtggttcgcagga

SEQ ID NO: 492318 - DNA, 20 bp, mouse
gtactgaccttgtggttcgc

SEQ ID NO: 492319 - DNA, 20 bp, mouse
gaggcaaccggaatctgctt

SEQ ID NO: 492320 - DNA, 20 bp, mouse
gataagttgtactgaccttg

SEQ ID NO: 492321 - DNA, 20 bp, mouse
gaggtgctaagaggataaga

SEQ ID NO: 492322 - DNA, 20 bp, mouse
gatgtgagtcgtacaacaga

SEQ ID NO: 492323 - DNA, 20 bp, mouse
gcagccaggcgtggcgcatc

SEQ ID NO: 492324 - DNA, 20 bp, mouse
ggactctattaattcatgta

SEQ ID NO: 492325 - DNA, 20 bp, mouse
gtctctgaagcaaacaatga

SEQ ID NO: 492326 - DNA, 20 bp, mouse
gactgtcattagtaaagtaa

SEQ ID NO: 492327 - DNA, 20 bp, mouse
gttgggagaggtagtcatga

SEQ ID NO: 492328 - DNA, 20 bp, mouse
ggaagggatgaggtgaacac

SEQ ID NO: 492329 - DNA, 20 bp, mouse
gcatacagtggggaagcctg

SEQ ID NO: 492330 - DNA, 20 bp, mouse
gcagacgcgaaacagaaagg

SEQ ID NO: 492331 - DNA, 20 bp, mouse
gtctgggctctttagggtct

SEQ ID NO: 492332 - DNA, 20 bp, mouse
gggtctgctgagaagggatg

SEQ ID NO: 492333 - DNA, 20 bp, mouse
gcatggccatcatgaaagtg

SEQ ID NO: 492334 - DNA, 20 bp, mouse
gggatgaggtgaacactggt

SEQ ID NO: 492335 - DNA, 20 bp, mouse
gaaaggaggtatctatccat

SEQ ID NO: 492336 - DNA, 20 bp, mouse
ggtgcatgggcttgtagaaa

SEQ ID NO: 492337 - DNA, 20 bp, mouse
ggaggtcatgaagcccatgc

SEQ ID NO: 492338 - DNA, 20 bp, mouse
gagaaagggaagccctgcat

SEQ ID NO: 492339 - DNA, 20 bp, mouse
ggtcgggtaagaccggaatt

SEQ ID NO: 492340 - DNA, 20 bp, mouse
ggtaagaccggaattggggg

SEQ ID NO: 492341 - DNA, 20 bp, mouse
gtgacatcctcccccaattc

SEQ ID NO: 492342 - DNA, 20 bp, mouse
ggcctttccaagaggaagtc

SEQ ID NO: 492343 - DNA, 20 bp, mouse
gtcccagtttggccagatct

SEQ ID NO: 492344 - DNA, 20 bp, mouse
gtgtcgttggaacgggtctc

SEQ ID NO: 492345 - DNA, 20 bp, mouse
gttgatataaatagtgtcgt

SEQ ID NO: 492346 - DNA, 20 bp, mouse
gtaactcgaggagggctggg

SEQ ID NO: 492347 - DNA, 20 bp, mouse
gggcggccacgtgactgtgt

SEQ ID NO: 492348 - DNA, 20 bp, mouse
gcacgtgactgtgttggcta

SEQ ID NO: 492349 - DNA, 20 bp, mouse
gaggtaactcgaggagggct

SEQ ID NO: 492350 - DNA, 20 bp, mouse
gggcgcaccttgctccagca

SEQ ID NO: 492351 - DNA, 20 bp, mouse
gcgagttacctggaatgtct

SEQ ID NO: 492352 - DNA, 20 bp, mouse
gcattccaggtaactcgagg

SEQ ID NO: 492353 - DNA, 20 bp, mouse
ggcctccgcccagacattcc

SEQ ID NO: 492354 - DNA, 20 bp, mouse
gaaaatgcatgctcccacca

SEQ ID NO: 492355 - DNA, 20 bp, mouse
gcattcaactctcctttcgg

SEQ ID NO: 492356 - DNA, 20 bp, mouse
gaggacactgtgatgaatct

SEQ ID NO: 492357 - DNA, 20 bp, mouse
gaatctgggtctgggcatct

SEQ ID NO: 492358 - DNA, 20 bp, mouse
gctgtgatgaatctgggtct

SEQ ID NO: 492359 - DNA, 20 bp, mouse
gtggggttaagaaccctgtc

SEQ ID NO: 492360 - DNA, 20 bp, mouse
ggaggcaccatgtagagtat

SEQ ID NO: 492361 - DNA, 20 bp, mouse
gagagtatcggtaatccctt

SEQ ID NO: 492362 - DNA, 20 bp, mouse
gggattaccgatactctaca

SEQ ID NO: 492363 - DNA, 20 bp, mouse
ggtaagagtagctcagtgtc

SEQ ID NO: 492364 - DNA, 20 bp, mouse
gggttcttatatgtacaaaa

SEQ ID NO: 492365 - DNA, 20 bp, mouse
gaagaagagcaggctttgtg

SEQ ID NO: 492366 - DNA, 20 bp, mouse
gcttatctgagtgtctccca

SEQ ID NO: 492367 - DNA, 20 bp, mouse
gcacttgcatggaagcacaa

SEQ ID NO: 492368 - DNA, 20 bp, mouse
ggagcccaagaagaaactcg

SEQ ID NO: 492369 - DNA, 20 bp, mouse
ggacaagttgagatggattc

SEQ ID NO: 492370 - DNA, 20 bp, mouse
gaggttagaatgtacattga

SEQ ID NO: 492371 - DNA, 20 bp, mouse
gcttatgaagagtaaatggt

SEQ ID NO: 492372 - DNA, 20 bp, mouse
gtctcctgattcctgagatt

SEQ ID NO: 492373 - DNA, 20 bp, mouse
gagtcacaagtcgttcataa

SEQ ID NO: 492374 - DNA, 20 bp, mouse
gggggtttgtttgcagctat

SEQ ID NO: 492375 - DNA, 20 bp, mouse
gaaacccccgagtttcttct

SEQ ID NO: 492376 - DNA, 20 bp, mouse
gcggccaatgatgagacctc

SEQ ID NO: 492377 - DNA, 20 bp, mouse
gaaacagctccaaggagtcg

SEQ ID NO: 492378 - DNA, 20 bp, mouse
gacctcaggccgcgactcct

SEQ ID NO: 492379 - DNA, 20 bp, mouse
gtccaaggagtcgcggcctg

SEQ ID NO: 492380 - DNA, 20 bp, mouse
gacaagatgccaggaacttc

SEQ ID NO: 492381 - DNA, 20 bp, mouse
gaattgttcagagtcggaaa

SEQ ID NO: 492382 - DNA, 20 bp, mouse
gattcagtcttggcagtgca

SEQ ID NO: 492383 - DNA, 20 bp, mouse
gaacttcatcctgaagttcc

SEQ ID NO: 492384 - DNA, 20 bp, mouse
gtacagaaggaattgtttga

SEQ ID NO: 492385 - DNA, 20 bp, mouse
gaattagaattgttcagagt

SEQ ID NO: 492386 - DNA, 20 bp, mouse
gagtggaaaaatgtaatgag

SEQ ID NO: 492387 - DNA, 20 bp, mouse
ggctgttcatagatggtaat

SEQ ID NO: 492388 - DNA, 20 bp, mouse
gcatctatgaacagcaaatg

SEQ ID NO: 492389 - DNA, 20 bp, mouse
gtagggtctgtaactttcca

SEQ ID NO: 492390 - DNA, 20 bp, mouse
gccttgctgggtgagtatgt

SEQ ID NO: 492391 - DNA, 20 bp, mouse
gcaagagagctgcaagaaat

SEQ ID NO: 492392 - DNA, 20 bp, mouse
gagatggtaataggactcca

SEQ ID NO: 492393 - DNA, 20 bp, mouse
gaagaaataggacccttgct

SEQ ID NO: 492394 - DNA, 20 bp, mouse
ggctctcttgctgataaact

SEQ ID NO: 492395 - DNA, 20 bp, mouse
gacaccattgctctaaggaa

SEQ ID NO: 492396 - DNA, 20 bp, mouse
ggcctggtgttaatataacc

SEQ ID NO: 492397 - DNA, 20 bp, mouse
gctggtagaacaagaaatac

SEQ ID NO: 492398 - DNA, 20 bp, mouse
ggtcaacgagaagaccctca

SEQ ID NO: 492399 - DNA, 20 bp, mouse
gtccaggttatattaacacc

SEQ ID NO: 492400 - DNA, 20 bp, mouse
gtctaccaggatagccttga

SEQ ID NO: 492401 - DNA, 20 bp, mouse
gttgtgacaatacttgacag

SEQ ID NO: 492402 - DNA, 20 bp, mouse
gtggccataaaatgcaaccc

SEQ ID NO: 492403 - DNA, 20 bp, mouse
gacatttggcacagttaaat

SEQ ID NO: 492404 - DNA, 20 bp, mouse
ggttgccgtaaaaatgatag

SEQ ID NO: 492405 - DNA, 20 bp, mouse
gatcatttttacggcaacca

SEQ ID NO: 492406 - DNA, 20 bp, mouse
gttaaaagcgataatctctg

SEQ ID NO: 492407 - DNA, 20 bp, mouse
ggagtgtctgactccatgga

SEQ ID NO: 492408 - DNA, 20 bp, mouse
ggtgggacgctctgtagata

SEQ ID NO: 492409 - DNA, 20 bp, mouse
gacactcccagcctagcttt

SEQ ID NO: 492410 - DNA, 20 bp, mouse
ggtaggtcattgactgtcat

SEQ ID NO: 492411 - DNA, 20 bp, mouse
gaactgagacaggtaaacat

SEQ ID NO: 492412 - DNA, 20 bp, mouse
gggacttccgaaagctaggc

SEQ ID NO: 492413 - DNA, 20 bp, mouse
gtgcttgtctgtatacggaa

SEQ ID NO: 492414 - DNA, 20 bp, mouse
ggtctgactccatggaagga

SEQ ID NO: 492415 - DNA, 20 bp, mouse
ggtcctgctggctagaagcc

SEQ ID NO: 492416 - DNA, 20 bp, mouse
gcttcaacgaggcagccgat

SEQ ID NO: 492417 - DNA, 20 bp, mouse
gggatggcagatgcagcacc

SEQ ID NO: 492418 - DNA, 20 bp, mouse
gcatgttggcatttgccaat

SEQ ID NO: 492419 - DNA, 20 bp, mouse
gtaaagttggggtcatacct

SEQ ID NO: 492420 - DNA, 20 bp, mouse
gtatttggtcccggggtccc

SEQ ID NO: 492421 - DNA, 20 bp, mouse
ggggtcatacctgggacccc

SEQ ID NO: 492422 - DNA, 20 bp, mouse
gaggctctttctcttcaacg

SEQ ID NO: 492423 - DNA, 20 bp, mouse
gagcagaggctgatattcac

SEQ ID NO: 492424 - DNA, 20 bp, mouse
ggttgactgcatgaggatgc

SEQ ID NO: 492425 - DNA, 20 bp, mouse
gtcttcttaaaacttttcag

SEQ ID NO: 492426 - DNA, 20 bp, mouse
gggaagctaaggctacgttg

SEQ ID NO: 492427 - DNA, 20 bp, mouse
gagaggcggaagccatgttg

SEQ ID NO: 492428 - DNA, 20 bp, mouse
gaaggtgctcagtccttcct

SEQ ID NO: 492429 - DNA, 20 bp, mouse
gtagatgcaggcaagctcag

SEQ ID NO: 492430 - DNA, 20 bp, mouse
ggtggcactggttgaagtga

SEQ ID NO: 492431 - DNA, 20 bp, mouse
gctttcctcagctgccacca

SEQ ID NO: 492432 - DNA, 20 bp, mouse
gttcaaccagtgccacaaca

SEQ ID NO: 492433 - DNA, 20 bp, mouse
gggaagccatgttgtggcac

SEQ ID NO: 492434 - DNA, 20 bp, mouse
gagcccctacgctgcagatg

SEQ ID NO: 492435 - DNA, 20 bp, mouse
gggccagaaaggtttgatga

SEQ ID NO: 492436 - DNA, 20 bp, mouse
gggagaggagaacctacctg

SEQ ID NO: 492437 - DNA, 20 bp, mouse
ggagagcgcagtcagctgag

SEQ ID NO: 492438 - DNA, 20 bp, mouse
gcctgaggagaaagccagca

SEQ ID NO: 492439 - DNA, 20 bp, mouse
gtaggttctcctctccccaa

SEQ ID NO: 492440 - DNA, 20 bp, mouse
gaggtcggacccttggggag

SEQ ID NO: 492441 - DNA, 20 bp, mouse
gaaaataggtcggacccttg

SEQ ID NO: 492442 - DNA, 20 bp, mouse
gatggagaagctgtttgtct

SEQ ID NO: 492443 - DNA, 20 bp, mouse
gacatcgcactgagaaggta

SEQ ID NO: 492444 - DNA, 20 bp, mouse
ggtctttgctctcgccctgc

SEQ ID NO: 492445 - DNA, 20 bp, mouse
gtgtcagtgtaaaaataggt

SEQ ID NO: 492446 - DNA, 20 bp, mouse
gccataaagacatccccagt

SEQ ID NO: 492447 - DNA, 20 bp, mouse
gatgtctttatgggttatga

SEQ ID NO: 492448 - DNA, 20 bp, mouse
gcaacaaggtttgggctaat

SEQ ID NO: 492449 - DNA, 20 bp, mouse
gtttatttagagtagtaacc

SEQ ID NO: 492450 - DNA, 20 bp, mouse
ggcattctgatgtgaatacc

SEQ ID NO: 492451 - DNA, 20 bp, mouse
gcaggaactttcacccactg

SEQ ID NO: 492452 - DNA, 20 bp, mouse
gtctcccaaagaacttatca

SEQ ID NO: 492453 - DNA, 20 bp, mouse
ggaatgcacagcaaggatcc

SEQ ID NO: 492454 - DNA, 20 bp, mouse
gtcctctttgctggcacagg

SEQ ID NO: 492455 - DNA, 20 bp, mouse
gcactcctctttgctggcac

SEQ ID NO: 492456 - DNA, 20 bp, mouse
gttaaggctcgggatccacg

SEQ ID NO: 492457 - DNA, 20 bp, mouse
gccgttgccaacgagacagg

SEQ ID NO: 492458 - DNA, 20 bp, mouse
ggagctattggacaatctta

SEQ ID NO: 492459 - DNA, 20 bp, mouse
ggcggtgccgcctgtctcgt

SEQ ID NO: 492460 - DNA, 20 bp, mouse
gctattggacaatcttaagg

SEQ ID NO: 492461 - DNA, 20 bp, mouse
gtcgttggcaacgggaagct

SEQ ID NO: 492462 - DNA, 20 bp, mouse
gagtacaggcccaagaagac

SEQ ID NO: 492463 - DNA, 20 bp, mouse
ggcaagactgcaagactgac

SEQ ID NO: 492464 - DNA, 20 bp, mouse
gttcccgttgccaacgagac

SEQ ID NO: 492465 - DNA, 20 bp, mouse
gtgcttggtctcctcgtgtt

SEQ ID NO: 492466 - DNA, 20 bp, mouse
gccacctgcagctgaagaac

SEQ ID NO: 492467 - DNA, 20 bp, mouse
ggctgttcgagaacttgtat

SEQ ID NO: 492468 - DNA, 20 bp, mouse
gggtccggttcttcagctgc

SEQ ID NO: 492469 - DNA, 20 bp, mouse
gcacgtggaggtggatggag

SEQ ID NO: 492470 - DNA, 20 bp, mouse
gcaggatggctatgactgag

SEQ ID NO: 492471 - DNA, 20 bp, mouse
gacacctgtctcacacgtgg

SEQ ID NO: 492472 - DNA, 20 bp, mouse
gccccagctgtcctatctcc

SEQ ID NO: 492473 - DNA, 20 bp, mouse
gacaatccaacctttttcaa

SEQ ID NO: 492474 - DNA, 20 bp, mouse
gagctgtcctatctccagga

SEQ ID NO: 492475 - DNA, 20 bp, mouse
gtctcacacgtggaggtgga

SEQ ID NO: 492476 - DNA, 20 bp, mouse
gggtcgtagaggcagtttgg

SEQ ID NO: 492477 - DNA, 20 bp, mouse
ggcaatgacaaccttggtcg

SEQ ID NO: 492478 - DNA, 20 bp, mouse
gggtggtcgtagaggcagtt

SEQ ID NO: 492479 - DNA, 20 bp, mouse
ggaagttccctcctcgacca

SEQ ID NO: 492480 - DNA, 20 bp, mouse
gggaacttcagtggttatgg

SEQ ID NO: 492481 - DNA, 20 bp, mouse
ggagggaacttcagtggtta

SEQ ID NO: 492482 - DNA, 20 bp, mouse
ggtggctttggtgacaactg

SEQ ID NO: 492483 - DNA, 20 bp, mouse
gatgacaaccttggtcgagg

SEQ ID NO: 492484 - DNA, 20 bp, mouse
gagaatcattgtgacctctc

SEQ ID NO: 492485 - DNA, 20 bp, mouse
gaatgacgaaaacaattttg

SEQ ID NO: 492486 - DNA, 20 bp, mouse
gtgcgtgggccgctcgggtg

SEQ ID NO: 492487 - DNA, 20 bp, mouse
gccacgcagccgggaccgcg

SEQ ID NO: 492488 - DNA, 20 bp, mouse
gcgcggcgcgtcgcttgtta

SEQ ID NO: 492489 - DNA, 20 bp, mouse
gccggaggagctggtagatg

SEQ ID NO: 492490 - DNA, 20 bp, mouse
ggctctccatgagcgagcgg

SEQ ID NO: 492491 - DNA, 20 bp, mouse
ggtagatgcggcggccacgg

SEQ ID NO: 492492 - DNA, 20 bp, mouse
gagcgacgcgccgcgccccg

SEQ ID NO: 492493 - DNA, 20 bp, mouse
gccggctgcgtgggccgctc

SEQ ID NO: 492494 - DNA, 20 bp, mouse
gcgaacaccgcactaccgag

SEQ ID NO: 492495 - DNA, 20 bp, mouse
ggaggagctggtagatgcgg

SEQ ID NO: 492496 - DNA, 20 bp, mouse
ggagaggtcacctgccgaga

SEQ ID NO: 492497 - DNA, 20 bp, mouse
gatggagctggacgcagggt

SEQ ID NO: 492498 - DNA, 20 bp, mouse
gaatagcgaaccatctcggc

SEQ ID NO: 492499 - DNA, 20 bp, mouse
ggtgccattcggcggtataa

SEQ ID NO: 492500 - DNA, 20 bp, mouse
gtcaccattataccgccgaa

SEQ ID NO: 492501 - DNA, 20 bp, mouse
ggtggatggagctggacgca

SEQ ID NO: 492502 - DNA, 20 bp, mouse
gtgcatatccttgatggcat

SEQ ID NO: 492503 - DNA, 20 bp, mouse
gagcaatgtgtgccattcgg

SEQ ID NO: 492504 - DNA, 20 bp, mouse
ggtgacctctcactgcttac

SEQ ID NO: 492505 - DNA, 20 bp, mouse
ggcccaggccaaacagtgga

SEQ ID NO: 492506 - DNA, 20 bp, mouse
gctctgcaatggcgactcag

SEQ ID NO: 492507 - DNA, 20 bp, mouse
gcaatggcgactcagtggca

SEQ ID NO: 492508 - DNA, 20 bp, mouse
gctgcggcactggggtccca

SEQ ID NO: 492509 - DNA, 20 bp, mouse
ggtcaacccacagagaagga

SEQ ID NO: 492510 - DNA, 20 bp, mouse
ggccttccagaacagaactt

SEQ ID NO: 492511 - DNA, 20 bp, mouse
gcatggcggctatagcagtg

SEQ ID NO: 492512 - DNA, 20 bp, mouse
ggttgagaagcgggctgcca

SEQ ID NO: 492513 - DNA, 20 bp, mouse
gtatatcctgcggagggaaa

SEQ ID NO: 492514 - DNA, 20 bp, mouse
ggaaagggagttcaagacaa

SEQ ID NO: 492515 - DNA, 20 bp, mouse
gggatctagccccatagaat

SEQ ID NO: 492516 - DNA, 20 bp, mouse
gtgtttatcaggtttaggat

SEQ ID NO: 492517 - DNA, 20 bp, mouse
gaggtttaggatgggatgtt

SEQ ID NO: 492518 - DNA, 20 bp, mouse
ggtgagcacaagtagtgagg

SEQ ID NO: 492519 - DNA, 20 bp, mouse
gtcagtgagcacaagtagtg

SEQ ID NO: 492520 - DNA, 20 bp, mouse
gggaatgtggtccccaatga

SEQ ID NO: 492521 - DNA, 20 bp, mouse
gcaagtagtgaggtggaatg

SEQ ID NO: 492522 - DNA, 20 bp, mouse
gagaaggaatatttcattct

SEQ ID NO: 492523 - DNA, 20 bp, mouse
gctacttgtgctcactgaaa

SEQ ID NO: 492524 - DNA, 20 bp, mouse
gggatgtttggggtggctta

SEQ ID NO: 492525 - DNA, 20 bp, mouse
gtgtcactgaagaaatgagc

SEQ ID NO: 492526 - DNA, 20 bp, mouse
gcagctccgacgaggaaaag

SEQ ID NO: 492527 - DNA, 20 bp, mouse
gagcgtacaggtgaccccgg

SEQ ID NO: 492528 - DNA, 20 bp, mouse
gacgctgacgactaccctgc

SEQ ID NO: 492529 - DNA, 20 bp, mouse
gctcgtcggagctgccggca

SEQ ID NO: 492530 - DNA, 20 bp, mouse
gaccaggactaggaagatgt

SEQ ID NO: 492531 - DNA, 20 bp, mouse
gcgtcattgaagcagttata

SEQ ID NO: 492532 - DNA, 20 bp, mouse
gtgtgagctgtcaaacatcg

SEQ ID NO: 492533 - DNA, 20 bp, mouse
ggcttacaaggccagcgtac

SEQ ID NO: 492534 - DNA, 20 bp, mouse
gggtcccacaggagcggtag

SEQ ID NO: 492535 - DNA, 20 bp, mouse
ggactccagtggggcattga

SEQ ID NO: 492536 - DNA, 20 bp, mouse
gacgaggcctcaaagcgtgg

SEQ ID NO: 492537 - DNA, 20 bp, mouse
gaggcctcgtgaacagtgtc

SEQ ID NO: 492538 - DNA, 20 bp, mouse
gaggcctcaaagcgtggagg

SEQ ID NO: 492539 - DNA, 20 bp, mouse
gtctggagtggtggcgccga

SEQ ID NO: 492540 - DNA, 20 bp, mouse
gccgcggccttgagacctgg

SEQ ID NO: 492541 - DNA, 20 bp, mouse
gcgccgaggaggatcaagag

SEQ ID NO: 492542 - DNA, 20 bp, mouse
gtgtcttgggaccaaattgg

SEQ ID NO: 492543 - DNA, 20 bp, mouse
gttggcggtcacccgagagt

SEQ ID NO: 492544 - DNA, 20 bp, mouse
gtggcccggggccgactctc

SEQ ID NO: 492545 - DNA, 20 bp, mouse
ggcgtggaggcggtggcccg

SEQ ID NO: 492546 - DNA, 20 bp, mouse
ggaaggtggctacagaaccc

SEQ ID NO: 492547 - DNA, 20 bp, mouse
gtcctggaggacctacaatg

SEQ ID NO: 492548 - DNA, 20 bp, mouse
gttggtgaggattctgtcca

SEQ ID NO: 492549 - DNA, 20 bp, mouse
ggaagagctatgaaacatcc

SEQ ID NO: 492550 - DNA, 20 bp, mouse
gcagaatcctcaccaacaat

SEQ ID NO: 492551 - DNA, 20 bp, mouse
gctcaatcacaggttaacaa

SEQ ID NO: 492552 - DNA, 20 bp, mouse
gaggacctacaatgtggaaa

SEQ ID NO: 492553 - DNA, 20 bp, mouse
gaactttagatgtttcgcca

SEQ ID NO: 492554 - DNA, 20 bp, mouse
gaaaaaatcgtgcagactca

SEQ ID NO: 492555 - DNA, 20 bp, mouse
gtccacattgtaggtcctcc

SEQ ID NO: 492556 - DNA, 20 bp, mouse
gtagcccacctgcagtgtgg

SEQ ID NO: 492557 - DNA, 20 bp, mouse
gtgctaatgaggacagtgac

SEQ ID NO: 492558 - DNA, 20 bp, mouse
gctctctgagagtagtactg

SEQ ID NO: 492559 - DNA, 20 bp, mouse
ggccaaagcagtagatgagg

SEQ ID NO: 492560 - DNA, 20 bp, mouse
ggaagccaaagcagtagatg

SEQ ID NO: 492561 - DNA, 20 bp, mouse
gaagcagtcctccaaacaca

SEQ ID NO: 492562 - DNA, 20 bp, mouse
gactgtggcaccgaggaaaa

SEQ ID NO: 492563 - DNA, 20 bp, mouse
ggtccatgacctcatggtag

SEQ ID NO: 492564 - DNA, 20 bp, mouse
gcccacagcaaggattttat

SEQ ID NO: 492565 - DNA, 20 bp, mouse
gtagaggaataaggtgaatg

SEQ ID NO: 492566 - DNA, 20 bp, mouse
ggtgtggttgcaggtagcac

SEQ ID NO: 492567 - DNA, 20 bp, mouse
ggaagaagaacattgtccac

SEQ ID NO: 492568 - DNA, 20 bp, mouse
gtctaataggatataatgac

SEQ ID NO: 492569 - DNA, 20 bp, mouse
gcctctgccccccaatgctc

SEQ ID NO: 492570 - DNA, 20 bp, mouse
ggaggaaataatagttcacc

SEQ ID NO: 492571 - DNA, 20 bp, mouse
gtgtcctatagcctgagcat

SEQ ID NO: 492572 - DNA, 20 bp, mouse
gtggatatcaagttttcctt

SEQ ID NO: 492573 - DNA, 20 bp, mouse
gtcctattagagagccaagg

SEQ ID NO: 492574 - DNA, 20 bp, mouse
gaacttctcaagctcctcct

SEQ ID NO: 492575 - DNA, 20 bp, mouse
gctatagcctgagcattggg

SEQ ID NO: 492576 - DNA, 20 bp, mouse
gtcggtgacaggctctacgt

SEQ ID NO: 492577 - DNA, 20 bp, mouse
gcacattccatacattggtt

SEQ ID NO: 492578 - DNA, 20 bp, mouse
gactcacacattccatacat

SEQ ID NO: 492579 - DNA, 20 bp, mouse
gcctgctccgaaccaatgta

SEQ ID NO: 492580 - DNA, 20 bp, mouse
gcgctgcagacaggcgtttc

SEQ ID NO: 492581 - DNA, 20 bp, mouse
gggtgttctggattcatgtt

SEQ ID NO: 492582 - DNA, 20 bp, mouse
gacacagttcttttccttca

SEQ ID NO: 492583 - DNA, 20 bp, mouse
ggacaggctctacgtaggcc

SEQ ID NO: 492584 - DNA, 20 bp, mouse
ggatctttcccatcggtgac

SEQ ID NO: 492585 - DNA, 20 bp, mouse
gcttgaaggtcttcaggtcc

SEQ ID NO: 492586 - DNA, 20 bp, mouse
gatggcagtacttgtggcag

SEQ ID NO: 492587 - DNA, 20 bp, mouse
gccaatccttgataatacag

SEQ ID NO: 492588 - DNA, 20 bp, mouse
gtcaccagatggtacaacat

SEQ ID NO: 492589 - DNA, 20 bp, mouse
gatgaagaggtggatagcct

SEQ ID NO: 492590 - DNA, 20 bp, mouse
gatggtacaacattggagcc

SEQ ID NO: 492591 - DNA, 20 bp, mouse
gtcgtatacctcgattccct

SEQ ID NO: 492592 - DNA, 20 bp, mouse
ggttgtaccatctggtgaat

SEQ ID NO: 492593 - DNA, 20 bp, mouse
gtcttaaatcaattactacc

SEQ ID NO: 492594 - DNA, 20 bp, mouse
gaagtgctaaagacatgaag

SEQ ID NO: 492595 - DNA, 20 bp, mouse
gttcatttctctcaaccgga

SEQ ID NO: 492596 - DNA, 20 bp, mouse
ggcaggagcctctacagtga

SEQ ID NO: 492597 - DNA, 20 bp, mouse
gatggtggtttgggtcgaca

SEQ ID NO: 492598 - DNA, 20 bp, mouse
ggccaatcccggggcatcag

SEQ ID NO: 492599 - DNA, 20 bp, mouse
ggtggcaatagggagttcta

SEQ ID NO: 492600 - DNA, 20 bp, mouse
gacctccagatgggtatccc

SEQ ID NO: 492601 - DNA, 20 bp, mouse
gagctagctactctacacat

SEQ ID NO: 492602 - DNA, 20 bp, mouse
gttggagccatctcacttca

SEQ ID NO: 492603 - DNA, 20 bp, mouse
gggagcttccctcactgtag

SEQ ID NO: 492604 - DNA, 20 bp, mouse
gtcccgggatacccatctgg

SEQ ID NO: 492605 - DNA, 20 bp, mouse
ggccactgatgccccgggat

SEQ ID NO: 492606 - DNA, 20 bp, mouse
gtctccatcacacgctggtt

SEQ ID NO: 492607 - DNA, 20 bp, mouse
gcaacctaaccagcgtgtga

SEQ ID NO: 492608 - DNA, 20 bp, mouse
gacacgctggttaggttgct

SEQ ID NO: 492609 - DNA, 20 bp, mouse
gccttatgcctggctcaggg

SEQ ID NO: 492610 - DNA, 20 bp, mouse
gcaaccttatgcctggctca

SEQ ID NO: 492611 - DNA, 20 bp, mouse
gcttcttctccatcacacgc

SEQ ID NO: 492612 - DNA, 20 bp, mouse
gtccactctggacaactcgg

SEQ ID NO: 492613 - DNA, 20 bp, mouse
gcgaatgatgttgaactcag

SEQ ID NO: 492614 - DNA, 20 bp, mouse
gatagcgaaaatatcaaaat

SEQ ID NO: 492615 - DNA, 20 bp, mouse
gtgtgttaactgctaggttt

SEQ ID NO: 492616 - DNA, 20 bp, mouse
gcccgagtctcagtgcttac

SEQ ID NO: 492617 - DNA, 20 bp, mouse
gacaccagcttcaactagag

SEQ ID NO: 492618 - DNA, 20 bp, mouse
ggctgaaggtaaattcacgt

SEQ ID NO: 492619 - DNA, 20 bp, mouse
ggtggatgtacttcaggaaa

SEQ ID NO: 492620 - DNA, 20 bp, mouse
gagcttcaactagagtggct

SEQ ID NO: 492621 - DNA, 20 bp, mouse
gtaggccgattttactctca

SEQ ID NO: 492622 - DNA, 20 bp, mouse
gagttgaagctggtgtatgg

SEQ ID NO: 492623 - DNA, 20 bp, mouse
gaagaccctgagagtaaaat

SEQ ID NO: 492624 - DNA, 20 bp, mouse
gtcatcaagatgattctcgg

SEQ ID NO: 492625 - DNA, 20 bp, mouse
gaactcatcaagatgattct

SEQ ID NO: 492626 - DNA, 20 bp, mouse
gctgctctggctaggatggt

SEQ ID NO: 492627 - DNA, 20 bp, mouse
gcagactgctctggctagga

SEQ ID NO: 492628 - DNA, 20 bp, mouse
ggccctaaaacagactgctc

SEQ ID NO: 492629 - DNA, 20 bp, mouse
gcagagcgagcaggaccggg

SEQ ID NO: 492630 - DNA, 20 bp, mouse
gtaacagaaggcttccaagg

SEQ ID NO: 492631 - DNA, 20 bp, mouse
ggcctgatgctctctagctg

SEQ ID NO: 492632 - DNA, 20 bp, mouse
ggggttcaggaatgagacca

SEQ ID NO: 492633 - DNA, 20 bp, mouse
gctctgggagctgagtcggt

SEQ ID NO: 492634 - DNA, 20 bp, mouse
gcgccagagcgagcaggacc

SEQ ID NO: 492635 - DNA, 20 bp, mouse
gcagagtcacgtgaccacaa

SEQ ID NO: 492636 - DNA, 20 bp, mouse
gaggagaagtgactaaggag

SEQ ID NO: 492637 - DNA, 20 bp, mouse
gctggcaggagaagtgacta

SEQ ID NO: 492638 - DNA, 20 bp, mouse
gcgcaaggcacagcgcagga

SEQ ID NO: 492639 - DNA, 20 bp, mouse
ggaagtgactaaggagtggc

SEQ ID NO: 492640 - DNA, 20 bp, mouse
gaatacgtcagacatctggc

SEQ ID NO: 492641 - DNA, 20 bp, mouse
gcatgaatacgtcagacatc

SEQ ID NO: 492642 - DNA, 20 bp, mouse
gcatgcgcaaggcacagcgc

SEQ ID NO: 492643 - DNA, 20 bp, mouse
gtgccaatctcagagattca

SEQ ID NO: 492644 - DNA, 20 bp, mouse
gggtaaataattcacacaac

SEQ ID NO: 492645 - DNA, 20 bp, mouse
gaagcagatggcatccatgc

SEQ ID NO: 492646 - DNA, 20 bp, mouse
ggatagcatataggtaccaa

SEQ ID NO: 492647 - DNA, 20 bp, mouse
gcctgacagcgctgtcccgt

SEQ ID NO: 492648 - DNA, 20 bp, mouse
gccagggacaggcggtgaac

SEQ ID NO: 492649 - DNA, 20 bp, mouse
gacagcggccacgcagacgc

SEQ ID NO: 492650 - DNA, 20 bp, mouse
ggtgggctggcaggttcccc

SEQ ID NO: 492651 - DNA, 20 bp, mouse
gatatgtacctgcgtctgcg

SEQ ID NO: 492652 - DNA, 20 bp, mouse
ggtagccgtggatagcatat

SEQ ID NO: 492653 - DNA, 20 bp, mouse
gtgagggccccgcagaacca

SEQ ID NO: 492654 - DNA, 20 bp, mouse
gggtacctatatgctatcca

SEQ ID NO: 492655 - DNA, 20 bp, mouse
gtgcgaggtgatgtttacag

SEQ ID NO: 492656 - DNA, 20 bp, mouse
ggccgcctgtgctcactgag

SEQ ID NO: 492657 - DNA, 20 bp, mouse
gtgaaccactcagtgagcac

SEQ ID NO: 492658 - DNA, 20 bp, mouse
ggctcactgagtggttcatc

SEQ ID NO: 492659 - DNA, 20 bp, mouse
gacatcttgtcttggattat

SEQ ID NO: 492660 - DNA, 20 bp, mouse
gggcttgtcttattattcta

SEQ ID NO: 492661 - DNA, 20 bp, mouse
gtggccaatgttggccaggt

SEQ ID NO: 492662 - DNA, 20 bp, mouse
gtcacggcgccacgggaaag

SEQ ID NO: 492663 - DNA, 20 bp, mouse
ggccaaaaaggtgttcattg

SEQ ID NO: 492664 - DNA, 20 bp, mouse
gacgggaaaggggaatgacc

SEQ ID NO: 492665 - DNA, 20 bp, mouse
gtccgtgtagtctgcttttc

SEQ ID NO: 492666 - DNA, 20 bp, mouse
gtttcacccgccatcttttt

SEQ ID NO: 492667 - DNA, 20 bp, mouse
gaactccacccccaaaaaga

SEQ ID NO: 492668 - DNA, 20 bp, mouse
gtttttgggggtggagtttg

SEQ ID NO: 492669 - DNA, 20 bp, mouse
gactttggcggcccagggcc

SEQ ID NO: 492670 - DNA, 20 bp, mouse
gaagaaacctgcgaccaaga

SEQ ID NO: 492671 - DNA, 20 bp, mouse
gtgccagccttcttggtcgc

SEQ ID NO: 492672 - DNA, 20 bp, mouse
gtggctactttggcggccca

SEQ ID NO: 492673 - DNA, 20 bp, mouse
ggctgctgcctcccggccct

SEQ ID NO: 492674 - DNA, 20 bp, mouse
gggatgatcaggagagtccg

SEQ ID NO: 492675 - DNA, 20 bp, mouse
gagagtccggggagtgatgc

SEQ ID NO: 492676 - DNA, 20 bp, mouse
ggagggactgcagtgaggtt

SEQ ID NO: 492677 - DNA, 20 bp, mouse
gctgtgtaaataagacacag

SEQ ID NO: 492678 - DNA, 20 bp, mouse
gtaaataagacacagaggtc

SEQ ID NO: 492679 - DNA, 20 bp, mouse
gtctggagagaagaatagac

SEQ ID NO: 492680 - DNA, 20 bp, mouse
ggaaatcacaagaagaccac

SEQ ID NO: 492681 - DNA, 20 bp, mouse
gaccactggcatcactgctc

SEQ ID NO: 492682 - DNA, 20 bp, mouse
gagctgtactagaacccttc

SEQ ID NO: 492683 - DNA, 20 bp, mouse
ggaatagacgggaagcaaat

SEQ ID NO: 492684 - DNA, 20 bp, mouse
gtttacacagtcagctgaaa

SEQ ID NO: 492685 - DNA, 20 bp, mouse
gggatgttcaggaaacagat

SEQ ID NO: 492686 - DNA, 20 bp, mouse
gaacattccgctgatggcac

SEQ ID NO: 492687 - DNA, 20 bp, mouse
gtaagagaacattccgctga

SEQ ID NO: 492688 - DNA, 20 bp, mouse
ggcccagccagtgccatcag

SEQ ID NO: 492689 - DNA, 20 bp, mouse
gtcaggaaaatgtactttac

SEQ ID NO: 492690 - DNA, 20 bp, mouse
ggagccagtgcggctctgaa

SEQ ID NO: 492691 - DNA, 20 bp, mouse
gctggtagtaaccctcatct

SEQ ID NO: 492692 - DNA, 20 bp, mouse
gaatgtactttacaggtcca

SEQ ID NO: 492693 - DNA, 20 bp, mouse
gaaccgtgcccggcgagcag

SEQ ID NO: 492694 - DNA, 20 bp, mouse
ggagcaccacgaatcaggag

SEQ ID NO: 492695 - DNA, 20 bp, mouse
gccgccgccgagagccagtg

SEQ ID NO: 492696 - DNA, 20 bp, mouse
gtgtgtggaaatggcatact

SEQ ID NO: 492697 - DNA, 20 bp, mouse
gaaaaacctactgcagtcta

SEQ ID NO: 492698 - DNA, 20 bp, mouse
gttgctgggatgcaggaata

SEQ ID NO: 492699 - DNA, 20 bp, mouse
ggacatttttctgaatgatg

SEQ ID NO: 492700 - DNA, 20 bp, mouse
gaatgatggggtggatgaac

SEQ ID NO: 492701 - DNA, 20 bp, mouse
gctgtagcttgctgggatgc

SEQ ID NO: 492702 - DNA, 20 bp, mouse
gaatttgttagtagctgaac

SEQ ID NO: 492703 - DNA, 20 bp, mouse
gttgctgaagttgtgcttgc

SEQ ID NO: 492704 - DNA, 20 bp, mouse
ggacggaactaaaagctttg

SEQ ID NO: 492705 - DNA, 20 bp, mouse
gaacaggagtcactcctgca

SEQ ID NO: 492706 - DNA, 20 bp, mouse
gggaccacagcgcctctcca

SEQ ID NO: 492707 - DNA, 20 bp, mouse
gagcttggtaaaccctggag

SEQ ID NO: 492708 - DNA, 20 bp, mouse
gaacagtctccaggcactag

SEQ ID NO: 492709 - DNA, 20 bp, mouse
gaaaccctggagaggcgctg

SEQ ID NO: 492710 - DNA, 20 bp, mouse
ggtgggggcaggggcaacta

SEQ ID NO: 492711 - DNA, 20 bp, mouse
gtcacatagcaacagtctcc

SEQ ID NO: 492712 - DNA, 20 bp, mouse
ggactcatgcctctagtgcc

SEQ ID NO: 492713 - DNA, 20 bp, mouse
ggcaggggcaactagggcaa

SEQ ID NO: 492714 - DNA, 20 bp, mouse
gttctgaaaacaaggatcct

SEQ ID NO: 492715 - DNA, 20 bp, mouse
gattacagagacatttcaca

SEQ ID NO: 492716 - DNA, 20 bp, mouse
gggaagttagaggatatcga

SEQ ID NO: 492717 - DNA, 20 bp, mouse
ggcatggaagtggacagaga

SEQ ID NO: 492718 - DNA, 20 bp, mouse
ggatatcgacggcatggaag

SEQ ID NO: 492719 - DNA, 20 bp, mouse
gaaggagaagaggaattgat

SEQ ID NO: 492720 - DNA, 20 bp, mouse
gggatcagcaccaggtcaag

SEQ ID NO: 492721 - DNA, 20 bp, mouse
gagaggcaaacctcagtcaa

SEQ ID NO: 492722 - DNA, 20 bp, mouse
gcaagagtccacagcggtca

SEQ ID NO: 492723 - DNA, 20 bp, mouse
gcagagctttggggtcccaa

SEQ ID NO: 492724 - DNA, 20 bp, mouse
gagtggaagggtggaattcg

SEQ ID NO: 492725 - DNA, 20 bp, mouse
gttagaggatatcgacggca

SEQ ID NO: 492726 - DNA, 20 bp, mouse
gttgaggagactcatagtgt

SEQ ID NO: 492727 - DNA, 20 bp, mouse
ggatgaaggagtccccatgc

SEQ ID NO: 492728 - DNA, 20 bp, mouse
gtcagttcttaccactcggt

SEQ ID NO: 492729 - DNA, 20 bp, mouse
gtgcggaacccgctcattgc

SEQ ID NO: 492730 - DNA, 20 bp, mouse
gtctacttgccagcaatgag

SEQ ID NO: 492731 - DNA, 20 bp, mouse
gaaaaaaaaatcccaccgag

SEQ ID NO: 492732 - DNA, 20 bp, mouse
gaatgaggtttgcagaaatc

SEQ ID NO: 492733 - DNA, 20 bp, mouse
gtcattcagttcttaccact

SEQ ID NO: 492734 - DNA, 20 bp, mouse
gctctaagatgttcctgcat

SEQ ID NO: 492735 - DNA, 20 bp, mouse
ggttttatttctcgcccttt

SEQ ID NO: 492736 - DNA, 20 bp, mouse
ggagatcagcgcctgcacag

SEQ ID NO: 492737 - DNA, 20 bp, mouse
gcatagccttgggtaggtag

SEQ ID NO: 492738 - DNA, 20 bp, mouse
gccttgaggaagggccacat

SEQ ID NO: 492739 - DNA, 20 bp, mouse
gtcctggaaagtcaaagatg

SEQ ID NO: 492740 - DNA, 20 bp, mouse
gcttgggtaggtagaggcct

SEQ ID NO: 492741 - DNA, 20 bp, mouse
gtgcacaggggctttcttca

SEQ ID NO: 492742 - DNA, 20 bp, mouse
gttgaagttagcctgaacaa

SEQ ID NO: 492743 - DNA, 20 bp, mouse
gggagggttggcagtgatag

SEQ ID NO: 492744 - DNA, 20 bp, mouse
gtgtagcataagctactcct

SEQ ID NO: 492745 - DNA, 20 bp, mouse
ggaattcacacggattctgt

SEQ ID NO: 492746 - DNA, 20 bp, mouse
gccgcccgggctcacagaaa

SEQ ID NO: 492747 - DNA, 20 bp, mouse
gctcacagaaagggcgcgaa

SEQ ID NO: 492748 - DNA, 20 bp, mouse
gcggtgcgtgcgcccgagct

SEQ ID NO: 492749 - DNA, 20 bp, mouse
ggcgcaagcccgcgacggag

SEQ ID NO: 492750 - DNA, 20 bp, mouse
ggcgccctttctgtgagccc

SEQ ID NO: 492751 - DNA, 20 bp, mouse
gaccccacgcggggctgcag

SEQ ID NO: 492752 - DNA, 20 bp, mouse
gggcttcggtacagcccggg

SEQ ID NO: 492753 - DNA, 20 bp, mouse
gctgcccgcgcgccaatccg

SEQ ID NO: 492754 - DNA, 20 bp, mouse
gaggggtgatcgtcccggga

SEQ ID NO: 492755 - DNA, 20 bp, mouse
gcaggagactgccggctgga

SEQ ID NO: 492756 - DNA, 20 bp, mouse
ggctctcgctcagacttaag

SEQ ID NO: 492757 - DNA, 20 bp, mouse
gcccgagggcgagcatatgc

SEQ ID NO: 492758 - DNA, 20 bp, mouse
ggtcgggagaacgtaccctg

SEQ ID NO: 492759 - DNA, 20 bp, mouse
gagaaagctggttgcggcgg

SEQ ID NO: 492760 - DNA, 20 bp, mouse
gtcccccaaggcaagcatct

SEQ ID NO: 492761 - DNA, 20 bp, mouse
gaggtctgggttggaagggt

SEQ ID NO: 492762 - DNA, 20 bp, mouse
ggagggcgagcatatgccgg

SEQ ID NO: 492763 - DNA, 20 bp, mouse
ggctcaggtctgggttggaa

SEQ ID NO: 492764 - DNA, 20 bp, mouse
gcagagaaagctggttgcgg

SEQ ID NO: 492765 - DNA, 20 bp, mouse
gcccccggcgggactgtctg

SEQ ID NO: 492766 - DNA, 20 bp, mouse
ggtcagtgggcaccgagcag

SEQ ID NO: 492767 - DNA, 20 bp, mouse
ggtcttgggagtaggacgac

SEQ ID NO: 492768 - DNA, 20 bp, mouse
gtattggcaactcccatccc

SEQ ID NO: 492769 - DNA, 20 bp, mouse
ggtggctcaagaagctaata

SEQ ID NO: 492770 - DNA, 20 bp, mouse
gatatgtcccgagcattccg

SEQ ID NO: 492771 - DNA, 20 bp, mouse
gctgaggccggggatggagt

SEQ ID NO: 492772 - DNA, 20 bp, mouse
gccaagaacaccccacgcct

SEQ ID NO: 492773 - DNA, 20 bp, mouse
gctcggagttatcatctctt

SEQ ID NO: 492774 - DNA, 20 bp, mouse
gaccttcggcgttcttatat

SEQ ID NO: 492775 - DNA, 20 bp, mouse
ggtgttcttggcgcgtcagt

SEQ ID NO: 492776 - DNA, 20 bp, mouse
gtgaatcctgatggtggatt

SEQ ID NO: 492777 - DNA, 20 bp, mouse
gggttcctagagaagaaaat

SEQ ID NO: 492778 - DNA, 20 bp, mouse
gctggtttgaatcctgatgg

SEQ ID NO: 492779 - DNA, 20 bp, mouse
gagccaccctgccccgggag

SEQ ID NO: 492780 - DNA, 20 bp, mouse
ggtctaccaaatccaccatc

SEQ ID NO: 492781 - DNA, 20 bp, mouse
ggccataggctcctccaaat

SEQ ID NO: 492782 - DNA, 20 bp, mouse
gtgccgctcccggggcaggg

SEQ ID NO: 492783 - DNA, 20 bp, mouse
gcctccaaatcggctgccat

SEQ ID NO: 492784 - DNA, 20 bp, mouse
gactgctaaacagaatagtg

SEQ ID NO: 492785 - DNA, 20 bp, mouse
gcgtgtgccgctcccggggc

SEQ ID NO: 492786 - DNA, 20 bp, mouse
ggagaaatgagtgtggactc

SEQ ID NO: 492787 - DNA, 20 bp, mouse
ggaggctgctgcgaagactg

SEQ ID NO: 492788 - DNA, 20 bp, mouse
gggccccacattaacagtgt

SEQ ID NO: 492789 - DNA, 20 bp, mouse
ggaattaaatgtaggaaatt

SEQ ID NO: 492790 - DNA, 20 bp, mouse
gggcagaaaccaggaatata

SEQ ID NO: 492791 - DNA, 20 bp, mouse
ggtgggaaatggcagaaacc

SEQ ID NO: 492792 - DNA, 20 bp, mouse
gttcccacactgttaatgtg

SEQ ID NO: 492793 - DNA, 20 bp, mouse
gcttggccaattttactatt

SEQ ID NO: 492794 - DNA, 20 bp, mouse
gaacaccccaatagtaaaat

SEQ ID NO: 492795 - DNA, 20 bp, mouse
gttttcaccatcatctactg

SEQ ID NO: 492796 - DNA, 20 bp, mouse
gggatcctacaaaaagaact

SEQ ID NO: 492797 - DNA, 20 bp, mouse
gacaggaaccggggtgtggt

SEQ ID NO: 492798 - DNA, 20 bp, mouse
gaggtacgtcacaggaaccg

SEQ ID NO: 492799 - DNA, 20 bp, mouse
gagcggcaggcggaggccac

SEQ ID NO: 492800 - DNA, 20 bp, mouse
gactttccggtgctttccag

SEQ ID NO: 492801 - DNA, 20 bp, mouse
ggaactcactatcagatatt

SEQ ID NO: 492802 - DNA, 20 bp, mouse
gcgtcacaggaaccggggtg

SEQ ID NO: 492803 - DNA, 20 bp, mouse
gccctgagactgagtggaag

SEQ ID NO: 492804 - DNA, 20 bp, mouse
gaacacctagttctttttgt

SEQ ID NO: 492805 - DNA, 20 bp, mouse
gacagctggagcagtgtggt

SEQ ID NO: 492806 - DNA, 20 bp, mouse
gctaagaaccagagaagcac

SEQ ID NO: 492807 - DNA, 20 bp, mouse
gagttcaggtcagtttttga

SEQ ID NO: 492808 - DNA, 20 bp, mouse
gcatagtccttagtcttagc

SEQ ID NO: 492809 - DNA, 20 bp, mouse
ggtgtgatctcaatgaaatc

SEQ ID NO: 492810 - DNA, 20 bp, mouse
gtaatggtcatccaactaaa

SEQ ID NO: 492811 - DNA, 20 bp, mouse
gtatacaactgggaaattga

SEQ ID NO: 492812 - DNA, 20 bp, mouse
ggagaacattacagagtatg

SEQ ID NO: 492813 - DNA, 20 bp, mouse
gtacaaggttaattttacta

SEQ ID NO: 492814 - DNA, 20 bp, mouse
gtcatccaactaaaaggtac

SEQ ID NO: 492815 - DNA, 20 bp, mouse
gtcttagtgactcctttaaa

SEQ ID NO: 492816 - DNA, 20 bp, mouse
gtcactgtggagcaacacgt

SEQ ID NO: 492817 - DNA, 20 bp, mouse
ggactttgactggagagaag

SEQ ID NO: 492818 - DNA, 20 bp, mouse
gcgctccagctcctcatcaa

SEQ ID NO: 492819 - DNA, 20 bp, mouse
ggagtacagtacaccgaggc

SEQ ID NO: 492820 - DNA, 20 bp, mouse
ggaacactatgcagagtgtg

SEQ ID NO: 492821 - DNA, 20 bp, mouse
gaaccgcagatccatcactg

SEQ ID NO: 492822 - DNA, 20 bp, mouse
ggtgtactgtactctttctg

SEQ ID NO: 492823 - DNA, 20 bp, mouse
gacagccatctttcctgcct

SEQ ID NO: 492824 - DNA, 20 bp, mouse
gaatgataaaaccattgatg

SEQ ID NO: 492825 - DNA, 20 bp, mouse
gaaaaccattgatgaggagc

SEQ ID NO: 492826 - DNA, 20 bp, mouse
gcactgagacgccaggaagt

SEQ ID NO: 492827 - DNA, 20 bp, mouse
gggtgaatcaggttcactgg

SEQ ID NO: 492828 - DNA, 20 bp, mouse
ggagacgccaggaagtagga

SEQ ID NO: 492829 - DNA, 20 bp, mouse
ggcagatactctggaatagg

SEQ ID NO: 492830 - DNA, 20 bp, mouse
gactctggaataggaggaat

SEQ ID NO: 492831 - DNA, 20 bp, mouse
gctcggtgaatcaggttcac

SEQ ID NO: 492832 - DNA, 20 bp, mouse
gttggtaccttcctacttcc

SEQ ID NO: 492833 - DNA, 20 bp, mouse
gcaaaggccagctggagttg

SEQ ID NO: 492834 - DNA, 20 bp, mouse
gggggcagatactctggaat

SEQ ID NO: 492835 - DNA, 20 bp, mouse
gccatgcccgcaaaacatct

SEQ ID NO: 492836 - DNA, 20 bp, mouse
gtttctagcagtgtctgtgt

SEQ ID NO: 492837 - DNA, 20 bp, mouse
gtgagcaggtagatagatat

SEQ ID NO: 492838 - DNA, 20 bp, mouse
gattcctgggaaagggacga

SEQ ID NO: 492839 - DNA, 20 bp, mouse
gtctgcatgtaagaaggtga

SEQ ID NO: 492840 - DNA, 20 bp, mouse
gtactcctttcctgacatgg

SEQ ID NO: 492841 - DNA, 20 bp, mouse
ggttctgcacatctcaaatg

SEQ ID NO: 492842 - DNA, 20 bp, mouse
gtgggtatagtggcccagca

SEQ ID NO: 492843 - DNA, 20 bp, mouse
gcagggctgcagctttgggt

SEQ ID NO: 492844 - DNA, 20 bp, mouse
gtgagaatctgcatgtaaga

SEQ ID NO: 492845 - DNA, 20 bp, mouse
gcctccttcgtccctttccc

SEQ ID NO: 492846 - DNA, 20 bp, mouse
gtgcgctcagagagaaaccg

SEQ ID NO: 492847 - DNA, 20 bp, mouse
ggcggccatagcatttgcct

SEQ ID NO: 492848 - DNA, 20 bp, mouse
gttagagtatcattgccata

SEQ ID NO: 492849 - DNA, 20 bp, mouse
gtccccagaaggacacagca

SEQ ID NO: 492850 - DNA, 20 bp, mouse
gtcctgtgttggagctaaga

SEQ ID NO: 492851 - DNA, 20 bp, mouse
gaccttcttagctccaacac

SEQ ID NO: 492852 - DNA, 20 bp, mouse
ggaatccgattctctccata

SEQ ID NO: 492853 - DNA, 20 bp, mouse
gattattcttcagagaagca

SEQ ID NO: 492854 - DNA, 20 bp, mouse
gacctcaaaagttcctgtgt

SEQ ID NO: 492855 - DNA, 20 bp, mouse
gaggcggcggccaggagtta

SEQ ID NO: 492856 - DNA, 20 bp, mouse
gtgatgggcccatgagagga

SEQ ID NO: 492857 - DNA, 20 bp, mouse
gaacttgatgggcccatgag

SEQ ID NO: 492858 - DNA, 20 bp, mouse
gcaggcaacactgatctcca

SEQ ID NO: 492859 - DNA, 20 bp, mouse
gacgtctgcacaaccatcga

SEQ ID NO: 492860 - DNA, 20 bp, mouse
ggatagtcagtgactcatct

SEQ ID NO: 492861 - DNA, 20 bp, mouse
ggctggctgaagatagtgac

SEQ ID NO: 492862 - DNA, 20 bp, mouse
gcacgcaaccaaaacttgat

SEQ ID NO: 492863 - DNA, 20 bp, mouse
ggtataagcccgggtagaaa

SEQ ID NO: 492864 - DNA, 20 bp, mouse
gcataagcaagaacgtgcta

SEQ ID NO: 492865 - DNA, 20 bp, mouse
gagctgaaaatatcttatgg

SEQ ID NO: 492866 - DNA, 20 bp, mouse
gttaaaggaagacgtaccat

SEQ ID NO: 492867 - DNA, 20 bp, mouse
gatcattgcacagaggttaa

SEQ ID NO: 492868 - DNA, 20 bp, mouse
ggacactcatcattgcacag

SEQ ID NO: 492869 - DNA, 20 bp, mouse
gcacagaattttgtatccca

SEQ ID NO: 492870 - DNA, 20 bp, mouse
gtttttcctgaggatcaggg

SEQ ID NO: 492871 - DNA, 20 bp, mouse
gacttcagaaatatcatctt

SEQ ID NO: 492872 - DNA, 20 bp, mouse
gattgaatgtacacaaaggg

SEQ ID NO: 492873 - DNA, 20 bp, mouse
gttcataaatagttgtaaca

SEQ ID NO: 492874 - DNA, 20 bp, mouse
gttaattgaatgtacacaaa

SEQ ID NO: 492875 - DNA, 20 bp, mouse
gatttttttcctgaggatca

SEQ ID NO: 492876 - DNA, 20 bp, mouse
gctggctaccaggaaccagg

SEQ ID NO: 492877 - DNA, 20 bp, mouse
gatgctggctaccaggaacc

SEQ ID NO: 492878 - DNA, 20 bp, mouse
ggaattaaggtgagttttgt

SEQ ID NO: 492879 - DNA, 20 bp, mouse
ggcatgaagtacagaacaca

SEQ ID NO: 492880 - DNA, 20 bp, mouse
gcatttcgccacctggttcc

SEQ ID NO: 492881 - DNA, 20 bp, mouse
gacagaacacacgggtttga

SEQ ID NO: 492882 - DNA, 20 bp, mouse
gcttgacctcaagagaatta

SEQ ID NO: 492883 - DNA, 20 bp, mouse
gtaacagcagccaagatcca

SEQ ID NO: 492884 - DNA, 20 bp, mouse
gacaagggcatttcgccacc

SEQ ID NO: 492885 - DNA, 20 bp, mouse
gagttttgtgggcagccata

SEQ ID NO: 492886 - DNA, 20 bp, mouse
ggagtgggaaaagctctgct

SEQ ID NO: 492887 - DNA, 20 bp, mouse
gacaggtactggacactcca

SEQ ID NO: 492888 - DNA, 20 bp, mouse
gaacaagatgatcatcaact

SEQ ID NO: 492889 - DNA, 20 bp, mouse
gctggggctgttatcttcat

SEQ ID NO: 492890 - DNA, 20 bp, mouse
ggccatggaggtgacagctg

SEQ ID NO: 492891 - DNA, 20 bp, mouse
gtggtgtctgtcatagctat

SEQ ID NO: 492892 - DNA, 20 bp, mouse
ggtccagtacctgtatctga

SEQ ID NO: 492893 - DNA, 20 bp, mouse
ggcttgctgtgtggataccc

SEQ ID NO: 492894 - DNA, 20 bp, mouse
gagccttcagatacaggtac

SEQ ID NO: 492895 - DNA, 20 bp, mouse
gatggcttcatgcgtcgagg

SEQ ID NO: 492896 - DNA, 20 bp, mouse
gtgggccaggcggaacccta

SEQ ID NO: 492897 - DNA, 20 bp, mouse
gtacggaaccggtacaccga

SEQ ID NO: 492898 - DNA, 20 bp, mouse
ggaaccggtacaccgagggt

SEQ ID NO: 492899 - DNA, 20 bp, mouse
ggccgcaagtgacgccccta

SEQ ID NO: 492900 - DNA, 20 bp, mouse
gaggcggaaccctacggaac

SEQ ID NO: 492901 - DNA, 20 bp, mouse
gaagtgacgcccctacggtc

SEQ ID NO: 492902 - DNA, 20 bp, mouse
gcgatgtcgccagaccgtag

SEQ ID NO: 492903 - DNA, 20 bp, mouse
gcccaaggcgcgcacggcgg

SEQ ID NO: 492904 - DNA, 20 bp, mouse
gccccccaccctcggtgtac

SEQ ID NO: 492905 - DNA, 20 bp, mouse
ggagggtggggggggcggat

SEQ ID NO: 492906 - DNA, 20 bp, mouse
gacctctggcacaaggaatg

SEQ ID NO: 492907 - DNA, 20 bp, mouse
gagtcatctcggctaatgta

SEQ ID NO: 492908 - DNA, 20 bp, mouse
gagaagggaatgtcgcacaa

SEQ ID NO: 492909 - DNA, 20 bp, mouse
gttcttctgcttgtagaagc

SEQ ID NO: 492910 - DNA, 20 bp, mouse
gagaaaccatctgcataaag

SEQ ID NO: 492911 - DNA, 20 bp, mouse
ggtttaagtattttcacgta

SEQ ID NO: 492912 - DNA, 20 bp, mouse
gaagtattttcacgtaggga

SEQ ID NO: 492913 - DNA, 20 bp, mouse
gcactgcctctttatgcaga

SEQ ID NO: 492914 - DNA, 20 bp, mouse
gctttccttcatatcacctc

SEQ ID NO: 492915 - DNA, 20 bp, mouse
gtttccttgctcattcagaa

SEQ ID NO: 492916 - DNA, 20 bp, mouse
gattcacacacgaacgaatc

SEQ ID NO: 492917 - DNA, 20 bp, mouse
gtggtactgaacacactctc

SEQ ID NO: 492918 - DNA, 20 bp, mouse
gcagtgaccagtgagctgtc

SEQ ID NO: 492919 - DNA, 20 bp, mouse
gtcagtaccagacagctcac

SEQ ID NO: 492920 - DNA, 20 bp, mouse
ggactagtgagggataccat

SEQ ID NO: 492921 - DNA, 20 bp, mouse
gatccatacgggactagtga

SEQ ID NO: 492922 - DNA, 20 bp, mouse
gcttaagaggcaagtaaatg

SEQ ID NO: 492923 - DNA, 20 bp, mouse
gatccctcactagtcccgta

SEQ ID NO: 492924 - DNA, 20 bp, mouse
gtgaactgttgagtcttaag

SEQ ID NO: 492925 - DNA, 20 bp, mouse
ggtatgaatatcaataccta

SEQ ID NO: 492926 - DNA, 20 bp, mouse
gacctgacatgtttgggggg

SEQ ID NO: 492927 - DNA, 20 bp, mouse
gagagagctcactggtcaca

SEQ ID NO: 492928 - DNA, 20 bp, mouse
gctggacacactcgctgatt

SEQ ID NO: 492929 - DNA, 20 bp, mouse
gttaaatctttagaatacta

SEQ ID NO: 492930 - DNA, 20 bp, mouse
gccccccccccaaacatgtc

SEQ ID NO: 492931 - DNA, 20 bp, mouse
gctttacctgacatgtttgg

SEQ ID NO: 492932 - DNA, 20 bp, mouse
gtttatccggctcaattgta

SEQ ID NO: 492933 - DNA, 20 bp, mouse
gatccggctcaattgtaggg

SEQ ID NO: 492934 - DNA, 20 bp, mouse
gagggggctagactctgcga

SEQ ID NO: 492935 - DNA, 20 bp, mouse
gtggggggggggctctgtat

SEQ ID NO: 492936 - DNA, 20 bp, mouse
gctgtatccgaggaggagtg

SEQ ID NO: 492937 - DNA, 20 bp, mouse
gttccgtgctgtatccgagg

SEQ ID NO: 492938 - DNA, 20 bp, mouse
gtggttccgtgctgtatccg

SEQ ID NO: 492939 - DNA, 20 bp, mouse
gctcctcctcggatacagca

SEQ ID NO: 492940 - DNA, 20 bp, mouse
gacagggagggctacttgtg

SEQ ID NO: 492941 - DNA, 20 bp, mouse
ggaacctctgctacacaggg

SEQ ID NO: 492942 - DNA, 20 bp, mouse
gcgatgtgtactcagcccca

SEQ ID NO: 492943 - DNA, 20 bp, mouse
gggaaccaacagcaaagcac

SEQ ID NO: 492944 - DNA, 20 bp, mouse
gcttcccggtgctttgctgt

SEQ ID NO: 492945 - DNA, 20 bp, mouse
gcaaccctatagccaattaa

SEQ ID NO: 492946 - DNA, 20 bp, mouse
gggttatgaatagcaagtgg

SEQ ID NO: 492947 - DNA, 20 bp, mouse
gccataataggcttccacta

SEQ ID NO: 492948 - DNA, 20 bp, mouse
gagaatgaggagctaaagaa

SEQ ID NO: 492949 - DNA, 20 bp, mouse
gttccactagggcagaggga

SEQ ID NO: 492950 - DNA, 20 bp, mouse
ggttctgacccacccataat

SEQ ID NO: 492951 - DNA, 20 bp, mouse
gaggcttccactagggcaga

SEQ ID NO: 492952 - DNA, 20 bp, mouse
gtttgattgaagtgacaagg

SEQ ID NO: 492953 - DNA, 20 bp, mouse
gaggtgatgcttttgggatg

SEQ ID NO: 492954 - DNA, 20 bp, mouse
gtgccctgcagattaacact

SEQ ID NO: 492955 - DNA, 20 bp, mouse
ggccgcttgccagggttaat

SEQ ID NO: 492956 - DNA, 20 bp, mouse
gcgcggcccgcaaccagaca

SEQ ID NO: 492957 - DNA, 20 bp, mouse
gcgagtgtgtgtgccgaacg

SEQ ID NO: 492958 - DNA, 20 bp, mouse
gaagctccttgctcctcgtt

SEQ ID NO: 492959 - DNA, 20 bp, mouse
ggccaggctccgagcagcga

SEQ ID NO: 492960 - DNA, 20 bp, mouse
gaccgggccactctccacag

SEQ ID NO: 492961 - DNA, 20 bp, mouse
ggtgtgccgaacgaggagca

SEQ ID NO: 492962 - DNA, 20 bp, mouse
gccaccggccgagcagggat

SEQ ID NO: 492963 - DNA, 20 bp, mouse
ggtgcgagcgagtgtgcgag

SEQ ID NO: 492964 - DNA, 20 bp, mouse
gagagtggcccggtaagggg

SEQ ID NO: 492965 - DNA, 20 bp, mouse
ggacagggctgcgaaggtgc

SEQ ID NO: 492966 - DNA, 20 bp, mouse
ggcgccaagtgcgtagacaa

SEQ ID NO: 492967 - DNA, 20 bp, mouse
gattcgccggtaccagagag

SEQ ID NO: 492968 - DNA, 20 bp, mouse
gcatggctccataggagagg

SEQ ID NO: 492969 - DNA, 20 bp, mouse
gtcagctcgcatggctccat

SEQ ID NO: 492970 - DNA, 20 bp, mouse
gtcgcatggctccataggag

SEQ ID NO: 492971 - DNA, 20 bp, mouse
ggtagacaagggacattcgc

SEQ ID NO: 492972 - DNA, 20 bp, mouse
ggccgagcccagcagggacc

SEQ ID NO: 492973 - DNA, 20 bp, mouse
gggagccatgcgagctgaaa

SEQ ID NO: 492974 - DNA, 20 bp, mouse
gaagtcgcttcggtgaccag

SEQ ID NO: 492975 - DNA, 20 bp, mouse
gaggacttcctcctctccta

SEQ ID NO: 492976 - DNA, 20 bp, mouse
ggatgagttacacattgtgg

SEQ ID NO: 492977 - DNA, 20 bp, mouse
gcggtcagtttaggagcagg

SEQ ID NO: 492978 - DNA, 20 bp, mouse
gaaagatgagttacacattg

SEQ ID NO: 492979 - DNA, 20 bp, mouse
gaaaactcttaggcatgtct

SEQ ID NO: 492980 - DNA, 20 bp, mouse
gctttagttcacagccaaaa

SEQ ID NO: 492981 - DNA, 20 bp, mouse
gatggaagactcgatggatg

SEQ ID NO: 492982 - DNA, 20 bp, mouse
gcagcatctagtagctatag

SEQ ID NO: 492983 - DNA, 20 bp, mouse
gtctgaagatgaagatgggg

SEQ ID NO: 492984 - DNA, 20 bp, mouse
ggaccgttcttaatgacatc

SEQ ID NO: 492985 - DNA, 20 bp, mouse
gcagcgtctgaagatgaaga

SEQ ID NO: 492986 - DNA, 20 bp, mouse
gggtcccaagtcagacgatc

SEQ ID NO: 492987 - DNA, 20 bp, mouse
ggagccagatcgtctgactt

SEQ ID NO: 492988 - DNA, 20 bp, mouse
gtagaaagtggactcggctg

SEQ ID NO: 492989 - DNA, 20 bp, mouse
gtacatggtttatgtctcac

SEQ ID NO: 492990 - DNA, 20 bp, mouse
gtacacttcggagatgggca

SEQ ID NO: 492991 - DNA, 20 bp, mouse
gttcttaaggatctagaaag

SEQ ID NO: 492992 - DNA, 20 bp, mouse
gaggatctagaaagtggact

SEQ ID NO: 492993 - DNA, 20 bp, mouse
gcggacggcatggcgcacgg

SEQ ID NO: 492994 - DNA, 20 bp, mouse
gacttggtcttgtccaagac

SEQ ID NO: 492995 - DNA, 20 bp, mouse
ggagaagcagctgcccgtct

SEQ ID NO: 492996 - DNA, 20 bp, mouse
gcctccgcaaagcagataaa

SEQ ID NO: 492997 - DNA, 20 bp, mouse
gtttgtcaccggattcatgt

SEQ ID NO: 492998 - DNA, 20 bp, mouse
gccctgaggtgggagaagac

SEQ ID NO: 492999 - DNA, 20 bp, mouse
gacccgaagactgaagttct

SEQ ID NO: 493000 - DNA, 20 bp, mouse
gacttccctccccctgaggt

SEQ ID NO: 493001 - DNA, 20 bp, mouse
ggtgtactgatttttgtcac

SEQ ID NO: 493002 - DNA, 20 bp, mouse
ggagggtaagtgcctgcaag

SEQ ID NO: 493003 - DNA, 20 bp, mouse
gaaacatgaccaggtactgg

SEQ ID NO: 493004 - DNA, 20 bp, mouse
gcaaccttaggaggattggg

SEQ ID NO: 493005 - DNA, 20 bp, mouse
gcccccccccaatcctccta

SEQ ID NO: 493006 - DNA, 20 bp, mouse
gcaggaagccacttcagaag

SEQ ID NO: 493007 - DNA, 20 bp, mouse
gcttcctgccgcttctgaag

SEQ ID NO: 493008 - DNA, 20 bp, mouse
ggcacagcagaggcagatgc

SEQ ID NO: 493009 - DNA, 20 bp, mouse
gggcgtttcagtccctcttg

SEQ ID NO: 493010 - DNA, 20 bp, mouse
ggccgcgcaggaaaaaggag

SEQ ID NO: 493011 - DNA, 20 bp, mouse
ggcggaaatcacttcagaag

SEQ ID NO: 493012 - DNA, 20 bp, mouse
ggaaacgccgcgcaggaaaa

SEQ ID NO: 493013 - DNA, 20 bp, mouse
gcgcaccgtagccatgacag

SEQ ID NO: 493014 - DNA, 20 bp, mouse
gagggactgaaacgccgcgc

SEQ ID NO: 493015 - DNA, 20 bp, mouse
gtcagcctctgtcatggcta

SEQ ID NO: 493016 - DNA, 20 bp, mouse
ggatcaaactgggccctcgg

SEQ ID NO: 493017 - DNA, 20 bp, mouse
gcgcgggctggagtgacctg

SEQ ID NO: 493018 - DNA, 20 bp, mouse
ggcgtgaaaaatggctactg

SEQ ID NO: 493019 - DNA, 20 bp, mouse
gtccgccgttgcgtgaaaaa

SEQ ID NO: 493020 - DNA, 20 bp, mouse
gtggcccaccgatcctccca

SEQ ID NO: 493021 - DNA, 20 bp, mouse
gtaacggttgcgtctgacgc

SEQ ID NO: 493022 - DNA, 20 bp, mouse
gtgacgcctgggatcgggta

SEQ ID NO: 493023 - DNA, 20 bp, mouse
ggtaaccaggaagctatctc

SEQ ID NO: 493024 - DNA, 20 bp, mouse
ggccggagccgaagccgcca

SEQ ID NO: 493025 - DNA, 20 bp, mouse
gaggagcagccgccggaaac

SEQ ID NO: 493026 - DNA, 20 bp, mouse
gttccggaagtgacatcctg

SEQ ID NO: 493027 - DNA, 20 bp, mouse
gccatgaccaactgggaggg

SEQ ID NO: 493028 - DNA, 20 bp, mouse
gtgctggcagggatcacagg

SEQ ID NO: 493029 - DNA, 20 bp, mouse
ggagtctgacgaccagtgta

SEQ ID NO: 493030 - DNA, 20 bp, mouse
gcctctcaataccacagtgc

SEQ ID NO: 493031 - DNA, 20 bp, mouse
gtcagactccagtggccctg

SEQ ID NO: 493032 - DNA, 20 bp, mouse
gtggtattgagaggcgcctc

SEQ ID NO: 493033 - DNA, 20 bp, mouse
gtcctgacctcctgacacca

SEQ ID NO: 493034 - DNA, 20 bp, mouse
gggaagaagcttgatcccca

SEQ ID NO: 493035 - DNA, 20 bp, mouse
gagcccagatgtgacctaca

SEQ ID NO: 493036 - DNA, 20 bp, mouse
gctgcctgacagctctagag

SEQ ID NO: 493037 - DNA, 20 bp, mouse
gggctggtgtggaagacaca

SEQ ID NO: 493038 - DNA, 20 bp, mouse
gggtccactctagagctgtc

SEQ ID NO: 493039 - DNA, 20 bp, mouse
gcgtgcaatgtgaagtctct

SEQ ID NO: 493040 - DNA, 20 bp, mouse
gaccagcggtgcctcctctt

SEQ ID NO: 493041 - DNA, 20 bp, mouse
gatgtgaagtctctgggctc

SEQ ID NO: 493042 - DNA, 20 bp, mouse
gtcatcgtggtcccagtcat

SEQ ID NO: 493043 - DNA, 20 bp, mouse
gcactcgggtctcacccaag

SEQ ID NO: 493044 - DNA, 20 bp, mouse
ggagctgtcaggcagggctt

SEQ ID NO: 493045 - DNA, 20 bp, mouse
gacccaagaggaggcaccgc

SEQ ID NO: 493046 - DNA, 20 bp, mouse
ggtactcataggaggattgg

SEQ ID NO: 493047 - DNA, 20 bp, mouse
gcagaacgcaacaactggca

SEQ ID NO: 493048 - DNA, 20 bp, mouse
gcatgtactcataggaggat

SEQ ID NO: 493049 - DNA, 20 bp, mouse
ggagaccagaacgcaacaac

SEQ ID NO: 493050 - DNA, 20 bp, mouse
gaacgcaacaactggcacgg

SEQ ID NO: 493051 - DNA, 20 bp, mouse
gcacggaggatttcaagcga

SEQ ID NO: 493052 - DNA, 20 bp, mouse
gggaggattggaggtacagc

SEQ ID NO: 493053 - DNA, 20 bp, mouse
ggccatcgacatgtactcat

SEQ ID NO: 493054 - DNA, 20 bp, mouse
gatcgacatgtactcatagg

SEQ ID NO: 493055 - DNA, 20 bp, mouse
gcaaaactgcctagatcagc

SEQ ID NO: 493056 - DNA, 20 bp, mouse
ggtggcatgaacccaagaaa

SEQ ID NO: 493057 - DNA, 20 bp, mouse
gagcaagcggcaactatcca

SEQ ID NO: 493058 - DNA, 20 bp, mouse
gccggaggcctgcctgacac

SEQ ID NO: 493059 - DNA, 20 bp, mouse
gtcattgccaaacagagagg

SEQ ID NO: 493060 - DNA, 20 bp, mouse
ggacaacacgagcgagcaag

SEQ ID NO: 493061 - DNA, 20 bp, mouse
gagagacagctgtctttggg

SEQ ID NO: 493062 - DNA, 20 bp, mouse
gggcttcaaccattctccaa

SEQ ID NO: 493063 - DNA, 20 bp, mouse
gtttgaggaggaggtaaatg

SEQ ID NO: 493064 - DNA, 20 bp, mouse
gtctgtctaactgagactag

SEQ ID NO: 493065 - DNA, 20 bp, mouse
ggagaatggttgaagcccag

SEQ ID NO: 493066 - DNA, 20 bp, mouse
gagaacagattgtcctagat

SEQ ID NO: 493067 - DNA, 20 bp, mouse
ggtagcctagtcaccaagga

SEQ ID NO: 493068 - DNA, 20 bp, mouse
gagtccttcgtcaaagaaga

SEQ ID NO: 493069 - DNA, 20 bp, mouse
ggtaccatcttctttgacga

SEQ ID NO: 493070 - DNA, 20 bp, mouse
gacgatgattgtttccttct

SEQ ID NO: 493071 - DNA, 20 bp, mouse
gaggaaggagagaggtaaga

SEQ ID NO: 493072 - DNA, 20 bp, mouse
gctgagtagcctagtcacca

SEQ ID NO: 493073 - DNA, 20 bp, mouse
gactaggctactcagaaact

SEQ ID NO: 493074 - DNA, 20 bp, mouse
gaggagagaggtaagaaggc

SEQ ID NO: 493075 - DNA, 20 bp, mouse
gttgaggattgtttaagcta

SEQ ID NO: 493076 - DNA, 20 bp, mouse
gagctgtgctttgacctggt

SEQ ID NO: 493077 - DNA, 20 bp, mouse
gtcattaaggtggatgtagg

SEQ ID NO: 493078 - DNA, 20 bp, mouse
gaattcttcatatttatcat

SEQ ID NO: 493079 - DNA, 20 bp, mouse
gtttgagctgtgctttgacc

SEQ ID NO: 493080 - DNA, 20 bp, mouse
gtaggtcagttcatcatctt

SEQ ID NO: 493081 - DNA, 20 bp, mouse
gctttctggaaagaacaatt

SEQ ID NO: 493082 - DNA, 20 bp, mouse
gacttgagttttatacacaa

SEQ ID NO: 493083 - DNA, 20 bp, mouse
gacttcattaaggtggatgt

SEQ ID NO: 493084 - DNA, 20 bp, mouse
ggatttgatgttacatactc

SEQ ID NO: 493085 - DNA, 20 bp, mouse
gtgttggttatggaaagcaa

SEQ ID NO: 493086 - DNA, 20 bp, mouse
gatgctgccccttgtctgga

SEQ ID NO: 493087 - DNA, 20 bp, mouse
gcccaaatccacacccgcca

SEQ ID NO: 493088 - DNA, 20 bp, mouse
ggccatggcgggtgtggatt

SEQ ID NO: 493089 - DNA, 20 bp, mouse
gttgtcagccatggcgggtg

SEQ ID NO: 493090 - DNA, 20 bp, mouse
gagcccgccatcacccgtag

SEQ ID NO: 493091 - DNA, 20 bp, mouse
gttcctgccactacgggtga

SEQ ID NO: 493092 - DNA, 20 bp, mouse
gagcctgttcctgccactac

SEQ ID NO: 493093 - DNA, 20 bp, mouse
gccttgtctggaaggtgttt

SEQ ID NO: 493094 - DNA, 20 bp, mouse
gggcagcatgaccacttcgt

SEQ ID NO: 493095 - DNA, 20 bp, mouse
gccgccatggctgacaaaat

SEQ ID NO: 493096 - DNA, 20 bp, mouse
gagtgttatgcttacatctt

SEQ ID NO: 493097 - DNA, 20 bp, mouse
gctgaagttcagaacttagg

SEQ ID NO: 493098 - DNA, 20 bp, mouse
gtttctgaagttcagaactt

SEQ ID NO: 493099 - DNA, 20 bp, mouse
gagcacacttgagaaagctg

SEQ ID NO: 493100 - DNA, 20 bp, mouse
gctctcagggcagactgcag

SEQ ID NO: 493101 - DNA, 20 bp, mouse
gcagtctgccctgagagaga

SEQ ID NO: 493102 - DNA, 20 bp, mouse
ggccagctctagactctcca

SEQ ID NO: 493103 - DNA, 20 bp, mouse
ggagagaaggtttgacagag

SEQ ID NO: 493104 - DNA, 20 bp, mouse
gaccctggagagtctagagc

SEQ ID NO: 493105 - DNA, 20 bp, mouse
ggaacttaggaggcaaaccc

SEQ ID NO: 493106 - DNA, 20 bp, mouse
ggtagtggtggttcgttgtg

SEQ ID NO: 493107 - DNA, 20 bp, mouse
gagtgtttgaaagtgatttc

SEQ ID NO: 493108 - DNA, 20 bp, mouse
gtggtaatatattttaaacg

SEQ ID NO: 493109 - DNA, 20 bp, mouse
gttcgcaggagatttatcat

SEQ ID NO: 493110 - DNA, 20 bp, mouse
gagggttcttcaatattctc

SEQ ID NO: 493111 - DNA, 20 bp, mouse
gtcttcaatattctctggaa

SEQ ID NO: 493112 - DNA, 20 bp, mouse
gccctggaaagtgagattca

SEQ ID NO: 493113 - DNA, 20 bp, mouse
gacggatactcttataaaag

SEQ ID NO: 493114 - DNA, 20 bp, mouse
gtccgtgaatctcactttcc

SEQ ID NO: 493115 - DNA, 20 bp, mouse
gtttgattatacttatacca

SEQ ID NO: 493116 - DNA, 20 bp, mouse
gactagataaacccctccag

SEQ ID NO: 493117 - DNA, 20 bp, mouse
gagataaacccctccagggg

SEQ ID NO: 493118 - DNA, 20 bp, mouse
gactctctcctcccctggag

SEQ ID NO: 493119 - DNA, 20 bp, mouse
ggtcacccagctgaggatgt

SEQ ID NO: 493120 - DNA, 20 bp, mouse
gccgctcagggcaggaggtg

SEQ ID NO: 493121 - DNA, 20 bp, mouse
gcaagcagccacagatccga

SEQ ID NO: 493122 - DNA, 20 bp, mouse
gctcttggaaggcctggcta

SEQ ID NO: 493123 - DNA, 20 bp, mouse
ggggtgactctctcctcccc

SEQ ID NO: 493124 - DNA, 20 bp, mouse
gccgggcaaaggatactgtg

SEQ ID NO: 493125 - DNA, 20 bp, mouse
gatgggaactgagaaaccag

SEQ ID NO: 493126 - DNA, 20 bp, mouse
ggaaaaacatctgaccccac

SEQ ID NO: 493127 - DNA, 20 bp, mouse
ggacaaggattctaacccgt

SEQ ID NO: 493128 - DNA, 20 bp, mouse
gtataaaaccaaattctcta

SEQ ID NO: 493129 - DNA, 20 bp, mouse
gacacttaaagagttgaatc

SEQ ID NO: 493130 - DNA, 20 bp, mouse
gggggtcagatgtttttcca

SEQ ID NO: 493131 - DNA, 20 bp, mouse
gttcgggtcaatataacatt

SEQ ID NO: 493132 - DNA, 20 bp, mouse
gatctgtgggtcacatcctt

SEQ ID NO: 493133 - DNA, 20 bp, mouse
ggatcatttaacaactccaa

SEQ ID NO: 493134 - DNA, 20 bp, mouse
gattttctggatgaataatc

SEQ ID NO: 493135 - DNA, 20 bp, mouse
gtatcatgcatcatgttttc

SEQ ID NO: 493136 - DNA, 20 bp, mouse
gtggggagagagccagagta

SEQ ID NO: 493137 - DNA, 20 bp, mouse
gagccagagtagggtaggtg

SEQ ID NO: 493138 - DNA, 20 bp, mouse
ggaagacgcctgaacacgct

SEQ ID NO: 493139 - DNA, 20 bp, mouse
gagagtagggtaggtgaggc

SEQ ID NO: 493140 - DNA, 20 bp, mouse
ggggtgggcacagctgtgta

SEQ ID NO: 493141 - DNA, 20 bp, mouse
gcaggcagccaagcgtgttc

SEQ ID NO: 493142 - DNA, 20 bp, mouse
gaagaagccaggtcagtatt

SEQ ID NO: 493143 - DNA, 20 bp, mouse
gtcgggcagtggagcaactg

SEQ ID NO: 493144 - DNA, 20 bp, mouse
gtgggcacagctgtgtaggg

SEQ ID NO: 493145 - DNA, 20 bp, mouse
gtggggtctgcaggtatcca

SEQ ID NO: 493146 - DNA, 20 bp, mouse
ggtcaaggtgcttgtcgatc

SEQ ID NO: 493147 - DNA, 20 bp, mouse
ggtggggaaagctgactcaa

SEQ ID NO: 493148 - DNA, 20 bp, mouse
gacttctctgatgaagagtg

SEQ ID NO: 493149 - DNA, 20 bp, mouse
gtatgtagaaatatcctgga

SEQ ID NO: 493150 - DNA, 20 bp, mouse
gctgtcagctctgcaaaggg

SEQ ID NO: 493151 - DNA, 20 bp, mouse
ggaagtatgtagaaatatcc

SEQ ID NO: 493152 - DNA, 20 bp, mouse
gagctgacagcatagatcat

SEQ ID NO: 493153 - DNA, 20 bp, mouse
gcaggaatgaaaggtatcat

SEQ ID NO: 493154 - DNA, 20 bp, mouse
gtttcttttcatgtacacgt

SEQ ID NO: 493155 - DNA, 20 bp, mouse
ggctacagtttgagaagatg

SEQ ID NO: 493156 - DNA, 20 bp, mouse
ggatgggaaagcagcctcag

SEQ ID NO: 493157 - DNA, 20 bp, mouse
gaaggttcacagtttctaga

SEQ ID NO: 493158 - DNA, 20 bp, mouse
ggtaggagaaagctctggtc

SEQ ID NO: 493159 - DNA, 20 bp, mouse
ggaaagcagcctcagtggca

SEQ ID NO: 493160 - DNA, 20 bp, mouse
gactgtgaaccttgccactg

SEQ ID NO: 493161 - DNA, 20 bp, mouse
ggagccaaaatccaggcttc

SEQ ID NO: 493162 - DNA, 20 bp, mouse
ggaacagtaggagaaagctc

SEQ ID NO: 493163 - DNA, 20 bp, mouse
gtaaaaaggaaggcatattg

SEQ ID NO: 493164 - DNA, 20 bp, mouse
gtcccacaagggccaggaag

SEQ ID NO: 493165 - DNA, 20 bp, mouse
gggtagaagctagtgagccc

SEQ ID NO: 493166 - DNA, 20 bp, mouse
gtccttagtggccaatgagg

SEQ ID NO: 493167 - DNA, 20 bp, mouse
gacctcctcattggccacta

SEQ ID NO: 493168 - DNA, 20 bp, mouse
gcaaaatgaaaagttgctta

SEQ ID NO: 493169 - DNA, 20 bp, mouse
gacatggaagccaagatctg

SEQ ID NO: 493170 - DNA, 20 bp, mouse
gtctttaacactgatctgtg

SEQ ID NO: 493171 - DNA, 20 bp, mouse
gtctgctggaggtactttgg

SEQ ID NO: 493172 - DNA, 20 bp, mouse
gtaaagaattctgctatgag

SEQ ID NO: 493173 - DNA, 20 bp, mouse
gattcaagctttgtgtatat

SEQ ID NO: 493174 - DNA, 20 bp, mouse
gtgtgtggagccccagatct

SEQ ID NO: 493175 - DNA, 20 bp, mouse
gggagaggagggaatctcga

SEQ ID NO: 493176 - DNA, 20 bp, mouse
ggctaggcttccgcgcctgg

SEQ ID NO: 493177 - DNA, 20 bp, mouse
gggcgcagctggagagcact

SEQ ID NO: 493178 - DNA, 20 bp, mouse
gggctcctttgcagaggaat

SEQ ID NO: 493179 - DNA, 20 bp, mouse
gccccgagcggcggccgggt

SEQ ID NO: 493180 - DNA, 20 bp, mouse
gtctagcttcaccaccggca

SEQ ID NO: 493181 - DNA, 20 bp, mouse
ggcactgggtatcggccacc

SEQ ID NO: 493182 - DNA, 20 bp, mouse
gaagtccccgagcggcggcc

SEQ ID NO: 493183 - DNA, 20 bp, mouse
gcggcactgggccgtgccgg

SEQ ID NO: 493184 - DNA, 20 bp, mouse
gacaaagagaagcacgggag

SEQ ID NO: 493185 - DNA, 20 bp, mouse
gctctgcaaaggagcccaga

SEQ ID NO: 493186 - DNA, 20 bp, mouse
gaacctagagaaactatatc

SEQ ID NO: 493187 - DNA, 20 bp, mouse
gatcctgatatagtttctct

SEQ ID NO: 493188 - DNA, 20 bp, mouse
gtttgttattctcacagagc

SEQ ID NO: 493189 - DNA, 20 bp, mouse
ggactctgattcaaccattg

SEQ ID NO: 493190 - DNA, 20 bp, mouse
ggatctttatttttctgtga

SEQ ID NO: 493191 - DNA, 20 bp, mouse
gatctgatggaatgcctcac

SEQ ID NO: 493192 - DNA, 20 bp, mouse
gcttcctcaaaaataccctg

SEQ ID NO: 493193 - DNA, 20 bp, mouse
gggttgggggagctaactgg

SEQ ID NO: 493194 - DNA, 20 bp, mouse
gcaaggttgggggagctaac

SEQ ID NO: 493195 - DNA, 20 bp, mouse
ggctcctcagggtatttttg

SEQ ID NO: 493196 - DNA, 20 bp, mouse
ggggtcatccggagtcaagg

SEQ ID NO: 493197 - DNA, 20 bp, mouse
gacaggcagtagggtcccag

SEQ ID NO: 493198 - DNA, 20 bp, mouse
gggcagggagtgcagccgaa

SEQ ID NO: 493199 - DNA, 20 bp, mouse
gacagggtcatccggagtca

SEQ ID NO: 493200 - DNA, 20 bp, mouse
gggggctcttacctgctcgg

SEQ ID NO: 493201 - DNA, 20 bp, mouse
ggaatggcgctggaaggaac

SEQ ID NO: 493202 - DNA, 20 bp, mouse
ggtaagagcccccttgactc

SEQ ID NO: 493203 - DNA, 20 bp, mouse
ggggatgcagacaggacagt

SEQ ID NO: 493204 - DNA, 20 bp, mouse
gtccctagctctgtaaacag

SEQ ID NO: 493205 - DNA, 20 bp, mouse
gtctggatcttagagttcca

SEQ ID NO: 493206 - DNA, 20 bp, mouse
gcacggagacgagcgactct

SEQ ID NO: 493207 - DNA, 20 bp, mouse
gaggtgctggagcacgagga

SEQ ID NO: 493208 - DNA, 20 bp, mouse
gatccattggctggaaaccg

SEQ ID NO: 493209 - DNA, 20 bp, mouse
gggccgcggtttccagccaa

SEQ ID NO: 493210 - DNA, 20 bp, mouse
gttctgctatggtctgcggt

SEQ ID NO: 493211 - DNA, 20 bp, mouse
gcgctcacatacgggaatta

SEQ ID NO: 493212 - DNA, 20 bp, mouse
gggaaaatgcgctcacatac

SEQ ID NO: 493213 - DNA, 20 bp, mouse
ggggggaaataactttgatt

SEQ ID NO: 493214 - DNA, 20 bp, mouse
gaccctcacggaccgagctc

SEQ ID NO: 493215 - DNA, 20 bp, mouse
ggtggaggtgctggagcacg

SEQ ID NO: 493216 - DNA, 20 bp, mouse
gaggcagaacctggcaaggt

SEQ ID NO: 493217 - DNA, 20 bp, mouse
gtctaaggcagaacctggca

SEQ ID NO: 493218 - DNA, 20 bp, mouse
ggttcaaacctgtcaatcca

SEQ ID NO: 493219 - DNA, 20 bp, mouse
gtcactaagacgaagatcta

SEQ ID NO: 493220 - DNA, 20 bp, mouse
ggaagatctaaggcagaacc

SEQ ID NO: 493221 - DNA, 20 bp, mouse
gttgcagtaggggcactcag

SEQ ID NO: 493222 - DNA, 20 bp, mouse
gtgagctggcacgggtcagg

SEQ ID NO: 493223 - DNA, 20 bp, mouse
gtcttctaagtctttatcta

SEQ ID NO: 493224 - DNA, 20 bp, mouse
gcgaggccaagaggaagatc

SEQ ID NO: 493225 - DNA, 20 bp, mouse
gtggcaggccacacactgtt

SEQ ID NO: 493226 - DNA, 20 bp, mouse
gtaatgtctcggcccctgac

SEQ ID NO: 493227 - DNA, 20 bp, mouse
gttataaataaggctgcgag

SEQ ID NO: 493228 - DNA, 20 bp, mouse
gcttggtgtatgtaatgtct

SEQ ID NO: 493229 - DNA, 20 bp, mouse
gctcgcaccctttcctgtca

SEQ ID NO: 493230 - DNA, 20 bp, mouse
gtacatcaattgtagcaggt

SEQ ID NO: 493231 - DNA, 20 bp, mouse
gagttctgactgaccaatag

SEQ ID NO: 493232 - DNA, 20 bp, mouse
ggggggcttgactatggacc

SEQ ID NO: 493233 - DNA, 20 bp, mouse
gtgaagatggagtttcccag

SEQ ID NO: 493234 - DNA, 20 bp, mouse
gtcaattgtagcaggtgggt

SEQ ID NO: 493235 - DNA, 20 bp, mouse
gtggacctggaccattctat

SEQ ID NO: 493236 - DNA, 20 bp, mouse
gttgattaattgtaactcaa

SEQ ID NO: 493237 - DNA, 20 bp, mouse
gttacagacggggtgcctct

SEQ ID NO: 493238 - DNA, 20 bp, mouse
gactgtccttccggcggctg

SEQ ID NO: 493239 - DNA, 20 bp, mouse
ggagcgacagcgatgcaaga

SEQ ID NO: 493240 - DNA, 20 bp, mouse
ggtggtagatctgagagcca

SEQ ID NO: 493241 - DNA, 20 bp, mouse
gtgtaacactgtccttccgg

SEQ ID NO: 493242 - DNA, 20 bp, mouse
gttccagctcttccaacagt

SEQ ID NO: 493243 - DNA, 20 bp, mouse
ggttacaaatcttacagacg

SEQ ID NO: 493244 - DNA, 20 bp, mouse
gcaggcgccgcagttcctgc

SEQ ID NO: 493245 - DNA, 20 bp, mouse
gttgggttggatgggagggg

SEQ ID NO: 493246 - DNA, 20 bp, mouse
gaccagcattctgcgaagga

SEQ ID NO: 493247 - DNA, 20 bp, mouse
ggatgagttaagagtcctgt

SEQ ID NO: 493248 - DNA, 20 bp, mouse
gacacatgtctactcagtac

SEQ ID NO: 493249 - DNA, 20 bp, mouse
gcttctggctcagggtgtct

SEQ ID NO: 493250 - DNA, 20 bp, mouse
gtcacagatggaacaagcca

SEQ ID NO: 493251 - DNA, 20 bp, mouse
gtccctccttcgcagaatgc

SEQ ID NO: 493252 - DNA, 20 bp, mouse
gtgcagcaaaggctctgtca

SEQ ID NO: 493253 - DNA, 20 bp, mouse
gattttgattatgttttcca

SEQ ID NO: 493254 - DNA, 20 bp, mouse
gacttgattaatgagagagg

SEQ ID NO: 493255 - DNA, 20 bp, mouse
gtggtatcttgggagtacgg

SEQ ID NO: 493256 - DNA, 20 bp, mouse
ggagccaaggtggattggag

SEQ ID NO: 493257 - DNA, 20 bp, mouse
gccaaggtggattggagagg

SEQ ID NO: 493258 - DNA, 20 bp, mouse
gtgctgccaagtgagcatag

SEQ ID NO: 493259 - DNA, 20 bp, mouse
gggttcccactatgctcact

SEQ ID NO: 493260 - DNA, 20 bp, mouse
gggtaagctggtcttcaggg

SEQ ID NO: 493261 - DNA, 20 bp, mouse
gggagaggaggaaatctcgt

SEQ ID NO: 493262 - DNA, 20 bp, mouse
ggggaggagccaaggtggat

SEQ ID NO: 493263 - DNA, 20 bp, mouse
ggagggtaagctggtcttca

SEQ ID NO: 493264 - DNA, 20 bp, mouse
gtttttcatggaaggaacta

SEQ ID NO: 493265 - DNA, 20 bp, mouse
ggaaatatcaaagtatgaag

SEQ ID NO: 493266 - DNA, 20 bp, mouse
gaaaggcacagctggcacca

SEQ ID NO: 493267 - DNA, 20 bp, mouse
ggccccagggcacgctaccc

SEQ ID NO: 493268 - DNA, 20 bp, mouse
gatttatctgcagcactaca

SEQ ID NO: 493269 - DNA, 20 bp, mouse
gaccagggtagcgtgccctg

SEQ ID NO: 493270 - DNA, 20 bp, mouse
gatcgtctctctgcgcatca

SEQ ID NO: 493271 - DNA, 20 bp, mouse
gtgggctctggctgctgacg

SEQ ID NO: 493272 - DNA, 20 bp, mouse
gcactgtcagccctgctcta

SEQ ID NO: 493273 - DNA, 20 bp, mouse
gttgttggcgccatagagca

SEQ ID NO: 493274 - DNA, 20 bp, mouse
ggctgacgcgggcccaggaa

SEQ ID NO: 493275 - DNA, 20 bp, mouse
ggcccaggaagggtgttcac

SEQ ID NO: 493276 - DNA, 20 bp, mouse
ggtgctggccttgggagaca

SEQ ID NO: 493277 - DNA, 20 bp, mouse
ggtgcgggaaggcggcgatg

SEQ ID NO: 493278 - DNA, 20 bp, mouse
gcagtcggcgtgggtggcca

SEQ ID NO: 493279 - DNA, 20 bp, mouse
ggccacccacgccgactgtg

SEQ ID NO: 493280 - DNA, 20 bp, mouse
gggcctgcggtgcgggaagg

SEQ ID NO: 493281 - DNA, 20 bp, mouse
gggggctcgtggaagattca

SEQ ID NO: 493282 - DNA, 20 bp, mouse
ggcctcacagtcggcgtggg

SEQ ID NO: 493283 - DNA, 20 bp, mouse
gcgaggttaagctgatgctt

SEQ ID NO: 493284 - DNA, 20 bp, mouse
gctcgtggaagattcagggc

SEQ ID NO: 493285 - DNA, 20 bp, mouse
ggcgagagggtgctggcctt

SEQ ID NO: 493286 - DNA, 20 bp, mouse
gggaccacgcaggctctagg

SEQ ID NO: 493287 - DNA, 20 bp, mouse
gtagaatcgtgcgagagccc

SEQ ID NO: 493288 - DNA, 20 bp, mouse
gagagccctggcacgaagtt

SEQ ID NO: 493289 - DNA, 20 bp, mouse
ggcttgctggaacaccgtcg

SEQ ID NO: 493290 - DNA, 20 bp, mouse
gccactaccaggactcccat

SEQ ID NO: 493291 - DNA, 20 bp, mouse
gccagctcgggcagtccata

SEQ ID NO: 493292 - DNA, 20 bp, mouse
gcagggaccacgcaggctct

SEQ ID NO: 493293 - DNA, 20 bp, mouse
ggcctagcgaacaccagctc

SEQ ID NO: 493294 - DNA, 20 bp, mouse
gtgagcgccatgggtctgag

SEQ ID NO: 493295 - DNA, 20 bp, mouse
ggttgcccaacttcgtgcca

SEQ ID NO: 493296 - DNA, 20 bp, mouse
gtccacctgacgtggcgggt

SEQ ID NO: 493297 - DNA, 20 bp, mouse
ggccgccgacccgccacgtc

SEQ ID NO: 493298 - DNA, 20 bp, mouse
gacaaggactccacctgacg

SEQ ID NO: 493299 - DNA, 20 bp, mouse
ggccgacccgccacgtcagg

SEQ ID NO: 493300 - DNA, 20 bp, mouse
gaggactccacctgacgtgg

SEQ ID NO: 493301 - DNA, 20 bp, mouse
ggaacgcgtcagcccaggac

SEQ ID NO: 493302 - DNA, 20 bp, mouse
gcatgtttccaagaccgtaa

SEQ ID NO: 493303 - DNA, 20 bp, mouse
gatgctggcccttacggtct

SEQ ID NO: 493304 - DNA, 20 bp, mouse
ggttgaacctcatccagtcc

SEQ ID NO: 493305 - DNA, 20 bp, mouse
ggaggactgggccctcaaca

SEQ ID NO: 493306 - DNA, 20 bp, mouse
gatgtttttagcatgtaaca

SEQ ID NO: 493307 - DNA, 20 bp, mouse
gagggcagaggaaggtacca

SEQ ID NO: 493308 - DNA, 20 bp, mouse
ggatcccactccataatcct

SEQ ID NO: 493309 - DNA, 20 bp, mouse
gcgtttctcagcacacagtt

SEQ ID NO: 493310 - DNA, 20 bp, mouse
gggatttctgtgagacaggt

SEQ ID NO: 493311 - DNA, 20 bp, mouse
gggtaccaaggattatggag

SEQ ID NO: 493312 - DNA, 20 bp, mouse
gaaaaaaggggagatagcaa

SEQ ID NO: 493313 - DNA, 20 bp, mouse
gaggaaggtaccaaggatta

SEQ ID NO: 493314 - DNA, 20 bp, mouse
ggagaagaaaacaggattat

SEQ ID NO: 493315 - DNA, 20 bp, mouse
gacatgtgtgagaagaaaac

SEQ ID NO: 493316 - DNA, 20 bp, mouse
gtgagcttactgctaaggag

SEQ ID NO: 493317 - DNA, 20 bp, mouse
gtcctccaggcgggtgttca

SEQ ID NO: 493318 - DNA, 20 bp, mouse
ggagtggagtgaacctggac

SEQ ID NO: 493319 - DNA, 20 bp, mouse
ggtggttccccttccagtaa

SEQ ID NO: 493320 - DNA, 20 bp, mouse
gagtgccgtgaacacccgcc

SEQ ID NO: 493321 - DNA, 20 bp, mouse
ggccgtgaacacccgcctgg

SEQ ID NO: 493322 - DNA, 20 bp, mouse
ggttctgggagagggagatc

SEQ ID NO: 493323 - DNA, 20 bp, mouse
gcattctcctttactggaag

SEQ ID NO: 493324 - DNA, 20 bp, mouse
gagtccgaggagcaccgcct

SEQ ID NO: 493325 - DNA, 20 bp, mouse
ggcgtgctacagagagtccg

SEQ ID NO: 493326 - DNA, 20 bp, mouse
ggcgtgcgtctgcagaggag

SEQ ID NO: 493327 - DNA, 20 bp, mouse
gttgaactgaaccacctggt

SEQ ID NO: 493328 - DNA, 20 bp, mouse
gggggtgccggttattaaag

SEQ ID NO: 493329 - DNA, 20 bp, mouse
gtactataacacctaccagg

SEQ ID NO: 493330 - DNA, 20 bp, mouse
gaaaagttgccaagtgttga

SEQ ID NO: 493331 - DNA, 20 bp, mouse
gggtctcagggcgtgctctg

SEQ ID NO: 493332 - DNA, 20 bp, mouse
ggttgtgtcagatagagacg

SEQ ID NO: 493333 - DNA, 20 bp, mouse
gttgccctcgcaacagacca

SEQ ID NO: 493334 - DNA, 20 bp, mouse
gtctgttgcgagggcaaacg

SEQ ID NO: 493335 - DNA, 20 bp, mouse
gctatgaaactcaccaccag

SEQ ID NO: 493336 - DNA, 20 bp, mouse
gggctactgaccaacatggt

SEQ ID NO: 493337 - DNA, 20 bp, mouse
gtgggggctactgaccaaca

SEQ ID NO: 493338 - DNA, 20 bp, mouse
gaggcgggcctaatctctct

SEQ ID NO: 493339 - DNA, 20 bp, mouse
gtccttgatgagggcccaag

SEQ ID NO: 493340 - DNA, 20 bp, mouse
gcaagctgcccagagagatt

SEQ ID NO: 493341 - DNA, 20 bp, mouse
gccctcatcaaggataaggt

SEQ ID NO: 493342 - DNA, 20 bp, mouse
gcatccagtgttagcaggtg

SEQ ID NO: 493343 - DNA, 20 bp, mouse
gtcttgggtggtttctgtgt

SEQ ID NO: 493344 - DNA, 20 bp, mouse
gaaagtggcaaagtatgacc

SEQ ID NO: 493345 - DNA, 20 bp, mouse
gtgggccctcatcaaggata

SEQ ID NO: 493346 - DNA, 20 bp, mouse
gcccacaggcaggtgtgtaa

SEQ ID NO: 493347 - DNA, 20 bp, mouse
gtactctagcaagaacattg

SEQ ID NO: 493348 - DNA, 20 bp, mouse
gtaagaagttgagtctctcc

SEQ ID NO: 493349 - DNA, 20 bp, mouse
gagcaaaagaccccagcatc

SEQ ID NO: 493350 - DNA, 20 bp, mouse
gcagcatcaggagaaagagt

SEQ ID NO: 493351 - DNA, 20 bp, mouse
gtgagctgctcccaggatgt

SEQ ID NO: 493352 - DNA, 20 bp, mouse
ggtgctcctgcccacatcct

SEQ ID NO: 493353 - DNA, 20 bp, mouse
gtctcagtctgggctatcag

SEQ ID NO: 493354 - DNA, 20 bp, mouse
gctgctcccaggatgtgggc

SEQ ID NO: 493355 - DNA, 20 bp, mouse
gtggtagcaagtgctcagga

SEQ ID NO: 493356 - DNA, 20 bp, mouse
gttctggggaggaagacggt

SEQ ID NO: 493357 - DNA, 20 bp, mouse
gctgccacactggaagacgg

SEQ ID NO: 493358 - DNA, 20 bp, mouse
ggggctgccacactggaaga

SEQ ID NO: 493359 - DNA, 20 bp, mouse
gcggagacgggctgccacac

SEQ ID NO: 493360 - DNA, 20 bp, mouse
gaaccctccgtcttccagtg

SEQ ID NO: 493361 - DNA, 20 bp, mouse
gcgcctgcagccggttgcca

SEQ ID NO: 493362 - DNA, 20 bp, mouse
gtactctgaaggtgtatagg

SEQ ID NO: 493363 - DNA, 20 bp, mouse
gagacagactgcgacttggt

SEQ ID NO: 493364 - DNA, 20 bp, mouse
gccgtaaactacaatttctg

SEQ ID NO: 493365 - DNA, 20 bp, mouse
gagaagtctggcgaaggcgt

SEQ ID NO: 493366 - DNA, 20 bp, mouse
ggttcccagcccccaagtgg

SEQ ID NO: 493367 - DNA, 20 bp, mouse
gccaccccacccccacttgg

SEQ ID NO: 493368 - DNA, 20 bp, mouse
gccaaaagttagggagccac

SEQ ID NO: 493369 - DNA, 20 bp, mouse
gaggcactgtgggacagatt

SEQ ID NO: 493370 - DNA, 20 bp, mouse
gccttgactcactaaaccag

SEQ ID NO: 493371 - DNA, 20 bp, mouse
gtaaattcaagagaaactga

SEQ ID NO: 493372 - DNA, 20 bp, mouse
gctgggacaagcatgtaagt

SEQ ID NO: 493373 - DNA, 20 bp, mouse
gaggcctgccctaggcactg

SEQ ID NO: 493374 - DNA, 20 bp, mouse
gaagtgggtcaggttagctt

SEQ ID NO: 493375 - DNA, 20 bp, mouse
gctgcccatcccaaaagtta

SEQ ID NO: 493376 - DNA, 20 bp, mouse
gagtgagcagcaactatcca

SEQ ID NO: 493377 - DNA, 20 bp, mouse
gggtaaacctggctaagggt

SEQ ID NO: 493378 - DNA, 20 bp, mouse
gcctggctaagggtagggtg

SEQ ID NO: 493379 - DNA, 20 bp, mouse
ggaggaggtaaacctggcta

SEQ ID NO: 493380 - DNA, 20 bp, mouse
gtttgaggaggaggtaaacc

SEQ ID NO: 493381 - DNA, 20 bp, mouse
ggctaagggtagggtgtggg

SEQ ID NO: 493382 - DNA, 20 bp, mouse
ggcatgaacccccaagaaag

SEQ ID NO: 493383 - DNA, 20 bp, mouse
ggactctgcccctttcttgg

SEQ ID NO: 493384 - DNA, 20 bp, mouse
gggggcagagtctgttccct

SEQ ID NO: 493385 - DNA, 20 bp, mouse
gccggaggcctgcctgacac

SEQ ID NO: 493386 - DNA, 20 bp, mouse
gagaaagtcttgtgccataa

SEQ ID NO: 493387 - DNA, 20 bp, mouse
ggtcagaaaggttatttcat

SEQ ID NO: 493388 - DNA, 20 bp, mouse
gacctttctgactttcattc

SEQ ID NO: 493389 - DNA, 20 bp, mouse
gaagtcatcatattgctctg

SEQ ID NO: 493390 - DNA, 20 bp, mouse
ggttatttcatgggtttgca

SEQ ID NO: 493391 - DNA, 20 bp, mouse
gaaatttctgctgcttgctt

SEQ ID NO: 493392 - DNA, 20 bp, mouse
gtttttattccttttacaga

SEQ ID NO: 493393 - DNA, 20 bp, mouse
gagcagaaattttgccatta

SEQ ID NO: 493394 - DNA, 20 bp, mouse
gtgctgcttgctttggcatt

SEQ ID NO: 493395 - DNA, 20 bp, mouse
gtcatagaattatgctactg

SEQ ID NO: 493396 - DNA, 20 bp, mouse
gaggggaagtatccggagaa

SEQ ID NO: 493397 - DNA, 20 bp, mouse
gaatatgtgaagaggactgt

SEQ ID NO: 493398 - DNA, 20 bp, mouse
ggccaggccaagcaatggtt

SEQ ID NO: 493399 - DNA, 20 bp, mouse
gctgggggaggggaagtatc

SEQ ID NO: 493400 - DNA, 20 bp, mouse
gactgtaggagaagggctat

SEQ ID NO: 493401 - DNA, 20 bp, mouse
gagctctcccaaccattgct

SEQ ID NO: 493402 - DNA, 20 bp, mouse
gacgaagagcaagaaaacgc

SEQ ID NO: 493403 - DNA, 20 bp, mouse
gcaatggttgggagagctgg

SEQ ID NO: 493404 - DNA, 20 bp, mouse
gtggctcaacatcaggtgtg

SEQ ID NO: 493405 - DNA, 20 bp, mouse
gaggcaagtgtccactgtct

SEQ ID NO: 493406 - DNA, 20 bp, mouse
ggctacccagcagcccccaa

SEQ ID NO: 493407 - DNA, 20 bp, mouse
gaggagacggtcgcagaaag

SEQ ID NO: 493408 - DNA, 20 bp, mouse
gttctggacactggaggaga

SEQ ID NO: 493409 - DNA, 20 bp, mouse
gcctgggcaacaggacctca

SEQ ID NO: 493410 - DNA, 20 bp, mouse
gggcagcaggtggaatgatg

SEQ ID NO: 493411 - DNA, 20 bp, mouse
gtcgcagaaaggggcacctg

SEQ ID NO: 493412 - DNA, 20 bp, mouse
gtgggcaggacccaacagta

SEQ ID NO: 493413 - DNA, 20 bp, mouse
gtgccctgggcaagaaagac

SEQ ID NO: 493414 - DNA, 20 bp, mouse
gctactgaggacgccagcaa

SEQ ID NO: 493415 - DNA, 20 bp, mouse
gcagcagcccccaagggctg

SEQ ID NO: 493416 - DNA, 20 bp, mouse
gctgtaggccatgttgaaga

SEQ ID NO: 493417 - DNA, 20 bp, mouse
gtgctgggagagcagcggat

SEQ ID NO: 493418 - DNA, 20 bp, mouse
gtggcagggtgtggaactcc

SEQ ID NO: 493419 - DNA, 20 bp, mouse
gtgtcaccttgtggagcgct

SEQ ID NO: 493420 - DNA, 20 bp, mouse
ggagggaatgtgagctctag

SEQ ID NO: 493421 - DNA, 20 bp, mouse
gtcagctcctctctgaacac

SEQ ID NO: 493422 - DNA, 20 bp, mouse
ggagtttgaatgtcaccttg

SEQ ID NO: 493423 - DNA, 20 bp, mouse
gtctctgaacactggctgcc

SEQ ID NO: 493424 - DNA, 20 bp, mouse
gagagccagcatatgtaccc

SEQ ID NO: 493425 - DNA, 20 bp, mouse
gatgctggctctctggactt

SEQ ID NO: 493426 - DNA, 20 bp, mouse
gagcccggactaacatacaa

SEQ ID NO: 493427 - DNA, 20 bp, mouse
gatgtccagtaccatagaca

SEQ ID NO: 493428 - DNA, 20 bp, mouse
gagcaaaacaaacatccgaa

SEQ ID NO: 493429 - DNA, 20 bp, mouse
gtccagagtcaccaccatct

SEQ ID NO: 493430 - DNA, 20 bp, mouse
gccgaaaggtgaggaaagcc

SEQ ID NO: 493431 - DNA, 20 bp, mouse
gaatgtgaaagtaacaactc

SEQ ID NO: 493432 - DNA, 20 bp, mouse
gatccccactccaagtataa

SEQ ID NO: 493433 - DNA, 20 bp, mouse
gaacaaacatccgaaaggtg

SEQ ID NO: 493434 - DNA, 20 bp, mouse
gtaagcctcaagctctctca

SEQ ID NO: 493435 - DNA, 20 bp, mouse
gctccattgtatgttagtcc

SEQ ID NO: 493436 - DNA, 20 bp, mouse
gagagtactactgtatggaa

SEQ ID NO: 493437 - DNA, 20 bp, mouse
gtgttcttccgtgtagctgg

SEQ ID NO: 493438 - DNA, 20 bp, mouse
gatgtgttcttccgtgtagc

SEQ ID NO: 493439 - DNA, 20 bp, mouse
gcttggagagtactactgta

SEQ ID NO: 493440 - DNA, 20 bp, mouse
gcacggaagaacacatacta

SEQ ID NO: 493441 - DNA, 20 bp, mouse
gagttgaccattagaaacaa

SEQ ID NO: 493442 - DNA, 20 bp, mouse
gcttacaaatgtagaaaata

SEQ ID NO: 493443 - DNA, 20 bp, mouse
gcaagtcacctccagctaca

SEQ ID NO: 493444 - DNA, 20 bp, mouse
ggtgatcttgaaaggtgtgg

SEQ ID NO: 493445 - DNA, 20 bp, mouse
ggtaaatcctttgtttctaa

SEQ ID NO: 493446 - DNA, 20 bp, mouse
ggtgaggtaacccacaccag

SEQ ID NO: 493447 - DNA, 20 bp, mouse
gtgtcaggtggtacagaaca

SEQ ID NO: 493448 - DNA, 20 bp, mouse
gcagccagtccaaggatgtt

SEQ ID NO: 493449 - DNA, 20 bp, mouse
gcctgagcatgtgtgtcagg

SEQ ID NO: 493450 - DNA, 20 bp, mouse
gagaatagattccctctcca

SEQ ID NO: 493451 - DNA, 20 bp, mouse
ggtactcgagcacacccaca

SEQ ID NO: 493452 - DNA, 20 bp, mouse
ggctatgcgcttcatgccac

SEQ ID NO: 493453 - DNA, 20 bp, mouse
gtacctcaccagccagtcca

SEQ ID NO: 493454 - DNA, 20 bp, mouse
gcgcttcatgccactggtgt

SEQ ID NO: 493455 - DNA, 20 bp, mouse
ggctcctgagcatgtgtgtc

SEQ ID NO: 493456 - DNA, 20 bp, mouse
gtctcgggaagacggagtga

SEQ ID NO: 493457 - DNA, 20 bp, mouse
gctggcaggcaaggactctc

SEQ ID NO: 493458 - DNA, 20 bp, mouse
gcagcgctttctgggcactt

SEQ ID NO: 493459 - DNA, 20 bp, mouse
gtgatctcaggccctctcat

SEQ ID NO: 493460 - DNA, 20 bp, mouse
ggctttttggtagaattcac

SEQ ID NO: 493461 - DNA, 20 bp, mouse
ggagactgcacactgatctc

SEQ ID NO: 493462 - DNA, 20 bp, mouse
gctaaaaaggaaagtcctga

SEQ ID NO: 493463 - DNA, 20 bp, mouse
gaatataactcactggtcct

SEQ ID NO: 493464 - DNA, 20 bp, mouse
gtgtctgtctgtctcccttc

SEQ ID NO: 493465 - DNA, 20 bp, mouse
gagttgactagctcgcatta

SEQ ID NO: 493466 - DNA, 20 bp, mouse
gttctcagttagtagaacat

SEQ ID NO: 493467 - DNA, 20 bp, mouse
gtgtgaagtatcaaggagca

SEQ ID NO: 493468 - DNA, 20 bp, mouse
gctgagaaaaagggtgtcta

SEQ ID NO: 493469 - DNA, 20 bp, mouse
gcctcttatgtgaagtatca

SEQ ID NO: 493470 - DNA, 20 bp, mouse
gggaggcgagtcatgagtgt

SEQ ID NO: 493471 - DNA, 20 bp, mouse
gttctactaactgagaaaaa

SEQ ID NO: 493472 - DNA, 20 bp, mouse
gcccaagtaccagcagctgg

SEQ ID NO: 493473 - DNA, 20 bp, mouse
gtctgtgctattagataagg

SEQ ID NO: 493474 - DNA, 20 bp, mouse
gtattctgtgctattagata

SEQ ID NO: 493475 - DNA, 20 bp, mouse
gagttaacaggttaagagat

SEQ ID NO: 493476 - DNA, 20 bp, mouse
gctcgaggccggagacccgg

SEQ ID NO: 493477 - DNA, 20 bp, mouse
gcagcgagcccgagccctcg

SEQ ID NO: 493478 - DNA, 20 bp, mouse
ggccctcgaggccggagacc

SEQ ID NO: 493479 - DNA, 20 bp, mouse
gtctccggcctcgagggctc

SEQ ID NO: 493480 - DNA, 20 bp, mouse
gtcctagccgcgggaggtga

SEQ ID NO: 493481 - DNA, 20 bp, mouse
ggggctcgggctcgctgcgg

SEQ ID NO: 493482 - DNA, 20 bp, mouse
gtggggaccccaggaacgag

SEQ ID NO: 493483 - DNA, 20 bp, mouse
ggacgcgctccgggccacgg

SEQ ID NO: 493484 - DNA, 20 bp, mouse
gtcccaggagcggaaggcag

SEQ ID NO: 493485 - DNA, 20 bp, mouse
ggcgctccgggccacggcgg

SEQ ID NO: 493486 - DNA, 20 bp, mouse
ggtaactcctgctaagtcca

SEQ ID NO: 493487 - DNA, 20 bp, mouse
gcacagtccttggacttagc

SEQ ID NO: 493488 - DNA, 20 bp, mouse
gaacttgttgtcacagtcct

SEQ ID NO: 493489 - DNA, 20 bp, mouse
gtgtttcatatgatcagttc

SEQ ID NO: 493490 - DNA, 20 bp, mouse
gtagacacacttataatcat

SEQ ID NO: 493491 - DNA, 20 bp, mouse
gagtttgtcatcatttactc

SEQ ID NO: 493492 - DNA, 20 bp, mouse
gtatacaactgagaaattta

SEQ ID NO: 493493 - DNA, 20 bp, mouse
gcagtacattatattgtaat

SEQ ID NO: 493494 - DNA, 20 bp, mouse
gactgtgacaacaagtttta

SEQ ID NO: 493495 - DNA, 20 bp, mouse
ggttcagagttgtgaattgc

SEQ ID NO: 493496 - DNA, 20 bp, mouse
ggggttcaatgagaacctgt

SEQ ID NO: 493497 - DNA, 20 bp, mouse
gagctgtgggtctggctgag

SEQ ID NO: 493498 - DNA, 20 bp, mouse
gtagtgggtttgatcagcct

SEQ ID NO: 493499 - DNA, 20 bp, mouse
gcacttctcctgctagctgt

SEQ ID NO: 493500 - DNA, 20 bp, mouse
gcttatgcaatgcatgggac

SEQ ID NO: 493501 - DNA, 20 bp, mouse
gagccagacccacagctagc

SEQ ID NO: 493502 - DNA, 20 bp, mouse
gtagggagggctccagtcca

SEQ ID NO: 493503 - DNA, 20 bp, mouse
gcgccacacccgctccccac

SEQ ID NO: 493504 - DNA, 20 bp, mouse
ggctggagtgacctgcagta

SEQ ID NO: 493505 - DNA, 20 bp, mouse
ggcagggctggtctgagaga

SEQ ID NO: 493506 - DNA, 20 bp, mouse
gaacagtccgtcgaatctat

SEQ ID NO: 493507 - DNA, 20 bp, mouse
gctctcacccatagattcga

SEQ ID NO: 493508 - DNA, 20 bp, mouse
ggctcgctgtgtgattatat

SEQ ID NO: 493509 - DNA, 20 bp, mouse
gtttagttcagtaggtaaag

SEQ ID NO: 493510 - DNA, 20 bp, mouse
gcaaattaaggctatgttat

SEQ ID NO: 493511 - DNA, 20 bp, mouse
gatgctttatgtaatgataa

SEQ ID NO: 493512 - DNA, 20 bp, mouse
gatacttgactgtgaaaaca

SEQ ID NO: 493513 - DNA, 20 bp, mouse
gcatgtacttttagttcagt

SEQ ID NO: 493514 - DNA, 20 bp, mouse
gtaatttgctactcacttcc

SEQ ID NO: 493515 - DNA, 20 bp, mouse
gaggaggagggtgagaatga

SEQ ID NO: 493516 - DNA, 20 bp, mouse
gttcttagctctcaaggctt

SEQ ID NO: 493517 - DNA, 20 bp, mouse
gcttgggtccgctgaaaggt

SEQ ID NO: 493518 - DNA, 20 bp, mouse
ggggtcttgggtccgctgaa

SEQ ID NO: 493519 - DNA, 20 bp, mouse
ggctctcaaggctttggctt

SEQ ID NO: 493520 - DNA, 20 bp, mouse
gttcgctttcggtaccatct

SEQ ID NO: 493521 - DNA, 20 bp, mouse
gtgatctttttttgtggcta

SEQ ID NO: 493522 - DNA, 20 bp, mouse
gttctgggtgcactatttcg

SEQ ID NO: 493523 - DNA, 20 bp, mouse
gaccatcttggtgaaaaggg

SEQ ID NO: 493524 - DNA, 20 bp, mouse
gaccaccttcttagctctca

SEQ ID NO: 493525 - DNA, 20 bp, mouse
gtcaaggctttggctttggg

SEQ ID NO: 493526 - DNA, 20 bp, mouse
gcttctgggtcaaaagagta

SEQ ID NO: 493527 - DNA, 20 bp, mouse
gatgcacccaggccaaacac

SEQ ID NO: 493528 - DNA, 20 bp, mouse
ggggctggatacagggacgt

SEQ ID NO: 493529 - DNA, 20 bp, mouse
gtgattttgtgggggcttct

SEQ ID NO: 493530 - DNA, 20 bp, mouse
gggagttggtacatgcaccc

SEQ ID NO: 493531 - DNA, 20 bp, mouse
ggatgtccttttgaccaaca

SEQ ID NO: 493532 - DNA, 20 bp, mouse
gcagaggtgacctgcaaaga

SEQ ID NO: 493533 - DNA, 20 bp, mouse
gagtagggaaccatctttgc

SEQ ID NO: 493534 - DNA, 20 bp, mouse
gaacactggggctggataca

SEQ ID NO: 493535 - DNA, 20 bp, mouse
gaaaattcagcactcatttc

SEQ ID NO: 493536 - DNA, 20 bp, mouse
gactggaggaggcccagact

SEQ ID NO: 493537 - DNA, 20 bp, mouse
gcctagggtcctaagcatag

SEQ ID NO: 493538 - DNA, 20 bp, mouse
gggtcctaagcataggggtt

SEQ ID NO: 493539 - DNA, 20 bp, mouse
gtctcttgtctgcctagtct

SEQ ID NO: 493540 - DNA, 20 bp, mouse
gagattattttagagactgg

SEQ ID NO: 493541 - DNA, 20 bp, mouse
ggggttgtcagcatctatag

SEQ ID NO: 493542 - DNA, 20 bp, mouse
gatgcccaacccctatgctt

SEQ ID NO: 493543 - DNA, 20 bp, mouse
gcaacccagggcaacagtct

SEQ ID NO: 493544 - DNA, 20 bp, mouse
gcagtctgggggtggacatg

SEQ ID NO: 493545 - DNA, 20 bp, mouse
ggacaagagagagcttttgg

SEQ ID NO: 493546 - DNA, 20 bp, mouse
gatcaccgacagggaggagt

SEQ ID NO: 493547 - DNA, 20 bp, mouse
gatcatctcaatcaccgaca

SEQ ID NO: 493548 - DNA, 20 bp, mouse
gccttctacaaggacaacaa

SEQ ID NO: 493549 - DNA, 20 bp, mouse
gtcggcctactcctccctgt

SEQ ID NO: 493550 - DNA, 20 bp, mouse
gttgtccttgtagaaggaag

SEQ ID NO: 493551 - DNA, 20 bp, mouse
ggagttgtcgctgggatact

SEQ ID NO: 493552 - DNA, 20 bp, mouse
gtctacaaggacaacaatgg

SEQ ID NO: 493553 - DNA, 20 bp, mouse
ggaggtgatcaggtacagga

SEQ ID NO: 493554 - DNA, 20 bp, mouse
gatctcaatcaccgacaggg

SEQ ID NO: 493555 - DNA, 20 bp, mouse
gatctgaagaagtcagtcca

SEQ ID NO: 493556 - DNA, 20 bp, mouse
gtcttcatcaatgatcccac

SEQ ID NO: 493557 - DNA, 20 bp, mouse
ggtgctgggaagaccacagt

SEQ ID NO: 493558 - DNA, 20 bp, mouse
ggtgtcagcagagtgtgtgt

SEQ ID NO: 493559 - DNA, 20 bp, mouse
gcagcagagtgtgtgtgggt

SEQ ID NO: 493560 - DNA, 20 bp, mouse
gcctttactgaagacctgag

SEQ ID NO: 493561 - DNA, 20 bp, mouse
gctggaggagttgcctactg

SEQ ID NO: 493562 - DNA, 20 bp, mouse
ggctttgatcatgtcctctc

SEQ ID NO: 493563 - DNA, 20 bp, mouse
gttgatcatgtcctctctgg

SEQ ID NO: 493564 - DNA, 20 bp, mouse
gggcctctttgaatagtgct

SEQ ID NO: 493565 - DNA, 20 bp, mouse
gcttgcaaggtttctaggtt

SEQ ID NO: 493566 - DNA, 20 bp, mouse
ggcagaggttcatagatccg

SEQ ID NO: 493567 - DNA, 20 bp, mouse
ggacaagggctgctccaata

SEQ ID NO: 493568 - DNA, 20 bp, mouse
ggatctatgaacctctgcat

SEQ ID NO: 493569 - DNA, 20 bp, mouse
gactgagaagaggagatcta

SEQ ID NO: 493570 - DNA, 20 bp, mouse
ggccgaactgtcacttctag

SEQ ID NO: 493571 - DNA, 20 bp, mouse
gtattggctccagcttgcct

SEQ ID NO: 493572 - DNA, 20 bp, mouse
gtcatagatccgaggcaagc

SEQ ID NO: 493573 - DNA, 20 bp, mouse
gagctagagaggcttgcacc

SEQ ID NO: 493574 - DNA, 20 bp, mouse
gcttcagaagacagtgaccc

SEQ ID NO: 493575 - DNA, 20 bp, mouse
gttctctgatgaagactcgc

SEQ ID NO: 493576 - DNA, 20 bp, mouse
ggtagtagtttgctgcatct

SEQ ID NO: 493577 - DNA, 20 bp, mouse
ggaagaagcacttgatgaaa

SEQ ID NO: 493578 - DNA, 20 bp, mouse
gctactacaccaacaaattc

SEQ ID NO: 493579 - DNA, 20 bp, mouse
gataaagtcagaataagtga

SEQ ID NO: 493580 - DNA, 20 bp, mouse
gtacctactcatctaaaata

SEQ ID NO: 493581 - DNA, 20 bp, mouse
gcataactgtggtcaagcac

SEQ ID NO: 493582 - DNA, 20 bp, mouse
gatttcctatgttgcagtat

SEQ ID NO: 493583 - DNA, 20 bp, mouse
gaataacagtggtaatggct

SEQ ID NO: 493584 - DNA, 20 bp, mouse
gattcatctagatctgatgc

SEQ ID NO: 493585 - DNA, 20 bp, mouse
gtggagattcaattagtgcc

SEQ ID NO: 493586 - DNA, 20 bp, mouse
gaggaaaacaggccccctgg

SEQ ID NO: 493587 - DNA, 20 bp, mouse
gagaaggatggcaacctcca

SEQ ID NO: 493588 - DNA, 20 bp, mouse
gtgacatctgaagcaggtac

SEQ ID NO: 493589 - DNA, 20 bp, mouse
ggaaaggcctctgggcaacc

SEQ ID NO: 493590 - DNA, 20 bp, mouse
gtctgggcaaccaggctaga

SEQ ID NO: 493591 - DNA, 20 bp, mouse
gggttgccatccttctagcc

SEQ ID NO: 493592 - DNA, 20 bp, mouse
gagtgtctgacatctgaagc

SEQ ID NO: 493593 - DNA, 20 bp, mouse
gacagagaaggaaaggcctc

SEQ ID NO: 493594 - DNA, 20 bp, mouse
gacaataattgaacgcatga

SEQ ID NO: 493595 - DNA, 20 bp, mouse
gggcaaccaggctagaagga

SEQ ID NO: 493596 - DNA, 20 bp, mouse
gcagacaagtaagtcgggta

SEQ ID NO: 493597 - DNA, 20 bp, mouse
gatgcctgaagtgtgacaga

SEQ ID NO: 493598 - DNA, 20 bp, mouse
gtataacagcccagaatacg

SEQ ID NO: 493599 - DNA, 20 bp, mouse
gggcgcctgggcatacagtc

SEQ ID NO: 493600 - DNA, 20 bp, mouse
gaggcaggaggagctaaatg

SEQ ID NO: 493601 - DNA, 20 bp, mouse
gggagccagactgtatgccc

SEQ ID NO: 493602 - DNA, 20 bp, mouse
ggctgttatagttgaatcgg

SEQ ID NO: 493603 - DNA, 20 bp, mouse
gtgggctgttatagttgaat

SEQ ID NO: 493604 - DNA, 20 bp, mouse
gagttgaatcgggggcgcct

SEQ ID NO: 493605 - DNA, 20 bp, mouse
gcattatgctgaacagcagc

SEQ ID NO: 493606 - DNA, 20 bp, mouse
gctctcatatgagaacctca

SEQ ID NO: 493607 - DNA, 20 bp, mouse
ggtccgaagagtgagttgac

SEQ ID NO: 493608 - DNA, 20 bp, mouse
gtcttcggaccacacatcac

SEQ ID NO: 493609 - DNA, 20 bp, mouse
gaggttctcatatgagaggg

SEQ ID NO: 493610 - DNA, 20 bp, mouse
gggcctgtcaactcactctt

SEQ ID NO: 493611 - DNA, 20 bp, mouse
ggcatagcttccctggccta

SEQ ID NO: 493612 - DNA, 20 bp, mouse
gggaagtgggtataatgaag

SEQ ID NO: 493613 - DNA, 20 bp, mouse
gactggtagcaaggctaccc

SEQ ID NO: 493614 - DNA, 20 bp, mouse
gctcaagccggataacatca

SEQ ID NO: 493615 - DNA, 20 bp, mouse
gcacttgggcatagcttccc

SEQ ID NO: 493616 - DNA, 20 bp, mouse
ggtctttctcagacaacttc

SEQ ID NO: 493617 - DNA, 20 bp, mouse
gaaattaaagaagaggaatt

SEQ ID NO: 493618 - DNA, 20 bp, mouse
gtgtatatattcacagaatg

SEQ ID NO: 493619 - DNA, 20 bp, mouse
gacttaatataaactcttag

SEQ ID NO: 493620 - DNA, 20 bp, mouse
gtgcagtcaaattaaagaag

SEQ ID NO: 493621 - DNA, 20 bp, mouse
gagttagattacattttgaa

SEQ ID NO: 493622 - DNA, 20 bp, mouse
gtctgagaaagacaagcggt

SEQ ID NO: 493623 - DNA, 20 bp, mouse
gactatggaggatactatgg

SEQ ID NO: 493624 - DNA, 20 bp, mouse
ggctactatggaggatacta

SEQ ID NO: 493625 - DNA, 20 bp, mouse
ggttgtctgagaaagacaag

SEQ ID NO: 493626 - DNA, 20 bp, mouse
gctcagaggagcaaatcttt

SEQ ID NO: 493627 - DNA, 20 bp, mouse
gctttctgagtttggactgt

SEQ ID NO: 493628 - DNA, 20 bp, mouse
gtcagaaagacctttctgtc

SEQ ID NO: 493629 - DNA, 20 bp, mouse
gctttaggtatcctgatctt

SEQ ID NO: 493630 - DNA, 20 bp, mouse
gttcaaataataacatagat

SEQ ID NO: 493631 - DNA, 20 bp, mouse
gcttacgttttccaaagatc

SEQ ID NO: 493632 - DNA, 20 bp, mouse
gaggttttgccagttagccc

SEQ ID NO: 493633 - DNA, 20 bp, mouse
ggaaatctttatcttgaatg

SEQ ID NO: 493634 - DNA, 20 bp, mouse
gatgaaatagcaaataagga

SEQ ID NO: 493635 - DNA, 20 bp, mouse
gattttgctatgtaagaggc

SEQ ID NO: 493636 - DNA, 20 bp, mouse
gctgcgggatgaagaagcgc

SEQ ID NO: 493637 - DNA, 20 bp, mouse
gatgaagaagcgcgggtgcc

SEQ ID NO: 493638 - DNA, 20 bp, mouse
gccccgccatcgcacctgcc

SEQ ID NO: 493639 - DNA, 20 bp, mouse
ggggcgcggggtcgacgcag

SEQ ID NO: 493640 - DNA, 20 bp, mouse
gtccggcgtgaggaaagcgc

SEQ ID NO: 493641 - DNA, 20 bp, mouse
gagaagcgcgggtgccgggc

SEQ ID NO: 493642 - DNA, 20 bp, mouse
ggccgggcaggtgcgatggc

SEQ ID NO: 493643 - DNA, 20 bp, mouse
gtcttggtagaagtactcac

SEQ ID NO: 493644 - DNA, 20 bp, mouse
gattgacgtcagggtgtatc

SEQ ID NO: 493645 - DNA, 20 bp, mouse
gtcagggtgtatccggcgtg

SEQ ID NO: 493646 - DNA, 20 bp, mouse
gacacacacaaagagcgcgg

SEQ ID NO: 493647 - DNA, 20 bp, mouse
ggccgcggctgacaggacag

SEQ ID NO: 493648 - DNA, 20 bp, mouse
ggacggccccgcctccccac

SEQ ID NO: 493649 - DNA, 20 bp, mouse
gcgggcggcgcgggtggtga

SEQ ID NO: 493650 - DNA, 20 bp, mouse
gcacacaaagagcgcggcgg

SEQ ID NO: 493651 - DNA, 20 bp, mouse
ggcggcgggctgcggaggta

SEQ ID NO: 493652 - DNA, 20 bp, mouse
ggctcgctcaagaacccggg

SEQ ID NO: 493653 - DNA, 20 bp, mouse
ggggcgtccggacatctgat

SEQ ID NO: 493654 - DNA, 20 bp, mouse
gggcacgagcagccagccgc

SEQ ID NO: 493655 - DNA, 20 bp, mouse
gcgctcttcgaggatcaggg

SEQ ID NO: 493656 - DNA, 20 bp, mouse
gtctcgctagggctccgtcg

SEQ ID NO: 493657 - DNA, 20 bp, mouse
ggctagggctccgtcgtgga

SEQ ID NO: 493658 - DNA, 20 bp, mouse
gttcctacagaaggcatctg

SEQ ID NO: 493659 - DNA, 20 bp, mouse
gctttttgttctcaaccttc

SEQ ID NO: 493660 - DNA, 20 bp, mouse
gttctgtaggaaacacttaa

SEQ ID NO: 493661 - DNA, 20 bp, mouse
gctcaataaaattctcgcta

SEQ ID NO: 493662 - DNA, 20 bp, mouse
gaaggtaacaagttttccag

SEQ ID NO: 493663 - DNA, 20 bp, mouse
ggtaggaaacacttaatgga

SEQ ID NO: 493664 - DNA, 20 bp, mouse
ggtaacaagttttccagggg

SEQ ID NO: 493665 - DNA, 20 bp, mouse
gagggctccggggaaagtcc

SEQ ID NO: 493666 - DNA, 20 bp, mouse
gctgcagcaagcttggggac

SEQ ID NO: 493667 - DNA, 20 bp, mouse
ggcttggggacgggacgcac

SEQ ID NO: 493668 - DNA, 20 bp, mouse
gtgggtagggccaggaacga

SEQ ID NO: 493669 - DNA, 20 bp, mouse
gttgctcctgcagcaagctt

SEQ ID NO: 493670 - DNA, 20 bp, mouse
gcactacagactgtgatctg

SEQ ID NO: 493671 - DNA, 20 bp, mouse
gcgtcggcgggtgtattgta

SEQ ID NO: 493672 - DNA, 20 bp, mouse
ggggcacagctatcatagat

SEQ ID NO: 493673 - DNA, 20 bp, mouse
gtcagatacgactgacatct

SEQ ID NO: 493674 - DNA, 20 bp, mouse
gcctagcaaagcaacgtctt

SEQ ID NO: 493675 - DNA, 20 bp, mouse
gagctaagaatggggcccgt

SEQ ID NO: 493676 - DNA, 20 bp, mouse
gctccccacaccaggcagtc

SEQ ID NO: 493677 - DNA, 20 bp, mouse
gtcctggaagagcgctttga

SEQ ID NO: 493678 - DNA, 20 bp, mouse
gagctagaagaccatgagaa

SEQ ID NO: 493679 - DNA, 20 bp, mouse
ggattctgagtgtctcaaag

SEQ ID NO: 493680 - DNA, 20 bp, mouse
gcgaaaaagactttaaagac

SEQ ID NO: 493681 - DNA, 20 bp, mouse
gcaaaagtttgtgaacaaag

SEQ ID NO: 493682 - DNA, 20 bp, mouse
ggttccagaatttgttgtcc

SEQ ID NO: 493683 - DNA, 20 bp, mouse
gacttttgatgctgacaacc

SEQ ID NO: 493684 - DNA, 20 bp, mouse
ggagctcggtaattaacgta

SEQ ID NO: 493685 - DNA, 20 bp, mouse
gcctgtctgctccccacacc

SEQ ID NO: 493686 - DNA, 20 bp, mouse
gttctgttagctcaatctaa

SEQ ID NO: 493687 - DNA, 20 bp, mouse
ggagactagactacaaacac

SEQ ID NO: 493688 - DNA, 20 bp, mouse
gaagcagcacactcatccag

SEQ ID NO: 493689 - DNA, 20 bp, mouse
gagcacactcatccagggga

SEQ ID NO: 493690 - DNA, 20 bp, mouse
ggagggaagatatgacttga

SEQ ID NO: 493691 - DNA, 20 bp, mouse
gacatgatataccacttcct

SEQ ID NO: 493692 - DNA, 20 bp, mouse
gcctactgccctctacacta

SEQ ID NO: 493693 - DNA, 20 bp, mouse
gagtctccgggaacactggg

SEQ ID NO: 493694 - DNA, 20 bp, mouse
gccttgctgaaagcagtggg

SEQ ID NO: 493695 - DNA, 20 bp, mouse
gcatccaggggaaggagagg

SEQ ID NO: 493696 - DNA, 20 bp, mouse
gcaacagggaggatgtgtgg

SEQ ID NO: 493697 - DNA, 20 bp, mouse
ggattgacccctggcagagg

SEQ ID NO: 493698 - DNA, 20 bp, mouse
gccttcagcctgctaaccca

SEQ ID NO: 493699 - DNA, 20 bp, mouse
gaacagccaggattgacccc

SEQ ID NO: 493700 - DNA, 20 bp, mouse
gcaggattgacccctggcag

SEQ ID NO: 493701 - DNA, 20 bp, mouse
ggagggctcaaccaacaggg

SEQ ID NO: 493702 - DNA, 20 bp, mouse
gtaatcagcttaccatccca

SEQ ID NO: 493703 - DNA, 20 bp, mouse
gagaggcaaagcaagaatag

SEQ ID NO: 493704 - DNA, 20 bp, mouse
gcctagagggctcaaccaac

SEQ ID NO: 493705 - DNA, 20 bp, mouse
gccatcctccacctctgcca

SEQ ID NO: 493706 - DNA, 20 bp, mouse
gaagaagaggcccggccacc

SEQ ID NO: 493707 - DNA, 20 bp, mouse
gctctgttcaagaagaggcc

SEQ ID NO: 493708 - DNA, 20 bp, mouse
gggctcatatccgggtggcc

SEQ ID NO: 493709 - DNA, 20 bp, mouse
gtcagctcgagcgccaagat

SEQ ID NO: 493710 - DNA, 20 bp, mouse
ggatcgctggcttagaaaga

SEQ ID NO: 493711 - DNA, 20 bp, mouse
gagaacggctcatatccggg

SEQ ID NO: 493712 - DNA, 20 bp, mouse
ggcgagaacggctcatatcc

SEQ ID NO: 493713 - DNA, 20 bp, mouse
ggggacggctctcgcgagaa

SEQ ID NO: 493714 - DNA, 20 bp, mouse
ggctggcttagaaagaggga

SEQ ID NO: 493715 - DNA, 20 bp, mouse
gttggcgctcgagctgaaca

SEQ ID NO: 493716 - DNA, 20 bp, mouse
gcagaaaatatgcagtctgg

SEQ ID NO: 493717 - DNA, 20 bp, mouse
ggccccggagagtgaaacga

SEQ ID NO: 493718 - DNA, 20 bp, mouse
gactagtgtagaaggcacta

SEQ ID NO: 493719 - DNA, 20 bp, mouse
gcagtcatcttggtcagcac

SEQ ID NO: 493720 - DNA, 20 bp, mouse
ggaatactacacacagaaga

SEQ ID NO: 493721 - DNA, 20 bp, mouse
gtgctggtcagattgcctca

SEQ ID NO: 493722 - DNA, 20 bp, mouse
gaccttcgtttcactctccg

SEQ ID NO: 493723 - DNA, 20 bp, mouse
gacagcaacatgagagcttg

SEQ ID NO: 493724 - DNA, 20 bp, mouse
gtttaaaaggtaaatctact

SEQ ID NO: 493725 - DNA, 20 bp, mouse
gtgagagaagacactaaaga

SEQ ID NO: 493726 - DNA, 20 bp, mouse
gaggtctacttgatacatct

SEQ ID NO: 493727 - DNA, 20 bp, mouse
gttttaagaatggagaagat

SEQ ID NO: 493728 - DNA, 20 bp, mouse
gttgctttagtattcaattc

SEQ ID NO: 493729 - DNA, 20 bp, mouse
gaaagcttctattttaagaa

SEQ ID NO: 493730 - DNA, 20 bp, mouse
ggtatcaagtagacctcctc

SEQ ID NO: 493731 - DNA, 20 bp, mouse
gaagtagacctcctctggaa

SEQ ID NO: 493732 - DNA, 20 bp, mouse
gtctacttgatacatctggg

SEQ ID NO: 493733 - DNA, 20 bp, mouse
gcgaaacaataggtggttgg

SEQ ID NO: 493734 - DNA, 20 bp, mouse
gaaacgaaacaataggtggt

SEQ ID NO: 493735 - DNA, 20 bp, mouse
gagaggatgcttaaaggata

SEQ ID NO: 493736 - DNA, 20 bp, mouse
gtgatgctaaggtccacagg

SEQ ID NO: 493737 - DNA, 20 bp, mouse
gtgctgatgctaaggtccac

SEQ ID NO: 493738 - DNA, 20 bp, mouse
gcccagaggggccactggag

SEQ ID NO: 493739 - DNA, 20 bp, mouse
gagctaggccaggccctcaa

SEQ ID NO: 493740 - DNA, 20 bp, mouse
ggaccacccagaggggccac

SEQ ID NO: 493741 - DNA, 20 bp, mouse
gggtcgcactgctgatgcta

SEQ ID NO: 493742 - DNA, 20 bp, mouse
gctggtgcgaagctcctgtg

SEQ ID NO: 493743 - DNA, 20 bp, mouse
gtctgtcaggcgagcctctg

SEQ ID NO: 493744 - DNA, 20 bp, mouse
ggcagtgcgacccgctccag

SEQ ID NO: 493745 - DNA, 20 bp, mouse
ggccatggctgacagtttcg

SEQ ID NO: 493746 - DNA, 20 bp, mouse
gcccaaatccacacttgcca

SEQ ID NO: 493747 - DNA, 20 bp, mouse
gttgtcagccatggcaagtg

SEQ ID NO: 493748 - DNA, 20 bp, mouse
ggccatggcaagtgtggatt

SEQ ID NO: 493749 - DNA, 20 bp, mouse
gctggacaaagtttagggac

SEQ ID NO: 493750 - DNA, 20 bp, mouse
gcgttgtgtatcaatctttg

SEQ ID NO: 493751 - DNA, 20 bp, mouse
gggcagcatgaccagttcgt

SEQ ID NO: 493752 - DNA, 20 bp, mouse
gcctgaagctgccaacgaac

SEQ ID NO: 493753 - DNA, 20 bp, mouse
gccagcaaggacgccacaac

SEQ ID NO: 493754 - DNA, 20 bp, mouse
gtcgggaatctggcctgttg

SEQ ID NO: 493755 - DNA, 20 bp, mouse
gtcgttggcagcttcagggc

SEQ ID NO: 493756 - DNA, 20 bp, mouse
gagccacccgaaacccctgg

SEQ ID NO: 493757 - DNA, 20 bp, mouse
gctcgaaaccaagacatcac

SEQ ID NO: 493758 - DNA, 20 bp, mouse
gtgccaccaggggtttcggg

SEQ ID NO: 493759 - DNA, 20 bp, mouse
gggtgttcccggtgatgtct

SEQ ID NO: 493760 - DNA, 20 bp, mouse
gccaagagggttacagagat

SEQ ID NO: 493761 - DNA, 20 bp, mouse
gtgcggaaacgagtccaaga

SEQ ID NO: 493762 - DNA, 20 bp, mouse
ggtagttccgtcagaccaag

SEQ ID NO: 493763 - DNA, 20 bp, mouse
gttccgtcagaccaagcgga

SEQ ID NO: 493764 - DNA, 20 bp, mouse
gaggggtttcgggtggctcc

SEQ ID NO: 493765 - DNA, 20 bp, mouse
ggttactgtcaccttccgct

SEQ ID NO: 493766 - DNA, 20 bp, mouse
ggaaggtactagaggtgggg

SEQ ID NO: 493767 - DNA, 20 bp, mouse
gcaggcacatccctgagcac

SEQ ID NO: 493768 - DNA, 20 bp, mouse
gaaagaaggtactagaggtg

SEQ ID NO: 493769 - DNA, 20 bp, mouse
gttcatgatatgtttttcag

SEQ ID NO: 493770 - DNA, 20 bp, mouse
ggagcactggcgaatgtgaa

SEQ ID NO: 493771 - DNA, 20 bp, mouse
gtggcgaatgtgaatggacc

SEQ ID NO: 493772 - DNA, 20 bp, mouse
gtggcagaaataatcctcag

SEQ ID NO: 493773 - DNA, 20 bp, mouse
gcccaaggacatagacaagt

SEQ ID NO: 493774 - DNA, 20 bp, mouse
ggggcctgctctcgaggtaa

SEQ ID NO: 493775 - DNA, 20 bp, mouse
gacaactcccagcagcacgc

SEQ ID NO: 493776 - DNA, 20 bp, mouse
gtgcccggcagaaaggtccc

SEQ ID NO: 493777 - DNA, 20 bp, mouse
gggcagaaaggtcccgggtc

SEQ ID NO: 493778 - DNA, 20 bp, mouse
gttacacgaagcagcatggt

SEQ ID NO: 493779 - DNA, 20 bp, mouse
gggcccacagagggatcggg

SEQ ID NO: 493780 - DNA, 20 bp, mouse
gagcagcatggtggggagtc

SEQ ID NO: 493781 - DNA, 20 bp, mouse
gctataggtggacagctgag

SEQ ID NO: 493782 - DNA, 20 bp, mouse
ggtggttacacgaagcagca

SEQ ID NO: 493783 - DNA, 20 bp, mouse
ggagctgaagaggctatgat

SEQ ID NO: 493784 - DNA, 20 bp, mouse
gccacagcccgcccggggac

SEQ ID NO: 493785 - DNA, 20 bp, mouse
gatgcccagaccctccaagg

SEQ ID NO: 493786 - DNA, 20 bp, mouse
gcctgaaaaggctgttgata

SEQ ID NO: 493787 - DNA, 20 bp, mouse
gctgcccgggcggctaggtt

SEQ ID NO: 493788 - DNA, 20 bp, mouse
ggatatggcatcggaaaaga

SEQ ID NO: 493789 - DNA, 20 bp, mouse
ggtttatccaggttaaccat

SEQ ID NO: 493790 - DNA, 20 bp, mouse
gattccaaacctagccgccc

SEQ ID NO: 493791 - DNA, 20 bp, mouse
gaaggctgttgatatggcat

SEQ ID NO: 493792 - DNA, 20 bp, mouse
gtccaggttaaccataggct

SEQ ID NO: 493793 - DNA, 20 bp, mouse
ggactgaaagaatgcagaag

SEQ ID NO: 493794 - DNA, 20 bp, mouse
gtccatctctagaaagtctg

SEQ ID NO: 493795 - DNA, 20 bp, mouse
gcagatgataaaccttttgt

SEQ ID NO: 493796 - DNA, 20 bp, mouse
gcctccacaaggccagggtg

SEQ ID NO: 493797 - DNA, 20 bp, mouse
gacaggccgctcccacaccc

SEQ ID NO: 493798 - DNA, 20 bp, mouse
gtggctggccaggtcagtga

SEQ ID NO: 493799 - DNA, 20 bp, mouse
gatctcgtaatcacccttct

SEQ ID NO: 493800 - DNA, 20 bp, mouse
gtcccagtcaccgggaatgg

SEQ ID NO: 493801 - DNA, 20 bp, mouse
ggggtgattacgagatctta

SEQ ID NO: 493802 - DNA, 20 bp, mouse
gaggctggatggtatcccct

SEQ ID NO: 493803 - DNA, 20 bp, mouse
gtctatgaccgaatggatgg

SEQ ID NO: 493804 - DNA, 20 bp, mouse
ggccatattgcctgccatgg

SEQ ID NO: 493805 - DNA, 20 bp, mouse
ggcagagtggcacattgatg

SEQ ID NO: 493806 - DNA, 20 bp, mouse
gtgaatgcattcaagtgaaa

SEQ ID NO: 493807 - DNA, 20 bp, mouse
gcactgacagggcacttgtg

SEQ ID NO: 493808 - DNA, 20 bp, mouse
ggggacataatagctatgtt

SEQ ID NO: 493809 - DNA, 20 bp, mouse
gctcagaaaggaggaatgac

SEQ ID NO: 493810 - DNA, 20 bp, mouse
gtaatattgaaggctcccat

SEQ ID NO: 493811 - DNA, 20 bp, mouse
gcaattttgccagctaaaca

SEQ ID NO: 493812 - DNA, 20 bp, mouse
gtgtttccgtggcttttgca

SEQ ID NO: 493813 - DNA, 20 bp, mouse
gcctgtcagtgtaaaagaag

SEQ ID NO: 493814 - DNA, 20 bp, mouse
ggtggcctttcaccatactt

SEQ ID NO: 493815 - DNA, 20 bp, mouse
gtattacatgacctcagtat

SEQ ID NO: 493816 - DNA, 20 bp, mouse
gttggaggtacaggcgtctt

SEQ ID NO: 493817 - DNA, 20 bp, mouse
gatccagaggggaggaacta

SEQ ID NO: 493818 - DNA, 20 bp, mouse
gccaacactggaaagacgtg

SEQ ID NO: 493819 - DNA, 20 bp, mouse
gggcaaagccctgtatccag

SEQ ID NO: 493820 - DNA, 20 bp, mouse
gcccaccagagttagtgact

SEQ ID NO: 493821 - DNA, 20 bp, mouse
gcactggaaagacgtgcggg

SEQ ID NO: 493822 - DNA, 20 bp, mouse
gtggtagcaggatctgggag

SEQ ID NO: 493823 - DNA, 20 bp, mouse
ggtacaggcgtctttggcgc

SEQ ID NO: 493824 - DNA, 20 bp, mouse
gctgtgactgtagagccctg

SEQ ID NO: 493825 - DNA, 20 bp, mouse
ggcccctggtagcaggatct

SEQ ID NO: 493826 - DNA, 20 bp, mouse
gggcaatgtagggaaagtgg

SEQ ID NO: 493827 - DNA, 20 bp, mouse
ggctagagctggggcaatgt

SEQ ID NO: 493828 - DNA, 20 bp, mouse
gggttccaggacttggacaa

SEQ ID NO: 493829 - DNA, 20 bp, mouse
gtccaggacttggacaaagg

SEQ ID NO: 493830 - DNA, 20 bp, mouse
gacccaaagtggaacactaa

SEQ ID NO: 493831 - DNA, 20 bp, mouse
gggacttggacaaaggtggt

SEQ ID NO: 493832 - DNA, 20 bp, mouse
gtagggacccggacaatggc

SEQ ID NO: 493833 - DNA, 20 bp, mouse
ggatgctctgcaccttctgt

SEQ ID NO: 493834 - DNA, 20 bp, mouse
gtggggcaatgtagggaaag

SEQ ID NO: 493835 - DNA, 20 bp, mouse
gttccagccggccattgtcc

SEQ ID NO: 493836 - DNA, 20 bp, mouse
ggtttatgaagtacttccat

SEQ ID NO: 493837 - DNA, 20 bp, mouse
gtcgatcctgggacatatga

SEQ ID NO: 493838 - DNA, 20 bp, mouse
gtttgtggtggaggacttag

SEQ ID NO: 493839 - DNA, 20 bp, mouse
ggtgagggggctgggtagtg

SEQ ID NO: 493840 - DNA, 20 bp, mouse
gagggggctgggtagtgggg

SEQ ID NO: 493841 - DNA, 20 bp, mouse
gagtgtcaccaaatgaatgt

SEQ ID NO: 493842 - DNA, 20 bp, mouse
gtctgcaaggtgagggggct

SEQ ID NO: 493843 - DNA, 20 bp, mouse
gaccaaatgaatgtaggact

SEQ ID NO: 493844 - DNA, 20 bp, mouse
gagtcccttgtaagtgaggg

SEQ ID NO: 493845 - DNA, 20 bp, mouse
gctcagtcccttgtaagtga

SEQ ID NO: 493846 - DNA, 20 bp, mouse
gctagagagggagcagtgtg

SEQ ID NO: 493847 - DNA, 20 bp, mouse
gactggatacagcagcgcac

SEQ ID NO: 493848 - DNA, 20 bp, mouse
gtaagcaaagatgtctagag

SEQ ID NO: 493849 - DNA, 20 bp, mouse
gaagccggaaagccgacgct

SEQ ID NO: 493850 - DNA, 20 bp, mouse
gcttcccagcgtcggctttc

SEQ ID NO: 493851 - DNA, 20 bp, mouse
gacgggtttgctccatccag

SEQ ID NO: 493852 - DNA, 20 bp, mouse
gggtttgctccatccagggg

SEQ ID NO: 493853 - DNA, 20 bp, mouse
gaaagaaaggctgaagggga

SEQ ID NO: 493854 - DNA, 20 bp, mouse
gagcaaggaccacccctgga

SEQ ID NO: 493855 - DNA, 20 bp, mouse
ggcagtgtgaggaagcagca

SEQ ID NO: 493856 - DNA, 20 bp, mouse
ggaaggtaataggactccat

SEQ ID NO: 493857 - DNA, 20 bp, mouse
gcctgttcatagaaggtaat

SEQ ID NO: 493858 - DNA, 20 bp, mouse
gcttctatgaacaggaaatg

SEQ ID NO: 493859 - DNA, 20 bp, mouse
gccttgctgggtgagtatgt

SEQ ID NO: 493860 - DNA, 20 bp, mouse
gcaagagagctgcaagaaat

SEQ ID NO: 493861 - DNA, 20 bp, mouse
gtagggtctgtaacttccca

SEQ ID NO: 493862 - DNA, 20 bp, mouse
gaagaaataggacccttgct

SEQ ID NO: 493863 - DNA, 20 bp, mouse
ggctctcttgctgataaact

SEQ ID NO: 493864 - DNA, 20 bp, mouse
gacaccattgctctaaggaa

SEQ ID NO: 493865 - DNA, 20 bp, mouse
gctcgactgggacgaagtac

SEQ ID NO: 493866 - DNA, 20 bp, mouse
gacagattcacaagaactgg

SEQ ID NO: 493867 - DNA, 20 bp, mouse
gtccaaagtttaaagatgaa

SEQ ID NO: 493868 - DNA, 20 bp, mouse
gtcaaatctttagaatacca

SEQ ID NO: 493869 - DNA, 20 bp, mouse
ggcccttcatctttaaactt

SEQ ID NO: 493870 - DNA, 20 bp, mouse
gtttatctggctcaattgtg

SEQ ID NO: 493871 - DNA, 20 bp, mouse
gatctggctcaattgtgggg

SEQ ID NO: 493872 - DNA, 20 bp, mouse
ggtttggggggggctctgta

SEQ ID NO: 493873 - DNA, 20 bp, mouse
gtgatactggacacacttgc

SEQ ID NO: 493874 - DNA, 20 bp, mouse
gctggacacacttgcgggtt

SEQ ID NO: 493875 - DNA, 20 bp, mouse
gagccccccccaaacatgtc

SEQ ID NO: 493876 - DNA, 20 bp, mouse
gagcaggcagaagaataaca

SEQ ID NO: 493877 - DNA, 20 bp, mouse
gctttgccaagattaaggta

SEQ ID NO: 493878 - DNA, 20 bp, mouse
gacaatccataccttaatct

SEQ ID NO: 493879 - DNA, 20 bp, mouse
gatacaaagacattatgatc

SEQ ID NO: 493880 - DNA, 20 bp, mouse
gagatgctttgccaagatta

SEQ ID NO: 493881 - DNA, 20 bp, mouse
ggctggactctgtagaaact

SEQ ID NO: 493882 - DNA, 20 bp, mouse
gagtaaaatgaacttttgat

SEQ ID NO: 493883 - DNA, 20 bp, mouse
gttattcttctgcctgctta

SEQ ID NO: 493884 - DNA, 20 bp, mouse
ggggttgcaatctttttctc

SEQ ID NO: 493885 - DNA, 20 bp, mouse
gtttcagtgcttgctttaaa

SEQ ID NO: 493886 - DNA, 20 bp, mouse
gccagaggttggccaatcaa

SEQ ID NO: 493887 - DNA, 20 bp, mouse
gttaagaaatcaacatccag

SEQ ID NO: 493888 - DNA, 20 bp, mouse
ggaaatcaacatccagaggt

SEQ ID NO: 493889 - DNA, 20 bp, mouse
gcatcagtaaaaaatgatac

SEQ ID NO: 493890 - DNA, 20 bp, mouse
gtctcaagtgctggaagtaa

SEQ ID NO: 493891 - DNA, 20 bp, mouse
gaatgatacaggaaatagta

SEQ ID NO: 493892 - DNA, 20 bp, mouse
gaatgatacaggccggccag

SEQ ID NO: 493893 - DNA, 20 bp, mouse
gagaatcctggaggaagcca

SEQ ID NO: 493894 - DNA, 20 bp, mouse
ggccctgacctcagctcaaa

SEQ ID NO: 493895 - DNA, 20 bp, mouse
ggcttcctccaggattcttc

SEQ ID NO: 493896 - DNA, 20 bp, mouse
gcgagcgcagagcacaaccc

SEQ ID NO: 493897 - DNA, 20 bp, mouse
gaggactccgctggaggagg

SEQ ID NO: 493898 - DNA, 20 bp, mouse
gtgcaggactccgctggagg

SEQ ID NO: 493899 - DNA, 20 bp, mouse
gaaacactgcctggccccac

SEQ ID NO: 493900 - DNA, 20 bp, mouse
ggagagctgcaggactccgc

SEQ ID NO: 493901 - DNA, 20 bp, mouse
gcggagcagccagtggggcc

SEQ ID NO: 493902 - DNA, 20 bp, mouse
gctggtgtccgcgtctaaca

SEQ ID NO: 493903 - DNA, 20 bp, mouse
ggctcctacgggcaagcagg

SEQ ID NO: 493904 - DNA, 20 bp, mouse
gtgtccgcgtctaacatgga

SEQ ID NO: 493905 - DNA, 20 bp, mouse
gtgcccctccatgttagacg

SEQ ID NO: 493906 - DNA, 20 bp, mouse
gtgctaggacacttgaggat

SEQ ID NO: 493907 - DNA, 20 bp, mouse
gaatgcagctcgtttttgaa

SEQ ID NO: 493908 - DNA, 20 bp, mouse
gcacagtgctaggacacttg

SEQ ID NO: 493909 - DNA, 20 bp, mouse
gcccacagactcacatggct

SEQ ID NO: 493910 - DNA, 20 bp, mouse
gacacttgaggataggtcac

SEQ ID NO: 493911 - DNA, 20 bp, mouse
gtgcagcccacagactcaca

SEQ ID NO: 493912 - DNA, 20 bp, mouse
gttttgaagggcatactgct

SEQ ID NO: 493913 - DNA, 20 bp, mouse
gcatgtctccaaatataaga

SEQ ID NO: 493914 - DNA, 20 bp, mouse
gtgttcagtactgaagaact

SEQ ID NO: 493915 - DNA, 20 bp, mouse
ggagaaagaaccagctatat

SEQ ID NO: 493916 - DNA, 20 bp, mouse
gtcgtcgctcggtccggcta

SEQ ID NO: 493917 - DNA, 20 bp, mouse
gctcgggtcgtcgctcggtc

SEQ ID NO: 493918 - DNA, 20 bp, mouse
ggtgcgcccgggccaatcag

SEQ ID NO: 493919 - DNA, 20 bp, mouse
gtagggctgcccaagaaagg

SEQ ID NO: 493920 - DNA, 20 bp, mouse
gtggcccgggcgcacagggg

SEQ ID NO: 493921 - DNA, 20 bp, mouse
ggccgtgaccggtgcagctc

SEQ ID NO: 493922 - DNA, 20 bp, mouse
gggctagggctgcccaagaa

SEQ ID NO: 493923 - DNA, 20 bp, mouse
ggattggcccgggcgcacag

SEQ ID NO: 493924 - DNA, 20 bp, mouse
gacccgagctgcaccggtca

SEQ ID NO: 493925 - DNA, 20 bp, mouse
ggcgacgacccgagctgcac

SEQ ID NO: 493926 - DNA, 20 bp, mouse
gggaggagctgaaaggacag

SEQ ID NO: 493927 - DNA, 20 bp, mouse
ggaacttctcacttaaccac

SEQ ID NO: 493928 - DNA, 20 bp, mouse
gctcacttaaccactggctt

SEQ ID NO: 493929 - DNA, 20 bp, mouse
gacttcatgggtcgctttga

SEQ ID NO: 493930 - DNA, 20 bp, mouse
gcaatcaagtaaggcagatt

SEQ ID NO: 493931 - DNA, 20 bp, mouse
gaggcagattgggaaagtcc

SEQ ID NO: 493932 - DNA, 20 bp, mouse
gggagaccctctaagtactc

SEQ ID NO: 493933 - DNA, 20 bp, mouse
gtcagggctgtagcaaacca

SEQ ID NO: 493934 - DNA, 20 bp, mouse
gggaaggcgtccaggcactt

SEQ ID NO: 493935 - DNA, 20 bp, mouse
ggtagagcttcatcttgtca

SEQ ID NO: 493936 - DNA, 20 bp, mouse
gcttgtcgaggaattcaaag

SEQ ID NO: 493937 - DNA, 20 bp, mouse
gcggcgggatatgcacgaag

SEQ ID NO: 493938 - DNA, 20 bp, mouse
gcataagataccttaccccg

SEQ ID NO: 493939 - DNA, 20 bp, mouse
gcattggcccaatctgaacg

SEQ ID NO: 493940 - DNA, 20 bp, mouse
gaatctgaacggggcagtgg

SEQ ID NO: 493941 - DNA, 20 bp, mouse
gaatttgcccccttccacca

SEQ ID NO: 493942 - DNA, 20 bp, mouse
gtcggagtaccctggtggaa

SEQ ID NO: 493943 - DNA, 20 bp, mouse
gagcatatagatccactcac

SEQ ID NO: 493944 - DNA, 20 bp, mouse
gcccaatctgaacggggcag

SEQ ID NO: 493945 - DNA, 20 bp, mouse
gcagggtactccgaaatcat

SEQ ID NO: 493946 - DNA, 20 bp, mouse
gctaaacagaatccttacca

SEQ ID NO: 493947 - DNA, 20 bp, mouse
gaagccttgctgccaccagt

SEQ ID NO: 493948 - DNA, 20 bp, mouse
gttggacatataactagtgt

SEQ ID NO: 493949 - DNA, 20 bp, mouse
gccacaataaactccatcac

SEQ ID NO: 493950 - DNA, 20 bp, mouse
gaaaatgttagaacctagag

SEQ ID NO: 493951 - DNA, 20 bp, mouse
gaccaaatcgggaattgagt

SEQ ID NO: 493952 - DNA, 20 bp, mouse
gtctcccactggtggcagca

SEQ ID NO: 493953 - DNA, 20 bp, mouse
gacctcgtgtaattacatca

SEQ ID NO: 493954 - DNA, 20 bp, mouse
gtcgtgtaattacatcaagg

SEQ ID NO: 493955 - DNA, 20 bp, mouse
gctggataaagaaaggaatt

SEQ ID NO: 493956 - DNA, 20 bp, mouse
ggtacatcattgtacgtcac

SEQ ID NO: 493957 - DNA, 20 bp, mouse
gagctttactcgggaagaat

SEQ ID NO: 493958 - DNA, 20 bp, mouse
ggtactggtgagctttactc

SEQ ID NO: 493959 - DNA, 20 bp, mouse
gatggcagtgaggttcttat

SEQ ID NO: 493960 - DNA, 20 bp, mouse
gtgtcttctaggctataact

SEQ ID NO: 493961 - DNA, 20 bp, mouse
gagaatgatgagaataaatt

SEQ ID NO: 493962 - DNA, 20 bp, mouse
gagttgtgtggttgtatgtg

SEQ ID NO: 493963 - DNA, 20 bp, mouse
gacattcacaatcttaccta

SEQ ID NO: 493964 - DNA, 20 bp, mouse
gtagcctagaagacagtaca

SEQ ID NO: 493965 - DNA, 20 bp, mouse
gtttctctttttgaaagagg

SEQ ID NO: 493966 - DNA, 20 bp, mouse
gaccctcaccaagataggaa

SEQ ID NO: 493967 - DNA, 20 bp, mouse
gatcttggtgagggtgcata

SEQ ID NO: 493968 - DNA, 20 bp, mouse
gtctgccaggataacgtcta

SEQ ID NO: 493969 - DNA, 20 bp, mouse
ggcttgatgttaatagaact

SEQ ID NO: 493970 - DNA, 20 bp, mouse
ggctctggttgccatcaaaa

SEQ ID NO: 493971 - DNA, 20 bp, mouse
ggcatcgggagggagcttat

SEQ ID NO: 493972 - DNA, 20 bp, mouse
gatagggtcctttcctatct

SEQ ID NO: 493973 - DNA, 20 bp, mouse
gagcttattggatttaatag

SEQ ID NO: 493974 - DNA, 20 bp, mouse
gaaaatattcggagagatac

SEQ ID NO: 493975 - DNA, 20 bp, mouse
gaagaccatagacgttatcc

SEQ ID NO: 493976 - DNA, 20 bp, mouse
gcgcgagccgcttctcgtga

SEQ ID NO: 493977 - DNA, 20 bp, mouse
ggatgtgaggacttcacact

SEQ ID NO: 493978 - DNA, 20 bp, mouse
gctgtaatgcatgtactata

SEQ ID NO: 493979 - DNA, 20 bp, mouse
gcaatccaggaaaccaaagg

SEQ ID NO: 493980 - DNA, 20 bp, mouse
gaagcaatccaggaaaccaa

SEQ ID NO: 493981 - DNA, 20 bp, mouse
gcactgggaagaagcaatcc

SEQ ID NO: 493982 - DNA, 20 bp, mouse
gtggtgacagacagactcag

SEQ ID NO: 493983 - DNA, 20 bp, mouse
gactcagagggaaaagatcg

SEQ ID NO: 493984 - DNA, 20 bp, mouse
gtacatgcattacagatgtg

SEQ ID NO: 493985 - DNA, 20 bp, mouse
gaaataccactacaaagaag

SEQ ID NO: 493986 - DNA, 20 bp, mouse
gacagaaagctgtatagtag

SEQ ID NO: 493987 - DNA, 20 bp, mouse
gccaaggtattgctttgtgt

SEQ ID NO: 493988 - DNA, 20 bp, mouse
ggcagaaggagaagataatc

SEQ ID NO: 493989 - DNA, 20 bp, mouse
ggggtcagatgtacagtaga

SEQ ID NO: 493990 - DNA, 20 bp, mouse
gcccatgagtcagggaaata

SEQ ID NO: 493991 - DNA, 20 bp, mouse
gctcgctcagagcccgaaca

SEQ ID NO: 493992 - DNA, 20 bp, mouse
gcctcctggtcattactgcc

SEQ ID NO: 493993 - DNA, 20 bp, mouse
gagatgtacagtagatggca

SEQ ID NO: 493994 - DNA, 20 bp, mouse
gaaggacaagaatgcaacgg

SEQ ID NO: 493995 - DNA, 20 bp, mouse
gataccttggaaaagaatga

SEQ ID NO: 493996 - DNA, 20 bp, mouse
gctcactgttccaggtagtc

SEQ ID NO: 493997 - DNA, 20 bp, mouse
gtcattctgctcactgttcc

SEQ ID NO: 493998 - DNA, 20 bp, mouse
gaaatgagcagttttcgtcg

SEQ ID NO: 493999 - DNA, 20 bp, mouse
gttggagagactgggcagtt

SEQ ID NO: 494000 - DNA, 20 bp, mouse
gacgaaaactgctcatttgc

SEQ ID NO: 494001 - DNA, 20 bp, mouse
gagcagctctattggctaat

SEQ ID NO: 494002 - DNA, 20 bp, mouse
gacacatccctggaacagag

SEQ ID NO: 494003 - DNA, 20 bp, mouse
gtagcagccactctgttcca

SEQ ID NO: 494004 - DNA, 20 bp, mouse
gccttcggagccgagaggtg

SEQ ID NO: 494005 - DNA, 20 bp, mouse
gtaatagagaaactcttctg

SEQ ID NO: 494006 - DNA, 20 bp, mouse
ggaggagagccggccttgat

SEQ ID NO: 494007 - DNA, 20 bp, mouse
gctggacctgggaatcatcg

SEQ ID NO: 494008 - DNA, 20 bp, mouse
ggccggccttgatgggaatc

SEQ ID NO: 494009 - DNA, 20 bp, mouse
gtgggaatcatcggggacaa

SEQ ID NO: 494010 - DNA, 20 bp, mouse
gtcatgccggattcccatca

SEQ ID NO: 494011 - DNA, 20 bp, mouse
gtttgtcaccagctggacct

SEQ ID NO: 494012 - DNA, 20 bp, mouse
gttcatcccagcaagcttgg

SEQ ID NO: 494013 - DNA, 20 bp, mouse
gatggtagcgctctattcct

SEQ ID NO: 494014 - DNA, 20 bp, mouse
gagcaagcttggaggagagc

SEQ ID NO: 494015 - DNA, 20 bp, mouse
gctcttgagggtgaatccca

SEQ ID NO: 494016 - DNA, 20 bp, mouse
gtagtctgcacatggtgggg

SEQ ID NO: 494017 - DNA, 20 bp, mouse
ggagtcccgttgaccctgga

SEQ ID NO: 494018 - DNA, 20 bp, mouse
gggctctagtctgcacatgg

SEQ ID NO: 494019 - DNA, 20 bp, mouse
gaggaaaaggaggaccacca

SEQ ID NO: 494020 - DNA, 20 bp, mouse
gaccagagtcccgttgaccc

SEQ ID NO: 494021 - DNA, 20 bp, mouse
ggactgatgttctccttcca

SEQ ID NO: 494022 - DNA, 20 bp, mouse
gccagggacctcttcagaaa

SEQ ID NO: 494023 - DNA, 20 bp, mouse
gtccatggtagcttagggtg

SEQ ID NO: 494024 - DNA, 20 bp, mouse
gttgccctcagaggtactgg

SEQ ID NO: 494025 - DNA, 20 bp, mouse
gcatgcagccatctctacaa

SEQ ID NO: 494026 - DNA, 20 bp, mouse
gaaagcctagcgggtgccaa

SEQ ID NO: 494027 - DNA, 20 bp, mouse
gcatcgaggaggtgagcggt

SEQ ID NO: 494028 - DNA, 20 bp, mouse
gctgcaaaggagccaagagg

SEQ ID NO: 494029 - DNA, 20 bp, mouse
gctctgcccgctgtgctctg

SEQ ID NO: 494030 - DNA, 20 bp, mouse
gccagggctccagggcgcca

SEQ ID NO: 494031 - DNA, 20 bp, mouse
gccgccgctcggggaacaaa

SEQ ID NO: 494032 - DNA, 20 bp, mouse
gcctctgcaaaggagccaag

SEQ ID NO: 494033 - DNA, 20 bp, mouse
ggggcatcgccagggctcca

SEQ ID NO: 494034 - DNA, 20 bp, mouse
ggctccagggcgccagggcg

SEQ ID NO: 494035 - DNA, 20 bp, mouse
ggtgtcggagcccgcgtcct

SEQ ID NO: 494036 - DNA, 20 bp, mouse
gcctcagcccggtaactctg

SEQ ID NO: 494037 - DNA, 20 bp, mouse
gttctgtcctcagagttacc

SEQ ID NO: 494038 - DNA, 20 bp, mouse
gatgcctgcacagagtgaag

SEQ ID NO: 494039 - DNA, 20 bp, mouse
gcgggctgagggctgggcag

SEQ ID NO: 494040 - DNA, 20 bp, mouse
gtcatggcttcctggaacca

SEQ ID NO: 494041 - DNA, 20 bp, mouse
gtataactttgtattgtgag

SEQ ID NO: 494042 - DNA, 20 bp, mouse
gcaaagttataagaactatc

SEQ ID NO: 494043 - DNA, 20 bp, mouse
gactcctcttcactctgtgc

SEQ ID NO: 494044 - DNA, 20 bp, mouse
ggagaagtgagacaatgttc

SEQ ID NO: 494045 - DNA, 20 bp, mouse
ggtccctatgcactatccca

SEQ ID NO: 494046 - DNA, 20 bp, mouse
ggtatttattaaccccattt

SEQ ID NO: 494047 - DNA, 20 bp, mouse
gtagactagacaaggagtag

SEQ ID NO: 494048 - DNA, 20 bp, mouse
gtccagtaaaacaccgaaat

SEQ ID NO: 494049 - DNA, 20 bp, mouse
ggtagagggtctgaaggtcc

SEQ ID NO: 494050 - DNA, 20 bp, mouse
gggaggaaacaggagctcat

SEQ ID NO: 494051 - DNA, 20 bp, mouse
gatttcagtagagggtctga

SEQ ID NO: 494052 - DNA, 20 bp, mouse
ggagaaagaaagtggagatg

SEQ ID NO: 494053 - DNA, 20 bp, mouse
gtcacagggagggattggtt

SEQ ID NO: 494054 - DNA, 20 bp, mouse
gctggaaggagatcacaggg

SEQ ID NO: 494055 - DNA, 20 bp, mouse
gttcctggaaggagatcaca

SEQ ID NO: 494056 - DNA, 20 bp, mouse
gctccgcttgtacactggga

SEQ ID NO: 494057 - DNA, 20 bp, mouse
gggcccaagtacgccatgac

SEQ ID NO: 494058 - DNA, 20 bp, mouse
gacgactccgcttgtacact

SEQ ID NO: 494059 - DNA, 20 bp, mouse
gctccttcccagtgtacaag

SEQ ID NO: 494060 - DNA, 20 bp, mouse
gtcatcagcatgtacaagag

SEQ ID NO: 494061 - DNA, 20 bp, mouse
ggtacaagcggagtcgtatt

SEQ ID NO: 494062 - DNA, 20 bp, mouse
gctgatgtggcctacccagt

SEQ ID NO: 494063 - DNA, 20 bp, mouse
ggacatccatgaagcccact

SEQ ID NO: 494064 - DNA, 20 bp, mouse
gcgtcgtgtgtgatgaggtg

SEQ ID NO: 494065 - DNA, 20 bp, mouse
gcgccggtcatggcgtactt

SEQ ID NO: 494066 - DNA, 20 bp, mouse
gcaaggctggaccccagaat

SEQ ID NO: 494067 - DNA, 20 bp, mouse
gttgggcacgacctattctg

SEQ ID NO: 494068 - DNA, 20 bp, mouse
gcccctaggcccctacccct

SEQ ID NO: 494069 - DNA, 20 bp, mouse
gacccctagcccccaccctt

SEQ ID NO: 494070 - DNA, 20 bp, mouse
gggtgggggcctaggggtag

SEQ ID NO: 494071 - DNA, 20 bp, mouse
gtgggatagcttatccgata

SEQ ID NO: 494072 - DNA, 20 bp, mouse
ggcctaagggtgggggctag

SEQ ID NO: 494073 - DNA, 20 bp, mouse
gtaggtcgtgcccaaatgtg

SEQ ID NO: 494074 - DNA, 20 bp, mouse
ggtccaagagccccacattt

SEQ ID NO: 494075 - DNA, 20 bp, mouse
gttggcccattatgagtcag

SEQ ID NO: 494076 - DNA, 20 bp, mouse
gagctgcagctctggagtaa

SEQ ID NO: 494077 - DNA, 20 bp, mouse
gcctgcaccggaaagggagg

SEQ ID NO: 494078 - DNA, 20 bp, mouse
gagagtcggagactagaggg

SEQ ID NO: 494079 - DNA, 20 bp, mouse
gaagcctgcaccggaaaggg

SEQ ID NO: 494080 - DNA, 20 bp, mouse
gctggagtaatggcatcccg

SEQ ID NO: 494081 - DNA, 20 bp, mouse
ggacagagtcggagactaga

SEQ ID NO: 494082 - DNA, 20 bp, mouse
gccaaaagcctgcaccggaa

SEQ ID NO: 494083 - DNA, 20 bp, mouse
gcgacaagctacaggggtcg

SEQ ID NO: 494084 - DNA, 20 bp, mouse
gcgcggtcctagggagcctc

SEQ ID NO: 494085 - DNA, 20 bp, mouse
gaaaaagagaaaggaccgac

SEQ ID NO: 494086 - DNA, 20 bp, mouse
gtgccatgcaagagaagagg

SEQ ID NO: 494087 - DNA, 20 bp, mouse
ggactgccatgcaagagaag

SEQ ID NO: 494088 - DNA, 20 bp, mouse
gcacaatcggataaactagg

SEQ ID NO: 494089 - DNA, 20 bp, mouse
gggcttgtgtgtggaaacct

SEQ ID NO: 494090 - DNA, 20 bp, mouse
ggtctaagacagcttcatat

SEQ ID NO: 494091 - DNA, 20 bp, mouse
gttacacaatcggataaact

SEQ ID NO: 494092 - DNA, 20 bp, mouse
gtggagcctgggcttgtgtg

SEQ ID NO: 494093 - DNA, 20 bp, mouse
gttttgatgtaagatatgtt

SEQ ID NO: 494094 - DNA, 20 bp, mouse
ggtgtggaaaccttggcaag

SEQ ID NO: 494095 - DNA, 20 bp, mouse
ggcttcatttgtgcaggttc

SEQ ID NO: 494096 - DNA, 20 bp, mouse
gagataccagataccagaaa

SEQ ID NO: 494097 - DNA, 20 bp, mouse
gctcaagcttcagttgaggt

SEQ ID NO: 494098 - DNA, 20 bp, mouse
ggtggagtctcctacagcag

SEQ ID NO: 494099 - DNA, 20 bp, mouse
gcagtggcactagtgtccac

SEQ ID NO: 494100 - DNA, 20 bp, mouse
gaggttccaagtaaagacac

SEQ ID NO: 494101 - DNA, 20 bp, mouse
gttaagcatgcgcccgggga

SEQ ID NO: 494102 - DNA, 20 bp, mouse
gtgttcataggacttcttcg

SEQ ID NO: 494103 - DNA, 20 bp, mouse
gtggcactagtgtccactgg

SEQ ID NO: 494104 - DNA, 20 bp, mouse
gtctgtgatcacttccaagg

SEQ ID NO: 494105 - DNA, 20 bp, mouse
gtctcagggacagatgactg

SEQ ID NO: 494106 - DNA, 20 bp, mouse
ggcggtgatgctgcatcaac

SEQ ID NO: 494107 - DNA, 20 bp, mouse
gcagcatcaccgctgggccc

SEQ ID NO: 494108 - DNA, 20 bp, mouse
gcgtgccaagcacaggcagc

SEQ ID NO: 494109 - DNA, 20 bp, mouse
ggcagggcttgaagaaggtg

SEQ ID NO: 494110 - DNA, 20 bp, mouse
gtaaacccgctgcctgtgct

SEQ ID NO: 494111 - DNA, 20 bp, mouse
gaggtgaggatagccaactg

SEQ ID NO: 494112 - DNA, 20 bp, mouse
gggagagcagggcttgaaga

SEQ ID NO: 494113 - DNA, 20 bp, mouse
gcggagcttgaggcctcagt

SEQ ID NO: 494114 - DNA, 20 bp, mouse
gtcaactggaaatcgaagcc

SEQ ID NO: 494115 - DNA, 20 bp, mouse
gatgttcccgtgccaagcac

SEQ ID NO: 494116 - DNA, 20 bp, mouse
gaaaccacactgcctgtgct

SEQ ID NO: 494117 - DNA, 20 bp, mouse
gcacttgtccctgggcgcaa

SEQ ID NO: 494118 - DNA, 20 bp, mouse
gagtatcaccgttgcgccca

SEQ ID NO: 494119 - DNA, 20 bp, mouse
gtcaactagaaatcgacacc

SEQ ID NO: 494120 - DNA, 20 bp, mouse
ggtgccaagcacaggcagtg

SEQ ID NO: 494121 - DNA, 20 bp, mouse
gatcttgtgggcaactccga

SEQ ID NO: 494122 - DNA, 20 bp, mouse
gccagcccagggaacactgt

SEQ ID NO: 494123 - DNA, 20 bp, mouse
gagaccctacagtgttccct

SEQ ID NO: 494124 - DNA, 20 bp, mouse
gtggagttgtatcttttcct

SEQ ID NO: 494125 - DNA, 20 bp, mouse
ggcagggctggcagaaggtg

SEQ ID NO: 494126 - DNA, 20 bp, mouse
gtcaccgggttccctcaaca

SEQ ID NO: 494127 - DNA, 20 bp, mouse
gccgggttccctcaacaggg

SEQ ID NO: 494128 - DNA, 20 bp, mouse
gcctcaacagggcggtatgt

SEQ ID NO: 494129 - DNA, 20 bp, mouse
gcaaagttgctggctaaagt

SEQ ID NO: 494130 - DNA, 20 bp, mouse
gagcgctgtggggactccgg

SEQ ID NO: 494131 - DNA, 20 bp, mouse
gaaggaggttgtgattcacc

SEQ ID NO: 494132 - DNA, 20 bp, mouse
ggagtcggtaccgggtgcgg

SEQ ID NO: 494133 - DNA, 20 bp, mouse
gcggcctccgccagactctg

SEQ ID NO: 494134 - DNA, 20 bp, mouse
gcccgcttagaagttgttct

SEQ ID NO: 494135 - DNA, 20 bp, mouse
gtcgccgctcaaggccggga

SEQ ID NO: 494136 - DNA, 20 bp, mouse
gggtgctcagacacacatgg

SEQ ID NO: 494137 - DNA, 20 bp, mouse
gggtggtgctcagacacaca

SEQ ID NO: 494138 - DNA, 20 bp, mouse
ggcgattagacttggacttc

SEQ ID NO: 494139 - DNA, 20 bp, mouse
gacagaagctgtaagttgat

SEQ ID NO: 494140 - DNA, 20 bp, mouse
gttctctggagtagaactac

SEQ ID NO: 494141 - DNA, 20 bp, mouse
gatagcagagaccaggaagg

SEQ ID NO: 494142 - DNA, 20 bp, mouse
ggacctccatagcagagacc

SEQ ID NO: 494143 - DNA, 20 bp, mouse
gaaccttgttggtcagaaga

SEQ ID NO: 494144 - DNA, 20 bp, mouse
gagtgagtttctctacactt

SEQ ID NO: 494145 - DNA, 20 bp, mouse
gacactttggtgactatgat

SEQ ID NO: 494146 - DNA, 20 bp, mouse
gagaacctcaaaactcacag

SEQ ID NO: 494147 - DNA, 20 bp, mouse
ggcaagtccccacccagcca

SEQ ID NO: 494148 - DNA, 20 bp, mouse
gtcttgggccatggctgggt

SEQ ID NO: 494149 - DNA, 20 bp, mouse
gtgagttctaagtttcaggt

SEQ ID NO: 494150 - DNA, 20 bp, mouse
gtattctgtccatgattcat

SEQ ID NO: 494151 - DNA, 20 bp, mouse
gttaaggatcatcccatggt

SEQ ID NO: 494152 - DNA, 20 bp, mouse
gaagtttcaggtcggcagga

SEQ ID NO: 494153 - DNA, 20 bp, mouse
gggtgggaatctccttgaga

SEQ ID NO: 494154 - DNA, 20 bp, mouse
gcaatactgacaaactgact

SEQ ID NO: 494155 - DNA, 20 bp, mouse
gtgttttaaggatcatccca

SEQ ID NO: 494156 - DNA, 20 bp, mouse
gctccacactagaatcccta

SEQ ID NO: 494157 - DNA, 20 bp, mouse
gcctaaggctggttctcctg

SEQ ID NO: 494158 - DNA, 20 bp, mouse
ggagcgcatggctttctcaa

SEQ ID NO: 494159 - DNA, 20 bp, mouse
gagacaagcactggagcgca

SEQ ID NO: 494160 - DNA, 20 bp, mouse
ggatgagctctggtaagatg

SEQ ID NO: 494161 - DNA, 20 bp, mouse
ggttgggctccagggtagga

SEQ ID NO: 494162 - DNA, 20 bp, mouse
ggcttgtctgaaaatgtctt

SEQ ID NO: 494163 - DNA, 20 bp, mouse
ggacattttcagacaagcac

SEQ ID NO: 494164 - DNA, 20 bp, mouse
gctagtgtggagatgagctc

SEQ ID NO: 494165 - DNA, 20 bp, mouse
gccaggtagggaagagatct

SEQ ID NO: 494166 - DNA, 20 bp, mouse
gtcaggtatggtgagaataa

SEQ ID NO: 494167 - DNA, 20 bp, mouse
ggtgggagcagtttcaggta

SEQ ID NO: 494168 - DNA, 20 bp, mouse
gctggagccacaatatcggt

SEQ ID NO: 494169 - DNA, 20 bp, mouse
gggagctggagccacaatat

SEQ ID NO: 494170 - DNA, 20 bp, mouse
gaaagaaaaggaaatctaac

SEQ ID NO: 494171 - DNA, 20 bp, mouse
ggtgcacgagctcataacta

SEQ ID NO: 494172 - DNA, 20 bp, mouse
gacgccaccgtcctccttag

SEQ ID NO: 494173 - DNA, 20 bp, mouse
gttaagcttgagagaacccg

SEQ ID NO: 494174 - DNA, 20 bp, mouse
gataagagtccggtgagcaa

SEQ ID NO: 494175 - DNA, 20 bp, mouse
ggctatgtttgcctctaagg

SEQ ID NO: 494176 - DNA, 20 bp, mouse
gtagaggcaggcacacacta

SEQ ID NO: 494177 - DNA, 20 bp, mouse
gatgggacatacacatgtag

SEQ ID NO: 494178 - DNA, 20 bp, mouse
gctgctgctttggactcttc

SEQ ID NO: 494179 - DNA, 20 bp, mouse
ggacatacacatgtagaggc

SEQ ID NO: 494180 - DNA, 20 bp, mouse
ggaggataattcttaagaaa

SEQ ID NO: 494181 - DNA, 20 bp, mouse
gtgttaccctatcaaatggg

SEQ ID NO: 494182 - DNA, 20 bp, mouse
gccttaaagagaacatagaa

SEQ ID NO: 494183 - DNA, 20 bp, mouse
ggagctgttaccctatcaaa

SEQ ID NO: 494184 - DNA, 20 bp, mouse
gaaatggggggcaaatgaca

SEQ ID NO: 494185 - DNA, 20 bp, mouse
gtaactgtacaagtaaaagg

SEQ ID NO: 494186 - DNA, 20 bp, mouse
gatagcagcccaggcaccga

SEQ ID NO: 494187 - DNA, 20 bp, mouse
gaaagctccacgcggcccta

SEQ ID NO: 494188 - DNA, 20 bp, mouse
gactacccgggtgaattcca

SEQ ID NO: 494189 - DNA, 20 bp, mouse
gccctaaggcatagcagccc

SEQ ID NO: 494190 - DNA, 20 bp, mouse
gactgggaggagcccggaga

SEQ ID NO: 494191 - DNA, 20 bp, mouse
gaggggcctcatattagcag

SEQ ID NO: 494192 - DNA, 20 bp, mouse
ggtcaccgcgatgagccatg

SEQ ID NO: 494193 - DNA, 20 bp, mouse
gggagatgtagttagcgaga

SEQ ID NO: 494194 - DNA, 20 bp, mouse
gacccgggtgaattccaggg

SEQ ID NO: 494195 - DNA, 20 bp, mouse
gactgccgcatggctcatcg

SEQ ID NO: 494196 - DNA, 20 bp, mouse
gcatgtccaggccaggctta

SEQ ID NO: 494197 - DNA, 20 bp, mouse
ggtaacccacggcggtgaac

SEQ ID NO: 494198 - DNA, 20 bp, mouse
gaacctcctctcaatgggcc

SEQ ID NO: 494199 - DNA, 20 bp, mouse
gagggtccccatcctgggat

SEQ ID NO: 494200 - DNA, 20 bp, mouse
ggccctggccccgacccgag

SEQ ID NO: 494201 - DNA, 20 bp, mouse
gcactcactcttgcccgctc

SEQ ID NO: 494202 - DNA, 20 bp, mouse
gactcttgcccgctcgggtc

SEQ ID NO: 494203 - DNA, 20 bp, mouse
gaccggggctcccctaagcc

SEQ ID NO: 494204 - DNA, 20 bp, mouse
gcagcagcaggagaagtaga

SEQ ID NO: 494205 - DNA, 20 bp, mouse
gagtagagggcaactcgtaa

SEQ ID NO: 494206 - DNA, 20 bp, mouse
ggttgagtagaactgtatga

SEQ ID NO: 494207 - DNA, 20 bp, mouse
gctgacacaggtatagagga

SEQ ID NO: 494208 - DNA, 20 bp, mouse
gcacagaaggaccctgtgag

SEQ ID NO: 494209 - DNA, 20 bp, mouse
gaggtgaataacccactcac

SEQ ID NO: 494210 - DNA, 20 bp, mouse
gtcacctgacacaggtatag

SEQ ID NO: 494211 - DNA, 20 bp, mouse
gagaggagggactgcaattc

SEQ ID NO: 494212 - DNA, 20 bp, mouse
gtcccagtgagtcactttcc

SEQ ID NO: 494213 - DNA, 20 bp, mouse
gactctatgatatattctac

SEQ ID NO: 494214 - DNA, 20 bp, mouse
ggagcaaaaggtgtgaggtg

SEQ ID NO: 494215 - DNA, 20 bp, mouse
gtcttcagacttctcgaact

SEQ ID NO: 494216 - DNA, 20 bp, mouse
gttgtggattgtgattctgt

SEQ ID NO: 494217 - DNA, 20 bp, mouse
gccattatggacaagtatgg

SEQ ID NO: 494218 - DNA, 20 bp, mouse
gaaagatctaggggctcctg

SEQ ID NO: 494219 - DNA, 20 bp, mouse
gtgtgattctgttggttgtg

SEQ ID NO: 494220 - DNA, 20 bp, mouse
gtgcccattatggacaagta

SEQ ID NO: 494221 - DNA, 20 bp, mouse
gtggacaagtatggtggctg

SEQ ID NO: 494222 - DNA, 20 bp, mouse
gctggaagaggcatattgtc

SEQ ID NO: 494223 - DNA, 20 bp, mouse
gtattgctcttgctcattat

SEQ ID NO: 494224 - DNA, 20 bp, mouse
gagagtatttcaaaagatct

SEQ ID NO: 494225 - DNA, 20 bp, mouse
gaatataatcgctaaataaa

SEQ ID NO: 494226 - DNA, 20 bp, mouse
gtccagctcaggctccaagt

SEQ ID NO: 494227 - DNA, 20 bp, mouse
gtgagctggagtgcgaagaa

SEQ ID NO: 494228 - DNA, 20 bp, mouse
gcccgacttggagcctgagc

SEQ ID NO: 494229 - DNA, 20 bp, mouse
gccatgacggcggcgcagat

SEQ ID NO: 494230 - DNA, 20 bp, mouse
gcagggacatgcaacagttg

SEQ ID NO: 494231 - DNA, 20 bp, mouse
ggacatgcaacagttgtgga

SEQ ID NO: 494232 - DNA, 20 bp, mouse
gtgcctttgagactcatcaa

SEQ ID NO: 494233 - DNA, 20 bp, mouse
gtccatcacctggaccctgc

SEQ ID NO: 494234 - DNA, 20 bp, mouse
gtccacgtcggccatgacgg

SEQ ID NO: 494235 - DNA, 20 bp, mouse
gtcctccacgtcggccatga

SEQ ID NO: 494236 - DNA, 20 bp, mouse
gggagtggacccaatccact

SEQ ID NO: 494237 - DNA, 20 bp, mouse
gcagctgaagcaggctggac

SEQ ID NO: 494238 - DNA, 20 bp, mouse
gccgtgggtgcagctgaagc

SEQ ID NO: 494239 - DNA, 20 bp, mouse
gggctccatagtccgaacca

SEQ ID NO: 494240 - DNA, 20 bp, mouse
gcccaggccccgctgatcct

SEQ ID NO: 494241 - DNA, 20 bp, mouse
ggactggagcccagtggatt

SEQ ID NO: 494242 - DNA, 20 bp, mouse
gccactccccaaggccctaa

SEQ ID NO: 494243 - DNA, 20 bp, mouse
gtgctcttcagtccatggtt

SEQ ID NO: 494244 - DNA, 20 bp, mouse
gccccgccagaagggaaccc

SEQ ID NO: 494245 - DNA, 20 bp, mouse
ggttcggactatggagccgt

SEQ ID NO: 494246 - DNA, 20 bp, mouse
ggatgaagctgatcctgacg

SEQ ID NO: 494247 - DNA, 20 bp, mouse
gatttcctgtaattcatctt

SEQ ID NO: 494248 - DNA, 20 bp, mouse
ggcgcataactttagaccaa

SEQ ID NO: 494249 - DNA, 20 bp, mouse
gcgctgaaatcgacaaggaa

SEQ ID NO: 494250 - DNA, 20 bp, mouse
gctgatcgctgaaatcgaca

SEQ ID NO: 494251 - DNA, 20 bp, mouse
gagggttgccaaggagctag

SEQ ID NO: 494252 - DNA, 20 bp, mouse
gtcaatatcgaataagtcaa

SEQ ID NO: 494253 - DNA, 20 bp, mouse
gtgctgcttttttcttccat

SEQ ID NO: 494254 - DNA, 20 bp, mouse
ggaaaaagaagaaatactga

SEQ ID NO: 494255 - DNA, 20 bp, mouse
gaacatcaagagggttgcca

SEQ ID NO: 494256 - DNA, 20 bp, mouse
ggcagttgatcgctgaggtt

SEQ ID NO: 494257 - DNA, 20 bp, mouse
gccgcggccgccctccctgt

SEQ ID NO: 494258 - DNA, 20 bp, mouse
ggctgtgctgctgagactgg

SEQ ID NO: 494259 - DNA, 20 bp, mouse
gcgctgaggttcggcagttg

SEQ ID NO: 494260 - DNA, 20 bp, mouse
gctcctgtaacagtcccaca

SEQ ID NO: 494261 - DNA, 20 bp, mouse
gtgtccttggagaaccctgg

SEQ ID NO: 494262 - DNA, 20 bp, mouse
gttctggcagttgatcgctg

SEQ ID NO: 494263 - DNA, 20 bp, mouse
ggccccgtgctaggccatac

SEQ ID NO: 494264 - DNA, 20 bp, mouse
gcacagcagcaacttctcag

SEQ ID NO: 494265 - DNA, 20 bp, mouse
ggtgttcggcgttcagcgtt

SEQ ID NO: 494266 - DNA, 20 bp, mouse
gttggctacaggccacccca

SEQ ID NO: 494267 - DNA, 20 bp, mouse
gctggcagggagaaccctct

SEQ ID NO: 494268 - DNA, 20 bp, mouse
gagcccctcagttgaccctg

SEQ ID NO: 494269 - DNA, 20 bp, mouse
gccaccccagggtcaactga

SEQ ID NO: 494270 - DNA, 20 bp, mouse
gactgaggggctttccaaga

SEQ ID NO: 494271 - DNA, 20 bp, mouse
gacacccacgctgtcaagga

SEQ ID NO: 494272 - DNA, 20 bp, mouse
ggccctgaacggggaaaagg

SEQ ID NO: 494273 - DNA, 20 bp, mouse
gctgtggacgatgcatttgg

SEQ ID NO: 494274 - DNA, 20 bp, mouse
gctttagactctggagtgat

SEQ ID NO: 494275 - DNA, 20 bp, mouse
gaacaggtggagataacctt

SEQ ID NO: 494276 - DNA, 20 bp, mouse
ggcccggtagtaggacagtg

SEQ ID NO: 494277 - DNA, 20 bp, mouse
gaggccctgggaggactcaa

SEQ ID NO: 494278 - DNA, 20 bp, mouse
ggcctcactgtcctactacc

SEQ ID NO: 494279 - DNA, 20 bp, mouse
gcactggaccttggttgtgg

SEQ ID NO: 494280 - DNA, 20 bp, mouse
gccctgggaggactcaaagg

SEQ ID NO: 494281 - DNA, 20 bp, mouse
ggataccatggaaaaatatc

SEQ ID NO: 494282 - DNA, 20 bp, mouse
ggagggctttgcccggtagt

SEQ ID NO: 494283 - DNA, 20 bp, mouse
gtcaaaggaggagaactcgg

SEQ ID NO: 494284 - DNA, 20 bp, mouse
ggactaccggcctggctcga

SEQ ID NO: 494285 - DNA, 20 bp, mouse
gaccaaggtccagtgtcctt

SEQ ID NO: 494286 - DNA, 20 bp, mouse
gaggcggaggatcgagtccc

SEQ ID NO: 494287 - DNA, 20 bp, mouse
gggaccgcgctgcgtccaga

SEQ ID NO: 494288 - DNA, 20 bp, mouse
gaggatcgagtcccgggccg

SEQ ID NO: 494289 - DNA, 20 bp, mouse
gagcgcagagccgagaagag

SEQ ID NO: 494290 - DNA, 20 bp, mouse
gcgctgcgtccagagggagc

SEQ ID NO: 494291 - DNA, 20 bp, mouse
gagcgaagcggggagccggt

SEQ ID NO: 494292 - DNA, 20 bp, mouse
gcggcgtcgacggggtcgga

SEQ ID NO: 494293 - DNA, 20 bp, mouse
ggtgacggcgacagatacaa

SEQ ID NO: 494294 - DNA, 20 bp, mouse
ggagaagagcggcgtcgacg

SEQ ID NO: 494295 - DNA, 20 bp, mouse
gtgtgaaagagcgcccgtga

SEQ ID NO: 494296 - DNA, 20 bp, mouse
gatgacagattggtcagacc

SEQ ID NO: 494297 - DNA, 20 bp, mouse
gcagattggtcagacccggc

SEQ ID NO: 494298 - DNA, 20 bp, mouse
gccggggtgggggggcaccg

SEQ ID NO: 494299 - DNA, 20 bp, mouse
ggtcatagaatatgacagat

SEQ ID NO: 494300 - DNA, 20 bp, mouse
gtcagggagaaggcgacgcc

SEQ ID NO: 494301 - DNA, 20 bp, mouse
gggtgctgcagatatgtaac

SEQ ID NO: 494302 - DNA, 20 bp, mouse
gacatatctgcagcaccgag

SEQ ID NO: 494303 - DNA, 20 bp, mouse
gcagatgtggctctccccag

SEQ ID NO: 494304 - DNA, 20 bp, mouse
gagacacagccagcagagag

SEQ ID NO: 494305 - DNA, 20 bp, mouse
gtagcttctcctgctctgag

SEQ ID NO: 494306 - DNA, 20 bp, mouse
gcactgtgggaggcccatgg

SEQ ID NO: 494307 - DNA, 20 bp, mouse
gaaggttccagtcgccaggt

SEQ ID NO: 494308 - DNA, 20 bp, mouse
ggttccagtcgccaggtagg

SEQ ID NO: 494309 - DNA, 20 bp, mouse
gcatagcaaaacctcctacc

SEQ ID NO: 494310 - DNA, 20 bp, mouse
gtactaggataagagatcag

SEQ ID NO: 494311 - DNA, 20 bp, mouse
gcgccactgtgggaggccca

SEQ ID NO: 494312 - DNA, 20 bp, mouse
gtgctatgtccaccatagga

SEQ ID NO: 494313 - DNA, 20 bp, mouse
ggttttgctatgtccaccat

SEQ ID NO: 494314 - DNA, 20 bp, mouse
gaaacctcctacctggcgac

SEQ ID NO: 494315 - DNA, 20 bp, mouse
gggtgtcatggtagctgtaa

SEQ ID NO: 494316 - DNA, 20 bp, mouse
gatgcactataccaagtccg

SEQ ID NO: 494317 - DNA, 20 bp, mouse
gtgagctactgccacggact

SEQ ID NO: 494318 - DNA, 20 bp, mouse
gtaaagttgtaagaactctc

SEQ ID NO: 494319 - DNA, 20 bp, mouse
gtgtttccagccagccatga

SEQ ID NO: 494320 - DNA, 20 bp, mouse
gtattggcctccttcatggc

SEQ ID NO: 494321 - DNA, 20 bp, mouse
ggggcatgggacttacgcca

SEQ ID NO: 494322 - DNA, 20 bp, mouse
gtgtgagccagtgcttggcc

SEQ ID NO: 494323 - DNA, 20 bp, mouse
gatatcatgatagatgacaa

SEQ ID NO: 494324 - DNA, 20 bp, mouse
gtgttttggtctcaaacact

SEQ ID NO: 494325 - DNA, 20 bp, mouse
gatgaatacatcaaaagttc

SEQ ID NO: 494326 - DNA, 20 bp, mouse
ggacttgaccaactcccgac

SEQ ID NO: 494327 - DNA, 20 bp, mouse
gctctaaagagccagcaacc

SEQ ID NO: 494328 - DNA, 20 bp, mouse
gagttggtcaagtccgcacc

SEQ ID NO: 494329 - DNA, 20 bp, mouse
gtctctcgccagtcgggagt

SEQ ID NO: 494330 - DNA, 20 bp, mouse
gccttcctccagttcctcag

SEQ ID NO: 494331 - DNA, 20 bp, mouse
gagggtatctatatcccgag

SEQ ID NO: 494332 - DNA, 20 bp, mouse
ggctctttagagggctgtaa

SEQ ID NO: 494333 - DNA, 20 bp, mouse
gctgttgtctctcgccagtc

SEQ ID NO: 494334 - DNA, 20 bp, mouse
gccgttggaaccagaagatc

SEQ ID NO: 494335 - DNA, 20 bp, mouse
gctgtaatggatgcagagcg

SEQ ID NO: 494336 - DNA, 20 bp, mouse
gcagctagcacccagtccca

SEQ ID NO: 494337 - DNA, 20 bp, mouse
ggtgaggcctccctgggact

SEQ ID NO: 494338 - DNA, 20 bp, mouse
gaactggagcgagtatggtg

SEQ ID NO: 494339 - DNA, 20 bp, mouse
ggccaaactgagtgatttcc

SEQ ID NO: 494340 - DNA, 20 bp, mouse
gtcctggaaatcactcagtt

SEQ ID NO: 494341 - DNA, 20 bp, mouse
gctagcacccagtcccaggg

SEQ ID NO: 494342 - DNA, 20 bp, mouse
gctctgaataattctgctct

SEQ ID NO: 494343 - DNA, 20 bp, mouse
gttctacaattttgtttgtt

SEQ ID NO: 494344 - DNA, 20 bp, mouse
gcagcattgaaccagcaaca

SEQ ID NO: 494345 - DNA, 20 bp, mouse
gtgcgcacctcagctacaca

SEQ ID NO: 494346 - DNA, 20 bp, mouse
gtccacaggacagggcaagt

SEQ ID NO: 494347 - DNA, 20 bp, mouse
gtcctgtggaaaggatttga

SEQ ID NO: 494348 - DNA, 20 bp, mouse
gcagtatgtgtcaatgacaa

SEQ ID NO: 494349 - DNA, 20 bp, mouse
gttattctctgatcggatca

SEQ ID NO: 494350 - DNA, 20 bp, mouse
gggaaaggatttgaaggtgc

SEQ ID NO: 494351 - DNA, 20 bp, mouse
ggccaacttgccctgtcctg

SEQ ID NO: 494352 - DNA, 20 bp, mouse
gaaatcctttccacaggaca

SEQ ID NO: 494353 - DNA, 20 bp, mouse
ggatttgaaggtgctggaaa

SEQ ID NO: 494354 - DNA, 20 bp, mouse
gaatatcaggaaaacactgt

SEQ ID NO: 494355 - DNA, 20 bp, mouse
gctagtatgtatatattcac

SEQ ID NO: 494356 - DNA, 20 bp, mouse
ggagtgctcaggtcccatat

SEQ ID NO: 494357 - DNA, 20 bp, mouse
gtcctcgcaaggtaagatcc

SEQ ID NO: 494358 - DNA, 20 bp, mouse
ggaagaagaagagggcaaca

SEQ ID NO: 494359 - DNA, 20 bp, mouse
gaggagaggacagagtgctc

SEQ ID NO: 494360 - DNA, 20 bp, mouse
ggattgtggtcgatactggt

SEQ ID NO: 494361 - DNA, 20 bp, mouse
gctcaggtcccatataggca

SEQ ID NO: 494362 - DNA, 20 bp, mouse
gagatcaatctcactgcaat

SEQ ID NO: 494363 - DNA, 20 bp, mouse
ggactgctgcaacacattag

SEQ ID NO: 494364 - DNA, 20 bp, mouse
gaaacttgccttgcctatat

SEQ ID NO: 494365 - DNA, 20 bp, mouse
gagatcctggcagatgattg

SEQ ID NO: 494366 - DNA, 20 bp, mouse
gtggcgcatcagtaaatcca

SEQ ID NO: 494367 - DNA, 20 bp, mouse
gcgagcagcagcccccatac

SEQ ID NO: 494368 - DNA, 20 bp, mouse
gtccatcgtgacccctgagc

SEQ ID NO: 494369 - DNA, 20 bp, mouse
gggggctgctgctcgtcacc

SEQ ID NO: 494370 - DNA, 20 bp, mouse
gtatacttcattctgcttac

SEQ ID NO: 494371 - DNA, 20 bp, mouse
gtagactttaataagtgtac

SEQ ID NO: 494372 - DNA, 20 bp, mouse
gtcagtgcctcagaagcctt

SEQ ID NO: 494373 - DNA, 20 bp, mouse
gaatgaagtatagagactcc

SEQ ID NO: 494374 - DNA, 20 bp, mouse
ggcttacaggatatttgtta

SEQ ID NO: 494375 - DNA, 20 bp, mouse
gataacgtaggagatacaag

SEQ ID NO: 494376 - DNA, 20 bp, mouse
ggatggctacagatctactt

SEQ ID NO: 494377 - DNA, 20 bp, mouse
gtcagtgggtgcctgctcac

SEQ ID NO: 494378 - DNA, 20 bp, mouse
gatctacttggggagtcccc

SEQ ID NO: 494379 - DNA, 20 bp, mouse
gaaggccaggctcctgtcag

SEQ ID NO: 494380 - DNA, 20 bp, mouse
gtgctcctgtgaaaggggaa

SEQ ID NO: 494381 - DNA, 20 bp, mouse
gcatagtgctcctgtgaaag

SEQ ID NO: 494382 - DNA, 20 bp, mouse
ggcaacctttcccctttcac

SEQ ID NO: 494383 - DNA, 20 bp, mouse
gtggcctcacactgaaatag

SEQ ID NO: 494384 - DNA, 20 bp, mouse
gtcctgtgggtcgctgatgg

SEQ ID NO: 494385 - DNA, 20 bp, mouse
gaaagagactgggaacccgg

SEQ ID NO: 494386 - DNA, 20 bp, mouse
gggtcagtggctcaaggata

SEQ ID NO: 494387 - DNA, 20 bp, mouse
ggggtaaaagaaagtgctaa

SEQ ID NO: 494388 - DNA, 20 bp, mouse
gatgaagagccggatagctt

SEQ ID NO: 494389 - DNA, 20 bp, mouse
gaatgaaaaccaaagctatc

SEQ ID NO: 494390 - DNA, 20 bp, mouse
gtggttacagttccgtgaaa

SEQ ID NO: 494391 - DNA, 20 bp, mouse
gcaaattcttgatatttcag

SEQ ID NO: 494392 - DNA, 20 bp, mouse
gaaggtacattggagcctag

SEQ ID NO: 494393 - DNA, 20 bp, mouse
gaccccaagctaaagcataa

SEQ ID NO: 494394 - DNA, 20 bp, mouse
gtcttaaattgattaccact

SEQ ID NO: 494395 - DNA, 20 bp, mouse
gttacagttccgtgaaaagg

SEQ ID NO: 494396 - DNA, 20 bp, mouse
ggagaactgcgtggtcaaga

SEQ ID NO: 494397 - DNA, 20 bp, mouse
gaaaggtaagaaagtctgag

SEQ ID NO: 494398 - DNA, 20 bp, mouse
gacctcaggaaggctaccgc

SEQ ID NO: 494399 - DNA, 20 bp, mouse
gagcaaggtcaccaaggcaa

SEQ ID NO: 494400 - DNA, 20 bp, mouse
gtgggatacaccgagtccgg

SEQ ID NO: 494401 - DNA, 20 bp, mouse
gcagcaagagctacatcaaa

SEQ ID NO: 494402 - DNA, 20 bp, mouse
ggcgggcgcaatcccggagg

SEQ ID NO: 494403 - DNA, 20 bp, mouse
gcagaagccgcagcacgaga

SEQ ID NO: 494404 - DNA, 20 bp, mouse
gggaaggctaccgccggact

SEQ ID NO: 494405 - DNA, 20 bp, mouse
gccctccacgggcagatccg

SEQ ID NO: 494406 - DNA, 20 bp, mouse
gaaaactaaacagatagttc

SEQ ID NO: 494407 - DNA, 20 bp, mouse
gactatctgtttagttttga

SEQ ID NO: 494408 - DNA, 20 bp, mouse
gctgtttagttttgatggac

SEQ ID NO: 494409 - DNA, 20 bp, mouse
gccctcgggctcacccggag

SEQ ID NO: 494410 - DNA, 20 bp, mouse
gtcacggcctcggcccgctc

SEQ ID NO: 494411 - DNA, 20 bp, mouse
gcagagagcgcagcgagctc

SEQ ID NO: 494412 - DNA, 20 bp, mouse
gcttcgccccgggcccctca

SEQ ID NO: 494413 - DNA, 20 bp, mouse
gcgcagcgagctcgggagtg

SEQ ID NO: 494414 - DNA, 20 bp, mouse
gtcctggcgtccgcagagta

SEQ ID NO: 494415 - DNA, 20 bp, mouse
gcaccggcgccctctctcca

SEQ ID NO: 494416 - DNA, 20 bp, mouse
gtaagagagctggtccaata

SEQ ID NO: 494417 - DNA, 20 bp, mouse
gatttagtcagtagataatg

SEQ ID NO: 494418 - DNA, 20 bp, mouse
gagaggagttaggactctga

SEQ ID NO: 494419 - DNA, 20 bp, mouse
gaggatgccccacaccaagg

SEQ ID NO: 494420 - DNA, 20 bp, mouse
gtgcacctggcaaagctcct

SEQ ID NO: 494421 - DNA, 20 bp, mouse
gaccacaactcagattcata

SEQ ID NO: 494422 - DNA, 20 bp, mouse
gaagttactacagcatcgga

SEQ ID NO: 494423 - DNA, 20 bp, mouse
gagctttgccaggtgcatca

SEQ ID NO: 494424 - DNA, 20 bp, mouse
gcacagggagtcctcatcat

SEQ ID NO: 494425 - DNA, 20 bp, mouse
gtctatgtagacatcacaaa

SEQ ID NO: 494426 - DNA, 20 bp, mouse
gacagcaggagaacccctgg

SEQ ID NO: 494427 - DNA, 20 bp, mouse
gaaaggaagaaagctaatgg

SEQ ID NO: 494428 - DNA, 20 bp, mouse
gcacaggtaggaggggaaaa

SEQ ID NO: 494429 - DNA, 20 bp, mouse
gctggaggtagaaagaacac

SEQ ID NO: 494430 - DNA, 20 bp, mouse
gaactgatcacaggtaggag

SEQ ID NO: 494431 - DNA, 20 bp, mouse
gtaatgggggaactgatcac

SEQ ID NO: 494432 - DNA, 20 bp, mouse
ggggggaactgatcacaggt

SEQ ID NO: 494433 - DNA, 20 bp, mouse
gtagacagcaggagaacccc

SEQ ID NO: 494434 - DNA, 20 bp, mouse
gagggagggcggaggcagta

SEQ ID NO: 494435 - DNA, 20 bp, mouse
gggtatagaggacatgaaca

SEQ ID NO: 494436 - DNA, 20 bp, mouse
gaccagttctaaccggccag

SEQ ID NO: 494437 - DNA, 20 bp, mouse
ggccactggccggttagaac

SEQ ID NO: 494438 - DNA, 20 bp, mouse
gggtgagagctgccactggc

SEQ ID NO: 494439 - DNA, 20 bp, mouse
gtgaaaactggggagtacag

SEQ ID NO: 494440 - DNA, 20 bp, mouse
ggttagaactggtgagcagg

SEQ ID NO: 494441 - DNA, 20 bp, mouse
gaaagggagggagggattaa

SEQ ID NO: 494442 - DNA, 20 bp, mouse
gtacagaggtataagctgaa

SEQ ID NO: 494443 - DNA, 20 bp, mouse
gggtcagagtatgcaaaggg

SEQ ID NO: 494444 - DNA, 20 bp, mouse
gttcaggtcagagtatgcaa

SEQ ID NO: 494445 - DNA, 20 bp, mouse
gccggttagaactggtgagc

SEQ ID NO: 494446 - DNA, 20 bp, mouse
ggtgaggtgtgctgccggta

SEQ ID NO: 494447 - DNA, 20 bp, mouse
gttgacacgaatgcatctgt

SEQ ID NO: 494448 - DNA, 20 bp, mouse
gaagctccttaggcaagccc

SEQ ID NO: 494449 - DNA, 20 bp, mouse
gcccagagtgtaagctcctt

SEQ ID NO: 494450 - DNA, 20 bp, mouse
gcagttaagaattgtgttgg

SEQ ID NO: 494451 - DNA, 20 bp, mouse
gcatctgtaggcctgacctt

SEQ ID NO: 494452 - DNA, 20 bp, mouse
gatccagaaaaaccatccaa

SEQ ID NO: 494453 - DNA, 20 bp, mouse
gtgtaggcctgacctttgga

SEQ ID NO: 494454 - DNA, 20 bp, mouse
gagagaaatataaaaatcac

SEQ ID NO: 494455 - DNA, 20 bp, mouse
gctctgggtggatccgtgtg

SEQ ID NO: 494456 - DNA, 20 bp, mouse
ggaccggcggactccggaga

SEQ ID NO: 494457 - DNA, 20 bp, mouse
gacacgctcagttaccctgc

SEQ ID NO: 494458 - DNA, 20 bp, mouse
gtgccacccgggaacacggg

SEQ ID NO: 494459 - DNA, 20 bp, mouse
gtggcagccacccgtgttcc

SEQ ID NO: 494460 - DNA, 20 bp, mouse
gactcccgtccaagtcggag

SEQ ID NO: 494461 - DNA, 20 bp, mouse
gtcatcaattagacctgaga

SEQ ID NO: 494462 - DNA, 20 bp, mouse
gtccacaggctgattcacaa

SEQ ID NO: 494463 - DNA, 20 bp, mouse
gaggagaagcccctccgact

SEQ ID NO: 494464 - DNA, 20 bp, mouse
gctgggtcagaagattccac

SEQ ID NO: 494465 - DNA, 20 bp, mouse
gtcctgccacccgggaacac

SEQ ID NO: 494466 - DNA, 20 bp, mouse
gcgccgccgcccggctcgcg

SEQ ID NO: 494467 - DNA, 20 bp, mouse
gtcggcgcggccgcgcgagc

SEQ ID NO: 494468 - DNA, 20 bp, mouse
ggcattgaaattcatcaaca

SEQ ID NO: 494469 - DNA, 20 bp, mouse
gaattcatcaacatggtttg

SEQ ID NO: 494470 - DNA, 20 bp, mouse
gtcaacatggtttgcggcgt

SEQ ID NO: 494471 - DNA, 20 bp, mouse
gctgctctgcaggccctcag

SEQ ID NO: 494472 - DNA, 20 bp, mouse
gccaatgcatcagggaagtt

SEQ ID NO: 494473 - DNA, 20 bp, mouse
ggaacatggccaatgcatca

SEQ ID NO: 494474 - DNA, 20 bp, mouse
gacaggccacggctgccatg

SEQ ID NO: 494475 - DNA, 20 bp, mouse
ggcagggggggaacaggcca

SEQ ID NO: 494476 - DNA, 20 bp, mouse
gtacagcaggtgtaagagtg

SEQ ID NO: 494477 - DNA, 20 bp, mouse
gcgtcacaggagtcagaacg

SEQ ID NO: 494478 - DNA, 20 bp, mouse
gcagttccttccttactcac

SEQ ID NO: 494479 - DNA, 20 bp, mouse
gcaggtgtaagagtgaggca

SEQ ID NO: 494480 - DNA, 20 bp, mouse
gtgtctgtcttcagctgagg

SEQ ID NO: 494481 - DNA, 20 bp, mouse
ggcccgcttggccttgactg

SEQ ID NO: 494482 - DNA, 20 bp, mouse
gggtgattgacaggcggagg

SEQ ID NO: 494483 - DNA, 20 bp, mouse
gctgaggcggaatttacagc

SEQ ID NO: 494484 - DNA, 20 bp, mouse
gggattcctgtgagtaagga

SEQ ID NO: 494485 - DNA, 20 bp, mouse
ggtcagagccggcatcatcg

SEQ ID NO: 494486 - DNA, 20 bp, mouse
gctttggttggagttgactg

SEQ ID NO: 494487 - DNA, 20 bp, mouse
ggaaatctttcatctttggt

SEQ ID NO: 494488 - DNA, 20 bp, mouse
gatatgccaagtcctcgtag

SEQ ID NO: 494489 - DNA, 20 bp, mouse
ggacagccactacgaggact

SEQ ID NO: 494490 - DNA, 20 bp, mouse
gcagtcgtaagatattttga

SEQ ID NO: 494491 - DNA, 20 bp, mouse
gtcaaaagacagccactacg

SEQ ID NO: 494492 - DNA, 20 bp, mouse
gcaaaaaccacccagagaaa

SEQ ID NO: 494493 - DNA, 20 bp, mouse
gacagaccactgaatagtca

SEQ ID NO: 494494 - DNA, 20 bp, mouse
gtttctccatgactattcag

SEQ ID NO: 494495 - DNA, 20 bp, mouse
gttaaaacaattgtcattgt

SEQ ID NO: 494496 - DNA, 20 bp, mouse
gatgacattaagcacaccag

SEQ ID NO: 494497 - DNA, 20 bp, mouse
gggtgtgcttaatgtcattg

SEQ ID NO: 494498 - DNA, 20 bp, mouse
ggtcatcaaaggtgtcgtca

SEQ ID NO: 494499 - DNA, 20 bp, mouse
gatgacaactgtgacaatta

SEQ ID NO: 494500 - DNA, 20 bp, mouse
gtgtcgcttgagtccgtctg

SEQ ID NO: 494501 - DNA, 20 bp, mouse
gcttgagtccgtctgtggct

SEQ ID NO: 494502 - DNA, 20 bp, mouse
gtcacagttgtcatgtgtaa

SEQ ID NO: 494503 - DNA, 20 bp, mouse
gttgtgctgtggtgtgtgcc

SEQ ID NO: 494504 - DNA, 20 bp, mouse
gccagttccagatgacagga

SEQ ID NO: 494505 - DNA, 20 bp, mouse
gatgacaggatggcatcctc

SEQ ID NO: 494506 - DNA, 20 bp, mouse
gtggaggaccttagattcta

SEQ ID NO: 494507 - DNA, 20 bp, mouse
gcctacagaggaggacctcg

SEQ ID NO: 494508 - DNA, 20 bp, mouse
gcaaggagatacatgctaag

SEQ ID NO: 494509 - DNA, 20 bp, mouse
gtctcctgcagccgagaggc

SEQ ID NO: 494510 - DNA, 20 bp, mouse
gatctaaggtcctccagaaa

SEQ ID NO: 494511 - DNA, 20 bp, mouse
ggagcctgcctctcggctgc

SEQ ID NO: 494512 - DNA, 20 bp, mouse
gagaatagggtttccctttc

SEQ ID NO: 494513 - DNA, 20 bp, mouse
gttccatgtctgcaaaggtt

SEQ ID NO: 494514 - DNA, 20 bp, mouse
gaaagtcatctgctaccccg

SEQ ID NO: 494515 - DNA, 20 bp, mouse
ggtatgtggaggagcctgca

SEQ ID NO: 494516 - DNA, 20 bp, mouse
gactatctacacgggcaaga

SEQ ID NO: 494517 - DNA, 20 bp, mouse
gggcagcatcaagctagagt

SEQ ID NO: 494518 - DNA, 20 bp, mouse
gacacgggcaagacggcagg

SEQ ID NO: 494519 - DNA, 20 bp, mouse
gagcaggaggggccaccgag

SEQ ID NO: 494520 - DNA, 20 bp, mouse
gtctacacgggcaagacggc

SEQ ID NO: 494521 - DNA, 20 bp, mouse
gtagtaatgcgaacccaagg

SEQ ID NO: 494522 - DNA, 20 bp, mouse
gttcgcattactatctacac

SEQ ID NO: 494523 - DNA, 20 bp, mouse
ggggcaagacggcaggaggc

SEQ ID NO: 494524 - DNA, 20 bp, mouse
gaccgagggggtctcaacag

SEQ ID NO: 494525 - DNA, 20 bp, mouse
gcatcctagggacagtatga

SEQ ID NO: 494526 - DNA, 20 bp, mouse
gggatgtagtaggtcagaag

SEQ ID NO: 494527 - DNA, 20 bp, mouse
gtgtagtaggtcagaagagg

SEQ ID NO: 494528 - DNA, 20 bp, mouse
gaggtagagaggaagtgtgc

SEQ ID NO: 494529 - DNA, 20 bp, mouse
ggtttggttgaggatgtagt

SEQ ID NO: 494530 - DNA, 20 bp, mouse
ggtcagaagaggaggtagag

SEQ ID NO: 494531 - DNA, 20 bp, mouse
gtgtggagtctcctgagcct

SEQ ID NO: 494532 - DNA, 20 bp, mouse
gctggatttacaacccccac

SEQ ID NO: 494533 - DNA, 20 bp, mouse
gcaacagggcttacaacagc

SEQ ID NO: 494534 - DNA, 20 bp, mouse
gacaggcttgcaacagcagc

SEQ ID NO: 494535 - DNA, 20 bp, mouse
ggtgggggctgtggctgttc

SEQ ID NO: 494536 - DNA, 20 bp, mouse
ggctggacacccagagacaa

SEQ ID NO: 494537 - DNA, 20 bp, mouse
gcagcccaggcccacacctc

SEQ ID NO: 494538 - DNA, 20 bp, mouse
ggtccagcattcctccactc

SEQ ID NO: 494539 - DNA, 20 bp, mouse
gctcacttctgccagagtgg

SEQ ID NO: 494540 - DNA, 20 bp, mouse
gacctgtgtgtctctaaagg

SEQ ID NO: 494541 - DNA, 20 bp, mouse
gcggcagcctcccttgtctc

SEQ ID NO: 494542 - DNA, 20 bp, mouse
gctgccgcgcaccacagccc

SEQ ID NO: 494543 - DNA, 20 bp, mouse
gtcctcctttagagacacac

SEQ ID NO: 494544 - DNA, 20 bp, mouse
ggcctcttggacagcgtcag

SEQ ID NO: 494545 - DNA, 20 bp, mouse
ggccaagtgttctgctctaa

SEQ ID NO: 494546 - DNA, 20 bp, mouse
gggtcacaacctcagcagag

SEQ ID NO: 494547 - DNA, 20 bp, mouse
gcagagtggcagaggaatct

SEQ ID NO: 494548 - DNA, 20 bp, mouse
gcacaagccacagacaaacc

SEQ ID NO: 494549 - DNA, 20 bp, mouse
gcttccactgaccctattag

SEQ ID NO: 494550 - DNA, 20 bp, mouse
ggaggttgtgaccaagggcc

SEQ ID NO: 494551 - DNA, 20 bp, mouse
ggtctcctccataagtacat

SEQ ID NO: 494552 - DNA, 20 bp, mouse
gcagcctctaatagggtcag

SEQ ID NO: 494553 - DNA, 20 bp, mouse
ggaggagacttggctgactc

SEQ ID NO: 494554 - DNA, 20 bp, mouse
gctagcatcaaaagagtcca

SEQ ID NO: 494555 - DNA, 20 bp, mouse
gaaaagagtccaaggaacca

SEQ ID NO: 494556 - DNA, 20 bp, mouse
gctccgtgaagtctaaggac

SEQ ID NO: 494557 - DNA, 20 bp, mouse
ggacatctcacatcatctag

SEQ ID NO: 494558 - DNA, 20 bp, mouse
gatgttcaggcacctggcgg

SEQ ID NO: 494559 - DNA, 20 bp, mouse
gaacacatagcaagcccggg

SEQ ID NO: 494560 - DNA, 20 bp, mouse
gggaaacacatagcaagccc

SEQ ID NO: 494561 - DNA, 20 bp, mouse
ggcctactccgtgaagtcta

SEQ ID NO: 494562 - DNA, 20 bp, mouse
gttcaggcacctggcggtgg

SEQ ID NO: 494563 - DNA, 20 bp, mouse
gcacctggcggtggaggcga

SEQ ID NO: 494564 - DNA, 20 bp, mouse
gatgaggatggtgaagaaca

SEQ ID NO: 494565 - DNA, 20 bp, mouse
gatggtgggtgatacgactg

SEQ ID NO: 494566 - DNA, 20 bp, mouse
gtgtcatccacaagaaagag

SEQ ID NO: 494567 - DNA, 20 bp, mouse
gaagggctcgaaaagcaggt

SEQ ID NO: 494568 - DNA, 20 bp, mouse
gcatattcaagcagagaggg

SEQ ID NO: 494569 - DNA, 20 bp, mouse
gagcagagaggggggcatct

SEQ ID NO: 494570 - DNA, 20 bp, mouse
gcaacagaggcccaagtcag

SEQ ID NO: 494571 - DNA, 20 bp, mouse
ggactgagagagcaatggtg

SEQ ID NO: 494572 - DNA, 20 bp, mouse
gtcttacctgtccgagaaaa

SEQ ID NO: 494573 - DNA, 20 bp, mouse
gggcaaagaagctctctctg

SEQ ID NO: 494574 - DNA, 20 bp, mouse
gctcaccgtggggacaacag

SEQ ID NO: 494575 - DNA, 20 bp, mouse
gacgtagtcttgaggctgaa

SEQ ID NO: 494576 - DNA, 20 bp, mouse
gtataaggcttcatactccc

SEQ ID NO: 494577 - DNA, 20 bp, mouse
gagctaaggaaaaatctgat

SEQ ID NO: 494578 - DNA, 20 bp, mouse
gatgttcatgttgatcatgt

SEQ ID NO: 494579 - DNA, 20 bp, mouse
gtgttaaagaactctaaggt

SEQ ID NO: 494580 - DNA, 20 bp, mouse
gtcagaggtagcatttcaat

SEQ ID NO: 494581 - DNA, 20 bp, mouse
gcattttatatgaagatata

SEQ ID NO: 494582 - DNA, 20 bp, mouse
gctttaacattcttagtgat

SEQ ID NO: 494583 - DNA, 20 bp, mouse
gaaatgctacctctgaagtt

SEQ ID NO: 494584 - DNA, 20 bp, mouse
gttcatatgaaatatagcta

SEQ ID NO: 494585 - DNA, 20 bp, mouse
gtttgagtggtgaaatgcag

SEQ ID NO: 494586 - DNA, 20 bp, mouse
gcctggacgaacctccgtca

SEQ ID NO: 494587 - DNA, 20 bp, mouse
ggagcgagtgtgaggaaagg

SEQ ID NO: 494588 - DNA, 20 bp, mouse
gtggagaaggagcgagtgtg

SEQ ID NO: 494589 - DNA, 20 bp, mouse
ggacgaccgagagataagcc

SEQ ID NO: 494590 - DNA, 20 bp, mouse
ggggaaagtgtgagaacggg

SEQ ID NO: 494591 - DNA, 20 bp, mouse
gtctgggcctgggcctctaa

SEQ ID NO: 494592 - DNA, 20 bp, mouse
gagaggagggagtgtgcaca

SEQ ID NO: 494593 - DNA, 20 bp, mouse
ggtgtgtcctgccttgacgg

SEQ ID NO: 494594 - DNA, 20 bp, mouse
gtcaccaaggggtaaataga

SEQ ID NO: 494595 - DNA, 20 bp, mouse
gctggtgaaacaaatcctgt

SEQ ID NO: 494596 - DNA, 20 bp, mouse
gtaaagaaggggaattgggt

SEQ ID NO: 494597 - DNA, 20 bp, mouse
gatattaaagaaggggaatt

SEQ ID NO: 494598 - DNA, 20 bp, mouse
gtttaacttagaaatctctg

SEQ ID NO: 494599 - DNA, 20 bp, mouse
gatgtatatattcacaatac

SEQ ID NO: 494600 - DNA, 20 bp, mouse
gcttctttaatatgattaca

SEQ ID NO: 494601 - DNA, 20 bp, mouse
gacaataataaagagttttg

SEQ ID NO: 494602 - DNA, 20 bp, mouse
gtatgtgttaccatctgcca

SEQ ID NO: 494603 - DNA, 20 bp, mouse
ggagatttctaagttaaagt

SEQ ID NO: 494604 - DNA, 20 bp, mouse
gaatgttcttaaatatcttc

SEQ ID NO: 494605 - DNA, 20 bp, mouse
gtcagaggaagacaagcagt

SEQ ID NO: 494606 - DNA, 20 bp, mouse
gatatcccagaacaagcaat

SEQ ID NO: 494607 - DNA, 20 bp, mouse
gccatcctattgcttgttct

SEQ ID NO: 494608 - DNA, 20 bp, mouse
gaataggatggaagaactat

SEQ ID NO: 494609 - DNA, 20 bp, mouse
gaggcccagtacctgtaggg

SEQ ID NO: 494610 - DNA, 20 bp, mouse
gagcaggcccagtacctgta

SEQ ID NO: 494611 - DNA, 20 bp, mouse
ggaactataggctttgagat

SEQ ID NO: 494612 - DNA, 20 bp, mouse
gactgggcctgctgttcatg

SEQ ID NO: 494613 - DNA, 20 bp, mouse
gagctttgtcacccccctac

SEQ ID NO: 494614 - DNA, 20 bp, mouse
ggtcacccccctacaggtac

SEQ ID NO: 494615 - DNA, 20 bp, mouse
gcactcacctcatgaacagc

SEQ ID NO: 494616 - DNA, 20 bp, mouse
gaccgaggggaccagaactg

SEQ ID NO: 494617 - DNA, 20 bp, mouse
gagctgggctaatgaagccg

SEQ ID NO: 494618 - DNA, 20 bp, mouse
gggcggagagtgagcagcta

SEQ ID NO: 494619 - DNA, 20 bp, mouse
ggcgcccggggcgttcgagg

SEQ ID NO: 494620 - DNA, 20 bp, mouse
gctctgacagcccgcgggtg

SEQ ID NO: 494621 - DNA, 20 bp, mouse
ggggtcggggcagcactctc

SEQ ID NO: 494622 - DNA, 20 bp, mouse
gaggcgtgcgcggtgggaac

SEQ ID NO: 494623 - DNA, 20 bp, mouse
ggtacaaccaccaccaggta

SEQ ID NO: 494624 - DNA, 20 bp, mouse
ggcacctgcagccgcacccg

SEQ ID NO: 494625 - DNA, 20 bp, mouse
gccgccaagccggagcgccc

SEQ ID NO: 494626 - DNA, 20 bp, mouse
gcgttcctgacctcaggtcc

SEQ ID NO: 494627 - DNA, 20 bp, mouse
gaggtcaggaacgggtcaca

SEQ ID NO: 494628 - DNA, 20 bp, mouse
gaacctgccactctctttga

SEQ ID NO: 494629 - DNA, 20 bp, mouse
gggttagccaggccagagcc

SEQ ID NO: 494630 - DNA, 20 bp, mouse
gagagagtggcaggttagcc

SEQ ID NO: 494631 - DNA, 20 bp, mouse
ggggtcacagggactaatgg

SEQ ID NO: 494632 - DNA, 20 bp, mouse
gtggctcacaagtctaccca

SEQ ID NO: 494633 - DNA, 20 bp, mouse
ggagtgtccacagggtccca

SEQ ID NO: 494634 - DNA, 20 bp, mouse
gagcaggggccagacaagaa

SEQ ID NO: 494635 - DNA, 20 bp, mouse
ggccctgtcagggatttgta

SEQ ID NO: 494636 - DNA, 20 bp, mouse
ggcatggcccccgacggaga

SEQ ID NO: 494637 - DNA, 20 bp, mouse
gctgctgagtctaggtgtcc

SEQ ID NO: 494638 - DNA, 20 bp, mouse
gtagagactctgctgagtct

SEQ ID NO: 494639 - DNA, 20 bp, mouse
gggatctcgaccctctccgt

SEQ ID NO: 494640 - DNA, 20 bp, mouse
gttggctgttacagaatgag

SEQ ID NO: 494641 - DNA, 20 bp, mouse
gtctcgaccctctccgtcgg

SEQ ID NO: 494642 - DNA, 20 bp, mouse
gaccagctaggacaactcag

SEQ ID NO: 494643 - DNA, 20 bp, mouse
gtgcttctcccaggtacagg

SEQ ID NO: 494644 - DNA, 20 bp, mouse
gggggcgctggagagaggcg

SEQ ID NO: 494645 - DNA, 20 bp, mouse
gtgggagccttgcaagtcat

SEQ ID NO: 494646 - DNA, 20 bp, mouse
ggctgtgtgaaagtgatata

SEQ ID NO: 494647 - DNA, 20 bp, mouse
gtggcttacctggagacctg

SEQ ID NO: 494648 - DNA, 20 bp, mouse
gactagtaatcttagtactg

SEQ ID NO: 494649 - DNA, 20 bp, mouse
gtcactcaatgtcttacctt

SEQ ID NO: 494650 - DNA, 20 bp, mouse
gtgatataaggcaaagccta

SEQ ID NO: 494651 - DNA, 20 bp, mouse
gaggataccctgaaaattat

SEQ ID NO: 494652 - DNA, 20 bp, mouse
gtaagcatgatgatgacaat

SEQ ID NO: 494653 - DNA, 20 bp, mouse
gatgcaacaatcaacaatca

SEQ ID NO: 494654 - DNA, 20 bp, mouse
gtgggttcctataattttca

SEQ ID NO: 494655 - DNA, 20 bp, mouse
gtgtcatcatcatgcttagt

SEQ ID NO: 494656 - DNA, 20 bp, mouse
gggcggactcgcgcgattgg

SEQ ID NO: 494657 - DNA, 20 bp, mouse
gactggcattgtagtctgta

SEQ ID NO: 494658 - DNA, 20 bp, mouse
gaacggcggactcgcgcgat

SEQ ID NO: 494659 - DNA, 20 bp, mouse
gcgtttaccaaattcaccat

SEQ ID NO: 494660 - DNA, 20 bp, mouse
ggatactcagtatgcgctcg

SEQ ID NO: 494661 - DNA, 20 bp, mouse
gtgttggggaaggtttcttc

SEQ ID NO: 494662 - DNA, 20 bp, mouse
gaaggtttcttctggctgtt

SEQ ID NO: 494663 - DNA, 20 bp, mouse
gtccccaacaccgaaaccaa

SEQ ID NO: 494664 - DNA, 20 bp, mouse
gaactgcaggccctcttcca

SEQ ID NO: 494665 - DNA, 20 bp, mouse
gaaaggaggcaagaatatta

SEQ ID NO: 494666 - DNA, 20 bp, mouse
gggccctctggaacagtgct

SEQ ID NO: 494667 - DNA, 20 bp, mouse
gtctgccagcaaaggccctc

SEQ ID NO: 494668 - DNA, 20 bp, mouse
ggtacacagtagagattgtg

SEQ ID NO: 494669 - DNA, 20 bp, mouse
gtgttccagagggcctttgc

SEQ ID NO: 494670 - DNA, 20 bp, mouse
gttcccagcactgttccaga

SEQ ID NO: 494671 - DNA, 20 bp, mouse
gataatcaagtcgtctataa

SEQ ID NO: 494672 - DNA, 20 bp, mouse
gctccagaatctgacattga

SEQ ID NO: 494673 - DNA, 20 bp, mouse
gcgtctataagggatcattt

SEQ ID NO: 494674 - DNA, 20 bp, mouse
gaaaggcacctcctccagac

SEQ ID NO: 494675 - DNA, 20 bp, mouse
gagtagagattgtggggtca

SEQ ID NO: 494676 - DNA, 20 bp, mouse
gatacagtcaataggataca

SEQ ID NO: 494677 - DNA, 20 bp, mouse
ggatgacacactccattcat

SEQ ID NO: 494678 - DNA, 20 bp, mouse
gcattcatgggagaaaatgt

SEQ ID NO: 494679 - DNA, 20 bp, mouse
gacctcaaggccaagtacaa

SEQ ID NO: 494680 - DNA, 20 bp, mouse
gaaatgtgggtcaacagaga

SEQ ID NO: 494681 - DNA, 20 bp, mouse
gtcaaggccaagtacaaagg

SEQ ID NO: 494682 - DNA, 20 bp, mouse
gtcagactccaagcacctca

SEQ ID NO: 494683 - DNA, 20 bp, mouse
gagggcacaatacagtcaat

SEQ ID NO: 494684 - DNA, 20 bp, mouse
gtaaggcagctattgtgacc

SEQ ID NO: 494685 - DNA, 20 bp, mouse
gttagtgatgttgcaatttt

SEQ ID NO: 494686 - DNA, 20 bp, mouse
gcccaaaagtcaccaatcta

SEQ ID NO: 494687 - DNA, 20 bp, mouse
gtggtccagagaaggatctt

SEQ ID NO: 494688 - DNA, 20 bp, mouse
ggacgggactaaggagtgtg

SEQ ID NO: 494689 - DNA, 20 bp, mouse
gagtaaacagctccagaatg

SEQ ID NO: 494690 - DNA, 20 bp, mouse
ggagtgtgtggagagagctc

SEQ ID NO: 494691 - DNA, 20 bp, mouse
gctagatcttccggtatgag

SEQ ID NO: 494692 - DNA, 20 bp, mouse
ggatactagcaatgactgac

SEQ ID NO: 494693 - DNA, 20 bp, mouse
gagtctggagtgtcagggta

SEQ ID NO: 494694 - DNA, 20 bp, mouse
gggtatggggtggttcactg

SEQ ID NO: 494695 - DNA, 20 bp, mouse
gaagtaacattctagagtgg

SEQ ID NO: 494696 - DNA, 20 bp, mouse
ggtagggacctcggacacac

SEQ ID NO: 494697 - DNA, 20 bp, mouse
gagtttggaggccagagggt

SEQ ID NO: 494698 - DNA, 20 bp, mouse
gcacaaggtagtcttgtcct

SEQ ID NO: 494699 - DNA, 20 bp, mouse
gcatgcctctgacaatacaa

SEQ ID NO: 494700 - DNA, 20 bp, mouse
ggctcagtttggaggccaga

SEQ ID NO: 494701 - DNA, 20 bp, mouse
ggtccgaggtccctaccctc

SEQ ID NO: 494702 - DNA, 20 bp, mouse
gcctctgacaatacaacggt

SEQ ID NO: 494703 - DNA, 20 bp, mouse
gcggtgggcccgtgtgtccg

SEQ ID NO: 494704 - DNA, 20 bp, mouse
gaatgaaagtagcccccagg

SEQ ID NO: 494705 - DNA, 20 bp, mouse
gcaaaatgaaagtagccccc

SEQ ID NO: 494706 - DNA, 20 bp, mouse
gtgtgtagcttaaatactgt

SEQ ID NO: 494707 - DNA, 20 bp, mouse
ggggataagctcgagatact

SEQ ID NO: 494708 - DNA, 20 bp, mouse
gcggaattttatctccacca

SEQ ID NO: 494709 - DNA, 20 bp, mouse
gacaaagaccagtatgctct

SEQ ID NO: 494710 - DNA, 20 bp, mouse
gggcgttttttcccgagttt

SEQ ID NO: 494711 - DNA, 20 bp, mouse
ggatacttggtgccgaaact

SEQ ID NO: 494712 - DNA, 20 bp, mouse
gatattgaggtagacaaaga

SEQ ID NO: 494713 - DNA, 20 bp, mouse
gttacttctatatcatattg

SEQ ID NO: 494714 - DNA, 20 bp, mouse
gtaacaacgcgcagcaccag

SEQ ID NO: 494715 - DNA, 20 bp, mouse
gcgaagcaggttcagaaccg

SEQ ID NO: 494716 - DNA, 20 bp, mouse
gtgagatgggacctaagaga

SEQ ID NO: 494717 - DNA, 20 bp, mouse
ggctaaagcctcttccggaa

SEQ ID NO: 494718 - DNA, 20 bp, mouse
gaggaagcccattccggaag

SEQ ID NO: 494719 - DNA, 20 bp, mouse
gtaggtcccatctcagcaat

SEQ ID NO: 494720 - DNA, 20 bp, mouse
ggatgtgctacccacttcac

SEQ ID NO: 494721 - DNA, 20 bp, mouse
gagagcctttccagtgaagt

SEQ ID NO: 494722 - DNA, 20 bp, mouse
gtataagctaaagcctcttc

SEQ ID NO: 494723 - DNA, 20 bp, mouse
gagctcttgggctactatga

SEQ ID NO: 494724 - DNA, 20 bp, mouse
ggaacatataagcatcactg

SEQ ID NO: 494725 - DNA, 20 bp, mouse
gttactaccttcatatcatt

SEQ ID NO: 494726 - DNA, 20 bp, mouse
gaggctggccaaggaagtag

SEQ ID NO: 494727 - DNA, 20 bp, mouse
gctcgctggtattctgacag

SEQ ID NO: 494728 - DNA, 20 bp, mouse
gcagcgagcctggaacttct

SEQ ID NO: 494729 - DNA, 20 bp, mouse
gttcatgatggccctgtctg

SEQ ID NO: 494730 - DNA, 20 bp, mouse
ggaaccaagttccctgaact

SEQ ID NO: 494731 - DNA, 20 bp, mouse
ggtctgaggtaagagtggca

SEQ ID NO: 494732 - DNA, 20 bp, mouse
ggatctctgagctttcatga

SEQ ID NO: 494733 - DNA, 20 bp, mouse
gcaggaaagcctgataaaca

SEQ ID NO: 494734 - DNA, 20 bp, mouse
gtcctttccccagaagttcc

SEQ ID NO: 494735 - DNA, 20 bp, mouse
ggtcagaataccagcgagcc

SEQ ID NO: 494736 - DNA, 20 bp, mouse
gtgtccacatccctcctcaa

SEQ ID NO: 494737 - DNA, 20 bp, mouse
gggctgtcaggataacctac

SEQ ID NO: 494738 - DNA, 20 bp, mouse
gaaataaatagatctgggga

SEQ ID NO: 494739 - DNA, 20 bp, mouse
ggaggtgagttttaacctgt

SEQ ID NO: 494740 - DNA, 20 bp, mouse
gaataaaatcaagggctgtc

SEQ ID NO: 494741 - DNA, 20 bp, mouse
ggtgggcaacagaacaacat

SEQ ID NO: 494742 - DNA, 20 bp, mouse
gacggtggcaggcatgtcca

SEQ ID NO: 494743 - DNA, 20 bp, mouse
gagtaagattttaaaatcaa

SEQ ID NO: 494744 - DNA, 20 bp, mouse
ggcatgtccaaggaatactg

SEQ ID NO: 494745 - DNA, 20 bp, mouse
gaggcctttgaggagggatg

SEQ ID NO: 494746 - DNA, 20 bp, mouse
gcttagggaaccagtctatc

SEQ ID NO: 494747 - DNA, 20 bp, mouse
gagacaattcagagtctgtc

SEQ ID NO: 494748 - DNA, 20 bp, mouse
gggcacaggcagtttttgaa

SEQ ID NO: 494749 - DNA, 20 bp, mouse
gacatgagctgccgtgatga

SEQ ID NO: 494750 - DNA, 20 bp, mouse
gaaagtacttccagatagac

SEQ ID NO: 494751 - DNA, 20 bp, mouse
gagcagagatgcaatgtcac

SEQ ID NO: 494752 - DNA, 20 bp, mouse
ggatttatgtctatggaaga

SEQ ID NO: 494753 - DNA, 20 bp, mouse
ggcagcgtcaaagagagatg

SEQ ID NO: 494754 - DNA, 20 bp, mouse
gaccaggcagaagaactccg

SEQ ID NO: 494755 - DNA, 20 bp, mouse
gtcaaagagagatgaggcac

SEQ ID NO: 494756 - DNA, 20 bp, mouse
gccggagggcccagaggatc

SEQ ID NO: 494757 - DNA, 20 bp, mouse
gttgactccagtgcagccgg

SEQ ID NO: 494758 - DNA, 20 bp, mouse
gaggactctgcagcagtcat

SEQ ID NO: 494759 - DNA, 20 bp, mouse
ggtcattggggctgcagtcg

SEQ ID NO: 494760 - DNA, 20 bp, mouse
ggtggtcgaggccgtgaccg

SEQ ID NO: 494761 - DNA, 20 bp, mouse
gggggctgcagtcgtggtcg

SEQ ID NO: 494762 - DNA, 20 bp, mouse
gtcctccgcagaagttgaca

SEQ ID NO: 494763 - DNA, 20 bp, mouse
ggaggccgtgtcaacttctg

SEQ ID NO: 494764 - DNA, 20 bp, mouse
ggaaggaagaagacaccaaa

SEQ ID NO: 494765 - DNA, 20 bp, mouse
gactggagtcaactgccatt

SEQ ID NO: 494766 - DNA, 20 bp, mouse
gacccggggcgcagatactg

SEQ ID NO: 494767 - DNA, 20 bp, mouse
gaaggaagggaccagcgtag

SEQ ID NO: 494768 - DNA, 20 bp, mouse
gaagggaccagcgtaggggg

SEQ ID NO: 494769 - DNA, 20 bp, mouse
gcagcgggtggcacagggat

SEQ ID NO: 494770 - DNA, 20 bp, mouse
gctctcaggacccttgccag

SEQ ID NO: 494771 - DNA, 20 bp, mouse
gtcgggtcggcctctggcaa

SEQ ID NO: 494772 - DNA, 20 bp, mouse
gcattcccgagagtggtcag

SEQ ID NO: 494773 - DNA, 20 bp, mouse
ggtggcacagggatgggacg

SEQ ID NO: 494774 - DNA, 20 bp, mouse
gcccgcccctccccctacgc

SEQ ID NO: 494775 - DNA, 20 bp, mouse
ggggccccctgaccactctc

SEQ ID NO: 494776 - DNA, 20 bp, mouse
gagaatatcaatgcacccca

SEQ ID NO: 494777 - DNA, 20 bp, mouse
gcacggccaaacatgtgaac

SEQ ID NO: 494778 - DNA, 20 bp, mouse
gtgacactggacacacaagg

SEQ ID NO: 494779 - DNA, 20 bp, mouse
gtagcacagggtagggcaca

SEQ ID NO: 494780 - DNA, 20 bp, mouse
ggtttttgtagcacagggta

SEQ ID NO: 494781 - DNA, 20 bp, mouse
gcattgcctgtagggcaagt

SEQ ID NO: 494782 - DNA, 20 bp, mouse
gagaaaactacatccaccat

SEQ ID NO: 494783 - DNA, 20 bp, mouse
gagaagcatgaaagtagtag

SEQ ID NO: 494784 - DNA, 20 bp, mouse
gattttgggtgcacatgaaa

SEQ ID NO: 494785 - DNA, 20 bp, mouse
gctacatccaccatgggaag

SEQ ID NO: 494786 - DNA, 20 bp, mouse
gtcgaaggggttgctatcaa

SEQ ID NO: 494787 - DNA, 20 bp, mouse
gcatatcatagagctcgaag

SEQ ID NO: 494788 - DNA, 20 bp, mouse
gcgagctctatgatatggag

SEQ ID NO: 494789 - DNA, 20 bp, mouse
ggggttgctatcaagggtcc

SEQ ID NO: 494790 - DNA, 20 bp, mouse
ggagtctgaggaccaataga

SEQ ID NO: 494791 - DNA, 20 bp, mouse
gctcatggctctccatctat

SEQ ID NO: 494792 - DNA, 20 bp, mouse
gccatcttagaaggataggc

SEQ ID NO: 494793 - DNA, 20 bp, mouse
gctcttggaggtcagcgggc

SEQ ID NO: 494794 - DNA, 20 bp, mouse
gaagctagcagtgaccaact

SEQ ID NO: 494795 - DNA, 20 bp, mouse
gctgccagcatccacgagac

SEQ ID NO: 494796 - DNA, 20 bp, mouse
gacgagaggaggaagaacga

SEQ ID NO: 494797 - DNA, 20 bp, mouse
gtgatctcctggaagaaagc

SEQ ID NO: 494798 - DNA, 20 bp, mouse
gaagaaatatgctgatctcc

SEQ ID NO: 494799 - DNA, 20 bp, mouse
gttaggagtaaaagcagaca

SEQ ID NO: 494800 - DNA, 20 bp, mouse
gggaagaagctagaatttgt

SEQ ID NO: 494801 - DNA, 20 bp, mouse
gctggacgagaagctcgaac

SEQ ID NO: 494802 - DNA, 20 bp, mouse
gtcaaccccagaggagaagc

SEQ ID NO: 494803 - DNA, 20 bp, mouse
gaatcttgctggccatcagg

SEQ ID NO: 494804 - DNA, 20 bp, mouse
gagaaaagagaagaaattcc

SEQ ID NO: 494805 - DNA, 20 bp, mouse
gctcgaacaggtcctcctga

SEQ ID NO: 494806 - DNA, 20 bp, mouse
gctgagaccaaggtcctctc

SEQ ID NO: 494807 - DNA, 20 bp, mouse
ggccagcacagccccagggg

SEQ ID NO: 494808 - DNA, 20 bp, mouse
ggggcctccagagaggacct

SEQ ID NO: 494809 - DNA, 20 bp, mouse
gtcgaccttggctgagacca

SEQ ID NO: 494810 - DNA, 20 bp, mouse
gataagaggacattcgacct

SEQ ID NO: 494811 - DNA, 20 bp, mouse
gagggaagggaagttgtcag

SEQ ID NO: 494812 - DNA, 20 bp, mouse
gggctgtgctggcatgctgg

SEQ ID NO: 494813 - DNA, 20 bp, mouse
gtcagtggccttcagataag

SEQ ID NO: 494814 - DNA, 20 bp, mouse
ggctgggggggcctccagag

SEQ ID NO: 494815 - DNA, 20 bp, mouse
ggacttccatagcctcccct

SEQ ID NO: 494816 - DNA, 20 bp, mouse
gtatataagtatgataagca

SEQ ID NO: 494817 - DNA, 20 bp, mouse
gaagtgcgagtcatagatgc

SEQ ID NO: 494818 - DNA, 20 bp, mouse
gcttcaatgttttctggtat

SEQ ID NO: 494819 - DNA, 20 bp, mouse
gagaaaacattgaagagcca

SEQ ID NO: 494820 - DNA, 20 bp, mouse
ggtattcctaaaagaatatt

SEQ ID NO: 494821 - DNA, 20 bp, mouse
gatgctttcttgactattga

SEQ ID NO: 494822 - DNA, 20 bp, mouse
gctatgactcgcactttcca

SEQ ID NO: 494823 - DNA, 20 bp, mouse
gttggagaagatttatcatg

SEQ ID NO: 494824 - DNA, 20 bp, mouse
gtaagaaaatatgtgaggag

SEQ ID NO: 494825 - DNA, 20 bp, mouse
ggagtttaagaaaatatgtg

SEQ ID NO: 494826 - DNA, 20 bp, mouse
ggcatgtccctcttgctttc

SEQ ID NO: 494827 - DNA, 20 bp, mouse
gctacagaacagattgacct

SEQ ID NO: 494828 - DNA, 20 bp, mouse
gctgcggagcagatgtaacc

SEQ ID NO: 494829 - DNA, 20 bp, mouse
gaagactaagagacgataga

SEQ ID NO: 494830 - DNA, 20 bp, mouse
gcatcttgctgcctttactt

SEQ ID NO: 494831 - DNA, 20 bp, mouse
gggaaggaagctggcaggga

SEQ ID NO: 494832 - DNA, 20 bp, mouse
gcaccaggtaggtcatgatt

SEQ ID NO: 494833 - DNA, 20 bp, mouse
gtgcagattgatataagctg

SEQ ID NO: 494834 - DNA, 20 bp, mouse
gatcaatctgcaaagaaaaa

SEQ ID NO: 494835 - DNA, 20 bp, mouse
gacccaaatcatgacctacc

SEQ ID NO: 494836 - DNA, 20 bp, mouse
gtctctgagacccgagcctg

SEQ ID NO: 494837 - DNA, 20 bp, mouse
gttttactcctggcagccaa

SEQ ID NO: 494838 - DNA, 20 bp, mouse
gttcgagggacttttactcc

SEQ ID NO: 494839 - DNA, 20 bp, mouse
gcatcttgagtggctgtagt

SEQ ID NO: 494840 - DNA, 20 bp, mouse
gcaattgtagacatcttgag

SEQ ID NO: 494841 - DNA, 20 bp, mouse
gcctgcagtcctggacacac

SEQ ID NO: 494842 - DNA, 20 bp, mouse
gactgcaggatgtcagacag

SEQ ID NO: 494843 - DNA, 20 bp, mouse
ggatgtcagacagtggccct

SEQ ID NO: 494844 - DNA, 20 bp, mouse
ggtctgacatcctgcagtcc

SEQ ID NO: 494845 - DNA, 20 bp, mouse
gacgtctctcctgtgtgtcc

SEQ ID NO: 494846 - DNA, 20 bp, mouse
gcggtccccatagtacaaag

SEQ ID NO: 494847 - DNA, 20 bp, mouse
ggagacactgtggagttcaa

SEQ ID NO: 494848 - DNA, 20 bp, mouse
gttcccctagaagtagctgg

SEQ ID NO: 494849 - DNA, 20 bp, mouse
ggggggggggcaaggatatg

SEQ ID NO: 494850 - DNA, 20 bp, mouse
gcggtccccacagtacacag

SEQ ID NO: 494851 - DNA, 20 bp, mouse
gatgcggccactttgtacta

SEQ ID NO: 494852 - DNA, 20 bp, mouse
ggtacttaaaggcccatcac

SEQ ID NO: 494853 - DNA, 20 bp, mouse
gtgctaccctcagggtcgaa

SEQ ID NO: 494854 - DNA, 20 bp, mouse
ggagacagtgtagagttcac

SEQ ID NO: 494855 - DNA, 20 bp, mouse
gggtctggctgactcctctc

SEQ ID NO: 494856 - DNA, 20 bp, mouse
gaccactccgatatctacaa

SEQ ID NO: 494857 - DNA, 20 bp, mouse
gacctttgtagatatcggag

SEQ ID NO: 494858 - DNA, 20 bp, mouse
gcgttcacctttgtagatat

SEQ ID NO: 494859 - DNA, 20 bp, mouse
ggctctcaatatctcatact

SEQ ID NO: 494860 - DNA, 20 bp, mouse
gtagaaggatgaaccaagag

SEQ ID NO: 494861 - DNA, 20 bp, mouse
gtcaatatctcatactaggt

SEQ ID NO: 494862 - DNA, 20 bp, mouse
ggcctgtccttggggattat

SEQ ID NO: 494863 - DNA, 20 bp, mouse
gcggagtggttgattgtgcc

SEQ ID NO: 494864 - DNA, 20 bp, mouse
gtctacaatagcctgtcctt

SEQ ID NO: 494865 - DNA, 20 bp, mouse
gacgaatgtcctgtgaaaac

SEQ ID NO: 494866 - DNA, 20 bp, mouse
gaagctcctagcactctggg

SEQ ID NO: 494867 - DNA, 20 bp, mouse
gtggaggggaagagcgatgt

SEQ ID NO: 494868 - DNA, 20 bp, mouse
ggtgaagctcctagcactct

SEQ ID NO: 494869 - DNA, 20 bp, mouse
gggtaagcgtcttctttcct

SEQ ID NO: 494870 - DNA, 20 bp, mouse
gtcagacaaaatacaactca

SEQ ID NO: 494871 - DNA, 20 bp, mouse
gaacaaccacccagagtgct

SEQ ID NO: 494872 - DNA, 20 bp, mouse
gaagcgtcttctttccttgg

SEQ ID NO: 494873 - DNA, 20 bp, mouse
gcaactcagggctgaacctc

SEQ ID NO: 494874 - DNA, 20 bp, mouse
gcagtattcagggagagccg

SEQ ID NO: 494875 - DNA, 20 bp, mouse
gctctggagaattcagagtt

SEQ ID NO: 494876 - DNA, 20 bp, mouse
gctcggtccgagtacaacag

SEQ ID NO: 494877 - DNA, 20 bp, mouse
gttcaggacatcggttgtgg

SEQ ID NO: 494878 - DNA, 20 bp, mouse
ggacatcggttgtggcggtg

SEQ ID NO: 494879 - DNA, 20 bp, mouse
gttcacacccctgttgtact

SEQ ID NO: 494880 - DNA, 20 bp, mouse
ggctagacatacaccctctg

SEQ ID NO: 494881 - DNA, 20 bp, mouse
gttggcatccagacctcaga

SEQ ID NO: 494882 - DNA, 20 bp, mouse
gacatacaccctctgaggtc

SEQ ID NO: 494883 - DNA, 20 bp, mouse
ggagggtgtatgtctagctg

SEQ ID NO: 494884 - DNA, 20 bp, mouse
ggctgctaggctccattagt

SEQ ID NO: 494885 - DNA, 20 bp, mouse
gagcttggttctacagccat

SEQ ID NO: 494886 - DNA, 20 bp, mouse
gattcgcagacaggtcgtta

SEQ ID NO: 494887 - DNA, 20 bp, mouse
gggtctactcacctcaggag

SEQ ID NO: 494888 - DNA, 20 bp, mouse
gcatctgacttctctcaaag

SEQ ID NO: 494889 - DNA, 20 bp, mouse
ggaggtcttagaagcagctc

SEQ ID NO: 494890 - DNA, 20 bp, mouse
gtgggaggggccgacaccag

SEQ ID NO: 494891 - DNA, 20 bp, mouse
gcagggactcaaggcctctt

SEQ ID NO: 494892 - DNA, 20 bp, mouse
gggccttgagtccctgggag

SEQ ID NO: 494893 - DNA, 20 bp, mouse
ggtcgttagggaatgtgtgc

SEQ ID NO: 494894 - DNA, 20 bp, mouse
gcttctctcaaagaggcaac

SEQ ID NO: 494895 - DNA, 20 bp, mouse
gcactggcagtcggcagaaa

SEQ ID NO: 494896 - DNA, 20 bp, mouse
gattaaggctctggactgcg

SEQ ID NO: 494897 - DNA, 20 bp, mouse
ggcaaaacaactctcgaacc

SEQ ID NO: 494898 - DNA, 20 bp, mouse
gtgcctgcatactttcgaag

SEQ ID NO: 494899 - DNA, 20 bp, mouse
gatcctcttcgaaagtatgc

SEQ ID NO: 494900 - DNA, 20 bp, mouse
gctaataacagtgaggactt

SEQ ID NO: 494901 - DNA, 20 bp, mouse
ggcaaaacaaaaggttgtgc

SEQ ID NO: 494902 - DNA, 20 bp, mouse
gagtttggctaataacagtg

SEQ ID NO: 494903 - DNA, 20 bp, mouse
gaggagctgttgaaacaact

SEQ ID NO: 494904 - DNA, 20 bp, mouse
gaagctctccaagatacgag

SEQ ID NO: 494905 - DNA, 20 bp, mouse
gttgcgaaccactcgtatct

SEQ ID NO: 494906 - DNA, 20 bp, mouse
gtgcagtacaccagagacta

SEQ ID NO: 494907 - DNA, 20 bp, mouse
gttgcgtcggaggtgagatc

SEQ ID NO: 494908 - DNA, 20 bp, mouse
gcctccgacgcaagagtctc

SEQ ID NO: 494909 - DNA, 20 bp, mouse
gttaaagtgcatagaaggat

SEQ ID NO: 494910 - DNA, 20 bp, mouse
gattccagagactcttgcgt

SEQ ID NO: 494911 - DNA, 20 bp, mouse
gattatagatatagttacgg

SEQ ID NO: 494912 - DNA, 20 bp, mouse
gggttccaaaaagatcaaca

SEQ ID NO: 494913 - DNA, 20 bp, mouse
ggatgtcttaataagtaact

SEQ ID NO: 494914 - DNA, 20 bp, mouse
gaaacataaacttataggat

SEQ ID NO: 494915 - DNA, 20 bp, mouse
gatctgatgccaatttctta

SEQ ID NO: 494916 - DNA, 20 bp, mouse
gtcaggccacgtgctatcag

SEQ ID NO: 494917 - DNA, 20 bp, mouse
ggaaccctcagactaaagtg

SEQ ID NO: 494918 - DNA, 20 bp, mouse
gtgtccaacacggaaagaaa

SEQ ID NO: 494919 - DNA, 20 bp, mouse
gaaatggagatgcaatagaa

SEQ ID NO: 494920 - DNA, 20 bp, mouse
gacgtggcctgagccactga

SEQ ID NO: 494921 - DNA, 20 bp, mouse
ggtaactgagagagcaacgg

SEQ ID NO: 494922 - DNA, 20 bp, mouse
gccaccaactactcaacctg

SEQ ID NO: 494923 - DNA, 20 bp, mouse
ggcagccacagggcttcttg

SEQ ID NO: 494924 - DNA, 20 bp, mouse
gtcccactcaagatgagaaa

SEQ ID NO: 494925 - DNA, 20 bp, mouse
ggcttgtcatctgccatcag

SEQ ID NO: 494926 - DNA, 20 bp, mouse
ggggggcctgcagaatctgt

SEQ ID NO: 494927 - DNA, 20 bp, mouse
gaccacacgcctcttggaga

SEQ ID NO: 494928 - DNA, 20 bp, mouse
gagattctgcaggcccccgt

SEQ ID NO: 494929 - DNA, 20 bp, mouse
ggtaggcagtgaagagcagg

SEQ ID NO: 494930 - DNA, 20 bp, mouse
gcccagggccacatactcct

SEQ ID NO: 494931 - DNA, 20 bp, mouse
gtgctcttcactgcctacgg

SEQ ID NO: 494932 - DNA, 20 bp, mouse
gatccgtctgcataatggag

SEQ ID NO: 494933 - DNA, 20 bp, mouse
gtggccctggggcaagaagg

SEQ ID NO: 494934 - DNA, 20 bp, mouse
gagctctggagtcactctgg

SEQ ID NO: 494935 - DNA, 20 bp, mouse
ggtgaactggataacatgag

SEQ ID NO: 494936 - DNA, 20 bp, mouse
gttttgcgctggcttctctt

SEQ ID NO: 494937 - DNA, 20 bp, mouse
gagatcattgattttggact

SEQ ID NO: 494938 - DNA, 20 bp, mouse
gataagttgagtttttgcgc

SEQ ID NO: 494939 - DNA, 20 bp, mouse
gcacctgggcgcagcttccc

SEQ ID NO: 494940 - DNA, 20 bp, mouse
gcgcctcacaggcacccacg

SEQ ID NO: 494941 - DNA, 20 bp, mouse
gtctccatgtcagagaaagg

SEQ ID NO: 494942 - DNA, 20 bp, mouse
ggtgccgggccagcttcacc

SEQ ID NO: 494943 - DNA, 20 bp, mouse
gcgcccaggtgaagctggcc

SEQ ID NO: 494944 - DNA, 20 bp, mouse
gagctgcgcccaggtgaagc

SEQ ID NO: 494945 - DNA, 20 bp, mouse
gggccagggaagctgcgccc

SEQ ID NO: 494946 - DNA, 20 bp, mouse
gtggaagctcagggagctgc

SEQ ID NO: 494947 - DNA, 20 bp, mouse
gtcagctagtccaagaccac

SEQ ID NO: 494948 - DNA, 20 bp, mouse
gctggcccctgctcacctac

SEQ ID NO: 494949 - DNA, 20 bp, mouse
ggaaggaaggagacatatca

SEQ ID NO: 494950 - DNA, 20 bp, mouse
ggggagctgccaagacatct

SEQ ID NO: 494951 - DNA, 20 bp, mouse
gaagaagaggccagtggtct

SEQ ID NO: 494952 - DNA, 20 bp, mouse
gttggcagctcccagtgtca

SEQ ID NO: 494953 - DNA, 20 bp, mouse
gcagtggtctccatgacact

SEQ ID NO: 494954 - DNA, 20 bp, mouse
gcacatgcatggttcctggg

SEQ ID NO: 494955 - DNA, 20 bp, mouse
gctacacagcaggagatgga

SEQ ID NO: 494956 - DNA, 20 bp, mouse
gtggacatagcaatggatat

SEQ ID NO: 494957 - DNA, 20 bp, mouse
gaagggacatcccaaaggtg

SEQ ID NO: 494958 - DNA, 20 bp, mouse
gcactggaataaagaagatg

SEQ ID NO: 494959 - DNA, 20 bp, mouse
ggaatagtattattgactca

SEQ ID NO: 494960 - DNA, 20 bp, mouse
gcaatggaacagcagtctgt

SEQ ID NO: 494961 - DNA, 20 bp, mouse
gcttcaggaagcgctgtaat

SEQ ID NO: 494962 - DNA, 20 bp, mouse
ggaacagcagtctgttggtc

SEQ ID NO: 494963 - DNA, 20 bp, mouse
ggcaaggctctcctcacctt

SEQ ID NO: 494964 - DNA, 20 bp, mouse
gtgtccctttctctttcagg

SEQ ID NO: 494965 - DNA, 20 bp, mouse
gacaggtgaactgaatattt

SEQ ID NO: 494966 - DNA, 20 bp, mouse
ggactcctcagaagaactgg

SEQ ID NO: 494967 - DNA, 20 bp, mouse
gtccaggggcccgtagaagg

SEQ ID NO: 494968 - DNA, 20 bp, mouse
gtgctgaactctgatagaca

SEQ ID NO: 494969 - DNA, 20 bp, mouse
gaccgatgtctcagagtctg

SEQ ID NO: 494970 - DNA, 20 bp, mouse
gtctcgcaagaggccaggag

SEQ ID NO: 494971 - DNA, 20 bp, mouse
gtcagagttcagcaggctag

SEQ ID NO: 494972 - DNA, 20 bp, mouse
gctgtccaggggcccgtaga

SEQ ID NO: 494973 - DNA, 20 bp, mouse
gcatcggaggtggtaagctg

SEQ ID NO: 494974 - DNA, 20 bp, mouse
ggggcagcgagtcctcggag

SEQ ID NO: 494975 - DNA, 20 bp, mouse
ggcccgtagaaggcggcaga

SEQ ID NO: 494976 - DNA, 20 bp, mouse
gttggttaatttcagaattc

SEQ ID NO: 494977 - DNA, 20 bp, mouse
gtggagctgttgctcatcca

SEQ ID NO: 494978 - DNA, 20 bp, mouse
gaatgaatggagcaaaccac

SEQ ID NO: 494979 - DNA, 20 bp, mouse
ggaatagcattattgatcca

SEQ ID NO: 494980 - DNA, 20 bp, mouse
gtgcattgcgattcagaaga

SEQ ID NO: 494981 - DNA, 20 bp, mouse
gatggagcaaaccacaggtg

SEQ ID NO: 494982 - DNA, 20 bp, mouse
gctcagatgctggtgacact

SEQ ID NO: 494983 - DNA, 20 bp, mouse
gccacaggtgaggagagcct

SEQ ID NO: 494984 - DNA, 20 bp, mouse
ggtctcaggtatgagatatg

SEQ ID NO: 494985 - DNA, 20 bp, mouse
gccttggtttatacacaatg

SEQ ID NO: 494986 - DNA, 20 bp, mouse
gagacccgggatgaaggagt

SEQ ID NO: 494987 - DNA, 20 bp, mouse
gaatcaccagcgtagcacaa

SEQ ID NO: 494988 - DNA, 20 bp, mouse
gagaagaagacccgggatga

SEQ ID NO: 494989 - DNA, 20 bp, mouse
gacgctggtgattctgttcc

SEQ ID NO: 494990 - DNA, 20 bp, mouse
gacgcagagtgagctgaccg

SEQ ID NO: 494991 - DNA, 20 bp, mouse
ggatgaaggagttggaagca

SEQ ID NO: 494992 - DNA, 20 bp, mouse
gaggttccgggttccgggag

SEQ ID NO: 494993 - DNA, 20 bp, mouse
ggcagaagagtaacccctcc

SEQ ID NO: 494994 - DNA, 20 bp, mouse
gctatctccagagccgcgcc

SEQ ID NO: 494995 - DNA, 20 bp, mouse
gtcagcagcagtggatggaa

SEQ ID NO: 494996 - DNA, 20 bp, mouse
gaggactccaacgagaccgg

SEQ ID NO: 494997 - DNA, 20 bp, mouse
gtgcaggactccaacgagac

SEQ ID NO: 494998 - DNA, 20 bp, mouse
gccagagaaggcagaacgag

SEQ ID NO: 494999 - DNA, 20 bp, mouse
gatatgtagagaagtagttc

SEQ ID NO: 495000 - DNA, 20 bp, mouse
gggttcgtggtgaaggtcag

SEQ ID NO: 495001 - DNA, 20 bp, mouse
gatggtgactgatggactct

SEQ ID NO: 495002 - DNA, 20 bp, mouse
gagaaagacagagaaaccat

SEQ ID NO: 495003 - DNA, 20 bp, mouse
gtcagcatcatggtgactga

SEQ ID NO: 495004 - DNA, 20 bp, mouse
ggtgactgatggactcttgg

SEQ ID NO: 495005 - DNA, 20 bp, mouse
ggaaggtcaggggcctaccc

SEQ ID NO: 495006 - DNA, 20 bp, mouse
gcaggaataccccactactc

SEQ ID NO: 495007 - DNA, 20 bp, mouse
ggaggcagaagctaatgtag

SEQ ID NO: 495008 - DNA, 20 bp, mouse
gtgtagaggtcatgcatgga

SEQ ID NO: 495009 - DNA, 20 bp, mouse
ggcactgtcagatgctgtgt

SEQ ID NO: 495010 - DNA, 20 bp, mouse
gtggagggatgtttctttac

SEQ ID NO: 495011 - DNA, 20 bp, mouse
gcaaattggtaccagagtag

SEQ ID NO: 495012 - DNA, 20 bp, mouse
gcagtgctcttaaaaacaaa

SEQ ID NO: 495013 - DNA, 20 bp, mouse
gcagatgctgtgtaggtgct

SEQ ID NO: 495014 - DNA, 20 bp, mouse
gaaattaaagacatttttca

SEQ ID NO: 495015 - DNA, 20 bp, mouse
gctaatgtagaggtcatgca

SEQ ID NO: 495016 - DNA, 20 bp, mouse
gggaggcatggcatgcagta

SEQ ID NO: 495017 - DNA, 20 bp, mouse
gtctaggtggatgatcagaa

SEQ ID NO: 495018 - DNA, 20 bp, mouse
gccacagcgctgtcccacac

SEQ ID NO: 495019 - DNA, 20 bp, mouse
gttcgtgcgccaaagtgcag

SEQ ID NO: 495020 - DNA, 20 bp, mouse
gccatgcctccactgcactt

SEQ ID NO: 495021 - DNA, 20 bp, mouse
ggagtatgtgcggctctagg

SEQ ID NO: 495022 - DNA, 20 bp, mouse
gcagcgctgtcccacactgg

SEQ ID NO: 495023 - DNA, 20 bp, mouse
ggagctgaacccagcatctg

SEQ ID NO: 495024 - DNA, 20 bp, mouse
gcagctcctgaagagtacta

SEQ ID NO: 495025 - DNA, 20 bp, mouse
ggtgggtgccaaccaagctc

SEQ ID NO: 495026 - DNA, 20 bp, mouse
gctggtaatcctgctcacag

SEQ ID NO: 495027 - DNA, 20 bp, mouse
gggcaagcacaatcaattat

SEQ ID NO: 495028 - DNA, 20 bp, mouse
ggagggtaacttatttttaa

SEQ ID NO: 495029 - DNA, 20 bp, mouse
gagagcttaaactaaactta

SEQ ID NO: 495030 - DNA, 20 bp, mouse
ggtgcttgccttgtgtatag

SEQ ID NO: 495031 - DNA, 20 bp, mouse
gagcaggattaccagcatct

SEQ ID NO: 495032 - DNA, 20 bp, mouse
gtctttttataaatttactc

SEQ ID NO: 495033 - DNA, 20 bp, mouse
gggagatggaaaaggaacag

SEQ ID NO: 495034 - DNA, 20 bp, mouse
ggtatagaggacagagaaag

SEQ ID NO: 495035 - DNA, 20 bp, mouse
gtctctgtcctctatacaca

SEQ ID NO: 495036 - DNA, 20 bp, mouse
gcgtgggccacactcaacaa

SEQ ID NO: 495037 - DNA, 20 bp, mouse
ggctgctgctctgcgatggc

SEQ ID NO: 495038 - DNA, 20 bp, mouse
gttgctgccaccaggtaagt

SEQ ID NO: 495039 - DNA, 20 bp, mouse
ggacatgatccgggagtgtg

SEQ ID NO: 495040 - DNA, 20 bp, mouse
gtgagtgtggcccacggcca

SEQ ID NO: 495041 - DNA, 20 bp, mouse
gctgctctgcgatggcgggc

SEQ ID NO: 495042 - DNA, 20 bp, mouse
ggcatgaagccgcacactcc

SEQ ID NO: 495043 - DNA, 20 bp, mouse
gacactttgagcaactccca

SEQ ID NO: 495044 - DNA, 20 bp, mouse
ggcagcgccgcgccttacgg

SEQ ID NO: 495045 - DNA, 20 bp, mouse
gagtgtgcggcttcatgcca

SEQ ID NO: 495046 - DNA, 20 bp, mouse
gcgtgtctccgtcagtatca

SEQ ID NO: 495047 - DNA, 20 bp, mouse
ggccgctgccctgatactga

SEQ ID NO: 495048 - DNA, 20 bp, mouse
gtccgtcagtatcagggcag

SEQ ID NO: 495049 - DNA, 20 bp, mouse
ggtggctgcgcgggcagaag

SEQ ID NO: 495050 - DNA, 20 bp, mouse
ggtatcatcattcccagatg

SEQ ID NO: 495051 - DNA, 20 bp, mouse
gctcctcccgggaccttcgg

SEQ ID NO: 495052 - DNA, 20 bp, mouse
gagccaccgaaggtcccggg

SEQ ID NO: 495053 - DNA, 20 bp, mouse
gcgcgggcagaagcggagca

SEQ ID NO: 495054 - DNA, 20 bp, mouse
gcgcagccaccgaaggtccc

SEQ ID NO: 495055 - DNA, 20 bp, mouse
gcggagcagggcgtaaggtt

SEQ ID NO: 495056 - DNA, 20 bp, mouse
ggagagaagcctaaactcca

SEQ ID NO: 495057 - DNA, 20 bp, mouse
gcccagtacaccatgcctag

SEQ ID NO: 495058 - DNA, 20 bp, mouse
gaagagcaagagccgatcca

SEQ ID NO: 495059 - DNA, 20 bp, mouse
ggccaaaaggcagcagatgc

SEQ ID NO: 495060 - DNA, 20 bp, mouse
gtcccctcctccttcccagt

SEQ ID NO: 495061 - DNA, 20 bp, mouse
ggccccagctcctctgatag

SEQ ID NO: 495062 - DNA, 20 bp, mouse
gtcttgctcttgttgcctct

SEQ ID NO: 495063 - DNA, 20 bp, mouse
ggagagatgctgaagctgat

SEQ ID NO: 495064 - DNA, 20 bp, mouse
gacgagctctagctgatagg

SEQ ID NO: 495065 - DNA, 20 bp, mouse
gtttaactcaggagagatat

SEQ ID NO: 495066 - DNA, 20 bp, mouse
ggagacacagctggcaccgg

SEQ ID NO: 495067 - DNA, 20 bp, mouse
gatcatgtcccgcatcgact

SEQ ID NO: 495068 - DNA, 20 bp, mouse
ggtgcttggtgaggcgcccc

SEQ ID NO: 495069 - DNA, 20 bp, mouse
gtcaagaattgatgaacccg

SEQ ID NO: 495070 - DNA, 20 bp, mouse
ggaattgatgaacccggggc

SEQ ID NO: 495071 - DNA, 20 bp, mouse
gaagcacaccaagtcgatgc

SEQ ID NO: 495072 - DNA, 20 bp, mouse
ggccgagacacagctggcac

SEQ ID NO: 495073 - DNA, 20 bp, mouse
ggaggcatccaatttcgtta

SEQ ID NO: 495074 - DNA, 20 bp, mouse
gcgaaattggatgcctcttc

SEQ ID NO: 495075 - DNA, 20 bp, mouse
gtcgatgcgggacatgatcc

SEQ ID NO: 495076 - DNA, 20 bp, mouse
ggtgccttatccatgtactt

SEQ ID NO: 495077 - DNA, 20 bp, mouse
gtgcaggtttaaaatgctgt

SEQ ID NO: 495078 - DNA, 20 bp, mouse
ggaacaaacaagcatcctga

SEQ ID NO: 495079 - DNA, 20 bp, mouse
gggtggtaggggtgcggagt

SEQ ID NO: 495080 - DNA, 20 bp, mouse
gcaacatttatgtgaccttc

SEQ ID NO: 495081 - DNA, 20 bp, mouse
gccagatcagttgaggattc

SEQ ID NO: 495082 - DNA, 20 bp, mouse
gagggtgggaaaggtggtag

SEQ ID NO: 495083 - DNA, 20 bp, mouse
gttattggttggtgtctctg

SEQ ID NO: 495084 - DNA, 20 bp, mouse
ggagataaggcacctaaagg

SEQ ID NO: 495085 - DNA, 20 bp, mouse
gatgtctgctagggtgggaa

SEQ ID NO: 495086 - DNA, 20 bp, mouse
ggacgtcgccatcctggtcg

SEQ ID NO: 495087 - DNA, 20 bp, mouse
gatggcgaccacgaccagga

SEQ ID NO: 495088 - DNA, 20 bp, mouse
ggagccagacgtcgccatcc

SEQ ID NO: 495089 - DNA, 20 bp, mouse
ggatcatggcgaccacgacc

SEQ ID NO: 495090 - DNA, 20 bp, mouse
gacattggtgcccccaacgc

SEQ ID NO: 495091 - DNA, 20 bp, mouse
gagtgccatgcctgcgttgg

SEQ ID NO: 495092 - DNA, 20 bp, mouse
gtgcagtgccatgcctgcgt

SEQ ID NO: 495093 - DNA, 20 bp, mouse
gagcggctgctcaaagagga

SEQ ID NO: 495094 - DNA, 20 bp, mouse
gtatcaagcagataatgaaa

SEQ ID NO: 495095 - DNA, 20 bp, mouse
gcaatgtcggggaggacatc

SEQ ID NO: 495096 - DNA, 20 bp, mouse
gtggtggcgcagcgagagga

SEQ ID NO: 495097 - DNA, 20 bp, mouse
gggcgcttagagctctatcg

SEQ ID NO: 495098 - DNA, 20 bp, mouse
gctcgctgcgccaccaccaa

SEQ ID NO: 495099 - DNA, 20 bp, mouse
gaagcttggggcagaaccgt

SEQ ID NO: 495100 - DNA, 20 bp, mouse
gctgctatagagaaattggt

SEQ ID NO: 495101 - DNA, 20 bp, mouse
gcagagggtataccccccca

SEQ ID NO: 495102 - DNA, 20 bp, mouse
gggggcagaaccgttggtgg

SEQ ID NO: 495103 - DNA, 20 bp, mouse
gggagtagtagcacttgtgg

SEQ ID NO: 495104 - DNA, 20 bp, mouse
ggctggcctctcaaagcttg

SEQ ID NO: 495105 - DNA, 20 bp, mouse
gggcagatagaaaaacctaa

SEQ ID NO: 495106 - DNA, 20 bp, mouse
gagagtcacgaggagagtcg

SEQ ID NO: 495107 - DNA, 20 bp, mouse
gagagtcgaggccgcgctcg

SEQ ID NO: 495108 - DNA, 20 bp, mouse
gcgcgggctcgtcccgctcg

SEQ ID NO: 495109 - DNA, 20 bp, mouse
gcaaggatgggagtcgggaa

SEQ ID NO: 495110 - DNA, 20 bp, mouse
gtccgccttccaagccggga

SEQ ID NO: 495111 - DNA, 20 bp, mouse
gacagaagggaacgccgtcc

SEQ ID NO: 495112 - DNA, 20 bp, mouse
gtggagcggtaaacaggaca

SEQ ID NO: 495113 - DNA, 20 bp, mouse
gatgggagtcgggaagggcc

SEQ ID NO: 495114 - DNA, 20 bp, mouse
ggcccccacccggcccgacc

SEQ ID NO: 495115 - DNA, 20 bp, mouse
gtgacacccaaagggagagc

SEQ ID NO: 495116 - DNA, 20 bp, mouse
gaatgaatgggacaaaccac

SEQ ID NO: 495117 - DNA, 20 bp, mouse
gccagcatctgagaatgaat

SEQ ID NO: 495118 - DNA, 20 bp, mouse
gtggagctgttgctcatcca

SEQ ID NO: 495119 - DNA, 20 bp, mouse
ggaatagcattattgatcca

SEQ ID NO: 495120 - DNA, 20 bp, mouse
ggaattgcaatgcagctctc

SEQ ID NO: 495121 - DNA, 20 bp, mouse
gtgcattgcaattcagaaga

SEQ ID NO: 495122 - DNA, 20 bp, mouse
gctcagatgctggtgacact

SEQ ID NO: 495123 - DNA, 20 bp, mouse
gatgggacaaaccacaggtg

SEQ ID NO: 495124 - DNA, 20 bp, mouse
gccaaggctctcctcacctg

SEQ ID NO: 495125 - DNA, 20 bp, mouse
gccttggtttacacacaatg

SEQ ID NO: 495126 - DNA, 20 bp, mouse
gcataacaacctggtcaatt

SEQ ID NO: 495127 - DNA, 20 bp, mouse
gtgttacttcctaattgacc

SEQ ID NO: 495128 - DNA, 20 bp, mouse
ggtaaccaagcatgatttgt

SEQ ID NO: 495129 - DNA, 20 bp, mouse
gttgacctacaaatcatgct

SEQ ID NO: 495130 - DNA, 20 bp, mouse
gaaatcatgcttggttacta

SEQ ID NO: 495131 - DNA, 20 bp, mouse
gtgaaatatataggatatta

SEQ ID NO: 495132 - DNA, 20 bp, mouse
gaagcaccagaacctgcaac

SEQ ID NO: 495133 - DNA, 20 bp, mouse
gcagctcctgttgcaggttc

SEQ ID NO: 495134 - DNA, 20 bp, mouse
gtatttcctggtccaccaag

SEQ ID NO: 495135 - DNA, 20 bp, mouse
gtgaattgtaaataaatcct

SEQ ID NO: 495136 - DNA, 20 bp, mouse
gttgagctgcctcgacatgg

SEQ ID NO: 495137 - DNA, 20 bp, mouse
gaggcctgaggcaacagggt

SEQ ID NO: 495138 - DNA, 20 bp, mouse
gatgtcgaggcagctcaaca

SEQ ID NO: 495139 - DNA, 20 bp, mouse
gtgcctcgacatggtggcaa

SEQ ID NO: 495140 - DNA, 20 bp, mouse
gttcctttgccaccatgtcg

SEQ ID NO: 495141 - DNA, 20 bp, mouse
gactgaggcctgaggcaaca

SEQ ID NO: 495142 - DNA, 20 bp, mouse
gcaaaggaatgagcagtatc

SEQ ID NO: 495143 - DNA, 20 bp, mouse
gcagggtagctattgctgag

SEQ ID NO: 495144 - DNA, 20 bp, mouse
gcaccctgcggcaaaacttc

SEQ ID NO: 495145 - DNA, 20 bp, mouse
gtagcgcccctgcaagtcgt

SEQ ID NO: 495146 - DNA, 20 bp, mouse
ggaatagcattatcgattca

SEQ ID NO: 495147 - DNA, 20 bp, mouse
gaatgaatggagcaaaccac

SEQ ID NO: 495148 - DNA, 20 bp, mouse
gtgcattgcgattcagaaga

SEQ ID NO: 495149 - DNA, 20 bp, mouse
gatggagcaaaccacaggtg

SEQ ID NO: 495150 - DNA, 20 bp, mouse
gctcagatgctggtgacact

SEQ ID NO: 495151 - DNA, 20 bp, mouse
gagtgtgagatgtgtcagga

SEQ ID NO: 495152 - DNA, 20 bp, mouse
gccaaggctctcctcacctg

SEQ ID NO: 495153 - DNA, 20 bp, mouse
ggtctcaggtatgagatatg

SEQ ID NO: 495154 - DNA, 20 bp, mouse
ggtgcagtgtgagatgtgtc

SEQ ID NO: 495155 - DNA, 20 bp, mouse
gccttggtttatacacaatg

SEQ ID NO: 495156 - DNA, 20 bp, mouse
gtgttcaaaccccagccccc

SEQ ID NO: 495157 - DNA, 20 bp, mouse
ggaagaccctccagggggct

SEQ ID NO: 495158 - DNA, 20 bp, mouse
ggagcaatcacacaggctgt

SEQ ID NO: 495159 - DNA, 20 bp, mouse
ggcttgctgtgagtggagag

SEQ ID NO: 495160 - DNA, 20 bp, mouse
ggctggggtttgaacagggc

SEQ ID NO: 495161 - DNA, 20 bp, mouse
ggctgtgagtggagagaggc

SEQ ID NO: 495162 - DNA, 20 bp, mouse
ggacttacctgcccagaagg

SEQ ID NO: 495163 - DNA, 20 bp, mouse
ggctgtactcagtcccaaca

SEQ ID NO: 495164 - DNA, 20 bp, mouse
gagagacttacctgcccaga

SEQ ID NO: 495165 - DNA, 20 bp, mouse
gcccctactttccgccttct

SEQ ID NO: 495166 - DNA, 20 bp, mouse
ggagccaaggtggattggag

SEQ ID NO: 495167 - DNA, 20 bp, mouse
gccaaggtggattggagagg

SEQ ID NO: 495168 - DNA, 20 bp, mouse
gtgctgccaagtgagcatag

SEQ ID NO: 495169 - DNA, 20 bp, mouse
gggttcccactatgctcact

SEQ ID NO: 495170 - DNA, 20 bp, mouse
gggtaagctggtcttcaggg

SEQ ID NO: 495171 - DNA, 20 bp, mouse
gggagaggaggaaatctcgt

SEQ ID NO: 495172 - DNA, 20 bp, mouse
ggggaggagccaaggtggat

SEQ ID NO: 495173 - DNA, 20 bp, mouse
ggagggtaagctggtcttca

SEQ ID NO: 495174 - DNA, 20 bp, mouse
gtttttcatggaaggaacta

SEQ ID NO: 495175 - DNA, 20 bp, mouse
gggtcttcagggaggagcca

SEQ ID NO: 495176 - DNA, 20 bp, mouse
ggatggtgagctgatcttca

SEQ ID NO: 495177 - DNA, 20 bp, mouse
ggctgcaaggtgaccatatt

SEQ ID NO: 495178 - DNA, 20 bp, mouse
gcaggtgttatgttttgact

SEQ ID NO: 495179 - DNA, 20 bp, mouse
ggagctgatcttcagggaga

SEQ ID NO: 495180 - DNA, 20 bp, mouse
gttatatttgcgtcctaata

SEQ ID NO: 495181 - DNA, 20 bp, mouse
gttctgacatatgaacagag

SEQ ID NO: 495182 - DNA, 20 bp, mouse
gcagaaagcattcgacaatg

SEQ ID NO: 495183 - DNA, 20 bp, mouse
gatatggaattcgagaactg

SEQ ID NO: 495184 - DNA, 20 bp, mouse
gggagaggaggagatctcga

SEQ ID NO: 495185 - DNA, 20 bp, mouse
gttgagggtgtacccaaagg

SEQ ID NO: 495186 - DNA, 20 bp, mouse
gacctataatttaattcaac

SEQ ID NO: 495187 - DNA, 20 bp, mouse
gtataatttaattcaacagg

SEQ ID NO: 495188 - DNA, 20 bp, mouse
gatttaattcaacaggagga

SEQ ID NO: 495189 - DNA, 20 bp, mouse
gttctgacatatgaacagag

SEQ ID NO: 495190 - DNA, 20 bp, mouse
gcagaaagcattcgacaatg

SEQ ID NO: 495191 - DNA, 20 bp, mouse
gggagaggaggagatctcga

SEQ ID NO: 495192 - DNA, 20 bp, mouse
gtcagaggagaataaggaag

SEQ ID NO: 495193 - DNA, 20 bp, mouse
ggagttttggaggttaaagt

SEQ ID NO: 495194 - DNA, 20 bp, mouse
gttgagggtgtacccaaagg

SEQ ID NO: 495195 - DNA, 20 bp, mouse
gttctcatcagaggagaata

SEQ ID NO: 495196 - DNA, 20 bp, mouse
gccaatacccgtgaagaaat

SEQ ID NO: 495197 - DNA, 20 bp, mouse
gtgatgagagcaagcagaca

SEQ ID NO: 495198 - DNA, 20 bp, mouse
ggagcaagcccatttcttca

SEQ ID NO: 495199 - DNA, 20 bp, mouse
gagaattccagcatctactg

SEQ ID NO: 495200 - DNA, 20 bp, mouse
gggtgttcctcagtagatgc

SEQ ID NO: 495201 - DNA, 20 bp, mouse
gtagagtgggtggggtactt

SEQ ID NO: 495202 - DNA, 20 bp, mouse
gactgtggctgataccacag

SEQ ID NO: 495203 - DNA, 20 bp, mouse
ggatccagttaatccaacaa

SEQ ID NO: 495204 - DNA, 20 bp, mouse
ggaagcatctcatccccctg

SEQ ID NO: 495205 - DNA, 20 bp, mouse
gtccacaaggtttgaagtct

SEQ ID NO: 495206 - DNA, 20 bp, mouse
gtagcatagcccgcaatggg

SEQ ID NO: 495207 - DNA, 20 bp, mouse
ggactgtgcgcgctggcgtc

SEQ ID NO: 495208 - DNA, 20 bp, mouse
gtcaagtccccgagcagcag

SEQ ID NO: 495209 - DNA, 20 bp, mouse
gcggtagcatagcccgcaat

SEQ ID NO: 495210 - DNA, 20 bp, mouse
gctccgaccccgctgctgct

SEQ ID NO: 495211 - DNA, 20 bp, mouse
gtggtgaagctagaagccgt

SEQ ID NO: 495212 - DNA, 20 bp, mouse
ggcgggaggctagggtcgca

SEQ ID NO: 495213 - DNA, 20 bp, mouse
gatagcccgcaatgggcggg

SEQ ID NO: 495214 - DNA, 20 bp, mouse
gcctagcctcccgcccattg

SEQ ID NO: 495215 - DNA, 20 bp, mouse
gtgctgccccgggcctgccg

SEQ ID NO: 495216 - DNA, 20 bp, mouse
gaagtgctatggaacaatca

SEQ ID NO: 495217 - DNA, 20 bp, mouse
gcatatcctggaaaaagtat

SEQ ID NO: 495218 - DNA, 20 bp, mouse
gttactgtgtgaacatatcc

SEQ ID NO: 495219 - DNA, 20 bp, mouse
gcagcgattgtgaaaaactc

SEQ ID NO: 495220 - DNA, 20 bp, mouse
gagtatgggtcaatttcatg

SEQ ID NO: 495221 - DNA, 20 bp, mouse
gaacttcaaagctttgagag

SEQ ID NO: 495222 - DNA, 20 bp, mouse
gattgacccatactttttcc

SEQ ID NO: 495223 - DNA, 20 bp, mouse
ggtcaatttcatggggaaca

SEQ ID NO: 495224 - DNA, 20 bp, mouse
gtagcacttatcaccagtaa

SEQ ID NO: 495225 - DNA, 20 bp, mouse
ggaagttctaatatgatata

SEQ ID NO: 495226 - DNA, 20 bp, mouse
gcgaaggagcccaggcgcgg

SEQ ID NO: 495227 - DNA, 20 bp, mouse
ggagcgcgtggtgaaactag

SEQ ID NO: 495228 - DNA, 20 bp, mouse
gaagtcccggagccgcagcg

SEQ ID NO: 495229 - DNA, 20 bp, mouse
gactgtgcgcccccgcgcct

SEQ ID NO: 495230 - DNA, 20 bp, mouse
gccgaccccgctgcggctcc

SEQ ID NO: 495231 - DNA, 20 bp, mouse
gctgcgaaggagcccaggcg

SEQ ID NO: 495232 - DNA, 20 bp, mouse
ggtcctctgcgaaggagccc

SEQ ID NO: 495233 - DNA, 20 bp, mouse
gtagcgtagcccgcaacggg

SEQ ID NO: 495234 - DNA, 20 bp, mouse
gcggtagcgtagcccgcaac

SEQ ID NO: 495235 - DNA, 20 bp, mouse
ggtagcccgcaacgggcggg

SEQ ID NO: 495236 - DNA, 20 bp, mouse
gggttctagccatcagaagg

SEQ ID NO: 495237 - DNA, 20 bp, mouse
gagctccaatagctactcac

SEQ ID NO: 495238 - DNA, 20 bp, mouse
gacctgatcagatcagtgag

SEQ ID NO: 495239 - DNA, 20 bp, mouse
gaagtgatgtctgagtaagt

SEQ ID NO: 495240 - DNA, 20 bp, mouse
gcctcacctgccttctggtt

SEQ ID NO: 495241 - DNA, 20 bp, mouse
ggtgggttctagccatcaga

SEQ ID NO: 495242 - DNA, 20 bp, mouse
gctgatcaactagtgggtgg

SEQ ID NO: 495243 - DNA, 20 bp, mouse
ggggtggcggctgatggacc

SEQ ID NO: 495244 - DNA, 20 bp, mouse
ggagctgacccctatttgag

SEQ ID NO: 495245 - DNA, 20 bp, mouse
gtgattccaaaccagaaggc

SEQ ID NO: 495246 - DNA, 20 bp, mouse
gctgagactggagaggaccc

SEQ ID NO: 495247 - DNA, 20 bp, mouse
gtcacgatgaagcctgagac

SEQ ID NO: 495248 - DNA, 20 bp, mouse
gtctgacaacggaaaactga

SEQ ID NO: 495249 - DNA, 20 bp, mouse
gatgtgtacataatttacct

SEQ ID NO: 495250 - DNA, 20 bp, mouse
gtttttcacgagctactaca

SEQ ID NO: 495251 - DNA, 20 bp, mouse
gggggagtccagggtcattc

SEQ ID NO: 495252 - DNA, 20 bp, mouse
gcacatagaagatctgacaa

SEQ ID NO: 495253 - DNA, 20 bp, mouse
gatgaagcctgagactggag

SEQ ID NO: 495254 - DNA, 20 bp, mouse
gacaacggaaaactgaagga

SEQ ID NO: 495255 - DNA, 20 bp, mouse
gtcagcgtcgaagaatgatg

SEQ ID NO: 495256 - DNA, 20 bp, mouse
gatacccaagacaacaggaa

SEQ ID NO: 495257 - DNA, 20 bp, mouse
ggcccggcatgtcaggatta

SEQ ID NO: 495258 - DNA, 20 bp, mouse
gtggtgcagataagttgcca

SEQ ID NO: 495259 - DNA, 20 bp, mouse
gcaccaatacccaagacaac

SEQ ID NO: 495260 - DNA, 20 bp, mouse
gttcgcctgatggttgtcct

SEQ ID NO: 495261 - DNA, 20 bp, mouse
gcagccattcctgttgtctt

SEQ ID NO: 495262 - DNA, 20 bp, mouse
ggcgccacataaagaacact

SEQ ID NO: 495263 - DNA, 20 bp, mouse
gctgatccagaacactaaag

SEQ ID NO: 495264 - DNA, 20 bp, mouse
gcaaatcttcaggtgcacct

SEQ ID NO: 495265 - DNA, 20 bp, mouse
gcttacctgcccggcatgtc

SEQ ID NO: 495266 - DNA, 20 bp, mouse
gagatgcagcaaggacgtca

SEQ ID NO: 495267 - DNA, 20 bp, mouse
gtcatggcaggcctgattac

SEQ ID NO: 495268 - DNA, 20 bp, mouse
gactgggcctaagaggtatc

SEQ ID NO: 495269 - DNA, 20 bp, mouse
ggcagcaaggacgtcatggc

SEQ ID NO: 495270 - DNA, 20 bp, mouse
gctcgattcatccggtaatc

SEQ ID NO: 495271 - DNA, 20 bp, mouse
gtagtcatggaatttggcct

SEQ ID NO: 495272 - DNA, 20 bp, mouse
gacaatggtgcctctttgga

SEQ ID NO: 495273 - DNA, 20 bp, mouse
ggattgtttatcagtctgtg

SEQ ID NO: 495274 - DNA, 20 bp, mouse
ggagtacaatggtgcctctt

SEQ ID NO: 495275 - DNA, 20 bp, mouse
gcccagtgcctcgattcatc

SEQ ID NO: 495276 - DNA, 20 bp, mouse
gaagccatgttccactctac

SEQ ID NO: 495277 - DNA, 20 bp, mouse
gagagccccagccagtagag

SEQ ID NO: 495278 - DNA, 20 bp, mouse
ggggctcttccacaattgag

SEQ ID NO: 495279 - DNA, 20 bp, mouse
gcatgaagcccgtccactgg

SEQ ID NO: 495280 - DNA, 20 bp, mouse
gacgggccaggtgcaggact

SEQ ID NO: 495281 - DNA, 20 bp, mouse
ggcccaggagaaagcctctg

SEQ ID NO: 495282 - DNA, 20 bp, mouse
gagcccgtccactggaggca

SEQ ID NO: 495283 - DNA, 20 bp, mouse
gatccttaggacactgactg

SEQ ID NO: 495284 - DNA, 20 bp, mouse
gttactaaccctgcctccag

SEQ ID NO: 495285 - DNA, 20 bp, mouse
gaaccctgcctccagtggac

SEQ ID NO: 495286 - DNA, 20 bp, mouse
gctcaggacccatatcagcg

SEQ ID NO: 495287 - DNA, 20 bp, mouse
gagatcaatcttgcagcaat

SEQ ID NO: 495288 - DNA, 20 bp, mouse
ggtggacatgggaatgagca

SEQ ID NO: 495289 - DNA, 20 bp, mouse
gtgctggtgatgtccctgca

SEQ ID NO: 495290 - DNA, 20 bp, mouse
gtcctgtgaggatttcttgt

SEQ ID NO: 495291 - DNA, 20 bp, mouse
gtaagaacctagcagatgtt

SEQ ID NO: 495292 - DNA, 20 bp, mouse
gtgttaggacattggagatg

SEQ ID NO: 495293 - DNA, 20 bp, mouse
gcaatttgcatataaactgg

SEQ ID NO: 495294 - DNA, 20 bp, mouse
ggaggaagtggatgtggaca

SEQ ID NO: 495295 - DNA, 20 bp, mouse
gggacccatatcagcgaggc

SEQ ID NO: 495296 - DNA, 20 bp, mouse
gggaggacacttaacatctc

SEQ ID NO: 495297 - DNA, 20 bp, mouse
gaggtgacagcccagtgcgg

SEQ ID NO: 495298 - DNA, 20 bp, mouse
gttagaagaacggagctctt

SEQ ID NO: 495299 - DNA, 20 bp, mouse
gaagggctttgcgcctggga

SEQ ID NO: 495300 - DNA, 20 bp, mouse
gatctgaccgcctccttccc

SEQ ID NO: 495301 - DNA, 20 bp, mouse
gctgaggaggcgggagacgt

SEQ ID NO: 495302 - DNA, 20 bp, mouse
gttctaagggctttgcgcct

SEQ ID NO: 495303 - DNA, 20 bp, mouse
gtagagagttcttgagaaag

SEQ ID NO: 495304 - DNA, 20 bp, mouse
gccctgactagataaaagga

SEQ ID NO: 495305 - DNA, 20 bp, mouse
ggttaagtgtcctccgcact

SEQ ID NO: 495306 - DNA, 20 bp, mouse
gcgggtcgaagccctagctg

SEQ ID NO: 495307 - DNA, 20 bp, mouse
ggctagggcttcgacccgga

SEQ ID NO: 495308 - DNA, 20 bp, mouse
gcccggagggcgcccacgcc

SEQ ID NO: 495309 - DNA, 20 bp, mouse
gacgcgcggtcaggcgggaa

SEQ ID NO: 495310 - DNA, 20 bp, mouse
gggaagggactgcccggcgt

SEQ ID NO: 495311 - DNA, 20 bp, mouse
gcagctctgggactgccagt

SEQ ID NO: 495312 - DNA, 20 bp, mouse
gcccggaacacggaacacat

SEQ ID NO: 495313 - DNA, 20 bp, mouse
gggcggacgcgcggtcaggc

SEQ ID NO: 495314 - DNA, 20 bp, mouse
ggatctggcaattcctgagg

SEQ ID NO: 495315 - DNA, 20 bp, mouse
gcacagcctcctcctcagct

SEQ ID NO: 495316 - DNA, 20 bp, mouse
gtgacctatcagcaatgagg

SEQ ID NO: 495317 - DNA, 20 bp, mouse
gagcagaggaggagttccac

SEQ ID NO: 495318 - DNA, 20 bp, mouse
ggttaaggagacttctccaa

SEQ ID NO: 495319 - DNA, 20 bp, mouse
gccccttctggttacaatac

SEQ ID NO: 495320 - DNA, 20 bp, mouse
gaaggggatttctactgctg

SEQ ID NO: 495321 - DNA, 20 bp, mouse
gtccagtattgtaaccagaa

SEQ ID NO: 495322 - DNA, 20 bp, mouse
gcctgtggacaatccccttc

SEQ ID NO: 495323 - DNA, 20 bp, mouse
gtcgattttggattggacaa

SEQ ID NO: 495324 - DNA, 20 bp, mouse
gcatgatttcgattttggat

SEQ ID NO: 495325 - DNA, 20 bp, mouse
gatgaggtggcaagcatgtc

SEQ ID NO: 495326 - DNA, 20 bp, mouse
gcggctcaacaagttagaac

SEQ ID NO: 495327 - DNA, 20 bp, mouse
ggccacagaatatgtacact

SEQ ID NO: 495328 - DNA, 20 bp, mouse
gtcccagtgtacatattctg

SEQ ID NO: 495329 - DNA, 20 bp, mouse
gaatacttgtcttaactgag

SEQ ID NO: 495330 - DNA, 20 bp, mouse
gaaagagcctgggatactat

SEQ ID NO: 495331 - DNA, 20 bp, mouse
gcttcaatgttgttgggcac

SEQ ID NO: 495332 - DNA, 20 bp, mouse
gattaacattataatttggg

SEQ ID NO: 495333 - DNA, 20 bp, mouse
gttgaatcccatagtatccc

SEQ ID NO: 495334 - DNA, 20 bp, mouse
ggttttagcaatcgcatcca

SEQ ID NO: 495335 - DNA, 20 bp, mouse
ggatttttgctttcattcta

SEQ ID NO: 495336 - DNA, 20 bp, mouse
gaagattctaggccgaggtc

SEQ ID NO: 495337 - DNA, 20 bp, mouse
gccgaggtctggcataatga

SEQ ID NO: 495338 - DNA, 20 bp, mouse
gctgagaagattctaggccg

SEQ ID NO: 495339 - DNA, 20 bp, mouse
gagcaatcctgaagcaacga

SEQ ID NO: 495340 - DNA, 20 bp, mouse
gtcagggggagacaacatag

SEQ ID NO: 495341 - DNA, 20 bp, mouse
gggctcaagggtgacctggt

SEQ ID NO: 495342 - DNA, 20 bp, mouse
gtaatgttctagtaattcag

SEQ ID NO: 495343 - DNA, 20 bp, mouse
gatagagccaggtatcagag

SEQ ID NO: 495344 - DNA, 20 bp, mouse
gcaaggtccactctgatacc

SEQ ID NO: 495345 - DNA, 20 bp, mouse
gggagacaacatagagggct

SEQ ID NO: 495346 - DNA, 20 bp, mouse
gtcggctctgaggcaagaga

SEQ ID NO: 495347 - DNA, 20 bp, mouse
gtttcacaggagtggggaaa

SEQ ID NO: 495348 - DNA, 20 bp, mouse
ggagactatagagtagagca

SEQ ID NO: 495349 - DNA, 20 bp, mouse
gcaagagctgttgaaagtct

SEQ ID NO: 495350 - DNA, 20 bp, mouse
gcagcgttgggatggttcca

SEQ ID NO: 495351 - DNA, 20 bp, mouse
gaactggcacaagtgaccct

SEQ ID NO: 495352 - DNA, 20 bp, mouse
ggtcctgactctgatcagga

SEQ ID NO: 495353 - DNA, 20 bp, mouse
gatggttatgcaggaaccca

SEQ ID NO: 495354 - DNA, 20 bp, mouse
gatggttccatggagacaac

SEQ ID NO: 495355 - DNA, 20 bp, mouse
gggatgggtttatcagcgtt

SEQ ID NO: 495356 - DNA, 20 bp, mouse
ggcagccctgaccccccgag

SEQ ID NO: 495357 - DNA, 20 bp, mouse
ggacctagggtcacaactga

SEQ ID NO: 495358 - DNA, 20 bp, mouse
gctagacagcctcccctcgg

SEQ ID NO: 495359 - DNA, 20 bp, mouse
gcccagctaagtaacagtga

SEQ ID NO: 495360 - DNA, 20 bp, mouse
gtcctcactgtcaagaccta

SEQ ID NO: 495361 - DNA, 20 bp, mouse
gacagtgacggccgaaccca

SEQ ID NO: 495362 - DNA, 20 bp, mouse
ggacggccgaacccaaggaa

SEQ ID NO: 495363 - DNA, 20 bp, mouse
gaccctaggtcttgacagtg

SEQ ID NO: 495364 - DNA, 20 bp, mouse
gttccctcagttgtgaccct

SEQ ID NO: 495365 - DNA, 20 bp, mouse
gatctgaatatccattcctt

SEQ ID NO: 495366 - DNA, 20 bp, mouse
gggccgtagcgccatgactg

SEQ ID NO: 495367 - DNA, 20 bp, mouse
gtcccgagcgagaagtggag

SEQ ID NO: 495368 - DNA, 20 bp, mouse
gctgtagtcgaccccagtca

SEQ ID NO: 495369 - DNA, 20 bp, mouse
gctgcatcccgagcgagaag

SEQ ID NO: 495370 - DNA, 20 bp, mouse
gaatagcagctgtggacgag

SEQ ID NO: 495371 - DNA, 20 bp, mouse
ggaccccagtcatggcgcta

SEQ ID NO: 495372 - DNA, 20 bp, mouse
ggtatgaaaaatagcagctg

SEQ ID NO: 495373 - DNA, 20 bp, mouse
ggcctctccacttctcgctc

SEQ ID NO: 495374 - DNA, 20 bp, mouse
gcaggccactccagcagcgt

SEQ ID NO: 495375 - DNA, 20 bp, mouse
gtgctggagtggcctgctcg

SEQ ID NO: 495376 - DNA, 20 bp, mouse
gcagactccaagccccacaa

SEQ ID NO: 495377 - DNA, 20 bp, mouse
gccattatgagagaaaatgt

SEQ ID NO: 495378 - DNA, 20 bp, mouse
gaaaatgtgggtttacagag

SEQ ID NO: 495379 - DNA, 20 bp, mouse
gacaagggcaaatacaaaag

SEQ ID NO: 495380 - DNA, 20 bp, mouse
gtaaggcagcagttgtgacc

SEQ ID NO: 495381 - DNA, 20 bp, mouse
ggtttgatacacagtttgta

SEQ ID NO: 495382 - DNA, 20 bp, mouse
gattccaaatgaatccaggt

SEQ ID NO: 495383 - DNA, 20 bp, mouse
ggaacctacctggattcatt

SEQ ID NO: 495384 - DNA, 20 bp, mouse
gagtttctgagacctttgat

SEQ ID NO: 495385 - DNA, 20 bp, mouse
gttgtactctggaacctacc

SEQ ID NO: 495386 - DNA, 20 bp, mouse
gtccaggtgatgcatggtca

SEQ ID NO: 495387 - DNA, 20 bp, mouse
gagtatgtggccggaagtcc

SEQ ID NO: 495388 - DNA, 20 bp, mouse
gtgatgcatggtcagggtta

SEQ ID NO: 495389 - DNA, 20 bp, mouse
gctcctggtggcagttcagg

SEQ ID NO: 495390 - DNA, 20 bp, mouse
gctcgtgaggtcgtagcttc

SEQ ID NO: 495391 - DNA, 20 bp, mouse
gaccctgaccatgcatcacc

SEQ ID NO: 495392 - DNA, 20 bp, mouse
gaggagtagagtcatgagca

SEQ ID NO: 495393 - DNA, 20 bp, mouse
ggaagagaaaagatgtactg

SEQ ID NO: 495394 - DNA, 20 bp, mouse
gattgaaactacagaaataa

SEQ ID NO: 495395 - DNA, 20 bp, mouse
ggtagccccgtcagcttcat

SEQ ID NO: 495396 - DNA, 20 bp, mouse
gtttgagctggagttcatca

SEQ ID NO: 495397 - DNA, 20 bp, mouse
ggaactccagctcaaacgtc

SEQ ID NO: 495398 - DNA, 20 bp, mouse
gtctggggacagctgtccag

SEQ ID NO: 495399 - DNA, 20 bp, mouse
gaagcaggatcagatcattg

SEQ ID NO: 495400 - DNA, 20 bp, mouse
gtctgagccaggcagtgtct

SEQ ID NO: 495401 - DNA, 20 bp, mouse
gctccagctcaaacgtctgg

SEQ ID NO: 495402 - DNA, 20 bp, mouse
gacaagggtgagcaggaagg

SEQ ID NO: 495403 - DNA, 20 bp, mouse
gtggctcagagagcggccaa

SEQ ID NO: 495404 - DNA, 20 bp, mouse
gggtcccagtatagaagcaa

SEQ ID NO: 495405 - DNA, 20 bp, mouse
gcactgcctggctcagagag

SEQ ID NO: 495406 - DNA, 20 bp, mouse
gaagtaccagacagaattgg

SEQ ID NO: 495407 - DNA, 20 bp, mouse
gtctaagtaccagacagaat

SEQ ID NO: 495408 - DNA, 20 bp, mouse
gaagatggtggtgctatcga

SEQ ID NO: 495409 - DNA, 20 bp, mouse
gatctgtgggttcatttaga

SEQ ID NO: 495410 - DNA, 20 bp, mouse
gttttacccccaattctgtc

SEQ ID NO: 495411 - DNA, 20 bp, mouse
gagcaacatagaccatgcgt

SEQ ID NO: 495412 - DNA, 20 bp, mouse
gggcccaccctgtagccaag

SEQ ID NO: 495413 - DNA, 20 bp, mouse
gtacctcttggctacagggt

SEQ ID NO: 495414 - DNA, 20 bp, mouse
gcctgtagccaagaggtata

SEQ ID NO: 495415 - DNA, 20 bp, mouse
gcagtggcaaagttctaaaa

SEQ ID NO: 495416 - DNA, 20 bp, mouse
gtgtatcacacagccctccg

SEQ ID NO: 495417 - DNA, 20 bp, mouse
gtgctggaagaggcccaagt

SEQ ID NO: 495418 - DNA, 20 bp, mouse
gccctctgttaggtgggaga

SEQ ID NO: 495419 - DNA, 20 bp, mouse
gccactcccgatggcatcac

SEQ ID NO: 495420 - DNA, 20 bp, mouse
gtggaagaggcccaagttgg

SEQ ID NO: 495421 - DNA, 20 bp, mouse
gtgcagaggatcagacctga

SEQ ID NO: 495422 - DNA, 20 bp, mouse
gcctcatagacatggctgga

SEQ ID NO: 495423 - DNA, 20 bp, mouse
gtttaatctgatactttccc

SEQ ID NO: 495424 - DNA, 20 bp, mouse
gccataagttctgtgtcact

SEQ ID NO: 495425 - DNA, 20 bp, mouse
gagcacagtggaacttggac

SEQ ID NO: 495426 - DNA, 20 bp, mouse
gcgcagagaccgctgaagcg

SEQ ID NO: 495427 - DNA, 20 bp, mouse
gtcggctagaattttcgtga

SEQ ID NO: 495428 - DNA, 20 bp, mouse
gcgaaaattctagccgaggg

SEQ ID NO: 495429 - DNA, 20 bp, mouse
gccccagaggagcgagctcg

SEQ ID NO: 495430 - DNA, 20 bp, mouse
gaggatacagccatccaggg

SEQ ID NO: 495431 - DNA, 20 bp, mouse
gtgaccaggacagtctgtgt

SEQ ID NO: 495432 - DNA, 20 bp, mouse
ggcagtgctatactccacat

SEQ ID NO: 495433 - DNA, 20 bp, mouse
gaacttagctccacctccct

SEQ ID NO: 495434 - DNA, 20 bp, mouse
ggagatagacaatgccccag

SEQ ID NO: 495435 - DNA, 20 bp, mouse
ggatggctgtatcctggtgg

SEQ ID NO: 495436 - DNA, 20 bp, mouse
ggtgtagcctgggtctgcag

SEQ ID NO: 495437 - DNA, 20 bp, mouse
gcaagtgatgactttaaggt

SEQ ID NO: 495438 - DNA, 20 bp, mouse
ggccacaagtgatgacttta

SEQ ID NO: 495439 - DNA, 20 bp, mouse
gaagccccctgaaaaactgg

SEQ ID NO: 495440 - DNA, 20 bp, mouse
gaactcagggtatctgatca

SEQ ID NO: 495441 - DNA, 20 bp, mouse
ggaactctcctgctctggtc

SEQ ID NO: 495442 - DNA, 20 bp, mouse
gtcagataccctgagttcca

SEQ ID NO: 495443 - DNA, 20 bp, mouse
ggtaagtaggtggtggcagt

SEQ ID NO: 495444 - DNA, 20 bp, mouse
gtactgagcctgaccagagc

SEQ ID NO: 495445 - DNA, 20 bp, mouse
gtcttcctccagtttttcag

SEQ ID NO: 495446 - DNA, 20 bp, mouse
gggtctccagagtacaggag

SEQ ID NO: 495447 - DNA, 20 bp, mouse
gtcagaagccggctgctcac

SEQ ID NO: 495448 - DNA, 20 bp, mouse
ggtacaggagaggtggtgcg

SEQ ID NO: 495449 - DNA, 20 bp, mouse
ggagaccaggcgctcaggac

SEQ ID NO: 495450 - DNA, 20 bp, mouse
gacaggtgagtggaccacca

SEQ ID NO: 495451 - DNA, 20 bp, mouse
gccgccaagaggaggatcgg

SEQ ID NO: 495452 - DNA, 20 bp, mouse
gctgcggggcgtgcagaggt

SEQ ID NO: 495453 - DNA, 20 bp, mouse
ggacgcggtgcggtcaccaa

SEQ ID NO: 495454 - DNA, 20 bp, mouse
gagaagtctggaactgatgg

SEQ ID NO: 495455 - DNA, 20 bp, mouse
gccaagaagtctggaactga

SEQ ID NO: 495456 - DNA, 20 bp, mouse
gattgaggcttgagtacatc

SEQ ID NO: 495457 - DNA, 20 bp, mouse
gtatagtttgaacagttatg

SEQ ID NO: 495458 - DNA, 20 bp, mouse
gaaagcctgaggatgatgaa

SEQ ID NO: 495459 - DNA, 20 bp, mouse
gaattcctaagaaaaattca

SEQ ID NO: 495460 - DNA, 20 bp, mouse
gtctcctataatggtattca

SEQ ID NO: 495461 - DNA, 20 bp, mouse
gacaccatgaataccattat

SEQ ID NO: 495462 - DNA, 20 bp, mouse
gcatgacaaaatccattatg

SEQ ID NO: 495463 - DNA, 20 bp, mouse
ggaaagtttatctcctataa

SEQ ID NO: 495464 - DNA, 20 bp, mouse
gagttgagttttaaagcctg

SEQ ID NO: 495465 - DNA, 20 bp, mouse
gaatcttttttgtgctgctc

SEQ ID NO: 495466 - DNA, 20 bp, mouse
gcctgaagtcgtcatcctgg

SEQ ID NO: 495467 - DNA, 20 bp, mouse
ggcgcctgaagtcgtcatcc

SEQ ID NO: 495468 - DNA, 20 bp, mouse
gaaaactgttccaggcccct

SEQ ID NO: 495469 - DNA, 20 bp, mouse
gcagcactgggcggtgaggg

SEQ ID NO: 495470 - DNA, 20 bp, mouse
gtttcagcactgggcggtga

SEQ ID NO: 495471 - DNA, 20 bp, mouse
gcacgtagaccctcccactg

SEQ ID NO: 495472 - DNA, 20 bp, mouse
gcagtgacccaggcatgggg

SEQ ID NO: 495473 - DNA, 20 bp, mouse
gtgggtcactgggagcaagt

SEQ ID NO: 495474 - DNA, 20 bp, mouse
gtgggagcaagtgggagtag

SEQ ID NO: 495475 - DNA, 20 bp, mouse
gacctcagtgccccagtggg

SEQ ID NO: 495476 - DNA, 20 bp, mouse
gctgccgggaagctacactc

SEQ ID NO: 495477 - DNA, 20 bp, mouse
gcaatctagcgcaccgggag

SEQ ID NO: 495478 - DNA, 20 bp, mouse
ggggtcagccggagagtcgt

SEQ ID NO: 495479 - DNA, 20 bp, mouse
ggccatcggggagcgatcag

SEQ ID NO: 495480 - DNA, 20 bp, mouse
gcccggcagcccctaacacc

SEQ ID NO: 495481 - DNA, 20 bp, mouse
ggtcgcgctccgggtgttag

SEQ ID NO: 495482 - DNA, 20 bp, mouse
ggagaagcaacgaaccctgg

SEQ ID NO: 495483 - DNA, 20 bp, mouse
gggtcccgagtgtagcttcc

SEQ ID NO: 495484 - DNA, 20 bp, mouse
gtacactcgggacccttaac

SEQ ID NO: 495485 - DNA, 20 bp, mouse
gcgggccccaggaaaaactt

SEQ ID NO: 495486 - DNA, 20 bp, mouse
gtgggtgttagcatctgcca

SEQ ID NO: 495487 - DNA, 20 bp, mouse
gaaattgatgaggatattta

SEQ ID NO: 495488 - DNA, 20 bp, mouse
ggataatgccttgtaaaatg

SEQ ID NO: 495489 - DNA, 20 bp, mouse
gcatcaatttacaatatctg

SEQ ID NO: 495490 - DNA, 20 bp, mouse
gaagcaaaccacattttaca

SEQ ID NO: 495491 - DNA, 20 bp, mouse
gtatcctccgtagtagcaca

SEQ ID NO: 495492 - DNA, 20 bp, mouse
gacaccatgtgctactacgg

SEQ ID NO: 495493 - DNA, 20 bp, mouse
gcatctgaagtgaagaaagt

SEQ ID NO: 495494 - DNA, 20 bp, mouse
gaaattagagagaaagaaca

SEQ ID NO: 495495 - DNA, 20 bp, mouse
gttagagagaaagaacaggg

SEQ ID NO: 495496 - DNA, 20 bp, mouse
ggccaagctaggcactcggg

SEQ ID NO: 495497 - DNA, 20 bp, mouse
gaagagtcttccgagacgcg

SEQ ID NO: 495498 - DNA, 20 bp, mouse
gaagctaggcactcgggtgg

SEQ ID NO: 495499 - DNA, 20 bp, mouse
gaatgccaagctaggcactc

SEQ ID NO: 495500 - DNA, 20 bp, mouse
gagaatgttggtgattagct

SEQ ID NO: 495501 - DNA, 20 bp, mouse
ggagagagaaaggtctgtgt

SEQ ID NO: 495502 - DNA, 20 bp, mouse
gtgtacaagctgaagagcag

SEQ ID NO: 495503 - DNA, 20 bp, mouse
gtaagccttagaagagctgg

SEQ ID NO: 495504 - DNA, 20 bp, mouse
gtaaggcttaggcttagggt

SEQ ID NO: 495505 - DNA, 20 bp, mouse
gcatgccaccagctcttcta

SEQ ID NO: 495506 - DNA, 20 bp, mouse
gtcaggaccaccatcacctg

SEQ ID NO: 495507 - DNA, 20 bp, mouse
ggcttcatcaccccaggtga

SEQ ID NO: 495508 - DNA, 20 bp, mouse
gaccttctcagcgacagtgc

SEQ ID NO: 495509 - DNA, 20 bp, mouse
gtcatcaccccaggtgatgg

SEQ ID NO: 495510 - DNA, 20 bp, mouse
ggcccgcactgtcgctgaga

SEQ ID NO: 495511 - DNA, 20 bp, mouse
ggccacggcttcatcacccc

SEQ ID NO: 495512 - DNA, 20 bp, mouse
gttcctgcacatctctgatg

SEQ ID NO: 495513 - DNA, 20 bp, mouse
gcagcttctcgttcttgggc

SEQ ID NO: 495514 - DNA, 20 bp, mouse
gttccacatcagagatgtgc

SEQ ID NO: 495515 - DNA, 20 bp, mouse
gggaggaggctcagatgaca

SEQ ID NO: 495516 - DNA, 20 bp, mouse
gagcagagacatgtccacac

SEQ ID NO: 495517 - DNA, 20 bp, mouse
ggcttgctgagacagatcaa

SEQ ID NO: 495518 - DNA, 20 bp, mouse
gcctcccctgggacagacct

SEQ ID NO: 495519 - DNA, 20 bp, mouse
gatgtacagacaacacactc

SEQ ID NO: 495520 - DNA, 20 bp, mouse
ggattctagaagagagaact

SEQ ID NO: 495521 - DNA, 20 bp, mouse
gtgtggaagatccacccata

SEQ ID NO: 495522 - DNA, 20 bp, mouse
gaggctagatacagcatcct

SEQ ID NO: 495523 - DNA, 20 bp, mouse
gacatgtccacactggaagc

SEQ ID NO: 495524 - DNA, 20 bp, mouse
ggggtcaggcccaggagcaa

SEQ ID NO: 495525 - DNA, 20 bp, mouse
ggatcttccacaagccccca

SEQ ID NO: 495526 - DNA, 20 bp, mouse
ggataagcctgggcctaagt

SEQ ID NO: 495527 - DNA, 20 bp, mouse
gcagcccgactgtccaactt

SEQ ID NO: 495528 - DNA, 20 bp, mouse
ggggcctaagttggacagtc

SEQ ID NO: 495529 - DNA, 20 bp, mouse
gtgaagagctgctgatgagg

SEQ ID NO: 495530 - DNA, 20 bp, mouse
ggaagtgcatggataagcct

SEQ ID NO: 495531 - DNA, 20 bp, mouse
gatgctgagatcagtcagaa

SEQ ID NO: 495532 - DNA, 20 bp, mouse
gtgaagaaatggctatgggg

SEQ ID NO: 495533 - DNA, 20 bp, mouse
gctttctgagaagacgggtt

SEQ ID NO: 495534 - DNA, 20 bp, mouse
gaattgaagagctgctgatg

SEQ ID NO: 495535 - DNA, 20 bp, mouse
gcaagacgataaagaaaatt

SEQ ID NO: 495536 - DNA, 20 bp, mouse
gtcgtgcgcaggcaccaggt

SEQ ID NO: 495537 - DNA, 20 bp, mouse
ggagggctcgggccaacaca

SEQ ID NO: 495538 - DNA, 20 bp, mouse
gaggctgtagtggaagactc

SEQ ID NO: 495539 - DNA, 20 bp, mouse
gaccagagcgtcgttgagag

SEQ ID NO: 495540 - DNA, 20 bp, mouse
gatgtgttcccaggctgtag

SEQ ID NO: 495541 - DNA, 20 bp, mouse
gtacagtgctacggccacta

SEQ ID NO: 495542 - DNA, 20 bp, mouse
gtcgtggcaggacactctca

SEQ ID NO: 495543 - DNA, 20 bp, mouse
gggaagactctggcgaagct

SEQ ID NO: 495544 - DNA, 20 bp, mouse
ggggctcgtgcgcaggcacc

SEQ ID NO: 495545 - DNA, 20 bp, mouse
gacctctctcaacgacgctc

SEQ ID NO: 495546 - DNA, 20 bp, mouse
gtccgccatggccaagtacc

SEQ ID NO: 495547 - DNA, 20 bp, mouse
gtaggtgttcataattcttc

SEQ ID NO: 495548 - DNA, 20 bp, mouse
ggcaaaagacatttattact

SEQ ID NO: 495549 - DNA, 20 bp, mouse
gaaaaaaaaaagagtttcgg

SEQ ID NO: 495550 - DNA, 20 bp, mouse
gtcaaaggttgtccgtgcaa

SEQ ID NO: 495551 - DNA, 20 bp, mouse
gtgatgggtgtgcaggtggt

SEQ ID NO: 495552 - DNA, 20 bp, mouse
gtgcctcagggccctggcaa

SEQ ID NO: 495553 - DNA, 20 bp, mouse
gtaaagtggagcgtccgcca

SEQ ID NO: 495554 - DNA, 20 bp, mouse
gggcacccgtccccctaaag

SEQ ID NO: 495555 - DNA, 20 bp, mouse
ggcggacgctccactttagg

SEQ ID NO: 495556 - DNA, 20 bp, mouse
gcccggcgccctgcttcccg

SEQ ID NO: 495557 - DNA, 20 bp, mouse
gtaccgcgcctcgggaagca

SEQ ID NO: 495558 - DNA, 20 bp, mouse
ggtagagcgcaagagcgcgc

SEQ ID NO: 495559 - DNA, 20 bp, mouse
gacgcggccggagggtctcc

SEQ ID NO: 495560 - DNA, 20 bp, mouse
ggacccaaggaccctcgcgg

SEQ ID NO: 495561 - DNA, 20 bp, mouse
gcggaggcccggccggaccg

SEQ ID NO: 495562 - DNA, 20 bp, mouse
ggctcggacgcagctcgcta

SEQ ID NO: 495563 - DNA, 20 bp, mouse
ggtgaggacctgcggaggag

SEQ ID NO: 495564 - DNA, 20 bp, mouse
ggccggggcctggaaccctc

SEQ ID NO: 495565 - DNA, 20 bp, mouse
gggcgccgggctccacggtc

SEQ ID NO: 495566 - DNA, 20 bp, mouse
ggccattcaagatttcatac

SEQ ID NO: 495567 - DNA, 20 bp, mouse
ggtaagatttctcttctata

SEQ ID NO: 495568 - DNA, 20 bp, mouse
gcttctaagattgtatttct

SEQ ID NO: 495569 - DNA, 20 bp, mouse
gatgtgagaaaagtttcacc

SEQ ID NO: 495570 - DNA, 20 bp, mouse
gcttctaagagcacctttgt

SEQ ID NO: 495571 - DNA, 20 bp, mouse
gctttcaaatatagtgaatg

SEQ ID NO: 495572 - DNA, 20 bp, mouse
gacaaagactttacctacaa

SEQ ID NO: 495573 - DNA, 20 bp, mouse
gtcctgtatgaaatcttgaa

SEQ ID NO: 495574 - DNA, 20 bp, mouse
gcctttctcagtaaagcatt

SEQ ID NO: 495575 - DNA, 20 bp, mouse
gtctttgatgaactgtaaga

SEQ ID NO: 495576 - DNA, 20 bp, mouse
gagtagcaggaaccttggaa

SEQ ID NO: 495577 - DNA, 20 bp, mouse
ggaagggtagccatgatggt

SEQ ID NO: 495578 - DNA, 20 bp, mouse
gcgttataggaagggaccat

SEQ ID NO: 495579 - DNA, 20 bp, mouse
gcagagagatagaccgttat

SEQ ID NO: 495580 - DNA, 20 bp, mouse
gtgagcagtgcccaccatca

SEQ ID NO: 495581 - DNA, 20 bp, mouse
gactgctcacaggagcctgt

SEQ ID NO: 495582 - DNA, 20 bp, mouse
gcttggaagggtagccatga

SEQ ID NO: 495583 - DNA, 20 bp, mouse
gcccatctggtgattgtcag

SEQ ID NO: 495584 - DNA, 20 bp, mouse
gagatagaccgttataggaa

SEQ ID NO: 495585 - DNA, 20 bp, mouse
gtgactcaggaagccctgga

SEQ ID NO: 495586 - DNA, 20 bp, mouse
ggaggatccgagaagtctag

SEQ ID NO: 495587 - DNA, 20 bp, mouse
gcgcgggcctcgaaagtgat

SEQ ID NO: 495588 - DNA, 20 bp, mouse
gcttaactgatgctcctcct

SEQ ID NO: 495589 - DNA, 20 bp, mouse
ggcctcgaaagtgatcggaa

SEQ ID NO: 495590 - DNA, 20 bp, mouse
gggagggagcgtgtatttcc

SEQ ID NO: 495591 - DNA, 20 bp, mouse
gctcctcctaggtgcgtcaa

SEQ ID NO: 495592 - DNA, 20 bp, mouse
ggtccattgacgcacctagg

SEQ ID NO: 495593 - DNA, 20 bp, mouse
ggctgtccattgacgcacct

SEQ ID NO: 495594 - DNA, 20 bp, mouse
gaccattccgatcactttcg

SEQ ID NO: 495595 - DNA, 20 bp, mouse
gaaaacgcctctagacttct

SEQ ID NO: 495596 - DNA, 20 bp, mouse
gcgcctctgggccagtgaag

SEQ ID NO: 495597 - DNA, 20 bp, mouse
ggggcaggcgtcctcttcac

SEQ ID NO: 495598 - DNA, 20 bp, mouse
gtgcagtgctggatcgcctg

SEQ ID NO: 495599 - DNA, 20 bp, mouse
ggctgcggggtgggcacgag

SEQ ID NO: 495600 - DNA, 20 bp, mouse
gtcgacgccgctcccctgca

SEQ ID NO: 495601 - DNA, 20 bp, mouse
gcgctccagtgcacagctcc

SEQ ID NO: 495602 - DNA, 20 bp, mouse
gtcccggagagaggcagcgg

SEQ ID NO: 495603 - DNA, 20 bp, mouse
gagaggcagcggcggtccag

SEQ ID NO: 495604 - DNA, 20 bp, mouse
ggctgttgggcatacagact

SEQ ID NO: 495605 - DNA, 20 bp, mouse
ggcactggagcggcgcctct

SEQ ID NO: 495606 - DNA, 20 bp, mouse
gggtggcggccttgggaaga

SEQ ID NO: 495607 - DNA, 20 bp, mouse
gcgaggcagcgccggcgtcc

SEQ ID NO: 495608 - DNA, 20 bp, mouse
gaagcagcagtaccaggtct

SEQ ID NO: 495609 - DNA, 20 bp, mouse
gtaaagtcccgaggcagcgc

SEQ ID NO: 495610 - DNA, 20 bp, mouse
ggttgagctggacctagacc

SEQ ID NO: 495611 - DNA, 20 bp, mouse
gcccgagctggaggttgagc

SEQ ID NO: 495612 - DNA, 20 bp, mouse
gaggaagctccagcatgtcc

SEQ ID NO: 495613 - DNA, 20 bp, mouse
gctggagctccgggacatgc

SEQ ID NO: 495614 - DNA, 20 bp, mouse
gtgatccttggtcacattcc

SEQ ID NO: 495615 - DNA, 20 bp, mouse
gggtggtttggatttggagc

SEQ ID NO: 495616 - DNA, 20 bp, mouse
gaattggaggggactcagga

SEQ ID NO: 495617 - DNA, 20 bp, mouse
gtgacaatcggtcaaatcag

SEQ ID NO: 495618 - DNA, 20 bp, mouse
ggaggtagggataacagacg

SEQ ID NO: 495619 - DNA, 20 bp, mouse
ggtggtaaccaaagaaatag

SEQ ID NO: 495620 - DNA, 20 bp, mouse
gcattcctcaacaattggag

SEQ ID NO: 495621 - DNA, 20 bp, mouse
gacagtatggccacaaccag

SEQ ID NO: 495622 - DNA, 20 bp, mouse
gagggcgtttcaagtattcc

SEQ ID NO: 495623 - DNA, 20 bp, mouse
gaaagatgacaaagaatacc

SEQ ID NO: 495624 - DNA, 20 bp, mouse
gcaacaattggaggggactc

SEQ ID NO: 495625 - DNA, 20 bp, mouse
gtcagtggcatggacggtca

SEQ ID NO: 495626 - DNA, 20 bp, mouse
gagcgccaacggcgttaaaa

SEQ ID NO: 495627 - DNA, 20 bp, mouse
gatttgatgagagaaaaagt

SEQ ID NO: 495628 - DNA, 20 bp, mouse
gttaaaacttcaaaagcgtc

SEQ ID NO: 495629 - DNA, 20 bp, mouse
gatattaaagaggatccgga

SEQ ID NO: 495630 - DNA, 20 bp, mouse
gaaatcaaggggttgtggcg

SEQ ID NO: 495631 - DNA, 20 bp, mouse
gttctccattttaacgccgt

SEQ ID NO: 495632 - DNA, 20 bp, mouse
ggatgcggaaggaaaatcaa

SEQ ID NO: 495633 - DNA, 20 bp, mouse
gaacccagatcccacatcgg

SEQ ID NO: 495634 - DNA, 20 bp, mouse
ggccgggcactgcagcgaac

SEQ ID NO: 495635 - DNA, 20 bp, mouse
ggttggtgaggttacatacg

SEQ ID NO: 495636 - DNA, 20 bp, mouse
gtcggtgtcgctctctccct

SEQ ID NO: 495637 - DNA, 20 bp, mouse
gtctctccctcggctgctgg

SEQ ID NO: 495638 - DNA, 20 bp, mouse
gcgccgcctccagcagccga

SEQ ID NO: 495639 - DNA, 20 bp, mouse
gcgcagtttgagcagtgatt

SEQ ID NO: 495640 - DNA, 20 bp, mouse
gctgccggtggccacggtgt

SEQ ID NO: 495641 - DNA, 20 bp, mouse
gtggctagctaagaaggaaa

SEQ ID NO: 495642 - DNA, 20 bp, mouse
gctgggccttgctggatgtt

SEQ ID NO: 495643 - DNA, 20 bp, mouse
gcaggcctgttggcagtgaa

SEQ ID NO: 495644 - DNA, 20 bp, mouse
gctgctggaggcggcgctct

SEQ ID NO: 495645 - DNA, 20 bp, mouse
ggctcaaactgcggaggcag

SEQ ID NO: 495646 - DNA, 20 bp, mouse
gcatgttggctactagcccg

SEQ ID NO: 495647 - DNA, 20 bp, mouse
gactcccaaggtggccaaac

SEQ ID NO: 495648 - DNA, 20 bp, mouse
gggccacatgatctttgatc

SEQ ID NO: 495649 - DNA, 20 bp, mouse
ggcccagatcaaagatcatg

SEQ ID NO: 495650 - DNA, 20 bp, mouse
gtagcaggccgcatgctggg

SEQ ID NO: 495651 - DNA, 20 bp, mouse
gtggaggatgaggccaccct

SEQ ID NO: 495652 - DNA, 20 bp, mouse
gggctcgccgctggaggatg

SEQ ID NO: 495653 - DNA, 20 bp, mouse
ggtgagaggtcagactccca

SEQ ID NO: 495654 - DNA, 20 bp, mouse
gctcgggctggaaaagtgag

SEQ ID NO: 495655 - DNA, 20 bp, mouse
gcagggcctctacgccacac

SEQ ID NO: 495656 - DNA, 20 bp, mouse
gtaccatcaagggcatgatt

SEQ ID NO: 495657 - DNA, 20 bp, mouse
gagggcatgattaaactcct

SEQ ID NO: 495658 - DNA, 20 bp, mouse
ggacctaatcatgcccttga

SEQ ID NO: 495659 - DNA, 20 bp, mouse
gttgacatgatgaaatgccc

SEQ ID NO: 495660 - DNA, 20 bp, mouse
gtcttcctccacatcatgag

SEQ ID NO: 495661 - DNA, 20 bp, mouse
gccaagaccccctcatgatg

SEQ ID NO: 495662 - DNA, 20 bp, mouse
gttgatggtaaaatataaaa

SEQ ID NO: 495663 - DNA, 20 bp, mouse
ggaaatcgccagctttgata

SEQ ID NO: 495664 - DNA, 20 bp, mouse
gagaccccctcatgatgtgg

SEQ ID NO: 495665 - DNA, 20 bp, mouse
ggggggtcttggagatgatg

SEQ ID NO: 495666 - DNA, 20 bp, mouse
ggatcgaacgagacactgtc

SEQ ID NO: 495667 - DNA, 20 bp, mouse
gcaatagagacactaccggg

SEQ ID NO: 495668 - DNA, 20 bp, mouse
gttgcaatagagacactacc

SEQ ID NO: 495669 - DNA, 20 bp, mouse
ggacactaccgggcggtcgc

SEQ ID NO: 495670 - DNA, 20 bp, mouse
gtggagactggacgagaacc

SEQ ID NO: 495671 - DNA, 20 bp, mouse
gcagagccctgcttaatgga

SEQ ID NO: 495672 - DNA, 20 bp, mouse
gaatgacctcggcagacaca

SEQ ID NO: 495673 - DNA, 20 bp, mouse
ggagtcctcagcaatgatgt

SEQ ID NO: 495674 - DNA, 20 bp, mouse
gccaggaggtccctgacgtt

SEQ ID NO: 495675 - DNA, 20 bp, mouse
gtccacctggtgaatgacct

SEQ ID NO: 495676 - DNA, 20 bp, mouse
gcgtcaccgccggaaagcaa

SEQ ID NO: 495677 - DNA, 20 bp, mouse
gcttatcccttgctttccgg

SEQ ID NO: 495678 - DNA, 20 bp, mouse
ggaacttatcccttgctttc

SEQ ID NO: 495679 - DNA, 20 bp, mouse
gaagaacttatcccttggcc

SEQ ID NO: 495680 - DNA, 20 bp, mouse
gaaaaaaagaacttatccct

SEQ ID NO: 495681 - DNA, 20 bp, mouse
gttatcccttggccaggcag

SEQ ID NO: 495682 - DNA, 20 bp, mouse
ggaaggagatcctttgcgag

SEQ ID NO: 495683 - DNA, 20 bp, mouse
ggacagaaggatgctccttc

SEQ ID NO: 495684 - DNA, 20 bp, mouse
ggccaccactgcctggccaa

SEQ ID NO: 495685 - DNA, 20 bp, mouse
gcttcccaataaacacgttt

SEQ ID NO: 495686 - DNA, 20 bp, mouse
ggtcaaacaggatggtactg

SEQ ID NO: 495687 - DNA, 20 bp, mouse
gtcccccgaggcggcacgtc

SEQ ID NO: 495688 - DNA, 20 bp, mouse
gcgagctcagtcaaacagga

SEQ ID NO: 495689 - DNA, 20 bp, mouse
ggagccctccgggaatggag

SEQ ID NO: 495690 - DNA, 20 bp, mouse
ggaatggagcggacaggacg

SEQ ID NO: 495691 - DNA, 20 bp, mouse
gggacaggacgcggagccag

SEQ ID NO: 495692 - DNA, 20 bp, mouse
ggaggaacagtcccccgagg

SEQ ID NO: 495693 - DNA, 20 bp, mouse
gtgtccgctccattcccgga

SEQ ID NO: 495694 - DNA, 20 bp, mouse
ggagggctccaggcaccgca

SEQ ID NO: 495695 - DNA, 20 bp, mouse
gccaggcaccgcagggtcat

SEQ ID NO: 495696 - DNA, 20 bp, mouse
gcacctcccaaagagaggag

SEQ ID NO: 495697 - DNA, 20 bp, mouse
ggccccgtgacacttggtat

SEQ ID NO: 495698 - DNA, 20 bp, mouse
ggggtcacggggcctgatga

SEQ ID NO: 495699 - DNA, 20 bp, mouse
ggaccctgccccgtgacact

SEQ ID NO: 495700 - DNA, 20 bp, mouse
gttgtgctggtggcacgaga

SEQ ID NO: 495701 - DNA, 20 bp, mouse
gccccataccaagtgtcacg

SEQ ID NO: 495702 - DNA, 20 bp, mouse
gtgaaggatccccacaactt

SEQ ID NO: 495703 - DNA, 20 bp, mouse
gtctcctagaaagaacatgg

SEQ ID NO: 495704 - DNA, 20 bp, mouse
gctctgtgctttcaactcag

SEQ ID NO: 495705 - DNA, 20 bp, mouse
gtgtcacggggcagggtcac

SEQ ID NO: 495706 - DNA, 20 bp, mouse
gcgcccagcgaggaccctga

SEQ ID NO: 495707 - DNA, 20 bp, mouse
gagggtcgtggtcctcccca

SEQ ID NO: 495708 - DNA, 20 bp, mouse
gccctgagggcgcagagcgc

SEQ ID NO: 495709 - DNA, 20 bp, mouse
ggcacctggctggccgcacc

SEQ ID NO: 495710 - DNA, 20 bp, mouse
gccagccaggtgcggagccc

SEQ ID NO: 495711 - DNA, 20 bp, mouse
gtccacccgggctccgcacc

SEQ ID NO: 495712 - DNA, 20 bp, mouse
gtccccagggttcggaagat

SEQ ID NO: 495713 - DNA, 20 bp, mouse
gcagggttcggaagataggt

SEQ ID NO: 495714 - DNA, 20 bp, mouse
gtggatgcgacccagactgg

SEQ ID NO: 495715 - DNA, 20 bp, mouse
ggcaggtcaacgcagcgcga

SEQ ID NO: 495716 - DNA, 20 bp, mouse
ggaacaaaggatctaataag

SEQ ID NO: 495717 - DNA, 20 bp, mouse
gaagccacaagccaacagtg

SEQ ID NO: 495718 - DNA, 20 bp, mouse
gcaccatccagcctcactgt

SEQ ID NO: 495719 - DNA, 20 bp, mouse
gggcttgctcatggcttcag

SEQ ID NO: 495720 - DNA, 20 bp, mouse
gaagtcaccttacagaacaa

SEQ ID NO: 495721 - DNA, 20 bp, mouse
ggctccaggacagcaaaaag

SEQ ID NO: 495722 - DNA, 20 bp, mouse
gttagatcctttgttctgta

SEQ ID NO: 495723 - DNA, 20 bp, mouse
gctaataaggggcttgctca

SEQ ID NO: 495724 - DNA, 20 bp, mouse
gactgtggcttgatggagaa

SEQ ID NO: 495725 - DNA, 20 bp, mouse
gaaaaggggaagaccaggcc

SEQ ID NO: 495726 - DNA, 20 bp, mouse
gccacaagatacctactgag

SEQ ID NO: 495727 - DNA, 20 bp, mouse
gggtggcagcacggatcagg

SEQ ID NO: 495728 - DNA, 20 bp, mouse
ggctggctatgatgaactgt

SEQ ID NO: 495729 - DNA, 20 bp, mouse
gggaacaaagatctgtacac

SEQ ID NO: 495730 - DNA, 20 bp, mouse
gcacggtggcagcacggatc

SEQ ID NO: 495731 - DNA, 20 bp, mouse
gaatgcagggtcgttcacgg

SEQ ID NO: 495732 - DNA, 20 bp, mouse
gcccgtgctcggcagcaaag

SEQ ID NO: 495733 - DNA, 20 bp, mouse
ggaccttcacagccttacga

SEQ ID NO: 495734 - DNA, 20 bp, mouse
gggagttacatacctgactt

SEQ ID NO: 495735 - DNA, 20 bp, mouse
gccaatggggtccctgaaag

SEQ ID NO: 495736 - DNA, 20 bp, mouse
gttcagctgccataagagga

SEQ ID NO: 495737 - DNA, 20 bp, mouse
gagcattcagctgccataag

SEQ ID NO: 495738 - DNA, 20 bp, mouse
gagtaggagacgatgaggtg

SEQ ID NO: 495739 - DNA, 20 bp, mouse
gggtagagatggagatgtgt

SEQ ID NO: 495740 - DNA, 20 bp, mouse
gagatggaattcaggtgtaa

SEQ ID NO: 495741 - DNA, 20 bp, mouse
gtggagatgtgtgggcgatc

SEQ ID NO: 495742 - DNA, 20 bp, mouse
ggactggccaagggggaagt

SEQ ID NO: 495743 - DNA, 20 bp, mouse
gggggaagtaggagacgatg

SEQ ID NO: 495744 - DNA, 20 bp, mouse
ggagcagggactggccaagg

SEQ ID NO: 495745 - DNA, 20 bp, mouse
gaaatgaggtgagcctgggg

SEQ ID NO: 495746 - DNA, 20 bp, mouse
gcctggcacagagtgatgga

SEQ ID NO: 495747 - DNA, 20 bp, mouse
gtgttctaaccagagcagaa

SEQ ID NO: 495748 - DNA, 20 bp, mouse
gttagaacagcaatgagaca

SEQ ID NO: 495749 - DNA, 20 bp, mouse
gctctctaaccattctgctc

SEQ ID NO: 495750 - DNA, 20 bp, mouse
gtgtaagacaagcggaagaa

SEQ ID NO: 495751 - DNA, 20 bp, mouse
gggaggattagaacaattcc

SEQ ID NO: 495752 - DNA, 20 bp, mouse
gccaaagctgtgcaaaccga

SEQ ID NO: 495753 - DNA, 20 bp, mouse
gcacagagtgatggatggct

SEQ ID NO: 495754 - DNA, 20 bp, mouse
gaagctgtgcaaaccgaggg

SEQ ID NO: 495755 - DNA, 20 bp, mouse
ggcaatgtgaaaacagacaa

SEQ ID NO: 495756 - DNA, 20 bp, mouse
ggtccaagtcacactagagg

SEQ ID NO: 495757 - DNA, 20 bp, mouse
gttctcaggaccttatgctt

SEQ ID NO: 495758 - DNA, 20 bp, mouse
ggcagtccaagtcacactag

SEQ ID NO: 495759 - DNA, 20 bp, mouse
gttctcaaaccagctctact

SEQ ID NO: 495760 - DNA, 20 bp, mouse
gggctttgctaggaacatcg

SEQ ID NO: 495761 - DNA, 20 bp, mouse
gtaccacctctagtgtgact

SEQ ID NO: 495762 - DNA, 20 bp, mouse
gtgctgaaacctagtagagc

SEQ ID NO: 495763 - DNA, 20 bp, mouse
ggtttgagaacccaagcata

SEQ ID NO: 495764 - DNA, 20 bp, mouse
gtgtatctgtataattgcaa

SEQ ID NO: 495765 - DNA, 20 bp, mouse
ggccaagaatcctccagctt

SEQ ID NO: 495766 - DNA, 20 bp, mouse
gtgaaggtagaacctgtgtg

SEQ ID NO: 495767 - DNA, 20 bp, mouse
gggcattgcaagaagactct

SEQ ID NO: 495768 - DNA, 20 bp, mouse
gcaagacccagtcttgggat

SEQ ID NO: 495769 - DNA, 20 bp, mouse
ggtcacagaaaataaacctc

SEQ ID NO: 495770 - DNA, 20 bp, mouse
gcctagtcagtaggattgtt

SEQ ID NO: 495771 - DNA, 20 bp, mouse
gataaacctcgggaagctga

SEQ ID NO: 495772 - DNA, 20 bp, mouse
gtaggattgttaggacgtgt

SEQ ID NO: 495773 - DNA, 20 bp, mouse
gggctgagggaaacagaatt

SEQ ID NO: 495774 - DNA, 20 bp, mouse
ggctttacttttcgacactg

SEQ ID NO: 495775 - DNA, 20 bp, mouse
gcagaatttggaacctaagg

SEQ ID NO: 495776 - DNA, 20 bp, mouse
ggctggtcgccaccaagtgt

SEQ ID NO: 495777 - DNA, 20 bp, mouse
gacgggaaggcgacatggag

SEQ ID NO: 495778 - DNA, 20 bp, mouse
gtggtggcgaccagcctcag

SEQ ID NO: 495779 - DNA, 20 bp, mouse
gcggagacgggaaggcgaca

SEQ ID NO: 495780 - DNA, 20 bp, mouse
ggactttctcctacacttgg

SEQ ID NO: 495781 - DNA, 20 bp, mouse
gtcctcagttcccaccgctg

SEQ ID NO: 495782 - DNA, 20 bp, mouse
gtggcgaccagcctcagcgg

SEQ ID NO: 495783 - DNA, 20 bp, mouse
ggcctgaggcaaagagcagt

SEQ ID NO: 495784 - DNA, 20 bp, mouse
ggaggatgcgaaaacctccc

SEQ ID NO: 495785 - DNA, 20 bp, mouse
gagctcaggacgcctgacct

SEQ ID NO: 495786 - DNA, 20 bp, mouse
gcggctgcgggtggcggtac

SEQ ID NO: 495787 - DNA, 20 bp, mouse
gagccgaggggaaaacgaga

SEQ ID NO: 495788 - DNA, 20 bp, mouse
gagcgggcgcgggcgtggag

SEQ ID NO: 495789 - DNA, 20 bp, mouse
ggagccgagagccggcgagt

SEQ ID NO: 495790 - DNA, 20 bp, mouse
gaggagattgcagcaaaacc

SEQ ID NO: 495791 - DNA, 20 bp, mouse
ggccggctctcggctctcgc

SEQ ID NO: 495792 - DNA, 20 bp, mouse
gcacccacccacccactcgc

SEQ ID NO: 495793 - DNA, 20 bp, mouse
gcccgctcgctgcagccgag

SEQ ID NO: 495794 - DNA, 20 bp, mouse
gaacccgagcgaggcagcca

SEQ ID NO: 495795 - DNA, 20 bp, mouse
ggagcccgagaccctcactc

SEQ ID NO: 495796 - DNA, 20 bp, mouse
ggagccggcgcgtgccgagg

SEQ ID NO: 495797 - DNA, 20 bp, mouse
gcggctggaggtaacctcaa

SEQ ID NO: 495798 - DNA, 20 bp, mouse
gcacgcgccggctccaactg

SEQ ID NO: 495799 - DNA, 20 bp, mouse
gtaccgccgggcctccgagg

SEQ ID NO: 495800 - DNA, 20 bp, mouse
gggagacccgcggagacccc

SEQ ID NO: 495801 - DNA, 20 bp, mouse
gcggcagcagagctaggagg

SEQ ID NO: 495802 - DNA, 20 bp, mouse
gggcctgcgagcaccggact

SEQ ID NO: 495803 - DNA, 20 bp, mouse
gccggcgcgtgccgaggcgg

SEQ ID NO: 495804 - DNA, 20 bp, mouse
gcggcggcagcagagctagg

SEQ ID NO: 495805 - DNA, 20 bp, mouse
gctcaagggccgagcccgaa

SEQ ID NO: 495806 - DNA, 20 bp, mouse
gaaattagggtcatttgagt

SEQ ID NO: 495807 - DNA, 20 bp, mouse
ggatcaattggaacaaatta

SEQ ID NO: 495808 - DNA, 20 bp, mouse
gtgtacctaggaacacaagg

SEQ ID NO: 495809 - DNA, 20 bp, mouse
gagaaaataatatcatatag

SEQ ID NO: 495810 - DNA, 20 bp, mouse
gagtaggtctcatgatcaat

SEQ ID NO: 495811 - DNA, 20 bp, mouse
gactctgtacaaggtctcat

SEQ ID NO: 495812 - DNA, 20 bp, mouse
gtggccatatcccataagga

SEQ ID NO: 495813 - DNA, 20 bp, mouse
gtcaatggccatatcccata

SEQ ID NO: 495814 - DNA, 20 bp, mouse
gtgcacgttgatgctgagat

SEQ ID NO: 495815 - DNA, 20 bp, mouse
gaataggcattttgataagt

SEQ ID NO: 495816 - DNA, 20 bp, mouse
ggtagagaataaagaagtcc

SEQ ID NO: 495817 - DNA, 20 bp, mouse
gtcacaaaaatgatttgacc

SEQ ID NO: 495818 - DNA, 20 bp, mouse
gtctttattctctactacac

SEQ ID NO: 495819 - DNA, 20 bp, mouse
ggtctaccgggagcgttggt

SEQ ID NO: 495820 - DNA, 20 bp, mouse
ggtccagaggcggaagtgaa

SEQ ID NO: 495821 - DNA, 20 bp, mouse
gaggtgtctaccgggagcgt

SEQ ID NO: 495822 - DNA, 20 bp, mouse
gctccctcccgggcgtccag

SEQ ID NO: 495823 - DNA, 20 bp, mouse
gcctcccgggcgtccagagg

SEQ ID NO: 495824 - DNA, 20 bp, mouse
gggagcgcggatgcagtgtg

SEQ ID NO: 495825 - DNA, 20 bp, mouse
ggaagtgaaaggtgtctacc

SEQ ID NO: 495826 - DNA, 20 bp, mouse
gggagggccatagacaacca

SEQ ID NO: 495827 - DNA, 20 bp, mouse
gggctggccacgaggctgac

SEQ ID NO: 495828 - DNA, 20 bp, mouse
gcagggacctgtcagcctcg

SEQ ID NO: 495829 - DNA, 20 bp, mouse
gtccggtgcactgtacagga

SEQ ID NO: 495830 - DNA, 20 bp, mouse
ggccatccggtgcactgtac

SEQ ID NO: 495831 - DNA, 20 bp, mouse
gggatggcaggtctgtgaca

SEQ ID NO: 495832 - DNA, 20 bp, mouse
gccaagccacacaacatgga

SEQ ID NO: 495833 - DNA, 20 bp, mouse
gaaggtctatttgtgctgtg

SEQ ID NO: 495834 - DNA, 20 bp, mouse
gacaggtccctggttgtcta

SEQ ID NO: 495835 - DNA, 20 bp, mouse
gtggcaggtctgtgacatgg

SEQ ID NO: 495836 - DNA, 20 bp, mouse
ggctaagtagccggcctcac

SEQ ID NO: 495837 - DNA, 20 bp, mouse
gggctaccgcgtgaatgcag

SEQ ID NO: 495838 - DNA, 20 bp, mouse
gactctaggtcgagacaggt

SEQ ID NO: 495839 - DNA, 20 bp, mouse
gttgttagcaatacccagat

SEQ ID NO: 495840 - DNA, 20 bp, mouse
gtttcggctagctcctatct

SEQ ID NO: 495841 - DNA, 20 bp, mouse
gctcggttcagtgaatccgg

SEQ ID NO: 495842 - DNA, 20 bp, mouse
gccgctgcaggtgtcgggag

SEQ ID NO: 495843 - DNA, 20 bp, mouse
gtggcgcccgctgcaggtgt

SEQ ID NO: 495844 - DNA, 20 bp, mouse
gggctacttagcgggagaga

SEQ ID NO: 495845 - DNA, 20 bp, mouse
gacggaccgaagccatggat

SEQ ID NO: 495846 - DNA, 20 bp, mouse
ggttgctcgggtcctgaggg

SEQ ID NO: 495847 - DNA, 20 bp, mouse
ggctccccgggccccagcgt

SEQ ID NO: 495848 - DNA, 20 bp, mouse
gctcaggacccgagcaactt

SEQ ID NO: 495849 - DNA, 20 bp, mouse
gcgggtcctgagggcggacg

SEQ ID NO: 495850 - DNA, 20 bp, mouse
gattgttcccaggccggcgg

SEQ ID NO: 495851 - DNA, 20 bp, mouse
ggacccgagcaactttgggt

SEQ ID NO: 495852 - DNA, 20 bp, mouse
gcgcattgttcccaggccgg

SEQ ID NO: 495853 - DNA, 20 bp, mouse
gtcaggccccagtgccagtt

SEQ ID NO: 495854 - DNA, 20 bp, mouse
ggccctacccaaagttgctc

SEQ ID NO: 495855 - DNA, 20 bp, mouse
gggcgtccgcgtccgccctc

SEQ ID NO: 495856 - DNA, 20 bp, mouse
gcggacccaagtgaacgaca

SEQ ID NO: 495857 - DNA, 20 bp, mouse
gtgcaggtgcctgttaggat

SEQ ID NO: 495858 - DNA, 20 bp, mouse
ggtagtcacagatcattggg

SEQ ID NO: 495859 - DNA, 20 bp, mouse
gcattgtgtaagcaaagacc

SEQ ID NO: 495860 - DNA, 20 bp, mouse
ggtgcctgttaggatgggag

SEQ ID NO: 495861 - DNA, 20 bp, mouse
gtcttccttgtcgttcactt

SEQ ID NO: 495862 - DNA, 20 bp, mouse
gctgtctgcaggtgcctgtt

SEQ ID NO: 495863 - DNA, 20 bp, mouse
gccagtcactaggactaaac

SEQ ID NO: 495864 - DNA, 20 bp, mouse
gtggcactcagtcttcagaa

SEQ ID NO: 495865 - DNA, 20 bp, mouse
gctttatataggaacctgga

SEQ ID NO: 495866 - DNA, 20 bp, mouse
gtcctacacgagccatgggg

SEQ ID NO: 495867 - DNA, 20 bp, mouse
ggagtcctacacgagccatg

SEQ ID NO: 495868 - DNA, 20 bp, mouse
gtccgccccatggctcgtgt

SEQ ID NO: 495869 - DNA, 20 bp, mouse
gccaatcgggccaagagaag

SEQ ID NO: 495870 - DNA, 20 bp, mouse
gagcgggaccccggagactc

SEQ ID NO: 495871 - DNA, 20 bp, mouse
gaaggagaccagagccaatc

SEQ ID NO: 495872 - DNA, 20 bp, mouse
gaggctcccagcctccaaat

SEQ ID NO: 495873 - DNA, 20 bp, mouse
gcggggaggtgagacactca

SEQ ID NO: 495874 - DNA, 20 bp, mouse
gcatggggcggacgccaatt

SEQ ID NO: 495875 - DNA, 20 bp, mouse
gggggcggacgccaatttgg

SEQ ID NO: 495876 - DNA, 20 bp, mouse
gtgctcatggcggaatccac

SEQ ID NO: 495877 - DNA, 20 bp, mouse
gctgtaaactgtgctcatgg

SEQ ID NO: 495878 - DNA, 20 bp, mouse
gccatggagcaacgcaaacc

SEQ ID NO: 495879 - DNA, 20 bp, mouse
gccatggagcagaagacgca

SEQ ID NO: 495880 - DNA, 20 bp, mouse
ggcagaagacgcagggtaag

SEQ ID NO: 495881 - DNA, 20 bp, mouse
ggctaggcaaagtactcacg

SEQ ID NO: 495882 - DNA, 20 bp, mouse
gaagagacggctgcgatgtc

SEQ ID NO: 495883 - DNA, 20 bp, mouse
gtgcaagatagtgattaaga

SEQ ID NO: 495884 - DNA, 20 bp, mouse
ggcggaatccactggctgcc

SEQ ID NO: 495885 - DNA, 20 bp, mouse
gcctagcctgtgtgcaaaac

SEQ ID NO: 495886 - DNA, 20 bp, mouse
gtggaaggagagtgttacag

SEQ ID NO: 495887 - DNA, 20 bp, mouse
gtagatggctgtttccagac

SEQ ID NO: 495888 - DNA, 20 bp, mouse
gtagctgttggcagtcagga

SEQ ID NO: 495889 - DNA, 20 bp, mouse
gactccggggtcccaaacgt

SEQ ID NO: 495890 - DNA, 20 bp, mouse
gggaggtctggtaaagcact

SEQ ID NO: 495891 - DNA, 20 bp, mouse
gtaacactctccttccagtc

SEQ ID NO: 495892 - DNA, 20 bp, mouse
gtggcagagccggattcatt

SEQ ID NO: 495893 - DNA, 20 bp, mouse
ggagccggattcatttggag

SEQ ID NO: 495894 - DNA, 20 bp, mouse
gcggcggtgggccaactccg

SEQ ID NO: 495895 - DNA, 20 bp, mouse
gcccaatatcaaggcagctg

SEQ ID NO: 495896 - DNA, 20 bp, mouse
gataattctgaccagagagg

SEQ ID NO: 495897 - DNA, 20 bp, mouse
ggtccttgcagccacctctc

SEQ ID NO: 495898 - DNA, 20 bp, mouse
gtctctggtcagaattatct

SEQ ID NO: 495899 - DNA, 20 bp, mouse
gctgcaaggaccctggcgag

SEQ ID NO: 495900 - DNA, 20 bp, mouse
ggcgggaaggatgccggctg

SEQ ID NO: 495901 - DNA, 20 bp, mouse
gccctggcgaggggcaagga

SEQ ID NO: 495902 - DNA, 20 bp, mouse
gctggtcagaattatctggg

SEQ ID NO: 495903 - DNA, 20 bp, mouse
gaaggcgggtagaggcggga

SEQ ID NO: 495904 - DNA, 20 bp, mouse
ggccccggcccaccccctac

SEQ ID NO: 495905 - DNA, 20 bp, mouse
gctgggaaggcgggtagagg

SEQ ID NO: 495906 - DNA, 20 bp, mouse
ggcttccggcagaggcctgg

SEQ ID NO: 495907 - DNA, 20 bp, mouse
gttagcttccggcagaggcc

SEQ ID NO: 495908 - DNA, 20 bp, mouse
gttctaaagaaattagcttc

SEQ ID NO: 495909 - DNA, 20 bp, mouse
gagaaattagcttccggcag

SEQ ID NO: 495910 - DNA, 20 bp, mouse
gcacatgagagaggtactgg

SEQ ID NO: 495911 - DNA, 20 bp, mouse
gctgtatgggcagtctgtgg

SEQ ID NO: 495912 - DNA, 20 bp, mouse
gcgtgagtaaatgaactgag

SEQ ID NO: 495913 - DNA, 20 bp, mouse
gttcttcttcagggttgtca

SEQ ID NO: 495914 - DNA, 20 bp, mouse
ggatctgtatgggcagtctg

SEQ ID NO: 495915 - DNA, 20 bp, mouse
gtgaagatgatgatctgtat

SEQ ID NO: 495916 - DNA, 20 bp, mouse
ggcaaagggatggtattgag

SEQ ID NO: 495917 - DNA, 20 bp, mouse
ggccggcgcctaggacgtgc

SEQ ID NO: 495918 - DNA, 20 bp, mouse
gggcggcgtgcgcaaaggga

SEQ ID NO: 495919 - DNA, 20 bp, mouse
ggtctcaggaggacaaactg

SEQ ID NO: 495920 - DNA, 20 bp, mouse
ggaggccctcaagaccactg

SEQ ID NO: 495921 - DNA, 20 bp, mouse
gggttcgcgccagatttgcg

SEQ ID NO: 495922 - DNA, 20 bp, mouse
gatggtgtctggaccaatgg

SEQ ID NO: 495923 - DNA, 20 bp, mouse
gtcgcgccagatttgcgggg

SEQ ID NO: 495924 - DNA, 20 bp, mouse
gtggaatcaggggaactcca

SEQ ID NO: 495925 - DNA, 20 bp, mouse
gagtggccccaggcgcgcgt

SEQ ID NO: 495926 - DNA, 20 bp, mouse
gtccagctgggacccagacc

SEQ ID NO: 495927 - DNA, 20 bp, mouse
gagctgggacccagacccgg

SEQ ID NO: 495928 - DNA, 20 bp, mouse
gcgcaggaggtgcagaaacc

SEQ ID NO: 495929 - DNA, 20 bp, mouse
ggaccggacgtccacgcagg

SEQ ID NO: 495930 - DNA, 20 bp, mouse
gagaggtcgcctccgggtct

SEQ ID NO: 495931 - DNA, 20 bp, mouse
gtccggtcccggggcaacct

SEQ ID NO: 495932 - DNA, 20 bp, mouse
gtccgcggtttgggtagaag

SEQ ID NO: 495933 - DNA, 20 bp, mouse
gcaccggggaccatccagct

SEQ ID NO: 495934 - DNA, 20 bp, mouse
ggcccaggttgccccgggac

SEQ ID NO: 495935 - DNA, 20 bp, mouse
gacgggagctcaggtcacta

SEQ ID NO: 495936 - DNA, 20 bp, mouse
ggtctgtgaaaggtcttcga

SEQ ID NO: 495937 - DNA, 20 bp, mouse
gaactatgcacccagatgaa

SEQ ID NO: 495938 - DNA, 20 bp, mouse
gacttgactcttggaaatat

SEQ ID NO: 495939 - DNA, 20 bp, mouse
gagaaatgtcttagaagtgt

SEQ ID NO: 495940 - DNA, 20 bp, mouse
gcatagtttccccatttctg

SEQ ID NO: 495941 - DNA, 20 bp, mouse
gggatgtttgcccttcatct

SEQ ID NO: 495942 - DNA, 20 bp, mouse
gatatgggaataagtaagga

SEQ ID NO: 495943 - DNA, 20 bp, mouse
gcggggacagagaacaaatg

SEQ ID NO: 495944 - DNA, 20 bp, mouse
gcatttctgtggtctgtgaa

SEQ ID NO: 495945 - DNA, 20 bp, mouse
gggactagctaaaagctgca

SEQ ID NO: 495946 - DNA, 20 bp, mouse
gaagggtagtgaaagaacac

SEQ ID NO: 495947 - DNA, 20 bp, mouse
gttgggatatgcctgaccaa

SEQ ID NO: 495948 - DNA, 20 bp, mouse
ggttgttgttgtccttgacc

SEQ ID NO: 495949 - DNA, 20 bp, mouse
gtctttcactacccttggtc

SEQ ID NO: 495950 - DNA, 20 bp, mouse
gtaaagtgctgtaatcaatt

SEQ ID NO: 495951 - DNA, 20 bp, mouse
gacaaagattctccaggtca

SEQ ID NO: 495952 - DNA, 20 bp, mouse
gaatgtcagtaagtgatctc

SEQ ID NO: 495953 - DNA, 20 bp, mouse
gattgcaaagagcaaatcag

SEQ ID NO: 495954 - DNA, 20 bp, mouse
gcatgtgagttatattttca

SEQ ID NO: 495955 - DNA, 20 bp, mouse
ggacagctttgtttgtcctt

SEQ ID NO: 495956 - DNA, 20 bp, mouse
ggggagccgcctccacggac

SEQ ID NO: 495957 - DNA, 20 bp, mouse
ggttagcagcccgtccgtgg

SEQ ID NO: 495958 - DNA, 20 bp, mouse
gatgcagggagccgcctcca

SEQ ID NO: 495959 - DNA, 20 bp, mouse
gagcagcccgtccgtggagg

SEQ ID NO: 495960 - DNA, 20 bp, mouse
ggtagacaggatctactcaa

SEQ ID NO: 495961 - DNA, 20 bp, mouse
gagcagtctggagacgttgt

SEQ ID NO: 495962 - DNA, 20 bp, mouse
gacggagcccaagacctgac

SEQ ID NO: 495963 - DNA, 20 bp, mouse
gcttgttagcagcccgtccg

SEQ ID NO: 495964 - DNA, 20 bp, mouse
ggggctgctaacaagcagtc

SEQ ID NO: 495965 - DNA, 20 bp, mouse
ggtcttgggctccgtatgca

SEQ ID NO: 495966 - DNA, 20 bp, mouse
gagcgcggggcacaggttca

SEQ ID NO: 495967 - DNA, 20 bp, mouse
gagccgccaatgcggtgtct

SEQ ID NO: 495968 - DNA, 20 bp, mouse
gagctgcaggtaggagcgcg

SEQ ID NO: 495969 - DNA, 20 bp, mouse
gcgctgcctagacaccgcat

SEQ ID NO: 495970 - DNA, 20 bp, mouse
gggttcagggcgcgggtgtg

SEQ ID NO: 495971 - DNA, 20 bp, mouse
gtgcctagacaccgcattgg

SEQ ID NO: 495972 - DNA, 20 bp, mouse
gggcggggcgggaagcccgg

SEQ ID NO: 495973 - DNA, 20 bp, mouse
gagctcccaccccagaaggg

SEQ ID NO: 495974 - DNA, 20 bp, mouse
gcccgggcagggacttgctg

SEQ ID NO: 495975 - DNA, 20 bp, mouse
gcaaagacaggagcccgagg

SEQ ID NO: 495976 - DNA, 20 bp, mouse
gcgcgaacgccagccacagg

SEQ ID NO: 495977 - DNA, 20 bp, mouse
gtggtctgaggacagctcgg

SEQ ID NO: 495978 - DNA, 20 bp, mouse
gacagctcgggggtgttcca

SEQ ID NO: 495979 - DNA, 20 bp, mouse
gcgccgcgaacgccagccac

SEQ ID NO: 495980 - DNA, 20 bp, mouse
gtgagcagccggcgatggtg

SEQ ID NO: 495981 - DNA, 20 bp, mouse
gccagggctcggggtatagt

SEQ ID NO: 495982 - DNA, 20 bp, mouse
gcaggaggcttcttggtctg

SEQ ID NO: 495983 - DNA, 20 bp, mouse
gcgggccagggcgtgagtct

SEQ ID NO: 495984 - DNA, 20 bp, mouse
gagttgctggcgccagactt

SEQ ID NO: 495985 - DNA, 20 bp, mouse
ggcaagcgctgtgggagacg

SEQ ID NO: 495986 - DNA, 20 bp, mouse
gccgggctctgatgtgtatc

SEQ ID NO: 495987 - DNA, 20 bp, mouse
gcgatgcgcccgagttacag

SEQ ID NO: 495988 - DNA, 20 bp, mouse
gtgggattacagattctgag

SEQ ID NO: 495989 - DNA, 20 bp, mouse
gggctgagtgagccgcctga

SEQ ID NO: 495990 - DNA, 20 bp, mouse
ggagcctggaaaaccccaca

SEQ ID NO: 495991 - DNA, 20 bp, mouse
ggtctgtgccctctccacaa

SEQ ID NO: 495992 - DNA, 20 bp, mouse
gtggcgttcaggtgatacca

SEQ ID NO: 495993 - DNA, 20 bp, mouse
gctctcttccgtctagacaa

SEQ ID NO: 495994 - DNA, 20 bp, mouse
gtgcgcccgagttacagtgg

SEQ ID NO: 495995 - DNA, 20 bp, mouse
ggagagggcacagacttgaa

SEQ ID NO: 495996 - DNA, 20 bp, mouse
gaaggcatatgaatataatt

SEQ ID NO: 495997 - DNA, 20 bp, mouse
gaaggaaaagatagtttgat

SEQ ID NO: 495998 - DNA, 20 bp, mouse
gaacagtaagatatgtgttg

SEQ ID NO: 495999 - DNA, 20 bp, mouse
ggctccacctcacagctgag

SEQ ID NO: 496000 - DNA, 20 bp, mouse
ggacatgtagggcggggtta

SEQ ID NO: 496001 - DNA, 20 bp, mouse
gtaattagctctttgaagaa

SEQ ID NO: 496002 - DNA, 20 bp, mouse
gttgattggcacattgcatc

SEQ ID NO: 496003 - DNA, 20 bp, mouse
ggctagctctgctgttctta

SEQ ID NO: 496004 - DNA, 20 bp, mouse
gtttaaaaacaaagacatgt

SEQ ID NO: 496005 - DNA, 20 bp, mouse
gagtggttttcttgatccac

SEQ ID NO: 496006 - DNA, 20 bp, mouse
gaggccacgatgtacaatgt

SEQ ID NO: 496007 - DNA, 20 bp, mouse
gctccccacattgtacatcg

SEQ ID NO: 496008 - DNA, 20 bp, mouse
gggcctgaaaagaaaacttt

SEQ ID NO: 496009 - DNA, 20 bp, mouse
gtgacagtgctaggagacat

SEQ ID NO: 496010 - DNA, 20 bp, mouse
gtttagtagtgtatccaagg

SEQ ID NO: 496011 - DNA, 20 bp, mouse
gttcctattatgcatataat

SEQ ID NO: 496012 - DNA, 20 bp, mouse
gctcccattatatgcataat

SEQ ID NO: 496013 - DNA, 20 bp, mouse
ggtggggagccatatagcct

SEQ ID NO: 496014 - DNA, 20 bp, mouse
ggccagcatagaaaccccct

SEQ ID NO: 496015 - DNA, 20 bp, mouse
ggttaggactctgtctcagg

SEQ ID NO: 496016 - DNA, 20 bp, mouse
gctgccactggaggtgcgga

SEQ ID NO: 496017 - DNA, 20 bp, mouse
gacagctgccactggaggtg

SEQ ID NO: 496018 - DNA, 20 bp, mouse
gtggtgggggcagtgcagag

SEQ ID NO: 496019 - DNA, 20 bp, mouse
gttccgcctttaattggtgg

SEQ ID NO: 496020 - DNA, 20 bp, mouse
gtacaggtgacagctgccac

SEQ ID NO: 496021 - DNA, 20 bp, mouse
gcactgcccccaccaattaa

SEQ ID NO: 496022 - DNA, 20 bp, mouse
gactggaggtgcggagggaa

SEQ ID NO: 496023 - DNA, 20 bp, mouse
gtgcccccaccaattaaagg

SEQ ID NO: 496024 - DNA, 20 bp, mouse
gcaattaaaggcggaattaa

SEQ ID NO: 496025 - DNA, 20 bp, mouse
gcccacctagcaaccgggag

SEQ ID NO: 496026 - DNA, 20 bp, mouse
gctgcggccgagcccttagg

SEQ ID NO: 496027 - DNA, 20 bp, mouse
gccgagcccttaggcgggag

SEQ ID NO: 496028 - DNA, 20 bp, mouse
gagaagccgctcccgcctaa

SEQ ID NO: 496029 - DNA, 20 bp, mouse
gactctgcggccgagccctt

SEQ ID NO: 496030 - DNA, 20 bp, mouse
gagagtgcaagcagtcgcag

SEQ ID NO: 496031 - DNA, 20 bp, mouse
ggcgcaggtggccgcgcagg

SEQ ID NO: 496032 - DNA, 20 bp, mouse
gaagaggaagcggctccgtg

SEQ ID NO: 496033 - DNA, 20 bp, mouse
gaggggaggaccagagacca

SEQ ID NO: 496034 - DNA, 20 bp, mouse
gcgaagactcggagatgagg

SEQ ID NO: 496035 - DNA, 20 bp, mouse
gcgcgctccatgcggagcag

SEQ ID NO: 496036 - DNA, 20 bp, mouse
gctctctggtgccccagcta

SEQ ID NO: 496037 - DNA, 20 bp, mouse
gcaccagagagagaaatcta

SEQ ID NO: 496038 - DNA, 20 bp, mouse
gtagggtagctggaagggag

SEQ ID NO: 496039 - DNA, 20 bp, mouse
gcttccagctaccctagctg

SEQ ID NO: 496040 - DNA, 20 bp, mouse
gggtagctggaagggagcgg

SEQ ID NO: 496041 - DNA, 20 bp, mouse
gcccgcacaggtgacctgaa

SEQ ID NO: 496042 - DNA, 20 bp, mouse
gacaggtgacctgaacggac

SEQ ID NO: 496043 - DNA, 20 bp, mouse
gtagcccgggcggggcccag

SEQ ID NO: 496044 - DNA, 20 bp, mouse
gcctccagacagcgcctggt

SEQ ID NO: 496045 - DNA, 20 bp, mouse
ggggcccagcggctccccgg

SEQ ID NO: 496046 - DNA, 20 bp, mouse
gcggcgggtaccaggtgaga

SEQ ID NO: 496047 - DNA, 20 bp, mouse
gcgagaagcagagacggtgg

SEQ ID NO: 496048 - DNA, 20 bp, mouse
ggttggcgctgatgaagacc

SEQ ID NO: 496049 - DNA, 20 bp, mouse
ggagcctcgggcgggagtca

SEQ ID NO: 496050 - DNA, 20 bp, mouse
ggggtaccaggtgagaagga

SEQ ID NO: 496051 - DNA, 20 bp, mouse
gtcggacccgcgcagatcaa

SEQ ID NO: 496052 - DNA, 20 bp, mouse
gaagacccggacgctgcgac

SEQ ID NO: 496053 - DNA, 20 bp, mouse
gcagtcctcagaggtgtagg

SEQ ID NO: 496054 - DNA, 20 bp, mouse
gacccggacgctgcgaccgg

SEQ ID NO: 496055 - DNA, 20 bp, mouse
ggcgcggagtcccggggaca

SEQ ID NO: 496056 - DNA, 20 bp, mouse
gacggggcagggatgcatca

SEQ ID NO: 496057 - DNA, 20 bp, mouse
ggcgcgggccccagggtcag

SEQ ID NO: 496058 - DNA, 20 bp, mouse
ggagcccgcgagcctgctag

SEQ ID NO: 496059 - DNA, 20 bp, mouse
gtgcgcggcccgctgaccct

SEQ ID NO: 496060 - DNA, 20 bp, mouse
gcccgcgagcctgctagcgg

SEQ ID NO: 496061 - DNA, 20 bp, mouse
ggagcgctggcactagactg

SEQ ID NO: 496062 - DNA, 20 bp, mouse
gctggggcccgcgccccacg

SEQ ID NO: 496063 - DNA, 20 bp, mouse
gccgcacagacccggagccc

SEQ ID NO: 496064 - DNA, 20 bp, mouse
ggctggtgcatctggaacct

SEQ ID NO: 496065 - DNA, 20 bp, mouse
gcccggactccggccacggg

SEQ ID NO: 496066 - DNA, 20 bp, mouse
gcatttggtatgaggagatg

SEQ ID NO: 496067 - DNA, 20 bp, mouse
gactccacacagccatagtt

SEQ ID NO: 496068 - DNA, 20 bp, mouse
ggtgttggtgggagaatgat

SEQ ID NO: 496069 - DNA, 20 bp, mouse
ggtcatgggcctgatgagtg

SEQ ID NO: 496070 - DNA, 20 bp, mouse
gacctctgcaaaataccgga

SEQ ID NO: 496071 - DNA, 20 bp, mouse
gcacaatatgttcctaacta

SEQ ID NO: 496072 - DNA, 20 bp, mouse
gctggtccagcactaccttc

SEQ ID NO: 496073 - DNA, 20 bp, mouse
gcaggatcaggcttcatctg

SEQ ID NO: 496074 - DNA, 20 bp, mouse
ggcagtcgattatagtaaag

SEQ ID NO: 496075 - DNA, 20 bp, mouse
ggttcctaactatggctgtg

SEQ ID NO: 496076 - DNA, 20 bp, mouse
gggccctggagtctgcactt

SEQ ID NO: 496077 - DNA, 20 bp, mouse
gctcccaagtgcagactcca

SEQ ID NO: 496078 - DNA, 20 bp, mouse
gcgtgggcgcagggaagcag

SEQ ID NO: 496079 - DNA, 20 bp, mouse
ggactccagggccggggagt

SEQ ID NO: 496080 - DNA, 20 bp, mouse
gcgcgggggagcccactccc

SEQ ID NO: 496081 - DNA, 20 bp, mouse
gccatcagccggcgccgcgg

SEQ ID NO: 496082 - DNA, 20 bp, mouse
gcccacctcccggatctgag

SEQ ID NO: 496083 - DNA, 20 bp, mouse
gagtccatccaggaggtccg

SEQ ID NO: 496084 - DNA, 20 bp, mouse
gctggcccctcagatccggg

SEQ ID NO: 496085 - DNA, 20 bp, mouse
gggcctggcccctcagatcc

SEQ ID NO: 496086 - DNA, 20 bp, mouse
gcccaaccgaccctagtagg

SEQ ID NO: 496087 - DNA, 20 bp, mouse
gctgcccaaccgaccctagt

SEQ ID NO: 496088 - DNA, 20 bp, mouse
ggcattctctccccctacta

SEQ ID NO: 496089 - DNA, 20 bp, mouse
gtgggaggagataccggtca

SEQ ID NO: 496090 - DNA, 20 bp, mouse
gtgcctggcaggtttaactc

SEQ ID NO: 496091 - DNA, 20 bp, mouse
ggggtcggttgggcaggctt

SEQ ID NO: 496092 - DNA, 20 bp, mouse
gagatgggccaggagaattt

SEQ ID NO: 496093 - DNA, 20 bp, mouse
gtgctggtccggcttacctg

SEQ ID NO: 496094 - DNA, 20 bp, mouse
gtgcgacctgtggggtagat

SEQ ID NO: 496095 - DNA, 20 bp, mouse
gcggcttacctggggcatag

SEQ ID NO: 496096 - DNA, 20 bp, mouse
gagtcagtgtgccctcaagg

SEQ ID NO: 496097 - DNA, 20 bp, mouse
gcgaagcagagggacattag

SEQ ID NO: 496098 - DNA, 20 bp, mouse
gcctcaaggaggaacgcaca

SEQ ID NO: 496099 - DNA, 20 bp, mouse
gctgcttcgggtaaacagat

SEQ ID NO: 496100 - DNA, 20 bp, mouse
gaggaggaacgcacaaggcc

SEQ ID NO: 496101 - DNA, 20 bp, mouse
gcccgtacctaggggcacca

SEQ ID NO: 496102 - DNA, 20 bp, mouse
gtggccctgtccatttacta

SEQ ID NO: 496103 - DNA, 20 bp, mouse
ggctggcttcccgtacctag

SEQ ID NO: 496104 - DNA, 20 bp, mouse
gtcactcggcagcaaaggta

SEQ ID NO: 496105 - DNA, 20 bp, mouse
gcttctgttcaacttatccc

SEQ ID NO: 496106 - DNA, 20 bp, mouse
ggtgtcatcgatggagtcat

SEQ ID NO: 496107 - DNA, 20 bp, mouse
gcacaggggacaagcagggt

SEQ ID NO: 496108 - DNA, 20 bp, mouse
gcaatggcgtccctaagaga

SEQ ID NO: 496109 - DNA, 20 bp, mouse
gacggcacaggggacaagca

SEQ ID NO: 496110 - DNA, 20 bp, mouse
gcccgcaaggaggcgcagaa

SEQ ID NO: 496111 - DNA, 20 bp, mouse
gcggccggcgggcaccaccg

SEQ ID NO: 496112 - DNA, 20 bp, mouse
ggactggcccgtgtcatcga

SEQ ID NO: 496113 - DNA, 20 bp, mouse
gcccctggtgctcataactg

SEQ ID NO: 496114 - DNA, 20 bp, mouse
gagagcttggggatcccgca

SEQ ID NO: 496115 - DNA, 20 bp, mouse
gaagagaaggcacacggcac

SEQ ID NO: 496116 - DNA, 20 bp, mouse
gcccagtagcacagaaagtc

SEQ ID NO: 496117 - DNA, 20 bp, mouse
gtcagttgtagtgagcttac

SEQ ID NO: 496118 - DNA, 20 bp, mouse
gagctttctgatcctcttct

SEQ ID NO: 496119 - DNA, 20 bp, mouse
gaaggctagtcaagaggtac

SEQ ID NO: 496120 - DNA, 20 bp, mouse
gcagtttaaggctagtcaag

SEQ ID NO: 496121 - DNA, 20 bp, mouse
gtaccaaacattgccagcag

SEQ ID NO: 496122 - DNA, 20 bp, mouse
gttcttagctacacagttta

SEQ ID NO: 496123 - DNA, 20 bp, mouse
gtggtattgcactgcctgag

SEQ ID NO: 496124 - DNA, 20 bp, mouse
gagtgagcttactggcttgc

SEQ ID NO: 496125 - DNA, 20 bp, mouse
gaagaatgacatgagccagc

SEQ ID NO: 496126 - DNA, 20 bp, mouse
ggccctcgccacaggcccaa

SEQ ID NO: 496127 - DNA, 20 bp, mouse
gggcaaaggactccactgtc

SEQ ID NO: 496128 - DNA, 20 bp, mouse
gctccactgtcaggaatgga

SEQ ID NO: 496129 - DNA, 20 bp, mouse
gtaccttccattcctgacag

SEQ ID NO: 496130 - DNA, 20 bp, mouse
ggcctttgggcctgtggcga

SEQ ID NO: 496131 - DNA, 20 bp, mouse
ggaccagcctcccaacatgt

SEQ ID NO: 496132 - DNA, 20 bp, mouse
gcttcgcaacctcctaacaa

SEQ ID NO: 496133 - DNA, 20 bp, mouse
gtctctaggttgcccttgtt

SEQ ID NO: 496134 - DNA, 20 bp, mouse
gggtacatgttccaagccgt

SEQ ID NO: 496135 - DNA, 20 bp, mouse
ggaagcaaagggagactgaa

SEQ ID NO: 496136 - DNA, 20 bp, mouse
ggacttgcagcctaacccag

SEQ ID NO: 496137 - DNA, 20 bp, mouse
gcagaggtgcaatcacgccc

SEQ ID NO: 496138 - DNA, 20 bp, mouse
ggccgtctcgcccggaaatg

SEQ ID NO: 496139 - DNA, 20 bp, mouse
gctaacccagaggctaaccc

SEQ ID NO: 496140 - DNA, 20 bp, mouse
gcgagatagcagagcagcag

SEQ ID NO: 496141 - DNA, 20 bp, mouse
gtagcgggagcccggagcag

SEQ ID NO: 496142 - DNA, 20 bp, mouse
gcacgcccgggttagcctct

SEQ ID NO: 496143 - DNA, 20 bp, mouse
ggccgcatttccgggcgaga

SEQ ID NO: 496144 - DNA, 20 bp, mouse
gttccgggcgagacggctag

SEQ ID NO: 496145 - DNA, 20 bp, mouse
gaagtcgtagccgcatttcc

SEQ ID NO: 496146 - DNA, 20 bp, mouse
gctcaggccttgaggaccca

SEQ ID NO: 496147 - DNA, 20 bp, mouse
ggacacctggcgggaagatc

SEQ ID NO: 496148 - DNA, 20 bp, mouse
ggatcgggatgtgtgttctt

SEQ ID NO: 496149 - DNA, 20 bp, mouse
ggagctaggtgaccacagga

SEQ ID NO: 496150 - DNA, 20 bp, mouse
gaggacccacggaacaagga

SEQ ID NO: 496151 - DNA, 20 bp, mouse
gaggtgaccacaggatggaa

SEQ ID NO: 496152 - DNA, 20 bp, mouse
gtgttcttgggctgcgactc

SEQ ID NO: 496153 - DNA, 20 bp, mouse
gcttgaggacccacggaaca

SEQ ID NO: 496154 - DNA, 20 bp, mouse
gttctgagctaggtgaccac

SEQ ID NO: 496155 - DNA, 20 bp, mouse
gccggggccgcagcgacacc

SEQ ID NO: 496156 - DNA, 20 bp, mouse
gcggccacgccggagacacc

SEQ ID NO: 496157 - DNA, 20 bp, mouse
ggcggcggcccggaattctg

SEQ ID NO: 496158 - DNA, 20 bp, mouse
gccggcccgtcgcagctgag

SEQ ID NO: 496159 - DNA, 20 bp, mouse
gcccgcaaggggaggagacc

SEQ ID NO: 496160 - DNA, 20 bp, mouse
gggagtcgggaggtgagctc

SEQ ID NO: 496161 - DNA, 20 bp, mouse
gcggcgtccggaccaacagt

SEQ ID NO: 496162 - DNA, 20 bp, mouse
ggtctccggcgtggccgcgg

SEQ ID NO: 496163 - DNA, 20 bp, mouse
gccggagaaagaggccctgg

SEQ ID NO: 496164 - DNA, 20 bp, mouse
gcctcctggtgtctccggcg

SEQ ID NO: 496165 - DNA, 20 bp, mouse
ggggcggcgccctggggcca

SEQ ID NO: 496166 - DNA, 20 bp, mouse
gtagcataatggctaaaggt

SEQ ID NO: 496167 - DNA, 20 bp, mouse
gggaaccatgagagcagcat

SEQ ID NO: 496168 - DNA, 20 bp, mouse
gttggagagaattaaactac

SEQ ID NO: 496169 - DNA, 20 bp, mouse
gtctctccaaggaacatact

SEQ ID NO: 496170 - DNA, 20 bp, mouse
gtcaaacccagtatgttcct

SEQ ID NO: 496171 - DNA, 20 bp, mouse
gagaatagcataatggctaa

SEQ ID NO: 496172 - DNA, 20 bp, mouse
gtcatacataaggacagaaa

SEQ ID NO: 496173 - DNA, 20 bp, mouse
gcataggcattagcattaga

SEQ ID NO: 496174 - DNA, 20 bp, mouse
gtagagcactatatgatatt

SEQ ID NO: 496175 - DNA, 20 bp, mouse
gatgctgatggctggtccag

SEQ ID NO: 496176 - DNA, 20 bp, mouse
gtcacgggcggggacctcag

SEQ ID NO: 496177 - DNA, 20 bp, mouse
gggcctggcatgctgctcac

SEQ ID NO: 496178 - DNA, 20 bp, mouse
gccctcctgccggatttcta

SEQ ID NO: 496179 - DNA, 20 bp, mouse
gtgcagcgtggtccactcag

SEQ ID NO: 496180 - DNA, 20 bp, mouse
gcggaaggggtctcacaaca

SEQ ID NO: 496181 - DNA, 20 bp, mouse
ggggtgacgccctagaaatc

SEQ ID NO: 496182 - DNA, 20 bp, mouse
gagggcccggacagcctggg

SEQ ID NO: 496183 - DNA, 20 bp, mouse
gtggtgttaatagctcctga

SEQ ID NO: 496184 - DNA, 20 bp, mouse
gagtgcaacagctcaggctg

SEQ ID NO: 496185 - DNA, 20 bp, mouse
gggcatgctgctcacgggcg

SEQ ID NO: 496186 - DNA, 20 bp, mouse
ggctatcggcgccatcacaa

SEQ ID NO: 496187 - DNA, 20 bp, mouse
ggcgccatcacaaagggtca

SEQ ID NO: 496188 - DNA, 20 bp, mouse
gggagactccgtaatgaccc

SEQ ID NO: 496189 - DNA, 20 bp, mouse
gaagggtcagggcgcagctg

SEQ ID NO: 496190 - DNA, 20 bp, mouse
gcggcgaacccgggtcatta

SEQ ID NO: 496191 - DNA, 20 bp, mouse
ggcgccctgaccctttgtga

SEQ ID NO: 496192 - DNA, 20 bp, mouse
ggcgcagctgcggcgaaccc

SEQ ID NO: 496193 - DNA, 20 bp, mouse
gccgaggcgcgggagctgct

SEQ ID NO: 496194 - DNA, 20 bp, mouse
ggaacccaaagagaacaagg

SEQ ID NO: 496195 - DNA, 20 bp, mouse
ggctggagtagggaagagga

SEQ ID NO: 496196 - DNA, 20 bp, mouse
ggatctagcctatcagagtc

SEQ ID NO: 496197 - DNA, 20 bp, mouse
gctggcaagctagcccaaat

SEQ ID NO: 496198 - DNA, 20 bp, mouse
ggataggctagatcccattt

SEQ ID NO: 496199 - DNA, 20 bp, mouse
gtgtatccagagactaccat

SEQ ID NO: 496200 - DNA, 20 bp, mouse
gatccagagactaccatagg

SEQ ID NO: 496201 - DNA, 20 bp, mouse
ggtgggaagctgacttctaa

SEQ ID NO: 496202 - DNA, 20 bp, mouse
gcaagtgagggtcttaactg

SEQ ID NO: 496203 - DNA, 20 bp, mouse
gaagtagcaagcacctccta

SEQ ID NO: 496204 - DNA, 20 bp, mouse
gctgtcatagcaagactcca

SEQ ID NO: 496205 - DNA, 20 bp, mouse
gcacctcctatggtagtctc

SEQ ID NO: 496206 - DNA, 20 bp, mouse
gtggctgacagacaagcgga

SEQ ID NO: 496207 - DNA, 20 bp, mouse
gatcatggctgacagacaag

SEQ ID NO: 496208 - DNA, 20 bp, mouse
gtgacagacaagcggagggt

SEQ ID NO: 496209 - DNA, 20 bp, mouse
gtacctgagaagtttggaga

SEQ ID NO: 496210 - DNA, 20 bp, mouse
gggttgttggaacgaagcta

SEQ ID NO: 496211 - DNA, 20 bp, mouse
gcaacctgccaagtcaggga

SEQ ID NO: 496212 - DNA, 20 bp, mouse
gacccagtgagactcgtgaa

SEQ ID NO: 496213 - DNA, 20 bp, mouse
gagcaaccataatagcagta

SEQ ID NO: 496214 - DNA, 20 bp, mouse
gagcggagggtggggatgct

SEQ ID NO: 496215 - DNA, 20 bp, mouse
ggcatcaacctgccaagtca

SEQ ID NO: 496216 - DNA, 20 bp, mouse
ggcagtggctgccactcaag

SEQ ID NO: 496217 - DNA, 20 bp, mouse
gccacatacggacgaaccca

SEQ ID NO: 496218 - DNA, 20 bp, mouse
gagtgtgtacttagtaccag

SEQ ID NO: 496219 - DNA, 20 bp, mouse
gtcccgtcacacaccacata

SEQ ID NO: 496220 - DNA, 20 bp, mouse
gtatagaggaggcaccactc

SEQ ID NO: 496221 - DNA, 20 bp, mouse
ggacgggaactgttccgagg

SEQ ID NO: 496222 - DNA, 20 bp, mouse
ggcagaaggaagagtccaca

SEQ ID NO: 496223 - DNA, 20 bp, mouse
gcatcacacacttatagagg

SEQ ID NO: 496224 - DNA, 20 bp, mouse
gatccctagaatataactgt

SEQ ID NO: 496225 - DNA, 20 bp, mouse
ggagtggcagccactgccct

SEQ ID NO: 496226 - DNA, 20 bp, mouse
gggcatgaatgggctcagat

SEQ ID NO: 496227 - DNA, 20 bp, mouse
gtcagggcttcaactttctg

SEQ ID NO: 496228 - DNA, 20 bp, mouse
gtctgtggagcaggcatgaa

SEQ ID NO: 496229 - DNA, 20 bp, mouse
gtgggtacaacataagataa

SEQ ID NO: 496230 - DNA, 20 bp, mouse
gcctgcctgtcagtggttca

SEQ ID NO: 496231 - DNA, 20 bp, mouse
gaggcttgtgacaaccaggg

SEQ ID NO: 496232 - DNA, 20 bp, mouse
ggataatggccccgaacaaa

SEQ ID NO: 496233 - DNA, 20 bp, mouse
ggttctgaagatggcacact

SEQ ID NO: 496234 - DNA, 20 bp, mouse
gacactaggctgagtgagga

SEQ ID NO: 496235 - DNA, 20 bp, mouse
gtcctgtaagcaccaagtat

SEQ ID NO: 496236 - DNA, 20 bp, mouse
gggcatctgggtaaatccct

SEQ ID NO: 496237 - DNA, 20 bp, mouse
gaggtacagaaacactgaag

SEQ ID NO: 496238 - DNA, 20 bp, mouse
gggaaagaacgcaccagccc

SEQ ID NO: 496239 - DNA, 20 bp, mouse
gctgtccacaccaccgccca

SEQ ID NO: 496240 - DNA, 20 bp, mouse
gcagatgccttcgagaatca

SEQ ID NO: 496241 - DNA, 20 bp, mouse
gtgttcgccctgattctcga

SEQ ID NO: 496242 - DNA, 20 bp, mouse
gcagaaacactgaagtggaa

SEQ ID NO: 496243 - DNA, 20 bp, mouse
gatctgggtaaatccctggg

SEQ ID NO: 496244 - DNA, 20 bp, mouse
gtgggtaaatccctgggcgg

SEQ ID NO: 496245 - DNA, 20 bp, mouse
gaggcccaggctgcacaagc

SEQ ID NO: 496246 - DNA, 20 bp, mouse
gaggattcaacagttaagct

SEQ ID NO: 496247 - DNA, 20 bp, mouse
gttgaactattttagaagac

SEQ ID NO: 496248 - DNA, 20 bp, mouse
gaacagttaagctaggtcac

SEQ ID NO: 496249 - DNA, 20 bp, mouse
gggaagtggaaggtcttgac

SEQ ID NO: 496250 - DNA, 20 bp, mouse
gcctcagagccgccaggaga

SEQ ID NO: 496251 - DNA, 20 bp, mouse
gcatcctgagaggcacacag

SEQ ID NO: 496252 - DNA, 20 bp, mouse
ggagccgccaggagatggac

SEQ ID NO: 496253 - DNA, 20 bp, mouse
gccctaggaagcttacctac

SEQ ID NO: 496254 - DNA, 20 bp, mouse
gttacctactggctcaggtg

SEQ ID NO: 496255 - DNA, 20 bp, mouse
gggataatgtccatcctgag

SEQ ID NO: 496256 - DNA, 20 bp, mouse
gaggagagaagtaaccggag

SEQ ID NO: 496257 - DNA, 20 bp, mouse
ggaaagagggcgggattgaa

SEQ ID NO: 496258 - DNA, 20 bp, mouse
ggggtgcaggatgctccaac

SEQ ID NO: 496259 - DNA, 20 bp, mouse
gggggaaccagggtagcggg

SEQ ID NO: 496260 - DNA, 20 bp, mouse
gatgcagcaggcaatacccg

SEQ ID NO: 496261 - DNA, 20 bp, mouse
ggagctgacctcaccggact

SEQ ID NO: 496262 - DNA, 20 bp, mouse
gccagctcgggcggagtcct

SEQ ID NO: 496263 - DNA, 20 bp, mouse
gttgttcggagaaacagagt

SEQ ID NO: 496264 - DNA, 20 bp, mouse
gctagagactccgctgggtc

SEQ ID NO: 496265 - DNA, 20 bp, mouse
gcttctttaagcaaccactc

SEQ ID NO: 496266 - DNA, 20 bp, mouse
gttcattccagaccagatgg

SEQ ID NO: 496267 - DNA, 20 bp, mouse
gcagcatggcacttcctgac

SEQ ID NO: 496268 - DNA, 20 bp, mouse
gttccagaccagatggtggg

SEQ ID NO: 496269 - DNA, 20 bp, mouse
gtgctgggccacccaccatc

SEQ ID NO: 496270 - DNA, 20 bp, mouse
ggttctgagtagcccacagt

SEQ ID NO: 496271 - DNA, 20 bp, mouse
gtcctgactggtgaactttg

SEQ ID NO: 496272 - DNA, 20 bp, mouse
gctgagtagcccacagtagg

SEQ ID NO: 496273 - DNA, 20 bp, mouse
gaatgaagccagggatcccc

SEQ ID NO: 496274 - DNA, 20 bp, mouse
gacctcaaagttcaccagtc

SEQ ID NO: 496275 - DNA, 20 bp, mouse
gggactctgcagatagatcc

SEQ ID NO: 496276 - DNA, 20 bp, mouse
ggagtaggcggtggagatac

SEQ ID NO: 496277 - DNA, 20 bp, mouse
ggcgcctagggagcaccgag

SEQ ID NO: 496278 - DNA, 20 bp, mouse
ggctttgttgggagaaggag

SEQ ID NO: 496279 - DNA, 20 bp, mouse
gcgagggcgacgagcagcag

SEQ ID NO: 496280 - DNA, 20 bp, mouse
gtagcgaagccggtccgctg

SEQ ID NO: 496281 - DNA, 20 bp, mouse
gcggtccgctgaggcgctac

SEQ ID NO: 496282 - DNA, 20 bp, mouse
ggaggcggcagcggagtagg

SEQ ID NO: 496283 - DNA, 20 bp, mouse
gcccgcccgtagcgcctcag

SEQ ID NO: 496284 - DNA, 20 bp, mouse
gccctaggcgccggagccat

SEQ ID NO: 496285 - DNA, 20 bp, mouse
gcggctgctgagagcgccca

SEQ ID NO: 496286 - DNA, 20 bp, mouse
ggcgccctgtcagaccgtgg

SEQ ID NO: 496287 - DNA, 20 bp, mouse
gcgcgggccggcagggacca

SEQ ID NO: 496288 - DNA, 20 bp, mouse
gcggccgccacggtctgaca

SEQ ID NO: 496289 - DNA, 20 bp, mouse
ggagtcccggaaggtgtgag

SEQ ID NO: 496290 - DNA, 20 bp, mouse
gcgtgcggccgagaggaagg

SEQ ID NO: 496291 - DNA, 20 bp, mouse
gggaaggtggctctcatcac

SEQ ID NO: 496292 - DNA, 20 bp, mouse
gagtggaacgagccgcgggc

SEQ ID NO: 496293 - DNA, 20 bp, mouse
ggagcgtgcggccgagagga

SEQ ID NO: 496294 - DNA, 20 bp, mouse
gggagctgcagcggccgcca

SEQ ID NO: 496295 - DNA, 20 bp, mouse
gcgcgcgccctgtcagaccg

SEQ ID NO: 496296 - DNA, 20 bp, mouse
gcgacggagacggtgaggag

SEQ ID NO: 496297 - DNA, 20 bp, mouse
gcccgcccgcccgacggaga

SEQ ID NO: 496298 - DNA, 20 bp, mouse
gccgcccgacggagacggtg

SEQ ID NO: 496299 - DNA, 20 bp, mouse
ggcggctcgggcggacccag

SEQ ID NO: 496300 - DNA, 20 bp, mouse
gacgtccgctcgctccccgg

SEQ ID NO: 496301 - DNA, 20 bp, mouse
gggcgggcggcgagcggcca

SEQ ID NO: 496302 - DNA, 20 bp, mouse
ggcgcacaaagccgccacgg

SEQ ID NO: 496303 - DNA, 20 bp, mouse
ggaagtgctggagcccggct

SEQ ID NO: 496304 - DNA, 20 bp, mouse
gcggcggccggcgacggcga

SEQ ID NO: 496305 - DNA, 20 bp, mouse
gcatgcgcacaaagccgcca

SEQ ID NO: 496306 - DNA, 20 bp, mouse
ggcggagcgtcaggacgtta

SEQ ID NO: 496307 - DNA, 20 bp, mouse
gctccgcagggacccctgac

SEQ ID NO: 496308 - DNA, 20 bp, mouse
gcgcgccgccgtccagtcag

SEQ ID NO: 496309 - DNA, 20 bp, mouse
ggtgtttgggacccatcggt

SEQ ID NO: 496310 - DNA, 20 bp, mouse
ggggacccctgactggacgg

SEQ ID NO: 496311 - DNA, 20 bp, mouse
ggagcgtcaggacgttacgg

SEQ ID NO: 496312 - DNA, 20 bp, mouse
gccatcggtgggcaccagat

SEQ ID NO: 496313 - DNA, 20 bp, mouse
ggacgacccgaccctgcctc

SEQ ID NO: 496314 - DNA, 20 bp, mouse
gctggcgggagggctcgcga

SEQ ID NO: 496315 - DNA, 20 bp, mouse
ggcctcgccagaggcagggt

SEQ ID NO: 496316 - DNA, 20 bp, mouse
ggcgccagccgaaacaggaa

SEQ ID NO: 496317 - DNA, 20 bp, mouse
gtccgccgcggggaccacaa

SEQ ID NO: 496318 - DNA, 20 bp, mouse
gaggggcccaagagatcgca

SEQ ID NO: 496319 - DNA, 20 bp, mouse
ggcggtgcgccagccgaaac

SEQ ID NO: 496320 - DNA, 20 bp, mouse
gcgttgccgtgcgatctctt

SEQ ID NO: 496321 - DNA, 20 bp, mouse
ggcaacgggccgctgacgac

SEQ ID NO: 496322 - DNA, 20 bp, mouse
gggcccctttaagaatggct

SEQ ID NO: 496323 - DNA, 20 bp, mouse
gctgccgagccattcttaaa

SEQ ID NO: 496324 - DNA, 20 bp, mouse
ggtccgttcccgacttccag

SEQ ID NO: 496325 - DNA, 20 bp, mouse
ggcctggactggaagaatgt

SEQ ID NO: 496326 - DNA, 20 bp, mouse
gaccccaggctgagagggat

SEQ ID NO: 496327 - DNA, 20 bp, mouse
gcagttcctctgtcttctag

SEQ ID NO: 496328 - DNA, 20 bp, mouse
ggggcctgggtgacaaggaa

SEQ ID NO: 496329 - DNA, 20 bp, mouse
ggtggggaccccaggctgag

SEQ ID NO: 496330 - DNA, 20 bp, mouse
gtcctctgtcttctaggggt

SEQ ID NO: 496331 - DNA, 20 bp, mouse
gtgacaaagcttggtcgtag

SEQ ID NO: 496332 - DNA, 20 bp, mouse
gtcagctccgagggacacac

SEQ ID NO: 496333 - DNA, 20 bp, mouse
ggcccatccctctcagcctg

SEQ ID NO: 496334 - DNA, 20 bp, mouse
gagcttggtcgtagaggtag

SEQ ID NO: 496335 - DNA, 20 bp, mouse
gagggatgggctatgaaagg

SEQ ID NO: 496336 - DNA, 20 bp, mouse
ggcgcggcaatgctgagaaa

SEQ ID NO: 496337 - DNA, 20 bp, mouse
gcaatgctgagaaagggaca

SEQ ID NO: 496338 - DNA, 20 bp, mouse
gggcatcgccatggactcag

SEQ ID NO: 496339 - DNA, 20 bp, mouse
gagtccatggcgatgcccgg

SEQ ID NO: 496340 - DNA, 20 bp, mouse
ggacaccactgggtcggcag

SEQ ID NO: 496341 - DNA, 20 bp, mouse
gcggggcgacaccactgggt

SEQ ID NO: 496342 - DNA, 20 bp, mouse
gcggctgtcagatagctcag

SEQ ID NO: 496343 - DNA, 20 bp, mouse
gaaatcgggctggtcccggg

SEQ ID NO: 496344 - DNA, 20 bp, mouse
ggctctggcgggcaatccga

SEQ ID NO: 496345 - DNA, 20 bp, mouse
ggactcagcggagacaggta

SEQ ID NO: 496346 - DNA, 20 bp, mouse
gaggtgccaaaggaacacaa

SEQ ID NO: 496347 - DNA, 20 bp, mouse
ggccaaaggaacacaaaggc

SEQ ID NO: 496348 - DNA, 20 bp, mouse
gtctgaaggagaggtgccaa

SEQ ID NO: 496349 - DNA, 20 bp, mouse
gagttaaaactctgaaggag

SEQ ID NO: 496350 - DNA, 20 bp, mouse
ggcctgcctttgtgttcctt

SEQ ID NO: 496351 - DNA, 20 bp, mouse
gtttctcttaagatatctct

SEQ ID NO: 496352 - DNA, 20 bp, mouse
gtcgcttagtgtacttcctt

SEQ ID NO: 496353 - DNA, 20 bp, mouse
ggagaagctcagaaccccaa

SEQ ID NO: 496354 - DNA, 20 bp, mouse
gagttggagccctacagtaa

SEQ ID NO: 496355 - DNA, 20 bp, mouse
gtctcggtatacctacctca

SEQ ID NO: 496356 - DNA, 20 bp, mouse
ggtgatgagaatcacggact

SEQ ID NO: 496357 - DNA, 20 bp, mouse
gtcacggactgggcaacaag

SEQ ID NO: 496358 - DNA, 20 bp, mouse
gagtaaaaccggttagaaag

SEQ ID NO: 496359 - DNA, 20 bp, mouse
gggaacagcagagcctacgt

SEQ ID NO: 496360 - DNA, 20 bp, mouse
gaggctctttctggcagaag

SEQ ID NO: 496361 - DNA, 20 bp, mouse
gttgcaacaatggatcccaa

SEQ ID NO: 496362 - DNA, 20 bp, mouse
gggttttactggcaccacgt

SEQ ID NO: 496363 - DNA, 20 bp, mouse
gctgtgttccaggttagtga

SEQ ID NO: 496364 - DNA, 20 bp, mouse
gtgttggtacacagaatatg

SEQ ID NO: 496365 - DNA, 20 bp, mouse
gtattctgtgtaccaacaac

SEQ ID NO: 496366 - DNA, 20 bp, mouse
gtgagagccgcacaaggccc

SEQ ID NO: 496367 - DNA, 20 bp, mouse
gggcgcgtcagctaccgggt

SEQ ID NO: 496368 - DNA, 20 bp, mouse
gctgggcgagctgagacgag

SEQ ID NO: 496369 - DNA, 20 bp, mouse
gcgagggcgcgggagaccga

SEQ ID NO: 496370 - DNA, 20 bp, mouse
gggcgtcgttgaatccggtg

SEQ ID NO: 496371 - DNA, 20 bp, mouse
gctgcaggttcgggtcgttc

SEQ ID NO: 496372 - DNA, 20 bp, mouse
gtctctggaagaggtcaccg

SEQ ID NO: 496373 - DNA, 20 bp, mouse
gcgggttagtctgcaggttc

SEQ ID NO: 496374 - DNA, 20 bp, mouse
ggcgtcagctaccgggtcgg

SEQ ID NO: 496375 - DNA, 20 bp, mouse
gtgggaggcgacgatttgaa

SEQ ID NO: 496376 - DNA, 20 bp, mouse
gctggcgtaaagggagctag

SEQ ID NO: 496377 - DNA, 20 bp, mouse
gggtaaaaggatctacatgg

SEQ ID NO: 496378 - DNA, 20 bp, mouse
ggcggcagagctggcgtaaa

SEQ ID NO: 496379 - DNA, 20 bp, mouse
gcagtggcaggcggcagagc

SEQ ID NO: 496380 - DNA, 20 bp, mouse
gtgcgcacggctggagtagt

SEQ ID NO: 496381 - DNA, 20 bp, mouse
gaaagggagctagtggtaaa

SEQ ID NO: 496382 - DNA, 20 bp, mouse
ggacgtagggagggctcaca

SEQ ID NO: 496383 - DNA, 20 bp, mouse
gcgcataccgaccactggtg

SEQ ID NO: 496384 - DNA, 20 bp, mouse
gatagaaccaacacaagcgt

SEQ ID NO: 496385 - DNA, 20 bp, mouse
gcacctagaggtgttagggt

SEQ ID NO: 496386 - DNA, 20 bp, mouse
ggatcctggaccccacatca

SEQ ID NO: 496387 - DNA, 20 bp, mouse
gcagaagacgaggaactggt

SEQ ID NO: 496388 - DNA, 20 bp, mouse
gacatcagggtagagcaggg

SEQ ID NO: 496389 - DNA, 20 bp, mouse
gtcagccagaacagaagacg

SEQ ID NO: 496390 - DNA, 20 bp, mouse
gcgaggaactggttggagac

SEQ ID NO: 496391 - DNA, 20 bp, mouse
gggcgaggtgacaccagagt

SEQ ID NO: 496392 - DNA, 20 bp, mouse
gccgcctccggccggaactc

SEQ ID NO: 496393 - DNA, 20 bp, mouse
gagaggcccagctagagaag

SEQ ID NO: 496394 - DNA, 20 bp, mouse
gtggtgaaacgtgcaggtca

SEQ ID NO: 496395 - DNA, 20 bp, mouse
gccccagggacctaaagaaa

SEQ ID NO: 496396 - DNA, 20 bp, mouse
ggcggggcgcgtgcgtacag

SEQ ID NO: 496397 - DNA, 20 bp, mouse
gagtctgcgcacagccaccc

SEQ ID NO: 496398 - DNA, 20 bp, mouse
gggtgcgcggtagcttcctg

SEQ ID NO: 496399 - DNA, 20 bp, mouse
ggcgtacagtggcgcccggg

SEQ ID NO: 496400 - DNA, 20 bp, mouse
gccccaagcccaccaccggt

SEQ ID NO: 496401 - DNA, 20 bp, mouse
gcgtgcgtacagtggcgccc

SEQ ID NO: 496402 - DNA, 20 bp, mouse
ggtgcgcgggcataagaaca

SEQ ID NO: 496403 - DNA, 20 bp, mouse
gcaagagccgatccgaggtg

SEQ ID NO: 496404 - DNA, 20 bp, mouse
gcagcggccccacctcggat

SEQ ID NO: 496405 - DNA, 20 bp, mouse
gcggcgtcagccgggagctg

SEQ ID NO: 496406 - DNA, 20 bp, mouse
gtggccctgaaggctcatcg

SEQ ID NO: 496407 - DNA, 20 bp, mouse
gggctcatcgaggctgcacg

SEQ ID NO: 496408 - DNA, 20 bp, mouse
gctcgttcgagtggccctga

SEQ ID NO: 496409 - DNA, 20 bp, mouse
gaagggagagtaactaggta

SEQ ID NO: 496410 - DNA, 20 bp, mouse
gtagtcgagtttgcaattag

SEQ ID NO: 496411 - DNA, 20 bp, mouse
gttagcggaactcgttcgag

SEQ ID NO: 496412 - DNA, 20 bp, mouse
ggaaaaaagggagagtaact

SEQ ID NO: 496413 - DNA, 20 bp, mouse
gcagacactggatggtccca

SEQ ID NO: 496414 - DNA, 20 bp, mouse
gtaggtaaggaagcaccttc

SEQ ID NO: 496415 - DNA, 20 bp, mouse
gagagtaagaagctaactta

SEQ ID NO: 496416 - DNA, 20 bp, mouse
ggcagcccggaacctaacag

SEQ ID NO: 496417 - DNA, 20 bp, mouse
gagaggctcaacaccgggac

SEQ ID NO: 496418 - DNA, 20 bp, mouse
ggacgccagaggctcaacac

SEQ ID NO: 496419 - DNA, 20 bp, mouse
ggtgttctgaggccgctgtt

SEQ ID NO: 496420 - DNA, 20 bp, mouse
gcagcgtgagcgagacctgg

SEQ ID NO: 496421 - DNA, 20 bp, mouse
gcccggccgagggagacgga

SEQ ID NO: 496422 - DNA, 20 bp, mouse
ggaggccgctgttaggttcc

SEQ ID NO: 496423 - DNA, 20 bp, mouse
gcgcgcgcttctgtgttctg

SEQ ID NO: 496424 - DNA, 20 bp, mouse
ggtgaagaacaagagcagcc

SEQ ID NO: 496425 - DNA, 20 bp, mouse
ggggccggttagaggaggtc

SEQ ID NO: 496426 - DNA, 20 bp, mouse
gctgccacgggccccgggac

SEQ ID NO: 496427 - DNA, 20 bp, mouse
ggccgtgcggcccctcccat

SEQ ID NO: 496428 - DNA, 20 bp, mouse
gggacctgaagcgctgccac

SEQ ID NO: 496429 - DNA, 20 bp, mouse
ggcggcgcggccaatgggag

SEQ ID NO: 496430 - DNA, 20 bp, mouse
gtggcgacggctgcgggtag

SEQ ID NO: 496431 - DNA, 20 bp, mouse
gggcagcgcttcaggtcctc

SEQ ID NO: 496432 - DNA, 20 bp, mouse
gcacgggccccgggacgggc

SEQ ID NO: 496433 - DNA, 20 bp, mouse
gctcgggcgccggcgctcgg

SEQ ID NO: 496434 - DNA, 20 bp, mouse
gcgccggggaccagagaccg

SEQ ID NO: 496435 - DNA, 20 bp, mouse
gggggaaccgggaagaggta

SEQ ID NO: 496436 - DNA, 20 bp, mouse
gacgcagcctgagggagcgg

SEQ ID NO: 496437 - DNA, 20 bp, mouse
ggcgagtgagggcctcgggg

SEQ ID NO: 496438 - DNA, 20 bp, mouse
gccggcgagtgagggcctcg

SEQ ID NO: 496439 - DNA, 20 bp, mouse
gcggacgcagcctgagggag

SEQ ID NO: 496440 - DNA, 20 bp, mouse
gcagccggcccggcgagtga

SEQ ID NO: 496441 - DNA, 20 bp, mouse
ggccatggacgcccctcagc

SEQ ID NO: 496442 - DNA, 20 bp, mouse
gggcggcgcctggcccggca

SEQ ID NO: 496443 - DNA, 20 bp, mouse
gcgccgggccggctgagggg

SEQ ID NO: 496444 - DNA, 20 bp, mouse
gcgcggagcgcgaggcccga

SEQ ID NO: 496445 - DNA, 20 bp, mouse
gcagcagcgcgtcgatgtcg

SEQ ID NO: 496446 - DNA, 20 bp, mouse
ggcccgagcgcgcccgggga

SEQ ID NO: 496447 - DNA, 20 bp, mouse
gcgggctgcgtgctgacgaa

SEQ ID NO: 496448 - DNA, 20 bp, mouse
gccctggcgagtcagtcctc

SEQ ID NO: 496449 - DNA, 20 bp, mouse
gacgcagcccgggaagcaca

SEQ ID NO: 496450 - DNA, 20 bp, mouse
gcggacagcacggagcgcga

SEQ ID NO: 496451 - DNA, 20 bp, mouse
ggagcagcagcgcaagtcca

SEQ ID NO: 496452 - DNA, 20 bp, mouse
gcgaagggaccagggcaaca

SEQ ID NO: 496453 - DNA, 20 bp, mouse
gctcctcctccggcagcggg

SEQ ID NO: 496454 - DNA, 20 bp, mouse
gtgcgtgctgacgaacggcg

SEQ ID NO: 496455 - DNA, 20 bp, mouse
gggcaacagggcgcacagaa

SEQ ID NO: 496456 - DNA, 20 bp, mouse
gctttgtccccaggcaccgt

SEQ ID NO: 496457 - DNA, 20 bp, mouse
gcggcttggggtaggacttc

SEQ ID NO: 496458 - DNA, 20 bp, mouse
gcgtctcgaacctgcagcca

SEQ ID NO: 496459 - DNA, 20 bp, mouse
gccgctctatgtgacaggag

SEQ ID NO: 496460 - DNA, 20 bp, mouse
gcccaagccgacggtgcctg

SEQ ID NO: 496461 - DNA, 20 bp, mouse
gagggagagaagagcgaact

SEQ ID NO: 496462 - DNA, 20 bp, mouse
gtggtctctccgggactgta

SEQ ID NO: 496463 - DNA, 20 bp, mouse
gcgcaggctagcagcaggtg

SEQ ID NO: 496464 - DNA, 20 bp, mouse
ggacaaaggatagcaacaag

SEQ ID NO: 496465 - DNA, 20 bp, mouse
gcaggcaactcctgcagcct

SEQ ID NO: 496466 - DNA, 20 bp, mouse
gccctaggcagggacacgga

SEQ ID NO: 496467 - DNA, 20 bp, mouse
ggcctgcagagcccaactgt

SEQ ID NO: 496468 - DNA, 20 bp, mouse
gcctcttgaagcccttgcct

SEQ ID NO: 496469 - DNA, 20 bp, mouse
gggcctgggtgctggaaaca

SEQ ID NO: 496470 - DNA, 20 bp, mouse
gggacagcagccccaagtca

SEQ ID NO: 496471 - DNA, 20 bp, mouse
gcaagggcttcaagaggcct

SEQ ID NO: 496472 - DNA, 20 bp, mouse
gatctcctggtcgattctgg

SEQ ID NO: 496473 - DNA, 20 bp, mouse
gtcagggaccgggccatggt

SEQ ID NO: 496474 - DNA, 20 bp, mouse
ggctcccacaggccctaggc

SEQ ID NO: 496475 - DNA, 20 bp, mouse
gcagggacacggagggccct

SEQ ID NO: 496476 - DNA, 20 bp, mouse
gcggcggcggcagagcctag

SEQ ID NO: 496477 - DNA, 20 bp, mouse
gcggctggcagagcgaggag

SEQ ID NO: 496478 - DNA, 20 bp, mouse
gcggccacgggcagctgcgg

SEQ ID NO: 496479 - DNA, 20 bp, mouse
ggcggctgcggctcggccac

SEQ ID NO: 496480 - DNA, 20 bp, mouse
gggcgacgctcggccaccat

SEQ ID NO: 496481 - DNA, 20 bp, mouse
gagcggtcgcagggattcgc

SEQ ID NO: 496482 - DNA, 20 bp, mouse
gggagtgtcgccggcaggga

SEQ ID NO: 496483 - DNA, 20 bp, mouse
ggcgggagctgaggacgtag

SEQ ID NO: 496484 - DNA, 20 bp, mouse
gagctcgctcgggctgtgcg

SEQ ID NO: 496485 - DNA, 20 bp, mouse
ggcagagcctagcggtcgca

SEQ ID NO: 496486 - DNA, 20 bp, mouse
gccctctgcgggaagctctc

SEQ ID NO: 496487 - DNA, 20 bp, mouse
gtcccaccgccggccctctg

SEQ ID NO: 496488 - DNA, 20 bp, mouse
gccgcagtcgctcggaactg

SEQ ID NO: 496489 - DNA, 20 bp, mouse
gcccgcagagggccggcggt

SEQ ID NO: 496490 - DNA, 20 bp, mouse
gcggagccaagggagaagtt

SEQ ID NO: 496491 - DNA, 20 bp, mouse
gaagttgcttctgttaggtg

SEQ ID NO: 496492 - DNA, 20 bp, mouse
ggagtcaagggtcccagaac

SEQ ID NO: 496493 - DNA, 20 bp, mouse
gacctgagagcttcccgcag

SEQ ID NO: 496494 - DNA, 20 bp, mouse
gggtgggagcggagtgggtc

SEQ ID NO: 496495 - DNA, 20 bp, mouse
gccaagggtagagctaacac

SEQ ID NO: 496496 - DNA, 20 bp, mouse
gcgcgggaatcgccacacac

SEQ ID NO: 496497 - DNA, 20 bp, mouse
ggggaatcgccacacaccgg

SEQ ID NO: 496498 - DNA, 20 bp, mouse
gcgggagctaggggagctga

SEQ ID NO: 496499 - DNA, 20 bp, mouse
ggccacacaccggcggagac

SEQ ID NO: 496500 - DNA, 20 bp, mouse
gcggagacgggtcttctgct

SEQ ID NO: 496501 - DNA, 20 bp, mouse
gagacgggtcttctgctggg

SEQ ID NO: 496502 - DNA, 20 bp, mouse
gctaggggagctgacggaga

SEQ ID NO: 496503 - DNA, 20 bp, mouse
gcggttcttccgggagctag

SEQ ID NO: 496504 - DNA, 20 bp, mouse
gggctcactcacacacaccg

SEQ ID NO: 496505 - DNA, 20 bp, mouse
gacccgtctccgccggtgtg

SEQ ID NO: 496506 - DNA, 20 bp, mouse
ggcaagaccgcggaagatca

SEQ ID NO: 496507 - DNA, 20 bp, mouse
gcggggatctgcgatcgcac

SEQ ID NO: 496508 - DNA, 20 bp, mouse
gttagccgggagcgtgcggt

SEQ ID NO: 496509 - DNA, 20 bp, mouse
gggcaacagcagcaagaccg

SEQ ID NO: 496510 - DNA, 20 bp, mouse
ggccgttagccgggagcgtg

SEQ ID NO: 496511 - DNA, 20 bp, mouse
gagagacggccaggtctccc

SEQ ID NO: 496512 - DNA, 20 bp, mouse
gagactgcccgtgccggtgg

SEQ ID NO: 496513 - DNA, 20 bp, mouse
gtcggagctaccacacaccc

SEQ ID NO: 496514 - DNA, 20 bp, mouse
ggagatgtgcgctcccgcga

SEQ ID NO: 496515 - DNA, 20 bp, mouse
gctgcttctgggtaaggccg

SEQ ID NO: 496516 - DNA, 20 bp, mouse
ggcggagcggacaggagacg

SEQ ID NO: 496517 - DNA, 20 bp, mouse
gcagaactcgcatcgctcgg

SEQ ID NO: 496518 - DNA, 20 bp, mouse
gggcgatgcacatgcactag

SEQ ID NO: 496519 - DNA, 20 bp, mouse
gtgcagctctctctagcggg

SEQ ID NO: 496520 - DNA, 20 bp, mouse
gatcgctcggcggagcggac

SEQ ID NO: 496521 - DNA, 20 bp, mouse
gcgcatcgacggccgaggag

SEQ ID NO: 496522 - DNA, 20 bp, mouse
gcagcggggagcgcgagaag

SEQ ID NO: 496523 - DNA, 20 bp, mouse
gctcgcatcgctcggcggag

SEQ ID NO: 496524 - DNA, 20 bp, mouse
ggtgtggagggagtgagtta

SEQ ID NO: 496525 - DNA, 20 bp, mouse
gcggggagcgcgagaagagg

SEQ ID NO: 496526 - DNA, 20 bp, mouse
gccggagccgagtcaggcgg

SEQ ID NO: 496527 - DNA, 20 bp, mouse
ggggcgcccggagccgagtc

SEQ ID NO: 496528 - DNA, 20 bp, mouse
gcgcccggagccgagtcagg

SEQ ID NO: 496529 - DNA, 20 bp, mouse
gggagcacagatccgggagg

SEQ ID NO: 496530 - DNA, 20 bp, mouse
gactggagcacagatccggg

SEQ ID NO: 496531 - DNA, 20 bp, mouse
gctgaactggagcacagatc

SEQ ID NO: 496532 - DNA, 20 bp, mouse
ggagccgagtcaggcggcgg

SEQ ID NO: 496533 - DNA, 20 bp, mouse
ggcgtcagggacgagctcag

SEQ ID NO: 496534 - DNA, 20 bp, mouse
gggcccgagctcatccaccg

SEQ ID NO: 496535 - DNA, 20 bp, mouse
gggccgcgcgctctccgaga

SEQ ID NO: 496536 - DNA, 20 bp, mouse
gtcggccccggagcgagggg

SEQ ID NO: 496537 - DNA, 20 bp, mouse
gagggtggcggctcggacta

SEQ ID NO: 496538 - DNA, 20 bp, mouse
gcggagcagagcaggagccg

SEQ ID NO: 496539 - DNA, 20 bp, mouse
gtcggactaaggcaagcgcg

SEQ ID NO: 496540 - DNA, 20 bp, mouse
gaaagcggggaacgcgggga

SEQ ID NO: 496541 - DNA, 20 bp, mouse
gctcctgctctgctccgcct

SEQ ID NO: 496542 - DNA, 20 bp, mouse
ggaccagcgcaacgaggaga

SEQ ID NO: 496543 - DNA, 20 bp, mouse
gttgccgaggcagcccatgg

SEQ ID NO: 496544 - DNA, 20 bp, mouse
gaccgaggaccagcgcaacg

SEQ ID NO: 496545 - DNA, 20 bp, mouse
gctcggcaacagtaagaccg

SEQ ID NO: 496546 - DNA, 20 bp, mouse
gttcaggtggctggtaccag

SEQ ID NO: 496547 - DNA, 20 bp, mouse
ggccccgagcccagagagcc

SEQ ID NO: 496548 - DNA, 20 bp, mouse
gcggagcgggttgcttcagg

SEQ ID NO: 496549 - DNA, 20 bp, mouse
gcgctagctcccggctctct

SEQ ID NO: 496550 - DNA, 20 bp, mouse
gtcgcgtcggcaccgcggag

SEQ ID NO: 496551 - DNA, 20 bp, mouse
ggcaggcaagagccgggata

SEQ ID NO: 496552 - DNA, 20 bp, mouse
gccgcggagcgggttgcttc

SEQ ID NO: 496553 - DNA, 20 bp, mouse
gcggggacactcagtcgcgt

SEQ ID NO: 496554 - DNA, 20 bp, mouse
gctcagtcgcgtcggcaccg

SEQ ID NO: 496555 - DNA, 20 bp, mouse
gccgccaagcgctgggacaa

SEQ ID NO: 496556 - DNA, 20 bp, mouse
gtcgtctgaggaggccgggg

SEQ ID NO: 496557 - DNA, 20 bp, mouse
gaggtcgtctgaggaggccg

SEQ ID NO: 496558 - DNA, 20 bp, mouse
ggccagaaggtcgtctgagg

SEQ ID NO: 496559 - DNA, 20 bp, mouse
gtggagagccagttgattgt

SEQ ID NO: 496560 - DNA, 20 bp, mouse
gggggccagaaggtcgtctg

SEQ ID NO: 496561 - DNA, 20 bp, mouse
gcccccatggtcccagcagc

SEQ ID NO: 496562 - DNA, 20 bp, mouse
ggcctcctcagacgaccttc

SEQ ID NO: 496563 - DNA, 20 bp, mouse
gggacagctgccgggcagtc

SEQ ID NO: 496564 - DNA, 20 bp, mouse
ggcagggattccttagacgg

SEQ ID NO: 496565 - DNA, 20 bp, mouse
gtaggggtgtgggccagcga

SEQ ID NO: 496566 - DNA, 20 bp, mouse
ggctcgggtaaggagtctca

SEQ ID NO: 496567 - DNA, 20 bp, mouse
ggctgggcgagagtgcggac

SEQ ID NO: 496568 - DNA, 20 bp, mouse
ggagctctccagctcgggta

SEQ ID NO: 496569 - DNA, 20 bp, mouse
gtaaaagctgggcgagagtg

SEQ ID NO: 496570 - DNA, 20 bp, mouse
gggaaggagctctccagctc

SEQ ID NO: 496571 - DNA, 20 bp, mouse
ggggcgagagtgcggaccgg

SEQ ID NO: 496572 - DNA, 20 bp, mouse
gaactcgaggctgaaccaga

SEQ ID NO: 496573 - DNA, 20 bp, mouse
gtcttcttcccgtaaaagct

SEQ ID NO: 496574 - DNA, 20 bp, mouse
gtgcaggctccagggtaact

SEQ ID NO: 496575 - DNA, 20 bp, mouse
gaggggacaatccccggatt

SEQ ID NO: 496576 - DNA, 20 bp, mouse
ggagcggtgctcgctacaac

SEQ ID NO: 496577 - DNA, 20 bp, mouse
gagcagaattgagagcgcag

SEQ ID NO: 496578 - DNA, 20 bp, mouse
gacagctgtagtttagatat

SEQ ID NO: 496579 - DNA, 20 bp, mouse
ggaactggagaagaagcttc

SEQ ID NO: 496580 - DNA, 20 bp, mouse
ggccactaacatcaaaagat

SEQ ID NO: 496581 - DNA, 20 bp, mouse
ggagcaaggaatcagccaga

SEQ ID NO: 496582 - DNA, 20 bp, mouse
gttcctggaggattaatata

SEQ ID NO: 496583 - DNA, 20 bp, mouse
gggatatgtttggaatccta

SEQ ID NO: 496584 - DNA, 20 bp, mouse
gattaatataaggatatgtt

SEQ ID NO: 496585 - DNA, 20 bp, mouse
gatgtgaaatcagtaccctt

SEQ ID NO: 496586 - DNA, 20 bp, mouse
gtggggacccgagatctata

SEQ ID NO: 496587 - DNA, 20 bp, mouse
gcgactccgccccctgccgg

SEQ ID NO: 496588 - DNA, 20 bp, mouse
ggggtggacccgcttgcagg

SEQ ID NO: 496589 - DNA, 20 bp, mouse
gcagggatgcccctccgggt

SEQ ID NO: 496590 - DNA, 20 bp, mouse
ggacgtgaccggtccgcggg

SEQ ID NO: 496591 - DNA, 20 bp, mouse
gcgggctctcccacccggag

SEQ ID NO: 496592 - DNA, 20 bp, mouse
gctcccgcgccgcctgcaag

SEQ ID NO: 496593 - DNA, 20 bp, mouse
ggcacgaagccgcgcccggg

SEQ ID NO: 496594 - DNA, 20 bp, mouse
gtcggtcgagctgcacccgg

SEQ ID NO: 496595 - DNA, 20 bp, mouse
ggcgcgcacagctgaacccg

SEQ ID NO: 496596 - DNA, 20 bp, mouse
ggccgccgcgcccatcctga

SEQ ID NO: 496597 - DNA, 20 bp, mouse
gcgcctccagccatcaggat

SEQ ID NO: 496598 - DNA, 20 bp, mouse
ggatggctggaggcgtctga

SEQ ID NO: 496599 - DNA, 20 bp, mouse
ggagcgcgacgaccaggcgg

SEQ ID NO: 496600 - DNA, 20 bp, mouse
ggcggcgtgggcgccagacc

SEQ ID NO: 496601 - DNA, 20 bp, mouse
ggcggcctgcgggcaggagt

SEQ ID NO: 496602 - DNA, 20 bp, mouse
gcgcgagcgcgacgaccagg

SEQ ID NO: 496603 - DNA, 20 bp, mouse
gggccgcgagcgcgacgacc

SEQ ID NO: 496604 - DNA, 20 bp, mouse
gctggggtctcggggtccgg

SEQ ID NO: 496605 - DNA, 20 bp, mouse
gcgcgacgtggggtttcccg

SEQ ID NO: 496606 - DNA, 20 bp, mouse
ggaggggccgccaggatcag

SEQ ID NO: 496607 - DNA, 20 bp, mouse
gcgttaggctcggatcttcg

SEQ ID NO: 496608 - DNA, 20 bp, mouse
gaggtggcagcaagaccctc

SEQ ID NO: 496609 - DNA, 20 bp, mouse
ggcagcaagaccctcgggtc

SEQ ID NO: 496610 - DNA, 20 bp, mouse
gtaggctcggatcttcgcgg

SEQ ID NO: 496611 - DNA, 20 bp, mouse
gcttcgcggcggggtctgtg

SEQ ID NO: 496612 - DNA, 20 bp, mouse
gtcctggcgcagtcctaggt

SEQ ID NO: 496613 - DNA, 20 bp, mouse
gcctaacgcaaccggacccg

SEQ ID NO: 496614 - DNA, 20 bp, mouse
gcaagacagggcccctacgc

SEQ ID NO: 496615 - DNA, 20 bp, mouse
gtctgtgtggaggcgtgagg

SEQ ID NO: 496616 - DNA, 20 bp, mouse
gctccgccgcggaggaagac

SEQ ID NO: 496617 - DNA, 20 bp, mouse
ggaggtcctgtcttcctccg

SEQ ID NO: 496618 - DNA, 20 bp, mouse
ggtcctgtcttcctccgcgg

SEQ ID NO: 496619 - DNA, 20 bp, mouse
gaacgaccgggccagaggaa

SEQ ID NO: 496620 - DNA, 20 bp, mouse
gcgggagacggaaggaaccg

SEQ ID NO: 496621 - DNA, 20 bp, mouse
ggcgctggacggttgagttg

SEQ ID NO: 496622 - DNA, 20 bp, mouse
ggctcctccaagcgacccct

SEQ ID NO: 496623 - DNA, 20 bp, mouse
ggggtcgcttggaggagcgc

SEQ ID NO: 496624 - DNA, 20 bp, mouse
gcacgagggctgttacccag

SEQ ID NO: 496625 - DNA, 20 bp, mouse
gttatcagcggaggtacctg

SEQ ID NO: 496626 - DNA, 20 bp, mouse
gagagagccaagcaccacag

SEQ ID NO: 496627 - DNA, 20 bp, mouse
ggtcgccgcagcgacaagga

SEQ ID NO: 496628 - DNA, 20 bp, mouse
ggtcgtggtggcagccgctg

SEQ ID NO: 496629 - DNA, 20 bp, mouse
gtttctccacagggtcgtgg

SEQ ID NO: 496630 - DNA, 20 bp, mouse
ggagggtcgccgcagcgaca

SEQ ID NO: 496631 - DNA, 20 bp, mouse
ggcagcgacaaggatggcac

SEQ ID NO: 496632 - DNA, 20 bp, mouse
gatggctgcagttgatgcga

SEQ ID NO: 496633 - DNA, 20 bp, mouse
gggacaccgggtgatttacc

SEQ ID NO: 496634 - DNA, 20 bp, mouse
gagggtcatctgctcggtca

SEQ ID NO: 496635 - DNA, 20 bp, mouse
gcgcagacaggatcatgtcc

SEQ ID NO: 496636 - DNA, 20 bp, mouse
gagacagtgaggaggcgccc

SEQ ID NO: 496637 - DNA, 20 bp, mouse
ggcccgggaagcggaaacct

SEQ ID NO: 496638 - DNA, 20 bp, mouse
gggccagctccctcttactt

SEQ ID NO: 496639 - DNA, 20 bp, mouse
gagggagagccccccatcac

SEQ ID NO: 496640 - DNA, 20 bp, mouse
gtcccaggtttccgcttccc

SEQ ID NO: 496641 - DNA, 20 bp, mouse
gctcctctggcagcagaggg

SEQ ID NO: 496642 - DNA, 20 bp, mouse
gcagccagagcccaagtaag

SEQ ID NO: 496643 - DNA, 20 bp, mouse
gatgggcccccgatcccaga

SEQ ID NO: 496644 - DNA, 20 bp, mouse
gctccctcttacttgggctc

SEQ ID NO: 496645 - DNA, 20 bp, mouse
ggccccccatcacaggagta

SEQ ID NO: 496646 - DNA, 20 bp, mouse
gtggcggccgggctccaggt

SEQ ID NO: 496647 - DNA, 20 bp, mouse
ggtgtggtggagccagctag

SEQ ID NO: 496648 - DNA, 20 bp, mouse
gctggctccaccacacaaga

SEQ ID NO: 496649 - DNA, 20 bp, mouse
ggcgcccagcagtagcgcgg

SEQ ID NO: 496650 - DNA, 20 bp, mouse
gcgtcctctagactcccggg

SEQ ID NO: 496651 - DNA, 20 bp, mouse
ggtgtggtcgccgtcttgtg

SEQ ID NO: 496652 - DNA, 20 bp, mouse
gccaccaccgcgctactgct

SEQ ID NO: 496653 - DNA, 20 bp, mouse
gcgtccacccgggagtctag

SEQ ID NO: 496654 - DNA, 20 bp, mouse
gcgctctgcgaggcccggga

SEQ ID NO: 496655 - DNA, 20 bp, mouse
gtggtcgccgtcttgtgtgg

SEQ ID NO: 496656 - DNA, 20 bp, mouse
gagactgtgagtcgatgcgg

SEQ ID NO: 496657 - DNA, 20 bp, mouse
ggggagactgtgagtcgatg

SEQ ID NO: 496658 - DNA, 20 bp, mouse
gggcggcgttggggtcacgg

SEQ ID NO: 496659 - DNA, 20 bp, mouse
gatgcgggggcccgacggga

SEQ ID NO: 496660 - DNA, 20 bp, mouse
ggtcgatgcgggggcccgac

SEQ ID NO: 496661 - DNA, 20 bp, mouse
ggctgctcccgccctcccgt

SEQ ID NO: 496662 - DNA, 20 bp, mouse
ggacgaagatggcaaccgat

SEQ ID NO: 496663 - DNA, 20 bp, mouse
gagcctcaagggcaagctag

SEQ ID NO: 496664 - DNA, 20 bp, mouse
gggagcgtgagtgcgagcag

SEQ ID NO: 496665 - DNA, 20 bp, mouse
gggctgcatccggacgaaga

SEQ ID NO: 496666 - DNA, 20 bp, mouse
gcgcgtccagcgggtccaca

SEQ ID NO: 496667 - DNA, 20 bp, mouse
gagcctgccaagtgccgagg

SEQ ID NO: 496668 - DNA, 20 bp, mouse
gccccggcaagcgcacccgg

SEQ ID NO: 496669 - DNA, 20 bp, mouse
ggcgccggagggaactaacc

SEQ ID NO: 496670 - DNA, 20 bp, mouse
gccggagggaactaacccgg

SEQ ID NO: 496671 - DNA, 20 bp, mouse
ggcgagcctgccaagtgccg

SEQ ID NO: 496672 - DNA, 20 bp, mouse
ggtcgagcggcgccgggtag

SEQ ID NO: 496673 - DNA, 20 bp, mouse
ggcctgccctgtggacccgc

SEQ ID NO: 496674 - DNA, 20 bp, mouse
gtccagcgggtccacagggc

SEQ ID NO: 496675 - DNA, 20 bp, mouse
ggcctgctgcgtgcacggat

SEQ ID NO: 496676 - DNA, 20 bp, mouse
ggaggccagacggcagctcg

SEQ ID NO: 496677 - DNA, 20 bp, mouse
gttcgtggcagctaaaccag

SEQ ID NO: 496678 - DNA, 20 bp, mouse
ggggagtccgaccacacctc

SEQ ID NO: 496679 - DNA, 20 bp, mouse
ggactccccgagctgccgtc

SEQ ID NO: 496680 - DNA, 20 bp, mouse
gcttgctaatgaccacttcg

SEQ ID NO: 496681 - DNA, 20 bp, mouse
gagtgctctaggggacctag

SEQ ID NO: 496682 - DNA, 20 bp, mouse
gctctcgtcagatgagaagg

SEQ ID NO: 496683 - DNA, 20 bp, mouse
gctgacgagagccaaagaat

SEQ ID NO: 496684 - DNA, 20 bp, mouse
gacacacgcgcatctccaca

SEQ ID NO: 496685 - DNA, 20 bp, mouse
gactcaggatgatgacatcg

SEQ ID NO: 496686 - DNA, 20 bp, mouse
gctggccccggaagacatgg

SEQ ID NO: 496687 - DNA, 20 bp, mouse
gacgctggccccggaagaca

SEQ ID NO: 496688 - DNA, 20 bp, mouse
gccggaagacatggcggcta

SEQ ID NO: 496689 - DNA, 20 bp, mouse
gcatcctcccgcagccgggt

SEQ ID NO: 496690 - DNA, 20 bp, mouse
gagcgccctgcagcgcctgg

SEQ ID NO: 496691 - DNA, 20 bp, mouse
gaggctgcgcgaggctggtt

SEQ ID NO: 496692 - DNA, 20 bp, mouse
gagccgggtgggcagagtcc

SEQ ID NO: 496693 - DNA, 20 bp, mouse
gcgctgcagggcgctcacgc

SEQ ID NO: 496694 - DNA, 20 bp, mouse
gctctcaaggatcccccatg

SEQ ID NO: 496695 - DNA, 20 bp, mouse
gcgcggctcgcgagcacccg

SEQ ID NO: 496696 - DNA, 20 bp, mouse
gacttctgggcccagttctg

SEQ ID NO: 496697 - DNA, 20 bp, mouse
gacttgtgcaagggagccac

SEQ ID NO: 496698 - DNA, 20 bp, mouse
gggcagatcctcgatgtgaa

SEQ ID NO: 496699 - DNA, 20 bp, mouse
gcagttctaggcgcttccag

SEQ ID NO: 496700 - DNA, 20 bp, mouse
ggcatctttgccccagaact

SEQ ID NO: 496701 - DNA, 20 bp, mouse
ggatcctcgatgtgaagggc

SEQ ID NO: 496702 - DNA, 20 bp, mouse
gggcagactgcctggctaca

SEQ ID NO: 496703 - DNA, 20 bp, mouse
ggggcgtggcaagagtcctg

SEQ ID NO: 496704 - DNA, 20 bp, mouse
ggcagctcccagctccccgg

SEQ ID NO: 496705 - DNA, 20 bp, mouse
gtgggagcttctctttaagg

SEQ ID NO: 496706 - DNA, 20 bp, mouse
gggagagccggactcccagg

SEQ ID NO: 496707 - DNA, 20 bp, mouse
gcggcgaagagtgagtgcca

SEQ ID NO: 496708 - DNA, 20 bp, mouse
gtccggtcccggcgctacct

SEQ ID NO: 496709 - DNA, 20 bp, mouse
gacaggcggccccgaagtag

SEQ ID NO: 496710 - DNA, 20 bp, mouse
ggtagcgccgggaccggacg

SEQ ID NO: 496711 - DNA, 20 bp, mouse
gcgcggagagccggactccc

SEQ ID NO: 496712 - DNA, 20 bp, mouse
ggccagcccgcgggacccac

SEQ ID NO: 496713 - DNA, 20 bp, mouse
gagcccgcgggacccacagg

SEQ ID NO: 496714 - DNA, 20 bp, mouse
gaggccgagcgaggcagcta

SEQ ID NO: 496715 - DNA, 20 bp, mouse
gacgcgcgtctagagatcgg

SEQ ID NO: 496716 - DNA, 20 bp, mouse
ggcaaaagcagagatgacaa

SEQ ID NO: 496717 - DNA, 20 bp, mouse
gacaagggccgagggatctg

SEQ ID NO: 496718 - DNA, 20 bp, mouse
ggccgacagatcgagtccag

SEQ ID NO: 496719 - DNA, 20 bp, mouse
gcacacgccgacaggcacgt

SEQ ID NO: 496720 - DNA, 20 bp, mouse
gggatctgtggagtgaggct

SEQ ID NO: 496721 - DNA, 20 bp, mouse
gggcggcagcagcgcaggta

SEQ ID NO: 496722 - DNA, 20 bp, mouse
gtggtcaagccctagagccc

SEQ ID NO: 496723 - DNA, 20 bp, mouse
gccgagggatctgtggagtg

SEQ ID NO: 496724 - DNA, 20 bp, mouse
gacgccgacaggcacgtggg

SEQ ID NO: 496725 - DNA, 20 bp, mouse
gcccccggccaggcgcacgg

SEQ ID NO: 496726 - DNA, 20 bp, mouse
gaagcctccggagccaagca

SEQ ID NO: 496727 - DNA, 20 bp, mouse
gttaccttgcttggctccgg

SEQ ID NO: 496728 - DNA, 20 bp, mouse
gactcaggcttgggcttcag

SEQ ID NO: 496729 - DNA, 20 bp, mouse
ggtaggagttgcccaccgag

SEQ ID NO: 496730 - DNA, 20 bp, mouse
gacacacgacgcctctcggt

SEQ ID NO: 496731 - DNA, 20 bp, mouse
gcggtgggcaactcctacta

SEQ ID NO: 496732 - DNA, 20 bp, mouse
gagcccagcccagccgtagt

SEQ ID NO: 496733 - DNA, 20 bp, mouse
gcaattcaaaaggagctaca

SEQ ID NO: 496734 - DNA, 20 bp, mouse
gcagtctgggcacccgagcg

SEQ ID NO: 496735 - DNA, 20 bp, mouse
gacaagggtctgccacgctc

SEQ ID NO: 496736 - DNA, 20 bp, mouse
gtcagacgagatccttggag

SEQ ID NO: 496737 - DNA, 20 bp, mouse
gctgggcagaacttaagctg

SEQ ID NO: 496738 - DNA, 20 bp, mouse
gagggtggggcacctatctg

SEQ ID NO: 496739 - DNA, 20 bp, mouse
gtccaagtcctggcagggtg

SEQ ID NO: 496740 - DNA, 20 bp, mouse
ggatgctcagacgagatcct

SEQ ID NO: 496741 - DNA, 20 bp, mouse
ggacgagatccttggagggg

SEQ ID NO: 496742 - DNA, 20 bp, mouse
gcagggatgtagggtcagtg

SEQ ID NO: 496743 - DNA, 20 bp, mouse
gtaagttctgcccagatggc

SEQ ID NO: 496744 - DNA, 20 bp, mouse
gggatgtagggtcagtgggg

SEQ ID NO: 496745 - DNA, 20 bp, mouse
gctagcatccttcatccttc

SEQ ID NO: 496746 - DNA, 20 bp, mouse
gagacctgctgcgaaggagt

SEQ ID NO: 496747 - DNA, 20 bp, mouse
gtggcgcagcaggcgagggt

SEQ ID NO: 496748 - DNA, 20 bp, mouse
gcgcagcaggcgagggttgg

SEQ ID NO: 496749 - DNA, 20 bp, mouse
ggtctgcgcagtgggcccac

SEQ ID NO: 496750 - DNA, 20 bp, mouse
gcacccgcaagcgggacctc

SEQ ID NO: 496751 - DNA, 20 bp, mouse
gggacctcgggtctgcgcag

SEQ ID NO: 496752 - DNA, 20 bp, mouse
ggcgtgctgaggcacctcca

SEQ ID NO: 496753 - DNA, 20 bp, mouse
gggcccactgcgcagacccg

SEQ ID NO: 496754 - DNA, 20 bp, mouse
gcgcgtctggggagaaaagg

SEQ ID NO: 496755 - DNA, 20 bp, mouse
ggcgcccgaggcccccggga

SEQ ID NO: 496756 - DNA, 20 bp, mouse
gggccagaggagccgcgtgt

SEQ ID NO: 496757 - DNA, 20 bp, mouse
gggaagcgcgagccgacacg

SEQ ID NO: 496758 - DNA, 20 bp, mouse
gcgaggctggacccccacaa

SEQ ID NO: 496759 - DNA, 20 bp, mouse
ggagtcggcgggcggcggaa

SEQ ID NO: 496760 - DNA, 20 bp, mouse
gcgccggggccgccgagagt

SEQ ID NO: 496761 - DNA, 20 bp, mouse
gcggggccgccgagagtcgg

SEQ ID NO: 496762 - DNA, 20 bp, mouse
ggccgcccgccgactctcgg

SEQ ID NO: 496763 - DNA, 20 bp, mouse
gccgccatccggagctaccc

SEQ ID NO: 496764 - DNA, 20 bp, mouse
gtcgccctcggcccacagcc

SEQ ID NO: 496765 - DNA, 20 bp, mouse
gaggtcagccgagcacgccg

SEQ ID NO: 496766 - DNA, 20 bp, mouse
gtgtgcggctgctgagacac

SEQ ID NO: 496767 - DNA, 20 bp, mouse
gctgctgagacactggctgg

SEQ ID NO: 496768 - DNA, 20 bp, mouse
ggcaccgcggggcctagaga

SEQ ID NO: 496769 - DNA, 20 bp, mouse
ggctgcccccgtcctctctg

SEQ ID NO: 496770 - DNA, 20 bp, mouse
ggctgcctcagagaggacgg

SEQ ID NO: 496771 - DNA, 20 bp, mouse
gcggctgctgagacactggc

SEQ ID NO: 496772 - DNA, 20 bp, mouse
gagagactcggggtgtatcg

SEQ ID NO: 496773 - DNA, 20 bp, mouse
ggactcggggtgtatcgggg

SEQ ID NO: 496774 - DNA, 20 bp, mouse
ggcaatcagggaggaatggg

SEQ ID NO: 496775 - DNA, 20 bp, mouse
gaggagtgtggtgtagtcag

SEQ ID NO: 496776 - DNA, 20 bp, mouse
gtccccgctggaccacacgg

SEQ ID NO: 496777 - DNA, 20 bp, mouse
gccttccccgctggaccaca

SEQ ID NO: 496778 - DNA, 20 bp, mouse
gggcggaggccgtgcctata

SEQ ID NO: 496779 - DNA, 20 bp, mouse
gcagcatgctctctccctat

SEQ ID NO: 496780 - DNA, 20 bp, mouse
gcctccgccgtgtggtccag

SEQ ID NO: 496781 - DNA, 20 bp, mouse
gatgctgtgggtgtgatcaa

SEQ ID NO: 496782 - DNA, 20 bp, mouse
gcagagggagccttccccgc

SEQ ID NO: 496783 - DNA, 20 bp, mouse
ggtgggtgtgatcaagggag

SEQ ID NO: 496784 - DNA, 20 bp, mouse
gtgctctctccctataggca

SEQ ID NO: 496785 - DNA, 20 bp, mouse
ggatagaaacgggagatctg

SEQ ID NO: 496786 - DNA, 20 bp, mouse
gggtcttcgatgttgatcac

SEQ ID NO: 496787 - DNA, 20 bp, mouse
gggtgacctctggaattcac

SEQ ID NO: 496788 - DNA, 20 bp, mouse
gaccagggaagctgtttttt

SEQ ID NO: 496789 - DNA, 20 bp, mouse
gatatactaaaggaattgag

SEQ ID NO: 496790 - DNA, 20 bp, mouse
gcttaagaaggaagtgacac

SEQ ID NO: 496791 - DNA, 20 bp, mouse
ggaggtagaccagcttaaga

SEQ ID NO: 496792 - DNA, 20 bp, mouse
gcctctgctttgcacttacc

SEQ ID NO: 496793 - DNA, 20 bp, mouse
gagagcttgttcatgagagc

SEQ ID NO: 496794 - DNA, 20 bp, mouse
gagaggcatgggctgcctgt

SEQ ID NO: 496795 - DNA, 20 bp, mouse
gatggtaagcgggtgacctc

SEQ ID NO: 496796 - DNA, 20 bp, mouse
gaacctgcctgtaaaggggt

SEQ ID NO: 496797 - DNA, 20 bp, mouse
ggcctctctgtaccctgctc

SEQ ID NO: 496798 - DNA, 20 bp, mouse
ggagagaccgagcccccaac

SEQ ID NO: 496799 - DNA, 20 bp, mouse
gagcctgtgaagggtcaggt

SEQ ID NO: 496800 - DNA, 20 bp, mouse
ggctggcagtacagctccag

SEQ ID NO: 496801 - DNA, 20 bp, mouse
ggggatggggtagtagagac

SEQ ID NO: 496802 - DNA, 20 bp, mouse
gtccactcatggaagagggg

SEQ ID NO: 496803 - DNA, 20 bp, mouse
ggaggaagctagttgatggg

SEQ ID NO: 496804 - DNA, 20 bp, mouse
gtgcgggagctgtttaccac

SEQ ID NO: 496805 - DNA, 20 bp, mouse
ggtctgacttcctcttgtcc

SEQ ID NO: 496806 - DNA, 20 bp, mouse
gggcggcacgtgagagtccg

SEQ ID NO: 496807 - DNA, 20 bp, mouse
gtccgcgggtccgggatgca

SEQ ID NO: 496808 - DNA, 20 bp, mouse
gctgcgggaaacccccaccg

SEQ ID NO: 496809 - DNA, 20 bp, mouse
gaccgtgcatcccggacccg

SEQ ID NO: 496810 - DNA, 20 bp, mouse
gcggtgacgtcagcagcgag

SEQ ID NO: 496811 - DNA, 20 bp, mouse
gacgtcagcagcgagcggcg

SEQ ID NO: 496812 - DNA, 20 bp, mouse
gtgccccggggagtcagttg

SEQ ID NO: 496813 - DNA, 20 bp, mouse
ggcctctggagaagttgggt

SEQ ID NO: 496814 - DNA, 20 bp, mouse
gggctctcgcgatcccgcgt

SEQ ID NO: 496815 - DNA, 20 bp, mouse
gcccggggagtcagttgcgg

SEQ ID NO: 496816 - DNA, 20 bp, mouse
gcggctgggaagtcgtgaag

SEQ ID NO: 496817 - DNA, 20 bp, mouse
ggcgagtagcagagcggtgt

SEQ ID NO: 496818 - DNA, 20 bp, mouse
gtacctcgcgagtagcagag

SEQ ID NO: 496819 - DNA, 20 bp, mouse
gggtccaacgtgcttcacac

SEQ ID NO: 496820 - DNA, 20 bp, mouse
gcaggccgcaggagccgtcg

SEQ ID NO: 496821 - DNA, 20 bp, mouse
ggagcaggtgcctagacctc

SEQ ID NO: 496822 - DNA, 20 bp, mouse
gacaggacgctttcccggct

SEQ ID NO: 496823 - DNA, 20 bp, mouse
gctcctcctgagaggcctcg

SEQ ID NO: 496824 - DNA, 20 bp, mouse
gttcacacaggacgctttcc

SEQ ID NO: 496825 - DNA, 20 bp, mouse
gtggtgaagcccaagtacaa

SEQ ID NO: 496826 - DNA, 20 bp, mouse
ggacgcttcaggagcagagg

SEQ ID NO: 496827 - DNA, 20 bp, mouse
gcgtggcgcccgagaagtcg

SEQ ID NO: 496828 - DNA, 20 bp, mouse
gtcaggagcagaggaggtct

SEQ ID NO: 496829 - DNA, 20 bp, mouse
ggggatcaccacgacttctc

SEQ ID NO: 496830 - DNA, 20 bp, mouse
gcacgtgcgaactggaactg

SEQ ID NO: 496831 - DNA, 20 bp, mouse
gtcgggcgccacgtgcgaac

SEQ ID NO: 496832 - DNA, 20 bp, mouse
gtctacgcggaactcatcaa

SEQ ID NO: 496833 - DNA, 20 bp, mouse
gtcactaggcctcttcatcc

SEQ ID NO: 496834 - DNA, 20 bp, mouse
ggctcccgaccccactcact

SEQ ID NO: 496835 - DNA, 20 bp, mouse
gtatacaacaggccaaattt

SEQ ID NO: 496836 - DNA, 20 bp, mouse
gtagctgcgcactcctggac

SEQ ID NO: 496837 - DNA, 20 bp, mouse
gtgggatccggaagtctggg

SEQ ID NO: 496838 - DNA, 20 bp, mouse
gagctctccgaggtccctgc

SEQ ID NO: 496839 - DNA, 20 bp, mouse
gggctgggatccggaagtct

SEQ ID NO: 496840 - DNA, 20 bp, mouse
ggagcctagctgcgcactcc

SEQ ID NO: 496841 - DNA, 20 bp, mouse
gtgcttctaacagctctccg

SEQ ID NO: 496842 - DNA, 20 bp, mouse
gtcgccatcctggactagag

SEQ ID NO: 496843 - DNA, 20 bp, mouse
gagtctcttacctacacttc

SEQ ID NO: 496844 - DNA, 20 bp, mouse
gagcacaacgtcgccagtcc

SEQ ID NO: 496845 - DNA, 20 bp, mouse
gcttacctacacttccggca

SEQ ID NO: 496846 - DNA, 20 bp, mouse
gtaccgtacccgctccctgg

SEQ ID NO: 496847 - DNA, 20 bp, mouse
gcacccccagggagcgggta

SEQ ID NO: 496848 - DNA, 20 bp, mouse
gccttcggccgccaccccca

SEQ ID NO: 496849 - DNA, 20 bp, mouse
gcaggcgccggtcaggatgg

SEQ ID NO: 496850 - DNA, 20 bp, mouse
gggccgccacccccagggag

SEQ ID NO: 496851 - DNA, 20 bp, mouse
gagccaggcgccggtcagga

SEQ ID NO: 496852 - DNA, 20 bp, mouse
gccgcagaggctgcccagac

SEQ ID NO: 496853 - DNA, 20 bp, mouse
ggaccagtatgcagatgggg

SEQ ID NO: 496854 - DNA, 20 bp, mouse
gcctggcaggcagtactagg

SEQ ID NO: 496855 - DNA, 20 bp, mouse
gtgcgcagagaaggattcat

SEQ ID NO: 496856 - DNA, 20 bp, mouse
gtggcttcttcaatgactgg

SEQ ID NO: 496857 - DNA, 20 bp, mouse
gttgtccagcgtcaaccagt

SEQ ID NO: 496858 - DNA, 20 bp, mouse
gagttggcttcttcaatgac

SEQ ID NO: 496859 - DNA, 20 bp, mouse
gatgcaggtctgccttatca

SEQ ID NO: 496860 - DNA, 20 bp, mouse
ggcagcaggccagccatctt

SEQ ID NO: 496861 - DNA, 20 bp, mouse
gcagccatcttcggacgtgg

SEQ ID NO: 496862 - DNA, 20 bp, mouse
ggaagccaactggttgacgc

SEQ ID NO: 496863 - DNA, 20 bp, mouse
gtgccagcactaaagaagac

SEQ ID NO: 496864 - DNA, 20 bp, mouse
ggaccagagcgagcaccggc

SEQ ID NO: 496865 - DNA, 20 bp, mouse
ggctcccccacgtccgaaga

SEQ ID NO: 496866 - DNA, 20 bp, mouse
gaggacagtggcactccgta

SEQ ID NO: 496867 - DNA, 20 bp, mouse
gggccactgcacgggacccc

SEQ ID NO: 496868 - DNA, 20 bp, mouse
ggcctcgggcctggttaaga

SEQ ID NO: 496869 - DNA, 20 bp, mouse
gtcgggcctggttaagatgg

SEQ ID NO: 496870 - DNA, 20 bp, mouse
gatagaggagcacactgcta

SEQ ID NO: 496871 - DNA, 20 bp, mouse
ggccgagccgaccgagaatc

SEQ ID NO: 496872 - DNA, 20 bp, mouse
ggtcccgtgcagtggccgta

SEQ ID NO: 496873 - DNA, 20 bp, mouse
gctccgtacggccactgcac

SEQ ID NO: 496874 - DNA, 20 bp, mouse
gaccagcccaggccccgcca

SEQ ID NO: 496875 - DNA, 20 bp, mouse
gccaggcgcctaccgcatag

SEQ ID NO: 496876 - DNA, 20 bp, mouse
gcttactcgcaggcttcccg

SEQ ID NO: 496877 - DNA, 20 bp, mouse
ggcagcagctacagcactag

SEQ ID NO: 496878 - DNA, 20 bp, mouse
gcgagtaagtgggagcgacc

SEQ ID NO: 496879 - DNA, 20 bp, mouse
gaggtagccccgagcaggga

SEQ ID NO: 496880 - DNA, 20 bp, mouse
ggtaagtgggagcgacccgg

SEQ ID NO: 496881 - DNA, 20 bp, mouse
gcgccatgacctaggatcga

SEQ ID NO: 496882 - DNA, 20 bp, mouse
gcctaggatcgagggtcggg

SEQ ID NO: 496883 - DNA, 20 bp, mouse
gggcgcgcgcaccccgtgac

SEQ ID NO: 496884 - DNA, 20 bp, mouse
ggcgcgcaccccgtgaccgg

SEQ ID NO: 496885 - DNA, 20 bp, mouse
gcgaggcacggggagaggtg

SEQ ID NO: 496886 - DNA, 20 bp, mouse
ggtgtcccccctaaactcac

SEQ ID NO: 496887 - DNA, 20 bp, mouse
gttgctgggtgtgttagctc

SEQ ID NO: 496888 - DNA, 20 bp, mouse
gcccagcgcaggcagatctg

SEQ ID NO: 496889 - DNA, 20 bp, mouse
gcctcaccggctggagtcgc

SEQ ID NO: 496890 - DNA, 20 bp, mouse
gtcccccctaaactcaccgg

SEQ ID NO: 496891 - DNA, 20 bp, mouse
ggctcaggggcgtcaggcag

SEQ ID NO: 496892 - DNA, 20 bp, mouse
ggagtcgctggcgggttgct

SEQ ID NO: 496893 - DNA, 20 bp, mouse
ggctcttcggtcgttggatg

SEQ ID NO: 496894 - DNA, 20 bp, mouse
gcccgcggcagagtgaggac

SEQ ID NO: 496895 - DNA, 20 bp, mouse
gttgcacaccccgggctcag

SEQ ID NO: 496896 - DNA, 20 bp, mouse
gccgcctcaccgcactggag

SEQ ID NO: 496897 - DNA, 20 bp, mouse
ggcggaccacgctccagtcc

SEQ ID NO: 496898 - DNA, 20 bp, mouse
gccaggccgcctcaccgcac

SEQ ID NO: 496899 - DNA, 20 bp, mouse
ggagggcctaggagtgtccg

SEQ ID NO: 496900 - DNA, 20 bp, mouse
ggcctggggctgggacgcga

SEQ ID NO: 496901 - DNA, 20 bp, mouse
gggcggcgctttgacccgca

SEQ ID NO: 496902 - DNA, 20 bp, mouse
gggcgggcttgggaccgcag

SEQ ID NO: 496903 - DNA, 20 bp, mouse
ggacggcggcagaaaaggtg

SEQ ID NO: 496904 - DNA, 20 bp, mouse
gtcgcgccctttcataggga

SEQ ID NO: 496905 - DNA, 20 bp, mouse
gtgccgccgtccctatgaaa

SEQ ID NO: 496906 - DNA, 20 bp, mouse
gtcgccggagcgacaatgtg

SEQ ID NO: 496907 - DNA, 20 bp, mouse
ggacaatgtgcggcagccgg

SEQ ID NO: 496908 - DNA, 20 bp, mouse
ggccgcggcgtggagcccag

SEQ ID NO: 496909 - DNA, 20 bp, mouse
gtcagcgagccgccattcag

SEQ ID NO: 496910 - DNA, 20 bp, mouse
ggtggagcccagcgggccgt

SEQ ID NO: 496911 - DNA, 20 bp, mouse
ggcgtccgggggcccctgaa

SEQ ID NO: 496912 - DNA, 20 bp, mouse
gcgccacctagagggcggag

SEQ ID NO: 496913 - DNA, 20 bp, mouse
gagttcggagaggtgagtag

SEQ ID NO: 496914 - DNA, 20 bp, mouse
gacgtagagcccatacctgt

SEQ ID NO: 496915 - DNA, 20 bp, mouse
gtccgggggcccctgaatgg

SEQ ID NO: 496916 - DNA, 20 bp, mouse
gcacgtgaccgtgagaccct

SEQ ID NO: 496917 - DNA, 20 bp, mouse
gcgcgagccccagcaacatc

SEQ ID NO: 496918 - DNA, 20 bp, mouse
ggagaccctaggagcaatgg

SEQ ID NO: 496919 - DNA, 20 bp, mouse
gcgccccgccattgctccta

SEQ ID NO: 496920 - DNA, 20 bp, mouse
ggctcgcgtcgcagggtcag

SEQ ID NO: 496921 - DNA, 20 bp, mouse
ggcatgtgccgggaagatga

SEQ ID NO: 496922 - DNA, 20 bp, mouse
gtggcttcctgatgttgctg

SEQ ID NO: 496923 - DNA, 20 bp, mouse
ggccgaggtgctgactgagg

SEQ ID NO: 496924 - DNA, 20 bp, mouse
gggaggagcctaacacattc

SEQ ID NO: 496925 - DNA, 20 bp, mouse
gctctcggttagggagggaa

SEQ ID NO: 496926 - DNA, 20 bp, mouse
ggaagtactcaacctaccaa

SEQ ID NO: 496927 - DNA, 20 bp, mouse
gcaaggctggtgggtgataa

SEQ ID NO: 496928 - DNA, 20 bp, mouse
gagggatctcgagcttccgt

SEQ ID NO: 496929 - DNA, 20 bp, mouse
gatctcgagcttccgttggt

SEQ ID NO: 496930 - DNA, 20 bp, mouse
gacactgctggcttcctcaa

SEQ ID NO: 496931 - DNA, 20 bp, mouse
ggctctctcccaaggctggt

SEQ ID NO: 496932 - DNA, 20 bp, mouse
ggtttggatgtgaaagtcaa

SEQ ID NO: 496933 - DNA, 20 bp, mouse
gacaaagaactgtacctgtt

SEQ ID NO: 496934 - DNA, 20 bp, mouse
ggggagagagccgacctttg

SEQ ID NO: 496935 - DNA, 20 bp, mouse
ggtcggctctctcccaaggc

SEQ ID NO: 496936 - DNA, 20 bp, mouse
ggcctgtccttggagaaata

SEQ ID NO: 496937 - DNA, 20 bp, mouse
gggcagtagagagtaggaaa

SEQ ID NO: 496938 - DNA, 20 bp, mouse
gtgttagccatatttctcca

SEQ ID NO: 496939 - DNA, 20 bp, mouse
ggcagaagtggactcagaag

SEQ ID NO: 496940 - DNA, 20 bp, mouse
gcactcttgaagcctgtcct

SEQ ID NO: 496941 - DNA, 20 bp, mouse
ggagcttgccctgtatcaag

SEQ ID NO: 496942 - DNA, 20 bp, mouse
gtgatggccgagcagtgatt

SEQ ID NO: 496943 - DNA, 20 bp, mouse
gcttgttgaagctgcagaag

SEQ ID NO: 496944 - DNA, 20 bp, mouse
gatcagagtctccagcaggt

SEQ ID NO: 496945 - DNA, 20 bp, mouse
gatagctgagaactttgcag

SEQ ID NO: 496946 - DNA, 20 bp, mouse
gaccaggacgcggagctcgg

SEQ ID NO: 496947 - DNA, 20 bp, mouse
ggagagctgcggagagacgc

SEQ ID NO: 496948 - DNA, 20 bp, mouse
gtggcggccaagctccgcgg

SEQ ID NO: 496949 - DNA, 20 bp, mouse
ggccaagcggcccagcaaag

SEQ ID NO: 496950 - DNA, 20 bp, mouse
ggccggtgagcgcaggagac

SEQ ID NO: 496951 - DNA, 20 bp, mouse
gctcaccgacgaccaggacg

SEQ ID NO: 496952 - DNA, 20 bp, mouse
ggagagacgccggtgagcgc

SEQ ID NO: 496953 - DNA, 20 bp, mouse
gggctgcctggggctcgtgg

SEQ ID NO: 496954 - DNA, 20 bp, mouse
gccagcaaaggggcaagggg

SEQ ID NO: 496955 - DNA, 20 bp, mouse
ggccgaagggagccgcatgg

SEQ ID NO: 496956 - DNA, 20 bp, mouse
gcgccctcgagagtccgcgg

SEQ ID NO: 496957 - DNA, 20 bp, mouse
gggagtccctggacgcaagt

SEQ ID NO: 496958 - DNA, 20 bp, mouse
ggtagagcgccggaggccat

SEQ ID NO: 496959 - DNA, 20 bp, mouse
ggggctgtcaaccaagggag

SEQ ID NO: 496960 - DNA, 20 bp, mouse
gtggaggcgcagccctacta

SEQ ID NO: 496961 - DNA, 20 bp, mouse
gcgcctccgcggactctcga

SEQ ID NO: 496962 - DNA, 20 bp, mouse
gtaggcctccctctctccca

SEQ ID NO: 496963 - DNA, 20 bp, mouse
gggaggcctacttgcgtcca

SEQ ID NO: 496964 - DNA, 20 bp, mouse
gaagcgccctcgagagtccg

SEQ ID NO: 496965 - DNA, 20 bp, mouse
gcctagggagacatgagtgt

SEQ ID NO: 496966 - DNA, 20 bp, mouse
gcgggatgtcggaagaaacc

SEQ ID NO: 496967 - DNA, 20 bp, mouse
ggaaaccaggcagagcaaat

SEQ ID NO: 496968 - DNA, 20 bp, mouse
gcctccccgccccgggatgt

SEQ ID NO: 496969 - DNA, 20 bp, mouse
gctaggggcgactgagaggg

SEQ ID NO: 496970 - DNA, 20 bp, mouse
gttggctgcggccaagaaaa

SEQ ID NO: 496971 - DNA, 20 bp, mouse
ggggtcaaggggccgcgacc

SEQ ID NO: 496972 - DNA, 20 bp, mouse
gcccacccgagctcctccaa

SEQ ID NO: 496973 - DNA, 20 bp, mouse
gtcacctaggggcgactgag

SEQ ID NO: 496974 - DNA, 20 bp, mouse
gggagctcgggtggggtcaa

SEQ ID NO: 496975 - DNA, 20 bp, mouse
gctccaatccagacctccca

SEQ ID NO: 496976 - DNA, 20 bp, mouse
gctgcggctccggtaggacg

SEQ ID NO: 496977 - DNA, 20 bp, mouse
gctaccggagccgcagggtt

SEQ ID NO: 496978 - DNA, 20 bp, mouse
ggttgggccggaaccggtga

SEQ ID NO: 496979 - DNA, 20 bp, mouse
gcaaggggcggggcgcaaca

SEQ ID NO: 496980 - DNA, 20 bp, mouse
ggaggagggtcgggaccttg

SEQ ID NO: 496981 - DNA, 20 bp, mouse
gaccttgtggcagaggaccg

SEQ ID NO: 496982 - DNA, 20 bp, mouse
ggctattactgaggagggtc

SEQ ID NO: 496983 - DNA, 20 bp, mouse
ggacgtggctgtgcaagggg

SEQ ID NO: 496984 - DNA, 20 bp, mouse
gttgcacagccacgtcctac

SEQ ID NO: 496985 - DNA, 20 bp, mouse
gaggcaggtttccaacccca

SEQ ID NO: 496986 - DNA, 20 bp, mouse
gccccatccagccccgtcag

SEQ ID NO: 496987 - DNA, 20 bp, mouse
gcatccagccccgtcagcgg

SEQ ID NO: 496988 - DNA, 20 bp, mouse
ggggggccgaggccagccag

SEQ ID NO: 496989 - DNA, 20 bp, mouse
gggacgacgtacctgagcag

SEQ ID NO: 496990 - DNA, 20 bp, mouse
gccagaaagaagagacgcgg

SEQ ID NO: 496991 - DNA, 20 bp, mouse
gcagcaggtgaacgcgcccc

SEQ ID NO: 496992 - DNA, 20 bp, mouse
gcgccagctccacaggaagg

SEQ ID NO: 496993 - DNA, 20 bp, mouse
gtcgacgtggagcttgccag

SEQ ID NO: 496994 - DNA, 20 bp, mouse
gggtggtcccaaaccttcca

SEQ ID NO: 496995 - DNA, 20 bp, mouse
ggcgctccgtagcaagcccc

SEQ ID NO: 496996 - DNA, 20 bp, mouse
gtcttccgggagacgtggaa

SEQ ID NO: 496997 - DNA, 20 bp, mouse
gtccgggagacgtggaaggg

SEQ ID NO: 496998 - DNA, 20 bp, mouse
gagagctagccggcaggtcc

SEQ ID NO: 496999 - DNA, 20 bp, mouse
gctcacctgaggacgccgag

SEQ ID NO: 497000 - DNA, 20 bp, mouse
gtcgctcagggacaaggaag

SEQ ID NO: 497001 - DNA, 20 bp, mouse
gaaggtcagatgtcacacag

SEQ ID NO: 497002 - DNA, 20 bp, mouse
gggtcagcctcggtatccgg

SEQ ID NO: 497003 - DNA, 20 bp, mouse
gctagctcttccgggagacg

SEQ ID NO: 497004 - DNA, 20 bp, mouse
gccgtagcctccggataccg

SEQ ID NO: 497005 - DNA, 20 bp, mouse
gccccagagcagagtcgggg

SEQ ID NO: 497006 - DNA, 20 bp, mouse
gagctgctggagggccgagg

SEQ ID NO: 497007 - DNA, 20 bp, mouse
gtggcgcgacagctgctgga

SEQ ID NO: 497008 - DNA, 20 bp, mouse
ggacagctgctggagggccg

SEQ ID NO: 497009 - DNA, 20 bp, mouse
gacgtaagcggcgacggagg

SEQ ID NO: 497010 - DNA, 20 bp, mouse
ggacaggacgtaagcggcga

SEQ ID NO: 497011 - DNA, 20 bp, mouse
gcaggcaccggtgtccggga

SEQ ID NO: 497012 - DNA, 20 bp, mouse
gttttgcgacaggacgtaag

SEQ ID NO: 497013 - DNA, 20 bp, mouse
gaaacacaaacccgcctcct

SEQ ID NO: 497014 - DNA, 20 bp, mouse
ggaggtggcgcgacagctgc

SEQ ID NO: 497015 - DNA, 20 bp, mouse
ggagagtccctggagcggga

SEQ ID NO: 497016 - DNA, 20 bp, mouse
gggcgggtgccggagtctgg

SEQ ID NO: 497017 - DNA, 20 bp, mouse
gcgcgggcggggctcctctc

SEQ ID NO: 497018 - DNA, 20 bp, mouse
gctggcagcaggcgatcggg

SEQ ID NO: 497019 - DNA, 20 bp, mouse
gcgaccggagggtccctgaa

SEQ ID NO: 497020 - DNA, 20 bp, mouse
ggggcggggctcctctccgg

SEQ ID NO: 497021 - DNA, 20 bp, mouse
gtgacgcgggagccggaccg

SEQ ID NO: 497022 - DNA, 20 bp, mouse
gaccctggcagcaggcgatc

SEQ ID NO: 497023 - DNA, 20 bp, mouse
gcccagcgacagccaaggac

SEQ ID NO: 497024 - DNA, 20 bp, mouse
ggaaggaggggccagcgcct

SEQ ID NO: 497025 - DNA, 20 bp, mouse
gggaggggccagcgcctcgg

SEQ ID NO: 497026 - DNA, 20 bp, mouse
gcccaggggcgcgtcgacgg

SEQ ID NO: 497027 - DNA, 20 bp, mouse
ggcgagtggctgactcccag

SEQ ID NO: 497028 - DNA, 20 bp, mouse
gagctgacgtggcttcgatt

SEQ ID NO: 497029 - DNA, 20 bp, mouse
gcagctcggtaacccaagca

SEQ ID NO: 497030 - DNA, 20 bp, mouse
gggcactgggcgaccaccta

SEQ ID NO: 497031 - DNA, 20 bp, mouse
gttgggttaccgagctgacg

SEQ ID NO: 497032 - DNA, 20 bp, mouse
gtgtgtccccgggccgagta

SEQ ID NO: 497033 - DNA, 20 bp, mouse
gtccgcggggagctccgcaa

SEQ ID NO: 497034 - DNA, 20 bp, mouse
gactcccaggggcgcgtcga

SEQ ID NO: 497035 - DNA, 20 bp, mouse
gccctgccggcagactgact

SEQ ID NO: 497036 - DNA, 20 bp, mouse
gggcgcgcgtcccctaccag

SEQ ID NO: 497037 - DNA, 20 bp, mouse
gggtgacacgtaagttgggt

SEQ ID NO: 497038 - DNA, 20 bp, mouse
gacgtaagttgggtgggagg

SEQ ID NO: 497039 - DNA, 20 bp, mouse
gggtctggtcaggttaaggg

SEQ ID NO: 497040 - DNA, 20 bp, mouse
ggcgcggggaccagtagcaa

SEQ ID NO: 497041 - DNA, 20 bp, mouse
gccgtgggtgacacgtaagt

SEQ ID NO: 497042 - DNA, 20 bp, mouse
gtgggctggtgtcactgatc

SEQ ID NO: 497043 - DNA, 20 bp, mouse
ggacacgtaagttgggtggg

SEQ ID NO: 497044 - DNA, 20 bp, mouse
gcccgagtgggacttcctcc

SEQ ID NO: 497045 - DNA, 20 bp, mouse
gggggacgcgcgcccaacaa

SEQ ID NO: 497046 - DNA, 20 bp, mouse
gtggccgcgctgcatcccac

SEQ ID NO: 497047 - DNA, 20 bp, mouse
gcgctcgcctgagacgtcct

SEQ ID NO: 497048 - DNA, 20 bp, mouse
gcgcaggtgagctctcccgt

SEQ ID NO: 497049 - DNA, 20 bp, mouse
gcgagagggaagacagtcgg

SEQ ID NO: 497050 - DNA, 20 bp, mouse
gtctctgccgaggacgtctc

SEQ ID NO: 497051 - DNA, 20 bp, mouse
ggtcctcggcagagaccgcg

SEQ ID NO: 497052 - DNA, 20 bp, mouse
ggaccgcgcggacgagcgga

SEQ ID NO: 497053 - DNA, 20 bp, mouse
ggctcacctgcggggcagcg

SEQ ID NO: 497054 - DNA, 20 bp, mouse
ggtccgcgcggtctctgccg

SEQ ID NO: 497055 - DNA, 20 bp, mouse
gctgcacccgggggactcag

SEQ ID NO: 497056 - DNA, 20 bp, mouse
gagcccaggagcccgagcgg

SEQ ID NO: 497057 - DNA, 20 bp, mouse
ggcgtcgatggggtacacaa

SEQ ID NO: 497058 - DNA, 20 bp, mouse
ggagccgcgccggaccgaca

SEQ ID NO: 497059 - DNA, 20 bp, mouse
ggcggtggcgcttcccaata

SEQ ID NO: 497060 - DNA, 20 bp, mouse
ggtggcgcttcccaatatgg

SEQ ID NO: 497061 - DNA, 20 bp, mouse
gagcaggacgacgacgacaa

SEQ ID NO: 497062 - DNA, 20 bp, mouse
gcgcctccgctcgggctcct

SEQ ID NO: 497063 - DNA, 20 bp, mouse
ggtggccccccacacagccc

SEQ ID NO: 497064 - DNA, 20 bp, mouse
gcggcgcgcgctgacgtcac

SEQ ID NO: 497065 - DNA, 20 bp, mouse
gccggcgctgccacatcctc

SEQ ID NO: 497066 - DNA, 20 bp, mouse
gaccctaggcgggttccagt

SEQ ID NO: 497067 - DNA, 20 bp, mouse
gctctctgcaacgaaggatc

SEQ ID NO: 497068 - DNA, 20 bp, mouse
gacctactggaacccgccta

SEQ ID NO: 497069 - DNA, 20 bp, mouse
gctgtttcccgtaccctagg

SEQ ID NO: 497070 - DNA, 20 bp, mouse
gtggaacccgcctagggtac

SEQ ID NO: 497071 - DNA, 20 bp, mouse
gcacctgtttcccgtaccct

SEQ ID NO: 497072 - DNA, 20 bp, mouse
gtattccctctctgcaacga

SEQ ID NO: 497073 - DNA, 20 bp, mouse
ggcccaatgaagaaacacca

SEQ ID NO: 497074 - DNA, 20 bp, mouse
gttcgcgctctcgttttgga

SEQ ID NO: 497075 - DNA, 20 bp, mouse
gatcactaggcaacctacct

SEQ ID NO: 497076 - DNA, 20 bp, mouse
ggccaccctggaacatgctc

SEQ ID NO: 497077 - DNA, 20 bp, mouse
gtgctcaggctcggtcctct

SEQ ID NO: 497078 - DNA, 20 bp, mouse
gcgagcctgagcatgttcca

SEQ ID NO: 497079 - DNA, 20 bp, mouse
ggaccaggaaggcccccccg

SEQ ID NO: 497080 - DNA, 20 bp, mouse
gactagccagctgaccagga

SEQ ID NO: 497081 - DNA, 20 bp, mouse
gatcatgcttcagtccacgg

SEQ ID NO: 497082 - DNA, 20 bp, mouse
gctccactagccagctgacc

SEQ ID NO: 497083 - DNA, 20 bp, mouse
gtgccaagggtcagccaccc

SEQ ID NO: 497084 - DNA, 20 bp, mouse
ggacctctggagccagcggt

SEQ ID NO: 497085 - DNA, 20 bp, mouse
gctccagaggtcacatctgt

SEQ ID NO: 497086 - DNA, 20 bp, mouse
gcgtcgccgaggctcttctc

SEQ ID NO: 497087 - DNA, 20 bp, mouse
gctggtccggagaagagcct

SEQ ID NO: 497088 - DNA, 20 bp, mouse
gtccgtgagggagatcatgg

SEQ ID NO: 497089 - DNA, 20 bp, mouse
gcacgctgcgaagcctggtc

SEQ ID NO: 497090 - DNA, 20 bp, mouse
ggtgtttccggaagacgtgg

SEQ ID NO: 497091 - DNA, 20 bp, mouse
ggtatccgtgagggagatca

SEQ ID NO: 497092 - DNA, 20 bp, mouse
gtcattgcggggcggagcag

SEQ ID NO: 497093 - DNA, 20 bp, mouse
gtgcgtgtttccggaagacg

SEQ ID NO: 497094 - DNA, 20 bp, mouse
ggtggcggctcgggcccggg

SEQ ID NO: 497095 - DNA, 20 bp, mouse
ggacgtggcggctcgggccc

SEQ ID NO: 497096 - DNA, 20 bp, mouse
gagcagcaagatgaccagga

SEQ ID NO: 497097 - DNA, 20 bp, mouse
gcgatcagctcagggcagag

SEQ ID NO: 497098 - DNA, 20 bp, mouse
gggtgatgacttggacctag

SEQ ID NO: 497099 - DNA, 20 bp, mouse
ggatggagacgatcagctca

SEQ ID NO: 497100 - DNA, 20 bp, mouse
ggcagctgtgaagccagaca

SEQ ID NO: 497101 - DNA, 20 bp, mouse
gtcttgctgctgagaagact

SEQ ID NO: 497102 - DNA, 20 bp, mouse
gtgactctgaccccaggaca

SEQ ID NO: 497103 - DNA, 20 bp, mouse
gtggcttcacagctgcctct

SEQ ID NO: 497104 - DNA, 20 bp, mouse
gggtctctgcctcaaagaaa

SEQ ID NO: 497105 - DNA, 20 bp, mouse
ggtccaagtcatcaccctcc

SEQ ID NO: 497106 - DNA, 20 bp, mouse
gtgggtgcccggtgcaagag

SEQ ID NO: 497107 - DNA, 20 bp, mouse
gccggtgcaagaggggaatc

SEQ ID NO: 497108 - DNA, 20 bp, mouse
gaagaggggaatcgggtagc

SEQ ID NO: 497109 - DNA, 20 bp, mouse
ggatcagagcgggcctctga

SEQ ID NO: 497110 - DNA, 20 bp, mouse
gaccagcggaagtaacgcaa

SEQ ID NO: 497111 - DNA, 20 bp, mouse
gagtttccgcgggatcagag

SEQ ID NO: 497112 - DNA, 20 bp, mouse
gcactaccaaataccctcag

SEQ ID NO: 497113 - DNA, 20 bp, mouse
gtatttggtagtgtgtggtg

SEQ ID NO: 497114 - DNA, 20 bp, mouse
gagcgctgaggtgtcgagag

SEQ ID NO: 497115 - DNA, 20 bp, mouse
ggaggcccgctctgatcccg

SEQ ID NO: 497116 - DNA, 20 bp, mouse
ggccaggggagacccccaca

SEQ ID NO: 497117 - DNA, 20 bp, mouse
gcgttggcggcgcgagggaa

SEQ ID NO: 497118 - DNA, 20 bp, mouse
gcagagcagcaaaggaagcg

SEQ ID NO: 497119 - DNA, 20 bp, mouse
gagggaagggaggggaccgg

SEQ ID NO: 497120 - DNA, 20 bp, mouse
gcatgggccacccgccgaca

SEQ ID NO: 497121 - DNA, 20 bp, mouse
gggagctgcgctgccggcgt

SEQ ID NO: 497122 - DNA, 20 bp, mouse
gtgaagcagcgacagcgaca

SEQ ID NO: 497123 - DNA, 20 bp, mouse
gagggcaggaggagccccct

SEQ ID NO: 497124 - DNA, 20 bp, mouse
ggccctggacggcgccatgt

SEQ ID NO: 497125 - DNA, 20 bp, mouse
ggctgcgctgccggcgttgg

SEQ ID NO: 497126 - DNA, 20 bp, mouse
gagtctgcgcgcggagattt

SEQ ID NO: 497127 - DNA, 20 bp, mouse
gaggcggatggctcaggatt

SEQ ID NO: 497128 - DNA, 20 bp, mouse
ggattgggcgggcttctctg

SEQ ID NO: 497129 - DNA, 20 bp, mouse
ggacaggaggccgtcttagt

SEQ ID NO: 497130 - DNA, 20 bp, mouse
ggtgcccagggctaggcgga

SEQ ID NO: 497131 - DNA, 20 bp, mouse
gcggagatttgggcactctt

SEQ ID NO: 497132 - DNA, 20 bp, mouse
gcacatccgggttccttcag

SEQ ID NO: 497133 - DNA, 20 bp, mouse
gtctgcagcaaagacaccta

SEQ ID NO: 497134 - DNA, 20 bp, mouse
ggccgtcttagtgggcgagg

SEQ ID NO: 497135 - DNA, 20 bp, mouse
gaggggtggtgggattccct

SEQ ID NO: 497136 - DNA, 20 bp, mouse
gagggcggccatggggctag

SEQ ID NO: 497137 - DNA, 20 bp, mouse
gacgcagcagcgggagaggg

SEQ ID NO: 497138 - DNA, 20 bp, mouse
ggccacgcagcagcgggaga

SEQ ID NO: 497139 - DNA, 20 bp, mouse
gtgactaggccacgcagcag

SEQ ID NO: 497140 - DNA, 20 bp, mouse
gcaagcagcgagcagccggc

SEQ ID NO: 497141 - DNA, 20 bp, mouse
ggcgggagagggcggccatg

SEQ ID NO: 497142 - DNA, 20 bp, mouse
gaggggctgggagagctcgt

SEQ ID NO: 497143 - DNA, 20 bp, mouse
ggaatgactggagccagggt

SEQ ID NO: 497144 - DNA, 20 bp, mouse
ggggtggtggaagatcacca

SEQ ID NO: 497145 - DNA, 20 bp, mouse
gatccgaggccccttctcta

SEQ ID NO: 497146 - DNA, 20 bp, mouse
gagagcgtcgagatcccggg

SEQ ID NO: 497147 - DNA, 20 bp, mouse
gctctgcgaggagcccatgg

SEQ ID NO: 497148 - DNA, 20 bp, mouse
gccacgtcccaagagctacg

SEQ ID NO: 497149 - DNA, 20 bp, mouse
ggcgactccgcgtagctctt

SEQ ID NO: 497150 - DNA, 20 bp, mouse
gacgctctgcgaggagccca

SEQ ID NO: 497151 - DNA, 20 bp, mouse
gtcccgggcggcggcaccga

SEQ ID NO: 497152 - DNA, 20 bp, mouse
gctgccgggcgacgatctcc

SEQ ID NO: 497153 - DNA, 20 bp, mouse
gcgcggagtcgccaagcggg

SEQ ID NO: 497154 - DNA, 20 bp, mouse
ggggagccggagggaacgat

SEQ ID NO: 497155 - DNA, 20 bp, mouse
gtgaagctcaggccagtgcg

SEQ ID NO: 497156 - DNA, 20 bp, mouse
gcccggtggaacccactccg

SEQ ID NO: 497157 - DNA, 20 bp, mouse
gtgagggcaaggcctcggag

SEQ ID NO: 497158 - DNA, 20 bp, mouse
ggcctgtcccgactgacgtt

SEQ ID NO: 497159 - DNA, 20 bp, mouse
ggaaccagcaattactggga

SEQ ID NO: 497160 - DNA, 20 bp, mouse
gtgacgttgggcaacaaaga

SEQ ID NO: 497161 - DNA, 20 bp, mouse
ggcccaacgtcagtcgggac

SEQ ID NO: 497162 - DNA, 20 bp, mouse
gagtcgggacaggcgagtag

SEQ ID NO: 497163 - DNA, 20 bp, mouse
ggccctgggcctgggaactt

SEQ ID NO: 497164 - DNA, 20 bp, mouse
ggaaggtgagggcaaggcct

SEQ ID NO: 497165 - DNA, 20 bp, mouse
gggcggagtgagccggacct

SEQ ID NO: 497166 - DNA, 20 bp, mouse
gtgttcgtttgttggtatag

SEQ ID NO: 497167 - DNA, 20 bp, mouse
gaggaagccgcaggccggct

SEQ ID NO: 497168 - DNA, 20 bp, mouse
ggttgtgaggacgtgttccg

SEQ ID NO: 497169 - DNA, 20 bp, mouse
ggctaagagcatcgcaccag

SEQ ID NO: 497170 - DNA, 20 bp, mouse
gttccgaggaagccgcaggc

SEQ ID NO: 497171 - DNA, 20 bp, mouse
gccaacaaacgaacaagtga

SEQ ID NO: 497172 - DNA, 20 bp, mouse
ggcagggcgggccctgagac

SEQ ID NO: 497173 - DNA, 20 bp, mouse
gtataggggctccatgacgc

SEQ ID NO: 497174 - DNA, 20 bp, mouse
gagctcgcggagagcggcgg

SEQ ID NO: 497175 - DNA, 20 bp, mouse
ggccccggctcgatcccctt

SEQ ID NO: 497176 - DNA, 20 bp, mouse
gtgtacaccggaggaggtgt

SEQ ID NO: 497177 - DNA, 20 bp, mouse
gagccgggagcagctctgtg

SEQ ID NO: 497178 - DNA, 20 bp, mouse
gtgcggggtccggtgactgg

SEQ ID NO: 497179 - DNA, 20 bp, mouse
ggagagtctcctccagtcac

SEQ ID NO: 497180 - DNA, 20 bp, mouse
gggaggagcttgcggaacct

SEQ ID NO: 497181 - DNA, 20 bp, mouse
ggaacctgggcaaagactga

SEQ ID NO: 497182 - DNA, 20 bp, mouse
gcctgggcaaagactgatgg

SEQ ID NO: 497183 - DNA, 20 bp, mouse
ggagacctcgagaacgagcc

SEQ ID NO: 497184 - DNA, 20 bp, mouse
gcggtgcggggtccggtgac

SEQ ID NO: 497185 - DNA, 20 bp, mouse
gggaatgcgagcagcctggg

SEQ ID NO: 497186 - DNA, 20 bp, mouse
ggctgatgcacgaggctatg

SEQ ID NO: 497187 - DNA, 20 bp, mouse
ggaaagaggcctgaaattat

SEQ ID NO: 497188 - DNA, 20 bp, mouse
gatcagcgctgccaaggttc

SEQ ID NO: 497189 - DNA, 20 bp, mouse
gacgtgggcagtgtccctag

SEQ ID NO: 497190 - DNA, 20 bp, mouse
gggtcatagttgagcacgtg

SEQ ID NO: 497191 - DNA, 20 bp, mouse
gtgggcagtgtccctagtgg

SEQ ID NO: 497192 - DNA, 20 bp, mouse
ggtttcaactggctgtacgt

SEQ ID NO: 497193 - DNA, 20 bp, mouse
ggtgcggtgccaataatttc

SEQ ID NO: 497194 - DNA, 20 bp, mouse
gtccctgaacacagaaagac

SEQ ID NO: 497195 - DNA, 20 bp, mouse
ggaactgggaggaactagag

SEQ ID NO: 497196 - DNA, 20 bp, mouse
ggaagcgtccgctggaaccg

SEQ ID NO: 497197 - DNA, 20 bp, mouse
gcgcgggctcctaaaaggtg

SEQ ID NO: 497198 - DNA, 20 bp, mouse
gcctctgtccggagatacag

SEQ ID NO: 497199 - DNA, 20 bp, mouse
gtccgctggaaccgaggcgc

SEQ ID NO: 497200 - DNA, 20 bp, mouse
ggatctggggaagcgtccgc

SEQ ID NO: 497201 - DNA, 20 bp, mouse
ggccgctctagccacgccca

SEQ ID NO: 497202 - DNA, 20 bp, mouse
gcagggtccacagttcggct

SEQ ID NO: 497203 - DNA, 20 bp, mouse
ggcacctcgtgtgtccccaa

SEQ ID NO: 497204 - DNA, 20 bp, mouse
gtgtccggagatacagggga

SEQ ID NO: 497205 - DNA, 20 bp, mouse
gccagagccaggtgagccga

SEQ ID NO: 497206 - DNA, 20 bp, mouse
gaagctggggctgggaccag

SEQ ID NO: 497207 - DNA, 20 bp, mouse
gcagacagacagtcctttgg

SEQ ID NO: 497208 - DNA, 20 bp, mouse
ggaaggaccgagtcatagcc

SEQ ID NO: 497209 - DNA, 20 bp, mouse
gtctgtctgactgtaagctg

SEQ ID NO: 497210 - DNA, 20 bp, mouse
gagaagctctgttcctccaa

SEQ ID NO: 497211 - DNA, 20 bp, mouse
gcttcttccaggctatgact

SEQ ID NO: 497212 - DNA, 20 bp, mouse
ggaggaacagagcttcttcc

SEQ ID NO: 497213 - DNA, 20 bp, mouse
gagaggtggagaaggttcta

SEQ ID NO: 497214 - DNA, 20 bp, mouse
gacacaggcatcctccacct

SEQ ID NO: 497215 - DNA, 20 bp, mouse
gacctgggcgagaaccaact

SEQ ID NO: 497216 - DNA, 20 bp, mouse
ggcccatggcgagaggatgg

SEQ ID NO: 497217 - DNA, 20 bp, mouse
gcagaactcacgggagccca

SEQ ID NO: 497218 - DNA, 20 bp, mouse
gggagcccatggcgagagga

SEQ ID NO: 497219 - DNA, 20 bp, mouse
gggcctacttcgttctggag

SEQ ID NO: 497220 - DNA, 20 bp, mouse
gatggtggcctacttcgttc

SEQ ID NO: 497221 - DNA, 20 bp, mouse
gcgcctctccagaacgaagt

SEQ ID NO: 497222 - DNA, 20 bp, mouse
gcacgggagcccatggcgag

SEQ ID NO: 497223 - DNA, 20 bp, mouse
ggacccgaccccagaactca

SEQ ID NO: 497224 - DNA, 20 bp, mouse
gtggccaggcggcagaattg

SEQ ID NO: 497225 - DNA, 20 bp, mouse
ggcgcccagagtggccgggg

SEQ ID NO: 497226 - DNA, 20 bp, mouse
ggcagggaggaaggatactt

SEQ ID NO: 497227 - DNA, 20 bp, mouse
gagtgtgggaacataaccta

SEQ ID NO: 497228 - DNA, 20 bp, mouse
gagggagactaaatcttcct

SEQ ID NO: 497229 - DNA, 20 bp, mouse
gtcacctgctggacagtcca

SEQ ID NO: 497230 - DNA, 20 bp, mouse
gcagtccaaggtgtccactt

SEQ ID NO: 497231 - DNA, 20 bp, mouse
gccaaggtgtccacttgggt

SEQ ID NO: 497232 - DNA, 20 bp, mouse
gactttgggttcttctctta

SEQ ID NO: 497233 - DNA, 20 bp, mouse
gcagagacaggggagtaacc

SEQ ID NO: 497234 - DNA, 20 bp, mouse
ggactgtccagcaggtgact

SEQ ID NO: 497235 - DNA, 20 bp, mouse
gttgtgtactggacttacta

SEQ ID NO: 497236 - DNA, 20 bp, mouse
ggaaccagagggcatcccct

SEQ ID NO: 497237 - DNA, 20 bp, mouse
gcatcctaggggatgccctc

SEQ ID NO: 497238 - DNA, 20 bp, mouse
gttttcacattgagaaccag

SEQ ID NO: 497239 - DNA, 20 bp, mouse
ggggctaatgtcttgttcca

SEQ ID NO: 497240 - DNA, 20 bp, mouse
gtgggttccagaataagagc

SEQ ID NO: 497241 - DNA, 20 bp, mouse
ggtctgaaggaagatgttct

SEQ ID NO: 497242 - DNA, 20 bp, mouse
ggagtgaagaatcaaattct

SEQ ID NO: 497243 - DNA, 20 bp, mouse
gtgaaaaagctttgagaaaa

SEQ ID NO: 497244 - DNA, 20 bp, mouse
gtggcgatcatggtgagtcc

SEQ ID NO: 497245 - DNA, 20 bp, mouse
gactgtgagcatggcgatca

SEQ ID NO: 497246 - DNA, 20 bp, mouse
gagaggctcagtctgtatag

SEQ ID NO: 497247 - DNA, 20 bp, mouse
gtgcagaactgcttcaggta

SEQ ID NO: 497248 - DNA, 20 bp, mouse
gaagcctttcagtcagtcca

SEQ ID NO: 497249 - DNA, 20 bp, mouse
gaattagtgtatgcagttag

SEQ ID NO: 497250 - DNA, 20 bp, mouse
ggtgacttggcacttcagag

SEQ ID NO: 497251 - DNA, 20 bp, mouse
gctgaagcagttctgcaccc

SEQ ID NO: 497252 - DNA, 20 bp, mouse
gcagtctgtataggggcaga

SEQ ID NO: 497253 - DNA, 20 bp, mouse
gacagtaacacgagtgcagt

SEQ ID NO: 497254 - DNA, 20 bp, mouse
gtctgggcattgagttaccc

SEQ ID NO: 497255 - DNA, 20 bp, mouse
ggtggaagtgggccttgctg

SEQ ID NO: 497256 - DNA, 20 bp, mouse
gtggccacatagctcaggac

SEQ ID NO: 497257 - DNA, 20 bp, mouse
gcaccaatacagaagaaagt

SEQ ID NO: 497258 - DNA, 20 bp, mouse
gcacccactttcttctgtat

SEQ ID NO: 497259 - DNA, 20 bp, mouse
gctgtattggtgagtcctga

SEQ ID NO: 497260 - DNA, 20 bp, mouse
ggtgtttctggtatagaggg

SEQ ID NO: 497261 - DNA, 20 bp, mouse
gcatttcccaggtcaccttc

SEQ ID NO: 497262 - DNA, 20 bp, mouse
gcagggaagttgtagatgcc

SEQ ID NO: 497263 - DNA, 20 bp, mouse
gactgttctaagcatttccc

SEQ ID NO: 497264 - DNA, 20 bp, mouse
gataggaacaggatgcgctg

SEQ ID NO: 497265 - DNA, 20 bp, mouse
gctctataccagaaacacca

SEQ ID NO: 497266 - DNA, 20 bp, mouse
ggatggtaccagcccacaaa

SEQ ID NO: 497267 - DNA, 20 bp, mouse
gatcctgttcaaggctgcgg

SEQ ID NO: 497268 - DNA, 20 bp, mouse
gtacctgtgaggccttggct

SEQ ID NO: 497269 - DNA, 20 bp, mouse
gttcaaggctgcggtggtgg

SEQ ID NO: 497270 - DNA, 20 bp, mouse
gaaaaggtgtgccccagcca

SEQ ID NO: 497271 - DNA, 20 bp, mouse
gcctcagagcaggcttctgg

SEQ ID NO: 497272 - DNA, 20 bp, mouse
gctgttcaaggctgcggtgg

SEQ ID NO: 497273 - DNA, 20 bp, mouse
ggctgtgtgagctggcagtg

SEQ ID NO: 497274 - DNA, 20 bp, mouse
gctgcttacctgtgaggcct

SEQ ID NO: 497275 - DNA, 20 bp, mouse
gctggtaggagagcagacaa

SEQ ID NO: 497276 - DNA, 20 bp, mouse
gcagggcactggacaggtct

SEQ ID NO: 497277 - DNA, 20 bp, mouse
gggagagtcacagggactac

SEQ ID NO: 497278 - DNA, 20 bp, mouse
ggcccagtctggaactggca

SEQ ID NO: 497279 - DNA, 20 bp, mouse
gagagcactgctgggaccag

SEQ ID NO: 497280 - DNA, 20 bp, mouse
gctgggaccaggggaagtga

SEQ ID NO: 497281 - DNA, 20 bp, mouse
gcacaagcccagtctggaac

SEQ ID NO: 497282 - DNA, 20 bp, mouse
gggctgtctggttaaagcta

SEQ ID NO: 497283 - DNA, 20 bp, mouse
ggccctgccagttccagact

SEQ ID NO: 497284 - DNA, 20 bp, mouse
gtgaccgactgctgaagcag

SEQ ID NO: 497285 - DNA, 20 bp, mouse
gccagctctggggaatgggt

SEQ ID NO: 497286 - DNA, 20 bp, mouse
gcgacaggagacccatggcg

SEQ ID NO: 497287 - DNA, 20 bp, mouse
ggggtccgacaggagaccca

SEQ ID NO: 497288 - DNA, 20 bp, mouse
gccggcgcaccgggtccgac

SEQ ID NO: 497289 - DNA, 20 bp, mouse
ggcgcggggctctgctctcg

SEQ ID NO: 497290 - DNA, 20 bp, mouse
gccaagagcagggttcctgt

SEQ ID NO: 497291 - DNA, 20 bp, mouse
gaccgggcgccgggtccgac

SEQ ID NO: 497292 - DNA, 20 bp, mouse
gagagccccgcgccccgcca

SEQ ID NO: 497293 - DNA, 20 bp, mouse
ggtgcccgccctcaccagag

SEQ ID NO: 497294 - DNA, 20 bp, mouse
gatcctgggaccggaaatta

SEQ ID NO: 497295 - DNA, 20 bp, mouse
gcctagatcagcgatggata

SEQ ID NO: 497296 - DNA, 20 bp, mouse
gggtctacaccgtccagcct

SEQ ID NO: 497297 - DNA, 20 bp, mouse
gtagctaaacccaggctgga

SEQ ID NO: 497298 - DNA, 20 bp, mouse
gacgcagtttagctaaaccc

SEQ ID NO: 497299 - DNA, 20 bp, mouse
gctaaactgcgtgtgcaggt

SEQ ID NO: 497300 - DNA, 20 bp, mouse
gctgcactcccgggaaggac

SEQ ID NO: 497301 - DNA, 20 bp, mouse
gcgggccttgcagcaaatcc

SEQ ID NO: 497302 - DNA, 20 bp, mouse
ggcggaccgcgcccactcca

SEQ ID NO: 497303 - DNA, 20 bp, mouse
gagcgggcgtctgcactccc

SEQ ID NO: 497304 - DNA, 20 bp, mouse
ggaaggactggcgaccaccg

SEQ ID NO: 497305 - DNA, 20 bp, mouse
ggtggtcgccagtccttccc

SEQ ID NO: 497306 - DNA, 20 bp, mouse
gaggcgcagagccgaagcgc

SEQ ID NO: 497307 - DNA, 20 bp, mouse
gccaggcgcgagctgccggg

SEQ ID NO: 497308 - DNA, 20 bp, mouse
gagctgccgggcgggtggag

SEQ ID NO: 497309 - DNA, 20 bp, mouse
ggcgctcctctccacccgcc

SEQ ID NO: 497310 - DNA, 20 bp, mouse
ggccgggctcccggatgggt

SEQ ID NO: 497311 - DNA, 20 bp, mouse
gcgcccaggcgcgagctgcc

SEQ ID NO: 497312 - DNA, 20 bp, mouse
ggggagcccggcccactcca

SEQ ID NO: 497313 - DNA, 20 bp, mouse
gcacgcagctgccagcgctt

SEQ ID NO: 497314 - DNA, 20 bp, mouse
ggtgggccgggctcccggat

SEQ ID NO: 497315 - DNA, 20 bp, mouse
ggcacgcccgggacactgtg

SEQ ID NO: 497316 - DNA, 20 bp, mouse
gctggaagctggagaccttc

SEQ ID NO: 497317 - DNA, 20 bp, mouse
gaaccccagagaagcaccgc

SEQ ID NO: 497318 - DNA, 20 bp, mouse
ggttactgctgtgtacccga

SEQ ID NO: 497319 - DNA, 20 bp, mouse
gagacgtgaagtggaaccca

SEQ ID NO: 497320 - DNA, 20 bp, mouse
gggcaggtagagcaagatag

SEQ ID NO: 497321 - DNA, 20 bp, mouse
ggggcagcagccaacagtcc

SEQ ID NO: 497322 - DNA, 20 bp, mouse
ggacttagaagctcctccag

SEQ ID NO: 497323 - DNA, 20 bp, mouse
gagaggctcgggtgatgtgt

SEQ ID NO: 497324 - DNA, 20 bp, mouse
gtatttgtgtagctggaagc

SEQ ID NO: 497325 - DNA, 20 bp, mouse
gtacacaaataggcctctgg

SEQ ID NO: 497326 - DNA, 20 bp, mouse
gatcagcccgaggacctacc

SEQ ID NO: 497327 - DNA, 20 bp, mouse
gtggcctggcacagggaaga

SEQ ID NO: 497328 - DNA, 20 bp, mouse
gaacgctgagggagcaccgc

SEQ ID NO: 497329 - DNA, 20 bp, mouse
gcgccctgcgagctaacctg

SEQ ID NO: 497330 - DNA, 20 bp, mouse
gaagcaaagcggaacgctga

SEQ ID NO: 497331 - DNA, 20 bp, mouse
gtgcgagctaacctgaggtg

SEQ ID NO: 497332 - DNA, 20 bp, mouse
gctgtgccaggccaacccac

SEQ ID NO: 497333 - DNA, 20 bp, mouse
ggggctgattgtcatccctg

SEQ ID NO: 497334 - DNA, 20 bp, mouse
gcctagaggaagccgcctgg

SEQ ID NO: 497335 - DNA, 20 bp, mouse
gacacagtggggagacctgt

SEQ ID NO: 497336 - DNA, 20 bp, mouse
gaacccagcctggtccaatc

SEQ ID NO: 497337 - DNA, 20 bp, mouse
gaatccggcacacgagtctc

SEQ ID NO: 497338 - DNA, 20 bp, mouse
ggctgtttggcgggagttgg

SEQ ID NO: 497339 - DNA, 20 bp, mouse
gacggctgtttggcgggagt

SEQ ID NO: 497340 - DNA, 20 bp, mouse
gcttcgtcggctcagtcaca

SEQ ID NO: 497341 - DNA, 20 bp, mouse
ggctcagtcacacggctgtt

SEQ ID NO: 497342 - DNA, 20 bp, mouse
gcagtcacacggctgtttgg

SEQ ID NO: 497343 - DNA, 20 bp, mouse
gggcaaagtggggctctcca

SEQ ID NO: 497344 - DNA, 20 bp, mouse
gccaagcaaagggcaaagtg

SEQ ID NO: 497345 - DNA, 20 bp, mouse
ggcccagtttccggcttcgt

SEQ ID NO: 497346 - DNA, 20 bp, mouse
gcccggaaggagcaggatgg

SEQ ID NO: 497347 - DNA, 20 bp, mouse
gagaggctcccgtagcgagg

SEQ ID NO: 497348 - DNA, 20 bp, mouse
gctggacagtgacagcgacg

SEQ ID NO: 497349 - DNA, 20 bp, mouse
gacgaggatctgatcagcta

SEQ ID NO: 497350 - DNA, 20 bp, mouse
gtgggcgccgcgttctcggg

SEQ ID NO: 497351 - DNA, 20 bp, mouse
ggacccgcaccttcgtccag

SEQ ID NO: 497352 - DNA, 20 bp, mouse
gggcggagcccggaaggagc

SEQ ID NO: 497353 - DNA, 20 bp, mouse
ggcctggagcctctggacga

SEQ ID NO: 497354 - DNA, 20 bp, mouse
gagcgagcgagcccagaccc

SEQ ID NO: 497355 - DNA, 20 bp, mouse
gcacagggaacacgctggag

SEQ ID NO: 497356 - DNA, 20 bp, mouse
ggcgctcaggagaatgacag

SEQ ID NO: 497357 - DNA, 20 bp, mouse
ggcgtagctgacgctgtgat

SEQ ID NO: 497358 - DNA, 20 bp, mouse
ggacagaggtcggtgcaagt

SEQ ID NO: 497359 - DNA, 20 bp, mouse
gcgatgcccgaggcacccac

SEQ ID NO: 497360 - DNA, 20 bp, mouse
gcagtaaagctccggcttca

SEQ ID NO: 497361 - DNA, 20 bp, mouse
gtcagggtgtgcgggcgctc

SEQ ID NO: 497362 - DNA, 20 bp, mouse
gacctccgcggagctggttc

SEQ ID NO: 497363 - DNA, 20 bp, mouse
gcgcccgcacaccctgaagc

SEQ ID NO: 497364 - DNA, 20 bp, mouse
gagctgggctaactctcctg

SEQ ID NO: 497365 - DNA, 20 bp, mouse
gaagccggagctttactgcc

SEQ ID NO: 497366 - DNA, 20 bp, mouse
gtcctgtgtggaattggccg

SEQ ID NO: 497367 - DNA, 20 bp, mouse
ggccccggccaattccacac

SEQ ID NO: 497368 - DNA, 20 bp, mouse
gtaggacagagcctccaggg

SEQ ID NO: 497369 - DNA, 20 bp, mouse
gggagttggagtcggtcctc

SEQ ID NO: 497370 - DNA, 20 bp, mouse
ggggctgcgggagttggagt

SEQ ID NO: 497371 - DNA, 20 bp, mouse
gacccgggagcgcggcctcg

SEQ ID NO: 497372 - DNA, 20 bp, mouse
ggcctcgaggctcaggcccg

SEQ ID NO: 497373 - DNA, 20 bp, mouse
gaaaatgctgaagtcctgtg

SEQ ID NO: 497374 - DNA, 20 bp, mouse
gtcctcgggcctgagcctcg

SEQ ID NO: 497375 - DNA, 20 bp, mouse
gctgaagtcctgtgtggaat

SEQ ID NO: 497376 - DNA, 20 bp, mouse
gcgccgggtgcaagcgactg

SEQ ID NO: 497377 - DNA, 20 bp, mouse
gggagctacggccccgaagg

SEQ ID NO: 497378 - DNA, 20 bp, mouse
gccggtgaggggaaggatgg

SEQ ID NO: 497379 - DNA, 20 bp, mouse
ggcccaccgaagagacagag

SEQ ID NO: 497380 - DNA, 20 bp, mouse
gctgggagctacggccccga

SEQ ID NO: 497381 - DNA, 20 bp, mouse
gggtctgggcctaagaggtg

SEQ ID NO: 497382 - DNA, 20 bp, mouse
gccagtgccgggcgggatca

SEQ ID NO: 497383 - DNA, 20 bp, mouse
gggctgcggcgagtgaccga

SEQ ID NO: 497384 - DNA, 20 bp, mouse
gtgccgcagtcgcttgcacc

SEQ ID NO: 497385 - DNA, 20 bp, mouse
gtgggcgacagcgagagctt

SEQ ID NO: 497386 - DNA, 20 bp, mouse
ggagtcgccggtttacctgg

SEQ ID NO: 497387 - DNA, 20 bp, mouse
ggagctggacgaagagtcgc

SEQ ID NO: 497388 - DNA, 20 bp, mouse
gactcttcgtccagctccct

SEQ ID NO: 497389 - DNA, 20 bp, mouse
gaactgagccgagcgtaaca

SEQ ID NO: 497390 - DNA, 20 bp, mouse
ggcgagaaccggatcctcag

SEQ ID NO: 497391 - DNA, 20 bp, mouse
ggccaagatggcgtcgccca

SEQ ID NO: 497392 - DNA, 20 bp, mouse
gagccgagcgtaacacggca

SEQ ID NO: 497393 - DNA, 20 bp, mouse
ggaagagtcgccggtttacc

SEQ ID NO: 497394 - DNA, 20 bp, mouse
gagggatcccgctcaccacc

SEQ ID NO: 497395 - DNA, 20 bp, mouse
gtccctgggcgacgccatct

SEQ ID NO: 497396 - DNA, 20 bp, mouse
gcacgtgtgacacccgactt

SEQ ID NO: 497397 - DNA, 20 bp, mouse
gggagaggactgtacactga

SEQ ID NO: 497398 - DNA, 20 bp, mouse
gcacacgtgcttccacggag

SEQ ID NO: 497399 - DNA, 20 bp, mouse
gggactgtacactgacggta

SEQ ID NO: 497400 - DNA, 20 bp, mouse
gtccccaggggcgggagcaa

SEQ ID NO: 497401 - DNA, 20 bp, mouse
gctaggctgctgcaaacggg

SEQ ID NO: 497402 - DNA, 20 bp, mouse
gcgggagcaagggcgaagat

SEQ ID NO: 497403 - DNA, 20 bp, mouse
ggcccttgctcccgcccctg

SEQ ID NO: 497404 - DNA, 20 bp, mouse
gttgggtgcagccatcttcc

SEQ ID NO: 497405 - DNA, 20 bp, mouse
gctgcaagtacactgagacg

SEQ ID NO: 497406 - DNA, 20 bp, mouse
gaggagtgagagcggcaaaa

SEQ ID NO: 497407 - DNA, 20 bp, mouse
gagtgagagcggcaaaatgg

SEQ ID NO: 497408 - DNA, 20 bp, mouse
gctcgcggcgagccctccgg

SEQ ID NO: 497409 - DNA, 20 bp, mouse
gggagagcgtcgtcctgagg

SEQ ID NO: 497410 - DNA, 20 bp, mouse
ggtctcggtcctcgttgaag

SEQ ID NO: 497411 - DNA, 20 bp, mouse
gaccggagagcgtcgtcctg

SEQ ID NO: 497412 - DNA, 20 bp, mouse
gcgcttctcccgcttcaacg

SEQ ID NO: 497413 - DNA, 20 bp, mouse
gcgggaggggaggagcgaac

SEQ ID NO: 497414 - DNA, 20 bp, mouse
gatttctccaggggcctccg

SEQ ID NO: 497415 - DNA, 20 bp, mouse
ggccgctctcactcctcctc

SEQ ID NO: 497416 - DNA, 20 bp, mouse
gtgctgttgggtgtcatcat

SEQ ID NO: 497417 - DNA, 20 bp, mouse
ggagcagcccggctagtagt

SEQ ID NO: 497418 - DNA, 20 bp, mouse
gtgggtgtcatcatgggtct

SEQ ID NO: 497419 - DNA, 20 bp, mouse
gtctggccactcctccatcc

SEQ ID NO: 497420 - DNA, 20 bp, mouse
gaaagccccagaacccccat

SEQ ID NO: 497421 - DNA, 20 bp, mouse
gtcttggcacatggagggtc

SEQ ID NO: 497422 - DNA, 20 bp, mouse
gtggaggagtggccagagtt

SEQ ID NO: 497423 - DNA, 20 bp, mouse
gggagtggccagagttaggt

SEQ ID NO: 497424 - DNA, 20 bp, mouse
gcccggctagtagtaggctt

SEQ ID NO: 497425 - DNA, 20 bp, mouse
gcagggagctgacccaggtg

SEQ ID NO: 497426 - DNA, 20 bp, mouse
gggactgagactggttgtgg

SEQ ID NO: 497427 - DNA, 20 bp, mouse
gagaacattgcggatcgggt

SEQ ID NO: 497428 - DNA, 20 bp, mouse
gttgggactgagactggttg

SEQ ID NO: 497429 - DNA, 20 bp, mouse
gcgggagtctcggggaccgg

SEQ ID NO: 497430 - DNA, 20 bp, mouse
gcaagccccaacgccgacac

SEQ ID NO: 497431 - DNA, 20 bp, mouse
gggagggaaaagcggcaaaa

SEQ ID NO: 497432 - DNA, 20 bp, mouse
gcgctgcgctcgatcccggg

SEQ ID NO: 497433 - DNA, 20 bp, mouse
gagtcccctgggccccggac

SEQ ID NO: 497434 - DNA, 20 bp, mouse
gggcccagaacattgcggat

SEQ ID NO: 497435 - DNA, 20 bp, mouse
gtgccgctgcgctcgatccc

SEQ ID NO: 497436 - DNA, 20 bp, mouse
gtacggtcaaggacgactcg

SEQ ID NO: 497437 - DNA, 20 bp, mouse
gggacgactcgcggcgtctg

SEQ ID NO: 497438 - DNA, 20 bp, mouse
gcggcccacaaggcccagga

SEQ ID NO: 497439 - DNA, 20 bp, mouse
ggccgctgccgggtgagtat

SEQ ID NO: 497440 - DNA, 20 bp, mouse
gcaccgagcagaaggagacc

SEQ ID NO: 497441 - DNA, 20 bp, mouse
gcccgtgccgggaccactcc

SEQ ID NO: 497442 - DNA, 20 bp, mouse
gggcacctaactggccgtct

SEQ ID NO: 497443 - DNA, 20 bp, mouse
gacccatactcacccggcag

SEQ ID NO: 497444 - DNA, 20 bp, mouse
gggtcggaaacgctcacctg

SEQ ID NO: 497445 - DNA, 20 bp, mouse
gccaggtccctcgtccaccc

SEQ ID NO: 497446 - DNA, 20 bp, mouse
gtctaggcggcccgactgag

SEQ ID NO: 497447 - DNA, 20 bp, mouse
ggaggtccggccgctcagtc

SEQ ID NO: 497448 - DNA, 20 bp, mouse
gaggcgcgaggcgcgaggtc

SEQ ID NO: 497449 - DNA, 20 bp, mouse
gagtcgggccgcctagagcg

SEQ ID NO: 497450 - DNA, 20 bp, mouse
gcgggccgcctagagcgcgg

SEQ ID NO: 497451 - DNA, 20 bp, mouse
gtcgcccgccgcgctctagg

SEQ ID NO: 497452 - DNA, 20 bp, mouse
ggcgggccggccgggaccga

SEQ ID NO: 497453 - DNA, 20 bp, mouse
ggaagtccgccagatctacg

SEQ ID NO: 497454 - DNA, 20 bp, mouse
gcctcgggtccggagttcca

SEQ ID NO: 497455 - DNA, 20 bp, mouse
ggaggcggtggcagtcgagg

SEQ ID NO: 497456 - DNA, 20 bp, mouse
gccagcaccgtagcaggacc

SEQ ID NO: 497457 - DNA, 20 bp, mouse
ggaggtcgcagcgcagacat

SEQ ID NO: 497458 - DNA, 20 bp, mouse
ggaggcatctgcggagacaa

SEQ ID NO: 497459 - DNA, 20 bp, mouse
ggggtctagggccgggacat

SEQ ID NO: 497460 - DNA, 20 bp, mouse
gtctcacctgagatgaggga

SEQ ID NO: 497461 - DNA, 20 bp, mouse
gccctagacccggacacaga

SEQ ID NO: 497462 - DNA, 20 bp, mouse
gacgtcccgcggccgagaac

SEQ ID NO: 497463 - DNA, 20 bp, mouse
gccgagtctctgcacaactc

SEQ ID NO: 497464 - DNA, 20 bp, mouse
gtctcaggtgagaagaaaga

SEQ ID NO: 497465 - DNA, 20 bp, mouse
gaagagggaagagtcggggt

SEQ ID NO: 497466 - DNA, 20 bp, mouse
gtagcccgacagagcaagag

SEQ ID NO: 497467 - DNA, 20 bp, mouse
gtcccgagactcagcaagtc

SEQ ID NO: 497468 - DNA, 20 bp, mouse
gttttgcggcggctgggtag

SEQ ID NO: 497469 - DNA, 20 bp, mouse
gctacctgggcgctgggcga

SEQ ID NO: 497470 - DNA, 20 bp, mouse
ggtggcaataagagccggag

SEQ ID NO: 497471 - DNA, 20 bp, mouse
gtgcgaggaaacttttgcgg

SEQ ID NO: 497472 - DNA, 20 bp, mouse
gggcctggaccatctaccaa

SEQ ID NO: 497473 - DNA, 20 bp, mouse
gagctgcgaggaaacttttg

SEQ ID NO: 497474 - DNA, 20 bp, mouse
gcagcgcccaggtagctgcg

SEQ ID NO: 497475 - DNA, 20 bp, mouse
gctgagtctcgggaccgctc

SEQ ID NO: 497476 - DNA, 20 bp, mouse
gagccgggccagtcaatcag

SEQ ID NO: 497477 - DNA, 20 bp, mouse
gtgagaagggcacagccgtg

SEQ ID NO: 497478 - DNA, 20 bp, mouse
ggaatgggcgcgggacccaa

SEQ ID NO: 497479 - DNA, 20 bp, mouse
gctcactgccctcggccgca

SEQ ID NO: 497480 - DNA, 20 bp, mouse
gcgcgggacccaagggacta

SEQ ID NO: 497481 - DNA, 20 bp, mouse
gacccgggccagctagccag

SEQ ID NO: 497482 - DNA, 20 bp, mouse
gtccgaaggctagagaaccc

SEQ ID NO: 497483 - DNA, 20 bp, mouse
gggagaggatccgtgacctc

SEQ ID NO: 497484 - DNA, 20 bp, mouse
gcgtgacctcgggactccga

SEQ ID NO: 497485 - DNA, 20 bp, mouse
gtcgcagaagagcagagtgt

SEQ ID NO: 497486 - DNA, 20 bp, mouse
ggccggggagaagcgagaca

SEQ ID NO: 497487 - DNA, 20 bp, mouse
gtaggcggctgcagcgatac

SEQ ID NO: 497488 - DNA, 20 bp, mouse
ggcgagacacggcaagcatc

SEQ ID NO: 497489 - DNA, 20 bp, mouse
gagctcgcagccactaacct

SEQ ID NO: 497490 - DNA, 20 bp, mouse
ggcaagccgaacacgagccg

SEQ ID NO: 497491 - DNA, 20 bp, mouse
gcagcgataccggccagtgc

SEQ ID NO: 497492 - DNA, 20 bp, mouse
ggaagaccgcgaagggaccg

SEQ ID NO: 497493 - DNA, 20 bp, mouse
ggccgtgtctcgcttctccc

SEQ ID NO: 497494 - DNA, 20 bp, mouse
ggcaagcatccggcactggc

SEQ ID NO: 497495 - DNA, 20 bp, mouse
ggccacgggaagaccgcgaa

SEQ ID NO: 497496 - DNA, 20 bp, mouse
gggagatgtacgggatcgag

SEQ ID NO: 497497 - DNA, 20 bp, mouse
gatttcaagaagactctcac

SEQ ID NO: 497498 - DNA, 20 bp, mouse
gtcagcttcacatagactga

SEQ ID NO: 497499 - DNA, 20 bp, mouse
gcagtgtgcgcgacgaaggt

SEQ ID NO: 497500 - DNA, 20 bp, mouse
ggaacgcggggctctcgggg

SEQ ID NO: 497501 - DNA, 20 bp, mouse
ggtatgtgatggagatgtac

SEQ ID NO: 497502 - DNA, 20 bp, mouse
gttcgtcgcgcacactggat

SEQ ID NO: 497503 - DNA, 20 bp, mouse
ggttccgagccgcagagtcg

SEQ ID NO: 497504 - DNA, 20 bp, mouse
gacacaggaggcaagaggga

SEQ ID NO: 497505 - DNA, 20 bp, mouse
ggggctgaacacccctactg

SEQ ID NO: 497506 - DNA, 20 bp, mouse
ggcctcgccagcgctccctt

SEQ ID NO: 497507 - DNA, 20 bp, mouse
ggcttcctcgggccacctaa

SEQ ID NO: 497508 - DNA, 20 bp, mouse
gtcgccagcgctcccttagg

SEQ ID NO: 497509 - DNA, 20 bp, mouse
gttgagaggcggctgtaact

SEQ ID NO: 497510 - DNA, 20 bp, mouse
ggggccacctaagggagcgc

SEQ ID NO: 497511 - DNA, 20 bp, mouse
gcagctgaaaccggtttgag

SEQ ID NO: 497512 - DNA, 20 bp, mouse
gctgaaaccggtttgagagg

SEQ ID NO: 497513 - DNA, 20 bp, mouse
ggggctggcagtttagtcta

SEQ ID NO: 497514 - DNA, 20 bp, mouse
gaatcccgggcggagaatag

SEQ ID NO: 497515 - DNA, 20 bp, mouse
gctggcgaggcgctgacgct

SEQ ID NO: 497516 - DNA, 20 bp, mouse
ggaagcagcaagcagcacca

SEQ ID NO: 497517 - DNA, 20 bp, mouse
gcagcaagcagcaccatggc

SEQ ID NO: 497518 - DNA, 20 bp, mouse
gggctctggcaactggtgag

SEQ ID NO: 497519 - DNA, 20 bp, mouse
gtcggagcccacacccgccg

SEQ ID NO: 497520 - DNA, 20 bp, mouse
gtggtgagtggttctgtgaa

SEQ ID NO: 497521 - DNA, 20 bp, mouse
ggtaccgtaagcactggaga

SEQ ID NO: 497522 - DNA, 20 bp, mouse
gtctctgccccggcgggtgt

SEQ ID NO: 497523 - DNA, 20 bp, mouse
ggcaagaaagtctgcattgt

SEQ ID NO: 497524 - DNA, 20 bp, mouse
gcaggaagcgggcagagggt

SEQ ID NO: 497525 - DNA, 20 bp, mouse
ggagtccagctggctcctga

SEQ ID NO: 497526 - DNA, 20 bp, mouse
gggtgagcagccggcctggg

SEQ ID NO: 497527 - DNA, 20 bp, mouse
gctgctcacctccacaggaa

SEQ ID NO: 497528 - DNA, 20 bp, mouse
gggaggtgagcagccggcct

SEQ ID NO: 497529 - DNA, 20 bp, mouse
gcgcccggagcgcctatact

SEQ ID NO: 497530 - DNA, 20 bp, mouse
gctggtgagcagaggcgggt

SEQ ID NO: 497531 - DNA, 20 bp, mouse
gtactaggccgttcctgtgg

SEQ ID NO: 497532 - DNA, 20 bp, mouse
gtgcttcagcgtggacacca

SEQ ID NO: 497533 - DNA, 20 bp, mouse
gcggaaccggggcttcctgg

SEQ ID NO: 497534 - DNA, 20 bp, mouse
gacaccagggcatcgcgggt

SEQ ID NO: 497535 - DNA, 20 bp, mouse
gtcgcgggtaggcagagagg

SEQ ID NO: 497536 - DNA, 20 bp, mouse
gggtgaggccgactccgttc

SEQ ID NO: 497537 - DNA, 20 bp, mouse
ggcaaggggtcggcgagcaa

SEQ ID NO: 497538 - DNA, 20 bp, mouse
gcctccagccagaacggagt

SEQ ID NO: 497539 - DNA, 20 bp, mouse
ggccactctggttctcggtg

SEQ ID NO: 497540 - DNA, 20 bp, mouse
ggagcgcgccgggatgtcac

SEQ ID NO: 497541 - DNA, 20 bp, mouse
ggtcgtcacgcgcaaggggt

SEQ ID NO: 497542 - DNA, 20 bp, mouse
gtcagggccactctggttct

SEQ ID NO: 497543 - DNA, 20 bp, mouse
ggcctgacccggtgacatcc

SEQ ID NO: 497544 - DNA, 20 bp, mouse
gcgcgctcgccgcgagctca

SEQ ID NO: 497545 - DNA, 20 bp, mouse
gaggccgactccgttctggc

SEQ ID NO: 497546 - DNA, 20 bp, mouse
gtccatccccaggcatcggg

SEQ ID NO: 497547 - DNA, 20 bp, mouse
gcccgcccgatgcctgggga

SEQ ID NO: 497548 - DNA, 20 bp, mouse
ggacgctgctggacggccac

SEQ ID NO: 497549 - DNA, 20 bp, mouse
ggtgtggccgagctttaggt

SEQ ID NO: 497550 - DNA, 20 bp, mouse
gaggaggcgctgtgccaagg

SEQ ID NO: 497551 - DNA, 20 bp, mouse
gactcccttggcagacagag

SEQ ID NO: 497552 - DNA, 20 bp, mouse
ggcatccatccccaggcatc

SEQ ID NO: 497553 - DNA, 20 bp, mouse
gagcacccgcccgatgcctg

SEQ ID NO: 497554 - DNA, 20 bp, mouse
gcagcagcgtctggccccct

SEQ ID NO: 497555 - DNA, 20 bp, mouse
gagatggcctggtaacgcca

SEQ ID NO: 497556 - DNA, 20 bp, mouse
gaggagtcttcagttgctgt

SEQ ID NO: 497557 - DNA, 20 bp, mouse
gttggactggtaagctgctg

SEQ ID NO: 497558 - DNA, 20 bp, mouse
gtgcctcagctactctggaa

SEQ ID NO: 497559 - DNA, 20 bp, mouse
ggatggtgaggacattccag

SEQ ID NO: 497560 - DNA, 20 bp, mouse
ggagaccagcaggaggcacc

SEQ ID NO: 497561 - DNA, 20 bp, mouse
gattccaggggagaatgcat

SEQ ID NO: 497562 - DNA, 20 bp, mouse
gcatctgcaaaggactgggt

SEQ ID NO: 497563 - DNA, 20 bp, mouse
ggcccagagacagccatccc

SEQ ID NO: 497564 - DNA, 20 bp, mouse
gcagggccttgtagccaaag

SEQ ID NO: 497565 - DNA, 20 bp, mouse
gtgccaggcccagcaggcaa

SEQ ID NO: 497566 - DNA, 20 bp, mouse
gaggcagcctgataacagaa

SEQ ID NO: 497567 - DNA, 20 bp, mouse
gagggcagaggtaatctatg

SEQ ID NO: 497568 - DNA, 20 bp, mouse
ggatcaagaacagacttcat

SEQ ID NO: 497569 - DNA, 20 bp, mouse
gccataccagtaggaactga

SEQ ID NO: 497570 - DNA, 20 bp, mouse
gtgctggaatcaactcttct

SEQ ID NO: 497571 - DNA, 20 bp, mouse
gtttcaaaagttgcaatgag

SEQ ID NO: 497572 - DNA, 20 bp, mouse
ggacagcatcccataccagt

SEQ ID NO: 497573 - DNA, 20 bp, mouse
gtccttgagtggcactgact

SEQ ID NO: 497574 - DNA, 20 bp, mouse
ggtctctcctttctgttatc

SEQ ID NO: 497575 - DNA, 20 bp, mouse
gagttgattccagcaaggtc

SEQ ID NO: 497576 - DNA, 20 bp, mouse
ggtgactgcgctgggaaaca

SEQ ID NO: 497577 - DNA, 20 bp, mouse
gacctgtgaggactccgaca

SEQ ID NO: 497578 - DNA, 20 bp, mouse
gtgggaaacatggcgaccga

SEQ ID NO: 497579 - DNA, 20 bp, mouse
gctcctggctcctgtcagtg

SEQ ID NO: 497580 - DNA, 20 bp, mouse
ggcgcagtcaccgcactgac

SEQ ID NO: 497581 - DNA, 20 bp, mouse
gtccgtgtcggagtcctcac

SEQ ID NO: 497582 - DNA, 20 bp, mouse
gtccgggctccggcttctcc

SEQ ID NO: 497583 - DNA, 20 bp, mouse
gagtcctcacaggtaacggg

SEQ ID NO: 497584 - DNA, 20 bp, mouse
gccgcagggaagcaccaccg

SEQ ID NO: 497585 - DNA, 20 bp, mouse
ggactccgacacggatttga

SEQ ID NO: 497586 - DNA, 20 bp, mouse
gcccaaaacccactccaagg

SEQ ID NO: 497587 - DNA, 20 bp, mouse
gggcgaagggatccccaagg

SEQ ID NO: 497588 - DNA, 20 bp, mouse
gggctgagactgagaggcgg

SEQ ID NO: 497589 - DNA, 20 bp, mouse
ggcggcggcgcgcggcaagt

SEQ ID NO: 497590 - DNA, 20 bp, mouse
gcaacttcaggtgcacgcac

SEQ ID NO: 497591 - DNA, 20 bp, mouse
gggtcccaaaacccactcca

SEQ ID NO: 497592 - DNA, 20 bp, mouse
gccccggcctgggccctgca

SEQ ID NO: 497593 - DNA, 20 bp, mouse
gtaaagcccgctgcgcgcac

SEQ ID NO: 497594 - DNA, 20 bp, mouse
gcagcggctgctcctcctca

SEQ ID NO: 497595 - DNA, 20 bp, mouse
gtcaggtgcacgcacggggt

SEQ ID NO: 497596 - DNA, 20 bp, mouse
ggccctgagagccttcatcc

SEQ ID NO: 497597 - DNA, 20 bp, mouse
gacttagtagcaagatcagg

SEQ ID NO: 497598 - DNA, 20 bp, mouse
ggtgcgggtcgcctcaagaa

SEQ ID NO: 497599 - DNA, 20 bp, mouse
gtaagtggacagccaggtgc

SEQ ID NO: 497600 - DNA, 20 bp, mouse
gtccacttagtagcaagatc

SEQ ID NO: 497601 - DNA, 20 bp, mouse
ggggtcgcctcaagaaggga

SEQ ID NO: 497602 - DNA, 20 bp, mouse
gtccctgtgacaccagggag

SEQ ID NO: 497603 - DNA, 20 bp, mouse
gactgggccatcccttcttg

SEQ ID NO: 497604 - DNA, 20 bp, mouse
gctcaggctgttctgtctac

SEQ ID NO: 497605 - DNA, 20 bp, mouse
gagactcagaaccccgagtg

SEQ ID NO: 497606 - DNA, 20 bp, mouse
gccgccgtctgccccgtcaa

SEQ ID NO: 497607 - DNA, 20 bp, mouse
ggtgactcgagcgaagatgg

SEQ ID NO: 497608 - DNA, 20 bp, mouse
gcctgtgactcgagcgaaga

SEQ ID NO: 497609 - DNA, 20 bp, mouse
gtggaggtaaccaggagtgg

SEQ ID NO: 497610 - DNA, 20 bp, mouse
ggaagaacataagaatgtaa

SEQ ID NO: 497611 - DNA, 20 bp, mouse
gctataagtcaggacctggg

SEQ ID NO: 497612 - DNA, 20 bp, mouse
gttatggaggtaaccaggag

SEQ ID NO: 497613 - DNA, 20 bp, mouse
gcgcctataagtcaggacct

SEQ ID NO: 497614 - DNA, 20 bp, mouse
ggtttagctcgagccgtgag

SEQ ID NO: 497615 - DNA, 20 bp, mouse
gaagaagagggaggtttgtt

SEQ ID NO: 497616 - DNA, 20 bp, mouse
ggttagcagagcagctgagg

SEQ ID NO: 497617 - DNA, 20 bp, mouse
gcagctgctctgctaacgtg

SEQ ID NO: 497618 - DNA, 20 bp, mouse
gggatttgggagtcatagtt

SEQ ID NO: 497619 - DNA, 20 bp, mouse
gggaatgacaacatgtctgc

SEQ ID NO: 497620 - DNA, 20 bp, mouse
gaggtagccagaactatatc

SEQ ID NO: 497621 - DNA, 20 bp, mouse
gttctacatagtgacctcca

SEQ ID NO: 497622 - DNA, 20 bp, mouse
gagcttttagagcagaaaag

SEQ ID NO: 497623 - DNA, 20 bp, mouse
gcgagtccgtgcctggattt

SEQ ID NO: 497624 - DNA, 20 bp, mouse
ggtagaaataggtaagtact

SEQ ID NO: 497625 - DNA, 20 bp, mouse
gatagttctggctaccttgg

SEQ ID NO: 497626 - DNA, 20 bp, mouse
gccccctttgccaccacagt

SEQ ID NO: 497627 - DNA, 20 bp, mouse
gtggcaaaggggggaattat

SEQ ID NO: 497628 - DNA, 20 bp, mouse
gaaagacacgacgagaattc

SEQ ID NO: 497629 - DNA, 20 bp, mouse
gggagctgcccagggaaaaa

SEQ ID NO: 497630 - DNA, 20 bp, mouse
gtggtccgcttcatgctagg

SEQ ID NO: 497631 - DNA, 20 bp, mouse
gtggtggtccgcttcatgct

SEQ ID NO: 497632 - DNA, 20 bp, mouse
gttactgtggcacacacaat

SEQ ID NO: 497633 - DNA, 20 bp, mouse
gaagcaaacaagaggcgcga

SEQ ID NO: 497634 - DNA, 20 bp, mouse
gtttgagtacctgcttactg

SEQ ID NO: 497635 - DNA, 20 bp, mouse
gtccccctcccaaaattatc

SEQ ID NO: 497636 - DNA, 20 bp, mouse
gcgtatggtcgcctgctcct

SEQ ID NO: 497637 - DNA, 20 bp, mouse
ggctgtctttatggaccagt

SEQ ID NO: 497638 - DNA, 20 bp, mouse
gtgggatcctcggtgacgta

SEQ ID NO: 497639 - DNA, 20 bp, mouse
gaggcgaccatacgtcaccg

SEQ ID NO: 497640 - DNA, 20 bp, mouse
gaagacagctgccaaggagc

SEQ ID NO: 497641 - DNA, 20 bp, mouse
gtccttggcagctgtcttta

SEQ ID NO: 497642 - DNA, 20 bp, mouse
ggaggggagtccaaaagaaa

SEQ ID NO: 497643 - DNA, 20 bp, mouse
gtcctcggctgcagtttcca

SEQ ID NO: 497644 - DNA, 20 bp, mouse
ggttttataactgggatcct

SEQ ID NO: 497645 - DNA, 20 bp, mouse
gtcaatttcgctctgcctac

SEQ ID NO: 497646 - DNA, 20 bp, mouse
gccgccgggcgatccctgag

SEQ ID NO: 497647 - DNA, 20 bp, mouse
gaacaccaacagacacacgg

SEQ ID NO: 497648 - DNA, 20 bp, mouse
ggcctcaggcccgggaagaa

SEQ ID NO: 497649 - DNA, 20 bp, mouse
ggggaagcctggggttcgga

SEQ ID NO: 497650 - DNA, 20 bp, mouse
ggatccctgagtggtgggcg

SEQ ID NO: 497651 - DNA, 20 bp, mouse
gcgggcgatccctgagtggt

SEQ ID NO: 497652 - DNA, 20 bp, mouse
gtggggttcggatggagcca

SEQ ID NO: 497653 - DNA, 20 bp, mouse
gtcgaggcttcgggaaggaa

SEQ ID NO: 497654 - DNA, 20 bp, mouse
ggcccgggcctaaagagtag

SEQ ID NO: 497655 - DNA, 20 bp, mouse
gcctcaagtgacccaggcta

SEQ ID NO: 497656 - DNA, 20 bp, mouse
gtacttggtgaggcgcccgt

SEQ ID NO: 497657 - DNA, 20 bp, mouse
gggtggagctggcagcccac

SEQ ID NO: 497658 - DNA, 20 bp, mouse
ggaaaaacgaacaaactacc

SEQ ID NO: 497659 - DNA, 20 bp, mouse
gcaaactacccggcaaggaa

SEQ ID NO: 497660 - DNA, 20 bp, mouse
ggaaagtagtggcctcgcag

SEQ ID NO: 497661 - DNA, 20 bp, mouse
gacctggaccccgctaacga

SEQ ID NO: 497662 - DNA, 20 bp, mouse
gtgcttgagtttacttggtg

SEQ ID NO: 497663 - DNA, 20 bp, mouse
gtgcccgaaggccgtagtcg

SEQ ID NO: 497664 - DNA, 20 bp, mouse
gctctccagacaagttccgg

SEQ ID NO: 497665 - DNA, 20 bp, mouse
gacgaacaaactacccggca

SEQ ID NO: 497666 - DNA, 20 bp, mouse
gctgtcgcgcgaaggctgaa

SEQ ID NO: 497667 - DNA, 20 bp, mouse
ggtgtgtgaaacccccggag

SEQ ID NO: 497668 - DNA, 20 bp, mouse
gtgtgaaacccccggagagg

SEQ ID NO: 497669 - DNA, 20 bp, mouse
gtgacgagctgcgcatatcg

SEQ ID NO: 497670 - DNA, 20 bp, mouse
gaggcatgccgcctctccgg

SEQ ID NO: 497671 - DNA, 20 bp, mouse
gcggctgtgtgtgaaacccc

SEQ ID NO: 497672 - DNA, 20 bp, mouse
gctgaagggagtgtggccgt

SEQ ID NO: 497673 - DNA, 20 bp, mouse
gagctcgtcatgggccccgc

SEQ ID NO: 497674 - DNA, 20 bp, mouse
ggcaggaagccgtataccca

SEQ ID NO: 497675 - DNA, 20 bp, mouse
ggtgctgaacgagcgatctg

SEQ ID NO: 497676 - DNA, 20 bp, mouse
ggagcgcctgcaaccagtca

SEQ ID NO: 497677 - DNA, 20 bp, mouse
ggtcagagtcaagccctgac

SEQ ID NO: 497678 - DNA, 20 bp, mouse
gccgacactgtgactcctgg

SEQ ID NO: 497679 - DNA, 20 bp, mouse
ggactcctggtggatgggac

SEQ ID NO: 497680 - DNA, 20 bp, mouse
gactgtgactcctggtggat

SEQ ID NO: 497681 - DNA, 20 bp, mouse
gctccccagtcccatccacc

SEQ ID NO: 497682 - DNA, 20 bp, mouse
gcaggcgctcggagtcagca

SEQ ID NO: 497683 - DNA, 20 bp, mouse
gcgagtgtaagcgcccagag

SEQ ID NO: 497684 - DNA, 20 bp, mouse
gagccagcagcagaaatccc

SEQ ID NO: 497685 - DNA, 20 bp, mouse
gttggaacagaccctgtctg

SEQ ID NO: 497686 - DNA, 20 bp, mouse
gcagcgcaggcacctttcgg

SEQ ID NO: 497687 - DNA, 20 bp, mouse
ggcacagagcccagaagacg

SEQ ID NO: 497688 - DNA, 20 bp, mouse
gggtgcctgcgctgaatcag

SEQ ID NO: 497689 - DNA, 20 bp, mouse
gctgaatcagcggggaagct

SEQ ID NO: 497690 - DNA, 20 bp, mouse
gtccaggctcggttcctcta

SEQ ID NO: 497691 - DNA, 20 bp, mouse
gaagggcggccacgtcttct

SEQ ID NO: 497692 - DNA, 20 bp, mouse
gacaaacacttacccccgaa

SEQ ID NO: 497693 - DNA, 20 bp, mouse
gttccccgctgattcagcgc

SEQ ID NO: 497694 - DNA, 20 bp, mouse
ggattcccttcggaaatgta

SEQ ID NO: 497695 - DNA, 20 bp, mouse
gaatcctccctaccactccc

SEQ ID NO: 497696 - DNA, 20 bp, mouse
gtaggagcagcggtgctcag

SEQ ID NO: 497697 - DNA, 20 bp, mouse
ggtgcgctggctggacgtac

SEQ ID NO: 497698 - DNA, 20 bp, mouse
gggacgtacgggcatatact

SEQ ID NO: 497699 - DNA, 20 bp, mouse
gagagctcgcaccgagtggt

SEQ ID NO: 497700 - DNA, 20 bp, mouse
ggctgagagctcgcaccgag

SEQ ID NO: 497701 - DNA, 20 bp, mouse
gtaagacctaagacccggag

SEQ ID NO: 497702 - DNA, 20 bp, mouse
gtggggtaggggacccggtt

SEQ ID NO: 497703 - DNA, 20 bp, mouse
gcaccgctgctcctaccact

SEQ ID NO: 497704 - DNA, 20 bp, mouse
gagcttgtggcgctgtgcgc

SEQ ID NO: 497705 - DNA, 20 bp, mouse
gcacggctagaaggttacta

SEQ ID NO: 497706 - DNA, 20 bp, mouse
ggaagcggccgaggggtacc

SEQ ID NO: 497707 - DNA, 20 bp, mouse
gtggccgtcccggtacccct

SEQ ID NO: 497708 - DNA, 20 bp, mouse
gcggccgaggggtaccggga

SEQ ID NO: 497709 - DNA, 20 bp, mouse
gaaggagccgaagcggccga

SEQ ID NO: 497710 - DNA, 20 bp, mouse
gatggacgcggcccaagacg

SEQ ID NO: 497711 - DNA, 20 bp, mouse
ggatcccgctgggctgaagt

SEQ ID NO: 497712 - DNA, 20 bp, mouse
ggaacttaggagatcccgct

SEQ ID NO: 497713 - DNA, 20 bp, mouse
gggcgtagtccatccctacg

SEQ ID NO: 497714 - DNA, 20 bp, mouse
gggagcgcgaccgctgtccc

SEQ ID NO: 497715 - DNA, 20 bp, mouse
gctttgacccggaagtgggt

SEQ ID NO: 497716 - DNA, 20 bp, mouse
ggcagtcgcagccccagaga

SEQ ID NO: 497717 - DNA, 20 bp, mouse
gtggcagtgagcgagaggag

SEQ ID NO: 497718 - DNA, 20 bp, mouse
ggtcagaggctgtgttcggg

SEQ ID NO: 497719 - DNA, 20 bp, mouse
gcagcgacaagtatccccat

SEQ ID NO: 497720 - DNA, 20 bp, mouse
gccaccggcggagctatggg

SEQ ID NO: 497721 - DNA, 20 bp, mouse
gctcgctcactgccatctct

SEQ ID NO: 497722 - DNA, 20 bp, mouse
gcccgggacgagaccactag

SEQ ID NO: 497723 - DNA, 20 bp, mouse
gactagcggcctgcagtggg

SEQ ID NO: 497724 - DNA, 20 bp, mouse
gtccccatcggcactgcgtt

SEQ ID NO: 497725 - DNA, 20 bp, mouse
ggcccaacgcagtgccgatg

SEQ ID NO: 497726 - DNA, 20 bp, mouse
ggacgctggtgacccaggac

SEQ ID NO: 497727 - DNA, 20 bp, mouse
gcaccgttgggagatgccaa

SEQ ID NO: 497728 - DNA, 20 bp, mouse
gcaagggacgctggtgaccc

SEQ ID NO: 497729 - DNA, 20 bp, mouse
gcccagccactgacaccgtt

SEQ ID NO: 497730 - DNA, 20 bp, mouse
ggtcccttggcatctcccaa

SEQ ID NO: 497731 - DNA, 20 bp, mouse
gctggtgatagatacatcag

SEQ ID NO: 497732 - DNA, 20 bp, mouse
gcatctcccaacggtgtcag

SEQ ID NO: 497733 - DNA, 20 bp, mouse
gagatacatcagtggacctg

SEQ ID NO: 497734 - DNA, 20 bp, mouse
ggggagatgccaagggacgc

SEQ ID NO: 497735 - DNA, 20 bp, mouse
gaagggttctccccaggaca

SEQ ID NO: 497736 - DNA, 20 bp, mouse
gcagtacagatgctactctc

SEQ ID NO: 497737 - DNA, 20 bp, mouse
ggaggaagcacccagcacgg

SEQ ID NO: 497738 - DNA, 20 bp, mouse
gggacctgtctgtcaggctg

SEQ ID NO: 497739 - DNA, 20 bp, mouse
ggtagcatctgtactgggag

SEQ ID NO: 497740 - DNA, 20 bp, mouse
ggaagcacccagcacggcgg

SEQ ID NO: 497741 - DNA, 20 bp, mouse
gtgggaggaagcacccagca

SEQ ID NO: 497742 - DNA, 20 bp, mouse
ggcccagttgctgatctgaa

SEQ ID NO: 497743 - DNA, 20 bp, mouse
gatctagctggagtcaggag

SEQ ID NO: 497744 - DNA, 20 bp, mouse
gatctgaagggagacgacaa

SEQ ID NO: 497745 - DNA, 20 bp, mouse
gcaggcaggacctgtctgtc

SEQ ID NO: 497746 - DNA, 20 bp, mouse
gagcatcgtattggagtcac

SEQ ID NO: 497747 - DNA, 20 bp, mouse
gtcctagagtggtcaagcca

SEQ ID NO: 497748 - DNA, 20 bp, mouse
ggccttggcttgaccactct

SEQ ID NO: 497749 - DNA, 20 bp, mouse
gatcctaacccaacaggtgt

SEQ ID NO: 497750 - DNA, 20 bp, mouse
gtgggctcagagttccatac

SEQ ID NO: 497751 - DNA, 20 bp, mouse
gctgagaagcaagtgctatt

SEQ ID NO: 497752 - DNA, 20 bp, mouse
ggtgctaagactaagtcccc

SEQ ID NO: 497753 - DNA, 20 bp, mouse
gtggtggttctaagaatggt

SEQ ID NO: 497754 - DNA, 20 bp, mouse
gtggctgtgtttgagcagaa

SEQ ID NO: 497755 - DNA, 20 bp, mouse
ggctgcttagtttagcagat

SEQ ID NO: 497756 - DNA, 20 bp, mouse
gacgagaaccgtgcagaaca

SEQ ID NO: 497757 - DNA, 20 bp, mouse
gttctacttggcctcacctg

SEQ ID NO: 497758 - DNA, 20 bp, mouse
gatcttttacatctccgtgg

SEQ ID NO: 497759 - DNA, 20 bp, mouse
gtgatcctgaatgacctcaa

SEQ ID NO: 497760 - DNA, 20 bp, mouse
gcacatcttttacatctccg

SEQ ID NO: 497761 - DNA, 20 bp, mouse
gacaagaagaagatcctcac

SEQ ID NO: 497762 - DNA, 20 bp, mouse
gcccacataccagaatttaa

SEQ ID NO: 497763 - DNA, 20 bp, mouse
gatcccaaagccagaagact

SEQ ID NO: 497764 - DNA, 20 bp, mouse
gccttgcaatgtattacaaa

SEQ ID NO: 497765 - DNA, 20 bp, mouse
gcttgctttattacagttgt

SEQ ID NO: 497766 - DNA, 20 bp, mouse
ggttctgttacagtctgggt

SEQ ID NO: 497767 - DNA, 20 bp, mouse
gctcatatctaggaaaaaca

SEQ ID NO: 497768 - DNA, 20 bp, mouse
gtaacagaacactcatatct

SEQ ID NO: 497769 - DNA, 20 bp, mouse
gttacagtctgggtaggcag

SEQ ID NO: 497770 - DNA, 20 bp, mouse
gacaaggacatcaaaaaggg

SEQ ID NO: 497771 - DNA, 20 bp, mouse
gtaagtccaagtcagctgtt

SEQ ID NO: 497772 - DNA, 20 bp, mouse
gtggagtatagcaacatctg

SEQ ID NO: 497773 - DNA, 20 bp, mouse
gactccatacctctaaatct

SEQ ID NO: 497774 - DNA, 20 bp, mouse
gaggacatcaaaaagggtgg

SEQ ID NO: 497775 - DNA, 20 bp, mouse
gtgagtgttctgttacagtc

SEQ ID NO: 497776 - DNA, 20 bp, mouse
gttggctccaactccagcag

SEQ ID NO: 497777 - DNA, 20 bp, mouse
gggaagtgtcccctcaccct

SEQ ID NO: 497778 - DNA, 20 bp, mouse
gcaggggaagagtcacggcc

SEQ ID NO: 497779 - DNA, 20 bp, mouse
gactcttcccctgctggagt

SEQ ID NO: 497780 - DNA, 20 bp, mouse
gcaggttgtgaggaaccaca

SEQ ID NO: 497781 - DNA, 20 bp, mouse
ggcccaatcagtaagtactg

SEQ ID NO: 497782 - DNA, 20 bp, mouse
ggaacagccggagggcttta

SEQ ID NO: 497783 - DNA, 20 bp, mouse
gcagggtgtaggatgaaagg

SEQ ID NO: 497784 - DNA, 20 bp, mouse
gaggaagattgccttcttgg

SEQ ID NO: 497785 - DNA, 20 bp, mouse
ggaccagcttgcccccaaga

SEQ ID NO: 497786 - DNA, 20 bp, mouse
gccatctcgagacagcagtg

SEQ ID NO: 497787 - DNA, 20 bp, mouse
gtggatggggaccaatgggt

SEQ ID NO: 497788 - DNA, 20 bp, mouse
gtggggaccaatgggtggga

SEQ ID NO: 497789 - DNA, 20 bp, mouse
gtctgtggatggggaccaat

SEQ ID NO: 497790 - DNA, 20 bp, mouse
gttctccctgcagaagctag

SEQ ID NO: 497791 - DNA, 20 bp, mouse
ggcccggcaaataggaactg

SEQ ID NO: 497792 - DNA, 20 bp, mouse
gcaccccccagatataatca

SEQ ID NO: 497793 - DNA, 20 bp, mouse
gctgccgctgactgctttac

SEQ ID NO: 497794 - DNA, 20 bp, mouse
gcacaaggcttgagtgacag

SEQ ID NO: 497795 - DNA, 20 bp, mouse
ggcacctggggtctgtggat

SEQ ID NO: 497796 - DNA, 20 bp, mouse
gaaggaagtcccgaaggccc

SEQ ID NO: 497797 - DNA, 20 bp, mouse
gcagattggcttctcattac

SEQ ID NO: 497798 - DNA, 20 bp, mouse
ggtgcctcaccatcacgtct

SEQ ID NO: 497799 - DNA, 20 bp, mouse
ggcttctcacccgggccttc

SEQ ID NO: 497800 - DNA, 20 bp, mouse
ggtcgggctgctatcactga

SEQ ID NO: 497801 - DNA, 20 bp, mouse
ggcgccgagacgtgatggtg

SEQ ID NO: 497802 - DNA, 20 bp, mouse
gtgctttgcagtggccagat

SEQ ID NO: 497803 - DNA, 20 bp, mouse
gtaggaaaggctaataccat

SEQ ID NO: 497804 - DNA, 20 bp, mouse
gtttgaaaaggaagtcccga

SEQ ID NO: 497805 - DNA, 20 bp, mouse
gtgcgtgagtacatggccca

SEQ ID NO: 497806 - DNA, 20 bp, mouse
gtgcctggagacgacaacgg

SEQ ID NO: 497807 - DNA, 20 bp, mouse
ggcttgcctggagacgacaa

SEQ ID NO: 497808 - DNA, 20 bp, mouse
ggacctcacagacaatcggg

SEQ ID NO: 497809 - DNA, 20 bp, mouse
ggatggctccgtgagcttgg

SEQ ID NO: 497810 - DNA, 20 bp, mouse
gtaacagcaaagaggctcta

SEQ ID NO: 497811 - DNA, 20 bp, mouse
gctgcactcctccaagctca

SEQ ID NO: 497812 - DNA, 20 bp, mouse
gctcccagcagtgaaccgga

SEQ ID NO: 497813 - DNA, 20 bp, mouse
gctggagacgacaacggtgg

SEQ ID NO: 497814 - DNA, 20 bp, mouse
gagacaatcgggaggcagcg

SEQ ID NO: 497815 - DNA, 20 bp, mouse
gattatcagtcagaataaca

SEQ ID NO: 497816 - DNA, 20 bp, mouse
gagagagctagaaaagccgg

SEQ ID NO: 497817 - DNA, 20 bp, mouse
gcattactggcaggccagtc

SEQ ID NO: 497818 - DNA, 20 bp, mouse
gctagaaaagccggaggctg

SEQ ID NO: 497819 - DNA, 20 bp, mouse
ggacatcaggaaaccaaaga

SEQ ID NO: 497820 - DNA, 20 bp, mouse
ggcagcacttccacttacaa

SEQ ID NO: 497821 - DNA, 20 bp, mouse
ggcaccgttctggccattac

SEQ ID NO: 497822 - DNA, 20 bp, mouse
gctgccagtaatggccagaa

SEQ ID NO: 497823 - DNA, 20 bp, mouse
gggcgagctcagattctcat

SEQ ID NO: 497824 - DNA, 20 bp, mouse
gtcagccacggccagattca

SEQ ID NO: 497825 - DNA, 20 bp, mouse
gaagtgctgctacctcacca

SEQ ID NO: 497826 - DNA, 20 bp, mouse
gccgcgtggcacgtccgtgg

SEQ ID NO: 497827 - DNA, 20 bp, mouse
gcacccgcgtggcacgtccg

SEQ ID NO: 497828 - DNA, 20 bp, mouse
gacgtccgtggtggcgcccg

SEQ ID NO: 497829 - DNA, 20 bp, mouse
ggcgggtggcccgagctatt

SEQ ID NO: 497830 - DNA, 20 bp, mouse
ggcacgccctggccgagggg

SEQ ID NO: 497831 - DNA, 20 bp, mouse
gcaagggctacaaaaaaggt

SEQ ID NO: 497832 - DNA, 20 bp, mouse
ggtctgtctgggcacctctg

SEQ ID NO: 497833 - DNA, 20 bp, mouse
gcagtgctgccgaatagctc

SEQ ID NO: 497834 - DNA, 20 bp, mouse
gcactgaaggagccacccct

SEQ ID NO: 497835 - DNA, 20 bp, mouse
gaccgcagctcacctgccgc

SEQ ID NO: 497836 - DNA, 20 bp, mouse
ggagttatcaacagattgca

SEQ ID NO: 497837 - DNA, 20 bp, mouse
gagggctgcagcctggcgac

SEQ ID NO: 497838 - DNA, 20 bp, mouse
gtgagattggagcttataag

SEQ ID NO: 497839 - DNA, 20 bp, mouse
gtggccagagcactgcgctg

SEQ ID NO: 497840 - DNA, 20 bp, mouse
gctgatgtctgagaagggaa

SEQ ID NO: 497841 - DNA, 20 bp, mouse
gcagagcactgcgctgggga

SEQ ID NO: 497842 - DNA, 20 bp, mouse
gtgtggccggccagtagctt

SEQ ID NO: 497843 - DNA, 20 bp, mouse
gacggagctctgcacccgga

SEQ ID NO: 497844 - DNA, 20 bp, mouse
gaacagctttctatgacgaa

SEQ ID NO: 497845 - DNA, 20 bp, mouse
gatgacgaaaggcatgagat

SEQ ID NO: 497846 - DNA, 20 bp, mouse
ggcctagctgcccccatcca

SEQ ID NO: 497847 - DNA, 20 bp, mouse
gagctccgtgccatggatgg

SEQ ID NO: 497848 - DNA, 20 bp, mouse
ggcgcgcggctgagacctag

SEQ ID NO: 497849 - DNA, 20 bp, mouse
gggcccaagggactaagtgg

SEQ ID NO: 497850 - DNA, 20 bp, mouse
gagacctagcggatcgtgcc

SEQ ID NO: 497851 - DNA, 20 bp, mouse
ggtgcgggaggagtgctcag

SEQ ID NO: 497852 - DNA, 20 bp, mouse
ggagcccggcacgatccgct

SEQ ID NO: 497853 - DNA, 20 bp, mouse
ggctggcggcgggagctgag

SEQ ID NO: 497854 - DNA, 20 bp, mouse
gagcggcccaagggactaag

SEQ ID NO: 497855 - DNA, 20 bp, mouse
gcgcggggcgatgggttgat

SEQ ID NO: 497856 - DNA, 20 bp, mouse
gcgagcgcggccgcggacaa

SEQ ID NO: 497857 - DNA, 20 bp, mouse
gcggccgcgctcgccctccg

SEQ ID NO: 497858 - DNA, 20 bp, mouse
gcccggcggccctgaccccg

SEQ ID NO: 497859 - DNA, 20 bp, mouse
gccctgaccccgcggctccg

SEQ ID NO: 497860 - DNA, 20 bp, mouse
gctcccggcggcccgaggat

SEQ ID NO: 497861 - DNA, 20 bp, mouse
gggttgggcagcgtgtccgg

SEQ ID NO: 497862 - DNA, 20 bp, mouse
ggccccgcaggcccggtcag

SEQ ID NO: 497863 - DNA, 20 bp, mouse
gggcgctcccgcgggccgag

SEQ ID NO: 497864 - DNA, 20 bp, mouse
gcgaagcgggaccgatcctc

SEQ ID NO: 497865 - DNA, 20 bp, mouse
ggccgccgccgaggggaagg

SEQ ID NO: 497866 - DNA, 20 bp, mouse
gcccagggccggccacccga

SEQ ID NO: 497867 - DNA, 20 bp, mouse
gcccagctctaggcgttcag

SEQ ID NO: 497868 - DNA, 20 bp, mouse
ggccggccacccgagggcag

SEQ ID NO: 497869 - DNA, 20 bp, mouse
gtagagctggggccacccgg

SEQ ID NO: 497870 - DNA, 20 bp, mouse
gggacagaggaccgtcctgc

SEQ ID NO: 497871 - DNA, 20 bp, mouse
gaggcgcagctgccccaccc

SEQ ID NO: 497872 - DNA, 20 bp, mouse
gctttgcctctgccctcggg

SEQ ID NO: 497873 - DNA, 20 bp, mouse
gaagccccgcaggccgggat

SEQ ID NO: 497874 - DNA, 20 bp, mouse
ggctccaccgaagaagatcc

SEQ ID NO: 497875 - DNA, 20 bp, mouse
gtcgtcgcctgcgcaagggg

SEQ ID NO: 497876 - DNA, 20 bp, mouse
ggtatgctcattcttcaccg

SEQ ID NO: 497877 - DNA, 20 bp, mouse
gactcagggcaataaaggag

SEQ ID NO: 497878 - DNA, 20 bp, mouse
ggttggaatcaccaaagaga

SEQ ID NO: 497879 - DNA, 20 bp, mouse
gttgtgtgtgggctactgac

SEQ ID NO: 497880 - DNA, 20 bp, mouse
gcaggaacgacaggaacgca

SEQ ID NO: 497881 - DNA, 20 bp, mouse
gtctgggactcggcatctgg

SEQ ID NO: 497882 - DNA, 20 bp, mouse
gactggtggctattgtgtgt

SEQ ID NO: 497883 - DNA, 20 bp, mouse
gagacaagggttctcagaaa

SEQ ID NO: 497884 - DNA, 20 bp, mouse
gtgtctgacaggtgatctca

SEQ ID NO: 497885 - DNA, 20 bp, mouse
gtggtcataaggatcaacag

SEQ ID NO: 497886 - DNA, 20 bp, mouse
ggcaggcccgtcctgaggca

SEQ ID NO: 497887 - DNA, 20 bp, mouse
gtccccaagaagggactcag

SEQ ID NO: 497888 - DNA, 20 bp, mouse
gacagggcaggcccgtcctg

SEQ ID NO: 497889 - DNA, 20 bp, mouse
gactggcttgggtaagtcag

SEQ ID NO: 497890 - DNA, 20 bp, mouse
gtcagtggatcctagatctg

SEQ ID NO: 497891 - DNA, 20 bp, mouse
gctaaccctaggtaactcct

SEQ ID NO: 497892 - DNA, 20 bp, mouse
gtgtccctgtgcccttacat

SEQ ID NO: 497893 - DNA, 20 bp, mouse
gggaggtttcaggaagtagt

SEQ ID NO: 497894 - DNA, 20 bp, mouse
gtggccactaaccgactctg

SEQ ID NO: 497895 - DNA, 20 bp, mouse
gcctgtgcccttacataggt

SEQ ID NO: 497896 - DNA, 20 bp, mouse
gcctgtctcaagtctcaagt

SEQ ID NO: 497897 - DNA, 20 bp, mouse
gtcactaagctccaagctac

SEQ ID NO: 497898 - DNA, 20 bp, mouse
ggtccctgaagactccagtt

SEQ ID NO: 497899 - DNA, 20 bp, mouse
gtgggcaggccagaacctct

SEQ ID NO: 497900 - DNA, 20 bp, mouse
gtaagcctgtaggcacccag

SEQ ID NO: 497901 - DNA, 20 bp, mouse
gctgggccaacgaggtgtgg

SEQ ID NO: 497902 - DNA, 20 bp, mouse
gtgaagactccagttcggag

SEQ ID NO: 497903 - DNA, 20 bp, mouse
gaggcccgctgacatcactc

SEQ ID NO: 497904 - DNA, 20 bp, mouse
gtggcccagagtccagcccg

SEQ ID NO: 497905 - DNA, 20 bp, mouse
gagaacctctgggtgcctac

SEQ ID NO: 497906 - DNA, 20 bp, mouse
gcggcctgcgtggaacccca

SEQ ID NO: 497907 - DNA, 20 bp, mouse
gtgcgggatgagcagagcgg

SEQ ID NO: 497908 - DNA, 20 bp, mouse
gcctgcgtggaaccccatgg

SEQ ID NO: 497909 - DNA, 20 bp, mouse
ggccgcgcctgctcctccat

SEQ ID NO: 497910 - DNA, 20 bp, mouse
ggcagtgagcaggtccgaca

SEQ ID NO: 497911 - DNA, 20 bp, mouse
gggtagcgcgcatccgggag

SEQ ID NO: 497912 - DNA, 20 bp, mouse
gatcgaggaaggcggcgggt

SEQ ID NO: 497913 - DNA, 20 bp, mouse
gtggaaccccatggaggagc

SEQ ID NO: 497914 - DNA, 20 bp, mouse
gctgccccgtgccatagcag

SEQ ID NO: 497915 - DNA, 20 bp, mouse
gctctgctcatcccgcagca

SEQ ID NO: 497916 - DNA, 20 bp, mouse
ggagctggagcccggtgtcc

SEQ ID NO: 497917 - DNA, 20 bp, mouse
ggatcccgcttaccccgcag

SEQ ID NO: 497918 - DNA, 20 bp, mouse
gggcggagcagagggagccg

SEQ ID NO: 497919 - DNA, 20 bp, mouse
gatccggtcgccgggacacc

SEQ ID NO: 497920 - DNA, 20 bp, mouse
gccgcgcaggcgcaggagtg

SEQ ID NO: 497921 - DNA, 20 bp, mouse
gcgtgtgcaggagccagcga

SEQ ID NO: 497922 - DNA, 20 bp, mouse
gcaggccgctgcggggtaag

SEQ ID NO: 497923 - DNA, 20 bp, mouse
gccaagatgcgaggatgcag

SEQ ID NO: 497924 - DNA, 20 bp, mouse
gcaggtctcaggccgctgcg

SEQ ID NO: 497925 - DNA, 20 bp, mouse
ggtgtccggctggcaggagg

SEQ ID NO: 497926 - DNA, 20 bp, mouse
gtagaagacggtgtagaccg

SEQ ID NO: 497927 - DNA, 20 bp, mouse
ggacggtgtagaccgcggtg

SEQ ID NO: 497928 - DNA, 20 bp, mouse
gcgaggagacctacccctcc

SEQ ID NO: 497929 - DNA, 20 bp, mouse
gaccatcctccgggaggggt

SEQ ID NO: 497930 - DNA, 20 bp, mouse
gggagacctacccctcccgg

SEQ ID NO: 497931 - DNA, 20 bp, mouse
gggctgctcgagcttcatca

SEQ ID NO: 497932 - DNA, 20 bp, mouse
gcgctgccaatcgcacacaa

SEQ ID NO: 497933 - DNA, 20 bp, mouse
gggcggcctttgtgtgcgat

SEQ ID NO: 497934 - DNA, 20 bp, mouse
ggcgggtacccgggagcgaa

SEQ ID NO: 497935 - DNA, 20 bp, mouse
gacgcagcgaggcccagaag

SEQ ID NO: 497936 - DNA, 20 bp, mouse
gaggaaccgagccccccggg

SEQ ID NO: 497937 - DNA, 20 bp, mouse
gccacgcgagacacaggaag

SEQ ID NO: 497938 - DNA, 20 bp, mouse
gacactgataccctcatgag

SEQ ID NO: 497939 - DNA, 20 bp, mouse
gccgaggaaccgagcccccc

SEQ ID NO: 497940 - DNA, 20 bp, mouse
gagccgccacagctgcaggt

SEQ ID NO: 497941 - DNA, 20 bp, mouse
gtgctcgcgtcccctcatga

SEQ ID NO: 497942 - DNA, 20 bp, mouse
gcacagctgcaggtaggcaa

SEQ ID NO: 497943 - DNA, 20 bp, mouse
gggttcctcgggccgcggct

SEQ ID NO: 497944 - DNA, 20 bp, mouse
ggcgagcgcctcaaaagctc

SEQ ID NO: 497945 - DNA, 20 bp, mouse
ggaaggggaggcgggcccga

SEQ ID NO: 497946 - DNA, 20 bp, mouse
gctatctaggagggcaggtg

SEQ ID NO: 497947 - DNA, 20 bp, mouse
gccgagctgcctatctagga

SEQ ID NO: 497948 - DNA, 20 bp, mouse
ggcaggtgcggagccacccg

SEQ ID NO: 497949 - DNA, 20 bp, mouse
gactggctggtgtcctcggg

SEQ ID NO: 497950 - DNA, 20 bp, mouse
gtggggaccaggcagcccta

SEQ ID NO: 497951 - DNA, 20 bp, mouse
gcgggacccgcttccactac

SEQ ID NO: 497952 - DNA, 20 bp, mouse
gggtgcggcgatcctcccta

SEQ ID NO: 497953 - DNA, 20 bp, mouse
gactactggctggtgtcctc

SEQ ID NO: 497954 - DNA, 20 bp, mouse
gagaaccgagctgcctatct

SEQ ID NO: 497955 - DNA, 20 bp, mouse
gggaccaggcagccctaggg

SEQ ID NO: 497956 - DNA, 20 bp, mouse
gtccagcagcagggctgtct

SEQ ID NO: 497957 - DNA, 20 bp, mouse
gtgctgctggagagcctctc

SEQ ID NO: 497958 - DNA, 20 bp, mouse
gactttgtgaacaaggaggg

SEQ ID NO: 497959 - DNA, 20 bp, mouse
ggccaagacagccctgctgc

SEQ ID NO: 497960 - DNA, 20 bp, mouse
gacagactttgtgaacaagg

SEQ ID NO: 497961 - DNA, 20 bp, mouse
gagacccagaaaacaacagg

SEQ ID NO: 497962 - DNA, 20 bp, mouse
gagctttgtggtaaaaatcg

SEQ ID NO: 497963 - DNA, 20 bp, mouse
gagttgctgagtcgggttac

SEQ ID NO: 497964 - DNA, 20 bp, mouse
gcagtatgagttgctgagtc

SEQ ID NO: 497965 - DNA, 20 bp, mouse
gcccagttacagcatcatag

SEQ ID NO: 497966 - DNA, 20 bp, mouse
gagaagatcagcatgttggt

SEQ ID NO: 497967 - DNA, 20 bp, mouse
ggttaacacatgaggagaca

SEQ ID NO: 497968 - DNA, 20 bp, mouse
gtcatgtgttaacaaaaggt

SEQ ID NO: 497969 - DNA, 20 bp, mouse
gtccatccagcactacctgg

SEQ ID NO: 497970 - DNA, 20 bp, mouse
gttgaggaccaggaagatca

SEQ ID NO: 497971 - DNA, 20 bp, mouse
gatgggcctgccataagtta

SEQ ID NO: 497972 - DNA, 20 bp, mouse
gtacctggaggaagcatcca

SEQ ID NO: 497973 - DNA, 20 bp, mouse
gggagggacaagcagatatt

SEQ ID NO: 497974 - DNA, 20 bp, mouse
gataagttaaggatgagcaa

SEQ ID NO: 497975 - DNA, 20 bp, mouse
gtcctccaggtagtgctgga

SEQ ID NO: 497976 - DNA, 20 bp, mouse
gtgtggctgcgtcccacgta

SEQ ID NO: 497977 - DNA, 20 bp, mouse
gagggcagcagaaaattccc

SEQ ID NO: 497978 - DNA, 20 bp, mouse
gggtccctgagcaagacgaa

SEQ ID NO: 497979 - DNA, 20 bp, mouse
gggttccgcaaaccagagac

SEQ ID NO: 497980 - DNA, 20 bp, mouse
gaggcagccaagcaagtcac

SEQ ID NO: 497981 - DNA, 20 bp, mouse
gacaggcagtggcagcacgg

SEQ ID NO: 497982 - DNA, 20 bp, mouse
gcggaggatgtggactgagg

SEQ ID NO: 497983 - DNA, 20 bp, mouse
gtggctgcgcgcccttaccc

SEQ ID NO: 497984 - DNA, 20 bp, mouse
gaggccattcgtcttgctca

SEQ ID NO: 497985 - DNA, 20 bp, mouse
ggaatggcctccccgcgcct

SEQ ID NO: 497986 - DNA, 20 bp, mouse
gccactcaccgctcgctggg

SEQ ID NO: 497987 - DNA, 20 bp, mouse
gcgtgtgtacacagccccca

SEQ ID NO: 497988 - DNA, 20 bp, mouse
ggcctggaacagagcattag

SEQ ID NO: 497989 - DNA, 20 bp, mouse
ggggctctcctaggacgcta

SEQ ID NO: 497990 - DNA, 20 bp, mouse
gctgcgctgggtggacgcca

SEQ ID NO: 497991 - DNA, 20 bp, mouse
gtgggcggcggcccgcgcac

SEQ ID NO: 497992 - DNA, 20 bp, mouse
gccaacagaagggacgaaga

SEQ ID NO: 497993 - DNA, 20 bp, mouse
ggctgcccgaggaggcggac

SEQ ID NO: 497994 - DNA, 20 bp, mouse
ggtgagtggggcccggggag

SEQ ID NO: 497995 - DNA, 20 bp, mouse
gatggtaaccgtagcgtcct

SEQ ID NO: 497996 - DNA, 20 bp, mouse
gtcacgagcatcgctggctg

SEQ ID NO: 497997 - DNA, 20 bp, mouse
gcaggcagcatgccgggcca

SEQ ID NO: 497998 - DNA, 20 bp, mouse
gaggatgaggaggctagaac

SEQ ID NO: 497999 - DNA, 20 bp, mouse
gtctatgtgacccacattgg

SEQ ID NO: 498000 - DNA, 20 bp, mouse
gtctgtgagtaattgactca

SEQ ID NO: 498001 - DNA, 20 bp, mouse
gcactgctactggcttagtg

SEQ ID NO: 498002 - DNA, 20 bp, mouse
gtggtgctcacgagcatcgc

SEQ ID NO: 498003 - DNA, 20 bp, mouse
gggtgacttgccaccaatgt

SEQ ID NO: 498004 - DNA, 20 bp, mouse
gagtacagcgggtactctgt

SEQ ID NO: 498005 - DNA, 20 bp, mouse
gctctgtgggcactgtggat

SEQ ID NO: 498006 - DNA, 20 bp, mouse
gagagagagaggagatatac

SEQ ID NO: 498007 - DNA, 20 bp, mouse
gtgctcagagctggattcaa

SEQ ID NO: 498008 - DNA, 20 bp, mouse
ggtaggtctcagctcagggg

SEQ ID NO: 498009 - DNA, 20 bp, mouse
gaagaacacaaaggtttgat

SEQ ID NO: 498010 - DNA, 20 bp, mouse
gccttaggaaaagacccgca

SEQ ID NO: 498011 - DNA, 20 bp, mouse
gaaggcagaggttgtcaggt

SEQ ID NO: 498012 - DNA, 20 bp, mouse
gcaaactggagatcctcctt

SEQ ID NO: 498013 - DNA, 20 bp, mouse
ggagcacagctttaaaacat

SEQ ID NO: 498014 - DNA, 20 bp, mouse
gaagaaatcaggagcttctc

SEQ ID NO: 498015 - DNA, 20 bp, mouse
gggtctcagctcaggggggg

SEQ ID NO: 498016 - DNA, 20 bp, mouse
gtacgaacttgagaaaccaa

SEQ ID NO: 498017 - DNA, 20 bp, mouse
gcaggtgggagggagtctcc

SEQ ID NO: 498018 - DNA, 20 bp, mouse
ggttcgtaagacgcaaggta

SEQ ID NO: 498019 - DNA, 20 bp, mouse
gacaaggaaaatgaagtcag

SEQ ID NO: 498020 - DNA, 20 bp, mouse
ggggagggagtctccaggaa

SEQ ID NO: 498021 - DNA, 20 bp, mouse
ggacagatgtgtaggacagg

SEQ ID NO: 498022 - DNA, 20 bp, mouse
gatgttcacggagatcacat

SEQ ID NO: 498023 - DNA, 20 bp, mouse
ggaagacagatgtgtaggac

SEQ ID NO: 498024 - DNA, 20 bp, mouse
ggtcctccatagtcctagag

SEQ ID NO: 498025 - DNA, 20 bp, mouse
ggtacatcaagacgctccct

SEQ ID NO: 498026 - DNA, 20 bp, mouse
gacacacacccagggtgaga

SEQ ID NO: 498027 - DNA, 20 bp, mouse
gcgcgtatccatctcaccct

SEQ ID NO: 498028 - DNA, 20 bp, mouse
gggccaaagtctatgagagg

SEQ ID NO: 498029 - DNA, 20 bp, mouse
gtggctgagtgggtacagaa

SEQ ID NO: 498030 - DNA, 20 bp, mouse
ggactccagcttggctgagt

SEQ ID NO: 498031 - DNA, 20 bp, mouse
ggcccgcgtggaggcgaatg

SEQ ID NO: 498032 - DNA, 20 bp, mouse
ggcctgtgcggcggtagcag

SEQ ID NO: 498033 - DNA, 20 bp, mouse
gggctccttgctcagaagtc

SEQ ID NO: 498034 - DNA, 20 bp, mouse
gtcgccgagacccagcggtg

SEQ ID NO: 498035 - DNA, 20 bp, mouse
gtggaggcgaatgcggtcct

SEQ ID NO: 498036 - DNA, 20 bp, mouse
ggtagcctcctgcaaagtgg

SEQ ID NO: 498037 - DNA, 20 bp, mouse
gtgtaagtgcacggaatgac

SEQ ID NO: 498038 - DNA, 20 bp, mouse
gtcagccaaccagcaaaggg

SEQ ID NO: 498039 - DNA, 20 bp, mouse
gctgcagggaggagcttgat

SEQ ID NO: 498040 - DNA, 20 bp, mouse
gtccacactgaagacacctc

SEQ ID NO: 498041 - DNA, 20 bp, mouse
gtccagtccttggagtcaga

SEQ ID NO: 498042 - DNA, 20 bp, mouse
ggccgtctgactccaaggac

SEQ ID NO: 498043 - DNA, 20 bp, mouse
gtccagaggtgtcttcagtg

SEQ ID NO: 498044 - DNA, 20 bp, mouse
gagtatgctgccgctcggac

SEQ ID NO: 498045 - DNA, 20 bp, mouse
ggagcggcagcatactccaa

SEQ ID NO: 498046 - DNA, 20 bp, mouse
gagggcacagcagcttcaga

SEQ ID NO: 498047 - DNA, 20 bp, mouse
ggcttctcctcggcaagaaa

SEQ ID NO: 498048 - DNA, 20 bp, mouse
gagactagtgaaggcccctt

SEQ ID NO: 498049 - DNA, 20 bp, mouse
gggcagtaccagatgggtct

SEQ ID NO: 498050 - DNA, 20 bp, mouse
gtaggagctcctccagtcca

SEQ ID NO: 498051 - DNA, 20 bp, mouse
ggtggcctggcagtaccaga

SEQ ID NO: 498052 - DNA, 20 bp, mouse
gggaggaggcatactggaaa

SEQ ID NO: 498053 - DNA, 20 bp, mouse
gtagtgaaggccccttaggc

SEQ ID NO: 498054 - DNA, 20 bp, mouse
gtggccaagaagactagtga

SEQ ID NO: 498055 - DNA, 20 bp, mouse
ggaagtttcctagacccatc

SEQ ID NO: 498056 - DNA, 20 bp, mouse
gcggaggcggcgcccaggga

SEQ ID NO: 498057 - DNA, 20 bp, mouse
gcgggagccgagtgcggccg

SEQ ID NO: 498058 - DNA, 20 bp, mouse
ggagcggcgggagccgagtg

SEQ ID NO: 498059 - DNA, 20 bp, mouse
ggaaccgcagccggagccag

SEQ ID NO: 498060 - DNA, 20 bp, mouse
gagcagcgagccggagccac

SEQ ID NO: 498061 - DNA, 20 bp, mouse
gtcgggccggggcatcctgg

SEQ ID NO: 498062 - DNA, 20 bp, mouse
gggctcgcaggagtcagaag

SEQ ID NO: 498063 - DNA, 20 bp, mouse
gccacccccgcggcccctgg

SEQ ID NO: 498064 - DNA, 20 bp, mouse
gctgcccacggccaatccga

SEQ ID NO: 498065 - DNA, 20 bp, mouse
gagcgcagcgctctgggcat

SEQ ID NO: 498066 - DNA, 20 bp, mouse
gcacgttccgagaaagggag

SEQ ID NO: 498067 - DNA, 20 bp, mouse
ggtagctgacaggaccgcag

SEQ ID NO: 498068 - DNA, 20 bp, mouse
gatcccgaggtgctcaggag

SEQ ID NO: 498069 - DNA, 20 bp, mouse
ggccccgaaccctcttgtag

SEQ ID NO: 498070 - DNA, 20 bp, mouse
gggcacacgccgctacaaga

SEQ ID NO: 498071 - DNA, 20 bp, mouse
gggctcacccctccctttct

SEQ ID NO: 498072 - DNA, 20 bp, mouse
ggcagctagccgaggcgcca

SEQ ID NO: 498073 - DNA, 20 bp, mouse
gccctggggtccggaccagt

SEQ ID NO: 498074 - DNA, 20 bp, mouse
ggccgctacaagagggttcg

SEQ ID NO: 498075 - DNA, 20 bp, mouse
gaggaagccgatgctcacag

SEQ ID NO: 498076 - DNA, 20 bp, mouse
ggcctcgtagacagccggag

SEQ ID NO: 498077 - DNA, 20 bp, mouse
gtcgtagacagccggagtgg

SEQ ID NO: 498078 - DNA, 20 bp, mouse
gagggacggcggtcagacag

SEQ ID NO: 498079 - DNA, 20 bp, mouse
gggctctcgggtttggaagg

SEQ ID NO: 498080 - DNA, 20 bp, mouse
gcggctgtctacgaggcgat

SEQ ID NO: 498081 - DNA, 20 bp, mouse
ggaggaggaggcgacccgca

SEQ ID NO: 498082 - DNA, 20 bp, mouse
gtctcgggtttggaaggtgg

SEQ ID NO: 498083 - DNA, 20 bp, mouse
ggtgggctctcgggtttgga

SEQ ID NO: 498084 - DNA, 20 bp, mouse
gcggtctctggtgggctctc

SEQ ID NO: 498085 - DNA, 20 bp, mouse
ggaaggtggcgggagggacg

SEQ ID NO: 498086 - DNA, 20 bp, mouse
gccagggtgcacaggcctaa

SEQ ID NO: 498087 - DNA, 20 bp, mouse
gcaggcctaagggtgccgag

SEQ ID NO: 498088 - DNA, 20 bp, mouse
ggcgccaaatgcccagacag

SEQ ID NO: 498089 - DNA, 20 bp, mouse
gcccagacagaggcgaccgc

SEQ ID NO: 498090 - DNA, 20 bp, mouse
gtaagggtgccgagaggtcg

SEQ ID NO: 498091 - DNA, 20 bp, mouse
gcggcttggccacgacctct

SEQ ID NO: 498092 - DNA, 20 bp, mouse
ggcgcgggtgagggcatggt

SEQ ID NO: 498093 - DNA, 20 bp, mouse
ggacgcaggcgggacccgtg

SEQ ID NO: 498094 - DNA, 20 bp, mouse
gctacgcaggtcaggccaca

SEQ ID NO: 498095 - DNA, 20 bp, mouse
ggagcaggtccgctagcgac

SEQ ID NO: 498096 - DNA, 20 bp, mouse
gttcatctgagagcagagaa

SEQ ID NO: 498097 - DNA, 20 bp, mouse
ggcagagaaaggcagcgctg

SEQ ID NO: 498098 - DNA, 20 bp, mouse
gggtttgtggccaaacctaa

SEQ ID NO: 498099 - DNA, 20 bp, mouse
ggtctgcagtccagacagcc

SEQ ID NO: 498100 - DNA, 20 bp, mouse
gtaactagagcctttaggtt

SEQ ID NO: 498101 - DNA, 20 bp, mouse
gggcgagtcccaaggaacca

SEQ ID NO: 498102 - DNA, 20 bp, mouse
gatccaagccgcgagctcag

SEQ ID NO: 498103 - DNA, 20 bp, mouse
ggggcgaagcggtcgaggag

SEQ ID NO: 498104 - DNA, 20 bp, mouse
gctgattaactagagccttt

SEQ ID NO: 498105 - DNA, 20 bp, mouse
gggcgggaacgacctgccaa

SEQ ID NO: 498106 - DNA, 20 bp, mouse
ggccgctcaggcagttacgg

SEQ ID NO: 498107 - DNA, 20 bp, mouse
gggctactcacgctacgcca

SEQ ID NO: 498108 - DNA, 20 bp, mouse
gaggcagttacggaggttgg

SEQ ID NO: 498109 - DNA, 20 bp, mouse
gacctccgtaactgcctgag

SEQ ID NO: 498110 - DNA, 20 bp, mouse
ggactgaggagtgccagctg

SEQ ID NO: 498111 - DNA, 20 bp, mouse
ggctggcactcctcagtccc

SEQ ID NO: 498112 - DNA, 20 bp, mouse
ggacgagggcagtgtcccac

SEQ ID NO: 498113 - DNA, 20 bp, mouse
gcctgccgctcaggcagtta

SEQ ID NO: 498114 - DNA, 20 bp, mouse
gtcaccccgagtcctaggaa

SEQ ID NO: 498115 - DNA, 20 bp, mouse
gcgtccgccacagacgtcgg

SEQ ID NO: 498116 - DNA, 20 bp, mouse
ggctagacagggccacgagt

SEQ ID NO: 498117 - DNA, 20 bp, mouse
gacagcctcaagtcatccaa

SEQ ID NO: 498118 - DNA, 20 bp, mouse
gaggcaagccttgtcactca

SEQ ID NO: 498119 - DNA, 20 bp, mouse
ggtgtgtgtgagacgagcag

SEQ ID NO: 498120 - DNA, 20 bp, mouse
gctggcagcagagggtactc

SEQ ID NO: 498121 - DNA, 20 bp, mouse
gtcacacacacagctagaca

SEQ ID NO: 498122 - DNA, 20 bp, mouse
ggagtcggtgtgagtcacac

SEQ ID NO: 498123 - DNA, 20 bp, mouse
gcctctgctgccaggcacaa

SEQ ID NO: 498124 - DNA, 20 bp, mouse
gaaggccacagatccaaggg

SEQ ID NO: 498125 - DNA, 20 bp, mouse
gcccagggcctgacaagcca

SEQ ID NO: 498126 - DNA, 20 bp, mouse
gctctcttggctgtatttcc

SEQ ID NO: 498127 - DNA, 20 bp, mouse
gtgtgtggtgtggtgcgctg

SEQ ID NO: 498128 - DNA, 20 bp, mouse
gctttcctatgtagtgtcaa

SEQ ID NO: 498129 - DNA, 20 bp, mouse
gtacataggaaaggcttacc

SEQ ID NO: 498130 - DNA, 20 bp, mouse
gcccacacagaggagttgtg

SEQ ID NO: 498131 - DNA, 20 bp, mouse
ggacacactagtcaaccaaa

SEQ ID NO: 498132 - DNA, 20 bp, mouse
ggagttctgtgaccatccct

SEQ ID NO: 498133 - DNA, 20 bp, mouse
gaaagtcagctattcatcta

SEQ ID NO: 498134 - DNA, 20 bp, mouse
ggtcagactatcaagccctt

SEQ ID NO: 498135 - DNA, 20 bp, mouse
gtgctccaatgagaaaataa

SEQ ID NO: 498136 - DNA, 20 bp, mouse
gcgaccccaagactggtcag

SEQ ID NO: 498137 - DNA, 20 bp, mouse
gtcacctagggtgttctcta

SEQ ID NO: 498138 - DNA, 20 bp, mouse
gggagccgctgaccagtctt

SEQ ID NO: 498139 - DNA, 20 bp, mouse
gaggagacgcactcccgacg

SEQ ID NO: 498140 - DNA, 20 bp, mouse
gtcagcggctccctaacccc

SEQ ID NO: 498141 - DNA, 20 bp, mouse
gtgatgaccctgggagacag

SEQ ID NO: 498142 - DNA, 20 bp, mouse
ggacggcggtgacttagagg

SEQ ID NO: 498143 - DNA, 20 bp, mouse
gcccgagaggccaggctggg

SEQ ID NO: 498144 - DNA, 20 bp, mouse
gctcgcaggctgatgaccct

SEQ ID NO: 498145 - DNA, 20 bp, mouse
gtcctccctccagtcaccta

SEQ ID NO: 498146 - DNA, 20 bp, mouse
gctgcaaacgctcttcctgg

SEQ ID NO: 498147 - DNA, 20 bp, mouse
ggctggctggcgctctgggc

SEQ ID NO: 498148 - DNA, 20 bp, mouse
gagctgaggtgtctggatca

SEQ ID NO: 498149 - DNA, 20 bp, mouse
gcagactgatgactgactga

SEQ ID NO: 498150 - DNA, 20 bp, mouse
gggtcctcagggtcccctaa

SEQ ID NO: 498151 - DNA, 20 bp, mouse
gcagaaagcctgctttgcac

SEQ ID NO: 498152 - DNA, 20 bp, mouse
gagactggccctgctcaggg

SEQ ID NO: 498153 - DNA, 20 bp, mouse
gatttggtcggaatgatcac

SEQ ID NO: 498154 - DNA, 20 bp, mouse
gatcactggcagcatggagg

SEQ ID NO: 498155 - DNA, 20 bp, mouse
gctttgcacgggcttggagc

SEQ ID NO: 498156 - DNA, 20 bp, mouse
gccgtgggtggtgctccaga

SEQ ID NO: 498157 - DNA, 20 bp, mouse
ggctgtgagctggccgtggg

SEQ ID NO: 498158 - DNA, 20 bp, mouse
gtaagctgtgagctggccgt

SEQ ID NO: 498159 - DNA, 20 bp, mouse
gcaccatctagagcaccctc

SEQ ID NO: 498160 - DNA, 20 bp, mouse
gggtgcaggtggcagagtag

SEQ ID NO: 498161 - DNA, 20 bp, mouse
gcagctacgaggagtccacc

SEQ ID NO: 498162 - DNA, 20 bp, mouse
ggcagtcacacagggacctg

SEQ ID NO: 498163 - DNA, 20 bp, mouse
gctctagatggtgctccagg

SEQ ID NO: 498164 - DNA, 20 bp, mouse
ggactcctcgtagctgtagg

SEQ ID NO: 498165 - DNA, 20 bp, mouse
gaggctctgtgcagtcacac

SEQ ID NO: 498166 - DNA, 20 bp, mouse
gatggaactgctgtcactgt

SEQ ID NO: 498167 - DNA, 20 bp, mouse
gcctgagtaggcccaggtcc

SEQ ID NO: 498168 - DNA, 20 bp, mouse
gagcaggcgaccctgcaaaa

SEQ ID NO: 498169 - DNA, 20 bp, mouse
gtctctgaagacctggacct

SEQ ID NO: 498170 - DNA, 20 bp, mouse
gctctggcctgagtaggccc

SEQ ID NO: 498171 - DNA, 20 bp, mouse
gtcattgaaaaggacgtacc

SEQ ID NO: 498172 - DNA, 20 bp, mouse
gcctgggtccaggttgtacc

SEQ ID NO: 498173 - DNA, 20 bp, mouse
ggtaattagatctgatctgt

SEQ ID NO: 498174 - DNA, 20 bp, mouse
gctactggggagatataaca

SEQ ID NO: 498175 - DNA, 20 bp, mouse
gttctggcctaagcaggcct

SEQ ID NO: 498176 - DNA, 20 bp, mouse
gggtgcaggtccacagccag

SEQ ID NO: 498177 - DNA, 20 bp, mouse
gccaggctaaccccactctc

SEQ ID NO: 498178 - DNA, 20 bp, mouse
gctcgccaggcccggagagt

SEQ ID NO: 498179 - DNA, 20 bp, mouse
gatgttggggaacaccaggt

SEQ ID NO: 498180 - DNA, 20 bp, mouse
gcagtagcagaggtggtgtt

SEQ ID NO: 498181 - DNA, 20 bp, mouse
gggcggtggcatgaagatgg

SEQ ID NO: 498182 - DNA, 20 bp, mouse
gggatggacgccagaaagag

SEQ ID NO: 498183 - DNA, 20 bp, mouse
gtaggcaggcagaacagtag

SEQ ID NO: 498184 - DNA, 20 bp, mouse
gtcagaagacacggtcccag

SEQ ID NO: 498185 - DNA, 20 bp, mouse
gcagcaggcagactgggtgg

SEQ ID NO: 498186 - DNA, 20 bp, mouse
gactaccatgttggaaaata

SEQ ID NO: 498187 - DNA, 20 bp, mouse
gtaccaaaccactaccatgt

SEQ ID NO: 498188 - DNA, 20 bp, mouse
gggcaggtttaaaaaagttc

SEQ ID NO: 498189 - DNA, 20 bp, mouse
gagtagcatcctcattggag

SEQ ID NO: 498190 - DNA, 20 bp, mouse
gttccaacatggtagtggtt

SEQ ID NO: 498191 - DNA, 20 bp, mouse
gagaaagaaactgaaacggt

SEQ ID NO: 498192 - DNA, 20 bp, mouse
gagatcagtagcatcctcat

SEQ ID NO: 498193 - DNA, 20 bp, mouse
ggtccaattctagatatcaa

SEQ ID NO: 498194 - DNA, 20 bp, mouse
gtctagatatcaagggtgaa

SEQ ID NO: 498195 - DNA, 20 bp, mouse
gtccttcactgcttttttgg

SEQ ID NO: 498196 - DNA, 20 bp, mouse
gggcgatgagcagacgtgag

SEQ ID NO: 498197 - DNA, 20 bp, mouse
gtccacgcccggggcaggag

SEQ ID NO: 498198 - DNA, 20 bp, mouse
gcgtggagggaccgacgctc

SEQ ID NO: 498199 - DNA, 20 bp, mouse
gctgcctggctcccgagcgt

SEQ ID NO: 498200 - DNA, 20 bp, mouse
gtcctgcagagccggccagc

SEQ ID NO: 498201 - DNA, 20 bp, mouse
ggccatccgcgaggaggggt

SEQ ID NO: 498202 - DNA, 20 bp, mouse
gggaccgacgctcgggagcc

SEQ ID NO: 498203 - DNA, 20 bp, mouse
ggcacagccgctcctgcccc

SEQ ID NO: 498204 - DNA, 20 bp, mouse
ggtcggtccctccacgcccg

SEQ ID NO: 498205 - DNA, 20 bp, mouse
gaggcagcgtcctgcagagc

SEQ ID NO: 498206 - DNA, 20 bp, mouse
gggactgtgtgtcagtgtac

SEQ ID NO: 498207 - DNA, 20 bp, mouse
gatggtactagtgacagggt

SEQ ID NO: 498208 - DNA, 20 bp, mouse
ggtagtatgccaggattaaa

SEQ ID NO: 498209 - DNA, 20 bp, mouse
ggtggaggcagagagcgcaa

SEQ ID NO: 498210 - DNA, 20 bp, mouse
gctgatgacattagagaggg

SEQ ID NO: 498211 - DNA, 20 bp, mouse
gccctagagccccactacag

SEQ ID NO: 498212 - DNA, 20 bp, mouse
gctacatggtactagtgaca

SEQ ID NO: 498213 - DNA, 20 bp, mouse
ggcttggcttgggacggtag

SEQ ID NO: 498214 - DNA, 20 bp, mouse
ggagaaaagagtagtatgcc

SEQ ID NO: 498215 - DNA, 20 bp, mouse
gaggccctcatacctatatc

SEQ ID NO: 498216 - DNA, 20 bp, mouse
ggacaccacctacctaacac

SEQ ID NO: 498217 - DNA, 20 bp, mouse
gagagtcgcctgtgttaggt

SEQ ID NO: 498218 - DNA, 20 bp, mouse
gagcagaccaaccccactat

SEQ ID NO: 498219 - DNA, 20 bp, mouse
ggctcagagtcgcctgtgtt

SEQ ID NO: 498220 - DNA, 20 bp, mouse
ggtcgcctgtgttaggtagg

SEQ ID NO: 498221 - DNA, 20 bp, mouse
gtgtgctgtgtcttgttgga

SEQ ID NO: 498222 - DNA, 20 bp, mouse
gcggttaaggagggtcacgt

SEQ ID NO: 498223 - DNA, 20 bp, mouse
ggagatgtagtaccgatagt

SEQ ID NO: 498224 - DNA, 20 bp, mouse
ggtagtaccgatagtggggt

SEQ ID NO: 498225 - DNA, 20 bp, mouse
gctgtcaaaggctgtctgag

SEQ ID NO: 498226 - DNA, 20 bp, mouse
ggccgggcgagcaaacggag

SEQ ID NO: 498227 - DNA, 20 bp, mouse
gggcgagcaaacggagcggg

SEQ ID NO: 498228 - DNA, 20 bp, mouse
gcaccagcagctgcacgtga

SEQ ID NO: 498229 - DNA, 20 bp, mouse
gcgagttccacggtaggtcc

SEQ ID NO: 498230 - DNA, 20 bp, mouse
gccacgtcggcagcagaggg

SEQ ID NO: 498231 - DNA, 20 bp, mouse
gtccgggcaggtcgagcgag

SEQ ID NO: 498232 - DNA, 20 bp, mouse
gcaggccgcaggcggttgcc

SEQ ID NO: 498233 - DNA, 20 bp, mouse
gctcgcccggcaaccgcctg

SEQ ID NO: 498234 - DNA, 20 bp, mouse
gagcccacgtcggcagcaga

SEQ ID NO: 498235 - DNA, 20 bp, mouse
gctaccgaccccgggctcga

SEQ ID NO: 498236 - DNA, 20 bp, mouse
gtggggctgttagtgccagg

SEQ ID NO: 498237 - DNA, 20 bp, mouse
ggctcagaggtgtgaggggt

SEQ ID NO: 498238 - DNA, 20 bp, mouse
gcctgggaagatgacagtca

SEQ ID NO: 498239 - DNA, 20 bp, mouse
gacacctctgagctgcccct

SEQ ID NO: 498240 - DNA, 20 bp, mouse
gagtgacagctacttcctgc

SEQ ID NO: 498241 - DNA, 20 bp, mouse
gtcacttgctgaggctctgt

SEQ ID NO: 498242 - DNA, 20 bp, mouse
gctcttgggagcacctgtcc

SEQ ID NO: 498243 - DNA, 20 bp, mouse
gcactaacagccccatccac

SEQ ID NO: 498244 - DNA, 20 bp, mouse
gagcttactagcatccccag

SEQ ID NO: 498245 - DNA, 20 bp, mouse
gggatggggctgttagtgcc

SEQ ID NO: 498246 - DNA, 20 bp, mouse
ggtggctaggacctccgttg

SEQ ID NO: 498247 - DNA, 20 bp, mouse
gacacggactgccacaacgg

SEQ ID NO: 498248 - DNA, 20 bp, mouse
gacttaaagagaatcatgtc

SEQ ID NO: 498249 - DNA, 20 bp, mouse
gctcaatgtagctcccgaga

SEQ ID NO: 498250 - DNA, 20 bp, mouse
ggaaaggaacaatggtgctg

SEQ ID NO: 498251 - DNA, 20 bp, mouse
gcattcattgcttccatctc

SEQ ID NO: 498252 - DNA, 20 bp, mouse
ggcagacttcccggggtaag

SEQ ID NO: 498253 - DNA, 20 bp, mouse
gggcagagcattcctaaatt

SEQ ID NO: 498254 - DNA, 20 bp, mouse
gtatcagcagcagacttccc

SEQ ID NO: 498255 - DNA, 20 bp, mouse
gataaactacatccaaattt

SEQ ID NO: 498256 - DNA, 20 bp, mouse
gcctgactgacatccctcgg

SEQ ID NO: 498257 - DNA, 20 bp, mouse
gcgcagtgggcgtgaatccc

SEQ ID NO: 498258 - DNA, 20 bp, mouse
gtggccccgtcggcccccga

SEQ ID NO: 498259 - DNA, 20 bp, mouse
gtggtcacaggtggccccgt

SEQ ID NO: 498260 - DNA, 20 bp, mouse
gccaagcaggaagttctgaa

SEQ ID NO: 498261 - DNA, 20 bp, mouse
ggtgggaagagaacccctcg

SEQ ID NO: 498262 - DNA, 20 bp, mouse
ggaacttcctgcttggtcac

SEQ ID NO: 498263 - DNA, 20 bp, mouse
gcctaaggacgtgccgcagt

SEQ ID NO: 498264 - DNA, 20 bp, mouse
gcgaatccaagagtcagagt

SEQ ID NO: 498265 - DNA, 20 bp, mouse
gcatccctcgggggccgacg

SEQ ID NO: 498266 - DNA, 20 bp, mouse
gggaggggcactgagagagt

SEQ ID NO: 498267 - DNA, 20 bp, mouse
gtgagccaccgggaaacctt

SEQ ID NO: 498268 - DNA, 20 bp, mouse
gcctctgagccacatttcag

SEQ ID NO: 498269 - DNA, 20 bp, mouse
gcccctataggagcttactc

SEQ ID NO: 498270 - DNA, 20 bp, mouse
gtgttccgaaggtttcccgg

SEQ ID NO: 498271 - DNA, 20 bp, mouse
gcagctcgcaggcaggactt

SEQ ID NO: 498272 - DNA, 20 bp, mouse
ggaggatgccatgagccacc

SEQ ID NO: 498273 - DNA, 20 bp, mouse
gcacatttcagcggtgatag

SEQ ID NO: 498274 - DNA, 20 bp, mouse
gtccagagtaagctcctata

SEQ ID NO: 498275 - DNA, 20 bp, mouse
gttggtcaggaacagctcgc

SEQ ID NO: 498276 - DNA, 20 bp, mouse
gcacagacctagagcttcag

SEQ ID NO: 498277 - DNA, 20 bp, mouse
gtcttgccgcaccttcctct

SEQ ID NO: 498278 - DNA, 20 bp, mouse
gcacagacagtgccttccca

SEQ ID NO: 498279 - DNA, 20 bp, mouse
gagctggctggcctgacgtc

SEQ ID NO: 498280 - DNA, 20 bp, mouse
gctgctgagtccaaagccaa

SEQ ID NO: 498281 - DNA, 20 bp, mouse
gagatgtaaagagtttggag

SEQ ID NO: 498282 - DNA, 20 bp, mouse
gcttcccagggcctgacgtc

SEQ ID NO: 498283 - DNA, 20 bp, mouse
gtaaccactagcaccaggag

SEQ ID NO: 498284 - DNA, 20 bp, mouse
ggcaggaggcagcagtgcct

SEQ ID NO: 498285 - DNA, 20 bp, mouse
gaatccagagtgggcaaggt

SEQ ID NO: 498286 - DNA, 20 bp, mouse
gttcggttaaggatgtattg

SEQ ID NO: 498287 - DNA, 20 bp, mouse
gccagcctactgcagaacta

SEQ ID NO: 498288 - DNA, 20 bp, mouse
gaggctgcttagggtgaagt

SEQ ID NO: 498289 - DNA, 20 bp, mouse
gctgcagaactaaggcacag

SEQ ID NO: 498290 - DNA, 20 bp, mouse
gtttcagcatgcagaatcac

SEQ ID NO: 498291 - DNA, 20 bp, mouse
gtgtcttcaggattaccata

SEQ ID NO: 498292 - DNA, 20 bp, mouse
gattgcaaggctttcggtta

SEQ ID NO: 498293 - DNA, 20 bp, mouse
ggcacagagggaggggctaa

SEQ ID NO: 498294 - DNA, 20 bp, mouse
gaagtaagggccgtttatgg

SEQ ID NO: 498295 - DNA, 20 bp, mouse
gtcttctatcagctgttcag

SEQ ID NO: 498296 - DNA, 20 bp, mouse
gaagggcactgctctggaga

SEQ ID NO: 498297 - DNA, 20 bp, mouse
gtggggagaagcgacaaggt

SEQ ID NO: 498298 - DNA, 20 bp, mouse
gggatccaggctttctgaaa

SEQ ID NO: 498299 - DNA, 20 bp, mouse
gtgcaaaagctgctcggagc

SEQ ID NO: 498300 - DNA, 20 bp, mouse
gtgagacagcattcggatcc

SEQ ID NO: 498301 - DNA, 20 bp, mouse
gcatattctatacattagca

SEQ ID NO: 498302 - DNA, 20 bp, mouse
ggcacctatatactataata

SEQ ID NO: 498303 - DNA, 20 bp, mouse
gtgcttattgactccacagt

SEQ ID NO: 498304 - DNA, 20 bp, mouse
ggttccttattatagtatat

SEQ ID NO: 498305 - DNA, 20 bp, mouse
gcctctcactcttcctactg

SEQ ID NO: 498306 - DNA, 20 bp, mouse
gtgccccagctaggactcca

SEQ ID NO: 498307 - DNA, 20 bp, mouse
gcagctaggactccagggtt

SEQ ID NO: 498308 - DNA, 20 bp, mouse
gctaggactccagggttcgg

SEQ ID NO: 498309 - DNA, 20 bp, mouse
gaccgggccggcgtgcatcc

SEQ ID NO: 498310 - DNA, 20 bp, mouse
gcgtgcatcctggcgcaggg

SEQ ID NO: 498311 - DNA, 20 bp, mouse
gctgcatggccggggtcacc

SEQ ID NO: 498312 - DNA, 20 bp, mouse
gcagggttcggtggactgca

SEQ ID NO: 498313 - DNA, 20 bp, mouse
ggtgagcacgaagcccaggt

SEQ ID NO: 498314 - DNA, 20 bp, mouse
gcggcgtgcatcctggcgca

SEQ ID NO: 498315 - DNA, 20 bp, mouse
gtcggtggactgcatggccg

SEQ ID NO: 498316 - DNA, 20 bp, mouse
gagagggacccagtaagggc

SEQ ID NO: 498317 - DNA, 20 bp, mouse
gagctgagagggacccagta

SEQ ID NO: 498318 - DNA, 20 bp, mouse
ggcctgcacccgcccttact

SEQ ID NO: 498319 - DNA, 20 bp, mouse
gacctcccaggcgagcacct

SEQ ID NO: 498320 - DNA, 20 bp, mouse
gacctcaccggcgatcacct

SEQ ID NO: 498321 - DNA, 20 bp, mouse
gacccagtaagggcgggtgc

SEQ ID NO: 498322 - DNA, 20 bp, mouse
gtgaagtgccctggaatccg

SEQ ID NO: 498323 - DNA, 20 bp, mouse
gactcagcccctaggcgaca

SEQ ID NO: 498324 - DNA, 20 bp, mouse
ggagtctggggtcacctcac

SEQ ID NO: 498325 - DNA, 20 bp, mouse
gggtgaccccagactccgag

SEQ ID NO: 498326 - DNA, 20 bp, mouse
ggcagagccaagaggcgcgg

SEQ ID NO: 498327 - DNA, 20 bp, mouse
gcgcaccgcgactgagatgg

SEQ ID NO: 498328 - DNA, 20 bp, mouse
ggccgccgccatctcagtcg

SEQ ID NO: 498329 - DNA, 20 bp, mouse
ggaggcgcgccgagcccccg

SEQ ID NO: 498330 - DNA, 20 bp, mouse
gaccgcgactgagatggcgg

SEQ ID NO: 498331 - DNA, 20 bp, mouse
gggggcagagccaagaggcg

SEQ ID NO: 498332 - DNA, 20 bp, mouse
gtcttggctctgccccccgc

SEQ ID NO: 498333 - DNA, 20 bp, mouse
gcgaacgctagtgagccggg

SEQ ID NO: 498334 - DNA, 20 bp, mouse
ggctgcgcgctccggcggag

SEQ ID NO: 498335 - DNA, 20 bp, mouse
ggcgcccagggcgcagggag

SEQ ID NO: 498336 - DNA, 20 bp, mouse
gtctgccagaacctgagtgg

SEQ ID NO: 498337 - DNA, 20 bp, mouse
gggcagggcccactactcac

SEQ ID NO: 498338 - DNA, 20 bp, mouse
gagggcccactactcaccgg

SEQ ID NO: 498339 - DNA, 20 bp, mouse
gccgcggggcgcctccactc

SEQ ID NO: 498340 - DNA, 20 bp, mouse
gtcaccggtggctcaggacc

SEQ ID NO: 498341 - DNA, 20 bp, mouse
gggtggctcaggaccgggtg

SEQ ID NO: 498342 - DNA, 20 bp, mouse
gggcgcctccactcaggttc

SEQ ID NO: 498343 - DNA, 20 bp, mouse
gcccagactccgggtacccg

SEQ ID NO: 498344 - DNA, 20 bp, mouse
gaccccccgaccctgagcag

SEQ ID NO: 498345 - DNA, 20 bp, mouse
gggaccccaagaagcccccg

SEQ ID NO: 498346 - DNA, 20 bp, mouse
gctgtggtggagacagccgt

SEQ ID NO: 498347 - DNA, 20 bp, mouse
gagtgtcagcatggtgccca

SEQ ID NO: 498348 - DNA, 20 bp, mouse
ggatagaaggcagcaaagaa

SEQ ID NO: 498349 - DNA, 20 bp, mouse
ggctgtctccaccacagtgc

SEQ ID NO: 498350 - DNA, 20 bp, mouse
gcagcaagaagagcaggact

SEQ ID NO: 498351 - DNA, 20 bp, mouse
ggaaggctactcccacacca

SEQ ID NO: 498352 - DNA, 20 bp, mouse
ggtcttgcccttcagataga

SEQ ID NO: 498353 - DNA, 20 bp, mouse
gagaagagcaggacttggca

SEQ ID NO: 498354 - DNA, 20 bp, mouse
gagtgtgtgctgggccttat

SEQ ID NO: 498355 - DNA, 20 bp, mouse
gagcagttggtgcgctccat

SEQ ID NO: 498356 - DNA, 20 bp, mouse
ggactctgtgaacttgtcaa

SEQ ID NO: 498357 - DNA, 20 bp, mouse
ggagcagcatccaccagaaa

SEQ ID NO: 498358 - DNA, 20 bp, mouse
gagctagtctgaggctcctg

SEQ ID NO: 498359 - DNA, 20 bp, mouse
gagaatcctgctgggcccag

SEQ ID NO: 498360 - DNA, 20 bp, mouse
ggctctgaggtaagacccct

SEQ ID NO: 498361 - DNA, 20 bp, mouse
ggacactgagctgcgtctgg

SEQ ID NO: 498362 - DNA, 20 bp, mouse
gtgttcctctcatccctttc

SEQ ID NO: 498363 - DNA, 20 bp, mouse
gagagacactgagctgcgtc

SEQ ID NO: 498364 - DNA, 20 bp, mouse
gctttccggaagcacttgta

SEQ ID NO: 498365 - DNA, 20 bp, mouse
gtgtccaacagtcttctctc

SEQ ID NO: 498366 - DNA, 20 bp, mouse
ggagcccagctgacacaacc

SEQ ID NO: 498367 - DNA, 20 bp, mouse
gttgcaccaccaccaccgga

SEQ ID NO: 498368 - DNA, 20 bp, mouse
ggctgacacaacctggtcta

SEQ ID NO: 498369 - DNA, 20 bp, mouse
gtcagctgggctcttccatc

SEQ ID NO: 498370 - DNA, 20 bp, mouse
ggggctcttccatccggtgg

SEQ ID NO: 498371 - DNA, 20 bp, mouse
gagctccaaacgggacccaa

SEQ ID NO: 498372 - DNA, 20 bp, mouse
gacccaaaactccctagacc

SEQ ID NO: 498373 - DNA, 20 bp, mouse
ggctgggctcttccatccgg

SEQ ID NO: 498374 - DNA, 20 bp, mouse
ggaagctttcctgaagtaaa

SEQ ID NO: 498375 - DNA, 20 bp, mouse
ggcaatgctagtatactttg

SEQ ID NO: 498376 - DNA, 20 bp, mouse
ggaaccccgtgggagacagt

SEQ ID NO: 498377 - DNA, 20 bp, mouse
gtacctctgtggaaccccgt

SEQ ID NO: 498378 - DNA, 20 bp, mouse
gctcccacggggttccacag

SEQ ID NO: 498379 - DNA, 20 bp, mouse
gtgggcacagagagacgagt

SEQ ID NO: 498380 - DNA, 20 bp, mouse
gggggttccacagaggtatg

SEQ ID NO: 498381 - DNA, 20 bp, mouse
gagcaatctgagggcagtaa

SEQ ID NO: 498382 - DNA, 20 bp, mouse
gcatcccactgtctcccacg

SEQ ID NO: 498383 - DNA, 20 bp, mouse
gagatggcttaggtcaatgg

SEQ ID NO: 498384 - DNA, 20 bp, mouse
gccttcagggctaagaaccc

SEQ ID NO: 498385 - DNA, 20 bp, mouse
gattgacctaagccatctgt

SEQ ID NO: 498386 - DNA, 20 bp, mouse
gtggccgcgggtttcgaatc

SEQ ID NO: 498387 - DNA, 20 bp, mouse
ggaagacagccaccacccaa

SEQ ID NO: 498388 - DNA, 20 bp, mouse
ggtgacagccagtcccctag

SEQ ID NO: 498389 - DNA, 20 bp, mouse
ggacaagtggatggcgccag

SEQ ID NO: 498390 - DNA, 20 bp, mouse
gcctagtgcacgggctgaga

SEQ ID NO: 498391 - DNA, 20 bp, mouse
gttcaaagggactgttgcca

SEQ ID NO: 498392 - DNA, 20 bp, mouse
gacccgggttgcgatggtgg

SEQ ID NO: 498393 - DNA, 20 bp, mouse
gagccagtcccctagtggag

SEQ ID NO: 498394 - DNA, 20 bp, mouse
gccccccgccagccgagagt

SEQ ID NO: 498395 - DNA, 20 bp, mouse
gtaactccgacgactttcaa

SEQ ID NO: 498396 - DNA, 20 bp, mouse
gagctgcctcggagaggtga

SEQ ID NO: 498397 - DNA, 20 bp, mouse
gcctcaccctcacctctccg

SEQ ID NO: 498398 - DNA, 20 bp, mouse
gtgctttcctggccatgcgg

SEQ ID NO: 498399 - DNA, 20 bp, mouse
gaggggccacagccaccgca

SEQ ID NO: 498400 - DNA, 20 bp, mouse
ggggctgagtggggtctctg

SEQ ID NO: 498401 - DNA, 20 bp, mouse
ggtgagggtgaggggaccta

SEQ ID NO: 498402 - DNA, 20 bp, mouse
ggaccgggacgccaagtcag

SEQ ID NO: 498403 - DNA, 20 bp, mouse
gcgaccccgaagaggcacca

SEQ ID NO: 498404 - DNA, 20 bp, mouse
gagcagagtcgaccccgaag

SEQ ID NO: 498405 - DNA, 20 bp, mouse
gccctgctttcctggccatg

SEQ ID NO: 498406 - DNA, 20 bp, mouse
gtgaggagggaccagtccgg

SEQ ID NO: 498407 - DNA, 20 bp, mouse
gggagggaccagtccggagg

SEQ ID NO: 498408 - DNA, 20 bp, mouse
gtagtcactccgggtgagga

SEQ ID NO: 498409 - DNA, 20 bp, mouse
ggggtgaggagggaccagtc

SEQ ID NO: 498410 - DNA, 20 bp, mouse
ggccgccagacagagttctg

SEQ ID NO: 498411 - DNA, 20 bp, mouse
gtactcagagttgagtaggg

SEQ ID NO: 498412 - DNA, 20 bp, mouse
gtcttactcagagttgagta

SEQ ID NO: 498413 - DNA, 20 bp, mouse
ggagatagtcactccgggtg

SEQ ID NO: 498414 - DNA, 20 bp, mouse
ggtcagagcctcctccggac

SEQ ID NO: 498415 - DNA, 20 bp, mouse
gtccctggcgacgcagtggg

SEQ ID NO: 498416 - DNA, 20 bp, mouse
ggcccagccgcggagcaggt

SEQ ID NO: 498417 - DNA, 20 bp, mouse
gcggtcgcccagcccagccg

SEQ ID NO: 498418 - DNA, 20 bp, mouse
gatagcacccacctgctccg

SEQ ID NO: 498419 - DNA, 20 bp, mouse
gccctgtgctgtgcagagtc

SEQ ID NO: 498420 - DNA, 20 bp, mouse
gaggggtagaatgggaacgg

SEQ ID NO: 498421 - DNA, 20 bp, mouse
ggcacagcacagggacccgg

SEQ ID NO: 498422 - DNA, 20 bp, mouse
gacctgagaaggggtagaat

SEQ ID NO: 498423 - DNA, 20 bp, mouse
gacccacctgctccgcggct

SEQ ID NO: 498424 - DNA, 20 bp, mouse
ggcgaccggcgtctctgact

SEQ ID NO: 498425 - DNA, 20 bp, mouse
gagagtcttggacctgagaa

SEQ ID NO: 498426 - DNA, 20 bp, mouse
ggcacagggttgagtcgtga

SEQ ID NO: 498427 - DNA, 20 bp, mouse
gagggttgagtcgtgaaggc

SEQ ID NO: 498428 - DNA, 20 bp, mouse
gtcctagctggagtgataag

SEQ ID NO: 498429 - DNA, 20 bp, mouse
gtaaggaggcagccttccag

SEQ ID NO: 498430 - DNA, 20 bp, mouse
gactgtgtggctcggtaagg

SEQ ID NO: 498431 - DNA, 20 bp, mouse
gggcctgatgcgcagaagga

SEQ ID NO: 498432 - DNA, 20 bp, mouse
gttcactgtgtggctcggta

SEQ ID NO: 498433 - DNA, 20 bp, mouse
gcagcctgagggatcagaat

SEQ ID NO: 498434 - DNA, 20 bp, mouse
gaccaaggctgcccagcccc

SEQ ID NO: 498435 - DNA, 20 bp, mouse
gtctcctcctgccactcgcc

SEQ ID NO: 498436 - DNA, 20 bp, mouse
ggcccagcggcccgagacaa

SEQ ID NO: 498437 - DNA, 20 bp, mouse
gcggctaggggaacagccgg

SEQ ID NO: 498438 - DNA, 20 bp, mouse
ggcggctgccggggaccagg

SEQ ID NO: 498439 - DNA, 20 bp, mouse
gccgcggctaggggaacagc

SEQ ID NO: 498440 - DNA, 20 bp, mouse
gtgggcccggatgcgcccag

SEQ ID NO: 498441 - DNA, 20 bp, mouse
gtccccggcagccgcggcta

SEQ ID NO: 498442 - DNA, 20 bp, mouse
gagggtggcggcccccgagg

SEQ ID NO: 498443 - DNA, 20 bp, mouse
gggccgggccggaggagcct

SEQ ID NO: 498444 - DNA, 20 bp, mouse
gcgcccgagcatcacagccg

SEQ ID NO: 498445 - DNA, 20 bp, mouse
gagacctcccctagggacca

SEQ ID NO: 498446 - DNA, 20 bp, mouse
gaagcgtggcgcactctctg

SEQ ID NO: 498447 - DNA, 20 bp, mouse
gcaggagctccgggaaagcg

SEQ ID NO: 498448 - DNA, 20 bp, mouse
gcacgaggtagggaaaataa

SEQ ID NO: 498449 - DNA, 20 bp, mouse
gagctcaccggagaggggcg

SEQ ID NO: 498450 - DNA, 20 bp, mouse
gccggagctcctgaagctcc

SEQ ID NO: 498451 - DNA, 20 bp, mouse
gagctcagggaattagcgtg

SEQ ID NO: 498452 - DNA, 20 bp, mouse
gtaatacctgctccttcacc

SEQ ID NO: 498453 - DNA, 20 bp, mouse
gcggtccccaagagcaacat

SEQ ID NO: 498454 - DNA, 20 bp, mouse
gagcaacatgggacctacaa

SEQ ID NO: 498455 - DNA, 20 bp, mouse
gcaatgcagccgaatggggt

SEQ ID NO: 498456 - DNA, 20 bp, mouse
gttgagagcagtcacatgag

SEQ ID NO: 498457 - DNA, 20 bp, mouse
gcatgtgactgctctcaagg

SEQ ID NO: 498458 - DNA, 20 bp, mouse
gaggcatcttcagtctccgt

SEQ ID NO: 498459 - DNA, 20 bp, mouse
ggagaatgtggtccacctag

SEQ ID NO: 498460 - DNA, 20 bp, mouse
gagaggcggggcattctaag

SEQ ID NO: 498461 - DNA, 20 bp, mouse
ggagacgtgtagctactgtg

SEQ ID NO: 498462 - DNA, 20 bp, mouse
gaagctgtctgaccactcat

SEQ ID NO: 498463 - DNA, 20 bp, mouse
gtctccgttggtggagaatg

SEQ ID NO: 498464 - DNA, 20 bp, mouse
gtgttggatagttcatgtca

SEQ ID NO: 498465 - DNA, 20 bp, mouse
gcagggtacctgccctagga

SEQ ID NO: 498466 - DNA, 20 bp, mouse
gaaggggctgctggcttggt

SEQ ID NO: 498467 - DNA, 20 bp, mouse
gcagtgggtgggagtagatg

SEQ ID NO: 498468 - DNA, 20 bp, mouse
ggcaccaggtaccggactaa

SEQ ID NO: 498469 - DNA, 20 bp, mouse
gccggactaagggcagccag

SEQ ID NO: 498470 - DNA, 20 bp, mouse
gtgtgtggagctggagaacc

SEQ ID NO: 498471 - DNA, 20 bp, mouse
gctagagcaagcaagtgcac

SEQ ID NO: 498472 - DNA, 20 bp, mouse
gtggagaacccggagaactg

SEQ ID NO: 498473 - DNA, 20 bp, mouse
ggctctatctactatagaga

SEQ ID NO: 498474 - DNA, 20 bp, mouse
gccaggcgacgggttctgga

SEQ ID NO: 498475 - DNA, 20 bp, mouse
gggtacctggtgccaggcga

SEQ ID NO: 498476 - DNA, 20 bp, mouse
ggcgtcaaagaggaaagtac

SEQ ID NO: 498477 - DNA, 20 bp, mouse
gctctcactcgcagcgaagg

SEQ ID NO: 498478 - DNA, 20 bp, mouse
gaggctgccccgcgtcaaag

SEQ ID NO: 498479 - DNA, 20 bp, mouse
gacgcggggcagccttctgc

SEQ ID NO: 498480 - DNA, 20 bp, mouse
gccgcgcagggaggatagcc

SEQ ID NO: 498481 - DNA, 20 bp, mouse
gtcctggagtgagtccgtcc

SEQ ID NO: 498482 - DNA, 20 bp, mouse
gtcctggacggactcactcc

SEQ ID NO: 498483 - DNA, 20 bp, mouse
gtgcctctcactcgcagcga

SEQ ID NO: 498484 - DNA, 20 bp, mouse
ggagcttctggggaaggcga

SEQ ID NO: 498485 - DNA, 20 bp, mouse
gagaagctcaaagtaccctt

SEQ ID NO: 498486 - DNA, 20 bp, mouse
gctgagaagagctatcacat

SEQ ID NO: 498487 - DNA, 20 bp, mouse
gcactgcagtgagcggagag

SEQ ID NO: 498488 - DNA, 20 bp, mouse
gggtgtcccaaaggtagtat

SEQ ID NO: 498489 - DNA, 20 bp, mouse
gtgtcacaggatgggctctc

SEQ ID NO: 498490 - DNA, 20 bp, mouse
gaactgcccaccacaggaca

SEQ ID NO: 498491 - DNA, 20 bp, mouse
gggagttgccgactaggcca

SEQ ID NO: 498492 - DNA, 20 bp, mouse
gtgcccaccacaggacaggg

SEQ ID NO: 498493 - DNA, 20 bp, mouse
gccgactaggccagggatgt

SEQ ID NO: 498494 - DNA, 20 bp, mouse
ggtctcagcttatagaaggg

SEQ ID NO: 498495 - DNA, 20 bp, mouse
gtgggtctgccccacatccc

SEQ ID NO: 498496 - DNA, 20 bp, mouse
gcatctccacagaggctgag

SEQ ID NO: 498497 - DNA, 20 bp, mouse
gggccctatgggtggatgca

SEQ ID NO: 498498 - DNA, 20 bp, mouse
gctggagctgtgctagggca

SEQ ID NO: 498499 - DNA, 20 bp, mouse
gaggcccagaggcatgatgg

SEQ ID NO: 498500 - DNA, 20 bp, mouse
gggcgttggagtcacctcct

SEQ ID NO: 498501 - DNA, 20 bp, mouse
gcagccttgcatccacccat

SEQ ID NO: 498502 - DNA, 20 bp, mouse
ggtcttgaggagcatgggac

SEQ ID NO: 498503 - DNA, 20 bp, mouse
ggaggggtcttgaggagcat

SEQ ID NO: 498504 - DNA, 20 bp, mouse
ggcgcggccagcaggcccag

SEQ ID NO: 498505 - DNA, 20 bp, mouse
gagggggagaaagccgagcc

SEQ ID NO: 498506 - DNA, 20 bp, mouse
ggcgagcgctggttaaccgg

SEQ ID NO: 498507 - DNA, 20 bp, mouse
gccggcagccggcaaggcgg

SEQ ID NO: 498508 - DNA, 20 bp, mouse
gggagagtcggggcatcgcc

SEQ ID NO: 498509 - DNA, 20 bp, mouse
gctcgcggcctaaccagcag

SEQ ID NO: 498510 - DNA, 20 bp, mouse
gagagcgagcgctggttaac

SEQ ID NO: 498511 - DNA, 20 bp, mouse
gtggcaggcgagcgcatcct

SEQ ID NO: 498512 - DNA, 20 bp, mouse
ggcaaggcggaggcactgcc

SEQ ID NO: 498513 - DNA, 20 bp, mouse
gggcagccggcaacccggag

SEQ ID NO: 498514 - DNA, 20 bp, mouse
gctggttaggccgcgaggta

SEQ ID NO: 498515 - DNA, 20 bp, mouse
gagcgctggttaaccggggg

SEQ ID NO: 498516 - DNA, 20 bp, mouse
gtgagtgtggcgccgagaaa

SEQ ID NO: 498517 - DNA, 20 bp, mouse
gttaggtcttaagaccccta

SEQ ID NO: 498518 - DNA, 20 bp, mouse
gaccggtcaccgggacccgc

SEQ ID NO: 498519 - DNA, 20 bp, mouse
ggctcttgggccgtctggaa

SEQ ID NO: 498520 - DNA, 20 bp, mouse
ggacgcggcccgacagaaag

SEQ ID NO: 498521 - DNA, 20 bp, mouse
ggaggacgccagcagccaac

SEQ ID NO: 498522 - DNA, 20 bp, mouse
gacctgcgggtcccggtgac

SEQ ID NO: 498523 - DNA, 20 bp, mouse
gagggtatctgaaaccctag

SEQ ID NO: 498524 - DNA, 20 bp, mouse
gccagcagccaaccggtcac

SEQ ID NO: 498525 - DNA, 20 bp, mouse
ggcccgacagaaaggggaaa

SEQ ID NO: 498526 - DNA, 20 bp, mouse
gaagcatccctccagaaaca

SEQ ID NO: 498527 - DNA, 20 bp, mouse
gtactcacccctgtttctgg

SEQ ID NO: 498528 - DNA, 20 bp, mouse
gactggttaggtgatgatat

SEQ ID NO: 498529 - DNA, 20 bp, mouse
gcctagactcgtgcactggt

SEQ ID NO: 498530 - DNA, 20 bp, mouse
ggccaacacactgcatcccg

SEQ ID NO: 498531 - DNA, 20 bp, mouse
gtcatactcacccctgtttc

SEQ ID NO: 498532 - DNA, 20 bp, mouse
gtttcttctactttgagcag

SEQ ID NO: 498533 - DNA, 20 bp, mouse
gctcaaacttagaactggtt

SEQ ID NO: 498534 - DNA, 20 bp, mouse
gcagaactcaaacttagaac

SEQ ID NO: 498535 - DNA, 20 bp, mouse
gtactttgagcagtggtatg

SEQ ID NO: 498536 - DNA, 20 bp, mouse
gctcctggtagggcaaagga

SEQ ID NO: 498537 - DNA, 20 bp, mouse
ggccccatacccacactgat

SEQ ID NO: 498538 - DNA, 20 bp, mouse
gagaaaaagccaatcagtgt

SEQ ID NO: 498539 - DNA, 20 bp, mouse
ggagcctcctggtagggcaa

SEQ ID NO: 498540 - DNA, 20 bp, mouse
gtcccacaggtaggtcaatt

SEQ ID NO: 498541 - DNA, 20 bp, mouse
gtttctagagcctcctggta

SEQ ID NO: 498542 - DNA, 20 bp, mouse
gagccaatcagtgtgggtat

SEQ ID NO: 498543 - DNA, 20 bp, mouse
gaggagtccacaggcagttg

SEQ ID NO: 498544 - DNA, 20 bp, mouse
gtccaaattgacctacctgt

SEQ ID NO: 498545 - DNA, 20 bp, mouse
gaggaggctgaaccaggtct

SEQ ID NO: 498546 - DNA, 20 bp, mouse
gaggctcccgggatgcgcgg

SEQ ID NO: 498547 - DNA, 20 bp, mouse
gctcccgggatgcgcggagg

SEQ ID NO: 498548 - DNA, 20 bp, mouse
gctgcgacacggaggaggaa

SEQ ID NO: 498549 - DNA, 20 bp, mouse
gcctaggctcccgggatgcg

SEQ ID NO: 498550 - DNA, 20 bp, mouse
gccgcgcgcccggctcgcct

SEQ ID NO: 498551 - DNA, 20 bp, mouse
gccggctcgcctaggctccc

SEQ ID NO: 498552 - DNA, 20 bp, mouse
gtagggtcactactgcgaca

SEQ ID NO: 498553 - DNA, 20 bp, mouse
gggcgatgatgactctagcc

SEQ ID NO: 498554 - DNA, 20 bp, mouse
gccggtggcctggaagctgc

SEQ ID NO: 498555 - DNA, 20 bp, mouse
gggcgctgaggccagctggt

SEQ ID NO: 498556 - DNA, 20 bp, mouse
gtctgcagcgcagagcgtga

SEQ ID NO: 498557 - DNA, 20 bp, mouse
gggagccctagtgttcggat

SEQ ID NO: 498558 - DNA, 20 bp, mouse
gtccaaggtggccggcacag

SEQ ID NO: 498559 - DNA, 20 bp, mouse
gcagctcgtgatccaagcct

SEQ ID NO: 498560 - DNA, 20 bp, mouse
gtcgttgctagatcgagccc

SEQ ID NO: 498561 - DNA, 20 bp, mouse
ggcagcaagtcctttctcct

SEQ ID NO: 498562 - DNA, 20 bp, mouse
gagaccaggatgagtagagg

SEQ ID NO: 498563 - DNA, 20 bp, mouse
ggctgcctatccgaacacta

SEQ ID NO: 498564 - DNA, 20 bp, mouse
gcgaagaccaggatgagtag

SEQ ID NO: 498565 - DNA, 20 bp, mouse
ggtgcagcgcctgcatccca

SEQ ID NO: 498566 - DNA, 20 bp, mouse
gcatctacgtactagacgag

SEQ ID NO: 498567 - DNA, 20 bp, mouse
ggacgagtggtaagcaaatg

SEQ ID NO: 498568 - DNA, 20 bp, mouse
gacagagagcaagcatctct

SEQ ID NO: 498569 - DNA, 20 bp, mouse
gaagattgatcctgagaagc

SEQ ID NO: 498570 - DNA, 20 bp, mouse
ggtgtgctcagagtatatat

SEQ ID NO: 498571 - DNA, 20 bp, mouse
gcatcagcaaagctctgtct

SEQ ID NO: 498572 - DNA, 20 bp, mouse
gagctctgtcttggagaatt

SEQ ID NO: 498573 - DNA, 20 bp, mouse
gctgaactgaccataaccga

SEQ ID NO: 498574 - DNA, 20 bp, mouse
ggagaattgggttataagaa

SEQ ID NO: 498575 - DNA, 20 bp, mouse
gattgggttataagaagggt

SEQ ID NO: 498576 - DNA, 20 bp, mouse
gcgccaccgaggaccgaggt

SEQ ID NO: 498577 - DNA, 20 bp, mouse
gcgagcgccaccgaggaccg

SEQ ID NO: 498578 - DNA, 20 bp, mouse
gcaccgaggaccgaggtggg

SEQ ID NO: 498579 - DNA, 20 bp, mouse
ggaaaactccgaaacgccaa

SEQ ID NO: 498580 - DNA, 20 bp, mouse
gggagacaaccgagatcctc

SEQ ID NO: 498581 - DNA, 20 bp, mouse
gaaacgccaagggagcctga

SEQ ID NO: 498582 - DNA, 20 bp, mouse
gagccgggcgagcgccaccg

SEQ ID NO: 498583 - DNA, 20 bp, mouse
gcctggaggctgggtgcgag

SEQ ID NO: 498584 - DNA, 20 bp, mouse
ggaccgaggtgggtggcagt

SEQ ID NO: 498585 - DNA, 20 bp, mouse
gcgagatcctccggagagtc

SEQ ID NO: 498586 - DNA, 20 bp, mouse
gcaggcttccagcttttcta

SEQ ID NO: 498587 - DNA, 20 bp, mouse
gtggctgtccctagaaaagc

SEQ ID NO: 498588 - DNA, 20 bp, mouse
gttctgtctagcatggtagg

SEQ ID NO: 498589 - DNA, 20 bp, mouse
gggctaaggttgggtaactt

SEQ ID NO: 498590 - DNA, 20 bp, mouse
gtggctatataacaagacac

SEQ ID NO: 498591 - DNA, 20 bp, mouse
ggaggcattatatgtccagc

SEQ ID NO: 498592 - DNA, 20 bp, mouse
gtgtgaaaactgggaacctc

SEQ ID NO: 498593 - DNA, 20 bp, mouse
gaggccccttcaatatgtgt

SEQ ID NO: 498594 - DNA, 20 bp, mouse
ggtcacaatcagaaaatgtg

SEQ ID NO: 498595 - DNA, 20 bp, mouse
gttcttatttctgtctagca

SEQ ID NO: 498596 - DNA, 20 bp, mouse
gctgcctggatgctcagtca

SEQ ID NO: 498597 - DNA, 20 bp, mouse
ggcatccaggcagggctcgg

SEQ ID NO: 498598 - DNA, 20 bp, mouse
ggtgccttgactgagcatcc

SEQ ID NO: 498599 - DNA, 20 bp, mouse
gaggatacagccctccctga

SEQ ID NO: 498600 - DNA, 20 bp, mouse
gggcgccgccgagccctgcc

SEQ ID NO: 498601 - DNA, 20 bp, mouse
gaggacgcggctggagctga

SEQ ID NO: 498602 - DNA, 20 bp, mouse
gctcggcggcgcctgcgcgt

SEQ ID NO: 498603 - DNA, 20 bp, mouse
gagtatatcctcctacctgt

SEQ ID NO: 498604 - DNA, 20 bp, mouse
ggaagaagctatagtctgtc

SEQ ID NO: 498605 - DNA, 20 bp, mouse
gaatatgagactgcgaatca

SEQ ID NO: 498606 - DNA, 20 bp, mouse
gggcagagcacctactatct

SEQ ID NO: 498607 - DNA, 20 bp, mouse
ggtgctctgccgccctgtgg

SEQ ID NO: 498608 - DNA, 20 bp, mouse
gccaaaggacaccctccaca

SEQ ID NO: 498609 - DNA, 20 bp, mouse
gtaggtgctctgccgccctg

SEQ ID NO: 498610 - DNA, 20 bp, mouse
gcttgttctgccgagatagt

SEQ ID NO: 498611 - DNA, 20 bp, mouse
gatgggcaggtcggtttgaa

SEQ ID NO: 498612 - DNA, 20 bp, mouse
gagccggccgccacaatgaa

SEQ ID NO: 498613 - DNA, 20 bp, mouse
gtccaggctcctcatctctt

SEQ ID NO: 498614 - DNA, 20 bp, mouse
gcagttgttcatgggcaggt

SEQ ID NO: 498615 - DNA, 20 bp, mouse
gtggaaggtaggaagcacct

SEQ ID NO: 498616 - DNA, 20 bp, mouse
ggctgcaagcccagaagggt

SEQ ID NO: 498617 - DNA, 20 bp, mouse
gagcaggagaggctccaagt

SEQ ID NO: 498618 - DNA, 20 bp, mouse
gcagcagcagcgaagatgcc

SEQ ID NO: 498619 - DNA, 20 bp, mouse
ggcaagagcgctggctgatg

SEQ ID NO: 498620 - DNA, 20 bp, mouse
gcgctcttgcttggagcaca

SEQ ID NO: 498621 - DNA, 20 bp, mouse
gtcctcggcagcagcatctg

SEQ ID NO: 498622 - DNA, 20 bp, mouse
ggcaggagccaacagctgtg

SEQ ID NO: 498623 - DNA, 20 bp, mouse
gggagactccccacagctgt

SEQ ID NO: 498624 - DNA, 20 bp, mouse
gatgccaggaaatacctcct

SEQ ID NO: 498625 - DNA, 20 bp, mouse
gatgctgcacgggagaagca

SEQ ID NO: 498626 - DNA, 20 bp, mouse
gctctgaggggtagacagct

SEQ ID NO: 498627 - DNA, 20 bp, mouse
gggccgcctaccacagcagg

SEQ ID NO: 498628 - DNA, 20 bp, mouse
ggtggacaggtcttaagccg

SEQ ID NO: 498629 - DNA, 20 bp, mouse
gctacccctcagagaagccg

SEQ ID NO: 498630 - DNA, 20 bp, mouse
gtaagccgcggcttctctga

SEQ ID NO: 498631 - DNA, 20 bp, mouse
gctcatggcgaagcctcggg

SEQ ID NO: 498632 - DNA, 20 bp, mouse
gaagctcatggcgaagcctc

SEQ ID NO: 498633 - DNA, 20 bp, mouse
ggtccacctgctgtggtagg

SEQ ID NO: 498634 - DNA, 20 bp, mouse
ggctgggcatgggcctcccg

SEQ ID NO: 498635 - DNA, 20 bp, mouse
ggccctagccagccaatcag

SEQ ID NO: 498636 - DNA, 20 bp, mouse
gtggacagggatgacctgga

SEQ ID NO: 498637 - DNA, 20 bp, mouse
gggttccagccagaacagat

SEQ ID NO: 498638 - DNA, 20 bp, mouse
ggggcaggaagaaggtcagt

SEQ ID NO: 498639 - DNA, 20 bp, mouse
gtggagggacaaggccagaa

SEQ ID NO: 498640 - DNA, 20 bp, mouse
gttggacagtttgggactga

SEQ ID NO: 498641 - DNA, 20 bp, mouse
gaagatggacagggatgacc

SEQ ID NO: 498642 - DNA, 20 bp, mouse
gctccaggcaaaggcatcag

SEQ ID NO: 498643 - DNA, 20 bp, mouse
gatggcgacagccaggagtc

SEQ ID NO: 498644 - DNA, 20 bp, mouse
gcccttacaggcagcttcca

SEQ ID NO: 498645 - DNA, 20 bp, mouse
ggcgaagttctatggctgtg

SEQ ID NO: 498646 - DNA, 20 bp, mouse
ggtgaagggaggaacggcag

SEQ ID NO: 498647 - DNA, 20 bp, mouse
ggggttgcgctgggtgtgaa

SEQ ID NO: 498648 - DNA, 20 bp, mouse
gtggggaccctgggtgtgaa

SEQ ID NO: 498649 - DNA, 20 bp, mouse
ggggcctcccttcacaccca

SEQ ID NO: 498650 - DNA, 20 bp, mouse
gaagggaggaacggcagcgg

SEQ ID NO: 498651 - DNA, 20 bp, mouse
gttgctggaggtaggagcga

SEQ ID NO: 498652 - DNA, 20 bp, mouse
gcagcaacaggtgcaagcgg

SEQ ID NO: 498653 - DNA, 20 bp, mouse
gggcaccggcggggatcgga

SEQ ID NO: 498654 - DNA, 20 bp, mouse
ggaagggacagtgcggggaa

SEQ ID NO: 498655 - DNA, 20 bp, mouse
gtggtgctgagggaatccag

SEQ ID NO: 498656 - DNA, 20 bp, mouse
gagtgcgtcccggcggatgt

SEQ ID NO: 498657 - DNA, 20 bp, mouse
gctatgtagtcgcttcgtga

SEQ ID NO: 498658 - DNA, 20 bp, mouse
gaacaggtcagtaagaagga

SEQ ID NO: 498659 - DNA, 20 bp, mouse
gagccgcgcctagtgcgtcc

SEQ ID NO: 498660 - DNA, 20 bp, mouse
gcgcgcctagtgcgtcccgg

SEQ ID NO: 498661 - DNA, 20 bp, mouse
ggtgttgggaagacagacta

SEQ ID NO: 498662 - DNA, 20 bp, mouse
gttgggaagacagactaggg

SEQ ID NO: 498663 - DNA, 20 bp, mouse
gttaggtgcgttctctccgg

SEQ ID NO: 498664 - DNA, 20 bp, mouse
gttcttaggtgcgttctctc

SEQ ID NO: 498665 - DNA, 20 bp, mouse
gggaagggagatggatgcaa

SEQ ID NO: 498666 - DNA, 20 bp, mouse
ggcaagccagctcgcctgga

SEQ ID NO: 498667 - DNA, 20 bp, mouse
gcgacaccctccaggcgagc

SEQ ID NO: 498668 - DNA, 20 bp, mouse
ggaggaggcgggaacccctg

SEQ ID NO: 498669 - DNA, 20 bp, mouse
gtgcggagccccaggcacca

SEQ ID NO: 498670 - DNA, 20 bp, mouse
gtagggcccagagattacgg

SEQ ID NO: 498671 - DNA, 20 bp, mouse
gtgcggcaagccagctcgcc

SEQ ID NO: 498672 - DNA, 20 bp, mouse
gtaatctctgggccctataa

SEQ ID NO: 498673 - DNA, 20 bp, mouse
gcctataagggttatggggt

SEQ ID NO: 498674 - DNA, 20 bp, mouse
gattacggagggccgggtat

SEQ ID NO: 498675 - DNA, 20 bp, mouse
gcagcagctccattcaaccc

SEQ ID NO: 498676 - DNA, 20 bp, mouse
gcgacaccctcgaggagagc

SEQ ID NO: 498677 - DNA, 20 bp, mouse
gacaagccagctctcctcga

SEQ ID NO: 498678 - DNA, 20 bp, mouse
gccagtgagaggatctgcag

SEQ ID NO: 498679 - DNA, 20 bp, mouse
gggcagggccgcaggagcag

SEQ ID NO: 498680 - DNA, 20 bp, mouse
gaggaggaagcggggaacta

SEQ ID NO: 498681 - DNA, 20 bp, mouse
gtcccggactgacacctgga

SEQ ID NO: 498682 - DNA, 20 bp, mouse
ggaagcggggaactaaggca

SEQ ID NO: 498683 - DNA, 20 bp, mouse
ggtggccacaggagaaatgg

SEQ ID NO: 498684 - DNA, 20 bp, mouse
gcacctggagggaggctgtc

SEQ ID NO: 498685 - DNA, 20 bp, mouse
gtaggtggccacaggagaaa

SEQ ID NO: 498686 - DNA, 20 bp, mouse
gcgctcaacccctggctact

SEQ ID NO: 498687 - DNA, 20 bp, mouse
ggcccagagaacacattcag

SEQ ID NO: 498688 - DNA, 20 bp, mouse
ggccagctgtagtccatcac

SEQ ID NO: 498689 - DNA, 20 bp, mouse
gggcgagagcgctcaacccc

SEQ ID NO: 498690 - DNA, 20 bp, mouse
gctgggcaggtcctgggaca

SEQ ID NO: 498691 - DNA, 20 bp, mouse
ggagacagtacagcccgtga

SEQ ID NO: 498692 - DNA, 20 bp, mouse
gccgcggcgcccaggtaaga

SEQ ID NO: 498693 - DNA, 20 bp, mouse
gtcagaggtgagagaagtta

SEQ ID NO: 498694 - DNA, 20 bp, mouse
ggggtgaaccgagggacaag

SEQ ID NO: 498695 - DNA, 20 bp, mouse
gcttgcgactcacgcgtgaa

SEQ ID NO: 498696 - DNA, 20 bp, mouse
ggcgcggccgcagctcggaa

SEQ ID NO: 498697 - DNA, 20 bp, mouse
gcagatgtaccccaaggagg

SEQ ID NO: 498698 - DNA, 20 bp, mouse
gccagggccagcaggagcgt

SEQ ID NO: 498699 - DNA, 20 bp, mouse
ggccgcattggaccgaccga

SEQ ID NO: 498700 - DNA, 20 bp, mouse
gctgcagatgtaccccaagg

SEQ ID NO: 498701 - DNA, 20 bp, mouse
gcaggcgacgtccctcacag

SEQ ID NO: 498702 - DNA, 20 bp, mouse
gcgatgcagtgaggcgggct

SEQ ID NO: 498703 - DNA, 20 bp, mouse
gcgctgcagagatgtgactt

SEQ ID NO: 498704 - DNA, 20 bp, mouse
gggtgagtaccagccagcgc

SEQ ID NO: 498705 - DNA, 20 bp, mouse
gacccctcactcgaacccca

SEQ ID NO: 498706 - DNA, 20 bp, mouse
gcctggaggtgagtcggagg

SEQ ID NO: 498707 - DNA, 20 bp, mouse
ggccgagcctggaggtgagt

SEQ ID NO: 498708 - DNA, 20 bp, mouse
ggcgcgtcggccgagcctgg

SEQ ID NO: 498709 - DNA, 20 bp, mouse
gtagctcagtgctcagtcgg

SEQ ID NO: 498710 - DNA, 20 bp, mouse
gggctgcgcgtcccaggtaa

SEQ ID NO: 498711 - DNA, 20 bp, mouse
gcccaccctggccgagagag

SEQ ID NO: 498712 - DNA, 20 bp, mouse
ggaggcagcagcccttacct

SEQ ID NO: 498713 - DNA, 20 bp, mouse
gtccgactcacctccaggct

SEQ ID NO: 498714 - DNA, 20 bp, mouse
gcgacgcgcactttcgggtt

SEQ ID NO: 498715 - DNA, 20 bp, mouse
gccaggcctgagcaaaggtg

SEQ ID NO: 498716 - DNA, 20 bp, mouse
gtccggagtagactcggagg

SEQ ID NO: 498717 - DNA, 20 bp, mouse
ggaggcttccggagtagact

SEQ ID NO: 498718 - DNA, 20 bp, mouse
ggcttccggagtagactcgg

SEQ ID NO: 498719 - DNA, 20 bp, mouse
ggcgtggtcatcccagtcca

SEQ ID NO: 498720 - DNA, 20 bp, mouse
ggaggaggtaagtcagtccg

SEQ ID NO: 498721 - DNA, 20 bp, mouse
gctgtggctgcaaatgagta

SEQ ID NO: 498722 - DNA, 20 bp, mouse
gtggctgcaaatgagtaagg

SEQ ID NO: 498723 - DNA, 20 bp, mouse
ggaagcctctgaggctgtgc

SEQ ID NO: 498724 - DNA, 20 bp, mouse
ggtaaggaggagacaacttc

SEQ ID NO: 498725 - DNA, 20 bp, mouse
gccaaaagggaccaagacta

SEQ ID NO: 498726 - DNA, 20 bp, mouse
gctgcggagcatgtgacagt

SEQ ID NO: 498727 - DNA, 20 bp, mouse
ggaatcggacatgttcttat

SEQ ID NO: 498728 - DNA, 20 bp, mouse
gcagcagagactcttggaat

SEQ ID NO: 498729 - DNA, 20 bp, mouse
gcgtctgggatggtcatctg

SEQ ID NO: 498730 - DNA, 20 bp, mouse
gatagccacgaagtcatctg

SEQ ID NO: 498731 - DNA, 20 bp, mouse
gtctggggtatgacaagact

SEQ ID NO: 498732 - DNA, 20 bp, mouse
gggggtatgacaagactggg

SEQ ID NO: 498733 - DNA, 20 bp, mouse
ggtaactactgtaatcaata

SEQ ID NO: 498734 - DNA, 20 bp, mouse
gacagtgggcatctgagagc

SEQ ID NO: 498735 - DNA, 20 bp, mouse
gctcctggacatatcatgat

SEQ ID NO: 498736 - DNA, 20 bp, mouse
ggcgcggccgaggagcaccg

SEQ ID NO: 498737 - DNA, 20 bp, mouse
ggcgcccagccgaccaggga

SEQ ID NO: 498738 - DNA, 20 bp, mouse
gcgcgccgcgcagaccaccc

SEQ ID NO: 498739 - DNA, 20 bp, mouse
gcggggcgcccagccgacca

SEQ ID NO: 498740 - DNA, 20 bp, mouse
gagaccaccccggtgctcct

SEQ ID NO: 498741 - DNA, 20 bp, mouse
gactccgcgccgtccctggt

SEQ ID NO: 498742 - DNA, 20 bp, mouse
gggcgcgagccggagctacg

SEQ ID NO: 498743 - DNA, 20 bp, mouse
gagcaccggggtggtctgcg

SEQ ID NO: 498744 - DNA, 20 bp, mouse
gtcgggtccgcccgccagcg

SEQ ID NO: 498745 - DNA, 20 bp, mouse
gaccgcggtgcggaacaaag

SEQ ID NO: 498746 - DNA, 20 bp, mouse
gcagaaggggaagctgtcac

SEQ ID NO: 498747 - DNA, 20 bp, mouse
gtcaccggtacccggagcag

SEQ ID NO: 498748 - DNA, 20 bp, mouse
ggcgctgccaagggccagaa

SEQ ID NO: 498749 - DNA, 20 bp, mouse
gtgcggccctggaggcgaca

SEQ ID NO: 498750 - DNA, 20 bp, mouse
gacccggagcaggggtgctg

SEQ ID NO: 498751 - DNA, 20 bp, mouse
ggcacccctgctccgggtac

SEQ ID NO: 498752 - DNA, 20 bp, mouse
gggaagctgtcaccggtacc

SEQ ID NO: 498753 - DNA, 20 bp, mouse
gtccgcggccggctgcacca

SEQ ID NO: 498754 - DNA, 20 bp, mouse
ggcggagcctgcgctgccaa

SEQ ID NO: 498755 - DNA, 20 bp, mouse
gaggaatgcggcgcagacag

SEQ ID NO: 498756 - DNA, 20 bp, mouse
ggagccagctctgcgcgatc

SEQ ID NO: 498757 - DNA, 20 bp, mouse
ggcagcgccgcctcagctct

SEQ ID NO: 498758 - DNA, 20 bp, mouse
ggctctgccacactgctgct

SEQ ID NO: 498759 - DNA, 20 bp, mouse
gggagcaggtaagcccggaa

SEQ ID NO: 498760 - DNA, 20 bp, mouse
ggttcctgatcgcgcagagc

SEQ ID NO: 498761 - DNA, 20 bp, mouse
ggcagacagcggcccagcgg

SEQ ID NO: 498762 - DNA, 20 bp, mouse
gtctagtcgattcccagccc

SEQ ID NO: 498763 - DNA, 20 bp, mouse
gccagcacagggacattgcc

SEQ ID NO: 498764 - DNA, 20 bp, mouse
gtgctggtgaaggaggaatt

SEQ ID NO: 498765 - DNA, 20 bp, mouse
gcagggacattgccaggctc

SEQ ID NO: 498766 - DNA, 20 bp, mouse
gggcgcgtcaggccaacatg

SEQ ID NO: 498767 - DNA, 20 bp, mouse
gcggtgccggcctcgcagag

SEQ ID NO: 498768 - DNA, 20 bp, mouse
ggcagggctgcggctcaggt

SEQ ID NO: 498769 - DNA, 20 bp, mouse
ggccgggctgccccgcatgt

SEQ ID NO: 498770 - DNA, 20 bp, mouse
ggggctgcggctcaggtcgg

SEQ ID NO: 498771 - DNA, 20 bp, mouse
gggcaccgcacggaaagcgt

SEQ ID NO: 498772 - DNA, 20 bp, mouse
gaggtcggaggccgacgacg

SEQ ID NO: 498773 - DNA, 20 bp, mouse
gctgcgaggccggcaccgca

SEQ ID NO: 498774 - DNA, 20 bp, mouse
gcccagctcggcctcgtcgt

SEQ ID NO: 498775 - DNA, 20 bp, mouse
gctgcgcgcccgcccgggag

SEQ ID NO: 498776 - DNA, 20 bp, mouse
gcgccagggctacgagggag

SEQ ID NO: 498777 - DNA, 20 bp, mouse
gccgacaaggcgggttgcgg

SEQ ID NO: 498778 - DNA, 20 bp, mouse
gctcggagaaagcgccgaca

SEQ ID NO: 498779 - DNA, 20 bp, mouse
ggttggcgccagggctacga

SEQ ID NO: 498780 - DNA, 20 bp, mouse
gcaaggcgcgccgaaggcct

SEQ ID NO: 498781 - DNA, 20 bp, mouse
gacctcaggcggggcctgca

SEQ ID NO: 498782 - DNA, 20 bp, mouse
ggccgccggatatgacgtag

SEQ ID NO: 498783 - DNA, 20 bp, mouse
gctggcagtcagtgagagtc

SEQ ID NO: 498784 - DNA, 20 bp, mouse
ggggcgcgtgcgagggtctt

SEQ ID NO: 498785 - DNA, 20 bp, mouse
gccgggacacgtgatcgaag

SEQ ID NO: 498786 - DNA, 20 bp, mouse
ggacaggcgggcagatcggc

SEQ ID NO: 498787 - DNA, 20 bp, mouse
gatgggaacggggacctgag

SEQ ID NO: 498788 - DNA, 20 bp, mouse
gggcggacggacgcgcggac

SEQ ID NO: 498789 - DNA, 20 bp, mouse
gggctgccggcccagaacaa

SEQ ID NO: 498790 - DNA, 20 bp, mouse
gggacgcgcggacaggcgga

SEQ ID NO: 498791 - DNA, 20 bp, mouse
gccgggctcgccatgagtcg

SEQ ID NO: 498792 - DNA, 20 bp, mouse
gggacggccgcagagcgggg

SEQ ID NO: 498793 - DNA, 20 bp, mouse
gggagcaccgccccgctctg

SEQ ID NO: 498794 - DNA, 20 bp, mouse
gcgctccctacgcagatcca

SEQ ID NO: 498795 - DNA, 20 bp, mouse
ggggcagatcggcaggcgga

SEQ ID NO: 498796 - DNA, 20 bp, mouse
gggcggtgagaccctctgag

SEQ ID NO: 498797 - DNA, 20 bp, mouse
gcgcccccggcaggtcacgt

SEQ ID NO: 498798 - DNA, 20 bp, mouse
ggtcacgtgggccagagctt

SEQ ID NO: 498799 - DNA, 20 bp, mouse
gtccccaagtcgggtcccgg

SEQ ID NO: 498800 - DNA, 20 bp, mouse
gagaggagtacaggcgctga

SEQ ID NO: 498801 - DNA, 20 bp, mouse
gggccgtagactaggaaccg

SEQ ID NO: 498802 - DNA, 20 bp, mouse
gcagagcttcggcctccccc

SEQ ID NO: 498803 - DNA, 20 bp, mouse
ggccgccgggacccgacttg

SEQ ID NO: 498804 - DNA, 20 bp, mouse
gggcgctgagggagccttgc

SEQ ID NO: 498805 - DNA, 20 bp, mouse
ggagggtctcaccgccagca

SEQ ID NO: 498806 - DNA, 20 bp, mouse
ggggttcctgaggggaatgg

SEQ ID NO: 498807 - DNA, 20 bp, mouse
ggaggaggacccggaacctt

SEQ ID NO: 498808 - DNA, 20 bp, mouse
ggacatgtgggacctagtga

SEQ ID NO: 498809 - DNA, 20 bp, mouse
gggaaccttgggttcctgag

SEQ ID NO: 498810 - DNA, 20 bp, mouse
ggatctccaaggccgagcgg

SEQ ID NO: 498811 - DNA, 20 bp, mouse
gtccagcccccattcccctc

SEQ ID NO: 498812 - DNA, 20 bp, mouse
gggggggctgaccaggaacc

SEQ ID NO: 498813 - DNA, 20 bp, mouse
gtcctggtcagcccccccat

SEQ ID NO: 498814 - DNA, 20 bp, mouse
gcttgggttcctgaggggaa

SEQ ID NO: 498815 - DNA, 20 bp, mouse
gagggaggagcagatctcca

SEQ ID NO: 498816 - DNA, 20 bp, mouse
gtaaggcaccaccctctcca

SEQ ID NO: 498817 - DNA, 20 bp, mouse
gaaggctgccgtggagaggg

SEQ ID NO: 498818 - DNA, 20 bp, mouse
gtagggccagaaggctgccg

SEQ ID NO: 498819 - DNA, 20 bp, mouse
gcagaaggctgccgtggaga

SEQ ID NO: 498820 - DNA, 20 bp, mouse
gggaatggggagtctgcgtg

SEQ ID NO: 498821 - DNA, 20 bp, mouse
gcaagaagaagggtccagtt

SEQ ID NO: 498822 - DNA, 20 bp, mouse
gcttctggccctactgaaag

SEQ ID NO: 498823 - DNA, 20 bp, mouse
gctactgaaaggggcagaaa

SEQ ID NO: 498824 - DNA, 20 bp, mouse
gggacaaaggcagtagagta

SEQ ID NO: 498825 - DNA, 20 bp, mouse
gagcagccatggcctcacaa

SEQ ID NO: 498826 - DNA, 20 bp, mouse
gaggctcaccttaaccggag

SEQ ID NO: 498827 - DNA, 20 bp, mouse
ggggctgctcccaaacccgg

SEQ ID NO: 498828 - DNA, 20 bp, mouse
ggtcccagtaaccagagggt

SEQ ID NO: 498829 - DNA, 20 bp, mouse
gcaccttaaccggagcggtg

SEQ ID NO: 498830 - DNA, 20 bp, mouse
ggtccgcaccgctccggtta

SEQ ID NO: 498831 - DNA, 20 bp, mouse
gggtggccggccaccgggtt

SEQ ID NO: 498832 - DNA, 20 bp, mouse
gccggagctgcgcctaatgt

SEQ ID NO: 498833 - DNA, 20 bp, mouse
gagcccaggctcaccttaac

SEQ ID NO: 498834 - DNA, 20 bp, mouse
gagcggtgcggacggtcccg

SEQ ID NO: 498835 - DNA, 20 bp, mouse
gggatgcggtggccggccac

SEQ ID NO: 498836 - DNA, 20 bp, mouse
gcgcctggaggtgcctaggg

SEQ ID NO: 498837 - DNA, 20 bp, mouse
gacccgccctaggcacctcc

SEQ ID NO: 498838 - DNA, 20 bp, mouse
gctccccccatcgaggaaca

SEQ ID NO: 498839 - DNA, 20 bp, mouse
gctctaccctccccccatcg

SEQ ID NO: 498840 - DNA, 20 bp, mouse
gggagggtagaggccggata

SEQ ID NO: 498841 - DNA, 20 bp, mouse
gcgcgcggagaaggcataca

SEQ ID NO: 498842 - DNA, 20 bp, mouse
gacctccaggcgctttagcc

SEQ ID NO: 498843 - DNA, 20 bp, mouse
gggccctgtgagcgctagta

SEQ ID NO: 498844 - DNA, 20 bp, mouse
ggccgggctaaagcgcctgg

SEQ ID NO: 498845 - DNA, 20 bp, mouse
gtgtgctgctcggctctccg

SEQ ID NO: 498846 - DNA, 20 bp, mouse
gtttagaccggtgggaagaa

SEQ ID NO: 498847 - DNA, 20 bp, mouse
gttaagtcctttagaccggt

SEQ ID NO: 498848 - DNA, 20 bp, mouse
gccagttcggacatcaggtg

SEQ ID NO: 498849 - DNA, 20 bp, mouse
gtcatcccgggaatgctcaa

SEQ ID NO: 498850 - DNA, 20 bp, mouse
gcacagggaagaagtagata

SEQ ID NO: 498851 - DNA, 20 bp, mouse
gttggaaagacagtactaaa

SEQ ID NO: 498852 - DNA, 20 bp, mouse
gagggcctttgagcattccc

SEQ ID NO: 498853 - DNA, 20 bp, mouse
gttgatggacagagcttgag

SEQ ID NO: 498854 - DNA, 20 bp, mouse
ggtgaatgtaaaacatcaca

SEQ ID NO: 498855 - DNA, 20 bp, mouse
gcatcaggtgaggagttcct

SEQ ID NO: 498856 - DNA, 20 bp, mouse
gcagaaggcaggatgcccgg

SEQ ID NO: 498857 - DNA, 20 bp, mouse
gcggaggatccgggccatgg

SEQ ID NO: 498858 - DNA, 20 bp, mouse
ggcgcttcggacacctcaga

SEQ ID NO: 498859 - DNA, 20 bp, mouse
gggaagagcgcagagaccga

SEQ ID NO: 498860 - DNA, 20 bp, mouse
gagagccactgcttccccag

SEQ ID NO: 498861 - DNA, 20 bp, mouse
gggtggccaccgtccgtctg

SEQ ID NO: 498862 - DNA, 20 bp, mouse
gttcggacacctcagacgga

SEQ ID NO: 498863 - DNA, 20 bp, mouse
gcggggacaagagaagtcta

SEQ ID NO: 498864 - DNA, 20 bp, mouse
gcggcccggcggaacaaacc

SEQ ID NO: 498865 - DNA, 20 bp, mouse
gcaggatgcccggaggatcc

SEQ ID NO: 498866 - DNA, 20 bp, mouse
gcggccgccgagatgagctg

SEQ ID NO: 498867 - DNA, 20 bp, mouse
gcagtgctggcttaagtaag

SEQ ID NO: 498868 - DNA, 20 bp, mouse
gtatccagggtggagatcag

SEQ ID NO: 498869 - DNA, 20 bp, mouse
gaccaggtcagagcccgcta

SEQ ID NO: 498870 - DNA, 20 bp, mouse
gagcctgataggcatctccg

SEQ ID NO: 498871 - DNA, 20 bp, mouse
gggtctggcaggcaccatgg

SEQ ID NO: 498872 - DNA, 20 bp, mouse
gcggccccagctcatctcgg

SEQ ID NO: 498873 - DNA, 20 bp, mouse
gctcggcgcgggaggtcctt

SEQ ID NO: 498874 - DNA, 20 bp, mouse
ggctatggtgaccccgacac

SEQ ID NO: 498875 - DNA, 20 bp, mouse
ggcatctccggggttgaaca

SEQ ID NO: 498876 - DNA, 20 bp, mouse
gaggccctcagaccagaaat

SEQ ID NO: 498877 - DNA, 20 bp, mouse
gaaatcggcagtactagtca

SEQ ID NO: 498878 - DNA, 20 bp, mouse
gcccaggccggaaaagatga

SEQ ID NO: 498879 - DNA, 20 bp, mouse
gtccaagaccgaagggacaa

SEQ ID NO: 498880 - DNA, 20 bp, mouse
gctatgtgcagacaaccccc

SEQ ID NO: 498881 - DNA, 20 bp, mouse
gcacagtcatcaagtaggta

SEQ ID NO: 498882 - DNA, 20 bp, mouse
ggaggctcttccaagaccga

SEQ ID NO: 498883 - DNA, 20 bp, mouse
gctgccgatttctggtctga

SEQ ID NO: 498884 - DNA, 20 bp, mouse
ggatctgctctcatctagta

SEQ ID NO: 498885 - DNA, 20 bp, mouse
gagagatgagcaaagactgc

SEQ ID NO: 498886 - DNA, 20 bp, mouse
gccatggcccagaagttgtg

SEQ ID NO: 498887 - DNA, 20 bp, mouse
gagagctgccgtagcatcag

SEQ ID NO: 498888 - DNA, 20 bp, mouse
gataaacaatgagaaaagac

SEQ ID NO: 498889 - DNA, 20 bp, mouse
gtggttgtacaaagaacacc

SEQ ID NO: 498890 - DNA, 20 bp, mouse
gctggtgagtcttgaccctc

SEQ ID NO: 498891 - DNA, 20 bp, mouse
gctgctgacgatcctcaaaa

SEQ ID NO: 498892 - DNA, 20 bp, mouse
gagtttaggtccactggtgg

SEQ ID NO: 498893 - DNA, 20 bp, mouse
gtttatggctgccttagctc

SEQ ID NO: 498894 - DNA, 20 bp, mouse
gctggtcagatggccatcaa

SEQ ID NO: 498895 - DNA, 20 bp, mouse
gcatggaatagggcaggtag

SEQ ID NO: 498896 - DNA, 20 bp, mouse
gccacctcgggagtgaacca

SEQ ID NO: 498897 - DNA, 20 bp, mouse
gcactcccgaggtggcgact

SEQ ID NO: 498898 - DNA, 20 bp, mouse
gcaaccatggttcactcccg

SEQ ID NO: 498899 - DNA, 20 bp, mouse
gcttggcgagggcaaagaca

SEQ ID NO: 498900 - DNA, 20 bp, mouse
gggcgagggcaaagacaagg

SEQ ID NO: 498901 - DNA, 20 bp, mouse
gcgtagccgcaggcctgagt

SEQ ID NO: 498902 - DNA, 20 bp, mouse
gcgaggtggcgacttggcga

SEQ ID NO: 498903 - DNA, 20 bp, mouse
ggagggcaaagacaaggcgg

SEQ ID NO: 498904 - DNA, 20 bp, mouse
gccgtggggatgctactctc

SEQ ID NO: 498905 - DNA, 20 bp, mouse
gtgtcgctggagaagtaccg

SEQ ID NO: 498906 - DNA, 20 bp, mouse
gttaatgggtaggcagcgaa

SEQ ID NO: 498907 - DNA, 20 bp, mouse
gccggaacattttaatgggt

SEQ ID NO: 498908 - DNA, 20 bp, mouse
gctcccaggatcgtccaaaa

SEQ ID NO: 498909 - DNA, 20 bp, mouse
ggggcccggaacattttaat

SEQ ID NO: 498910 - DNA, 20 bp, mouse
ggcagcgaaaggctccattt

SEQ ID NO: 498911 - DNA, 20 bp, mouse
gcaggctggaatgcaaggcg

SEQ ID NO: 498912 - DNA, 20 bp, mouse
gtgtctctggaaaagttcaa

SEQ ID NO: 498913 - DNA, 20 bp, mouse
gagaataagtgtcagggcca

SEQ ID NO: 498914 - DNA, 20 bp, mouse
gctccattttggacgatcct

SEQ ID NO: 498915 - DNA, 20 bp, mouse
ggttcggcacagccataagt

SEQ ID NO: 498916 - DNA, 20 bp, mouse
gacgccgaggcggcctccgg

SEQ ID NO: 498917 - DNA, 20 bp, mouse
gtgcgggtggcagggtccgg

SEQ ID NO: 498918 - DNA, 20 bp, mouse
gcagggtccggtggaggcgg

SEQ ID NO: 498919 - DNA, 20 bp, mouse
ggggtggcagggtccggtgg

SEQ ID NO: 498920 - DNA, 20 bp, mouse
gccggctgcagggcaggacc

SEQ ID NO: 498921 - DNA, 20 bp, mouse
gtggcagggtccggtggagg

SEQ ID NO: 498922 - DNA, 20 bp, mouse
gaccccgctggggaccagaa

SEQ ID NO: 498923 - DNA, 20 bp, mouse
gtgtaggagcgaccccgctg

SEQ ID NO: 498924 - DNA, 20 bp, mouse
gcggccggctgctctgagat

SEQ ID NO: 498925 - DNA, 20 bp, mouse
gctgcagggcaggacccggc

SEQ ID NO: 498926 - DNA, 20 bp, mouse
ggcgaaggggagccccagga

SEQ ID NO: 498927 - DNA, 20 bp, mouse
gagaagaggcggtggtagga

SEQ ID NO: 498928 - DNA, 20 bp, mouse
gtggaagaagaggcggtggt

SEQ ID NO: 498929 - DNA, 20 bp, mouse
gcagggtagggagccgagag

SEQ ID NO: 498930 - DNA, 20 bp, mouse
gtgccacgggccccagggta

SEQ ID NO: 498931 - DNA, 20 bp, mouse
gagcgagcaagcgggcgcag

SEQ ID NO: 498932 - DNA, 20 bp, mouse
gaacctcagggcgcacccga

SEQ ID NO: 498933 - DNA, 20 bp, mouse
gagttctagaccgcaggagg

SEQ ID NO: 498934 - DNA, 20 bp, mouse
gtgcaggtgccagaacctca

SEQ ID NO: 498935 - DNA, 20 bp, mouse
gcgcgaggaggggactgaag

SEQ ID NO: 498936 - DNA, 20 bp, mouse
ggaagagccccgtaaagagt

SEQ ID NO: 498937 - DNA, 20 bp, mouse
gtacctgcaaaggagcggag

SEQ ID NO: 498938 - DNA, 20 bp, mouse
gagggctggtgctcagaacc

SEQ ID NO: 498939 - DNA, 20 bp, mouse
gcagtttcctactctttacg

SEQ ID NO: 498940 - DNA, 20 bp, mouse
gaaccaagcagtaatcagat

SEQ ID NO: 498941 - DNA, 20 bp, mouse
ggtcgaccacctacctgcaa

SEQ ID NO: 498942 - DNA, 20 bp, mouse
ggaccggccccctggaaaga

SEQ ID NO: 498943 - DNA, 20 bp, mouse
gtggtattctaagtactcta

SEQ ID NO: 498944 - DNA, 20 bp, mouse
gccgctcctttgcaggtagg

SEQ ID NO: 498945 - DNA, 20 bp, mouse
gaaagttgcgactatcagac

SEQ ID NO: 498946 - DNA, 20 bp, mouse
ggtcaaacagatccaggagt

SEQ ID NO: 498947 - DNA, 20 bp, mouse
gggcagggtcaaacagatcc

SEQ ID NO: 498948 - DNA, 20 bp, mouse
gaggccgaggaggatgtctg

SEQ ID NO: 498949 - DNA, 20 bp, mouse
gagcctaaccagccaactcc

SEQ ID NO: 498950 - DNA, 20 bp, mouse
gaaagcagcgagatggagaa

SEQ ID NO: 498951 - DNA, 20 bp, mouse
ggctcagtggtacatagagg

SEQ ID NO: 498952 - DNA, 20 bp, mouse
gctgggttcaaccaccagaa

SEQ ID NO: 498953 - DNA, 20 bp, mouse
ggcgagatggagaatggcca

SEQ ID NO: 498954 - DNA, 20 bp, mouse
gctgcctcaaagcagcgaga

SEQ ID NO: 498955 - DNA, 20 bp, mouse
gatccaggagttggctggtt

SEQ ID NO: 498956 - DNA, 20 bp, mouse
gcgcctcgacaggctcgcta

SEQ ID NO: 498957 - DNA, 20 bp, mouse
gtgtcgaggcgggcaggtaa

SEQ ID NO: 498958 - DNA, 20 bp, mouse
gagccgtagcgagcctgtcg

SEQ ID NO: 498959 - DNA, 20 bp, mouse
gggcctcgggctcccggaga

SEQ ID NO: 498960 - DNA, 20 bp, mouse
gtccaggaggctgcgacgaa

SEQ ID NO: 498961 - DNA, 20 bp, mouse
gaggtaagggaggcgtcccg

SEQ ID NO: 498962 - DNA, 20 bp, mouse
gacaggctcgctacggctca

SEQ ID NO: 498963 - DNA, 20 bp, mouse
ggatcccgctgggagtggag

SEQ ID NO: 498964 - DNA, 20 bp, mouse
ggtcatcgcagcgccttctc

SEQ ID NO: 498965 - DNA, 20 bp, mouse
gcccagcgggatctactctt

SEQ ID NO: 498966 - DNA, 20 bp, mouse
gctagcgctgcgcatccagg

SEQ ID NO: 498967 - DNA, 20 bp, mouse
gtccaggcggcggtgctccc

SEQ ID NO: 498968 - DNA, 20 bp, mouse
ggcgctgcgcatccaggcgg

SEQ ID NO: 498969 - DNA, 20 bp, mouse
gctcccggctcccagctctc

SEQ ID NO: 498970 - DNA, 20 bp, mouse
ggagccgggagccccgaata

SEQ ID NO: 498971 - DNA, 20 bp, mouse
ggccgccaacatggacacgt

SEQ ID NO: 498972 - DNA, 20 bp, mouse
gggctccaacgtgtccatgt

SEQ ID NO: 498973 - DNA, 20 bp, mouse
gaccctagcgctgcgcatcc

SEQ ID NO: 498974 - DNA, 20 bp, mouse
gtgctcccgggccgccaaca

SEQ ID NO: 498975 - DNA, 20 bp, mouse
ggctagggtgccggagagct

SEQ ID NO: 498976 - DNA, 20 bp, mouse
gggccaccgagtgagagtgt

SEQ ID NO: 498977 - DNA, 20 bp, mouse
gccggccacgagcgcggagg

SEQ ID NO: 498978 - DNA, 20 bp, mouse
ggtgccggccacgagcgcgg

SEQ ID NO: 498979 - DNA, 20 bp, mouse
gccggggagcggggactacg

SEQ ID NO: 498980 - DNA, 20 bp, mouse
ggcgtcgcccaggtccgtgt

SEQ ID NO: 498981 - DNA, 20 bp, mouse
gcgggtgccggccacgagcg

SEQ ID NO: 498982 - DNA, 20 bp, mouse
gaggacgtgagcgcgcgacg

SEQ ID NO: 498983 - DNA, 20 bp, mouse
gctcgtggccggcacccgcg

SEQ ID NO: 498984 - DNA, 20 bp, mouse
ggcgcacgcggactcccaca

SEQ ID NO: 498985 - DNA, 20 bp, mouse
gtgcgggtcagggtcctggt

SEQ ID NO: 498986 - DNA, 20 bp, mouse
gggtcctcggctgaagccca

SEQ ID NO: 498987 - DNA, 20 bp, mouse
ggtagcctggaagctgtaca

SEQ ID NO: 498988 - DNA, 20 bp, mouse
ggacagtgggatggagtccg

SEQ ID NO: 498989 - DNA, 20 bp, mouse
gaagcccagggacagtggga

SEQ ID NO: 498990 - DNA, 20 bp, mouse
gtggaagctgtacagggcca

SEQ ID NO: 498991 - DNA, 20 bp, mouse
gcagagagtcctgggagtct

SEQ ID NO: 498992 - DNA, 20 bp, mouse
gtgtccctgggcttcagccg

SEQ ID NO: 498993 - DNA, 20 bp, mouse
gctgagtgggccaacagggt

SEQ ID NO: 498994 - DNA, 20 bp, mouse
gaaggccagctcgtcactct

SEQ ID NO: 498995 - DNA, 20 bp, mouse
gctgggagtctgggctgtga

SEQ ID NO: 498996 - DNA, 20 bp, mouse
gtactgtgcattaggccagg

SEQ ID NO: 498997 - DNA, 20 bp, mouse
gggcagcagctacaagttct

SEQ ID NO: 498998 - DNA, 20 bp, mouse
gaggatggtctggattacag

SEQ ID NO: 498999 - DNA, 20 bp, mouse
gggatcccctttctgtcaca

SEQ ID NO: 499000 - DNA, 20 bp, mouse
gtgtcctcaggagacttcca

SEQ ID NO: 499001 - DNA, 20 bp, mouse
gccctactgtgcattaggcc

SEQ ID NO: 499002 - DNA, 20 bp, mouse
gcagagtactgtgaggactg

SEQ ID NO: 499003 - DNA, 20 bp, mouse
gatatctgagtgtctctcat

SEQ ID NO: 499004 - DNA, 20 bp, mouse
gcagcccccagagtactgtg

SEQ ID NO: 499005 - DNA, 20 bp, mouse
gaggtaggtccctaacagga

SEQ ID NO: 499006 - DNA, 20 bp, mouse
gttggggaagcagatctgga

SEQ ID NO: 499007 - DNA, 20 bp, mouse
gctcccaggggagtagtgag

SEQ ID NO: 499008 - DNA, 20 bp, mouse
ggagagctaggctcaggcgg

SEQ ID NO: 499009 - DNA, 20 bp, mouse
ggtatctagagaatgatttg

SEQ ID NO: 499010 - DNA, 20 bp, mouse
gaggtaatgtgggctcccag

SEQ ID NO: 499011 - DNA, 20 bp, mouse
gtaggctcaggcggtggaga

SEQ ID NO: 499012 - DNA, 20 bp, mouse
gcggtggagaaggctgtgcg

SEQ ID NO: 499013 - DNA, 20 bp, mouse
gttctctagataccagaagt

SEQ ID NO: 499014 - DNA, 20 bp, mouse
gagcccctcactactcccct

SEQ ID NO: 499015 - DNA, 20 bp, mouse
gcagagcagatggcactgcc

SEQ ID NO: 499016 - DNA, 20 bp, mouse
gagagagcgcggcctctgag

SEQ ID NO: 499017 - DNA, 20 bp, mouse
gggcgtccggcgcccctcag

SEQ ID NO: 499018 - DNA, 20 bp, mouse
gcggcggagggtcatggctc

SEQ ID NO: 499019 - DNA, 20 bp, mouse
ggcgtacagctcctccccgg

SEQ ID NO: 499020 - DNA, 20 bp, mouse
gctgcagcttcctgagtcgg

SEQ ID NO: 499021 - DNA, 20 bp, mouse
gcggcagccggagggccgga

SEQ ID NO: 499022 - DNA, 20 bp, mouse
ggagctgtacgcagcactgg

SEQ ID NO: 499023 - DNA, 20 bp, mouse
gtgcgggtgagtgtatcctg

SEQ ID NO: 499024 - DNA, 20 bp, mouse
ggcgagcgcgcggtacagct

SEQ ID NO: 499025 - DNA, 20 bp, mouse
gctctctgcttgatggtgtt

SEQ ID NO: 499026 - DNA, 20 bp, mouse
gggaagggcgctgcgaccag

SEQ ID NO: 499027 - DNA, 20 bp, mouse
gagggcgctgcgaccagtgg

SEQ ID NO: 499028 - DNA, 20 bp, mouse
gattcgcgttccgagaccca

SEQ ID NO: 499029 - DNA, 20 bp, mouse
gggaaacttcgtgctcccgt

SEQ ID NO: 499030 - DNA, 20 bp, mouse
gttcgtgctcccgtgggtct

SEQ ID NO: 499031 - DNA, 20 bp, mouse
ggaggagctgcacgtcaggt

SEQ ID NO: 499032 - DNA, 20 bp, mouse
gcccgtgggctggagcgcag

SEQ ID NO: 499033 - DNA, 20 bp, mouse
gccccgagcgcagacaatga

SEQ ID NO: 499034 - DNA, 20 bp, mouse
gccagtcgccgtgcgtgaga

SEQ ID NO: 499035 - DNA, 20 bp, mouse
gggcaaagccggacactgga

SEQ ID NO: 499036 - DNA, 20 bp, mouse
ggagcgccttgcaggtgcgg

SEQ ID NO: 499037 - DNA, 20 bp, mouse
ggcgaggcgaaagctacgaa

SEQ ID NO: 499038 - DNA, 20 bp, mouse
gagcgagcgccttgcaggtg

SEQ ID NO: 499039 - DNA, 20 bp, mouse
gcgcggtgccatagacaggt

SEQ ID NO: 499040 - DNA, 20 bp, mouse
ggaaagctacgaagggctgg

SEQ ID NO: 499041 - DNA, 20 bp, mouse
gagcagagccgagcggttgc

SEQ ID NO: 499042 - DNA, 20 bp, mouse
gccgcctgcgctcacggcca

SEQ ID NO: 499043 - DNA, 20 bp, mouse
gccctgccaccgcacctgca

SEQ ID NO: 499044 - DNA, 20 bp, mouse
gcctgcgctcacggccaggg

SEQ ID NO: 499045 - DNA, 20 bp, mouse
gaagggagacgcccaggacc

SEQ ID NO: 499046 - DNA, 20 bp, mouse
gctggcgaggagcggaagct

SEQ ID NO: 499047 - DNA, 20 bp, mouse
gttctgcgatcgggcggcgg

SEQ ID NO: 499048 - DNA, 20 bp, mouse
gtgcttctgcgatcgggcgg

SEQ ID NO: 499049 - DNA, 20 bp, mouse
gtgttgcttctgcgatcggg

SEQ ID NO: 499050 - DNA, 20 bp, mouse
gggagcgggcgggaagtgag

SEQ ID NO: 499051 - DNA, 20 bp, mouse
gcggcggcggcgagagcgag

SEQ ID NO: 499052 - DNA, 20 bp, mouse
ggctgccccgaccgccgtcc

SEQ ID NO: 499053 - DNA, 20 bp, mouse
ggcccgcgagcggccctccc

SEQ ID NO: 499054 - DNA, 20 bp, mouse
ggaagtgagcgggagctccg

SEQ ID NO: 499055 - DNA, 20 bp, mouse
gcgcgtcacggtgagtgcag

SEQ ID NO: 499056 - DNA, 20 bp, mouse
gaatagccccagaagaggaa

SEQ ID NO: 499057 - DNA, 20 bp, mouse
ggcaagaatagccccagaag

SEQ ID NO: 499058 - DNA, 20 bp, mouse
gttccctgctgaagagctct

SEQ ID NO: 499059 - DNA, 20 bp, mouse
gtcactcttctgatccaggg

SEQ ID NO: 499060 - DNA, 20 bp, mouse
gaagcgtgagaagcaaccac

SEQ ID NO: 499061 - DNA, 20 bp, mouse
gagagaagtggccagatcga

SEQ ID NO: 499062 - DNA, 20 bp, mouse
gcttaaggtaagagctcctg

SEQ ID NO: 499063 - DNA, 20 bp, mouse
gtggggctattcttgcacac

SEQ ID NO: 499064 - DNA, 20 bp, mouse
gagcctgaagcaggggggaa

SEQ ID NO: 499065 - DNA, 20 bp, mouse
ggagtgatgattaagagaag

SEQ ID NO: 499066 - DNA, 20 bp, mouse
gcctggaatctggatacgca

SEQ ID NO: 499067 - DNA, 20 bp, mouse
gtatccagattccaggccca

SEQ ID NO: 499068 - DNA, 20 bp, mouse
gtatctcgggcaggtaaggg

SEQ ID NO: 499069 - DNA, 20 bp, mouse
gcaggtgccccggagagaac

SEQ ID NO: 499070 - DNA, 20 bp, mouse
gtcccgcctttggaatgttg

SEQ ID NO: 499071 - DNA, 20 bp, mouse
ggggaaactaaaattatctc

SEQ ID NO: 499072 - DNA, 20 bp, mouse
gaattatctcgggcaggtaa

SEQ ID NO: 499073 - DNA, 20 bp, mouse
ggcctcccggccatctaact

SEQ ID NO: 499074 - DNA, 20 bp, mouse
gaggtcaggccagaggcggg

SEQ ID NO: 499075 - DNA, 20 bp, mouse
gtttccctgggcctggaatc

SEQ ID NO: 499076 - DNA, 20 bp, mouse
gtgggaacacagaagagatc

SEQ ID NO: 499077 - DNA, 20 bp, mouse
gctctggcctgcatccgtgg

SEQ ID NO: 499078 - DNA, 20 bp, mouse
ggaagaggcagggaattagt

SEQ ID NO: 499079 - DNA, 20 bp, mouse
gcactcggtgcttgagtagt

SEQ ID NO: 499080 - DNA, 20 bp, mouse
ggacggcccacacccagact

SEQ ID NO: 499081 - DNA, 20 bp, mouse
ggaagcgggaccgcacgagg

SEQ ID NO: 499082 - DNA, 20 bp, mouse
gattagggcgaagggttggg

SEQ ID NO: 499083 - DNA, 20 bp, mouse
gcctgcatccgtgggggagg

SEQ ID NO: 499084 - DNA, 20 bp, mouse
gcccattagggcgaagggtt

SEQ ID NO: 499085 - DNA, 20 bp, mouse
gtggcctgcatccgtggggg

SEQ ID NO: 499086 - DNA, 20 bp, mouse
gcggaagtcggaagcctccg

SEQ ID NO: 499087 - DNA, 20 bp, mouse
gaaatgacctctgtccccgg

SEQ ID NO: 499088 - DNA, 20 bp, mouse
gcggaagcctccggggacag

SEQ ID NO: 499089 - DNA, 20 bp, mouse
ggaggggtccgcgcggaagt

SEQ ID NO: 499090 - DNA, 20 bp, mouse
gcgcctcgctgggttctcac

SEQ ID NO: 499091 - DNA, 20 bp, mouse
gtccggctccgtccaggtgt

SEQ ID NO: 499092 - DNA, 20 bp, mouse
gggtttgggaggggtccgcg

SEQ ID NO: 499093 - DNA, 20 bp, mouse
gcggggttcccggtttggga

SEQ ID NO: 499094 - DNA, 20 bp, mouse
gtggccacaaatgcccgaag

SEQ ID NO: 499095 - DNA, 20 bp, mouse
gggagcagcagtcccagctc

SEQ ID NO: 499096 - DNA, 20 bp, mouse
gagcctcgatggagttgtgg

SEQ ID NO: 499097 - DNA, 20 bp, mouse
ggtcctccacaactccatcg

SEQ ID NO: 499098 - DNA, 20 bp, mouse
gctcacaaagcccgacaaag

SEQ ID NO: 499099 - DNA, 20 bp, mouse
ggagcgtaaggaagcctcga

SEQ ID NO: 499100 - DNA, 20 bp, mouse
gcataggaattgcccatctc

SEQ ID NO: 499101 - DNA, 20 bp, mouse
gttctcgcagctgtatctgg

SEQ ID NO: 499102 - DNA, 20 bp, mouse
ggctcctgccaggcaattac

SEQ ID NO: 499103 - DNA, 20 bp, mouse
ggctgcgagaaaatgggccg

SEQ ID NO: 499104 - DNA, 20 bp, mouse
gaaaatgggccggggcacca

SEQ ID NO: 499105 - DNA, 20 bp, mouse
gaagagcacacggtttgaag

SEQ ID NO: 499106 - DNA, 20 bp, mouse
gcagagacgccagccaccgg

SEQ ID NO: 499107 - DNA, 20 bp, mouse
gctggccccggcgggagtga

SEQ ID NO: 499108 - DNA, 20 bp, mouse
gtggtctccacagccccggg

SEQ ID NO: 499109 - DNA, 20 bp, mouse
gccgcagagacgccagccac

SEQ ID NO: 499110 - DNA, 20 bp, mouse
gtgctgcgctctgctccgag

SEQ ID NO: 499111 - DNA, 20 bp, mouse
ggagaggctagcgccgccgg

SEQ ID NO: 499112 - DNA, 20 bp, mouse
gtgagggcagagggccgggg

SEQ ID NO: 499113 - DNA, 20 bp, mouse
gctgcgcgctcagttcccgg

SEQ ID NO: 499114 - DNA, 20 bp, mouse
ggtagggctccgcagcacgt

SEQ ID NO: 499115 - DNA, 20 bp, mouse
ggcgcagcacggagccgccc

SEQ ID NO: 499116 - DNA, 20 bp, mouse
gctggagacccagagtaccg

SEQ ID NO: 499117 - DNA, 20 bp, mouse
gacccagagtaccgtggtag

SEQ ID NO: 499118 - DNA, 20 bp, mouse
ggaagggcgcacctagtgtc

SEQ ID NO: 499119 - DNA, 20 bp, mouse
gaccgcggctcgagccactt

SEQ ID NO: 499120 - DNA, 20 bp, mouse
gaaggagagcgccgctacca

SEQ ID NO: 499121 - DNA, 20 bp, mouse
ggccgctaccacggtactct

SEQ ID NO: 499122 - DNA, 20 bp, mouse
ggggtctccaggtctgcgaa

SEQ ID NO: 499123 - DNA, 20 bp, mouse
gcacttgggctcgacgcggg

SEQ ID NO: 499124 - DNA, 20 bp, mouse
ggtggcgctgcgtgagaccg

SEQ ID NO: 499125 - DNA, 20 bp, mouse
ggagccacttgggctcgacg

SEQ ID NO: 499126 - DNA, 20 bp, mouse
ggcccagtggagcgcacaga

SEQ ID NO: 499127 - DNA, 20 bp, mouse
ggagacacacaagggaaccg

SEQ ID NO: 499128 - DNA, 20 bp, mouse
gccgcgcctgcagatgtgga

SEQ ID NO: 499129 - DNA, 20 bp, mouse
gccagccgcgcctgcagatg

SEQ ID NO: 499130 - DNA, 20 bp, mouse
ggccctctgtgcgctccact

SEQ ID NO: 499131 - DNA, 20 bp, mouse
gtaccctaggtgccttagaa

SEQ ID NO: 499132 - DNA, 20 bp, mouse
gacacacaagggaaccgagg

SEQ ID NO: 499133 - DNA, 20 bp, mouse
gcgagggtgtgcggagcgag

SEQ ID NO: 499134 - DNA, 20 bp, mouse
gctgtgcgccgtatcgtcgg

SEQ ID NO: 499135 - DNA, 20 bp, mouse
gctgcagatgtggaaggagc

SEQ ID NO: 499136 - DNA, 20 bp, mouse
ggcaggcggtgggtccggag

SEQ ID NO: 499137 - DNA, 20 bp, mouse
gacagtacacccgatccggg

SEQ ID NO: 499138 - DNA, 20 bp, mouse
gtgccggagcgagagatcta

SEQ ID NO: 499139 - DNA, 20 bp, mouse
gccggagcggcggccccgac

SEQ ID NO: 499140 - DNA, 20 bp, mouse
ggcggcggccccgacgggtt

SEQ ID NO: 499141 - DNA, 20 bp, mouse
ggagcgagagatctagggga

SEQ ID NO: 499142 - DNA, 20 bp, mouse
gaagcgaacccaacccgtcg

SEQ ID NO: 499143 - DNA, 20 bp, mouse
ggcgcgcggcggcaggcggt

SEQ ID NO: 499144 - DNA, 20 bp, mouse
gtgggacagtacacccgatc

SEQ ID NO: 499145 - DNA, 20 bp, mouse
ggccgtcgccgcggcaggtg

SEQ ID NO: 499146 - DNA, 20 bp, mouse
ggcagacacagagcgcaaag

SEQ ID NO: 499147 - DNA, 20 bp, mouse
ggacacagagcgcaaagtgg

SEQ ID NO: 499148 - DNA, 20 bp, mouse
gcctcccggatcgctgcaat

SEQ ID NO: 499149 - DNA, 20 bp, mouse
gcggcggcgcggagtcctcc

SEQ ID NO: 499150 - DNA, 20 bp, mouse
gtgtgtgagagcgcccgaga

SEQ ID NO: 499151 - DNA, 20 bp, mouse
gagcgcaaagtggcggactt

SEQ ID NO: 499152 - DNA, 20 bp, mouse
ggcaaagtggcggacttggg

SEQ ID NO: 499153 - DNA, 20 bp, mouse
ggagcgcgggccccatgtga

SEQ ID NO: 499154 - DNA, 20 bp, mouse
gcttgcgagaaagttacctg

SEQ ID NO: 499155 - DNA, 20 bp, mouse
gtggggcccgcgctcggagg

SEQ ID NO: 499156 - DNA, 20 bp, mouse
gccgggaggccagacatccg

SEQ ID NO: 499157 - DNA, 20 bp, mouse
gacgcttccccgggcaggaa

SEQ ID NO: 499158 - DNA, 20 bp, mouse
gtgacagcggtccccggctg

SEQ ID NO: 499159 - DNA, 20 bp, mouse
gcggctgcggtggcgctgat

SEQ ID NO: 499160 - DNA, 20 bp, mouse
ggctgattggctggaagcac

SEQ ID NO: 499161 - DNA, 20 bp, mouse
ggtagagcaaacgcttcccc

SEQ ID NO: 499162 - DNA, 20 bp, mouse
gcagcggtccccggctgcgg

SEQ ID NO: 499163 - DNA, 20 bp, mouse
gaggagagaaagcttccctg

SEQ ID NO: 499164 - DNA, 20 bp, mouse
gatcgctggaacctcggaga

SEQ ID NO: 499165 - DNA, 20 bp, mouse
gcggcctccccagcacaccg

SEQ ID NO: 499166 - DNA, 20 bp, mouse
gaaaccggcgcgactcatga

SEQ ID NO: 499167 - DNA, 20 bp, mouse
gacagctctggaagccctag

SEQ ID NO: 499168 - DNA, 20 bp, mouse
gcaggcacccggctcttgag

SEQ ID NO: 499169 - DNA, 20 bp, mouse
ggcggagccaggacccgaga

SEQ ID NO: 499170 - DNA, 20 bp, mouse
ggctgcgggtcttatgaaac

SEQ ID NO: 499171 - DNA, 20 bp, mouse
ggcagcagcaaacacgtacc

SEQ ID NO: 499172 - DNA, 20 bp, mouse
gccatggagacacgccgcta

SEQ ID NO: 499173 - DNA, 20 bp, mouse
ggctgcctcccggagaacta

SEQ ID NO: 499174 - DNA, 20 bp, mouse
gcaggagacgacggaagtgt

SEQ ID NO: 499175 - DNA, 20 bp, mouse
gctggccttgcaggagacga

SEQ ID NO: 499176 - DNA, 20 bp, mouse
gctggctgctagagaagagg

SEQ ID NO: 499177 - DNA, 20 bp, mouse
gagaaaaaggcaaagatgta

SEQ ID NO: 499178 - DNA, 20 bp, mouse
ggctcccggctcagttaatc

SEQ ID NO: 499179 - DNA, 20 bp, mouse
gagttaatctggctgtcagt

SEQ ID NO: 499180 - DNA, 20 bp, mouse
gaacagctccgactgagaat

SEQ ID NO: 499181 - DNA, 20 bp, mouse
gccagaagaatcaaagggag

SEQ ID NO: 499182 - DNA, 20 bp, mouse
gagaaaaccggtgcagaaaa

SEQ ID NO: 499183 - DNA, 20 bp, mouse
gaggtttctcttgtttctct

SEQ ID NO: 499184 - DNA, 20 bp, mouse
gcaggaagggaggaagactt

SEQ ID NO: 499185 - DNA, 20 bp, mouse
ggagcatccagaagaatcaa

SEQ ID NO: 499186 - DNA, 20 bp, mouse
gggagaagagagctcgagag

SEQ ID NO: 499187 - DNA, 20 bp, mouse
ggattgtgtgagtgcacggg

SEQ ID NO: 499188 - DNA, 20 bp, mouse
gtgctgtggtcccggtgtct

SEQ ID NO: 499189 - DNA, 20 bp, mouse
gggacttcaggagcagggac

SEQ ID NO: 499190 - DNA, 20 bp, mouse
gtaacagcatacagataggt

SEQ ID NO: 499191 - DNA, 20 bp, mouse
gcagctaaacctgggagata

SEQ ID NO: 499192 - DNA, 20 bp, mouse
gtgctgatattcccagacac

SEQ ID NO: 499193 - DNA, 20 bp, mouse
gtgctaaaaccacgaagtga

SEQ ID NO: 499194 - DNA, 20 bp, mouse
gaggagcagggacaggacgc

SEQ ID NO: 499195 - DNA, 20 bp, mouse
ggggtgattgtgtgagtgca

SEQ ID NO: 499196 - DNA, 20 bp, mouse
gagccaggcagaagaaaatg

SEQ ID NO: 499197 - DNA, 20 bp, mouse
ggatacccccagccccacta

SEQ ID NO: 499198 - DNA, 20 bp, mouse
gaccctgggacaacttccag

SEQ ID NO: 499199 - DNA, 20 bp, mouse
gggacggtgtctagggatgg

SEQ ID NO: 499200 - DNA, 20 bp, mouse
gccagccccactagggtagt

SEQ ID NO: 499201 - DNA, 20 bp, mouse
ggggcaaagcgtgctccggg

SEQ ID NO: 499202 - DNA, 20 bp, mouse
gttttaggcgtagcacagcc

SEQ ID NO: 499203 - DNA, 20 bp, mouse
gagaagagcctggccccctc

SEQ ID NO: 499204 - DNA, 20 bp, mouse
gaagagcatgggcgcaactc

SEQ ID NO: 499205 - DNA, 20 bp, mouse
ggactaaaaagaagaccgcc

SEQ ID NO: 499206 - DNA, 20 bp, mouse
gtaggctgggcaaggctgag

SEQ ID NO: 499207 - DNA, 20 bp, mouse
gccaatagcagaagcggact

SEQ ID NO: 499208 - DNA, 20 bp, mouse
gcgcaacccaatagcagaag

SEQ ID NO: 499209 - DNA, 20 bp, mouse
gagctcaaccaagaatccaa

SEQ ID NO: 499210 - DNA, 20 bp, mouse
gatccttgcaggctcgcggg

SEQ ID NO: 499211 - DNA, 20 bp, mouse
gtgcaggggactgagaccat

SEQ ID NO: 499212 - DNA, 20 bp, mouse
gagcatccttgcaggctcgc

SEQ ID NO: 499213 - DNA, 20 bp, mouse
ggcgcggaaggtaggaggaa

SEQ ID NO: 499214 - DNA, 20 bp, mouse
gaatccaaaggcgacttgga

SEQ ID NO: 499215 - DNA, 20 bp, mouse
gggcaggaaactaccccggg

SEQ ID NO: 499216 - DNA, 20 bp, mouse
ggcggctcgagcggctctgg

SEQ ID NO: 499217 - DNA, 20 bp, mouse
gccaggcgaggagcgaactg

SEQ ID NO: 499218 - DNA, 20 bp, mouse
gatgtgtctgagcccaggcg

SEQ ID NO: 499219 - DNA, 20 bp, mouse
gggcgaggagcgaactgcgg

SEQ ID NO: 499220 - DNA, 20 bp, mouse
ggcgcttccagcggctcgag

SEQ ID NO: 499221 - DNA, 20 bp, mouse
gagcgcgggggaagacgcac

SEQ ID NO: 499222 - DNA, 20 bp, mouse
gtaacgcactggcatatcca

SEQ ID NO: 499223 - DNA, 20 bp, mouse
ggtggcggcggcgcttccag

SEQ ID NO: 499224 - DNA, 20 bp, mouse
gagcccagcccagcgctctc

SEQ ID NO: 499225 - DNA, 20 bp, mouse
gggcccgcaccgtaacgcac

SEQ ID NO: 499226 - DNA, 20 bp, mouse
ggcctagaaatggatcacct

SEQ ID NO: 499227 - DNA, 20 bp, mouse
gaagcgagtccgcaagagag

SEQ ID NO: 499228 - DNA, 20 bp, mouse
ggccccacgttgcctagaaa

SEQ ID NO: 499229 - DNA, 20 bp, mouse
gttgcggactcgcttctcct

SEQ ID NO: 499230 - DNA, 20 bp, mouse
gtgacagcaccgctctcttg

SEQ ID NO: 499231 - DNA, 20 bp, mouse
gggtgctgtcaggcggagag

SEQ ID NO: 499232 - DNA, 20 bp, mouse
gtccatttctaggcaacgtg

SEQ ID NO: 499233 - DNA, 20 bp, mouse
gaggtccgcttcgggagggg

SEQ ID NO: 499234 - DNA, 20 bp, mouse
gtgcagagaatactcccctt

SEQ ID NO: 499235 - DNA, 20 bp, mouse
ggggaggtccgcttcgggag

SEQ ID NO: 499236 - DNA, 20 bp, mouse
gcaccctaggcagctcatgg

SEQ ID NO: 499237 - DNA, 20 bp, mouse
gtcctggggaggtgacagat

SEQ ID NO: 499238 - DNA, 20 bp, mouse
gcataggaggccaccgaaag

SEQ ID NO: 499239 - DNA, 20 bp, mouse
gcagcagcgaaacgcatagg

SEQ ID NO: 499240 - DNA, 20 bp, mouse
gactcagcagcgaaacgcat

SEQ ID NO: 499241 - DNA, 20 bp, mouse
gaggccaccatgagctgcct

SEQ ID NO: 499242 - DNA, 20 bp, mouse
gacctctcctgggacagcgg

SEQ ID NO: 499243 - DNA, 20 bp, mouse
ggccgccgctgtcccaggag

SEQ ID NO: 499244 - DNA, 20 bp, mouse
gaggggactgactcttgctg

SEQ ID NO: 499245 - DNA, 20 bp, mouse
gtccgcccgccacctctcct

SEQ ID NO: 499246 - DNA, 20 bp, mouse
ggccctcgcggatccagatg

SEQ ID NO: 499247 - DNA, 20 bp, mouse
gtccccatctggatccgcga

SEQ ID NO: 499248 - DNA, 20 bp, mouse
gtccagatggggaaggacca

SEQ ID NO: 499249 - DNA, 20 bp, mouse
gtggatccgcgagggcggcg

SEQ ID NO: 499250 - DNA, 20 bp, mouse
gaggttgcccacccaggaca

SEQ ID NO: 499251 - DNA, 20 bp, mouse
ggcaggtgcgcaccgggcag

SEQ ID NO: 499252 - DNA, 20 bp, mouse
gcggggcgcgaggttcccag

SEQ ID NO: 499253 - DNA, 20 bp, mouse
gaaagtgccgagagaagccc

SEQ ID NO: 499254 - DNA, 20 bp, mouse
ggcgccctctctgtcatcgc

SEQ ID NO: 499255 - DNA, 20 bp, mouse
gagagcccgcgatgacagag

SEQ ID NO: 499256 - DNA, 20 bp, mouse
ggggtaagatccacagccca

SEQ ID NO: 499257 - DNA, 20 bp, mouse
gctgagggcaatgacactgc

SEQ ID NO: 499258 - DNA, 20 bp, mouse
gcagcatttgcaacctccct

SEQ ID NO: 499259 - DNA, 20 bp, mouse
gccccacacccagtggctga

SEQ ID NO: 499260 - DNA, 20 bp, mouse
gagggtcccgaccccagcga

SEQ ID NO: 499261 - DNA, 20 bp, mouse
gcccagctctatagtggagt

SEQ ID NO: 499262 - DNA, 20 bp, mouse
gttgcaacctccctgggctg

SEQ ID NO: 499263 - DNA, 20 bp, mouse
gtggagtaggtggccccacc

SEQ ID NO: 499264 - DNA, 20 bp, mouse
gagctctatagtggagtagg

SEQ ID NO: 499265 - DNA, 20 bp, mouse
ggccctcagccactgggtgt

SEQ ID NO: 499266 - DNA, 20 bp, mouse
ggttcggtttcggttaatac

SEQ ID NO: 499267 - DNA, 20 bp, mouse
gggtattgggcatcaaggtt

SEQ ID NO: 499268 - DNA, 20 bp, mouse
gcataggttaatgtggtatt

SEQ ID NO: 499269 - DNA, 20 bp, mouse
gtggatgtcataggttaatg

SEQ ID NO: 499270 - DNA, 20 bp, mouse
ggcagcagacttatcaccca

SEQ ID NO: 499271 - DNA, 20 bp, mouse
gaatgtggtattgggcatca

SEQ ID NO: 499272 - DNA, 20 bp, mouse
gcagttaatcatagaataga

SEQ ID NO: 499273 - DNA, 20 bp, mouse
gcttagtgcaaatgggtgat

SEQ ID NO: 499274 - DNA, 20 bp, mouse
gaaacagttacctcttcggg

SEQ ID NO: 499275 - DNA, 20 bp, mouse
gttaattctctggatgtcat

SEQ ID NO: 499276 - DNA, 20 bp, mouse
gcggttcagcgggaagtccc

SEQ ID NO: 499277 - DNA, 20 bp, mouse
gtcagagctgcggcaggagg

SEQ ID NO: 499278 - DNA, 20 bp, mouse
ggcgagagcgcaagtgacgg

SEQ ID NO: 499279 - DNA, 20 bp, mouse
ggcggcaggaggcggttcag

SEQ ID NO: 499280 - DNA, 20 bp, mouse
gcactagccgcggacaggaa

SEQ ID NO: 499281 - DNA, 20 bp, mouse
gcggctgcgtggccgaggct

SEQ ID NO: 499282 - DNA, 20 bp, mouse
gtcacttgcgctctcgctgg

SEQ ID NO: 499283 - DNA, 20 bp, mouse
gagagcgcaagtgacggcgg

SEQ ID NO: 499284 - DNA, 20 bp, mouse
gctctcagagctgcggcagg

SEQ ID NO: 499285 - DNA, 20 bp, mouse
ggcgttcgctgtgggtccgg

SEQ ID NO: 499286 - DNA, 20 bp, mouse
ggcccgggcgatagcatcag

SEQ ID NO: 499287 - DNA, 20 bp, mouse
gcgggcgatagcatcagcgg

SEQ ID NO: 499288 - DNA, 20 bp, mouse
gtagcatcagcggcggctgg

SEQ ID NO: 499289 - DNA, 20 bp, mouse
gcccggcagccggggcaggt

SEQ ID NO: 499290 - DNA, 20 bp, mouse
gcgcgtgcaactccactccg

SEQ ID NO: 499291 - DNA, 20 bp, mouse
ggcgggcttgcacgcgtctc

SEQ ID NO: 499292 - DNA, 20 bp, mouse
gggagcgcctctgcgagtgg

SEQ ID NO: 499293 - DNA, 20 bp, mouse
gcgccccagggagcccgcca

SEQ ID NO: 499294 - DNA, 20 bp, mouse
gcccgcgagcgaaggctcct

SEQ ID NO: 499295 - DNA, 20 bp, mouse
ggggcgccccccactcgcag

SEQ ID NO: 499296 - DNA, 20 bp, mouse
gtcgatccgccagcagccga

SEQ ID NO: 499297 - DNA, 20 bp, mouse
ggcccggagggagctagcgg

SEQ ID NO: 499298 - DNA, 20 bp, mouse
gggcgcggggagacagcgta

SEQ ID NO: 499299 - DNA, 20 bp, mouse
gggctgctggcggatcgagc

SEQ ID NO: 499300 - DNA, 20 bp, mouse
ggcggagacgtcagaagtcg

SEQ ID NO: 499301 - DNA, 20 bp, mouse
gaggcagggatggagactag

SEQ ID NO: 499302 - DNA, 20 bp, mouse
gagcgtagggcgccggtcgg

SEQ ID NO: 499303 - DNA, 20 bp, mouse
ggacgtcagaagtcggggtg

SEQ ID NO: 499304 - DNA, 20 bp, mouse
gggagactaggggaagtacg

SEQ ID NO: 499305 - DNA, 20 bp, mouse
gcgcaggcatcagagtgcag

SEQ ID NO: 499306 - DNA, 20 bp, mouse
ggccctggtgagaccaagaa

SEQ ID NO: 499307 - DNA, 20 bp, mouse
gccaagaagggaggcagacg

SEQ ID NO: 499308 - DNA, 20 bp, mouse
ggagaggccggtcaatgaag

SEQ ID NO: 499309 - DNA, 20 bp, mouse
gcgaggtggcgagatgaggt

SEQ ID NO: 499310 - DNA, 20 bp, mouse
gacagagcaactggcagccc

SEQ ID NO: 499311 - DNA, 20 bp, mouse
gcatgcttgagggccaggag

SEQ ID NO: 499312 - DNA, 20 bp, mouse
gctagcgaggacagagcaac

SEQ ID NO: 499313 - DNA, 20 bp, mouse
gccggccctagcctcatcca

SEQ ID NO: 499314 - DNA, 20 bp, mouse
gcagacgaggtggcgagatg

SEQ ID NO: 499315 - DNA, 20 bp, mouse
gggtgtgtacccagaagtaa

SEQ ID NO: 499316 - DNA, 20 bp, mouse
ggggaccagtcgcacagtcc

SEQ ID NO: 499317 - DNA, 20 bp, mouse
ggcgactggtcccgatgctg

SEQ ID NO: 499318 - DNA, 20 bp, mouse
ggcagctgcggagtcgtgag

SEQ ID NO: 499319 - DNA, 20 bp, mouse
gtgggaggggtagaacgcgt

SEQ ID NO: 499320 - DNA, 20 bp, mouse
gactccgcgtcaggaagcgg

SEQ ID NO: 499321 - DNA, 20 bp, mouse
gggcgaaaaagacagctgcc

SEQ ID NO: 499322 - DNA, 20 bp, mouse
gtcatgagcctcgggcacag

SEQ ID NO: 499323 - DNA, 20 bp, mouse
gaccaggccaataagcgaca

SEQ ID NO: 499324 - DNA, 20 bp, mouse
gtcgaacacccgcgcggaaa

SEQ ID NO: 499325 - DNA, 20 bp, mouse
gcgaggtgctgaagcgtatt

SEQ ID NO: 499326 - DNA, 20 bp, mouse
gccaagcaggagcaggactg

SEQ ID NO: 499327 - DNA, 20 bp, mouse
gcaggcgcgctcagaggacc

SEQ ID NO: 499328 - DNA, 20 bp, mouse
gcaggagcaggactgcggag

SEQ ID NO: 499329 - DNA, 20 bp, mouse
gacgcacgccaagcaggagc

SEQ ID NO: 499330 - DNA, 20 bp, mouse
gtatgctccactccggacag

SEQ ID NO: 499331 - DNA, 20 bp, mouse
gggtgtccaggcgcgctcag

SEQ ID NO: 499332 - DNA, 20 bp, mouse
gtgagctctgagagtcgcgg

SEQ ID NO: 499333 - DNA, 20 bp, mouse
gtcagccctggagatgacca

SEQ ID NO: 499334 - DNA, 20 bp, mouse
gggatgagctctgagagtcg

SEQ ID NO: 499335 - DNA, 20 bp, mouse
gctgagaactatgtggagag

SEQ ID NO: 499336 - DNA, 20 bp, mouse
gccaacctgaatggaagaga

SEQ ID NO: 499337 - DNA, 20 bp, mouse
gagggaagtggaaagcaagg

SEQ ID NO: 499338 - DNA, 20 bp, mouse
gtgggacaggcatggatgaa

SEQ ID NO: 499339 - DNA, 20 bp, mouse
gcctgtcccaggaacggcat

SEQ ID NO: 499340 - DNA, 20 bp, mouse
gtgagaaaagccaacctgaa

SEQ ID NO: 499341 - DNA, 20 bp, mouse
ggattcgagtgtctcccgga

SEQ ID NO: 499342 - DNA, 20 bp, mouse
gaccaagtcgttataaggaa

SEQ ID NO: 499343 - DNA, 20 bp, mouse
gaagtcgttataaggaaagg

SEQ ID NO: 499344 - DNA, 20 bp, mouse
ggaatgaccacgctccacgg

SEQ ID NO: 499345 - DNA, 20 bp, mouse
gcctctggtgtgtactctgt

SEQ ID NO: 499346 - DNA, 20 bp, mouse
gccagcgtgccagctcacgg

SEQ ID NO: 499347 - DNA, 20 bp, mouse
gggcgcggcgggaccagtac

SEQ ID NO: 499348 - DNA, 20 bp, mouse
gtgtgtcccgggctgcgcaa

SEQ ID NO: 499349 - DNA, 20 bp, mouse
gggtgagccccgagagcggg

SEQ ID NO: 499350 - DNA, 20 bp, mouse
gcgcggcggggctgtgtccc

SEQ ID NO: 499351 - DNA, 20 bp, mouse
gggctggtgagccccgagag

SEQ ID NO: 499352 - DNA, 20 bp, mouse
ggccgcgcgggcaaggacgg

SEQ ID NO: 499353 - DNA, 20 bp, mouse
gtggcgagctccatctcagt

SEQ ID NO: 499354 - DNA, 20 bp, mouse
gagcgccgcgcgggcaagga

SEQ ID NO: 499355 - DNA, 20 bp, mouse
gccccttccccggtgagtgg

SEQ ID NO: 499356 - DNA, 20 bp, mouse
ggagacagcgggaaaggcaa

SEQ ID NO: 499357 - DNA, 20 bp, mouse
gcaagaagagacagcgggaa

SEQ ID NO: 499358 - DNA, 20 bp, mouse
gagagcccgaggggagacac

SEQ ID NO: 499359 - DNA, 20 bp, mouse
gctgcgtggacgggaggcga

SEQ ID NO: 499360 - DNA, 20 bp, mouse
gcgctgtctcttcttgtctc

SEQ ID NO: 499361 - DNA, 20 bp, mouse
gagagagggaggggccgaca

SEQ ID NO: 499362 - DNA, 20 bp, mouse
ggggagacacgggagagacg

SEQ ID NO: 499363 - DNA, 20 bp, mouse
gtaagggagaacgagacaga

SEQ ID NO: 499364 - DNA, 20 bp, mouse
gtgggtgagagaaggcgcgg

SEQ ID NO: 499365 - DNA, 20 bp, mouse
ggcggcggcagaagcataga

SEQ ID NO: 499366 - DNA, 20 bp, mouse
gaggaggctgtgggcgcagg

SEQ ID NO: 499367 - DNA, 20 bp, mouse
gccgaggaggctgtgggcgc

SEQ ID NO: 499368 - DNA, 20 bp, mouse
gctctggctcctgcaagccg

SEQ ID NO: 499369 - DNA, 20 bp, mouse
gccagcagcgccctgttgag

SEQ ID NO: 499370 - DNA, 20 bp, mouse
gaacagggcgctgctggccg

SEQ ID NO: 499371 - DNA, 20 bp, mouse
gggagggtggctggcggcag

SEQ ID NO: 499372 - DNA, 20 bp, mouse
gcagcggcggtagctgaggg

SEQ ID NO: 499373 - DNA, 20 bp, mouse
gtagcacgagagacccctgg

SEQ ID NO: 499374 - DNA, 20 bp, mouse
gctgcagcggcggtagctga

SEQ ID NO: 499375 - DNA, 20 bp, mouse
gggctcagggaacagatcgg

SEQ ID NO: 499376 - DNA, 20 bp, mouse
gcgctcctccaaggaagccg

SEQ ID NO: 499377 - DNA, 20 bp, mouse
gacttccgcggcttccttgg

SEQ ID NO: 499378 - DNA, 20 bp, mouse
gcgaaaagcccggcagaaaa

SEQ ID NO: 499379 - DNA, 20 bp, mouse
ggacacaactggccagcgaa

SEQ ID NO: 499380 - DNA, 20 bp, mouse
gggcgcctgggcgaaaagcc

SEQ ID NO: 499381 - DNA, 20 bp, mouse
ggctgaggcggggagaactt

SEQ ID NO: 499382 - DNA, 20 bp, mouse
gtcggacacgcggtgagggt

SEQ ID NO: 499383 - DNA, 20 bp, mouse
ggaagagccgggcgcaggag

SEQ ID NO: 499384 - DNA, 20 bp, mouse
ggcaccagtgcacagggcgg

SEQ ID NO: 499385 - DNA, 20 bp, mouse
gccagcgggtctcagtaatg

SEQ ID NO: 499386 - DNA, 20 bp, mouse
gctcctgtggacacccggac

SEQ ID NO: 499387 - DNA, 20 bp, mouse
gggcaggaggaacgagagcg

SEQ ID NO: 499388 - DNA, 20 bp, mouse
gactgtgctgtgcgagggta

SEQ ID NO: 499389 - DNA, 20 bp, mouse
gggaggaacgagagcggggc

SEQ ID NO: 499390 - DNA, 20 bp, mouse
gtgccggtccgggtgtccac

SEQ ID NO: 499391 - DNA, 20 bp, mouse
gggacacccggaccggcagg

SEQ ID NO: 499392 - DNA, 20 bp, mouse
ggccgggcggtgccagaacc

SEQ ID NO: 499393 - DNA, 20 bp, mouse
gttaccactgtgctgtgcga

SEQ ID NO: 499394 - DNA, 20 bp, mouse
gctggcgcgagggtcctggg

SEQ ID NO: 499395 - DNA, 20 bp, mouse
gtgcacacactccatcccga

SEQ ID NO: 499396 - DNA, 20 bp, mouse
gctcttctgcgtctccccag

SEQ ID NO: 499397 - DNA, 20 bp, mouse
ggtccgcacctgcacccgct

SEQ ID NO: 499398 - DNA, 20 bp, mouse
gctgggcggccggattgctt

SEQ ID NO: 499399 - DNA, 20 bp, mouse
gggcgcaggcccaagcaatc

SEQ ID NO: 499400 - DNA, 20 bp, mouse
gcgcacctgcacccgctggg

SEQ ID NO: 499401 - DNA, 20 bp, mouse
ggcccgctcacccagactgg

SEQ ID NO: 499402 - DNA, 20 bp, mouse
gggtcgcgctcagtaacaca

SEQ ID NO: 499403 - DNA, 20 bp, mouse
gggacggccgactgacaggg

SEQ ID NO: 499404 - DNA, 20 bp, mouse
gggtgcaggtgcggacgcac

SEQ ID NO: 499405 - DNA, 20 bp, mouse
ggcgcagccgcgcgcggtga

SEQ ID NO: 499406 - DNA, 20 bp, mouse
gtctggcaaagtgtacacag

SEQ ID NO: 499407 - DNA, 20 bp, mouse
gaggtccgctacatgtcatc

SEQ ID NO: 499408 - DNA, 20 bp, mouse
gggcaggcgcacggtgaagg

SEQ ID NO: 499409 - DNA, 20 bp, mouse
gggaggcaggcgcacggtga

SEQ ID NO: 499410 - DNA, 20 bp, mouse
gaggcgcacggtgaaggagg

SEQ ID NO: 499411 - DNA, 20 bp, mouse
gtctgccagatgacatgtag

SEQ ID NO: 499412 - DNA, 20 bp, mouse
gttctaaggcgacttaccaa

SEQ ID NO: 499413 - DNA, 20 bp, mouse
gatgccgctgtcaaattcta

SEQ ID NO: 499414 - DNA, 20 bp, mouse
ggagaaaggtagtcccagtg

SEQ ID NO: 499415 - DNA, 20 bp, mouse
gctgtggttctgggctgcgg

SEQ ID NO: 499416 - DNA, 20 bp, mouse
gctctgcagaggcaggtacg

SEQ ID NO: 499417 - DNA, 20 bp, mouse
ggacagcagacatgctgtgt

SEQ ID NO: 499418 - DNA, 20 bp, mouse
ggcttcccaggactgaccct

SEQ ID NO: 499419 - DNA, 20 bp, mouse
gtatgcccagggtcagtcct

SEQ ID NO: 499420 - DNA, 20 bp, mouse
gagctctactcccctcatgg

SEQ ID NO: 499421 - DNA, 20 bp, mouse
gaccctgggcataggttaca

SEQ ID NO: 499422 - DNA, 20 bp, mouse
ggacagctctactcccctca

SEQ ID NO: 499423 - DNA, 20 bp, mouse
gggcctgcatgctaggaatg

SEQ ID NO: 499424 - DNA, 20 bp, mouse
ggcccagctgccacattcct

SEQ ID NO: 499425 - DNA, 20 bp, mouse
gtccctgtaacctatgccca

SEQ ID NO: 499426 - DNA, 20 bp, mouse
gagagagggagtctccccag

SEQ ID NO: 499427 - DNA, 20 bp, mouse
gtgcagccgcccctcagcct

SEQ ID NO: 499428 - DNA, 20 bp, mouse
ggccccagccgcctgactgg

SEQ ID NO: 499429 - DNA, 20 bp, mouse
gtccaccagtcaggcggctg

SEQ ID NO: 499430 - DNA, 20 bp, mouse
gagggcagggaggagtacca

SEQ ID NO: 499431 - DNA, 20 bp, mouse
gcggctggggcgcagcgccg

SEQ ID NO: 499432 - DNA, 20 bp, mouse
ggcgccagctcccggctccg

SEQ ID NO: 499433 - DNA, 20 bp, mouse
gtcgggaccaaggggagaga

SEQ ID NO: 499434 - DNA, 20 bp, mouse
gaggcggaggcccaaaggta

SEQ ID NO: 499435 - DNA, 20 bp, mouse
ggagccgggagctggcgcct

SEQ ID NO: 499436 - DNA, 20 bp, mouse
ggtctgaagaggagtttcaa

SEQ ID NO: 499437 - DNA, 20 bp, mouse
ggcaggtgccgctggatgtg

SEQ ID NO: 499438 - DNA, 20 bp, mouse
gctgcgcacaaagcttgcgg

SEQ ID NO: 499439 - DNA, 20 bp, mouse
ggtctggagaagggaaaccg

SEQ ID NO: 499440 - DNA, 20 bp, mouse
gcaaagcttgcgggggatgg

SEQ ID NO: 499441 - DNA, 20 bp, mouse
gcacccgtctagtagactgg

SEQ ID NO: 499442 - DNA, 20 bp, mouse
gccgcccccagtctactaga

SEQ ID NO: 499443 - DNA, 20 bp, mouse
gtgcgcagccgcagcttctg

SEQ ID NO: 499444 - DNA, 20 bp, mouse
gcggctgcgcacaaagcttg

SEQ ID NO: 499445 - DNA, 20 bp, mouse
gagatcgccactcagagcct

SEQ ID NO: 499446 - DNA, 20 bp, mouse
ggggtccttggagaccgtgg

SEQ ID NO: 499447 - DNA, 20 bp, mouse
ggcagcgatgaaggcagagt

SEQ ID NO: 499448 - DNA, 20 bp, mouse
gttcgggtccttggagaccg

SEQ ID NO: 499449 - DNA, 20 bp, mouse
gtgtgctcagagcaacccat

SEQ ID NO: 499450 - DNA, 20 bp, mouse
gctgccccgggcagcgatga

SEQ ID NO: 499451 - DNA, 20 bp, mouse
gttggccaccacggtctcca

SEQ ID NO: 499452 - DNA, 20 bp, mouse
ggtggacacagggcatcagc

SEQ ID NO: 499453 - DNA, 20 bp, mouse
gctccaagctgaggttgtca

SEQ ID NO: 499454 - DNA, 20 bp, mouse
gaggctggaagaggccgtcc

SEQ ID NO: 499455 - DNA, 20 bp, mouse
gtgcttgggaacccactgag

SEQ ID NO: 499456 - DNA, 20 bp, mouse
gacggcgacagctccagcag

SEQ ID NO: 499457 - DNA, 20 bp, mouse
gactcgagagcggtctccag

SEQ ID NO: 499458 - DNA, 20 bp, mouse
gtgtcttgcgagttaactgg

SEQ ID NO: 499459 - DNA, 20 bp, mouse
ggagcggtctccagcggcga

SEQ ID NO: 499460 - DNA, 20 bp, mouse
gtaagctcctcggtagggta

SEQ ID NO: 499461 - DNA, 20 bp, mouse
ggagcttacaaactcgagag

SEQ ID NO: 499462 - DNA, 20 bp, mouse
ggccgcgccctaccctaccg

SEQ ID NO: 499463 - DNA, 20 bp, mouse
ggcggagatgggacacgggt

SEQ ID NO: 499464 - DNA, 20 bp, mouse
ggttgtggcgaccccggagg

SEQ ID NO: 499465 - DNA, 20 bp, mouse
ggacacgggtaggctcgcta

SEQ ID NO: 499466 - DNA, 20 bp, mouse
gagtaccacacccccgggag

SEQ ID NO: 499467 - DNA, 20 bp, mouse
gcctggagtaccacaccccc

SEQ ID NO: 499468 - DNA, 20 bp, mouse
ggcatccgagggagccggag

SEQ ID NO: 499469 - DNA, 20 bp, mouse
ggcagctcgagcagtggcag

SEQ ID NO: 499470 - DNA, 20 bp, mouse
gcggaaagcacaagccaagg

SEQ ID NO: 499471 - DNA, 20 bp, mouse
gcgcggtgggagttgcctcc

SEQ ID NO: 499472 - DNA, 20 bp, mouse
gcacccccgggaggggaacg

SEQ ID NO: 499473 - DNA, 20 bp, mouse
gcgcgcaggcgtctgcccgg

SEQ ID NO: 499474 - DNA, 20 bp, mouse
gtcctcccctccggctccct

SEQ ID NO: 499475 - DNA, 20 bp, mouse
gtcccctcgttcccctcccg

SEQ ID NO: 499476 - DNA, 20 bp, mouse
gagtccgggtgcagactcca

SEQ ID NO: 499477 - DNA, 20 bp, mouse
gaggggcgcagagtacgcgg

SEQ ID NO: 499478 - DNA, 20 bp, mouse
gtgctactcaaggcccggga

SEQ ID NO: 499479 - DNA, 20 bp, mouse
gctcaaggcccgggaaggtg

SEQ ID NO: 499480 - DNA, 20 bp, mouse
ggggaggggcgcagagtacg

SEQ ID NO: 499481 - DNA, 20 bp, mouse
gggcgccggtggaccgggag

SEQ ID NO: 499482 - DNA, 20 bp, mouse
gggaggccggtggggcccgg

SEQ ID NO: 499483 - DNA, 20 bp, mouse
gcctgggccccgggttccgg

SEQ ID NO: 499484 - DNA, 20 bp, mouse
gcatcggctccggctctcgt

SEQ ID NO: 499485 - DNA, 20 bp, mouse
ggcgaacacggtgctactca

SEQ ID NO: 499486 - DNA, 20 bp, mouse
gctcaggaacgagtcgctag

SEQ ID NO: 499487 - DNA, 20 bp, mouse
gacgagtcgctaggggaaca

SEQ ID NO: 499488 - DNA, 20 bp, mouse
ggccccgctgcgggatccaa

SEQ ID NO: 499489 - DNA, 20 bp, mouse
gatcccagccgcagcgacgg

SEQ ID NO: 499490 - DNA, 20 bp, mouse
gcggagcccgcgaacaatgg

SEQ ID NO: 499491 - DNA, 20 bp, mouse
gtgaggggcgagagatgctg

SEQ ID NO: 499492 - DNA, 20 bp, mouse
ggctgcggctgggatcgcgg

SEQ ID NO: 499493 - DNA, 20 bp, mouse
gagcgcaccgcgaggaccgt

SEQ ID NO: 499494 - DNA, 20 bp, mouse
gaggcacgcgcggacaccga

SEQ ID NO: 499495 - DNA, 20 bp, mouse
gagacacttaccagtctcgg

SEQ ID NO: 499496 - DNA, 20 bp, mouse
gggtgtctgcgaaccgaggg

SEQ ID NO: 499497 - DNA, 20 bp, mouse
gtgaggtgtctgcgaaccga

SEQ ID NO: 499498 - DNA, 20 bp, mouse
gtccgggtagacagagctat

SEQ ID NO: 499499 - DNA, 20 bp, mouse
gtcaagacctacctgagtcc

SEQ ID NO: 499500 - DNA, 20 bp, mouse
gtgtctacccggactcaggt

SEQ ID NO: 499501 - DNA, 20 bp, mouse
gagacagagctattggtctc

SEQ ID NO: 499502 - DNA, 20 bp, mouse
gagaggactgcagccgccct

SEQ ID NO: 499503 - DNA, 20 bp, mouse
gaccgtctgatttggagctg

SEQ ID NO: 499504 - DNA, 20 bp, mouse
ggctctgtctacccggactc

SEQ ID NO: 499505 - DNA, 20 bp, mouse
gcggtgcaaggctgccatct

SEQ ID NO: 499506 - DNA, 20 bp, mouse
ggcagtgacggcggcaccaa

SEQ ID NO: 499507 - DNA, 20 bp, mouse
gtacctggcgctcccagctc

SEQ ID NO: 499508 - DNA, 20 bp, mouse
gggagccccgcgccagagct

SEQ ID NO: 499509 - DNA, 20 bp, mouse
gaccaagggctaaccctacc

SEQ ID NO: 499510 - DNA, 20 bp, mouse
ggaagcgggaagaccgtccc

SEQ ID NO: 499511 - DNA, 20 bp, mouse
gtgggagtccagcagccgag

SEQ ID NO: 499512 - DNA, 20 bp, mouse
gggtcagggctaaaaaaggt

SEQ ID NO: 499513 - DNA, 20 bp, mouse
gcgcttgctggctctctcgc

SEQ ID NO: 499514 - DNA, 20 bp, mouse
gaaaaggttggcagtgacgg

SEQ ID NO: 499515 - DNA, 20 bp, mouse
gaaaggcggggtgcccggga

SEQ ID NO: 499516 - DNA, 20 bp, mouse
gctaaggactgcaaaccttg

SEQ ID NO: 499517 - DNA, 20 bp, mouse
gctactgtacctagacccaa

SEQ ID NO: 499518 - DNA, 20 bp, mouse
gcaatacagaaagcctggcg

SEQ ID NO: 499519 - DNA, 20 bp, mouse
gccttaggcaatgcatacaa

SEQ ID NO: 499520 - DNA, 20 bp, mouse
gccaggcctccgagtcaagg

SEQ ID NO: 499521 - DNA, 20 bp, mouse
gtgagagcttctctgcccca

SEQ ID NO: 499522 - DNA, 20 bp, mouse
gctccgagtcaaggaggagt

SEQ ID NO: 499523 - DNA, 20 bp, mouse
gaagctgaccgcggtggtag

SEQ ID NO: 499524 - DNA, 20 bp, mouse
gcatccaggcctccgagtca

SEQ ID NO: 499525 - DNA, 20 bp, mouse
gagaagctctcaaccccgcc

SEQ ID NO: 499526 - DNA, 20 bp, mouse
gcctagcacagggagccgag

SEQ ID NO: 499527 - DNA, 20 bp, mouse
ggcggcggcgaggagaaaat

SEQ ID NO: 499528 - DNA, 20 bp, mouse
gtgcggtgcggcagggcggt

SEQ ID NO: 499529 - DNA, 20 bp, mouse
gctgcgtgcgccgaggatcg

SEQ ID NO: 499530 - DNA, 20 bp, mouse
gcactcgcggcgcaaacttg

SEQ ID NO: 499531 - DNA, 20 bp, mouse
ggggtgcgggcacctgacgg

SEQ ID NO: 499532 - DNA, 20 bp, mouse
gagcagcacgggcaccgtgg

SEQ ID NO: 499533 - DNA, 20 bp, mouse
gccggggtgcgggcacctga

SEQ ID NO: 499534 - DNA, 20 bp, mouse
gggagcctcggagcaacgag

SEQ ID NO: 499535 - DNA, 20 bp, mouse
gtgcgctcgccccgcactcg

SEQ ID NO: 499536 - DNA, 20 bp, mouse
ggctgctgcagaagcgctag

SEQ ID NO: 499537 - DNA, 20 bp, mouse
ggctgcgatctaagctgtag

SEQ ID NO: 499538 - DNA, 20 bp, mouse
gaacggctgcgggcccgcgg

SEQ ID NO: 499539 - DNA, 20 bp, mouse
ggcagggagcttgaaaggag

SEQ ID NO: 499540 - DNA, 20 bp, mouse
ggaaaggagcggctgtccag

SEQ ID NO: 499541 - DNA, 20 bp, mouse
ggagtgagcgagcaaggggc

SEQ ID NO: 499542 - DNA, 20 bp, mouse
ggctccctgcgctttcgtag

SEQ ID NO: 499543 - DNA, 20 bp, mouse
ggggcccgcagccgttctgc

SEQ ID NO: 499544 - DNA, 20 bp, mouse
gaaatagctaaaataatcag

SEQ ID NO: 499545 - DNA, 20 bp, mouse
gaggccgctacgaaagcgca

SEQ ID NO: 499546 - DNA, 20 bp, mouse
ggctcaggtaagcaccactg

SEQ ID NO: 499547 - DNA, 20 bp, mouse
gcgtcctactagccagaggt

SEQ ID NO: 499548 - DNA, 20 bp, mouse
gcaggtaagcaccactgggg

SEQ ID NO: 499549 - DNA, 20 bp, mouse
gccactggggaggtagccta

SEQ ID NO: 499550 - DNA, 20 bp, mouse
gtgcgctggggtgggtccag

SEQ ID NO: 499551 - DNA, 20 bp, mouse
ggactcgtcctactagccag

SEQ ID NO: 499552 - DNA, 20 bp, mouse
gggtagcctagggtgcgctg

SEQ ID NO: 499553 - DNA, 20 bp, mouse
ggcttacctgagccaacctc

SEQ ID NO: 499554 - DNA, 20 bp, mouse
ggagccaacctctggctagt

SEQ ID NO: 499555 - DNA, 20 bp, mouse
gtccggccagaatcccgaag

SEQ ID NO: 499556 - DNA, 20 bp, mouse
gcgagcggcaagccagggag

SEQ ID NO: 499557 - DNA, 20 bp, mouse
ggagcgcgagcggcaagcca

SEQ ID NO: 499558 - DNA, 20 bp, mouse
gggagcgcaagctggtgcac

SEQ ID NO: 499559 - DNA, 20 bp, mouse
gaagctggtgcacgggccag

SEQ ID NO: 499560 - DNA, 20 bp, mouse
gcccaggtcccggcttctcg

SEQ ID NO: 499561 - DNA, 20 bp, mouse
gaggaggtgcagcaggagag

SEQ ID NO: 499562 - DNA, 20 bp, mouse
gaagccccggggacttctgt

SEQ ID NO: 499563 - DNA, 20 bp, mouse
gcgaggtgagctcctttcgg

SEQ ID NO: 499564 - DNA, 20 bp, mouse
gactgggaacagccccccaa

SEQ ID NO: 499565 - DNA, 20 bp, mouse
gctgtaggcacagagggtgg

SEQ ID NO: 499566 - DNA, 20 bp, mouse
gctctcggtggccaaggcgg

SEQ ID NO: 499567 - DNA, 20 bp, mouse
gcggagaccagccacaagtg

SEQ ID NO: 499568 - DNA, 20 bp, mouse
gcctctctcggtggccaagg

SEQ ID NO: 499569 - DNA, 20 bp, mouse
gactcaggccaggcaatccc

SEQ ID NO: 499570 - DNA, 20 bp, mouse
gccccgcagagggcgaggtg

SEQ ID NO: 499571 - DNA, 20 bp, mouse
gccgagtctggggagagaac

SEQ ID NO: 499572 - DNA, 20 bp, mouse
gagtctggggagagaactgg

SEQ ID NO: 499573 - DNA, 20 bp, mouse
gttgcagccagctcagggtt

SEQ ID NO: 499574 - DNA, 20 bp, mouse
gccgtggtgctcgcctctct

SEQ ID NO: 499575 - DNA, 20 bp, mouse
gcaggtccaggaggtcactc

SEQ ID NO: 499576 - DNA, 20 bp, mouse
gctccctgggaggcatctgg

SEQ ID NO: 499577 - DNA, 20 bp, mouse
ggaccgccagatgcctccca

SEQ ID NO: 499578 - DNA, 20 bp, mouse
gcccggaccccgacgcaggt

SEQ ID NO: 499579 - DNA, 20 bp, mouse
gggagcccggaccccgacgc

SEQ ID NO: 499580 - DNA, 20 bp, mouse
gggtcctcctacctgcgtcg

SEQ ID NO: 499581 - DNA, 20 bp, mouse
gccggggagattgtctgcag

SEQ ID NO: 499582 - DNA, 20 bp, mouse
ggtcggggtccgggctccct

SEQ ID NO: 499583 - DNA, 20 bp, mouse
ggacctctggacagtagccg

SEQ ID NO: 499584 - DNA, 20 bp, mouse
gctctgagctgagactccag

SEQ ID NO: 499585 - DNA, 20 bp, mouse
gctccccggctactgtccag

SEQ ID NO: 499586 - DNA, 20 bp, mouse
ggcagcagtggctctcgaag

SEQ ID NO: 499587 - DNA, 20 bp, mouse
ggtcccgacggagcagcgac

SEQ ID NO: 499588 - DNA, 20 bp, mouse
ggtggctctcgaagcggcag

SEQ ID NO: 499589 - DNA, 20 bp, mouse
gccgacggagcagcgacagg

SEQ ID NO: 499590 - DNA, 20 bp, mouse
gaccctcagagctctcgact

SEQ ID NO: 499591 - DNA, 20 bp, mouse
gcgacaggaggacggttctc

SEQ ID NO: 499592 - DNA, 20 bp, mouse
gcgcgtggagtctgcagcag

SEQ ID NO: 499593 - DNA, 20 bp, mouse
gtgtcgacaggcgcaggtgg

SEQ ID NO: 499594 - DNA, 20 bp, mouse
gtgagagtgcgttgtcccga

SEQ ID NO: 499595 - DNA, 20 bp, mouse
ggcctagtcgagagctctga

SEQ ID NO: 499596 - DNA, 20 bp, mouse
gcgcagtgacgcgacctcgg

SEQ ID NO: 499597 - DNA, 20 bp, mouse
gacctcgggggcagtcatgg

SEQ ID NO: 499598 - DNA, 20 bp, mouse
gcgacagtgccaaagccggg

SEQ ID NO: 499599 - DNA, 20 bp, mouse
gtgccaaagccgggaggctg

SEQ ID NO: 499600 - DNA, 20 bp, mouse
ggcgacctcgggggcagtca

SEQ ID NO: 499601 - DNA, 20 bp, mouse
ggtgagtgaggccgacgcag

SEQ ID NO: 499602 - DNA, 20 bp, mouse
gcgccgcagcctcccggctt

SEQ ID NO: 499603 - DNA, 20 bp, mouse
gaacaggcacagggactcga

SEQ ID NO: 499604 - DNA, 20 bp, mouse
ggaacgacagtgccaaagcc

SEQ ID NO: 499605 - DNA, 20 bp, mouse
gcatggcggctcggtgtgtg

SEQ ID NO: 499606 - DNA, 20 bp, mouse
ggctctactctggaacatgg

SEQ ID NO: 499607 - DNA, 20 bp, mouse
gggcgctctactctggaaca

SEQ ID NO: 499608 - DNA, 20 bp, mouse
ggagtgcgcaggcgtagtgt

SEQ ID NO: 499609 - DNA, 20 bp, mouse
gtagtgttggcgctctactc

SEQ ID NO: 499610 - DNA, 20 bp, mouse
ggctgggctgcgcagaggac

SEQ ID NO: 499611 - DNA, 20 bp, mouse
gtcccaggagggagaacccc

SEQ ID NO: 499612 - DNA, 20 bp, mouse
ggtcagagagcaggtaagag

SEQ ID NO: 499613 - DNA, 20 bp, mouse
gcacgccgcggctcttgcaa

SEQ ID NO: 499614 - DNA, 20 bp, mouse
ggccgcggctcttgcaaggg

SEQ ID NO: 499615 - DNA, 20 bp, mouse
ggccctgggaaggaaagcga

SEQ ID NO: 499616 - DNA, 20 bp, mouse
gagccagagagactcagtct

SEQ ID NO: 499617 - DNA, 20 bp, mouse
gggaagagctgagacaaagt

SEQ ID NO: 499618 - DNA, 20 bp, mouse
gtgctggtggtgtgaaggct

SEQ ID NO: 499619 - DNA, 20 bp, mouse
gtccacgtccaagttcaggt

SEQ ID NO: 499620 - DNA, 20 bp, mouse
ggcagtttactaagaacttt

SEQ ID NO: 499621 - DNA, 20 bp, mouse
gttctacaaatcagggaaga

SEQ ID NO: 499622 - DNA, 20 bp, mouse
gcagatgtattgcttgctgg

SEQ ID NO: 499623 - DNA, 20 bp, mouse
gccttcaggttctacaaatc

SEQ ID NO: 499624 - DNA, 20 bp, mouse
gaacaaactgagctagagtt

SEQ ID NO: 499625 - DNA, 20 bp, mouse
gagggtccacgtccaagttc

SEQ ID NO: 499626 - DNA, 20 bp, mouse
gctgggtatgcccagactga

SEQ ID NO: 499627 - DNA, 20 bp, mouse
gctgaaggcagaaggaacag

SEQ ID NO: 499628 - DNA, 20 bp, mouse
ggaaggaacagcggggacga

SEQ ID NO: 499629 - DNA, 20 bp, mouse
gggagcagagaggacaagac

SEQ ID NO: 499630 - DNA, 20 bp, mouse
gttcagagccgaagctggag

SEQ ID NO: 499631 - DNA, 20 bp, mouse
gtggccctcccacccagcgt

SEQ ID NO: 499632 - DNA, 20 bp, mouse
ggctgggagagtttaggcag

SEQ ID NO: 499633 - DNA, 20 bp, mouse
gggatacactcactcgtcgt

SEQ ID NO: 499634 - DNA, 20 bp, mouse
gctggctaccagtctaggat

SEQ ID NO: 499635 - DNA, 20 bp, mouse
gacactcactcgtcgtcggg

SEQ ID NO: 499636 - DNA, 20 bp, mouse
gcggccatcggctccggagg

SEQ ID NO: 499637 - DNA, 20 bp, mouse
gtcccggccatcggctccgg

SEQ ID NO: 499638 - DNA, 20 bp, mouse
ggcgtcccggccatcggctc

SEQ ID NO: 499639 - DNA, 20 bp, mouse
gccctccgctcgcgccacag

SEQ ID NO: 499640 - DNA, 20 bp, mouse
gcgccacagcggccacctcc

SEQ ID NO: 499641 - DNA, 20 bp, mouse
gcccagcgcgtcccggccat

SEQ ID NO: 499642 - DNA, 20 bp, mouse
gtgctaggcgcgttgctccg

SEQ ID NO: 499643 - DNA, 20 bp, mouse
gcgcagggccgagtaggacg

SEQ ID NO: 499644 - DNA, 20 bp, mouse
gaggccccgcgtctgcgaag

SEQ ID NO: 499645 - DNA, 20 bp, mouse
gcccgaggagtagcagcagg

SEQ ID NO: 499646 - DNA, 20 bp, mouse
gagccccgagcgctggaccc

SEQ ID NO: 499647 - DNA, 20 bp, mouse
gccagcgctcggggctgcag

SEQ ID NO: 499648 - DNA, 20 bp, mouse
ggcgctctgcgggatccatg

SEQ ID NO: 499649 - DNA, 20 bp, mouse
gcaccggggtccagcgctcg

SEQ ID NO: 499650 - DNA, 20 bp, mouse
ggagagcgaggggcatgagg

SEQ ID NO: 499651 - DNA, 20 bp, mouse
ggcagaggttgtgagtcccg

SEQ ID NO: 499652 - DNA, 20 bp, mouse
gctggtccacggagagcgag

SEQ ID NO: 499653 - DNA, 20 bp, mouse
ggaactgaggatggacggag

SEQ ID NO: 499654 - DNA, 20 bp, mouse
ggcgggatccatgcggagaa

SEQ ID NO: 499655 - DNA, 20 bp, mouse
gatccatgcggagaagggcc

SEQ ID NO: 499656 - DNA, 20 bp, mouse
ggcccaggggataaggaggg

SEQ ID NO: 499657 - DNA, 20 bp, mouse
ggctcagagcccaggggata

SEQ ID NO: 499658 - DNA, 20 bp, mouse
gcagagcccaggggataagg

SEQ ID NO: 499659 - DNA, 20 bp, mouse
gaggttgagctcagagccca

SEQ ID NO: 499660 - DNA, 20 bp, mouse
ggccaccctccttatcccct

SEQ ID NO: 499661 - DNA, 20 bp, mouse
gcagtcgatggtagtatcca

SEQ ID NO: 499662 - DNA, 20 bp, mouse
gtttaggaagacaagtgctc

SEQ ID NO: 499663 - DNA, 20 bp, mouse
gcgaggccatcaggacaggt

SEQ ID NO: 499664 - DNA, 20 bp, mouse
gttcctctctgcattggttt

SEQ ID NO: 499665 - DNA, 20 bp, mouse
gactaccatcgactgctcga

SEQ ID NO: 499666 - DNA, 20 bp, mouse
gccatcgtgcgcaaactggt

SEQ ID NO: 499667 - DNA, 20 bp, mouse
ggagggccgccactgagcga

SEQ ID NO: 499668 - DNA, 20 bp, mouse
gggagtcgcacgtgtgaaac

SEQ ID NO: 499669 - DNA, 20 bp, mouse
gccgccactgagcgagggag

SEQ ID NO: 499670 - DNA, 20 bp, mouse
gcgcaggtttcagcctccat

SEQ ID NO: 499671 - DNA, 20 bp, mouse
ggggcaggtagacctgggat

SEQ ID NO: 499672 - DNA, 20 bp, mouse
gcaagaaggttcgaagatgg

SEQ ID NO: 499673 - DNA, 20 bp, mouse
ggggcaagaaggttcgaaga

SEQ ID NO: 499674 - DNA, 20 bp, mouse
gcgaagatggcggcgcgcaa

SEQ ID NO: 499675 - DNA, 20 bp, mouse
ggcacgatggtacagcacgt

SEQ ID NO: 499676 - DNA, 20 bp, mouse
gatcccccttgccacagcaa

SEQ ID NO: 499677 - DNA, 20 bp, mouse
gacaggagggctaccatctc

SEQ ID NO: 499678 - DNA, 20 bp, mouse
ggagtcacttagcccatcta

SEQ ID NO: 499679 - DNA, 20 bp, mouse
gcagagctgaattccagaga

SEQ ID NO: 499680 - DNA, 20 bp, mouse
gttctttcgctgtcacagga

SEQ ID NO: 499681 - DNA, 20 bp, mouse
gactgacagcagatccataa

SEQ ID NO: 499682 - DNA, 20 bp, mouse
gttcagctctgccgttgctg

SEQ ID NO: 499683 - DNA, 20 bp, mouse
gatgggctaagtgactctga

SEQ ID NO: 499684 - DNA, 20 bp, mouse
ggaggtgaccatgctaagaa

SEQ ID NO: 499685 - DNA, 20 bp, mouse
gggtgtaaactggttcatgt

SEQ ID NO: 499686 - DNA, 20 bp, mouse
gggaggcctggaaacctgag

SEQ ID NO: 499687 - DNA, 20 bp, mouse
ggtttcactgggctactcgg

SEQ ID NO: 499688 - DNA, 20 bp, mouse
gtggctgcccgccagagtgt

SEQ ID NO: 499689 - DNA, 20 bp, mouse
gactcggccactgtaggaag

SEQ ID NO: 499690 - DNA, 20 bp, mouse
gaggcccttgaaccaatgga

SEQ ID NO: 499691 - DNA, 20 bp, mouse
gcagtcagcttgggggagta

SEQ ID NO: 499692 - DNA, 20 bp, mouse
gcaggaggcccttgaaccaa

SEQ ID NO: 499693 - DNA, 20 bp, mouse
gcagcagaaagttcccgctc

SEQ ID NO: 499694 - DNA, 20 bp, mouse
ggacagcggcgcctacactc

SEQ ID NO: 499695 - DNA, 20 bp, mouse
gctctgagcagtcagcttgg

SEQ ID NO: 499696 - DNA, 20 bp, mouse
ggtgaccagccgcagagcca

SEQ ID NO: 499697 - DNA, 20 bp, mouse
ggaggtggttgtaggctgag

SEQ ID NO: 499698 - DNA, 20 bp, mouse
gagcggcgggcattccgggc

SEQ ID NO: 499699 - DNA, 20 bp, mouse
ggtcacccgaagtcccatag

SEQ ID NO: 499700 - DNA, 20 bp, mouse
gggctcccaagcagcagcgg

SEQ ID NO: 499701 - DNA, 20 bp, mouse
gtagaggctctgggttgagg

SEQ ID NO: 499702 - DNA, 20 bp, mouse
ggcagcagcggcgggcattc

SEQ ID NO: 499703 - DNA, 20 bp, mouse
gtccctgcgggcacatcttg

SEQ ID NO: 499704 - DNA, 20 bp, mouse
gtgagaggtgtaagcccgcc

SEQ ID NO: 499705 - DNA, 20 bp, mouse
gaggatcaggacaaagtata

SEQ ID NO: 499706 - DNA, 20 bp, mouse
gcgcccgcgggagcagagag

SEQ ID NO: 499707 - DNA, 20 bp, mouse
gagaagaagaagtctccaag

SEQ ID NO: 499708 - DNA, 20 bp, mouse
gaaagacgcggtgctcccgg

SEQ ID NO: 499709 - DNA, 20 bp, mouse
gaaggcgccgtagtccgagg

SEQ ID NO: 499710 - DNA, 20 bp, mouse
ggtagagccgggaagaccac

SEQ ID NO: 499711 - DNA, 20 bp, mouse
gcgatcgcgaccctacctgg

SEQ ID NO: 499712 - DNA, 20 bp, mouse
ggcaaaccgaaagagagcgc

SEQ ID NO: 499713 - DNA, 20 bp, mouse
gcggccgcgctgcaaagacg

SEQ ID NO: 499714 - DNA, 20 bp, mouse
gctccaagtggtgttgtttg

SEQ ID NO: 499715 - DNA, 20 bp, mouse
gcccagcgccgcggctccgg

SEQ ID NO: 499716 - DNA, 20 bp, mouse
gggccagccgcagggacccc

SEQ ID NO: 499717 - DNA, 20 bp, mouse
ggggtcgcccggggtccctg

SEQ ID NO: 499718 - DNA, 20 bp, mouse
gctggagaggatgtgctcga

SEQ ID NO: 499719 - DNA, 20 bp, mouse
ggaaagggcagggtcgcccg

SEQ ID NO: 499720 - DNA, 20 bp, mouse
gcgcgcggaggggcaagact

SEQ ID NO: 499721 - DNA, 20 bp, mouse
gggatgtgctcgatggagaa

SEQ ID NO: 499722 - DNA, 20 bp, mouse
gtgctcgatggagaaagggc

SEQ ID NO: 499723 - DNA, 20 bp, mouse
gctgctctaggcgccgtcaa

SEQ ID NO: 499724 - DNA, 20 bp, mouse
gggcagcgcggccagccgca

SEQ ID NO: 499725 - DNA, 20 bp, mouse
gtggcgggcgccaacctcag

SEQ ID NO: 499726 - DNA, 20 bp, mouse
gtatagggtgagggaatgac

SEQ ID NO: 499727 - DNA, 20 bp, mouse
gagatcaatgatggctgagg

SEQ ID NO: 499728 - DNA, 20 bp, mouse
ggaggcagggggacattctg

SEQ ID NO: 499729 - DNA, 20 bp, mouse
gtcgttctgtctatagggtg

SEQ ID NO: 499730 - DNA, 20 bp, mouse
ggtgaagggtaggtccttct

SEQ ID NO: 499731 - DNA, 20 bp, mouse
gtgactggctgtcctttatc

SEQ ID NO: 499732 - DNA, 20 bp, mouse
gccacccaccaggaaaacct

SEQ ID NO: 499733 - DNA, 20 bp, mouse
gctggatcctgtctggcagc

SEQ ID NO: 499734 - DNA, 20 bp, mouse
gaggagcacacagagatgtt

SEQ ID NO: 499735 - DNA, 20 bp, mouse
ggtaagatcaatgatggctg

SEQ ID NO: 499736 - DNA, 20 bp, mouse
gctgtctggcagcagatgtg

SEQ ID NO: 499737 - DNA, 20 bp, mouse
gtggcagcagatgtgtggta

SEQ ID NO: 499738 - DNA, 20 bp, mouse
gaaggcagggggacactctg

SEQ ID NO: 499739 - DNA, 20 bp, mouse
gagttcccctggatttcaat

SEQ ID NO: 499740 - DNA, 20 bp, mouse
gagatcaatgatggctcaga

SEQ ID NO: 499741 - DNA, 20 bp, mouse
gctacacccattgaaatcca

SEQ ID NO: 499742 - DNA, 20 bp, mouse
gcatggccataaagttcccc

SEQ ID NO: 499743 - DNA, 20 bp, mouse
gagcaacacacacagatgtt

SEQ ID NO: 499744 - DNA, 20 bp, mouse
ggaaatccaggggaacttta

SEQ ID NO: 499745 - DNA, 20 bp, mouse
gccgttgttcctggaagggc

SEQ ID NO: 499746 - DNA, 20 bp, mouse
gtcctcttggatttcactgg

SEQ ID NO: 499747 - DNA, 20 bp, mouse
gcagagctctttcggtctat

SEQ ID NO: 499748 - DNA, 20 bp, mouse
gaaggcatgaggacattctg

SEQ ID NO: 499749 - DNA, 20 bp, mouse
ggattgagggggactaacag

SEQ ID NO: 499750 - DNA, 20 bp, mouse
gtacctacccttcatcagag

SEQ ID NO: 499751 - DNA, 20 bp, mouse
gttcctctctgatgaagggt

SEQ ID NO: 499752 - DNA, 20 bp, mouse
gtctttcggtctataggttg

SEQ ID NO: 499753 - DNA, 20 bp, mouse
gattgaggttctttacaggt

SEQ ID NO: 499754 - DNA, 20 bp, mouse
gatgaagggtaggtacttct

SEQ ID NO: 499755 - DNA, 20 bp, mouse
gacccccagtgaaatccaag

SEQ ID NO: 499756 - DNA, 20 bp, mouse
ggaatggtggctttgagcac

SEQ ID NO: 499757 - DNA, 20 bp, mouse
gatccccatcagctcttacc

SEQ ID NO: 499758 - DNA, 20 bp, mouse
gctgcctggtaagagctgat

SEQ ID NO: 499759 - DNA, 20 bp, mouse
gtgaatcaaagagcattggc

SEQ ID NO: 499760 - DNA, 20 bp, mouse
gctctgttcaggtttcgtgt

SEQ ID NO: 499761 - DNA, 20 bp, mouse
gtataacttgtacgaaatcc

SEQ ID NO: 499762 - DNA, 20 bp, mouse
gctctgacacatctctgttc

SEQ ID NO: 499763 - DNA, 20 bp, mouse
gattctggccaggtaagctc

SEQ ID NO: 499764 - DNA, 20 bp, mouse
ggagctcagagcttagttcc

SEQ ID NO: 499765 - DNA, 20 bp, mouse
ggccaccattcaaaagactg

SEQ ID NO: 499766 - DNA, 20 bp, mouse
gaaagaggctcttactcagg

SEQ ID NO: 499767 - DNA, 20 bp, mouse
gtctgagcacctcagggacc

SEQ ID NO: 499768 - DNA, 20 bp, mouse
gcccatgttgctaggataga

SEQ ID NO: 499769 - DNA, 20 bp, mouse
ggaccgggctagcaaggatg

SEQ ID NO: 499770 - DNA, 20 bp, mouse
gggaagagatctgaggcctg

SEQ ID NO: 499771 - DNA, 20 bp, mouse
gcatcggacaagcattccac

SEQ ID NO: 499772 - DNA, 20 bp, mouse
gccaggtattgtcagtcaag

SEQ ID NO: 499773 - DNA, 20 bp, mouse
gatgggctacagttttgacc

SEQ ID NO: 499774 - DNA, 20 bp, mouse
gctggagtatgtgaaatagg

SEQ ID NO: 499775 - DNA, 20 bp, mouse
ggagactcctcgatcaggtt

SEQ ID NO: 499776 - DNA, 20 bp, mouse
gtgagcacctcaaggaacct

SEQ ID NO: 499777 - DNA, 20 bp, mouse
gcagcttcccaggttccttg

SEQ ID NO: 499778 - DNA, 20 bp, mouse
gtagttcaaactggtaagtc

SEQ ID NO: 499779 - DNA, 20 bp, mouse
ggaccgggctagcaaggatg

SEQ ID NO: 499780 - DNA, 20 bp, mouse
gggaagagatctgaggcctg

SEQ ID NO: 499781 - DNA, 20 bp, mouse
gcccatgttgctaggataga

SEQ ID NO: 499782 - DNA, 20 bp, mouse
gccaggtattgtcagtcaag

SEQ ID NO: 499783 - DNA, 20 bp, mouse
gcatctgacaagcattccac

SEQ ID NO: 499784 - DNA, 20 bp, mouse
gctggagtatgtgaaatagg

SEQ ID NO: 499785 - DNA, 20 bp, mouse
gctcctggagtatgtgaaat

SEQ ID NO: 499786 - DNA, 20 bp, mouse
gactagaatccagaagaact

SEQ ID NO: 499787 - DNA, 20 bp, mouse
ggctttaaaggttccgtcag

SEQ ID NO: 499788 - DNA, 20 bp, mouse
ggtttaacacacatggtcca

SEQ ID NO: 499789 - DNA, 20 bp, mouse
ggcctcagtcccatacctct

SEQ ID NO: 499790 - DNA, 20 bp, mouse
ggaccagctgaaacacctag

SEQ ID NO: 499791 - DNA, 20 bp, mouse
gaaggacaatgggagaagga

SEQ ID NO: 499792 - DNA, 20 bp, mouse
gacctagaggtatgggactg

SEQ ID NO: 499793 - DNA, 20 bp, mouse
gcatacatgagggcctgagg

SEQ ID NO: 499794 - DNA, 20 bp, mouse
gccagcaaggaagtgcaagc

SEQ ID NO: 499795 - DNA, 20 bp, mouse
gggttgttacccagttcttc

SEQ ID NO: 499796 - DNA, 20 bp, mouse
ggaatctgggccctagtact

SEQ ID NO: 499797 - DNA, 20 bp, mouse
gacgcagaagactcacacta

SEQ ID NO: 499798 - DNA, 20 bp, mouse
gtcgccattgcccagtacta

SEQ ID NO: 499799 - DNA, 20 bp, mouse
gtgagtcttctgcgtcccag

SEQ ID NO: 499800 - DNA, 20 bp, mouse
gtaagggtcagcccaagtca

SEQ ID NO: 499801 - DNA, 20 bp, mouse
ggcaatggcgacactcctct

SEQ ID NO: 499802 - DNA, 20 bp, mouse
gggtacctagaagagagagg

SEQ ID NO: 499803 - DNA, 20 bp, mouse
ggagaggaggagaggaatct

SEQ ID NO: 499804 - DNA, 20 bp, mouse
gggccagagacgcctcgcgc

SEQ ID NO: 499805 - DNA, 20 bp, mouse
ggggccctagtactgggcaa

SEQ ID NO: 499806 - DNA, 20 bp, mouse
gtgtgggtcagcctaagtca

SEQ ID NO: 499807 - DNA, 20 bp, mouse
gtggccatggccctgcatta

SEQ ID NO: 499808 - DNA, 20 bp, mouse
ggaatatgggccctaatgca

SEQ ID NO: 499809 - DNA, 20 bp, mouse
gggctcacactaagggttgt

SEQ ID NO: 499810 - DNA, 20 bp, mouse
ggccccagtgagtgtggcca

SEQ ID NO: 499811 - DNA, 20 bp, mouse
gaattatcatttaatactgt

SEQ ID NO: 499812 - DNA, 20 bp, mouse
ggccatggccacactcactg

SEQ ID NO: 499813 - DNA, 20 bp, mouse
gagagagaggagaggaatat

SEQ ID NO: 499814 - DNA, 20 bp, mouse
gccggataccaaggccactg

SEQ ID NO: 499815 - DNA, 20 bp, mouse
ggacctgcacatcagtactg

SEQ ID NO: 499816 - DNA, 20 bp, mouse
gcgggagccacgaccaagag

SEQ ID NO: 499817 - DNA, 20 bp, mouse
gaccaagagcggaactcagg

SEQ ID NO: 499818 - DNA, 20 bp, mouse
gctgctcaacccgggagcaa

SEQ ID NO: 499819 - DNA, 20 bp, mouse
gacgaccaagagcggaactc

SEQ ID NO: 499820 - DNA, 20 bp, mouse
gctgctgggatgccggggag

SEQ ID NO: 499821 - DNA, 20 bp, mouse
gcgtggctcccgttgctccc

SEQ ID NO: 499822 - DNA, 20 bp, mouse
gaggacctgctgggatgccg

SEQ ID NO: 499823 - DNA, 20 bp, mouse
gaccacactagatagaggag

SEQ ID NO: 499824 - DNA, 20 bp, mouse
gcagacaatagacccctccc

SEQ ID NO: 499825 - DNA, 20 bp, mouse
gcgtagaccacactagatag

SEQ ID NO: 499826 - DNA, 20 bp, mouse
gctccggcatgtgtcaggag

SEQ ID NO: 499827 - DNA, 20 bp, mouse
gagacaaacccgggcgacgg

SEQ ID NO: 499828 - DNA, 20 bp, mouse
gcggcatgtgtcaggagcgg

SEQ ID NO: 499829 - DNA, 20 bp, mouse
gacccgggcgacggtggctc

SEQ ID NO: 499830 - DNA, 20 bp, mouse
ggtcaggagcggtggagcag

SEQ ID NO: 499831 - DNA, 20 bp, mouse
gaagcagttcagacaaaccc

SEQ ID NO: 499832 - DNA, 20 bp, mouse
gggtggctccggcatgtgtc

SEQ ID NO: 499833 - DNA, 20 bp, mouse
gcgcgagtgtggcttcaggt

SEQ ID NO: 499834 - DNA, 20 bp, mouse
ggccgccgccgcacagcccc

SEQ ID NO: 499835 - DNA, 20 bp, mouse
gttcagacaaacccgggcga

SEQ ID NO: 499836 - DNA, 20 bp, mouse
ggctcaggtgttgagggaga

SEQ ID NO: 499837 - DNA, 20 bp, mouse
gagctggcggcgtgcctgag

SEQ ID NO: 499838 - DNA, 20 bp, mouse
gaggtggtatgtgggcagtt

SEQ ID NO: 499839 - DNA, 20 bp, mouse
gaccccctctgctggcaaga

SEQ ID NO: 499840 - DNA, 20 bp, mouse
gggtcccctcttgccagcag

SEQ ID NO: 499841 - DNA, 20 bp, mouse
gaccaccttaccccctctgc

SEQ ID NO: 499842 - DNA, 20 bp, mouse
ggagaggatgaatgcccctc

SEQ ID NO: 499843 - DNA, 20 bp, mouse
gttgcgtggctcaggtgttg

SEQ ID NO: 499844 - DNA, 20 bp, mouse
ggcacgccgccagcttgggt

SEQ ID NO: 499845 - DNA, 20 bp, mouse
ggttcatgccactagagatg

SEQ ID NO: 499846 - DNA, 20 bp, mouse
gcgaggacgcggggcgactg

SEQ ID NO: 499847 - DNA, 20 bp, mouse
gggcgactggggccgcagag

SEQ ID NO: 499848 - DNA, 20 bp, mouse
ggctggtcggctccactctg

SEQ ID NO: 499849 - DNA, 20 bp, mouse
gacgcggggcgacgaggacg

SEQ ID NO: 499850 - DNA, 20 bp, mouse
ggggctccgggcgcgctggt

SEQ ID NO: 499851 - DNA, 20 bp, mouse
ggcaggcccatggcccacgg

SEQ ID NO: 499852 - DNA, 20 bp, mouse
gcagtacgtggtgaggaagg

SEQ ID NO: 499853 - DNA, 20 bp, mouse
gcaggagcgctcggccgcgg

SEQ ID NO: 499854 - DNA, 20 bp, mouse
ggcatgaagacgagccgccg

SEQ ID NO: 499855 - DNA, 20 bp, mouse
gctccgcgcgaagttggcag

SEQ ID NO: 499856 - DNA, 20 bp, mouse
gtatggcacaggctcacccg

SEQ ID NO: 499857 - DNA, 20 bp, mouse
ggccgggcgggcgctcgcta

SEQ ID NO: 499858 - DNA, 20 bp, mouse
gagagccgggtacccgaccg

SEQ ID NO: 499859 - DNA, 20 bp, mouse
gcacaggctcacccgcggtc

SEQ ID NO: 499860 - DNA, 20 bp, mouse
ggcgtacgttcgaaagagcc

SEQ ID NO: 499861 - DNA, 20 bp, mouse
gcgggcgctcgctatggcac

SEQ ID NO: 499862 - DNA, 20 bp, mouse
ggaggctgccggggaagtcg

SEQ ID NO: 499863 - DNA, 20 bp, mouse
gaggctgccgctgcgacccc

SEQ ID NO: 499864 - DNA, 20 bp, mouse
gcagcctcgtgggccagcgg

SEQ ID NO: 499865 - DNA, 20 bp, mouse
gtcacccgcggtcgggtacc

SEQ ID NO: 499866 - DNA, 20 bp, mouse
gtggaagaggccggagccca

SEQ ID NO: 499867 - DNA, 20 bp, mouse
gagccggagcccgaacggcg

SEQ ID NO: 499868 - DNA, 20 bp, mouse
ggagcccgaacggcgcggcc

SEQ ID NO: 499869 - DNA, 20 bp, mouse
gctgcgctcggcgccatgag

SEQ ID NO: 499870 - DNA, 20 bp, mouse
gggcccagcttcactcccgg

SEQ ID NO: 499871 - DNA, 20 bp, mouse
gggcgggaaagcgtcagtcg

SEQ ID NO: 499872 - DNA, 20 bp, mouse
gcgctcggcgccatgagcgg

SEQ ID NO: 499873 - DNA, 20 bp, mouse
ggggcgcccctaagtactca

SEQ ID NO: 499874 - DNA, 20 bp, mouse
gagcgcaggcccaggccgcg

SEQ ID NO: 499875 - DNA, 20 bp, mouse
gccccagggccgcctcccga

SEQ ID NO: 499876 - DNA, 20 bp, mouse
gtgtcactcggcccaggcgg

SEQ ID NO: 499877 - DNA, 20 bp, mouse
gccgcattcggccgggtcgg

SEQ ID NO: 499878 - DNA, 20 bp, mouse
gcacaagcccgcattcggcc

SEQ ID NO: 499879 - DNA, 20 bp, mouse
gggcgacacaagcccgcatt

SEQ ID NO: 499880 - DNA, 20 bp, mouse
gagcccgcattcggccgggt

SEQ ID NO: 499881 - DNA, 20 bp, mouse
gctttgtcactcggcccagg

SEQ ID NO: 499882 - DNA, 20 bp, mouse
gctcctggcgcaatgaggag

SEQ ID NO: 499883 - DNA, 20 bp, mouse
gggcggccgggtgaaccgga

SEQ ID NO: 499884 - DNA, 20 bp, mouse
gtgggccgagtgacaaagga

SEQ ID NO: 499885 - DNA, 20 bp, mouse
gggctaggcggctgcgcaga

SEQ ID NO: 499886 - DNA, 20 bp, mouse
gcgaggaaggataagaacat

SEQ ID NO: 499887 - DNA, 20 bp, mouse
gtgggcgctcgcaggtgagt

SEQ ID NO: 499888 - DNA, 20 bp, mouse
gagcagtctccggacgagga

SEQ ID NO: 499889 - DNA, 20 bp, mouse
gcggccgcgactgcaaggtg

SEQ ID NO: 499890 - DNA, 20 bp, mouse
ggcgctcgcaggtgagtggg

SEQ ID NO: 499891 - DNA, 20 bp, mouse
gccccagcagtctccggacg

SEQ ID NO: 499892 - DNA, 20 bp, mouse
gagggcgaggactggagacc

SEQ ID NO: 499893 - DNA, 20 bp, mouse
gactgctggggccaggatcg

SEQ ID NO: 499894 - DNA, 20 bp, mouse
gtaagaacatgggcgctcgc

SEQ ID NO: 499895 - DNA, 20 bp, mouse
gatgggcggggcaactgcgg

SEQ ID NO: 499896 - DNA, 20 bp, mouse
gctggtgacggcgacagcga

SEQ ID NO: 499897 - DNA, 20 bp, mouse
gagctctgctgcatcaggta

SEQ ID NO: 499898 - DNA, 20 bp, mouse
gggctagaggcgaagaggag

SEQ ID NO: 499899 - DNA, 20 bp, mouse
ggctgtgcgagcggcagggt

SEQ ID NO: 499900 - DNA, 20 bp, mouse
gggctcacccgatctcggat

SEQ ID NO: 499901 - DNA, 20 bp, mouse
gcaaaagtctgggacccggg

SEQ ID NO: 499902 - DNA, 20 bp, mouse
gcccacgcacggttgaacag

SEQ ID NO: 499903 - DNA, 20 bp, mouse
gcgcaccccgccccaaggcc

SEQ ID NO: 499904 - DNA, 20 bp, mouse
gcacagcgcaccccgcccca

SEQ ID NO: 499905 - DNA, 20 bp, mouse
ggggcatcgcgggagaaaag

SEQ ID NO: 499906 - DNA, 20 bp, mouse
gagagcagtgaagagcggta

SEQ ID NO: 499907 - DNA, 20 bp, mouse
gacggtgaggacccaggctg

SEQ ID NO: 499908 - DNA, 20 bp, mouse
gcagtgcgcacagcgccagg

SEQ ID NO: 499909 - DNA, 20 bp, mouse
ggaagagcggtacggagcca

SEQ ID NO: 499910 - DNA, 20 bp, mouse
gcggtacggagccatggcga

SEQ ID NO: 499911 - DNA, 20 bp, mouse
gatgtggtggctgcatggga

SEQ ID NO: 499912 - DNA, 20 bp, mouse
gcggagccatggcgacggtg

SEQ ID NO: 499913 - DNA, 20 bp, mouse
gcggggcagggcccaagaga

SEQ ID NO: 499914 - DNA, 20 bp, mouse
gtgggtcctcaccgtcgcca

SEQ ID NO: 499915 - DNA, 20 bp, mouse
gtggggcgaccaagggtccg

SEQ ID NO: 499916 - DNA, 20 bp, mouse
gctcgagaccaggtcgacag

SEQ ID NO: 499917 - DNA, 20 bp, mouse
gactcactcgccggcgtcct

SEQ ID NO: 499918 - DNA, 20 bp, mouse
gtggtctcgagtgtactgtc

SEQ ID NO: 499919 - DNA, 20 bp, mouse
gcgatcatggatcctagcag

SEQ ID NO: 499920 - DNA, 20 bp, mouse
gccggaccccgcaggaagga

SEQ ID NO: 499921 - DNA, 20 bp, mouse
gctaggatccatgatcgggg

SEQ ID NO: 499922 - DNA, 20 bp, mouse
gcctttcgcacacacgagga

SEQ ID NO: 499923 - DNA, 20 bp, mouse
gagcaggccgcgctgacccg

SEQ ID NO: 499924 - DNA, 20 bp, mouse
gtagctgctgcccaggacgc

SEQ ID NO: 499925 - DNA, 20 bp, mouse
gcggggaggacggcaagact

SEQ ID NO: 499926 - DNA, 20 bp, mouse
ggatgctgcactcacagctg

SEQ ID NO: 499927 - DNA, 20 bp, mouse
ggcgaaccttagcggcgcgg

SEQ ID NO: 499928 - DNA, 20 bp, mouse
gcgagcgacgcgaaccttag

SEQ ID NO: 499929 - DNA, 20 bp, mouse
ggctgcactcacagctgcgg

SEQ ID NO: 499930 - DNA, 20 bp, mouse
ggcactcacagctgcggcgg

SEQ ID NO: 499931 - DNA, 20 bp, mouse
gaggaacagccacgggccac

SEQ ID NO: 499932 - DNA, 20 bp, mouse
gccgatccaggcaggaagga

SEQ ID NO: 499933 - DNA, 20 bp, mouse
gctcggcagcagcagcgact

SEQ ID NO: 499934 - DNA, 20 bp, mouse
gcaggaggagagggttctac

SEQ ID NO: 499935 - DNA, 20 bp, mouse
ggtaaggcaggaacagccac

SEQ ID NO: 499936 - DNA, 20 bp, mouse
gggctcgccgggactcgcca

SEQ ID NO: 499937 - DNA, 20 bp, mouse
gcctgcgccatggcgagtcc

SEQ ID NO: 499938 - DNA, 20 bp, mouse
gtcgaaggaagaggtgtccg

SEQ ID NO: 499939 - DNA, 20 bp, mouse
gccgatcaccaggtagtcga

SEQ ID NO: 499940 - DNA, 20 bp, mouse
gggcccgggatcccaagaag

SEQ ID NO: 499941 - DNA, 20 bp, mouse
gtggagagtcacaagctggg

SEQ ID NO: 499942 - DNA, 20 bp, mouse
gaagaggtgtccggggccgg

SEQ ID NO: 499943 - DNA, 20 bp, mouse
gaccaggtagtcgaaggaag

SEQ ID NO: 499944 - DNA, 20 bp, mouse
ggcggccccgagcctgcggc

SEQ ID NO: 499945 - DNA, 20 bp, mouse
gtgcagagtggcgggatcgg

SEQ ID NO: 499946 - DNA, 20 bp, mouse
gacaacgagcgagtaagtcg

SEQ ID NO: 499947 - DNA, 20 bp, mouse
ggccccccgagcccgggtaa

SEQ ID NO: 499948 - DNA, 20 bp, mouse
ggtaagtcggggcttcgcga

SEQ ID NO: 499949 - DNA, 20 bp, mouse
ggagcgggcagatgacgcgg

SEQ ID NO: 499950 - DNA, 20 bp, mouse
gggcgagcgggcagatgacg

SEQ ID NO: 499951 - DNA, 20 bp, mouse
gcttgggaggagagcggtga

SEQ ID NO: 499952 - DNA, 20 bp, mouse
ggaaacttgtgtccagtgag

SEQ ID NO: 499953 - DNA, 20 bp, mouse
ggccgttacccgggctcggg

SEQ ID NO: 499954 - DNA, 20 bp, mouse
gcccatcacggggacaagac

SEQ ID NO: 499955 - DNA, 20 bp, mouse
ggagcggacggggcccatca

SEQ ID NO: 499956 - DNA, 20 bp, mouse
ggaaaagggatgaggaggga

SEQ ID NO: 499957 - DNA, 20 bp, mouse
ggagggaaaagggatgagga

SEQ ID NO: 499958 - DNA, 20 bp, mouse
gagaattgtcaccttactaa

SEQ ID NO: 499959 - DNA, 20 bp, mouse
ggtgtcactgagccaaaggg

SEQ ID NO: 499960 - DNA, 20 bp, mouse
gaaccgaaagaaggaataga

SEQ ID NO: 499961 - DNA, 20 bp, mouse
gaggtgacaattcttaccca

SEQ ID NO: 499962 - DNA, 20 bp, mouse
gtcagtgtcactgagccaaa

SEQ ID NO: 499963 - DNA, 20 bp, mouse
ggatggagggaaaagggatg

SEQ ID NO: 499964 - DNA, 20 bp, mouse
ggggaaagatggagggaaaa

SEQ ID NO: 499965 - DNA, 20 bp, mouse
gagctggactgtgagctgag

SEQ ID NO: 499966 - DNA, 20 bp, mouse
gcccagtatagggaccaata

SEQ ID NO: 499967 - DNA, 20 bp, mouse
gagggagggagaaccgaaga

SEQ ID NO: 499968 - DNA, 20 bp, mouse
gtccctattggtccctatac

SEQ ID NO: 499969 - DNA, 20 bp, mouse
gacaattcttacccagtata

SEQ ID NO: 499970 - DNA, 20 bp, mouse
ggggaggggctgatccctat

SEQ ID NO: 499971 - DNA, 20 bp, mouse
ggaagaagaaaggatagaag

SEQ ID NO: 499972 - DNA, 20 bp, mouse
gagaaccgaagaaggaatag

SEQ ID NO: 499973 - DNA, 20 bp, mouse
gactcctctggagctggatt

SEQ ID NO: 499974 - DNA, 20 bp, mouse
ggggagcaataggtggctac

SEQ ID NO: 499975 - DNA, 20 bp, mouse
gagctggattgggagctgag

SEQ ID NO: 499976 - DNA, 20 bp, mouse
gtaaaagctagctttttaga

SEQ ID NO: 499977 - DNA, 20 bp, mouse
ggtccagggaagagaagcat

SEQ ID NO: 499978 - DNA, 20 bp, mouse
gcagcagaaactcttgcata

SEQ ID NO: 499979 - DNA, 20 bp, mouse
gttatactggcatgcagact

SEQ ID NO: 499980 - DNA, 20 bp, mouse
gtatccagcagaaatggatt

SEQ ID NO: 499981 - DNA, 20 bp, mouse
gctgagggtggaggtttccc

SEQ ID NO: 499982 - DNA, 20 bp, mouse
ggcatgcagactaggtgtgc

SEQ ID NO: 499983 - DNA, 20 bp, mouse
gttattttctaggaacatat

SEQ ID NO: 499984 - DNA, 20 bp, mouse
ggactaggtgtgctggattc

SEQ ID NO: 499985 - DNA, 20 bp, mouse
gaatctcataagtagacaat

SEQ ID NO: 499986 - DNA, 20 bp, mouse
gcaacaatcccacaagaata

SEQ ID NO: 499987 - DNA, 20 bp, mouse
gtaccaaccgctcatctact

SEQ ID NO: 499988 - DNA, 20 bp, mouse
gttgtgggattgttgtctcc

SEQ ID NO: 499989 - DNA, 20 bp, mouse
gtcactcaccttattcttgt

SEQ ID NO: 499990 - DNA, 20 bp, mouse
gtggtctaaaggtcttggta

SEQ ID NO: 499991 - DNA, 20 bp, mouse
gcttgtttaggccaaataaa

SEQ ID NO: 499992 - DNA, 20 bp, mouse
gtgcctagtagatgagcggt

SEQ ID NO: 499993 - DNA, 20 bp, mouse
gagccctcgagaagagatcg

SEQ ID NO: 499994 - DNA, 20 bp, mouse
gtaaatgttcaatggctggt

SEQ ID NO: 499995 - DNA, 20 bp, mouse
gactatctcaaagcttgttt

SEQ ID NO: 499996 - DNA, 20 bp, mouse
ggacagcaggaagtgacgta

SEQ ID NO: 499997 - DNA, 20 bp, mouse
gcggtccgccggattatgaa

SEQ ID NO: 499998 - DNA, 20 bp, mouse
ggggctggcaagactctcaa

SEQ ID NO: 499999 - DNA, 20 bp, mouse
gtatgaatggcgttgggcgg

SEQ ID NO: 500000 - DNA, 20 bp, mouse
gctgcgtgggtagagcaaca

SEQ ID NO: 500001 - DNA, 20 bp, mouse
gcccagcgaggccctgagca

SEQ ID NO: 500002 - DNA, 20 bp, mouse
gggcgagcgcggatctcagg

SEQ ID NO: 500003 - DNA, 20 bp, mouse
ggattatgaatggcgttggg

SEQ ID NO: 500004 - DNA, 20 bp, mouse
gagctcgagccgggactccg

SEQ ID NO: 500005 - DNA, 20 bp, mouse
ggggcccacgcgtcactcag

SEQ ID NO: 500006 - DNA, 20 bp, mouse
ggcgaggcgagtgcacagtg

SEQ ID NO: 500007 - DNA, 20 bp, mouse
gtaaccctgagggcatccac

SEQ ID NO: 500008 - DNA, 20 bp, mouse
gtgggctgccgaagagcttt

SEQ ID NO: 500009 - DNA, 20 bp, mouse
gtcgcagaccacaacccggg

SEQ ID NO: 500010 - DNA, 20 bp, mouse
gacagtggggcactgatcac

SEQ ID NO: 500011 - DNA, 20 bp, mouse
ggcctcgcagaccacaaccc

SEQ ID NO: 500012 - DNA, 20 bp, mouse
gaaccctgtgctaaccctga

SEQ ID NO: 500013 - DNA, 20 bp, mouse
ggttcggggagggggatcag

SEQ ID NO: 500014 - DNA, 20 bp, mouse
gggatcaggaccctacttgg

SEQ ID NO: 500015 - DNA, 20 bp, mouse
ggcaattcgcggactacgat

SEQ ID NO: 500016 - DNA, 20 bp, mouse
gcgtccgcggagtgagagag

SEQ ID NO: 500017 - DNA, 20 bp, mouse
gggacccctctctcactccg

SEQ ID NO: 500018 - DNA, 20 bp, mouse
gactgagcgctgagagctac

SEQ ID NO: 500019 - DNA, 20 bp, mouse
gcagactactagagaaacgt

SEQ ID NO: 500020 - DNA, 20 bp, mouse
gcagtgtgggaggtctcaac

SEQ ID NO: 500021 - DNA, 20 bp, mouse
gcccagtcccaccctccaag

SEQ ID NO: 500022 - DNA, 20 bp, mouse
ggagagaggggtccacttgg

SEQ ID NO: 500023 - DNA, 20 bp, mouse
gagcgctgagagctacaggc

SEQ ID NO: 500024 - DNA, 20 bp, mouse
gaggggtccacttggagggt

SEQ ID NO: 500025 - DNA, 20 bp, mouse
gagagtacccgctgtaggaa

SEQ ID NO: 500026 - DNA, 20 bp, mouse
gagactagcaaggcccgggt

SEQ ID NO: 500027 - DNA, 20 bp, mouse
gagtgtcataggcatagtgc

SEQ ID NO: 500028 - DNA, 20 bp, mouse
ggtccagagcagaccaaccc

SEQ ID NO: 500029 - DNA, 20 bp, mouse
ggctcagactagcaaggccc

SEQ ID NO: 500030 - DNA, 20 bp, mouse
gagcgttctcactcacccca

SEQ ID NO: 500031 - DNA, 20 bp, mouse
ggtgtcagagcagtgtctct

SEQ ID NO: 500032 - DNA, 20 bp, mouse
gcagcagagtcagactgtca

SEQ ID NO: 500033 - DNA, 20 bp, mouse
gagcaggggcctgagaaaca

SEQ ID NO: 500034 - DNA, 20 bp, mouse
gtctaggcaccagttagcag

SEQ ID NO: 500035 - DNA, 20 bp, mouse
gaagaggcgggacctggata

SEQ ID NO: 500036 - DNA, 20 bp, mouse
gtccaatagcccagtgtcat

SEQ ID NO: 500037 - DNA, 20 bp, mouse
gacacccgcggagtgagagg

SEQ ID NO: 500038 - DNA, 20 bp, mouse
ggatccccctctcactccgc

SEQ ID NO: 500039 - DNA, 20 bp, mouse
gaggcatggcgctgatgctg

SEQ ID NO: 500040 - DNA, 20 bp, mouse
gggaacacccgcggagtgag

SEQ ID NO: 500041 - DNA, 20 bp, mouse
gtggagctcacaaacttggg

SEQ ID NO: 500042 - DNA, 20 bp, mouse
gccctggagctcacaaactt

SEQ ID NO: 500043 - DNA, 20 bp, mouse
gcacaaacacagccaccctg

SEQ ID NO: 500044 - DNA, 20 bp, mouse
gatgtgtacacaccgcaggg

SEQ ID NO: 500045 - DNA, 20 bp, mouse
ggggtggctgtgtttgtgga

SEQ ID NO: 500046 - DNA, 20 bp, mouse
gtgcggggcagagtctggag

SEQ ID NO: 500047 - DNA, 20 bp, mouse
ggccccgcccagggacccga

SEQ ID NO: 500048 - DNA, 20 bp, mouse
ggagcagggtgtgtgttgcg

SEQ ID NO: 500049 - DNA, 20 bp, mouse
gttctgtaggtgactgtcag

SEQ ID NO: 500050 - DNA, 20 bp, mouse
gcaggtggttgctcacccca

SEQ ID NO: 500051 - DNA, 20 bp, mouse
gtgtgttgcggggcagagtc

SEQ ID NO: 500052 - DNA, 20 bp, mouse
gtaggagaaggcgagctggg

SEQ ID NO: 500053 - DNA, 20 bp, mouse
ggagcaaccacctgatgagt

SEQ ID NO: 500054 - DNA, 20 bp, mouse
gggaggggcaggatcacgcc

SEQ ID NO: 500055 - DNA, 20 bp, mouse
gatgagtgggaaggattgca

SEQ ID NO: 500056 - DNA, 20 bp, mouse
gggatacagcgatggactgt

SEQ ID NO: 500057 - DNA, 20 bp, mouse
gcccttcggggatacagcga

SEQ ID NO: 500058 - DNA, 20 bp, mouse
gatggggtccccaggactgt

SEQ ID NO: 500059 - DNA, 20 bp, mouse
gtcctggggaccccataggt

SEQ ID NO: 500060 - DNA, 20 bp, mouse
gtccatcgctgtatccccga

SEQ ID NO: 500061 - DNA, 20 bp, mouse
ggagcatagagcgagagagg

SEQ ID NO: 500062 - DNA, 20 bp, mouse
gggcgatcttagccccttcg

SEQ ID NO: 500063 - DNA, 20 bp, mouse
ggagagaggaggagacagtt

SEQ ID NO: 500064 - DNA, 20 bp, mouse
gtaacccagaaccatagact

SEQ ID NO: 500065 - DNA, 20 bp, mouse
gtgggcggctaactttatac

SEQ ID NO: 500066 - DNA, 20 bp, mouse
gagactgtgcagtcagtcac

SEQ ID NO: 500067 - DNA, 20 bp, mouse
gtgtgcagtcagtcactggt

SEQ ID NO: 500068 - DNA, 20 bp, mouse
gggtgtggctctgacagaga

SEQ ID NO: 500069 - DNA, 20 bp, mouse
gatgagtctgagaacaggtc

SEQ ID NO: 500070 - DNA, 20 bp, mouse
ggggtcaaggaaaacccgat

SEQ ID NO: 500071 - DNA, 20 bp, mouse
gcccagctgtgagagatagt

SEQ ID NO: 500072 - DNA, 20 bp, mouse
ggtaaaggcgtccctagagg

SEQ ID NO: 500073 - DNA, 20 bp, mouse
gactgcacagtcttcgaggc

SEQ ID NO: 500074 - DNA, 20 bp, mouse
gccacgaagaagattcccat

SEQ ID NO: 500075 - DNA, 20 bp, mouse
gggttggttcctttggggag

SEQ ID NO: 500076 - DNA, 20 bp, mouse
gcatggtgccgaggtctgaa

SEQ ID NO: 500077 - DNA, 20 bp, mouse
gtgccgaggtctgaacggac

SEQ ID NO: 500078 - DNA, 20 bp, mouse
gagcctgtccgttcagacct

SEQ ID NO: 500079 - DNA, 20 bp, mouse
gggatccgtgcagtcaatgg

SEQ ID NO: 500080 - DNA, 20 bp, mouse
gtgtcatgggcatggtgccg

SEQ ID NO: 500081 - DNA, 20 bp, mouse
gagagctgccagaaacggat

SEQ ID NO: 500082 - DNA, 20 bp, mouse
gagggccgcccccagagcca

SEQ ID NO: 500083 - DNA, 20 bp, mouse
gggacccctctctcacccca

SEQ ID NO: 500084 - DNA, 20 bp, mouse
ggcatccaggaacaaggcca

SEQ ID NO: 500085 - DNA, 20 bp, mouse
gccgaatgcagagtaggact

SEQ ID NO: 500086 - DNA, 20 bp, mouse
gtggctctcggcctgcacgg

SEQ ID NO: 500087 - DNA, 20 bp, mouse
gagtcgcccgcaaacgggag

SEQ ID NO: 500088 - DNA, 20 bp, mouse
gtgcaggccgagagccacgc

SEQ ID NO: 500089 - DNA, 20 bp, mouse
gcagcgtcctctgagcgaag

SEQ ID NO: 500090 - DNA, 20 bp, mouse
gaggagcctggggaagggtg

SEQ ID NO: 500091 - DNA, 20 bp, mouse
gaggccaagggaatccggtg

SEQ ID NO: 500092 - DNA, 20 bp, mouse
gcggatcgcacagggatccc

SEQ ID NO: 500093 - DNA, 20 bp, mouse
gtccagagtcgcccgcaaac

SEQ ID NO: 500094 - DNA, 20 bp, mouse
ggcggaacccgcgtggctct

SEQ ID NO: 500095 - DNA, 20 bp, mouse
ggggcgactctggaagcacg

SEQ ID NO: 500096 - DNA, 20 bp, mouse
ggggcgtcccaactccgggt

SEQ ID NO: 500097 - DNA, 20 bp, mouse
gtctcagagcaaccttcggg

SEQ ID NO: 500098 - DNA, 20 bp, mouse
gcgccgggcgtcccaactcc

SEQ ID NO: 500099 - DNA, 20 bp, mouse
ggcatctcagagcaaccttc

SEQ ID NO: 500100 - DNA, 20 bp, mouse
gggcggctatggctccaacc

SEQ ID NO: 500101 - DNA, 20 bp, mouse
gccgaaccccccagtggcgg

SEQ ID NO: 500102 - DNA, 20 bp, mouse
gtggagccatagccgcccga

SEQ ID NO: 500103 - DNA, 20 bp, mouse
gagcaaccttcgggcggcta

SEQ ID NO: 500104 - DNA, 20 bp, mouse
gggacgcccggcggccgacg

SEQ ID NO: 500105 - DNA, 20 bp, mouse
gtatggctccaacccggagt

SEQ ID NO: 500106 - DNA, 20 bp, mouse
gcagtgctgcgtagacagag

SEQ ID NO: 500107 - DNA, 20 bp, mouse
gcagaggggtactcagagtg

SEQ ID NO: 500108 - DNA, 20 bp, mouse
gcctgggaagctgtgcggag

SEQ ID NO: 500109 - DNA, 20 bp, mouse
gactcactgcctgctgggtg

SEQ ID NO: 500110 - DNA, 20 bp, mouse
gagagtgaggacgcacgcgt

SEQ ID NO: 500111 - DNA, 20 bp, mouse
gtataaggctggcggcccgg

SEQ ID NO: 500112 - DNA, 20 bp, mouse
ggacgcacgcgtaggccacc

SEQ ID NO: 500113 - DNA, 20 bp, mouse
gatctcccgggtcccttctc

SEQ ID NO: 500114 - DNA, 20 bp, mouse
gggcgtttcaaaccagagaa

SEQ ID NO: 500115 - DNA, 20 bp, mouse
gcactgaatccgcacccagc

SEQ ID NO: 500116 - DNA, 20 bp, mouse
gcttcagggcgtggactcac

SEQ ID NO: 500117 - DNA, 20 bp, mouse
ggtagttcggggaagcttca

SEQ ID NO: 500118 - DNA, 20 bp, mouse
gtctccatggcagataggaa

SEQ ID NO: 500119 - DNA, 20 bp, mouse
ggctgcaagctggtagttcg

SEQ ID NO: 500120 - DNA, 20 bp, mouse
gtggtgtacggcggcactgg

SEQ ID NO: 500121 - DNA, 20 bp, mouse
gctacttcccaagtccaggt

SEQ ID NO: 500122 - DNA, 20 bp, mouse
ggaatgttaggtagaagaag

SEQ ID NO: 500123 - DNA, 20 bp, mouse
ggggacccgggagatggagc

SEQ ID NO: 500124 - DNA, 20 bp, mouse
gagaagaaggggaatgatta

SEQ ID NO: 500125 - DNA, 20 bp, mouse
gcattttgcaccaggagcct

SEQ ID NO: 500126 - DNA, 20 bp, mouse
ggggctgcgacagcagatcc

SEQ ID NO: 500127 - DNA, 20 bp, mouse
ggttcccgccgcctatgcca

SEQ ID NO: 500128 - DNA, 20 bp, mouse
gggtggagctgcgcaagggt

SEQ ID NO: 500129 - DNA, 20 bp, mouse
gagaaccatggcataggcgg

SEQ ID NO: 500130 - DNA, 20 bp, mouse
gttcttggcgaagatataaa

SEQ ID NO: 500131 - DNA, 20 bp, mouse
gaagtccaggctggctagta

SEQ ID NO: 500132 - DNA, 20 bp, mouse
gggaggcaagacggacttag

SEQ ID NO: 500133 - DNA, 20 bp, mouse
gacacggtggagctgcgcaa

SEQ ID NO: 500134 - DNA, 20 bp, mouse
gagatataaatggcgcgaca

SEQ ID NO: 500135 - DNA, 20 bp, mouse
gcgggaaccacttctgtaac

SEQ ID NO: 500136 - DNA, 20 bp, mouse
gggtgtcagctatccagagg

SEQ ID NO: 500137 - DNA, 20 bp, mouse
gggtccagcacagcctcagt

SEQ ID NO: 500138 - DNA, 20 bp, mouse
gtccagaggaggaaatcgtt

SEQ ID NO: 500139 - DNA, 20 bp, mouse
gcgtttggcttggccaactg

SEQ ID NO: 500140 - DNA, 20 bp, mouse
gcacctgctgatcttgggga

SEQ ID NO: 500141 - DNA, 20 bp, mouse
ggctgacacctgctgatctt

SEQ ID NO: 500142 - DNA, 20 bp, mouse
ggtaccgtggatatactcaa

SEQ ID NO: 500143 - DNA, 20 bp, mouse
ggttcgataacagcaagctg

SEQ ID NO: 500144 - DNA, 20 bp, mouse
gcttggggagggagacgctt

SEQ ID NO: 500145 - DNA, 20 bp, mouse
gctccctccccaagatcagc

SEQ ID NO: 500146 - DNA, 20 bp, mouse
gccgcaacggcgagcaggaa

SEQ ID NO: 500147 - DNA, 20 bp, mouse
gctcgggtgaactgcctctg

SEQ ID NO: 500148 - DNA, 20 bp, mouse
gacggcgagcaggaacggct

SEQ ID NO: 500149 - DNA, 20 bp, mouse
ggacctcgggaactagcctc

SEQ ID NO: 500150 - DNA, 20 bp, mouse
gagctccgatcgaggctaag

SEQ ID NO: 500151 - DNA, 20 bp, mouse
ggtagccgctggcagacctc

SEQ ID NO: 500152 - DNA, 20 bp, mouse
gcgaggctaagaggcacttg

SEQ ID NO: 500153 - DNA, 20 bp, mouse
gagttcccgaggtctgccag

SEQ ID NO: 500154 - DNA, 20 bp, mouse
gacccacccgctgcagaggt

SEQ ID NO: 500155 - DNA, 20 bp, mouse
gaaaggcgccctggaagcta

SEQ ID NO: 500156 - DNA, 20 bp, mouse
gcaggttcctcagatcagga

SEQ ID NO: 500157 - DNA, 20 bp, mouse
gaggtgctcaggctagcccc

SEQ ID NO: 500158 - DNA, 20 bp, mouse
gggacacccgctgtagctgt

SEQ ID NO: 500159 - DNA, 20 bp, mouse
gcaggctgcctggcagtact

SEQ ID NO: 500160 - DNA, 20 bp, mouse
gaatgcaggttcctcagatc

SEQ ID NO: 500161 - DNA, 20 bp, mouse
gtcataagtacatcaaggta

SEQ ID NO: 500162 - DNA, 20 bp, mouse
ggggggcccacagctacagc

SEQ ID NO: 500163 - DNA, 20 bp, mouse
gcagttagcgcctcaggacc

SEQ ID NO: 500164 - DNA, 20 bp, mouse
gcctgaggcgctaactgcca

SEQ ID NO: 500165 - DNA, 20 bp, mouse
gagcctgagcacctggctct

SEQ ID NO: 500166 - DNA, 20 bp, mouse
gagcggggtccagagagcga

SEQ ID NO: 500167 - DNA, 20 bp, mouse
gggtagacagacctcttcta

SEQ ID NO: 500168 - DNA, 20 bp, mouse
gagatgactgaggcctagcg

SEQ ID NO: 500169 - DNA, 20 bp, mouse
ggcggggccagcccgaagga

SEQ ID NO: 500170 - DNA, 20 bp, mouse
gagctcgcggcgcttccagg

SEQ ID NO: 500171 - DNA, 20 bp, mouse
ggggccagcccgaaggaggg

SEQ ID NO: 500172 - DNA, 20 bp, mouse
gcgcgcaggtgtagagtgag

SEQ ID NO: 500173 - DNA, 20 bp, mouse
gtggccgctgaaccttatgg

SEQ ID NO: 500174 - DNA, 20 bp, mouse
gggccaagaaagtcagctct

SEQ ID NO: 500175 - DNA, 20 bp, mouse
gcccctgagagacatacgaa

SEQ ID NO: 500176 - DNA, 20 bp, mouse
ggcccgggctggaatcacct

SEQ ID NO: 500177 - DNA, 20 bp, mouse
gctgcgggcacctcccggag

SEQ ID NO: 500178 - DNA, 20 bp, mouse
gccacgcgcggctcaagccc

SEQ ID NO: 500179 - DNA, 20 bp, mouse
gtgctgctgcgggcacctcc

SEQ ID NO: 500180 - DNA, 20 bp, mouse
gctggcttcccgcagcacaa

SEQ ID NO: 500181 - DNA, 20 bp, mouse
gcggcggcgggaccgcgtag

SEQ ID NO: 500182 - DNA, 20 bp, mouse
gtggtgctgaaagacgccgg

SEQ ID NO: 500183 - DNA, 20 bp, mouse
ggccagcacctcgcccgctc

SEQ ID NO: 500184 - DNA, 20 bp, mouse
ggccgcgcgtggagcctccg

SEQ ID NO: 500185 - DNA, 20 bp, mouse
gccgcgtaggggaagagcgg

SEQ ID NO: 500186 - DNA, 20 bp, mouse
gtgaggaccaaccctctcca

SEQ ID NO: 500187 - DNA, 20 bp, mouse
ggtctgggactcgaacaaag

SEQ ID NO: 500188 - DNA, 20 bp, mouse
ggcgggcggtcaagtccttg

SEQ ID NO: 500189 - DNA, 20 bp, mouse
gactcgaacaaaggggtccc

SEQ ID NO: 500190 - DNA, 20 bp, mouse
gcggaaagctgggcgcacgc

SEQ ID NO: 500191 - DNA, 20 bp, mouse
ggagcactgtccggaaagct

SEQ ID NO: 500192 - DNA, 20 bp, mouse
gaaagctgggcgcacgcggg

SEQ ID NO: 500193 - DNA, 20 bp, mouse
gacggggacggcatgcccag

SEQ ID NO: 500194 - DNA, 20 bp, mouse
gcccaggagcgggagagaac

SEQ ID NO: 500195 - DNA, 20 bp, mouse
gttggggatgctgaggtgtc

SEQ ID NO: 500196 - DNA, 20 bp, mouse
gtagtatcacatgactctct

SEQ ID NO: 500197 - DNA, 20 bp, mouse
gaaagtagtaaacaatgata

SEQ ID NO: 500198 - DNA, 20 bp, mouse
gaagtagcaaatagcaagtt

SEQ ID NO: 500199 - DNA, 20 bp, mouse
gactttgaacctagatacta

SEQ ID NO: 500200 - DNA, 20 bp, mouse
gtgtttacttttcagaatct

SEQ ID NO: 500201 - DNA, 20 bp, mouse
gaaatttttttgactttggt

SEQ ID NO: 500202 - DNA, 20 bp, mouse
ggaaattttccatagtatct

SEQ ID NO: 500203 - DNA, 20 bp, mouse
gtaattaaatcttattatta

SEQ ID NO: 500204 - DNA, 20 bp, mouse
gttgagtttacttagcatat

SEQ ID NO: 500205 - DNA, 20 bp, mouse
gactatggaaaatttcaata

SEQ ID NO: 500206 - DNA, 20 bp, mouse
gccgcaccacgtccttacca

SEQ ID NO: 500207 - DNA, 20 bp, mouse
gcggcaagccagggccccaa

SEQ ID NO: 500208 - DNA, 20 bp, mouse
gtcggcaaacacaaacaccg

SEQ ID NO: 500209 - DNA, 20 bp, mouse
ggagaagcaggcggaccgga

SEQ ID NO: 500210 - DNA, 20 bp, mouse
gacctccggagagcccccga

SEQ ID NO: 500211 - DNA, 20 bp, mouse
gaagtcacccgccaagagtg

SEQ ID NO: 500212 - DNA, 20 bp, mouse
gggggctgcgaaggttccgg

SEQ ID NO: 500213 - DNA, 20 bp, mouse
gaggttccggcggcaggcaa

SEQ ID NO: 500214 - DNA, 20 bp, mouse
gaaacaccgtggtaaggacg

SEQ ID NO: 500215 - DNA, 20 bp, mouse
gaggggagaagcaggcggac

SEQ ID NO: 500216 - DNA, 20 bp, mouse
gcacgcaggcgcaaacggtt

SEQ ID NO: 500217 - DNA, 20 bp, mouse
gcaaacggttaggcacagag

SEQ ID NO: 500218 - DNA, 20 bp, mouse
gcaacctggtggtaaggagg

SEQ ID NO: 500219 - DNA, 20 bp, mouse
gcggttaggcacagagcggc

SEQ ID NO: 500220 - DNA, 20 bp, mouse
gtgcccgcctccttaccacc

SEQ ID NO: 500221 - DNA, 20 bp, mouse
gatcaaagtctggagggtgt

SEQ ID NO: 500222 - DNA, 20 bp, mouse
gatggccttcatcaacctgg

SEQ ID NO: 500223 - DNA, 20 bp, mouse
gggcatggccttcatcaacc

SEQ ID NO: 500224 - DNA, 20 bp, mouse
ggcacctagacatcgtgtag

SEQ ID NO: 500225 - DNA, 20 bp, mouse
gtgaggtcacccaggtttca

SEQ ID NO: 500226 - DNA, 20 bp, mouse
gcggcctgaggagagcggga

SEQ ID NO: 500227 - DNA, 20 bp, mouse
gccacggcggtagcagagcc

SEQ ID NO: 500228 - DNA, 20 bp, mouse
gcctgaggagagcgggaagg

SEQ ID NO: 500229 - DNA, 20 bp, mouse
gagggaaggcgcttccgcca

SEQ ID NO: 500230 - DNA, 20 bp, mouse
ggaaggcgcttccgccacgg

SEQ ID NO: 500231 - DNA, 20 bp, mouse
gccgccgcctacctgaggga

SEQ ID NO: 500232 - DNA, 20 bp, mouse
gccagctctgcagtgaggag

SEQ ID NO: 500233 - DNA, 20 bp, mouse
gctctcctcaggccgcgctt

SEQ ID NO: 500234 - DNA, 20 bp, mouse
gcccgccgccgcctacctga

SEQ ID NO: 500235 - DNA, 20 bp, mouse
gtgtgtgcccggcatccgag

SEQ ID NO: 500236 - DNA, 20 bp, mouse
gccgaggccgttgcactcac

SEQ ID NO: 500237 - DNA, 20 bp, mouse
gcttcggacggagctgttgg

SEQ ID NO: 500238 - DNA, 20 bp, mouse
gctgcttcggacggagctgt

SEQ ID NO: 500239 - DNA, 20 bp, mouse
ggaccagccggtgagtgcaa

SEQ ID NO: 500240 - DNA, 20 bp, mouse
gtgctgcttcctgcttcgga

SEQ ID NO: 500241 - DNA, 20 bp, mouse
gccggctggatgggccgtaa

SEQ ID NO: 500242 - DNA, 20 bp, mouse
ggggcggcgatgactcaggt

SEQ ID NO: 500243 - DNA, 20 bp, mouse
ggttggcggagccgcgaaga

SEQ ID NO: 500244 - DNA, 20 bp, mouse
gcctcggagcgagtggagca

SEQ ID NO: 500245 - DNA, 20 bp, mouse
gggccgttgcactcaccggc

SEQ ID NO: 500246 - DNA, 20 bp, mouse
gtgctgagggcggctgtagt

SEQ ID NO: 500247 - DNA, 20 bp, mouse
ggtagttgaggtgctgaggg

SEQ ID NO: 500248 - DNA, 20 bp, mouse
gccggtagttgaggtgctga

SEQ ID NO: 500249 - DNA, 20 bp, mouse
gcccatgtgcgacctcgggt

SEQ ID NO: 500250 - DNA, 20 bp, mouse
gagtgttcgagcatccactt

SEQ ID NO: 500251 - DNA, 20 bp, mouse
gcagaaaccgggaacaagga

SEQ ID NO: 500252 - DNA, 20 bp, mouse
ggccaagcccgtcctacccg

SEQ ID NO: 500253 - DNA, 20 bp, mouse
ggtgcgacctcgggtaggac

SEQ ID NO: 500254 - DNA, 20 bp, mouse
gaggtcagaaaccgggaaca

SEQ ID NO: 500255 - DNA, 20 bp, mouse
gtggctgaagccggtagttg

SEQ ID NO: 500256 - DNA, 20 bp, mouse
gggctgcgggcgctgaggta

SEQ ID NO: 500257 - DNA, 20 bp, mouse
ggctgaggtagggactgcgg

SEQ ID NO: 500258 - DNA, 20 bp, mouse
gagcgggaaggattccgggt

SEQ ID NO: 500259 - DNA, 20 bp, mouse
gctgcggcggcgggcgaagg

SEQ ID NO: 500260 - DNA, 20 bp, mouse
gggcgagcccctcctctcgg

SEQ ID NO: 500261 - DNA, 20 bp, mouse
gtagccgccgcaccaggaag

SEQ ID NO: 500262 - DNA, 20 bp, mouse
gagggggacgagtcccgcgt

SEQ ID NO: 500263 - DNA, 20 bp, mouse
gcgcctcccagcctccgcct

SEQ ID NO: 500264 - DNA, 20 bp, mouse
gcgccgcaccaggaagtgga

SEQ ID NO: 500265 - DNA, 20 bp, mouse
ggttgtggccaagaagcggt

SEQ ID NO: 500266 - DNA, 20 bp, mouse
gcttaagtctcggagaatgc

SEQ ID NO: 500267 - DNA, 20 bp, mouse
gaagagagcaggggtctgta

SEQ ID NO: 500268 - DNA, 20 bp, mouse
gaacgcatgcgcagagagtt

SEQ ID NO: 500269 - DNA, 20 bp, mouse
ggggtctgtaaggcgaggag

SEQ ID NO: 500270 - DNA, 20 bp, mouse
ggcttgagcaacggccatgg

SEQ ID NO: 500271 - DNA, 20 bp, mouse
gtctccgagacttaaggatt

SEQ ID NO: 500272 - DNA, 20 bp, mouse
ggtccctcggctccaggaaa

SEQ ID NO: 500273 - DNA, 20 bp, mouse
gtgatctagagtagttacag

SEQ ID NO: 500274 - DNA, 20 bp, mouse
gggctgcgctcttctcggtg

SEQ ID NO: 500275 - DNA, 20 bp, mouse
ggctctagtgagtatgaatg

SEQ ID NO: 500276 - DNA, 20 bp, mouse
gacagtccagagccggccaa

SEQ ID NO: 500277 - DNA, 20 bp, mouse
gccggcgtcgcacacagccc

SEQ ID NO: 500278 - DNA, 20 bp, mouse
gcagtggtcccggcgctgaa

SEQ ID NO: 500279 - DNA, 20 bp, mouse
ggagagcgacagtccagagc

SEQ ID NO: 500280 - DNA, 20 bp, mouse
gcgggcgccaaacagaacac

SEQ ID NO: 500281 - DNA, 20 bp, mouse
gggcgcagttcttcattcgg

SEQ ID NO: 500282 - DNA, 20 bp, mouse
gcgcggtctacttactccct

SEQ ID NO: 500283 - DNA, 20 bp, mouse
ggcagtgcgcgcacaagcag

SEQ ID NO: 500284 - DNA, 20 bp, mouse
ggtgcgacgccggcttttcg

SEQ ID NO: 500285 - DNA, 20 bp, mouse
ggacccggtggtccccgagt

SEQ ID NO: 500286 - DNA, 20 bp, mouse
ggaccccccggcaacagagg

SEQ ID NO: 500287 - DNA, 20 bp, mouse
gcgagaccccccggcaacag

SEQ ID NO: 500288 - DNA, 20 bp, mouse
gcgatggaggcgagaccccc

SEQ ID NO: 500289 - DNA, 20 bp, mouse
gccctcgcagccagcgatgg

SEQ ID NO: 500290 - DNA, 20 bp, mouse
ggcgccctcgcagccagcga

SEQ ID NO: 500291 - DNA, 20 bp, mouse
gcacagccgctgcacggagg

SEQ ID NO: 500292 - DNA, 20 bp, mouse
gctggctgcgagggcgctga

SEQ ID NO: 500293 - DNA, 20 bp, mouse
gtctcacagccgctgcacgg

SEQ ID NO: 500294 - DNA, 20 bp, mouse
gccaccgcctctgttgccgg

SEQ ID NO: 500295 - DNA, 20 bp, mouse
gagggtctgacaggccccgg

SEQ ID NO: 500296 - DNA, 20 bp, mouse
gtcgtctcgtcgaggctggt

SEQ ID NO: 500297 - DNA, 20 bp, mouse
ggtctacgcgaggagacctg

SEQ ID NO: 500298 - DNA, 20 bp, mouse
gttcgggccacacagactca

SEQ ID NO: 500299 - DNA, 20 bp, mouse
gggtgagggtcgtctcgtcg

SEQ ID NO: 500300 - DNA, 20 bp, mouse
gaggctggtgggtctacgcg

SEQ ID NO: 500301 - DNA, 20 bp, mouse
gcgaccctcaccggaagtac

SEQ ID NO: 500302 - DNA, 20 bp, mouse
gttcagagagggacagctcg

SEQ ID NO: 500303 - DNA, 20 bp, mouse
gggggtcctgaggctgtgga

SEQ ID NO: 500304 - DNA, 20 bp, mouse
gctgccggtacttccggtga

SEQ ID NO: 500305 - DNA, 20 bp, mouse
gtgtccctctctgaacacgg

SEQ ID NO: 500306 - DNA, 20 bp, mouse
gcggaggcgtagggaagcaa

SEQ ID NO: 500307 - DNA, 20 bp, mouse
gtggccgctgacggtgaggg

SEQ ID NO: 500308 - DNA, 20 bp, mouse
gcgtgggcggcgcttcacgg

SEQ ID NO: 500309 - DNA, 20 bp, mouse
gcaatggccgctgacggtga

SEQ ID NO: 500310 - DNA, 20 bp, mouse
ggggaagcaatggccgctga

SEQ ID NO: 500311 - DNA, 20 bp, mouse
gatgccaccctcaccgtcag

SEQ ID NO: 500312 - DNA, 20 bp, mouse
ggcccgtgggcggcgcttca

SEQ ID NO: 500313 - DNA, 20 bp, mouse
gggcgcttcacggaggcgta

SEQ ID NO: 500314 - DNA, 20 bp, mouse
gcgagtgcgccttggcccgt

SEQ ID NO: 500315 - DNA, 20 bp, mouse
gggtggcatggatcgaaacg

SEQ ID NO: 500316 - DNA, 20 bp, mouse
gaaaggatgagaattctaaa

SEQ ID NO: 500317 - DNA, 20 bp, mouse
gcacgaagaacttcacagac

SEQ ID NO: 500318 - DNA, 20 bp, mouse
ggatgagaattctaaaaggt

SEQ ID NO: 500319 - DNA, 20 bp, mouse
gcggagtgaaaggaaagtcg

SEQ ID NO: 500320 - DNA, 20 bp, mouse
gggaaagtcggggagatgtg

SEQ ID NO: 500321 - DNA, 20 bp, mouse
gctttggactgcttattgac

SEQ ID NO: 500322 - DNA, 20 bp, mouse
ggtgaggagctcagaggcgt

SEQ ID NO: 500323 - DNA, 20 bp, mouse
gggtctcagtgagaggggta

SEQ ID NO: 500324 - DNA, 20 bp, mouse
ggagcgagaagcggagtgaa

SEQ ID NO: 500325 - DNA, 20 bp, mouse
gggcgtgggtctcagtgaga

SEQ ID NO: 500326 - DNA, 20 bp, mouse
gcctctgcgcgcctagaaaa

SEQ ID NO: 500327 - DNA, 20 bp, mouse
gtgcgcgcctagaaaaaggt

SEQ ID NO: 500328 - DNA, 20 bp, mouse
gctgcctcggagataaggcg

SEQ ID NO: 500329 - DNA, 20 bp, mouse
gagtgtctacacgcaggcat

SEQ ID NO: 500330 - DNA, 20 bp, mouse
gctcggctgcctcggagata

SEQ ID NO: 500331 - DNA, 20 bp, mouse
gccgcgcggacccacaacac

SEQ ID NO: 500332 - DNA, 20 bp, mouse
gcggcgcaggcgcagtgagt

SEQ ID NO: 500333 - DNA, 20 bp, mouse
gcttccccgccttatctccg

SEQ ID NO: 500334 - DNA, 20 bp, mouse
gtcgcaggcgcgatgacgta

SEQ ID NO: 500335 - DNA, 20 bp, mouse
ggcctgcgtgtagacactgg

SEQ ID NO: 500336 - DNA, 20 bp, mouse
gcgaagcccagggataaccg

SEQ ID NO: 500337 - DNA, 20 bp, mouse
ggcctgccgcggttatccct

SEQ ID NO: 500338 - DNA, 20 bp, mouse
ggtgcacacactcccgacgg

SEQ ID NO: 500339 - DNA, 20 bp, mouse
gaagcgagtgtaggccggag

SEQ ID NO: 500340 - DNA, 20 bp, mouse
gggaacagggacgaagccca

SEQ ID NO: 500341 - DNA, 20 bp, mouse
gctcggcgagctggcgaacg

SEQ ID NO: 500342 - DNA, 20 bp, mouse
ggcggacagcaagcgagtgt

SEQ ID NO: 500343 - DNA, 20 bp, mouse
gcagctcgccgaggcccctc

SEQ ID NO: 500344 - DNA, 20 bp, mouse
ggagcacggccgagacgcac

SEQ ID NO: 500345 - DNA, 20 bp, mouse
gagcgcgtgcagggaagcgg

SEQ ID NO: 500346 - DNA, 20 bp, mouse
gccacctccagggaattcga

SEQ ID NO: 500347 - DNA, 20 bp, mouse
ggagggaaggagggcggacg

SEQ ID NO: 500348 - DNA, 20 bp, mouse
gtcaccctcgaattccctgg

SEQ ID NO: 500349 - DNA, 20 bp, mouse
ggggaattcgagggtgagag

SEQ ID NO: 500350 - DNA, 20 bp, mouse
gggacaggatcagtagaggg

SEQ ID NO: 500351 - DNA, 20 bp, mouse
gagcaggcctggatacagtt

SEQ ID NO: 500352 - DNA, 20 bp, mouse
gattccagcaggtatccgga

SEQ ID NO: 500353 - DNA, 20 bp, mouse
gtccgaacactgccccagag

SEQ ID NO: 500354 - DNA, 20 bp, mouse
gagcttgagcgttggaggac

SEQ ID NO: 500355 - DNA, 20 bp, mouse
ggttgggcgaatgaggtcag

SEQ ID NO: 500356 - DNA, 20 bp, mouse
gaagtggccgtccccaccgg

SEQ ID NO: 500357 - DNA, 20 bp, mouse
gccggaagcggaagttgtga

SEQ ID NO: 500358 - DNA, 20 bp, mouse
gcgcgtggccgaagcacccc

SEQ ID NO: 500359 - DNA, 20 bp, mouse
gcggcgggatacgcacctga

SEQ ID NO: 500360 - DNA, 20 bp, mouse
gggaagccgaccttccttcc

SEQ ID NO: 500361 - DNA, 20 bp, mouse
gggccgaagcacccccggtg

SEQ ID NO: 500362 - DNA, 20 bp, mouse
ggaagttgtgagggaagcgg

SEQ ID NO: 500363 - DNA, 20 bp, mouse
gcttccgggagtccccgccg

SEQ ID NO: 500364 - DNA, 20 bp, mouse
gcggaagtggccgtccccac

SEQ ID NO: 500365 - DNA, 20 bp, mouse
gtcgggccgtgaagagtggg

SEQ ID NO: 500366 - DNA, 20 bp, mouse
gaacgcgggacgcaagccac

SEQ ID NO: 500367 - DNA, 20 bp, mouse
ggtgccgtccccgggaacgc

SEQ ID NO: 500368 - DNA, 20 bp, mouse
gcaaagtctccgggcgccag

SEQ ID NO: 500369 - DNA, 20 bp, mouse
gtcgggcccgggctgacgcg

SEQ ID NO: 500370 - DNA, 20 bp, mouse
ggagccgcgggtgtcagtcg

SEQ ID NO: 500371 - DNA, 20 bp, mouse
ggctccagggcgacacgatc

SEQ ID NO: 500372 - DNA, 20 bp, mouse
gactgacacccgcggctcca

SEQ ID NO: 500373 - DNA, 20 bp, mouse
gcgtcccgcgttcccgggga

SEQ ID NO: 500374 - DNA, 20 bp, mouse
ggcagccacgtgccgtcccc

SEQ ID NO: 500375 - DNA, 20 bp, mouse
gcccggaagttcaaagtctc

SEQ ID NO: 500376 - DNA, 20 bp, mouse
gaggccgtcgagcccctcca

SEQ ID NO: 500377 - DNA, 20 bp, mouse
gcgggcgctgctaactgaag

SEQ ID NO: 500378 - DNA, 20 bp, mouse
ggacgcgctcgagtcgttgt

SEQ ID NO: 500379 - DNA, 20 bp, mouse
gtggccctggaggggctcga

SEQ ID NO: 500380 - DNA, 20 bp, mouse
gaacgactcgagcgcgtcca

SEQ ID NO: 500381 - DNA, 20 bp, mouse
gaggcgagcgggattccagg

SEQ ID NO: 500382 - DNA, 20 bp, mouse
gccacagcgcgggcaggcac

SEQ ID NO: 500383 - DNA, 20 bp, mouse
gaagaccggtcagccaccag

SEQ ID NO: 500384 - DNA, 20 bp, mouse
ggcaggtcaggtctctctcg

SEQ ID NO: 500385 - DNA, 20 bp, mouse
gctcgagtcgttgttggacg

SEQ ID NO: 500386 - DNA, 20 bp, mouse
ggaccggctggcagagatgg

SEQ ID NO: 500387 - DNA, 20 bp, mouse
ggctacggcaaaagaatggg

SEQ ID NO: 500388 - DNA, 20 bp, mouse
gagcgctacggcaaaagaat

SEQ ID NO: 500389 - DNA, 20 bp, mouse
gtcccccgcacaccccgttg

SEQ ID NO: 500390 - DNA, 20 bp, mouse
gtcgaacttggacttccgga

SEQ ID NO: 500391 - DNA, 20 bp, mouse
ggcgggtgagtgtaccgcaa

SEQ ID NO: 500392 - DNA, 20 bp, mouse
gtggacttccggaaggactt

SEQ ID NO: 500393 - DNA, 20 bp, mouse
gaaaaccgcgacccgacagg

SEQ ID NO: 500394 - DNA, 20 bp, mouse
gtccggaaggactttggcgc

SEQ ID NO: 500395 - DNA, 20 bp, mouse
gggaagtccaagttcgaaga

SEQ ID NO: 500396 - DNA, 20 bp, mouse
gcggccctgcagacatgtcg

SEQ ID NO: 500397 - DNA, 20 bp, mouse
gtaggcgtcctacagagcct

SEQ ID NO: 500398 - DNA, 20 bp, mouse
gcagggccgacgctgcgcag

SEQ ID NO: 500399 - DNA, 20 bp, mouse
ggggaagctgcagcactccc

SEQ ID NO: 500400 - DNA, 20 bp, mouse
gaggctctgagtactcgggt

SEQ ID NO: 500401 - DNA, 20 bp, mouse
ggaaccccgacatgtctgca

SEQ ID NO: 500402 - DNA, 20 bp, mouse
gcgctggtccggtctctcct

SEQ ID NO: 500403 - DNA, 20 bp, mouse
gccctgggcaacccacgact

SEQ ID NO: 500404 - DNA, 20 bp, mouse
ggacatgtcggggttcagcc

SEQ ID NO: 500405 - DNA, 20 bp, mouse
gctggcccgctgcgcagcgt

SEQ ID NO: 500406 - DNA, 20 bp, mouse
gtactaggagcgaggaggtc

SEQ ID NO: 500407 - DNA, 20 bp, mouse
gagggcgctgggagaggccg

SEQ ID NO: 500408 - DNA, 20 bp, mouse
gagcgaggaggtcgggttac

SEQ ID NO: 500409 - DNA, 20 bp, mouse
gcatcttactaggagcgagg

SEQ ID NO: 500410 - DNA, 20 bp, mouse
gcgggagagtgagcctccgt

SEQ ID NO: 500411 - DNA, 20 bp, mouse
gggtcctcagaccaggagag

SEQ ID NO: 500412 - DNA, 20 bp, mouse
gctcccgccgagtcaccatg

SEQ ID NO: 500413 - DNA, 20 bp, mouse
gtggaaagtgcgctccggta

SEQ ID NO: 500414 - DNA, 20 bp, mouse
ggggagtgaacgggcgcgga

SEQ ID NO: 500415 - DNA, 20 bp, mouse
ggacgcgccacggatcccaa

SEQ ID NO: 500416 - DNA, 20 bp, mouse
ggggctggaaccagactagt

SEQ ID NO: 500417 - DNA, 20 bp, mouse
gaccagactagtaggcatgg

SEQ ID NO: 500418 - DNA, 20 bp, mouse
gcgccgcaggtccacaggga

SEQ ID NO: 500419 - DNA, 20 bp, mouse
gagactagtaggcatggcgg

SEQ ID NO: 500420 - DNA, 20 bp, mouse
gttcccgccgcaggtccaca

SEQ ID NO: 500421 - DNA, 20 bp, mouse
gctagtaggcatggcggcgg

SEQ ID NO: 500422 - DNA, 20 bp, mouse
ggagccggatgcggacccga

SEQ ID NO: 500423 - DNA, 20 bp, mouse
gtgctctcggcagaaaaccg

SEQ ID NO: 500424 - DNA, 20 bp, mouse
gccgaaggccgccatccctg

SEQ ID NO: 500425 - DNA, 20 bp, mouse
gaatgggcgggaccaccggg

SEQ ID NO: 500426 - DNA, 20 bp, mouse
gatggcgtctccgaacgcta

SEQ ID NO: 500427 - DNA, 20 bp, mouse
ggcgtctccgaacgctatgg

SEQ ID NO: 500428 - DNA, 20 bp, mouse
gtctccgaacgctatggcgg

SEQ ID NO: 500429 - DNA, 20 bp, mouse
ggcggcagtggatcccattt

SEQ ID NO: 500430 - DNA, 20 bp, mouse
gcgttcggagacgccatcac

SEQ ID NO: 500431 - DNA, 20 bp, mouse
ggcagtggatcccatttggg

SEQ ID NO: 500432 - DNA, 20 bp, mouse
gaagcccgagaagccgtgga

SEQ ID NO: 500433 - DNA, 20 bp, mouse
gctgccgccgccatagcgtt

SEQ ID NO: 500434 - DNA, 20 bp, mouse
gcctccaagtcctcccaaat

SEQ ID NO: 500435 - DNA, 20 bp, mouse
gtagccctccacggcttctc

SEQ ID NO: 500436 - DNA, 20 bp, mouse
gtcctctccggcaggctcgg

SEQ ID NO: 500437 - DNA, 20 bp, mouse
gcggcgctccgcctcctctc

SEQ ID NO: 500438 - DNA, 20 bp, mouse
ggcgcgggcggcagttgctg

SEQ ID NO: 500439 - DNA, 20 bp, mouse
gaagcgtgcggagggatccg

SEQ ID NO: 500440 - DNA, 20 bp, mouse
ggccgccgagcctgccggag

SEQ ID NO: 500441 - DNA, 20 bp, mouse
ggtcccggtcagtagaatgg

SEQ ID NO: 500442 - DNA, 20 bp, mouse
gggtggctcggtgctcaccg

SEQ ID NO: 500443 - DNA, 20 bp, mouse
ggacgcagatccgtaagcct

SEQ ID NO: 500444 - DNA, 20 bp, mouse
gggtagccactccatcacgt

SEQ ID NO: 500445 - DNA, 20 bp, mouse
gtaggcccgggattggagat

SEQ ID NO: 500446 - DNA, 20 bp, mouse
gcccggagagctaggctcgg

SEQ ID NO: 500447 - DNA, 20 bp, mouse
gcgaacatcgaggccggcac

SEQ ID NO: 500448 - DNA, 20 bp, mouse
gggcaccggcgagtcgaccg

SEQ ID NO: 500449 - DNA, 20 bp, mouse
gcttaagttcttaaagatgg

SEQ ID NO: 500450 - DNA, 20 bp, mouse
gggctcgggggcgaacatcg

SEQ ID NO: 500451 - DNA, 20 bp, mouse
gccagcaaggtaggcccggg

SEQ ID NO: 500452 - DNA, 20 bp, mouse
gaggacggcgaggcgctcaa

SEQ ID NO: 500453 - DNA, 20 bp, mouse
gcttaaagatggcggcggag

SEQ ID NO: 500454 - DNA, 20 bp, mouse
gcgggggcgaacatcgaggc

SEQ ID NO: 500455 - DNA, 20 bp, mouse
ggctgtgttggccccactag

SEQ ID NO: 500456 - DNA, 20 bp, mouse
ggactcccgcccgcagaatc

SEQ ID NO: 500457 - DNA, 20 bp, mouse
ggcagaatccggacaaactt

SEQ ID NO: 500458 - DNA, 20 bp, mouse
gacgtcactactggtcgcag

SEQ ID NO: 500459 - DNA, 20 bp, mouse
gatccggacaaacttcggtc

SEQ ID NO: 500460 - DNA, 20 bp, mouse
gtcccaggagacgggaaccg

SEQ ID NO: 500461 - DNA, 20 bp, mouse
gcgcccgaccgaagtttgtc

SEQ ID NO: 500462 - DNA, 20 bp, mouse
gcgcagaggtgacgtctcag

SEQ ID NO: 500463 - DNA, 20 bp, mouse
gcgaggaacgacaacccagg

SEQ ID NO: 500464 - DNA, 20 bp, mouse
gggcgaagacaccaaagctg

SEQ ID NO: 500465 - DNA, 20 bp, mouse
gtcctcggttcccgtctcct

SEQ ID NO: 500466 - DNA, 20 bp, mouse
ggactcggcggtggcagtag

SEQ ID NO: 500467 - DNA, 20 bp, mouse
gtcggcggtggcagtagggg

SEQ ID NO: 500468 - DNA, 20 bp, mouse
gtccggctggcccgactcgg

SEQ ID NO: 500469 - DNA, 20 bp, mouse
ggccacaccccgctctcctc

SEQ ID NO: 500470 - DNA, 20 bp, mouse
gcagttgcgggggcccaaag

SEQ ID NO: 500471 - DNA, 20 bp, mouse
gggctggcccgactcggcgg

SEQ ID NO: 500472 - DNA, 20 bp, mouse
gtcctccggctggcccgact

SEQ ID NO: 500473 - DNA, 20 bp, mouse
gggccagccggaggagagcg

SEQ ID NO: 500474 - DNA, 20 bp, mouse
gggtccccgagactccaagg

SEQ ID NO: 500475 - DNA, 20 bp, mouse
gcggtgtcaagacccaaggg

SEQ ID NO: 500476 - DNA, 20 bp, mouse
gcacgccgcctgggtcacca

SEQ ID NO: 500477 - DNA, 20 bp, mouse
gtgaagccctgcgggagtgt

SEQ ID NO: 500478 - DNA, 20 bp, mouse
gcctgcgggagtgtcggcca

SEQ ID NO: 500479 - DNA, 20 bp, mouse
ggctaagtcacaccgcaaag

SEQ ID NO: 500480 - DNA, 20 bp, mouse
gcccgcagggcttcaagttc

SEQ ID NO: 500481 - DNA, 20 bp, mouse
gagctgcgggaggaggaacg

SEQ ID NO: 500482 - DNA, 20 bp, mouse
gtcccgaacttgaagccctg

SEQ ID NO: 500483 - DNA, 20 bp, mouse
gcgagcggtggccaggcgat

SEQ ID NO: 500484 - DNA, 20 bp, mouse
gtccgtgccactcacctgag

SEQ ID NO: 500485 - DNA, 20 bp, mouse
ggcccaagctgtacgagcgg

SEQ ID NO: 500486 - DNA, 20 bp, mouse
ggaggaaccaggagaagcgg

SEQ ID NO: 500487 - DNA, 20 bp, mouse
gacctctgtcacccctacct

SEQ ID NO: 500488 - DNA, 20 bp, mouse
gaccaggagaagcggaggac

SEQ ID NO: 500489 - DNA, 20 bp, mouse
gaacttcaagaagattacgg

SEQ ID NO: 500490 - DNA, 20 bp, mouse
ggtgccgtctgccaaggtag

SEQ ID NO: 500491 - DNA, 20 bp, mouse
gtacaacttcaagaagatta

SEQ ID NO: 500492 - DNA, 20 bp, mouse
gttgtaatgcgccatgccgg

SEQ ID NO: 500493 - DNA, 20 bp, mouse
gccacagtaaggagcagggt

SEQ ID NO: 500494 - DNA, 20 bp, mouse
gtaatgcgccatgccggcgg

SEQ ID NO: 500495 - DNA, 20 bp, mouse
gagtccctcggccctcagtg

SEQ ID NO: 500496 - DNA, 20 bp, mouse
gcagaaccccgggagcacgg

SEQ ID NO: 500497 - DNA, 20 bp, mouse
gcacgcgggagccagaaccc

SEQ ID NO: 500498 - DNA, 20 bp, mouse
gagccagaaccccgggagca

SEQ ID NO: 500499 - DNA, 20 bp, mouse
ggctccgaacgagttgtacg

SEQ ID NO: 500500 - DNA, 20 bp, mouse
gttgtacgcggcgcacacgc

SEQ ID NO: 500501 - DNA, 20 bp, mouse
ggacccccgtgaggacgaag

SEQ ID NO: 500502 - DNA, 20 bp, mouse
ggtgtatccaagggcaggag

SEQ ID NO: 500503 - DNA, 20 bp, mouse
gacttggcagggtcaccgcg

SEQ ID NO: 500504 - DNA, 20 bp, mouse
ggcggcgcgcagaaaaagca

SEQ ID NO: 500505 - DNA, 20 bp, mouse
gtgcgcgccgccgtgctccc

SEQ ID NO: 500506 - DNA, 20 bp, mouse
gctaggttgagtcatagaat

SEQ ID NO: 500507 - DNA, 20 bp, mouse
gcagtgctggcgctttctca

SEQ ID NO: 500508 - DNA, 20 bp, mouse
gatccagtcgcgaggattct

SEQ ID NO: 500509 - DNA, 20 bp, mouse
ggaggaaaatggcagcggct

SEQ ID NO: 500510 - DNA, 20 bp, mouse
gagcacttctgcgaaggcag

SEQ ID NO: 500511 - DNA, 20 bp, mouse
ggtacccgctgcgggaactg

SEQ ID NO: 500512 - DNA, 20 bp, mouse
gaggccaggccccgagtccg

SEQ ID NO: 500513 - DNA, 20 bp, mouse
gggagctgaggtactcgatg

SEQ ID NO: 500514 - DNA, 20 bp, mouse
gagcctggaggacatcgggc

SEQ ID NO: 500515 - DNA, 20 bp, mouse
gcccgagcctggaggacatc

SEQ ID NO: 500516 - DNA, 20 bp, mouse
gccctcgcctctgaccggga

SEQ ID NO: 500517 - DNA, 20 bp, mouse
gcggtcagaggcgaggggta

SEQ ID NO: 500518 - DNA, 20 bp, mouse
gggagaattaggcaagtcag

SEQ ID NO: 500519 - DNA, 20 bp, mouse
gtaaaatccagctgggtctc

SEQ ID NO: 500520 - DNA, 20 bp, mouse
gtttatgccttcccggtcag

SEQ ID NO: 500521 - DNA, 20 bp, mouse
ggcgcacagtctgggaaacc

SEQ ID NO: 500522 - DNA, 20 bp, mouse
gtccggcaccggtttaaacg

SEQ ID NO: 500523 - DNA, 20 bp, mouse
ggcaaggggacgggagaatt

SEQ ID NO: 500524 - DNA, 20 bp, mouse
gccgggcgccgcgtttaaac

SEQ ID NO: 500525 - DNA, 20 bp, mouse
ggcgctggtcccggagagtg

SEQ ID NO: 500526 - DNA, 20 bp, mouse
gggctgtgaggcgaagtcgg

SEQ ID NO: 500527 - DNA, 20 bp, mouse
gtgaggcgaagtcggcggtg

SEQ ID NO: 500528 - DNA, 20 bp, mouse
gagagcttctggactgaggt

SEQ ID NO: 500529 - DNA, 20 bp, mouse
gctgcatgaacggcttacaa

SEQ ID NO: 500530 - DNA, 20 bp, mouse
gcctggctgtgaggcgaagt

SEQ ID NO: 500531 - DNA, 20 bp, mouse
gcggcggtggggagagcttc

SEQ ID NO: 500532 - DNA, 20 bp, mouse
gtcgcctcacagccaggccc

SEQ ID NO: 500533 - DNA, 20 bp, mouse
gctggcatcaggccggaagt

SEQ ID NO: 500534 - DNA, 20 bp, mouse
gttgccggggcctggctgtg

SEQ ID NO: 500535 - DNA, 20 bp, mouse
gccggaagtgggcgttgccg

SEQ ID NO: 500536 - DNA, 20 bp, mouse
gccaccagagacgttaactc

SEQ ID NO: 500537 - DNA, 20 bp, mouse
ggaaacagtagcttccaagg

SEQ ID NO: 500538 - DNA, 20 bp, mouse
gctgcctgagttaacgtctc

SEQ ID NO: 500539 - DNA, 20 bp, mouse
gctttctgatgggaaccacg

SEQ ID NO: 500540 - DNA, 20 bp, mouse
gcttcaagtcaactcccgga

SEQ ID NO: 500541 - DNA, 20 bp, mouse
ggtacgtggtacacctcgaa

SEQ ID NO: 500542 - DNA, 20 bp, mouse
gccaaggaggtgaagttagc

SEQ ID NO: 500543 - DNA, 20 bp, mouse
gctggttctgcggctgtggg

SEQ ID NO: 500544 - DNA, 20 bp, mouse
gttggcttcaagtcaactcc

SEQ ID NO: 500545 - DNA, 20 bp, mouse
ggtctctggtggctgttttc

SEQ ID NO: 500546 - DNA, 20 bp, mouse
ggccagagtagcctaggggt

SEQ ID NO: 500547 - DNA, 20 bp, mouse
gaatgtcccctgcacaaggg

SEQ ID NO: 500548 - DNA, 20 bp, mouse
gcagcaccgagtgccatcag

SEQ ID NO: 500549 - DNA, 20 bp, mouse
gttgtttaggctggtgatag

SEQ ID NO: 500550 - DNA, 20 bp, mouse
ggagggtgagctggccagat

SEQ ID NO: 500551 - DNA, 20 bp, mouse
gcaaagacagccctgtgagt

SEQ ID NO: 500552 - DNA, 20 bp, mouse
ggaactggcggaattcgtag

SEQ ID NO: 500553 - DNA, 20 bp, mouse
gatcatggagggcaagtccg

SEQ ID NO: 500554 - DNA, 20 bp, mouse
gctgtgagtcggactaaaaa

SEQ ID NO: 500555 - DNA, 20 bp, mouse
gcccctgcacaagggtggct

SEQ ID NO: 500556 - DNA, 20 bp, mouse
gaggtcagcggaggacttgg

SEQ ID NO: 500557 - DNA, 20 bp, mouse
gctaaggtcagcggaggact

SEQ ID NO: 500558 - DNA, 20 bp, mouse
gaggagcctaaggtcagcgg

SEQ ID NO: 500559 - DNA, 20 bp, mouse
gccaaggagagaggagccta

SEQ ID NO: 500560 - DNA, 20 bp, mouse
gctgctcagaccaaggagag

SEQ ID NO: 500561 - DNA, 20 bp, mouse
gaaggtcacgggcaatgagg

SEQ ID NO: 500562 - DNA, 20 bp, mouse
gaggacttggaggaggtagc

SEQ ID NO: 500563 - DNA, 20 bp, mouse
gtgtcgtggagtgtcccagt

SEQ ID NO: 500564 - DNA, 20 bp, mouse
gttggaggaggtagcgggcc

SEQ ID NO: 500565 - DNA, 20 bp, mouse
ggtagtctcactgaacgggt

SEQ ID NO: 500566 - DNA, 20 bp, mouse
gcaggacagccaaggcaccc

SEQ ID NO: 500567 - DNA, 20 bp, mouse
ggtgcctggggtaaacagtg

SEQ ID NO: 500568 - DNA, 20 bp, mouse
gagtatgcaatgcagagaac

SEQ ID NO: 500569 - DNA, 20 bp, mouse
gttaccccaggcactagtac

SEQ ID NO: 500570 - DNA, 20 bp, mouse
gcacagtgaccccttctacc

SEQ ID NO: 500571 - DNA, 20 bp, mouse
gctggctggcaggtctcggg

SEQ ID NO: 500572 - DNA, 20 bp, mouse
gaggccagtactagtgcctg

SEQ ID NO: 500573 - DNA, 20 bp, mouse
gtggctggctggcaggtctc

SEQ ID NO: 500574 - DNA, 20 bp, mouse
ggatggggctagactaagta

SEQ ID NO: 500575 - DNA, 20 bp, mouse
gaagccccactgtttacccc

SEQ ID NO: 500576 - DNA, 20 bp, mouse
gaggagcagcagcaggacga

SEQ ID NO: 500577 - DNA, 20 bp, mouse
gactgcaggcgtgtcaacag

SEQ ID NO: 500578 - DNA, 20 bp, mouse
gatgtcaagaagccaactgt

SEQ ID NO: 500579 - DNA, 20 bp, mouse
gcttccaagctcacacctct

SEQ ID NO: 500580 - DNA, 20 bp, mouse
ggccagtctagacacctgtt

SEQ ID NO: 500581 - DNA, 20 bp, mouse
gagtgtggaaggaaccctag

SEQ ID NO: 500582 - DNA, 20 bp, mouse
ggagccacagagttccctct

SEQ ID NO: 500583 - DNA, 20 bp, mouse
ggcctgggtgaacatgttct

SEQ ID NO: 500584 - DNA, 20 bp, mouse
ggaacccagaggtgtgagct

SEQ ID NO: 500585 - DNA, 20 bp, mouse
gggtcctccaggtaaaaggt

SEQ ID NO: 500586 - DNA, 20 bp, mouse
gcctacccggctctgaaccg

SEQ ID NO: 500587 - DNA, 20 bp, mouse
gacccggctctgaaccgcgg

SEQ ID NO: 500588 - DNA, 20 bp, mouse
gaaggcaaggccctgaagag

SEQ ID NO: 500589 - DNA, 20 bp, mouse
gtgcagcggcgacttctgct

SEQ ID NO: 500590 - DNA, 20 bp, mouse
gcggctctgaaccgcggtgg

SEQ ID NO: 500591 - DNA, 20 bp, mouse
gaccctgcccggctctaggg

SEQ ID NO: 500592 - DNA, 20 bp, mouse
gcagaccctgcccggctcta

SEQ ID NO: 500593 - DNA, 20 bp, mouse
gatccgggtcatgaggacgg

SEQ ID NO: 500594 - DNA, 20 bp, mouse
gtgaggccgcagacgaccca

SEQ ID NO: 500595 - DNA, 20 bp, mouse
gcccagcctggagcttctag

SEQ ID NO: 500596 - DNA, 20 bp, mouse
gctctacaggcgcagcctca

SEQ ID NO: 500597 - DNA, 20 bp, mouse
gtgcggagctgagggaatca

SEQ ID NO: 500598 - DNA, 20 bp, mouse
gcagcgagagcggtgcgcac

SEQ ID NO: 500599 - DNA, 20 bp, mouse
gtgcgcacaggcgggccctg

SEQ ID NO: 500600 - DNA, 20 bp, mouse
gaccagcccggaggaggaag

SEQ ID NO: 500601 - DNA, 20 bp, mouse
gcgatctagacgcaaggcgg

SEQ ID NO: 500602 - DNA, 20 bp, mouse
gcgagagcggtgcgcacagg

SEQ ID NO: 500603 - DNA, 20 bp, mouse
ggcccagacgcgagtccctg

SEQ ID NO: 500604 - DNA, 20 bp, mouse
gccctcgagacagctgctca

SEQ ID NO: 500605 - DNA, 20 bp, mouse
ggctgtctcgaggggctcag

SEQ ID NO: 500606 - DNA, 20 bp, mouse
gccagccggaccggacccca

SEQ ID NO: 500607 - DNA, 20 bp, mouse
gcggtccggctggcaggcac

SEQ ID NO: 500608 - DNA, 20 bp, mouse
ggcggtgtgtgagaaacccg

SEQ ID NO: 500609 - DNA, 20 bp, mouse
gttcgccttggggtccggtc

SEQ ID NO: 500610 - DNA, 20 bp, mouse
ggagcagcagtgcacagcct

SEQ ID NO: 500611 - DNA, 20 bp, mouse
gaggcacggtactgagacgt

SEQ ID NO: 500612 - DNA, 20 bp, mouse
gttctcacacaccgccttct

SEQ ID NO: 500613 - DNA, 20 bp, mouse
gtcccgagcgggttcaccca

SEQ ID NO: 500614 - DNA, 20 bp, mouse
gtcatggcagggaaaaacaa

SEQ ID NO: 500615 - DNA, 20 bp, mouse
ggaagaagtcctgtgcggca

SEQ ID NO: 500616 - DNA, 20 bp, mouse
gaggcagcttccctcagtcc

SEQ ID NO: 500617 - DNA, 20 bp, mouse
gtcactcttctggagtgaag

SEQ ID NO: 500618 - DNA, 20 bp, mouse
gctccagctatgctctggag

SEQ ID NO: 500619 - DNA, 20 bp, mouse
gtaccttcagaggtatgtct

SEQ ID NO: 500620 - DNA, 20 bp, mouse
gcgtggccaggtaccttcag

SEQ ID NO: 500621 - DNA, 20 bp, mouse
gaggcgagctgcagctgggt

SEQ ID NO: 500622 - DNA, 20 bp, mouse
gggagccagccagtgaagac

SEQ ID NO: 500623 - DNA, 20 bp, mouse
gagcctcggagggatactca

SEQ ID NO: 500624 - DNA, 20 bp, mouse
ggggttcccagaccacacga

SEQ ID NO: 500625 - DNA, 20 bp, mouse
gggcctctccagagcatagc

SEQ ID NO: 500626 - DNA, 20 bp, mouse
gcttccaggcaagagtaccg

SEQ ID NO: 500627 - DNA, 20 bp, mouse
gaggcaagagtaccgcggaa

SEQ ID NO: 500628 - DNA, 20 bp, mouse
gagccccagggcacacagag

SEQ ID NO: 500629 - DNA, 20 bp, mouse
ggctgtctgggtcccttccg

SEQ ID NO: 500630 - DNA, 20 bp, mouse
ggccgctgtagtcgctgtct

SEQ ID NO: 500631 - DNA, 20 bp, mouse
gtgtcaccgtggtgcaacag

SEQ ID NO: 500632 - DNA, 20 bp, mouse
ggtgctgtcaggatggtcag

SEQ ID NO: 500633 - DNA, 20 bp, mouse
gtccacgggcagggtggtgt

SEQ ID NO: 500634 - DNA, 20 bp, mouse
ggctccgggcgcggacacca

SEQ ID NO: 500635 - DNA, 20 bp, mouse
gatcctgacagcactcacca

SEQ ID NO: 500636 - DNA, 20 bp, mouse
gacggcccgtgtgaccagtg

SEQ ID NO: 500637 - DNA, 20 bp, mouse
ggcagccaggctgagtctca

SEQ ID NO: 500638 - DNA, 20 bp, mouse
gcttgccacactggtcacac

SEQ ID NO: 500639 - DNA, 20 bp, mouse
gcgtggggaagagaagacca

SEQ ID NO: 500640 - DNA, 20 bp, mouse
ggagacacagggagcccctc

SEQ ID NO: 500641 - DNA, 20 bp, mouse
gagtcgctagcagagtccct

SEQ ID NO: 500642 - DNA, 20 bp, mouse
gcaagaccagaaaggtgcgt

SEQ ID NO: 500643 - DNA, 20 bp, mouse
gtgctagcgactctccagag

SEQ ID NO: 500644 - DNA, 20 bp, mouse
gcgggccgtgagactcagcc

SEQ ID NO: 500645 - DNA, 20 bp, mouse
ggttctgggcctctcaggtg

SEQ ID NO: 500646 - DNA, 20 bp, mouse
ggaactggacagcaccacac

SEQ ID NO: 500647 - DNA, 20 bp, mouse
ggtctccacgggccctggca

SEQ ID NO: 500648 - DNA, 20 bp, mouse
gacctgaggaagggtatgta

SEQ ID NO: 500649 - DNA, 20 bp, mouse
gcagctgggtagctatgctg

SEQ ID NO: 500650 - DNA, 20 bp, mouse
gggagggcctgggcaaagat

SEQ ID NO: 500651 - DNA, 20 bp, mouse
gtcactttgaaggccagaac

SEQ ID NO: 500652 - DNA, 20 bp, mouse
gactgacagtgagtctccac

SEQ ID NO: 500653 - DNA, 20 bp, mouse
gagtgagtctccacgggccc

SEQ ID NO: 500654 - DNA, 20 bp, mouse
gtccatacatacccttcctc

SEQ ID NO: 500655 - DNA, 20 bp, mouse
ggcagaacccaggattaaca

SEQ ID NO: 500656 - DNA, 20 bp, mouse
ggctgccaggggagaccgaa

SEQ ID NO: 500657 - DNA, 20 bp, mouse
gatgccccttcggtctcccc

SEQ ID NO: 500658 - DNA, 20 bp, mouse
gggcttggctaaggggtcac

SEQ ID NO: 500659 - DNA, 20 bp, mouse
gcaagactgctgaagaggaa

SEQ ID NO: 500660 - DNA, 20 bp, mouse
gtggcttccaggaccctaga

SEQ ID NO: 500661 - DNA, 20 bp, mouse
gttacttaccggaaagtccg

SEQ ID NO: 500662 - DNA, 20 bp, mouse
gcacaggatcgatgcccctt

SEQ ID NO: 500663 - DNA, 20 bp, mouse
gttcccacaccccccgccct

SEQ ID NO: 500664 - DNA, 20 bp, mouse
gaaagtccggggctagggct

SEQ ID NO: 500665 - DNA, 20 bp, mouse
gaccggaaagtccggggcta

SEQ ID NO: 500666 - DNA, 20 bp, mouse
ggaaagagtaaataactgtg

SEQ ID NO: 500667 - DNA, 20 bp, mouse
ggtcaacagactggagtcct

SEQ ID NO: 500668 - DNA, 20 bp, mouse
gagtgtctgagctcacgagt

SEQ ID NO: 500669 - DNA, 20 bp, mouse
gggctgtcataatcctgcca

SEQ ID NO: 500670 - DNA, 20 bp, mouse
gacagactggagtccttggc

SEQ ID NO: 500671 - DNA, 20 bp, mouse
gccacaccaagacctggatt

SEQ ID NO: 500672 - DNA, 20 bp, mouse
ggggtggctagttcaagaca

SEQ ID NO: 500673 - DNA, 20 bp, mouse
gtgggaaagcttatgatggg

SEQ ID NO: 500674 - DNA, 20 bp, mouse
gtaaatcctaatccaggtct

SEQ ID NO: 500675 - DNA, 20 bp, mouse
gttatgggaaagcttatgat

SEQ ID NO: 500676 - DNA, 20 bp, mouse
gctgcatgtgactatctacc

SEQ ID NO: 500677 - DNA, 20 bp, mouse
ggctcgtcattactcctgca

SEQ ID NO: 500678 - DNA, 20 bp, mouse
gcaagcacggcagcacatgg

SEQ ID NO: 500679 - DNA, 20 bp, mouse
gacatggaggagctacaacc

SEQ ID NO: 500680 - DNA, 20 bp, mouse
gcaggaacagcaagccctgc

SEQ ID NO: 500681 - DNA, 20 bp, mouse
gagaccattcaggtagccat

SEQ ID NO: 500682 - DNA, 20 bp, mouse
gaggaggccacagaccattc

SEQ ID NO: 500683 - DNA, 20 bp, mouse
ggtgcggtggcatgaatctg

SEQ ID NO: 500684 - DNA, 20 bp, mouse
ggcatatgaaacagaactgg

SEQ ID NO: 500685 - DNA, 20 bp, mouse
gtggaggagctacaaccagg

SEQ ID NO: 500686 - DNA, 20 bp, mouse
gctcagggcccaacccgcca

SEQ ID NO: 500687 - DNA, 20 bp, mouse
ggagcgcccacatgcctcgg

SEQ ID NO: 500688 - DNA, 20 bp, mouse
gtcgcgtcaggcctgggtct

SEQ ID NO: 500689 - DNA, 20 bp, mouse
gagccgccgccgaggcatgt

SEQ ID NO: 500690 - DNA, 20 bp, mouse
ggcttcagcacatgcacggt

SEQ ID NO: 500691 - DNA, 20 bp, mouse
gcgcccacatgcctcggcgg

SEQ ID NO: 500692 - DNA, 20 bp, mouse
gtcaaggtgaccatcacccg

SEQ ID NO: 500693 - DNA, 20 bp, mouse
gcacgagcgcccacatgcct

SEQ ID NO: 500694 - DNA, 20 bp, mouse
gccacggagaccacaaagcc

SEQ ID NO: 500695 - DNA, 20 bp, mouse
ggacgcgtcgacgtcataag

SEQ ID NO: 500696 - DNA, 20 bp, mouse
gtccgcggggacccgaccca

SEQ ID NO: 500697 - DNA, 20 bp, mouse
ggcggggacccgacccaggg

SEQ ID NO: 500698 - DNA, 20 bp, mouse
gccaccgccagcccgaccag

SEQ ID NO: 500699 - DNA, 20 bp, mouse
gagcgggcgccgcagcatca

SEQ ID NO: 500700 - DNA, 20 bp, mouse
gaccccagaacgacagggat

SEQ ID NO: 500701 - DNA, 20 bp, mouse
ggtcccagccaccagcagat

SEQ ID NO: 500702 - DNA, 20 bp, mouse
gcagaggaagagcgcagact

SEQ ID NO: 500703 - DNA, 20 bp, mouse
gtcgggaccccagaacgaca

SEQ ID NO: 500704 - DNA, 20 bp, mouse
gccaggacgccggctgggta

SEQ ID NO: 500705 - DNA, 20 bp, mouse
gcggcgcccgctggtcgggc

SEQ ID NO: 500706 - DNA, 20 bp, mouse
gaggctgcaacacatcaagt

SEQ ID NO: 500707 - DNA, 20 bp, mouse
ggtaggtgggtgccatcctg

SEQ ID NO: 500708 - DNA, 20 bp, mouse
gtcttcccaggctaccatgg

SEQ ID NO: 500709 - DNA, 20 bp, mouse
ggactcttcccaggctacca

SEQ ID NO: 500710 - DNA, 20 bp, mouse
ggcagccattgactcttccc

SEQ ID NO: 500711 - DNA, 20 bp, mouse
ggtcccagatagcctgatgg

SEQ ID NO: 500712 - DNA, 20 bp, mouse
gagggaggagcacccgctgt

SEQ ID NO: 500713 - DNA, 20 bp, mouse
gccagatagcctgatggagg

SEQ ID NO: 500714 - DNA, 20 bp, mouse
gctctgcactgagggctagg

SEQ ID NO: 500715 - DNA, 20 bp, mouse
gcgatgccatcggaacttca

SEQ ID NO: 500716 - DNA, 20 bp, mouse
gagcagcagatgcagtggtc

SEQ ID NO: 500717 - DNA, 20 bp, mouse
gctgaggtaacccagagccg

SEQ ID NO: 500718 - DNA, 20 bp, mouse
ggcatctgtgagccaagtga

SEQ ID NO: 500719 - DNA, 20 bp, mouse
ggggttacctcaggcagaac

SEQ ID NO: 500720 - DNA, 20 bp, mouse
gacctcaggcagaacgggac

SEQ ID NO: 500721 - DNA, 20 bp, mouse
gggtcaggcaacctcggctc

SEQ ID NO: 500722 - DNA, 20 bp, mouse
gggaaggtaaagtcagacca

SEQ ID NO: 500723 - DNA, 20 bp, mouse
ggccatcagaggggccactg

SEQ ID NO: 500724 - DNA, 20 bp, mouse
gggactggaagtttagccac

SEQ ID NO: 500725 - DNA, 20 bp, mouse
gtatctggctggctatacag

SEQ ID NO: 500726 - DNA, 20 bp, mouse
gggagaggaccagagcccta

SEQ ID NO: 500727 - DNA, 20 bp, mouse
ggcttcagcggattagaagg

SEQ ID NO: 500728 - DNA, 20 bp, mouse
gggaccagagccctagggtc

SEQ ID NO: 500729 - DNA, 20 bp, mouse
gcccaaactggtgctggcga

SEQ ID NO: 500730 - DNA, 20 bp, mouse
gtccctctacaagccagggt

SEQ ID NO: 500731 - DNA, 20 bp, mouse
gtgggcttcagcggattaga

SEQ ID NO: 500732 - DNA, 20 bp, mouse
ggccgtcgccagcaccagtt

SEQ ID NO: 500733 - DNA, 20 bp, mouse
gtacaagccagggtaggaag

SEQ ID NO: 500734 - DNA, 20 bp, mouse
ggcactgggctccggaccct

SEQ ID NO: 500735 - DNA, 20 bp, mouse
gaccaggaacagaccccgag

SEQ ID NO: 500736 - DNA, 20 bp, mouse
gagcccagccgctggtcggt

SEQ ID NO: 500737 - DNA, 20 bp, mouse
ggagcgcgcacctcccgtag

SEQ ID NO: 500738 - DNA, 20 bp, mouse
gctctgccctcccagagagg

SEQ ID NO: 500739 - DNA, 20 bp, mouse
gcgcctctgccctcccagag

SEQ ID NO: 500740 - DNA, 20 bp, mouse
gtgcccaccgaccagcggct

SEQ ID NO: 500741 - DNA, 20 bp, mouse
gggccagtatgtccctaaaa

SEQ ID NO: 500742 - DNA, 20 bp, mouse
ggctgcgcgctggctctgaa

SEQ ID NO: 500743 - DNA, 20 bp, mouse
gcctaaaatggagtgcgtgt

SEQ ID NO: 500744 - DNA, 20 bp, mouse
ggcagggtttcgagcagcaa

SEQ ID NO: 500745 - DNA, 20 bp, mouse
gtaccggcagccgctacggg

SEQ ID NO: 500746 - DNA, 20 bp, mouse
gtgctctagagagtaattgg

SEQ ID NO: 500747 - DNA, 20 bp, mouse
gtccaggttgctagaaccta

SEQ ID NO: 500748 - DNA, 20 bp, mouse
gtgttgctctagagagtaat

SEQ ID NO: 500749 - DNA, 20 bp, mouse
gtctagagagtaattggagg

SEQ ID NO: 500750 - DNA, 20 bp, mouse
gcaggacctacaaaaaaaga

SEQ ID NO: 500751 - DNA, 20 bp, mouse
gtgattgggaccatcatgga

SEQ ID NO: 500752 - DNA, 20 bp, mouse
gtcagttcttggaagtgtca

SEQ ID NO: 500753 - DNA, 20 bp, mouse
gcacatgattgggaccatca

SEQ ID NO: 500754 - DNA, 20 bp, mouse
gtctcacccatacaaacaaa

SEQ ID NO: 500755 - DNA, 20 bp, mouse
gtgaaacgtatggacattcg

SEQ ID NO: 500756 - DNA, 20 bp, mouse
gggcagcgcgggccgggatg

SEQ ID NO: 500757 - DNA, 20 bp, mouse
ggattcttcgtagttcgccc

SEQ ID NO: 500758 - DNA, 20 bp, mouse
gtggaggaaggagctgccgg

SEQ ID NO: 500759 - DNA, 20 bp, mouse
gtcttcgtagttcgcccggg

SEQ ID NO: 500760 - DNA, 20 bp, mouse
gttgccgggagtggaggtct

SEQ ID NO: 500761 - DNA, 20 bp, mouse
gtagttcgcccgggcgggcg

SEQ ID NO: 500762 - DNA, 20 bp, mouse
gacctccactcccggcaatg

SEQ ID NO: 500763 - DNA, 20 bp, mouse
gcgggagtggaggtctggga

SEQ ID NO: 500764 - DNA, 20 bp, mouse
gtccatcaccgagcactggc

SEQ ID NO: 500765 - DNA, 20 bp, mouse
ggccagccagtgctcggtga

SEQ ID NO: 500766 - DNA, 20 bp, mouse
gtagcttcgaccctagtccg

SEQ ID NO: 500767 - DNA, 20 bp, mouse
gctagggtcgaagctagcgg

SEQ ID NO: 500768 - DNA, 20 bp, mouse
ggccggctcgccccggacta

SEQ ID NO: 500769 - DNA, 20 bp, mouse
gtgcgcatcgctgcccgcgg

SEQ ID NO: 500770 - DNA, 20 bp, mouse
ggggcgcgcggggaacccag

SEQ ID NO: 500771 - DNA, 20 bp, mouse
ggggtcgaagctagcggtgg

SEQ ID NO: 500772 - DNA, 20 bp, mouse
gccgcggcggcgcagcgtcc

SEQ ID NO: 500773 - DNA, 20 bp, mouse
gaagttggcgaggtgagtcg

SEQ ID NO: 500774 - DNA, 20 bp, mouse
gggcggcgcagcgtccaggc

SEQ ID NO: 500775 - DNA, 20 bp, mouse
gctctgcgcatcgctgcccg

SEQ ID NO: 500776 - DNA, 20 bp, mouse
ggtgacggccgctataagag

SEQ ID NO: 500777 - DNA, 20 bp, mouse
gcagcccgccgctcttatag

SEQ ID NO: 500778 - DNA, 20 bp, mouse
gacggccgctataagagcgg

SEQ ID NO: 500779 - DNA, 20 bp, mouse
ggtgaccgcggccagcaggg

SEQ ID NO: 500780 - DNA, 20 bp, mouse
gtaggtgaccgcggccagca

SEQ ID NO: 500781 - DNA, 20 bp, mouse
gcagccggagccgctctcca

SEQ ID NO: 500782 - DNA, 20 bp, mouse
gtgtcatagtgtggccgggt

SEQ ID NO: 500783 - DNA, 20 bp, mouse
ggagccgcgctgcagagcgg

SEQ ID NO: 500784 - DNA, 20 bp, mouse
gaccggggaggatgcggcct

SEQ ID NO: 500785 - DNA, 20 bp, mouse
gagcttcccgggcttagggg

SEQ ID NO: 500786 - DNA, 20 bp, mouse
gtctccggggtgactgtgga

SEQ ID NO: 500787 - DNA, 20 bp, mouse
gcagagcagagagcttaaca

SEQ ID NO: 500788 - DNA, 20 bp, mouse
gcagccctccacagtcaccc

SEQ ID NO: 500789 - DNA, 20 bp, mouse
ggctagtgtcccagttcagt

SEQ ID NO: 500790 - DNA, 20 bp, mouse
gttaacacggctggtctccg

SEQ ID NO: 500791 - DNA, 20 bp, mouse
gtagctgctggggcgaggaa

SEQ ID NO: 500792 - DNA, 20 bp, mouse
ggaaggctcgcgcggctcct

SEQ ID NO: 500793 - DNA, 20 bp, mouse
gcactagccggaggacgaaa

SEQ ID NO: 500794 - DNA, 20 bp, mouse
gcggccgggcgggagtaaag

SEQ ID NO: 500795 - DNA, 20 bp, mouse
ggaactgggacactagccgg

SEQ ID NO: 500796 - DNA, 20 bp, mouse
gggtccactgcccctaccaa

SEQ ID NO: 500797 - DNA, 20 bp, mouse
ggccaccaaagctggattca

SEQ ID NO: 500798 - DNA, 20 bp, mouse
gatgacagtgggcggaggag

SEQ ID NO: 500799 - DNA, 20 bp, mouse
ggccatgaatccagctttgg

SEQ ID NO: 500800 - DNA, 20 bp, mouse
gccgcccactgtcatcacca

SEQ ID NO: 500801 - DNA, 20 bp, mouse
gtgggtagagcaagacccaa

SEQ ID NO: 500802 - DNA, 20 bp, mouse
gggttttggggccgttggta

SEQ ID NO: 500803 - DNA, 20 bp, mouse
gacggccccaaaaccgcttt

SEQ ID NO: 500804 - DNA, 20 bp, mouse
gacgtgttgagctggtacct

SEQ ID NO: 500805 - DNA, 20 bp, mouse
ggaggctccaaaagcggttt

SEQ ID NO: 500806 - DNA, 20 bp, mouse
gctggcctcacctgctccag

SEQ ID NO: 500807 - DNA, 20 bp, mouse
gggcggtcgcaggaggaaca

SEQ ID NO: 500808 - DNA, 20 bp, mouse
gtgctccagtggctccggga

SEQ ID NO: 500809 - DNA, 20 bp, mouse
gagggccttcccggagccac

SEQ ID NO: 500810 - DNA, 20 bp, mouse
gccagctgctgcgcacagca

SEQ ID NO: 500811 - DNA, 20 bp, mouse
gactggaccgcggggcccga

SEQ ID NO: 500812 - DNA, 20 bp, mouse
gtgaccgggacctgactgca

SEQ ID NO: 500813 - DNA, 20 bp, mouse
gaggaggaacagggccttcc

SEQ ID NO: 500814 - DNA, 20 bp, mouse
gactgcagggcggtcgcagg

SEQ ID NO: 500815 - DNA, 20 bp, mouse
gagcagggcgagtagccgtc

SEQ ID NO: 500816 - DNA, 20 bp, mouse
gcagctgctgtgacaacatc

SEQ ID NO: 500817 - DNA, 20 bp, mouse
gggtaggcaaggccttccta

SEQ ID NO: 500818 - DNA, 20 bp, mouse
gattcagctagggacaggag

SEQ ID NO: 500819 - DNA, 20 bp, mouse
gctgtgctctcggtcatact

SEQ ID NO: 500820 - DNA, 20 bp, mouse
gtatctagggttagaatcaa

SEQ ID NO: 500821 - DNA, 20 bp, mouse
gggttaactggtgaaggtta

SEQ ID NO: 500822 - DNA, 20 bp, mouse
ggtgtctgtcagccttagga

SEQ ID NO: 500823 - DNA, 20 bp, mouse
gttcaggcacaaatggttgt

SEQ ID NO: 500824 - DNA, 20 bp, mouse
gataggattcagctagggac

SEQ ID NO: 500825 - DNA, 20 bp, mouse
gacaagtttactgctatcta

SEQ ID NO: 500826 - DNA, 20 bp, mouse
gctccgcgcggccagcagaa

SEQ ID NO: 500827 - DNA, 20 bp, mouse
gcgcgcggccagcagaaggg

SEQ ID NO: 500828 - DNA, 20 bp, mouse
gggttcacgggtccaggaac

SEQ ID NO: 500829 - DNA, 20 bp, mouse
gacggagaagccgggttcac

SEQ ID NO: 500830 - DNA, 20 bp, mouse
gaggggctccgctccaagat

SEQ ID NO: 500831 - DNA, 20 bp, mouse
gccagacgcgggtcctactg

SEQ ID NO: 500832 - DNA, 20 bp, mouse
gggcttctccgttgcacctg

SEQ ID NO: 500833 - DNA, 20 bp, mouse
gactcaccgaggagctcggg

SEQ ID NO: 500834 - DNA, 20 bp, mouse
gcgtgacccgagggagggaa

SEQ ID NO: 500835 - DNA, 20 bp, mouse
gaagtgtgcctatcttggag

SEQ ID NO: 500836 - DNA, 20 bp, mouse
ggagcgctccgactcaggta

SEQ ID NO: 500837 - DNA, 20 bp, mouse
gcctgagtcggagcgctctg

SEQ ID NO: 500838 - DNA, 20 bp, mouse
ggagttagcgggtgtcccag

SEQ ID NO: 500839 - DNA, 20 bp, mouse
ggcggtcgtgcaataggaag

SEQ ID NO: 500840 - DNA, 20 bp, mouse
ggagtcggagcgctctgggg

SEQ ID NO: 500841 - DNA, 20 bp, mouse
gcagctcaccctacctgagt

SEQ ID NO: 500842 - DNA, 20 bp, mouse
gcgaggacacagagagactg

SEQ ID NO: 500843 - DNA, 20 bp, mouse
gtcggagcgctctggggcgg

SEQ ID NO: 500844 - DNA, 20 bp, mouse
gtgagctgagacactgaatc

SEQ ID NO: 500845 - DNA, 20 bp, mouse
gctgagacactgaatcgggc

SEQ ID NO: 500846 - DNA, 20 bp, mouse
gcagcagggcaggtagccag

SEQ ID NO: 500847 - DNA, 20 bp, mouse
gccctgtagaggctatccca

SEQ ID NO: 500848 - DNA, 20 bp, mouse
gtgccctgctgtgaatagtc

SEQ ID NO: 500849 - DNA, 20 bp, mouse
gttgctggctcaccctgtag

SEQ ID NO: 500850 - DNA, 20 bp, mouse
gaacctgactattcacagca

SEQ ID NO: 500851 - DNA, 20 bp, mouse
gggcactgccctctcctgaa

SEQ ID NO: 500852 - DNA, 20 bp, mouse
gtcatgctcagtctgtcctc

SEQ ID NO: 500853 - DNA, 20 bp, mouse
ggccttgggatagcctctac

SEQ ID NO: 500854 - DNA, 20 bp, mouse
gaggccaaaggccaaaggac

SEQ ID NO: 500855 - DNA, 20 bp, mouse
gggatgtcaccgacaaggag

SEQ ID NO: 500856 - DNA, 20 bp, mouse
gccagggtacgggtccgtgg

SEQ ID NO: 500857 - DNA, 20 bp, mouse
ggcctagaagacgaaccagt

SEQ ID NO: 500858 - DNA, 20 bp, mouse
gtacgggtccgtggaggcac

SEQ ID NO: 500859 - DNA, 20 bp, mouse
gcgtggaggcactggctaag

SEQ ID NO: 500860 - DNA, 20 bp, mouse
gaggtgagcgtgctgccgac

SEQ ID NO: 500861 - DNA, 20 bp, mouse
ggctggcctgggccagggta

SEQ ID NO: 500862 - DNA, 20 bp, mouse
gccgcagggagaatgaactc

SEQ ID NO: 500863 - DNA, 20 bp, mouse
ggagagccaggatccctcta

SEQ ID NO: 500864 - DNA, 20 bp, mouse
gactcggggtagccaaggtg

SEQ ID NO: 500865 - DNA, 20 bp, mouse
gcacgcaggctggactctgg

SEQ ID NO: 500866 - DNA, 20 bp, mouse
ggggtgggagagccacgatg

SEQ ID NO: 500867 - DNA, 20 bp, mouse
gtagcaagagatggcccccg

SEQ ID NO: 500868 - DNA, 20 bp, mouse
gccagaggcgttcctcatcg

SEQ ID NO: 500869 - DNA, 20 bp, mouse
gagatccctgctgattgggg

SEQ ID NO: 500870 - DNA, 20 bp, mouse
ggaacgcctctggtccccgg

SEQ ID NO: 500871 - DNA, 20 bp, mouse
gaaaggagagtagcaagaga

SEQ ID NO: 500872 - DNA, 20 bp, mouse
gcagagatccctgctgattg

SEQ ID NO: 500873 - DNA, 20 bp, mouse
gcttccaagagaggtaatag

SEQ ID NO: 500874 - DNA, 20 bp, mouse
gcggcagcaatctccattgg

SEQ ID NO: 500875 - DNA, 20 bp, mouse
ggaggtaatagtggtaaatg

SEQ ID NO: 500876 - DNA, 20 bp, mouse
gcttgacgctgggacctagg

SEQ ID NO: 500877 - DNA, 20 bp, mouse
gcttccccggaaggccgcct

SEQ ID NO: 500878 - DNA, 20 bp, mouse
gactcttgacgctgggacct

SEQ ID NO: 500879 - DNA, 20 bp, mouse
ggggagcggagagcattcag

SEQ ID NO: 500880 - DNA, 20 bp, mouse
gctcttttaacctctaggag

SEQ ID NO: 500881 - DNA, 20 bp, mouse
gagacaaggtcagcagtagc

SEQ ID NO: 500882 - DNA, 20 bp, mouse
gggaagagaccaagtagcta

SEQ ID NO: 500883 - DNA, 20 bp, mouse
gggacaacactcttgacgct

SEQ ID NO: 500884 - DNA, 20 bp, mouse
gacctctgccctcctgctac

SEQ ID NO: 500885 - DNA, 20 bp, mouse
gctcctgctactggtgacag

SEQ ID NO: 500886 - DNA, 20 bp, mouse
gaggtgagtgaacacccctg

SEQ ID NO: 500887 - DNA, 20 bp, mouse
gaagtcagcagaggtgccat

SEQ ID NO: 500888 - DNA, 20 bp, mouse
gtggcagtgatgccgtccca

SEQ ID NO: 500889 - DNA, 20 bp, mouse
gtaggctgaaataaagtaaa

SEQ ID NO: 500890 - DNA, 20 bp, mouse
gttcaacaaggtctgaagaa

SEQ ID NO: 500891 - DNA, 20 bp, mouse
gcaggtgatgaaaaaatgtt

SEQ ID NO: 500892 - DNA, 20 bp, mouse
gtgctttcagaaaacttagt

SEQ ID NO: 500893 - DNA, 20 bp, mouse
gttaaagctgctcattccct

SEQ ID NO: 500894 - DNA, 20 bp, mouse
gtctaagtctgggtttgtta

SEQ ID NO: 500895 - DNA, 20 bp, mouse
gtcagaccttgttgaaaatt

SEQ ID NO: 500896 - DNA, 20 bp, mouse
gagcagcaacaaaaacaact

SEQ ID NO: 500897 - DNA, 20 bp, mouse
gctcaacaaggtctgagtaa

SEQ ID NO: 500898 - DNA, 20 bp, mouse
gtcatccttagaaagagatg

SEQ ID NO: 500899 - DNA, 20 bp, mouse
gaacaaggtctgagtaaggg

SEQ ID NO: 500900 - DNA, 20 bp, mouse
gtgtgccacatctctttcta

SEQ ID NO: 500901 - DNA, 20 bp, mouse
gttttcgttttttcattacc

SEQ ID NO: 500902 - DNA, 20 bp, mouse
gtttttcattacctggaaac

SEQ ID NO: 500903 - DNA, 20 bp, mouse
gccaggaaggctgctcagga

SEQ ID NO: 500904 - DNA, 20 bp, mouse
gaaggcgaggaaggagatgt

SEQ ID NO: 500905 - DNA, 20 bp, mouse
gagcagacaaagcccttgga

SEQ ID NO: 500906 - DNA, 20 bp, mouse
gagcagcaacaaaaacaact

SEQ ID NO: 500907 - DNA, 20 bp, mouse
gctcaacaaggtctgagtaa

SEQ ID NO: 500908 - DNA, 20 bp, mouse
gtcatccttagaaagagatg

SEQ ID NO: 500909 - DNA, 20 bp, mouse
gaacaaggtctgagtaaggg

SEQ ID NO: 500910 - DNA, 20 bp, mouse
gtgtgccacatctctttcta

SEQ ID NO: 500911 - DNA, 20 bp, mouse
gttttcgttttttcattacc

SEQ ID NO: 500912 - DNA, 20 bp, mouse
gtttttcattacctggaaac

SEQ ID NO: 500913 - DNA, 20 bp, mouse
gccaggaaggctgctcagga

SEQ ID NO: 500914 - DNA, 20 bp, mouse
gaaggcgaggaaggagatgt

SEQ ID NO: 500915 - DNA, 20 bp, mouse
gagcagacaaagcccttgga

SEQ ID NO: 500916 - DNA, 20 bp, mouse
gatcatccttagaaagagtg

SEQ ID NO: 500917 - DNA, 20 bp, mouse
gggatgatccagtctccaga

SEQ ID NO: 500918 - DNA, 20 bp, mouse
gcggggacaagcctacaatg

SEQ ID NO: 500919 - DNA, 20 bp, mouse
gctctgccacactctttcta

SEQ ID NO: 500920 - DNA, 20 bp, mouse
ggtgtttttagaaagttagt

SEQ ID NO: 500921 - DNA, 20 bp, mouse
ggagaataaagatagcttcg

SEQ ID NO: 500922 - DNA, 20 bp, mouse
gcgtgctaattttcttgagc

SEQ ID NO: 500923 - DNA, 20 bp, mouse
gtcaggatggaggagggcag

SEQ ID NO: 500924 - DNA, 20 bp, mouse
gggagacactgcccttggaa

SEQ ID NO: 500925 - DNA, 20 bp, mouse
gggtgaaatcaccacattgt

SEQ ID NO: 500926 - DNA, 20 bp, mouse
gaacaactgggagaatctag

SEQ ID NO: 500927 - DNA, 20 bp, mouse
gtaatgaccagtctgcaatg

SEQ ID NO: 500928 - DNA, 20 bp, mouse
ggcctcaccccattgcagac

SEQ ID NO: 500929 - DNA, 20 bp, mouse
gcatcttgactttagccaag

SEQ ID NO: 500930 - DNA, 20 bp, mouse
gttaaaactgccttgcccct

SEQ ID NO: 500931 - DNA, 20 bp, mouse
gatgctaagattattgagct

SEQ ID NO: 500932 - DNA, 20 bp, mouse
gagattctcaacaaggtctg

SEQ ID NO: 500933 - DNA, 20 bp, mouse
gctgtgccacatctcttcta

SEQ ID NO: 500934 - DNA, 20 bp, mouse
ggttgaaaaaaaaaacaact

SEQ ID NO: 500935 - DNA, 20 bp, mouse
gaccagtctgcaatggggtg

SEQ ID NO: 500936 - DNA, 20 bp, mouse
gccgaagccctgtaattatg

SEQ ID NO: 500937 - DNA, 20 bp, mouse
gtgggctctggtttccctgg

SEQ ID NO: 500938 - DNA, 20 bp, mouse
gttacagggcttcggtgtta

SEQ ID NO: 500939 - DNA, 20 bp, mouse
gggacaaactgcttgcttcg

SEQ ID NO: 500940 - DNA, 20 bp, mouse
ggcttcggtgttaaggagca

SEQ ID NO: 500941 - DNA, 20 bp, mouse
gatataaacgccagccacca

SEQ ID NO: 500942 - DNA, 20 bp, mouse
gtacaactgctagccggaaa

SEQ ID NO: 500943 - DNA, 20 bp, mouse
gtgcttgctgcggtactgga

SEQ ID NO: 500944 - DNA, 20 bp, mouse
gaagaaaacctcataattac

SEQ ID NO: 500945 - DNA, 20 bp, mouse
ggtcttagaaagggatataa

SEQ ID NO: 500946 - DNA, 20 bp, mouse
ggaccagcagacctccatcc

SEQ ID NO: 500947 - DNA, 20 bp, mouse
gcatcctggcacaggatcag

SEQ ID NO: 500948 - DNA, 20 bp, mouse
gtgggcaggtgagcattcgg

SEQ ID NO: 500949 - DNA, 20 bp, mouse
gcagacctccatcctggcac

SEQ ID NO: 500950 - DNA, 20 bp, mouse
gccctgaaaacactgtgggc

SEQ ID NO: 500951 - DNA, 20 bp, mouse
gggaccactgatcctgtgcc

SEQ ID NO: 500952 - DNA, 20 bp, mouse
gtggtccctgctgctactgc

SEQ ID NO: 500953 - DNA, 20 bp, mouse
gccagagccgggtatccaga

SEQ ID NO: 500954 - DNA, 20 bp, mouse
gttagagtgagacctatcag

SEQ ID NO: 500955 - DNA, 20 bp, mouse
gagcgtagagccgggcgcgg

SEQ ID NO: 500956 - DNA, 20 bp, mouse
gatgggaggccatggaacag

SEQ ID NO: 500957 - DNA, 20 bp, mouse
gtaaaagaaggaatccaaga

SEQ ID NO: 500958 - DNA, 20 bp, mouse
ggatcatctttaagagagat

SEQ ID NO: 500959 - DNA, 20 bp, mouse
gtaaacagacttacatcaga

SEQ ID NO: 500960 - DNA, 20 bp, mouse
gttgttagaccgagttaagg

SEQ ID NO: 500961 - DNA, 20 bp, mouse
gaaggaagtaaagtctgtca

SEQ ID NO: 500962 - DNA, 20 bp, mouse
gggccagcatgtgtctgtag

SEQ ID NO: 500963 - DNA, 20 bp, mouse
gcgattttctgagttaaggg

SEQ ID NO: 500964 - DNA, 20 bp, mouse
gctgggtataaaaatgtata

SEQ ID NO: 500965 - DNA, 20 bp, mouse
gtaactctgcccccttaact

SEQ ID NO: 500966 - DNA, 20 bp, mouse
gacgaacgtagacggagaag

SEQ ID NO: 500967 - DNA, 20 bp, mouse
ggcagggcgccgaagaagat

SEQ ID NO: 500968 - DNA, 20 bp, mouse
ggccgcagcacgaacgtaga

SEQ ID NO: 500969 - DNA, 20 bp, mouse
gtcgctgacagccgaatcca

SEQ ID NO: 500970 - DNA, 20 bp, mouse
gctgcgcccgcggcaaggta

SEQ ID NO: 500971 - DNA, 20 bp, mouse
gccgcggcaaggtagggtct

SEQ ID NO: 500972 - DNA, 20 bp, mouse
gctgtcagcgatccgcacaa

SEQ ID NO: 500973 - DNA, 20 bp, mouse
ggacagccgaatccatggcg

SEQ ID NO: 500974 - DNA, 20 bp, mouse
gtccgtctacgttcgtgctg

SEQ ID NO: 500975 - DNA, 20 bp, mouse
gcgtgaagcaggggtctggg

SEQ ID NO: 500976 - DNA, 20 bp, mouse
gggaacaccactgcagggag

SEQ ID NO: 500977 - DNA, 20 bp, mouse
gcttctccagcagatcctgg

SEQ ID NO: 500978 - DNA, 20 bp, mouse
ggggagaggcaggggcgaga

SEQ ID NO: 500979 - DNA, 20 bp, mouse
gcgagacggcaaggatcaga

SEQ ID NO: 500980 - DNA, 20 bp, mouse
gggccttgcttattgagaat

SEQ ID NO: 500981 - DNA, 20 bp, mouse
ggatccccgacaggcagaca

SEQ ID NO: 500982 - DNA, 20 bp, mouse
gatgtctccaagtcccagca

SEQ ID NO: 500983 - DNA, 20 bp, mouse
gaggcaggggcgagacggca

SEQ ID NO: 500984 - DNA, 20 bp, mouse
gcaccactgcagggagaggc

SEQ ID NO: 500985 - DNA, 20 bp, mouse
gtcctctcccagcaattacc

SEQ ID NO: 500986 - DNA, 20 bp, mouse
gcgccgggcgagcgaccgaa

SEQ ID NO: 500987 - DNA, 20 bp, mouse
ggctcccagcccccaccgtt

SEQ ID NO: 500988 - DNA, 20 bp, mouse
ggcgagcgaccgaacggtgg

SEQ ID NO: 500989 - DNA, 20 bp, mouse
ggagcgccagacgcagagct

SEQ ID NO: 500990 - DNA, 20 bp, mouse
gcgggcgagcgaccgaacgg

SEQ ID NO: 500991 - DNA, 20 bp, mouse
gcggaggcagcgccaggcgc

SEQ ID NO: 500992 - DNA, 20 bp, mouse
gcgagggctggcccatcgga

SEQ ID NO: 500993 - DNA, 20 bp, mouse
gcggaaggctccttgaacag

SEQ ID NO: 500994 - DNA, 20 bp, mouse
gatgggccagccctcgccgg

SEQ ID NO: 500995 - DNA, 20 bp, mouse
ggttcaaggagccttccgat

SEQ ID NO: 500996 - DNA, 20 bp, mouse
gcaggtggccccgcggtggg

SEQ ID NO: 500997 - DNA, 20 bp, mouse
gaagcaggtggccccgcggt

SEQ ID NO: 500998 - DNA, 20 bp, mouse
gcgccttgggattccccact

SEQ ID NO: 500999 - DNA, 20 bp, mouse
gggctggacagcctcagcca

SEQ ID NO: 501000 - DNA, 20 bp, mouse
gtgaggctgtccagcccagt

SEQ ID NO: 501001 - DNA, 20 bp, mouse
ggcacgctcctgagggtcag

SEQ ID NO: 501002 - DNA, 20 bp, mouse
gactctggatgcgctcaaga

SEQ ID NO: 501003 - DNA, 20 bp, mouse
gaagagctaggatgtcacag

SEQ ID NO: 501004 - DNA, 20 bp, mouse
ggaggccagatcaaagcagg

SEQ ID NO: 501005 - DNA, 20 bp, mouse
gggccaccagcacctgactc

SEQ ID NO: 501006 - DNA, 20 bp, mouse
ggagctaactgagcgagcac

SEQ ID NO: 501007 - DNA, 20 bp, mouse
ggccgcatgcaccttctcag

SEQ ID NO: 501008 - DNA, 20 bp, mouse
gaactgagcgagcactggcc

SEQ ID NO: 501009 - DNA, 20 bp, mouse
ggagcccacatgatccagaa

SEQ ID NO: 501010 - DNA, 20 bp, mouse
gtgacaagccaggtaagcaa

SEQ ID NO: 501011 - DNA, 20 bp, mouse
gccagaaggggatgtgtccc

SEQ ID NO: 501012 - DNA, 20 bp, mouse
gtccaatccgagcgagcggt

SEQ ID NO: 501013 - DNA, 20 bp, mouse
ggccgctgagaaggtgcatg

SEQ ID NO: 501014 - DNA, 20 bp, mouse
gttcattccccaccaggact

SEQ ID NO: 501015 - DNA, 20 bp, mouse
gaggagacctagtcctggtg

SEQ ID NO: 501016 - DNA, 20 bp, mouse
gggagcgcggcagcactgcg

SEQ ID NO: 501017 - DNA, 20 bp, mouse
ggcgcgggctccggagctct

SEQ ID NO: 501018 - DNA, 20 bp, mouse
gatgcggagaggagcctgcg

SEQ ID NO: 501019 - DNA, 20 bp, mouse
ggacatggtggccagcgggt

SEQ ID NO: 501020 - DNA, 20 bp, mouse
gcgtgcgcgctacgctctgg

SEQ ID NO: 501021 - DNA, 20 bp, mouse
gggccgggcctgggaccagg

SEQ ID NO: 501022 - DNA, 20 bp, mouse
gtcccgtcggcgctcgttgg

SEQ ID NO: 501023 - DNA, 20 bp, mouse
gggcagcactgcgcgggctc

SEQ ID NO: 501024 - DNA, 20 bp, mouse
gtcctcaagctccaccgaca

SEQ ID NO: 501025 - DNA, 20 bp, mouse
gccgctggccaccatgtcgg

SEQ ID NO: 501026 - DNA, 20 bp, mouse
gagcagagctctgattctgg

SEQ ID NO: 501027 - DNA, 20 bp, mouse
ggaatcagagctctgctgcg

SEQ ID NO: 501028 - DNA, 20 bp, mouse
gcagagacctcccagagacc

SEQ ID NO: 501029 - DNA, 20 bp, mouse
gctactagtgggcccagtga

SEQ ID NO: 501030 - DNA, 20 bp, mouse
ggcgcggcatcctggtctct

SEQ ID NO: 501031 - DNA, 20 bp, mouse
ggctctgctgcgcggcatcc

SEQ ID NO: 501032 - DNA, 20 bp, mouse
gtagtgggcccagtgaggga

SEQ ID NO: 501033 - DNA, 20 bp, mouse
ggagcatggtggtcagggcg

SEQ ID NO: 501034 - DNA, 20 bp, mouse
gaccagagcctcctgaagaa

SEQ ID NO: 501035 - DNA, 20 bp, mouse
ggagtacactacaggtacaa

SEQ ID NO: 501036 - DNA, 20 bp, mouse
ggcacagcaggtgtgagtcc

SEQ ID NO: 501037 - DNA, 20 bp, mouse
gcacagcagccgagaggagg

SEQ ID NO: 501038 - DNA, 20 bp, mouse
gcaccacagcagccgagagg

SEQ ID NO: 501039 - DNA, 20 bp, mouse
ggactctgggatgtgggagg

SEQ ID NO: 501040 - DNA, 20 bp, mouse
gcgtgttctgagggaccctg

SEQ ID NO: 501041 - DNA, 20 bp, mouse
ggaactttgctttctgaagg

SEQ ID NO: 501042 - DNA, 20 bp, mouse
gacaggtaatggcagtcacc

SEQ ID NO: 501043 - DNA, 20 bp, mouse
ggagggaccctggggactct

SEQ ID NO: 501044 - DNA, 20 bp, mouse
gattacctgtgccttagaga

SEQ ID NO: 501045 - DNA, 20 bp, mouse
ggagcctgacatataaacgg

SEQ ID NO: 501046 - DNA, 20 bp, mouse
gccgcgggactcagacaccc

SEQ ID NO: 501047 - DNA, 20 bp, mouse
ggcaggccgggaggggatct

SEQ ID NO: 501048 - DNA, 20 bp, mouse
gtaaagtccacgcaacccgc

SEQ ID NO: 501049 - DNA, 20 bp, mouse
gccgcgcccagatcccctcc

SEQ ID NO: 501050 - DNA, 20 bp, mouse
gggcaggtctcactatcatt

SEQ ID NO: 501051 - DNA, 20 bp, mouse
gaggtctcactatcattggg

SEQ ID NO: 501052 - DNA, 20 bp, mouse
ggctctctgtccgcagtaca

SEQ ID NO: 501053 - DNA, 20 bp, mouse
ggatgtaccggggctcctcg

SEQ ID NO: 501054 - DNA, 20 bp, mouse
gacggcctctgcggggagag

SEQ ID NO: 501055 - DNA, 20 bp, mouse
gtgcgcagccgcccggggtt

SEQ ID NO: 501056 - DNA, 20 bp, mouse
gggtagctcccatttactgt

SEQ ID NO: 501057 - DNA, 20 bp, mouse
gtactgtgggtgttaaggta

SEQ ID NO: 501058 - DNA, 20 bp, mouse
gcgagcaccgcccaggagtg

SEQ ID NO: 501059 - DNA, 20 bp, mouse
gggagctaccactcgagtgt

SEQ ID NO: 501060 - DNA, 20 bp, mouse
gtgagggcggtcgagaccag

SEQ ID NO: 501061 - DNA, 20 bp, mouse
gtggctgctgccccactcct

SEQ ID NO: 501062 - DNA, 20 bp, mouse
gctgctgccccactcctggg

SEQ ID NO: 501063 - DNA, 20 bp, mouse
gccatttactgtgggtgtta

SEQ ID NO: 501064 - DNA, 20 bp, mouse
gacagcagccctctccctca

SEQ ID NO: 501065 - DNA, 20 bp, mouse
ggagggctgctgttcacgaa

SEQ ID NO: 501066 - DNA, 20 bp, mouse
gcaggacccgcgtgcctcct

SEQ ID NO: 501067 - DNA, 20 bp, mouse
gtccgcggggccccatgctg

SEQ ID NO: 501068 - DNA, 20 bp, mouse
gctgcagcagcgggactgca

SEQ ID NO: 501069 - DNA, 20 bp, mouse
gagggcgagcctccctggaa

SEQ ID NO: 501070 - DNA, 20 bp, mouse
gcctcctgggaccacagcat

SEQ ID NO: 501071 - DNA, 20 bp, mouse
ggcggacccccaccgttcca

SEQ ID NO: 501072 - DNA, 20 bp, mouse
ggtggtcccaggaggcacgc

SEQ ID NO: 501073 - DNA, 20 bp, mouse
gaccacagcatggggccccg

SEQ ID NO: 501074 - DNA, 20 bp, mouse
ggagcctccctggaacggtg

SEQ ID NO: 501075 - DNA, 20 bp, mouse
ggccaggcaacgcctcagac

SEQ ID NO: 501076 - DNA, 20 bp, mouse
gaagtttaggatctcaggag

SEQ ID NO: 501077 - DNA, 20 bp, mouse
gagttactgggtacaagttt

SEQ ID NO: 501078 - DNA, 20 bp, mouse
gtggcgccacataagcagca

SEQ ID NO: 501079 - DNA, 20 bp, mouse
ggggatttggttgagttact

SEQ ID NO: 501080 - DNA, 20 bp, mouse
ggactgtatgggggcaggta

SEQ ID NO: 501081 - DNA, 20 bp, mouse
gtcccggaacctaaagggag

SEQ ID NO: 501082 - DNA, 20 bp, mouse
ggtggtcagattagttgggt

SEQ ID NO: 501083 - DNA, 20 bp, mouse
gccaaatcccggaacctaaa

SEQ ID NO: 501084 - DNA, 20 bp, mouse
ggaccactccctttaggttc

SEQ ID NO: 501085 - DNA, 20 bp, mouse
gggtacaagtttaggatctc

SEQ ID NO: 501086 - DNA, 20 bp, mouse
gtcatgccaggcaccatgtt

SEQ ID NO: 501087 - DNA, 20 bp, mouse
gagacaaacagaccaacagg

SEQ ID NO: 501088 - DNA, 20 bp, mouse
gcaaacagaccaacaggagg

SEQ ID NO: 501089 - DNA, 20 bp, mouse
gtgggtcctggttcctaaca

SEQ ID NO: 501090 - DNA, 20 bp, mouse
ggacagacaaacagaccaac

SEQ ID NO: 501091 - DNA, 20 bp, mouse
gtccccttccctcctcctgt

SEQ ID NO: 501092 - DNA, 20 bp, mouse
gctgtctgtttctttctcat

SEQ ID NO: 501093 - DNA, 20 bp, mouse
gagtcagtcttgctctgtgc

SEQ ID NO: 501094 - DNA, 20 bp, mouse
gaccttcagagagtggaaca

SEQ ID NO: 501095 - DNA, 20 bp, mouse
gttcctgcaccttcagagag

SEQ ID NO: 501096 - DNA, 20 bp, mouse
ggagtgactcggggccacat

SEQ ID NO: 501097 - DNA, 20 bp, mouse
gggaggggctgagtgactcg

SEQ ID NO: 501098 - DNA, 20 bp, mouse
ggttgagtgagtgggtacaa

SEQ ID NO: 501099 - DNA, 20 bp, mouse
gcagatttggttgagtgagt

SEQ ID NO: 501100 - DNA, 20 bp, mouse
gtcatgccaggcaccatgtt

SEQ ID NO: 501101 - DNA, 20 bp, mouse
gtgggtcctggttcctaaca

SEQ ID NO: 501102 - DNA, 20 bp, mouse
ggtgagtgggtacaaaggag

SEQ ID NO: 501103 - DNA, 20 bp, mouse
gccctgggcacctcctgcaa

SEQ ID NO: 501104 - DNA, 20 bp, mouse
gaccttcagagagtggaaca

SEQ ID NO: 501105 - DNA, 20 bp, mouse
ggtcctcagtctgcactgta

SEQ ID NO: 501106 - DNA, 20 bp, mouse
gtctctaggctacaggtagt

SEQ ID NO: 501107 - DNA, 20 bp, mouse
gcaggtagtaggctcagaga

SEQ ID NO: 501108 - DNA, 20 bp, mouse
gtcagagatggggtcaagac

SEQ ID NO: 501109 - DNA, 20 bp, mouse
gccaggaaaagagggcttgg

SEQ ID NO: 501110 - DNA, 20 bp, mouse
ggtggagtaagcctttgagg

SEQ ID NO: 501111 - DNA, 20 bp, mouse
gtacctgtagcctagagaga

SEQ ID NO: 501112 - DNA, 20 bp, mouse
gaacagaagaaaggcatacc

SEQ ID NO: 501113 - DNA, 20 bp, mouse
ggaacccagataaccgaagt

SEQ ID NO: 501114 - DNA, 20 bp, mouse
gataccaggaaaagagggct

SEQ ID NO: 501115 - DNA, 20 bp, mouse
gaaaagagggcttggaggct

SEQ ID NO: 501116 - DNA, 20 bp, mouse
gggagacacaggagtcagag

SEQ ID NO: 501117 - DNA, 20 bp, mouse
gctgccacacagggaactct

SEQ ID NO: 501118 - DNA, 20 bp, mouse
gccacaccatgctgcaggag

SEQ ID NO: 501119 - DNA, 20 bp, mouse
gctccccagagttccctgtg

SEQ ID NO: 501120 - DNA, 20 bp, mouse
gctgtccaggccaagtccct

SEQ ID NO: 501121 - DNA, 20 bp, mouse
ggtgctgggatgctcggggt

SEQ ID NO: 501122 - DNA, 20 bp, mouse
gagcaatggctgatacccag

SEQ ID NO: 501123 - DNA, 20 bp, mouse
gtcaggtgctgggatgctcg

SEQ ID NO: 501124 - DNA, 20 bp, mouse
gaagatatcaatagttccga

SEQ ID NO: 501125 - DNA, 20 bp, mouse
gctctgaccaaagccactgg

SEQ ID NO: 501126 - DNA, 20 bp, mouse
ggatcacagctgccacacag

SEQ ID NO: 501127 - DNA, 20 bp, mouse
gctgccacacagaggcctct

SEQ ID NO: 501128 - DNA, 20 bp, mouse
gagacaccatgcttgaggag

SEQ ID NO: 501129 - DNA, 20 bp, mouse
gggtcagcatcatcagactc

SEQ ID NO: 501130 - DNA, 20 bp, mouse
gggtccctgactaaaatcac

SEQ ID NO: 501131 - DNA, 20 bp, mouse
ggagaggttggttgctagag

SEQ ID NO: 501132 - DNA, 20 bp, mouse
gcctctcctctcctcaagca

SEQ ID NO: 501133 - DNA, 20 bp, mouse
gctgactaaaatcaccggag

SEQ ID NO: 501134 - DNA, 20 bp, mouse
gcaactcagaacatgagagg

SEQ ID NO: 501135 - DNA, 20 bp, mouse
gttcctacatgaaaacgaca

SEQ ID NO: 501136 - DNA, 20 bp, mouse
gcggctgcgcgggctgagag

SEQ ID NO: 501137 - DNA, 20 bp, mouse
ggaatcgccgacaggtgcga

SEQ ID NO: 501138 - DNA, 20 bp, mouse
gacggtaccatcgcacctgt

SEQ ID NO: 501139 - DNA, 20 bp, mouse
ggtgccgcccctcccctcag

SEQ ID NO: 501140 - DNA, 20 bp, mouse
ggaagtcgcgaatcgccgac

SEQ ID NO: 501141 - DNA, 20 bp, mouse
gacagcaggagcagcgtgca

SEQ ID NO: 501142 - DNA, 20 bp, mouse
gggtgagtaccgggccggga

SEQ ID NO: 501143 - DNA, 20 bp, mouse
ggtcggctacgtggacgaca

SEQ ID NO: 501144 - DNA, 20 bp, mouse
gtaccgggccgggagggaaa

SEQ ID NO: 501145 - DNA, 20 bp, mouse
ggactcagggcctacctgga

SEQ ID NO: 501146 - DNA, 20 bp, mouse
gtccagaatagccactccct

SEQ ID NO: 501147 - DNA, 20 bp, mouse
gggttagcgtttggcttgga

SEQ ID NO: 501148 - DNA, 20 bp, mouse
ggagaaagcctcctgggcgg

SEQ ID NO: 501149 - DNA, 20 bp, mouse
ggcgtgaagaggttagcgtt

SEQ ID NO: 501150 - DNA, 20 bp, mouse
gaaggagaaagcctcctggg

SEQ ID NO: 501151 - DNA, 20 bp, mouse
ggctgcagaagggtaagaga

SEQ ID NO: 501152 - DNA, 20 bp, mouse
gccagcgacccccgcccagg

SEQ ID NO: 501153 - DNA, 20 bp, mouse
gacccccgcagcccccaatg

SEQ ID NO: 501154 - DNA, 20 bp, mouse
gcgtttggcttggagggttc

SEQ ID NO: 501155 - DNA, 20 bp, mouse
gccgggtttattgattacag

SEQ ID NO: 501156 - DNA, 20 bp, mouse
gcgcggaagcgggagaagaa

SEQ ID NO: 501157 - DNA, 20 bp, mouse
gagccggagctgagacgcca

SEQ ID NO: 501158 - DNA, 20 bp, mouse
gcacctgagatgggagtccg

SEQ ID NO: 501159 - DNA, 20 bp, mouse
ggaccagggccagcgcagag

SEQ ID NO: 501160 - DNA, 20 bp, mouse
gcggagctgagacgccatgg

SEQ ID NO: 501161 - DNA, 20 bp, mouse
gctgcgctggccctggtcac

SEQ ID NO: 501162 - DNA, 20 bp, mouse
ggccctggtcacaggttcag

SEQ ID NO: 501163 - DNA, 20 bp, mouse
gcgccatggcggctgtgggt

SEQ ID NO: 501164 - DNA, 20 bp, mouse
gccatctcaggtgcgggtag

SEQ ID NO: 501165 - DNA, 20 bp, mouse
gggccagcgcagagcggagc

SEQ ID NO: 501166 - DNA, 20 bp, mouse
ggagcagcaggaggagagtc

SEQ ID NO: 501167 - DNA, 20 bp, mouse
gcctattcccaaggaaggta

SEQ ID NO: 501168 - DNA, 20 bp, mouse
gccatttggatgcttcgtga

SEQ ID NO: 501169 - DNA, 20 bp, mouse
gggcccaggccatgacagga

SEQ ID NO: 501170 - DNA, 20 bp, mouse
gagtatatcagagaatctgg

SEQ ID NO: 501171 - DNA, 20 bp, mouse
gtaaggtgatcatgagcagc

SEQ ID NO: 501172 - DNA, 20 bp, mouse
gggatgcttcgtgatggcta

SEQ ID NO: 501173 - DNA, 20 bp, mouse
gtctccacactccacctagg

SEQ ID NO: 501174 - DNA, 20 bp, mouse
gactggcattgcctcctagg

SEQ ID NO: 501175 - DNA, 20 bp, mouse
gaaatctccacactccacct

SEQ ID NO: 501176 - DNA, 20 bp, mouse
ggtccaaggccaccatcagg

SEQ ID NO: 501177 - DNA, 20 bp, mouse
gacactcctgctcctcctga

SEQ ID NO: 501178 - DNA, 20 bp, mouse
gggccaccatcaggaggagc

SEQ ID NO: 501179 - DNA, 20 bp, mouse
gaggaggagcaggagtgtgc

SEQ ID NO: 501180 - DNA, 20 bp, mouse
gccagctaggggatcaggaa

SEQ ID NO: 501181 - DNA, 20 bp, mouse
ggaatggtctcgttagacaa

SEQ ID NO: 501182 - DNA, 20 bp, mouse
ggatgagtggagtttcaatt

SEQ ID NO: 501183 - DNA, 20 bp, mouse
gcgagctgcatggatagagc

SEQ ID NO: 501184 - DNA, 20 bp, mouse
gcagcaaagacccatctgca

SEQ ID NO: 501185 - DNA, 20 bp, mouse
gagaccctgcctcttcagcc

SEQ ID NO: 501186 - DNA, 20 bp, mouse
ggtggagtctcaatggggac

SEQ ID NO: 501187 - DNA, 20 bp, mouse
ggttcatctttcaagatgag

SEQ ID NO: 501188 - DNA, 20 bp, mouse
gggagggtctggttatgcaa

SEQ ID NO: 501189 - DNA, 20 bp, mouse
gggaggaagttgcagggtcc

SEQ ID NO: 501190 - DNA, 20 bp, mouse
ggtcagggtgatccagctcg

SEQ ID NO: 501191 - DNA, 20 bp, mouse
gatcggcatctgccacatca

SEQ ID NO: 501192 - DNA, 20 bp, mouse
gagccgacctggatgatccg

SEQ ID NO: 501193 - DNA, 20 bp, mouse
gtctctttataaccctgatg

SEQ ID NO: 501194 - DNA, 20 bp, mouse
ggttggtagggagcagagcg

SEQ ID NO: 501195 - DNA, 20 bp, mouse
gggagggaactggactttgg

SEQ ID NO: 501196 - DNA, 20 bp, mouse
gagttgcagcagaggatcag

SEQ ID NO: 501197 - DNA, 20 bp, mouse
ggcaagaagatgcagagatg

SEQ ID NO: 501198 - DNA, 20 bp, mouse
gtggacctgagttgcagcag

SEQ ID NO: 501199 - DNA, 20 bp, mouse
ggcaggaactacctaagtat

SEQ ID NO: 501200 - DNA, 20 bp, mouse
ggatgagtcaagtctcaatc

SEQ ID NO: 501201 - DNA, 20 bp, mouse
gctacctaagtattggaacg

SEQ ID NO: 501202 - DNA, 20 bp, mouse
gatggctattttgaaacctc

SEQ ID NO: 501203 - DNA, 20 bp, mouse
gtttgaaacctcgggctgca

SEQ ID NO: 501204 - DNA, 20 bp, mouse
gactttcaacattgcatttt

SEQ ID NO: 501205 - DNA, 20 bp, mouse
gtgactcatcagagaagatg

SEQ ID NO: 501206 - DNA, 20 bp, mouse
ggtctatggtcaccaatagg

SEQ ID NO: 501207 - DNA, 20 bp, mouse
gccggtctatggtcaccaat

SEQ ID NO: 501208 - DNA, 20 bp, mouse
gacccaccttcacaatactg

SEQ ID NO: 501209 - DNA, 20 bp, mouse
gcaatactggggccggtcta

SEQ ID NO: 501210 - DNA, 20 bp, mouse
gaccggccccagtattgtga

SEQ ID NO: 501211 - DNA, 20 bp, mouse
ggccccagtattgtgaaggt

SEQ ID NO: 501212 - DNA, 20 bp, mouse
gttcagcctgaacccagagt

SEQ ID NO: 501213 - DNA, 20 bp, mouse
gaacccagagtaggtttgta

SEQ ID NO: 501214 - DNA, 20 bp, mouse
gggttcaggctgaagggtca

SEQ ID NO: 501215 - DNA, 20 bp, mouse
gctccctacaaacctactct

SEQ ID NO: 501216 - DNA, 20 bp, mouse
gcgagggtctggttaggcaa

SEQ ID NO: 501217 - DNA, 20 bp, mouse
gtggtatgcctatggacctg

SEQ ID NO: 501218 - DNA, 20 bp, mouse
ggcctatggacctgaggtgc

SEQ ID NO: 501219 - DNA, 20 bp, mouse
gcactggtccaatatgtcat

SEQ ID NO: 501220 - DNA, 20 bp, mouse
ggaggtagcaaaactgcaat

SEQ ID NO: 501221 - DNA, 20 bp, mouse
gactttcaacgctgtgattt

SEQ ID NO: 501222 - DNA, 20 bp, mouse
gtttgctacctcgggttgca

SEQ ID NO: 501223 - DNA, 20 bp, mouse
ggcaggtgccaatgacatat

SEQ ID NO: 501224 - DNA, 20 bp, mouse
gatgcagaaatgaggattcc

SEQ ID NO: 501225 - DNA, 20 bp, mouse
gctacctcgggttgcatgga

SEQ ID NO: 501226 - DNA, 20 bp, mouse
gacaggaggaggaggtccca

SEQ ID NO: 501227 - DNA, 20 bp, mouse
gtgccatcaacaggaggagg

SEQ ID NO: 501228 - DNA, 20 bp, mouse
ggtctattgccatcaacagg

SEQ ID NO: 501229 - DNA, 20 bp, mouse
gggaggaggtcccagggtcc

SEQ ID NO: 501230 - DNA, 20 bp, mouse
ggaagccctacttatcagag

SEQ ID NO: 501231 - DNA, 20 bp, mouse
gtattgtgcaggtgggtgag

SEQ ID NO: 501232 - DNA, 20 bp, mouse
gcaggtctattgccatcaac

SEQ ID NO: 501233 - DNA, 20 bp, mouse
gatgaggaagcctggaccct

SEQ ID NO: 501234 - DNA, 20 bp, mouse
gtcatcctctctgataagta

SEQ ID NO: 501235 - DNA, 20 bp, mouse
gggttggtagagagtagaac

SEQ ID NO: 501236 - DNA, 20 bp, mouse
gctgctgctgcaggttctgt

SEQ ID NO: 501237 - DNA, 20 bp, mouse
gacaaaccccagggataagt

SEQ ID NO: 501238 - DNA, 20 bp, mouse
gaccccacaagaggaccctc

SEQ ID NO: 501239 - DNA, 20 bp, mouse
gcactcaccatctggatgac

SEQ ID NO: 501240 - DNA, 20 bp, mouse
gccatgaccagtcatccaga

SEQ ID NO: 501241 - DNA, 20 bp, mouse
gcccagggataagtaggatt

SEQ ID NO: 501242 - DNA, 20 bp, mouse
gaagtaggattaggaaacaa

SEQ ID NO: 501243 - DNA, 20 bp, mouse
ggcaggagtaggatgtaaag

SEQ ID NO: 501244 - DNA, 20 bp, mouse
gattggggcttaggcatcca

SEQ ID NO: 501245 - DNA, 20 bp, mouse
gaccagagggtcctcttgtg

SEQ ID NO: 501246 - DNA, 20 bp, mouse
gcagcaggtagagagtgaag

SEQ ID NO: 501247 - DNA, 20 bp, mouse
gtccagggcaggtggtagaa

SEQ ID NO: 501248 - DNA, 20 bp, mouse
gaaggtctgtgccagggcaa

SEQ ID NO: 501249 - DNA, 20 bp, mouse
gtcgctccaaatccagagaa

SEQ ID NO: 501250 - DNA, 20 bp, mouse
gcttccctcatggggatcca

SEQ ID NO: 501251 - DNA, 20 bp, mouse
ggcagggtttaagggagtgg

SEQ ID NO: 501252 - DNA, 20 bp, mouse
gcaggaggtgcagggtttaa

SEQ ID NO: 501253 - DNA, 20 bp, mouse
gcctttaaaggtctgtgcca

SEQ ID NO: 501254 - DNA, 20 bp, mouse
gaagggaagcaggaggtgca

SEQ ID NO: 501255 - DNA, 20 bp, mouse
gtgctgaagtctccattctc

SEQ ID NO: 501256 - DNA, 20 bp, mouse
ggggctaccacgggaaggat

SEQ ID NO: 501257 - DNA, 20 bp, mouse
gcaccatgtgcaggagagcg

SEQ ID NO: 501258 - DNA, 20 bp, mouse
gaatcagggctaccacggga

SEQ ID NO: 501259 - DNA, 20 bp, mouse
gagagaccaccaccatgtgc

SEQ ID NO: 501260 - DNA, 20 bp, mouse
gaggagagcgcggttgcttg

SEQ ID NO: 501261 - DNA, 20 bp, mouse
gaaccgcgctctcctgcaca

SEQ ID NO: 501262 - DNA, 20 bp, mouse
gctcaggtcccggcagaaaa

SEQ ID NO: 501263 - DNA, 20 bp, mouse
gagcccacagagatatactg

SEQ ID NO: 501264 - DNA, 20 bp, mouse
gacctctaaagagaggatca

SEQ ID NO: 501265 - DNA, 20 bp, mouse
gcgggccagtgaacaagcat

SEQ ID NO: 501266 - DNA, 20 bp, mouse
ggtgagcagcaaggatagga

SEQ ID NO: 501267 - DNA, 20 bp, mouse
gtaggagggtagagagcgca

SEQ ID NO: 501268 - DNA, 20 bp, mouse
gctagaccttctaaacacgg

SEQ ID NO: 501269 - DNA, 20 bp, mouse
gagggtcaaggccaaagctc

SEQ ID NO: 501270 - DNA, 20 bp, mouse
gcctcggccaaggagagtga

SEQ ID NO: 501271 - DNA, 20 bp, mouse
ggaggtgtaggtgacagaag

SEQ ID NO: 501272 - DNA, 20 bp, mouse
gccgggacttgtagaggtgt

SEQ ID NO: 501273 - DNA, 20 bp, mouse
gcctctagaccttctaaaca

SEQ ID NO: 501274 - DNA, 20 bp, mouse
gaaagctccggtgagcagca

SEQ ID NO: 501275 - DNA, 20 bp, mouse
gcctgcgcgaaccagggtca

SEQ ID NO: 501276 - DNA, 20 bp, mouse
gggatgctttgcgatgacca

SEQ ID NO: 501277 - DNA, 20 bp, mouse
gcaaggtgaccatgaacagc

SEQ ID NO: 501278 - DNA, 20 bp, mouse
gtcatcgcaaagcatccaaa

SEQ ID NO: 501279 - DNA, 20 bp, mouse
gcctctcctcctgctgttca

SEQ ID NO: 501280 - DNA, 20 bp, mouse
ggcattggctcttaggtgaa

SEQ ID NO: 501281 - DNA, 20 bp, mouse
gttggctcttaggtgaaggg

SEQ ID NO: 501282 - DNA, 20 bp, mouse
gtgtcgaggccatgataaga

SEQ ID NO: 501283 - DNA, 20 bp, mouse
ggatggagagtcgggtacca

SEQ ID NO: 501284 - DNA, 20 bp, mouse
gcccagttactgcaccccca

SEQ ID NO: 501285 - DNA, 20 bp, mouse
gtaggcctgtggactggcat

SEQ ID NO: 501286 - DNA, 20 bp, mouse
ggagccactcaccccagcaa

SEQ ID NO: 501287 - DNA, 20 bp, mouse
gaagcaagggagcaagatcg

SEQ ID NO: 501288 - DNA, 20 bp, mouse
ggttaggcccacaatggagg

SEQ ID NO: 501289 - DNA, 20 bp, mouse
gccagtggttaggcccacaa

SEQ ID NO: 501290 - DNA, 20 bp, mouse
ggtggttaggcccacaatgg

SEQ ID NO: 501291 - DNA, 20 bp, mouse
gggactcaggaagctcattg

SEQ ID NO: 501292 - DNA, 20 bp, mouse
gtcattgcggttaggagtac

SEQ ID NO: 501293 - DNA, 20 bp, mouse
gagacccagcctcagcccag

SEQ ID NO: 501294 - DNA, 20 bp, mouse
gtctgcagtgaggcgggtga

SEQ ID NO: 501295 - DNA, 20 bp, mouse
ggctctaacaacgtctgttt

SEQ ID NO: 501296 - DNA, 20 bp, mouse
ggctgggagggccccctggg

SEQ ID NO: 501297 - DNA, 20 bp, mouse
gggcgctgggagggccccct

SEQ ID NO: 501298 - DNA, 20 bp, mouse
gcccagcgcccattctggag

SEQ ID NO: 501299 - DNA, 20 bp, mouse
gcctttgtcccctccagaat

SEQ ID NO: 501300 - DNA, 20 bp, mouse
ggccctcccagcgcccattc

SEQ ID NO: 501301 - DNA, 20 bp, mouse
ggggagggccccctgggtgg

SEQ ID NO: 501302 - DNA, 20 bp, mouse
gccaaagtctcagactagag

SEQ ID NO: 501303 - DNA, 20 bp, mouse
gtcccctccagaatgggcgc

SEQ ID NO: 501304 - DNA, 20 bp, mouse
gaagagtccccccagccagg

SEQ ID NO: 501305 - DNA, 20 bp, mouse
gtctgttggtgaacctcatg

SEQ ID NO: 501306 - DNA, 20 bp, mouse
gtggggcaatggcactggga

SEQ ID NO: 501307 - DNA, 20 bp, mouse
gccggttttggtcagggtca

SEQ ID NO: 501308 - DNA, 20 bp, mouse
gcagatggggcaatggcact

SEQ ID NO: 501309 - DNA, 20 bp, mouse
gaccctgaccaaaaccggag

SEQ ID NO: 501310 - DNA, 20 bp, mouse
gctcctcccgagactcccgg

SEQ ID NO: 501311 - DNA, 20 bp, mouse
ggaccgccgggagtctcggg

SEQ ID NO: 501312 - DNA, 20 bp, mouse
ggcggtccgtggtccgagag

SEQ ID NO: 501313 - DNA, 20 bp, mouse
gacggaccgccgggagtctc

SEQ ID NO: 501314 - DNA, 20 bp, mouse
gggaacacacggagagtcaa

SEQ ID NO: 501315 - DNA, 20 bp, mouse
ggcggggtccgaagagaaac

SEQ ID NO: 501316 - DNA, 20 bp, mouse
gctggccccgacccagaccc

SEQ ID NO: 501317 - DNA, 20 bp, mouse
gaggaacgcgccactcatgg

SEQ ID NO: 501318 - DNA, 20 bp, mouse
gcaggtctcacccccatgag

SEQ ID NO: 501319 - DNA, 20 bp, mouse
ggcactcacctgcctgggtc

SEQ ID NO: 501320 - DNA, 20 bp, mouse
gtaaagtccacacagcccga

SEQ ID NO: 501321 - DNA, 20 bp, mouse
gacccgcccggggtccggag

SEQ ID NO: 501322 - DNA, 20 bp, mouse
gcttctgcagagaggggcgg

SEQ ID NO: 501323 - DNA, 20 bp, mouse
gctgagtccctcgggctgtg

SEQ ID NO: 501324 - DNA, 20 bp, mouse
gctcctctccggaccccggg

SEQ ID NO: 501325 - DNA, 20 bp, mouse
gcgagccgagccgaatgacc

SEQ ID NO: 501326 - DNA, 20 bp, mouse
gggtgcggtgctcgagatgt

SEQ ID NO: 501327 - DNA, 20 bp, mouse
gcgagatgtaggtggagaag

SEQ ID NO: 501328 - DNA, 20 bp, mouse
gaaggggcggaaggtatggt

SEQ ID NO: 501329 - DNA, 20 bp, mouse
gtggggcaatggcgctgcga

SEQ ID NO: 501330 - DNA, 20 bp, mouse
gccgcccgcgaacccggccg

SEQ ID NO: 501331 - DNA, 20 bp, mouse
gacccggccggggctccggg

SEQ ID NO: 501332 - DNA, 20 bp, mouse
ggcggtgctcgagatgtagg

SEQ ID NO: 501333 - DNA, 20 bp, mouse
gcgtctgcggagaggggctg

SEQ ID NO: 501334 - DNA, 20 bp, mouse
gataaagtccatgcagccaa

SEQ ID NO: 501335 - DNA, 20 bp, mouse
gaggtatggtgggcgacgtg

SEQ ID NO: 501336 - DNA, 20 bp, mouse
ggaatcccagaggggagcaa

SEQ ID NO: 501337 - DNA, 20 bp, mouse
gcggatctcgatcagggtct

SEQ ID NO: 501338 - DNA, 20 bp, mouse
ggatgcccagaatcccagag

SEQ ID NO: 501339 - DNA, 20 bp, mouse
gaagtgtgggcctggaggca

SEQ ID NO: 501340 - DNA, 20 bp, mouse
ggacgccattgctcccctct

SEQ ID NO: 501341 - DNA, 20 bp, mouse
gcggcccgctcacccgccgg

SEQ ID NO: 501342 - DNA, 20 bp, mouse
gggtgagtaccgggtccgga

SEQ ID NO: 501343 - DNA, 20 bp, mouse
gtctgggcatctgactctgg

SEQ ID NO: 501344 - DNA, 20 bp, mouse
ggaaataactcagcaagtgt

SEQ ID NO: 501345 - DNA, 20 bp, mouse
ggcagggcgcggggctaggg

SEQ ID NO: 501346 - DNA, 20 bp, mouse
gcactcggaaactctcctca

SEQ ID NO: 501347 - DNA, 20 bp, mouse
gcagaaagccaagggccatg

SEQ ID NO: 501348 - DNA, 20 bp, mouse
gtggttgtagtatctctgtg

SEQ ID NO: 501349 - DNA, 20 bp, mouse
gaatgaaccggggctccacg

SEQ ID NO: 501350 - DNA, 20 bp, mouse
gaaccggggctccacgaggc

SEQ ID NO: 501351 - DNA, 20 bp, mouse
gacactgctgtgtcctggcc

SEQ ID NO: 501352 - DNA, 20 bp, mouse
ggaatccccgagaggagcaa

SEQ ID NO: 501353 - DNA, 20 bp, mouse
ggtcgacctgaatccccgag

SEQ ID NO: 501354 - DNA, 20 bp, mouse
gagagccattgctcctctcg

SEQ ID NO: 501355 - DNA, 20 bp, mouse
ggtatctctgtgcggtcctc

SEQ ID NO: 501356 - DNA, 20 bp, mouse
ggaatcccccaggggagcaa

SEQ ID NO: 501357 - DNA, 20 bp, mouse
gagtcgaccggaatccccca

SEQ ID NO: 501358 - DNA, 20 bp, mouse
gagagccattgctcccctgg

SEQ ID NO: 501359 - DNA, 20 bp, mouse
ggttagagccattgctcccc

SEQ ID NO: 501360 - DNA, 20 bp, mouse
gtgcagcgagtgttggcctg

SEQ ID NO: 501361 - DNA, 20 bp, mouse
gacccgaccggggtccgggg

SEQ ID NO: 501362 - DNA, 20 bp, mouse
gcgtacccgaccggggtccg

SEQ ID NO: 501363 - DNA, 20 bp, mouse
ggaaatattgcagcgagtgt

SEQ ID NO: 501364 - DNA, 20 bp, mouse
gccggtcgactgactcctgt

SEQ ID NO: 501365 - DNA, 20 bp, mouse
gacaatgctgctcttgctgg

SEQ ID NO: 501366 - DNA, 20 bp, mouse
gaagtcatgacgtgggagaa

SEQ ID NO: 501367 - DNA, 20 bp, mouse
gggtcgcagagagagcaggg

SEQ ID NO: 501368 - DNA, 20 bp, mouse
gttttcagctgtcccgagct

SEQ ID NO: 501369 - DNA, 20 bp, mouse
gggagggtcgcagagagagc

SEQ ID NO: 501370 - DNA, 20 bp, mouse
gctttgggtgagtgagaccg

SEQ ID NO: 501371 - DNA, 20 bp, mouse
ggggtgagtgagaccgggga

SEQ ID NO: 501372 - DNA, 20 bp, mouse
ggcagaccacagcggccctg

SEQ ID NO: 501373 - DNA, 20 bp, mouse
gcagtggcggcttttgccac

SEQ ID NO: 501374 - DNA, 20 bp, mouse
gttttaaaattcagattttc

SEQ ID NO: 501375 - DNA, 20 bp, mouse
gaccctgcctggggagagga

SEQ ID NO: 501376 - DNA, 20 bp, mouse
gaggttcctcacagacccag

SEQ ID NO: 501377 - DNA, 20 bp, mouse
gggacagggcggcggaactt

SEQ ID NO: 501378 - DNA, 20 bp, mouse
gacaggaatagtcctcattc

SEQ ID NO: 501379 - DNA, 20 bp, mouse
gctcaaagtacgaagtcaac

SEQ ID NO: 501380 - DNA, 20 bp, mouse
gagagtaacgacggtgagtg

SEQ ID NO: 501381 - DNA, 20 bp, mouse
gaacgacggtgagtgcggct

SEQ ID NO: 501382 - DNA, 20 bp, mouse
gtctgtgaggaaaagcggga

SEQ ID NO: 501383 - DNA, 20 bp, mouse
gaggaaaagcgggagggtgg

SEQ ID NO: 501384 - DNA, 20 bp, mouse
ggggagggactaggacaggg

SEQ ID NO: 501385 - DNA, 20 bp, mouse
gagggactaggacagggcgg

SEQ ID NO: 501386 - DNA, 20 bp, mouse
ggtctagtttctcaggacag

SEQ ID NO: 501387 - DNA, 20 bp, mouse
gcagaagataagagcccaca

SEQ ID NO: 501388 - DNA, 20 bp, mouse
gtaagagcccacatggtgtc

SEQ ID NO: 501389 - DNA, 20 bp, mouse
gacgggctccgccgtcctgg

SEQ ID NO: 501390 - DNA, 20 bp, mouse
ggcttgatcctgacaccatg

SEQ ID NO: 501391 - DNA, 20 bp, mouse
gtgagtcacccccaggacgg

SEQ ID NO: 501392 - DNA, 20 bp, mouse
gacggcggagcccgtaagta

SEQ ID NO: 501393 - DNA, 20 bp, mouse
gctgcctgcggaaaccaata

SEQ ID NO: 501394 - DNA, 20 bp, mouse
gtcaaaggagttgggactaa

SEQ ID NO: 501395 - DNA, 20 bp, mouse
gcagcacacaaccctactta

SEQ ID NO: 501396 - DNA, 20 bp, mouse
gcggccaggtgcgcaggtca

SEQ ID NO: 501397 - DNA, 20 bp, mouse
gaggagggtgccaggcacca

SEQ ID NO: 501398 - DNA, 20 bp, mouse
gtcctcctggctgcctcaca

SEQ ID NO: 501399 - DNA, 20 bp, mouse
gcgcaggtcagggaagtaga

SEQ ID NO: 501400 - DNA, 20 bp, mouse
gattgcaggtcgggacaagg

SEQ ID NO: 501401 - DNA, 20 bp, mouse
ggccttgagtggagaagtgg

SEQ ID NO: 501402 - DNA, 20 bp, mouse
gggatggggaccatggtgcc

SEQ ID NO: 501403 - DNA, 20 bp, mouse
gacctgggcaggtctgggtc

SEQ ID NO: 501404 - DNA, 20 bp, mouse
gtgagcctgggggcagcatg

SEQ ID NO: 501405 - DNA, 20 bp, mouse
gagtcaggcccgcccaccct

SEQ ID NO: 501406 - DNA, 20 bp, mouse
gaagcatcatggccaggaaa

SEQ ID NO: 501407 - DNA, 20 bp, mouse
gtcagctgaccctctgtggt

SEQ ID NO: 501408 - DNA, 20 bp, mouse
ggcacacccgcgaggaatac

SEQ ID NO: 501409 - DNA, 20 bp, mouse
gaccctctgtggttggtacc

SEQ ID NO: 501410 - DNA, 20 bp, mouse
gaggacattggagctgggta

SEQ ID NO: 501411 - DNA, 20 bp, mouse
ggtactcgagcacacccgcg

SEQ ID NO: 501412 - DNA, 20 bp, mouse
gacctccagactcgagaccc

SEQ ID NO: 501413 - DNA, 20 bp, mouse
gccacacggcacacatgctc

SEQ ID NO: 501414 - DNA, 20 bp, mouse
ggatgcctgggtctcgagtc

SEQ ID NO: 501415 - DNA, 20 bp, mouse
ggcctgggtctcgagtctgg

SEQ ID NO: 501416 - DNA, 20 bp, mouse
gatcactcccgcacctccag

SEQ ID NO: 501417 - DNA, 20 bp, mouse
gggaggtgcgggagtgatgt

SEQ ID NO: 501418 - DNA, 20 bp, mouse
gggtgcgggagtgatgttgg

SEQ ID NO: 501419 - DNA, 20 bp, mouse
gtgaggagtgatgagcctct

SEQ ID NO: 501420 - DNA, 20 bp, mouse
gaactccaggatggctacca

SEQ ID NO: 501421 - DNA, 20 bp, mouse
gggatggctaccagggagac

SEQ ID NO: 501422 - DNA, 20 bp, mouse
ggacagttctccgtgttcct

SEQ ID NO: 501423 - DNA, 20 bp, mouse
gttggaggtctacagcagta

SEQ ID NO: 501424 - DNA, 20 bp, mouse
ggatatggtgcccgtctccc

SEQ ID NO: 501425 - DNA, 20 bp, mouse
gaattgggagagggttagga

SEQ ID NO: 501426 - DNA, 20 bp, mouse
gtttatttgataacacaatt

SEQ ID NO: 501427 - DNA, 20 bp, mouse
gttgataacacaattgggag

SEQ ID NO: 501428 - DNA, 20 bp, mouse
gctaatctttgctgtgagcc

SEQ ID NO: 501429 - DNA, 20 bp, mouse
gtctggaggtgcgggagcga

SEQ ID NO: 501430 - DNA, 20 bp, mouse
gggtgcgggagcgacggtgg

SEQ ID NO: 501431 - DNA, 20 bp, mouse
gggaggtgcgggagcgacgg

SEQ ID NO: 501432 - DNA, 20 bp, mouse
gtcccacagacagccctgaa

SEQ ID NO: 501433 - DNA, 20 bp, mouse
gggaggttagccgtgcccgg

SEQ ID NO: 501434 - DNA, 20 bp, mouse
gactgtcttcgagagtcttc

SEQ ID NO: 501435 - DNA, 20 bp, mouse
ggtggaacagcatctgaggg

SEQ ID NO: 501436 - DNA, 20 bp, mouse
gcgcggggtcgagcatgtcc

SEQ ID NO: 501437 - DNA, 20 bp, mouse
ggcgcctggaactccaacac

SEQ ID NO: 501438 - DNA, 20 bp, mouse
ggaactgagcgagccggtgt

SEQ ID NO: 501439 - DNA, 20 bp, mouse
gtggcgaggcagttccgggg

SEQ ID NO: 501440 - DNA, 20 bp, mouse
ggtttggcgaggcagttccg

SEQ ID NO: 501441 - DNA, 20 bp, mouse
ggcgcccgtgtacctggcgg

SEQ ID NO: 501442 - DNA, 20 bp, mouse
gtgcctgtcacgggcggcag

SEQ ID NO: 501443 - DNA, 20 bp, mouse
gggggtggcgcgcgtcgtcc

SEQ ID NO: 501444 - DNA, 20 bp, mouse
gacatgctcgaccccgcgcc

SEQ ID NO: 501445 - DNA, 20 bp, mouse
ggcaagtgaacccgacagac

SEQ ID NO: 501446 - DNA, 20 bp, mouse
gggtccgactgcgagagcgg

SEQ ID NO: 501447 - DNA, 20 bp, mouse
gggcggtccgactgcgagag

SEQ ID NO: 501448 - DNA, 20 bp, mouse
gcgtcgcgcggccgagacca

SEQ ID NO: 501449 - DNA, 20 bp, mouse
gcccgcactcaccatggtct

SEQ ID NO: 501450 - DNA, 20 bp, mouse
ggtgctgcgccgcacagagg

SEQ ID NO: 501451 - DNA, 20 bp, mouse
gcagccggacctcctctgtg

SEQ ID NO: 501452 - DNA, 20 bp, mouse
gcattgtcccgctctggctg

SEQ ID NO: 501453 - DNA, 20 bp, mouse
gggaccgccgcagccagagc

SEQ ID NO: 501454 - DNA, 20 bp, mouse
gccgccgccgctctcgcagt

SEQ ID NO: 501455 - DNA, 20 bp, mouse
gcccgggcattgtcccgctc

SEQ ID NO: 501456 - DNA, 20 bp, mouse
gccggacgcggcaagaccgg

SEQ ID NO: 501457 - DNA, 20 bp, mouse
ggccaggcgaccgttgactg

SEQ ID NO: 501458 - DNA, 20 bp, mouse
gcgtccggacatagtgtacg

SEQ ID NO: 501459 - DNA, 20 bp, mouse
gaggcgaccgttgactgcgg

SEQ ID NO: 501460 - DNA, 20 bp, mouse
gctacctcgtacactatgtc

SEQ ID NO: 501461 - DNA, 20 bp, mouse
gtaccaaccgccgcagtcaa

SEQ ID NO: 501462 - DNA, 20 bp, mouse
gtgcggcggttggtagttcg

SEQ ID NO: 501463 - DNA, 20 bp, mouse
gtgtccggacgcggcaagac

SEQ ID NO: 501464 - DNA, 20 bp, mouse
gcggtggcgctgctcttctt

SEQ ID NO: 501465 - DNA, 20 bp, mouse
gccctgtaggccgcgtacac

SEQ ID NO: 501466 - DNA, 20 bp, mouse
ggcgcgggcgggaagcgagg

SEQ ID NO: 501467 - DNA, 20 bp, mouse
ggcgggaagcgaggaggcgt

SEQ ID NO: 501468 - DNA, 20 bp, mouse
gttccagcggagccgggcgg

SEQ ID NO: 501469 - DNA, 20 bp, mouse
ggccaggcaggagtgcggag

SEQ ID NO: 501470 - DNA, 20 bp, mouse
gggaagcgaggaggcgtggg

SEQ ID NO: 501471 - DNA, 20 bp, mouse
ggcgagtggttccagttcac

SEQ ID NO: 501472 - DNA, 20 bp, mouse
ggaactggaaccactcgcgg

SEQ ID NO: 501473 - DNA, 20 bp, mouse
ggcaggagtgcggagcggac

SEQ ID NO: 501474 - DNA, 20 bp, mouse
ggggcccagacggggcggac

SEQ ID NO: 501475 - DNA, 20 bp, mouse
gcgcgctcgcgccctccgcc

SEQ ID NO: 501476 - DNA, 20 bp, mouse
gcaggggccgaagggagcca

SEQ ID NO: 501477 - DNA, 20 bp, mouse
gctgcactgcccggacaaga

SEQ ID NO: 501478 - DNA, 20 bp, mouse
gctccccccgctactatccg

SEQ ID NO: 501479 - DNA, 20 bp, mouse
ggcggcaagcggcagttctc

SEQ ID NO: 501480 - DNA, 20 bp, mouse
gtctcccgaggaagcaagtt

SEQ ID NO: 501481 - DNA, 20 bp, mouse
ggcgtgtcaatggcggcaag

SEQ ID NO: 501482 - DNA, 20 bp, mouse
gtcctcgggagataaaaggg

SEQ ID NO: 501483 - DNA, 20 bp, mouse
ggggccgcggatagtagcgg

SEQ ID NO: 501484 - DNA, 20 bp, mouse
ggggcagtgcaggggccgaa

SEQ ID NO: 501485 - DNA, 20 bp, mouse
gtgaccggggtgcgccctca

SEQ ID NO: 501486 - DNA, 20 bp, mouse
ggcgcgaggaaggcgggaga

SEQ ID NO: 501487 - DNA, 20 bp, mouse
gtaaagggcgcgaggaaggc

SEQ ID NO: 501488 - DNA, 20 bp, mouse
ggaacattctgcagtataaa

SEQ ID NO: 501489 - DNA, 20 bp, mouse
gagtataaagggcgcgagga

SEQ ID NO: 501490 - DNA, 20 bp, mouse
gcggccgagttcccggatga

SEQ ID NO: 501491 - DNA, 20 bp, mouse
gctgcagtataaagggcgcg

SEQ ID NO: 501492 - DNA, 20 bp, mouse
gcgggctgcaggctccgagc

SEQ ID NO: 501493 - DNA, 20 bp, mouse
gctcccagccccggggacgg

SEQ ID NO: 501494 - DNA, 20 bp, mouse
gatggtaacgtgaagagtga

SEQ ID NO: 501495 - DNA, 20 bp, mouse
gccctgccgcgagcccgccg

SEQ ID NO: 501496 - DNA, 20 bp, mouse
gatagccgtggtagacgcca

SEQ ID NO: 501497 - DNA, 20 bp, mouse
gaggttggcgccctcagcca

SEQ ID NO: 501498 - DNA, 20 bp, mouse
ggctgagggcgccaacctga

SEQ ID NO: 501499 - DNA, 20 bp, mouse
gtggtagacgccatggctga

SEQ ID NO: 501500 - DNA, 20 bp, mouse
gtccagaacgtccatagccg

SEQ ID NO: 501501 - DNA, 20 bp, mouse
gcagagaaagagaagccgga

SEQ ID NO: 501502 - DNA, 20 bp, mouse
ggttctggaggagctatctt

SEQ ID NO: 501503 - DNA, 20 bp, mouse
gctgacggaaagtcagaaaa

SEQ ID NO: 501504 - DNA, 20 bp, mouse
gttacggcgtctgatcagac

SEQ ID NO: 501505 - DNA, 20 bp, mouse
gttctgactttccgtcaggt

SEQ ID NO: 501506 - DNA, 20 bp, mouse
gggctgagacggagagaccg

SEQ ID NO: 501507 - DNA, 20 bp, mouse
gaggcacccacagtcccccc

SEQ ID NO: 501508 - DNA, 20 bp, mouse
gtgccactgctgggctgaga

SEQ ID NO: 501509 - DNA, 20 bp, mouse
gcccggaggcggcagttaag

SEQ ID NO: 501510 - DNA, 20 bp, mouse
gtcgagcccggggggactgt

SEQ ID NO: 501511 - DNA, 20 bp, mouse
gactggggcctgggacccgg

SEQ ID NO: 501512 - DNA, 20 bp, mouse
gctccgtctcagcccagcag

SEQ ID NO: 501513 - DNA, 20 bp, mouse
gcccagcagtggcaccgccg

SEQ ID NO: 501514 - DNA, 20 bp, mouse
gttggcgcagaaatggagat

SEQ ID NO: 501515 - DNA, 20 bp, mouse
gggtctggggtcccgggaag

SEQ ID NO: 501516 - DNA, 20 bp, mouse
gtcgggagatgtcagcgcgt

SEQ ID NO: 501517 - DNA, 20 bp, mouse
gaagcctcaccgctacaggt

SEQ ID NO: 501518 - DNA, 20 bp, mouse
gcgttggtgtatgcaaatca

SEQ ID NO: 501519 - DNA, 20 bp, mouse
gaccgcggtcctaaaagcca

SEQ ID NO: 501520 - DNA, 20 bp, mouse
gcgccaatcgaaaaagtcgt

SEQ ID NO: 501521 - DNA, 20 bp, mouse
ggcggtcctaaaagccaggg

SEQ ID NO: 501522 - DNA, 20 bp, mouse
ggcctcaccgaccagaccgt

SEQ ID NO: 501523 - DNA, 20 bp, mouse
gcgggcggccggaaacaccg

SEQ ID NO: 501524 - DNA, 20 bp, mouse
ggcagacaggacggaggtgg

SEQ ID NO: 501525 - DNA, 20 bp, mouse
gcatctgctgcggcgaggag

SEQ ID NO: 501526 - DNA, 20 bp, mouse
gttcatgatggaccagggac

SEQ ID NO: 501527 - DNA, 20 bp, mouse
gggcttcacctcaccccctc

SEQ ID NO: 501528 - DNA, 20 bp, mouse
gtcactcagcaagttcatga

SEQ ID NO: 501529 - DNA, 20 bp, mouse
gctgactgcagcagtgcctt

SEQ ID NO: 501530 - DNA, 20 bp, mouse
ggcaagttcatgatggacca

SEQ ID NO: 501531 - DNA, 20 bp, mouse
gcctgaattgatcgatggga

SEQ ID NO: 501532 - DNA, 20 bp, mouse
ggcacttgcctgagggggtg

SEQ ID NO: 501533 - DNA, 20 bp, mouse
gctcttatttaatagttata

SEQ ID NO: 501534 - DNA, 20 bp, mouse
gaagccagggaaaaataagt

SEQ ID NO: 501535 - DNA, 20 bp, mouse
ggcagtgtgcacttgcctga

SEQ ID NO: 501536 - DNA, 20 bp, mouse
gcaggggatggacacaatgg

SEQ ID NO: 501537 - DNA, 20 bp, mouse
gcccgcacgtgttcgcccgg

SEQ ID NO: 501538 - DNA, 20 bp, mouse
gggatggacacaatggcgga

SEQ ID NO: 501539 - DNA, 20 bp, mouse
gtggacacaatggcggaggg

SEQ ID NO: 501540 - DNA, 20 bp, mouse
gcgcggacacctcgacacca

SEQ ID NO: 501541 - DNA, 20 bp, mouse
gaaatctgttcagctggcat

SEQ ID NO: 501542 - DNA, 20 bp, mouse
ggtcgaggtgtccgcgctgt

SEQ ID NO: 501543 - DNA, 20 bp, mouse
ggggggctagaggtcttgcg

SEQ ID NO: 501544 - DNA, 20 bp, mouse
gcgcaagaaatctgttcagc

SEQ ID NO: 501545 - DNA, 20 bp, mouse
ggggcaggggatggacacaa

SEQ ID NO: 501546 - DNA, 20 bp, mouse
ggcggggcgaacacttgcgg

SEQ ID NO: 501547 - DNA, 20 bp, mouse
gtccgcggggcgaacacttg

SEQ ID NO: 501548 - DNA, 20 bp, mouse
gggatgggcacagcggcgca

SEQ ID NO: 501549 - DNA, 20 bp, mouse
gtgaccccttggagtcccct

SEQ ID NO: 501550 - DNA, 20 bp, mouse
ggttatgagggccagcttgg

SEQ ID NO: 501551 - DNA, 20 bp, mouse
ggggagctagaggtcttgag

SEQ ID NO: 501552 - DNA, 20 bp, mouse
gagggcgctgtgtgacccct

SEQ ID NO: 501553 - DNA, 20 bp, mouse
gcacagcggcgcagggcgga

SEQ ID NO: 501554 - DNA, 20 bp, mouse
gcggggacacccggacacca

SEQ ID NO: 501555 - DNA, 20 bp, mouse
gtgagaggaacctcccacag

SEQ ID NO: 501556 - DNA, 20 bp, mouse
ggagcagcgcccagggaccc

SEQ ID NO: 501557 - DNA, 20 bp, mouse
ggaccatcaatatcagaagc

SEQ ID NO: 501558 - DNA, 20 bp, mouse
gactggtggctgcaccgtgg

SEQ ID NO: 501559 - DNA, 20 bp, mouse
gggaagcctaagtaactcag

SEQ ID NO: 501560 - DNA, 20 bp, mouse
ggaatcactcccgggtccct

SEQ ID NO: 501561 - DNA, 20 bp, mouse
gaagagttcaaggaaaggat

SEQ ID NO: 501562 - DNA, 20 bp, mouse
ggaaactggtggctgcaccg

SEQ ID NO: 501563 - DNA, 20 bp, mouse
gcaaggaaaggatgggacta

SEQ ID NO: 501564 - DNA, 20 bp, mouse
gtgcaccgtgggggagaaat

SEQ ID NO: 501565 - DNA, 20 bp, mouse
gttagaggggaatcactccc

SEQ ID NO: 501566 - DNA, 20 bp, mouse
ggtcgggctgcgcagcgtca

SEQ ID NO: 501567 - DNA, 20 bp, mouse
gctagcacgacaggcagcgg

SEQ ID NO: 501568 - DNA, 20 bp, mouse
gcccgggatgccgcagagtc

SEQ ID NO: 501569 - DNA, 20 bp, mouse
ggctgcgcagcccgactctg

SEQ ID NO: 501570 - DNA, 20 bp, mouse
ggcgcagcgtcagggcgcag

SEQ ID NO: 501571 - DNA, 20 bp, mouse
gccaggagcgcgcgcaatgg

SEQ ID NO: 501572 - DNA, 20 bp, mouse
gtggctagcacgacaggcag

SEQ ID NO: 501573 - DNA, 20 bp, mouse
ggccgggagccgcgctcgca

SEQ ID NO: 501574 - DNA, 20 bp, mouse
gggcacgcggcgagagccca

SEQ ID NO: 501575 - DNA, 20 bp, mouse
gggcgaagctagcgcagagg

SEQ ID NO: 501576 - DNA, 20 bp, mouse
gtcccctcatggccaatctg

SEQ ID NO: 501577 - DNA, 20 bp, mouse
gttagaggaggccggagaaa

SEQ ID NO: 501578 - DNA, 20 bp, mouse
gcttagaggagagcttcatc

SEQ ID NO: 501579 - DNA, 20 bp, mouse
gaagggctctttggacttag

SEQ ID NO: 501580 - DNA, 20 bp, mouse
ggcctcctctaaagataact

SEQ ID NO: 501581 - DNA, 20 bp, mouse
gtcccagttatctttagagg

SEQ ID NO: 501582 - DNA, 20 bp, mouse
gggccggagaaagggctctt

SEQ ID NO: 501583 - DNA, 20 bp, mouse
gggctcccagttatctttag

SEQ ID NO: 501584 - DNA, 20 bp, mouse
gaagataactgggagcccgg

SEQ ID NO: 501585 - DNA, 20 bp, mouse
gcggagccccggaactggag

SEQ ID NO: 501586 - DNA, 20 bp, mouse
gtggtggccaggtaatcggg

SEQ ID NO: 501587 - DNA, 20 bp, mouse
gtacctggccaccacgttgt

SEQ ID NO: 501588 - DNA, 20 bp, mouse
gtcttctgcccacaacgtgg

SEQ ID NO: 501589 - DNA, 20 bp, mouse
gacgtggtggccaggtaatc

SEQ ID NO: 501590 - DNA, 20 bp, mouse
ggactcttctgcccacaacg

SEQ ID NO: 501591 - DNA, 20 bp, mouse
gtggaacgcaaggttagagg

SEQ ID NO: 501592 - DNA, 20 bp, mouse
gtagagctgccccctcagag

SEQ ID NO: 501593 - DNA, 20 bp, mouse
gcgtgtgagagtgaagtctt

SEQ ID NO: 501594 - DNA, 20 bp, mouse
gaggagactgcgcagatcgc

SEQ ID NO: 501595 - DNA, 20 bp, mouse
gggccaggtaatcgggaggt

SEQ ID NO: 501596 - DNA, 20 bp, mouse
gggcgattagcagcaggaca

SEQ ID NO: 501597 - DNA, 20 bp, mouse
ggctgctaatcgccctggtg

SEQ ID NO: 501598 - DNA, 20 bp, mouse
ggtccccacagaggtgacta

SEQ ID NO: 501599 - DNA, 20 bp, mouse
gtagggacaggacttctcag

SEQ ID NO: 501600 - DNA, 20 bp, mouse
gggtcaggacacacacaact

SEQ ID NO: 501601 - DNA, 20 bp, mouse
gcagatatttgtcaggatgt

SEQ ID NO: 501602 - DNA, 20 bp, mouse
gacttctcagaggatttccg

SEQ ID NO: 501603 - DNA, 20 bp, mouse
gaactacacagatatttgtc

SEQ ID NO: 501604 - DNA, 20 bp, mouse
gtccctaggagactagatta

SEQ ID NO: 501605 - DNA, 20 bp, mouse
gtctcaaccaaagaaacgtg

SEQ ID NO: 501606 - DNA, 20 bp, mouse
gcagcatgggtcctcgcccg

SEQ ID NO: 501607 - DNA, 20 bp, mouse
gtgaggttcagcgaagccgc

SEQ ID NO: 501608 - DNA, 20 bp, mouse
gctgcccgcggcgcccgcag

SEQ ID NO: 501609 - DNA, 20 bp, mouse
gcgcggggccgagagtgcgg

SEQ ID NO: 501610 - DNA, 20 bp, mouse
gcagctgctggacgacgagt

SEQ ID NO: 501611 - DNA, 20 bp, mouse
gcctcccgcaggatgtcgaa

SEQ ID NO: 501612 - DNA, 20 bp, mouse
gcgcaagcgtcgcgatgagg

SEQ ID NO: 501613 - DNA, 20 bp, mouse
gccgcgatgcaggagacgtt

SEQ ID NO: 501614 - DNA, 20 bp, mouse
gggccgggaggagccgaccg

SEQ ID NO: 501615 - DNA, 20 bp, mouse
gggacccgttcgacatcctg

SEQ ID NO: 501616 - DNA, 20 bp, mouse
ggaaaggcgcgagcgagcgg

SEQ ID NO: 501617 - DNA, 20 bp, mouse
gaaccagaccgcgctggggt

SEQ ID NO: 501618 - DNA, 20 bp, mouse
gtggttggcagccgtcggtg

SEQ ID NO: 501619 - DNA, 20 bp, mouse
gagcggggccgcggcaggaa

SEQ ID NO: 501620 - DNA, 20 bp, mouse
gaggcgcgagcgagcggagg

SEQ ID NO: 501621 - DNA, 20 bp, mouse
gcggcctgtgcggggatgta

SEQ ID NO: 501622 - DNA, 20 bp, mouse
gcaggaaaggcgcgagcgag

SEQ ID NO: 501623 - DNA, 20 bp, mouse
gctccgggcgcctcaccctc

SEQ ID NO: 501624 - DNA, 20 bp, mouse
gtgccaaccagaccgcgctg

SEQ ID NO: 501625 - DNA, 20 bp, mouse
gagtcagtccgccgcaccga

SEQ ID NO: 501626 - DNA, 20 bp, mouse
ggtcaccaacaacaactctt

SEQ ID NO: 501627 - DNA, 20 bp, mouse
gaccccccgggagggcaaga

SEQ ID NO: 501628 - DNA, 20 bp, mouse
gagctcagtccggtatggag

SEQ ID NO: 501629 - DNA, 20 bp, mouse
gcttctgtcgctaccctctg

SEQ ID NO: 501630 - DNA, 20 bp, mouse
gctagagacggagggcaagg

SEQ ID NO: 501631 - DNA, 20 bp, mouse
ggcgttgtcctagagacgga

SEQ ID NO: 501632 - DNA, 20 bp, mouse
gtccacctaaagttacttca

SEQ ID NO: 501633 - DNA, 20 bp, mouse
ggagggtgactgcagagacc

SEQ ID NO: 501634 - DNA, 20 bp, mouse
ggccttgaagtaactttagg

SEQ ID NO: 501635 - DNA, 20 bp, mouse
gctagtggaggacaaaacca

SEQ ID NO: 501636 - DNA, 20 bp, mouse
gcggctgctgcactgagcta

SEQ ID NO: 501637 - DNA, 20 bp, mouse
gctcagtgcagcagccgagg

SEQ ID NO: 501638 - DNA, 20 bp, mouse
gagaggtcccggagcgtcgt

SEQ ID NO: 501639 - DNA, 20 bp, mouse
ggcagtggggacagcgcgag

SEQ ID NO: 501640 - DNA, 20 bp, mouse
gatggagcgcaagaattgcc

SEQ ID NO: 501641 - DNA, 20 bp, mouse
ggggacagcgcgagaggtcc

SEQ ID NO: 501642 - DNA, 20 bp, mouse
gggccgaaggctgtagttct

SEQ ID NO: 501643 - DNA, 20 bp, mouse
gagctatggcgttcgtgacc

SEQ ID NO: 501644 - DNA, 20 bp, mouse
gagcatgtgaccgtcatcgg

SEQ ID NO: 501645 - DNA, 20 bp, mouse
gttggcggccgccgacgcag

SEQ ID NO: 501646 - DNA, 20 bp, mouse
gctggagcgtaggatcctga

SEQ ID NO: 501647 - DNA, 20 bp, mouse
gtagttgagagcaagaggta

SEQ ID NO: 501648 - DNA, 20 bp, mouse
gccctctccaggctcacctc

SEQ ID NO: 501649 - DNA, 20 bp, mouse
gaggctcacctctggagcgt

SEQ ID NO: 501650 - DNA, 20 bp, mouse
gcccgggacccgtggaaatg

SEQ ID NO: 501651 - DNA, 20 bp, mouse
gactctcccgagccctctcc

SEQ ID NO: 501652 - DNA, 20 bp, mouse
gcgggtcccgggaaaggggt

SEQ ID NO: 501653 - DNA, 20 bp, mouse
gctcaagatggtggcgtccc

SEQ ID NO: 501654 - DNA, 20 bp, mouse
gtacaaggacacaggaaata

SEQ ID NO: 501655 - DNA, 20 bp, mouse
gtggtggcgtcccgggcgat

SEQ ID NO: 501656 - DNA, 20 bp, mouse
gtttcgcggactctaaggtg

SEQ ID NO: 501657 - DNA, 20 bp, mouse
gagtctggacttgaccttgt

SEQ ID NO: 501658 - DNA, 20 bp, mouse
ggggagccgcccctcggcgt

SEQ ID NO: 501659 - DNA, 20 bp, mouse
gagaagagtcgggagcaaag

SEQ ID NO: 501660 - DNA, 20 bp, mouse
ggccctgaggcggttcgcac

SEQ ID NO: 501661 - DNA, 20 bp, mouse
ggtccgcccacgccgagggg

SEQ ID NO: 501662 - DNA, 20 bp, mouse
gagggtcgaagtcccaagag

SEQ ID NO: 501663 - DNA, 20 bp, mouse
gggcatcgacgagaagagtc

SEQ ID NO: 501664 - DNA, 20 bp, mouse
gtccagtgcgaaccgcctca

SEQ ID NO: 501665 - DNA, 20 bp, mouse
gaccaccgcccgccctgagg

SEQ ID NO: 501666 - DNA, 20 bp, mouse
ggcgtcgtgggcatcaacac

SEQ ID NO: 501667 - DNA, 20 bp, mouse
gctgcgcctggaaacagcaa

SEQ ID NO: 501668 - DNA, 20 bp, mouse
gtccgcaacaccagcgtcgt

SEQ ID NO: 501669 - DNA, 20 bp, mouse
ggacccggctgtgcaccccg

SEQ ID NO: 501670 - DNA, 20 bp, mouse
gggtggctcccagcgctgac

SEQ ID NO: 501671 - DNA, 20 bp, mouse
gctgtgcaccccgtgggtca

SEQ ID NO: 501672 - DNA, 20 bp, mouse
gtggaggccggacgtcggtt

SEQ ID NO: 501673 - DNA, 20 bp, mouse
ggtgttgagggccttggaat

SEQ ID NO: 501674 - DNA, 20 bp, mouse
ggacacacttacccagacca

SEQ ID NO: 501675 - DNA, 20 bp, mouse
gtgttgcggactccgcgacc

SEQ ID NO: 501676 - DNA, 20 bp, mouse
ggaagtggtgatgtcgcggt

SEQ ID NO: 501677 - DNA, 20 bp, mouse
gcgatcctgaaagagtactg

SEQ ID NO: 501678 - DNA, 20 bp, mouse
ggagtactgcggagacctga

SEQ ID NO: 501679 - DNA, 20 bp, mouse
gcagggaagtggtgatgtcg

SEQ ID NO: 501680 - DNA, 20 bp, mouse
ggggcctactgtaccaggag

SEQ ID NO: 501681 - DNA, 20 bp, mouse
gcaggatcgcgacagggaag

SEQ ID NO: 501682 - DNA, 20 bp, mouse
gtccaagctccaagactcag

SEQ ID NO: 501683 - DNA, 20 bp, mouse
gcactccaggactagatcgg

SEQ ID NO: 501684 - DNA, 20 bp, mouse
gctctttcaggatcgcgaca

SEQ ID NO: 501685 - DNA, 20 bp, mouse
gagagccgccgatctagtcc

SEQ ID NO: 501686 - DNA, 20 bp, mouse
gagcaggccactgtaaccaa

SEQ ID NO: 501687 - DNA, 20 bp, mouse
ggcacgtgcactgtgtacct

SEQ ID NO: 501688 - DNA, 20 bp, mouse
gagccagcccttggttacag

SEQ ID NO: 501689 - DNA, 20 bp, mouse
gtgcactgtgtacctaggca

SEQ ID NO: 501690 - DNA, 20 bp, mouse
gctccccagtcgaggactgt

SEQ ID NO: 501691 - DNA, 20 bp, mouse
gggccactgtaaccaagggc

SEQ ID NO: 501692 - DNA, 20 bp, mouse
gggcggtgccctgtcaggat

SEQ ID NO: 501693 - DNA, 20 bp, mouse
gtaaaggctctccccagtcg

SEQ ID NO: 501694 - DNA, 20 bp, mouse
gaggatgggaagctcactgt

SEQ ID NO: 501695 - DNA, 20 bp, mouse
ggacaatggtggcttcactt

SEQ ID NO: 501696 - DNA, 20 bp, mouse
gtggctgtcccaccccgtca

SEQ ID NO: 501697 - DNA, 20 bp, mouse
gaagaatgccctgacggggt

SEQ ID NO: 501698 - DNA, 20 bp, mouse
gcttaaagaatgccctgacg

SEQ ID NO: 501699 - DNA, 20 bp, mouse
ggggcagaaaaactctaatg

SEQ ID NO: 501700 - DNA, 20 bp, mouse
ggccaaacaaaagtgttcct

SEQ ID NO: 501701 - DNA, 20 bp, mouse
gtgtggaaaatgaagcatgg

SEQ ID NO: 501702 - DNA, 20 bp, mouse
ggccaaggaacacttttgtt

SEQ ID NO: 501703 - DNA, 20 bp, mouse
gagaaaaactctaatgagga

SEQ ID NO: 501704 - DNA, 20 bp, mouse
gatgcttcattttccacagt

SEQ ID NO: 501705 - DNA, 20 bp, mouse
gttataaaatactcatgtaa

SEQ ID NO: 501706 - DNA, 20 bp, mouse
gagctgtcccaccccagtca

SEQ ID NO: 501707 - DNA, 20 bp, mouse
gactggggtgggacagctgg

SEQ ID NO: 501708 - DNA, 20 bp, mouse
ggattaagaaatgccctgac

SEQ ID NO: 501709 - DNA, 20 bp, mouse
gatttagtaaagacttactg

SEQ ID NO: 501710 - DNA, 20 bp, mouse
gggcagaaaaaattctcatg

SEQ ID NO: 501711 - DNA, 20 bp, mouse
gtcctttcattttccacagt

SEQ ID NO: 501712 - DNA, 20 bp, mouse
gttagactgcacagcagaac

SEQ ID NO: 501713 - DNA, 20 bp, mouse
gtcctactgtggaaaatgaa

SEQ ID NO: 501714 - DNA, 20 bp, mouse
ggaaatgccctgactggggt

SEQ ID NO: 501715 - DNA, 20 bp, mouse
gtgaaaggaaggaacatggt

SEQ ID NO: 501716 - DNA, 20 bp, mouse
gtgtaggcaacgagggagaa

SEQ ID NO: 501717 - DNA, 20 bp, mouse
gccgccggcagggaaatctg

SEQ ID NO: 501718 - DNA, 20 bp, mouse
gaggtttctgtaggcaacga

SEQ ID NO: 501719 - DNA, 20 bp, mouse
gacctcttgaaggtttctgt

SEQ ID NO: 501720 - DNA, 20 bp, mouse
gtggtggcaagtccgcagaa

SEQ ID NO: 501721 - DNA, 20 bp, mouse
gggacctgccgacctcttga

SEQ ID NO: 501722 - DNA, 20 bp, mouse
gtctccaacatgaacctcgt

SEQ ID NO: 501723 - DNA, 20 bp, mouse
gaggccgggccaaacaggaa

SEQ ID NO: 501724 - DNA, 20 bp, mouse
gctgcccacgaggttcatgt

SEQ ID NO: 501725 - DNA, 20 bp, mouse
ggcctacagaaaccttcaag

SEQ ID NO: 501726 - DNA, 20 bp, mouse
gggttctcttgggctggacg

SEQ ID NO: 501727 - DNA, 20 bp, mouse
ggaggggtgtgctcagacag

SEQ ID NO: 501728 - DNA, 20 bp, mouse
gagtggccgcggaagctcct

SEQ ID NO: 501729 - DNA, 20 bp, mouse
gcttgggctggacgcggtga

SEQ ID NO: 501730 - DNA, 20 bp, mouse
ggctcctcaggctctctcgg

SEQ ID NO: 501731 - DNA, 20 bp, mouse
gggcgaatggactctcggag

SEQ ID NO: 501732 - DNA, 20 bp, mouse
ggcagcggcggcggttctct

SEQ ID NO: 501733 - DNA, 20 bp, mouse
gaagcctccgagagagcctg

SEQ ID NO: 501734 - DNA, 20 bp, mouse
gattcttgtccggagaggag

SEQ ID NO: 501735 - DNA, 20 bp, mouse
gccggggcgagtccaagctg

SEQ ID NO: 501736 - DNA, 20 bp, mouse
ggcaacattgtggcagggta

SEQ ID NO: 501737 - DNA, 20 bp, mouse
gcactgatgcagaccagtcg

SEQ ID NO: 501738 - DNA, 20 bp, mouse
gtcgaggcaacattgtggca

SEQ ID NO: 501739 - DNA, 20 bp, mouse
gcaacctcagatactctgga

SEQ ID NO: 501740 - DNA, 20 bp, mouse
gtgacttctgaagcactgat

SEQ ID NO: 501741 - DNA, 20 bp, mouse
ggtcagtgtatgactattac

SEQ ID NO: 501742 - DNA, 20 bp, mouse
gacttatgaagcacaaatcc

SEQ ID NO: 501743 - DNA, 20 bp, mouse
gatcttgaagattgatggat

SEQ ID NO: 501744 - DNA, 20 bp, mouse
gtgtatgactattacaggtc

SEQ ID NO: 501745 - DNA, 20 bp, mouse
gatacttgtgttgatggact

SEQ ID NO: 501746 - DNA, 20 bp, mouse
gcagcaatagcagtatgtag

SEQ ID NO: 501747 - DNA, 20 bp, mouse
ggctacagaggcccaccgtt

SEQ ID NO: 501748 - DNA, 20 bp, mouse
gcaagacaaacctgacacta

SEQ ID NO: 501749 - DNA, 20 bp, mouse
gctctgtagcaggctttgca

SEQ ID NO: 501750 - DNA, 20 bp, mouse
gtacttcagagccgaacggt

SEQ ID NO: 501751 - DNA, 20 bp, mouse
ggaggagaagatgaaatagt

SEQ ID NO: 501752 - DNA, 20 bp, mouse
gttgatactacagctttctt

SEQ ID NO: 501753 - DNA, 20 bp, mouse
gtacatggagataggtggca

SEQ ID NO: 501754 - DNA, 20 bp, mouse
ggtagtatcaaagagtctgc

SEQ ID NO: 501755 - DNA, 20 bp, mouse
ggcataaaaagttcagtcca

SEQ ID NO: 501756 - DNA, 20 bp, mouse
ggagcaggtgcagagcggtg

SEQ ID NO: 501757 - DNA, 20 bp, mouse
gcgaaagagcaggtgcagag

SEQ ID NO: 501758 - DNA, 20 bp, mouse
gcggtgcgggagacgggaca

SEQ ID NO: 501759 - DNA, 20 bp, mouse
gactgcaggctgggtcgtgg

SEQ ID NO: 501760 - DNA, 20 bp, mouse
ggcgggagacgggacagggt

SEQ ID NO: 501761 - DNA, 20 bp, mouse
gtgcagagcggtgcgggaga

SEQ ID NO: 501762 - DNA, 20 bp, mouse
gggagacgggacagggtcgg

SEQ ID NO: 501763 - DNA, 20 bp, mouse
gggttataaagccccggctg

SEQ ID NO: 501764 - DNA, 20 bp, mouse
gcggctgcggcagcggactg

SEQ ID NO: 501765 - DNA, 20 bp, mouse
gccggagcgggaccaactgc

SEQ ID NO: 501766 - DNA, 20 bp, mouse
gctccagctcccagctaagt

SEQ ID NO: 501767 - DNA, 20 bp, mouse
gaagatatgtctgaaagagg

SEQ ID NO: 501768 - DNA, 20 bp, mouse
gcagtgctatgaaatatata

SEQ ID NO: 501769 - DNA, 20 bp, mouse
gttctgctcttggtgagaag

SEQ ID NO: 501770 - DNA, 20 bp, mouse
gtggcagaggtcctgatccg

SEQ ID NO: 501771 - DNA, 20 bp, mouse
gctctgggcgagtgcggtgt

SEQ ID NO: 501772 - DNA, 20 bp, mouse
gctgttgctattaatctgaa

SEQ ID NO: 501773 - DNA, 20 bp, mouse
gtctctctgaggggatgtat

SEQ ID NO: 501774 - DNA, 20 bp, mouse
gaagctgagtcccacttagc

SEQ ID NO: 501775 - DNA, 20 bp, mouse
gggtcctgatccgaggataa

SEQ ID NO: 501776 - DNA, 20 bp, mouse
gcagaagaggctgtcaagat

SEQ ID NO: 501777 - DNA, 20 bp, mouse
gctctgtgccaggctatata

SEQ ID NO: 501778 - DNA, 20 bp, mouse
gacttctgtccttagaccag

SEQ ID NO: 501779 - DNA, 20 bp, mouse
gagggcaagacaccggttgg

SEQ ID NO: 501780 - DNA, 20 bp, mouse
gcttgacagcctcttctgaa

SEQ ID NO: 501781 - DNA, 20 bp, mouse
gtctgtccttagaccagggg

SEQ ID NO: 501782 - DNA, 20 bp, mouse
gagtacaagggtgctggacc

SEQ ID NO: 501783 - DNA, 20 bp, mouse
gtggggccagggcaagacac

SEQ ID NO: 501784 - DNA, 20 bp, mouse
gctggccccaggacatcaac

SEQ ID NO: 501785 - DNA, 20 bp, mouse
gagaccaattgtaagtacaa

SEQ ID NO: 501786 - DNA, 20 bp, mouse
gtgcgacacgctgaggccac

SEQ ID NO: 501787 - DNA, 20 bp, mouse
gagagggcagaaggaactag

SEQ ID NO: 501788 - DNA, 20 bp, mouse
ggggccactgcgacacgctg

SEQ ID NO: 501789 - DNA, 20 bp, mouse
gtcgcagtggccccaagcgt

SEQ ID NO: 501790 - DNA, 20 bp, mouse
ggatagaagacagggaacag

SEQ ID NO: 501791 - DNA, 20 bp, mouse
ggtggttgccgagaaggatg

SEQ ID NO: 501792 - DNA, 20 bp, mouse
gaggatggggatagaagaca

SEQ ID NO: 501793 - DNA, 20 bp, mouse
gtccccagaaagctcttcga

SEQ ID NO: 501794 - DNA, 20 bp, mouse
gggatcttgaatggcctgag

SEQ ID NO: 501795 - DNA, 20 bp, mouse
gtcttctgctgcttcggacc

SEQ ID NO: 501796 - DNA, 20 bp, mouse
ggcaagggccacgaccagga

SEQ ID NO: 501797 - DNA, 20 bp, mouse
gagaggaaggagatactagt

SEQ ID NO: 501798 - DNA, 20 bp, mouse
gagcgtggcactcaccatcc

SEQ ID NO: 501799 - DNA, 20 bp, mouse
ggatactagtgggagagaca

SEQ ID NO: 501800 - DNA, 20 bp, mouse
gggtcgtggcccttgctgag

SEQ ID NO: 501801 - DNA, 20 bp, mouse
ggacagacacccggagacag

SEQ ID NO: 501802 - DNA, 20 bp, mouse
gcgcagttggggaagcgcac

SEQ ID NO: 501803 - DNA, 20 bp, mouse
gtgcagagactcagaggtag

SEQ ID NO: 501804 - DNA, 20 bp, mouse
gggcgtctgcctgcaagcag

SEQ ID NO: 501805 - DNA, 20 bp, mouse
gggtgagtgccacgctgcac

SEQ ID NO: 501806 - DNA, 20 bp, mouse
gtaatccggtagctacggaa

SEQ ID NO: 501807 - DNA, 20 bp, mouse
gtccggtagctacggaaagg

SEQ ID NO: 501808 - DNA, 20 bp, mouse
ggagagtgctccggttaatc

SEQ ID NO: 501809 - DNA, 20 bp, mouse
gccgtagctaccggattaac

SEQ ID NO: 501810 - DNA, 20 bp, mouse
gggagcactctccaccctcg

SEQ ID NO: 501811 - DNA, 20 bp, mouse
ggtgcggccgtgggttccgg

SEQ ID NO: 501812 - DNA, 20 bp, mouse
gatcagcgttcggttattct

SEQ ID NO: 501813 - DNA, 20 bp, mouse
gtagtaagataaccaaagtc

SEQ ID NO: 501814 - DNA, 20 bp, mouse
ggccacctttccgtagctac

SEQ ID NO: 501815 - DNA, 20 bp, mouse
ggggtcgagcagccagactt

SEQ ID NO: 501816 - DNA, 20 bp, mouse
gaggagctggtacgactcca

SEQ ID NO: 501817 - DNA, 20 bp, mouse
ggacagccgtcagttcctgc

SEQ ID NO: 501818 - DNA, 20 bp, mouse
gcaggctggtagagtgaacg

SEQ ID NO: 501819 - DNA, 20 bp, mouse
gtggctggaggacagacatg

SEQ ID NO: 501820 - DNA, 20 bp, mouse
ggagtgaacggggctgagtg

SEQ ID NO: 501821 - DNA, 20 bp, mouse
gccggaagtcatccgaacct

SEQ ID NO: 501822 - DNA, 20 bp, mouse
gatggcagatcgtgctgctc

SEQ ID NO: 501823 - DNA, 20 bp, mouse
gactccagggagcgcatgtg

SEQ ID NO: 501824 - DNA, 20 bp, mouse
ggtcgcacctacctgctcag

SEQ ID NO: 501825 - DNA, 20 bp, mouse
gcttaggcctcgcttctctc

SEQ ID NO: 501826 - DNA, 20 bp, mouse
gtcagggagcgtgagatcct

SEQ ID NO: 501827 - DNA, 20 bp, mouse
gagctggaaacacctgagat

SEQ ID NO: 501828 - DNA, 20 bp, mouse
gggaaggagccggctcaggg

SEQ ID NO: 501829 - DNA, 20 bp, mouse
gccgaactaactccgatctc

SEQ ID NO: 501830 - DNA, 20 bp, mouse
gctggaaagctaccgagagc

SEQ ID NO: 501831 - DNA, 20 bp, mouse
gcggagttagttcggatggt

SEQ ID NO: 501832 - DNA, 20 bp, mouse
gtttctggaactgaagtcaa

SEQ ID NO: 501833 - DNA, 20 bp, mouse
gaggtggagggaacacttcc

SEQ ID NO: 501834 - DNA, 20 bp, mouse
gatggtgggattgaacaccg

SEQ ID NO: 501835 - DNA, 20 bp, mouse
ggcccgcctaggccagaagt

SEQ ID NO: 501836 - DNA, 20 bp, mouse
ggacggagaagagagaatcc

SEQ ID NO: 501837 - DNA, 20 bp, mouse
gctcagattgcagaacaaga

SEQ ID NO: 501838 - DNA, 20 bp, mouse
gggacccacagccatgagac

SEQ ID NO: 501839 - DNA, 20 bp, mouse
gtcatggctgtgggtcctcc

SEQ ID NO: 501840 - DNA, 20 bp, mouse
gctatggaaggcaaacctca

SEQ ID NO: 501841 - DNA, 20 bp, mouse
gcacacctgtctcatggctg

SEQ ID NO: 501842 - DNA, 20 bp, mouse
gtgtgtctgaagctagctgg

SEQ ID NO: 501843 - DNA, 20 bp, mouse
gacggcagtgaacacagaga

SEQ ID NO: 501844 - DNA, 20 bp, mouse
gtagtaattaccccgcatgg

SEQ ID NO: 501845 - DNA, 20 bp, mouse
ggtctgaagctagctggagg

SEQ ID NO: 501846 - DNA, 20 bp, mouse
ggacccccttaagttggagg

SEQ ID NO: 501847 - DNA, 20 bp, mouse
ggcaaccacagcgaagaaga

SEQ ID NO: 501848 - DNA, 20 bp, mouse
gtgcctcctccaacttaagg

SEQ ID NO: 501849 - DNA, 20 bp, mouse
gtgttaagacccccttaagt

SEQ ID NO: 501850 - DNA, 20 bp, mouse
gtcttaacaagtgagccggt

SEQ ID NO: 501851 - DNA, 20 bp, mouse
gggctgctcgaagccaggac

SEQ ID NO: 501852 - DNA, 20 bp, mouse
ggtcctattaaaacacccac

SEQ ID NO: 501853 - DNA, 20 bp, mouse
gcgagcagcccattgaacgg

SEQ ID NO: 501854 - DNA, 20 bp, mouse
gttctccttcttcttcgctg

SEQ ID NO: 501855 - DNA, 20 bp, mouse
gttgtgtcgtcggagggaag

SEQ ID NO: 501856 - DNA, 20 bp, mouse
gtcgtcagtcggagccccag

SEQ ID NO: 501857 - DNA, 20 bp, mouse
gagccccagcggcaccgtgg

SEQ ID NO: 501858 - DNA, 20 bp, mouse
ggcaccgtggaggcagtgcg

SEQ ID NO: 501859 - DNA, 20 bp, mouse
gccgtggaggcagtgcgcgg

SEQ ID NO: 501860 - DNA, 20 bp, mouse
gcggctccatgctcctcctc

SEQ ID NO: 501861 - DNA, 20 bp, mouse
gtcgcgcgcgatacttaagg

SEQ ID NO: 501862 - DNA, 20 bp, mouse
ggcggctctgctgggcaagg

SEQ ID NO: 501863 - DNA, 20 bp, mouse
ggccgctcaatgcttcccgg

SEQ ID NO: 501864 - DNA, 20 bp, mouse
gaggatgtcggaagaaaggg

SEQ ID NO: 501865 - DNA, 20 bp, mouse
gtgcctccacggtgccgctg

SEQ ID NO: 501866 - DNA, 20 bp, mouse
gggcgctcggagctcggaaa

SEQ ID NO: 501867 - DNA, 20 bp, mouse
gctcggagctcggaaatggc

SEQ ID NO: 501868 - DNA, 20 bp, mouse
ggagcgcccgcagctgagga

SEQ ID NO: 501869 - DNA, 20 bp, mouse
gaaatggcgggtaagttccc

SEQ ID NO: 501870 - DNA, 20 bp, mouse
gtccgcgaggcactgagggt

SEQ ID NO: 501871 - DNA, 20 bp, mouse
gctccgagcgcccgcagctg

SEQ ID NO: 501872 - DNA, 20 bp, mouse
gcaaggcccgggaggcccac

SEQ ID NO: 501873 - DNA, 20 bp, mouse
ggaggaggcgggtgcttctg

SEQ ID NO: 501874 - DNA, 20 bp, mouse
gcccgggaaaagtttagcaa

SEQ ID NO: 501875 - DNA, 20 bp, mouse
gcgccgagcgtcagcaccgg

SEQ ID NO: 501876 - DNA, 20 bp, mouse
gcgaggctttgagattgagg

SEQ ID NO: 501877 - DNA, 20 bp, mouse
ggagattgaggtggcgggag

SEQ ID NO: 501878 - DNA, 20 bp, mouse
gtgacatccggagctgggtc

SEQ ID NO: 501879 - DNA, 20 bp, mouse
gtcggccagcctgaagccag

SEQ ID NO: 501880 - DNA, 20 bp, mouse
gggctccgggagggaataag

SEQ ID NO: 501881 - DNA, 20 bp, mouse
gcgggtgcccgacccagctc

SEQ ID NO: 501882 - DNA, 20 bp, mouse
gggctgggagacccggagaa

SEQ ID NO: 501883 - DNA, 20 bp, mouse
gccgatacgtggctccggga

SEQ ID NO: 501884 - DNA, 20 bp, mouse
ggtggcgggagcggcggcta

SEQ ID NO: 501885 - DNA, 20 bp, mouse
gccgcgaggctttgagattg

SEQ ID NO: 501886 - DNA, 20 bp, mouse
ggacgctgggtcccacgggt

SEQ ID NO: 501887 - DNA, 20 bp, mouse
gcgaggacgctgggtcccac

SEQ ID NO: 501888 - DNA, 20 bp, mouse
gaggtgtgcggaagccatgg

SEQ ID NO: 501889 - DNA, 20 bp, mouse
gatggcggccgccaacccgt

SEQ ID NO: 501890 - DNA, 20 bp, mouse
gaactggcgcgaggagtgag

SEQ ID NO: 501891 - DNA, 20 bp, mouse
gctcctcgcgccagttccag

SEQ ID NO: 501892 - DNA, 20 bp, mouse
gcagaggtgtgcggaagcca

SEQ ID NO: 501893 - DNA, 20 bp, mouse
gggcgtgagtgagccagctg

SEQ ID NO: 501894 - DNA, 20 bp, mouse
gaacccagctgcagtctgcg

SEQ ID NO: 501895 - DNA, 20 bp, mouse
ggctgggtcccacgggttgg

SEQ ID NO: 501896 - DNA, 20 bp, mouse
gtggcagagagcagtgactg

SEQ ID NO: 501897 - DNA, 20 bp, mouse
ggcgtcctggcactcccgtg

SEQ ID NO: 501898 - DNA, 20 bp, mouse
gcctcaagcaggctgtagga

SEQ ID NO: 501899 - DNA, 20 bp, mouse
ggcactcccgtgaggcactg

SEQ ID NO: 501900 - DNA, 20 bp, mouse
gagtgactgcggctttcctg

SEQ ID NO: 501901 - DNA, 20 bp, mouse
gtgcggctttcctgaggtaa

SEQ ID NO: 501902 - DNA, 20 bp, mouse
gggcgcgcgcggttggaggc

SEQ ID NO: 501903 - DNA, 20 bp, mouse
gggctgtaggagggtagcgg

SEQ ID NO: 501904 - DNA, 20 bp, mouse
ggatgcctcaagcaggctgt

SEQ ID NO: 501905 - DNA, 20 bp, mouse
gtaagggtcttgtaagttcg

SEQ ID NO: 501906 - DNA, 20 bp, mouse
ggctcgccgccggagcgcta

SEQ ID NO: 501907 - DNA, 20 bp, mouse
gctaaggccggggcctgccc

SEQ ID NO: 501908 - DNA, 20 bp, mouse
gcgtcgagcgctaacctgca

SEQ ID NO: 501909 - DNA, 20 bp, mouse
gcgccggagcgctaaggccg

SEQ ID NO: 501910 - DNA, 20 bp, mouse
ggccggggcctgcccgggaa

SEQ ID NO: 501911 - DNA, 20 bp, mouse
gtccgctgaggacccctggg

SEQ ID NO: 501912 - DNA, 20 bp, mouse
gcgccagcgtagaaacaact

SEQ ID NO: 501913 - DNA, 20 bp, mouse
gatcagccgggcacaggacg

SEQ ID NO: 501914 - DNA, 20 bp, mouse
gggccccggccttagcgctc

SEQ ID NO: 501915 - DNA, 20 bp, mouse
gattatctccggccttgtaa

SEQ ID NO: 501916 - DNA, 20 bp, mouse
gacgcagcgtcgactcccgg

SEQ ID NO: 501917 - DNA, 20 bp, mouse
gggaactaacgcagaaagag

SEQ ID NO: 501918 - DNA, 20 bp, mouse
gcgctcctgacgtcatagat

SEQ ID NO: 501919 - DNA, 20 bp, mouse
ggggccccgggggtctaaca

SEQ ID NO: 501920 - DNA, 20 bp, mouse
ggccatacttaaagagagtg

SEQ ID NO: 501921 - DNA, 20 bp, mouse
gcgaggctaattccaggatg

SEQ ID NO: 501922 - DNA, 20 bp, mouse
gccccgggggtctaacaggg

SEQ ID NO: 501923 - DNA, 20 bp, mouse
gagtcgacgctgcgtaggtg

SEQ ID NO: 501924 - DNA, 20 bp, mouse
ggagtaaggtctccccatcc

SEQ ID NO: 501925 - DNA, 20 bp, mouse
gactcctcgaggctaattcc

SEQ ID NO: 501926 - DNA, 20 bp, mouse
ggggatggctctcggagagg

SEQ ID NO: 501927 - DNA, 20 bp, mouse
gtccgcaagcgcgggagtct

SEQ ID NO: 501928 - DNA, 20 bp, mouse
gggtgacgacaacccctctg

SEQ ID NO: 501929 - DNA, 20 bp, mouse
gacgggcagggcgactgtga

SEQ ID NO: 501930 - DNA, 20 bp, mouse
gctgtgacggaggaaaacga

SEQ ID NO: 501931 - DNA, 20 bp, mouse
gtggagagtaaggagatctg

SEQ ID NO: 501932 - DNA, 20 bp, mouse
gccctcctacaggcatcccg

SEQ ID NO: 501933 - DNA, 20 bp, mouse
gggcagggcgactgtgacgg

SEQ ID NO: 501934 - DNA, 20 bp, mouse
gaggggtccaagggtcctca

SEQ ID NO: 501935 - DNA, 20 bp, mouse
gccgagctcatgctttccac

SEQ ID NO: 501936 - DNA, 20 bp, mouse
gggcggcctgtaagcttggg

SEQ ID NO: 501937 - DNA, 20 bp, mouse
gttcagagcgcgaaacatgg

SEQ ID NO: 501938 - DNA, 20 bp, mouse
gggcggcggcctgtaagctt

SEQ ID NO: 501939 - DNA, 20 bp, mouse
ggcaccacaggggtccacag

SEQ ID NO: 501940 - DNA, 20 bp, mouse
ggcggagagacctaagaaac

SEQ ID NO: 501941 - DNA, 20 bp, mouse
gctggtcccctatcaaggag

SEQ ID NO: 501942 - DNA, 20 bp, mouse
gtcgcgctctgaactacaac

SEQ ID NO: 501943 - DNA, 20 bp, mouse
gtgagcttttagcagtgtgg

SEQ ID NO: 501944 - DNA, 20 bp, mouse
gtcacgccccccaagcttac

SEQ ID NO: 501945 - DNA, 20 bp, mouse
gtagttcagagcgcgaaaca

SEQ ID NO: 501946 - DNA, 20 bp, mouse
gacacgtctgagggacacct

SEQ ID NO: 501947 - DNA, 20 bp, mouse
gggccaagagcgccgaaaaa

SEQ ID NO: 501948 - DNA, 20 bp, mouse
gagagcgccgaaaaagggcg

SEQ ID NO: 501949 - DNA, 20 bp, mouse
gagtagtgctggaagccgga

SEQ ID NO: 501950 - DNA, 20 bp, mouse
ggaaaaagggcgtggctcca

SEQ ID NO: 501951 - DNA, 20 bp, mouse
gcggaagcccacacgtctga

SEQ ID NO: 501952 - DNA, 20 bp, mouse
gtcagaagggcggaatttag

SEQ ID NO: 501953 - DNA, 20 bp, mouse
gaagcttggagcccgccccg

SEQ ID NO: 501954 - DNA, 20 bp, mouse
gacgggacgcagggtgagtt

SEQ ID NO: 501955 - DNA, 20 bp, mouse
gtctcccgccttccactcaa

SEQ ID NO: 501956 - DNA, 20 bp, mouse
ggcttaaaagtagctgctct

SEQ ID NO: 501957 - DNA, 20 bp, mouse
ggccaaggccaactttctaa

SEQ ID NO: 501958 - DNA, 20 bp, mouse
gggtgtctctagacatctct

SEQ ID NO: 501959 - DNA, 20 bp, mouse
gtctaggtatgagagctctg

SEQ ID NO: 501960 - DNA, 20 bp, mouse
gtgagagctctgtggatcta

SEQ ID NO: 501961 - DNA, 20 bp, mouse
ggtcctggccagaagtcata

SEQ ID NO: 501962 - DNA, 20 bp, mouse
gtgtaacattctccgtaaat

SEQ ID NO: 501963 - DNA, 20 bp, mouse
gtttaaggtagctgaggtct

SEQ ID NO: 501964 - DNA, 20 bp, mouse
gctacttttaagcccattta

SEQ ID NO: 501965 - DNA, 20 bp, mouse
gacagggtatcctagcggag

SEQ ID NO: 501966 - DNA, 20 bp, mouse
gcagcagcaggacacagttg

SEQ ID NO: 501967 - DNA, 20 bp, mouse
gtccaaggacagctctgtgt

SEQ ID NO: 501968 - DNA, 20 bp, mouse
gacctgaaaacatgagtact

SEQ ID NO: 501969 - DNA, 20 bp, mouse
gtagtagttgcagcagcagc

SEQ ID NO: 501970 - DNA, 20 bp, mouse
gagagcctcatatagactgt

SEQ ID NO: 501971 - DNA, 20 bp, mouse
gaatgccaacagtctatatg

SEQ ID NO: 501972 - DNA, 20 bp, mouse
gaaaacatgagtacttggca

SEQ ID NO: 501973 - DNA, 20 bp, mouse
gagtgcaaggcaaagatacc

SEQ ID NO: 501974 - DNA, 20 bp, mouse
gactacttgcaagtaagtct

SEQ ID NO: 501975 - DNA, 20 bp, mouse
ggccgtgaaatgtgaagagt

SEQ ID NO: 501976 - DNA, 20 bp, mouse
ggccctggctatatccgaca

SEQ ID NO: 501977 - DNA, 20 bp, mouse
gaccctgtcggatatagcca

SEQ ID NO: 501978 - DNA, 20 bp, mouse
gctgccggaaagcaacccta

SEQ ID NO: 501979 - DNA, 20 bp, mouse
gccgacagggtagcgtaagc

SEQ ID NO: 501980 - DNA, 20 bp, mouse
gggtgatgcaacagggacct

SEQ ID NO: 501981 - DNA, 20 bp, mouse
gggaaagcaaccctacggtg

SEQ ID NO: 501982 - DNA, 20 bp, mouse
ggagggagtggcctgttcag

SEQ ID NO: 501983 - DNA, 20 bp, mouse
gctgggctggatatacggga

SEQ ID NO: 501984 - DNA, 20 bp, mouse
gctctcagcaggagttgaag

SEQ ID NO: 501985 - DNA, 20 bp, mouse
gagttctgggctggatatac

SEQ ID NO: 501986 - DNA, 20 bp, mouse
gtagggcccctgagattctg

SEQ ID NO: 501987 - DNA, 20 bp, mouse
gcccagccccagaatctcag

SEQ ID NO: 501988 - DNA, 20 bp, mouse
gcccttggagcagttctcat

SEQ ID NO: 501989 - DNA, 20 bp, mouse
gtggagctgaagccctggaa

SEQ ID NO: 501990 - DNA, 20 bp, mouse
gggccctaacaagttttact

SEQ ID NO: 501991 - DNA, 20 bp, mouse
gtggaggacacgcccttgga

SEQ ID NO: 501992 - DNA, 20 bp, mouse
gtggccaccaatcttccccc

SEQ ID NO: 501993 - DNA, 20 bp, mouse
ggctgggttgtgcttcccct

SEQ ID NO: 501994 - DNA, 20 bp, mouse
gagggcgtgtcctccaggca

SEQ ID NO: 501995 - DNA, 20 bp, mouse
ggaaaccatggtgctctctg

SEQ ID NO: 501996 - DNA, 20 bp, mouse
ggaaaccatggtgctctctg

SEQ ID NO: 501997 - DNA, 20 bp, mouse
gtcttccccagagagcacca

SEQ ID NO: 501998 - DNA, 20 bp, mouse
gtggccaccaatcttccccc

SEQ ID NO: 501999 - DNA, 20 bp, mouse
gcagactcaggaagaaacca

SEQ ID NO: 502000 - DNA, 20 bp, mouse
gcaacatcaaggctgcctgg

SEQ ID NO: 502001 - DNA, 20 bp, mouse
gtggagctgaagccctggaa

SEQ ID NO: 502002 - DNA, 20 bp, mouse
gaggtcgctcagagcagaca

SEQ ID NO: 502003 - DNA, 20 bp, mouse
gaggctgcctgggggaagat

SEQ ID NO: 502004 - DNA, 20 bp, mouse
gggaagctagcaaacatcct

SEQ ID NO: 502005 - DNA, 20 bp, mouse
gttctgattctgacagactc

SEQ ID NO: 502006 - DNA, 20 bp, mouse
gttcatcagagacatggtgg

SEQ ID NO: 502007 - DNA, 20 bp, mouse
gcctcatgaccccttctcag

SEQ ID NO: 502008 - DNA, 20 bp, mouse
gagaggcagagaggacaacg

SEQ ID NO: 502009 - DNA, 20 bp, mouse
gtggcactgagactctagag

SEQ ID NO: 502010 - DNA, 20 bp, mouse
gttcttcatcagagacatgg

SEQ ID NO: 502011 - DNA, 20 bp, mouse
gggagccacatggaagactc

SEQ ID NO: 502012 - DNA, 20 bp, mouse
gtcatgaggacagtatggtc

SEQ ID NO: 502013 - DNA, 20 bp, mouse
gactctagagaggtaagtcc

SEQ ID NO: 502014 - DNA, 20 bp, mouse
gagttgagtgcactcaagac

SEQ ID NO: 502015 - DNA, 20 bp, mouse
gtgacaaagagcagttagtg

SEQ ID NO: 502016 - DNA, 20 bp, mouse
gtcagctgtgaagtgaacca

SEQ ID NO: 502017 - DNA, 20 bp, mouse
gtgaagtgaaccatggtgtg

SEQ ID NO: 502018 - DNA, 20 bp, mouse
gatcaggagcctaagacata

SEQ ID NO: 502019 - DNA, 20 bp, mouse
gggtgtgaggtatagaagct

SEQ ID NO: 502020 - DNA, 20 bp, mouse
gtgccatgggctctaatccg

SEQ ID NO: 502021 - DNA, 20 bp, mouse
gagtccatgggtaaacaatc

SEQ ID NO: 502022 - DNA, 20 bp, mouse
gaagttggaggagaaactct

SEQ ID NO: 502023 - DNA, 20 bp, mouse
gacccccggattagagccca

SEQ ID NO: 502024 - DNA, 20 bp, mouse
gaatttccagggtttctata

SEQ ID NO: 502025 - DNA, 20 bp, mouse
ggagaaactctgggaaggta

SEQ ID NO: 502026 - DNA, 20 bp, mouse
gaacctcagctgaaacacta

SEQ ID NO: 502027 - DNA, 20 bp, mouse
gttagtccacgtggcagtga

SEQ ID NO: 502028 - DNA, 20 bp, mouse
ggccacgtggactaaggtga

SEQ ID NO: 502029 - DNA, 20 bp, mouse
gctgtgccagaagtaagtgc

SEQ ID NO: 502030 - DNA, 20 bp, mouse
gagcttgtggttatcttcag

SEQ ID NO: 502031 - DNA, 20 bp, mouse
ggccttcaccttagtccacg

SEQ ID NO: 502032 - DNA, 20 bp, mouse
ggcctaagggagcaagtgga

SEQ ID NO: 502033 - DNA, 20 bp, mouse
ggacagcctaagggagcaag

SEQ ID NO: 502034 - DNA, 20 bp, mouse
gtcggatactgacctttcca

SEQ ID NO: 502035 - DNA, 20 bp, mouse
gaagtggtcaaagtatctct

SEQ ID NO: 502036 - DNA, 20 bp, mouse
gaggcagctcacaagaagtt

SEQ ID NO: 502037 - DNA, 20 bp, mouse
gtatgtcagaagcaaatgtg

SEQ ID NO: 502038 - DNA, 20 bp, mouse
gtcacaagaagttgggtgct

SEQ ID NO: 502039 - DNA, 20 bp, mouse
ggcaccatgatgtctgtttc

SEQ ID NO: 502040 - DNA, 20 bp, mouse
gaacacagaacagagtgagg

SEQ ID NO: 502041 - DNA, 20 bp, mouse
gagccaggggaaggaaaccc

SEQ ID NO: 502042 - DNA, 20 bp, mouse
gggttgagcagaatagccag

SEQ ID NO: 502043 - DNA, 20 bp, mouse
gcaggggaaggaaacccagg

SEQ ID NO: 502044 - DNA, 20 bp, mouse
ggaaaggggaagcgattcta

SEQ ID NO: 502045 - DNA, 20 bp, mouse
gaacactccacacacagtca

SEQ ID NO: 502046 - DNA, 20 bp, mouse
gcagctcacaagtagaagtt

SEQ ID NO: 502047 - DNA, 20 bp, mouse
gcaagtagaagttgggtgct

SEQ ID NO: 502048 - DNA, 20 bp, mouse
gacctcagaaacagacatca

SEQ ID NO: 502049 - DNA, 20 bp, mouse
gaaaagggaaacatagacag

SEQ ID NO: 502050 - DNA, 20 bp, mouse
gcacctgactgatgctgaga

SEQ ID NO: 502051 - DNA, 20 bp, mouse
gagccttctcagcatcagtc

SEQ ID NO: 502052 - DNA, 20 bp, mouse
ggttgggtgcttggagacag

SEQ ID NO: 502053 - DNA, 20 bp, mouse
ggtcacagtggagctcactg

SEQ ID NO: 502054 - DNA, 20 bp, mouse
ggcctcaccaccaacttcat

SEQ ID NO: 502055 - DNA, 20 bp, mouse
gaaagtaccgctgggtccaa

SEQ ID NO: 502056 - DNA, 20 bp, mouse
gtcaccatgatggcaagtct

SEQ ID NO: 502057 - DNA, 20 bp, mouse
gggaggttgctggtgatcac

SEQ ID NO: 502058 - DNA, 20 bp, mouse
gcctcccagacttgccatca

SEQ ID NO: 502059 - DNA, 20 bp, mouse
gctccacaggccattgatga

SEQ ID NO: 502060 - DNA, 20 bp, mouse
gaggaaaagaccctcatcaa

SEQ ID NO: 502061 - DNA, 20 bp, mouse
ggcagtaaagttcaccatga

SEQ ID NO: 502062 - DNA, 20 bp, mouse
gtatgtactgctgctagaag

SEQ ID NO: 502063 - DNA, 20 bp, mouse
gaagacaagtagaaatataa

SEQ ID NO: 502064 - DNA, 20 bp, mouse
gagggaaatcaagaattctg

SEQ ID NO: 502065 - DNA, 20 bp, mouse
gggcaagtctgggaggttgc

SEQ ID NO: 502066 - DNA, 20 bp, mouse
gcggcctgacagaccttcaa

SEQ ID NO: 502067 - DNA, 20 bp, mouse
gcggcccggggagctgcacg

SEQ ID NO: 502068 - DNA, 20 bp, mouse
gctgcgagcgagagctcagt

SEQ ID NO: 502069 - DNA, 20 bp, mouse
gggacagcgaggttccacta

SEQ ID NO: 502070 - DNA, 20 bp, mouse
ggcgagagctcagtcggccc

SEQ ID NO: 502071 - DNA, 20 bp, mouse
gccccggtgcaggcgtccag

SEQ ID NO: 502072 - DNA, 20 bp, mouse
gctgcacgcggctggctggt

SEQ ID NO: 502073 - DNA, 20 bp, mouse
gcgtccactccagcccttga

SEQ ID NO: 502074 - DNA, 20 bp, mouse
gcccgagcctggcggagacg

SEQ ID NO: 502075 - DNA, 20 bp, mouse
gcagacaggatctcacccag

SEQ ID NO: 502076 - DNA, 20 bp, mouse
gcggcgcgccacagagaggt

SEQ ID NO: 502077 - DNA, 20 bp, mouse
gggctgaggagtaaacgcgg

SEQ ID NO: 502078 - DNA, 20 bp, mouse
gagcttgaaagacttggtaa

SEQ ID NO: 502079 - DNA, 20 bp, mouse
gttcggctgaggagtaaacg

SEQ ID NO: 502080 - DNA, 20 bp, mouse
gaacgcggcggtgggagtcg

SEQ ID NO: 502081 - DNA, 20 bp, mouse
gttggtaagtaggaaagttt

SEQ ID NO: 502082 - DNA, 20 bp, mouse
ggtcgcggcgcgccacagag

SEQ ID NO: 502083 - DNA, 20 bp, mouse
gccagtgcccagagtcccaa

SEQ ID NO: 502084 - DNA, 20 bp, mouse
gggcgacgggtttggtaagt

SEQ ID NO: 502085 - DNA, 20 bp, mouse
gctcccctgaagcccccggg

SEQ ID NO: 502086 - DNA, 20 bp, mouse
gcacgaccgaggccttggag

SEQ ID NO: 502087 - DNA, 20 bp, mouse
gatctacacgaccgaggcct

SEQ ID NO: 502088 - DNA, 20 bp, mouse
gaggctcagttcattgaaga

SEQ ID NO: 502089 - DNA, 20 bp, mouse
gagccttgcgctctgccccc

SEQ ID NO: 502090 - DNA, 20 bp, mouse
gcgttggaagatgaacccga

SEQ ID NO: 502091 - DNA, 20 bp, mouse
gaaagccacgaaggtcctat

SEQ ID NO: 502092 - DNA, 20 bp, mouse
gcctgtattgagctctcccc

SEQ ID NO: 502093 - DNA, 20 bp, mouse
ggtcggaatctacacgaccg

SEQ ID NO: 502094 - DNA, 20 bp, mouse
gtcggtcccaggatgatcag

SEQ ID NO: 502095 - DNA, 20 bp, mouse
gaccagccactgatcatcct

SEQ ID NO: 502096 - DNA, 20 bp, mouse
gcgcgaccgaggctttggag

SEQ ID NO: 502097 - DNA, 20 bp, mouse
gccttcaaggcttggtgtag

SEQ ID NO: 502098 - DNA, 20 bp, mouse
gtggtgtaggggagaaatta

SEQ ID NO: 502099 - DNA, 20 bp, mouse
gatctacgcgaccgaggctt

SEQ ID NO: 502100 - DNA, 20 bp, mouse
ggagaaattaaggcaaggcg

SEQ ID NO: 502101 - DNA, 20 bp, mouse
gaaattaaggcaaggcgtgg

SEQ ID NO: 502102 - DNA, 20 bp, mouse
gtaggggagaaattaaggca

SEQ ID NO: 502103 - DNA, 20 bp, mouse
gtgtgggtcccttcaaggct

SEQ ID NO: 502104 - DNA, 20 bp, mouse
gaggctcagttcactgaaga

SEQ ID NO: 502105 - DNA, 20 bp, mouse
gaaagccacgaaggtcctgt

SEQ ID NO: 502106 - DNA, 20 bp, mouse
ggctcggcgcagaggcctgg

SEQ ID NO: 502107 - DNA, 20 bp, mouse
ggacctgagaggaacacccg

SEQ ID NO: 502108 - DNA, 20 bp, mouse
ggctggaagagctaaggtca

SEQ ID NO: 502109 - DNA, 20 bp, mouse
gtagcatctccagggcccat

SEQ ID NO: 502110 - DNA, 20 bp, mouse
gagagcgagcaggacctgag

SEQ ID NO: 502111 - DNA, 20 bp, mouse
ggcgcggacgctcggcgcag

SEQ ID NO: 502112 - DNA, 20 bp, mouse
gacgctcgcaatgggatctt

SEQ ID NO: 502113 - DNA, 20 bp, mouse
gctcgcaatgggatcttcgg

SEQ ID NO: 502114 - DNA, 20 bp, mouse
gtctccagggcccataggtg

SEQ ID NO: 502115 - DNA, 20 bp, mouse
gtcttcggcggagagggagc

SEQ ID NO: 502116 - DNA, 20 bp, mouse
gggtagcggcataaacccat

SEQ ID NO: 502117 - DNA, 20 bp, mouse
gacagggaggccatgcccat

SEQ ID NO: 502118 - DNA, 20 bp, mouse
gagtattccccaaagaccca

SEQ ID NO: 502119 - DNA, 20 bp, mouse
ggctccacacgagaaagctg

SEQ ID NO: 502120 - DNA, 20 bp, mouse
gttatgccgctaccagccat

SEQ ID NO: 502121 - DNA, 20 bp, mouse
gggtggctgtcccacagaaa

SEQ ID NO: 502122 - DNA, 20 bp, mouse
gtaccagccatgggtctttg

SEQ ID NO: 502123 - DNA, 20 bp, mouse
gtaaaaggaaagtggttaca

SEQ ID NO: 502124 - DNA, 20 bp, mouse
gaaggaaagtggttacaggg

SEQ ID NO: 502125 - DNA, 20 bp, mouse
gagtgagaaggaggttcata

SEQ ID NO: 502126 - DNA, 20 bp, mouse
gcccgcgtgaggaaaaaccg

SEQ ID NO: 502127 - DNA, 20 bp, mouse
gcaaaacgggaggcaaggag

SEQ ID NO: 502128 - DNA, 20 bp, mouse
gggctgtgaccggacgttag

SEQ ID NO: 502129 - DNA, 20 bp, mouse
gcagtcggcgaggtgacttg

SEQ ID NO: 502130 - DNA, 20 bp, mouse
gccgcgcggcgcgggacagt

SEQ ID NO: 502131 - DNA, 20 bp, mouse
gcgagaacgccggctgtgac

SEQ ID NO: 502132 - DNA, 20 bp, mouse
gagtcgctcggctgcacccg

SEQ ID NO: 502133 - DNA, 20 bp, mouse
gcggtgggacgcgcatagac

SEQ ID NO: 502134 - DNA, 20 bp, mouse
gcaggcgcctcagggaaaat

SEQ ID NO: 502135 - DNA, 20 bp, mouse
gtaacggcgcccgagaacgc

SEQ ID NO: 502136 - DNA, 20 bp, mouse
ggagggctacgactgaggaa

SEQ ID NO: 502137 - DNA, 20 bp, mouse
gagagagaggcggctcaaga

SEQ ID NO: 502138 - DNA, 20 bp, mouse
gggctacgactgaggaaggg

SEQ ID NO: 502139 - DNA, 20 bp, mouse
ggaagcggctccttacacag

SEQ ID NO: 502140 - DNA, 20 bp, mouse
ggttctaagcgggaacaccc

SEQ ID NO: 502141 - DNA, 20 bp, mouse
ggcggtggacgactccatgg

SEQ ID NO: 502142 - DNA, 20 bp, mouse
gggcagctctcacgaagaag

SEQ ID NO: 502143 - DNA, 20 bp, mouse
gacagcggtggacgactcca

SEQ ID NO: 502144 - DNA, 20 bp, mouse
ggcttagaacctcgagcagg

SEQ ID NO: 502145 - DNA, 20 bp, mouse
gatagcagaggcggactcaa

SEQ ID NO: 502146 - DNA, 20 bp, mouse
gctcagggtcctgcagatag

SEQ ID NO: 502147 - DNA, 20 bp, mouse
gaggccgcgagttaccccag

SEQ ID NO: 502148 - DNA, 20 bp, mouse
gtccagggctggtcagtagg

SEQ ID NO: 502149 - DNA, 20 bp, mouse
gggagcgaggtcccccaagt

SEQ ID NO: 502150 - DNA, 20 bp, mouse
gcgctgtaccacgccctcaa

SEQ ID NO: 502151 - DNA, 20 bp, mouse
gcccgtgggtcccgacttgg

SEQ ID NO: 502152 - DNA, 20 bp, mouse
gtggcccgtgggtcccgact

SEQ ID NO: 502153 - DNA, 20 bp, mouse
gagtgggctggacgagcgga

SEQ ID NO: 502154 - DNA, 20 bp, mouse
gccgcgagttaccccagtgg

SEQ ID NO: 502155 - DNA, 20 bp, mouse
gcctctcccaggctatacac

SEQ ID NO: 502156 - DNA, 20 bp, mouse
gaacccgcctccagttgagg

SEQ ID NO: 502157 - DNA, 20 bp, mouse
gcgaggcaccggtccggtaa

SEQ ID NO: 502158 - DNA, 20 bp, mouse
gtcccagcctcctcaactgg

SEQ ID NO: 502159 - DNA, 20 bp, mouse
gggaaacccgcctccagttg

SEQ ID NO: 502160 - DNA, 20 bp, mouse
gcgggcgcgaggcaccggtc

SEQ ID NO: 502161 - DNA, 20 bp, mouse
gggcaccggtccggtaaagg

SEQ ID NO: 502162 - DNA, 20 bp, mouse
gggctcccagcctcctcaac

SEQ ID NO: 502163 - DNA, 20 bp, mouse
gcagcctcctcaactggagg

SEQ ID NO: 502164 - DNA, 20 bp, mouse
gcggggcattgtgggccgag

SEQ ID NO: 502165 - DNA, 20 bp, mouse
ggcacgtctacaataccggt

SEQ ID NO: 502166 - DNA, 20 bp, mouse
gcagcttgcactccccgcgg

SEQ ID NO: 502167 - DNA, 20 bp, mouse
gcccgcggcggctctcagac

SEQ ID NO: 502168 - DNA, 20 bp, mouse
ggcggcggctctcagacggg

SEQ ID NO: 502169 - DNA, 20 bp, mouse
ggggtcagagcccccttcac

SEQ ID NO: 502170 - DNA, 20 bp, mouse
gggctctcagacgggtggga

SEQ ID NO: 502171 - DNA, 20 bp, mouse
ggggctgcccacgaagcgaa

SEQ ID NO: 502172 - DNA, 20 bp, mouse
gatggccagtgagcgccact

SEQ ID NO: 502173 - DNA, 20 bp, mouse
ggaccaaagtcgcccgtgaa

SEQ ID NO: 502174 - DNA, 20 bp, mouse
gctgcccacgaagcgaaggg

SEQ ID NO: 502175 - DNA, 20 bp, mouse
ggctgcgttggcgctcggaa

SEQ ID NO: 502176 - DNA, 20 bp, mouse
gcaccaggcgccccctccag

SEQ ID NO: 502177 - DNA, 20 bp, mouse
gtccagcggctgccacttca

SEQ ID NO: 502178 - DNA, 20 bp, mouse
gcgtaaccaggaaccagtaa

SEQ ID NO: 502179 - DNA, 20 bp, mouse
ggggctgtgtagatcatcaa

SEQ ID NO: 502180 - DNA, 20 bp, mouse
ggatgtgaaaagccgtaacc

SEQ ID NO: 502181 - DNA, 20 bp, mouse
gaccctgaagtggcagccgc

SEQ ID NO: 502182 - DNA, 20 bp, mouse
gccttcaggttagcacactg

SEQ ID NO: 502183 - DNA, 20 bp, mouse
gacaatgaacatctgaggat

SEQ ID NO: 502184 - DNA, 20 bp, mouse
gaaccaggaaccagtaaagg

SEQ ID NO: 502185 - DNA, 20 bp, mouse
gtcagagcacccacctttac

SEQ ID NO: 502186 - DNA, 20 bp, mouse
gccggcagcgcagccactga

SEQ ID NO: 502187 - DNA, 20 bp, mouse
ggcccggagcgcggcagagc

SEQ ID NO: 502188 - DNA, 20 bp, mouse
gcagccactgagggcagcgg

SEQ ID NO: 502189 - DNA, 20 bp, mouse
gtcagcctcagtaccaggcg

SEQ ID NO: 502190 - DNA, 20 bp, mouse
ggcgcggccgggaaggaaca

SEQ ID NO: 502191 - DNA, 20 bp, mouse
gctccgggcatggaaggcgg

SEQ ID NO: 502192 - DNA, 20 bp, mouse
gcatgcccggaggacgcgac

SEQ ID NO: 502193 - DNA, 20 bp, mouse
gcgggctccagactcgccgg

SEQ ID NO: 502194 - DNA, 20 bp, mouse
ggcgggagccaggcgcgcag

SEQ ID NO: 502195 - DNA, 20 bp, mouse
gcgtcgcgggcgccttggag

SEQ ID NO: 502196 - DNA, 20 bp, mouse
ggcgcgcatccatggcgagg

SEQ ID NO: 502197 - DNA, 20 bp, mouse
gccgcccccgcgcgcatcca

SEQ ID NO: 502198 - DNA, 20 bp, mouse
gtcgccatggatgcgcgcgg

SEQ ID NO: 502199 - DNA, 20 bp, mouse
ggaggcggcgccgggcagtg

SEQ ID NO: 502200 - DNA, 20 bp, mouse
gggcggccgggcgatagtcc

SEQ ID NO: 502201 - DNA, 20 bp, mouse
gtccatggcgaggcggcgcc

SEQ ID NO: 502202 - DNA, 20 bp, mouse
gcgccgccggccgagcccga

SEQ ID NO: 502203 - DNA, 20 bp, mouse
gcgctccgctccgcactgcc

SEQ ID NO: 502204 - DNA, 20 bp, mouse
gccctcgcacccggagtcgg

SEQ ID NO: 502205 - DNA, 20 bp, mouse
gtcgtgcccggactatcgcc

SEQ ID NO: 502206 - DNA, 20 bp, mouse
gggtcggagctcccctgcct

SEQ ID NO: 502207 - DNA, 20 bp, mouse
gtggcgggcgcgcaagtctc

SEQ ID NO: 502208 - DNA, 20 bp, mouse
gtgcgcccgagccgaagagg

SEQ ID NO: 502209 - DNA, 20 bp, mouse
ggcccgcgcggcctcaggtg

SEQ ID NO: 502210 - DNA, 20 bp, mouse
gcgtgcgcccggggcacagg

SEQ ID NO: 502211 - DNA, 20 bp, mouse
gcgagtgagggcaatcatgg

SEQ ID NO: 502212 - DNA, 20 bp, mouse
gtcggctcgggcgcagactc

SEQ ID NO: 502213 - DNA, 20 bp, mouse
ggccccgggcgcacgcgggt

SEQ ID NO: 502214 - DNA, 20 bp, mouse
gcccaaccggtccagggcca

SEQ ID NO: 502215 - DNA, 20 bp, mouse
ggtctgcgcccgagccgaag

SEQ ID NO: 502216 - DNA, 20 bp, mouse
gcccgggaggaggtgcagcg

SEQ ID NO: 502217 - DNA, 20 bp, mouse
gcgggctgcgcgccgagggg

SEQ ID NO: 502218 - DNA, 20 bp, mouse
gcgaggggaggctcctagtc

SEQ ID NO: 502219 - DNA, 20 bp, mouse
ggtgcagcgcggcgaacccg

SEQ ID NO: 502220 - DNA, 20 bp, mouse
gtagtccggctgcaggtccc

SEQ ID NO: 502221 - DNA, 20 bp, mouse
gctcctcccgggcccggctt

SEQ ID NO: 502222 - DNA, 20 bp, mouse
ggaaaagagggagggagcgt

SEQ ID NO: 502223 - DNA, 20 bp, mouse
gccgcagccaccgagggaga

SEQ ID NO: 502224 - DNA, 20 bp, mouse
gagcagcccgcagccaccga

SEQ ID NO: 502225 - DNA, 20 bp, mouse
ggccgcttgcgcatggacgg

SEQ ID NO: 502226 - DNA, 20 bp, mouse
gcgacggcctcagacttctt

SEQ ID NO: 502227 - DNA, 20 bp, mouse
gagctcaggggaaagtaatc

SEQ ID NO: 502228 - DNA, 20 bp, mouse
gagcactgagagaggagtat

SEQ ID NO: 502229 - DNA, 20 bp, mouse
gagcgagccactgaagacga

SEQ ID NO: 502230 - DNA, 20 bp, mouse
gctgagagaggagtatgggt

SEQ ID NO: 502231 - DNA, 20 bp, mouse
gctgaggccgtcgtcttcag

SEQ ID NO: 502232 - DNA, 20 bp, mouse
gtacccagtgttaaccaagg

SEQ ID NO: 502233 - DNA, 20 bp, mouse
gaggaagggctatcccaagg

SEQ ID NO: 502234 - DNA, 20 bp, mouse
ggcgtacccagtgttaacca

SEQ ID NO: 502235 - DNA, 20 bp, mouse
gtcctcggcaagcactatca

SEQ ID NO: 502236 - DNA, 20 bp, mouse
gggaccacgcagccactgag

SEQ ID NO: 502237 - DNA, 20 bp, mouse
gacagcgccgcctcaggagg

SEQ ID NO: 502238 - DNA, 20 bp, mouse
gtggtgcggaactggagacg

SEQ ID NO: 502239 - DNA, 20 bp, mouse
gagctcgggagggctaggga

SEQ ID NO: 502240 - DNA, 20 bp, mouse
gggcggcgctgtccgctcag

SEQ ID NO: 502241 - DNA, 20 bp, mouse
gcggaactggagacgcggcg

SEQ ID NO: 502242 - DNA, 20 bp, mouse
ggggtagccccctcctgagg

SEQ ID NO: 502243 - DNA, 20 bp, mouse
gtgcccgcggtagctcggga

SEQ ID NO: 502244 - DNA, 20 bp, mouse
gcatcggcaggtgatggagg

SEQ ID NO: 502245 - DNA, 20 bp, mouse
gtcgagagccctaggggaag

SEQ ID NO: 502246 - DNA, 20 bp, mouse
gggtgctggacatcacggac

SEQ ID NO: 502247 - DNA, 20 bp, mouse
gcatgagcactgaggatccg

SEQ ID NO: 502248 - DNA, 20 bp, mouse
ggagagggaatcctccagtt

SEQ ID NO: 502249 - DNA, 20 bp, mouse
gcttgcagcactgagccgaa

SEQ ID NO: 502250 - DNA, 20 bp, mouse
ggagcactgaggatccgcgg

SEQ ID NO: 502251 - DNA, 20 bp, mouse
gatgtccagcaccaaactgg

SEQ ID NO: 502252 - DNA, 20 bp, mouse
ggaccagttgcgacgagaga

SEQ ID NO: 502253 - DNA, 20 bp, mouse
ggtgatgtccagcaccaaac

SEQ ID NO: 502254 - DNA, 20 bp, mouse
gtgacgacgaggaattcctg

SEQ ID NO: 502255 - DNA, 20 bp, mouse
gatcacggactggtcccgtt

SEQ ID NO: 502256 - DNA, 20 bp, mouse
ggaagtcctcagaacagtag

SEQ ID NO: 502257 - DNA, 20 bp, mouse
gtgctgggctgggacctgaa

SEQ ID NO: 502258 - DNA, 20 bp, mouse
gagggatctggccaaaactg

SEQ ID NO: 502259 - DNA, 20 bp, mouse
gcttctcctctactgttctg

SEQ ID NO: 502260 - DNA, 20 bp, mouse
ggctgggacctgaagggatc

SEQ ID NO: 502261 - DNA, 20 bp, mouse
gggtagcattgtcaccatcg

SEQ ID NO: 502262 - DNA, 20 bp, mouse
ggaacaggaggtagcctggg

SEQ ID NO: 502263 - DNA, 20 bp, mouse
gagcccagcatggacccccc

SEQ ID NO: 502264 - DNA, 20 bp, mouse
gaggacggatgtcaccccga

SEQ ID NO: 502265 - DNA, 20 bp, mouse
gacctaactaaactccacag

SEQ ID NO: 502266 - DNA, 20 bp, mouse
gtagtctgcggtaatcccgg

SEQ ID NO: 502267 - DNA, 20 bp, mouse
ggcccgcccgcggctcctta

SEQ ID NO: 502268 - DNA, 20 bp, mouse
gggacgccgtaaggagccgc

SEQ ID NO: 502269 - DNA, 20 bp, mouse
gtggagggaagcctaagtgg

SEQ ID NO: 502270 - DNA, 20 bp, mouse
gggaaagtcgaggctgaagg

SEQ ID NO: 502271 - DNA, 20 bp, mouse
gccttacggcgtccgaccag

SEQ ID NO: 502272 - DNA, 20 bp, mouse
gcgccgtaaggagccgcggg

SEQ ID NO: 502273 - DNA, 20 bp, mouse
gtcctggagggaagcctaag

SEQ ID NO: 502274 - DNA, 20 bp, mouse
gacggcgtccgaccaggggg

SEQ ID NO: 502275 - DNA, 20 bp, mouse
gacgacggtgagctgcgggt

SEQ ID NO: 502276 - DNA, 20 bp, mouse
gggttgtgcacgctggacct

SEQ ID NO: 502277 - DNA, 20 bp, mouse
gtctcttctgacaatcgggc

SEQ ID NO: 502278 - DNA, 20 bp, mouse
gcggttctcttctgacaatc

SEQ ID NO: 502279 - DNA, 20 bp, mouse
ggagcggatcaaagtgacca

SEQ ID NO: 502280 - DNA, 20 bp, mouse
ggtgaccacggtgtagctat

SEQ ID NO: 502281 - DNA, 20 bp, mouse
ggcagcgtggcctggaagaa

SEQ ID NO: 502282 - DNA, 20 bp, mouse
gctcacaagctgacaaacac

SEQ ID NO: 502283 - DNA, 20 bp, mouse
gcacaccacggtgaacccaa

SEQ ID NO: 502284 - DNA, 20 bp, mouse
gagggcgtgttgcgttagag

SEQ ID NO: 502285 - DNA, 20 bp, mouse
gtgtgcccatagctacaccg

SEQ ID NO: 502286 - DNA, 20 bp, mouse
gactccgcaccgggaggggt

SEQ ID NO: 502287 - DNA, 20 bp, mouse
ggcggagtggcgtccagagc

SEQ ID NO: 502288 - DNA, 20 bp, mouse
gcctcccacccctcccggtg

SEQ ID NO: 502289 - DNA, 20 bp, mouse
gcgcgcgtggggccaagcat

SEQ ID NO: 502290 - DNA, 20 bp, mouse
gggctgcagggctgcgagga

SEQ ID NO: 502291 - DNA, 20 bp, mouse
gtctggacgccactccgcac

SEQ ID NO: 502292 - DNA, 20 bp, mouse
gctgcgggatgtgagtgtgc

SEQ ID NO: 502293 - DNA, 20 bp, mouse
gagtagaccgcgactgcagg

SEQ ID NO: 502294 - DNA, 20 bp, mouse
ggacgccactccgcaccggg

SEQ ID NO: 502295 - DNA, 20 bp, mouse
ggggttctggggattcccat

SEQ ID NO: 502296 - DNA, 20 bp, mouse
ggtagggcacagagcgggat

SEQ ID NO: 502297 - DNA, 20 bp, mouse
gagggccgtagggcacagag

SEQ ID NO: 502298 - DNA, 20 bp, mouse
ggggtgccgggagggccgta

SEQ ID NO: 502299 - DNA, 20 bp, mouse
gcacagagcgggataggcag

SEQ ID NO: 502300 - DNA, 20 bp, mouse
ggacgcgcgacactcggcag

SEQ ID NO: 502301 - DNA, 20 bp, mouse
gccatggcgtacagtcaagg

SEQ ID NO: 502302 - DNA, 20 bp, mouse
gacggcggcgggtgccggga

SEQ ID NO: 502303 - DNA, 20 bp, mouse
gagcccatggcgtacagtca

SEQ ID NO: 502304 - DNA, 20 bp, mouse
gtcctcgggagaccggtcag

SEQ ID NO: 502305 - DNA, 20 bp, mouse
gaccaacacggcctacccag

SEQ ID NO: 502306 - DNA, 20 bp, mouse
ggtgtccagctcctgagggt

SEQ ID NO: 502307 - DNA, 20 bp, mouse
ggggtcgtagaaatacgcca

SEQ ID NO: 502308 - DNA, 20 bp, mouse
ggtggaagttgcccacatcg

SEQ ID NO: 502309 - DNA, 20 bp, mouse
gtgcgggaggagaggttctg

SEQ ID NO: 502310 - DNA, 20 bp, mouse
gggcgggcagctgaggctcg

SEQ ID NO: 502311 - DNA, 20 bp, mouse
gtgcgcagcacgcacggcgg

SEQ ID NO: 502312 - DNA, 20 bp, mouse
ggcaagggctgcaactctag

SEQ ID NO: 502313 - DNA, 20 bp, mouse
gggcaacttccactatggta

SEQ ID NO: 502314 - DNA, 20 bp, mouse
gctgtcgtccggtggcgggc

SEQ ID NO: 502315 - DNA, 20 bp, mouse
gtggggctgtcgtccggtgg

SEQ ID NO: 502316 - DNA, 20 bp, mouse
gaagatgtccaggtaaacag

SEQ ID NO: 502317 - DNA, 20 bp, mouse
ggcatgtgctggtggaaatt

SEQ ID NO: 502318 - DNA, 20 bp, mouse
gagacctcccaggggttcag

SEQ ID NO: 502319 - DNA, 20 bp, mouse
ggtggaaatttggagtgtgt

SEQ ID NO: 502320 - DNA, 20 bp, mouse
ggtttacgcagctgggaccc

SEQ ID NO: 502321 - DNA, 20 bp, mouse
gcagtgccttaagttcaaaa

SEQ ID NO: 502322 - DNA, 20 bp, mouse
gacatgcaggaacaaaattg

SEQ ID NO: 502323 - DNA, 20 bp, mouse
gctttgtctgcccactccag

SEQ ID NO: 502324 - DNA, 20 bp, mouse
ggggcatcctctgaacccct

SEQ ID NO: 502325 - DNA, 20 bp, mouse
gactgatatagacctcccag

SEQ ID NO: 502326 - DNA, 20 bp, mouse
gagcggcagcgcctcctcga

SEQ ID NO: 502327 - DNA, 20 bp, mouse
gggaggagccgccgcaaaga

SEQ ID NO: 502328 - DNA, 20 bp, mouse
ggatggaggagccgtcgagg

SEQ ID NO: 502329 - DNA, 20 bp, mouse
ggagccagcccgcaccccca

SEQ ID NO: 502330 - DNA, 20 bp, mouse
gaaagatggaggagccgtcg

SEQ ID NO: 502331 - DNA, 20 bp, mouse
ggaaggagccctgcaaggga

SEQ ID NO: 502332 - DNA, 20 bp, mouse
ggcccagcgacgctccctgg

SEQ ID NO: 502333 - DNA, 20 bp, mouse
gagcccgcgggcagcgacgg

SEQ ID NO: 502334 - DNA, 20 bp, mouse
gttctctgcaggtaagggag

SEQ ID NO: 502335 - DNA, 20 bp, mouse
gcggtctgcgggacatttgg

SEQ ID NO: 502336 - DNA, 20 bp, mouse
gggcagtcctcggagcagcg

SEQ ID NO: 502337 - DNA, 20 bp, mouse
gcggggcacggggaaagctc

SEQ ID NO: 502338 - DNA, 20 bp, mouse
gcgagatctgcgcgagtgga

SEQ ID NO: 502339 - DNA, 20 bp, mouse
gcgttccgggcgcagattag

SEQ ID NO: 502340 - DNA, 20 bp, mouse
gctcggagcagcggggcacg

SEQ ID NO: 502341 - DNA, 20 bp, mouse
ggatcgaaaggggcagtcct

SEQ ID NO: 502342 - DNA, 20 bp, mouse
gctgcgcgagtggaaggcgc

SEQ ID NO: 502343 - DNA, 20 bp, mouse
gggtaaccccaggctcaatc

SEQ ID NO: 502344 - DNA, 20 bp, mouse
ggaaggattctgatcgaaag

SEQ ID NO: 502345 - DNA, 20 bp, mouse
gcgcagattagaggtatgaa

SEQ ID NO: 502346 - DNA, 20 bp, mouse
gctgcagagcgactgtgaga

SEQ ID NO: 502347 - DNA, 20 bp, mouse
gtgtgagacggcgagaggaa

SEQ ID NO: 502348 - DNA, 20 bp, mouse
gcgccggcctcacatccccc

SEQ ID NO: 502349 - DNA, 20 bp, mouse
gacatccccccggtcgccgg

SEQ ID NO: 502350 - DNA, 20 bp, mouse
ggcagcgacaggccccgggg

SEQ ID NO: 502351 - DNA, 20 bp, mouse
gtgcagcctccggcgaccgg

SEQ ID NO: 502352 - DNA, 20 bp, mouse
gcagagccgggggctcatgg

SEQ ID NO: 502353 - DNA, 20 bp, mouse
gccggggccctcagagccgg

SEQ ID NO: 502354 - DNA, 20 bp, mouse
ggcgactgtgagacggcgag

SEQ ID NO: 502355 - DNA, 20 bp, mouse
ggacccagccgcagccggag

SEQ ID NO: 502356 - DNA, 20 bp, mouse
ggtctccctgaccctctcta

SEQ ID NO: 502357 - DNA, 20 bp, mouse
gatagccctagagagggtca

SEQ ID NO: 502358 - DNA, 20 bp, mouse
gacctccatagccctagaga

SEQ ID NO: 502359 - DNA, 20 bp, mouse
ggagccctagctggaaacga

SEQ ID NO: 502360 - DNA, 20 bp, mouse
gggagactcagagccctagc

SEQ ID NO: 502361 - DNA, 20 bp, mouse
gtagagggtagaacagccag

SEQ ID NO: 502362 - DNA, 20 bp, mouse
gagggtagaacagccagggg

SEQ ID NO: 502363 - DNA, 20 bp, mouse
gacaccatcgtttccagcta

SEQ ID NO: 502364 - DNA, 20 bp, mouse
gggttgaggcccagagtctt

SEQ ID NO: 502365 - DNA, 20 bp, mouse
gtgggcctcaaccctcggat

SEQ ID NO: 502366 - DNA, 20 bp, mouse
gcaccgctggggctgaacag

SEQ ID NO: 502367 - DNA, 20 bp, mouse
gccgtccgcgagccaaagtc

SEQ ID NO: 502368 - DNA, 20 bp, mouse
gtgacaagggagcaccgctg

SEQ ID NO: 502369 - DNA, 20 bp, mouse
gagaggaacccgccaacagt

SEQ ID NO: 502370 - DNA, 20 bp, mouse
gaactgttggctccagactt

SEQ ID NO: 502371 - DNA, 20 bp, mouse
gctcgcggacggttggaagt

SEQ ID NO: 502372 - DNA, 20 bp, mouse
gcgtttggggaccttcacaa

SEQ ID NO: 502373 - DNA, 20 bp, mouse
gggtagtgaatgcccactgt

SEQ ID NO: 502374 - DNA, 20 bp, mouse
ggtccccaaacgggtaagag

SEQ ID NO: 502375 - DNA, 20 bp, mouse
gaggtctggatcaaagacca

SEQ ID NO: 502376 - DNA, 20 bp, mouse
gcagataggaggacaccctc

SEQ ID NO: 502377 - DNA, 20 bp, mouse
ggcctgcaagtggctccaga

SEQ ID NO: 502378 - DNA, 20 bp, mouse
gctggactgctaaggtatca

SEQ ID NO: 502379 - DNA, 20 bp, mouse
ggagatcctcagcctgcaag

SEQ ID NO: 502380 - DNA, 20 bp, mouse
gaccctctggagccacttgc

SEQ ID NO: 502381 - DNA, 20 bp, mouse
ggaggagggaggaccagtca

SEQ ID NO: 502382 - DNA, 20 bp, mouse
gctagctccctggactgcta

SEQ ID NO: 502383 - DNA, 20 bp, mouse
gtggagccacttgcaggctg

SEQ ID NO: 502384 - DNA, 20 bp, mouse
gctggaaactaagagcaggt

SEQ ID NO: 502385 - DNA, 20 bp, mouse
ggcagactggatgctatagc

SEQ ID NO: 502386 - DNA, 20 bp, mouse
gtggaaggcagctgtcaaca

SEQ ID NO: 502387 - DNA, 20 bp, mouse
gtcccttggattgctcctcc

SEQ ID NO: 502388 - DNA, 20 bp, mouse
gtgccaggaggagcaatcca

SEQ ID NO: 502389 - DNA, 20 bp, mouse
gagccaaaccggctctccca

SEQ ID NO: 502390 - DNA, 20 bp, mouse
gagggctccatcatctccct

SEQ ID NO: 502391 - DNA, 20 bp, mouse
gtgccttgggagagccggtt

SEQ ID NO: 502392 - DNA, 20 bp, mouse
gtctagctcggtagtattca

SEQ ID NO: 502393 - DNA, 20 bp, mouse
gcgagctagaggtgagtgac

SEQ ID NO: 502394 - DNA, 20 bp, mouse
ggaaacaaaatgcaagacac

SEQ ID NO: 502395 - DNA, 20 bp, mouse
gtcacctgcctccaacagca

SEQ ID NO: 502396 - DNA, 20 bp, mouse
gaacagcccggctccagagc

SEQ ID NO: 502397 - DNA, 20 bp, mouse
gccatggcgatgctgcggag

SEQ ID NO: 502398 - DNA, 20 bp, mouse
gcagctcaaggtgagcgggt

SEQ ID NO: 502399 - DNA, 20 bp, mouse
gcgcagaaaacgcaacagcc

SEQ ID NO: 502400 - DNA, 20 bp, mouse
gctcgtccggctctggagcc

SEQ ID NO: 502401 - DNA, 20 bp, mouse
gcgtctagttgggcagctca

SEQ ID NO: 502402 - DNA, 20 bp, mouse
ggaagtgcataagagctggg

SEQ ID NO: 502403 - DNA, 20 bp, mouse
gcgcagccgaggctggaccg

SEQ ID NO: 502404 - DNA, 20 bp, mouse
gttgggcagctcaaggtgag

SEQ ID NO: 502405 - DNA, 20 bp, mouse
gaggcggtgcggcccagctc

SEQ ID NO: 502406 - DNA, 20 bp, mouse
gcctcgcgccaccagcgcaa

SEQ ID NO: 502407 - DNA, 20 bp, mouse
ggcctccgagcccattgcgc

SEQ ID NO: 502408 - DNA, 20 bp, mouse
gtccgggctacacctggcag

SEQ ID NO: 502409 - DNA, 20 bp, mouse
gggtggggactaactgggac

SEQ ID NO: 502410 - DNA, 20 bp, mouse
gaacgcttgggactcgaaga

SEQ ID NO: 502411 - DNA, 20 bp, mouse
gaactggcgcgcccaccgat

SEQ ID NO: 502412 - DNA, 20 bp, mouse
gcgatggggtgattaatgta

SEQ ID NO: 502413 - DNA, 20 bp, mouse
ggcgacgaaaagatcctgaa

SEQ ID NO: 502414 - DNA, 20 bp, mouse
gcagccctcgcggcccgtgg

SEQ ID NO: 502415 - DNA, 20 bp, mouse
gctgccttctaccccaggtg

SEQ ID NO: 502416 - DNA, 20 bp, mouse
ggggcgcggtgggcaacaca

SEQ ID NO: 502417 - DNA, 20 bp, mouse
gcccgcgcgccgctcggaca

SEQ ID NO: 502418 - DNA, 20 bp, mouse
ggcgcccggccctgtccgag

SEQ ID NO: 502419 - DNA, 20 bp, mouse
gggtgggcaacacacggctc

SEQ ID NO: 502420 - DNA, 20 bp, mouse
gccgccgcacgcgcaaactt

SEQ ID NO: 502421 - DNA, 20 bp, mouse
gccgggagcgctagctcgtg

SEQ ID NO: 502422 - DNA, 20 bp, mouse
ggcccccgacgcgagctccg

SEQ ID NO: 502423 - DNA, 20 bp, mouse
gcgcgagggccggagcgcag

SEQ ID NO: 502424 - DNA, 20 bp, mouse
gcgcgccgctcggacagggc

SEQ ID NO: 502425 - DNA, 20 bp, mouse
ggagcgcggagcgggcgtag

SEQ ID NO: 502426 - DNA, 20 bp, mouse
gccagtggcctgagcagacg

SEQ ID NO: 502427 - DNA, 20 bp, mouse
gtcatgcgcactctacccag

SEQ ID NO: 502428 - DNA, 20 bp, mouse
gcccggtcttgtacttagag

SEQ ID NO: 502429 - DNA, 20 bp, mouse
gagacgcggtagtcagcttc

SEQ ID NO: 502430 - DNA, 20 bp, mouse
gcccagcagggcggtctcat

SEQ ID NO: 502431 - DNA, 20 bp, mouse
ggagctacacagaggatcct

SEQ ID NO: 502432 - DNA, 20 bp, mouse
gggtcccgaagaagaacacc

SEQ ID NO: 502433 - DNA, 20 bp, mouse
gtagcagaggagccggaact

SEQ ID NO: 502434 - DNA, 20 bp, mouse
ggcagcagcgggacctctcg

SEQ ID NO: 502435 - DNA, 20 bp, mouse
ggaggatcagagctacacag

SEQ ID NO: 502436 - DNA, 20 bp, mouse
gaggccgcgggaagcagcaa

SEQ ID NO: 502437 - DNA, 20 bp, mouse
gccgcgggaagcagcaacgg

SEQ ID NO: 502438 - DNA, 20 bp, mouse
gtgagaggcgaagtcagagg

SEQ ID NO: 502439 - DNA, 20 bp, mouse
gaagcagcaacggcggtgag

SEQ ID NO: 502440 - DNA, 20 bp, mouse
ggagtcggacgcctgagggg

SEQ ID NO: 502441 - DNA, 20 bp, mouse
gcgggagtcggacgcctgag

SEQ ID NO: 502442 - DNA, 20 bp, mouse
gcgaagtcagaggcgggagt

SEQ ID NO: 502443 - DNA, 20 bp, mouse
ggcgtgcggcatgctgtcgg

SEQ ID NO: 502444 - DNA, 20 bp, mouse
gaaggcgtgcggcatgctgt

SEQ ID NO: 502445 - DNA, 20 bp, mouse
gttggcggccccgagcagag

SEQ ID NO: 502446 - DNA, 20 bp, mouse
gtgcccgaggaggaattcgg

SEQ ID NO: 502447 - DNA, 20 bp, mouse
gcgctgcccgaggaggaatt

SEQ ID NO: 502448 - DNA, 20 bp, mouse
gttgcggtcgctgcccgagg

SEQ ID NO: 502449 - DNA, 20 bp, mouse
gaccgccgcgcgctgctcac

SEQ ID NO: 502450 - DNA, 20 bp, mouse
gggaacccagaagctcggcg

SEQ ID NO: 502451 - DNA, 20 bp, mouse
gccgctccgacgagggagag

SEQ ID NO: 502452 - DNA, 20 bp, mouse
gacccagaagctcggcgggg

SEQ ID NO: 502453 - DNA, 20 bp, mouse
gcgagcggccgctccgacga

SEQ ID NO: 502454 - DNA, 20 bp, mouse
gggcgagcaggagaacgacc

SEQ ID NO: 502455 - DNA, 20 bp, mouse
gccgccgcgaagatgctggg

SEQ ID NO: 502456 - DNA, 20 bp, mouse
ggccgccgccataatagtag

SEQ ID NO: 502457 - DNA, 20 bp, mouse
ggccgccataatagtagtgg

SEQ ID NO: 502458 - DNA, 20 bp, mouse
gtccaccactactattatgg

SEQ ID NO: 502459 - DNA, 20 bp, mouse
gataatagtagtggtggaca

SEQ ID NO: 502460 - DNA, 20 bp, mouse
ggtgtaactggtcgaaattg

SEQ ID NO: 502461 - DNA, 20 bp, mouse
gtccgtccaggtcaaatatc

SEQ ID NO: 502462 - DNA, 20 bp, mouse
gctggtcgaaattggggcac

SEQ ID NO: 502463 - DNA, 20 bp, mouse
gacacacctgatatttgacc

SEQ ID NO: 502464 - DNA, 20 bp, mouse
ggtagacacacaggattctt

SEQ ID NO: 502465 - DNA, 20 bp, mouse
gatgttaagtccctggtcat

SEQ ID NO: 502466 - DNA, 20 bp, mouse
gggaggcgcgcgcaaccaag

SEQ ID NO: 502467 - DNA, 20 bp, mouse
gggcgctcgggcctttccag

SEQ ID NO: 502468 - DNA, 20 bp, mouse
gcggggctgcgagggtgagg

SEQ ID NO: 502469 - DNA, 20 bp, mouse
ggcctttccagaggacagcg

SEQ ID NO: 502470 - DNA, 20 bp, mouse
gagaactgttctcccagggg

SEQ ID NO: 502471 - DNA, 20 bp, mouse
gggttggaaggcgtgctcgg

SEQ ID NO: 502472 - DNA, 20 bp, mouse
gtgcggtgaccggccctctg

SEQ ID NO: 502473 - DNA, 20 bp, mouse
gcaggcatccacattataca

SEQ ID NO: 502474 - DNA, 20 bp, mouse
ggtcacgactgcatccgggt

SEQ ID NO: 502475 - DNA, 20 bp, mouse
ggcgcgtcacgactgcatcc

SEQ ID NO: 502476 - DNA, 20 bp, mouse
gaaagagacctgagacgcag

SEQ ID NO: 502477 - DNA, 20 bp, mouse
gatcgcctacatagagccgg

SEQ ID NO: 502478 - DNA, 20 bp, mouse
ggacgcagcggctgctccac

SEQ ID NO: 502479 - DNA, 20 bp, mouse
ggcccagccaggaaccagac

SEQ ID NO: 502480 - DNA, 20 bp, mouse
gggagcagccgctgcgtctc

SEQ ID NO: 502481 - DNA, 20 bp, mouse
ggaatcaatggcaagtccga

SEQ ID NO: 502482 - DNA, 20 bp, mouse
gccgagccaggtgggtgcgg

SEQ ID NO: 502483 - DNA, 20 bp, mouse
gtctcatcgagcaggtaggt

SEQ ID NO: 502484 - DNA, 20 bp, mouse
gtcgactgcacggattccca

SEQ ID NO: 502485 - DNA, 20 bp, mouse
gctcttttcccgagccaggt

SEQ ID NO: 502486 - DNA, 20 bp, mouse
ggacagacggacagactctc

SEQ ID NO: 502487 - DNA, 20 bp, mouse
ggcgcagcggcagcgacaga

SEQ ID NO: 502488 - DNA, 20 bp, mouse
gagacggacagactctcggg

SEQ ID NO: 502489 - DNA, 20 bp, mouse
gccgctgcgcgggagaagcc

SEQ ID NO: 502490 - DNA, 20 bp, mouse
ggggccgccgctgctatata

SEQ ID NO: 502491 - DNA, 20 bp, mouse
gacactcacgagtgaggatc

SEQ ID NO: 502492 - DNA, 20 bp, mouse
ggccgcgcctcggagcgtcc

SEQ ID NO: 502493 - DNA, 20 bp, mouse
ggagaagccgggacgctccg

SEQ ID NO: 502494 - DNA, 20 bp, mouse
ggggcccgcaagcagacccg

SEQ ID NO: 502495 - DNA, 20 bp, mouse
gtagcggcccccgcccgtcg

SEQ ID NO: 502496 - DNA, 20 bp, mouse
ggaatccaagctcataaggt

SEQ ID NO: 502497 - DNA, 20 bp, mouse
gtgcggagcagtgaagggga

SEQ ID NO: 502498 - DNA, 20 bp, mouse
gtgaggaatccaagctcata

SEQ ID NO: 502499 - DNA, 20 bp, mouse
gtgagtgcggagcagtgaag

SEQ ID NO: 502500 - DNA, 20 bp, mouse
gttccaggaggaaaggatag

SEQ ID NO: 502501 - DNA, 20 bp, mouse
ggtaggaactgtggcgaaac

SEQ ID NO: 502502 - DNA, 20 bp, mouse
ggagagcgagagacgaccgg

SEQ ID NO: 502503 - DNA, 20 bp, mouse
gcatcttggtaaaggagaag

SEQ ID NO: 502504 - DNA, 20 bp, mouse
gcaggaacaagacgccatct

SEQ ID NO: 502505 - DNA, 20 bp, mouse
ggccatagagacggccgcag

SEQ ID NO: 502506 - DNA, 20 bp, mouse
gaccctacgggccccctact

SEQ ID NO: 502507 - DNA, 20 bp, mouse
gcggtcacgaaagagatcag

SEQ ID NO: 502508 - DNA, 20 bp, mouse
ggtccgcaagattttttcct

SEQ ID NO: 502509 - DNA, 20 bp, mouse
gtactgggcacattatccca

SEQ ID NO: 502510 - DNA, 20 bp, mouse
ggacccaggaaaaaatcttg

SEQ ID NO: 502511 - DNA, 20 bp, mouse
gcttcacagacagtcaggtt

SEQ ID NO: 502512 - DNA, 20 bp, mouse
gacgctgatttcattgtctg

SEQ ID NO: 502513 - DNA, 20 bp, mouse
gtcctctaccctccaagcaa

SEQ ID NO: 502514 - DNA, 20 bp, mouse
gtttaggccacagaccctac

SEQ ID NO: 502515 - DNA, 20 bp, mouse
ggaggttccaagatgagacc

SEQ ID NO: 502516 - DNA, 20 bp, mouse
ggacagtgccggcaccatgt

SEQ ID NO: 502517 - DNA, 20 bp, mouse
gtagagttccgggacagtgc

SEQ ID NO: 502518 - DNA, 20 bp, mouse
ggaagccggaagttcctatg

SEQ ID NO: 502519 - DNA, 20 bp, mouse
ggtagcaccaaggagcggag

SEQ ID NO: 502520 - DNA, 20 bp, mouse
gggtgaggaggagcacggtg

SEQ ID NO: 502521 - DNA, 20 bp, mouse
gatcagctcccacatggtgc

SEQ ID NO: 502522 - DNA, 20 bp, mouse
ggagctgtagcaccaaggag

SEQ ID NO: 502523 - DNA, 20 bp, mouse
gttgctgtggtgggtcctgg

SEQ ID NO: 502524 - DNA, 20 bp, mouse
gaggtcgtggtgcagagctg

SEQ ID NO: 502525 - DNA, 20 bp, mouse
gaacttccggcttctcacta

SEQ ID NO: 502526 - DNA, 20 bp, mouse
gggcaacgcgctcaagatgg

SEQ ID NO: 502527 - DNA, 20 bp, mouse
ggcggccccgggcttaaccg

SEQ ID NO: 502528 - DNA, 20 bp, mouse
gcagcagcagacgggcccag

SEQ ID NO: 502529 - DNA, 20 bp, mouse
ggccccgggcttaaccgagg

SEQ ID NO: 502530 - DNA, 20 bp, mouse
gacaggcaacgcgctcaaga

SEQ ID NO: 502531 - DNA, 20 bp, mouse
gagcgcgcgggtcagttccg

SEQ ID NO: 502532 - DNA, 20 bp, mouse
ggccgcctcggttaagcccg

SEQ ID NO: 502533 - DNA, 20 bp, mouse
gtgagcgccggcagcagacg

SEQ ID NO: 502534 - DNA, 20 bp, mouse
gaggtggagcagctgcacga

SEQ ID NO: 502535 - DNA, 20 bp, mouse
ggtactagcgccggttccct

SEQ ID NO: 502536 - DNA, 20 bp, mouse
gtcacattggacccgctgag

SEQ ID NO: 502537 - DNA, 20 bp, mouse
ggagagctgtcaggccgagg

SEQ ID NO: 502538 - DNA, 20 bp, mouse
gaagtcgccacgggcccggt

SEQ ID NO: 502539 - DNA, 20 bp, mouse
gcgggcccgtggcgacttcc

SEQ ID NO: 502540 - DNA, 20 bp, mouse
gggcctgacagctctcgata

SEQ ID NO: 502541 - DNA, 20 bp, mouse
gtgtgctcaggccgtcacat

SEQ ID NO: 502542 - DNA, 20 bp, mouse
gtctcgataggggagaactg

SEQ ID NO: 502543 - DNA, 20 bp, mouse
gtcgagcctggaagtcgcca

SEQ ID NO: 502544 - DNA, 20 bp, mouse
gcggagcttctggagaaggt

SEQ ID NO: 502545 - DNA, 20 bp, mouse
gttccaggctcgacgttact

SEQ ID NO: 502546 - DNA, 20 bp, mouse
gcggctccgcgacagcacag

SEQ ID NO: 502547 - DNA, 20 bp, mouse
gaacgtggcacagccgggac

SEQ ID NO: 502548 - DNA, 20 bp, mouse
gaggcacagacgggacacgg

SEQ ID NO: 502549 - DNA, 20 bp, mouse
ggggtgccgctgtgctgtcg

SEQ ID NO: 502550 - DNA, 20 bp, mouse
gggctccccgcgggcgaatg

SEQ ID NO: 502551 - DNA, 20 bp, mouse
gcctgagctcacacccgtcc

SEQ ID NO: 502552 - DNA, 20 bp, mouse
gggcgaatgcggagctggga

SEQ ID NO: 502553 - DNA, 20 bp, mouse
gcaagccgggagatccggag

SEQ ID NO: 502554 - DNA, 20 bp, mouse
gccgggaacgtggcacagcc

SEQ ID NO: 502555 - DNA, 20 bp, mouse
gcccggctgcaggcacagac

SEQ ID NO: 502556 - DNA, 20 bp, mouse
gcggctcggactagaccagg

SEQ ID NO: 502557 - DNA, 20 bp, mouse
gcggactagaccaggaggtg

SEQ ID NO: 502558 - DNA, 20 bp, mouse
gtccgggtccctcggcagag

SEQ ID NO: 502559 - DNA, 20 bp, mouse
ggcgagaccgcctcacctcc

SEQ ID NO: 502560 - DNA, 20 bp, mouse
ggctcggctcggactagacc

SEQ ID NO: 502561 - DNA, 20 bp, mouse
gctgagggccggagtttggg

SEQ ID NO: 502562 - DNA, 20 bp, mouse
gggagcttggctgctcggct

SEQ ID NO: 502563 - DNA, 20 bp, mouse
gccctcggcagagcggagct

SEQ ID NO: 502564 - DNA, 20 bp, mouse
gcgaggactcctacgacggg

SEQ ID NO: 502565 - DNA, 20 bp, mouse
ggcggggcatccgggtccct

SEQ ID NO: 502566 - DNA, 20 bp, mouse
gggctgcccacaaggaagag

SEQ ID NO: 502567 - DNA, 20 bp, mouse
ggttcccgcggggcctctcg

SEQ ID NO: 502568 - DNA, 20 bp, mouse
gcagccgcgagaggccccgc

SEQ ID NO: 502569 - DNA, 20 bp, mouse
gcggagtcgctcaccaggga

SEQ ID NO: 502570 - DNA, 20 bp, mouse
gcacggaggaaaaatggcgg

SEQ ID NO: 502571 - DNA, 20 bp, mouse
ggcggcgtggcccccgaggt

SEQ ID NO: 502572 - DNA, 20 bp, mouse
ggcggagcctggcagacaag

SEQ ID NO: 502573 - DNA, 20 bp, mouse
ggagcctggcagacaagcgg

SEQ ID NO: 502574 - DNA, 20 bp, mouse
gggcgcgccgcctacctcgg

SEQ ID NO: 502575 - DNA, 20 bp, mouse
gccgttgtccgggcaggatg

SEQ ID NO: 502576 - DNA, 20 bp, mouse
gctcgatcggccagacccca

SEQ ID NO: 502577 - DNA, 20 bp, mouse
gcgatcgagcgtacactcac

SEQ ID NO: 502578 - DNA, 20 bp, mouse
gcccacggcgtcaccatgtt

SEQ ID NO: 502579 - DNA, 20 bp, mouse
gactggcagtaaggtccaca

SEQ ID NO: 502580 - DNA, 20 bp, mouse
ggtaaggtccacagggcgag

SEQ ID NO: 502581 - DNA, 20 bp, mouse
ggtgccgcggggccatgggt

SEQ ID NO: 502582 - DNA, 20 bp, mouse
ggcaagcgccgggcagtaca

SEQ ID NO: 502583 - DNA, 20 bp, mouse
gatggtgacgccgtggggtc

SEQ ID NO: 502584 - DNA, 20 bp, mouse
gttcctgatcatgcccaaca

SEQ ID NO: 502585 - DNA, 20 bp, mouse
gcaccatgttgggcatgatc

SEQ ID NO: 502586 - DNA, 20 bp, mouse
gtcctacggacccgcagtaa

SEQ ID NO: 502587 - DNA, 20 bp, mouse
gagcgtgcgccggtggggag

SEQ ID NO: 502588 - DNA, 20 bp, mouse
gggccgagcgtgcgccggtg

SEQ ID NO: 502589 - DNA, 20 bp, mouse
gagtaagggcagcttgggag

SEQ ID NO: 502590 - DNA, 20 bp, mouse
gtggggaggggactcagaac

SEQ ID NO: 502591 - DNA, 20 bp, mouse
gacccgcagtaagggctgca

SEQ ID NO: 502592 - DNA, 20 bp, mouse
gtcagaccgagaatgtccta

SEQ ID NO: 502593 - DNA, 20 bp, mouse
gggccctgcagcccttactg

SEQ ID NO: 502594 - DNA, 20 bp, mouse
gctggaagacgcctacctgg

SEQ ID NO: 502595 - DNA, 20 bp, mouse
gggcccgcaaagattcatct

SEQ ID NO: 502596 - DNA, 20 bp, mouse
gccccgagcagagcgagacg

SEQ ID NO: 502597 - DNA, 20 bp, mouse
gcgagcagagcgagacgcgg

SEQ ID NO: 502598 - DNA, 20 bp, mouse
ggagacgcggaggagcccga

SEQ ID NO: 502599 - DNA, 20 bp, mouse
gggagcccgagggaaaaggc

SEQ ID NO: 502600 - DNA, 20 bp, mouse
gcggaggagcccgagggaaa

SEQ ID NO: 502601 - DNA, 20 bp, mouse
ggcgggcgcctgaggaagag

SEQ ID NO: 502602 - DNA, 20 bp, mouse
gcgcggctgcgagcctcggg

SEQ ID NO: 502603 - DNA, 20 bp, mouse
gcgcagccgcgcgggcgcaa

SEQ ID NO: 502604 - DNA, 20 bp, mouse
gcgcggcggccggaatgtcg

SEQ ID NO: 502605 - DNA, 20 bp, mouse
gcgccctccgcggcagaagc

SEQ ID NO: 502606 - DNA, 20 bp, mouse
gccgcggccctcgagttcct

SEQ ID NO: 502607 - DNA, 20 bp, mouse
gcggtttcctaggaactcga

SEQ ID NO: 502608 - DNA, 20 bp, mouse
ggaaggggagggacgagaca

SEQ ID NO: 502609 - DNA, 20 bp, mouse
gcgatacgcagaggcgacgg

SEQ ID NO: 502610 - DNA, 20 bp, mouse
gtccagctccaagcaggccg

SEQ ID NO: 502611 - DNA, 20 bp, mouse
ggcgcggcctgcggtttcct

SEQ ID NO: 502612 - DNA, 20 bp, mouse
gtccgggccgccgagtccag

SEQ ID NO: 502613 - DNA, 20 bp, mouse
gaggccgcgcaggtcgagcc

SEQ ID NO: 502614 - DNA, 20 bp, mouse
gcaaagggcccgatacgcag

SEQ ID NO: 502615 - DNA, 20 bp, mouse
gaagagcctgcggtcagggt

SEQ ID NO: 502616 - DNA, 20 bp, mouse
gctgaggcgcgaggcggtgg

SEQ ID NO: 502617 - DNA, 20 bp, mouse
gcggctgaggcgcgaggcgg

SEQ ID NO: 502618 - DNA, 20 bp, mouse
ggcccggccagacatgagtg

SEQ ID NO: 502619 - DNA, 20 bp, mouse
gcggccagacatgagtgagg

SEQ ID NO: 502620 - DNA, 20 bp, mouse
gatgtctggccgggcggctg

SEQ ID NO: 502621 - DNA, 20 bp, mouse
ggcccgccccggctgcagtc

SEQ ID NO: 502622 - DNA, 20 bp, mouse
ggagccgcctcactcatgtc

SEQ ID NO: 502623 - DNA, 20 bp, mouse
gcgccccggaggagaggaag

SEQ ID NO: 502624 - DNA, 20 bp, mouse
gcgccggccgtcacgatggg

SEQ ID NO: 502625 - DNA, 20 bp, mouse
gctgcgccggccgtcacgat

SEQ ID NO: 502626 - DNA, 20 bp, mouse
gtggacgagtctcacttcag

SEQ ID NO: 502627 - DNA, 20 bp, mouse
ggactcgtccagggaaaccc

SEQ ID NO: 502628 - DNA, 20 bp, mouse
gcctggccggccgcagccag

SEQ ID NO: 502629 - DNA, 20 bp, mouse
ggcttgtagagcacttcccg

SEQ ID NO: 502630 - DNA, 20 bp, mouse
gggccctctgcttcccacac

SEQ ID NO: 502631 - DNA, 20 bp, mouse
gcacttcagcggcttcgcta

SEQ ID NO: 502632 - DNA, 20 bp, mouse
gaagctagcgccgcaggcag

SEQ ID NO: 502633 - DNA, 20 bp, mouse
gaagctgtacaaggacccgg

SEQ ID NO: 502634 - DNA, 20 bp, mouse
gcggagctcgatactgtcac

SEQ ID NO: 502635 - DNA, 20 bp, mouse
gtacaagctgtacaaggacc

SEQ ID NO: 502636 - DNA, 20 bp, mouse
gacctgtgcgagccaggagg

SEQ ID NO: 502637 - DNA, 20 bp, mouse
gtggtgttgcggctcaaaca

SEQ ID NO: 502638 - DNA, 20 bp, mouse
gagccaggagggggtcctct

SEQ ID NO: 502639 - DNA, 20 bp, mouse
gtcagaggctcgtggtgttg

SEQ ID NO: 502640 - DNA, 20 bp, mouse
ggtgctgcgttgccacgcac

SEQ ID NO: 502641 - DNA, 20 bp, mouse
gaacaaggactcccagtgcg

SEQ ID NO: 502642 - DNA, 20 bp, mouse
ggcacgcaggttagaaccgg

SEQ ID NO: 502643 - DNA, 20 bp, mouse
gaacctcgcgggagaagaga

SEQ ID NO: 502644 - DNA, 20 bp, mouse
gggtcgcacgtggcttgcat

SEQ ID NO: 502645 - DNA, 20 bp, mouse
gggaagccgccccagaaagg

SEQ ID NO: 502646 - DNA, 20 bp, mouse
gggcccacgggacctccctg

SEQ ID NO: 502647 - DNA, 20 bp, mouse
gctctggagcgccgtcccca

SEQ ID NO: 502648 - DNA, 20 bp, mouse
gcggaggacgagttagactg

SEQ ID NO: 502649 - DNA, 20 bp, mouse
gtggagcgccgtccccaggg

SEQ ID NO: 502650 - DNA, 20 bp, mouse
ggggacggcgctccagagct

SEQ ID NO: 502651 - DNA, 20 bp, mouse
ggggagaagcggccagaccc

SEQ ID NO: 502652 - DNA, 20 bp, mouse
gcggccagacccgggcccac

SEQ ID NO: 502653 - DNA, 20 bp, mouse
gagctccacccgcccagctc

SEQ ID NO: 502654 - DNA, 20 bp, mouse
gcggcgtctagcggacaagg

SEQ ID NO: 502655 - DNA, 20 bp, mouse
gagactgcggagcgaaggac

SEQ ID NO: 502656 - DNA, 20 bp, mouse
gctcgccgccgccctcggcc

SEQ ID NO: 502657 - DNA, 20 bp, mouse
ggcgcgcggcgtggccatgg

SEQ ID NO: 502658 - DNA, 20 bp, mouse
gaccgggaggagtgttcgat

SEQ ID NO: 502659 - DNA, 20 bp, mouse
gccgcccgcgctcacatgcc

SEQ ID NO: 502660 - DNA, 20 bp, mouse
gagttgtgggagccgcggga

SEQ ID NO: 502661 - DNA, 20 bp, mouse
gatgccgggcgccgggccga

SEQ ID NO: 502662 - DNA, 20 bp, mouse
ggcccatcgaacactcctcc

SEQ ID NO: 502663 - DNA, 20 bp, mouse
gagggagccccgcgccccgg

SEQ ID NO: 502664 - DNA, 20 bp, mouse
ggcgcccggcatgtgagcgc

SEQ ID NO: 502665 - DNA, 20 bp, mouse
gaggctccgtggaccctcgt

SEQ ID NO: 502666 - DNA, 20 bp, mouse
gcgccgaagagataatggct

SEQ ID NO: 502667 - DNA, 20 bp, mouse
gaagttcgccgaagagataa

SEQ ID NO: 502668 - DNA, 20 bp, mouse
gagcgccagccgggccgggt

SEQ ID NO: 502669 - DNA, 20 bp, mouse
gtacaagagcgacgacgagg

SEQ ID NO: 502670 - DNA, 20 bp, mouse
gccgtacaagagcgacgacg

SEQ ID NO: 502671 - DNA, 20 bp, mouse
gagccgggccgggttggcag

SEQ ID NO: 502672 - DNA, 20 bp, mouse
ggctcttgtacgggtgcaga

SEQ ID NO: 502673 - DNA, 20 bp, mouse
gaagagcgacgacgaggagg

SEQ ID NO: 502674 - DNA, 20 bp, mouse
ggaagctgaccggcttaccc

SEQ ID NO: 502675 - DNA, 20 bp, mouse
gccgaggaactctgcagcgg

SEQ ID NO: 502676 - DNA, 20 bp, mouse
gctcgtgaggagacctgtaa

SEQ ID NO: 502677 - DNA, 20 bp, mouse
gacctgtaagggagacgtgg

SEQ ID NO: 502678 - DNA, 20 bp, mouse
gctggagccaaggaccctaa

SEQ ID NO: 502679 - DNA, 20 bp, mouse
gggtgtgaggatttagctcg

SEQ ID NO: 502680 - DNA, 20 bp, mouse
gtcccgaagttggaactcgg

SEQ ID NO: 502681 - DNA, 20 bp, mouse
gccctaagggagcacggcgg

SEQ ID NO: 502682 - DNA, 20 bp, mouse
gagccgcccgcgagcagcag

SEQ ID NO: 502683 - DNA, 20 bp, mouse
gaggcgactgggtccccggc

SEQ ID NO: 502684 - DNA, 20 bp, mouse
gcgcggcgtttgaggcgact

SEQ ID NO: 502685 - DNA, 20 bp, mouse
gggcgacctggtctgcttgg

SEQ ID NO: 502686 - DNA, 20 bp, mouse
ggggctgcgctgctgaggga

SEQ ID NO: 502687 - DNA, 20 bp, mouse
gcagcctgccgaggacacgg

SEQ ID NO: 502688 - DNA, 20 bp, mouse
gctccgggctgcacccaggg

SEQ ID NO: 502689 - DNA, 20 bp, mouse
ggtctccagaacggcgccac

SEQ ID NO: 502690 - DNA, 20 bp, mouse
ggggatggaaagctgatgct

SEQ ID NO: 502691 - DNA, 20 bp, mouse
gtccctgcgacagccgccct

SEQ ID NO: 502692 - DNA, 20 bp, mouse
gcggctccgggctgcaccca

SEQ ID NO: 502693 - DNA, 20 bp, mouse
gctccagcctgccgaggaca

SEQ ID NO: 502694 - DNA, 20 bp, mouse
gagctcggccggggtcgggg

SEQ ID NO: 502695 - DNA, 20 bp, mouse
ggcgccgttctggagacagc

SEQ ID NO: 502696 - DNA, 20 bp, mouse
ggcgatcgtgtgagactcag

SEQ ID NO: 502697 - DNA, 20 bp, mouse
ggactcagcggtgggactaa

SEQ ID NO: 502698 - DNA, 20 bp, mouse
gtcgtgtgagactcagcggt

SEQ ID NO: 502699 - DNA, 20 bp, mouse
gcagcctcccaggtccgagg

SEQ ID NO: 502700 - DNA, 20 bp, mouse
ggagccccctcggacctggg

SEQ ID NO: 502701 - DNA, 20 bp, mouse
ggctactgccgcccagagtg

SEQ ID NO: 502702 - DNA, 20 bp, mouse
ggcagtggctgcgggcaccg

SEQ ID NO: 502703 - DNA, 20 bp, mouse
gcaacaggcacctcaggaag

SEQ ID NO: 502704 - DNA, 20 bp, mouse
gtcgcccaaggagtcatcca

SEQ ID NO: 502705 - DNA, 20 bp, mouse
gcactcggcgctgggaccgc

SEQ ID NO: 502706 - DNA, 20 bp, mouse
ggaggctcctgaagcgaccc

SEQ ID NO: 502707 - DNA, 20 bp, mouse
gcgacccgggcagcggagaa

SEQ ID NO: 502708 - DNA, 20 bp, mouse
gtggcgtagaaagtaatgac

SEQ ID NO: 502709 - DNA, 20 bp, mouse
ggagcctccagagccatccg

SEQ ID NO: 502710 - DNA, 20 bp, mouse
gtctccccggatggctctgg

SEQ ID NO: 502711 - DNA, 20 bp, mouse
gtggcacctcagccccccag

SEQ ID NO: 502712 - DNA, 20 bp, mouse
gttgtggggacgttgacaag

SEQ ID NO: 502713 - DNA, 20 bp, mouse
ggagagtccgggcctctccc

SEQ ID NO: 502714 - DNA, 20 bp, mouse
gcagggtcgcggcttagggt

SEQ ID NO: 502715 - DNA, 20 bp, mouse
gacctcagccccccagcgga

SEQ ID NO: 502716 - DNA, 20 bp, mouse
gtggtgcactgggtgagtat

SEQ ID NO: 502717 - DNA, 20 bp, mouse
ggagttctgagtcgccccag

SEQ ID NO: 502718 - DNA, 20 bp, mouse
gctggaggggccacctagag

SEQ ID NO: 502719 - DNA, 20 bp, mouse
gaagtcgatgctggtgcact

SEQ ID NO: 502720 - DNA, 20 bp, mouse
ggtcttcacacctctctagg

SEQ ID NO: 502721 - DNA, 20 bp, mouse
gagagctagaaccccatacc

SEQ ID NO: 502722 - DNA, 20 bp, mouse
gtccacagaggagtgcaggg

SEQ ID NO: 502723 - DNA, 20 bp, mouse
gaccaccacccagcaaggat

SEQ ID NO: 502724 - DNA, 20 bp, mouse
ggctactcttaagtcgatgc

SEQ ID NO: 502725 - DNA, 20 bp, mouse
gaactccacagaggagtgca

SEQ ID NO: 502726 - DNA, 20 bp, mouse
gacactgcacaggtgtgagg

SEQ ID NO: 502727 - DNA, 20 bp, mouse
gtgcagtgtgataaagaaag

SEQ ID NO: 502728 - DNA, 20 bp, mouse
ggtgagctcgaagcttcaca

SEQ ID NO: 502729 - DNA, 20 bp, mouse
gcacaggtgtgagggggaaa

SEQ ID NO: 502730 - DNA, 20 bp, mouse
gtctggttagaccacagctg

SEQ ID NO: 502731 - DNA, 20 bp, mouse
gtggagcacaggacttctgt

SEQ ID NO: 502732 - DNA, 20 bp, mouse
gggtcctggtcagacgaaag

SEQ ID NO: 502733 - DNA, 20 bp, mouse
gtcgtggcaagatggacatg

SEQ ID NO: 502734 - DNA, 20 bp, mouse
gtgctccaggtaaggagtgg

SEQ ID NO: 502735 - DNA, 20 bp, mouse
gatcacactgcacaggtgtg

SEQ ID NO: 502736 - DNA, 20 bp, mouse
gagcgtgcatgccctctggt

SEQ ID NO: 502737 - DNA, 20 bp, mouse
gctggtgcatacctaccaga

SEQ ID NO: 502738 - DNA, 20 bp, mouse
gcagagcaggagatccggat

SEQ ID NO: 502739 - DNA, 20 bp, mouse
gtgcaccagagcaggagatc

SEQ ID NO: 502740 - DNA, 20 bp, mouse
ggtccaccagtacccagcta

SEQ ID NO: 502741 - DNA, 20 bp, mouse
gtgggatggacgctgtgtcg

SEQ ID NO: 502742 - DNA, 20 bp, mouse
ggtaccagaaaattgaccca

SEQ ID NO: 502743 - DNA, 20 bp, mouse
ggtgggggggcgctaaccct

SEQ ID NO: 502744 - DNA, 20 bp, mouse
gtcagacagggctccagaag

SEQ ID NO: 502745 - DNA, 20 bp, mouse
gtacaggttacgcacatccg

SEQ ID NO: 502746 - DNA, 20 bp, mouse
gaggccggaacactgatgaa

SEQ ID NO: 502747 - DNA, 20 bp, mouse
gaaaggttgggaatacttga

SEQ ID NO: 502748 - DNA, 20 bp, mouse
gataccgagagatgtcttaa

SEQ ID NO: 502749 - DNA, 20 bp, mouse
gtttcccttaagacatctct

SEQ ID NO: 502750 - DNA, 20 bp, mouse
gtctgaagggacacaaaggc

SEQ ID NO: 502751 - DNA, 20 bp, mouse
gggaacactgatgaaaggtt

SEQ ID NO: 502752 - DNA, 20 bp, mouse
gagagaggctcagaacccca

SEQ ID NO: 502753 - DNA, 20 bp, mouse
gcgcttagtgtacttccctt

SEQ ID NO: 502754 - DNA, 20 bp, mouse
gagcgagttaaaactctgaa

SEQ ID NO: 502755 - DNA, 20 bp, mouse
gtccggcagaggctctgact

SEQ ID NO: 502756 - DNA, 20 bp, mouse
gtggatgcgacccagactgg

SEQ ID NO: 502757 - DNA, 20 bp, mouse
gtgttggatgcgacccagac

SEQ ID NO: 502758 - DNA, 20 bp, mouse
ggcagtctggccgccagtct

SEQ ID NO: 502759 - DNA, 20 bp, mouse
gggccagactgcgtgctcgg

SEQ ID NO: 502760 - DNA, 20 bp, mouse
gcgcccagcgaggaccctga

SEQ ID NO: 502761 - DNA, 20 bp, mouse
gcctcgcacacgggacgcca

SEQ ID NO: 502762 - DNA, 20 bp, mouse
gcatccaacagtcgccgcag

SEQ ID NO: 502763 - DNA, 20 bp, mouse
gctgcgttgacctgcccctg

SEQ ID NO: 502764 - DNA, 20 bp, mouse
gagccgccgagcacgcagtc

SEQ ID NO: 502765 - DNA, 20 bp, mouse
gctgcccctgcggcgactgt

SEQ ID NO: 502766 - DNA, 20 bp, mouse
ggccctggaggctcttgaca

SEQ ID NO: 502767 - DNA, 20 bp, mouse
ggccctgtcaagagcctcca

SEQ ID NO: 502768 - DNA, 20 bp, mouse
gagtcccactcccaaggcag

SEQ ID NO: 502769 - DNA, 20 bp, mouse
ggcagagcctgataccttcg

SEQ ID NO: 502770 - DNA, 20 bp, mouse
gcaaagggacgtgcccggag

SEQ ID NO: 502771 - DNA, 20 bp, mouse
ggggccaggcgggaagcaca

SEQ ID NO: 502772 - DNA, 20 bp, mouse
gcagccaggtaagagatcag

SEQ ID NO: 502773 - DNA, 20 bp, mouse
gtaccttcggggctggagga

SEQ ID NO: 502774 - DNA, 20 bp, mouse
ggagagcgctcagtggccgt

SEQ ID NO: 502775 - DNA, 20 bp, mouse
gtagcaggttccatcctatg

SEQ ID NO: 502776 - DNA, 20 bp, mouse
gtgcggcgccctgttctcag

SEQ ID NO: 502777 - DNA, 20 bp, mouse
gaacagggcgccgcatgcat

SEQ ID NO: 502778 - DNA, 20 bp, mouse
gggcgccgcatgcatgggac

SEQ ID NO: 502779 - DNA, 20 bp, mouse
ggcatcctgtcccatgcatg

SEQ ID NO: 502780 - DNA, 20 bp, mouse
gggactcgctaagaaagtta

SEQ ID NO: 502781 - DNA, 20 bp, mouse
gtcagtggcaagttggttca

SEQ ID NO: 502782 - DNA, 20 bp, mouse
gtgttgctccaagggaacaa

SEQ ID NO: 502783 - DNA, 20 bp, mouse
gtctcccagggcttaccgat

SEQ ID NO: 502784 - DNA, 20 bp, mouse
ggagcaacagctactgtcaa

SEQ ID NO: 502785 - DNA, 20 bp, mouse
gaccttcttcttataggtaa

SEQ ID NO: 502786 - DNA, 20 bp, mouse
gtgtctggcggggattactg

SEQ ID NO: 502787 - DNA, 20 bp, mouse
gtccaggtgcttcaggttcg

SEQ ID NO: 502788 - DNA, 20 bp, mouse
gacctgaagcacctggagta

SEQ ID NO: 502789 - DNA, 20 bp, mouse
ggaaatagcccctctcaaca

SEQ ID NO: 502790 - DNA, 20 bp, mouse
gaccagaagacctaggacgt

SEQ ID NO: 502791 - DNA, 20 bp, mouse
gtcctggtgaggatctccgg

SEQ ID NO: 502792 - DNA, 20 bp, mouse
gtgccaacaccagaagacct

SEQ ID NO: 502793 - DNA, 20 bp, mouse
gctttcttggcccctactcc

SEQ ID NO: 502794 - DNA, 20 bp, mouse
ggatctccggaggaattaca

SEQ ID NO: 502795 - DNA, 20 bp, mouse
ggtggccagccaaagcccac

SEQ ID NO: 502796 - DNA, 20 bp, mouse
gtgtttctgaagcagccggg

SEQ ID NO: 502797 - DNA, 20 bp, mouse
gggagaaggatgcagccacc

SEQ ID NO: 502798 - DNA, 20 bp, mouse
gaactagtccaagcagaccc

SEQ ID NO: 502799 - DNA, 20 bp, mouse
gttgccaagaggtcaaacca

SEQ ID NO: 502800 - DNA, 20 bp, mouse
gccggtaggcagcctgaaaa

SEQ ID NO: 502801 - DNA, 20 bp, mouse
gtgggtcagggaggttgtgt

SEQ ID NO: 502802 - DNA, 20 bp, mouse
ggtcaaaccagggagtctat

SEQ ID NO: 502803 - DNA, 20 bp, mouse
gtggcaactctgggtcaggg

SEQ ID NO: 502804 - DNA, 20 bp, mouse
gctggaactatgtgcctcaa

SEQ ID NO: 502805 - DNA, 20 bp, mouse
gcctgaaaagggagtcaacc

SEQ ID NO: 502806 - DNA, 20 bp, mouse
ggcggcggcgacttgtcaaa

SEQ ID NO: 502807 - DNA, 20 bp, mouse
ggccccggaacggccccgag

SEQ ID NO: 502808 - DNA, 20 bp, mouse
gggaaagacgtaagaggcgg

SEQ ID NO: 502809 - DNA, 20 bp, mouse
gtcaaagggaaagacgtaag

SEQ ID NO: 502810 - DNA, 20 bp, mouse
gtcgccggccgacttcggag

SEQ ID NO: 502811 - DNA, 20 bp, mouse
gtacgtgggtcgggagctgg

SEQ ID NO: 502812 - DNA, 20 bp, mouse
gcacactcgggaggtcacga

SEQ ID NO: 502813 - DNA, 20 bp, mouse
gggccggcgacagggagcac

SEQ ID NO: 502814 - DNA, 20 bp, mouse
gtcgggagctggcggcgatg

SEQ ID NO: 502815 - DNA, 20 bp, mouse
gagtctcgcgggacttatga

SEQ ID NO: 502816 - DNA, 20 bp, mouse
gctcggaggccgcgcagtca

SEQ ID NO: 502817 - DNA, 20 bp, mouse
gcgttggcgcggaggaacca

SEQ ID NO: 502818 - DNA, 20 bp, mouse
ggcgctcgcgatccagtctg

SEQ ID NO: 502819 - DNA, 20 bp, mouse
gtgctccgccagccggctga

SEQ ID NO: 502820 - DNA, 20 bp, mouse
gctgagggaacactccctgc

SEQ ID NO: 502821 - DNA, 20 bp, mouse
ggcgccggccggctcctgca

SEQ ID NO: 502822 - DNA, 20 bp, mouse
gggcggagcaggcggcgcca

SEQ ID NO: 502823 - DNA, 20 bp, mouse
gcagggcctgtgcgcctcgg

SEQ ID NO: 502824 - DNA, 20 bp, mouse
ggccgagctgggccgaagga

SEQ ID NO: 502825 - DNA, 20 bp, mouse
gacgccggccggacctacag

SEQ ID NO: 502826 - DNA, 20 bp, mouse
gcgcgggcgcagaatgagct

SEQ ID NO: 502827 - DNA, 20 bp, mouse
gcattggccaggcgggaagt

SEQ ID NO: 502828 - DNA, 20 bp, mouse
gtgcgcccgcgggagtgcgg

SEQ ID NO: 502829 - DNA, 20 bp, mouse
ggcctggccaatggtggcgg

SEQ ID NO: 502830 - DNA, 20 bp, mouse
ggtttcccccgcactcccgc

SEQ ID NO: 502831 - DNA, 20 bp, mouse
gggaggcccgagctgcctga

SEQ ID NO: 502832 - DNA, 20 bp, mouse
ggagcccgccgcacccgcgg

SEQ ID NO: 502833 - DNA, 20 bp, mouse
gactgtgacgctgaaggccg

SEQ ID NO: 502834 - DNA, 20 bp, mouse
gttctgcgcccgcgggagtg

SEQ ID NO: 502835 - DNA, 20 bp, mouse
gcccgcctggccaatggtgg

SEQ ID NO: 502836 - DNA, 20 bp, mouse
gtcggtccggagagtgctgg

SEQ ID NO: 502837 - DNA, 20 bp, mouse
ggagcctgggaaagtttcac

SEQ ID NO: 502838 - DNA, 20 bp, mouse
gcgactcaccgggtctctca

SEQ ID NO: 502839 - DNA, 20 bp, mouse
gtggcggcagcgtttctcgg

SEQ ID NO: 502840 - DNA, 20 bp, mouse
ggccaggcgacaagggagag

SEQ ID NO: 502841 - DNA, 20 bp, mouse
gagggagagccaggcgacaa

SEQ ID NO: 502842 - DNA, 20 bp, mouse
ggagctggagagccgcccag

SEQ ID NO: 502843 - DNA, 20 bp, mouse
gagcagggcggagaccacga

SEQ ID NO: 502844 - DNA, 20 bp, mouse
gctctcggtccggagagtgc

SEQ ID NO: 502845 - DNA, 20 bp, mouse
gggagagccctaagcgatgg

SEQ ID NO: 502846 - DNA, 20 bp, mouse
gcccgcaggaatacaccctg

SEQ ID NO: 502847 - DNA, 20 bp, mouse
gagcgagtggtgttccccgc

SEQ ID NO: 502848 - DNA, 20 bp, mouse
gtgctcaggacagtatgtgg

SEQ ID NO: 502849 - DNA, 20 bp, mouse
gcctgtggttgctgaacagt

SEQ ID NO: 502850 - DNA, 20 bp, mouse
gccaggggaccagggatacc

SEQ ID NO: 502851 - DNA, 20 bp, mouse
gctcttgcaggcagccagcg

SEQ ID NO: 502852 - DNA, 20 bp, mouse
gagcggcattgaactcttgc

SEQ ID NO: 502853 - DNA, 20 bp, mouse
gcggaagcctcggcgcctga

SEQ ID NO: 502854 - DNA, 20 bp, mouse
gggggaccagggataccggg

SEQ ID NO: 502855 - DNA, 20 bp, mouse
gataccgggtggctggacca

SEQ ID NO: 502856 - DNA, 20 bp, mouse
ggcgctcagggatgccgaac

SEQ ID NO: 502857 - DNA, 20 bp, mouse
gctcagggatgccgaacggg

SEQ ID NO: 502858 - DNA, 20 bp, mouse
gaggggcacaggagacggtt

SEQ ID NO: 502859 - DNA, 20 bp, mouse
ggccgccagcgacgcagaca

SEQ ID NO: 502860 - DNA, 20 bp, mouse
gagcgctagggcgagcagag

SEQ ID NO: 502861 - DNA, 20 bp, mouse
gcgggcgctcggggtagact

SEQ ID NO: 502862 - DNA, 20 bp, mouse
gggcggctcgactgcgctca

SEQ ID NO: 502863 - DNA, 20 bp, mouse
gtccatgtctgcgtcgctgg

SEQ ID NO: 502864 - DNA, 20 bp, mouse
gctgcaggcgtggcaccccg

SEQ ID NO: 502865 - DNA, 20 bp, mouse
gggacacgcgcccccgtctc

SEQ ID NO: 502866 - DNA, 20 bp, mouse
gcagcaggagggcggggact

SEQ ID NO: 502867 - DNA, 20 bp, mouse
gccgccccgcgagaccagga

SEQ ID NO: 502868 - DNA, 20 bp, mouse
ggcgaggctgcggctcagag

SEQ ID NO: 502869 - DNA, 20 bp, mouse
gtcctcacatcaacaatccc

SEQ ID NO: 502870 - DNA, 20 bp, mouse
ggcccgggattgttgatgtg

SEQ ID NO: 502871 - DNA, 20 bp, mouse
gcggcctgccctcctgaagg

SEQ ID NO: 502872 - DNA, 20 bp, mouse
gggcgcggccaggcggcagg

SEQ ID NO: 502873 - DNA, 20 bp, mouse
gacgcggcctgccctcctga

SEQ ID NO: 502874 - DNA, 20 bp, mouse
ggagcttgaagagaggacgg

SEQ ID NO: 502875 - DNA, 20 bp, mouse
gaggaggaggaggaatgcgg

SEQ ID NO: 502876 - DNA, 20 bp, mouse
ggagctggtgctgataacag

SEQ ID NO: 502877 - DNA, 20 bp, mouse
gattccaggaccaaggagag

SEQ ID NO: 502878 - DNA, 20 bp, mouse
gcagggcctgcggatcacac

SEQ ID NO: 502879 - DNA, 20 bp, mouse
gtagcactattccaggacca

SEQ ID NO: 502880 - DNA, 20 bp, mouse
gcttagggctacttagtgat

SEQ ID NO: 502881 - DNA, 20 bp, mouse
gaccaaggagagaggtagac

SEQ ID NO: 502882 - DNA, 20 bp, mouse
gtgtagccgagaagggtggt

SEQ ID NO: 502883 - DNA, 20 bp, mouse
gaggctgtagccgagaaggg

SEQ ID NO: 502884 - DNA, 20 bp, mouse
gctgcggatcacacaggatc

SEQ ID NO: 502885 - DNA, 20 bp, mouse
gctgtggtagaagccggtga

SEQ ID NO: 502886 - DNA, 20 bp, mouse
gagggtctgttacctcgggg

SEQ ID NO: 502887 - DNA, 20 bp, mouse
gtgctctgcaggaaagcgaa

SEQ ID NO: 502888 - DNA, 20 bp, mouse
ggttctgcgggagagcgaga

SEQ ID NO: 502889 - DNA, 20 bp, mouse
gggaaagcgaagggtgcaca

SEQ ID NO: 502890 - DNA, 20 bp, mouse
ggcaaggatcctccaccccg

SEQ ID NO: 502891 - DNA, 20 bp, mouse
gtgaactccgaggaccccgg

SEQ ID NO: 502892 - DNA, 20 bp, mouse
gccgcgtcctcaactcttct

SEQ ID NO: 502893 - DNA, 20 bp, mouse
gtctctctgccttgcagcag

SEQ ID NO: 502894 - DNA, 20 bp, mouse
ggaagagctcgcagatccgt

SEQ ID NO: 502895 - DNA, 20 bp, mouse
ggccaccgaaaggtccccag

SEQ ID NO: 502896 - DNA, 20 bp, mouse
ggagagctttcccagcggta

SEQ ID NO: 502897 - DNA, 20 bp, mouse
gctgggagaagggagtgaag

SEQ ID NO: 502898 - DNA, 20 bp, mouse
gttacacagcttgctcagag

SEQ ID NO: 502899 - DNA, 20 bp, mouse
gatgtcttacctgcgtccac

SEQ ID NO: 502900 - DNA, 20 bp, mouse
gctatcctagtggaagggag

SEQ ID NO: 502901 - DNA, 20 bp, mouse
ggcgatgaaagctatcctag

SEQ ID NO: 502902 - DNA, 20 bp, mouse
gtgagatgcaggctgacgac

SEQ ID NO: 502903 - DNA, 20 bp, mouse
ggctgtctctccttaccgct

SEQ ID NO: 502904 - DNA, 20 bp, mouse
gcgctgggaaagctctcttc

SEQ ID NO: 502905 - DNA, 20 bp, mouse
gttctgggtgggtctgcctg

SEQ ID NO: 502906 - DNA, 20 bp, mouse
ggccatgcctggagctctgg

SEQ ID NO: 502907 - DNA, 20 bp, mouse
gattagcgagcggagcggag

SEQ ID NO: 502908 - DNA, 20 bp, mouse
gaggcgattagcgagcggag

SEQ ID NO: 502909 - DNA, 20 bp, mouse
gtctggaggcgattagcgag

SEQ ID NO: 502910 - DNA, 20 bp, mouse
gagagccaggcgtcccggac

SEQ ID NO: 502911 - DNA, 20 bp, mouse
gggcatggccccaagtaccg

SEQ ID NO: 502912 - DNA, 20 bp, mouse
gcagctgcggaagccggtgg

SEQ ID NO: 502913 - DNA, 20 bp, mouse
gatggccccaagtaccgtgg

SEQ ID NO: 502914 - DNA, 20 bp, mouse
gtaatcgcctccagagctcc

SEQ ID NO: 502915 - DNA, 20 bp, mouse
ggtccaggtcgcgccagtcc

SEQ ID NO: 502916 - DNA, 20 bp, mouse
gcgccgggctccgtagacca

SEQ ID NO: 502917 - DNA, 20 bp, mouse
gcccgcgggccggaagactc

SEQ ID NO: 502918 - DNA, 20 bp, mouse
gcgctgagtagtttgcacta

SEQ ID NO: 502919 - DNA, 20 bp, mouse
gagactccggagagctagtg

SEQ ID NO: 502920 - DNA, 20 bp, mouse
ggagagctagtggggcctcc

SEQ ID NO: 502921 - DNA, 20 bp, mouse
ggggacggagccatggtcta

SEQ ID NO: 502922 - DNA, 20 bp, mouse
ggcaaactactcagcgaggt

SEQ ID NO: 502923 - DNA, 20 bp, mouse
gctcctggcctgcacggtcc

SEQ ID NO: 502924 - DNA, 20 bp, mouse
gccacaggcccggaagcccc

SEQ ID NO: 502925 - DNA, 20 bp, mouse
gcccggctgggcgcctggga

SEQ ID NO: 502926 - DNA, 20 bp, mouse
ggacaaagccagctagacaa

SEQ ID NO: 502927 - DNA, 20 bp, mouse
gggccaggagcgacaggtgt

SEQ ID NO: 502928 - DNA, 20 bp, mouse
gtcccgcggcgaggcagggc

SEQ ID NO: 502929 - DNA, 20 bp, mouse
gatggaccgccgacgacgcg

SEQ ID NO: 502930 - DNA, 20 bp, mouse
ggcaacaggcacgcctgtgt

SEQ ID NO: 502931 - DNA, 20 bp, mouse
ggcaggaaccaagaatagaa

SEQ ID NO: 502932 - DNA, 20 bp, mouse
gcccctcccgcggcgaggca

SEQ ID NO: 502933 - DNA, 20 bp, mouse
gccaagccccgcgtcgtcgg

SEQ ID NO: 502934 - DNA, 20 bp, mouse
gcaggccggccaggagcgac

SEQ ID NO: 502935 - DNA, 20 bp, mouse
gcgcccaagccccgcgtcgt

SEQ ID NO: 502936 - DNA, 20 bp, mouse
gcggcgggatataaggatct

SEQ ID NO: 502937 - DNA, 20 bp, mouse
gagtccaccgaagggtccgg

SEQ ID NO: 502938 - DNA, 20 bp, mouse
gcctgcagcggcgggatata

SEQ ID NO: 502939 - DNA, 20 bp, mouse
gacgcgctgagtccaccgaa

SEQ ID NO: 502940 - DNA, 20 bp, mouse
ggctcctccggacccttcgg

SEQ ID NO: 502941 - DNA, 20 bp, mouse
ggaagggtccggaggagcaa

SEQ ID NO: 502942 - DNA, 20 bp, mouse
gggaggagcaatggtcaccc

SEQ ID NO: 502943 - DNA, 20 bp, mouse
gccgccgctgcagggtagga

SEQ ID NO: 502944 - DNA, 20 bp, mouse
gcgggagcgagctgagaata

SEQ ID NO: 502945 - DNA, 20 bp, mouse
gtatcccgccgctgcagggt

SEQ ID NO: 502946 - DNA, 20 bp, mouse
gtgggtcgtacagcgccgga

SEQ ID NO: 502947 - DNA, 20 bp, mouse
gtgtctcccagccttcggga

SEQ ID NO: 502948 - DNA, 20 bp, mouse
ggagcaccttcccgaaggct

SEQ ID NO: 502949 - DNA, 20 bp, mouse
gtcccagctctgcacacgtg

SEQ ID NO: 502950 - DNA, 20 bp, mouse
gactgggagtgaaccaccta

SEQ ID NO: 502951 - DNA, 20 bp, mouse
ggtctccaacagggtcggaa

SEQ ID NO: 502952 - DNA, 20 bp, mouse
gttgagaaggagcagggcgc

SEQ ID NO: 502953 - DNA, 20 bp, mouse
gagaatgtctcccagccttc

SEQ ID NO: 502954 - DNA, 20 bp, mouse
gcttctgggtcgtacagcgc

SEQ ID NO: 502955 - DNA, 20 bp, mouse
gggagtgaaccacctagggc

SEQ ID NO: 502956 - DNA, 20 bp, mouse
gagctgaccggggctcacgt

SEQ ID NO: 502957 - DNA, 20 bp, mouse
gcagagcctgcagccggcca

SEQ ID NO: 502958 - DNA, 20 bp, mouse
ggcgtcgaaaggcctcgtcg

SEQ ID NO: 502959 - DNA, 20 bp, mouse
gtgctggaaggggagctggc

SEQ ID NO: 502960 - DNA, 20 bp, mouse
gtgagccccggtcagctgag

SEQ ID NO: 502961 - DNA, 20 bp, mouse
gctgcgcggccgaactgaca

SEQ ID NO: 502962 - DNA, 20 bp, mouse
gggaaccgaagagcaggtta

SEQ ID NO: 502963 - DNA, 20 bp, mouse
gggccaacgggagggtgtct

SEQ ID NO: 502964 - DNA, 20 bp, mouse
gggagctggccggtgggcca

SEQ ID NO: 502965 - DNA, 20 bp, mouse
gggaaggcggctccttcgga

SEQ ID NO: 502966 - DNA, 20 bp, mouse
ggactgcctagccagactcg

SEQ ID NO: 502967 - DNA, 20 bp, mouse
gagtctggctaggcagtctt

SEQ ID NO: 502968 - DNA, 20 bp, mouse
ggagcaggaagggcccgctg

SEQ ID NO: 502969 - DNA, 20 bp, mouse
gccagcggggaggggacctt

SEQ ID NO: 502970 - DNA, 20 bp, mouse
gtcttcccagcgacccagac

SEQ ID NO: 502971 - DNA, 20 bp, mouse
gtcgatgctgaagtcctccg

SEQ ID NO: 502972 - DNA, 20 bp, mouse
gctgtagcagcgagcaggaa

SEQ ID NO: 502973 - DNA, 20 bp, mouse
gaagggcccgctgtggaatt

SEQ ID NO: 502974 - DNA, 20 bp, mouse
gcggctgttgtacatctccg

SEQ ID NO: 502975 - DNA, 20 bp, mouse
ggtccccgcgtagcgccccc

SEQ ID NO: 502976 - DNA, 20 bp, mouse
ggccagacgagagcaatcgg

SEQ ID NO: 502977 - DNA, 20 bp, mouse
gccggcgcgcgaccaggtag

SEQ ID NO: 502978 - DNA, 20 bp, mouse
gccgggcccagcacaatcgg

SEQ ID NO: 502979 - DNA, 20 bp, mouse
gcgatggcgcctcagcggag

SEQ ID NO: 502980 - DNA, 20 bp, mouse
gctgcagcactacttccctc

SEQ ID NO: 502981 - DNA, 20 bp, mouse
gggaccacccagaattcccg

SEQ ID NO: 502982 - DNA, 20 bp, mouse
gtacttccctcgggaattct

SEQ ID NO: 502983 - DNA, 20 bp, mouse
gccttggcactgcaaccctg

SEQ ID NO: 502984 - DNA, 20 bp, mouse
gcgcggcctcccggtcccta

SEQ ID NO: 502985 - DNA, 20 bp, mouse
gccaggtagcgggatcctta

SEQ ID NO: 502986 - DNA, 20 bp, mouse
gaggaactgggagctcgggt

SEQ ID NO: 502987 - DNA, 20 bp, mouse
gggcaggtggaaagtcaggt

SEQ ID NO: 502988 - DNA, 20 bp, mouse
gcgacacccgtggaagtggg

SEQ ID NO: 502989 - DNA, 20 bp, mouse
gcctgaggaactgggagctc

SEQ ID NO: 502990 - DNA, 20 bp, mouse
gcctgccgcagagcccacaa

SEQ ID NO: 502991 - DNA, 20 bp, mouse
gcgtctgtgggagcactcgg

SEQ ID NO: 502992 - DNA, 20 bp, mouse
gcacccgtggaagtgggagg

SEQ ID NO: 502993 - DNA, 20 bp, mouse
ggagcgacacccgtggaagt

SEQ ID NO: 502994 - DNA, 20 bp, mouse
gcgatgacgctgcctcggag

SEQ ID NO: 502995 - DNA, 20 bp, mouse
ggtggaaagtcaggttggga

SEQ ID NO: 502996 - DNA, 20 bp, mouse
ggcagcaagagatagggcag

SEQ ID NO: 502997 - DNA, 20 bp, mouse
gagaggcgttgagactctca

SEQ ID NO: 502998 - DNA, 20 bp, mouse
gtgagactctcatggacagg

SEQ ID NO: 502999 - DNA, 20 bp, mouse
gtgctactgcagcaagagat

SEQ ID NO: 503000 - DNA, 20 bp, mouse
gcgttgagactctcatggac

SEQ ID NO: 503001 - DNA, 20 bp, mouse
gcaaggaacggggagctaaa

SEQ ID NO: 503002 - DNA, 20 bp, mouse
ggacaggctggcagttagga

SEQ ID NO: 503003 - DNA, 20 bp, mouse
gtctctcctgtctcaaggaa

SEQ ID NO: 503004 - DNA, 20 bp, mouse
gccccatcttagggctttag

SEQ ID NO: 503005 - DNA, 20 bp, mouse
ggctccccgttccttgagac

SEQ ID NO: 503006 - DNA, 20 bp, mouse
gcccgcagccgagcgctgag

SEQ ID NO: 503007 - DNA, 20 bp, mouse
gccggagactgagcgtgagt

SEQ ID NO: 503008 - DNA, 20 bp, mouse
gggctccgaggagggtcgcg

SEQ ID NO: 503009 - DNA, 20 bp, mouse
ggcgcagcgtgggaaaggga

SEQ ID NO: 503010 - DNA, 20 bp, mouse
gggagcgtgggctccgagga

SEQ ID NO: 503011 - DNA, 20 bp, mouse
ggggtgagctctcttcatgg

SEQ ID NO: 503012 - DNA, 20 bp, mouse
ggcgtccgaccgatccggag

SEQ ID NO: 503013 - DNA, 20 bp, mouse
gcccgccgcgcgaccctcct

SEQ ID NO: 503014 - DNA, 20 bp, mouse
gtatctgaggagctgtagtc

SEQ ID NO: 503015 - DNA, 20 bp, mouse
gggagagcgcggacgagaat

SEQ ID NO: 503016 - DNA, 20 bp, mouse
gagcgtgggaaagaacctcc

SEQ ID NO: 503017 - DNA, 20 bp, mouse
ggagccgaccgcgccgccga

SEQ ID NO: 503018 - DNA, 20 bp, mouse
gtctgcaggcgccgctccct

SEQ ID NO: 503019 - DNA, 20 bp, mouse
gccagccagggcgcaagacc

SEQ ID NO: 503020 - DNA, 20 bp, mouse
ggagcgagaacaattaccct

SEQ ID NO: 503021 - DNA, 20 bp, mouse
ggtgtccggggagcttcggg

SEQ ID NO: 503022 - DNA, 20 bp, mouse
gcgggtgctagagtcgggtg

SEQ ID NO: 503023 - DNA, 20 bp, mouse
gctgcagaagccgggcaggg

SEQ ID NO: 503024 - DNA, 20 bp, mouse
gagggagggaggaagcccgc

SEQ ID NO: 503025 - DNA, 20 bp, mouse
gtggacgagaccatcgacgt

SEQ ID NO: 503026 - DNA, 20 bp, mouse
ggggcgcccagtggctccga

SEQ ID NO: 503027 - DNA, 20 bp, mouse
gggtccatcagactcgccgt

SEQ ID NO: 503028 - DNA, 20 bp, mouse
gctgatggacccatcgatgt

SEQ ID NO: 503029 - DNA, 20 bp, mouse
gactcgccgtcggagccact

SEQ ID NO: 503030 - DNA, 20 bp, mouse
ggccagctttcggcatgaag

SEQ ID NO: 503031 - DNA, 20 bp, mouse
gttcggcatgaagcggccca

SEQ ID NO: 503032 - DNA, 20 bp, mouse
gtgcgtccatagcaccaatg

SEQ ID NO: 503033 - DNA, 20 bp, mouse
ggctccgacggcgagtctga

SEQ ID NO: 503034 - DNA, 20 bp, mouse
gtctcttgacccacatcgat

SEQ ID NO: 503035 - DNA, 20 bp, mouse
gggtgtcagccaagatgcgg

SEQ ID NO: 503036 - DNA, 20 bp, mouse
gtgcgggaggaaaaaggtgg

SEQ ID NO: 503037 - DNA, 20 bp, mouse
gtgtcctcagctgggtccac

SEQ ID NO: 503038 - DNA, 20 bp, mouse
gtcactaggatctggaaacg

SEQ ID NO: 503039 - DNA, 20 bp, mouse
ggggtccaccggtcttcact

SEQ ID NO: 503040 - DNA, 20 bp, mouse
gtactagcgaggagtcacgt

SEQ ID NO: 503041 - DNA, 20 bp, mouse
gagatcctagtgaagaccgg

SEQ ID NO: 503042 - DNA, 20 bp, mouse
gtcctcccgcactcacgcgg

SEQ ID NO: 503043 - DNA, 20 bp, mouse
gtccagatcctagtgaagac

SEQ ID NO: 503044 - DNA, 20 bp, mouse
gagaccggtggacccagctg

SEQ ID NO: 503045 - DNA, 20 bp, mouse
gcaccctgtagccattgctg

SEQ ID NO: 503046 - DNA, 20 bp, mouse
gtgagactgcagccattccg

SEQ ID NO: 503047 - DNA, 20 bp, mouse
gctccatgattgccccggaa

SEQ ID NO: 503048 - DNA, 20 bp, mouse
gtggagcagaccaacagaat

SEQ ID NO: 503049 - DNA, 20 bp, mouse
gtctttctccatgattgccc

SEQ ID NO: 503050 - DNA, 20 bp, mouse
gccaacagaataggcaacta

SEQ ID NO: 503051 - DNA, 20 bp, mouse
gcatggattagaaaacatct

SEQ ID NO: 503052 - DNA, 20 bp, mouse
gaaagagatgggggaccccc

SEQ ID NO: 503053 - DNA, 20 bp, mouse
gagatgggggaccccctggc

SEQ ID NO: 503054 - DNA, 20 bp, mouse
gagactggggtagttgctaa

SEQ ID NO: 503055 - DNA, 20 bp, mouse
ggccagaggaggtttggtgt

SEQ ID NO: 503056 - DNA, 20 bp, mouse
gggacgcgcgcgcctcgcgt

SEQ ID NO: 503057 - DNA, 20 bp, mouse
gctccctgacgggaatgtgt

SEQ ID NO: 503058 - DNA, 20 bp, mouse
gggcagccgggcgccctcag

SEQ ID NO: 503059 - DNA, 20 bp, mouse
gggccacagccacctgccgg

SEQ ID NO: 503060 - DNA, 20 bp, mouse
ggggctcggtgagcgagcag

SEQ ID NO: 503061 - DNA, 20 bp, mouse
gagctaggcagggatagcct

SEQ ID NO: 503062 - DNA, 20 bp, mouse
gccccccacgcgcccacgcg

SEQ ID NO: 503063 - DNA, 20 bp, mouse
gcacaactgagcgcgagggg

SEQ ID NO: 503064 - DNA, 20 bp, mouse
gtcgctcgctcgcccgctga

SEQ ID NO: 503065 - DNA, 20 bp, mouse
gtgggcctgggtctctgcac

SEQ ID NO: 503066 - DNA, 20 bp, mouse
gttctgctggagggagaccc

SEQ ID NO: 503067 - DNA, 20 bp, mouse
gaagccacagggctagaaga

SEQ ID NO: 503068 - DNA, 20 bp, mouse
gttaaaggtaagaaaccatc

SEQ ID NO: 503069 - DNA, 20 bp, mouse
gctagccctgtggcttctgt

SEQ ID NO: 503070 - DNA, 20 bp, mouse
gaagacaggagagtgttcta

SEQ ID NO: 503071 - DNA, 20 bp, mouse
ggttcacactccaggtccag

SEQ ID NO: 503072 - DNA, 20 bp, mouse
ggctggatttggattaagac

SEQ ID NO: 503073 - DNA, 20 bp, mouse
gcaggagagtgttctagggg

SEQ ID NO: 503074 - DNA, 20 bp, mouse
ggaatgaagagatgtctgac

SEQ ID NO: 503075 - DNA, 20 bp, mouse
gtggagtgtgaactgctgaa

SEQ ID NO: 503076 - DNA, 20 bp, mouse
gcatgctgcagcaacaggac

SEQ ID NO: 503077 - DNA, 20 bp, mouse
ggaactgcaagcatgatgtg

SEQ ID NO: 503078 - DNA, 20 bp, mouse
gagaaaggatgctggaaata

SEQ ID NO: 503079 - DNA, 20 bp, mouse
ggcccggcatctcctgcaga

SEQ ID NO: 503080 - DNA, 20 bp, mouse
gaacaggaccggcagaagtt

SEQ ID NO: 503081 - DNA, 20 bp, mouse
gagcagactgatccctctgc

SEQ ID NO: 503082 - DNA, 20 bp, mouse
gaatagggcagagagcttct

SEQ ID NO: 503083 - DNA, 20 bp, mouse
gccacacatggaattaagaa

SEQ ID NO: 503084 - DNA, 20 bp, mouse
gaaagcagctcagaaccgac

SEQ ID NO: 503085 - DNA, 20 bp, mouse
gaatcctgttgcaaaccggt

SEQ ID NO: 503086 - DNA, 20 bp, mouse
gccagctcaggaggagccat

SEQ ID NO: 503087 - DNA, 20 bp, mouse
gggacagaggctagagatcc

SEQ ID NO: 503088 - DNA, 20 bp, mouse
gagggacatggcctgggtaa

SEQ ID NO: 503089 - DNA, 20 bp, mouse
gatccaggcctgtcgcccca

SEQ ID NO: 503090 - DNA, 20 bp, mouse
gagctagggacccagtgtgg

SEQ ID NO: 503091 - DNA, 20 bp, mouse
gctacacctcacgccagctc

SEQ ID NO: 503092 - DNA, 20 bp, mouse
gggaggagccatggggcgac

SEQ ID NO: 503093 - DNA, 20 bp, mouse
gtcggttcctgggaagagag

SEQ ID NO: 503094 - DNA, 20 bp, mouse
gcacctcacgccagctcagg

SEQ ID NO: 503095 - DNA, 20 bp, mouse
gctcctcctgagctggcgtg

SEQ ID NO: 503096 - DNA, 20 bp, mouse
gtcgccatggggcgaggcag

SEQ ID NO: 503097 - DNA, 20 bp, mouse
gctgcagcgtcggtccggag

SEQ ID NO: 503098 - DNA, 20 bp, mouse
gtccggagtggggtcgccat

SEQ ID NO: 503099 - DNA, 20 bp, mouse
gttacctaggagacgctcga

SEQ ID NO: 503100 - DNA, 20 bp, mouse
ggcgcgtcagctccgaaaga

SEQ ID NO: 503101 - DNA, 20 bp, mouse
gacgggcggacgcgttacct

SEQ ID NO: 503102 - DNA, 20 bp, mouse
gctgacttggagctgacggg

SEQ ID NO: 503103 - DNA, 20 bp, mouse
ggtggggtcgccatggggcg

SEQ ID NO: 503104 - DNA, 20 bp, mouse
ggcaccttcgagcgtctcct

SEQ ID NO: 503105 - DNA, 20 bp, mouse
ggctctcctgagacctacgg

SEQ ID NO: 503106 - DNA, 20 bp, mouse
ggcctcccacagcctctctc

SEQ ID NO: 503107 - DNA, 20 bp, mouse
gcccggagagaggctgtggg

SEQ ID NO: 503108 - DNA, 20 bp, mouse
ggagcgcaactcccggagag

SEQ ID NO: 503109 - DNA, 20 bp, mouse
gcacgggagcgggcgatgac

SEQ ID NO: 503110 - DNA, 20 bp, mouse
gggggacagagcgcaactcc

SEQ ID NO: 503111 - DNA, 20 bp, mouse
gactcccggagagaggctgt

SEQ ID NO: 503112 - DNA, 20 bp, mouse
ggaagagcgcagctcggctg

SEQ ID NO: 503113 - DNA, 20 bp, mouse
gacaggagcggtgacgccac

SEQ ID NO: 503114 - DNA, 20 bp, mouse
gagcggtgacgccacgggag

SEQ ID NO: 503115 - DNA, 20 bp, mouse
gggtgagcgagcggccccca

SEQ ID NO: 503116 - DNA, 20 bp, mouse
ggcccgcgcgagacagacag

SEQ ID NO: 503117 - DNA, 20 bp, mouse
gggagccgaatcattacaca

SEQ ID NO: 503118 - DNA, 20 bp, mouse
gctccgcgcaggttaagtcg

SEQ ID NO: 503119 - DNA, 20 bp, mouse
gccccaaaggaatgagtctg

SEQ ID NO: 503120 - DNA, 20 bp, mouse
gccgaacgcaggattggcca

SEQ ID NO: 503121 - DNA, 20 bp, mouse
ggtgctcgcgagtccctccc

SEQ ID NO: 503122 - DNA, 20 bp, mouse
gcagggctctgtacatttac

SEQ ID NO: 503123 - DNA, 20 bp, mouse
ggggaccctgtgtaatgatt

SEQ ID NO: 503124 - DNA, 20 bp, mouse
gctggagggcggcgacacaa

SEQ ID NO: 503125 - DNA, 20 bp, mouse
gcgcgcgtggagagcaggag

SEQ ID NO: 503126 - DNA, 20 bp, mouse
gagccagccggacagactca

SEQ ID NO: 503127 - DNA, 20 bp, mouse
gtggcgcgctgcccacctca

SEQ ID NO: 503128 - DNA, 20 bp, mouse
gagccggacagactcacggt

SEQ ID NO: 503129 - DNA, 20 bp, mouse
ggtccgaccgtgagtctgtc

SEQ ID NO: 503130 - DNA, 20 bp, mouse
gtcaagaccccggagccctg

SEQ ID NO: 503131 - DNA, 20 bp, mouse
ggagctgtggggcttcgatg

SEQ ID NO: 503132 - DNA, 20 bp, mouse
gacggtcggactcaagaccc

SEQ ID NO: 503133 - DNA, 20 bp, mouse
gtgcccacctcagggctccg

SEQ ID NO: 503134 - DNA, 20 bp, mouse
gaagaggctgcgaggaaccc

SEQ ID NO: 503135 - DNA, 20 bp, mouse
gagaccacgagccccaaggt

SEQ ID NO: 503136 - DNA, 20 bp, mouse
ggcatacagcgggactccca

SEQ ID NO: 503137 - DNA, 20 bp, mouse
gtacagcgggactcccacgg

SEQ ID NO: 503138 - DNA, 20 bp, mouse
ggcggcgtgggcgcatacag

SEQ ID NO: 503139 - DNA, 20 bp, mouse
gcagccgcgggccccgggtg

SEQ ID NO: 503140 - DNA, 20 bp, mouse
gcccgggtgcgggaactgca

SEQ ID NO: 503141 - DNA, 20 bp, mouse
gggtccggtaggaggacacg

SEQ ID NO: 503142 - DNA, 20 bp, mouse
gggccggcagctctctgcga

SEQ ID NO: 503143 - DNA, 20 bp, mouse
gccgcggctgcgcccgccgt

SEQ ID NO: 503144 - DNA, 20 bp, mouse
ggaggacacgaggctggtga

SEQ ID NO: 503145 - DNA, 20 bp, mouse
gtcgtacaccggggtccggt

SEQ ID NO: 503146 - DNA, 20 bp, mouse
ggttgccatagcccacgggg

SEQ ID NO: 503147 - DNA, 20 bp, mouse
gccagttaaagccaccccgt

SEQ ID NO: 503148 - DNA, 20 bp, mouse
gtttcacactcggcctgcgg

SEQ ID NO: 503149 - DNA, 20 bp, mouse
gaaagccaccccgtgggcta

SEQ ID NO: 503150 - DNA, 20 bp, mouse
gaatgttgccatagcccacg

SEQ ID NO: 503151 - DNA, 20 bp, mouse
ggctctggatactcaagaca

SEQ ID NO: 503152 - DNA, 20 bp, mouse
gaagtggctggagagcgccc

SEQ ID NO: 503153 - DNA, 20 bp, mouse
gccgagtgtgaaatcagagg

SEQ ID NO: 503154 - DNA, 20 bp, mouse
gcacactcggcctgcggggg

SEQ ID NO: 503155 - DNA, 20 bp, mouse
gggccagcaggggttcttgg

SEQ ID NO: 503156 - DNA, 20 bp, mouse
gtgggctcccgaggatgctg

SEQ ID NO: 503157 - DNA, 20 bp, mouse
gaagctgcagccgccggcag

SEQ ID NO: 503158 - DNA, 20 bp, mouse
ggaggagacctcagcatcct

SEQ ID NO: 503159 - DNA, 20 bp, mouse
gagagggagcgaaacatgag

SEQ ID NO: 503160 - DNA, 20 bp, mouse
gctgaggtctcctctgccgg

SEQ ID NO: 503161 - DNA, 20 bp, mouse
gacagcggttgggaagtggg

SEQ ID NO: 503162 - DNA, 20 bp, mouse
gtgtgagaagctgcagccgc

SEQ ID NO: 503163 - DNA, 20 bp, mouse
gggttggcgctgggctcccg

SEQ ID NO: 503164 - DNA, 20 bp, mouse
gatgctgaggtctcctctgc

SEQ ID NO: 503165 - DNA, 20 bp, mouse
gacagtagcaggaaccgaaa

SEQ ID NO: 503166 - DNA, 20 bp, mouse
ggcagagtgctcccaagcag

SEQ ID NO: 503167 - DNA, 20 bp, mouse
ggcctgtagggcgaatccac

SEQ ID NO: 503168 - DNA, 20 bp, mouse
gcctggaccctaggcctgta

SEQ ID NO: 503169 - DNA, 20 bp, mouse
ggcagaggtgacctccagcg

SEQ ID NO: 503170 - DNA, 20 bp, mouse
gctgcagactgccaggagaa

SEQ ID NO: 503171 - DNA, 20 bp, mouse
gctccagcgaggggagtccc

SEQ ID NO: 503172 - DNA, 20 bp, mouse
ggtccagggactcccctcgc

SEQ ID NO: 503173 - DNA, 20 bp, mouse
gaggagaatggcgggacgga

SEQ ID NO: 503174 - DNA, 20 bp, mouse
ggagatcaccgggaaaccgg

SEQ ID NO: 503175 - DNA, 20 bp, mouse
ggagcactctgcaggattgg

SEQ ID NO: 503176 - DNA, 20 bp, mouse
gatgaccaggaacagtgtgt

SEQ ID NO: 503177 - DNA, 20 bp, mouse
gaatgccaggagagagccac

SEQ ID NO: 503178 - DNA, 20 bp, mouse
gcaacaagaacgggaggccc

SEQ ID NO: 503179 - DNA, 20 bp, mouse
gccagcccaacaagaacggg

SEQ ID NO: 503180 - DNA, 20 bp, mouse
gtcctggtcatcgggccccg

SEQ ID NO: 503181 - DNA, 20 bp, mouse
ggggccccgtggctctctcc

SEQ ID NO: 503182 - DNA, 20 bp, mouse
gcacccagcccaacaagaac

SEQ ID NO: 503183 - DNA, 20 bp, mouse
ggccacggggcccgatgacc

SEQ ID NO: 503184 - DNA, 20 bp, mouse
gggcccaggcagaaaatgcc

SEQ ID NO: 503185 - DNA, 20 bp, mouse
gtgtatgtaagcctaggaag

SEQ ID NO: 503186 - DNA, 20 bp, mouse
gtttggggcgaggagtccaa

SEQ ID NO: 503187 - DNA, 20 bp, mouse
ggcagtgaggtcagaatggt

SEQ ID NO: 503188 - DNA, 20 bp, mouse
gacctcactgctaatcttct

SEQ ID NO: 503189 - DNA, 20 bp, mouse
gactcaccggtctcctgagc

SEQ ID NO: 503190 - DNA, 20 bp, mouse
ggaagtcattcatcctgctc

SEQ ID NO: 503191 - DNA, 20 bp, mouse
gtggctgcccatttcctcta

SEQ ID NO: 503192 - DNA, 20 bp, mouse
gggtattgattaggatctta

SEQ ID NO: 503193 - DNA, 20 bp, mouse
ggcattcttgagccagtggg

SEQ ID NO: 503194 - DNA, 20 bp, mouse
gtgctgttagacacatctcg

SEQ ID NO: 503195 - DNA, 20 bp, mouse
gactcaatgtgctgaagatc

SEQ ID NO: 503196 - DNA, 20 bp, mouse
ggcaggccgggccctcaaga

SEQ ID NO: 503197 - DNA, 20 bp, mouse
gtgccgggccgagccgctca

SEQ ID NO: 503198 - DNA, 20 bp, mouse
gtggcggcgtgcgccctgag

SEQ ID NO: 503199 - DNA, 20 bp, mouse
gctcggcccggcagtagtgg

SEQ ID NO: 503200 - DNA, 20 bp, mouse
gcagcgccggcggcacggaa

SEQ ID NO: 503201 - DNA, 20 bp, mouse
gcagcgaaggcggaagcggg

SEQ ID NO: 503202 - DNA, 20 bp, mouse
ggggcccggcctgcctcggg

SEQ ID NO: 503203 - DNA, 20 bp, mouse
gggcgcacgccgccatcttg

SEQ ID NO: 503204 - DNA, 20 bp, mouse
gtgagggcccggcctgcctc

SEQ ID NO: 503205 - DNA, 20 bp, mouse
gccgcacccgggccgtcctg

SEQ ID NO: 503206 - DNA, 20 bp, mouse
gcgcccggagaactcagcaa

SEQ ID NO: 503207 - DNA, 20 bp, mouse
gcagtagcgcccgaacagtc

SEQ ID NO: 503208 - DNA, 20 bp, mouse
ggaacacaggaccccgacac

SEQ ID NO: 503209 - DNA, 20 bp, mouse
gcgcccgaacagtcgggaga

SEQ ID NO: 503210 - DNA, 20 bp, mouse
ggaggggtgggcgttctagg

SEQ ID NO: 503211 - DNA, 20 bp, mouse
gcggatcgcggagcccatga

SEQ ID NO: 503212 - DNA, 20 bp, mouse
gtgggctccgcgatccgcag

SEQ ID NO: 503213 - DNA, 20 bp, mouse
ggcggcgccagtggcgacac

SEQ ID NO: 503214 - DNA, 20 bp, mouse
gacctgctctggcatgacgg

SEQ ID NO: 503215 - DNA, 20 bp, mouse
gacgccgtctcccgactgtt

SEQ ID NO: 503216 - DNA, 20 bp, mouse
ggcgcgagctgtccttacgg

SEQ ID NO: 503217 - DNA, 20 bp, mouse
gtgtgaggcggcggaggtca

SEQ ID NO: 503218 - DNA, 20 bp, mouse
gacggaggtgcgggccatcc

SEQ ID NO: 503219 - DNA, 20 bp, mouse
ggctccccggaaccccaagg

SEQ ID NO: 503220 - DNA, 20 bp, mouse
ggccctcctcggatgaccag

SEQ ID NO: 503221 - DNA, 20 bp, mouse
gggcatagggcaggagtgga

SEQ ID NO: 503222 - DNA, 20 bp, mouse
gcgagtgtgcgcagccggga

SEQ ID NO: 503223 - DNA, 20 bp, mouse
ggcgcacactcgtagttcac

SEQ ID NO: 503224 - DNA, 20 bp, mouse
gctccagtaccagaggccgg

SEQ ID NO: 503225 - DNA, 20 bp, mouse
ggctgctccccggaacccca

SEQ ID NO: 503226 - DNA, 20 bp, mouse
gagcagaggctgccatacaa

SEQ ID NO: 503227 - DNA, 20 bp, mouse
gacaggagccgccacgcata

SEQ ID NO: 503228 - DNA, 20 bp, mouse
gtgccccgcggcgacctcag

SEQ ID NO: 503229 - DNA, 20 bp, mouse
gccgcggggcagcaaagcag

SEQ ID NO: 503230 - DNA, 20 bp, mouse
ggtctaactaccagagccgg

SEQ ID NO: 503231 - DNA, 20 bp, mouse
gcgggtctaactaccagagc

SEQ ID NO: 503232 - DNA, 20 bp, mouse
gcacgcatatggctgcccca

SEQ ID NO: 503233 - DNA, 20 bp, mouse
gtgcgtggcggctcctgtcg

SEQ ID NO: 503234 - DNA, 20 bp, mouse
gggctcctgtcgaggtgagt

SEQ ID NO: 503235 - DNA, 20 bp, mouse
gcctaacagatgctagagga

SEQ ID NO: 503236 - DNA, 20 bp, mouse
ggccagggcggtgcctcgat

SEQ ID NO: 503237 - DNA, 20 bp, mouse
gggctgtcaggccttcgtta

SEQ ID NO: 503238 - DNA, 20 bp, mouse
ggggagcaagatgcccatcg

SEQ ID NO: 503239 - DNA, 20 bp, mouse
ggccactgtctccgctcccc

SEQ ID NO: 503240 - DNA, 20 bp, mouse
ggctccttgtctccccactt

SEQ ID NO: 503241 - DNA, 20 bp, mouse
gggccggccggccctaacga

SEQ ID NO: 503242 - DNA, 20 bp, mouse
gtgggtcctgggaacttcca

SEQ ID NO: 503243 - DNA, 20 bp, mouse
gccggttaggggaagtgata

SEQ ID NO: 503244 - DNA, 20 bp, mouse
ggagcgcgaaggccgggccc

SEQ ID NO: 503245 - DNA, 20 bp, mouse
gcccgccggccccagacaga

SEQ ID NO: 503246 - DNA, 20 bp, mouse
gcggctgtgagcagcgctct

SEQ ID NO: 503247 - DNA, 20 bp, mouse
gcttccaagatggcgcggag

SEQ ID NO: 503248 - DNA, 20 bp, mouse
gtgggcggagagccgagcgg

SEQ ID NO: 503249 - DNA, 20 bp, mouse
gcccacgcccccctctccgg

SEQ ID NO: 503250 - DNA, 20 bp, mouse
gcgcacgcgggaccctggac

SEQ ID NO: 503251 - DNA, 20 bp, mouse
ggtcgggcgcccaagacgag

SEQ ID NO: 503252 - DNA, 20 bp, mouse
gaggtaagcggtgtcctcga

SEQ ID NO: 503253 - DNA, 20 bp, mouse
gcgcctcggttcgagactag

SEQ ID NO: 503254 - DNA, 20 bp, mouse
gacaagcttccaagatggcg

SEQ ID NO: 503255 - DNA, 20 bp, mouse
ggggcgcgcccccggagagg

SEQ ID NO: 503256 - DNA, 20 bp, mouse
ggcggcagagtcggaatccg

SEQ ID NO: 503257 - DNA, 20 bp, mouse
gccggagcccgcggcagagt

SEQ ID NO: 503258 - DNA, 20 bp, mouse
ggcatagggtgggctcccag

SEQ ID NO: 503259 - DNA, 20 bp, mouse
gagtgttcccaggggagagt

SEQ ID NO: 503260 - DNA, 20 bp, mouse
gggccggcaggtggatgaag

SEQ ID NO: 503261 - DNA, 20 bp, mouse
gcgccgccggctccaggagt

SEQ ID NO: 503262 - DNA, 20 bp, mouse
ggggagagtaggcatagggt

SEQ ID NO: 503263 - DNA, 20 bp, mouse
gcagagtcggaatccggggt

SEQ ID NO: 503264 - DNA, 20 bp, mouse
gtgaccggctaatccagagg

SEQ ID NO: 503265 - DNA, 20 bp, mouse
gggcacacgtcagcctaagg

SEQ ID NO: 503266 - DNA, 20 bp, mouse
gtagacactgcccgcgacgg

SEQ ID NO: 503267 - DNA, 20 bp, mouse
gcgcgtcccctcagccgagg

SEQ ID NO: 503268 - DNA, 20 bp, mouse
gcagagcctcctcggctgag

SEQ ID NO: 503269 - DNA, 20 bp, mouse
gggctagacactgcccgcga

SEQ ID NO: 503270 - DNA, 20 bp, mouse
gccggccgggaagacaacgc

SEQ ID NO: 503271 - DNA, 20 bp, mouse
ggagaaagagacaagtccag

SEQ ID NO: 503272 - DNA, 20 bp, mouse
gctgtcctcgccgccgtcgc

SEQ ID NO: 503273 - DNA, 20 bp, mouse
gctcgctcgggcctaaacgc

SEQ ID NO: 503274 - DNA, 20 bp, mouse
gtcctccggctagcttgtca

SEQ ID NO: 503275 - DNA, 20 bp, mouse
ggctagccggaggagcgcct

SEQ ID NO: 503276 - DNA, 20 bp, mouse
ggtccctagagtagagatgg

SEQ ID NO: 503277 - DNA, 20 bp, mouse
ggagccagaggccgcaacct

SEQ ID NO: 503278 - DNA, 20 bp, mouse
ggccgtccctagagtagaga

SEQ ID NO: 503279 - DNA, 20 bp, mouse
gcgtagctgggactcatccc

SEQ ID NO: 503280 - DNA, 20 bp, mouse
gagccagagtgaccctcggg

SEQ ID NO: 503281 - DNA, 20 bp, mouse
ggacccggttagcggagagg

SEQ ID NO: 503282 - DNA, 20 bp, mouse
gcgccgccatctctactcta

SEQ ID NO: 503283 - DNA, 20 bp, mouse
gggagcttcggcttcttccc

SEQ ID NO: 503284 - DNA, 20 bp, mouse
ggcgacggcagccgaggttg

SEQ ID NO: 503285 - DNA, 20 bp, mouse
ggtcactctggctcagacgt

SEQ ID NO: 503286 - DNA, 20 bp, mouse
gctgcagcgcgtgaggtaca

SEQ ID NO: 503287 - DNA, 20 bp, mouse
gagggctctggaaccgcgaa

SEQ ID NO: 503288 - DNA, 20 bp, mouse
gcgctgcagccccaacgcca

SEQ ID NO: 503289 - DNA, 20 bp, mouse
gaaccgcgaagggcgagcca

SEQ ID NO: 503290 - DNA, 20 bp, mouse
ggcttcggggataggatggt

SEQ ID NO: 503291 - DNA, 20 bp, mouse
ggttggggctgcagcgcgtg

SEQ ID NO: 503292 - DNA, 20 bp, mouse
gcagggcttcggggatagga

SEQ ID NO: 503293 - DNA, 20 bp, mouse
ggaagggcgagccatggcgt

SEQ ID NO: 503294 - DNA, 20 bp, mouse
gataggatggtggggtctgg

SEQ ID NO: 503295 - DNA, 20 bp, mouse
gcgcgtgaggtacagggctt

SEQ ID NO: 503296 - DNA, 20 bp, mouse
gctacagctaagtcccggag

SEQ ID NO: 503297 - DNA, 20 bp, mouse
gtaagtcccggagaggacag

SEQ ID NO: 503298 - DNA, 20 bp, mouse
gccttaggcacacaacctag

SEQ ID NO: 503299 - DNA, 20 bp, mouse
gatgagctacagctaagtcc

SEQ ID NO: 503300 - DNA, 20 bp, mouse
gtaaggccctctgtcctctc

SEQ ID NO: 503301 - DNA, 20 bp, mouse
ggagctagagacgccgtctg

SEQ ID NO: 503302 - DNA, 20 bp, mouse
gggcctccctgtcccccaga

SEQ ID NO: 503303 - DNA, 20 bp, mouse
ggacagggaggcctcccggt

SEQ ID NO: 503304 - DNA, 20 bp, mouse
gccgccggaacgccaaaagg

SEQ ID NO: 503305 - DNA, 20 bp, mouse
gtccatgtggccctccctgt

SEQ ID NO: 503306 - DNA, 20 bp, mouse
gcacccgagtgcgagaacac

SEQ ID NO: 503307 - DNA, 20 bp, mouse
ggccgagggaacgagagtcg

SEQ ID NO: 503308 - DNA, 20 bp, mouse
gtggccgcagcaggcgaagc

SEQ ID NO: 503309 - DNA, 20 bp, mouse
gagccggtgttctcgcactc

SEQ ID NO: 503310 - DNA, 20 bp, mouse
ggagggaacgagagtcgcgg

SEQ ID NO: 503311 - DNA, 20 bp, mouse
gggatcccgggagcagtggg

SEQ ID NO: 503312 - DNA, 20 bp, mouse
ggagcttctggagcggatcg

SEQ ID NO: 503313 - DNA, 20 bp, mouse
ggaggccggagcttctggag

SEQ ID NO: 503314 - DNA, 20 bp, mouse
gagagggagcgcgatcgcac

SEQ ID NO: 503315 - DNA, 20 bp, mouse
gggcgagcagtggccgcagc

SEQ ID NO: 503316 - DNA, 20 bp, mouse
ggatgtcacggacacgagga

SEQ ID NO: 503317 - DNA, 20 bp, mouse
ggtaaagtcagatgaaccag

SEQ ID NO: 503318 - DNA, 20 bp, mouse
gctcagaggaggggtacagt

SEQ ID NO: 503319 - DNA, 20 bp, mouse
gggcagatgtcacggacacg

SEQ ID NO: 503320 - DNA, 20 bp, mouse
gtgttctcttgcaagggttt

SEQ ID NO: 503321 - DNA, 20 bp, mouse
gggatcatgtctgctaacaa

SEQ ID NO: 503322 - DNA, 20 bp, mouse
ggctggtgggtgccacctga

SEQ ID NO: 503323 - DNA, 20 bp, mouse
gtctgggtgttctcttgcaa

SEQ ID NO: 503324 - DNA, 20 bp, mouse
gggtgcctataggtgagtag

SEQ ID NO: 503325 - DNA, 20 bp, mouse
gaagaccagggagtctccac

SEQ ID NO: 503326 - DNA, 20 bp, mouse
gcccgtgcagatcaaagacc

SEQ ID NO: 503327 - DNA, 20 bp, mouse
gttccagcacgtacaaggta

SEQ ID NO: 503328 - DNA, 20 bp, mouse
ggtgcagatcaaagaccagg

SEQ ID NO: 503329 - DNA, 20 bp, mouse
gaattagctggaaatcgcag

SEQ ID NO: 503330 - DNA, 20 bp, mouse
ggaagagcggttgtcagcat

SEQ ID NO: 503331 - DNA, 20 bp, mouse
gtactgttccagcacgtaca

SEQ ID NO: 503332 - DNA, 20 bp, mouse
gcagaccagacaatgaagag

SEQ ID NO: 503333 - DNA, 20 bp, mouse
gggtctggcccgacgcacag

SEQ ID NO: 503334 - DNA, 20 bp, mouse
gtgagttgcgacagccttgg

SEQ ID NO: 503335 - DNA, 20 bp, mouse
gtaaacacagtagcattgta

SEQ ID NO: 503336 - DNA, 20 bp, mouse
gcccggtcctgtgagtccag

SEQ ID NO: 503337 - DNA, 20 bp, mouse
gtctgtgctggtgggtatgg

SEQ ID NO: 503338 - DNA, 20 bp, mouse
gaaggcgcctctggactcac

SEQ ID NO: 503339 - DNA, 20 bp, mouse
gtgaagccctcgataactgg

SEQ ID NO: 503340 - DNA, 20 bp, mouse
gtacccaccagcacagaaat

SEQ ID NO: 503341 - DNA, 20 bp, mouse
gcggaagaccgagaggacag

SEQ ID NO: 503342 - DNA, 20 bp, mouse
gtcgtagggaaaggaaatag

SEQ ID NO: 503343 - DNA, 20 bp, mouse
ggtaggaacggaagaccgag

SEQ ID NO: 503344 - DNA, 20 bp, mouse
gagaggacagcggtttcgta

SEQ ID NO: 503345 - DNA, 20 bp, mouse
gtcccagagccacaacagga

SEQ ID NO: 503346 - DNA, 20 bp, mouse
gaccaggtcgtgcaggagta

SEQ ID NO: 503347 - DNA, 20 bp, mouse
gggtcggctgagtcgcaacg

SEQ ID NO: 503348 - DNA, 20 bp, mouse
gcagtcacaccaggtcgtgc

SEQ ID NO: 503349 - DNA, 20 bp, mouse
gggctgctcacagtcacacc

SEQ ID NO: 503350 - DNA, 20 bp, mouse
ggcgacgcagagagagccgg

SEQ ID NO: 503351 - DNA, 20 bp, mouse
gtctaaagcggtgacaggaa

SEQ ID NO: 503352 - DNA, 20 bp, mouse
gtccttactcctgcacgacc

SEQ ID NO: 503353 - DNA, 20 bp, mouse
gctccacgcaggcactgctc

SEQ ID NO: 503354 - DNA, 20 bp, mouse
gcccatggagttcatagatt

SEQ ID NO: 503355 - DNA, 20 bp, mouse
gaaacctggtgggcaaacaa

SEQ ID NO: 503356 - DNA, 20 bp, mouse
gccacacctcggccagagag

SEQ ID NO: 503357 - DNA, 20 bp, mouse
ggtctgctgaggccaatcgt

SEQ ID NO: 503358 - DNA, 20 bp, mouse
gcagaggcgcctctctaggg

SEQ ID NO: 503359 - DNA, 20 bp, mouse
gtcggccagagagaggactg

SEQ ID NO: 503360 - DNA, 20 bp, mouse
gcctcagaggcgcctctcta

SEQ ID NO: 503361 - DNA, 20 bp, mouse
gctgcgtatggtgacaccag

SEQ ID NO: 503362 - DNA, 20 bp, mouse
ggggggtctgggccacacct

SEQ ID NO: 503363 - DNA, 20 bp, mouse
gggtgctagatactccagga

SEQ ID NO: 503364 - DNA, 20 bp, mouse
ggagtttctacagcagtctt

SEQ ID NO: 503365 - DNA, 20 bp, mouse
gtggctggagaccaagatgc

SEQ ID NO: 503366 - DNA, 20 bp, mouse
gcgctttagccgccaaggta

SEQ ID NO: 503367 - DNA, 20 bp, mouse
gagcggcgctggcaggtgag

SEQ ID NO: 503368 - DNA, 20 bp, mouse
gggcgctgaggccggaggat

SEQ ID NO: 503369 - DNA, 20 bp, mouse
ggcacggacgccacaccgag

SEQ ID NO: 503370 - DNA, 20 bp, mouse
gcggctaaagcggctctctc

SEQ ID NO: 503371 - DNA, 20 bp, mouse
gtgcggctcccgtaccttgg

SEQ ID NO: 503372 - DNA, 20 bp, mouse
ggcgcaggaccagggagatc

SEQ ID NO: 503373 - DNA, 20 bp, mouse
ggcttgcggctcccgtacct

SEQ ID NO: 503374 - DNA, 20 bp, mouse
gcagaggaagtagcccatcc

SEQ ID NO: 503375 - DNA, 20 bp, mouse
ggcttgacgccggggatccc

SEQ ID NO: 503376 - DNA, 20 bp, mouse
ggcgcgggaaggacagtgag

SEQ ID NO: 503377 - DNA, 20 bp, mouse
gccgcgccgcggccacagtg

SEQ ID NO: 503378 - DNA, 20 bp, mouse
gacagtggggagaggaaccg

SEQ ID NO: 503379 - DNA, 20 bp, mouse
gggacagtgagcggccgcga

SEQ ID NO: 503380 - DNA, 20 bp, mouse
gtcttcgaggacgaccgggt

SEQ ID NO: 503381 - DNA, 20 bp, mouse
ggcaatctcgtcagccatcg

SEQ ID NO: 503382 - DNA, 20 bp, mouse
gctcaagtggcccagcccgg

SEQ ID NO: 503383 - DNA, 20 bp, mouse
gtcaggcccgcggctcctca

SEQ ID NO: 503384 - DNA, 20 bp, mouse
gatggctgacgagattgcca

SEQ ID NO: 503385 - DNA, 20 bp, mouse
gccggcggcgacacgatctt

SEQ ID NO: 503386 - DNA, 20 bp, mouse
gggcgacactctcaggaaga

SEQ ID NO: 503387 - DNA, 20 bp, mouse
gcgcgcagcgcgcaagccca

SEQ ID NO: 503388 - DNA, 20 bp, mouse
gcagcaggccacggccaatg

SEQ ID NO: 503389 - DNA, 20 bp, mouse
gcgcgctgcgcgcagaaccc

SEQ ID NO: 503390 - DNA, 20 bp, mouse
gcgggcccccgcggcagcca

SEQ ID NO: 503391 - DNA, 20 bp, mouse
ggagccactgcctcgaccaa

SEQ ID NO: 503392 - DNA, 20 bp, mouse
gagccggctagctcccagaa

SEQ ID NO: 503393 - DNA, 20 bp, mouse
gctgcccgcccgcagagtcc

SEQ ID NO: 503394 - DNA, 20 bp, mouse
gcgaccaagggtcaaattcc

SEQ ID NO: 503395 - DNA, 20 bp, mouse
gcaggcagatcgcttctctc

SEQ ID NO: 503396 - DNA, 20 bp, mouse
gcggagagccggatcccgag

SEQ ID NO: 503397 - DNA, 20 bp, mouse
gagaagcaagcgggcttggt

SEQ ID NO: 503398 - DNA, 20 bp, mouse
gcactaggcgggccacccta

SEQ ID NO: 503399 - DNA, 20 bp, mouse
ggtcccaggcgaggacccct

SEQ ID NO: 503400 - DNA, 20 bp, mouse
ggcgaggacccctcgggatc

SEQ ID NO: 503401 - DNA, 20 bp, mouse
ggactccgaggtcccaggcg

SEQ ID NO: 503402 - DNA, 20 bp, mouse
ggcgacgtcaggatcagctg

SEQ ID NO: 503403 - DNA, 20 bp, mouse
gtcccgaggggtcctcgcct

SEQ ID NO: 503404 - DNA, 20 bp, mouse
ggaagcctgcgagcagggat

SEQ ID NO: 503405 - DNA, 20 bp, mouse
gacgcgcagggccagactct

SEQ ID NO: 503406 - DNA, 20 bp, mouse
gtctgggtgaacagagtcag

SEQ ID NO: 503407 - DNA, 20 bp, mouse
ggtgcaagagaggcttggaa

SEQ ID NO: 503408 - DNA, 20 bp, mouse
ggtgatgcagggtgcaagag

SEQ ID NO: 503409 - DNA, 20 bp, mouse
gcgcggcggctcaacacttt

SEQ ID NO: 503410 - DNA, 20 bp, mouse
gcatcccagcaccaactccg

SEQ ID NO: 503411 - DNA, 20 bp, mouse
gaggctccgcggggatcccg

SEQ ID NO: 503412 - DNA, 20 bp, mouse
gccagacaacatggaccgaa

SEQ ID NO: 503413 - DNA, 20 bp, mouse
ggatccccgcgggtagggag

SEQ ID NO: 503414 - DNA, 20 bp, mouse
ggggttggatacctgcttca

SEQ ID NO: 503415 - DNA, 20 bp, mouse
ggtgagattcgagaaccctg

SEQ ID NO: 503416 - DNA, 20 bp, mouse
gagccgggccgggacacggt

SEQ ID NO: 503417 - DNA, 20 bp, mouse
gcgggccgggacacggtcgg

SEQ ID NO: 503418 - DNA, 20 bp, mouse
gctcaagcctaggcacacgg

SEQ ID NO: 503419 - DNA, 20 bp, mouse
gcccgggcggcgcaggtgac

SEQ ID NO: 503420 - DNA, 20 bp, mouse
ggcagggccgagcgcaccga

SEQ ID NO: 503421 - DNA, 20 bp, mouse
gagcttccctggaaaggcgg

SEQ ID NO: 503422 - DNA, 20 bp, mouse
gcaccgcccgcctcaagcct

SEQ ID NO: 503423 - DNA, 20 bp, mouse
gtgcctaggcttgaggcggg

SEQ ID NO: 503424 - DNA, 20 bp, mouse
gaccggaagccgcgcgacag

SEQ ID NO: 503425 - DNA, 20 bp, mouse
gcgcgccgcgccgcacgggg

SEQ ID NO: 503426 - DNA, 20 bp, mouse
gccgtggccccggaccgcag

SEQ ID NO: 503427 - DNA, 20 bp, mouse
gtcgggtctggtgacaacgg

SEQ ID NO: 503428 - DNA, 20 bp, mouse
gggagcgctcggcgctgagg

SEQ ID NO: 503429 - DNA, 20 bp, mouse
gaagcaagccggctacccaa

SEQ ID NO: 503430 - DNA, 20 bp, mouse
gacggcggctgcggagcgaa

SEQ ID NO: 503431 - DNA, 20 bp, mouse
gttgtcgggtctggtgacaa

SEQ ID NO: 503432 - DNA, 20 bp, mouse
gggctgagaactacacacac

SEQ ID NO: 503433 - DNA, 20 bp, mouse
gactgcgtgccggagaaaat

SEQ ID NO: 503434 - DNA, 20 bp, mouse
gggagtcggcgccccgaggt

SEQ ID NO: 503435 - DNA, 20 bp, mouse
gtgagaactacacacaccgg

SEQ ID NO: 503436 - DNA, 20 bp, mouse
gccgcatggctgtgaggcgg

SEQ ID NO: 503437 - DNA, 20 bp, mouse
ggctccgcatggctgtgagg

SEQ ID NO: 503438 - DNA, 20 bp, mouse
gtcagctccgcatggctgtg

SEQ ID NO: 503439 - DNA, 20 bp, mouse
ggcgccgagagcggagacac

SEQ ID NO: 503440 - DNA, 20 bp, mouse
gagttgcccgtgaggagcag

SEQ ID NO: 503441 - DNA, 20 bp, mouse
gcgagccgggaagagcccca

SEQ ID NO: 503442 - DNA, 20 bp, mouse
gcggagacacaggctcaaga

SEQ ID NO: 503443 - DNA, 20 bp, mouse
gcggcgccggccaagtgagg

SEQ ID NO: 503444 - DNA, 20 bp, mouse
gccccgtgtacgaaggtaag

SEQ ID NO: 503445 - DNA, 20 bp, mouse
ggccgaggccaagggccggg

SEQ ID NO: 503446 - DNA, 20 bp, mouse
gctgccggcagtcgtcaccc

SEQ ID NO: 503447 - DNA, 20 bp, mouse
gaccgctcgactggggagag

SEQ ID NO: 503448 - DNA, 20 bp, mouse
ggaggaggggcccgatatcg

SEQ ID NO: 503449 - DNA, 20 bp, mouse
ggaggggcccgatatcgggg

SEQ ID NO: 503450 - DNA, 20 bp, mouse
gccgggctcggcgctcagag

SEQ ID NO: 503451 - DNA, 20 bp, mouse
gggcaggccgccccgatatc

SEQ ID NO: 503452 - DNA, 20 bp, mouse
gcggggcctacgggcaacaa

SEQ ID NO: 503453 - DNA, 20 bp, mouse
gggagttgagacgaggacga

SEQ ID NO: 503454 - DNA, 20 bp, mouse
ggcgctcagagcggccgagc

SEQ ID NO: 503455 - DNA, 20 bp, mouse
gctgcggctcggactcctcg

SEQ ID NO: 503456 - DNA, 20 bp, mouse
gaacgctggaacccattcag

SEQ ID NO: 503457 - DNA, 20 bp, mouse
gcctcttggcttgggatgag

SEQ ID NO: 503458 - DNA, 20 bp, mouse
gtagctaggggccatcatca

SEQ ID NO: 503459 - DNA, 20 bp, mouse
gggctcaggcccccctgaat

SEQ ID NO: 503460 - DNA, 20 bp, mouse
gcccaaagccctcttggctt

SEQ ID NO: 503461 - DNA, 20 bp, mouse
ggtaaaggcagagtagtgac

SEQ ID NO: 503462 - DNA, 20 bp, mouse
ggccacacagtgagtctacc

SEQ ID NO: 503463 - DNA, 20 bp, mouse
gcaggggctgaactcatata

SEQ ID NO: 503464 - DNA, 20 bp, mouse
gctaggggccatcatcaggg

SEQ ID NO: 503465 - DNA, 20 bp, mouse
ggataacgtgggcctcgtca

SEQ ID NO: 503466 - DNA, 20 bp, mouse
gcggaggaggagcggcgcag

SEQ ID NO: 503467 - DNA, 20 bp, mouse
gaccagcgtctggacaaggt

SEQ ID NO: 503468 - DNA, 20 bp, mouse
gcgggcaacgccggaagtca

SEQ ID NO: 503469 - DNA, 20 bp, mouse
gccaggcgtgctgagggaca

SEQ ID NO: 503470 - DNA, 20 bp, mouse
ggcggcgcgggaggaagctg

SEQ ID NO: 503471 - DNA, 20 bp, mouse
ggcaggggatgcggctgtgg

SEQ ID NO: 503472 - DNA, 20 bp, mouse
gcgagcgcaggaggcggctg

SEQ ID NO: 503473 - DNA, 20 bp, mouse
ggagtgcacgcaggagtcgt

SEQ ID NO: 503474 - DNA, 20 bp, mouse
gggcggctcccgggcaacgc

SEQ ID NO: 503475 - DNA, 20 bp, mouse
gggcgcaggggatgcggctg

SEQ ID NO: 503476 - DNA, 20 bp, mouse
gggcgggagcaaccaatccc

SEQ ID NO: 503477 - DNA, 20 bp, mouse
gctctatgcacctgaggtcc

SEQ ID NO: 503478 - DNA, 20 bp, mouse
gcctcaggtgcatagagtct

SEQ ID NO: 503479 - DNA, 20 bp, mouse
gccctgggccagcagagaca

SEQ ID NO: 503480 - DNA, 20 bp, mouse
gagaggagctggacactggg

SEQ ID NO: 503481 - DNA, 20 bp, mouse
ggcctgtgggtgcagcatga

SEQ ID NO: 503482 - DNA, 20 bp, mouse
gacaccgcccgccctcctgg

SEQ ID NO: 503483 - DNA, 20 bp, mouse
gtcgagcttgcccggacctc

SEQ ID NO: 503484 - DNA, 20 bp, mouse
gcaggtgtgggtctaaccct

SEQ ID NO: 503485 - DNA, 20 bp, mouse
gagagaagcaggcgttgaag

SEQ ID NO: 503486 - DNA, 20 bp, mouse
gactggcgccgtctccgaca

SEQ ID NO: 503487 - DNA, 20 bp, mouse
ggcagcagcaggtttctccg

SEQ ID NO: 503488 - DNA, 20 bp, mouse
gtcagcaaccatgtcggaga

SEQ ID NO: 503489 - DNA, 20 bp, mouse
ggagacggcgccagtcgctc

SEQ ID NO: 503490 - DNA, 20 bp, mouse
ggctgcggcgggatacgatg

SEQ ID NO: 503491 - DNA, 20 bp, mouse
gtattcatcagcaaccatgt

SEQ ID NO: 503492 - DNA, 20 bp, mouse
gtagaagcagcctgagcgac

SEQ ID NO: 503493 - DNA, 20 bp, mouse
ggtgtcggagctcatcgtgc

SEQ ID NO: 503494 - DNA, 20 bp, mouse
ggaaagacaaggcccctgca

SEQ ID NO: 503495 - DNA, 20 bp, mouse
ggacacgccactgcgctctt

SEQ ID NO: 503496 - DNA, 20 bp, mouse
ggcgggagcagtctcagaca

SEQ ID NO: 503497 - DNA, 20 bp, mouse
gacgccgccgcgctccttag

SEQ ID NO: 503498 - DNA, 20 bp, mouse
gaaaccaggagcctgagcaa

SEQ ID NO: 503499 - DNA, 20 bp, mouse
ggccggagccgcggtctcag

SEQ ID NO: 503500 - DNA, 20 bp, mouse
gcccaaggctaagaagaccg

SEQ ID NO: 503501 - DNA, 20 bp, mouse
gctgcctctaaggagcgcgg

SEQ ID NO: 503502 - DNA, 20 bp, mouse
gttaagcttgaaggaaccag

SEQ ID NO: 503503 - DNA, 20 bp, mouse
gactgctcccgctgagaccg

SEQ ID NO: 503504 - DNA, 20 bp, mouse
ggatgagctcggacaccggg

SEQ ID NO: 503505 - DNA, 20 bp, mouse
gaagcctaagaagactgcgg

SEQ ID NO: 503506 - DNA, 20 bp, mouse
ggcaggcgccttctccgcag

SEQ ID NO: 503507 - DNA, 20 bp, mouse
gcgggcccgcgctactctat

SEQ ID NO: 503508 - DNA, 20 bp, mouse
gcccgctgccgcgccccctg

SEQ ID NO: 503509 - DNA, 20 bp, mouse
gaccccggcgggcttcttgg

SEQ ID NO: 503510 - DNA, 20 bp, mouse
ggcatcctggtgcaaaccaa

SEQ ID NO: 503511 - DNA, 20 bp, mouse
ggccgccaagaagcccgccg

SEQ ID NO: 503512 - DNA, 20 bp, mouse
gtccgcagggggcgcggcag

SEQ ID NO: 503513 - DNA, 20 bp, mouse
ggccgcgccccctgcggaga

SEQ ID NO: 503514 - DNA, 20 bp, mouse
gtctggcgaggccaaacccc

SEQ ID NO: 503515 - DNA, 20 bp, mouse
ggccaaaccccaggctaaga

SEQ ID NO: 503516 - DNA, 20 bp, mouse
gatgtccgagaccgctcccg

SEQ ID NO: 503517 - DNA, 20 bp, mouse
gggcgccgcgggagcggtct

SEQ ID NO: 503518 - DNA, 20 bp, mouse
gcaggggcagcaggcgccgc

SEQ ID NO: 503519 - DNA, 20 bp, mouse
gctgggaagcgcaaggcgtc

SEQ ID NO: 503520 - DNA, 20 bp, mouse
ggtgtcttctccacaggtgc

SEQ ID NO: 503521 - DNA, 20 bp, mouse
gagaagaccggcgccgctgc

SEQ ID NO: 503522 - DNA, 20 bp, mouse
gacccagagcctgcagcact

SEQ ID NO: 503523 - DNA, 20 bp, mouse
gaagcacaaacagtcagaga

SEQ ID NO: 503524 - DNA, 20 bp, mouse
ggccttgcgcttcccagcag

SEQ ID NO: 503525 - DNA, 20 bp, mouse
gcctgctgcccctgcacctg

SEQ ID NO: 503526 - DNA, 20 bp, mouse
ggcaggcgcggtctcggaca

SEQ ID NO: 503527 - DNA, 20 bp, mouse
gggacatggcgaagcgtgtg

SEQ ID NO: 503528 - DNA, 20 bp, mouse
gaactcgagccggaagcaga

SEQ ID NO: 503529 - DNA, 20 bp, mouse
ggaggagagagaactcgagc

SEQ ID NO: 503530 - DNA, 20 bp, mouse
gagcgccgcggcccgagtcc

SEQ ID NO: 503531 - DNA, 20 bp, mouse
gggcgcagcaggcgcggtct

SEQ ID NO: 503532 - DNA, 20 bp, mouse
gttctcggcgggggccggtg

SEQ ID NO: 503533 - DNA, 20 bp, mouse
gtgcgggccttcttcttgac

SEQ ID NO: 503534 - DNA, 20 bp, mouse
gacgggtgtcttctcggcgg

SEQ ID NO: 503535 - DNA, 20 bp, mouse
gagagggactggccaggact

SEQ ID NO: 503536 - DNA, 20 bp, mouse
ggcaggagccgtttccgaca

SEQ ID NO: 503537 - DNA, 20 bp, mouse
gtccacaggagctggaacaa

SEQ ID NO: 503538 - DNA, 20 bp, mouse
gcccactaccccatcactgt

SEQ ID NO: 503539 - DNA, 20 bp, mouse
gaggagagccaacagtgatg

SEQ ID NO: 503540 - DNA, 20 bp, mouse
gcggcttctgggaacgacaa

SEQ ID NO: 503541 - DNA, 20 bp, mouse
gctcttgaccatgtcggaaa

SEQ ID NO: 503542 - DNA, 20 bp, mouse
gtacaccaagtgaaaactaa

SEQ ID NO: 503543 - DNA, 20 bp, mouse
ggctggaacaagggtacttg

SEQ ID NO: 503544 - DNA, 20 bp, mouse
ggcagccagggctttcttca

SEQ ID NO: 503545 - DNA, 20 bp, mouse
ggtccagctcttgaccatgt

SEQ ID NO: 503546 - DNA, 20 bp, mouse
ggaagagcgagacttgacct

SEQ ID NO: 503547 - DNA, 20 bp, mouse
gctggtcctacaaagcgggg

SEQ ID NO: 503548 - DNA, 20 bp, mouse
ggtcaagtctcgctcttcca

SEQ ID NO: 503549 - DNA, 20 bp, mouse
gcatgtctggtcctacaaag

SEQ ID NO: 503550 - DNA, 20 bp, mouse
gggtgcaccagtgtatctgg

SEQ ID NO: 503551 - DNA, 20 bp, mouse
gcctacaaagcggggtggca

SEQ ID NO: 503552 - DNA, 20 bp, mouse
ggcactgccgccagatacac

SEQ ID NO: 503553 - DNA, 20 bp, mouse
gacttttgaagaatcatgtc

SEQ ID NO: 503554 - DNA, 20 bp, mouse
gcaggtttgcagtttcctgt

SEQ ID NO: 503555 - DNA, 20 bp, mouse
ggctggtgcaccagtgtatc

SEQ ID NO: 503556 - DNA, 20 bp, mouse
gtgcgtttaagtatcagtaa

SEQ ID NO: 503557 - DNA, 20 bp, mouse
gacttaaacgcatacatgtc

SEQ ID NO: 503558 - DNA, 20 bp, mouse
gacgcatacatgtctggacg

SEQ ID NO: 503559 - DNA, 20 bp, mouse
gccgatgcacgcggcctacg

SEQ ID NO: 503560 - DNA, 20 bp, mouse
gggtggcaaggcccgcgcta

SEQ ID NO: 503561 - DNA, 20 bp, mouse
gaggccaaggggaagtaatc

SEQ ID NO: 503562 - DNA, 20 bp, mouse
gcgggtcttggccttagcgc

SEQ ID NO: 503563 - DNA, 20 bp, mouse
gggaagaacgtttcacgagg

SEQ ID NO: 503564 - DNA, 20 bp, mouse
gtgtagtataaaaactgtag

SEQ ID NO: 503565 - DNA, 20 bp, mouse
gtgaaagttaaccaaaacaa

SEQ ID NO: 503566 - DNA, 20 bp, mouse
gacagcactattactatgtc

SEQ ID NO: 503567 - DNA, 20 bp, mouse
gctattactatgtctggacg

SEQ ID NO: 503568 - DNA, 20 bp, mouse
gaaataagcaacagaatctg

SEQ ID NO: 503569 - DNA, 20 bp, mouse
ggcggaaacttcaaacccaa

SEQ ID NO: 503570 - DNA, 20 bp, mouse
gtcttcttttgaaaaagtgg

SEQ ID NO: 503571 - DNA, 20 bp, mouse
gtctgttgcttatttcccct

SEQ ID NO: 503572 - DNA, 20 bp, mouse
gttcaaaagaagagttgaac

SEQ ID NO: 503573 - DNA, 20 bp, mouse
gtaccaagactgtacagacg

SEQ ID NO: 503574 - DNA, 20 bp, mouse
gtgccgcgtctgtacagtct

SEQ ID NO: 503575 - DNA, 20 bp, mouse
gaactcttcttttgaaaaag

SEQ ID NO: 503576 - DNA, 20 bp, mouse
gaagctgggggacaattgac

SEQ ID NO: 503577 - DNA, 20 bp, mouse
gatttccgatttgtattcaa

SEQ ID NO: 503578 - DNA, 20 bp, mouse
gcatttattggagaagctgg

SEQ ID NO: 503579 - DNA, 20 bp, mouse
gataagccttaagtggattt

SEQ ID NO: 503580 - DNA, 20 bp, mouse
gaaatactataagccttaag

SEQ ID NO: 503581 - DNA, 20 bp, mouse
gtatgccattgaatacaaat

SEQ ID NO: 503582 - DNA, 20 bp, mouse
gaatctcgtaaaaaaaacaa

SEQ ID NO: 503583 - DNA, 20 bp, mouse
gctttactgaattaagtgaa

SEQ ID NO: 503584 - DNA, 20 bp, mouse
gttagtcctaaatccactta

SEQ ID NO: 503585 - DNA, 20 bp, mouse
gccggcctgcagtttcccgt

SEQ ID NO: 503586 - DNA, 20 bp, mouse
gtgccgcgtccagacattgt

SEQ ID NO: 503587 - DNA, 20 bp, mouse
ggcaaggtacctacaatgtc

SEQ ID NO: 503588 - DNA, 20 bp, mouse
gtgaacagatcctgacagca

SEQ ID NO: 503589 - DNA, 20 bp, mouse
ggaaaacggagtgatctcgt

SEQ ID NO: 503590 - DNA, 20 bp, mouse
ggagagccaccataagccca

SEQ ID NO: 503591 - DNA, 20 bp, mouse
gttcatatacaagctaccat

SEQ ID NO: 503592 - DNA, 20 bp, mouse
gaatatttcaggactctaaa

SEQ ID NO: 503593 - DNA, 20 bp, mouse
gagagttttacctaaaccaa

SEQ ID NO: 503594 - DNA, 20 bp, mouse
gtcactggcttactttccct

SEQ ID NO: 503595 - DNA, 20 bp, mouse
gcattctaatactcaacttc

SEQ ID NO: 503596 - DNA, 20 bp, mouse
gacctaacctttcctaacaa

SEQ ID NO: 503597 - DNA, 20 bp, mouse
gcactgttgatcgccaacaa

SEQ ID NO: 503598 - DNA, 20 bp, mouse
gcaacagtgctttgtataaa

SEQ ID NO: 503599 - DNA, 20 bp, mouse
ggaacgtacagttgtcacta

SEQ ID NO: 503600 - DNA, 20 bp, mouse
ggcccttgttaggaaaggtt

SEQ ID NO: 503601 - DNA, 20 bp, mouse
gggaccaagctcttgctctt

SEQ ID NO: 503602 - DNA, 20 bp, mouse
gaaagggttttatttcccct

SEQ ID NO: 503603 - DNA, 20 bp, mouse
ggtttaatctttacaatgtc

SEQ ID NO: 503604 - DNA, 20 bp, mouse
gttcccaaagagcaagagct

SEQ ID NO: 503605 - DNA, 20 bp, mouse
gtggtccttatagttttctc

SEQ ID NO: 503606 - DNA, 20 bp, mouse
ggtttagctaacgcttacca

SEQ ID NO: 503607 - DNA, 20 bp, mouse
ggctaaacagcagaaacaaa

SEQ ID NO: 503608 - DNA, 20 bp, mouse
ggtacaacttaaaacttccc

SEQ ID NO: 503609 - DNA, 20 bp, mouse
gttaagttgtacaatatgtc

SEQ ID NO: 503610 - DNA, 20 bp, mouse
gtgtacaatatgtctggacg

SEQ ID NO: 503611 - DNA, 20 bp, mouse
gaggtttcaatatctcccaa

SEQ ID NO: 503612 - DNA, 20 bp, mouse
gtctttctggactttgtgtg

SEQ ID NO: 503613 - DNA, 20 bp, mouse
gcctgcttcacttggccttg

SEQ ID NO: 503614 - DNA, 20 bp, mouse
gacatgtaccagcttctttc

SEQ ID NO: 503615 - DNA, 20 bp, mouse
gtattgaaacctgcttcact

SEQ ID NO: 503616 - DNA, 20 bp, mouse
gtgtcaggaagaggcaagca

SEQ ID NO: 503617 - DNA, 20 bp, mouse
gtataagcctgctcagtaag

SEQ ID NO: 503618 - DNA, 20 bp, mouse
gtgctcagtaagtggtttga

SEQ ID NO: 503619 - DNA, 20 bp, mouse
gcaagggcctcacttcccct

SEQ ID NO: 503620 - DNA, 20 bp, mouse
gaagggttgctttctatcaa

SEQ ID NO: 503621 - DNA, 20 bp, mouse
ggagcctttggtggttggaa

SEQ ID NO: 503622 - DNA, 20 bp, mouse
gagccacctacaaaaacact

SEQ ID NO: 503623 - DNA, 20 bp, mouse
ggtactctagcacggctgcc

SEQ ID NO: 503624 - DNA, 20 bp, mouse
gctccaagtgtttttgtagg

SEQ ID NO: 503625 - DNA, 20 bp, mouse
ggaaaagagcctttggtggt

SEQ ID NO: 503626 - DNA, 20 bp, mouse
gaagagtggacgtgacaatt

SEQ ID NO: 503627 - DNA, 20 bp, mouse
ggacaattgggagctcgcgg

SEQ ID NO: 503628 - DNA, 20 bp, mouse
gcgtgacaattgggagctcg

SEQ ID NO: 503629 - DNA, 20 bp, mouse
gcatcttgacacaagcaagg

SEQ ID NO: 503630 - DNA, 20 bp, mouse
gtgacacaagcaaggaggca

SEQ ID NO: 503631 - DNA, 20 bp, mouse
gagtcatcttgacacaagca

SEQ ID NO: 503632 - DNA, 20 bp, mouse
gaagacggagagccaccata

SEQ ID NO: 503633 - DNA, 20 bp, mouse
gcgcgggccgacgcgagcag

SEQ ID NO: 503634 - DNA, 20 bp, mouse
gagagccaccataaggcgaa

SEQ ID NO: 503635 - DNA, 20 bp, mouse
gcttgcccttcgccttatgg

SEQ ID NO: 503636 - DNA, 20 bp, mouse
gtctttttgtttagaatgtc

SEQ ID NO: 503637 - DNA, 20 bp, mouse
ggtcttcttcggcagcagta

SEQ ID NO: 503638 - DNA, 20 bp, mouse
gggccaagctcctccacttt

SEQ ID NO: 503639 - DNA, 20 bp, mouse
gggccaaaagtggaggagct

SEQ ID NO: 503640 - DNA, 20 bp, mouse
gctgcaaaggccaaaagtgg

SEQ ID NO: 503641 - DNA, 20 bp, mouse
gcaactgcaaaggccaaaag

SEQ ID NO: 503642 - DNA, 20 bp, mouse
gctgatcatttaaaaaacaa

SEQ ID NO: 503643 - DNA, 20 bp, mouse
gtaacacatttgtcttttta

SEQ ID NO: 503644 - DNA, 20 bp, mouse
gaaagaactgacaactgcaa

SEQ ID NO: 503645 - DNA, 20 bp, mouse
gcttcggcagcagtacggcc

SEQ ID NO: 503646 - DNA, 20 bp, mouse
gagttctttaaaagacactg

SEQ ID NO: 503647 - DNA, 20 bp, mouse
gcgcccagagaaaactataa

SEQ ID NO: 503648 - DNA, 20 bp, mouse
gagaagtcagccaatcgcat

SEQ ID NO: 503649 - DNA, 20 bp, mouse
gtttctctgggcgcaaaaaa

SEQ ID NO: 503650 - DNA, 20 bp, mouse
gacgaatgggaagcattcgc

SEQ ID NO: 503651 - DNA, 20 bp, mouse
gaaaaaagggcctatgcgat

SEQ ID NO: 503652 - DNA, 20 bp, mouse
gtcttttcttctagacgaat

SEQ ID NO: 503653 - DNA, 20 bp, mouse
gcttgctctttgcaagcgta

SEQ ID NO: 503654 - DNA, 20 bp, mouse
gttcttttcgggtgagtgaa

SEQ ID NO: 503655 - DNA, 20 bp, mouse
gctttaaaagacactgtgga

SEQ ID NO: 503656 - DNA, 20 bp, mouse
gacttgagccatgccggagg

SEQ ID NO: 503657 - DNA, 20 bp, mouse
gtgagacgttggtgtgggaa

SEQ ID NO: 503658 - DNA, 20 bp, mouse
gtgagccatgccggaggtgg

SEQ ID NO: 503659 - DNA, 20 bp, mouse
ggttacttgagccatgccgg

SEQ ID NO: 503660 - DNA, 20 bp, mouse
gcaccctttaccgccacctc

SEQ ID NO: 503661 - DNA, 20 bp, mouse
gtttaccgccacctccggca

SEQ ID NO: 503662 - DNA, 20 bp, mouse
gtgttttgagacgttggtgt

SEQ ID NO: 503663 - DNA, 20 bp, mouse
gtggaactgttttgagacgt

SEQ ID NO: 503664 - DNA, 20 bp, mouse
ggacttgaggttgagaagcg

SEQ ID NO: 503665 - DNA, 20 bp, mouse
ggtgctactatttccaagaa

SEQ ID NO: 503666 - DNA, 20 bp, mouse
ggggctggtgcagacttaga

SEQ ID NO: 503667 - DNA, 20 bp, mouse
ggtgcagacttagaaggctc

SEQ ID NO: 503668 - DNA, 20 bp, mouse
gctgcaccagcccctaagaa

SEQ ID NO: 503669 - DNA, 20 bp, mouse
gaaaatggtcagaaactggt

SEQ ID NO: 503670 - DNA, 20 bp, mouse
gagaaactggtaggcagtga

SEQ ID NO: 503671 - DNA, 20 bp, mouse
gtctaagaaagccatctcta

SEQ ID NO: 503672 - DNA, 20 bp, mouse
gtagatcccttcttaggggc

SEQ ID NO: 503673 - DNA, 20 bp, mouse
gtttcttagatcccttctta

SEQ ID NO: 503674 - DNA, 20 bp, mouse
gttcttctgcgccttagaga

SEQ ID NO: 503675 - DNA, 20 bp, mouse
gacttcttttctgaaaagtg

SEQ ID NO: 503676 - DNA, 20 bp, mouse
gccgttcccagcccacactg

SEQ ID NO: 503677 - DNA, 20 bp, mouse
gaaacacaggaacctcagtg

SEQ ID NO: 503678 - DNA, 20 bp, mouse
gtcttcggatttccaaacac

SEQ ID NO: 503679 - DNA, 20 bp, mouse
gaggaacctcagtgtgggct

SEQ ID NO: 503680 - DNA, 20 bp, mouse
ggagcctttggaattcgcta

SEQ ID NO: 503681 - DNA, 20 bp, mouse
gcctccgtagcgaattccaa

SEQ ID NO: 503682 - DNA, 20 bp, mouse
gcggacttctcctacttata

SEQ ID NO: 503683 - DNA, 20 bp, mouse
gttcgctacggaggcttact

SEQ ID NO: 503684 - DNA, 20 bp, mouse
gcttacttggcaggatcact

SEQ ID NO: 503685 - DNA, 20 bp, mouse
gctacggaggcttacttggc

SEQ ID NO: 503686 - DNA, 20 bp, mouse
gttctaagaatccttctgtg

SEQ ID NO: 503687 - DNA, 20 bp, mouse
gctcggacttcgccagctca

SEQ ID NO: 503688 - DNA, 20 bp, mouse
gtccgagcctgccccacaga

SEQ ID NO: 503689 - DNA, 20 bp, mouse
ggagcgcaaacgctactgaa

SEQ ID NO: 503690 - DNA, 20 bp, mouse
gtgtttagtgtgcccaaggg

SEQ ID NO: 503691 - DNA, 20 bp, mouse
gtccttctgtggggcaggct

SEQ ID NO: 503692 - DNA, 20 bp, mouse
gtggatcaactgagatatga

SEQ ID NO: 503693 - DNA, 20 bp, mouse
gggtgctctgccagcttcct

SEQ ID NO: 503694 - DNA, 20 bp, mouse
gcctgcattgcccaggaagc

SEQ ID NO: 503695 - DNA, 20 bp, mouse
gttttacacaatccctgagc

SEQ ID NO: 503696 - DNA, 20 bp, mouse
gatttctggaactttcacgg

SEQ ID NO: 503697 - DNA, 20 bp, mouse
gagaatttctggaactttca

SEQ ID NO: 503698 - DNA, 20 bp, mouse
ggacgtgcctgtaaattcat

SEQ ID NO: 503699 - DNA, 20 bp, mouse
gcatggttggtgagaatttc

SEQ ID NO: 503700 - DNA, 20 bp, mouse
ggctccctttttgaaagggt

SEQ ID NO: 503701 - DNA, 20 bp, mouse
gtggtcttgtctagttgatg

SEQ ID NO: 503702 - DNA, 20 bp, mouse
gccctttttgaaagggtagg

SEQ ID NO: 503703 - DNA, 20 bp, mouse
ggaactttcacggaggcaac

SEQ ID NO: 503704 - DNA, 20 bp, mouse
gaacagctccctttttgaaa

SEQ ID NO: 503705 - DNA, 20 bp, mouse
gccccaaaatcaacgagaaa

SEQ ID NO: 503706 - DNA, 20 bp, mouse
ggtgaacagagaatgaaggt

SEQ ID NO: 503707 - DNA, 20 bp, mouse
gagttcaatatctcttttct

SEQ ID NO: 503708 - DNA, 20 bp, mouse
gtgagtcttgagcactcact

SEQ ID NO: 503709 - DNA, 20 bp, mouse
gccaattttgaagtcttgag

SEQ ID NO: 503710 - DNA, 20 bp, mouse
gcatagtgaacagagaatga

SEQ ID NO: 503711 - DNA, 20 bp, mouse
gttaaagagcaggaaaggaa

SEQ ID NO: 503712 - DNA, 20 bp, mouse
ggactcagctcttaacccaa

SEQ ID NO: 503713 - DNA, 20 bp, mouse
ggcatctcctccaaagccat

SEQ ID NO: 503714 - DNA, 20 bp, mouse
gttcatgatgcccatggctt

SEQ ID NO: 503715 - DNA, 20 bp, mouse
gggggcaggagcggacttgg

SEQ ID NO: 503716 - DNA, 20 bp, mouse
ggtggtatagctctacgtag

SEQ ID NO: 503717 - DNA, 20 bp, mouse
gaagagccgatcagcttctg

SEQ ID NO: 503718 - DNA, 20 bp, mouse
gtctctttaaaaattgtgcg

SEQ ID NO: 503719 - DNA, 20 bp, mouse
gtactgctaacttatgtttt

SEQ ID NO: 503720 - DNA, 20 bp, mouse
gctataccacagaagctgat

SEQ ID NO: 503721 - DNA, 20 bp, mouse
gtactcggtgtacgtctaca

SEQ ID NO: 503722 - DNA, 20 bp, mouse
gggctcaggcatagtgaagc

SEQ ID NO: 503723 - DNA, 20 bp, mouse
gaggctgacaccaaatccaa

SEQ ID NO: 503724 - DNA, 20 bp, mouse
gagctccaagtgagcgctcc

SEQ ID NO: 503725 - DNA, 20 bp, mouse
gtcagcctggagcgctcact

SEQ ID NO: 503726 - DNA, 20 bp, mouse
gcccaacaggacaagcagat

SEQ ID NO: 503727 - DNA, 20 bp, mouse
gcaagcagataggaacacca

SEQ ID NO: 503728 - DNA, 20 bp, mouse
gacaaagctgaacacccaac

SEQ ID NO: 503729 - DNA, 20 bp, mouse
gtacttggcgctagtatact

SEQ ID NO: 503730 - DNA, 20 bp, mouse
gggttgacgtctagcaccaa

SEQ ID NO: 503731 - DNA, 20 bp, mouse
gccaagtaaacttctcaata

SEQ ID NO: 503732 - DNA, 20 bp, mouse
gtctaatactggtggtttag

SEQ ID NO: 503733 - DNA, 20 bp, mouse
gatgtttgcagctctaatac

SEQ ID NO: 503734 - DNA, 20 bp, mouse
gtttgcagctctaatactgg

SEQ ID NO: 503735 - DNA, 20 bp, mouse
gatgaattcaccttcgagta

SEQ ID NO: 503736 - DNA, 20 bp, mouse
gcgggctcaggcatactgag

SEQ ID NO: 503737 - DNA, 20 bp, mouse
gcttttccagaggaaagtgt

SEQ ID NO: 503738 - DNA, 20 bp, mouse
gtgtgcaacagcttttccag

SEQ ID NO: 503739 - DNA, 20 bp, mouse
gttaaaagagcctttgagtt

SEQ ID NO: 503740 - DNA, 20 bp, mouse
gtgagttaaacgagctcact

SEQ ID NO: 503741 - DNA, 20 bp, mouse
gaaaagctgttgcacatgcg

SEQ ID NO: 503742 - DNA, 20 bp, mouse
gaagtgaactaagttgaaaa

SEQ ID NO: 503743 - DNA, 20 bp, mouse
gttccagaggaaagtgtggg

SEQ ID NO: 503744 - DNA, 20 bp, mouse
gtaaaagttaatgactgttc

SEQ ID NO: 503745 - DNA, 20 bp, mouse
gagccacccacactttcctc

SEQ ID NO: 503746 - DNA, 20 bp, mouse
ggagcggacttcgttggctc

SEQ ID NO: 503747 - DNA, 20 bp, mouse
gcaatttgtctgtatagagg

SEQ ID NO: 503748 - DNA, 20 bp, mouse
ggcataacagcgtgtatata

SEQ ID NO: 503749 - DNA, 20 bp, mouse
gctgcaatttgtctgtatag

SEQ ID NO: 503750 - DNA, 20 bp, mouse
gtagcacagcacaaatccaa

SEQ ID NO: 503751 - DNA, 20 bp, mouse
gttttcaaagaactgcttag

SEQ ID NO: 503752 - DNA, 20 bp, mouse
ggagatagtcgcatgtttat

SEQ ID NO: 503753 - DNA, 20 bp, mouse
ggggcgggagcggacttcgt

SEQ ID NO: 503754 - DNA, 20 bp, mouse
ggtgtacttggtgaccgcct

SEQ ID NO: 503755 - DNA, 20 bp, mouse
gttcgagcgcatcgcaggcg

SEQ ID NO: 503756 - DNA, 20 bp, mouse
ggacttagcgggttcaggca

SEQ ID NO: 503757 - DNA, 20 bp, mouse
gcgctcccgccccgaagaag

SEQ ID NO: 503758 - DNA, 20 bp, mouse
ggagcggacttagcgggttc

SEQ ID NO: 503759 - DNA, 20 bp, mouse
gttctgtatctttaggcttt

SEQ ID NO: 503760 - DNA, 20 bp, mouse
gttttagttgaaagtgtggg

SEQ ID NO: 503761 - DNA, 20 bp, mouse
gcttttctttctgtatcttt

SEQ ID NO: 503762 - DNA, 20 bp, mouse
gatgtaaagtgtgtctgcac

SEQ ID NO: 503763 - DNA, 20 bp, mouse
gcttttttagttgaaagtgt

SEQ ID NO: 503764 - DNA, 20 bp, mouse
gtagcgggttcaggcatggt

SEQ ID NO: 503765 - DNA, 20 bp, mouse
gggggcgggagcggacttag

SEQ ID NO: 503766 - DNA, 20 bp, mouse
ggggcgggaacggacttaac

SEQ ID NO: 503767 - DNA, 20 bp, mouse
gtaacaggctcaggcatgtt

SEQ ID NO: 503768 - DNA, 20 bp, mouse
gggctcaggcatgttaggtc

SEQ ID NO: 503769 - DNA, 20 bp, mouse
gcacggcgcaagttgtagcg

SEQ ID NO: 503770 - DNA, 20 bp, mouse
gttaaaaagcgaagggctca

SEQ ID NO: 503771 - DNA, 20 bp, mouse
gatctctgttttgagaatgt

SEQ ID NO: 503772 - DNA, 20 bp, mouse
gtctgttttgagaatgtggg

SEQ ID NO: 503773 - DNA, 20 bp, mouse
gtaagtgattctaccttact

SEQ ID NO: 503774 - DNA, 20 bp, mouse
ggaacggacttaacaggctc

SEQ ID NO: 503775 - DNA, 20 bp, mouse
gcccttcttcggggcgggaa

SEQ ID NO: 503776 - DNA, 20 bp, mouse
ggctggtgagcacttggaga

SEQ ID NO: 503777 - DNA, 20 bp, mouse
ggtatgcaaaggatagtgat

SEQ ID NO: 503778 - DNA, 20 bp, mouse
gtagacactagggaatatat

SEQ ID NO: 503779 - DNA, 20 bp, mouse
gtactatttatagtatgcaa

SEQ ID NO: 503780 - DNA, 20 bp, mouse
gagtgattggatgaaaatac

SEQ ID NO: 503781 - DNA, 20 bp, mouse
ggttctacggaattaaccaa

SEQ ID NO: 503782 - DNA, 20 bp, mouse
gtattccctagtgtctataa

SEQ ID NO: 503783 - DNA, 20 bp, mouse
gtgacgtttaagactctgat

SEQ ID NO: 503784 - DNA, 20 bp, mouse
gaagcaagctggtgagcact

SEQ ID NO: 503785 - DNA, 20 bp, mouse
gttaattccgtagaactgta

SEQ ID NO: 503786 - DNA, 20 bp, mouse
gcttagtacgagccattctt

SEQ ID NO: 503787 - DNA, 20 bp, mouse
gagtacgagccattcttggg

SEQ ID NO: 503788 - DNA, 20 bp, mouse
gccgcggagagagggcataa

SEQ ID NO: 503789 - DNA, 20 bp, mouse
gaggagatacacaaaagtgc

SEQ ID NO: 503790 - DNA, 20 bp, mouse
gctttacatgacatcttagg

SEQ ID NO: 503791 - DNA, 20 bp, mouse
ggtgtatctcctcccaagaa

SEQ ID NO: 503792 - DNA, 20 bp, mouse
gcaactttacatgacatctt

SEQ ID NO: 503793 - DNA, 20 bp, mouse
gttttatgctatttaaaaaa

SEQ ID NO: 503794 - DNA, 20 bp, mouse
gcgccgcatccgcggagaga

SEQ ID NO: 503795 - DNA, 20 bp, mouse
gtgccctctctccgcggatg

SEQ ID NO: 503796 - DNA, 20 bp, mouse
gtgagaacggtaatgaactg

SEQ ID NO: 503797 - DNA, 20 bp, mouse
ggagtgaatttggaccccaa

SEQ ID NO: 503798 - DNA, 20 bp, mouse
gaacggtaatgaactgtggc

SEQ ID NO: 503799 - DNA, 20 bp, mouse
gtggggagagggcgtaaatt

SEQ ID NO: 503800 - DNA, 20 bp, mouse
gttagggtagtgagtgaatt

SEQ ID NO: 503801 - DNA, 20 bp, mouse
gcacccccgttttctataaa

SEQ ID NO: 503802 - DNA, 20 bp, mouse
gaagtctcagggaatgagaa

SEQ ID NO: 503803 - DNA, 20 bp, mouse
gttctctctttttcttatca

SEQ ID NO: 503804 - DNA, 20 bp, mouse
gctggcccgtcgcattcgtg

SEQ ID NO: 503805 - DNA, 20 bp, mouse
gcttggcgtggatggcacac

SEQ ID NO: 503806 - DNA, 20 bp, mouse
gttagtacgagccattgcag

SEQ ID NO: 503807 - DNA, 20 bp, mouse
ggtacgagccattgcagagg

SEQ ID NO: 503808 - DNA, 20 bp, mouse
gggaggagaaacgggagcag

SEQ ID NO: 503809 - DNA, 20 bp, mouse
gcgtttctcctcctctgcaa

SEQ ID NO: 503810 - DNA, 20 bp, mouse
gcgcggcgagcgggcttaat

SEQ ID NO: 503811 - DNA, 20 bp, mouse
gataggcacgccttctacac

SEQ ID NO: 503812 - DNA, 20 bp, mouse
gccgctcgccgcggatacgg

SEQ ID NO: 503813 - DNA, 20 bp, mouse
ggaaacgggagcagagggct

SEQ ID NO: 503814 - DNA, 20 bp, mouse
gactggcacgtaaaccaaaa

SEQ ID NO: 503815 - DNA, 20 bp, mouse
gagcccgctcgccgcggata

SEQ ID NO: 503816 - DNA, 20 bp, mouse
gtatatttaaggagatgtaa

SEQ ID NO: 503817 - DNA, 20 bp, mouse
gaagggagcagtttactatc

SEQ ID NO: 503818 - DNA, 20 bp, mouse
ggtacttaatggtaacaatg

SEQ ID NO: 503819 - DNA, 20 bp, mouse
ggtacttccgcatacatcat

SEQ ID NO: 503820 - DNA, 20 bp, mouse
gttaaaagatgtacaaagtt

SEQ ID NO: 503821 - DNA, 20 bp, mouse
ggaaggaacatgctcctgat

SEQ ID NO: 503822 - DNA, 20 bp, mouse
gtaacaattacggtacttaa

SEQ ID NO: 503823 - DNA, 20 bp, mouse
ggaagcaatagttaacaaag

SEQ ID NO: 503824 - DNA, 20 bp, mouse
ggtaatccttggggccgctg

SEQ ID NO: 503825 - DNA, 20 bp, mouse
ggacgaaaatgtaacaatta

SEQ ID NO: 503826 - DNA, 20 bp, mouse
ggccatggcaagtaaccgta

SEQ ID NO: 503827 - DNA, 20 bp, mouse
gtccctacggttacttgcca

SEQ ID NO: 503828 - DNA, 20 bp, mouse
gctaagaagagcctttaaag

SEQ ID NO: 503829 - DNA, 20 bp, mouse
gatacctaagtagcgcactt

SEQ ID NO: 503830 - DNA, 20 bp, mouse
gatccacacaaccactttaa

SEQ ID NO: 503831 - DNA, 20 bp, mouse
gggtatctcacttttcccta

SEQ ID NO: 503832 - DNA, 20 bp, mouse
gccgcggggagagggcttaa

SEQ ID NO: 503833 - DNA, 20 bp, mouse
gagcctttaaagtggttgtg

SEQ ID NO: 503834 - DNA, 20 bp, mouse
gccgctcgcaagtctaccgg

SEQ ID NO: 503835 - DNA, 20 bp, mouse
gagaccgctcgcaagtctac

SEQ ID NO: 503836 - DNA, 20 bp, mouse
gtggagtcagagctgagagt

SEQ ID NO: 503837 - DNA, 20 bp, mouse
gaggccaagcagctatataa

SEQ ID NO: 503838 - DNA, 20 bp, mouse
gccgcgacccgacatgtctt

SEQ ID NO: 503839 - DNA, 20 bp, mouse
gacatgtcgggtcgcggcaa

SEQ ID NO: 503840 - DNA, 20 bp, mouse
gcgacatgtcttaggaagaa

SEQ ID NO: 503841 - DNA, 20 bp, mouse
gtaaccaaaggcccttctca

SEQ ID NO: 503842 - DNA, 20 bp, mouse
gagatgcccaagctgttagg

SEQ ID NO: 503843 - DNA, 20 bp, mouse
ggatgccctggatgttatcg

SEQ ID NO: 503844 - DNA, 20 bp, mouse
gctgagatgcccaagctgtt

SEQ ID NO: 503845 - DNA, 20 bp, mouse
ggtttgtgtgattctgttgg

SEQ ID NO: 503846 - DNA, 20 bp, mouse
ggaattcgctgtgttattat

SEQ ID NO: 503847 - DNA, 20 bp, mouse
gattcttacaagctttcagt

SEQ ID NO: 503848 - DNA, 20 bp, mouse
gtataggctcttatcggacc

SEQ ID NO: 503849 - DNA, 20 bp, mouse
gctatgtctggtcgcggcaa

SEQ ID NO: 503850 - DNA, 20 bp, mouse
gcctggttgagaacttcaag

SEQ ID NO: 503851 - DNA, 20 bp, mouse
ggtaagaatttaactatgtc

SEQ ID NO: 503852 - DNA, 20 bp, mouse
gtcagtgagtggtcctgaaa

SEQ ID NO: 503853 - DNA, 20 bp, mouse
gtgagaacttcaagtgggcg

SEQ ID NO: 503854 - DNA, 20 bp, mouse
gctacggattcgggggttaa

SEQ ID NO: 503855 - DNA, 20 bp, mouse
gttttaaggaattcagtgag

SEQ ID NO: 503856 - DNA, 20 bp, mouse
ggacgtggtaagggtggtaa

SEQ ID NO: 503857 - DNA, 20 bp, mouse
ggtggtaaaggccttgggaa

SEQ ID NO: 503858 - DNA, 20 bp, mouse
gtcataaccatgtctggacg

SEQ ID NO: 503859 - DNA, 20 bp, mouse
gctgctgtcataaccatgtc

SEQ ID NO: 503860 - DNA, 20 bp, mouse
ggtaagggtggtaaaggcct

SEQ ID NO: 503861 - DNA, 20 bp, mouse
gcggtaagtgaacaactcct

SEQ ID NO: 503862 - DNA, 20 bp, mouse
gctacccaccacataagtat

SEQ ID NO: 503863 - DNA, 20 bp, mouse
ggcaggctcgattaaagctt

SEQ ID NO: 503864 - DNA, 20 bp, mouse
ggcagccgaatataccctgt

SEQ ID NO: 503865 - DNA, 20 bp, mouse
gacaactcctaggaatttgt

SEQ ID NO: 503866 - DNA, 20 bp, mouse
gtgtctggacgcgggaaagg

SEQ ID NO: 503867 - DNA, 20 bp, mouse
ggcggcaagggtcttggtaa

SEQ ID NO: 503868 - DNA, 20 bp, mouse
gacatgtctggacgcgggaa

SEQ ID NO: 503869 - DNA, 20 bp, mouse
ggcaagggtcttggtaaggg

SEQ ID NO: 503870 - DNA, 20 bp, mouse
gggccgcttgttacagtcac

SEQ ID NO: 503871 - DNA, 20 bp, mouse
gacatgttagcaaactagga

SEQ ID NO: 503872 - DNA, 20 bp, mouse
gtgctaacatgtctggacgc

SEQ ID NO: 503873 - DNA, 20 bp, mouse
gagccagtgactgtaacaag

SEQ ID NO: 503874 - DNA, 20 bp, mouse
gcctttaagtgagaaggtag

SEQ ID NO: 503875 - DNA, 20 bp, mouse
ggcagctcctttaagtgaga

SEQ ID NO: 503876 - DNA, 20 bp, mouse
gccatagccatgtctggtcg

SEQ ID NO: 503877 - DNA, 20 bp, mouse
gagtgctccatagccatgtc

SEQ ID NO: 503878 - DNA, 20 bp, mouse
gtccctaaagttcaaaatgg

SEQ ID NO: 503879 - DNA, 20 bp, mouse
gtaattactacaaactactg

SEQ ID NO: 503880 - DNA, 20 bp, mouse
gttcggcggttaagctcacc

SEQ ID NO: 503881 - DNA, 20 bp, mouse
gcttttcaaaaggtaaatct

SEQ ID NO: 503882 - DNA, 20 bp, mouse
gcctggagcttctttctcaa

SEQ ID NO: 503883 - DNA, 20 bp, mouse
gctttttatgacaaagtggg

SEQ ID NO: 503884 - DNA, 20 bp, mouse
gcagctttttatgacaaagt

SEQ ID NO: 503885 - DNA, 20 bp, mouse
ggccgccattttgaacttta

SEQ ID NO: 503886 - DNA, 20 bp, mouse
ggtcgtggcaagggcggtaa

SEQ ID NO: 503887 - DNA, 20 bp, mouse
ggcaagggcggtaaaggtct

SEQ ID NO: 503888 - DNA, 20 bp, mouse
gagtacaccatgtctggtcg

SEQ ID NO: 503889 - DNA, 20 bp, mouse
ggcggtaaaggtcttggcaa

SEQ ID NO: 503890 - DNA, 20 bp, mouse
ggtaaaggtcttggcaaagg

SEQ ID NO: 503891 - DNA, 20 bp, mouse
gtcaacagagtggaaggcac

SEQ ID NO: 503892 - DNA, 20 bp, mouse
gaaaacctcaacagagtgga

SEQ ID NO: 503893 - DNA, 20 bp, mouse
gaaagggcctttggttttgt

SEQ ID NO: 503894 - DNA, 20 bp, mouse
ggttaatcgactcactattc

SEQ ID NO: 503895 - DNA, 20 bp, mouse
gtcagcaagtacaccatgtc

SEQ ID NO: 503896 - DNA, 20 bp, mouse
ggccgaacccgtacagagta

SEQ ID NO: 503897 - DNA, 20 bp, mouse
gccagggccgtactctgtac

SEQ ID NO: 503898 - DNA, 20 bp, mouse
ggcgccaccgcaaagtgctt

SEQ ID NO: 503899 - DNA, 20 bp, mouse
gaagggcctttaagtagcat

SEQ ID NO: 503900 - DNA, 20 bp, mouse
ggacgaagcagatggctttg

SEQ ID NO: 503901 - DNA, 20 bp, mouse
gtttgtggtggccctaaaaa

SEQ ID NO: 503902 - DNA, 20 bp, mouse
gttcttccaatgctacttaa

SEQ ID NO: 503903 - DNA, 20 bp, mouse
ggccgtactctgtacgggtt

SEQ ID NO: 503904 - DNA, 20 bp, mouse
gctacttaaaggcccttttt

SEQ ID NO: 503905 - DNA, 20 bp, mouse
gtcgggaagcaaaggcagac

SEQ ID NO: 503906 - DNA, 20 bp, mouse
gccagggccgcaccctctac

SEQ ID NO: 503907 - DNA, 20 bp, mouse
gctgagaactggagtgaaaa

SEQ ID NO: 503908 - DNA, 20 bp, mouse
gagatgtggtggtcctgaaa

SEQ ID NO: 503909 - DNA, 20 bp, mouse
gagctcttctgtaaaagatg

SEQ ID NO: 503910 - DNA, 20 bp, mouse
gacgcttgttaactgagaac

SEQ ID NO: 503911 - DNA, 20 bp, mouse
gagtgaaaacggctcgtaac

SEQ ID NO: 503912 - DNA, 20 bp, mouse
gttacactatatttccctaa

SEQ ID NO: 503913 - DNA, 20 bp, mouse
gcatacatgttcgttctgat

SEQ ID NO: 503914 - DNA, 20 bp, mouse
gttccctaaaggtccttttc

SEQ ID NO: 503915 - DNA, 20 bp, mouse
ggtcctgaaaaggaccttta

SEQ ID NO: 503916 - DNA, 20 bp, mouse
ggcgcttcaaagaattaagt

SEQ ID NO: 503917 - DNA, 20 bp, mouse
gcgctgtactcatgtcagaa

SEQ ID NO: 503918 - DNA, 20 bp, mouse
gtgggtgacctactttgtaa

SEQ ID NO: 503919 - DNA, 20 bp, mouse
gcttcaaagaattaagtggg

SEQ ID NO: 503920 - DNA, 20 bp, mouse
gttgtgtaaagtgaactaat

SEQ ID NO: 503921 - DNA, 20 bp, mouse
ggagacattacttgtattct

SEQ ID NO: 503922 - DNA, 20 bp, mouse
gcaagtaatgtctctgacat

SEQ ID NO: 503923 - DNA, 20 bp, mouse
gacttgtattcttggtcatg

SEQ ID NO: 503924 - DNA, 20 bp, mouse
gcttttatttctgctacaaa

SEQ ID NO: 503925 - DNA, 20 bp, mouse
gtcatgtctggcagaggtaa

SEQ ID NO: 503926 - DNA, 20 bp, mouse
gacgggggggaaggcgacga

SEQ ID NO: 503927 - DNA, 20 bp, mouse
gtctcgggggacggggggga

SEQ ID NO: 503928 - DNA, 20 bp, mouse
ggcagacggccttctggaga

SEQ ID NO: 503929 - DNA, 20 bp, mouse
ggttttgtcttcgtcatgtc

SEQ ID NO: 503930 - DNA, 20 bp, mouse
gtagttgagaaagaagctct

SEQ ID NO: 503931 - DNA, 20 bp, mouse
ggacgaagcagacggccttc

SEQ ID NO: 503932 - DNA, 20 bp, mouse
gtacttctcgggggacgggg

SEQ ID NO: 503933 - DNA, 20 bp, mouse
gctgcaatgttgcaaccctt

SEQ ID NO: 503934 - DNA, 20 bp, mouse
gggggccggccttctccaga

SEQ ID NO: 503935 - DNA, 20 bp, mouse
ggcaacattgcagtacgggc

SEQ ID NO: 503936 - DNA, 20 bp, mouse
gacttctcgggggacggggg

SEQ ID NO: 503937 - DNA, 20 bp, mouse
gctcgggggacgggggggga

SEQ ID NO: 503938 - DNA, 20 bp, mouse
ggcagacggccttctggaga

SEQ ID NO: 503939 - DNA, 20 bp, mouse
gtagttgagaaagaagctct

SEQ ID NO: 503940 - DNA, 20 bp, mouse
ggacgaagcagacggccttc

SEQ ID NO: 503941 - DNA, 20 bp, mouse
gctgcaatgttgcaaccctt

SEQ ID NO: 503942 - DNA, 20 bp, mouse
ggcaacattgcagtacgggc

SEQ ID NO: 503943 - DNA, 20 bp, mouse
gggggccggccttctccaga

SEQ ID NO: 503944 - DNA, 20 bp, mouse
ggggttgcaacattgcagta

SEQ ID NO: 503945 - DNA, 20 bp, mouse
gctttccagctacttctcgg

SEQ ID NO: 503946 - DNA, 20 bp, mouse
gccggtcgtggcaagcaagg

SEQ ID NO: 503947 - DNA, 20 bp, mouse
ggaaagcgcaaacagacgaa

SEQ ID NO: 503948 - DNA, 20 bp, mouse
gcagacgaacggccacaacc

SEQ ID NO: 503949 - DNA, 20 bp, mouse
gctttcgtgatgtccggtcg

SEQ ID NO: 503950 - DNA, 20 bp, mouse
gcaaccaggaaacggtactc

SEQ ID NO: 503951 - DNA, 20 bp, mouse
ggcgccggagtaccgtttcc

SEQ ID NO: 503952 - DNA, 20 bp, mouse
gaagagtgaggcgtcggcgc

SEQ ID NO: 503953 - DNA, 20 bp, mouse
gcccccgcgagctcctaaaa

SEQ ID NO: 503954 - DNA, 20 bp, mouse
ggagcctttttaggagctcg

SEQ ID NO: 503955 - DNA, 20 bp, mouse
gaacggccacaaccaggaaa

SEQ ID NO: 503956 - DNA, 20 bp, mouse
gtcgggtctgcgtctataaa

SEQ ID NO: 503957 - DNA, 20 bp, mouse
gctgcgtctataaaagggtg

SEQ ID NO: 503958 - DNA, 20 bp, mouse
ggaaagcgcaaacagacgaa

SEQ ID NO: 503959 - DNA, 20 bp, mouse
gcagacgaacggccacaacc

SEQ ID NO: 503960 - DNA, 20 bp, mouse
ggagcgtcgggcggacaatc

SEQ ID NO: 503961 - DNA, 20 bp, mouse
gccggtcgtggcaagcaagg

SEQ ID NO: 503962 - DNA, 20 bp, mouse
gctataaaagggtgaggcgt

SEQ ID NO: 503963 - DNA, 20 bp, mouse
gcaaccaggaaacggtactc

SEQ ID NO: 503964 - DNA, 20 bp, mouse
gaagggtgaggcgtcggcgc

SEQ ID NO: 503965 - DNA, 20 bp, mouse
ggcgccggagtaccgtttcc

SEQ ID NO: 503966 - DNA, 20 bp, mouse
gtgtttgccacggccagaca

SEQ ID NO: 503967 - DNA, 20 bp, mouse
ggacgaccgcgacttcgcct

SEQ ID NO: 503968 - DNA, 20 bp, mouse
gctagctgtgaggaacgatg

SEQ ID NO: 503969 - DNA, 20 bp, mouse
gattccgccatgtctggccg

SEQ ID NO: 503970 - DNA, 20 bp, mouse
gagctcaacaagttactagg

SEQ ID NO: 503971 - DNA, 20 bp, mouse
gttgcttattccgccatgtc

SEQ ID NO: 503972 - DNA, 20 bp, mouse
gtttttccaagggaaggata

SEQ ID NO: 503973 - DNA, 20 bp, mouse
gttataagatctatcgggag

SEQ ID NO: 503974 - DNA, 20 bp, mouse
gtaagacagcctgaatattg

SEQ ID NO: 503975 - DNA, 20 bp, mouse
gcctttggatgacactttgg

SEQ ID NO: 503976 - DNA, 20 bp, mouse
gtataatgtaggacacaccg

SEQ ID NO: 503977 - DNA, 20 bp, mouse
gataacttagagtataatgt

SEQ ID NO: 503978 - DNA, 20 bp, mouse
gttatactctaagttatgtc

SEQ ID NO: 503979 - DNA, 20 bp, mouse
gtctaagttatgtctggccg

SEQ ID NO: 503980 - DNA, 20 bp, mouse
gtttacagaagttgtcacct

SEQ ID NO: 503981 - DNA, 20 bp, mouse
gtcgtctctaaggcctttat

SEQ ID NO: 503982 - DNA, 20 bp, mouse
gtgacaacttctgtaaagct

SEQ ID NO: 503983 - DNA, 20 bp, mouse
gtcctttgtaaaagatttgg

SEQ ID NO: 503984 - DNA, 20 bp, mouse
gactcaacacgaatccaaaa

SEQ ID NO: 503985 - DNA, 20 bp, mouse
gctaggttgattcgtctcta

SEQ ID NO: 503986 - DNA, 20 bp, mouse
gatgcaacgtaaggtagacc

SEQ ID NO: 503987 - DNA, 20 bp, mouse
ggagcagacttcgctggatc

SEQ ID NO: 503988 - DNA, 20 bp, mouse
gcgtctaaagatgcaacgta

SEQ ID NO: 503989 - DNA, 20 bp, mouse
gtagacgcggaggaaaatgc

SEQ ID NO: 503990 - DNA, 20 bp, mouse
ggacacgggcatctcatcta

SEQ ID NO: 503991 - DNA, 20 bp, mouse
gttcttagagcccttctttg

SEQ ID NO: 503992 - DNA, 20 bp, mouse
gctgctgctgccgggagagt

SEQ ID NO: 503993 - DNA, 20 bp, mouse
ggttgcatctttagacgcgg

SEQ ID NO: 503994 - DNA, 20 bp, mouse
gtctgctcctgccccaaaga

SEQ ID NO: 503995 - DNA, 20 bp, mouse
gttcagcgcggcttgctatg

SEQ ID NO: 503996 - DNA, 20 bp, mouse
gctgccccggctcccaagaa

SEQ ID NO: 503997 - DNA, 20 bp, mouse
gttgggagccggggcagatt

SEQ ID NO: 503998 - DNA, 20 bp, mouse
ggaacccttcttgggagccg

SEQ ID NO: 503999 - DNA, 20 bp, mouse
gaaatcaaccagggacccgg

SEQ ID NO: 504000 - DNA, 20 bp, mouse
ggtaagtagaaaatcaacca

SEQ ID NO: 504001 - DNA, 20 bp, mouse
gtcgcgggagatccagacgt

SEQ ID NO: 504002 - DNA, 20 bp, mouse
gccagcgagcgcctcatcca

SEQ ID NO: 504003 - DNA, 20 bp, mouse
gtaaagggctcaagtcctcc

SEQ ID NO: 504004 - DNA, 20 bp, mouse
ggcgagcgcctcatccaggg

SEQ ID NO: 504005 - DNA, 20 bp, mouse
gtgcataaggcgttcataaa

SEQ ID NO: 504006 - DNA, 20 bp, mouse
gagccgaagtcgcaaaaata

SEQ ID NO: 504007 - DNA, 20 bp, mouse
ggtctataagtatggccact

SEQ ID NO: 504008 - DNA, 20 bp, mouse
gtcggcttgcagacgccaag

SEQ ID NO: 504009 - DNA, 20 bp, mouse
ggaagataagtctataagta

SEQ ID NO: 504010 - DNA, 20 bp, mouse
gctgaaaagagcctttgtgg

SEQ ID NO: 504011 - DNA, 20 bp, mouse
gggccatatttttgcgactt

SEQ ID NO: 504012 - DNA, 20 bp, mouse
ggggggatggaagggaaaca

SEQ ID NO: 504013 - DNA, 20 bp, mouse
ggcctttgtgggggatggaa

SEQ ID NO: 504014 - DNA, 20 bp, mouse
gtcccttccatcccccacaa

SEQ ID NO: 504015 - DNA, 20 bp, mouse
ggcgggcggtctgcttcgta

SEQ ID NO: 504016 - DNA, 20 bp, mouse
ggtacgggccatggcgaaga

SEQ ID NO: 504017 - DNA, 20 bp, mouse
ggacggaagacacccaaacg

SEQ ID NO: 504018 - DNA, 20 bp, mouse
gacccaaacgaggagcactc

SEQ ID NO: 504019 - DNA, 20 bp, mouse
gccccgagtgctcctcgttt

SEQ ID NO: 504020 - DNA, 20 bp, mouse
ggcactcggggacctgatac

SEQ ID NO: 504021 - DNA, 20 bp, mouse
ggtgtcttccgtcttcgcca

SEQ ID NO: 504022 - DNA, 20 bp, mouse
gacctgataccggcccgagc

SEQ ID NO: 504023 - DNA, 20 bp, mouse
gccgagccggccgcctttat

SEQ ID NO: 504024 - DNA, 20 bp, mouse
ggcctttgtggggaatggat

SEQ ID NO: 504025 - DNA, 20 bp, mouse
gggggaatggatgggagaca

SEQ ID NO: 504026 - DNA, 20 bp, mouse
ggtacgggccatggcgaaga

SEQ ID NO: 504027 - DNA, 20 bp, mouse
ggacggaagacacccaaacg

SEQ ID NO: 504028 - DNA, 20 bp, mouse
gacccaaacgaggagcactc

SEQ ID NO: 504029 - DNA, 20 bp, mouse
ggcactcggggacctgatac

SEQ ID NO: 504030 - DNA, 20 bp, mouse
gccccgagtgctcctcgttt

SEQ ID NO: 504031 - DNA, 20 bp, mouse
ggtgtcttccgtcttcgcca

SEQ ID NO: 504032 - DNA, 20 bp, mouse
gacctgataccggcccgagc

SEQ ID NO: 504033 - DNA, 20 bp, mouse
ggcctttgtggggaatggat

SEQ ID NO: 504034 - DNA, 20 bp, mouse
gggggaatggatgggagaca

SEQ ID NO: 504035 - DNA, 20 bp, mouse
ggccggctcgggccggtatc

SEQ ID NO: 504036 - DNA, 20 bp, mouse
gccatgtctggcagaggaaa

SEQ ID NO: 504037 - DNA, 20 bp, mouse
ggcgtacaccacatccatag

SEQ ID NO: 504038 - DNA, 20 bp, mouse
gagattacattagccatgtc

SEQ ID NO: 504039 - DNA, 20 bp, mouse
gcattagccatgtctggcag

SEQ ID NO: 504040 - DNA, 20 bp, mouse
gtctgaaacaccagctggtg

SEQ ID NO: 504041 - DNA, 20 bp, mouse
gccagctggtgaggcattgg

SEQ ID NO: 504042 - DNA, 20 bp, mouse
gacaccagctggtgaggcat

SEQ ID NO: 504043 - DNA, 20 bp, mouse
gagctctcctgaagagactg

SEQ ID NO: 504044 - DNA, 20 bp, mouse
gcccaccgcgccgagccagg

SEQ ID NO: 504045 - DNA, 20 bp, mouse
gaccgtcaccgctatggatg

SEQ ID NO: 504046 - DNA, 20 bp, mouse
ggttatcagtggaagatgtc

SEQ ID NO: 504047 - DNA, 20 bp, mouse
gagtggaagatgtctggtcg

SEQ ID NO: 504048 - DNA, 20 bp, mouse
ggcgtacttttggttatcag

SEQ ID NO: 504049 - DNA, 20 bp, mouse
gtcgcactaacgaccggtag

SEQ ID NO: 504050 - DNA, 20 bp, mouse
gactgctgagatcctggaat

SEQ ID NO: 504051 - DNA, 20 bp, mouse
ggggcaagtgaggcccctac

SEQ ID NO: 504052 - DNA, 20 bp, mouse
gtaagggtaattattcggag

SEQ ID NO: 504053 - DNA, 20 bp, mouse
gtggaaactgcaggccggca

SEQ ID NO: 504054 - DNA, 20 bp, mouse
gctccgtaagggtaattatt

SEQ ID NO: 504055 - DNA, 20 bp, mouse
gattacccttacggagaagg

SEQ ID NO: 504056 - DNA, 20 bp, mouse
ggagtggagcgggaaggctc

SEQ ID NO: 504057 - DNA, 20 bp, mouse
gagccagtgcagcaggatgc

SEQ ID NO: 504058 - DNA, 20 bp, mouse
gcttcggggcgggagtggag

SEQ ID NO: 504059 - DNA, 20 bp, mouse
gacccagacgaacaagcaaa

SEQ ID NO: 504060 - DNA, 20 bp, mouse
ggagagcgcccccaacccaa

SEQ ID NO: 504061 - DNA, 20 bp, mouse
gaccgtttgcttgttcgtct

SEQ ID NO: 504062 - DNA, 20 bp, mouse
gcaagcaaacggtgaaggca

SEQ ID NO: 504063 - DNA, 20 bp, mouse
gcaccttccaagctcaaaaa

SEQ ID NO: 504064 - DNA, 20 bp, mouse
ggtgaatgacaatcttattc

SEQ ID NO: 504065 - DNA, 20 bp, mouse
gctccttttttgagcttgga

SEQ ID NO: 504066 - DNA, 20 bp, mouse
gtgtcaggacgaggaaaagg

SEQ ID NO: 504067 - DNA, 20 bp, mouse
gggttgtttactaatatgtc

SEQ ID NO: 504068 - DNA, 20 bp, mouse
gaaaaggcggcaagggtctg

SEQ ID NO: 504069 - DNA, 20 bp, mouse
gatatgtcaggacgaggaaa

SEQ ID NO: 504070 - DNA, 20 bp, mouse
ggggaagccggccaagggaa

SEQ ID NO: 504071 - DNA, 20 bp, mouse
ggttgtcgcggagaaccttg

SEQ ID NO: 504072 - DNA, 20 bp, mouse
gtaccaagcccgctatccgg

SEQ ID NO: 504073 - DNA, 20 bp, mouse
gttactaatatgtcaggacg

SEQ ID NO: 504074 - DNA, 20 bp, mouse
ggccgaagccgtacagagtg

SEQ ID NO: 504075 - DNA, 20 bp, mouse
ggagactcgcggtgtcctca

SEQ ID NO: 504076 - DNA, 20 bp, mouse
gggacacccgggagaggtaa

SEQ ID NO: 504077 - DNA, 20 bp, mouse
ggccgtcctcacggacaccc

SEQ ID NO: 504078 - DNA, 20 bp, mouse
gcctcacggacacccgggag

SEQ ID NO: 504079 - DNA, 20 bp, mouse
ggcgctgccagccgtcctca

SEQ ID NO: 504080 - DNA, 20 bp, mouse
gggagggaccgagtggaacc

SEQ ID NO: 504081 - DNA, 20 bp, mouse
gagcggcctttacctctccc

SEQ ID NO: 504082 - DNA, 20 bp, mouse
ggtggaacccggcgggagag

SEQ ID NO: 504083 - DNA, 20 bp, mouse
gggaccgagtggaacccggc

SEQ ID NO: 504084 - DNA, 20 bp, mouse
gaggacggctggcagcgcga

SEQ ID NO: 504085 - DNA, 20 bp, mouse
gcggccagggcgaaggtcgg

SEQ ID NO: 504086 - DNA, 20 bp, mouse
gcaagaacaagggcaccggg

SEQ ID NO: 504087 - DNA, 20 bp, mouse
ggtcaccgcagcgcaggagg

SEQ ID NO: 504088 - DNA, 20 bp, mouse
gggaggggaggaaagccccc

SEQ ID NO: 504089 - DNA, 20 bp, mouse
gagccgccgcagcaagaaca

SEQ ID NO: 504090 - DNA, 20 bp, mouse
gggtgcccttgttcttgctg

SEQ ID NO: 504091 - DNA, 20 bp, mouse
gcggcggctgctcctcgccc

SEQ ID NO: 504092 - DNA, 20 bp, mouse
gcggccgcgagcccctcggg

SEQ ID NO: 504093 - DNA, 20 bp, mouse
ggcccttgttcttgctgcgg

SEQ ID NO: 504094 - DNA, 20 bp, mouse
gccggcagtccgggtgacag

SEQ ID NO: 504095 - DNA, 20 bp, mouse
gggtgacagcggccgaagga

SEQ ID NO: 504096 - DNA, 20 bp, mouse
ggcctctggagcaacctcag

SEQ ID NO: 504097 - DNA, 20 bp, mouse
gttacctgcgcgctccgctg

SEQ ID NO: 504098 - DNA, 20 bp, mouse
gcccggcgtgcgagcagccg

SEQ ID NO: 504099 - DNA, 20 bp, mouse
gtccgctgaggttgctccag

SEQ ID NO: 504100 - DNA, 20 bp, mouse
gcgcggacaactggtcccca

SEQ ID NO: 504101 - DNA, 20 bp, mouse
gggagacccggcgcaacccg

SEQ ID NO: 504102 - DNA, 20 bp, mouse
ggggtcctggggctgtcagt

SEQ ID NO: 504103 - DNA, 20 bp, mouse
gctggtccccagggacgcgt

SEQ ID NO: 504104 - DNA, 20 bp, mouse
gtgctcgcacgccgggcctc

SEQ ID NO: 504105 - DNA, 20 bp, mouse
gacgcgttggcgctgcggcg

SEQ ID NO: 504106 - DNA, 20 bp, mouse
gcgccatggagtctatgggt

SEQ ID NO: 504107 - DNA, 20 bp, mouse
ggagagctggtcagactccg

SEQ ID NO: 504108 - DNA, 20 bp, mouse
gtagcgaaggtaggctggga

SEQ ID NO: 504109 - DNA, 20 bp, mouse
gcttgggcgggtgcagtgcc

SEQ ID NO: 504110 - DNA, 20 bp, mouse
gccggaaacgcgggcaggat

SEQ ID NO: 504111 - DNA, 20 bp, mouse
gtgccgacccatagactcca

SEQ ID NO: 504112 - DNA, 20 bp, mouse
gggcgccccgcgcgctaata

SEQ ID NO: 504113 - DNA, 20 bp, mouse
gagcggctgatagcgaaggt

SEQ ID NO: 504114 - DNA, 20 bp, mouse
gtggcactgggccagaacag

SEQ ID NO: 504115 - DNA, 20 bp, mouse
gcccgtccacagatcaaacg

SEQ ID NO: 504116 - DNA, 20 bp, mouse
gctgctcaccagggctactg

SEQ ID NO: 504117 - DNA, 20 bp, mouse
gtgcgcggcgatcatgttga

SEQ ID NO: 504118 - DNA, 20 bp, mouse
ggcgatcatgttgacggtgg

SEQ ID NO: 504119 - DNA, 20 bp, mouse
gagcagtggtcctccagcgg

SEQ ID NO: 504120 - DNA, 20 bp, mouse
gatgttgacggtgggggatg

SEQ ID NO: 504121 - DNA, 20 bp, mouse
gctagccgggagaggccggg

SEQ ID NO: 504122 - DNA, 20 bp, mouse
ggcggcgatcatgttgacgg

SEQ ID NO: 504123 - DNA, 20 bp, mouse
gagcatctagttggactaca

SEQ ID NO: 504124 - DNA, 20 bp, mouse
gcggctagacagcatctagt

SEQ ID NO: 504125 - DNA, 20 bp, mouse
gatgatcgccgcgcaactac

SEQ ID NO: 504126 - DNA, 20 bp, mouse
gttctgctttggagatccga

SEQ ID NO: 504127 - DNA, 20 bp, mouse
gctccaaagcagaacaactc

SEQ ID NO: 504128 - DNA, 20 bp, mouse
gcaggacaccacaggctacc

SEQ ID NO: 504129 - DNA, 20 bp, mouse
gtcggcaggagtgagactta

SEQ ID NO: 504130 - DNA, 20 bp, mouse
gtcgcacctatcagagtcac

SEQ ID NO: 504131 - DNA, 20 bp, mouse
gtggagttggtgcaacaatg

SEQ ID NO: 504132 - DNA, 20 bp, mouse
gggcgtgatgctcctgccct

SEQ ID NO: 504133 - DNA, 20 bp, mouse
ggaggctcgagcgctaccga

SEQ ID NO: 504134 - DNA, 20 bp, mouse
gaacaatgtggcttattgag

SEQ ID NO: 504135 - DNA, 20 bp, mouse
gataggtgcgatcgccggat

SEQ ID NO: 504136 - DNA, 20 bp, mouse
gagttgatcaccttcctcgg

SEQ ID NO: 504137 - DNA, 20 bp, mouse
gtatcactgtggtcatattt

SEQ ID NO: 504138 - DNA, 20 bp, mouse
gaagccgagggcttgagacg

SEQ ID NO: 504139 - DNA, 20 bp, mouse
gtagccataggataagccga

SEQ ID NO: 504140 - DNA, 20 bp, mouse
gattagaggaagtgcttacc

SEQ ID NO: 504141 - DNA, 20 bp, mouse
gatcaacttctgaatctccc

SEQ ID NO: 504142 - DNA, 20 bp, mouse
gatggagacatgcccctcac

SEQ ID NO: 504143 - DNA, 20 bp, mouse
gccgcacgtgccagacgatg

SEQ ID NO: 504144 - DNA, 20 bp, mouse
gattctagagaccggtcctg

SEQ ID NO: 504145 - DNA, 20 bp, mouse
gaagccctcggcttatccta

SEQ ID NO: 504146 - DNA, 20 bp, mouse
gctcgggaacaaccgcactt

SEQ ID NO: 504147 - DNA, 20 bp, mouse
gacctccccgcccaaactag

SEQ ID NO: 504148 - DNA, 20 bp, mouse
gctgaagactcggcgctctc

SEQ ID NO: 504149 - DNA, 20 bp, mouse
gagagagtgtactgaagact

SEQ ID NO: 504150 - DNA, 20 bp, mouse
gaccagtgaatgtctcaggg

SEQ ID NO: 504151 - DNA, 20 bp, mouse
ggcctctagtttgggcgggg

SEQ ID NO: 504152 - DNA, 20 bp, mouse
gctgttgagagggagtctgt

SEQ ID NO: 504153 - DNA, 20 bp, mouse
gatgtttgcagtacacttgg

SEQ ID NO: 504154 - DNA, 20 bp, mouse
gtcctccctgagacattcac

SEQ ID NO: 504155 - DNA, 20 bp, mouse
ggtgctgcacgcctctagtt

SEQ ID NO: 504156 - DNA, 20 bp, mouse
gccagcgcgcccacaggtac

SEQ ID NO: 504157 - DNA, 20 bp, mouse
ggcgtcggcgagagccaggt

SEQ ID NO: 504158 - DNA, 20 bp, mouse
gctgtgctacctgtacctgt

SEQ ID NO: 504159 - DNA, 20 bp, mouse
ggctggtgctgtccacggtg

SEQ ID NO: 504160 - DNA, 20 bp, mouse
ggccgcgcggcagaaggtga

SEQ ID NO: 504161 - DNA, 20 bp, mouse
gtgcaggaccggagacacca

SEQ ID NO: 504162 - DNA, 20 bp, mouse
gacagcgtgatgagcatggc

SEQ ID NO: 504163 - DNA, 20 bp, mouse
ggccgcgctggtgctgtcca

SEQ ID NO: 504164 - DNA, 20 bp, mouse
gcgcgcgtgtgcctgagcca

SEQ ID NO: 504165 - DNA, 20 bp, mouse
ggtgcccccttcccagtgag

SEQ ID NO: 504166 - DNA, 20 bp, mouse
gtctcagtgcgatcaccctg

SEQ ID NO: 504167 - DNA, 20 bp, mouse
ggtgcgatcaccctgcggag

SEQ ID NO: 504168 - DNA, 20 bp, mouse
gtacctcgcagccctgagcg

SEQ ID NO: 504169 - DNA, 20 bp, mouse
gcgcagtggtggtggaccaa

SEQ ID NO: 504170 - DNA, 20 bp, mouse
gcgaggtaagcgaggcgccg

SEQ ID NO: 504171 - DNA, 20 bp, mouse
gcccccggatgaggacccac

SEQ ID NO: 504172 - DNA, 20 bp, mouse
gtccccgacacccgccgccg

SEQ ID NO: 504173 - DNA, 20 bp, mouse
gagccgcgctcagggctgcg

SEQ ID NO: 504174 - DNA, 20 bp, mouse
ggaccaagggcccccggatg

SEQ ID NO: 504175 - DNA, 20 bp, mouse
gcgcggctgcccgctccgca

SEQ ID NO: 504176 - DNA, 20 bp, mouse
ggtcactcttgtcagggcag

SEQ ID NO: 504177 - DNA, 20 bp, mouse
gcctgacgtcactcttgtca

SEQ ID NO: 504178 - DNA, 20 bp, mouse
gcccctcgcgcgagcaccgg

SEQ ID NO: 504179 - DNA, 20 bp, mouse
gttgtcagggcagcggcaca

SEQ ID NO: 504180 - DNA, 20 bp, mouse
gactgggtcggaggagtccg

SEQ ID NO: 504181 - DNA, 20 bp, mouse
gtctcagtgccgacagtcca

SEQ ID NO: 504182 - DNA, 20 bp, mouse
gttgcaagactgagtgttgg

SEQ ID NO: 504183 - DNA, 20 bp, mouse
gagtgccgacagtccaggga

SEQ ID NO: 504184 - DNA, 20 bp, mouse
ggactcctccgacccagtgc

SEQ ID NO: 504185 - DNA, 20 bp, mouse
gcgctgctccccgcgctccg

SEQ ID NO: 504186 - DNA, 20 bp, mouse
gaaagggctcaagccagagg

SEQ ID NO: 504187 - DNA, 20 bp, mouse
gagccacggttgcctaggga

SEQ ID NO: 504188 - DNA, 20 bp, mouse
gtccaagccacggttgccta

SEQ ID NO: 504189 - DNA, 20 bp, mouse
ggtcactgtgataacaccaa

SEQ ID NO: 504190 - DNA, 20 bp, mouse
gtaagtctcaaaccttccct

SEQ ID NO: 504191 - DNA, 20 bp, mouse
gtggagctaaggagacgggt

SEQ ID NO: 504192 - DNA, 20 bp, mouse
gggcttggagctaaggagac

SEQ ID NO: 504193 - DNA, 20 bp, mouse
gaaccttccctaggcaaccg

SEQ ID NO: 504194 - DNA, 20 bp, mouse
gccggtgctctcttcccggt

SEQ ID NO: 504195 - DNA, 20 bp, mouse
ggctctcttcccggtgggag

SEQ ID NO: 504196 - DNA, 20 bp, mouse
ggtggacacgtctcaccggg

SEQ ID NO: 504197 - DNA, 20 bp, mouse
gtggtgtggacacgtctcac

SEQ ID NO: 504198 - DNA, 20 bp, mouse
gacgtctcaccgggcggacg

SEQ ID NO: 504199 - DNA, 20 bp, mouse
gcggcaagcgacccgcagaa

SEQ ID NO: 504200 - DNA, 20 bp, mouse
gcggcctggcggttctgatt

SEQ ID NO: 504201 - DNA, 20 bp, mouse
gaaagctcctcaaggcgtcg

SEQ ID NO: 504202 - DNA, 20 bp, mouse
gctcgtgaacgtataggaca

SEQ ID NO: 504203 - DNA, 20 bp, mouse
ggccgatcgcagaacgtcac

SEQ ID NO: 504204 - DNA, 20 bp, mouse
gcctcaaggcgtcgtggccc

SEQ ID NO: 504205 - DNA, 20 bp, mouse
ggcgaacagtgggataacat

SEQ ID NO: 504206 - DNA, 20 bp, mouse
gcgcagaagccggggagaca

SEQ ID NO: 504207 - DNA, 20 bp, mouse
gcccgccgaggagcagtagg

SEQ ID NO: 504208 - DNA, 20 bp, mouse
gggagccctagcgccaccga

SEQ ID NO: 504209 - DNA, 20 bp, mouse
gtgctactccgcagaagccg

SEQ ID NO: 504210 - DNA, 20 bp, mouse
gctagcgccaccgagggacg

SEQ ID NO: 504211 - DNA, 20 bp, mouse
ggccaggcgctggggcgaca

SEQ ID NO: 504212 - DNA, 20 bp, mouse
gccctcgcctcgtccctcgg

SEQ ID NO: 504213 - DNA, 20 bp, mouse
gaagccaggggcccaggccg

SEQ ID NO: 504214 - DNA, 20 bp, mouse
ggcctttcaagccaagccag

SEQ ID NO: 504215 - DNA, 20 bp, mouse
gaggccggctgcgaacatcc

SEQ ID NO: 504216 - DNA, 20 bp, mouse
gcccagtgcaaggctgaggg

SEQ ID NO: 504217 - DNA, 20 bp, mouse
ggctgttgctatcaatatgg

SEQ ID NO: 504218 - DNA, 20 bp, mouse
ggtgagtaggcgccacagat

SEQ ID NO: 504219 - DNA, 20 bp, mouse
gcgtcccagtgcaaggctga

SEQ ID NO: 504220 - DNA, 20 bp, mouse
gtactccagagacccatctg

SEQ ID NO: 504221 - DNA, 20 bp, mouse
ggcactgggacgctggggag

SEQ ID NO: 504222 - DNA, 20 bp, mouse
gggggctgttgctatcaata

SEQ ID NO: 504223 - DNA, 20 bp, mouse
ggcgcaggaagagcctaggg

SEQ ID NO: 504224 - DNA, 20 bp, mouse
gtctgatgtgattgagacaa

SEQ ID NO: 504225 - DNA, 20 bp, mouse
gagtaggggtacttccgagg

SEQ ID NO: 504226 - DNA, 20 bp, mouse
gtccagagaagcaagaccag

SEQ ID NO: 504227 - DNA, 20 bp, mouse
gttgcttctctggatcccgt

SEQ ID NO: 504228 - DNA, 20 bp, mouse
gaggagggcagaaggtacca

SEQ ID NO: 504229 - DNA, 20 bp, mouse
gttctctggatcccgtagga

SEQ ID NO: 504230 - DNA, 20 bp, mouse
ggctgtaataggatctgttg

SEQ ID NO: 504231 - DNA, 20 bp, mouse
gccagaggaaaagctgtaat

SEQ ID NO: 504232 - DNA, 20 bp, mouse
gaaggagagactcccaggac

SEQ ID NO: 504233 - DNA, 20 bp, mouse
gagatgagggtgattcgagt

SEQ ID NO: 504234 - DNA, 20 bp, mouse
gtacagagaagggactctca

SEQ ID NO: 504235 - DNA, 20 bp, mouse
gctggtccttgaatcttcct

SEQ ID NO: 504236 - DNA, 20 bp, mouse
gctgcagccggagtgaagtg

SEQ ID NO: 504237 - DNA, 20 bp, mouse
gctgggccggccgggactga

SEQ ID NO: 504238 - DNA, 20 bp, mouse
ggccgggactgaaggcacat

SEQ ID NO: 504239 - DNA, 20 bp, mouse
gccgagcccgcacttcactc

SEQ ID NO: 504240 - DNA, 20 bp, mouse
ggcaccgccccgttgaggga

SEQ ID NO: 504241 - DNA, 20 bp, mouse
gagacaccaggggaccgcag

SEQ ID NO: 504242 - DNA, 20 bp, mouse
gcggcttctgcagacaccag

SEQ ID NO: 504243 - DNA, 20 bp, mouse
gctgcagaagccggcgacct

SEQ ID NO: 504244 - DNA, 20 bp, mouse
gagaagccggcgacctgggc

SEQ ID NO: 504245 - DNA, 20 bp, mouse
gctacagggatggaatccca

SEQ ID NO: 504246 - DNA, 20 bp, mouse
gggacgctagctgcgaggaa

SEQ ID NO: 504247 - DNA, 20 bp, mouse
gcgctagctgcgaggaaggg

SEQ ID NO: 504248 - DNA, 20 bp, mouse
gggtggactagaccctcggg

SEQ ID NO: 504249 - DNA, 20 bp, mouse
gaagggtggactagaccctc

SEQ ID NO: 504250 - DNA, 20 bp, mouse
ggcgtcctctcaccgcccga

SEQ ID NO: 504251 - DNA, 20 bp, mouse
gggttaccgaggagcgggac

SEQ ID NO: 504252 - DNA, 20 bp, mouse
ggggacgggcgtctcttagg

SEQ ID NO: 504253 - DNA, 20 bp, mouse
gagcgggacgggcgtctctt

SEQ ID NO: 504254 - DNA, 20 bp, mouse
gggcggaagagaggacccgg

SEQ ID NO: 504255 - DNA, 20 bp, mouse
gaggctccagctcggaacgt

SEQ ID NO: 504256 - DNA, 20 bp, mouse
gaggctcgcagcgtccccca

SEQ ID NO: 504257 - DNA, 20 bp, mouse
gctagctgtggaaagttggg

SEQ ID NO: 504258 - DNA, 20 bp, mouse
ggagcgcggggtccatgccc

SEQ ID NO: 504259 - DNA, 20 bp, mouse
gaggcagccgggctccgggt

SEQ ID NO: 504260 - DNA, 20 bp, mouse
gcagtcgctggcctggagcg

SEQ ID NO: 504261 - DNA, 20 bp, mouse
ggcctgatgaggcaccagag

SEQ ID NO: 504262 - DNA, 20 bp, mouse
gggagtcccatctccagcta

SEQ ID NO: 504263 - DNA, 20 bp, mouse
ggccgagcgcccgcagagcg

SEQ ID NO: 504264 - DNA, 20 bp, mouse
ggtaggtcctgggctctaag

SEQ ID NO: 504265 - DNA, 20 bp, mouse
gactcctcaacagcaggcag

SEQ ID NO: 504266 - DNA, 20 bp, mouse
gcgacctgcgggtcccatca

SEQ ID NO: 504267 - DNA, 20 bp, mouse
gcggaggctgcagccctgat

SEQ ID NO: 504268 - DNA, 20 bp, mouse
gcagccctgatgggacccgc

SEQ ID NO: 504269 - DNA, 20 bp, mouse
gaggcgtcatggtgagccgg

SEQ ID NO: 504270 - DNA, 20 bp, mouse
gtagcgggttcaccggacag

SEQ ID NO: 504271 - DNA, 20 bp, mouse
gcgcctcgggctcccaccag

SEQ ID NO: 504272 - DNA, 20 bp, mouse
gagctgcgccccaggcgtca

SEQ ID NO: 504273 - DNA, 20 bp, mouse
gtagagatcgccacgagcag

SEQ ID NO: 504274 - DNA, 20 bp, mouse
gctcgctctagcgggttcac

SEQ ID NO: 504275 - DNA, 20 bp, mouse
gacatcgaagacgaaggcta

SEQ ID NO: 504276 - DNA, 20 bp, mouse
ggagtgaaggcgattgcgag

SEQ ID NO: 504277 - DNA, 20 bp, mouse
gggaattgtcctctgtgcaa

SEQ ID NO: 504278 - DNA, 20 bp, mouse
gctgtcaagctgtgagacga

SEQ ID NO: 504279 - DNA, 20 bp, mouse
gacgacggagtgaagagtga

SEQ ID NO: 504280 - DNA, 20 bp, mouse
ggtgaggcgcccccattcag

SEQ ID NO: 504281 - DNA, 20 bp, mouse
gggcgattgcgaggggctga

SEQ ID NO: 504282 - DNA, 20 bp, mouse
gatgaaagtcccttgcacag

SEQ ID NO: 504283 - DNA, 20 bp, mouse
ggtaagcaagacgagcatgg

SEQ ID NO: 504284 - DNA, 20 bp, mouse
gagggagacatgctgtcata

SEQ ID NO: 504285 - DNA, 20 bp, mouse
gcacttagtcacctccagat

SEQ ID NO: 504286 - DNA, 20 bp, mouse
gagggacaggacaggatcag

SEQ ID NO: 504287 - DNA, 20 bp, mouse
gttgcgagatcgagtcccgg

SEQ ID NO: 504288 - DNA, 20 bp, mouse
gcccgggaaagttttttcag

SEQ ID NO: 504289 - DNA, 20 bp, mouse
gggaagtccgggcctgcgcg

SEQ ID NO: 504290 - DNA, 20 bp, mouse
gtcgccgcgtctcaggtccc

SEQ ID NO: 504291 - DNA, 20 bp, mouse
gagaagccggcaaaggtcag

SEQ ID NO: 504292 - DNA, 20 bp, mouse
gcctgcggttcccatcgagg

SEQ ID NO: 504293 - DNA, 20 bp, mouse
gccggggcggggaggtcctc

SEQ ID NO: 504294 - DNA, 20 bp, mouse
ggacatgtccaggagtaccc

SEQ ID NO: 504295 - DNA, 20 bp, mouse
ggggaggcgcactcacgcgg

SEQ ID NO: 504296 - DNA, 20 bp, mouse
ggggctgcgctcctctaatt

SEQ ID NO: 504297 - DNA, 20 bp, mouse
ggcccctcgccatcctccag

SEQ ID NO: 504298 - DNA, 20 bp, mouse
ggcccgtcccccctgcccct

SEQ ID NO: 504299 - DNA, 20 bp, mouse
gtcccctggaggatggcgag

SEQ ID NO: 504300 - DNA, 20 bp, mouse
gaggagcgcagccccggctc

SEQ ID NO: 504301 - DNA, 20 bp, mouse
gtttaagctcccctgagccg

SEQ ID NO: 504302 - DNA, 20 bp, mouse
ggtgtgtcacatccgagctg

SEQ ID NO: 504303 - DNA, 20 bp, mouse
gaaagaagccacccgagcgg

SEQ ID NO: 504304 - DNA, 20 bp, mouse
gcttaaaaagagcgacccag

SEQ ID NO: 504305 - DNA, 20 bp, mouse
gccgggcggcgcgcacgcag

SEQ ID NO: 504306 - DNA, 20 bp, mouse
gcacacagtgagtgccttct

SEQ ID NO: 504307 - DNA, 20 bp, mouse
gacaagagtcgcctctaatt

SEQ ID NO: 504308 - DNA, 20 bp, mouse
gggagctgtggtgactttcc

SEQ ID NO: 504309 - DNA, 20 bp, mouse
ggtgactttccgggtcttgg

SEQ ID NO: 504310 - DNA, 20 bp, mouse
ggtggtgactttccgggtct

SEQ ID NO: 504311 - DNA, 20 bp, mouse
gactcttgtaaatctaagca

SEQ ID NO: 504312 - DNA, 20 bp, mouse
gctccagggaggaaaccaag

SEQ ID NO: 504313 - DNA, 20 bp, mouse
gcctccggtgagtcctggga

SEQ ID NO: 504314 - DNA, 20 bp, mouse
ggctgccccacacatagaga

SEQ ID NO: 504315 - DNA, 20 bp, mouse
gcaaagggaagcaagaataa

SEQ ID NO: 504316 - DNA, 20 bp, mouse
gggacgtccggtgttgatgg

SEQ ID NO: 504317 - DNA, 20 bp, mouse
gaagcagcagcagtagtccc

SEQ ID NO: 504318 - DNA, 20 bp, mouse
gcgagctggcgagtgcgccg

SEQ ID NO: 504319 - DNA, 20 bp, mouse
gatcaacaccggacgtccag

SEQ ID NO: 504320 - DNA, 20 bp, mouse
ggcagcggcggtaccggtag

SEQ ID NO: 504321 - DNA, 20 bp, mouse
ggcggtaccggtagaggcag

SEQ ID NO: 504322 - DNA, 20 bp, mouse
gcggctgccaaaaagagaga

SEQ ID NO: 504323 - DNA, 20 bp, mouse
gcgcttctgtggcaccgggg

SEQ ID NO: 504324 - DNA, 20 bp, mouse
gttggcagccgctggacgtc

SEQ ID NO: 504325 - DNA, 20 bp, mouse
gccggagcgcgggagcgcag

SEQ ID NO: 504326 - DNA, 20 bp, mouse
gggagagtaatgttacagag

SEQ ID NO: 504327 - DNA, 20 bp, mouse
gcgggtcaggctccacacaa

SEQ ID NO: 504328 - DNA, 20 bp, mouse
gcagccagcgcgcctcctat

SEQ ID NO: 504329 - DNA, 20 bp, mouse
gggaacacgaacacacacac

SEQ ID NO: 504330 - DNA, 20 bp, mouse
gcgccgcgggtgtgaagtgg

SEQ ID NO: 504331 - DNA, 20 bp, mouse
gcggcgccgcgggtgtgaag

SEQ ID NO: 504332 - DNA, 20 bp, mouse
gtagccaataggaggcgcgc

SEQ ID NO: 504333 - DNA, 20 bp, mouse
gccgtgcgcagttcccccca

SEQ ID NO: 504334 - DNA, 20 bp, mouse
ggcggcggggagagcgcctc

SEQ ID NO: 504335 - DNA, 20 bp, mouse
gtccacacaaaggcaaatga

SEQ ID NO: 504336 - DNA, 20 bp, mouse
gactcggagaaacttcagac

SEQ ID NO: 504337 - DNA, 20 bp, mouse
gatctcggggccaaagcgat

SEQ ID NO: 504338 - DNA, 20 bp, mouse
gagagcagaaacgcatctcg

SEQ ID NO: 504339 - DNA, 20 bp, mouse
gacaggcctaggagagcagg

SEQ ID NO: 504340 - DNA, 20 bp, mouse
gaggaaactgcggcctctcc

SEQ ID NO: 504341 - DNA, 20 bp, mouse
gccgcagtttcctatcgctt

SEQ ID NO: 504342 - DNA, 20 bp, mouse
gaaagtgtgatctcaagagt

SEQ ID NO: 504343 - DNA, 20 bp, mouse
gtgatctcaagagtaggcac

SEQ ID NO: 504344 - DNA, 20 bp, mouse
gttaagagaattacaggcct

SEQ ID NO: 504345 - DNA, 20 bp, mouse
ggatgagggcataggacaca

SEQ ID NO: 504346 - DNA, 20 bp, mouse
gatcagagcggagggaggtg

SEQ ID NO: 504347 - DNA, 20 bp, mouse
gtggtctggtcaagttgccg

SEQ ID NO: 504348 - DNA, 20 bp, mouse
gtgagggccggggccatgga

SEQ ID NO: 504349 - DNA, 20 bp, mouse
ggggaggtgtggcccgcgac

SEQ ID NO: 504350 - DNA, 20 bp, mouse
gagccaatcagagcggaggg

SEQ ID NO: 504351 - DNA, 20 bp, mouse
gcttaacgcgtagacgtggg

SEQ ID NO: 504352 - DNA, 20 bp, mouse
gcggcttcggcggctttaga

SEQ ID NO: 504353 - DNA, 20 bp, mouse
gcggccctcacccaaagact

SEQ ID NO: 504354 - DNA, 20 bp, mouse
ggtgtggcccgcgactggtc

SEQ ID NO: 504355 - DNA, 20 bp, mouse
gaagccgccacgccgaagcc

SEQ ID NO: 504356 - DNA, 20 bp, mouse
ggcgcgggcggaaagttgtg

SEQ ID NO: 504357 - DNA, 20 bp, mouse
ggctcggcgggcgcccccag

SEQ ID NO: 504358 - DNA, 20 bp, mouse
gtagcgtggcgagcgagagg

SEQ ID NO: 504359 - DNA, 20 bp, mouse
gccagactagcgaacaatac

SEQ ID NO: 504360 - DNA, 20 bp, mouse
ggagcgcggctccacgtaga

SEQ ID NO: 504361 - DNA, 20 bp, mouse
gcaggtctcggccctctacg

SEQ ID NO: 504362 - DNA, 20 bp, mouse
ggcaggcactggaaaagttg

SEQ ID NO: 504363 - DNA, 20 bp, mouse
ggccaggctgctgcccctgg

SEQ ID NO: 504364 - DNA, 20 bp, mouse
gaagcagcaggctggagcgc

SEQ ID NO: 504365 - DNA, 20 bp, mouse
gaggcggctgcgggctctgg

SEQ ID NO: 504366 - DNA, 20 bp, mouse
gacccgaggagcaatctaga

SEQ ID NO: 504367 - DNA, 20 bp, mouse
gggaaatttcaccataagta

SEQ ID NO: 504368 - DNA, 20 bp, mouse
gctagaaggtgccctactta

SEQ ID NO: 504369 - DNA, 20 bp, mouse
gtcgctggaccctgctgatc

SEQ ID NO: 504370 - DNA, 20 bp, mouse
gaccttctagattgctcctc

SEQ ID NO: 504371 - DNA, 20 bp, mouse
gcactgaaaaggctgggccc

SEQ ID NO: 504372 - DNA, 20 bp, mouse
gtcccgggagaagagcagga

SEQ ID NO: 504373 - DNA, 20 bp, mouse
gaaggccaccagcactgaaa

SEQ ID NO: 504374 - DNA, 20 bp, mouse
gggtccagcgaaggacatta

SEQ ID NO: 504375 - DNA, 20 bp, mouse
gatttctgtctctgcacccg

SEQ ID NO: 504376 - DNA, 20 bp, mouse
gagtgaggaaggctttcccg

SEQ ID NO: 504377 - DNA, 20 bp, mouse
gggagcacttacagcccgga

SEQ ID NO: 504378 - DNA, 20 bp, mouse
gctttcccgcggaggctggt

SEQ ID NO: 504379 - DNA, 20 bp, mouse
gagtgaagatggcgtcagtg

SEQ ID NO: 504380 - DNA, 20 bp, mouse
gtcaagcccaccagcctccg

SEQ ID NO: 504381 - DNA, 20 bp, mouse
ggtgggcttgacgtccctcc

SEQ ID NO: 504382 - DNA, 20 bp, mouse
gctccggaggccaacccact

SEQ ID NO: 504383 - DNA, 20 bp, mouse
gttggcctccggagtgaaga

SEQ ID NO: 504384 - DNA, 20 bp, mouse
ggaggaaggctttcccgcgg

SEQ ID NO: 504385 - DNA, 20 bp, mouse
gggagtcagggtcaccgtaa

SEQ ID NO: 504386 - DNA, 20 bp, mouse
gctctggagcggagactcag

SEQ ID NO: 504387 - DNA, 20 bp, mouse
gtgggcggtgctggatccca

SEQ ID NO: 504388 - DNA, 20 bp, mouse
ggcagcctaggtgccgtggg

SEQ ID NO: 504389 - DNA, 20 bp, mouse
gagcaccgcccacggcacct

SEQ ID NO: 504390 - DNA, 20 bp, mouse
ggcaggaccctggcttacag

SEQ ID NO: 504391 - DNA, 20 bp, mouse
ggcagcagcctaggtgccgt

SEQ ID NO: 504392 - DNA, 20 bp, mouse
gccgagagccgggtgagagc

SEQ ID NO: 504393 - DNA, 20 bp, mouse
gcggtgctggatcccacggc

SEQ ID NO: 504394 - DNA, 20 bp, mouse
ggcagtgcagctcggacccc

SEQ ID NO: 504395 - DNA, 20 bp, mouse
gctcacccggctctcggctc

SEQ ID NO: 504396 - DNA, 20 bp, mouse
ggctcacctccggatctcaa

SEQ ID NO: 504397 - DNA, 20 bp, mouse
ggcgtccgccagctcacctc

SEQ ID NO: 504398 - DNA, 20 bp, mouse
gcacctccggatctcaatgg

SEQ ID NO: 504399 - DNA, 20 bp, mouse
gcagccaacggagccccggg

SEQ ID NO: 504400 - DNA, 20 bp, mouse
ggggctccgttggctggaga

SEQ ID NO: 504401 - DNA, 20 bp, mouse
gctggagacggcagctgggc

SEQ ID NO: 504402 - DNA, 20 bp, mouse
gggcctccattgagatccgg

SEQ ID NO: 504403 - DNA, 20 bp, mouse
gcggcggccagggaacccgt

SEQ ID NO: 504404 - DNA, 20 bp, mouse
gcttccgcccggggctccgt

SEQ ID NO: 504405 - DNA, 20 bp, mouse
gcgggagccctagagaacaa

SEQ ID NO: 504406 - DNA, 20 bp, mouse
ggcgcgggacactcacccaa

SEQ ID NO: 504407 - DNA, 20 bp, mouse
gcgcggggccggccagccaa

SEQ ID NO: 504408 - DNA, 20 bp, mouse
ggctgggagcgagcttgtgt

SEQ ID NO: 504409 - DNA, 20 bp, mouse
gagccgggtcccggaggatg

SEQ ID NO: 504410 - DNA, 20 bp, mouse
gggcgtgagccgggtcccgg

SEQ ID NO: 504411 - DNA, 20 bp, mouse
ggtggagtccgggtcccctc

SEQ ID NO: 504412 - DNA, 20 bp, mouse
ggtgcctgtgaccaccgaag

SEQ ID NO: 504413 - DNA, 20 bp, mouse
gtttgctcgttcttcttcca

SEQ ID NO: 504414 - DNA, 20 bp, mouse
ggcgtcccgccggcgcacag

SEQ ID NO: 504415 - DNA, 20 bp, mouse
gaagaagaacgagcaaagca

SEQ ID NO: 504416 - DNA, 20 bp, mouse
gcgttgggcatctctcccaa

SEQ ID NO: 504417 - DNA, 20 bp, mouse
gagcccaacccagaatcgtt

SEQ ID NO: 504418 - DNA, 20 bp, mouse
ggctctcagcagcccagcag

SEQ ID NO: 504419 - DNA, 20 bp, mouse
gcccaagggctgtggactgc

SEQ ID NO: 504420 - DNA, 20 bp, mouse
ggccagcagtccacagccct

SEQ ID NO: 504421 - DNA, 20 bp, mouse
gactcccagacaagcaccgt

SEQ ID NO: 504422 - DNA, 20 bp, mouse
gcttgcaggacccgcctcgc

SEQ ID NO: 504423 - DNA, 20 bp, mouse
gctgctgagagcaggtgagc

SEQ ID NO: 504424 - DNA, 20 bp, mouse
ggtccccacggtgcttgtct

SEQ ID NO: 504425 - DNA, 20 bp, mouse
gcgtggggaccagtaaaacg

SEQ ID NO: 504426 - DNA, 20 bp, mouse
gggctgcggagagaaagacg

SEQ ID NO: 504427 - DNA, 20 bp, mouse
gcgcagggttcgggtctgag

SEQ ID NO: 504428 - DNA, 20 bp, mouse
ggatggagccgccaaggcgg

SEQ ID NO: 504429 - DNA, 20 bp, mouse
gcccgcactcacctccgcct

SEQ ID NO: 504430 - DNA, 20 bp, mouse
ggatccgcccggcccacccg

SEQ ID NO: 504431 - DNA, 20 bp, mouse
gaaaaggccgcgggaaaggt

SEQ ID NO: 504432 - DNA, 20 bp, mouse
ggccaaggcggaggtgagtg

SEQ ID NO: 504433 - DNA, 20 bp, mouse
gaatcttcgcggggtgcggg

SEQ ID NO: 504434 - DNA, 20 bp, mouse
gggaccgagcgcggtactta

SEQ ID NO: 504435 - DNA, 20 bp, mouse
gtccatccgcgctaacctgc

SEQ ID NO: 504436 - DNA, 20 bp, mouse
gccccaactgggccaatgag

SEQ ID NO: 504437 - DNA, 20 bp, mouse
gcgctcgcccgcgggaggaa

SEQ ID NO: 504438 - DNA, 20 bp, mouse
gcgggactcggcggtaggtc

SEQ ID NO: 504439 - DNA, 20 bp, mouse
gtcgccccgcagccggactc

SEQ ID NO: 504440 - DNA, 20 bp, mouse
gggcgacgggaggtgaaatc

SEQ ID NO: 504441 - DNA, 20 bp, mouse
ggccccggaccggttagaac

SEQ ID NO: 504442 - DNA, 20 bp, mouse
gcatattggaggctcggtgg

SEQ ID NO: 504443 - DNA, 20 bp, mouse
ggtagcaggaggagccatgt

SEQ ID NO: 504444 - DNA, 20 bp, mouse
gcgggcgccagaagccatat

SEQ ID NO: 504445 - DNA, 20 bp, mouse
gcgaggttccagcccgagtc

SEQ ID NO: 504446 - DNA, 20 bp, mouse
gaggaagcggaggtgcaggt

SEQ ID NO: 504447 - DNA, 20 bp, mouse
gattgcgggagtagcagcag

SEQ ID NO: 504448 - DNA, 20 bp, mouse
ggcgatgcgcctaataactc

SEQ ID NO: 504449 - DNA, 20 bp, mouse
ggggccgcctggcacactgc

SEQ ID NO: 504450 - DNA, 20 bp, mouse
gggctagccgagcccattgc

SEQ ID NO: 504451 - DNA, 20 bp, mouse
gaggtgcaggtcggagaggc

SEQ ID NO: 504452 - DNA, 20 bp, mouse
gggcgagcgaggtcagcaac

SEQ ID NO: 504453 - DNA, 20 bp, mouse
ggcaatgagaggagtctccc

SEQ ID NO: 504454 - DNA, 20 bp, mouse
gaggggaggacgtccctgga

SEQ ID NO: 504455 - DNA, 20 bp, mouse
gggagaggggaggacgtccc

SEQ ID NO: 504456 - DNA, 20 bp, mouse
gagtcgctcgcggagcggtc

SEQ ID NO: 504457 - DNA, 20 bp, mouse
gaactcagtcgctcgcggag

SEQ ID NO: 504458 - DNA, 20 bp, mouse
gtgaatggaaggcgagggaa

SEQ ID NO: 504459 - DNA, 20 bp, mouse
gtgtcctgaatggaaggcga

SEQ ID NO: 504460 - DNA, 20 bp, mouse
gtggcgctggaagtgtggtt

SEQ ID NO: 504461 - DNA, 20 bp, mouse
gttgaaaactcagtcgctcg

SEQ ID NO: 504462 - DNA, 20 bp, mouse
gggagaagagttctccaata

SEQ ID NO: 504463 - DNA, 20 bp, mouse
gtctccaatagggtaagcgg

SEQ ID NO: 504464 - DNA, 20 bp, mouse
gaatagggtaagcggaggaa

SEQ ID NO: 504465 - DNA, 20 bp, mouse
gttatgatgtcctgaatgga

SEQ ID NO: 504466 - DNA, 20 bp, mouse
ggggtctccctggcgatcag

SEQ ID NO: 504467 - DNA, 20 bp, mouse
ggcaaggacacgagtctccg

SEQ ID NO: 504468 - DNA, 20 bp, mouse
gtcgccagggagacccgtcc

SEQ ID NO: 504469 - DNA, 20 bp, mouse
gccgccgggacgggtctccc

SEQ ID NO: 504470 - DNA, 20 bp, mouse
gcgtggcaccggcgcgctgg

SEQ ID NO: 504471 - DNA, 20 bp, mouse
gcggcaccggggctcgacag

SEQ ID NO: 504472 - DNA, 20 bp, mouse
gcagggagcgaaagggactg

SEQ ID NO: 504473 - DNA, 20 bp, mouse
ggcagcgcgactcggactca

SEQ ID NO: 504474 - DNA, 20 bp, mouse
gggccccgcccggcgacaca

SEQ ID NO: 504475 - DNA, 20 bp, mouse
ggcctctgccaccagcgcgc

SEQ ID NO: 504476 - DNA, 20 bp, mouse
ggcgagccgagtgaaggtag

SEQ ID NO: 504477 - DNA, 20 bp, mouse
gatccgagcgagccgagtga

SEQ ID NO: 504478 - DNA, 20 bp, mouse
gccaagatggcggccgtcgg

SEQ ID NO: 504479 - DNA, 20 bp, mouse
gccccggagcgcccagacag

SEQ ID NO: 504480 - DNA, 20 bp, mouse
ggctcgccgctaccttcact

SEQ ID NO: 504481 - DNA, 20 bp, mouse
ggtccggacgggtctggtgg

SEQ ID NO: 504482 - DNA, 20 bp, mouse
gtgcgctctgggctcgactg

SEQ ID NO: 504483 - DNA, 20 bp, mouse
gcccgcctcagcgccgccga

SEQ ID NO: 504484 - DNA, 20 bp, mouse
gagaaaagcgcgagcaacaa

SEQ ID NO: 504485 - DNA, 20 bp, mouse
gcgctcgagccccttccccg

SEQ ID NO: 504486 - DNA, 20 bp, mouse
gtaacactggctacctacaa

SEQ ID NO: 504487 - DNA, 20 bp, mouse
gaggtagccagtgttactaa

SEQ ID NO: 504488 - DNA, 20 bp, mouse
gtggttacctgaagttgtct

SEQ ID NO: 504489 - DNA, 20 bp, mouse
gagttgtctgggcacttcta

SEQ ID NO: 504490 - DNA, 20 bp, mouse
ggccagtgttactaaaggac

SEQ ID NO: 504491 - DNA, 20 bp, mouse
ggaagtgcccagacaacttc

SEQ ID NO: 504492 - DNA, 20 bp, mouse
gaccagtcctttagtaacac

SEQ ID NO: 504493 - DNA, 20 bp, mouse
ggaacgcagctccaaggagg

SEQ ID NO: 504494 - DNA, 20 bp, mouse
gtaacagtacctcatcgggt

SEQ ID NO: 504495 - DNA, 20 bp, mouse
gggccacgaacgcagctcca

SEQ ID NO: 504496 - DNA, 20 bp, mouse
gggacaggcgggcaacggca

SEQ ID NO: 504497 - DNA, 20 bp, mouse
gagtggccctaggtgaggac

SEQ ID NO: 504498 - DNA, 20 bp, mouse
gaggcgggcaacggcagggt

SEQ ID NO: 504499 - DNA, 20 bp, mouse
gaacggcagggtgggagtct

SEQ ID NO: 504500 - DNA, 20 bp, mouse
ggccctaggtgaggacaggc

SEQ ID NO: 504501 - DNA, 20 bp, mouse
gggtgaggacaggcgggcaa

SEQ ID NO: 504502 - DNA, 20 bp, mouse
ggtctcagtcctgcaactcc

SEQ ID NO: 504503 - DNA, 20 bp, mouse
ggcccgcctgtcctcaccta

SEQ ID NO: 504504 - DNA, 20 bp, mouse
gagcctgcaccaggagttgc

SEQ ID NO: 504505 - DNA, 20 bp, mouse
gacagcctgtggtcactgat

SEQ ID NO: 504506 - DNA, 20 bp, mouse
ggcgagctgacagtttgctg

SEQ ID NO: 504507 - DNA, 20 bp, mouse
gggtcattgaatctcttcag

SEQ ID NO: 504508 - DNA, 20 bp, mouse
gtgctgtctcatctggaccc

SEQ ID NO: 504509 - DNA, 20 bp, mouse
gtggttagcgcagtgtggga

SEQ ID NO: 504510 - DNA, 20 bp, mouse
gaaaggacattctgacgcct

SEQ ID NO: 504511 - DNA, 20 bp, mouse
gcgagtggaaaagaatccgt

SEQ ID NO: 504512 - DNA, 20 bp, mouse
gatctcttcaggggcgcctt

SEQ ID NO: 504513 - DNA, 20 bp, mouse
ggtgtgggatggtagagacg

SEQ ID NO: 504514 - DNA, 20 bp, mouse
gccacccgtacgtacccgaa

SEQ ID NO: 504515 - DNA, 20 bp, mouse
gtgacccttcgggtacgtac

SEQ ID NO: 504516 - DNA, 20 bp, mouse
ggcgggcaggctccactcac

SEQ ID NO: 504517 - DNA, 20 bp, mouse
gctccgggctatgctcgaga

SEQ ID NO: 504518 - DNA, 20 bp, mouse
ggctcgagacggctctgcgc

SEQ ID NO: 504519 - DNA, 20 bp, mouse
gtagctacaggtagactggg

SEQ ID NO: 504520 - DNA, 20 bp, mouse
gttgtatgcggaaactctgg

SEQ ID NO: 504521 - DNA, 20 bp, mouse
gccatagctacaggtagact

SEQ ID NO: 504522 - DNA, 20 bp, mouse
gtggttgtatgcggaaactc

SEQ ID NO: 504523 - DNA, 20 bp, mouse
ggagacggctctgcgcgggc

SEQ ID NO: 504524 - DNA, 20 bp, mouse
gagccgtctcgagcatagcc

SEQ ID NO: 504525 - DNA, 20 bp, mouse
gtccactcactggttgtatg

SEQ ID NO: 504526 - DNA, 20 bp, mouse
ggcggagactgactgacctg

SEQ ID NO: 504527 - DNA, 20 bp, mouse
gcgagcgagcgggagactgg

SEQ ID NO: 504528 - DNA, 20 bp, mouse
gacagagagagtcgcagacg

SEQ ID NO: 504529 - DNA, 20 bp, mouse
ggacccgggaggggaggacg

SEQ ID NO: 504530 - DNA, 20 bp, mouse
ggcggaccactcaccgtcag

SEQ ID NO: 504531 - DNA, 20 bp, mouse
ggggcgagcgccaggacggt

SEQ ID NO: 504532 - DNA, 20 bp, mouse
gtgtaccttcgcagccgaga

SEQ ID NO: 504533 - DNA, 20 bp, mouse
gctcctccgggacctcaggt

SEQ ID NO: 504534 - DNA, 20 bp, mouse
ggtcctggcgctcgccctct

SEQ ID NO: 504535 - DNA, 20 bp, mouse
gccatgcaaggacccgggag

SEQ ID NO: 504536 - DNA, 20 bp, mouse
gaccgctcggagaaacgcga

SEQ ID NO: 504537 - DNA, 20 bp, mouse
gagggaggctgctgcgggaa

SEQ ID NO: 504538 - DNA, 20 bp, mouse
gggcgtcgggctccacgagg

SEQ ID NO: 504539 - DNA, 20 bp, mouse
ggagccgctgcccggagtga

SEQ ID NO: 504540 - DNA, 20 bp, mouse
gggcaaggctgggatcctgg

SEQ ID NO: 504541 - DNA, 20 bp, mouse
gggctccacgaggcgggcgt

SEQ ID NO: 504542 - DNA, 20 bp, mouse
gggcgcgacgacgactacag

SEQ ID NO: 504543 - DNA, 20 bp, mouse
ggagggcgtcgggctccacg

SEQ ID NO: 504544 - DNA, 20 bp, mouse
gagcccgacgccctcactcc

SEQ ID NO: 504545 - DNA, 20 bp, mouse
ggggcgtcggcttctgtgcc

SEQ ID NO: 504546 - DNA, 20 bp, mouse
gatgggcagcaaggaagatg

SEQ ID NO: 504547 - DNA, 20 bp, mouse
ggcccccgcccaggatggac

SEQ ID NO: 504548 - DNA, 20 bp, mouse
gccgcccaggatggactgga

SEQ ID NO: 504549 - DNA, 20 bp, mouse
gtttcttatgaacccaggat

SEQ ID NO: 504550 - DNA, 20 bp, mouse
gctcctccgaggacacagac

SEQ ID NO: 504551 - DNA, 20 bp, mouse
ggaacccaggatgggcagca

SEQ ID NO: 504552 - DNA, 20 bp, mouse
gctcccgcggtgcctcggag

SEQ ID NO: 504553 - DNA, 20 bp, mouse
gagtggtccaggctaagggg

SEQ ID NO: 504554 - DNA, 20 bp, mouse
ggctagtggtccaggctaag

SEQ ID NO: 504555 - DNA, 20 bp, mouse
ggagccttccaaccttcctc

SEQ ID NO: 504556 - DNA, 20 bp, mouse
gccgagggaaggcgaggagg

SEQ ID NO: 504557 - DNA, 20 bp, mouse
gaatccgagggaaggcgagg

SEQ ID NO: 504558 - DNA, 20 bp, mouse
gaggctgcgagagcggtccc

SEQ ID NO: 504559 - DNA, 20 bp, mouse
ggccaaagcgccaaaatccg

SEQ ID NO: 504560 - DNA, 20 bp, mouse
gagcgccaaaatccgaggga

SEQ ID NO: 504561 - DNA, 20 bp, mouse
gcgctctcgcagcctcctcc

SEQ ID NO: 504562 - DNA, 20 bp, mouse
gcaaaatccgagggaaggcg

SEQ ID NO: 504563 - DNA, 20 bp, mouse
gggagctgcggctccccggg

SEQ ID NO: 504564 - DNA, 20 bp, mouse
gcggcggggcgagcaggcta

SEQ ID NO: 504565 - DNA, 20 bp, mouse
gcataaacggaactcaacta

SEQ ID NO: 504566 - DNA, 20 bp, mouse
ggaagctcgtggagccctgg

SEQ ID NO: 504567 - DNA, 20 bp, mouse
gagtccggcgagccccgcgg

SEQ ID NO: 504568 - DNA, 20 bp, mouse
gccgcggcggtagaagctcg

SEQ ID NO: 504569 - DNA, 20 bp, mouse
gccggtaaggcgacagggta

SEQ ID NO: 504570 - DNA, 20 bp, mouse
gtggtcgggtccaggatggt

SEQ ID NO: 504571 - DNA, 20 bp, mouse
gtgaatagaagggacgactg

SEQ ID NO: 504572 - DNA, 20 bp, mouse
ggcagtcctgccgcacaaag

SEQ ID NO: 504573 - DNA, 20 bp, mouse
gagctcccggtaaggcgaca

SEQ ID NO: 504574 - DNA, 20 bp, mouse
gggtccccacaagccctgga

SEQ ID NO: 504575 - DNA, 20 bp, mouse
gccgtacggcaggttggagt

SEQ ID NO: 504576 - DNA, 20 bp, mouse
gcggctgtgaaagcgcgggg

SEQ ID NO: 504577 - DNA, 20 bp, mouse
gttagagcggagtggagacc

SEQ ID NO: 504578 - DNA, 20 bp, mouse
ggcgcgcacagtatcctcag

SEQ ID NO: 504579 - DNA, 20 bp, mouse
ggaaggctgtggggttagag

SEQ ID NO: 504580 - DNA, 20 bp, mouse
gcccacccgggccccagcac

SEQ ID NO: 504581 - DNA, 20 bp, mouse
gaccaaactggacaagggaa

SEQ ID NO: 504582 - DNA, 20 bp, mouse
gcggcggctgtgaaagcgcg

SEQ ID NO: 504583 - DNA, 20 bp, mouse
gctgtggggttagagcggag

SEQ ID NO: 504584 - DNA, 20 bp, mouse
ggagcggagtggagaccggg

SEQ ID NO: 504585 - DNA, 20 bp, mouse
gtacctgcgcgggaccaagc

SEQ ID NO: 504586 - DNA, 20 bp, mouse
gcccagcggccagtgaatca

SEQ ID NO: 504587 - DNA, 20 bp, mouse
gcccactagtcaagctctgt

SEQ ID NO: 504588 - DNA, 20 bp, mouse
gggcaggggccctgattcac

SEQ ID NO: 504589 - DNA, 20 bp, mouse
gctcaggccagactcgagca

SEQ ID NO: 504590 - DNA, 20 bp, mouse
gtcactggccgctggggcca

SEQ ID NO: 504591 - DNA, 20 bp, mouse
ggcccacagagcttgactag

SEQ ID NO: 504592 - DNA, 20 bp, mouse
ggagctggggaaattctcca

SEQ ID NO: 504593 - DNA, 20 bp, mouse
ggctccaatgtaaacagagc

SEQ ID NO: 504594 - DNA, 20 bp, mouse
gagacaccggccgtgggtgg

SEQ ID NO: 504595 - DNA, 20 bp, mouse
gccggcaggctggcagtcaa

SEQ ID NO: 504596 - DNA, 20 bp, mouse
gtcccggagactcctccgag

SEQ ID NO: 504597 - DNA, 20 bp, mouse
gtcctctcggaggagtctcc

SEQ ID NO: 504598 - DNA, 20 bp, mouse
gcgggaccccagagagtaac

SEQ ID NO: 504599 - DNA, 20 bp, mouse
gcaggtgtctgaaagctaaa

SEQ ID NO: 504600 - DNA, 20 bp, mouse
gggcctaatggtggagatca

SEQ ID NO: 504601 - DNA, 20 bp, mouse
gagacacctgttactctctg

SEQ ID NO: 504602 - DNA, 20 bp, mouse
ggttttctgactcctctcgg

SEQ ID NO: 504603 - DNA, 20 bp, mouse
ggacggcagtaactcctcca

SEQ ID NO: 504604 - DNA, 20 bp, mouse
gccaaggacggaaaaagaag

SEQ ID NO: 504605 - DNA, 20 bp, mouse
gacaagagaactccaagtcc

SEQ ID NO: 504606 - DNA, 20 bp, mouse
ggtggtgtaggctgggtcca

SEQ ID NO: 504607 - DNA, 20 bp, mouse
ggggcagttggactgaggta

SEQ ID NO: 504608 - DNA, 20 bp, mouse
ggacccagcctacaccaccc

SEQ ID NO: 504609 - DNA, 20 bp, mouse
gatgtgcaggtgttgaccat

SEQ ID NO: 504610 - DNA, 20 bp, mouse
gcctaagtagggagggtctg

SEQ ID NO: 504611 - DNA, 20 bp, mouse
gacccttgccggcatggata

SEQ ID NO: 504612 - DNA, 20 bp, mouse
gtagtcggccatatccatgc

SEQ ID NO: 504613 - DNA, 20 bp, mouse
gccgggggcctaagtaggga

SEQ ID NO: 504614 - DNA, 20 bp, mouse
ggttgaccatgggcaatggt

SEQ ID NO: 504615 - DNA, 20 bp, mouse
gccatgggcaatggtaggtg

SEQ ID NO: 504616 - DNA, 20 bp, mouse
gcaatggcgacgatggtcca

SEQ ID NO: 504617 - DNA, 20 bp, mouse
ggggcctgactctcacagtg

SEQ ID NO: 504618 - DNA, 20 bp, mouse
ggactccccgtgcagaacag

SEQ ID NO: 504619 - DNA, 20 bp, mouse
gactaaacaaactgaatcgt

SEQ ID NO: 504620 - DNA, 20 bp, mouse
gtgtcagggcgcatgcatat

SEQ ID NO: 504621 - DNA, 20 bp, mouse
gctcagttcccccaagaagg

SEQ ID NO: 504622 - DNA, 20 bp, mouse
gaggctgcctgaaaacttct

SEQ ID NO: 504623 - DNA, 20 bp, mouse
gtgtagagtgggtcattcgc

SEQ ID NO: 504624 - DNA, 20 bp, mouse
gaggcagcctggaaattggg

SEQ ID NO: 504625 - DNA, 20 bp, mouse
gtgttcagcagtgcaccttc

SEQ ID NO: 504626 - DNA, 20 bp, mouse
gcccagagggtaggcagagg

SEQ ID NO: 504627 - DNA, 20 bp, mouse
gtttatcagagaacccaata

SEQ ID NO: 504628 - DNA, 20 bp, mouse
gatacgtagaatcttttcgg

SEQ ID NO: 504629 - DNA, 20 bp, mouse
gccaagcaggggtcacaagt

SEQ ID NO: 504630 - DNA, 20 bp, mouse
ggtcaaaaactaagatacta

SEQ ID NO: 504631 - DNA, 20 bp, mouse
gcacgtagccagctgctggt

SEQ ID NO: 504632 - DNA, 20 bp, mouse
gaaccggcaacctagcccag

SEQ ID NO: 504633 - DNA, 20 bp, mouse
gagattctacgtatctgcct

SEQ ID NO: 504634 - DNA, 20 bp, mouse
gtgcatgcactggtgttccg

SEQ ID NO: 504635 - DNA, 20 bp, mouse
gtcatgcaagatgccatatt

SEQ ID NO: 504636 - DNA, 20 bp, mouse
gggacgctggaacccgaccg

SEQ ID NO: 504637 - DNA, 20 bp, mouse
gtggtgtcccgataggggag

SEQ ID NO: 504638 - DNA, 20 bp, mouse
gcccgataggggagcggagg

SEQ ID NO: 504639 - DNA, 20 bp, mouse
gtgtcccgataggggagcgg

SEQ ID NO: 504640 - DNA, 20 bp, mouse
gttgtgtggtgtcccgatag

SEQ ID NO: 504641 - DNA, 20 bp, mouse
gatcgggacaccacacaaag

SEQ ID NO: 504642 - DNA, 20 bp, mouse
gcatccggcgaggggaggga

SEQ ID NO: 504643 - DNA, 20 bp, mouse
gagggtgcgcgcgccttcag

SEQ ID NO: 504644 - DNA, 20 bp, mouse
gcttcagcggcctctttgtg

SEQ ID NO: 504645 - DNA, 20 bp, mouse
ggccacctccgctcccctat

SEQ ID NO: 504646 - DNA, 20 bp, mouse
ggcgaggaggcgggataaaa

SEQ ID NO: 504647 - DNA, 20 bp, mouse
gaaaagggcgagcagaaggt

SEQ ID NO: 504648 - DNA, 20 bp, mouse
ggagcagaaggtaggctggc

SEQ ID NO: 504649 - DNA, 20 bp, mouse
ggggcgagcagaaggtaggc

SEQ ID NO: 504650 - DNA, 20 bp, mouse
ggataaaacaccgaaaccac

SEQ ID NO: 504651 - DNA, 20 bp, mouse
gcggtcggatcgcagcctca

SEQ ID NO: 504652 - DNA, 20 bp, mouse
ggattgttagaccagaatgg

SEQ ID NO: 504653 - DNA, 20 bp, mouse
gcagcctcatggtgactatg

SEQ ID NO: 504654 - DNA, 20 bp, mouse
ggtctaagtccgaggtaagt

SEQ ID NO: 504655 - DNA, 20 bp, mouse
gaacagtgcatggacgttaa

SEQ ID NO: 504656 - DNA, 20 bp, mouse
ggagctcctgcacacgggac

SEQ ID NO: 504657 - DNA, 20 bp, mouse
gcaaaggagctcctgcacac

SEQ ID NO: 504658 - DNA, 20 bp, mouse
ggactcgtcctggcgctgtg

SEQ ID NO: 504659 - DNA, 20 bp, mouse
ggcggcggtctcggctccag

SEQ ID NO: 504660 - DNA, 20 bp, mouse
gcccctccgccggaccacgg

SEQ ID NO: 504661 - DNA, 20 bp, mouse
gacgcgcacgggactcgtcc

SEQ ID NO: 504662 - DNA, 20 bp, mouse
ggaggccgtaggcaccgcaa

SEQ ID NO: 504663 - DNA, 20 bp, mouse
gcggcgccggtcccgtgtgc

SEQ ID NO: 504664 - DNA, 20 bp, mouse
ggccttggcgagtttctgag

SEQ ID NO: 504665 - DNA, 20 bp, mouse
gaatggcatggcgaggccgt

SEQ ID NO: 504666 - DNA, 20 bp, mouse
gtaatacctcctccccccgg

SEQ ID NO: 504667 - DNA, 20 bp, mouse
gggtagttgccggcatgggg

SEQ ID NO: 504668 - DNA, 20 bp, mouse
gaagcgcgggacgatcgtcc

SEQ ID NO: 504669 - DNA, 20 bp, mouse
gggccccgccgcgtcttcga

SEQ ID NO: 504670 - DNA, 20 bp, mouse
gaccgagaggaccaggccga

SEQ ID NO: 504671 - DNA, 20 bp, mouse
gtggggaggccggggagacc

SEQ ID NO: 504672 - DNA, 20 bp, mouse
ggagaggaccaggccgacgg

SEQ ID NO: 504673 - DNA, 20 bp, mouse
gaggccgacggagggcccgg

SEQ ID NO: 504674 - DNA, 20 bp, mouse
ggcggccgaccgagaggacc

SEQ ID NO: 504675 - DNA, 20 bp, mouse
gcggctgccgagccactccc

SEQ ID NO: 504676 - DNA, 20 bp, mouse
gaccgcgcgggacggagtta

SEQ ID NO: 504677 - DNA, 20 bp, mouse
gcgagcggagcgatagtcag

SEQ ID NO: 504678 - DNA, 20 bp, mouse
gagttggcattgtcaggcgg

SEQ ID NO: 504679 - DNA, 20 bp, mouse
gcagcggctactgcaacgag

SEQ ID NO: 504680 - DNA, 20 bp, mouse
ggcggtggcaccgcgcggga

SEQ ID NO: 504681 - DNA, 20 bp, mouse
gctttatcggcagtgtacgg

SEQ ID NO: 504682 - DNA, 20 bp, mouse
gggcctcgcggcgtcatcgg

SEQ ID NO: 504683 - DNA, 20 bp, mouse
gcttctttatcggcagtgta

SEQ ID NO: 504684 - DNA, 20 bp, mouse
ggcctgacaatgccaactcg

SEQ ID NO: 504685 - DNA, 20 bp, mouse
gtatcggcagtgtacggcgg

SEQ ID NO: 504686 - DNA, 20 bp, mouse
gctcggcgtagactcgcagt

SEQ ID NO: 504687 - DNA, 20 bp, mouse
gcaccgcacgggaacaaacg

SEQ ID NO: 504688 - DNA, 20 bp, mouse
gtcggcggcagaggagctcg

SEQ ID NO: 504689 - DNA, 20 bp, mouse
gtctcatgcgggaggcaaca

SEQ ID NO: 504690 - DNA, 20 bp, mouse
gcccccttggaatccctgat

SEQ ID NO: 504691 - DNA, 20 bp, mouse
ggggccattttgtgaggaga

SEQ ID NO: 504692 - DNA, 20 bp, mouse
gggcctcgcggcagaagccg

SEQ ID NO: 504693 - DNA, 20 bp, mouse
gacccaagtccccaccgcac

SEQ ID NO: 504694 - DNA, 20 bp, mouse
gcccgccagcgtgtgtaagg

SEQ ID NO: 504695 - DNA, 20 bp, mouse
ggctcgggggccattttgtg

SEQ ID NO: 504696 - DNA, 20 bp, mouse
gagcgaggaggaggcgagag

SEQ ID NO: 504697 - DNA, 20 bp, mouse
gcggcggcgccattaaagcg

SEQ ID NO: 504698 - DNA, 20 bp, mouse
gaagaatgaagtagcagcgg

SEQ ID NO: 504699 - DNA, 20 bp, mouse
gaaaaagaatgaagtagcag

SEQ ID NO: 504700 - DNA, 20 bp, mouse
gtcgcgaggcaccctagaca

SEQ ID NO: 504701 - DNA, 20 bp, mouse
gcattttaggtggtccgcgg

SEQ ID NO: 504702 - DNA, 20 bp, mouse
ggtgcctcgcgaggtagagc

SEQ ID NO: 504703 - DNA, 20 bp, mouse
gcgcgctgcgcgagagtggg

SEQ ID NO: 504704 - DNA, 20 bp, mouse
gcacgcgcgcgccttgtcta

SEQ ID NO: 504705 - DNA, 20 bp, mouse
gaggtagagcgggcatcgcg

SEQ ID NO: 504706 - DNA, 20 bp, mouse
ggcggcggcggagcgttgta

SEQ ID NO: 504707 - DNA, 20 bp, mouse
ggcggctccggagggacgaa

SEQ ID NO: 504708 - DNA, 20 bp, mouse
gtggcgcgcagtccgggtcc

SEQ ID NO: 504709 - DNA, 20 bp, mouse
gcgactcggggaaagactgg

SEQ ID NO: 504710 - DNA, 20 bp, mouse
gtataaagggagggcgcagg

SEQ ID NO: 504711 - DNA, 20 bp, mouse
gaatggcggcggaagagatc

SEQ ID NO: 504712 - DNA, 20 bp, mouse
gcaagaaccagcaggatgac

SEQ ID NO: 504713 - DNA, 20 bp, mouse
gtgcgcactcgggacaccga

SEQ ID NO: 504714 - DNA, 20 bp, mouse
gtcattcatgtcctccatgg

SEQ ID NO: 504715 - DNA, 20 bp, mouse
gtggcggagccgtcggcgag

SEQ ID NO: 504716 - DNA, 20 bp, mouse
gcatccttccggctccgtcg

SEQ ID NO: 504717 - DNA, 20 bp, mouse
gttccccgaaccccaccttc

SEQ ID NO: 504718 - DNA, 20 bp, mouse
ggagccggaaggatgcaaga

SEQ ID NO: 504719 - DNA, 20 bp, mouse
gcttccacgacggagccgga

SEQ ID NO: 504720 - DNA, 20 bp, mouse
gaggatgcaagacggtgatg

SEQ ID NO: 504721 - DNA, 20 bp, mouse
gcctcgtcttcctgaaggtg

SEQ ID NO: 504722 - DNA, 20 bp, mouse
gggatcaggagggcttccgg

SEQ ID NO: 504723 - DNA, 20 bp, mouse
gatgcaagacggtgatgggg

SEQ ID NO: 504724 - DNA, 20 bp, mouse
gcctcaggcagcggacatcc

SEQ ID NO: 504725 - DNA, 20 bp, mouse
gcctcagagcacctagagga

SEQ ID NO: 504726 - DNA, 20 bp, mouse
gcgcggcgcggtcgactacc

SEQ ID NO: 504727 - DNA, 20 bp, mouse
ggcaaggtgacgctgctccg

SEQ ID NO: 504728 - DNA, 20 bp, mouse
gtggcgggaagcagggcgga

SEQ ID NO: 504729 - DNA, 20 bp, mouse
ggactaccgggcgaaggccg

SEQ ID NO: 504730 - DNA, 20 bp, mouse
gcgagcccgcgcaggccccg

SEQ ID NO: 504731 - DNA, 20 bp, mouse
ggcggtcgactaccgggcga

SEQ ID NO: 504732 - DNA, 20 bp, mouse
gctgctccgcggccttcgcc

SEQ ID NO: 504733 - DNA, 20 bp, mouse
ggttttggcgggaagcaggg

SEQ ID NO: 504734 - DNA, 20 bp, mouse
gaggcgctcgctgcgcggcg

SEQ ID NO: 504735 - DNA, 20 bp, mouse
gctgctctaaaacttaccag

SEQ ID NO: 504736 - DNA, 20 bp, mouse
gaggtgtccgtggagagctc

SEQ ID NO: 504737 - DNA, 20 bp, mouse
gctcgggcagcagtcgaaga

SEQ ID NO: 504738 - DNA, 20 bp, mouse
gctgctgcccgagctctcca

SEQ ID NO: 504739 - DNA, 20 bp, mouse
gacgccgaggctttttgtgg

SEQ ID NO: 504740 - DNA, 20 bp, mouse
gagacactcgcggctcccag

SEQ ID NO: 504741 - DNA, 20 bp, mouse
ggccacgccgaggctttttg

SEQ ID NO: 504742 - DNA, 20 bp, mouse
gctctccacggacacctctt

SEQ ID NO: 504743 - DNA, 20 bp, mouse
gggttgagacgaggaaatgg

SEQ ID NO: 504744 - DNA, 20 bp, mouse
gtttctcctcagccacgccg

SEQ ID NO: 504745 - DNA, 20 bp, mouse
gaagcaatcgtcacccaaag

SEQ ID NO: 504746 - DNA, 20 bp, mouse
gtacagtagtaaaaataatg

SEQ ID NO: 504747 - DNA, 20 bp, mouse
ggacactgtgtacacatgcg

SEQ ID NO: 504748 - DNA, 20 bp, mouse
ggattagtaaggggatatat

SEQ ID NO: 504749 - DNA, 20 bp, mouse
ggtgttcaactaaattcact

SEQ ID NO: 504750 - DNA, 20 bp, mouse
gcatttagaatagattagta

SEQ ID NO: 504751 - DNA, 20 bp, mouse
gtcttatcacaaatcccaat

SEQ ID NO: 504752 - DNA, 20 bp, mouse
gttaaattatttgtaacctc

SEQ ID NO: 504753 - DNA, 20 bp, mouse
ggctgcaacagcatcttcat

SEQ ID NO: 504754 - DNA, 20 bp, mouse
gggaagcttggttgtactga

SEQ ID NO: 504755 - DNA, 20 bp, mouse
ggatctctagtgaggaagct

SEQ ID NO: 504756 - DNA, 20 bp, mouse
gcaacctccaacgagaccgg

SEQ ID NO: 504757 - DNA, 20 bp, mouse
gacgtgagcagaagtagttc

SEQ ID NO: 504758 - DNA, 20 bp, mouse
ggagccgagcacgaaaaagg

SEQ ID NO: 504759 - DNA, 20 bp, mouse
gggacccccgggtggtgata

SEQ ID NO: 504760 - DNA, 20 bp, mouse
gggggagccgagcacgaaaa

SEQ ID NO: 504761 - DNA, 20 bp, mouse
gcaccaacctccaacgagac

SEQ ID NO: 504762 - DNA, 20 bp, mouse
gccgagcacgaaaaaggcgg

SEQ ID NO: 504763 - DNA, 20 bp, mouse
gtggtcgtgaggggtcccga

SEQ ID NO: 504764 - DNA, 20 bp, mouse
gcgcagcgcaggccgcttcc

SEQ ID NO: 504765 - DNA, 20 bp, mouse
gtcccccgagatccagccaa

SEQ ID NO: 504766 - DNA, 20 bp, mouse
gagacggttgaggggagcga

SEQ ID NO: 504767 - DNA, 20 bp, mouse
gggctgcgcagctcctagag

SEQ ID NO: 504768 - DNA, 20 bp, mouse
gagcgctcgccacaacggtt

SEQ ID NO: 504769 - DNA, 20 bp, mouse
ggcgcagctcctagagcggt

SEQ ID NO: 504770 - DNA, 20 bp, mouse
gcctagagcggttggcgcgg

SEQ ID NO: 504771 - DNA, 20 bp, mouse
ggcggcgggagacggttgag

SEQ ID NO: 504772 - DNA, 20 bp, mouse
gcgagggagccgaaccgttg

SEQ ID NO: 504773 - DNA, 20 bp, mouse
gcggttggcgcggcgggaga

SEQ ID NO: 504774 - DNA, 20 bp, mouse
ggctcctagagcggttggcg

SEQ ID NO: 504775 - DNA, 20 bp, mouse
gctaccggcccccaagatgg

SEQ ID NO: 504776 - DNA, 20 bp, mouse
gccgtgcagcggagaagcag

SEQ ID NO: 504777 - DNA, 20 bp, mouse
ggagtgggagacgagcacga

SEQ ID NO: 504778 - DNA, 20 bp, mouse
gctacaggccgcaatcgagt

SEQ ID NO: 504779 - DNA, 20 bp, mouse
ggcgcgaacgagaaaggagg

SEQ ID NO: 504780 - DNA, 20 bp, mouse
ggaaaggaggagggcgctac

SEQ ID NO: 504781 - DNA, 20 bp, mouse
ggacggcgacgtccgtgcag

SEQ ID NO: 504782 - DNA, 20 bp, mouse
gcagagtgcgcgaacgagaa

SEQ ID NO: 504783 - DNA, 20 bp, mouse
gcccgtggccgcgtcaatta

SEQ ID NO: 504784 - DNA, 20 bp, mouse
gtggggcgcgacgctgaagt

SEQ ID NO: 504785 - DNA, 20 bp, mouse
ggcccaaagggagtcgccgg

SEQ ID NO: 504786 - DNA, 20 bp, mouse
ggctgccccgggcggagaag

SEQ ID NO: 504787 - DNA, 20 bp, mouse
ggcgggagcgatggtgaaga

SEQ ID NO: 504788 - DNA, 20 bp, mouse
gacgccggcgaccagcacgg

SEQ ID NO: 504789 - DNA, 20 bp, mouse
gccgggcggagaagcggcgt

SEQ ID NO: 504790 - DNA, 20 bp, mouse
gcccgcctcagctgctcgtc

SEQ ID NO: 504791 - DNA, 20 bp, mouse
gggcggagaagcggcgtcgg

SEQ ID NO: 504792 - DNA, 20 bp, mouse
gctgaggcgggcgggagcga

SEQ ID NO: 504793 - DNA, 20 bp, mouse
gcggaggctgctgccccggg

SEQ ID NO: 504794 - DNA, 20 bp, mouse
gtcgcggaggctgctgcccc

SEQ ID NO: 504795 - DNA, 20 bp, mouse
gagcagcctccgcgacatgg

SEQ ID NO: 504796 - DNA, 20 bp, mouse
ggagccgcgaagctggcgga

SEQ ID NO: 504797 - DNA, 20 bp, mouse
gacggaggcgacggagacgg

SEQ ID NO: 504798 - DNA, 20 bp, mouse
gaggagcccgtgactgagaa

SEQ ID NO: 504799 - DNA, 20 bp, mouse
ggaggctggctgagagataa

SEQ ID NO: 504800 - DNA, 20 bp, mouse
ggaccgatcagcgacatctg

SEQ ID NO: 504801 - DNA, 20 bp, mouse
ggccaagcgcctcaagaccg

SEQ ID NO: 504802 - DNA, 20 bp, mouse
ggcgctcccttctcagtcac

SEQ ID NO: 504803 - DNA, 20 bp, mouse
gtactttcgcgtcccccccg

SEQ ID NO: 504804 - DNA, 20 bp, mouse
ggccgaggaggcgcagcccg

SEQ ID NO: 504805 - DNA, 20 bp, mouse
gcccaaggaggagacgtacg

SEQ ID NO: 504806 - DNA, 20 bp, mouse
gccagacgcggagaaaatgg

SEQ ID NO: 504807 - DNA, 20 bp, mouse
ggaagcggcagccgaagtgg

SEQ ID NO: 504808 - DNA, 20 bp, mouse
gatggcggcaggggtcgaag

SEQ ID NO: 504809 - DNA, 20 bp, mouse
ggtcgaagcggcagccgaag

SEQ ID NO: 504810 - DNA, 20 bp, mouse
gggttctgtcgccgccactt

SEQ ID NO: 504811 - DNA, 20 bp, mouse
gagcccagacgcggagaaaa

SEQ ID NO: 504812 - DNA, 20 bp, mouse
ggcggcgacagaacccaaaa

SEQ ID NO: 504813 - DNA, 20 bp, mouse
gctcacacaaagcccagacg

SEQ ID NO: 504814 - DNA, 20 bp, mouse
ggcgacagaacccaaaatgg

SEQ ID NO: 504815 - DNA, 20 bp, mouse
gaagcggcccacagacctaa

SEQ ID NO: 504816 - DNA, 20 bp, mouse
ggccagcgcgagactcacca

SEQ ID NO: 504817 - DNA, 20 bp, mouse
ggcccgtgagaagcagcgcg

SEQ ID NO: 504818 - DNA, 20 bp, mouse
ggactcaccagggcagagct

SEQ ID NO: 504819 - DNA, 20 bp, mouse
gagggaccggggcaccggag

SEQ ID NO: 504820 - DNA, 20 bp, mouse
gcaggccgcacggaggacag

SEQ ID NO: 504821 - DNA, 20 bp, mouse
gacagagagaggaggcgccg

SEQ ID NO: 504822 - DNA, 20 bp, mouse
gagaccggcaggccgcacgg

SEQ ID NO: 504823 - DNA, 20 bp, mouse
gacagcggaccgagggaccg

SEQ ID NO: 504824 - DNA, 20 bp, mouse
ggctccgaggccccagggtg

SEQ ID NO: 504825 - DNA, 20 bp, mouse
gtctcggtccatgcgagggg

SEQ ID NO: 504826 - DNA, 20 bp, mouse
ggagttcgcgaggcaagacg

SEQ ID NO: 504827 - DNA, 20 bp, mouse
gggacccgcctggtgtcgaa

SEQ ID NO: 504828 - DNA, 20 bp, mouse
gcaagacgcggagactcgcc

SEQ ID NO: 504829 - DNA, 20 bp, mouse
ggcctcgcgaactcggtgaa

SEQ ID NO: 504830 - DNA, 20 bp, mouse
gacgcaacgtcctctcgcag

SEQ ID NO: 504831 - DNA, 20 bp, mouse
ggcggcgccgcccctgcgag

SEQ ID NO: 504832 - DNA, 20 bp, mouse
gcgaactcggtgaaaggaat

SEQ ID NO: 504833 - DNA, 20 bp, mouse
ggaaggaggagctcaagaag

SEQ ID NO: 504834 - DNA, 20 bp, mouse
gcaggccgcgctggacaacg

SEQ ID NO: 504835 - DNA, 20 bp, mouse
gggcgccgttcgacaccagg

SEQ ID NO: 504836 - DNA, 20 bp, mouse
gtgacaggcaaggtttaggg

SEQ ID NO: 504837 - DNA, 20 bp, mouse
gtccatggcccgggcccccg

SEQ ID NO: 504838 - DNA, 20 bp, mouse
gcgaggagcccgaagacgaa

SEQ ID NO: 504839 - DNA, 20 bp, mouse
gaggaggtcgagaccgaggg

SEQ ID NO: 504840 - DNA, 20 bp, mouse
ggaggccgggccaggctcgg

SEQ ID NO: 504841 - DNA, 20 bp, mouse
gctcctgacaggcaaggttt

SEQ ID NO: 504842 - DNA, 20 bp, mouse
gtgcctgtcaggaggcgaag

SEQ ID NO: 504843 - DNA, 20 bp, mouse
ggagcctggcccggcctccc

SEQ ID NO: 504844 - DNA, 20 bp, mouse
ggaaggccgagcttgctgag

SEQ ID NO: 504845 - DNA, 20 bp, mouse
gttaggggggacagagccct

SEQ ID NO: 504846 - DNA, 20 bp, mouse
gaaggcctttccagcatcaa

SEQ ID NO: 504847 - DNA, 20 bp, mouse
gtaagcacagaaagaggtcc

SEQ ID NO: 504848 - DNA, 20 bp, mouse
ggaagtaagagacctgagat

SEQ ID NO: 504849 - DNA, 20 bp, mouse
gccggagtcccgcccatctc

SEQ ID NO: 504850 - DNA, 20 bp, mouse
gcaattaccggagcacccta

SEQ ID NO: 504851 - DNA, 20 bp, mouse
ggaagccaagctggaaggat

SEQ ID NO: 504852 - DNA, 20 bp, mouse
gggacatcgagtaagcccta

SEQ ID NO: 504853 - DNA, 20 bp, mouse
ggatgtttaagcacagaaag

SEQ ID NO: 504854 - DNA, 20 bp, mouse
gctctcccttgatgctggaa

SEQ ID NO: 504855 - DNA, 20 bp, mouse
gagagcctacgactgaagta

SEQ ID NO: 504856 - DNA, 20 bp, mouse
gctcagaccctgcctcatgg

SEQ ID NO: 504857 - DNA, 20 bp, mouse
ggacctcccgcagaaatgct

SEQ ID NO: 504858 - DNA, 20 bp, mouse
gcatggaggcccaaatttgg

SEQ ID NO: 504859 - DNA, 20 bp, mouse
gtgggggcccagcatttctg

SEQ ID NO: 504860 - DNA, 20 bp, mouse
ggagccagatccaggagggt

SEQ ID NO: 504861 - DNA, 20 bp, mouse
gccaggctggctgaacatga

SEQ ID NO: 504862 - DNA, 20 bp, mouse
gcaccgcagaggtagactat

SEQ ID NO: 504863 - DNA, 20 bp, mouse
gcaagcgggcctgagagaca

SEQ ID NO: 504864 - DNA, 20 bp, mouse
gcagccagcctggaaacgga

SEQ ID NO: 504865 - DNA, 20 bp, mouse
ggccctggcgctgggtaaag

SEQ ID NO: 504866 - DNA, 20 bp, mouse
ggcccgctccgtggagtcag

SEQ ID NO: 504867 - DNA, 20 bp, mouse
gccgaaccgagcgcagccga

SEQ ID NO: 504868 - DNA, 20 bp, mouse
gcgtgagacgagcacggcag

SEQ ID NO: 504869 - DNA, 20 bp, mouse
ggtcgctgcctctgactcca

SEQ ID NO: 504870 - DNA, 20 bp, mouse
gtgcctctgactccacggag

SEQ ID NO: 504871 - DNA, 20 bp, mouse
gcgccggcgtgagacgagca

SEQ ID NO: 504872 - DNA, 20 bp, mouse
ggaccgggaagcggcgccct

SEQ ID NO: 504873 - DNA, 20 bp, mouse
ggagcgggagagacgagccg

SEQ ID NO: 504874 - DNA, 20 bp, mouse
gcggcagcggagcaggagag

SEQ ID NO: 504875 - DNA, 20 bp, mouse
gccgcgggtgctgcgaggag

SEQ ID NO: 504876 - DNA, 20 bp, mouse
gctggcggcggccccgacac

SEQ ID NO: 504877 - DNA, 20 bp, mouse
gcgcagccggcggaatggaa

SEQ ID NO: 504878 - DNA, 20 bp, mouse
gagccgcgcagccggcggaa

SEQ ID NO: 504879 - DNA, 20 bp, mouse
gcctagcgcgagcaactcca

SEQ ID NO: 504880 - DNA, 20 bp, mouse
gccccgcgcggcacatgcgg

SEQ ID NO: 504881 - DNA, 20 bp, mouse
gcggctggctgagacgggaa

SEQ ID NO: 504882 - DNA, 20 bp, mouse
ggctaggggcaaggagaccg

SEQ ID NO: 504883 - DNA, 20 bp, mouse
gcggcgccgttccattccgc

SEQ ID NO: 504884 - DNA, 20 bp, mouse
gggctgctctgccggtgtcg

SEQ ID NO: 504885 - DNA, 20 bp, mouse
gacgagcagcgccggagatg

SEQ ID NO: 504886 - DNA, 20 bp, mouse
gccggaggcggcgcagacaa

SEQ ID NO: 504887 - DNA, 20 bp, mouse
ggccgcgatgggaccggagg

SEQ ID NO: 504888 - DNA, 20 bp, mouse
gcgcggggtgagccagacag

SEQ ID NO: 504889 - DNA, 20 bp, mouse
gggactggccgcgatgggac

SEQ ID NO: 504890 - DNA, 20 bp, mouse
gagctcgtgagggcaactac

SEQ ID NO: 504891 - DNA, 20 bp, mouse
gctgaggggttgggatcctg

SEQ ID NO: 504892 - DNA, 20 bp, mouse
gcctccagggcagctcgtga

SEQ ID NO: 504893 - DNA, 20 bp, mouse
ggagctgccctggagggagt

SEQ ID NO: 504894 - DNA, 20 bp, mouse
gccggttcccactccctcca

SEQ ID NO: 504895 - DNA, 20 bp, mouse
gtcgtcgtcgctgcagcctc

SEQ ID NO: 504896 - DNA, 20 bp, mouse
ggcggagcgcctcggtccag

SEQ ID NO: 504897 - DNA, 20 bp, mouse
gctccgcgccgcactggtag

SEQ ID NO: 504898 - DNA, 20 bp, mouse
ggaggatccaagagggcgag

SEQ ID NO: 504899 - DNA, 20 bp, mouse
gctggcgccacgcaaagccc

SEQ ID NO: 504900 - DNA, 20 bp, mouse
gagcgcctcggtccaggggt

SEQ ID NO: 504901 - DNA, 20 bp, mouse
gggcggtccagggctttgcg

SEQ ID NO: 504902 - DNA, 20 bp, mouse
gaggatggggctctgagggt

SEQ ID NO: 504903 - DNA, 20 bp, mouse
ggccccctacccctggaccg

SEQ ID NO: 504904 - DNA, 20 bp, mouse
gagggggcagcggcggtcca

SEQ ID NO: 504905 - DNA, 20 bp, mouse
gcgccgctgccccctacccc

SEQ ID NO: 504906 - DNA, 20 bp, mouse
ggcccgccactggagctcgg

SEQ ID NO: 504907 - DNA, 20 bp, mouse
gactcacgcgcgaagcctca

SEQ ID NO: 504908 - DNA, 20 bp, mouse
gcctggccgccgagctccag

SEQ ID NO: 504909 - DNA, 20 bp, mouse
gacagacgcggtgggcgagg

SEQ ID NO: 504910 - DNA, 20 bp, mouse
gggccgccgagctccagtgg

SEQ ID NO: 504911 - DNA, 20 bp, mouse
gccgggacgcgggacagacg

SEQ ID NO: 504912 - DNA, 20 bp, mouse
gcctcacggcgcagacgtcg

SEQ ID NO: 504913 - DNA, 20 bp, mouse
gacagcggcagctcggactg

SEQ ID NO: 504914 - DNA, 20 bp, mouse
ggcccacacagcacccatgg

SEQ ID NO: 504915 - DNA, 20 bp, mouse
ggacgcgggacagacgcggt

SEQ ID NO: 504916 - DNA, 20 bp, mouse
ggatccgggccaaggagccc

SEQ ID NO: 504917 - DNA, 20 bp, mouse
gtcgctggtggcggacccgg

SEQ ID NO: 504918 - DNA, 20 bp, mouse
gtaggccgagcgggaggtct

SEQ ID NO: 504919 - DNA, 20 bp, mouse
gggaaggaggaatagatcgt

SEQ ID NO: 504920 - DNA, 20 bp, mouse
gttcgggcgctcgctggtgg

SEQ ID NO: 504921 - DNA, 20 bp, mouse
ggaggccacgcccctctgga

SEQ ID NO: 504922 - DNA, 20 bp, mouse
gaggcctgtgccctccagag

SEQ ID NO: 504923 - DNA, 20 bp, mouse
gaggctgctgctgcgtgccg

SEQ ID NO: 504924 - DNA, 20 bp, mouse
ggcgctctaggccgagcggg

SEQ ID NO: 504925 - DNA, 20 bp, mouse
gaagaccaagacaggacgag

SEQ ID NO: 504926 - DNA, 20 bp, mouse
gccccgagcgagggaaggag

SEQ ID NO: 504927 - DNA, 20 bp, mouse
gagcggacggacggaagaga

SEQ ID NO: 504928 - DNA, 20 bp, mouse
gcgcggccccgagcgaggga

SEQ ID NO: 504929 - DNA, 20 bp, mouse
gagtgcgcggccccgagcga

SEQ ID NO: 504930 - DNA, 20 bp, mouse
gaggggtcaggcagcagacc

SEQ ID NO: 504931 - DNA, 20 bp, mouse
gtccgcgccccgggagcgga

SEQ ID NO: 504932 - DNA, 20 bp, mouse
gtcggggtttgagtccgaag

SEQ ID NO: 504933 - DNA, 20 bp, mouse
gaccggtgtccgcgaaaagg

SEQ ID NO: 504934 - DNA, 20 bp, mouse
gtcccaagccccggatgtga

SEQ ID NO: 504935 - DNA, 20 bp, mouse
ggctcacttgggtacgtggt

SEQ ID NO: 504936 - DNA, 20 bp, mouse
gccgaggggacagtatactg

SEQ ID NO: 504937 - DNA, 20 bp, mouse
gtcccgcctgacactccgag

SEQ ID NO: 504938 - DNA, 20 bp, mouse
gggcagctccggatctccgg

SEQ ID NO: 504939 - DNA, 20 bp, mouse
gcgagtgtcctcagtcccta

SEQ ID NO: 504940 - DNA, 20 bp, mouse
ggagatccggagctgcccta

SEQ ID NO: 504941 - DNA, 20 bp, mouse
gtctccggaggcagcacttg

SEQ ID NO: 504942 - DNA, 20 bp, mouse
gtcccctcggagtgtcaggc

SEQ ID NO: 504943 - DNA, 20 bp, mouse
gccagtcccggaggatacat

SEQ ID NO: 504944 - DNA, 20 bp, mouse
gagacgcgcacggaccatgt

SEQ ID NO: 504945 - DNA, 20 bp, mouse
gagtgctgcctccggagatc

SEQ ID NO: 504946 - DNA, 20 bp, mouse
gaccgcctgagggaagcgtc

SEQ ID NO: 504947 - DNA, 20 bp, mouse
ggccggacgcttccctcagg

SEQ ID NO: 504948 - DNA, 20 bp, mouse
gtccgaagcgggtcctgagg

SEQ ID NO: 504949 - DNA, 20 bp, mouse
ggcagtcgccatgggactaa

SEQ ID NO: 504950 - DNA, 20 bp, mouse
gggtcctgagggggcgacga

SEQ ID NO: 504951 - DNA, 20 bp, mouse
gtactttacgcaccgcctga

SEQ ID NO: 504952 - DNA, 20 bp, mouse
gaggcaagagtcttgaagtg

SEQ ID NO: 504953 - DNA, 20 bp, mouse
gggcagctggcagtcgccat

SEQ ID NO: 504954 - DNA, 20 bp, mouse
ggaccgtaaggaacctgaga

SEQ ID NO: 504955 - DNA, 20 bp, mouse
ggcactgcgcacgtgctgac

SEQ ID NO: 504956 - DNA, 20 bp, mouse
gaggggccaaccttagactt

SEQ ID NO: 504957 - DNA, 20 bp, mouse
gcctggcaaagcccacccct

SEQ ID NO: 504958 - DNA, 20 bp, mouse
gggaaagtcgtaaagccgag

SEQ ID NO: 504959 - DNA, 20 bp, mouse
gagtcgtaaagccgaggggt

SEQ ID NO: 504960 - DNA, 20 bp, mouse
gtagagcaaggcctgctgag

SEQ ID NO: 504961 - DNA, 20 bp, mouse
ggcggtggcgaggaatgaac

SEQ ID NO: 504962 - DNA, 20 bp, mouse
gactttccggccagggccac

SEQ ID NO: 504963 - DNA, 20 bp, mouse
gtcggcctttacctcagcag

SEQ ID NO: 504964 - DNA, 20 bp, mouse
ggaggagactcctgtggccc

SEQ ID NO: 504965 - DNA, 20 bp, mouse
ggcggagggccaacgaggac

SEQ ID NO: 504966 - DNA, 20 bp, mouse
gatggaggaagtgagaaagt

SEQ ID NO: 504967 - DNA, 20 bp, mouse
gcggtcagtgccaacagctg

SEQ ID NO: 504968 - DNA, 20 bp, mouse
gccccctgcccactaggaag

SEQ ID NO: 504969 - DNA, 20 bp, mouse
ggcgacgaccgcttcctagt

SEQ ID NO: 504970 - DNA, 20 bp, mouse
gtcagtgccaacagctgcgg

SEQ ID NO: 504971 - DNA, 20 bp, mouse
gattggatcctgcgaagccc

SEQ ID NO: 504972 - DNA, 20 bp, mouse
gggcaggcggagggctcgag

SEQ ID NO: 504973 - DNA, 20 bp, mouse
gcggtcacccagggcttcgc

SEQ ID NO: 504974 - DNA, 20 bp, mouse
gtcgtcgccgccgcagctgt

SEQ ID NO: 504975 - DNA, 20 bp, mouse
gaaagttggcacggtcaccc

SEQ ID NO: 504976 - DNA, 20 bp, mouse
gtctgatactaagagcagca

SEQ ID NO: 504977 - DNA, 20 bp, mouse
gtagtatcagaagcgaacaa

SEQ ID NO: 504978 - DNA, 20 bp, mouse
gggaaccccagcgagattct

SEQ ID NO: 504979 - DNA, 20 bp, mouse
ggtacgttatttcacttgtc

SEQ ID NO: 504980 - DNA, 20 bp, mouse
gcctctttttgaatacgaag

SEQ ID NO: 504981 - DNA, 20 bp, mouse
gaaggccaagaatctcgctg

SEQ ID NO: 504982 - DNA, 20 bp, mouse
gcgcctgtggtgagaagctt

SEQ ID NO: 504983 - DNA, 20 bp, mouse
gatggcccggagctttgctt

SEQ ID NO: 504984 - DNA, 20 bp, mouse
ggccgtcccatcgctctcta

SEQ ID NO: 504985 - DNA, 20 bp, mouse
gtctatggttggaaagcagt

SEQ ID NO: 504986 - DNA, 20 bp, mouse
gacattgttgtgggataatt

SEQ ID NO: 504987 - DNA, 20 bp, mouse
gggcaggtagaccccaccgt

SEQ ID NO: 504988 - DNA, 20 bp, mouse
ggggagcagatagccctttc

SEQ ID NO: 504989 - DNA, 20 bp, mouse
gctgccagcgacctgcccta

SEQ ID NO: 504990 - DNA, 20 bp, mouse
gtcgaccaaaaaggagttcg

SEQ ID NO: 504991 - DNA, 20 bp, mouse
gcgcagctttgcagcccgta

SEQ ID NO: 504992 - DNA, 20 bp, mouse
gcgtccagccacaggtctag

SEQ ID NO: 504993 - DNA, 20 bp, mouse
gcgctcatcagctcaggcag

SEQ ID NO: 504994 - DNA, 20 bp, mouse
gccgagcatgacattgttgt

SEQ ID NO: 504995 - DNA, 20 bp, mouse
gagcccgtagggcaggtcgc

SEQ ID NO: 504996 - DNA, 20 bp, mouse
gtcacggatccgcttcaaag

SEQ ID NO: 504997 - DNA, 20 bp, mouse
gtgcagctgcctctttgaag

SEQ ID NO: 504998 - DNA, 20 bp, mouse
gcgcgcacgggttggacctg

SEQ ID NO: 504999 - DNA, 20 bp, mouse
ggcccaaggtagcccaatga

SEQ ID NO: 505000 - DNA, 20 bp, mouse
gtccatcattgggctacctt

SEQ ID NO: 505001 - DNA, 20 bp, mouse
gaggagtaggagtatgtcat

SEQ ID NO: 505002 - DNA, 20 bp, mouse
gctggcccactgctactccg

SEQ ID NO: 505003 - DNA, 20 bp, mouse
ggtcattgggcgcgaagacg

SEQ ID NO: 505004 - DNA, 20 bp, mouse
gtggagaatcatgttaagct

SEQ ID NO: 505005 - DNA, 20 bp, mouse
gggcgcgaagacggggtctg

SEQ ID NO: 505006 - DNA, 20 bp, mouse
gcgcatggagaagaccccag

SEQ ID NO: 505007 - DNA, 20 bp, mouse
gggtgggctcgatccagcgg

SEQ ID NO: 505008 - DNA, 20 bp, mouse
gcgtagagaaacatgacggt

SEQ ID NO: 505009 - DNA, 20 bp, mouse
gttgtcgtagagaaacatga

SEQ ID NO: 505010 - DNA, 20 bp, mouse
ggacggtgggctcgatccag

SEQ ID NO: 505011 - DNA, 20 bp, mouse
gggccctcccgacgacgacg

SEQ ID NO: 505012 - DNA, 20 bp, mouse
gtgtttctctacgacaacgg

SEQ ID NO: 505013 - DNA, 20 bp, mouse
gcgcgctcttcacttcttgg

SEQ ID NO: 505014 - DNA, 20 bp, mouse
ggcggccgcggcagccgggt

SEQ ID NO: 505015 - DNA, 20 bp, mouse
gtgcagtccctgctcggcgg

SEQ ID NO: 505016 - DNA, 20 bp, mouse
gtagtagcgcggtccccata

SEQ ID NO: 505017 - DNA, 20 bp, mouse
gtcatagaagatcgctgctg

SEQ ID NO: 505018 - DNA, 20 bp, mouse
gcactgattacagccgtatg

SEQ ID NO: 505019 - DNA, 20 bp, mouse
gggggcaaggcccaggaaaa

SEQ ID NO: 505020 - DNA, 20 bp, mouse
gaggaaaaaggcgagcgcga

SEQ ID NO: 505021 - DNA, 20 bp, mouse
gtggtctgctcaaaaggagg

SEQ ID NO: 505022 - DNA, 20 bp, mouse
gcgggcagtcaccctcgcca

SEQ ID NO: 505023 - DNA, 20 bp, mouse
ggcactcagcgagcgacggc

SEQ ID NO: 505024 - DNA, 20 bp, mouse
gctccttggagccccctcgg

SEQ ID NO: 505025 - DNA, 20 bp, mouse
gcgcggggctcgacttgggg

SEQ ID NO: 505026 - DNA, 20 bp, mouse
ggccggacaaagcgcagccc

SEQ ID NO: 505027 - DNA, 20 bp, mouse
gagctccgaagcacgcagga

SEQ ID NO: 505028 - DNA, 20 bp, mouse
ggacaaagcgcagcccaggc

SEQ ID NO: 505029 - DNA, 20 bp, mouse
ggaagcgacagctgtcagag

SEQ ID NO: 505030 - DNA, 20 bp, mouse
ggcagagctccgaagcacgc

SEQ ID NO: 505031 - DNA, 20 bp, mouse
gtccggcgatggcgagcgag

SEQ ID NO: 505032 - DNA, 20 bp, mouse
gggtgggtgaggtactacag

SEQ ID NO: 505033 - DNA, 20 bp, mouse
ggtctgaaggtgagacctgt

SEQ ID NO: 505034 - DNA, 20 bp, mouse
ggtactacagtggtaagaga

SEQ ID NO: 505035 - DNA, 20 bp, mouse
ggctccacctccagcgacaa

SEQ ID NO: 505036 - DNA, 20 bp, mouse
gaacaccagagggtgaatag

SEQ ID NO: 505037 - DNA, 20 bp, mouse
gaatagtggctgtgaaggaa

SEQ ID NO: 505038 - DNA, 20 bp, mouse
gggctcctggaggaccatat

SEQ ID NO: 505039 - DNA, 20 bp, mouse
ggcagagaaataaacaccag

SEQ ID NO: 505040 - DNA, 20 bp, mouse
gacagccactattcaccctc

SEQ ID NO: 505041 - DNA, 20 bp, mouse
gctccagttccaggtgctca

SEQ ID NO: 505042 - DNA, 20 bp, mouse
ggggtgaatagtggctgtga

SEQ ID NO: 505043 - DNA, 20 bp, mouse
gaggctccaaagtctacagt

SEQ ID NO: 505044 - DNA, 20 bp, mouse
gcgctcctggcaactagaat

SEQ ID NO: 505045 - DNA, 20 bp, mouse
gagaagcaaaagatgaagta

SEQ ID NO: 505046 - DNA, 20 bp, mouse
ggcggggcgaactcctcgaa

SEQ ID NO: 505047 - DNA, 20 bp, mouse
gcggcaggcgtagggacagg

SEQ ID NO: 505048 - DNA, 20 bp, mouse
gaacttgggctcgatgtagt

SEQ ID NO: 505049 - DNA, 20 bp, mouse
gggagcggcgcggacttcgg

SEQ ID NO: 505050 - DNA, 20 bp, mouse
gccgcggcaggcgtagggac

SEQ ID NO: 505051 - DNA, 20 bp, mouse
ggcggcgcgtagtaagcggg

SEQ ID NO: 505052 - DNA, 20 bp, mouse
ggggcgaactcctcgaaagg

SEQ ID NO: 505053 - DNA, 20 bp, mouse
ggcgagcccagctaccccgg

SEQ ID NO: 505054 - DNA, 20 bp, mouse
gcccgtcgcgacagccgggg

SEQ ID NO: 505055 - DNA, 20 bp, mouse
gcgggagcgcagtgccgagg

SEQ ID NO: 505056 - DNA, 20 bp, mouse
gggtacggctacggctacaa

SEQ ID NO: 505057 - DNA, 20 bp, mouse
gactcggcgagcatgcactc

SEQ ID NO: 505058 - DNA, 20 bp, mouse
gactccggcaggtacggcta

SEQ ID NO: 505059 - DNA, 20 bp, mouse
gaaagtggccggaacccgaa

SEQ ID NO: 505060 - DNA, 20 bp, mouse
ggcatgcactccggcaggta

SEQ ID NO: 505061 - DNA, 20 bp, mouse
gactcggttccctcctacgt

SEQ ID NO: 505062 - DNA, 20 bp, mouse
gttcatcataaattgtgcaa

SEQ ID NO: 505063 - DNA, 20 bp, mouse
ggatatgtgtgcttgatttg

SEQ ID NO: 505064 - DNA, 20 bp, mouse
ggagcgcgcccgcagctacg

SEQ ID NO: 505065 - DNA, 20 bp, mouse
ggcgctcgccggagccaaag

SEQ ID NO: 505066 - DNA, 20 bp, mouse
gagtcgcgccaggctcaaag

SEQ ID NO: 505067 - DNA, 20 bp, mouse
gtgcttctggggattctgag

SEQ ID NO: 505068 - DNA, 20 bp, mouse
ggcctggcgcgactgctgta

SEQ ID NO: 505069 - DNA, 20 bp, mouse
gcgcgccaggctcaaagagg

SEQ ID NO: 505070 - DNA, 20 bp, mouse
gcctgaggggcagtctccaa

SEQ ID NO: 505071 - DNA, 20 bp, mouse
ggggcacaaaaggggacctg

SEQ ID NO: 505072 - DNA, 20 bp, mouse
gctcccctaacccagcacca

SEQ ID NO: 505073 - DNA, 20 bp, mouse
gggacccgaatctattccag

SEQ ID NO: 505074 - DNA, 20 bp, mouse
gggattggctatggcatgga

SEQ ID NO: 505075 - DNA, 20 bp, mouse
ggcagccatgaccagccagg

SEQ ID NO: 505076 - DNA, 20 bp, mouse
gaaagtgggattcacaaaat

SEQ ID NO: 505077 - DNA, 20 bp, mouse
gcatagccggccgggtagag

SEQ ID NO: 505078 - DNA, 20 bp, mouse
gtccctgggagcctgcccag

SEQ ID NO: 505079 - DNA, 20 bp, mouse
gttgcaggccaagaccgagt

SEQ ID NO: 505080 - DNA, 20 bp, mouse
gcccttcccggcctcttacg

SEQ ID NO: 505081 - DNA, 20 bp, mouse
gcatgaggccccgtactcgt

SEQ ID NO: 505082 - DNA, 20 bp, mouse
gcatttgcgcgcccctctgc

SEQ ID NO: 505083 - DNA, 20 bp, mouse
gcgagggtgaggcgccactg

SEQ ID NO: 505084 - DNA, 20 bp, mouse
gagcagcagtacaaacctga

SEQ ID NO: 505085 - DNA, 20 bp, mouse
gagaaggagtcctggccgct

SEQ ID NO: 505086 - DNA, 20 bp, mouse
gtataagcccggcacagtgg

SEQ ID NO: 505087 - DNA, 20 bp, mouse
gctgccggacaacaaatcac

SEQ ID NO: 505088 - DNA, 20 bp, mouse
ggaaggggctctgatagagg

SEQ ID NO: 505089 - DNA, 20 bp, mouse
ggtccggcagctttcagtgt

SEQ ID NO: 505090 - DNA, 20 bp, mouse
ggtgcaaaggagcaagaagt

SEQ ID NO: 505091 - DNA, 20 bp, mouse
ggccatagccggacgcgaag

SEQ ID NO: 505092 - DNA, 20 bp, mouse
gtttcagtgtcggttttacg

SEQ ID NO: 505093 - DNA, 20 bp, mouse
gcacccaactcgcagagaag

SEQ ID NO: 505094 - DNA, 20 bp, mouse
gcccggcacagtggaggcga

SEQ ID NO: 505095 - DNA, 20 bp, mouse
gcgcgaaggggctctgatag

SEQ ID NO: 505096 - DNA, 20 bp, mouse
gcgcctggggatgcacgtag

SEQ ID NO: 505097 - DNA, 20 bp, mouse
ggaccctgggtcaaccccca

SEQ ID NO: 505098 - DNA, 20 bp, mouse
ggccctgggcaactactatg

SEQ ID NO: 505099 - DNA, 20 bp, mouse
gaacttggtggcaccagggg

SEQ ID NO: 505100 - DNA, 20 bp, mouse
gttgcccagggccccggtgg

SEQ ID NO: 505101 - DNA, 20 bp, mouse
gcaggcgcgggctactgcaa

SEQ ID NO: 505102 - DNA, 20 bp, mouse
ggctgcaaggactgaagtcg

SEQ ID NO: 505103 - DNA, 20 bp, mouse
ggcgtcggcgcccagcagga

SEQ ID NO: 505104 - DNA, 20 bp, mouse
gactgcaatggccaccaccg

SEQ ID NO: 505105 - DNA, 20 bp, mouse
gtgcagtttcataatttcgg

SEQ ID NO: 505106 - DNA, 20 bp, mouse
gatactgccgaaaggttgta

SEQ ID NO: 505107 - DNA, 20 bp, mouse
ggccgttgacagctacgcag

SEQ ID NO: 505108 - DNA, 20 bp, mouse
gaggcagccctccaccatag

SEQ ID NO: 505109 - DNA, 20 bp, mouse
gtagaggccgaaggagggtc

SEQ ID NO: 505110 - DNA, 20 bp, mouse
gtccatgtagaggccgaagg

SEQ ID NO: 505111 - DNA, 20 bp, mouse
ggtatgcccgagccaaggag

SEQ ID NO: 505112 - DNA, 20 bp, mouse
gacgcaggggagagccgcta

SEQ ID NO: 505113 - DNA, 20 bp, mouse
gtaagacaggtagggctcag

SEQ ID NO: 505114 - DNA, 20 bp, mouse
gacacccccagggatgacgg

SEQ ID NO: 505115 - DNA, 20 bp, mouse
ggccccgccagcgatcccct

SEQ ID NO: 505116 - DNA, 20 bp, mouse
ggccgagggtgagggttcta

SEQ ID NO: 505117 - DNA, 20 bp, mouse
ggagcctggcagatccaggg

SEQ ID NO: 505118 - DNA, 20 bp, mouse
gggattccctgggcctgggt

SEQ ID NO: 505119 - DNA, 20 bp, mouse
gaggcaccccaggacaaggg

SEQ ID NO: 505120 - DNA, 20 bp, mouse
ggagctggagatgccccctg

SEQ ID NO: 505121 - DNA, 20 bp, mouse
gtgcaggcgccgttcgagct

SEQ ID NO: 505122 - DNA, 20 bp, mouse
gaaatcgctcccagctcgaa

SEQ ID NO: 505123 - DNA, 20 bp, mouse
gacggggccaaggatatcga

SEQ ID NO: 505124 - DNA, 20 bp, mouse
gctgaggcaccccaggacaa

SEQ ID NO: 505125 - DNA, 20 bp, mouse
gccactggctagccatcccg

SEQ ID NO: 505126 - DNA, 20 bp, mouse
gcagcaatatacaattataa

SEQ ID NO: 505127 - DNA, 20 bp, mouse
gcgcagagcaggcccatctc

SEQ ID NO: 505128 - DNA, 20 bp, mouse
gcgtcaggagggagaatcag

SEQ ID NO: 505129 - DNA, 20 bp, mouse
gcaatggagcaatttcgcgg

SEQ ID NO: 505130 - DNA, 20 bp, mouse
gctccctggtctctgaaggg

SEQ ID NO: 505131 - DNA, 20 bp, mouse
gtgaatttgagagggagatt

SEQ ID NO: 505132 - DNA, 20 bp, mouse
gacactcggcgagcgatggc

SEQ ID NO: 505133 - DNA, 20 bp, mouse
gtgataaatacaagcgtatg

SEQ ID NO: 505134 - DNA, 20 bp, mouse
ggggaaggaagtcagacact

SEQ ID NO: 505135 - DNA, 20 bp, mouse
gttcatccaggggaactcgg

SEQ ID NO: 505136 - DNA, 20 bp, mouse
gtagggcaaccacactgtgg

SEQ ID NO: 505137 - DNA, 20 bp, mouse
gcggccaagccgccacagtg

SEQ ID NO: 505138 - DNA, 20 bp, mouse
gagggcgtaccagtcttata

SEQ ID NO: 505139 - DNA, 20 bp, mouse
gttatagggcaaccacactg

SEQ ID NO: 505140 - DNA, 20 bp, mouse
gcccggctagggagcccgag

SEQ ID NO: 505141 - DNA, 20 bp, mouse
ggccattgttacggagagta

SEQ ID NO: 505142 - DNA, 20 bp, mouse
ggctcggctcgccgagaatc

SEQ ID NO: 505143 - DNA, 20 bp, mouse
ggagcccggagccggattct

SEQ ID NO: 505144 - DNA, 20 bp, mouse
gtcgccgagaatccggctcc

SEQ ID NO: 505145 - DNA, 20 bp, mouse
gtgtggttgccctataagac

SEQ ID NO: 505146 - DNA, 20 bp, mouse
gggcaattcccagaaattaa

SEQ ID NO: 505147 - DNA, 20 bp, mouse
ggagcccgaggggacagccc

SEQ ID NO: 505148 - DNA, 20 bp, mouse
ggcatccaggggtagacgac

SEQ ID NO: 505149 - DNA, 20 bp, mouse
gcccgggcagcgcagcgagg

SEQ ID NO: 505150 - DNA, 20 bp, mouse
gcgtagcgctgcacagtgca

SEQ ID NO: 505151 - DNA, 20 bp, mouse
gtagtttgagttgatcaaaa

SEQ ID NO: 505152 - DNA, 20 bp, mouse
gggccgccggcgtagtaccc

SEQ ID NO: 505153 - DNA, 20 bp, mouse
gtgagcacgggtgagtgcgt

SEQ ID NO: 505154 - DNA, 20 bp, mouse
gtgaatactcctcgcacgga

SEQ ID NO: 505155 - DNA, 20 bp, mouse
gtggctgcactggagcccga

SEQ ID NO: 505156 - DNA, 20 bp, mouse
gtcatttgggtgattttgga

SEQ ID NO: 505157 - DNA, 20 bp, mouse
gagggactcgggcgaggaca

SEQ ID NO: 505158 - DNA, 20 bp, mouse
gtctctgagcggctcttaca

SEQ ID NO: 505159 - DNA, 20 bp, mouse
gccgtaagagccggtgtgca

SEQ ID NO: 505160 - DNA, 20 bp, mouse
gatcccgctgccatgcacac

SEQ ID NO: 505161 - DNA, 20 bp, mouse
gcttacggctacaattacaa

SEQ ID NO: 505162 - DNA, 20 bp, mouse
gtggggtcgcctggtcggaa

SEQ ID NO: 505163 - DNA, 20 bp, mouse
ggggcttgatttgtggatcg

SEQ ID NO: 505164 - DNA, 20 bp, mouse
gggctgtcgccgttagtgca

SEQ ID NO: 505165 - DNA, 20 bp, mouse
gtcctctgagcccgaggaag

SEQ ID NO: 505166 - DNA, 20 bp, mouse
gtagtgctccgacctaggtg

SEQ ID NO: 505167 - DNA, 20 bp, mouse
gggagcactaccgtccttca

SEQ ID NO: 505168 - DNA, 20 bp, mouse
ggacggtagtgctccgacct

SEQ ID NO: 505169 - DNA, 20 bp, mouse
gtcttttggacaccacacct

SEQ ID NO: 505170 - DNA, 20 bp, mouse
gttggacaccacacctaggt

SEQ ID NO: 505171 - DNA, 20 bp, mouse
ggatatcaggctgcagtcct

SEQ ID NO: 505172 - DNA, 20 bp, mouse
ggtctgagaaggggaaacga

SEQ ID NO: 505173 - DNA, 20 bp, mouse
gaggttgggacaatattatc

SEQ ID NO: 505174 - DNA, 20 bp, mouse
gttataatgcagcattcttt

SEQ ID NO: 505175 - DNA, 20 bp, mouse
gaaacgacggctctcaggtt

SEQ ID NO: 505176 - DNA, 20 bp, mouse
gaggaactcatcgggagggg

SEQ ID NO: 505177 - DNA, 20 bp, mouse
gaaacccggcggagcagcag

SEQ ID NO: 505178 - DNA, 20 bp, mouse
gctggccagagtgacgggga

SEQ ID NO: 505179 - DNA, 20 bp, mouse
gcccgctggccagagtgacg

SEQ ID NO: 505180 - DNA, 20 bp, mouse
gccggctggtgggtaatagg

SEQ ID NO: 505181 - DNA, 20 bp, mouse
gaataggaactcatcgggag

SEQ ID NO: 505182 - DNA, 20 bp, mouse
ggcgccggcccataatcaca

SEQ ID NO: 505183 - DNA, 20 bp, mouse
gcaacaaatcataaacccgg

SEQ ID NO: 505184 - DNA, 20 bp, mouse
gcatagccagacgagtagag

SEQ ID NO: 505185 - DNA, 20 bp, mouse
gaaggtggagttcacgaaat

SEQ ID NO: 505186 - DNA, 20 bp, mouse
ggagtacagaccctgcaccg

SEQ ID NO: 505187 - DNA, 20 bp, mouse
gtacagaccctgcaccgagg

SEQ ID NO: 505188 - DNA, 20 bp, mouse
gcgggctatggagcaggtcc

SEQ ID NO: 505189 - DNA, 20 bp, mouse
gtggccggatgatttgtagt

SEQ ID NO: 505190 - DNA, 20 bp, mouse
ggcccggacacaccccggag

SEQ ID NO: 505191 - DNA, 20 bp, mouse
ggtcggggacgttttagtgt

SEQ ID NO: 505192 - DNA, 20 bp, mouse
ggggtcgcccggacacaccc

SEQ ID NO: 505193 - DNA, 20 bp, mouse
ggagcagagggactcggact

SEQ ID NO: 505194 - DNA, 20 bp, mouse
gtccatagcccgggcgctgg

SEQ ID NO: 505195 - DNA, 20 bp, mouse
gatacaatgaactcataatt

SEQ ID NO: 505196 - DNA, 20 bp, mouse
gagggtctggtagcgactgt

SEQ ID NO: 505197 - DNA, 20 bp, mouse
ggtagcgactgtaggtctgg

SEQ ID NO: 505198 - DNA, 20 bp, mouse
gctggtagcgactgtaggtc

SEQ ID NO: 505199 - DNA, 20 bp, mouse
gagtcagatagggattaaat

SEQ ID NO: 505200 - DNA, 20 bp, mouse
gcagccgccggacgcaggcg

SEQ ID NO: 505201 - DNA, 20 bp, mouse
gtccgcttgcgagtcagata

SEQ ID NO: 505202 - DNA, 20 bp, mouse
gcggcctcgcctgcgtccgg

SEQ ID NO: 505203 - DNA, 20 bp, mouse
gcccagcagccgccggacgc

SEQ ID NO: 505204 - DNA, 20 bp, mouse
gagcagggcgatgcgcagaa

SEQ ID NO: 505205 - DNA, 20 bp, mouse
gcagaagggtgacaagaagt

SEQ ID NO: 505206 - DNA, 20 bp, mouse
gcggacagaacgcagagcga

SEQ ID NO: 505207 - DNA, 20 bp, mouse
gctagagcgagagagcgcca

SEQ ID NO: 505208 - DNA, 20 bp, mouse
gaccctcgccaggaaaggag

SEQ ID NO: 505209 - DNA, 20 bp, mouse
gtagtcaccctcgccaggaa

SEQ ID NO: 505210 - DNA, 20 bp, mouse
gggcttctgggtactcctcc

SEQ ID NO: 505211 - DNA, 20 bp, mouse
gtggtgtacggtcccagcag

SEQ ID NO: 505212 - DNA, 20 bp, mouse
gtgtacggtcccagcagcgg

SEQ ID NO: 505213 - DNA, 20 bp, mouse
gtagagaccccgcatcctat

SEQ ID NO: 505214 - DNA, 20 bp, mouse
ggctctgcgttctgtccggg

SEQ ID NO: 505215 - DNA, 20 bp, mouse
gaagcgaggacctctttaag

SEQ ID NO: 505216 - DNA, 20 bp, mouse
gtggctgagaagttgagcag

SEQ ID NO: 505217 - DNA, 20 bp, mouse
gcgcccaagcagggaaaagg

SEQ ID NO: 505218 - DNA, 20 bp, mouse
gcccaggaggcgccgaacac

SEQ ID NO: 505219 - DNA, 20 bp, mouse
ggccctggggctgcaggtag

SEQ ID NO: 505220 - DNA, 20 bp, mouse
gctgctccactgtactttgt

SEQ ID NO: 505221 - DNA, 20 bp, mouse
gccgaggcgtgcgggctcag

SEQ ID NO: 505222 - DNA, 20 bp, mouse
gttgcaaggagctccgagcc

SEQ ID NO: 505223 - DNA, 20 bp, mouse
ggctgcacgaggggaagtcc

SEQ ID NO: 505224 - DNA, 20 bp, mouse
gacagacggcaggctccccg

SEQ ID NO: 505225 - DNA, 20 bp, mouse
gcggcgcccaagcagggaaa

SEQ ID NO: 505226 - DNA, 20 bp, mouse
gcagctgcgagaggtaggac

SEQ ID NO: 505227 - DNA, 20 bp, mouse
ggagtccagctgcgagaggt

SEQ ID NO: 505228 - DNA, 20 bp, mouse
gaactcgtacgcggagccct

SEQ ID NO: 505229 - DNA, 20 bp, mouse
gtgcgagaggtaggacgggt

SEQ ID NO: 505230 - DNA, 20 bp, mouse
gtctcgcagctggactcctg

SEQ ID NO: 505231 - DNA, 20 bp, mouse
ggttcggagttacattgcga

SEQ ID NO: 505232 - DNA, 20 bp, mouse
gggtaggaacaggaggacag

SEQ ID NO: 505233 - DNA, 20 bp, mouse
ggtaactccgaactcgtacg

SEQ ID NO: 505234 - DNA, 20 bp, mouse
gtcaactgcggggtgatgag

SEQ ID NO: 505235 - DNA, 20 bp, mouse
gctctctccaagagggacga

SEQ ID NO: 505236 - DNA, 20 bp, mouse
ggtccaaaacctccagccgg

SEQ ID NO: 505237 - DNA, 20 bp, mouse
gtgtttaactcggtcaacct

SEQ ID NO: 505238 - DNA, 20 bp, mouse
gacgagagggagcctggggt

SEQ ID NO: 505239 - DNA, 20 bp, mouse
gcgccttcgcgcaaggagag

SEQ ID NO: 505240 - DNA, 20 bp, mouse
gcggtccgggaggtctccta

SEQ ID NO: 505241 - DNA, 20 bp, mouse
gtctgacgagagggagcctg

SEQ ID NO: 505242 - DNA, 20 bp, mouse
gaagagacggtggagaactc

SEQ ID NO: 505243 - DNA, 20 bp, mouse
gcgggtccaaaacctccagc

SEQ ID NO: 505244 - DNA, 20 bp, mouse
ggcacgtagtaagtgcaact

SEQ ID NO: 505245 - DNA, 20 bp, mouse
gcgcccctctccttgcgcga

SEQ ID NO: 505246 - DNA, 20 bp, mouse
gggtcgggccccgcggaaat

SEQ ID NO: 505247 - DNA, 20 bp, mouse
gctgtgtggatattcaccag

SEQ ID NO: 505248 - DNA, 20 bp, mouse
gacacgggactgccgagata

SEQ ID NO: 505249 - DNA, 20 bp, mouse
ggctacccacagccctatct

SEQ ID NO: 505250 - DNA, 20 bp, mouse
gctcgcgtggaggatagcaa

SEQ ID NO: 505251 - DNA, 20 bp, mouse
gactgccgagatagggctgt

SEQ ID NO: 505252 - DNA, 20 bp, mouse
gaaggcgggttgagagacac

SEQ ID NO: 505253 - DNA, 20 bp, mouse
gcctgaatcctgggtttgtg

SEQ ID NO: 505254 - DNA, 20 bp, mouse
gccctgacgcgcggaagttg

SEQ ID NO: 505255 - DNA, 20 bp, mouse
ggaacccggagcgggacccg

SEQ ID NO: 505256 - DNA, 20 bp, mouse
ggtctatgaggacagcgcgg

SEQ ID NO: 505257 - DNA, 20 bp, mouse
gcggcgggcgggccaataca

SEQ ID NO: 505258 - DNA, 20 bp, mouse
ggtgtagacggcgccctgag

SEQ ID NO: 505259 - DNA, 20 bp, mouse
gtacgtctatgaggacagcg

SEQ ID NO: 505260 - DNA, 20 bp, mouse
gagacgtacataaggctctc

SEQ ID NO: 505261 - DNA, 20 bp, mouse
gaaggctctccggccagcgc

SEQ ID NO: 505262 - DNA, 20 bp, mouse
gcgccctgaggggcacccag

SEQ ID NO: 505263 - DNA, 20 bp, mouse
ggtcctcatagacgtacata

SEQ ID NO: 505264 - DNA, 20 bp, mouse
gctcctctgggtgcccctca

SEQ ID NO: 505265 - DNA, 20 bp, mouse
gtgccagaggcagcgagcta

SEQ ID NO: 505266 - DNA, 20 bp, mouse
gagggtcgctagctagtagg

SEQ ID NO: 505267 - DNA, 20 bp, mouse
gtacagggtcgctagctagt

SEQ ID NO: 505268 - DNA, 20 bp, mouse
gagctagtaggagggcttta

SEQ ID NO: 505269 - DNA, 20 bp, mouse
gcagggtagctagggcgcgg

SEQ ID NO: 505270 - DNA, 20 bp, mouse
gtggtgggtacagctcctgg

SEQ ID NO: 505271 - DNA, 20 bp, mouse
gtgatcattaatttctggag

SEQ ID NO: 505272 - DNA, 20 bp, mouse
gagggcgcggaggcggtggt

SEQ ID NO: 505273 - DNA, 20 bp, mouse
ggaggcgccggctcgcagag

SEQ ID NO: 505274 - DNA, 20 bp, mouse
gcggtggtgggtacagctcc

SEQ ID NO: 505275 - DNA, 20 bp, mouse
ggagcggctgcgatttctca

SEQ ID NO: 505276 - DNA, 20 bp, mouse
ggctacgtaggagctcatgg

SEQ ID NO: 505277 - DNA, 20 bp, mouse
gtaggagctcatggcgggga

SEQ ID NO: 505278 - DNA, 20 bp, mouse
gtctaccccgtggagagagt

SEQ ID NO: 505279 - DNA, 20 bp, mouse
gccccgtggagagagttgga

SEQ ID NO: 505280 - DNA, 20 bp, mouse
ggctctgggcagagacgaag

SEQ ID NO: 505281 - DNA, 20 bp, mouse
gagaggagcaggcgcagaca

SEQ ID NO: 505282 - DNA, 20 bp, mouse
gccgctccgggacacgctct

SEQ ID NO: 505283 - DNA, 20 bp, mouse
gaggcatccaggtactgcta

SEQ ID NO: 505284 - DNA, 20 bp, mouse
gggcagccatgtctaccccg

SEQ ID NO: 505285 - DNA, 20 bp, mouse
ggagcgagctaagagcagtg

SEQ ID NO: 505286 - DNA, 20 bp, mouse
gcaatggttaggctcttaca

SEQ ID NO: 505287 - DNA, 20 bp, mouse
gggtttccctggcaatggtt

SEQ ID NO: 505288 - DNA, 20 bp, mouse
gtacagggaggactgttctg

SEQ ID NO: 505289 - DNA, 20 bp, mouse
gtggttaggctcttacaggg

SEQ ID NO: 505290 - DNA, 20 bp, mouse
gggccagagggtcgggtata

SEQ ID NO: 505291 - DNA, 20 bp, mouse
ggcgcaggtttccctggcaa

SEQ ID NO: 505292 - DNA, 20 bp, mouse
gcgaccctctggcccccaag

SEQ ID NO: 505293 - DNA, 20 bp, mouse
gaagagcctaaccattgcca

SEQ ID NO: 505294 - DNA, 20 bp, mouse
gttctgcggagcgctcggaa

SEQ ID NO: 505295 - DNA, 20 bp, mouse
gtgaacggagcgcccagcgc

SEQ ID NO: 505296 - DNA, 20 bp, mouse
gctctctgctcactgtcggt

SEQ ID NO: 505297 - DNA, 20 bp, mouse
gtgccggctgcgggctcggg

SEQ ID NO: 505298 - DNA, 20 bp, mouse
gcgaagtaggagctcatgct

SEQ ID NO: 505299 - DNA, 20 bp, mouse
ggagtctgaggaattcgcct

SEQ ID NO: 505300 - DNA, 20 bp, mouse
gaattcgcctgggctgttag

SEQ ID NO: 505301 - DNA, 20 bp, mouse
ggccgtggtggaagaagtct

SEQ ID NO: 505302 - DNA, 20 bp, mouse
ggcccagcagtccagcccgg

SEQ ID NO: 505303 - DNA, 20 bp, mouse
ggggagcgtgatccaagggg

SEQ ID NO: 505304 - DNA, 20 bp, mouse
gagcgtgatccaaggggagg

SEQ ID NO: 505305 - DNA, 20 bp, mouse
ggggaaccggcagtcgtaat

SEQ ID NO: 505306 - DNA, 20 bp, mouse
ggcagcctcccgcccaggga

SEQ ID NO: 505307 - DNA, 20 bp, mouse
gggagccaagaagcaggtaa

SEQ ID NO: 505308 - DNA, 20 bp, mouse
gggcagcagcctcccgccca

SEQ ID NO: 505309 - DNA, 20 bp, mouse
gaggtaaaggaggctttctg

SEQ ID NO: 505310 - DNA, 20 bp, mouse
gacccgggcactccttccaa

SEQ ID NO: 505311 - DNA, 20 bp, mouse
gtccccacggccacagaggc

SEQ ID NO: 505312 - DNA, 20 bp, mouse
ggcttccctccctgggcggg

SEQ ID NO: 505313 - DNA, 20 bp, mouse
gccgtggggagccaagaagc

SEQ ID NO: 505314 - DNA, 20 bp, mouse
ggcgcccaccaggcctggaa

SEQ ID NO: 505315 - DNA, 20 bp, mouse
ggccctgcctctgtggccgt

SEQ ID NO: 505316 - DNA, 20 bp, mouse
gggctcggcgagggcagcgg

SEQ ID NO: 505317 - DNA, 20 bp, mouse
gggagctgcgcagacctgca

SEQ ID NO: 505318 - DNA, 20 bp, mouse
gacctcgggctcgctcgcca

SEQ ID NO: 505319 - DNA, 20 bp, mouse
ggcgagcccgaggtaaatag

SEQ ID NO: 505320 - DNA, 20 bp, mouse
ggctcgccatggctcggcga

SEQ ID NO: 505321 - DNA, 20 bp, mouse
gggctcgctccgcacgacct

SEQ ID NO: 505322 - DNA, 20 bp, mouse
gggcagcgggggtagcggga

SEQ ID NO: 505323 - DNA, 20 bp, mouse
ggggctcgctcgccatggct

SEQ ID NO: 505324 - DNA, 20 bp, mouse
gtgcagccggccttccccct

SEQ ID NO: 505325 - DNA, 20 bp, mouse
gcccaagaagccatactcgg

SEQ ID NO: 505326 - DNA, 20 bp, mouse
gtagcagcaggagagctgtt

SEQ ID NO: 505327 - DNA, 20 bp, mouse
gtagcgatgtcagcctacaa

SEQ ID NO: 505328 - DNA, 20 bp, mouse
ggcaggagagctgttgggaa

SEQ ID NO: 505329 - DNA, 20 bp, mouse
ggcgcagacatggggaccta

SEQ ID NO: 505330 - DNA, 20 bp, mouse
gctgttgggaaaggacattt

SEQ ID NO: 505331 - DNA, 20 bp, mouse
gccatgtctgcgctaggtgg

SEQ ID NO: 505332 - DNA, 20 bp, mouse
gaaagacgggagcagtccac

SEQ ID NO: 505333 - DNA, 20 bp, mouse
gctctggtacgaagggacct

SEQ ID NO: 505334 - DNA, 20 bp, mouse
gcctatggaatgcaaacctg

SEQ ID NO: 505335 - DNA, 20 bp, mouse
gtgtctacttgaggtatata

SEQ ID NO: 505336 - DNA, 20 bp, mouse
gtggcggcagatgcgcccag

SEQ ID NO: 505337 - DNA, 20 bp, mouse
gggcgggcggcccagtccgg

SEQ ID NO: 505338 - DNA, 20 bp, mouse
gcagcggtggcagccgccgg

SEQ ID NO: 505339 - DNA, 20 bp, mouse
gcatctgccgccaccggact

SEQ ID NO: 505340 - DNA, 20 bp, mouse
ggtcacctgcgcgccgccgg

SEQ ID NO: 505341 - DNA, 20 bp, mouse
ggcgggcgggcggcccagtc

SEQ ID NO: 505342 - DNA, 20 bp, mouse
ggagccgtcccggggcgtgt

SEQ ID NO: 505343 - DNA, 20 bp, mouse
gctgcagcgcagcctgctca

SEQ ID NO: 505344 - DNA, 20 bp, mouse
gcagcgcgggcgggctaagg

SEQ ID NO: 505345 - DNA, 20 bp, mouse
gccggtcacctgcgcgccgc

SEQ ID NO: 505346 - DNA, 20 bp, mouse
gtctacagagctggctatgt

SEQ ID NO: 505347 - DNA, 20 bp, mouse
ggcccagagccggtcaagta

SEQ ID NO: 505348 - DNA, 20 bp, mouse
gggctgagagaagcctccaa

SEQ ID NO: 505349 - DNA, 20 bp, mouse
ggagaagcctccaaaggcag

SEQ ID NO: 505350 - DNA, 20 bp, mouse
gtggaaaagtagaaagagtc

SEQ ID NO: 505351 - DNA, 20 bp, mouse
gcacagccgaggccctttgt

SEQ ID NO: 505352 - DNA, 20 bp, mouse
gtgaaccagactagactcgg

SEQ ID NO: 505353 - DNA, 20 bp, mouse
gcaacccggaataggaggac

SEQ ID NO: 505354 - DNA, 20 bp, mouse
gcggctgcgttcctcagatg

SEQ ID NO: 505355 - DNA, 20 bp, mouse
gaataggaggacgggctcag

SEQ ID NO: 505356 - DNA, 20 bp, mouse
gccgcggaacacagcgagga

SEQ ID NO: 505357 - DNA, 20 bp, mouse
gcgcgccgcggaacacagcg

SEQ ID NO: 505358 - DNA, 20 bp, mouse
gcagtgtcgcggcttcctgt

SEQ ID NO: 505359 - DNA, 20 bp, mouse
gggcgctgctacggaggagg

SEQ ID NO: 505360 - DNA, 20 bp, mouse
ggaggcgggaggctcgcgga

SEQ ID NO: 505361 - DNA, 20 bp, mouse
gtggccaggcgctgctacgg

SEQ ID NO: 505362 - DNA, 20 bp, mouse
gcatgtcccaagtccccgag

SEQ ID NO: 505363 - DNA, 20 bp, mouse
ggctggcgcgggacactctt

SEQ ID NO: 505364 - DNA, 20 bp, mouse
gtgtgcgctcagaggtccct

SEQ ID NO: 505365 - DNA, 20 bp, mouse
gccagcgcgggagcgcccgg

SEQ ID NO: 505366 - DNA, 20 bp, mouse
gagaggtgggctctagtcgc

SEQ ID NO: 505367 - DNA, 20 bp, mouse
gctccctgctggagtgtgag

SEQ ID NO: 505368 - DNA, 20 bp, mouse
gctgggaaagcagaatgcgg

SEQ ID NO: 505369 - DNA, 20 bp, mouse
ggttgctggagggatcgggt

SEQ ID NO: 505370 - DNA, 20 bp, mouse
ggaccacgcgatcccgcagc

SEQ ID NO: 505371 - DNA, 20 bp, mouse
gggtaggaagctcgggacca

SEQ ID NO: 505372 - DNA, 20 bp, mouse
gctaacctttgtctctgcag

SEQ ID NO: 505373 - DNA, 20 bp, mouse
ggcgagctgcggtggagtcg

SEQ ID NO: 505374 - DNA, 20 bp, mouse
ggggatcgggtaggaagctc

SEQ ID NO: 505375 - DNA, 20 bp, mouse
gaaagagggggtgaggctct

SEQ ID NO: 505376 - DNA, 20 bp, mouse
ggagtgcgcgcggcccacgg

SEQ ID NO: 505377 - DNA, 20 bp, mouse
gtcgctccctctcctcgcag

SEQ ID NO: 505378 - DNA, 20 bp, mouse
gcgaggagagggagcgagat

SEQ ID NO: 505379 - DNA, 20 bp, mouse
ggccccgccactgcgaggag

SEQ ID NO: 505380 - DNA, 20 bp, mouse
gccctctcctcgcagtggcg

SEQ ID NO: 505381 - DNA, 20 bp, mouse
ggcccacgggggagacgctt

SEQ ID NO: 505382 - DNA, 20 bp, mouse
ggcctaagcgtctcccccgt

SEQ ID NO: 505383 - DNA, 20 bp, mouse
ggcctcgccggcgcgcaccg

SEQ ID NO: 505384 - DNA, 20 bp, mouse
gttcgcgccccgccactgcg

SEQ ID NO: 505385 - DNA, 20 bp, mouse
gtcgtctccctgcagagcgg

SEQ ID NO: 505386 - DNA, 20 bp, mouse
ggggcagtggaaccttgggt

SEQ ID NO: 505387 - DNA, 20 bp, mouse
gagggtgccactggacgaca

SEQ ID NO: 505388 - DNA, 20 bp, mouse
gcagcctgcgaactagtcgg

SEQ ID NO: 505389 - DNA, 20 bp, mouse
ggccactggacgacatggtg

SEQ ID NO: 505390 - DNA, 20 bp, mouse
ggcggtgggcagtggaacct

SEQ ID NO: 505391 - DNA, 20 bp, mouse
ggccaccgcggaccacgagg

SEQ ID NO: 505392 - DNA, 20 bp, mouse
gctgcagcctgcgaactagt

SEQ ID NO: 505393 - DNA, 20 bp, mouse
ggccgctcggcggtgggcag

SEQ ID NO: 505394 - DNA, 20 bp, mouse
gtccactgcccaccgccgag

SEQ ID NO: 505395 - DNA, 20 bp, mouse
gctacacgaggcgaactcgg

SEQ ID NO: 505396 - DNA, 20 bp, mouse
ggcaagagaggtccacgatg

SEQ ID NO: 505397 - DNA, 20 bp, mouse
gtactcaaagtgggaagcgt

SEQ ID NO: 505398 - DNA, 20 bp, mouse
gtactcggtgtactcaaagt

SEQ ID NO: 505399 - DNA, 20 bp, mouse
gaagtgggaagcgtgggctg

SEQ ID NO: 505400 - DNA, 20 bp, mouse
gggctgggctgtgctgactc

SEQ ID NO: 505401 - DNA, 20 bp, mouse
gctccccgtagacttatact

SEQ ID NO: 505402 - DNA, 20 bp, mouse
gtctcttgcctctctctgga

SEQ ID NO: 505403 - DNA, 20 bp, mouse
gaaaacccctgaggcataaa

SEQ ID NO: 505404 - DNA, 20 bp, mouse
gtacaccgagtataagtcta

SEQ ID NO: 505405 - DNA, 20 bp, mouse
ggaggcataaagggctcggc

SEQ ID NO: 505406 - DNA, 20 bp, mouse
ggccattacggagtccccag

SEQ ID NO: 505407 - DNA, 20 bp, mouse
gggacagcggtgtcgcgagt

SEQ ID NO: 505408 - DNA, 20 bp, mouse
gcaacgccgagaggccgtac

SEQ ID NO: 505409 - DNA, 20 bp, mouse
gggaggagcagcgaagacaa

SEQ ID NO: 505410 - DNA, 20 bp, mouse
gcggcgcccgcgttcccgta

SEQ ID NO: 505411 - DNA, 20 bp, mouse
ggtcggcgatcggtggtccg

SEQ ID NO: 505412 - DNA, 20 bp, mouse
gaccactggggactccgtaa

SEQ ID NO: 505413 - DNA, 20 bp, mouse
ggtcgcgagtcggcgatcgg

SEQ ID NO: 505414 - DNA, 20 bp, mouse
ggcgaagcgacagcgcccag

SEQ ID NO: 505415 - DNA, 20 bp, mouse
gtccgtgcgcgagtgagtag

SEQ ID NO: 505416 - DNA, 20 bp, mouse
gaccgactgcgcagagaagg

SEQ ID NO: 505417 - DNA, 20 bp, mouse
gcccagtgcgggaagaatgg

SEQ ID NO: 505418 - DNA, 20 bp, mouse
gcgacgcgcgatttccccag

SEQ ID NO: 505419 - DNA, 20 bp, mouse
gtctacaagtcgacacggag

SEQ ID NO: 505420 - DNA, 20 bp, mouse
gcggccctgcgcccaggtag

SEQ ID NO: 505421 - DNA, 20 bp, mouse
gccaggagccggccacttgg

SEQ ID NO: 505422 - DNA, 20 bp, mouse
gtctgagggaggaatccgat

SEQ ID NO: 505423 - DNA, 20 bp, mouse
gaggcttggaggggatgcta

SEQ ID NO: 505424 - DNA, 20 bp, mouse
gcagtcccaaggtcttccag

SEQ ID NO: 505425 - DNA, 20 bp, mouse
gtcccgagccagatgaactg

SEQ ID NO: 505426 - DNA, 20 bp, mouse
gccaggagagagcgaggtgt

SEQ ID NO: 505427 - DNA, 20 bp, mouse
gccgccagcccgggaaggaa

SEQ ID NO: 505428 - DNA, 20 bp, mouse
ggccggcccaggagagagcg

SEQ ID NO: 505429 - DNA, 20 bp, mouse
ggtccagctccagagccggt

SEQ ID NO: 505430 - DNA, 20 bp, mouse
gagaaggcgggacccggagg

SEQ ID NO: 505431 - DNA, 20 bp, mouse
gtccagagccggtaggaaag

SEQ ID NO: 505432 - DNA, 20 bp, mouse
gggtcgcagagcaggcgcgg

SEQ ID NO: 505433 - DNA, 20 bp, mouse
gcttgggctcgagaagccag

SEQ ID NO: 505434 - DNA, 20 bp, mouse
gcaaaaggatccgccggccc

SEQ ID NO: 505435 - DNA, 20 bp, mouse
ggagagacaaaaggatccgc

SEQ ID NO: 505436 - DNA, 20 bp, mouse
ggcggacgacaggctctgta

SEQ ID NO: 505437 - DNA, 20 bp, mouse
ggacaaggctggctatcagg

SEQ ID NO: 505438 - DNA, 20 bp, mouse
ggatctgagcagatgaggat

SEQ ID NO: 505439 - DNA, 20 bp, mouse
gaccctgggtctgtcatagg

SEQ ID NO: 505440 - DNA, 20 bp, mouse
gagtgatacaagaactgggg

SEQ ID NO: 505441 - DNA, 20 bp, mouse
gctgaccctgggtctgtcat

SEQ ID NO: 505442 - DNA, 20 bp, mouse
gcataggtggacagccatct

SEQ ID NO: 505443 - DNA, 20 bp, mouse
gtggctatcaggcggacgac

SEQ ID NO: 505444 - DNA, 20 bp, mouse
gtctggagtaggagcctcag

SEQ ID NO: 505445 - DNA, 20 bp, mouse
gaatagtgatacaagaactg

SEQ ID NO: 505446 - DNA, 20 bp, mouse
gagggagaccgctaagaccc

SEQ ID NO: 505447 - DNA, 20 bp, mouse
ggacccaggcagacttacca

SEQ ID NO: 505448 - DNA, 20 bp, mouse
gtggtggtcagacctctacc

SEQ ID NO: 505449 - DNA, 20 bp, mouse
ggacttaccatggttgatgg

SEQ ID NO: 505450 - DNA, 20 bp, mouse
ggtctgaccaccatcaacca

SEQ ID NO: 505451 - DNA, 20 bp, mouse
ggacctctaccaggaagact

SEQ ID NO: 505452 - DNA, 20 bp, mouse
gaagtctgcctgggtcttag

SEQ ID NO: 505453 - DNA, 20 bp, mouse
gtgggtcgttggcactcaca

SEQ ID NO: 505454 - DNA, 20 bp, mouse
ggtcccagtcttcctggtag

SEQ ID NO: 505455 - DNA, 20 bp, mouse
ggagagtcactgtgggtcgt

SEQ ID NO: 505456 - DNA, 20 bp, mouse
ggaagccggctgaggaccac

SEQ ID NO: 505457 - DNA, 20 bp, mouse
gtgaggtggccctgccgaga

SEQ ID NO: 505458 - DNA, 20 bp, mouse
gggccacctcaaccagaagc

SEQ ID NO: 505459 - DNA, 20 bp, mouse
gctcaaccagaagccggctg

SEQ ID NO: 505460 - DNA, 20 bp, mouse
ggggactgaccctctcggca

SEQ ID NO: 505461 - DNA, 20 bp, mouse
gaggtcgcgaagtcaaactt

SEQ ID NO: 505462 - DNA, 20 bp, mouse
gagagcctgtggtcctcagc

SEQ ID NO: 505463 - DNA, 20 bp, mouse
ggtcccagaagaacagatcc

SEQ ID NO: 505464 - DNA, 20 bp, mouse
gcgacgggcgggcgcagtca

SEQ ID NO: 505465 - DNA, 20 bp, mouse
gccagaagaacagatccggg

SEQ ID NO: 505466 - DNA, 20 bp, mouse
ggacccgccatgcacgtgaa

SEQ ID NO: 505467 - DNA, 20 bp, mouse
gccggcgcggcacagggcat

SEQ ID NO: 505468 - DNA, 20 bp, mouse
ggtggctctggtgaccggcg

SEQ ID NO: 505469 - DNA, 20 bp, mouse
gagcagcagagcctcagcga

SEQ ID NO: 505470 - DNA, 20 bp, mouse
gatgcacgtgaacggcaaag

SEQ ID NO: 505471 - DNA, 20 bp, mouse
ggtgaacggcaaagtggctc

SEQ ID NO: 505472 - DNA, 20 bp, mouse
gtcgcgtctctgcgggtggt

SEQ ID NO: 505473 - DNA, 20 bp, mouse
gctggcagagaacccgaact

SEQ ID NO: 505474 - DNA, 20 bp, mouse
gtggtgaccggcgcggcaca

SEQ ID NO: 505475 - DNA, 20 bp, mouse
gcgggtcgcgtctctgcggg

SEQ ID NO: 505476 - DNA, 20 bp, mouse
gagacacggagacacggcac

SEQ ID NO: 505477 - DNA, 20 bp, mouse
gtctcaagctggggaagacg

SEQ ID NO: 505478 - DNA, 20 bp, mouse
gcacgtatacagggttgaag

SEQ ID NO: 505479 - DNA, 20 bp, mouse
ggcagtcacaagacagccag

SEQ ID NO: 505480 - DNA, 20 bp, mouse
gccagcttgagactgttcgg

SEQ ID NO: 505481 - DNA, 20 bp, mouse
gtatcaaggatgatcaagat

SEQ ID NO: 505482 - DNA, 20 bp, mouse
ggctacccagagctctttac

SEQ ID NO: 505483 - DNA, 20 bp, mouse
gaacagcgtcagctcactcc

SEQ ID NO: 505484 - DNA, 20 bp, mouse
gttggatccacagctcttac

SEQ ID NO: 505485 - DNA, 20 bp, mouse
gcacatggtcacgtagaaat

SEQ ID NO: 505486 - DNA, 20 bp, mouse
gacagcccggaaggcaaggg

SEQ ID NO: 505487 - DNA, 20 bp, mouse
gcggacagcccggaaggcaa

SEQ ID NO: 505488 - DNA, 20 bp, mouse
gcagcagcggacagcccgga

SEQ ID NO: 505489 - DNA, 20 bp, mouse
ggagcctgcggcctcacctg

SEQ ID NO: 505490 - DNA, 20 bp, mouse
gccagggagcagccgaccgt

SEQ ID NO: 505491 - DNA, 20 bp, mouse
gcgggctgtccgctgctgtg

SEQ ID NO: 505492 - DNA, 20 bp, mouse
gcctagggacaggaacaagg

SEQ ID NO: 505493 - DNA, 20 bp, mouse
ggccccctcctcctcaggtg

SEQ ID NO: 505494 - DNA, 20 bp, mouse
gagtcccaggctcccatcca

SEQ ID NO: 505495 - DNA, 20 bp, mouse
ggggctgctgaacatcagac

SEQ ID NO: 505496 - DNA, 20 bp, mouse
gcggccatgtcctgaacccc

SEQ ID NO: 505497 - DNA, 20 bp, mouse
gtggccgcaggtcgagtcac

SEQ ID NO: 505498 - DNA, 20 bp, mouse
gcccgggcacactgagatcc

SEQ ID NO: 505499 - DNA, 20 bp, mouse
gtctccagtgactcgacctg

SEQ ID NO: 505500 - DNA, 20 bp, mouse
ggtttcttgggcaactactt

SEQ ID NO: 505501 - DNA, 20 bp, mouse
gctagctccgacccacatta

SEQ ID NO: 505502 - DNA, 20 bp, mouse
gaacctggggctcacagagg

SEQ ID NO: 505503 - DNA, 20 bp, mouse
gtctcagagccgtgagaaaa

SEQ ID NO: 505504 - DNA, 20 bp, mouse
gccccaacctggaaagggta

SEQ ID NO: 505505 - DNA, 20 bp, mouse
gttacggttcccttttctca

SEQ ID NO: 505506 - DNA, 20 bp, mouse
gggtctgaggaggaagccgg

SEQ ID NO: 505507 - DNA, 20 bp, mouse
gtcggcatgacgggaccggt

SEQ ID NO: 505508 - DNA, 20 bp, mouse
ggtcggctcgcggcaaaaag

SEQ ID NO: 505509 - DNA, 20 bp, mouse
gcgggtcggcatgacgggac

SEQ ID NO: 505510 - DNA, 20 bp, mouse
gagcggtctgaggaggaagc

SEQ ID NO: 505511 - DNA, 20 bp, mouse
ggactgcgggtcggcatgac

SEQ ID NO: 505512 - DNA, 20 bp, mouse
gctgaggaggaagccggcgg

SEQ ID NO: 505513 - DNA, 20 bp, mouse
gggcaaaaagcggtctgagg

SEQ ID NO: 505514 - DNA, 20 bp, mouse
gcgcggcaaaaagcggtctg

SEQ ID NO: 505515 - DNA, 20 bp, mouse
gagcgtcgtggtgagccaag

SEQ ID NO: 505516 - DNA, 20 bp, mouse
gtccggtacgtgggcatcgt

SEQ ID NO: 505517 - DNA, 20 bp, mouse
gaggctggctacacgctggg

SEQ ID NO: 505518 - DNA, 20 bp, mouse
gagccgcggatccggtacgt

SEQ ID NO: 505519 - DNA, 20 bp, mouse
gtgcccacgtaccggatccg

SEQ ID NO: 505520 - DNA, 20 bp, mouse
gccgcaggctggctacacgc

SEQ ID NO: 505521 - DNA, 20 bp, mouse
gacccacgatgcccacgtac

SEQ ID NO: 505522 - DNA, 20 bp, mouse
gggtgaccaagcgcagtcct

SEQ ID NO: 505523 - DNA, 20 bp, mouse
ggccggaggtgcccaccgag

SEQ ID NO: 505524 - DNA, 20 bp, mouse
gtcctgggtcgcccctcggt

SEQ ID NO: 505525 - DNA, 20 bp, mouse
gccggaagcgcgccgcaggc

SEQ ID NO: 505526 - DNA, 20 bp, mouse
gcggcgcccggaccgctggg

SEQ ID NO: 505527 - DNA, 20 bp, mouse
ggacctgctccggctcccac

SEQ ID NO: 505528 - DNA, 20 bp, mouse
gttgtacagacgcaccatcc

SEQ ID NO: 505529 - DNA, 20 bp, mouse
gtacctgctgcgacccaaac

SEQ ID NO: 505530 - DNA, 20 bp, mouse
ggcctacagcgaagccggtg

SEQ ID NO: 505531 - DNA, 20 bp, mouse
gctccggctcccactggcag

SEQ ID NO: 505532 - DNA, 20 bp, mouse
gcagcgaagccggtgaggag

SEQ ID NO: 505533 - DNA, 20 bp, mouse
gccccaaagccgctcctcac

SEQ ID NO: 505534 - DNA, 20 bp, mouse
gcggaagccgcccagcggtc

SEQ ID NO: 505535 - DNA, 20 bp, mouse
gggctgctgacagtcagtgt

SEQ ID NO: 505536 - DNA, 20 bp, mouse
ggtcatcgccaagcccccac

SEQ ID NO: 505537 - DNA, 20 bp, mouse
ggggcgggcgcaggtatcgg

SEQ ID NO: 505538 - DNA, 20 bp, mouse
gatcgccaagcccccaccgg

SEQ ID NO: 505539 - DNA, 20 bp, mouse
ggcccccaccggcgggaggt

SEQ ID NO: 505540 - DNA, 20 bp, mouse
ggccgggcgggcgcaggtat

SEQ ID NO: 505541 - DNA, 20 bp, mouse
gacccacctcccgccggtgg

SEQ ID NO: 505542 - DNA, 20 bp, mouse
gtgatcgcggggctgccggg

SEQ ID NO: 505543 - DNA, 20 bp, mouse
gccaagcccccaccggcggg

SEQ ID NO: 505544 - DNA, 20 bp, mouse
gcatgacaccctaagagtac

SEQ ID NO: 505545 - DNA, 20 bp, mouse
ggggtccgcgcgtgatcgcg

SEQ ID NO: 505546 - DNA, 20 bp, mouse
gcgatcgctggtctctgggg

SEQ ID NO: 505547 - DNA, 20 bp, mouse
gagaacctcaggctgactag

SEQ ID NO: 505548 - DNA, 20 bp, mouse
gaagcgatcgctggtctctg

SEQ ID NO: 505549 - DNA, 20 bp, mouse
ggagcacgtgaccaccaccg

SEQ ID NO: 505550 - DNA, 20 bp, mouse
gccggaccggatgctctcta

SEQ ID NO: 505551 - DNA, 20 bp, mouse
ggttcaggttccgctgtcaa

SEQ ID NO: 505552 - DNA, 20 bp, mouse
ggccaggttcacagaacctc

SEQ ID NO: 505553 - DNA, 20 bp, mouse
gactcaacaccccttgacag

SEQ ID NO: 505554 - DNA, 20 bp, mouse
gctccgccgctcgagaccgg

SEQ ID NO: 505555 - DNA, 20 bp, mouse
gaacaggcgggaatcggtgg

SEQ ID NO: 505556 - DNA, 20 bp, mouse
gtgctagtcctggtacccgg

SEQ ID NO: 505557 - DNA, 20 bp, mouse
gtggtacccgggggagtgca

SEQ ID NO: 505558 - DNA, 20 bp, mouse
gtggctcacctcattcacca

SEQ ID NO: 505559 - DNA, 20 bp, mouse
gaaggcctgatcgcccagtg

SEQ ID NO: 505560 - DNA, 20 bp, mouse
ggaggccggactgctagtcc

SEQ ID NO: 505561 - DNA, 20 bp, mouse
gcagcaagtggcggccgtca

SEQ ID NO: 505562 - DNA, 20 bp, mouse
gaggccttggctagctcctg

SEQ ID NO: 505563 - DNA, 20 bp, mouse
gggagtcgacgttcagtcca

SEQ ID NO: 505564 - DNA, 20 bp, mouse
gtcacctcattcaccaggga

SEQ ID NO: 505565 - DNA, 20 bp, mouse
gcttccgtccctggtgaatg

SEQ ID NO: 505566 - DNA, 20 bp, mouse
ggccagaggcgaagcaggac

SEQ ID NO: 505567 - DNA, 20 bp, mouse
gaagcaggaccggttgcagg

SEQ ID NO: 505568 - DNA, 20 bp, mouse
gtactgagtcctggcgccag

SEQ ID NO: 505569 - DNA, 20 bp, mouse
gagggactcacgcttcggag

SEQ ID NO: 505570 - DNA, 20 bp, mouse
gggagccgaggacagacgaa

SEQ ID NO: 505571 - DNA, 20 bp, mouse
ggcccgctgccgggagagct

SEQ ID NO: 505572 - DNA, 20 bp, mouse
gggctcaagccccctgcaac

SEQ ID NO: 505573 - DNA, 20 bp, mouse
ggggatggagcgctgtggga

SEQ ID NO: 505574 - DNA, 20 bp, mouse
gtggtgatggacaggaacga

SEQ ID NO: 505575 - DNA, 20 bp, mouse
gaaggtgaggaagcgcgggt

SEQ ID NO: 505576 - DNA, 20 bp, mouse
gtcaccatcgagacccagta

SEQ ID NO: 505577 - DNA, 20 bp, mouse
gaatcagagggatttaatga

SEQ ID NO: 505578 - DNA, 20 bp, mouse
gaccagggctaggcacgagg

SEQ ID NO: 505579 - DNA, 20 bp, mouse
gtttccctactgggtctcga

SEQ ID NO: 505580 - DNA, 20 bp, mouse
ggagcaccaagaacccagtc

SEQ ID NO: 505581 - DNA, 20 bp, mouse
gctcacatcaagtagaatca

SEQ ID NO: 505582 - DNA, 20 bp, mouse
gctatcccctgctccaaagg

SEQ ID NO: 505583 - DNA, 20 bp, mouse
gtgcctgtagacagagctac

SEQ ID NO: 505584 - DNA, 20 bp, mouse
ggagacacacactttagata

SEQ ID NO: 505585 - DNA, 20 bp, mouse
gggctcgatttcttaaggta

SEQ ID NO: 505586 - DNA, 20 bp, mouse
gagcatggctaggacagcag

SEQ ID NO: 505587 - DNA, 20 bp, mouse
ggcagtggcgctaaatatcc

SEQ ID NO: 505588 - DNA, 20 bp, mouse
gattctggccctactcacgt

SEQ ID NO: 505589 - DNA, 20 bp, mouse
ggcacaggcccagcaacacc

SEQ ID NO: 505590 - DNA, 20 bp, mouse
gtgagctgcaaaggccacac

SEQ ID NO: 505591 - DNA, 20 bp, mouse
gagagggctggcaacagcca

SEQ ID NO: 505592 - DNA, 20 bp, mouse
gacttcggcaactctcccgt

SEQ ID NO: 505593 - DNA, 20 bp, mouse
gccctactcacgtaggaaga

SEQ ID NO: 505594 - DNA, 20 bp, mouse
ggatagaaatctgggtccag

SEQ ID NO: 505595 - DNA, 20 bp, mouse
ggtgagtagggccagaatta

SEQ ID NO: 505596 - DNA, 20 bp, mouse
gctgcctgctgcccacccct

SEQ ID NO: 505597 - DNA, 20 bp, mouse
gggcaagcacagtacccctc

SEQ ID NO: 505598 - DNA, 20 bp, mouse
ggccaagctgccactaatcc

SEQ ID NO: 505599 - DNA, 20 bp, mouse
gctctccccgcccggattag

SEQ ID NO: 505600 - DNA, 20 bp, mouse
ggaaggagccccggagagtc

SEQ ID NO: 505601 - DNA, 20 bp, mouse
gcagcttggcctgactctcc

SEQ ID NO: 505602 - DNA, 20 bp, mouse
gaccccagagacccttacct

SEQ ID NO: 505603 - DNA, 20 bp, mouse
gaagctgccactaatccggg

SEQ ID NO: 505604 - DNA, 20 bp, mouse
gtggtcacaagaccagatca

SEQ ID NO: 505605 - DNA, 20 bp, mouse
gctgggcccatgtgagtctg

SEQ ID NO: 505606 - DNA, 20 bp, mouse
ggcccgagccgcacccgccg

SEQ ID NO: 505607 - DNA, 20 bp, mouse
ggcatgagctccgtccgcgg

SEQ ID NO: 505608 - DNA, 20 bp, mouse
gtcgctgggaggacggccac

SEQ ID NO: 505609 - DNA, 20 bp, mouse
gtccgcggcgggtgcggctc

SEQ ID NO: 505610 - DNA, 20 bp, mouse
ggctccgtccgcggcgggtg

SEQ ID NO: 505611 - DNA, 20 bp, mouse
gcgcgcatgagctccgtccg

SEQ ID NO: 505612 - DNA, 20 bp, mouse
gagagcgagtccggccgcag

SEQ ID NO: 505613 - DNA, 20 bp, mouse
gtgccgggccgagaggagca

SEQ ID NO: 505614 - DNA, 20 bp, mouse
gggcacgctgccgggccgag

SEQ ID NO: 505615 - DNA, 20 bp, mouse
gccgcgttgggccccaacca

SEQ ID NO: 505616 - DNA, 20 bp, mouse
ggaacccgcggagggatcag

SEQ ID NO: 505617 - DNA, 20 bp, mouse
gatgcggatggagtcaccca

SEQ ID NO: 505618 - DNA, 20 bp, mouse
ggacgctggcgttgacgcag

SEQ ID NO: 505619 - DNA, 20 bp, mouse
ggcgttgacgcagcggaggg

SEQ ID NO: 505620 - DNA, 20 bp, mouse
gcccgcggagggatcagagg

SEQ ID NO: 505621 - DNA, 20 bp, mouse
gcggtgccgctagcagaccc

SEQ ID NO: 505622 - DNA, 20 bp, mouse
gccgcatcgccctgaggcca

SEQ ID NO: 505623 - DNA, 20 bp, mouse
gctggcgttgacgcagcgga

SEQ ID NO: 505624 - DNA, 20 bp, mouse
ggcgagcccgtggagaaccc

SEQ ID NO: 505625 - DNA, 20 bp, mouse
gggcttcccgggttctccac

SEQ ID NO: 505626 - DNA, 20 bp, mouse
gcgcctagccccgggatcat

SEQ ID NO: 505627 - DNA, 20 bp, mouse
ggctggaacggaggtgagag

SEQ ID NO: 505628 - DNA, 20 bp, mouse
ggaacggaggtgagagaggt

SEQ ID NO: 505629 - DNA, 20 bp, mouse
gcccagtgcccatgatcccg

SEQ ID NO: 505630 - DNA, 20 bp, mouse
ggggagcgcgtgtcaaacgg

SEQ ID NO: 505631 - DNA, 20 bp, mouse
gtttgacacgcgctccctgg

SEQ ID NO: 505632 - DNA, 20 bp, mouse
gcctggggcagacctgagtg

SEQ ID NO: 505633 - DNA, 20 bp, mouse
gtgcagggaggtgcggacca

SEQ ID NO: 505634 - DNA, 20 bp, mouse
gtggccatgggaccctggaa

SEQ ID NO: 505635 - DNA, 20 bp, mouse
gcccaggagtcccaggagta

SEQ ID NO: 505636 - DNA, 20 bp, mouse
gaggcacaaggacccatcag

SEQ ID NO: 505637 - DNA, 20 bp, mouse
ggagggtcatccaagacctg

SEQ ID NO: 505638 - DNA, 20 bp, mouse
ggagctataccacgacaaaa

SEQ ID NO: 505639 - DNA, 20 bp, mouse
ggcaaaggggacatcctcag

SEQ ID NO: 505640 - DNA, 20 bp, mouse
ggtgacccaggagttgagag

SEQ ID NO: 505641 - DNA, 20 bp, mouse
gtcaactcctgggtcaccac

SEQ ID NO: 505642 - DNA, 20 bp, mouse
gggcttcagctgcctctgat

SEQ ID NO: 505643 - DNA, 20 bp, mouse
gaccctgtggccatattccc

SEQ ID NO: 505644 - DNA, 20 bp, mouse
gctgaaagtcaaagccaaaa

SEQ ID NO: 505645 - DNA, 20 bp, mouse
gactcctgggtcaccactgg

SEQ ID NO: 505646 - DNA, 20 bp, mouse
ggtgaagtgcagagatcctc

SEQ ID NO: 505647 - DNA, 20 bp, mouse
gatctctgcacttcactcag

SEQ ID NO: 505648 - DNA, 20 bp, mouse
gccccagaaggcctaacatc

SEQ ID NO: 505649 - DNA, 20 bp, mouse
gttgagttcagtgactgtga

SEQ ID NO: 505650 - DNA, 20 bp, mouse
ggagaacagccagggaatgt

SEQ ID NO: 505651 - DNA, 20 bp, mouse
gagatcacaggagcatgacg

SEQ ID NO: 505652 - DNA, 20 bp, mouse
gcccgtgatccagcacacaa

SEQ ID NO: 505653 - DNA, 20 bp, mouse
ggccggccatggaagagtcg

SEQ ID NO: 505654 - DNA, 20 bp, mouse
ggagtcgaggccgggcttgt

SEQ ID NO: 505655 - DNA, 20 bp, mouse
gcccggcctcgactcttcca

SEQ ID NO: 505656 - DNA, 20 bp, mouse
ggtgactagaagcaatgctg

SEQ ID NO: 505657 - DNA, 20 bp, mouse
gctatggtggaccacagtca

SEQ ID NO: 505658 - DNA, 20 bp, mouse
gggtggaccacagtcaagga

SEQ ID NO: 505659 - DNA, 20 bp, mouse
gggtagaattctctctgcta

SEQ ID NO: 505660 - DNA, 20 bp, mouse
ggctaaaccatccttgactg

SEQ ID NO: 505661 - DNA, 20 bp, mouse
gggtaagacatggccaatgg

SEQ ID NO: 505662 - DNA, 20 bp, mouse
gtctagacctgatcaataaa

SEQ ID NO: 505663 - DNA, 20 bp, mouse
gcttaccgctctgtccaagt

SEQ ID NO: 505664 - DNA, 20 bp, mouse
gggctcagaagcatcacagt

SEQ ID NO: 505665 - DNA, 20 bp, mouse
gtggacagagcggtaagaca

SEQ ID NO: 505666 - DNA, 20 bp, mouse
ggccagctccggggaaagtt

SEQ ID NO: 505667 - DNA, 20 bp, mouse
gagctccggggaaagtttgg

SEQ ID NO: 505668 - DNA, 20 bp, mouse
ggcggccagactgctcggtg

SEQ ID NO: 505669 - DNA, 20 bp, mouse
ggccgccgccaaactttccc

SEQ ID NO: 505670 - DNA, 20 bp, mouse
gcccctggcccagaaatcgg

SEQ ID NO: 505671 - DNA, 20 bp, mouse
gtccggggaaagtttggcgg

SEQ ID NO: 505672 - DNA, 20 bp, mouse
ggactcacccgcgccagctc

SEQ ID NO: 505673 - DNA, 20 bp, mouse
ggccaccgcaccgagcagtc

SEQ ID NO: 505674 - DNA, 20 bp, mouse
ggcaggtggccgcacgaggt

SEQ ID NO: 505675 - DNA, 20 bp, mouse
ggccagactgctcggtgcgg

SEQ ID NO: 505676 - DNA, 20 bp, mouse
gctaggacagccagagaccg

SEQ ID NO: 505677 - DNA, 20 bp, mouse
gcagtagcaggagcaagctc

SEQ ID NO: 505678 - DNA, 20 bp, mouse
gcagatctacccagaagagt

SEQ ID NO: 505679 - DNA, 20 bp, mouse
gtggagaaagtcaagtacct

SEQ ID NO: 505680 - DNA, 20 bp, mouse
gatgcttgtgggctgcagtt

SEQ ID NO: 505681 - DNA, 20 bp, mouse
gagtcaagtacctcggtctc

SEQ ID NO: 505682 - DNA, 20 bp, mouse
gtgctcctgctactgtgggc

SEQ ID NO: 505683 - DNA, 20 bp, mouse
gagctggaaaaggatggatg

SEQ ID NO: 505684 - DNA, 20 bp, mouse
ggatctagcaaagaggacta

SEQ ID NO: 505685 - DNA, 20 bp, mouse
gaggaggtgggaatgacgtc

SEQ ID NO: 505686 - DNA, 20 bp, mouse
gagcgacccggtacagccgg

SEQ ID NO: 505687 - DNA, 20 bp, mouse
gacagcagcagcaccaggta

SEQ ID NO: 505688 - DNA, 20 bp, mouse
gggtgacagggaggaaatct

SEQ ID NO: 505689 - DNA, 20 bp, mouse
gcgcgcagtcctaagcgacc

SEQ ID NO: 505690 - DNA, 20 bp, mouse
gacaggaagcacctgacctt

SEQ ID NO: 505691 - DNA, 20 bp, mouse
gtgtgcgccaccggctgtac

SEQ ID NO: 505692 - DNA, 20 bp, mouse
ggaggcatcagcccaaggtc

SEQ ID NO: 505693 - DNA, 20 bp, mouse
gtaggactgcgcgcttgcac

SEQ ID NO: 505694 - DNA, 20 bp, mouse
ggcagcctgaggtcgatctg

SEQ ID NO: 505695 - DNA, 20 bp, mouse
gagggaggaaatctaggtag

SEQ ID NO: 505696 - DNA, 20 bp, mouse
gtcggaatctgagcagagtg

SEQ ID NO: 505697 - DNA, 20 bp, mouse
gtgcaccgacgcgccgcggg

SEQ ID NO: 505698 - DNA, 20 bp, mouse
gtgaagagccggcaaagatt

SEQ ID NO: 505699 - DNA, 20 bp, mouse
gaccgggctgggtgaagagc

SEQ ID NO: 505700 - DNA, 20 bp, mouse
gccgagtctggagtccggga

SEQ ID NO: 505701 - DNA, 20 bp, mouse
ggtccgggagggtgatgcag

SEQ ID NO: 505702 - DNA, 20 bp, mouse
gggcgctctggccggagagg

SEQ ID NO: 505703 - DNA, 20 bp, mouse
gcgggagggtgatgcagagg

SEQ ID NO: 505704 - DNA, 20 bp, mouse
ggcagccaggacagcggtcc

SEQ ID NO: 505705 - DNA, 20 bp, mouse
ggcaggggccgagtgctggg

SEQ ID NO: 505706 - DNA, 20 bp, mouse
ggtaggggactgtatctaag

SEQ ID NO: 505707 - DNA, 20 bp, mouse
gactctggcaaggatatgtg

SEQ ID NO: 505708 - DNA, 20 bp, mouse
gactgtatctaagaggtgtc

SEQ ID NO: 505709 - DNA, 20 bp, mouse
gtgtcggagtctaacagtac

SEQ ID NO: 505710 - DNA, 20 bp, mouse
gaggtttctgtccaccacaa

SEQ ID NO: 505711 - DNA, 20 bp, mouse
gttaagactgcctggccaag

SEQ ID NO: 505712 - DNA, 20 bp, mouse
ggtcatcttagcctttgtgg

SEQ ID NO: 505713 - DNA, 20 bp, mouse
gccgacatcacatcaaatga

SEQ ID NO: 505714 - DNA, 20 bp, mouse
gataatggtaggcaatgctg

SEQ ID NO: 505715 - DNA, 20 bp, mouse
gttgcctttgctataatggt

SEQ ID NO: 505716 - DNA, 20 bp, mouse
ggccgcgatgccggggacac

SEQ ID NO: 505717 - DNA, 20 bp, mouse
gcggtgaagggcgaaacttg

SEQ ID NO: 505718 - DNA, 20 bp, mouse
ggggcgaaacttggggtcca

SEQ ID NO: 505719 - DNA, 20 bp, mouse
ggcgtgcggaggagcctccc

SEQ ID NO: 505720 - DNA, 20 bp, mouse
gacgggcacatggcgtgcgg

SEQ ID NO: 505721 - DNA, 20 bp, mouse
ggacacgggcacatggcgtg

SEQ ID NO: 505722 - DNA, 20 bp, mouse
gacaacaaacgcgcggtgaa

SEQ ID NO: 505723 - DNA, 20 bp, mouse
ggcccgcggccgcgatgccg

SEQ ID NO: 505724 - DNA, 20 bp, mouse
gctcggcaggcggagcgcgt

SEQ ID NO: 505725 - DNA, 20 bp, mouse
ggcgtcgccgcaaccgcaca

SEQ ID NO: 505726 - DNA, 20 bp, mouse
ggttcaccagaggaacagta

SEQ ID NO: 505727 - DNA, 20 bp, mouse
gaccagaggaacagtaggga

SEQ ID NO: 505728 - DNA, 20 bp, mouse
gaaatactgtgagtagaagt

SEQ ID NO: 505729 - DNA, 20 bp, mouse
gtccatccctactgttcctc

SEQ ID NO: 505730 - DNA, 20 bp, mouse
gaaaggagacaagctgctag

SEQ ID NO: 505731 - DNA, 20 bp, mouse
gaagtaccagtggctaactt

SEQ ID NO: 505732 - DNA, 20 bp, mouse
gtcacagttcccatattcag

SEQ ID NO: 505733 - DNA, 20 bp, mouse
gcttgcagggtgctgctcat

SEQ ID NO: 505734 - DNA, 20 bp, mouse
gctttctgcttatataacag

SEQ ID NO: 505735 - DNA, 20 bp, mouse
gaaaagctagctatagggtt

SEQ ID NO: 505736 - DNA, 20 bp, mouse
gctggtcagtggacaagagt

SEQ ID NO: 505737 - DNA, 20 bp, mouse
gccccggcagctccagatgg

SEQ ID NO: 505738 - DNA, 20 bp, mouse
gactgtagctctgaaggacc

SEQ ID NO: 505739 - DNA, 20 bp, mouse
gcaaatccctcagagaatgg

SEQ ID NO: 505740 - DNA, 20 bp, mouse
gtagggaccaatggccgccg

SEQ ID NO: 505741 - DNA, 20 bp, mouse
gtcttttgcctagggctgtc

SEQ ID NO: 505742 - DNA, 20 bp, mouse
gaccaagacgaaaggcaagg

SEQ ID NO: 505743 - DNA, 20 bp, mouse
ggggccgtgcgaattcgcac

SEQ ID NO: 505744 - DNA, 20 bp, mouse
gcattacctgtagggaccaa

SEQ ID NO: 505745 - DNA, 20 bp, mouse
gcgaattcgcacggcccgat

SEQ ID NO: 505746 - DNA, 20 bp, mouse
ggccgacatgcagtccccgg

SEQ ID NO: 505747 - DNA, 20 bp, mouse
ggcagccgacatgcagtccc

SEQ ID NO: 505748 - DNA, 20 bp, mouse
ggaggtgcggagcaccgccg

SEQ ID NO: 505749 - DNA, 20 bp, mouse
ggggggtctggctcacctgg

SEQ ID NO: 505750 - DNA, 20 bp, mouse
gcgtcagctgctgggacgtc

SEQ ID NO: 505751 - DNA, 20 bp, mouse
gtctggatcatgcatgttgg

SEQ ID NO: 505752 - DNA, 20 bp, mouse
gacgccagcaggatagtgtg

SEQ ID NO: 505753 - DNA, 20 bp, mouse
gggaaactgaggccccctaa

SEQ ID NO: 505754 - DNA, 20 bp, mouse
ggcgctatctcgccaatccc

SEQ ID NO: 505755 - DNA, 20 bp, mouse
gcggggacgcagcgacgccc

SEQ ID NO: 505756 - DNA, 20 bp, mouse
ggccgcgagcgaccgaggga

SEQ ID NO: 505757 - DNA, 20 bp, mouse
gcgcggccgcgagcgaccga

SEQ ID NO: 505758 - DNA, 20 bp, mouse
gccctggcttcgggacccca

SEQ ID NO: 505759 - DNA, 20 bp, mouse
gcgcgggcgggagaccggag

SEQ ID NO: 505760 - DNA, 20 bp, mouse
ggcagccgcatcgccaccgg

SEQ ID NO: 505761 - DNA, 20 bp, mouse
gtcccgggcgaagctaggtg

SEQ ID NO: 505762 - DNA, 20 bp, mouse
gcagcggcaggagggcgcca

SEQ ID NO: 505763 - DNA, 20 bp, mouse
gccagcagctgcaacttggg

SEQ ID NO: 505764 - DNA, 20 bp, mouse
gtcccgaagccagggggcag

SEQ ID NO: 505765 - DNA, 20 bp, mouse
gtcgccaccggaggagcgcg

SEQ ID NO: 505766 - DNA, 20 bp, mouse
gctcaccgagagagacccgg

SEQ ID NO: 505767 - DNA, 20 bp, mouse
ggcgagcggtgaagggacac

SEQ ID NO: 505768 - DNA, 20 bp, mouse
ggcactcaccgagagagacc

SEQ ID NO: 505769 - DNA, 20 bp, mouse
ggtcaccgccgggtctctct

SEQ ID NO: 505770 - DNA, 20 bp, mouse
gataccagaagaaggtgcct

SEQ ID NO: 505771 - DNA, 20 bp, mouse
gagcgcactgaggaccttgc

SEQ ID NO: 505772 - DNA, 20 bp, mouse
gtcaccccgggacgggcgag

SEQ ID NO: 505773 - DNA, 20 bp, mouse
gttcacactcaccccgggac

SEQ ID NO: 505774 - DNA, 20 bp, mouse
gaggtgagcgcggagcgtga

SEQ ID NO: 505775 - DNA, 20 bp, mouse
gccggagctgcggtcaccgc

SEQ ID NO: 505776 - DNA, 20 bp, mouse
ggtgccggcgggaggatgag

SEQ ID NO: 505777 - DNA, 20 bp, mouse
gttcccgaggagccagaacg

SEQ ID NO: 505778 - DNA, 20 bp, mouse
gggaggatgagcggaccgga

SEQ ID NO: 505779 - DNA, 20 bp, mouse
gggatgagcggaccggacgg

SEQ ID NO: 505780 - DNA, 20 bp, mouse
gcggcgccagcgccaccgtc

SEQ ID NO: 505781 - DNA, 20 bp, mouse
gctccactcggcatttcccg

SEQ ID NO: 505782 - DNA, 20 bp, mouse
gtgtggccgcgcggcagtgc

SEQ ID NO: 505783 - DNA, 20 bp, mouse
gtgctccgagcgcctttctg

SEQ ID NO: 505784 - DNA, 20 bp, mouse
gggccgcgcggcagtgccgg

SEQ ID NO: 505785 - DNA, 20 bp, mouse
gcgaggagccagaacgcggc

SEQ ID NO: 505786 - DNA, 20 bp, mouse
gaagagcacagtggcagcgg

SEQ ID NO: 505787 - DNA, 20 bp, mouse
ggctggggccccagaggagt

SEQ ID NO: 505788 - DNA, 20 bp, mouse
gagctgggaacagcttggag

SEQ ID NO: 505789 - DNA, 20 bp, mouse
ggctgacaggtcccgcacag

SEQ ID NO: 505790 - DNA, 20 bp, mouse
ggagcgggcgcaggactctc

SEQ ID NO: 505791 - DNA, 20 bp, mouse
gagtggcagcggtggctgac

SEQ ID NO: 505792 - DNA, 20 bp, mouse
ggaagtctacccactcctct

SEQ ID NO: 505793 - DNA, 20 bp, mouse
ggtcccacgtgtggcggtag

SEQ ID NO: 505794 - DNA, 20 bp, mouse
gggcgactctcggagaccca

SEQ ID NO: 505795 - DNA, 20 bp, mouse
gcccggcaagggagtctctg

SEQ ID NO: 505796 - DNA, 20 bp, mouse
gcaatctcctggctgcgagg

SEQ ID NO: 505797 - DNA, 20 bp, mouse
gcctcagcgggcaagcgccg

SEQ ID NO: 505798 - DNA, 20 bp, mouse
gggcgcacgacagctcgccg

SEQ ID NO: 505799 - DNA, 20 bp, mouse
gcgcttgcccgctgaggctg

SEQ ID NO: 505800 - DNA, 20 bp, mouse
gggggctgctctcaatctcc

SEQ ID NO: 505801 - DNA, 20 bp, mouse
gttctccgccgcagcctcag

SEQ ID NO: 505802 - DNA, 20 bp, mouse
gtccaaccccggcttctcgt

SEQ ID NO: 505803 - DNA, 20 bp, mouse
gcactcagtaactctggacg

SEQ ID NO: 505804 - DNA, 20 bp, mouse
ggccccgcactcagtaactc

SEQ ID NO: 505805 - DNA, 20 bp, mouse
gcgaggctgcggctcttccc

SEQ ID NO: 505806 - DNA, 20 bp, mouse
ggcagcagggaaggaactcg

SEQ ID NO: 505807 - DNA, 20 bp, mouse
gcggcgccggtcctctctcc

SEQ ID NO: 505808 - DNA, 20 bp, mouse
gttctgccgggagagaggac

SEQ ID NO: 505809 - DNA, 20 bp, mouse
gagagaggaccggcgccgag

SEQ ID NO: 505810 - DNA, 20 bp, mouse
gcggcagcgcggggagagcg

SEQ ID NO: 505811 - DNA, 20 bp, mouse
gagcaggctgtagcacaggt

SEQ ID NO: 505812 - DNA, 20 bp, mouse
ggggaaggaactcggggctg

SEQ ID NO: 505813 - DNA, 20 bp, mouse
gtgtccccggcgcagcggga

SEQ ID NO: 505814 - DNA, 20 bp, mouse
ggccggcggccccttagtgg

SEQ ID NO: 505815 - DNA, 20 bp, mouse
gaggcgccgggcagcagcgg

SEQ ID NO: 505816 - DNA, 20 bp, mouse
gccgcgagccgaagtgatgg

SEQ ID NO: 505817 - DNA, 20 bp, mouse
ggagctgggagggtgtggac

SEQ ID NO: 505818 - DNA, 20 bp, mouse
gctcccgcgagccgaagtga

SEQ ID NO: 505819 - DNA, 20 bp, mouse
gcgcggcgcgagcacgccag

SEQ ID NO: 505820 - DNA, 20 bp, mouse
gcaggccaccggagtacgca

SEQ ID NO: 505821 - DNA, 20 bp, mouse
gcagctggccgccagggacc

SEQ ID NO: 505822 - DNA, 20 bp, mouse
gtcggctcgcgggagggacc

SEQ ID NO: 505823 - DNA, 20 bp, mouse
gactctgcagctggccgcca

SEQ ID NO: 505824 - DNA, 20 bp, mouse
gccaccggagtacgcaggga

SEQ ID NO: 505825 - DNA, 20 bp, mouse
ggcggctgtgacagcgcgag

SEQ ID NO: 505826 - DNA, 20 bp, mouse
gcgtcgcccgctcaacccca

SEQ ID NO: 505827 - DNA, 20 bp, mouse
ggggagcgggaaccgcagac

SEQ ID NO: 505828 - DNA, 20 bp, mouse
gccagaagccgggcgccctg

SEQ ID NO: 505829 - DNA, 20 bp, mouse
gtcgcgctcaggctcgggag

SEQ ID NO: 505830 - DNA, 20 bp, mouse
gcgggcgacgcactatagcc

SEQ ID NO: 505831 - DNA, 20 bp, mouse
gtgagcgcgaagcgacccca

SEQ ID NO: 505832 - DNA, 20 bp, mouse
gcaaccctggagccggagag

SEQ ID NO: 505833 - DNA, 20 bp, mouse
gcggagctcaacccagaagc

SEQ ID NO: 505834 - DNA, 20 bp, mouse
ggcggggccggtgacctcca

SEQ ID NO: 505835 - DNA, 20 bp, mouse
ggcgggcggcaggtggacag

SEQ ID NO: 505836 - DNA, 20 bp, mouse
ggcgatggtgacacatgcgg

SEQ ID NO: 505837 - DNA, 20 bp, mouse
ggacgcggcggcgcacgggg

SEQ ID NO: 505838 - DNA, 20 bp, mouse
gcgcgccggcggcaggacca

SEQ ID NO: 505839 - DNA, 20 bp, mouse
gcgggcccggggctgagtct

SEQ ID NO: 505840 - DNA, 20 bp, mouse
gacagtcgcagggcacctcg

SEQ ID NO: 505841 - DNA, 20 bp, mouse
gagccgagccgggatcgggg

SEQ ID NO: 505842 - DNA, 20 bp, mouse
ggggcggtgcagagcgttct

SEQ ID NO: 505843 - DNA, 20 bp, mouse
ggctagccgagccgggatcg

SEQ ID NO: 505844 - DNA, 20 bp, mouse
gcgggcccgcgtactggtaa

SEQ ID NO: 505845 - DNA, 20 bp, mouse
gagagatccaggtcgtcggg

SEQ ID NO: 505846 - DNA, 20 bp, mouse
ggaggtcgtgcatccgcctg

SEQ ID NO: 505847 - DNA, 20 bp, mouse
gggcagcagcgcgaagagcg

SEQ ID NO: 505848 - DNA, 20 bp, mouse
gagtgagcagggcccggcag

SEQ ID NO: 505849 - DNA, 20 bp, mouse
ggcctcgaggccgccgcagg

SEQ ID NO: 505850 - DNA, 20 bp, mouse
gtcaggcgacgctgggacct

SEQ ID NO: 505851 - DNA, 20 bp, mouse
gctccaggacaagcccccaa

SEQ ID NO: 505852 - DNA, 20 bp, mouse
gtccgcctgcggcggcctcg

SEQ ID NO: 505853 - DNA, 20 bp, mouse
gccgggtccagggtgagccc

SEQ ID NO: 505854 - DNA, 20 bp, mouse
ggtcgtgcatccgcctgcgg

SEQ ID NO: 505855 - DNA, 20 bp, mouse
gtacgtggtgagcgaacgtg

SEQ ID NO: 505856 - DNA, 20 bp, mouse
gtcggcgcccagggacccgt

SEQ ID NO: 505857 - DNA, 20 bp, mouse
gccgggaggcggctccgcag

SEQ ID NO: 505858 - DNA, 20 bp, mouse
gttgcaaagccgcccctcgg

SEQ ID NO: 505859 - DNA, 20 bp, mouse
gcctttgcccacgggtccct

SEQ ID NO: 505860 - DNA, 20 bp, mouse
gcagagccggggcctacgag

SEQ ID NO: 505861 - DNA, 20 bp, mouse
gggcgagcaagacgcctctg

SEQ ID NO: 505862 - DNA, 20 bp, mouse
gcgcctgagcgtctaccgac

SEQ ID NO: 505863 - DNA, 20 bp, mouse
ggggcggctttgcaaacttg

SEQ ID NO: 505864 - DNA, 20 bp, mouse
gcagctgccccgggaaggtc

SEQ ID NO: 505865 - DNA, 20 bp, mouse
gggtagacgctcaggcgctg

SEQ ID NO: 505866 - DNA, 20 bp, mouse
gcgccgagaaaccgaagtgt

SEQ ID NO: 505867 - DNA, 20 bp, mouse
ggagacatcgccgccaagct

SEQ ID NO: 505868 - DNA, 20 bp, mouse
gaccggggagatggccgaga

SEQ ID NO: 505869 - DNA, 20 bp, mouse
gggaaccgtcacctacactt

SEQ ID NO: 505870 - DNA, 20 bp, mouse
ggtgtagtcgcgagaactgt

SEQ ID NO: 505871 - DNA, 20 bp, mouse
gtcgccgccaagctgggcac

SEQ ID NO: 505872 - DNA, 20 bp, mouse
gaggtccggagggtccgggt

SEQ ID NO: 505873 - DNA, 20 bp, mouse
gcctgcgggtcaggtccgga

SEQ ID NO: 505874 - DNA, 20 bp, mouse
gaggctgccgcttaccacca

SEQ ID NO: 505875 - DNA, 20 bp, mouse
gggtcaggtccggagggtcc

SEQ ID NO: 505876 - DNA, 20 bp, mouse
ggccatgccacatagatgag

SEQ ID NO: 505877 - DNA, 20 bp, mouse
gaacatggtaggccgtctcc

SEQ ID NO: 505878 - DNA, 20 bp, mouse
gcagagtaggctatcactca

SEQ ID NO: 505879 - DNA, 20 bp, mouse
gagatggcttgtgagtatga

SEQ ID NO: 505880 - DNA, 20 bp, mouse
gtaccaggctataggcactg

SEQ ID NO: 505881 - DNA, 20 bp, mouse
gctcagggtagaatcatacc

SEQ ID NO: 505882 - DNA, 20 bp, mouse
gcttgtgagtatgagggact

SEQ ID NO: 505883 - DNA, 20 bp, mouse
gtagaatcataccaggctat

SEQ ID NO: 505884 - DNA, 20 bp, mouse
gctggagaggcgcgacccca

SEQ ID NO: 505885 - DNA, 20 bp, mouse
ggcatggcatgattgagcat

SEQ ID NO: 505886 - DNA, 20 bp, mouse
gcgagcggccgtcccaatgt

SEQ ID NO: 505887 - DNA, 20 bp, mouse
gggctccgcatccccacatt

SEQ ID NO: 505888 - DNA, 20 bp, mouse
gccgcatccccacattggga

SEQ ID NO: 505889 - DNA, 20 bp, mouse
gtgctacctaggtcagcgag

SEQ ID NO: 505890 - DNA, 20 bp, mouse
ggacggccgctcgctgacct

SEQ ID NO: 505891 - DNA, 20 bp, mouse
ggtagcaagacccgagggaa

SEQ ID NO: 505892 - DNA, 20 bp, mouse
gcctaggtagcaagacccga

SEQ ID NO: 505893 - DNA, 20 bp, mouse
ggtcaggaggctgcagagcg

SEQ ID NO: 505894 - DNA, 20 bp, mouse
gggctgaagtagtcacgagt

SEQ ID NO: 505895 - DNA, 20 bp, mouse
gtgcggctggcagggttcct

SEQ ID NO: 505896 - DNA, 20 bp, mouse
gctggctcagggcgccctgt

SEQ ID NO: 505897 - DNA, 20 bp, mouse
ggagctttctacaacctccc

SEQ ID NO: 505898 - DNA, 20 bp, mouse
gccctgatgtcacaattcag

SEQ ID NO: 505899 - DNA, 20 bp, mouse
gcaaacagggacctggctca

SEQ ID NO: 505900 - DNA, 20 bp, mouse
gtctgtggctggaggataca

SEQ ID NO: 505901 - DNA, 20 bp, mouse
gctgccatcaaacagggacc

SEQ ID NO: 505902 - DNA, 20 bp, mouse
gaaacaggcttaaaacacag

SEQ ID NO: 505903 - DNA, 20 bp, mouse
gcaggaagagcaccaggatc

SEQ ID NO: 505904 - DNA, 20 bp, mouse
gctctcctgcccacagtctg

SEQ ID NO: 505905 - DNA, 20 bp, mouse
gtttctacaacctcccaggc

SEQ ID NO: 505906 - DNA, 20 bp, mouse
gaagagaagcaaccagagat

SEQ ID NO: 505907 - DNA, 20 bp, mouse
gttgaggcttcagataagtg

SEQ ID NO: 505908 - DNA, 20 bp, mouse
gtttattggctgcctatctc

SEQ ID NO: 505909 - DNA, 20 bp, mouse
ggcgggagggatgacataaa

SEQ ID NO: 505910 - DNA, 20 bp, mouse
gaaaatgctgagggagttct

SEQ ID NO: 505911 - DNA, 20 bp, mouse
gaagtgcggctcctttttat

SEQ ID NO: 505912 - DNA, 20 bp, mouse
gcggtctactgccaaatgat

SEQ ID NO: 505913 - DNA, 20 bp, mouse
gcattctcaagttcttctgg

SEQ ID NO: 505914 - DNA, 20 bp, mouse
gctatacactatacacagta

SEQ ID NO: 505915 - DNA, 20 bp, mouse
gtatagtgtatagtcctgag

SEQ ID NO: 505916 - DNA, 20 bp, mouse
ggagcgccgagagggactcg

SEQ ID NO: 505917 - DNA, 20 bp, mouse
ggctaggacacggaatgcag

SEQ ID NO: 505918 - DNA, 20 bp, mouse
gaggaacaccggcctggggt

SEQ ID NO: 505919 - DNA, 20 bp, mouse
gccgagagggactcgaggct

SEQ ID NO: 505920 - DNA, 20 bp, mouse
gtggttggggagcgccgaga

SEQ ID NO: 505921 - DNA, 20 bp, mouse
gggccagtgccgccaacaac

SEQ ID NO: 505922 - DNA, 20 bp, mouse
gctcgcgcggtgctcatcac

SEQ ID NO: 505923 - DNA, 20 bp, mouse
gcagtgccgccaacaacggg

SEQ ID NO: 505924 - DNA, 20 bp, mouse
gatgcagaggaacaccggcc

SEQ ID NO: 505925 - DNA, 20 bp, mouse
gcctgctggctgctctcgac

SEQ ID NO: 505926 - DNA, 20 bp, mouse
gcgagcatgaagggtcctat

SEQ ID NO: 505927 - DNA, 20 bp, mouse
gggtaatgagcactaccgtg

SEQ ID NO: 505928 - DNA, 20 bp, mouse
gccaggggagagccccccag

SEQ ID NO: 505929 - DNA, 20 bp, mouse
gcatcgtgcttacctctggg

SEQ ID NO: 505930 - DNA, 20 bp, mouse
ggcaagcaagcgagcatgaa

SEQ ID NO: 505931 - DNA, 20 bp, mouse
gaagtgcatgccgattccag

SEQ ID NO: 505932 - DNA, 20 bp, mouse
gtcctggcggcctccaacaa

SEQ ID NO: 505933 - DNA, 20 bp, mouse
ggccacattgcgggacctga

SEQ ID NO: 505934 - DNA, 20 bp, mouse
ggccttcaggtcccgcaatg

SEQ ID NO: 505935 - DNA, 20 bp, mouse
gactttagtactattccaca

SEQ ID NO: 505936 - DNA, 20 bp, mouse
ggcggcagttcggagcgtga

SEQ ID NO: 505937 - DNA, 20 bp, mouse
gggcttgtgcaagatggctg

SEQ ID NO: 505938 - DNA, 20 bp, mouse
gctagcctgcataaaaacaa

SEQ ID NO: 505939 - DNA, 20 bp, mouse
gaagcctcgccaccagagga

SEQ ID NO: 505940 - DNA, 20 bp, mouse
gactaaaagccctcctctgg

SEQ ID NO: 505941 - DNA, 20 bp, mouse
gcaagatggctgcggcagtt

SEQ ID NO: 505942 - DNA, 20 bp, mouse
gcccagcgacgaaacttggg

SEQ ID NO: 505943 - DNA, 20 bp, mouse
ggcataaaaacaaaggttag

SEQ ID NO: 505944 - DNA, 20 bp, mouse
gatgcaggctaggactgcgc

SEQ ID NO: 505945 - DNA, 20 bp, mouse
gggcactaaaagccctcctc

SEQ ID NO: 505946 - DNA, 20 bp, mouse
ggtcctaaacggcctctgga

SEQ ID NO: 505947 - DNA, 20 bp, mouse
gcgtaaccgacaccctccag

SEQ ID NO: 505948 - DNA, 20 bp, mouse
gggaccgggaacgagagcac

SEQ ID NO: 505949 - DNA, 20 bp, mouse
gagagcaccgggcctccaaa

SEQ ID NO: 505950 - DNA, 20 bp, mouse
gtctcgttcccggtcctaaa

SEQ ID NO: 505951 - DNA, 20 bp, mouse
gcaccctccagaggccgttt

SEQ ID NO: 505952 - DNA, 20 bp, mouse
ggtgatcaggacgatctctc

SEQ ID NO: 505953 - DNA, 20 bp, mouse
gttaagtttggcaaattcgt

SEQ ID NO: 505954 - DNA, 20 bp, mouse
gggcccggtgctctcgttcc

SEQ ID NO: 505955 - DNA, 20 bp, mouse
gtgctgaagacgatgagcaa

SEQ ID NO: 505956 - DNA, 20 bp, mouse
ggctcgcgcccacccagtac

SEQ ID NO: 505957 - DNA, 20 bp, mouse
ggccgggggagcgcactcca

SEQ ID NO: 505958 - DNA, 20 bp, mouse
gcgcagggccaggtaggcaa

SEQ ID NO: 505959 - DNA, 20 bp, mouse
gtacaggaagccggccgccg

SEQ ID NO: 505960 - DNA, 20 bp, mouse
ggaggcctagtcacgagcca

SEQ ID NO: 505961 - DNA, 20 bp, mouse
ggccatggagtgcgctcccc

SEQ ID NO: 505962 - DNA, 20 bp, mouse
gggtccgcgactcggagaat

SEQ ID NO: 505963 - DNA, 20 bp, mouse
gtgactaggcctcactacta

SEQ ID NO: 505964 - DNA, 20 bp, mouse
ggccggcttcctgtactggg

SEQ ID NO: 505965 - DNA, 20 bp, mouse
ggcggccggcttcctgtact

SEQ ID NO: 505966 - DNA, 20 bp, mouse
ggagccctgtcaggtattat

SEQ ID NO: 505967 - DNA, 20 bp, mouse
gaattccaggatgaggttca

SEQ ID NO: 505968 - DNA, 20 bp, mouse
gctccacagagagccctgtc

SEQ ID NO: 505969 - DNA, 20 bp, mouse
gttatgggctgctgcagaag

SEQ ID NO: 505970 - DNA, 20 bp, mouse
ggcagcccataatacctgac

SEQ ID NO: 505971 - DNA, 20 bp, mouse
gcaccagaaggagaaattcc

SEQ ID NO: 505972 - DNA, 20 bp, mouse
gcgggggccggacacggaat

SEQ ID NO: 505973 - DNA, 20 bp, mouse
gtcatcacgggggccggaca

SEQ ID NO: 505974 - DNA, 20 bp, mouse
gggccggacacggaataggc

SEQ ID NO: 505975 - DNA, 20 bp, mouse
ggatgatgacgcccaccaga

SEQ ID NO: 505976 - DNA, 20 bp, mouse
gagaagctgacggaagccct

SEQ ID NO: 505977 - DNA, 20 bp, mouse
gggcttccgtcagcttctgg

SEQ ID NO: 505978 - DNA, 20 bp, mouse
ggtgcgtgtggtggactgaa

SEQ ID NO: 505979 - DNA, 20 bp, mouse
gctgtgcaggtgggtctaaa

SEQ ID NO: 505980 - DNA, 20 bp, mouse
gccacctgcacagctgcccg

SEQ ID NO: 505981 - DNA, 20 bp, mouse
gagggagggcagggacgatg

SEQ ID NO: 505982 - DNA, 20 bp, mouse
ggagaggatgaggccaggac

SEQ ID NO: 505983 - DNA, 20 bp, mouse
ggatggggttagaggaagga

SEQ ID NO: 505984 - DNA, 20 bp, mouse
gaccttgatcaaggtgagac

SEQ ID NO: 505985 - DNA, 20 bp, mouse
gcaaggtgtatgtccccagc

SEQ ID NO: 505986 - DNA, 20 bp, mouse
ggtgccccccagcactgcag

SEQ ID NO: 505987 - DNA, 20 bp, mouse
gctgcactcacagtattcac

SEQ ID NO: 505988 - DNA, 20 bp, mouse
gctgccgctgcagtgctggg

SEQ ID NO: 505989 - DNA, 20 bp, mouse
gaaacgggctcattctccac

SEQ ID NO: 505990 - DNA, 20 bp, mouse
gtaagaggaacaaggtgcag

SEQ ID NO: 505991 - DNA, 20 bp, mouse
ggaagcaggccacggataag

SEQ ID NO: 505992 - DNA, 20 bp, mouse
ggtctcgctggcctctgggg

SEQ ID NO: 505993 - DNA, 20 bp, mouse
gactggccttcacttgctct

SEQ ID NO: 505994 - DNA, 20 bp, mouse
ggagtcagcatggctctgct

SEQ ID NO: 505995 - DNA, 20 bp, mouse
gatccacaggtaacaagtct

SEQ ID NO: 505996 - DNA, 20 bp, mouse
gtcctcagaggagatctggc

SEQ ID NO: 505997 - DNA, 20 bp, mouse
gttgccctgggaatcacacg

SEQ ID NO: 505998 - DNA, 20 bp, mouse
gagcctcctcagaggagatc

SEQ ID NO: 505999 - DNA, 20 bp, mouse
gtatccccgtgtgattccca

SEQ ID NO: 506000 - DNA, 20 bp, mouse
gtcacacggggataaagacc

SEQ ID NO: 506001 - DNA, 20 bp, mouse
ggcccgccagatctcctctg

SEQ ID NO: 506002 - DNA, 20 bp, mouse
ggacacgagggaaacctggg

SEQ ID NO: 506003 - DNA, 20 bp, mouse
gacacccagagcctcctcag

SEQ ID NO: 506004 - DNA, 20 bp, mouse
ggcaatgaagagcttctcca

SEQ ID NO: 506005 - DNA, 20 bp, mouse
gcacccaggccacttgccct

SEQ ID NO: 506006 - DNA, 20 bp, mouse
gagtactgctcggcaagacc

SEQ ID NO: 506007 - DNA, 20 bp, mouse
ggcaagaccgggacagcggg

SEQ ID NO: 506008 - DNA, 20 bp, mouse
gctcggcaagaccgggacag

SEQ ID NO: 506009 - DNA, 20 bp, mouse
gcagcgtcccgagtactgct

SEQ ID NO: 506010 - DNA, 20 bp, mouse
gcacgcccgtcgaacctcag

SEQ ID NO: 506011 - DNA, 20 bp, mouse
gggcgccagtttcccgagac

SEQ ID NO: 506012 - DNA, 20 bp, mouse
gcaggcgcacttggaaccac

SEQ ID NO: 506013 - DNA, 20 bp, mouse
gagctggtgctggatcggga

SEQ ID NO: 506014 - DNA, 20 bp, mouse
gagccacacactagagagag

SEQ ID NO: 506015 - DNA, 20 bp, mouse
gggccagcgatccggataga

SEQ ID NO: 506016 - DNA, 20 bp, mouse
gtcagagtaaggatccaggg

SEQ ID NO: 506017 - DNA, 20 bp, mouse
gccctcagagtaaggatcca

SEQ ID NO: 506018 - DNA, 20 bp, mouse
ggatagactcccagcaatgt

SEQ ID NO: 506019 - DNA, 20 bp, mouse
gaaggatccagggaggcaca

SEQ ID NO: 506020 - DNA, 20 bp, mouse
gccggagaggcagaacctat

SEQ ID NO: 506021 - DNA, 20 bp, mouse
gactttaattctgtccccaa

SEQ ID NO: 506022 - DNA, 20 bp, mouse
ggtgttagtattagccggag

SEQ ID NO: 506023 - DNA, 20 bp, mouse
ggggtgagtcctacattgct

SEQ ID NO: 506024 - DNA, 20 bp, mouse
gtcatataaccctcagagta

SEQ ID NO: 506025 - DNA, 20 bp, mouse
gggacaacaggtacaaacaa

SEQ ID NO: 506026 - DNA, 20 bp, mouse
ggtgcagggcgtggaagatg

SEQ ID NO: 506027 - DNA, 20 bp, mouse
ggttcaggctaagagaaccc

SEQ ID NO: 506028 - DNA, 20 bp, mouse
gccccggtgcagttctactt

SEQ ID NO: 506029 - DNA, 20 bp, mouse
gagggcgtggaagatgcgga

SEQ ID NO: 506030 - DNA, 20 bp, mouse
gaggtctcacctgctcgccc

SEQ ID NO: 506031 - DNA, 20 bp, mouse
ggcgtggaagatgcggaagg

SEQ ID NO: 506032 - DNA, 20 bp, mouse
ggagcaccgagcaccaagcg

SEQ ID NO: 506033 - DNA, 20 bp, mouse
gtggtcacggatcaaggttc

SEQ ID NO: 506034 - DNA, 20 bp, mouse
ggagcaggtgagacctccta

SEQ ID NO: 506035 - DNA, 20 bp, mouse
gtctacttcggtgcagggcg

SEQ ID NO: 506036 - DNA, 20 bp, mouse
gagggaagtggtaatagggg

SEQ ID NO: 506037 - DNA, 20 bp, mouse
gaccatctcagacttttgag

SEQ ID NO: 506038 - DNA, 20 bp, mouse
ggccgctcagttcagaatgt

SEQ ID NO: 506039 - DNA, 20 bp, mouse
gtcctacattctgaactgag

SEQ ID NO: 506040 - DNA, 20 bp, mouse
gttctccccactcacagaat

SEQ ID NO: 506041 - DNA, 20 bp, mouse
gggagaagggaagtggtaat

SEQ ID NO: 506042 - DNA, 20 bp, mouse
gggcttcccattctgtgagt

SEQ ID NO: 506043 - DNA, 20 bp, mouse
gaactgagcggctgctgcac

SEQ ID NO: 506044 - DNA, 20 bp, mouse
ggcagtccagaggggggaag

SEQ ID NO: 506045 - DNA, 20 bp, mouse
gcagggtgggtgggtagcct

SEQ ID NO: 506046 - DNA, 20 bp, mouse
gcaagagttggagatcctga

SEQ ID NO: 506047 - DNA, 20 bp, mouse
gtctgtgtcctaatcaagaa

SEQ ID NO: 506048 - DNA, 20 bp, mouse
ggagagctcccttcttgatt

SEQ ID NO: 506049 - DNA, 20 bp, mouse
gtgctggttactcccacagt

SEQ ID NO: 506050 - DNA, 20 bp, mouse
gagagtagcccaagtaggaa

SEQ ID NO: 506051 - DNA, 20 bp, mouse
gaagaatacagtgcctggta

SEQ ID NO: 506052 - DNA, 20 bp, mouse
gtaaaacacaaagtgagtaa

SEQ ID NO: 506053 - DNA, 20 bp, mouse
ggagctccaggggttcatgg

SEQ ID NO: 506054 - DNA, 20 bp, mouse
gttagaaatctacctactgt

SEQ ID NO: 506055 - DNA, 20 bp, mouse
gcagcaggaatgatccagca

SEQ ID NO: 506056 - DNA, 20 bp, mouse
gcaacaactggatgatcctc

SEQ ID NO: 506057 - DNA, 20 bp, mouse
ggtgcaggagaaagatcttg

SEQ ID NO: 506058 - DNA, 20 bp, mouse
ggtcttcaaacctgaaacca

SEQ ID NO: 506059 - DNA, 20 bp, mouse
gagtctgcataaagagctac

SEQ ID NO: 506060 - DNA, 20 bp, mouse
gagccaacacagcttgcata

SEQ ID NO: 506061 - DNA, 20 bp, mouse
gagcagatcacagttgtgcg

SEQ ID NO: 506062 - DNA, 20 bp, mouse
gcaaactgtgttttgctatg

SEQ ID NO: 506063 - DNA, 20 bp, mouse
gtcttttgtttgctagacat

SEQ ID NO: 506064 - DNA, 20 bp, mouse
gtttgtttgctagacatggg

SEQ ID NO: 506065 - DNA, 20 bp, mouse
gtgttggctatgcagtcatg

SEQ ID NO: 506066 - DNA, 20 bp, mouse
gaattagaaaccttcctact

SEQ ID NO: 506067 - DNA, 20 bp, mouse
gtataagttgctttggttgt

SEQ ID NO: 506068 - DNA, 20 bp, mouse
gaatacactgcctagtagga

SEQ ID NO: 506069 - DNA, 20 bp, mouse
gaaaaaatacactgcctagt

SEQ ID NO: 506070 - DNA, 20 bp, mouse
gtctccgtccagatcaaaaa

SEQ ID NO: 506071 - DNA, 20 bp, mouse
gagggagatctcaactgctc

SEQ ID NO: 506072 - DNA, 20 bp, mouse
gacttacgttttgttttcaa

SEQ ID NO: 506073 - DNA, 20 bp, mouse
gtgttggttattcccacaat

SEQ ID NO: 506074 - DNA, 20 bp, mouse
gtctccctttttgatctgga

SEQ ID NO: 506075 - DNA, 20 bp, mouse
gacagtagcccaagtagaaa

SEQ ID NO: 506076 - DNA, 20 bp, mouse
gtataagttgctttggttgt

SEQ ID NO: 506077 - DNA, 20 bp, mouse
gaattagaaaccttcctact

SEQ ID NO: 506078 - DNA, 20 bp, mouse
gaatacactgcctagtagga

SEQ ID NO: 506079 - DNA, 20 bp, mouse
gaaaaaatacactgcctagt

SEQ ID NO: 506080 - DNA, 20 bp, mouse
gacttacgttttgttttcaa

SEQ ID NO: 506081 - DNA, 20 bp, mouse
gagggagatctcaactgctc

SEQ ID NO: 506082 - DNA, 20 bp, mouse
gtgttggttattcccacaat

SEQ ID NO: 506083 - DNA, 20 bp, mouse
gtctccctttttgatctgga

SEQ ID NO: 506084 - DNA, 20 bp, mouse
gacagtagcccaagtagaaa

SEQ ID NO: 506085 - DNA, 20 bp, mouse
ggtatagatgagcttactgt

SEQ ID NO: 506086 - DNA, 20 bp, mouse
gcatagacgggctaaaagga

SEQ ID NO: 506087 - DNA, 20 bp, mouse
gggagctgggggacatagac

SEQ ID NO: 506088 - DNA, 20 bp, mouse
gcctgctcatgaccagttgt

SEQ ID NO: 506089 - DNA, 20 bp, mouse
gctggtcatgagcaggtcct

SEQ ID NO: 506090 - DNA, 20 bp, mouse
gagtctaaggctcattgcta

SEQ ID NO: 506091 - DNA, 20 bp, mouse
ggggacatagacgggctaaa

SEQ ID NO: 506092 - DNA, 20 bp, mouse
ggtaagtgatataggagctg

SEQ ID NO: 506093 - DNA, 20 bp, mouse
gtattaacaacattcacaac

SEQ ID NO: 506094 - DNA, 20 bp, mouse
gggagaagacctttaggccc

SEQ ID NO: 506095 - DNA, 20 bp, mouse
gtcatgaccagttgtgggtg

SEQ ID NO: 506096 - DNA, 20 bp, mouse
gtctggatgcagagaataga

SEQ ID NO: 506097 - DNA, 20 bp, mouse
gcaagagctttagatcctga

SEQ ID NO: 506098 - DNA, 20 bp, mouse
gtctgcatccagatcaagaa

SEQ ID NO: 506099 - DNA, 20 bp, mouse
gtaaagctcttggaaacaaa

SEQ ID NO: 506100 - DNA, 20 bp, mouse
gcccttgtgatatggaaggg

SEQ ID NO: 506101 - DNA, 20 bp, mouse
gcacagttcccttcttgatc

SEQ ID NO: 506102 - DNA, 20 bp, mouse
gtcacccttgtgatatggaa

SEQ ID NO: 506103 - DNA, 20 bp, mouse
ggtagaattcgacatactgt

SEQ ID NO: 506104 - DNA, 20 bp, mouse
ggcagagaatagagggcagt

SEQ ID NO: 506105 - DNA, 20 bp, mouse
gaagttgaaatcagaggact

SEQ ID NO: 506106 - DNA, 20 bp, mouse
ggccagtcaactcagatgag

SEQ ID NO: 506107 - DNA, 20 bp, mouse
gccctctcatctgagttgac

SEQ ID NO: 506108 - DNA, 20 bp, mouse
gtactcagccacaaggtgtg

SEQ ID NO: 506109 - DNA, 20 bp, mouse
gccagctggtccctagtcca

SEQ ID NO: 506110 - DNA, 20 bp, mouse
gagttgcaggagtcccatga

SEQ ID NO: 506111 - DNA, 20 bp, mouse
gacagttctagctccagact

SEQ ID NO: 506112 - DNA, 20 bp, mouse
ggttagcaatagaatagtgt

SEQ ID NO: 506113 - DNA, 20 bp, mouse
ggctgacaccccacaccttg

SEQ ID NO: 506114 - DNA, 20 bp, mouse
gagctagaactgtggaagga

SEQ ID NO: 506115 - DNA, 20 bp, mouse
gagaacatctgacaccgtgc

SEQ ID NO: 506116 - DNA, 20 bp, mouse
gctacctgtagtaagtccca

SEQ ID NO: 506117 - DNA, 20 bp, mouse
ggcgccctgggacttactac

SEQ ID NO: 506118 - DNA, 20 bp, mouse
gaggacacaacctcctccag

SEQ ID NO: 506119 - DNA, 20 bp, mouse
gcgcacaaactggccactgg

SEQ ID NO: 506120 - DNA, 20 bp, mouse
gagtcccagggcgcacaaac

SEQ ID NO: 506121 - DNA, 20 bp, mouse
ggggcgcacaaactggccac

SEQ ID NO: 506122 - DNA, 20 bp, mouse
gctagctggtccaccagtcc

SEQ ID NO: 506123 - DNA, 20 bp, mouse
gggaccagctagatgtacat

SEQ ID NO: 506124 - DNA, 20 bp, mouse
gtggaagggcgcaggctaaa

SEQ ID NO: 506125 - DNA, 20 bp, mouse
gggaggagcgagcggaagga

SEQ ID NO: 506126 - DNA, 20 bp, mouse
ggacctgcggtggtgtcccg

SEQ ID NO: 506127 - DNA, 20 bp, mouse
gacctgctcagggagctgag

SEQ ID NO: 506128 - DNA, 20 bp, mouse
ggcgcaatacctgcagcgag

SEQ ID NO: 506129 - DNA, 20 bp, mouse
gatacctgcagcgagaggcg

SEQ ID NO: 506130 - DNA, 20 bp, mouse
gcgcgggcagcgggcgggac

SEQ ID NO: 506131 - DNA, 20 bp, mouse
gacctagcgaccaggaataa

SEQ ID NO: 506132 - DNA, 20 bp, mouse
gcacgtgggtagcggacctg

SEQ ID NO: 506133 - DNA, 20 bp, mouse
gcaggcgacacgccccggga

SEQ ID NO: 506134 - DNA, 20 bp, mouse
gggcgcgtgcgcggatcacg

SEQ ID NO: 506135 - DNA, 20 bp, mouse
ggtgtcccatccctccccag

SEQ ID NO: 506136 - DNA, 20 bp, mouse
gcgtcctcttacccagtgtt

SEQ ID NO: 506137 - DNA, 20 bp, mouse
gggtcatgctgcccaacact

SEQ ID NO: 506138 - DNA, 20 bp, mouse
gctgcccaacactgggtaag

SEQ ID NO: 506139 - DNA, 20 bp, mouse
ggatggggtcaggggccagt

SEQ ID NO: 506140 - DNA, 20 bp, mouse
gagtggtgtcagatactcca

SEQ ID NO: 506141 - DNA, 20 bp, mouse
ggccgcgcgctctggaacac

SEQ ID NO: 506142 - DNA, 20 bp, mouse
gcaagttctctgaactgcga

SEQ ID NO: 506143 - DNA, 20 bp, mouse
gaggcgagatggggctacaa

SEQ ID NO: 506144 - DNA, 20 bp, mouse
gtgtcaccaggccaagctaa

SEQ ID NO: 506145 - DNA, 20 bp, mouse
ggggctacaacgggtcgtcg

SEQ ID NO: 506146 - DNA, 20 bp, mouse
ggagcgcgccggtcgcaaga

SEQ ID NO: 506147 - DNA, 20 bp, mouse
ggaccggcgcgctctcgcta

SEQ ID NO: 506148 - DNA, 20 bp, mouse
gcacacagcaaggcctcgca

SEQ ID NO: 506149 - DNA, 20 bp, mouse
gggccctagcgagagcgcgc

SEQ ID NO: 506150 - DNA, 20 bp, mouse
ggccggtcgcaagatggctg

SEQ ID NO: 506151 - DNA, 20 bp, mouse
ggccgcagccatcttgcgac

SEQ ID NO: 506152 - DNA, 20 bp, mouse
gcgcacagaggctacaggtc

SEQ ID NO: 506153 - DNA, 20 bp, mouse
gcccacggccagatccatct

SEQ ID NO: 506154 - DNA, 20 bp, mouse
ggtgtccgggtcgctcacga

SEQ ID NO: 506155 - DNA, 20 bp, mouse
ggtcgctgcccctgccgtcc

SEQ ID NO: 506156 - DNA, 20 bp, mouse
gccgaacgcggaggtcgcag

SEQ ID NO: 506157 - DNA, 20 bp, mouse
gaacgcggaggtcgcagcgg

SEQ ID NO: 506158 - DNA, 20 bp, mouse
gctccaggtgatgaactcgt

SEQ ID NO: 506159 - DNA, 20 bp, mouse
gattctactaccgaacgcgg

SEQ ID NO: 506160 - DNA, 20 bp, mouse
gctggagtcaggtagggtcg

SEQ ID NO: 506161 - DNA, 20 bp, mouse
gagccgagccggttcgacaa

SEQ ID NO: 506162 - DNA, 20 bp, mouse
gaagctgtggacgcttgtgg

SEQ ID NO: 506163 - DNA, 20 bp, mouse
gctgcgtggtgtgcgttccc

SEQ ID NO: 506164 - DNA, 20 bp, mouse
gcgcaggcgcggcggatctc

SEQ ID NO: 506165 - DNA, 20 bp, mouse
gcgcggcgagcagacgactg

SEQ ID NO: 506166 - DNA, 20 bp, mouse
ggcagcagctcccatatgta

SEQ ID NO: 506167 - DNA, 20 bp, mouse
ggcgcaggcgcacgaagctg

SEQ ID NO: 506168 - DNA, 20 bp, mouse
ggacgggtccggtactgagg

SEQ ID NO: 506169 - DNA, 20 bp, mouse
gcggctatggccgcaaccgt

SEQ ID NO: 506170 - DNA, 20 bp, mouse
gggcgacgggtccggtactg

SEQ ID NO: 506171 - DNA, 20 bp, mouse
gggccagggccggagacaag

SEQ ID NO: 506172 - DNA, 20 bp, mouse
gcaaccgtgggcgacgggtc

SEQ ID NO: 506173 - DNA, 20 bp, mouse
gggaggcctgccgggtcagt

SEQ ID NO: 506174 - DNA, 20 bp, mouse
gcagtgggtgccctacatat

SEQ ID NO: 506175 - DNA, 20 bp, mouse
ggaagctgaggcagcggcta

SEQ ID NO: 506176 - DNA, 20 bp, mouse
ggagcaatttcgcaagacaa

SEQ ID NO: 506177 - DNA, 20 bp, mouse
gtggaccacgtgattcgctg

SEQ ID NO: 506178 - DNA, 20 bp, mouse
gtcaactaatatccagagtt

SEQ ID NO: 506179 - DNA, 20 bp, mouse
ggcagtgaaatcccaaaaca

SEQ ID NO: 506180 - DNA, 20 bp, mouse
gagtgtccaactcagttgag

SEQ ID NO: 506181 - DNA, 20 bp, mouse
gcttgccccagcgaatcacg

SEQ ID NO: 506182 - DNA, 20 bp, mouse
gctcagttgagtggctgcgg

SEQ ID NO: 506183 - DNA, 20 bp, mouse
ggcaaggtaaaaagacttct

SEQ ID NO: 506184 - DNA, 20 bp, mouse
gaaggatgtgacttcagaaa

SEQ ID NO: 506185 - DNA, 20 bp, mouse
ggtaaaaagacttctgggaa

SEQ ID NO: 506186 - DNA, 20 bp, mouse
gtgcatggcgcagtctcggc

SEQ ID NO: 506187 - DNA, 20 bp, mouse
gggctggggcctggctccgt

SEQ ID NO: 506188 - DNA, 20 bp, mouse
gtgacaagcccgcagcggcc

SEQ ID NO: 506189 - DNA, 20 bp, mouse
ggcagctggcgcttcctgca

SEQ ID NO: 506190 - DNA, 20 bp, mouse
gggctttgacaagcccgcag

SEQ ID NO: 506191 - DNA, 20 bp, mouse
gcgacattggagggatcccg

SEQ ID NO: 506192 - DNA, 20 bp, mouse
gcgttccagcccggccgctg

SEQ ID NO: 506193 - DNA, 20 bp, mouse
gttcctgcatggcgcagtct

SEQ ID NO: 506194 - DNA, 20 bp, mouse
gcgggctccagcggatgagg

SEQ ID NO: 506195 - DNA, 20 bp, mouse
gggcaaacgcagcactttcg

SEQ ID NO: 506196 - DNA, 20 bp, mouse
ggggcgcagcgaaggcccgg

SEQ ID NO: 506197 - DNA, 20 bp, mouse
gaggcccgggggatcgagaa

SEQ ID NO: 506198 - DNA, 20 bp, mouse
gcccgggggatcgagaacgg

SEQ ID NO: 506199 - DNA, 20 bp, mouse
ggcagctcggcctcgaagag

SEQ ID NO: 506200 - DNA, 20 bp, mouse
gctgggacggccgaggcgag

SEQ ID NO: 506201 - DNA, 20 bp, mouse
gcaccttgcggaagccgtag

SEQ ID NO: 506202 - DNA, 20 bp, mouse
gccgccgaggcccggaccgt

SEQ ID NO: 506203 - DNA, 20 bp, mouse
gcatcgcccgcccgggccct

SEQ ID NO: 506204 - DNA, 20 bp, mouse
gagggggcagggcgcagcga

SEQ ID NO: 506205 - DNA, 20 bp, mouse
gcccaccgttctcgatcccc

SEQ ID NO: 506206 - DNA, 20 bp, mouse
gtgtactctgcagattatat

SEQ ID NO: 506207 - DNA, 20 bp, mouse
gtcagatgtgaagtctgtgt

SEQ ID NO: 506208 - DNA, 20 bp, mouse
gaggcacagagggtatgcgg

SEQ ID NO: 506209 - DNA, 20 bp, mouse
gctgaggcacagagggtatg

SEQ ID NO: 506210 - DNA, 20 bp, mouse
ggggtaaagtgtacaggata

SEQ ID NO: 506211 - DNA, 20 bp, mouse
ggtaagtgactacatcataa

SEQ ID NO: 506212 - DNA, 20 bp, mouse
gctgtgtgggtaaagtgtac

SEQ ID NO: 506213 - DNA, 20 bp, mouse
gtatttggtgggatgaggac

SEQ ID NO: 506214 - DNA, 20 bp, mouse
gcaccaaggctcgccggaag

SEQ ID NO: 506215 - DNA, 20 bp, mouse
ggaaaactctggaaaatagt

SEQ ID NO: 506216 - DNA, 20 bp, mouse
gggatgtaggatgcatacct

SEQ ID NO: 506217 - DNA, 20 bp, mouse
ggcttgggttgtgttccgaa

SEQ ID NO: 506218 - DNA, 20 bp, mouse
gacacaacccaagctgtcca

SEQ ID NO: 506219 - DNA, 20 bp, mouse
gagaagctccgggagagggt

SEQ ID NO: 506220 - DNA, 20 bp, mouse
ggaggaggaaagcattgcaa

SEQ ID NO: 506221 - DNA, 20 bp, mouse
gtactggagctgccagagaa

SEQ ID NO: 506222 - DNA, 20 bp, mouse
gcattgcaagggctaaactc

SEQ ID NO: 506223 - DNA, 20 bp, mouse
gcaccctgcatccagaatcc

SEQ ID NO: 506224 - DNA, 20 bp, mouse
gagcgctgcaatgacttgtg

SEQ ID NO: 506225 - DNA, 20 bp, mouse
gacttcagcactgggtgtag

SEQ ID NO: 506226 - DNA, 20 bp, mouse
gctgcgccggccttatatag

SEQ ID NO: 506227 - DNA, 20 bp, mouse
gataaggccggcgcaggggg

SEQ ID NO: 506228 - DNA, 20 bp, mouse
ggcgggcccgcctctatata

SEQ ID NO: 506229 - DNA, 20 bp, mouse
gcgccggccttatatagagg

SEQ ID NO: 506230 - DNA, 20 bp, mouse
gccgcggcgccagcaaccta

SEQ ID NO: 506231 - DNA, 20 bp, mouse
gttcttccggaaggttccgg

SEQ ID NO: 506232 - DNA, 20 bp, mouse
ggcgcaggcggacttagcgg

SEQ ID NO: 506233 - DNA, 20 bp, mouse
gcccgcctggggcctagggt

SEQ ID NO: 506234 - DNA, 20 bp, mouse
gcgcggggcgagcgaagcga

SEQ ID NO: 506235 - DNA, 20 bp, mouse
ggcccgcctctatataaggc

SEQ ID NO: 506236 - DNA, 20 bp, mouse
gggaccaagtccgactcgca

SEQ ID NO: 506237 - DNA, 20 bp, mouse
gctaggcttgccgtgcgagt

SEQ ID NO: 506238 - DNA, 20 bp, mouse
gagtcacccccgcgcagcct

SEQ ID NO: 506239 - DNA, 20 bp, mouse
gttgccgtgcgagtcggact

SEQ ID NO: 506240 - DNA, 20 bp, mouse
gcgccggggacgagagaccc

SEQ ID NO: 506241 - DNA, 20 bp, mouse
gttgcacgcgaggctccccg

SEQ ID NO: 506242 - DNA, 20 bp, mouse
gagccgcgcccggaagtgga

SEQ ID NO: 506243 - DNA, 20 bp, mouse
gagcccccggagagccgccg

SEQ ID NO: 506244 - DNA, 20 bp, mouse
gaccccggccttaccttgac

SEQ ID NO: 506245 - DNA, 20 bp, mouse
gcggaagtggagggcaaaca

SEQ ID NO: 506246 - DNA, 20 bp, mouse
gggtcgaagggagcccgccg

SEQ ID NO: 506247 - DNA, 20 bp, mouse
ggtccatgatgaacacacgg

SEQ ID NO: 506248 - DNA, 20 bp, mouse
gtgttctcaaaaaggtcgaa

SEQ ID NO: 506249 - DNA, 20 bp, mouse
ggcgaaggagctcagagagg

SEQ ID NO: 506250 - DNA, 20 bp, mouse
ggagctcagagaggcggcgt

SEQ ID NO: 506251 - DNA, 20 bp, mouse
ggtccgccgtgtgttcatca

SEQ ID NO: 506252 - DNA, 20 bp, mouse
gattgctcttcattccccgg

SEQ ID NO: 506253 - DNA, 20 bp, mouse
gctcttctccgagctggctg

SEQ ID NO: 506254 - DNA, 20 bp, mouse
gctcggagtcaaccacaccg

SEQ ID NO: 506255 - DNA, 20 bp, mouse
gctgagaggtgtgatagcga

SEQ ID NO: 506256 - DNA, 20 bp, mouse
ggacctgcgcgcggcttagt

SEQ ID NO: 506257 - DNA, 20 bp, mouse
gcttagactcgggattgggg

SEQ ID NO: 506258 - DNA, 20 bp, mouse
gctgcgcgcggcttagtggg

SEQ ID NO: 506259 - DNA, 20 bp, mouse
ggtgtgaggagcttagactc

SEQ ID NO: 506260 - DNA, 20 bp, mouse
gccgcgctgctggaggtgtg

SEQ ID NO: 506261 - DNA, 20 bp, mouse
gccttcggtgagtgaccggg

SEQ ID NO: 506262 - DNA, 20 bp, mouse
ggcggccacacaggaagggg

SEQ ID NO: 506263 - DNA, 20 bp, mouse
gagaagcggccacacaggaa

SEQ ID NO: 506264 - DNA, 20 bp, mouse
ggcagaggcccaacacccac

SEQ ID NO: 506265 - DNA, 20 bp, mouse
ggcggctcctgagaccgaaa

SEQ ID NO: 506266 - DNA, 20 bp, mouse
gcaccggaggctcctttccc

SEQ ID NO: 506267 - DNA, 20 bp, mouse
gggagcctaagatttagcac

SEQ ID NO: 506268 - DNA, 20 bp, mouse
gtgcagcctcagcccgggaa

SEQ ID NO: 506269 - DNA, 20 bp, mouse
gtgaggctgcaggaccatgg

SEQ ID NO: 506270 - DNA, 20 bp, mouse
gagcccgggaaaggagcctc

SEQ ID NO: 506271 - DNA, 20 bp, mouse
gcacctggcagcccagtcga

SEQ ID NO: 506272 - DNA, 20 bp, mouse
ggcctccggtgctaaatctt

SEQ ID NO: 506273 - DNA, 20 bp, mouse
ggcctaagatttagcaccgg

SEQ ID NO: 506274 - DNA, 20 bp, mouse
ggggaggcaagaccgaacca

SEQ ID NO: 506275 - DNA, 20 bp, mouse
gtcgagggcgttagaaaagt

SEQ ID NO: 506276 - DNA, 20 bp, mouse
gcccgcagcggagcttacag

SEQ ID NO: 506277 - DNA, 20 bp, mouse
gcccaggcgacaagacccgg

SEQ ID NO: 506278 - DNA, 20 bp, mouse
ggcacccaggcgacaagacc

SEQ ID NO: 506279 - DNA, 20 bp, mouse
gctagctcagagtcccgcag

SEQ ID NO: 506280 - DNA, 20 bp, mouse
gacccggaggagctgtccga

SEQ ID NO: 506281 - DNA, 20 bp, mouse
gtccactgtaagctccgctg

SEQ ID NO: 506282 - DNA, 20 bp, mouse
ggcccctcggacagctcctc

SEQ ID NO: 506283 - DNA, 20 bp, mouse
ggagggtgcagagacgggcc

SEQ ID NO: 506284 - DNA, 20 bp, mouse
ggagctggggaaggacctct

SEQ ID NO: 506285 - DNA, 20 bp, mouse
gacgggcctggtgcacgttg

SEQ ID NO: 506286 - DNA, 20 bp, mouse
gccggagagatgacgatctt

SEQ ID NO: 506287 - DNA, 20 bp, mouse
gtcttaggtcagtatctcag

SEQ ID NO: 506288 - DNA, 20 bp, mouse
ggccatcagtcccgccgaac

SEQ ID NO: 506289 - DNA, 20 bp, mouse
gagttcgacgaggtctgggt

SEQ ID NO: 506290 - DNA, 20 bp, mouse
gtcaggggtccctgcaacta

SEQ ID NO: 506291 - DNA, 20 bp, mouse
gggatgactgtaccgatggg

SEQ ID NO: 506292 - DNA, 20 bp, mouse
ggcggggcgtctggagtcgg

SEQ ID NO: 506293 - DNA, 20 bp, mouse
gccacaggtctgagagacga

SEQ ID NO: 506294 - DNA, 20 bp, mouse
gacagccggcgactaggggg

SEQ ID NO: 506295 - DNA, 20 bp, mouse
ggcgacagccggcgactagg

SEQ ID NO: 506296 - DNA, 20 bp, mouse
gcataaggcggcggagacca

SEQ ID NO: 506297 - DNA, 20 bp, mouse
ggccgatcgccgccataagg

SEQ ID NO: 506298 - DNA, 20 bp, mouse
ggctagctgaagctgctgaa

SEQ ID NO: 506299 - DNA, 20 bp, mouse
ggaccacggcagctcaacga

SEQ ID NO: 506300 - DNA, 20 bp, mouse
ggcctgatgggcttgttccg

SEQ ID NO: 506301 - DNA, 20 bp, mouse
gtcctcggaacaagcccatc

SEQ ID NO: 506302 - DNA, 20 bp, mouse
ggatcgccgccataaggcgg

SEQ ID NO: 506303 - DNA, 20 bp, mouse
gcagcgtgcttggccttgga

SEQ ID NO: 506304 - DNA, 20 bp, mouse
gacaagcccatcaggcactg

SEQ ID NO: 506305 - DNA, 20 bp, mouse
gcacgccgatcgccgccata

SEQ ID NO: 506306 - DNA, 20 bp, mouse
gctctggatggaaccagatt

SEQ ID NO: 506307 - DNA, 20 bp, mouse
gaggtgcaggtgaactacaa

SEQ ID NO: 506308 - DNA, 20 bp, mouse
gccttccaggtggtgaacga

SEQ ID NO: 506309 - DNA, 20 bp, mouse
gctcctccgggaagaacgac

SEQ ID NO: 506310 - DNA, 20 bp, mouse
gccggaggagatctcgtcca

SEQ ID NO: 506311 - DNA, 20 bp, mouse
gaagcactggcccttccagg

SEQ ID NO: 506312 - DNA, 20 bp, mouse
gaacgacggcgacaagccca

SEQ ID NO: 506313 - DNA, 20 bp, mouse
gagccggtcgttcttcccgg

SEQ ID NO: 506314 - DNA, 20 bp, mouse
ggaactacaagggcgagagc

SEQ ID NO: 506315 - DNA, 20 bp, mouse
ggagagccggtcgttcttcc

SEQ ID NO: 506316 - DNA, 20 bp, mouse
gcgacaccgagcgcctcatc

SEQ ID NO: 506317 - DNA, 20 bp, mouse
gaggcgcagggcggcgagca

SEQ ID NO: 506318 - DNA, 20 bp, mouse
gcttggcggcgtccccgatg

SEQ ID NO: 506319 - DNA, 20 bp, mouse
gtccgcggcgtggatgctct

SEQ ID NO: 506320 - DNA, 20 bp, mouse
gacaagagaagcagagcgag

SEQ ID NO: 506321 - DNA, 20 bp, mouse
ggtcttcgcttgtctctgga

SEQ ID NO: 506322 - DNA, 20 bp, mouse
gggcgccatggccaagaaca

SEQ ID NO: 506323 - DNA, 20 bp, mouse
gtcttgtcttcgcttgtctc

SEQ ID NO: 506324 - DNA, 20 bp, mouse
gagctactcagaatcaaatc

SEQ ID NO: 506325 - DNA, 20 bp, mouse
gctctggggaaggctggtcc

SEQ ID NO: 506326 - DNA, 20 bp, mouse
gtggagctccctgctcgtag

SEQ ID NO: 506327 - DNA, 20 bp, mouse
gggctcaaagttgccgggag

SEQ ID NO: 506328 - DNA, 20 bp, mouse
gtagtctgagctcaaatcgg

SEQ ID NO: 506329 - DNA, 20 bp, mouse
gtcgaaggcgtagagatccc

SEQ ID NO: 506330 - DNA, 20 bp, mouse
gagacgatgaggcctaagga

SEQ ID NO: 506331 - DNA, 20 bp, mouse
ggagctgggaaggctctgat

SEQ ID NO: 506332 - DNA, 20 bp, mouse
gcatccaaactgagcagccg

SEQ ID NO: 506333 - DNA, 20 bp, mouse
gcatcaaacgaggaccaact

SEQ ID NO: 506334 - DNA, 20 bp, mouse
gtcaaagttgccgggagggg

SEQ ID NO: 506335 - DNA, 20 bp, mouse
gtgctcagtttggatgttcc

SEQ ID NO: 506336 - DNA, 20 bp, mouse
gggtcggagtgaccagccgg

SEQ ID NO: 506337 - DNA, 20 bp, mouse
ggtccaactgatatctagtt

SEQ ID NO: 506338 - DNA, 20 bp, mouse
gtctcccggagacctctacg

SEQ ID NO: 506339 - DNA, 20 bp, mouse
gcttgggcagggagaccaag

SEQ ID NO: 506340 - DNA, 20 bp, mouse
gaggacgaaagcgtcaggag

SEQ ID NO: 506341 - DNA, 20 bp, mouse
gaagccgggacctgagccaa

SEQ ID NO: 506342 - DNA, 20 bp, mouse
gtagatatcagttggaccac

SEQ ID NO: 506343 - DNA, 20 bp, mouse
gacccgtccggcgctcccac

SEQ ID NO: 506344 - DNA, 20 bp, mouse
gggcgcttgacgccagcctt

SEQ ID NO: 506345 - DNA, 20 bp, mouse
gaagccccgtagaggtctcc

SEQ ID NO: 506346 - DNA, 20 bp, mouse
ggaggcggagaagatctcga

SEQ ID NO: 506347 - DNA, 20 bp, mouse
ggaggaggcgccggtcgcgg

SEQ ID NO: 506348 - DNA, 20 bp, mouse
gcaagccccaagcctcctag

SEQ ID NO: 506349 - DNA, 20 bp, mouse
ggcagaggaggcgccggtcg

SEQ ID NO: 506350 - DNA, 20 bp, mouse
gcccgagccggagcagtagc

SEQ ID NO: 506351 - DNA, 20 bp, mouse
gaccgtccgctaggaggctt

SEQ ID NO: 506352 - DNA, 20 bp, mouse
ggcagtagccggcgccatgt

SEQ ID NO: 506353 - DNA, 20 bp, mouse
ggccgcggcccgagcggtag

SEQ ID NO: 506354 - DNA, 20 bp, mouse
ggcccaggatccgaagcagg

SEQ ID NO: 506355 - DNA, 20 bp, mouse
gaggaaaagcgtctgagccg

SEQ ID NO: 506356 - DNA, 20 bp, mouse
gcctgcgagaagcaaaggag

SEQ ID NO: 506357 - DNA, 20 bp, mouse
gggagtcgcagcgcccgcag

SEQ ID NO: 506358 - DNA, 20 bp, mouse
gcgactcctgcgagaagcaa

SEQ ID NO: 506359 - DNA, 20 bp, mouse
gtcgctgtagcgaggagcgg

SEQ ID NO: 506360 - DNA, 20 bp, mouse
ggtctacagccagacgagga

SEQ ID NO: 506361 - DNA, 20 bp, mouse
gctctctatcggaaaatcta

SEQ ID NO: 506362 - DNA, 20 bp, mouse
gccgcagtggggacccgcag

SEQ ID NO: 506363 - DNA, 20 bp, mouse
gtctgcggcaagcagagatg

SEQ ID NO: 506364 - DNA, 20 bp, mouse
gccagggtcagggatgtctg

SEQ ID NO: 506365 - DNA, 20 bp, mouse
ggccttaagcgggatgtcgg

SEQ ID NO: 506366 - DNA, 20 bp, mouse
gaacactgacctggacactt

SEQ ID NO: 506367 - DNA, 20 bp, mouse
gcgcagaagcccaagtgtcc

SEQ ID NO: 506368 - DNA, 20 bp, mouse
ggcgacggcgcgctcgatac

SEQ ID NO: 506369 - DNA, 20 bp, mouse
gaggagacacgaagcagact

SEQ ID NO: 506370 - DNA, 20 bp, mouse
ggtgtgtgaggtaagcgccg

SEQ ID NO: 506371 - DNA, 20 bp, mouse
gggcatgatgaagttcactg

SEQ ID NO: 506372 - DNA, 20 bp, mouse
ggcagtcaggcaggagtctt

SEQ ID NO: 506373 - DNA, 20 bp, mouse
gggccgagacaacactgacc

SEQ ID NO: 506374 - DNA, 20 bp, mouse
gcaggggcctcggggtcagg

SEQ ID NO: 506375 - DNA, 20 bp, mouse
gtatccgtcgaaggaggagg

SEQ ID NO: 506376 - DNA, 20 bp, mouse
gtgggcctacacacaaggtg

SEQ ID NO: 506377 - DNA, 20 bp, mouse
ggcagctgggcctacacaca

SEQ ID NO: 506378 - DNA, 20 bp, mouse
gtgcagcagatccggaggat

SEQ ID NO: 506379 - DNA, 20 bp, mouse
ggagactgcagcagatccgg

SEQ ID NO: 506380 - DNA, 20 bp, mouse
ggctcaggccgtcaccacca

SEQ ID NO: 506381 - DNA, 20 bp, mouse
gaggatgggctgagtcaggg

SEQ ID NO: 506382 - DNA, 20 bp, mouse
ggagtcccggggagtctctt

SEQ ID NO: 506383 - DNA, 20 bp, mouse
ggccgcctaagagactcccc

SEQ ID NO: 506384 - DNA, 20 bp, mouse
gaaaccggtctcattgaacg

SEQ ID NO: 506385 - DNA, 20 bp, mouse
gtcccggggagtctcttagg

SEQ ID NO: 506386 - DNA, 20 bp, mouse
gggcactaaggagtgtgatg

SEQ ID NO: 506387 - DNA, 20 bp, mouse
ggcagaagcgtacctcggaa

SEQ ID NO: 506388 - DNA, 20 bp, mouse
gaagcgtacctcggaaaggt

SEQ ID NO: 506389 - DNA, 20 bp, mouse
gaggtaacacccatctcaaa

SEQ ID NO: 506390 - DNA, 20 bp, mouse
gaacaggtgccatttgagat

SEQ ID NO: 506391 - DNA, 20 bp, mouse
gaaaaaaacccacctttccg

SEQ ID NO: 506392 - DNA, 20 bp, mouse
gtaattcacacattctgatc

SEQ ID NO: 506393 - DNA, 20 bp, mouse
gaatgaattgcacaattgtt

SEQ ID NO: 506394 - DNA, 20 bp, mouse
gaattgcacaattgtttggt

SEQ ID NO: 506395 - DNA, 20 bp, mouse
gtttgcagtgataggcacta

SEQ ID NO: 506396 - DNA, 20 bp, mouse
gggagctgcgtgcacggtgg

SEQ ID NO: 506397 - DNA, 20 bp, mouse
gcccggagctgcgtgcacgg

SEQ ID NO: 506398 - DNA, 20 bp, mouse
gccaggcccggactcgagtg

SEQ ID NO: 506399 - DNA, 20 bp, mouse
gccggagcgaagggatgtaa

SEQ ID NO: 506400 - DNA, 20 bp, mouse
ggagcccccaccggaaggca

SEQ ID NO: 506401 - DNA, 20 bp, mouse
gccgcggccgcgcgtctcgt

SEQ ID NO: 506402 - DNA, 20 bp, mouse
gccgggcctggagcccccac

SEQ ID NO: 506403 - DNA, 20 bp, mouse
gcccttcggggtcagactct

SEQ ID NO: 506404 - DNA, 20 bp, mouse
ggcctggagcccccaccgga

SEQ ID NO: 506405 - DNA, 20 bp, mouse
gagcgccacaggttagaggg

SEQ ID NO: 506406 - DNA, 20 bp, mouse
ggatccgagaagtgccggac

SEQ ID NO: 506407 - DNA, 20 bp, mouse
gctgaggatccgagaagtgc

SEQ ID NO: 506408 - DNA, 20 bp, mouse
gcacacataaaagcacgctg

SEQ ID NO: 506409 - DNA, 20 bp, mouse
ggctccagtccggcacttct

SEQ ID NO: 506410 - DNA, 20 bp, mouse
gctgctaaaaatacccggct

SEQ ID NO: 506411 - DNA, 20 bp, mouse
gaccgcctgctaaaaatacc

SEQ ID NO: 506412 - DNA, 20 bp, mouse
ggctgccgaggcgagagtgg

SEQ ID NO: 506413 - DNA, 20 bp, mouse
ggaagctgccgaggcgagag

SEQ ID NO: 506414 - DNA, 20 bp, mouse
gcggcagcttcgtcccctct

SEQ ID NO: 506415 - DNA, 20 bp, mouse
gtcgtcccctctgggcacaa

SEQ ID NO: 506416 - DNA, 20 bp, mouse
gcgaagaggtgggagcccgg

SEQ ID NO: 506417 - DNA, 20 bp, mouse
gcgggtccgtgcagcacggt

SEQ ID NO: 506418 - DNA, 20 bp, mouse
ggggcgggcaccgaagaggt

SEQ ID NO: 506419 - DNA, 20 bp, mouse
ggcggagctacccaaggccc

SEQ ID NO: 506420 - DNA, 20 bp, mouse
gtccgtgcagcacggtgggc

SEQ ID NO: 506421 - DNA, 20 bp, mouse
gcctttcgcggagctaccca

SEQ ID NO: 506422 - DNA, 20 bp, mouse
gacccaaggcccaggcgagc

SEQ ID NO: 506423 - DNA, 20 bp, mouse
gcggtgggcgggcaccgaag

SEQ ID NO: 506424 - DNA, 20 bp, mouse
gggtagctccgcgaaaggac

SEQ ID NO: 506425 - DNA, 20 bp, mouse
gtgcacggacccgctcgcct

SEQ ID NO: 506426 - DNA, 20 bp, mouse
gtaagccccaggtagagtgg

SEQ ID NO: 506427 - DNA, 20 bp, mouse
gtactcggcagtggctgggt

SEQ ID NO: 506428 - DNA, 20 bp, mouse
gggtcgccttgatcttgttg

SEQ ID NO: 506429 - DNA, 20 bp, mouse
ggtgggcgtgtggcactgtg

SEQ ID NO: 506430 - DNA, 20 bp, mouse
gtcttgttggggcagtactt

SEQ ID NO: 506431 - DNA, 20 bp, mouse
ggtcgcaacagcagtcatgt

SEQ ID NO: 506432 - DNA, 20 bp, mouse
ggctctccctgaagccggtg

SEQ ID NO: 506433 - DNA, 20 bp, mouse
gacttaagccccaggtagag

SEQ ID NO: 506434 - DNA, 20 bp, mouse
gaagatcaaggcgaccccac

SEQ ID NO: 506435 - DNA, 20 bp, mouse
gggggcagtacttgggatca

SEQ ID NO: 506436 - DNA, 20 bp, mouse
gccagacggcagcttaattg

SEQ ID NO: 506437 - DNA, 20 bp, mouse
ggtttacagtcctgcccaga

SEQ ID NO: 506438 - DNA, 20 bp, mouse
gagactagacactcacggaa

SEQ ID NO: 506439 - DNA, 20 bp, mouse
gtagtctctggcgttgcctg

SEQ ID NO: 506440 - DNA, 20 bp, mouse
gacgcactggggtctctatg

SEQ ID NO: 506441 - DNA, 20 bp, mouse
gctgcccgggccaaccatcg

SEQ ID NO: 506442 - DNA, 20 bp, mouse
gccgggtggcttctccgtgg

SEQ ID NO: 506443 - DNA, 20 bp, mouse
gattaagctgccgtctgggc

SEQ ID NO: 506444 - DNA, 20 bp, mouse
ggactaagaatcgagtccgc

SEQ ID NO: 506445 - DNA, 20 bp, mouse
gaggacctgagtaaagccag

SEQ ID NO: 506446 - DNA, 20 bp, mouse
ggggcccagggtggcagcgt

SEQ ID NO: 506447 - DNA, 20 bp, mouse
gggcactgcggggcccaggg

SEQ ID NO: 506448 - DNA, 20 bp, mouse
gagggtggcagcgtaggaac

SEQ ID NO: 506449 - DNA, 20 bp, mouse
gaagcacggcgcagccaaga

SEQ ID NO: 506450 - DNA, 20 bp, mouse
gtggcagcgtaggaacagga

SEQ ID NO: 506451 - DNA, 20 bp, mouse
ggcaccccaggctgagtcag

SEQ ID NO: 506452 - DNA, 20 bp, mouse
ggcagccaagaaggctgcac

SEQ ID NO: 506453 - DNA, 20 bp, mouse
ggtgggtaacgccacactgg

SEQ ID NO: 506454 - DNA, 20 bp, mouse
gagaaggctgcacaggcacg

SEQ ID NO: 506455 - DNA, 20 bp, mouse
gagcccaggtgccaggccta

SEQ ID NO: 506456 - DNA, 20 bp, mouse
gacagcctcctaggaggggt

SEQ ID NO: 506457 - DNA, 20 bp, mouse
gtcagcccacccctcctagg

SEQ ID NO: 506458 - DNA, 20 bp, mouse
ggagctaaggcacctgtcag

SEQ ID NO: 506459 - DNA, 20 bp, mouse
ggaaatacagcctcctagga

SEQ ID NO: 506460 - DNA, 20 bp, mouse
ggggctgaacctaagtacgt

SEQ ID NO: 506461 - DNA, 20 bp, mouse
gtctacctcaggctcagagt

SEQ ID NO: 506462 - DNA, 20 bp, mouse
gcagccattccaacgtactt

SEQ ID NO: 506463 - DNA, 20 bp, mouse
gtcatgtgactaggacgctt

SEQ ID NO: 506464 - DNA, 20 bp, mouse
ggaggggagatagaacgtgt

SEQ ID NO: 506465 - DNA, 20 bp, mouse
ggcagtggccagagacatcg

SEQ ID NO: 506466 - DNA, 20 bp, mouse
ggaagccaggagaagtttct

SEQ ID NO: 506467 - DNA, 20 bp, mouse
gtcccagccaaagcctgctg

SEQ ID NO: 506468 - DNA, 20 bp, mouse
gcgagagagagaggccctct

SEQ ID NO: 506469 - DNA, 20 bp, mouse
gctgggagccggggcagcct

SEQ ID NO: 506470 - DNA, 20 bp, mouse
ggcggcttgggtaggagcac

SEQ ID NO: 506471 - DNA, 20 bp, mouse
ggggcagccagcggatggtt

SEQ ID NO: 506472 - DNA, 20 bp, mouse
gtgttggtcgaacttagagg

SEQ ID NO: 506473 - DNA, 20 bp, mouse
ggctgggcccgcttagggag

SEQ ID NO: 506474 - DNA, 20 bp, mouse
gttgggtaggagcacgggaa

SEQ ID NO: 506475 - DNA, 20 bp, mouse
ggctgcccagaattgagctg

SEQ ID NO: 506476 - DNA, 20 bp, mouse
gactctcggatgcagcgggt

SEQ ID NO: 506477 - DNA, 20 bp, mouse
gcgcgaacccggggaaaacc

SEQ ID NO: 506478 - DNA, 20 bp, mouse
gtcctccggagcgaaacctt

SEQ ID NO: 506479 - DNA, 20 bp, mouse
gtaggaagcagtttctccac

SEQ ID NO: 506480 - DNA, 20 bp, mouse
gctgctgcctgagggcgcga

SEQ ID NO: 506481 - DNA, 20 bp, mouse
gcaccgggcagcgcgaaccc

SEQ ID NO: 506482 - DNA, 20 bp, mouse
ggggacatcgggaagctacc

SEQ ID NO: 506483 - DNA, 20 bp, mouse
gttcgctccggaggacttgg

SEQ ID NO: 506484 - DNA, 20 bp, mouse
gcaggcagcagttgcactct

SEQ ID NO: 506485 - DNA, 20 bp, mouse
ggttgcactctcggatgcag

SEQ ID NO: 506486 - DNA, 20 bp, mouse
ggagggctcaccgggatctg

SEQ ID NO: 506487 - DNA, 20 bp, mouse
gatcctcggcgcgataacca

SEQ ID NO: 506488 - DNA, 20 bp, mouse
ggtgtggaagccgcagatcc

SEQ ID NO: 506489 - DNA, 20 bp, mouse
gggagagagcgccaggtgag

SEQ ID NO: 506490 - DNA, 20 bp, mouse
gccatggcagcaggctgcga

SEQ ID NO: 506491 - DNA, 20 bp, mouse
gccctgggcgagagaactgt

SEQ ID NO: 506492 - DNA, 20 bp, mouse
ggcggaggatccttcctgtg

SEQ ID NO: 506493 - DNA, 20 bp, mouse
ggcatcgcgcccccgaccct

SEQ ID NO: 506494 - DNA, 20 bp, mouse
gttctctcgcccagggtcgg

SEQ ID NO: 506495 - DNA, 20 bp, mouse
ggcgccggttccggcagagg

SEQ ID NO: 506496 - DNA, 20 bp, mouse
ggtggtggcagctctagacc

SEQ ID NO: 506497 - DNA, 20 bp, mouse
ggaagaggggcgccccaatg

SEQ ID NO: 506498 - DNA, 20 bp, mouse
gggcagctctagacccggca

SEQ ID NO: 506499 - DNA, 20 bp, mouse
gccacgcctaaagatagact

SEQ ID NO: 506500 - DNA, 20 bp, mouse
gggcggcgcccagtagagtc

SEQ ID NO: 506501 - DNA, 20 bp, mouse
ggggctcgttgccagggagt

SEQ ID NO: 506502 - DNA, 20 bp, mouse
gtgcagcctagtctatcttt

SEQ ID NO: 506503 - DNA, 20 bp, mouse
gcgttgccagggagtaggtg

SEQ ID NO: 506504 - DNA, 20 bp, mouse
gcgcccctcttcaaagacac

SEQ ID NO: 506505 - DNA, 20 bp, mouse
gaaggtgagatcagccccat

SEQ ID NO: 506506 - DNA, 20 bp, mouse
gaggccgcgtacctgcgggg

SEQ ID NO: 506507 - DNA, 20 bp, mouse
gtggcccaggaaccagcgta

SEQ ID NO: 506508 - DNA, 20 bp, mouse
gtgcggtgcgcgcccagagc

SEQ ID NO: 506509 - DNA, 20 bp, mouse
gccgagcacggaggactagg

SEQ ID NO: 506510 - DNA, 20 bp, mouse
gccgaggccgcgtacctgcg

SEQ ID NO: 506511 - DNA, 20 bp, mouse
gaggccgagcgccggagcaa

SEQ ID NO: 506512 - DNA, 20 bp, mouse
gaggggactcgggctcattg

SEQ ID NO: 506513 - DNA, 20 bp, mouse
gccgagcgccggagcaaggg

SEQ ID NO: 506514 - DNA, 20 bp, mouse
gccggagcaagggcgggcta

SEQ ID NO: 506515 - DNA, 20 bp, mouse
gcccaggaaccagcgtaggg

SEQ ID NO: 506516 - DNA, 20 bp, mouse
ggcggcccgagttcagagtc

SEQ ID NO: 506517 - DNA, 20 bp, mouse
ggcgtgcggcaaagccatgg

SEQ ID NO: 506518 - DNA, 20 bp, mouse
ggtgtgcgacaaagcgtctg

SEQ ID NO: 506519 - DNA, 20 bp, mouse
gcgtgcgtgcggcaaagcca

SEQ ID NO: 506520 - DNA, 20 bp, mouse
gcagagccatgggcggacac

SEQ ID NO: 506521 - DNA, 20 bp, mouse
gatggtgagtgtctcgtggt

SEQ ID NO: 506522 - DNA, 20 bp, mouse
gaagccctgccagggcaggt

SEQ ID NO: 506523 - DNA, 20 bp, mouse
gctaataggacaggggtccg

SEQ ID NO: 506524 - DNA, 20 bp, mouse
gatccactgaagccctgcca

SEQ ID NO: 506525 - DNA, 20 bp, mouse
gagtgtccggtgtccgccca

SEQ ID NO: 506526 - DNA, 20 bp, mouse
gcgaacgaggccgggccatg

SEQ ID NO: 506527 - DNA, 20 bp, mouse
gccgagcgagccagcgaacg

SEQ ID NO: 506528 - DNA, 20 bp, mouse
ggcgagcagtccgaaggact

SEQ ID NO: 506529 - DNA, 20 bp, mouse
gcgcgcccgcgaaggaccct

SEQ ID NO: 506530 - DNA, 20 bp, mouse
gaaagaggcgagcagtccga

SEQ ID NO: 506531 - DNA, 20 bp, mouse
gcccactgcccgctgcccca

SEQ ID NO: 506532 - DNA, 20 bp, mouse
gaacttggcggggccaccgg

SEQ ID NO: 506533 - DNA, 20 bp, mouse
gtgcccgctgccccatggcc

SEQ ID NO: 506534 - DNA, 20 bp, mouse
ggcagtccgaaggactcggc

SEQ ID NO: 506535 - DNA, 20 bp, mouse
gcaggccgggccatgcccag

SEQ ID NO: 506536 - DNA, 20 bp, mouse
gggcggcggctgcgtgagag

SEQ ID NO: 506537 - DNA, 20 bp, mouse
gcggtggttgggctagacgt

SEQ ID NO: 506538 - DNA, 20 bp, mouse
gctcctcagtaggctacata

SEQ ID NO: 506539 - DNA, 20 bp, mouse
gcagcggtcgctgaactcgt

SEQ ID NO: 506540 - DNA, 20 bp, mouse
ggtcttgcagggtaagccgg

SEQ ID NO: 506541 - DNA, 20 bp, mouse
ggcttcccgagggagatggt

SEQ ID NO: 506542 - DNA, 20 bp, mouse
gccagtcgggaagatgcctc

SEQ ID NO: 506543 - DNA, 20 bp, mouse
gtcagctaccaatccaaaag

SEQ ID NO: 506544 - DNA, 20 bp, mouse
gccgtaagtaggagcctggg

SEQ ID NO: 506545 - DNA, 20 bp, mouse
gtcctacttacggggtgcag

SEQ ID NO: 506546 - DNA, 20 bp, mouse
gcccggcaaggagccccaag

SEQ ID NO: 506547 - DNA, 20 bp, mouse
gggaagacgtcgcggccggt

SEQ ID NO: 506548 - DNA, 20 bp, mouse
gcgtcgcggccggtaggctc

SEQ ID NO: 506549 - DNA, 20 bp, mouse
gtgtcacccggaagacgtcg

SEQ ID NO: 506550 - DNA, 20 bp, mouse
ggctccggctggacctcttg

SEQ ID NO: 506551 - DNA, 20 bp, mouse
gaagcaggctgggttaccgt

SEQ ID NO: 506552 - DNA, 20 bp, mouse
gactctgagacaggacccac

SEQ ID NO: 506553 - DNA, 20 bp, mouse
ggagacagcggggctgcagg

SEQ ID NO: 506554 - DNA, 20 bp, mouse
gtcccaggtaaccccgggta

SEQ ID NO: 506555 - DNA, 20 bp, mouse
gacaagggttgttaactgtt

SEQ ID NO: 506556 - DNA, 20 bp, mouse
gcgactgcatcagcctgagg

SEQ ID NO: 506557 - DNA, 20 bp, mouse
gtgagagcgaagtccccctc

SEQ ID NO: 506558 - DNA, 20 bp, mouse
gttgccacccgcgcggacaa

SEQ ID NO: 506559 - DNA, 20 bp, mouse
ggcttcctccccgccacgtc

SEQ ID NO: 506560 - DNA, 20 bp, mouse
gtggcgactgcatcagcctg

SEQ ID NO: 506561 - DNA, 20 bp, mouse
gcgcgcgggtggcaacgtag

SEQ ID NO: 506562 - DNA, 20 bp, mouse
gagaccctgggaagtctgcg

SEQ ID NO: 506563 - DNA, 20 bp, mouse
gcgcggtcagagaagtgaag

SEQ ID NO: 506564 - DNA, 20 bp, mouse
ggcgcaggcgtgcacgaggg

SEQ ID NO: 506565 - DNA, 20 bp, mouse
gccgctgcggccggttccgg

SEQ ID NO: 506566 - DNA, 20 bp, mouse
gcgagtgacccgggaggatg

SEQ ID NO: 506567 - DNA, 20 bp, mouse
ggcgggtcctgagcgctcag

SEQ ID NO: 506568 - DNA, 20 bp, mouse
gggggttaacgtgggaggaa

SEQ ID NO: 506569 - DNA, 20 bp, mouse
gtctggcgaaggcatctgag

SEQ ID NO: 506570 - DNA, 20 bp, mouse
gtgtccaactggctgcgtgg

SEQ ID NO: 506571 - DNA, 20 bp, mouse
gtggcggtgggggttaacgt

SEQ ID NO: 506572 - DNA, 20 bp, mouse
gcagctaggaaactgtagtt

SEQ ID NO: 506573 - DNA, 20 bp, mouse
ggcgctcagaggctccagct

SEQ ID NO: 506574 - DNA, 20 bp, mouse
ggagccaagcaagagagcgc

SEQ ID NO: 506575 - DNA, 20 bp, mouse
gaaaggaaggaagaccctag

SEQ ID NO: 506576 - DNA, 20 bp, mouse
ggccagcaaactccttcggg

SEQ ID NO: 506577 - DNA, 20 bp, mouse
gggagaggagctagcagacg

SEQ ID NO: 506578 - DNA, 20 bp, mouse
gtggcgcactggaagtgcag

SEQ ID NO: 506579 - DNA, 20 bp, mouse
ggccaggacgaggagagcta

SEQ ID NO: 506580 - DNA, 20 bp, mouse
gcaggccagtgcagagtcct

SEQ ID NO: 506581 - DNA, 20 bp, mouse
gcggaccagggaaagaacag

SEQ ID NO: 506582 - DNA, 20 bp, mouse
ggttccctggaggcaaacag

SEQ ID NO: 506583 - DNA, 20 bp, mouse
gcccgggcgaagacggggag

SEQ ID NO: 506584 - DNA, 20 bp, mouse
ggagagaagctggactgggt

SEQ ID NO: 506585 - DNA, 20 bp, mouse
gattcacccgggcgaagacg

SEQ ID NO: 506586 - DNA, 20 bp, mouse
gccgtccgagaggcgcacag

SEQ ID NO: 506587 - DNA, 20 bp, mouse
gcccgagctgcaggcgcgga

SEQ ID NO: 506588 - DNA, 20 bp, mouse
gcccagagcgcgggacacgg

SEQ ID NO: 506589 - DNA, 20 bp, mouse
gtggggagcgagcccagcgg

SEQ ID NO: 506590 - DNA, 20 bp, mouse
gtccgagaggcgcacagagg

SEQ ID NO: 506591 - DNA, 20 bp, mouse
gccacggtaggaggacgcag

SEQ ID NO: 506592 - DNA, 20 bp, mouse
gcagagcacggagcagcggc

SEQ ID NO: 506593 - DNA, 20 bp, mouse
ggaacccgcggatggagtct

SEQ ID NO: 506594 - DNA, 20 bp, mouse
gcgtcaccggggccacctgg

SEQ ID NO: 506595 - DNA, 20 bp, mouse
gtagccgggcgggtcctgat

SEQ ID NO: 506596 - DNA, 20 bp, mouse
gcgccagagaacgaccgcgg

SEQ ID NO: 506597 - DNA, 20 bp, mouse
ggcgcgtcccggctgctctt

SEQ ID NO: 506598 - DNA, 20 bp, mouse
gtggcgacaacagcgcgtcc

SEQ ID NO: 506599 - DNA, 20 bp, mouse
gtgtcgccagagaacgaccg

SEQ ID NO: 506600 - DNA, 20 bp, mouse
gtctggtccctagcccgccg

SEQ ID NO: 506601 - DNA, 20 bp, mouse
ggcccgccgcggtcgttctc

SEQ ID NO: 506602 - DNA, 20 bp, mouse
gagcttggggcgcagctcta

SEQ ID NO: 506603 - DNA, 20 bp, mouse
gtcaccagagcgaagctaag

SEQ ID NO: 506604 - DNA, 20 bp, mouse
gcccggaggcggaggtgtag

SEQ ID NO: 506605 - DNA, 20 bp, mouse
gtcgccacccaagagcagcc

SEQ ID NO: 506606 - DNA, 20 bp, mouse
gagagaggaatcagtcacta

SEQ ID NO: 506607 - DNA, 20 bp, mouse
gctgaggcgagcgcacagag

SEQ ID NO: 506608 - DNA, 20 bp, mouse
gaaagagccgcagggaaagt

SEQ ID NO: 506609 - DNA, 20 bp, mouse
ggctagaagctcaaagagag

SEQ ID NO: 506610 - DNA, 20 bp, mouse
gaagagaggggattccacac

SEQ ID NO: 506611 - DNA, 20 bp, mouse
gcatggtgactaggccagtg

SEQ ID NO: 506612 - DNA, 20 bp, mouse
gcatgcgacaggcaagtcac

SEQ ID NO: 506613 - DNA, 20 bp, mouse
gtcagcaagcagccaggctc

SEQ ID NO: 506614 - DNA, 20 bp, mouse
gacttcaaccgtgctggaac

SEQ ID NO: 506615 - DNA, 20 bp, mouse
gaaacgctgtctgtatcaag

SEQ ID NO: 506616 - DNA, 20 bp, mouse
gagtccaactgaacagacac

SEQ ID NO: 506617 - DNA, 20 bp, mouse
ggacacaggacggctggctt

SEQ ID NO: 506618 - DNA, 20 bp, mouse
gagctcctgaagattaaaat

SEQ ID NO: 506619 - DNA, 20 bp, mouse
gtcagttggactccctctcc

SEQ ID NO: 506620 - DNA, 20 bp, mouse
gctcttaaagtgcttctcaa

SEQ ID NO: 506621 - DNA, 20 bp, mouse
gaaaagaactggttcaaagt

SEQ ID NO: 506622 - DNA, 20 bp, mouse
gatgaaggcaaatttaatat

SEQ ID NO: 506623 - DNA, 20 bp, mouse
gttcctttgtatctattcag

SEQ ID NO: 506624 - DNA, 20 bp, mouse
gcgtcctgtgtctgttcagt

SEQ ID NO: 506625 - DNA, 20 bp, mouse
gaaattcatatgcaactagc

SEQ ID NO: 506626 - DNA, 20 bp, mouse
gggtgctctggttctcacca

SEQ ID NO: 506627 - DNA, 20 bp, mouse
ggcacccaaggaagcttcct

SEQ ID NO: 506628 - DNA, 20 bp, mouse
gattaagcctggtgcaccca

SEQ ID NO: 506629 - DNA, 20 bp, mouse
gcacctacccagagctggtg

SEQ ID NO: 506630 - DNA, 20 bp, mouse
gctcaccaaggaagcttcct

SEQ ID NO: 506631 - DNA, 20 bp, mouse
gggcgtcgtggagatcgtcg

SEQ ID NO: 506632 - DNA, 20 bp, mouse
gagcggacgaagaccaccac

SEQ ID NO: 506633 - DNA, 20 bp, mouse
gaagcttccttgggtgcacc

SEQ ID NO: 506634 - DNA, 20 bp, mouse
ggaggctgcaccaggctctt

SEQ ID NO: 506635 - DNA, 20 bp, mouse
gaacaatcttgctgctccaa

SEQ ID NO: 506636 - DNA, 20 bp, mouse
gtctgcctgggacatgaggt

SEQ ID NO: 506637 - DNA, 20 bp, mouse
ggcagtctgcctgggacatg

SEQ ID NO: 506638 - DNA, 20 bp, mouse
gtggcaagcttcccagatgt

SEQ ID NO: 506639 - DNA, 20 bp, mouse
ggcgtgcaggctggcagtct

SEQ ID NO: 506640 - DNA, 20 bp, mouse
gacatgaggttggcagcggg

SEQ ID NO: 506641 - DNA, 20 bp, mouse
gctgggggactcatcctgag

SEQ ID NO: 506642 - DNA, 20 bp, mouse
gcagcgggtggcgtgcaggc

SEQ ID NO: 506643 - DNA, 20 bp, mouse
gctgaggccctcccacatct

SEQ ID NO: 506644 - DNA, 20 bp, mouse
gagaggccggagccgcagga

SEQ ID NO: 506645 - DNA, 20 bp, mouse
ggccaggctgcagcctcaca

SEQ ID NO: 506646 - DNA, 20 bp, mouse
gaagcttgtggggttcatga

SEQ ID NO: 506647 - DNA, 20 bp, mouse
gatcctagggcagatccaag

SEQ ID NO: 506648 - DNA, 20 bp, mouse
gccaagtggagaagcttgtg

SEQ ID NO: 506649 - DNA, 20 bp, mouse
gacacatgaacaccacatac

SEQ ID NO: 506650 - DNA, 20 bp, mouse
gctggtacctgccccagaat

SEQ ID NO: 506651 - DNA, 20 bp, mouse
gaggtaccagagaagagcga

SEQ ID NO: 506652 - DNA, 20 bp, mouse
ggcgatggctgccggctggt

SEQ ID NO: 506653 - DNA, 20 bp, mouse
gtgaacaccacatacaggtt

SEQ ID NO: 506654 - DNA, 20 bp, mouse
gctccacttggatctgccct

SEQ ID NO: 506655 - DNA, 20 bp, mouse
gggcagccatcgctcttctc

SEQ ID NO: 506656 - DNA, 20 bp, mouse
gcccaggtgagcctaggctg

SEQ ID NO: 506657 - DNA, 20 bp, mouse
gctgtggagcctgccgaacc

SEQ ID NO: 506658 - DNA, 20 bp, mouse
gacgcggctgcggaaggcta

SEQ ID NO: 506659 - DNA, 20 bp, mouse
gtgccgaacccggcttggtt

SEQ ID NO: 506660 - DNA, 20 bp, mouse
ggaaggcgggcacctggcac

SEQ ID NO: 506661 - DNA, 20 bp, mouse
ggcagggacacccaagctgg

SEQ ID NO: 506662 - DNA, 20 bp, mouse
gctactcagcgcagcagcag

SEQ ID NO: 506663 - DNA, 20 bp, mouse
gacccggcttggttaggagc

SEQ ID NO: 506664 - DNA, 20 bp, mouse
gaccccagcctaggctcacc

SEQ ID NO: 506665 - DNA, 20 bp, mouse
ggaggatgctctgcgtgccc

SEQ ID NO: 506666 - DNA, 20 bp, mouse
gggagcagcagcctcaggca

SEQ ID NO: 506667 - DNA, 20 bp, mouse
ggcagcagcctcaggcacgg

SEQ ID NO: 506668 - DNA, 20 bp, mouse
gggcacggtggagagagatc

SEQ ID NO: 506669 - DNA, 20 bp, mouse
gctctcggagcagcagcctc

SEQ ID NO: 506670 - DNA, 20 bp, mouse
gactttgctaaagcaggtct

SEQ ID NO: 506671 - DNA, 20 bp, mouse
gtctctctccaccgtgcctg

SEQ ID NO: 506672 - DNA, 20 bp, mouse
gcagaacagtcgctggtcca

SEQ ID NO: 506673 - DNA, 20 bp, mouse
ggcgcgccagcgtgccctct

SEQ ID NO: 506674 - DNA, 20 bp, mouse
gtcccggcagtggctccgag

SEQ ID NO: 506675 - DNA, 20 bp, mouse
gggggctcccgcactacgta

SEQ ID NO: 506676 - DNA, 20 bp, mouse
ggaaggtctctattgagccc

SEQ ID NO: 506677 - DNA, 20 bp, mouse
gcaaaccgactgcagaggat

SEQ ID NO: 506678 - DNA, 20 bp, mouse
ggctgggcaaagctggacta

SEQ ID NO: 506679 - DNA, 20 bp, mouse
gcgcatcaaaccgactgcag

SEQ ID NO: 506680 - DNA, 20 bp, mouse
gtccagcaaccattcaggga

SEQ ID NO: 506681 - DNA, 20 bp, mouse
gactgcagaggattggggac

SEQ ID NO: 506682 - DNA, 20 bp, mouse
gtggttccagcaaccattca

SEQ ID NO: 506683 - DNA, 20 bp, mouse
gtgcatgaactgtggatagg

SEQ ID NO: 506684 - DNA, 20 bp, mouse
gctctcgggtcccggaggaa

SEQ ID NO: 506685 - DNA, 20 bp, mouse
ggcagtgacagcccaagttc

SEQ ID NO: 506686 - DNA, 20 bp, mouse
gccgcggggctggagactac

SEQ ID NO: 506687 - DNA, 20 bp, mouse
gggctggagactacaggcag

SEQ ID NO: 506688 - DNA, 20 bp, mouse
gctcctgcgcaccatctccc

SEQ ID NO: 506689 - DNA, 20 bp, mouse
gcagccacgcgcggtcccgg

SEQ ID NO: 506690 - DNA, 20 bp, mouse
ggccgggccagacctggtgg

SEQ ID NO: 506691 - DNA, 20 bp, mouse
gcgcgtggctgaagcgtcgc

SEQ ID NO: 506692 - DNA, 20 bp, mouse
gctaggcactgaaggatccc

SEQ ID NO: 506693 - DNA, 20 bp, mouse
gtggtggcgcggcgggcata

SEQ ID NO: 506694 - DNA, 20 bp, mouse
gcaggcagcggctggtggcg

SEQ ID NO: 506695 - DNA, 20 bp, mouse
gggagactacaggcagcggc

SEQ ID NO: 506696 - DNA, 20 bp, mouse
gcccgcagcgacgcgcgccg

SEQ ID NO: 506697 - DNA, 20 bp, mouse
gtccgcaacttcggccacgg

SEQ ID NO: 506698 - DNA, 20 bp, mouse
gcggtccccgacgggcacgg

SEQ ID NO: 506699 - DNA, 20 bp, mouse
gcactccgcaacttcggcca

SEQ ID NO: 506700 - DNA, 20 bp, mouse
gtggccagcgccggacccca

SEQ ID NO: 506701 - DNA, 20 bp, mouse
ggagatggccgtagaggtcg

SEQ ID NO: 506702 - DNA, 20 bp, mouse
ggccccggcgcgcgtcgctg

SEQ ID NO: 506703 - DNA, 20 bp, mouse
ggacgctgcgggtgacgcgt

SEQ ID NO: 506704 - DNA, 20 bp, mouse
gggcgccagcggtccccgac

SEQ ID NO: 506705 - DNA, 20 bp, mouse
gcacggcggccgggcgctct

SEQ ID NO: 506706 - DNA, 20 bp, mouse
gcagtgctcgggacagacgg

SEQ ID NO: 506707 - DNA, 20 bp, mouse
ggactgcatgacgactccga

SEQ ID NO: 506708 - DNA, 20 bp, mouse
ggacaggagcgtggtacgca

SEQ ID NO: 506709 - DNA, 20 bp, mouse
gccgaggccggcaccccgaa

SEQ ID NO: 506710 - DNA, 20 bp, mouse
gtgacgactccgacggccac

SEQ ID NO: 506711 - DNA, 20 bp, mouse
gtcggctgtggtccagcccg

SEQ ID NO: 506712 - DNA, 20 bp, mouse
gccgagcggccggtccccga

SEQ ID NO: 506713 - DNA, 20 bp, mouse
gtggtccagcccgtggccgt

SEQ ID NO: 506714 - DNA, 20 bp, mouse
ggactccgacggccacgggc

SEQ ID NO: 506715 - DNA, 20 bp, mouse
gcgctcgggacggtgtgtcg

SEQ ID NO: 506716 - DNA, 20 bp, mouse
ggggcgggcgaggagagtcg

SEQ ID NO: 506717 - DNA, 20 bp, mouse
gggaggtcaggagctaacag

SEQ ID NO: 506718 - DNA, 20 bp, mouse
gcgggcgaggagagtcgagg

SEQ ID NO: 506719 - DNA, 20 bp, mouse
gggaccgcctctgagtaggg

SEQ ID NO: 506720 - DNA, 20 bp, mouse
gcctcgcccgccctactcag

SEQ ID NO: 506721 - DNA, 20 bp, mouse
gagcggggcggggtgcaaac

SEQ ID NO: 506722 - DNA, 20 bp, mouse
gacctgggccgggagactgg

SEQ ID NO: 506723 - DNA, 20 bp, mouse
gggctgcgctgaaagcgggg

SEQ ID NO: 506724 - DNA, 20 bp, mouse
gcaaagcccgccatgcccga

SEQ ID NO: 506725 - DNA, 20 bp, mouse
gctgatggctgcgctgaaag

SEQ ID NO: 506726 - DNA, 20 bp, mouse
gctggcccggagcgcaaaca

SEQ ID NO: 506727 - DNA, 20 bp, mouse
gagctcggctgagagaggcc

SEQ ID NO: 506728 - DNA, 20 bp, mouse
ggctgaagctcggctgagag

SEQ ID NO: 506729 - DNA, 20 bp, mouse
gctggcccgggagcccccag

SEQ ID NO: 506730 - DNA, 20 bp, mouse
gatggtgtggggactgaccc

SEQ ID NO: 506731 - DNA, 20 bp, mouse
gcgcctgcatcgcggagagg

SEQ ID NO: 506732 - DNA, 20 bp, mouse
gaccgaggcccgaaccgctc

SEQ ID NO: 506733 - DNA, 20 bp, mouse
gcccgcacggagagtccagg

SEQ ID NO: 506734 - DNA, 20 bp, mouse
ggggccgccccttccagcga

SEQ ID NO: 506735 - DNA, 20 bp, mouse
ggtcaggcacatagccccca

SEQ ID NO: 506736 - DNA, 20 bp, mouse
gccagtgtgctgatagataa

SEQ ID NO: 506737 - DNA, 20 bp, mouse
gtatcagcacactggccact

SEQ ID NO: 506738 - DNA, 20 bp, mouse
gagcagcccgaggcccagag

SEQ ID NO: 506739 - DNA, 20 bp, mouse
gacagcagtatgttggagag

SEQ ID NO: 506740 - DNA, 20 bp, mouse
gactgctgttacatgggatc

SEQ ID NO: 506741 - DNA, 20 bp, mouse
gcgctggcagcaaggaccaa

SEQ ID NO: 506742 - DNA, 20 bp, mouse
gcccggccttgaggagtcca

SEQ ID NO: 506743 - DNA, 20 bp, mouse
gtcgccctctctgtgcctag

SEQ ID NO: 506744 - DNA, 20 bp, mouse
ggctggagaccagcgccact

SEQ ID NO: 506745 - DNA, 20 bp, mouse
gccttgttaaccattctcca

SEQ ID NO: 506746 - DNA, 20 bp, mouse
gagtcgaatcgacgaggtca

SEQ ID NO: 506747 - DNA, 20 bp, mouse
gcgagcaggtaggcagagtc

SEQ ID NO: 506748 - DNA, 20 bp, mouse
gatgagcttccagcggttgt

SEQ ID NO: 506749 - DNA, 20 bp, mouse
gtcggcccacggaacaggca

SEQ ID NO: 506750 - DNA, 20 bp, mouse
gaaagtccgaaggctggctg

SEQ ID NO: 506751 - DNA, 20 bp, mouse
ggagggatcccgggagaacg

SEQ ID NO: 506752 - DNA, 20 bp, mouse
ggctggctgaggcagcatcc

SEQ ID NO: 506753 - DNA, 20 bp, mouse
gcccacggaacaggcacggc

SEQ ID NO: 506754 - DNA, 20 bp, mouse
gagcgcacataggctggggt

SEQ ID NO: 506755 - DNA, 20 bp, mouse
gctgaggatgcggtagtgtg

SEQ ID NO: 506756 - DNA, 20 bp, mouse
ggcaggcagaagcggaacca

SEQ ID NO: 506757 - DNA, 20 bp, mouse
gtgccgggacgggcccaaga

SEQ ID NO: 506758 - DNA, 20 bp, mouse
gtctgcgcggcaggcagaag

SEQ ID NO: 506759 - DNA, 20 bp, mouse
gcaatgaatggggctctgcg

SEQ ID NO: 506760 - DNA, 20 bp, mouse
gagcagcaaggcaatgaatg

SEQ ID NO: 506761 - DNA, 20 bp, mouse
gggagcctactggcactacg

SEQ ID NO: 506762 - DNA, 20 bp, mouse
gcccgtcccggcaaccctcg

SEQ ID NO: 506763 - DNA, 20 bp, mouse
gccctcagccgccgcctcag

SEQ ID NO: 506764 - DNA, 20 bp, mouse
gagccatcttgggcccgtcc

SEQ ID NO: 506765 - DNA, 20 bp, mouse
gccaccgccgctgccaggtc

SEQ ID NO: 506766 - DNA, 20 bp, mouse
ggcgagcgcgatgccggcag

SEQ ID NO: 506767 - DNA, 20 bp, mouse
ggcgtgggcaactacctcat

SEQ ID NO: 506768 - DNA, 20 bp, mouse
gagccgagcgagcgcgatgc

SEQ ID NO: 506769 - DNA, 20 bp, mouse
ggcccgtcccccgccgctgc

SEQ ID NO: 506770 - DNA, 20 bp, mouse
ggaggagcggctgcgagcgc

SEQ ID NO: 506771 - DNA, 20 bp, mouse
gagcgcgatgccggcagcgg

SEQ ID NO: 506772 - DNA, 20 bp, mouse
gcggcgggggacgggctctt

SEQ ID NO: 506773 - DNA, 20 bp, mouse
gtccagcaccacaagcgcgt

SEQ ID NO: 506774 - DNA, 20 bp, mouse
gctcgcagccgctcctcctc

SEQ ID NO: 506775 - DNA, 20 bp, mouse
ggagcggcgtgtcccgcgag

SEQ ID NO: 506776 - DNA, 20 bp, mouse
gatcttggcgcgaaacttca

SEQ ID NO: 506777 - DNA, 20 bp, mouse
gcaagccaggtccacgatct

SEQ ID NO: 506778 - DNA, 20 bp, mouse
ggcggataccaggccgacgg

SEQ ID NO: 506779 - DNA, 20 bp, mouse
gttggcgcgaaacttcatgg

SEQ ID NO: 506780 - DNA, 20 bp, mouse
gacaaggttaggcagacccc

SEQ ID NO: 506781 - DNA, 20 bp, mouse
gtcacaactgctacaaggtt

SEQ ID NO: 506782 - DNA, 20 bp, mouse
gcggcggcgttggtccaagg

SEQ ID NO: 506783 - DNA, 20 bp, mouse
gcgacggcggcgttggtcca

SEQ ID NO: 506784 - DNA, 20 bp, mouse
gcccgccgggacgctcaggg

SEQ ID NO: 506785 - DNA, 20 bp, mouse
gtgtgagctgcagtacccgg

SEQ ID NO: 506786 - DNA, 20 bp, mouse
gatcctggcccgaaacctca

SEQ ID NO: 506787 - DNA, 20 bp, mouse
gtggtgcctcaaaacctcgg

SEQ ID NO: 506788 - DNA, 20 bp, mouse
gagcaggctacactccaggc

SEQ ID NO: 506789 - DNA, 20 bp, mouse
gtcatggtgcctcaaaacct

SEQ ID NO: 506790 - DNA, 20 bp, mouse
gacagctctctctaccaccg

SEQ ID NO: 506791 - DNA, 20 bp, mouse
gacagaagtacagcctgtca

SEQ ID NO: 506792 - DNA, 20 bp, mouse
gcgctgccagagaagtcagc

SEQ ID NO: 506793 - DNA, 20 bp, mouse
gcaccaccaaagtaaggcag

SEQ ID NO: 506794 - DNA, 20 bp, mouse
gctctaccaccgaggttttg

SEQ ID NO: 506795 - DNA, 20 bp, mouse
ggctccgtgtgtgccctgac

SEQ ID NO: 506796 - DNA, 20 bp, mouse
ggcttcgcgtggggtgagag

SEQ ID NO: 506797 - DNA, 20 bp, mouse
gaacctcacggagcactacg

SEQ ID NO: 506798 - DNA, 20 bp, mouse
gagaactcaccggctaagaa

SEQ ID NO: 506799 - DNA, 20 bp, mouse
gtgctcccgcgagaactcac

SEQ ID NO: 506800 - DNA, 20 bp, mouse
gtggggtgagagcggagcgg

SEQ ID NO: 506801 - DNA, 20 bp, mouse
gcaaatgacgcacaacctca

SEQ ID NO: 506802 - DNA, 20 bp, mouse
gggcaagcgagggttgggac

SEQ ID NO: 506803 - DNA, 20 bp, mouse
gcgccccgtagtgctccgtg

SEQ ID NO: 506804 - DNA, 20 bp, mouse
ggtggcgatttggggtttgg

SEQ ID NO: 506805 - DNA, 20 bp, mouse
ggcggtggcgatttggggtt

SEQ ID NO: 506806 - DNA, 20 bp, mouse
gcccccaggtcccggaagag

SEQ ID NO: 506807 - DNA, 20 bp, mouse
gaggtcccggaagaggggag

SEQ ID NO: 506808 - DNA, 20 bp, mouse
gcctcgccaagcccctgcgg

SEQ ID NO: 506809 - DNA, 20 bp, mouse
gaagctcacctccgccgcag

SEQ ID NO: 506810 - DNA, 20 bp, mouse
gtgctgaagggccagactgg

SEQ ID NO: 506811 - DNA, 20 bp, mouse
gcgccaagcccctgcggcgg

SEQ ID NO: 506812 - DNA, 20 bp, mouse
gtctctgctggaggccgcag

SEQ ID NO: 506813 - DNA, 20 bp, mouse
gctggaggccgcagaggact

SEQ ID NO: 506814 - DNA, 20 bp, mouse
ggaggcctgcaacagtgtgc

SEQ ID NO: 506815 - DNA, 20 bp, mouse
gtcccaaaggctctccaaag

SEQ ID NO: 506816 - DNA, 20 bp, mouse
gagactgctgccaggtaacg

SEQ ID NO: 506817 - DNA, 20 bp, mouse
gcatcccagggtagagactc

SEQ ID NO: 506818 - DNA, 20 bp, mouse
gctgccaggtaacgaggatg

SEQ ID NO: 506819 - DNA, 20 bp, mouse
gagtcacaagatgctgggtg

SEQ ID NO: 506820 - DNA, 20 bp, mouse
gagagcagcagggaatcacg

SEQ ID NO: 506821 - DNA, 20 bp, mouse
gaagcctcatcctcgttacc

SEQ ID NO: 506822 - DNA, 20 bp, mouse
gaggcaagggccctccccct

SEQ ID NO: 506823 - DNA, 20 bp, mouse
gtgtgcctgagtctctaccc

SEQ ID NO: 506824 - DNA, 20 bp, mouse
gagggaatcacgaggatgga

SEQ ID NO: 506825 - DNA, 20 bp, mouse
gcagtgtgctgactccttgg

SEQ ID NO: 506826 - DNA, 20 bp, mouse
gtctctaagctggtgcaact

SEQ ID NO: 506827 - DNA, 20 bp, mouse
gtggccgacctggtgaacaa

SEQ ID NO: 506828 - DNA, 20 bp, mouse
gcagcttagagaagctgcgg

SEQ ID NO: 506829 - DNA, 20 bp, mouse
gatccggccaagacatgctt

SEQ ID NO: 506830 - DNA, 20 bp, mouse
gtggcccctgggaggaaagt

SEQ ID NO: 506831 - DNA, 20 bp, mouse
gtgctgacctcaggactgaa

SEQ ID NO: 506832 - DNA, 20 bp, mouse
gccaggtcggccaggaccta

SEQ ID NO: 506833 - DNA, 20 bp, mouse
gagcccaagcatgtcttggc

SEQ ID NO: 506834 - DNA, 20 bp, mouse
ggcaactaggaccagcttgc

SEQ ID NO: 506835 - DNA, 20 bp, mouse
ggaaaaactggcagccactg

SEQ ID NO: 506836 - DNA, 20 bp, mouse
gctcggggcggagccaacag

SEQ ID NO: 506837 - DNA, 20 bp, mouse
ggccagggccgccgccatcc

SEQ ID NO: 506838 - DNA, 20 bp, mouse
gttgggcgaagggccggatc

SEQ ID NO: 506839 - DNA, 20 bp, mouse
ggccaacagaggctcgagct

SEQ ID NO: 506840 - DNA, 20 bp, mouse
ggggccggatcgggcttggt

SEQ ID NO: 506841 - DNA, 20 bp, mouse
ggtaccaaccaagcccgatc

SEQ ID NO: 506842 - DNA, 20 bp, mouse
gcagtgcttgggcgaagggc

SEQ ID NO: 506843 - DNA, 20 bp, mouse
ggccctggcgtgggtcctgg

SEQ ID NO: 506844 - DNA, 20 bp, mouse
gaggcgccccggggacaaag

SEQ ID NO: 506845 - DNA, 20 bp, mouse
gtcccgcacaaagaccggag

SEQ ID NO: 506846 - DNA, 20 bp, mouse
ggtactgctgggaccagcgt

SEQ ID NO: 506847 - DNA, 20 bp, mouse
ggtcacaacagaactcctgt

SEQ ID NO: 506848 - DNA, 20 bp, mouse
gtgacgctcagaaccagggg

SEQ ID NO: 506849 - DNA, 20 bp, mouse
gttgccagtcaccaccggaa

SEQ ID NO: 506850 - DNA, 20 bp, mouse
ggggcgggcactgagaactt

SEQ ID NO: 506851 - DNA, 20 bp, mouse
gcgtaggcagaccgaggagt

SEQ ID NO: 506852 - DNA, 20 bp, mouse
gagggacagaatgggcctac

SEQ ID NO: 506853 - DNA, 20 bp, mouse
gcgggcactgagaacttagg

SEQ ID NO: 506854 - DNA, 20 bp, mouse
ggaccagcgtaggcagaccg

SEQ ID NO: 506855 - DNA, 20 bp, mouse
gggcaggacgtggatcatcc

SEQ ID NO: 506856 - DNA, 20 bp, mouse
gctctggagcaggtgaataa

SEQ ID NO: 506857 - DNA, 20 bp, mouse
gcaggcttccgggagcagtg

SEQ ID NO: 506858 - DNA, 20 bp, mouse
gaggtgaataaaggaccagc

SEQ ID NO: 506859 - DNA, 20 bp, mouse
gtgctgctcaaccactgctc

SEQ ID NO: 506860 - DNA, 20 bp, mouse
gattatactttatgttctgt

SEQ ID NO: 506861 - DNA, 20 bp, mouse
gtgtattagagctgtttaat

SEQ ID NO: 506862 - DNA, 20 bp, mouse
gtgtacaacatcaaaactta

SEQ ID NO: 506863 - DNA, 20 bp, mouse
gcttttatgtttagtcaagc

SEQ ID NO: 506864 - DNA, 20 bp, mouse
gagcaggcaaacaaaagcaa

SEQ ID NO: 506865 - DNA, 20 bp, mouse
gttcacctgctccagagcag

SEQ ID NO: 506866 - DNA, 20 bp, mouse
gggtgagtctagctaggcca

SEQ ID NO: 506867 - DNA, 20 bp, mouse
gccatctgttctgggtatgt

SEQ ID NO: 506868 - DNA, 20 bp, mouse
gcctgtgttcatgtgaacca

SEQ ID NO: 506869 - DNA, 20 bp, mouse
ggatggaataccatctccac

SEQ ID NO: 506870 - DNA, 20 bp, mouse
gtatgttggtgagtctagct

SEQ ID NO: 506871 - DNA, 20 bp, mouse
gctgattgaatggactatct

SEQ ID NO: 506872 - DNA, 20 bp, mouse
gaatgaaagtgcaggtggtg

SEQ ID NO: 506873 - DNA, 20 bp, mouse
gatggtattccatctgttct

SEQ ID NO: 506874 - DNA, 20 bp, mouse
gagtccattcaatcagggaa

SEQ ID NO: 506875 - DNA, 20 bp, mouse
gtggtgaggagttctgcata

SEQ ID NO: 506876 - DNA, 20 bp, mouse
gttctatgaagggatggatg

SEQ ID NO: 506877 - DNA, 20 bp, mouse
gtcccttcatagaagagtag

SEQ ID NO: 506878 - DNA, 20 bp, mouse
gaacccagcgtctgagaata

SEQ ID NO: 506879 - DNA, 20 bp, mouse
gaccactactcttctatgaa

SEQ ID NO: 506880 - DNA, 20 bp, mouse
gggccatattctcagacgct

SEQ ID NO: 506881 - DNA, 20 bp, mouse
gaacacagaagggttcccac

SEQ ID NO: 506882 - DNA, 20 bp, mouse
gctgactatgtgtgactaaa

SEQ ID NO: 506883 - DNA, 20 bp, mouse
gtgaagtatactgacctcaa

SEQ ID NO: 506884 - DNA, 20 bp, mouse
gtgtgtcatgatattcccgt

SEQ ID NO: 506885 - DNA, 20 bp, mouse
gacagtcaacaacagatgat

SEQ ID NO: 506886 - DNA, 20 bp, mouse
gtcggcagtgcagcaaaaag

SEQ ID NO: 506887 - DNA, 20 bp, mouse
ggatggtaacaagatggact

SEQ ID NO: 506888 - DNA, 20 bp, mouse
gcggttgctgtggcaacaga

SEQ ID NO: 506889 - DNA, 20 bp, mouse
ggcaacagatggtaacaaga

SEQ ID NO: 506890 - DNA, 20 bp, mouse
gctgtacactcagaatccca

SEQ ID NO: 506891 - DNA, 20 bp, mouse
gcgcgctccctgacgaaact

SEQ ID NO: 506892 - DNA, 20 bp, mouse
gtagaagcgagcttccaggc

SEQ ID NO: 506893 - DNA, 20 bp, mouse
gttcagtggggtgaacagta

SEQ ID NO: 506894 - DNA, 20 bp, mouse
gccacagcaaccgcagagtg

SEQ ID NO: 506895 - DNA, 20 bp, mouse
gttcgtcagggagcgcggtg

SEQ ID NO: 506896 - DNA, 20 bp, mouse
gcgctgtgcgtgagaggagg

SEQ ID NO: 506897 - DNA, 20 bp, mouse
gggtcgctgtgcgtgagagg

SEQ ID NO: 506898 - DNA, 20 bp, mouse
gagagactgaagcgagtcaa

SEQ ID NO: 506899 - DNA, 20 bp, mouse
gtccggtcgctgtgcgtgag

SEQ ID NO: 506900 - DNA, 20 bp, mouse
gcaatcggcctcaggacgtc

SEQ ID NO: 506901 - DNA, 20 bp, mouse
gatgcaggcccgcggagggt

SEQ ID NO: 506902 - DNA, 20 bp, mouse
gcgagtcaagggtctctctg

SEQ ID NO: 506903 - DNA, 20 bp, mouse
gacagcgaccggacgtcctg

SEQ ID NO: 506904 - DNA, 20 bp, mouse
gggacatccccgagaagcgg

SEQ ID NO: 506905 - DNA, 20 bp, mouse
ggcaaccactagctgactga

SEQ ID NO: 506906 - DNA, 20 bp, mouse
gtagcagtcgcggctcaccc

SEQ ID NO: 506907 - DNA, 20 bp, mouse
ggcccagggtctagcagtcg

SEQ ID NO: 506908 - DNA, 20 bp, mouse
gagtgggaaacagcgttccg

SEQ ID NO: 506909 - DNA, 20 bp, mouse
gacgactacgctgaacgtgg

SEQ ID NO: 506910 - DNA, 20 bp, mouse
ggctagaccctgggcagcgg

SEQ ID NO: 506911 - DNA, 20 bp, mouse
gcggccgagggaaagagcgt

SEQ ID NO: 506912 - DNA, 20 bp, mouse
ggtcgtgcgcctgcgcgagt

SEQ ID NO: 506913 - DNA, 20 bp, mouse
gccgaggctggtgaggatca

SEQ ID NO: 506914 - DNA, 20 bp, mouse
gagccgcgactgctagaccc

SEQ ID NO: 506915 - DNA, 20 bp, mouse
ggaggatcacggagccggag

SEQ ID NO: 506916 - DNA, 20 bp, mouse
gcgagacgccgctgagaggt

SEQ ID NO: 506917 - DNA, 20 bp, mouse
gtgcgcgagacgccgctgag

SEQ ID NO: 506918 - DNA, 20 bp, mouse
ggacgccgctgagaggttgg

SEQ ID NO: 506919 - DNA, 20 bp, mouse
ggcagcacgaccccaacccc

SEQ ID NO: 506920 - DNA, 20 bp, mouse
ggtcgggccgcggctcctag

SEQ ID NO: 506921 - DNA, 20 bp, mouse
gtgaaggccagagggagcgg

SEQ ID NO: 506922 - DNA, 20 bp, mouse
gcggcgaggacgtacccaca

SEQ ID NO: 506923 - DNA, 20 bp, mouse
gcaccagccggccccggacg

SEQ ID NO: 506924 - DNA, 20 bp, mouse
gcttcgctccgggatcaagg

SEQ ID NO: 506925 - DNA, 20 bp, mouse
gaacgaaggggagttgtgaa

SEQ ID NO: 506926 - DNA, 20 bp, mouse
gcggcgcggtgagatcgaaa

SEQ ID NO: 506927 - DNA, 20 bp, mouse
gatggcgaccgagggagacg

SEQ ID NO: 506928 - DNA, 20 bp, mouse
ggaagcggcagcctatgcgg

SEQ ID NO: 506929 - DNA, 20 bp, mouse
gaccgagggagacgtggagt

SEQ ID NO: 506930 - DNA, 20 bp, mouse
gtccaactccacgtctccct

SEQ ID NO: 506931 - DNA, 20 bp, mouse
gagatcgaaatggcgaccga

SEQ ID NO: 506932 - DNA, 20 bp, mouse
gtgtgaagcggcagcctatg

SEQ ID NO: 506933 - DNA, 20 bp, mouse
gcgagaccagcggcccggag

SEQ ID NO: 506934 - DNA, 20 bp, mouse
gagttagagaccgagaccag

SEQ ID NO: 506935 - DNA, 20 bp, mouse
gatctgggcggaagctgtga

SEQ ID NO: 506936 - DNA, 20 bp, mouse
gcctacatggtaagcaggcg

SEQ ID NO: 506937 - DNA, 20 bp, mouse
gtgggctctataccttctgc

SEQ ID NO: 506938 - DNA, 20 bp, mouse
gtttagagtcacagaacgtg

SEQ ID NO: 506939 - DNA, 20 bp, mouse
gtcagtcctacatggtaagc

SEQ ID NO: 506940 - DNA, 20 bp, mouse
ggtgtgttgggaggcagaga

SEQ ID NO: 506941 - DNA, 20 bp, mouse
gacacatactgtattagtta

SEQ ID NO: 506942 - DNA, 20 bp, mouse
gttgggaggcagagaaggtg

SEQ ID NO: 506943 - DNA, 20 bp, mouse
gatggtatggtatgagtgtg

SEQ ID NO: 506944 - DNA, 20 bp, mouse
ggcagttactcagtcctaca

SEQ ID NO: 506945 - DNA, 20 bp, mouse
gggtgtatgtgtgtatggta

SEQ ID NO: 506946 - DNA, 20 bp, mouse
gttccacgcagaaggcctgg

SEQ ID NO: 506947 - DNA, 20 bp, mouse
gtgtaccagacaccatgatg

SEQ ID NO: 506948 - DNA, 20 bp, mouse
gtagatgcacagttctctct

SEQ ID NO: 506949 - DNA, 20 bp, mouse
ggggtgctaaaccatggcac

SEQ ID NO: 506950 - DNA, 20 bp, mouse
gatcctccaggccttctgcg

SEQ ID NO: 506951 - DNA, 20 bp, mouse
gcacactccagcgaggggtg

SEQ ID NO: 506952 - DNA, 20 bp, mouse
gtttctgtgatcgggaccca

SEQ ID NO: 506953 - DNA, 20 bp, mouse
gatggtttagcacccacgtg

SEQ ID NO: 506954 - DNA, 20 bp, mouse
gaactccacactccagcgag

SEQ ID NO: 506955 - DNA, 20 bp, mouse
gaagctgatataggatagtt

SEQ ID NO: 506956 - DNA, 20 bp, mouse
gagcatggctttttttttat

SEQ ID NO: 506957 - DNA, 20 bp, mouse
gcactctttctgggatttgt

SEQ ID NO: 506958 - DNA, 20 bp, mouse
ggctgggaaaagctgggtgt

SEQ ID NO: 506959 - DNA, 20 bp, mouse
ggattgcactgacctcatga

SEQ ID NO: 506960 - DNA, 20 bp, mouse
ggaaacagatcaccatcatg

SEQ ID NO: 506961 - DNA, 20 bp, mouse
gactctaagtggagactcag

SEQ ID NO: 506962 - DNA, 20 bp, mouse
gctgtgctgctgggaaaagc

SEQ ID NO: 506963 - DNA, 20 bp, mouse
gaatctcagtccactctaag

SEQ ID NO: 506964 - DNA, 20 bp, mouse
gaatattgatagacacgggt

SEQ ID NO: 506965 - DNA, 20 bp, mouse
ggtctatcaatattctccag

SEQ ID NO: 506966 - DNA, 20 bp, mouse
gtatttagtctggattagaa

SEQ ID NO: 506967 - DNA, 20 bp, mouse
gcgtatgactggagtctttc

SEQ ID NO: 506968 - DNA, 20 bp, mouse
ggagagactcacactccata

SEQ ID NO: 506969 - DNA, 20 bp, mouse
gcacagctgcatcgtatgac

SEQ ID NO: 506970 - DNA, 20 bp, mouse
gttgcacaggcctcaccgta

SEQ ID NO: 506971 - DNA, 20 bp, mouse
gactcacactccatacggtg

SEQ ID NO: 506972 - DNA, 20 bp, mouse
gtctttgcgacacagcctga

SEQ ID NO: 506973 - DNA, 20 bp, mouse
gtgctctttgcagtttgatc

SEQ ID NO: 506974 - DNA, 20 bp, mouse
ggggaagggttacattggaa

SEQ ID NO: 506975 - DNA, 20 bp, mouse
ggatgggcaattatttagtc

SEQ ID NO: 506976 - DNA, 20 bp, mouse
ggctcgctcgcacagcgaca

SEQ ID NO: 506977 - DNA, 20 bp, mouse
gtgtgcgagcgagctgctag

SEQ ID NO: 506978 - DNA, 20 bp, mouse
gccccgaagagcaacacgcg

SEQ ID NO: 506979 - DNA, 20 bp, mouse
gggcagctcgggatccgtac

SEQ ID NO: 506980 - DNA, 20 bp, mouse
ggcggcgggtacctgcgtga

SEQ ID NO: 506981 - DNA, 20 bp, mouse
ggaaagcccaaaaccccgca

SEQ ID NO: 506982 - DNA, 20 bp, mouse
gggaggttgcaaccaagcga

SEQ ID NO: 506983 - DNA, 20 bp, mouse
gcaccgggccatccagagtc

SEQ ID NO: 506984 - DNA, 20 bp, mouse
gagggctgcgccggatgtgg

SEQ ID NO: 506985 - DNA, 20 bp, mouse
ggcggatgcagccgagggtg

SEQ ID NO: 506986 - DNA, 20 bp, mouse
gaagtcgtgcatgcagactt

SEQ ID NO: 506987 - DNA, 20 bp, mouse
ggctgcctcggaccactgaa

SEQ ID NO: 506988 - DNA, 20 bp, mouse
gtttacctttcagtggtccg

SEQ ID NO: 506989 - DNA, 20 bp, mouse
gtatggtaatagaaattctc

SEQ ID NO: 506990 - DNA, 20 bp, mouse
gtaaaggataccctgtgctt

SEQ ID NO: 506991 - DNA, 20 bp, mouse
gtttgacagcctgaagcttc

SEQ ID NO: 506992 - DNA, 20 bp, mouse
ggtattatcttcccaagcac

SEQ ID NO: 506993 - DNA, 20 bp, mouse
gacatttggtactatttcaa

SEQ ID NO: 506994 - DNA, 20 bp, mouse
ggacaggtgtagctctcaag

SEQ ID NO: 506995 - DNA, 20 bp, mouse
ggacttggcaattagcaagc

SEQ ID NO: 506996 - DNA, 20 bp, mouse
ggaacccggagagctcgctc

SEQ ID NO: 506997 - DNA, 20 bp, mouse
gaagagggtgcggcttacct

SEQ ID NO: 506998 - DNA, 20 bp, mouse
gtgcggcccagaaggacaag

SEQ ID NO: 506999 - DNA, 20 bp, mouse
gcaacctgagcgagctctcc

SEQ ID NO: 507000 - DNA, 20 bp, mouse
gcacctccagacgcggaacg

SEQ ID NO: 507001 - DNA, 20 bp, mouse
ggcgagctctccgggttccc

SEQ ID NO: 507002 - DNA, 20 bp, mouse
gacgggcgggcctcactctg

SEQ ID NO: 507003 - DNA, 20 bp, mouse
gacctccagacagcacgagg

SEQ ID NO: 507004 - DNA, 20 bp, mouse
ggaccacgttccgcgtctgg

SEQ ID NO: 507005 - DNA, 20 bp, mouse
gttccagagagctttcgtgg

SEQ ID NO: 507006 - DNA, 20 bp, mouse
ggcagccgcccggtacctaa

SEQ ID NO: 507007 - DNA, 20 bp, mouse
gtcgccgccgagctcttcaa

SEQ ID NO: 507008 - DNA, 20 bp, mouse
ggccctccgcacacggccca

SEQ ID NO: 507009 - DNA, 20 bp, mouse
gtctacctttaggtaccggg

SEQ ID NO: 507010 - DNA, 20 bp, mouse
ggtgtctggggatgacgagg

SEQ ID NO: 507011 - DNA, 20 bp, mouse
ggcatggtggacgagccggg

SEQ ID NO: 507012 - DNA, 20 bp, mouse
gacggcccacggcagccgcc

SEQ ID NO: 507013 - DNA, 20 bp, mouse
gggctgccgtgggccgtgtg

SEQ ID NO: 507014 - DNA, 20 bp, mouse
ggccgtgggccgtgtgcgga

SEQ ID NO: 507015 - DNA, 20 bp, mouse
gttcaagggtctctaccttt

SEQ ID NO: 507016 - DNA, 20 bp, mouse
ggtgaaggcgggcaccacag

SEQ ID NO: 507017 - DNA, 20 bp, mouse
ggcaccacagcggccccggg

SEQ ID NO: 507018 - DNA, 20 bp, mouse
gcatcttgggcgctaagtga

SEQ ID NO: 507019 - DNA, 20 bp, mouse
gttgggcgctaagtgaaggc

SEQ ID NO: 507020 - DNA, 20 bp, mouse
gcggtcggaggccccgaaag

SEQ ID NO: 507021 - DNA, 20 bp, mouse
gccaagaaggccaaagccac

SEQ ID NO: 507022 - DNA, 20 bp, mouse
gcgtgcgtgggggggaaagt

SEQ ID NO: 507023 - DNA, 20 bp, mouse
gagcaaccccgcggacggtg

SEQ ID NO: 507024 - DNA, 20 bp, mouse
gcaggaagggtgcagcgtcc

SEQ ID NO: 507025 - DNA, 20 bp, mouse
gcttcttggcagcaaccccg

SEQ ID NO: 507026 - DNA, 20 bp, mouse
gcagtcctggctcgagtgag

SEQ ID NO: 507027 - DNA, 20 bp, mouse
gtcgagccaggactgccgaa

SEQ ID NO: 507028 - DNA, 20 bp, mouse
gaagccacacaggaagactg

SEQ ID NO: 507029 - DNA, 20 bp, mouse
gctggctcgagtgagtggca

SEQ ID NO: 507030 - DNA, 20 bp, mouse
gaaaggaaggttaaggtaat

SEQ ID NO: 507031 - DNA, 20 bp, mouse
gctccaagccaaagccacac

SEQ ID NO: 507032 - DNA, 20 bp, mouse
gactgccgaaaggaaggtta

SEQ ID NO: 507033 - DNA, 20 bp, mouse
gaccttcctttcggcagtcc

SEQ ID NO: 507034 - DNA, 20 bp, mouse
ggctgtgattggctgttgag

SEQ ID NO: 507035 - DNA, 20 bp, mouse
ggtggcacggattgttctcc

SEQ ID NO: 507036 - DNA, 20 bp, mouse
gagctaccggggacaacgaa

SEQ ID NO: 507037 - DNA, 20 bp, mouse
ggtcccggcgccgacagtcg

SEQ ID NO: 507038 - DNA, 20 bp, mouse
ggacgcccgagtcagctccg

SEQ ID NO: 507039 - DNA, 20 bp, mouse
gctttccgtgcagccgtccc

SEQ ID NO: 507040 - DNA, 20 bp, mouse
gaagcgacagccgcgactgt

SEQ ID NO: 507041 - DNA, 20 bp, mouse
gtagcgactggtgagggcga

SEQ ID NO: 507042 - DNA, 20 bp, mouse
gctaggaagggatccaaggg

SEQ ID NO: 507043 - DNA, 20 bp, mouse
ggtttccccgaacccggtcc

SEQ ID NO: 507044 - DNA, 20 bp, mouse
gtccttagtgaaagctaccg

SEQ ID NO: 507045 - DNA, 20 bp, mouse
gtccccggtagctttcacta

SEQ ID NO: 507046 - DNA, 20 bp, mouse
ggcccccaggagcctcccgg

SEQ ID NO: 507047 - DNA, 20 bp, mouse
gtccgccgggaggctcctgg

SEQ ID NO: 507048 - DNA, 20 bp, mouse
gcccccgccccggccctgga

SEQ ID NO: 507049 - DNA, 20 bp, mouse
gccctggagggcaggtacct

SEQ ID NO: 507050 - DNA, 20 bp, mouse
gggacgctaggatctccgcc

SEQ ID NO: 507051 - DNA, 20 bp, mouse
gagggagctggagggacgct

SEQ ID NO: 507052 - DNA, 20 bp, mouse
gcgagggaggatctgcggga

SEQ ID NO: 507053 - DNA, 20 bp, mouse
gcctgggggccggagcacca

SEQ ID NO: 507054 - DNA, 20 bp, mouse
gtgacgtcggcgcagggagc

SEQ ID NO: 507055 - DNA, 20 bp, mouse
gggcccgagggaggatctgc

SEQ ID NO: 507056 - DNA, 20 bp, mouse
gcggcccgagcggcgaggag

SEQ ID NO: 507057 - DNA, 20 bp, mouse
gtctcctgcgctccctccag

SEQ ID NO: 507058 - DNA, 20 bp, mouse
gggagcggagggccagaccc

SEQ ID NO: 507059 - DNA, 20 bp, mouse
gcgggccgcgcgctctccgt

SEQ ID NO: 507060 - DNA, 20 bp, mouse
ggcccgccgccctgagggag

SEQ ID NO: 507061 - DNA, 20 bp, mouse
gctggccctccgctccctca

SEQ ID NO: 507062 - DNA, 20 bp, mouse
gtccgtgggccggcctcagg

SEQ ID NO: 507063 - DNA, 20 bp, mouse
gagacgcccccgccgcggac

SEQ ID NO: 507064 - DNA, 20 bp, mouse
gcctgggcgctcccgatacg

SEQ ID NO: 507065 - DNA, 20 bp, mouse
gctccaggggaaggaagccg

SEQ ID NO: 507066 - DNA, 20 bp, mouse
gccaggagcagaggtagcgt

SEQ ID NO: 507067 - DNA, 20 bp, mouse
gggtagcgtgggcttggcac

SEQ ID NO: 507068 - DNA, 20 bp, mouse
gacgggttgaagccattgca

SEQ ID NO: 507069 - DNA, 20 bp, mouse
gtagcactgggtgcagactg

SEQ ID NO: 507070 - DNA, 20 bp, mouse
ggactcaccagggatcacaa

SEQ ID NO: 507071 - DNA, 20 bp, mouse
gcagggccagggcaaagtgc

SEQ ID NO: 507072 - DNA, 20 bp, mouse
gctttgccctggccctgcaa

SEQ ID NO: 507073 - DNA, 20 bp, mouse
gagcagaggtagcgtgggct

SEQ ID NO: 507074 - DNA, 20 bp, mouse
ggggatcacaacggtgacca

SEQ ID NO: 507075 - DNA, 20 bp, mouse
gaagtgggattggaaaccca

SEQ ID NO: 507076 - DNA, 20 bp, mouse
gtggagtctatgggcttcag

SEQ ID NO: 507077 - DNA, 20 bp, mouse
gacggctgcctggagggtta

SEQ ID NO: 507078 - DNA, 20 bp, mouse
gcatctctccctaaccctcc

SEQ ID NO: 507079 - DNA, 20 bp, mouse
gcagctgacggctgcctgga

SEQ ID NO: 507080 - DNA, 20 bp, mouse
gagagatgtctgctacaggt

SEQ ID NO: 507081 - DNA, 20 bp, mouse
gagggagagatgtctgctac

SEQ ID NO: 507082 - DNA, 20 bp, mouse
ggtggggtctgtggagtcta

SEQ ID NO: 507083 - DNA, 20 bp, mouse
ggcacatggcatcttagggt

SEQ ID NO: 507084 - DNA, 20 bp, mouse
gacagaggcctctccaccat

SEQ ID NO: 507085 - DNA, 20 bp, mouse
gcatctcaggtggggtctgt

SEQ ID NO: 507086 - DNA, 20 bp, mouse
ggctcctgggaggggaactg

SEQ ID NO: 507087 - DNA, 20 bp, mouse
gatgccacccagagcaggaa

SEQ ID NO: 507088 - DNA, 20 bp, mouse
gctgctgctgggctcctggg

SEQ ID NO: 507089 - DNA, 20 bp, mouse
gcgcggtaagtcacagcatc

SEQ ID NO: 507090 - DNA, 20 bp, mouse
gtaccgcgtgctggcaattg

SEQ ID NO: 507091 - DNA, 20 bp, mouse
gatccccaattgccagcacg

SEQ ID NO: 507092 - DNA, 20 bp, mouse
gggaaacagtcactaaggcg

SEQ ID NO: 507093 - DNA, 20 bp, mouse
gtggggatcctgccgcaatg

SEQ ID NO: 507094 - DNA, 20 bp, mouse
gcactagggagacagaatca

SEQ ID NO: 507095 - DNA, 20 bp, mouse
gcactaaggcggggcagaga

SEQ ID NO: 507096 - DNA, 20 bp, mouse
gaaaagcgacgggagcagaa

SEQ ID NO: 507097 - DNA, 20 bp, mouse
ggggctcccacccctcggat

SEQ ID NO: 507098 - DNA, 20 bp, mouse
gcagccaccagcaaaagcga

SEQ ID NO: 507099 - DNA, 20 bp, mouse
gtggtggctgcctatccgag

SEQ ID NO: 507100 - DNA, 20 bp, mouse
gcagcctgcgcacccaactg

SEQ ID NO: 507101 - DNA, 20 bp, mouse
gtgggagcccccagcaagag

SEQ ID NO: 507102 - DNA, 20 bp, mouse
gtggctgcctatccgagggg

SEQ ID NO: 507103 - DNA, 20 bp, mouse
gtagaggccgtgcctcccgg

SEQ ID NO: 507104 - DNA, 20 bp, mouse
gaaggtgctgaggtcacgga

SEQ ID NO: 507105 - DNA, 20 bp, mouse
ggcggaacgccagggagttt

SEQ ID NO: 507106 - DNA, 20 bp, mouse
ggggagagcacagaaggcga

SEQ ID NO: 507107 - DNA, 20 bp, mouse
ggcagccctggcgaaggccc

SEQ ID NO: 507108 - DNA, 20 bp, mouse
gagcccggagctccaggtgg

SEQ ID NO: 507109 - DNA, 20 bp, mouse
gaatgccggggccttcgcca

SEQ ID NO: 507110 - DNA, 20 bp, mouse
gaagcgtgggaagctagaag

SEQ ID NO: 507111 - DNA, 20 bp, mouse
gctcggcgcagccctggcga

SEQ ID NO: 507112 - DNA, 20 bp, mouse
gccagaggccgaggagcgct

SEQ ID NO: 507113 - DNA, 20 bp, mouse
gggcagcggcggcaatgccg

SEQ ID NO: 507114 - DNA, 20 bp, mouse
gcagggcagcccagaggccg

SEQ ID NO: 507115 - DNA, 20 bp, mouse
gagccaggtggataaggcgg

SEQ ID NO: 507116 - DNA, 20 bp, mouse
ggagagggcccggcaggcaa

SEQ ID NO: 507117 - DNA, 20 bp, mouse
gaagggcagtgggatccgag

SEQ ID NO: 507118 - DNA, 20 bp, mouse
gggatccgagcgggcgaacc

SEQ ID NO: 507119 - DNA, 20 bp, mouse
gctggatgccacgcgctgac

SEQ ID NO: 507120 - DNA, 20 bp, mouse
ggtccacacccgtcagcgcg

SEQ ID NO: 507121 - DNA, 20 bp, mouse
gtgccacgcgctgacgggtg

SEQ ID NO: 507122 - DNA, 20 bp, mouse
gactcatggccgggaatgag

SEQ ID NO: 507123 - DNA, 20 bp, mouse
gaaggagacccgcaagaccg

SEQ ID NO: 507124 - DNA, 20 bp, mouse
gcccggcaggcaagggcagt

SEQ ID NO: 507125 - DNA, 20 bp, mouse
gcggagcggcgggttcctgc

SEQ ID NO: 507126 - DNA, 20 bp, mouse
gccgattccacgtcaataga

SEQ ID NO: 507127 - DNA, 20 bp, mouse
ggacatggaggtaaaagggg

SEQ ID NO: 507128 - DNA, 20 bp, mouse
gcacgtcaatagaaggcact

SEQ ID NO: 507129 - DNA, 20 bp, mouse
gtgacgtggaatcggatgtt

SEQ ID NO: 507130 - DNA, 20 bp, mouse
gtaaatgtctgtcagaggcc

SEQ ID NO: 507131 - DNA, 20 bp, mouse
gaaagacatggaggtaaaag

SEQ ID NO: 507132 - DNA, 20 bp, mouse
ggtcttcggcaaagacatgg

SEQ ID NO: 507133 - DNA, 20 bp, mouse
gtacgtcttcggcaaagaca

SEQ ID NO: 507134 - DNA, 20 bp, mouse
gatatgctagcaaaacttac

SEQ ID NO: 507135 - DNA, 20 bp, mouse
ggtaagaagtggcaccgggt

SEQ ID NO: 507136 - DNA, 20 bp, mouse
gagcccgccatggcgcaggg

SEQ ID NO: 507137 - DNA, 20 bp, mouse
gcgcgccgcgcagcccgcca

SEQ ID NO: 507138 - DNA, 20 bp, mouse
gagggcggcggaagagccgg

SEQ ID NO: 507139 - DNA, 20 bp, mouse
gggccggcgcgcgtgagcag

SEQ ID NO: 507140 - DNA, 20 bp, mouse
gccgccatggcgcagggcgg

SEQ ID NO: 507141 - DNA, 20 bp, mouse
gagagccggcggcggactag

SEQ ID NO: 507142 - DNA, 20 bp, mouse
gtgtagccggggaaacccga

SEQ ID NO: 507143 - DNA, 20 bp, mouse
gcgcggccttcgggtttccc

SEQ ID NO: 507144 - DNA, 20 bp, mouse
gcgcagcccgccatggcgca

SEQ ID NO: 507145 - DNA, 20 bp, mouse
ggaagcgccgactgtagccg

SEQ ID NO: 507146 - DNA, 20 bp, mouse
gcaaagacacggcagaagta

SEQ ID NO: 507147 - DNA, 20 bp, mouse
gagaagactgcaactgctcc

SEQ ID NO: 507148 - DNA, 20 bp, mouse
gtcagaggcactgaagctca

SEQ ID NO: 507149 - DNA, 20 bp, mouse
gtgacacttttgagcactgg

SEQ ID NO: 507150 - DNA, 20 bp, mouse
ggtacggcttcatgtctgcc

SEQ ID NO: 507151 - DNA, 20 bp, mouse
gactcaataagagctatgga

SEQ ID NO: 507152 - DNA, 20 bp, mouse
gacctgacagtgtataaagt

SEQ ID NO: 507153 - DNA, 20 bp, mouse
gtactatagaaggatttcca

SEQ ID NO: 507154 - DNA, 20 bp, mouse
gtctatagtagagaaaaaag

SEQ ID NO: 507155 - DNA, 20 bp, mouse
gtcctaatcagacttttaac

SEQ ID NO: 507156 - DNA, 20 bp, mouse
gcttggggcgctgaaatctg

SEQ ID NO: 507157 - DNA, 20 bp, mouse
gctagcgagcgcagttacag

SEQ ID NO: 507158 - DNA, 20 bp, mouse
gtgggggccacgaagaactg

SEQ ID NO: 507159 - DNA, 20 bp, mouse
ggcggctgtaggcggaggaa

SEQ ID NO: 507160 - DNA, 20 bp, mouse
gtggggagcttccaggcttg

SEQ ID NO: 507161 - DNA, 20 bp, mouse
gtagcgcagcggctctgtac

SEQ ID NO: 507162 - DNA, 20 bp, mouse
gcggacgcggagagttgcag

SEQ ID NO: 507163 - DNA, 20 bp, mouse
ggctgcgcgcctggctaatt

SEQ ID NO: 507164 - DNA, 20 bp, mouse
gccggggacccacccgaact

SEQ ID NO: 507165 - DNA, 20 bp, mouse
gtctcagtcctagttcgggt

SEQ ID NO: 507166 - DNA, 20 bp, mouse
gccccagcgtaggccccagg

SEQ ID NO: 507167 - DNA, 20 bp, mouse
gcggtcctgggaggtgaaca

SEQ ID NO: 507168 - DNA, 20 bp, mouse
gtcggctcaggccccagcgt

SEQ ID NO: 507169 - DNA, 20 bp, mouse
ggagcaacaacgttccagtt

SEQ ID NO: 507170 - DNA, 20 bp, mouse
ggctggggcctgagccgaac

SEQ ID NO: 507171 - DNA, 20 bp, mouse
ggaagagtgagcaccggaag

SEQ ID NO: 507172 - DNA, 20 bp, mouse
gtgaacatggcgaccgcctg

SEQ ID NO: 507173 - DNA, 20 bp, mouse
ggagaaaggcgggacggaaa

SEQ ID NO: 507174 - DNA, 20 bp, mouse
gggtcccggtgagccgagaa

SEQ ID NO: 507175 - DNA, 20 bp, mouse
gtgagcaccggaagcggtcc

SEQ ID NO: 507176 - DNA, 20 bp, mouse
gatcctgagaacaggcggag

SEQ ID NO: 507177 - DNA, 20 bp, mouse
ggaaaggttgtacaatgaga

SEQ ID NO: 507178 - DNA, 20 bp, mouse
gggatcatgaaggtcgccag

SEQ ID NO: 507179 - DNA, 20 bp, mouse
gagaacaagaagttgaagaa

SEQ ID NO: 507180 - DNA, 20 bp, mouse
gctagggcctgcagcggctg

SEQ ID NO: 507181 - DNA, 20 bp, mouse
gtgcggttctggggcagggt

SEQ ID NO: 507182 - DNA, 20 bp, mouse
gctgaaggcgggcaggacag

SEQ ID NO: 507183 - DNA, 20 bp, mouse
ggcggctgcggcactgccac

SEQ ID NO: 507184 - DNA, 20 bp, mouse
gtcctgctctacgacatgaa

SEQ ID NO: 507185 - DNA, 20 bp, mouse
ggcggccgaggtgaggtccg

SEQ ID NO: 507186 - DNA, 20 bp, mouse
gtgctcgtaggaggaagacc

SEQ ID NO: 507187 - DNA, 20 bp, mouse
gtcgtaggaggaagaccggg

SEQ ID NO: 507188 - DNA, 20 bp, mouse
gcgggagggagccgccacag

SEQ ID NO: 507189 - DNA, 20 bp, mouse
gaggctttcatgctgctcgt

SEQ ID NO: 507190 - DNA, 20 bp, mouse
gctttcatgctgctcgtagg

SEQ ID NO: 507191 - DNA, 20 bp, mouse
ggactgcgcggcaccaggct

SEQ ID NO: 507192 - DNA, 20 bp, mouse
ggcctgtcggaccacagctt

SEQ ID NO: 507193 - DNA, 20 bp, mouse
gacggacctcaccggactga

SEQ ID NO: 507194 - DNA, 20 bp, mouse
gatagtgggatgcgagtcca

SEQ ID NO: 507195 - DNA, 20 bp, mouse
gtcccggagcaaaaccccgg

SEQ ID NO: 507196 - DNA, 20 bp, mouse
ggtgcgcggctgctacgagg

SEQ ID NO: 507197 - DNA, 20 bp, mouse
gccggtgcgcggctgctacg

SEQ ID NO: 507198 - DNA, 20 bp, mouse
gccgcaggcgcgagtagcag

SEQ ID NO: 507199 - DNA, 20 bp, mouse
ggggactcggggacgcgata

SEQ ID NO: 507200 - DNA, 20 bp, mouse
gctgtctgtgaaagaaggtt

SEQ ID NO: 507201 - DNA, 20 bp, mouse
ggccagagcccagggcaagt

SEQ ID NO: 507202 - DNA, 20 bp, mouse
gagagggtcccagagtccca

SEQ ID NO: 507203 - DNA, 20 bp, mouse
gctctgccaggaccacctga

SEQ ID NO: 507204 - DNA, 20 bp, mouse
gcgcgctcggcggaaactga

SEQ ID NO: 507205 - DNA, 20 bp, mouse
gtggtgccgggagtcccgcg

SEQ ID NO: 507206 - DNA, 20 bp, mouse
gaagtcgttactttgagggg

SEQ ID NO: 507207 - DNA, 20 bp, mouse
gcggcgctcgcagcacccgg

SEQ ID NO: 507208 - DNA, 20 bp, mouse
gacggctcagggaccagggt

SEQ ID NO: 507209 - DNA, 20 bp, mouse
ggcgacgctgttgagctggg

SEQ ID NO: 507210 - DNA, 20 bp, mouse
gcccttctgagcttcgacta

SEQ ID NO: 507211 - DNA, 20 bp, mouse
gcgccggacgcgcaggagag

SEQ ID NO: 507212 - DNA, 20 bp, mouse
gtcgactaaggtggatcgcc

SEQ ID NO: 507213 - DNA, 20 bp, mouse
gccgagctccagaaatcgac

SEQ ID NO: 507214 - DNA, 20 bp, mouse
gtggaagtcgttactttgag

SEQ ID NO: 507215 - DNA, 20 bp, mouse
ggcgagaggaccgcgacaag

SEQ ID NO: 507216 - DNA, 20 bp, mouse
gactcttaccttctgaactg

SEQ ID NO: 507217 - DNA, 20 bp, mouse
ggttgtctccccagttcaga

SEQ ID NO: 507218 - DNA, 20 bp, mouse
gaactgagaacacctcctga

SEQ ID NO: 507219 - DNA, 20 bp, mouse
gcacacaagggatatgaatt

SEQ ID NO: 507220 - DNA, 20 bp, mouse
gagctgttgatgaatccatc

SEQ ID NO: 507221 - DNA, 20 bp, mouse
gaagcatttggacactgaag

SEQ ID NO: 507222 - DNA, 20 bp, mouse
ggatatgcagcattgctagt

SEQ ID NO: 507223 - DNA, 20 bp, mouse
ggacactacttctaagtgac

SEQ ID NO: 507224 - DNA, 20 bp, mouse
gtgtctaaaagaagctgcac

SEQ ID NO: 507225 - DNA, 20 bp, mouse
gcttacagccatgtctgtaa

SEQ ID NO: 507226 - DNA, 20 bp, mouse
gccttcgctcggaagcccag

SEQ ID NO: 507227 - DNA, 20 bp, mouse
gggcttccgagcgaaggttg

SEQ ID NO: 507228 - DNA, 20 bp, mouse
ggcagatgctgatctaactg

SEQ ID NO: 507229 - DNA, 20 bp, mouse
gaggcgccccagctactcac

SEQ ID NO: 507230 - DNA, 20 bp, mouse
gaagcccagcggcagggtca

SEQ ID NO: 507231 - DNA, 20 bp, mouse
gggtgccccaaggcttagag

SEQ ID NO: 507232 - DNA, 20 bp, mouse
ggctcggaagcccagcggca

SEQ ID NO: 507233 - DNA, 20 bp, mouse
gttggggcacctgtagggag

SEQ ID NO: 507234 - DNA, 20 bp, mouse
gtctgcacagccaagacctg

SEQ ID NO: 507235 - DNA, 20 bp, mouse
gtgtacgcgcgggtgtgagc

SEQ ID NO: 507236 - DNA, 20 bp, mouse
ggctgtgcggtggggactct

SEQ ID NO: 507237 - DNA, 20 bp, mouse
ggagcgagctcacagcccgc

SEQ ID NO: 507238 - DNA, 20 bp, mouse
gggacctcgcgtgctcggga

SEQ ID NO: 507239 - DNA, 20 bp, mouse
ggccgctgcaccgggctgtg

SEQ ID NO: 507240 - DNA, 20 bp, mouse
ggtggggacccaggggatag

SEQ ID NO: 507241 - DNA, 20 bp, mouse
gcccggtgcgacactcacag

SEQ ID NO: 507242 - DNA, 20 bp, mouse
gtgtcgcgagtggcactcca

SEQ ID NO: 507243 - DNA, 20 bp, mouse
gcggccatcccgagcacgcg

SEQ ID NO: 507244 - DNA, 20 bp, mouse
gacgtggcgacgtcccggga

SEQ ID NO: 507245 - DNA, 20 bp, mouse
gcccggtgcagcggcgtgct

SEQ ID NO: 507246 - DNA, 20 bp, mouse
ggtcgccgcggtgagggaag

SEQ ID NO: 507247 - DNA, 20 bp, mouse
ggcgatggccgggtccgcgt

SEQ ID NO: 507248 - DNA, 20 bp, mouse
gggcgacagcggcaacacca

SEQ ID NO: 507249 - DNA, 20 bp, mouse
ggtccaaggtgagcgctaca

SEQ ID NO: 507250 - DNA, 20 bp, mouse
ggtgagggaagtggacgcga

SEQ ID NO: 507251 - DNA, 20 bp, mouse
gtccctcaccgcggcgacag

SEQ ID NO: 507252 - DNA, 20 bp, mouse
ggcgtccacttccctcaccg

SEQ ID NO: 507253 - DNA, 20 bp, mouse
gtacagggcagcaagctcga

SEQ ID NO: 507254 - DNA, 20 bp, mouse
gctcaccttggacacccacg

SEQ ID NO: 507255 - DNA, 20 bp, mouse
gtgccctgtagcgctcacct

SEQ ID NO: 507256 - DNA, 20 bp, mouse
gcttctaggcacctattcag

SEQ ID NO: 507257 - DNA, 20 bp, mouse
gtaggcacctattcagtggg

SEQ ID NO: 507258 - DNA, 20 bp, mouse
ggtacagtggggaggaactc

SEQ ID NO: 507259 - DNA, 20 bp, mouse
gaactctggctgagtctagg

SEQ ID NO: 507260 - DNA, 20 bp, mouse
gaggaactctggctgagtct

SEQ ID NO: 507261 - DNA, 20 bp, mouse
gggtggtctgtcagaagtga

SEQ ID NO: 507262 - DNA, 20 bp, mouse
gtgagtctaggcggcatagt

SEQ ID NO: 507263 - DNA, 20 bp, mouse
gcagcaattcaaggaccagg

SEQ ID NO: 507264 - DNA, 20 bp, mouse
gcacaatgggtacttcctaa

SEQ ID NO: 507265 - DNA, 20 bp, mouse
gagaagtgagggcctccttt

SEQ ID NO: 507266 - DNA, 20 bp, mouse
gcgacttcctcggccgaaca

SEQ ID NO: 507267 - DNA, 20 bp, mouse
gcctcactcgggtcagccag

SEQ ID NO: 507268 - DNA, 20 bp, mouse
ggacgacctgagcggagggt

SEQ ID NO: 507269 - DNA, 20 bp, mouse
gaggcccgggacgacctgag

SEQ ID NO: 507270 - DNA, 20 bp, mouse
gctcgccgctcggaactccg

SEQ ID NO: 507271 - DNA, 20 bp, mouse
gtcggccgaggaagtcgcgg

SEQ ID NO: 507272 - DNA, 20 bp, mouse
gagaggtctcggaacatcta

SEQ ID NO: 507273 - DNA, 20 bp, mouse
ggcaaggaggcgacaaggat

SEQ ID NO: 507274 - DNA, 20 bp, mouse
gcctccgctcaggtcgtccc

SEQ ID NO: 507275 - DNA, 20 bp, mouse
gggtcgtcccgggcctcact

SEQ ID NO: 507276 - DNA, 20 bp, mouse
ggctgtgcgagccataggag

SEQ ID NO: 507277 - DNA, 20 bp, mouse
gaggtggcgatagctgctgg

SEQ ID NO: 507278 - DNA, 20 bp, mouse
ggtgcgagccataggagggg

SEQ ID NO: 507279 - DNA, 20 bp, mouse
ggctgctggcggtgctgcaa

SEQ ID NO: 507280 - DNA, 20 bp, mouse
gctcctctgccgtccttggg

SEQ ID NO: 507281 - DNA, 20 bp, mouse
gccacaaggacactacggag

SEQ ID NO: 507282 - DNA, 20 bp, mouse
gtgaaggtggcgatagctgc

SEQ ID NO: 507283 - DNA, 20 bp, mouse
gaggtcctcacttttcgtca

SEQ ID NO: 507284 - DNA, 20 bp, mouse
ggaaaagtgaggacctctac

SEQ ID NO: 507285 - DNA, 20 bp, mouse
gtctaagagagggaaaacca

SEQ ID NO: 507286 - DNA, 20 bp, mouse
gcacctgcagccggaatctc

SEQ ID NO: 507287 - DNA, 20 bp, mouse
gggaggcttaccagagattc

SEQ ID NO: 507288 - DNA, 20 bp, mouse
gcatccttccccaaatagaa

SEQ ID NO: 507289 - DNA, 20 bp, mouse
gctggaggcggagcatgctg

SEQ ID NO: 507290 - DNA, 20 bp, mouse
gtggggaaggatggcgagag

SEQ ID NO: 507291 - DNA, 20 bp, mouse
gggcggagcatgctgcggag

SEQ ID NO: 507292 - DNA, 20 bp, mouse
gtggcgagaggggaccaaga

SEQ ID NO: 507293 - DNA, 20 bp, mouse
gggtaagcctcccttctatt

SEQ ID NO: 507294 - DNA, 20 bp, mouse
gaagggtgggtggctgtatg

SEQ ID NO: 507295 - DNA, 20 bp, mouse
ggacaaccctgagaacccga

SEQ ID NO: 507296 - DNA, 20 bp, mouse
ggtaaggcacagacagacct

SEQ ID NO: 507297 - DNA, 20 bp, mouse
gtcagaggaggtgagagcct

SEQ ID NO: 507298 - DNA, 20 bp, mouse
gcaagactgatcttcagagg

SEQ ID NO: 507299 - DNA, 20 bp, mouse
gattcactcccaggtttcag

SEQ ID NO: 507300 - DNA, 20 bp, mouse
ggcacaagactgatcttcag

SEQ ID NO: 507301 - DNA, 20 bp, mouse
gaattaccaactatactgta

SEQ ID NO: 507302 - DNA, 20 bp, mouse
gcctgggagtgaatggagat

SEQ ID NO: 507303 - DNA, 20 bp, mouse
gcagaagcatgaggctctct

SEQ ID NO: 507304 - DNA, 20 bp, mouse
gctcaacccagcctaataca

SEQ ID NO: 507305 - DNA, 20 bp, mouse
ggtctgaggacacccagagc

SEQ ID NO: 507306 - DNA, 20 bp, mouse
gcctgggagcacggtcatgg

SEQ ID NO: 507307 - DNA, 20 bp, mouse
gaagcgggcgctgaggacct

SEQ ID NO: 507308 - DNA, 20 bp, mouse
gggacctgggagcacggtca

SEQ ID NO: 507309 - DNA, 20 bp, mouse
gtgctggtgatgggtgtgag

SEQ ID NO: 507310 - DNA, 20 bp, mouse
gcagcggggcaggacagcag

SEQ ID NO: 507311 - DNA, 20 bp, mouse
gcgtgacgtcaggaactggg

SEQ ID NO: 507312 - DNA, 20 bp, mouse
ggaggaacctgccccggaag

SEQ ID NO: 507313 - DNA, 20 bp, mouse
gtcctcagcgcccgcttccg

SEQ ID NO: 507314 - DNA, 20 bp, mouse
gtcctcagcaggggccgcaa

SEQ ID NO: 507315 - DNA, 20 bp, mouse
gacggtccgcggtgaccctg

SEQ ID NO: 507316 - DNA, 20 bp, mouse
gccagggcacccaaagatgc

SEQ ID NO: 507317 - DNA, 20 bp, mouse
gtcctggcgcctgcatcttt

SEQ ID NO: 507318 - DNA, 20 bp, mouse
gaggcttggtgcccaaagac

SEQ ID NO: 507319 - DNA, 20 bp, mouse
gcacttgtagcaaggatatc

SEQ ID NO: 507320 - DNA, 20 bp, mouse
gatccttgctacaagtgtcc

SEQ ID NO: 507321 - DNA, 20 bp, mouse
gtaacaggaagcagccctag

SEQ ID NO: 507322 - DNA, 20 bp, mouse
gtgtggaactgaccacctca

SEQ ID NO: 507323 - DNA, 20 bp, mouse
gactgcagcgctaaaccctg

SEQ ID NO: 507324 - DNA, 20 bp, mouse
ggcagcgctaaaccctgagg

SEQ ID NO: 507325 - DNA, 20 bp, mouse
gtcctaatgtcccaccccta

SEQ ID NO: 507326 - DNA, 20 bp, mouse
gcagaggaatgcccaggcca

SEQ ID NO: 507327 - DNA, 20 bp, mouse
gctgccccagaggaatgccc

SEQ ID NO: 507328 - DNA, 20 bp, mouse
gctggaaagctccctggcct

SEQ ID NO: 507329 - DNA, 20 bp, mouse
gtacttgtgcggtgcttcag

SEQ ID NO: 507330 - DNA, 20 bp, mouse
ggtgagtcccggaagagcag

SEQ ID NO: 507331 - DNA, 20 bp, mouse
gaccacacagaagacacagc

SEQ ID NO: 507332 - DNA, 20 bp, mouse
gggtataagtcaccagctgg

SEQ ID NO: 507333 - DNA, 20 bp, mouse
gggtatctccccaaggacaa

SEQ ID NO: 507334 - DNA, 20 bp, mouse
gtgcggtgcttcagcggtag

SEQ ID NO: 507335 - DNA, 20 bp, mouse
ggagacctcacgcgaaaata

SEQ ID NO: 507336 - DNA, 20 bp, mouse
ggccgccgccgcctatctgg

SEQ ID NO: 507337 - DNA, 20 bp, mouse
gtaagctgccgccagatagg

SEQ ID NO: 507338 - DNA, 20 bp, mouse
ggagactttggtggtgacag

SEQ ID NO: 507339 - DNA, 20 bp, mouse
gccttgcgctgcggactcca

SEQ ID NO: 507340 - DNA, 20 bp, mouse
gctccacccccgacagggag

SEQ ID NO: 507341 - DNA, 20 bp, mouse
ggcgcagtcttgcaagaagg

SEQ ID NO: 507342 - DNA, 20 bp, mouse
gggcggccactgctacgtaa

SEQ ID NO: 507343 - DNA, 20 bp, mouse
ggactccagggcgatgcaga

SEQ ID NO: 507344 - DNA, 20 bp, mouse
ggtagggaggggtgaaatgt

SEQ ID NO: 507345 - DNA, 20 bp, mouse
gcgtgctcgggccagcgccc

SEQ ID NO: 507346 - DNA, 20 bp, mouse
gtagctgaggagggacgcgg

SEQ ID NO: 507347 - DNA, 20 bp, mouse
gcacgtggggcgttacgcag

SEQ ID NO: 507348 - DNA, 20 bp, mouse
ggcatagctgaggagggacg

SEQ ID NO: 507349 - DNA, 20 bp, mouse
gagccggtgctcctccagaa

SEQ ID NO: 507350 - DNA, 20 bp, mouse
gtcgcatggttgggatatcc

SEQ ID NO: 507351 - DNA, 20 bp, mouse
gctgagtgtccaggagtgat

SEQ ID NO: 507352 - DNA, 20 bp, mouse
ggcctggcgagaggtcacgt

SEQ ID NO: 507353 - DNA, 20 bp, mouse
ggtggggcgttacgcagagg

SEQ ID NO: 507354 - DNA, 20 bp, mouse
gtgtaatggggggaacccag

SEQ ID NO: 507355 - DNA, 20 bp, mouse
gaacccagaggatagagcaa

SEQ ID NO: 507356 - DNA, 20 bp, mouse
ggtcgagaatgggttaagac

SEQ ID NO: 507357 - DNA, 20 bp, mouse
ggagaatgggttaagacggg

SEQ ID NO: 507358 - DNA, 20 bp, mouse
gggtactctgctagacgttc

SEQ ID NO: 507359 - DNA, 20 bp, mouse
gggacagctgcagactccgg

SEQ ID NO: 507360 - DNA, 20 bp, mouse
gtgctgtaagcttgtcgtct

SEQ ID NO: 507361 - DNA, 20 bp, mouse
ggagtagttaagtcgagaat

SEQ ID NO: 507362 - DNA, 20 bp, mouse
ggaggtctacctctcagcca

SEQ ID NO: 507363 - DNA, 20 bp, mouse
gcgagcgctgcgcataacga

SEQ ID NO: 507364 - DNA, 20 bp, mouse
gctgctagacgttcgggcga

SEQ ID NO: 507365 - DNA, 20 bp, mouse
gggcgggtcacagagcgcag

SEQ ID NO: 507366 - DNA, 20 bp, mouse
gcgttgtgcagagagtgtag

SEQ ID NO: 507367 - DNA, 20 bp, mouse
gggcgatactcaccactcga

SEQ ID NO: 507368 - DNA, 20 bp, mouse
gtggtgagtatcgcccgagt

SEQ ID NO: 507369 - DNA, 20 bp, mouse
gcaaggaggaagcaaaatgt

SEQ ID NO: 507370 - DNA, 20 bp, mouse
gcgctccgggagagggtcga

SEQ ID NO: 507371 - DNA, 20 bp, mouse
gggagttccgggccggtgga

SEQ ID NO: 507372 - DNA, 20 bp, mouse
gtagcatcctccggagccag

SEQ ID NO: 507373 - DNA, 20 bp, mouse
ggacctcctgatgcccactc

SEQ ID NO: 507374 - DNA, 20 bp, mouse
ggcgtcgccctggaacttgt

SEQ ID NO: 507375 - DNA, 20 bp, mouse
gcgcccgagtgggcatcagg

SEQ ID NO: 507376 - DNA, 20 bp, mouse
gacgtcccgggcggtgtccg

SEQ ID NO: 507377 - DNA, 20 bp, mouse
ggagaagtcagtcgggcctg

SEQ ID NO: 507378 - DNA, 20 bp, mouse
gcgtagctggacgcggacgg

SEQ ID NO: 507379 - DNA, 20 bp, mouse
gaccggggcggccaggagag

SEQ ID NO: 507380 - DNA, 20 bp, mouse
gtgtccggggagaagtcagt

SEQ ID NO: 507381 - DNA, 20 bp, mouse
gagctggacgcggacggtgg

SEQ ID NO: 507382 - DNA, 20 bp, mouse
gggcggcgccacgtcccggg

SEQ ID NO: 507383 - DNA, 20 bp, mouse
gggtggcggcgccacgtccc

SEQ ID NO: 507384 - DNA, 20 bp, mouse
gggccctgcgtggcgatctg

SEQ ID NO: 507385 - DNA, 20 bp, mouse
ggggcaggcgctgggaaccg

SEQ ID NO: 507386 - DNA, 20 bp, mouse
ggccgagggtacaaccacag

SEQ ID NO: 507387 - DNA, 20 bp, mouse
ggttgtctgaagggaagcgg

SEQ ID NO: 507388 - DNA, 20 bp, mouse
gtttagagtccggctcagaa

SEQ ID NO: 507389 - DNA, 20 bp, mouse
ggccagccaggtagaggcca

SEQ ID NO: 507390 - DNA, 20 bp, mouse
gctgaagggaagcggcggag

SEQ ID NO: 507391 - DNA, 20 bp, mouse
gcgcagggccagccaggtag

SEQ ID NO: 507392 - DNA, 20 bp, mouse
gtcggcgtctgaaagctcgg

SEQ ID NO: 507393 - DNA, 20 bp, mouse
gcagggagatgctgacgatg

SEQ ID NO: 507394 - DNA, 20 bp, mouse
ggccagggcaggggtcactc

SEQ ID NO: 507395 - DNA, 20 bp, mouse
gccttcgcttccagacgata

SEQ ID NO: 507396 - DNA, 20 bp, mouse
gggtggcgcgcaacgcatgg

SEQ ID NO: 507397 - DNA, 20 bp, mouse
gctggggagcgtgagcctgc

SEQ ID NO: 507398 - DNA, 20 bp, mouse
gcggcggaggctcattgctt

SEQ ID NO: 507399 - DNA, 20 bp, mouse
ggcatggtggcgacttctct

SEQ ID NO: 507400 - DNA, 20 bp, mouse
ggcgggtggcgcgcaacgca

SEQ ID NO: 507401 - DNA, 20 bp, mouse
gatcaggctctgggcgtcca

SEQ ID NO: 507402 - DNA, 20 bp, mouse
gcgagcccgggtcggcgggt

SEQ ID NO: 507403 - DNA, 20 bp, mouse
gcattgctttggcgccgtct

SEQ ID NO: 507404 - DNA, 20 bp, mouse
ggaaccgagcccgggtcggc

SEQ ID NO: 507405 - DNA, 20 bp, mouse
ggcccgggcgagccaggcac

SEQ ID NO: 507406 - DNA, 20 bp, mouse
gtgctgtaggaggaagaggt

SEQ ID NO: 507407 - DNA, 20 bp, mouse
gttgctgctcctgctgtagg

SEQ ID NO: 507408 - DNA, 20 bp, mouse
gagaggttgggaccaaataa

SEQ ID NO: 507409 - DNA, 20 bp, mouse
gtggctctccgcaacgacct

SEQ ID NO: 507410 - DNA, 20 bp, mouse
gtaggaagcagcgaaaccgg

SEQ ID NO: 507411 - DNA, 20 bp, mouse
gcgctgggggaccctctggg

SEQ ID NO: 507412 - DNA, 20 bp, mouse
gcagcaggagcagcaaggct

SEQ ID NO: 507413 - DNA, 20 bp, mouse
gcagcacccgcgctgatggg

SEQ ID NO: 507414 - DNA, 20 bp, mouse
gccaggccccggaggcgaat

SEQ ID NO: 507415 - DNA, 20 bp, mouse
gagctcaggggcagccccag

SEQ ID NO: 507416 - DNA, 20 bp, mouse
gctgcgtcgggagagatggt

SEQ ID NO: 507417 - DNA, 20 bp, mouse
gacagcagctctgacagtcg

SEQ ID NO: 507418 - DNA, 20 bp, mouse
gtgtggaccggccgcagcag

SEQ ID NO: 507419 - DNA, 20 bp, mouse
gtgtcagagctgctgtggac

SEQ ID NO: 507420 - DNA, 20 bp, mouse
gacagtcgcggcgcaggcac

SEQ ID NO: 507421 - DNA, 20 bp, mouse
ggacgagctggaggtcgcgg

SEQ ID NO: 507422 - DNA, 20 bp, mouse
gccgcagcagcggctcgcag

SEQ ID NO: 507423 - DNA, 20 bp, mouse
gtgggacgagctggaggtcg

SEQ ID NO: 507424 - DNA, 20 bp, mouse
ggaggtcgcggtggctgcgt

SEQ ID NO: 507425 - DNA, 20 bp, mouse
ggcggggctcgccgcagagg

SEQ ID NO: 507426 - DNA, 20 bp, mouse
ggagtgtgtcagctttaaga

SEQ ID NO: 507427 - DNA, 20 bp, mouse
ggggtcctagatctccaaca

SEQ ID NO: 507428 - DNA, 20 bp, mouse
gcctgctctctatagaacag

SEQ ID NO: 507429 - DNA, 20 bp, mouse
gagaatgccaggatcagtgt

SEQ ID NO: 507430 - DNA, 20 bp, mouse
gtaagaaggaaaataaatga

SEQ ID NO: 507431 - DNA, 20 bp, mouse
ggaagagccaacactgatcc

SEQ ID NO: 507432 - DNA, 20 bp, mouse
ggagtcactgaagaagttcc

SEQ ID NO: 507433 - DNA, 20 bp, mouse
ggagatctaggacccggaac

SEQ ID NO: 507434 - DNA, 20 bp, mouse
gaccgagaagagtatttaac

SEQ ID NO: 507435 - DNA, 20 bp, mouse
gaatggtaagaaaatgacac

SEQ ID NO: 507436 - DNA, 20 bp, mouse
gttaccacaagctcgaggga

SEQ ID NO: 507437 - DNA, 20 bp, mouse
gatttattgactttatactt

SEQ ID NO: 507438 - DNA, 20 bp, mouse
gtttcttaccacaagctcga

SEQ ID NO: 507439 - DNA, 20 bp, mouse
gtacaaaataacagggaggg

SEQ ID NO: 507440 - DNA, 20 bp, mouse
gacagtgtgctgtcttcctg

SEQ ID NO: 507441 - DNA, 20 bp, mouse
gttgctgagaaatttcactg

SEQ ID NO: 507442 - DNA, 20 bp, mouse
gggagacttaagatgaaatt

SEQ ID NO: 507443 - DNA, 20 bp, mouse
gttcagcaagtcaggaaatg

SEQ ID NO: 507444 - DNA, 20 bp, mouse
gtctccatccctcgagcttg

SEQ ID NO: 507445 - DNA, 20 bp, mouse
ggataaatcttcagcaagtc

SEQ ID NO: 507446 - DNA, 20 bp, mouse
gttcatttcttgaacagcac

SEQ ID NO: 507447 - DNA, 20 bp, mouse
gccttcaccgggtcaagaag

SEQ ID NO: 507448 - DNA, 20 bp, mouse
gcagatcctgagaccttcac

SEQ ID NO: 507449 - DNA, 20 bp, mouse
gagcaggccacttcttgacc

SEQ ID NO: 507450 - DNA, 20 bp, mouse
gaataagaaactgaacagtt

SEQ ID NO: 507451 - DNA, 20 bp, mouse
gaccagctacagcaggttca

SEQ ID NO: 507452 - DNA, 20 bp, mouse
gagttgggtgtaaaggaaga

SEQ ID NO: 507453 - DNA, 20 bp, mouse
gactgaacagttgggtgtaa

SEQ ID NO: 507454 - DNA, 20 bp, mouse
gactgcagaaatatccagga

SEQ ID NO: 507455 - DNA, 20 bp, mouse
ggttgaatggtggaggacca

SEQ ID NO: 507456 - DNA, 20 bp, mouse
gctgagagtgtcctaaccac

SEQ ID NO: 507457 - DNA, 20 bp, mouse
gaatgaagacaccagtggtt

SEQ ID NO: 507458 - DNA, 20 bp, mouse
gtgctgccgaaattccaggg

SEQ ID NO: 507459 - DNA, 20 bp, mouse
gactgagaaagtgaaaaatg

SEQ ID NO: 507460 - DNA, 20 bp, mouse
gcattgctgccgaaattcca

SEQ ID NO: 507461 - DNA, 20 bp, mouse
ggtgcagctggtactagccc

SEQ ID NO: 507462 - DNA, 20 bp, mouse
gactcacctccctggaattt

SEQ ID NO: 507463 - DNA, 20 bp, mouse
gaatttcggcagcaatgtac

SEQ ID NO: 507464 - DNA, 20 bp, mouse
gaatcagtattggagttggg

SEQ ID NO: 507465 - DNA, 20 bp, mouse
gatgaaaagttatgggaata

SEQ ID NO: 507466 - DNA, 20 bp, mouse
gacttgacgggcctggaggg

SEQ ID NO: 507467 - DNA, 20 bp, mouse
gtggacttgacgggcctgga

SEQ ID NO: 507468 - DNA, 20 bp, mouse
gggtgtgtcttcctgcacag

SEQ ID NO: 507469 - DNA, 20 bp, mouse
ggcctaggggcatctgagta

SEQ ID NO: 507470 - DNA, 20 bp, mouse
gcagctgttggtagtagtgg

SEQ ID NO: 507471 - DNA, 20 bp, mouse
gaatgatgtaaataaactag

SEQ ID NO: 507472 - DNA, 20 bp, mouse
gacagtggacttgacgggcc

SEQ ID NO: 507473 - DNA, 20 bp, mouse
gagatgcccctaggcctagg

SEQ ID NO: 507474 - DNA, 20 bp, mouse
ggtcttcaggaaatcttcag

SEQ ID NO: 507475 - DNA, 20 bp, mouse
gagagtggaaaactctactg

SEQ ID NO: 507476 - DNA, 20 bp, mouse
gcctggtagcagcagagcat

SEQ ID NO: 507477 - DNA, 20 bp, mouse
gcaggaggactcaacatgtt

SEQ ID NO: 507478 - DNA, 20 bp, mouse
gcccgttcccagctcactcg

SEQ ID NO: 507479 - DNA, 20 bp, mouse
gtcctgagggtgaggtggtg

SEQ ID NO: 507480 - DNA, 20 bp, mouse
gcccagctcactcggggcag

SEQ ID NO: 507481 - DNA, 20 bp, mouse
gagagcataggaagaactta

SEQ ID NO: 507482 - DNA, 20 bp, mouse
gagggagtggcttatatctg

SEQ ID NO: 507483 - DNA, 20 bp, mouse
gctcaagcctgggaacacca

SEQ ID NO: 507484 - DNA, 20 bp, mouse
gagagacaaacctcctccta

SEQ ID NO: 507485 - DNA, 20 bp, mouse
gttggctctgccataggagg

SEQ ID NO: 507486 - DNA, 20 bp, mouse
gtttaagtcactgtctaagt

SEQ ID NO: 507487 - DNA, 20 bp, mouse
gaggcactgtgctccctacc

SEQ ID NO: 507488 - DNA, 20 bp, mouse
gagacagtgacttaaatcag

SEQ ID NO: 507489 - DNA, 20 bp, mouse
gggacaactcaccggctacc

SEQ ID NO: 507490 - DNA, 20 bp, mouse
ggaattggtgaagaatggga

SEQ ID NO: 507491 - DNA, 20 bp, mouse
gtcttgcttgtgaacaaata

SEQ ID NO: 507492 - DNA, 20 bp, mouse
gccctaccaggacaactcac

SEQ ID NO: 507493 - DNA, 20 bp, mouse
ggccggtgagttgtcctggt

SEQ ID NO: 507494 - DNA, 20 bp, mouse
gtgggcgctgctataggagg

SEQ ID NO: 507495 - DNA, 20 bp, mouse
gaattcctagtcaaatccag

SEQ ID NO: 507496 - DNA, 20 bp, mouse
gtgctctgggaacctcgagt

SEQ ID NO: 507497 - DNA, 20 bp, mouse
gcagaagggacaaaaatggt

SEQ ID NO: 507498 - DNA, 20 bp, mouse
gtggctgcggaggaaaaagc

SEQ ID NO: 507499 - DNA, 20 bp, mouse
ggaccaggacatggctgcgg

SEQ ID NO: 507500 - DNA, 20 bp, mouse
gaatggtaggatcggagacc

SEQ ID NO: 507501 - DNA, 20 bp, mouse
ggcttgcgaaagggacgcag

SEQ ID NO: 507502 - DNA, 20 bp, mouse
gcctaagctgacagactggc

SEQ ID NO: 507503 - DNA, 20 bp, mouse
gtcactcagacatatccggt

SEQ ID NO: 507504 - DNA, 20 bp, mouse
gtcagggactggattagggg

SEQ ID NO: 507505 - DNA, 20 bp, mouse
gtgcggaggaaaaagctggc

SEQ ID NO: 507506 - DNA, 20 bp, mouse
ggaccagagccacctctgag

SEQ ID NO: 507507 - DNA, 20 bp, mouse
gaaactctttgacccctcag

SEQ ID NO: 507508 - DNA, 20 bp, mouse
ggtgtttcagacgctgctgg

SEQ ID NO: 507509 - DNA, 20 bp, mouse
ggacccctcagaggtggctc

SEQ ID NO: 507510 - DNA, 20 bp, mouse
gactgtaagtacgggagcag

SEQ ID NO: 507511 - DNA, 20 bp, mouse
gctcggctcaagcctgctaa

SEQ ID NO: 507512 - DNA, 20 bp, mouse
gaagctggggcttcagagca

SEQ ID NO: 507513 - DNA, 20 bp, mouse
gtagagcgcttagggtacct

SEQ ID NO: 507514 - DNA, 20 bp, mouse
gccctgcaaactgtaagtac

SEQ ID NO: 507515 - DNA, 20 bp, mouse
gcagacatggctctcacgtc

SEQ ID NO: 507516 - DNA, 20 bp, mouse
gaccgaggctggcaccgagg

SEQ ID NO: 507517 - DNA, 20 bp, mouse
ggtgtgaagagtctgtaccg

SEQ ID NO: 507518 - DNA, 20 bp, mouse
gagacagaagctgccctcct

SEQ ID NO: 507519 - DNA, 20 bp, mouse
gtgtaccgaggctggcaccg

SEQ ID NO: 507520 - DNA, 20 bp, mouse
ggaagagtctgtaccgaggc

SEQ ID NO: 507521 - DNA, 20 bp, mouse
gagcaggatgaggcaaacag

SEQ ID NO: 507522 - DNA, 20 bp, mouse
gtcgtttcccgagcaggatg

SEQ ID NO: 507523 - DNA, 20 bp, mouse
gcaattgtctcatagaaccc

SEQ ID NO: 507524 - DNA, 20 bp, mouse
gaggactgtgctctttaaga

SEQ ID NO: 507525 - DNA, 20 bp, mouse
gtcactgtaaaccactatca

SEQ ID NO: 507526 - DNA, 20 bp, mouse
gtccttcagaggcggagagg

SEQ ID NO: 507527 - DNA, 20 bp, mouse
gcggcttcatcggctcacag

SEQ ID NO: 507528 - DNA, 20 bp, mouse
gctgtccttcagaggcggag

SEQ ID NO: 507529 - DNA, 20 bp, mouse
gaggcggagaggcggcgtga

SEQ ID NO: 507530 - DNA, 20 bp, mouse
ggaatcctgtccttcagagg

SEQ ID NO: 507531 - DNA, 20 bp, mouse
ggggagtgcttcggcttcat

SEQ ID NO: 507532 - DNA, 20 bp, mouse
ggccagcagccagcagccac

SEQ ID NO: 507533 - DNA, 20 bp, mouse
ggccgcctctccgcctctga

SEQ ID NO: 507534 - DNA, 20 bp, mouse
gtgtcatcggacactacaga

SEQ ID NO: 507535 - DNA, 20 bp, mouse
gcattcagaactgaaggcct

SEQ ID NO: 507536 - DNA, 20 bp, mouse
gcagccaccaccaacggcac

SEQ ID NO: 507537 - DNA, 20 bp, mouse
gagacccgtgccgttggtgg

SEQ ID NO: 507538 - DNA, 20 bp, mouse
gtatcacagataggagtcat

SEQ ID NO: 507539 - DNA, 20 bp, mouse
ggagggcagacccgtgccgt

SEQ ID NO: 507540 - DNA, 20 bp, mouse
gctgcagtgagaaacagacc

SEQ ID NO: 507541 - DNA, 20 bp, mouse
gcacgggtctgccctccttc

SEQ ID NO: 507542 - DNA, 20 bp, mouse
gccaagaagtagaaaatacc

SEQ ID NO: 507543 - DNA, 20 bp, mouse
gaggcagcaggtcatgtcac

SEQ ID NO: 507544 - DNA, 20 bp, mouse
gtaggtcacaccaggtgcaa

SEQ ID NO: 507545 - DNA, 20 bp, mouse
gcagaacaactggcaccaaa

SEQ ID NO: 507546 - DNA, 20 bp, mouse
gggacagcgctgcaactggt

SEQ ID NO: 507547 - DNA, 20 bp, mouse
gctgagggtgaacgtcccag

SEQ ID NO: 507548 - DNA, 20 bp, mouse
gagcggccgcagagcgagag

SEQ ID NO: 507549 - DNA, 20 bp, mouse
gcgcagagcgagagcggtcc

SEQ ID NO: 507550 - DNA, 20 bp, mouse
gcgagcaccggatcgatcgg

SEQ ID NO: 507551 - DNA, 20 bp, mouse
gcgggaggacgatcctcagg

SEQ ID NO: 507552 - DNA, 20 bp, mouse
gaatacttaaagctccctga

SEQ ID NO: 507553 - DNA, 20 bp, mouse
ggccaggacagcgctgcaac

SEQ ID NO: 507554 - DNA, 20 bp, mouse
ggaaacagaaaccgatctgt

SEQ ID NO: 507555 - DNA, 20 bp, mouse
ggggcgggaggacgatcctc

SEQ ID NO: 507556 - DNA, 20 bp, mouse
ggagtcaaggcaggtttctg

SEQ ID NO: 507557 - DNA, 20 bp, mouse
ggagagcagagagtcaaggc

SEQ ID NO: 507558 - DNA, 20 bp, mouse
gcccatggttgctgtaaagg

SEQ ID NO: 507559 - DNA, 20 bp, mouse
gctactgctgatggggaaca

SEQ ID NO: 507560 - DNA, 20 bp, mouse
gtccctcagagtggagaaca

SEQ ID NO: 507561 - DNA, 20 bp, mouse
gtaattgtcctgagggtcca

SEQ ID NO: 507562 - DNA, 20 bp, mouse
gaaaggtggtagctgttctc

SEQ ID NO: 507563 - DNA, 20 bp, mouse
gcatgtagtaggacgtacct

SEQ ID NO: 507564 - DNA, 20 bp, mouse
gtgcagactgtcacaccaac

SEQ ID NO: 507565 - DNA, 20 bp, mouse
gaccaggcacacagcttagt

SEQ ID NO: 507566 - DNA, 20 bp, mouse
gtgggtccccacatcactaa

SEQ ID NO: 507567 - DNA, 20 bp, mouse
gatgtggggacccagcgaga

SEQ ID NO: 507568 - DNA, 20 bp, mouse
gacagcggggagtcccccaa

SEQ ID NO: 507569 - DNA, 20 bp, mouse
ggcgagatggagctcacttt

SEQ ID NO: 507570 - DNA, 20 bp, mouse
gtcccgcccttagtgatgtg

SEQ ID NO: 507571 - DNA, 20 bp, mouse
gtagtcgagccaggttgcct

SEQ ID NO: 507572 - DNA, 20 bp, mouse
gtccccacatcactaagggc

SEQ ID NO: 507573 - DNA, 20 bp, mouse
gttgcagcgttagtcgggtg

SEQ ID NO: 507574 - DNA, 20 bp, mouse
gcgggaaactgcactcaccc

SEQ ID NO: 507575 - DNA, 20 bp, mouse
gcccggcagtcaggagtcat

SEQ ID NO: 507576 - DNA, 20 bp, mouse
ggagcatggcttttttttat

SEQ ID NO: 507577 - DNA, 20 bp, mouse
ggctgggaaaagctgggtgt

SEQ ID NO: 507578 - DNA, 20 bp, mouse
ggattgcactgacctcatga

SEQ ID NO: 507579 - DNA, 20 bp, mouse
gactctaagtggagactcag

SEQ ID NO: 507580 - DNA, 20 bp, mouse
ggaaacagatcaccatcatg

SEQ ID NO: 507581 - DNA, 20 bp, mouse
gctgtgctgctgggaaaagc

SEQ ID NO: 507582 - DNA, 20 bp, mouse
gaatctcagtccactctaag

SEQ ID NO: 507583 - DNA, 20 bp, mouse
gaatattgatagacacgggt

SEQ ID NO: 507584 - DNA, 20 bp, mouse
ggtctatcaatattctccag

SEQ ID NO: 507585 - DNA, 20 bp, mouse
ggactcaaagctagcactag

SEQ ID NO: 507586 - DNA, 20 bp, mouse
ggtaccacctgggtaagtca

SEQ ID NO: 507587 - DNA, 20 bp, mouse
gcacaacccaggtaccacct

SEQ ID NO: 507588 - DNA, 20 bp, mouse
ggaggtgcctggggatccgt

SEQ ID NO: 507589 - DNA, 20 bp, mouse
gtatgtgtggagggaatccc

SEQ ID NO: 507590 - DNA, 20 bp, mouse
gtacaataccttcacggagt

SEQ ID NO: 507591 - DNA, 20 bp, mouse
gggcccatacaataccttca

SEQ ID NO: 507592 - DNA, 20 bp, mouse
ggtgtggagggaatcccagg

SEQ ID NO: 507593 - DNA, 20 bp, mouse
gacttacccaggtggtacct

SEQ ID NO: 507594 - DNA, 20 bp, mouse
gttccaagaatcaggaagta

SEQ ID NO: 507595 - DNA, 20 bp, mouse
gccttgacccacggatcccc

SEQ ID NO: 507596 - DNA, 20 bp, mouse
ggcgatcagcggacagacag

SEQ ID NO: 507597 - DNA, 20 bp, mouse
ggccgctgggacgcgatcag

SEQ ID NO: 507598 - DNA, 20 bp, mouse
gcgcgcgctcctaggttcag

SEQ ID NO: 507599 - DNA, 20 bp, mouse
ggggtcagacccctgaacct

SEQ ID NO: 507600 - DNA, 20 bp, mouse
gcagacagcgggagagcgga

SEQ ID NO: 507601 - DNA, 20 bp, mouse
gtactggcgactcgacgagt

SEQ ID NO: 507602 - DNA, 20 bp, mouse
ggctccccgcccccaaggtt

SEQ ID NO: 507603 - DNA, 20 bp, mouse
gaccagtaccgctcacctac

SEQ ID NO: 507604 - DNA, 20 bp, mouse
gcgagtcgccagtaggtgag

SEQ ID NO: 507605 - DNA, 20 bp, mouse
gtccgctgatcgcgtcccag

SEQ ID NO: 507606 - DNA, 20 bp, mouse
gtggagactaacccaccaac

SEQ ID NO: 507607 - DNA, 20 bp, mouse
gatctactcagatagcaccg

SEQ ID NO: 507608 - DNA, 20 bp, mouse
gtagcaccgaggtgtgagtg

SEQ ID NO: 507609 - DNA, 20 bp, mouse
ggtgaaggtgagtgtgctag

SEQ ID NO: 507610 - DNA, 20 bp, mouse
gcttcttgtccaccaatgcc

SEQ ID NO: 507611 - DNA, 20 bp, mouse
gcgcgcgcactgtctgtctc

SEQ ID NO: 507612 - DNA, 20 bp, mouse
gtctgagtagatggcgcttc

SEQ ID NO: 507613 - DNA, 20 bp, mouse
gagggcgggtctacagaacc

SEQ ID NO: 507614 - DNA, 20 bp, mouse
gaaattgctagagaaagggc

SEQ ID NO: 507615 - DNA, 20 bp, mouse
gaaggaaattgctagagaaa

SEQ ID NO: 507616 - DNA, 20 bp, mouse
gggttcatggtgcggagcaa

SEQ ID NO: 507617 - DNA, 20 bp, mouse
gtgcgggtctgccctttctg

SEQ ID NO: 507618 - DNA, 20 bp, mouse
gcaaaggatggagcgcgctg

SEQ ID NO: 507619 - DNA, 20 bp, mouse
gtatgaggtggctgagatgg

SEQ ID NO: 507620 - DNA, 20 bp, mouse
gaggcttaaaggctctctgg

SEQ ID NO: 507621 - DNA, 20 bp, mouse
gggctgtcctccactggcag

SEQ ID NO: 507622 - DNA, 20 bp, mouse
ggtgagtgtgctagaatggg

SEQ ID NO: 507623 - DNA, 20 bp, mouse
gatgggggcaccgcacggat

SEQ ID NO: 507624 - DNA, 20 bp, mouse
gtgacagaagccgatccgtg

SEQ ID NO: 507625 - DNA, 20 bp, mouse
gatctacccagatggcaccg

SEQ ID NO: 507626 - DNA, 20 bp, mouse
gagtctcagctaggaagaca

SEQ ID NO: 507627 - DNA, 20 bp, mouse
ggacacggcgctggaaccca

SEQ ID NO: 507628 - DNA, 20 bp, mouse
ggaccagcgccaggaatcca

SEQ ID NO: 507629 - DNA, 20 bp, mouse
gcccatggagagggctgtgt

SEQ ID NO: 507630 - DNA, 20 bp, mouse
gtatccccgtgaggaccccc

SEQ ID NO: 507631 - DNA, 20 bp, mouse
gggagcccgggggtcctcac

SEQ ID NO: 507632 - DNA, 20 bp, mouse
gggggatatgaagtgtccat

SEQ ID NO: 507633 - DNA, 20 bp, mouse
gcagccagggagggtagcaa

SEQ ID NO: 507634 - DNA, 20 bp, mouse
ggcgggatgatggagcccgg

SEQ ID NO: 507635 - DNA, 20 bp, mouse
ggtagcaaggggctataagc

SEQ ID NO: 507636 - DNA, 20 bp, mouse
gcatgacccaggtgtcctct

SEQ ID NO: 507637 - DNA, 20 bp, mouse
gaccttcaccgagtagatgt

SEQ ID NO: 507638 - DNA, 20 bp, mouse
ggtttcaaggaagttcatat

SEQ ID NO: 507639 - DNA, 20 bp, mouse
ggctccagtgccatccactg

SEQ ID NO: 507640 - DNA, 20 bp, mouse
gagaatgcccagggattctg

SEQ ID NO: 507641 - DNA, 20 bp, mouse
gtgatgcaaaccacagtgga

SEQ ID NO: 507642 - DNA, 20 bp, mouse
gtcaaggaagttcatatggg

SEQ ID NO: 507643 - DNA, 20 bp, mouse
gctgttgatgcaaaccacag

SEQ ID NO: 507644 - DNA, 20 bp, mouse
gtttgtgcttaaaggaagca

SEQ ID NO: 507645 - DNA, 20 bp, mouse
gcaaggaagctcttgtttca

SEQ ID NO: 507646 - DNA, 20 bp, mouse
gcctctcaggcgttatgggg

SEQ ID NO: 507647 - DNA, 20 bp, mouse
ggagacagcatggaaagcgg

SEQ ID NO: 507648 - DNA, 20 bp, mouse
gaagcctctcaggcgttatg

SEQ ID NO: 507649 - DNA, 20 bp, mouse
gtaacgcctgagaggcttct

SEQ ID NO: 507650 - DNA, 20 bp, mouse
gaggcgttatggggcggtgg

SEQ ID NO: 507651 - DNA, 20 bp, mouse
gctcaggcgttatggggcgg

SEQ ID NO: 507652 - DNA, 20 bp, mouse
gcatggaaagcggagggact

SEQ ID NO: 507653 - DNA, 20 bp, mouse
gtgcccgcggggaacagcaa

SEQ ID NO: 507654 - DNA, 20 bp, mouse
gtgagtgttcgggcagggaa

SEQ ID NO: 507655 - DNA, 20 bp, mouse
ggttcgggcagggaacgggt

SEQ ID NO: 507656 - DNA, 20 bp, mouse
gcaagaatgtgaggacgggg

SEQ ID NO: 507657 - DNA, 20 bp, mouse
gcatacaagaatgtgaggac

SEQ ID NO: 507658 - DNA, 20 bp, mouse
ggtgcgcagtggctcctcgg

SEQ ID NO: 507659 - DNA, 20 bp, mouse
gttgagagcgggagagtagg

SEQ ID NO: 507660 - DNA, 20 bp, mouse
gccgaacagtgcaagaagga

SEQ ID NO: 507661 - DNA, 20 bp, mouse
gacatccatacaagaatgtg

SEQ ID NO: 507662 - DNA, 20 bp, mouse
gcggaggacgtgcagttggc

SEQ ID NO: 507663 - DNA, 20 bp, mouse
gaggacggaggacgtgcagt

SEQ ID NO: 507664 - DNA, 20 bp, mouse
gccttctctgaggatgacac

SEQ ID NO: 507665 - DNA, 20 bp, mouse
gtggaccgaacagtgcaaga

SEQ ID NO: 507666 - DNA, 20 bp, mouse
gatatctgcaagacccataa

SEQ ID NO: 507667 - DNA, 20 bp, mouse
gcatcactatcaagatcatg

SEQ ID NO: 507668 - DNA, 20 bp, mouse
gtgggtcttgcagatattga

SEQ ID NO: 507669 - DNA, 20 bp, mouse
gacccctctttcctgcctaa

SEQ ID NO: 507670 - DNA, 20 bp, mouse
gcacagagcctagccattat

SEQ ID NO: 507671 - DNA, 20 bp, mouse
gtgcaagacccataatggct

SEQ ID NO: 507672 - DNA, 20 bp, mouse
gggtcctggcacaaatgagg

SEQ ID NO: 507673 - DNA, 20 bp, mouse
ggaaggtcctggcacaaatg

SEQ ID NO: 507674 - DNA, 20 bp, mouse
gtctttcctgcctaaaggac

SEQ ID NO: 507675 - DNA, 20 bp, mouse
gtgtttgagtcttctcctcc

SEQ ID NO: 507676 - DNA, 20 bp, mouse
ggtcttcagagaacttaaaa

SEQ ID NO: 507677 - DNA, 20 bp, mouse
ggcctagccattaaaaatta

SEQ ID NO: 507678 - DNA, 20 bp, mouse
gaaggtcttgcagatgcttc

SEQ ID NO: 507679 - DNA, 20 bp, mouse
gagctcatgaacaaaaggga

SEQ ID NO: 507680 - DNA, 20 bp, mouse
gggtcagctcatgaacaaaa

SEQ ID NO: 507681 - DNA, 20 bp, mouse
gctctgaagactctcttgtc

SEQ ID NO: 507682 - DNA, 20 bp, mouse
gaccttaatttttaatggct

SEQ ID NO: 507683 - DNA, 20 bp, mouse
ggcaagaccttaatttttaa

SEQ ID NO: 507684 - DNA, 20 bp, mouse
gtgtctgatgcagcaggttg

SEQ ID NO: 507685 - DNA, 20 bp, mouse
ggagtctcctcatttgttcc

SEQ ID NO: 507686 - DNA, 20 bp, mouse
gatgcagcaggtagagatac

SEQ ID NO: 507687 - DNA, 20 bp, mouse
ggtgttgaggtcattgcaga

SEQ ID NO: 507688 - DNA, 20 bp, mouse
gaggtcacatcctagacagc

SEQ ID NO: 507689 - DNA, 20 bp, mouse
gtcctgcctgaaggaccgga

SEQ ID NO: 507690 - DNA, 20 bp, mouse
gcagtagctcatcaccagca

SEQ ID NO: 507691 - DNA, 20 bp, mouse
ggacacttctggtaaaaatg

SEQ ID NO: 507692 - DNA, 20 bp, mouse
gtggatcttgcagatgtcgc

SEQ ID NO: 507693 - DNA, 20 bp, mouse
gaagagagccttgacacttc

SEQ ID NO: 507694 - DNA, 20 bp, mouse
ggtcattgagctgagtgttg

SEQ ID NO: 507695 - DNA, 20 bp, mouse
gacatctgcaagatccacaa

SEQ ID NO: 507696 - DNA, 20 bp, mouse
gtgggtcttgcagaggttga

SEQ ID NO: 507697 - DNA, 20 bp, mouse
gcatcactatcagcatcacg

SEQ ID NO: 507698 - DNA, 20 bp, mouse
gaaggggagggtatttggaa

SEQ ID NO: 507699 - DNA, 20 bp, mouse
gcttcaggcaggagagaaag

SEQ ID NO: 507700 - DNA, 20 bp, mouse
ggccattgtgggtcttgcag

SEQ ID NO: 507701 - DNA, 20 bp, mouse
gtttgatgtgaagaggttca

SEQ ID NO: 507702 - DNA, 20 bp, mouse
gggtcctggcacagatgagg

SEQ ID NO: 507703 - DNA, 20 bp, mouse
gtgtttgagtcttctcctct

SEQ ID NO: 507704 - DNA, 20 bp, mouse
gtaagatagatgcacacagc

SEQ ID NO: 507705 - DNA, 20 bp, mouse
gtcctgcctgaaggacaggc

SEQ ID NO: 507706 - DNA, 20 bp, mouse
gtagatgctggtcactctct

SEQ ID NO: 507707 - DNA, 20 bp, mouse
ggtagtagctcatcattacc

SEQ ID NO: 507708 - DNA, 20 bp, mouse
gaagagggccttgacagtcc

SEQ ID NO: 507709 - DNA, 20 bp, mouse
gttgtgggtcttgtagatgc

SEQ ID NO: 507710 - DNA, 20 bp, mouse
gggtttgagtcttctcctac

SEQ ID NO: 507711 - DNA, 20 bp, mouse
gctggtcactctctgggctg

SEQ ID NO: 507712 - DNA, 20 bp, mouse
gggtaagatctcttagcaca

SEQ ID NO: 507713 - DNA, 20 bp, mouse
gaaaagacttgtctgctact

SEQ ID NO: 507714 - DNA, 20 bp, mouse
gccttcaggcaggaaagagg

SEQ ID NO: 507715 - DNA, 20 bp, mouse
gggaggttcctgcatcacac

SEQ ID NO: 507716 - DNA, 20 bp, mouse
gtgtgtgatgcaacaggtcg

SEQ ID NO: 507717 - DNA, 20 bp, mouse
gaaagcctgtgtgatgcaac

SEQ ID NO: 507718 - DNA, 20 bp, mouse
ggattcccacaggagaaggt

SEQ ID NO: 507719 - DNA, 20 bp, mouse
gatgcaacaggtcggggtgc

SEQ ID NO: 507720 - DNA, 20 bp, mouse
gggcacccaccttctcctgt

SEQ ID NO: 507721 - DNA, 20 bp, mouse
gatttttaccaggagggtta

SEQ ID NO: 507722 - DNA, 20 bp, mouse
gcacatcctagagagcaggt

SEQ ID NO: 507723 - DNA, 20 bp, mouse
gcagcaccgccaggaccatc

SEQ ID NO: 507724 - DNA, 20 bp, mouse
gctgagtgagctgacccagc

SEQ ID NO: 507725 - DNA, 20 bp, mouse
gaagagagccttaaccctcc

SEQ ID NO: 507726 - DNA, 20 bp, mouse
gcagctcatgcagaacacag

SEQ ID NO: 507727 - DNA, 20 bp, mouse
gccagtagctcaacaccacc

SEQ ID NO: 507728 - DNA, 20 bp, mouse
gactcatctgctgcttggga

SEQ ID NO: 507729 - DNA, 20 bp, mouse
gcaacaccaccaggaccatc

SEQ ID NO: 507730 - DNA, 20 bp, mouse
ggccagcagggcatcttcct

SEQ ID NO: 507731 - DNA, 20 bp, mouse
gacccaggaagatgccctgc

SEQ ID NO: 507732 - DNA, 20 bp, mouse
gcaggaacacagtgatgctg

SEQ ID NO: 507733 - DNA, 20 bp, mouse
gatttttaccaggagggtta

SEQ ID NO: 507734 - DNA, 20 bp, mouse
gcatatcctagagagcaggt

SEQ ID NO: 507735 - DNA, 20 bp, mouse
gcatcttcctgggtcagagg

SEQ ID NO: 507736 - DNA, 20 bp, mouse
ggcatcttcaagactcataa

SEQ ID NO: 507737 - DNA, 20 bp, mouse
gcttggtggtgataagctac

SEQ ID NO: 507738 - DNA, 20 bp, mouse
gaagaccatcaggaaagcaa

SEQ ID NO: 507739 - DNA, 20 bp, mouse
gctgtctgatgcagctggtc

SEQ ID NO: 507740 - DNA, 20 bp, mouse
gatgcagctggtcgggatga

SEQ ID NO: 507741 - DNA, 20 bp, mouse
gtcctagactcattctgcac

SEQ ID NO: 507742 - DNA, 20 bp, mouse
gtatttcttcatagccagct

SEQ ID NO: 507743 - DNA, 20 bp, mouse
gtatcaccaccaagaccatc

SEQ ID NO: 507744 - DNA, 20 bp, mouse
gaaggaactgcccctgaccc

SEQ ID NO: 507745 - DNA, 20 bp, mouse
gtatgaagaaatatttccac

SEQ ID NO: 507746 - DNA, 20 bp, mouse
ggaggcaggtcacatcctag

SEQ ID NO: 507747 - DNA, 20 bp, mouse
gcatcactgccaggaccatt

SEQ ID NO: 507748 - DNA, 20 bp, mouse
gagcactttcctaatggtcc

SEQ ID NO: 507749 - DNA, 20 bp, mouse
gccagtagctcatcactgcc

SEQ ID NO: 507750 - DNA, 20 bp, mouse
gctgaaaacctgtctgatgc

SEQ ID NO: 507751 - DNA, 20 bp, mouse
gaggtcacatcctagagggc

SEQ ID NO: 507752 - DNA, 20 bp, mouse
gactggtcaacctgccctct

SEQ ID NO: 507753 - DNA, 20 bp, mouse
gattgcagaatgagtctagt

SEQ ID NO: 507754 - DNA, 20 bp, mouse
gaaaacctgtctgatgcagg

SEQ ID NO: 507755 - DNA, 20 bp, mouse
gacctgtctgatgcaggagg

SEQ ID NO: 507756 - DNA, 20 bp, mouse
gatcgtcttgggaggccggg

SEQ ID NO: 507757 - DNA, 20 bp, mouse
ggaggtagtctccagctccg

SEQ ID NO: 507758 - DNA, 20 bp, mouse
ggcgtcctcaggctgaagag

SEQ ID NO: 507759 - DNA, 20 bp, mouse
ggagggccgggcaccatgga

SEQ ID NO: 507760 - DNA, 20 bp, mouse
gcagcgagcatcgtcttggg

SEQ ID NO: 507761 - DNA, 20 bp, mouse
gcgacagcgagcatcgtctt

SEQ ID NO: 507762 - DNA, 20 bp, mouse
gcttctcctcagcagcaccg

SEQ ID NO: 507763 - DNA, 20 bp, mouse
gtcccgggctgagaggagtg

SEQ ID NO: 507764 - DNA, 20 bp, mouse
gcgggagaatgcccactaag

SEQ ID NO: 507765 - DNA, 20 bp, mouse
gagcatcgtcttgggaggcc

SEQ ID NO: 507766 - DNA, 20 bp, mouse
gagaccacgcaggctcccgg

SEQ ID NO: 507767 - DNA, 20 bp, mouse
gtggtctagccctagaccag

SEQ ID NO: 507768 - DNA, 20 bp, mouse
ggcaggctcccggaggccaa

SEQ ID NO: 507769 - DNA, 20 bp, mouse
gccctagaccaggggaaacc

SEQ ID NO: 507770 - DNA, 20 bp, mouse
gccgagccaggcgaaaggga

SEQ ID NO: 507771 - DNA, 20 bp, mouse
gctggcagcctggtttcccc

SEQ ID NO: 507772 - DNA, 20 bp, mouse
ggctagaccacgcaggctcc

SEQ ID NO: 507773 - DNA, 20 bp, mouse
gcgacccgaagagtctccgc

SEQ ID NO: 507774 - DNA, 20 bp, mouse
ggtctagggctagaccacgc

SEQ ID NO: 507775 - DNA, 20 bp, mouse
gtagcggtgaacagagaacg

SEQ ID NO: 507776 - DNA, 20 bp, mouse
gggctgctacctgcaagatg

SEQ ID NO: 507777 - DNA, 20 bp, mouse
gtacctgcaagatgaggcaa

SEQ ID NO: 507778 - DNA, 20 bp, mouse
gatgaggcaaaggctgtcaa

SEQ ID NO: 507779 - DNA, 20 bp, mouse
ggtagcagccgacaccagcc

SEQ ID NO: 507780 - DNA, 20 bp, mouse
gcagcaggaacgcagcgtgg

SEQ ID NO: 507781 - DNA, 20 bp, mouse
ggaagtccgccctgtaggtg

SEQ ID NO: 507782 - DNA, 20 bp, mouse
gagcatctcttggatggcaa

SEQ ID NO: 507783 - DNA, 20 bp, mouse
gaagatcaacctcacctaca

SEQ ID NO: 507784 - DNA, 20 bp, mouse
gatcaacctcacctacaggg

SEQ ID NO: 507785 - DNA, 20 bp, mouse
gctgctggtggagttcatcc

SEQ ID NO: 507786 - DNA, 20 bp, mouse
ggtctgtgaaccatggtgga

SEQ ID NO: 507787 - DNA, 20 bp, mouse
gggtactggtgaggactcac

SEQ ID NO: 507788 - DNA, 20 bp, mouse
ggagcagcaacaccgtttca

SEQ ID NO: 507789 - DNA, 20 bp, mouse
gatatttcccagaactggag

SEQ ID NO: 507790 - DNA, 20 bp, mouse
ggtcctcaccagtaccaaga

SEQ ID NO: 507791 - DNA, 20 bp, mouse
gggactgacgagcttggcaa

SEQ ID NO: 507792 - DNA, 20 bp, mouse
ggcatctgaaaccctgaggg

SEQ ID NO: 507793 - DNA, 20 bp, mouse
gcaccggcagctggaatacg

SEQ ID NO: 507794 - DNA, 20 bp, mouse
ggtccctcttggtactggtg

SEQ ID NO: 507795 - DNA, 20 bp, mouse
gtggaatacgtggagtcact

SEQ ID NO: 507796 - DNA, 20 bp, mouse
gctcagagctaggccgcagg

SEQ ID NO: 507797 - DNA, 20 bp, mouse
ggacttgagacagaagttct

SEQ ID NO: 507798 - DNA, 20 bp, mouse
ggctatagcctgcacctctc

SEQ ID NO: 507799 - DNA, 20 bp, mouse
gtcttctctaggtcagccga

SEQ ID NO: 507800 - DNA, 20 bp, mouse
ggacacatcagctgatcctt

SEQ ID NO: 507801 - DNA, 20 bp, mouse
gctggaagccagagaggtgc

SEQ ID NO: 507802 - DNA, 20 bp, mouse
gagcaagtcaacatcaacca

SEQ ID NO: 507803 - DNA, 20 bp, mouse
gtgtctcagagctaggccgc

SEQ ID NO: 507804 - DNA, 20 bp, mouse
gccctctgtccaacttacta

SEQ ID NO: 507805 - DNA, 20 bp, mouse
gtttctggctgttactgcca

SEQ ID NO: 507806 - DNA, 20 bp, mouse
gagcgcgggtcccctgtcag

SEQ ID NO: 507807 - DNA, 20 bp, mouse
ggctcggagagattacccga

SEQ ID NO: 507808 - DNA, 20 bp, mouse
ggacgccaaggccaggccac

SEQ ID NO: 507809 - DNA, 20 bp, mouse
ggcgagggacacctctgaca

SEQ ID NO: 507810 - DNA, 20 bp, mouse
gggacttggcgactagtctg

SEQ ID NO: 507811 - DNA, 20 bp, mouse
ggcaggaatgggcccgcagg

SEQ ID NO: 507812 - DNA, 20 bp, mouse
gtgtctgcgaaggtcgggag

SEQ ID NO: 507813 - DNA, 20 bp, mouse
gcggagagattacccgaggg

SEQ ID NO: 507814 - DNA, 20 bp, mouse
gcagccccaaggggccccgg

SEQ ID NO: 507815 - DNA, 20 bp, mouse
gctcccgccccagcccgcag

SEQ ID NO: 507816 - DNA, 20 bp, mouse
ggctgcggtgcgagtctgag

SEQ ID NO: 507817 - DNA, 20 bp, mouse
ggcccacagagcagcagcga

SEQ ID NO: 507818 - DNA, 20 bp, mouse
gcggctctgcggctaggctg

SEQ ID NO: 507819 - DNA, 20 bp, mouse
ggcgaggcggctctgcggct

SEQ ID NO: 507820 - DNA, 20 bp, mouse
gacgcgcggacgcgacaccc

SEQ ID NO: 507821 - DNA, 20 bp, mouse
gcgacacccaggagagcccg

SEQ ID NO: 507822 - DNA, 20 bp, mouse
gaaaggccgcatggcccggg

SEQ ID NO: 507823 - DNA, 20 bp, mouse
gcgactcctcgggctctcct

SEQ ID NO: 507824 - DNA, 20 bp, mouse
gggctccgggagcttgcacc

SEQ ID NO: 507825 - DNA, 20 bp, mouse
ggggtgaccgcgatcggacg

SEQ ID NO: 507826 - DNA, 20 bp, mouse
gggccccggtgcaattggag

SEQ ID NO: 507827 - DNA, 20 bp, mouse
ggcaggcctgtcggtcttag

SEQ ID NO: 507828 - DNA, 20 bp, mouse
ggcctgtcggtcttagaggc

SEQ ID NO: 507829 - DNA, 20 bp, mouse
gcatttgtggtattatgaca

SEQ ID NO: 507830 - DNA, 20 bp, mouse
gaattgcaccggggcccatc

SEQ ID NO: 507831 - DNA, 20 bp, mouse
ggcaatgcgaagatgcccaa

SEQ ID NO: 507832 - DNA, 20 bp, mouse
gtcttcctgggacgagaaaa

SEQ ID NO: 507833 - DNA, 20 bp, mouse
gctcaccgctccaattgcac

SEQ ID NO: 507834 - DNA, 20 bp, mouse
gggggcccatcaggtgaatt

SEQ ID NO: 507835 - DNA, 20 bp, mouse
gcgagaaaacggcccagcag

SEQ ID NO: 507836 - DNA, 20 bp, mouse
gggaatgtatagagccacaa

SEQ ID NO: 507837 - DNA, 20 bp, mouse
gagttcagagattggatggg

SEQ ID NO: 507838 - DNA, 20 bp, mouse
gccaccagccataaaaactt

SEQ ID NO: 507839 - DNA, 20 bp, mouse
gttggagtcattctcaaccc

SEQ ID NO: 507840 - DNA, 20 bp, mouse
ggccagagaggatatacgat

SEQ ID NO: 507841 - DNA, 20 bp, mouse
gttatggctggtggcccttg

SEQ ID NO: 507842 - DNA, 20 bp, mouse
gccagtgacagaggaacact

SEQ ID NO: 507843 - DNA, 20 bp, mouse
ggaggatatacgataggaga

SEQ ID NO: 507844 - DNA, 20 bp, mouse
gtgtatggcaaaatctcttt

SEQ ID NO: 507845 - DNA, 20 bp, mouse
gtgacagtctacctggagtt

SEQ ID NO: 507846 - DNA, 20 bp, mouse
gagactcacgatggcatcct

SEQ ID NO: 507847 - DNA, 20 bp, mouse
ggaggctagcccatacagga

SEQ ID NO: 507848 - DNA, 20 bp, mouse
ggccaggtgagtcccaagaa

SEQ ID NO: 507849 - DNA, 20 bp, mouse
gagtcccaagaatggtgtgt

SEQ ID NO: 507850 - DNA, 20 bp, mouse
gggcagagggagactcacga

SEQ ID NO: 507851 - DNA, 20 bp, mouse
gagtgagatgtgtagcaagg

SEQ ID NO: 507852 - DNA, 20 bp, mouse
gacacccacacaccattctt

SEQ ID NO: 507853 - DNA, 20 bp, mouse
gcagcagcagaggcaacagc

SEQ ID NO: 507854 - DNA, 20 bp, mouse
gtagagtgagatgtgtagca

SEQ ID NO: 507855 - DNA, 20 bp, mouse
gaggctcccagtggaagcaa

SEQ ID NO: 507856 - DNA, 20 bp, mouse
gaggccttcaaaaaggccaa

SEQ ID NO: 507857 - DNA, 20 bp, mouse
gtgatctccactttgcaaac

SEQ ID NO: 507858 - DNA, 20 bp, mouse
ggcctcctgtaggaatgatg

SEQ ID NO: 507859 - DNA, 20 bp, mouse
gctaagggttagctcactga

SEQ ID NO: 507860 - DNA, 20 bp, mouse
gtagctcactgaaggaagag

SEQ ID NO: 507861 - DNA, 20 bp, mouse
gagaatattacaggaaatgt

SEQ ID NO: 507862 - DNA, 20 bp, mouse
gaaagtggagatcattctaa

SEQ ID NO: 507863 - DNA, 20 bp, mouse
ggtggaaaatagcctcctgt

SEQ ID NO: 507864 - DNA, 20 bp, mouse
gtaagccccatcattcctac

SEQ ID NO: 507865 - DNA, 20 bp, mouse
ggccccatcattcctacagg

SEQ ID NO: 507866 - DNA, 20 bp, mouse
gccgccgcaaggcccctggg

SEQ ID NO: 507867 - DNA, 20 bp, mouse
ggaccccagggaccgaaatg

SEQ ID NO: 507868 - DNA, 20 bp, mouse
gcgcccgccgcaaggcccct

SEQ ID NO: 507869 - DNA, 20 bp, mouse
gccctctcgggacctcgggt

SEQ ID NO: 507870 - DNA, 20 bp, mouse
gctgggaccaagcaaacccg

SEQ ID NO: 507871 - DNA, 20 bp, mouse
gcggcaggtgacaagggcgg

SEQ ID NO: 507872 - DNA, 20 bp, mouse
gagtaggggcgcccaccggt

SEQ ID NO: 507873 - DNA, 20 bp, mouse
gcccagggaccgaaatgtgg

SEQ ID NO: 507874 - DNA, 20 bp, mouse
gctaggtgaatccccaccgg

SEQ ID NO: 507875 - DNA, 20 bp, mouse
ggccctaggtgaatccccac

SEQ ID NO: 507876 - DNA, 20 bp, mouse
ggagcggcgcgggtgagaag

SEQ ID NO: 507877 - DNA, 20 bp, mouse
gagtctcgggctaacaagag

SEQ ID NO: 507878 - DNA, 20 bp, mouse
gtccgctcgcagctcttcac

SEQ ID NO: 507879 - DNA, 20 bp, mouse
ggatgccgaagaacaagaag

SEQ ID NO: 507880 - DNA, 20 bp, mouse
gcggctgagaggcgagtctc

SEQ ID NO: 507881 - DNA, 20 bp, mouse
gaagtgtaggcggcaccggg

SEQ ID NO: 507882 - DNA, 20 bp, mouse
gctctctagcgcgggagcga

SEQ ID NO: 507883 - DNA, 20 bp, mouse
ggcgagtcccagggcatgat

SEQ ID NO: 507884 - DNA, 20 bp, mouse
ggtagacagtgcagctccat

SEQ ID NO: 507885 - DNA, 20 bp, mouse
gctagcgcgggagcgaaggc

SEQ ID NO: 507886 - DNA, 20 bp, mouse
ggagctgcacacatcccttc

SEQ ID NO: 507887 - DNA, 20 bp, mouse
gctctccgaagctgacggta

SEQ ID NO: 507888 - DNA, 20 bp, mouse
ggtaaaaggttgttccagaa

SEQ ID NO: 507889 - DNA, 20 bp, mouse
gcacagacagagaatgtacc

SEQ ID NO: 507890 - DNA, 20 bp, mouse
gaataactaactggaggtca

SEQ ID NO: 507891 - DNA, 20 bp, mouse
gcgaagctgacggtaaggta

SEQ ID NO: 507892 - DNA, 20 bp, mouse
gagccagaaggaaaacagta

SEQ ID NO: 507893 - DNA, 20 bp, mouse
gcacattacactggcaccta

SEQ ID NO: 507894 - DNA, 20 bp, mouse
gagctcatcgcagcatttga

SEQ ID NO: 507895 - DNA, 20 bp, mouse
gcgtacctctccgaagctga

SEQ ID NO: 507896 - DNA, 20 bp, mouse
gtgagactggcgaggacgac

SEQ ID NO: 507897 - DNA, 20 bp, mouse
ggggcgcctcacgaagatgg

SEQ ID NO: 507898 - DNA, 20 bp, mouse
ggcggggcgcctcacgaaga

SEQ ID NO: 507899 - DNA, 20 bp, mouse
gagggcaatgcgctccgcaa

SEQ ID NO: 507900 - DNA, 20 bp, mouse
gcccggactcacctcctcca

SEQ ID NO: 507901 - DNA, 20 bp, mouse
ggaatgcctcgtgctcggaa

SEQ ID NO: 507902 - DNA, 20 bp, mouse
gacgtggccaatgccagctg

SEQ ID NO: 507903 - DNA, 20 bp, mouse
gcgcggggtcagggacccgg

SEQ ID NO: 507904 - DNA, 20 bp, mouse
gtgacatcgaaggggaatca

SEQ ID NO: 507905 - DNA, 20 bp, mouse
gggtcacgctgggctgatct

SEQ ID NO: 507906 - DNA, 20 bp, mouse
ggtagcgcaggtagctgaag

SEQ ID NO: 507907 - DNA, 20 bp, mouse
gggaggggcccgaagcgtga

SEQ ID NO: 507908 - DNA, 20 bp, mouse
gtcccagcctcggcagcaac

SEQ ID NO: 507909 - DNA, 20 bp, mouse
ggaagctgagattcctggag

SEQ ID NO: 507910 - DNA, 20 bp, mouse
gaagctgagaaaacactggt

SEQ ID NO: 507911 - DNA, 20 bp, mouse
ggcctgttgctgccgaggct

SEQ ID NO: 507912 - DNA, 20 bp, mouse
ggcccgaagcgtgagggaaa

SEQ ID NO: 507913 - DNA, 20 bp, mouse
ggcgttgctaagggtagcgc

SEQ ID NO: 507914 - DNA, 20 bp, mouse
gtgcgcatgtgcgttgctaa

SEQ ID NO: 507915 - DNA, 20 bp, mouse
gaagaagcctgttgctgccg

SEQ ID NO: 507916 - DNA, 20 bp, mouse
ggctaggcacagggttccct

SEQ ID NO: 507917 - DNA, 20 bp, mouse
gggtaggcaggatgaactcg

SEQ ID NO: 507918 - DNA, 20 bp, mouse
ggccatcagtcggcacctcg

SEQ ID NO: 507919 - DNA, 20 bp, mouse
gactcgccgttggctaacac

SEQ ID NO: 507920 - DNA, 20 bp, mouse
gctcggggcaagctgcgtca

SEQ ID NO: 507921 - DNA, 20 bp, mouse
gcgcttgcagcggtctctcg

SEQ ID NO: 507922 - DNA, 20 bp, mouse
gcgttgtccgggcaacacgg

SEQ ID NO: 507923 - DNA, 20 bp, mouse
gtgctgagtaccgcttgcag

SEQ ID NO: 507924 - DNA, 20 bp, mouse
gcttgcagcagctaggcaca

SEQ ID NO: 507925 - DNA, 20 bp, mouse
gactcggggagaaaagtatt

SEQ ID NO: 507926 - DNA, 20 bp, mouse
gtggacaacccgccaagcat

SEQ ID NO: 507927 - DNA, 20 bp, mouse
gacaacccgccaagcatcgg

SEQ ID NO: 507928 - DNA, 20 bp, mouse
gcgggttgtccaggtaacca

SEQ ID NO: 507929 - DNA, 20 bp, mouse
ggtcagtgagcatccgagac

SEQ ID NO: 507930 - DNA, 20 bp, mouse
gtagcgccgccgatgcttgg

SEQ ID NO: 507931 - DNA, 20 bp, mouse
gctgaccgagacaactcccg

SEQ ID NO: 507932 - DNA, 20 bp, mouse
ggcgctaaccgctgacgcac

SEQ ID NO: 507933 - DNA, 20 bp, mouse
ggtaaccacgggagttgtct

SEQ ID NO: 507934 - DNA, 20 bp, mouse
ggcatgacgtacaccggtct

SEQ ID NO: 507935 - DNA, 20 bp, mouse
gggttagcgccgccgatgct

SEQ ID NO: 507936 - DNA, 20 bp, mouse
gtgccacggagacaagatct

SEQ ID NO: 507937 - DNA, 20 bp, mouse
gctggtgcttctggactcgg

SEQ ID NO: 507938 - DNA, 20 bp, mouse
gctgcggccctgacgactgt

SEQ ID NO: 507939 - DNA, 20 bp, mouse
ggtcggtagaagcttctctc

SEQ ID NO: 507940 - DNA, 20 bp, mouse
gtggactcgggggtgacgtg

SEQ ID NO: 507941 - DNA, 20 bp, mouse
gccagcaagcaccgcagggt

SEQ ID NO: 507942 - DNA, 20 bp, mouse
gggttcaccggtgacatcga

SEQ ID NO: 507943 - DNA, 20 bp, mouse
gtctctccggcaactgcaac

SEQ ID NO: 507944 - DNA, 20 bp, mouse
gacccggtccagccaatcct

SEQ ID NO: 507945 - DNA, 20 bp, mouse
gctcctagatcttgtctccg

SEQ ID NO: 507946 - DNA, 20 bp, mouse
gcttgggaccagaggactag

SEQ ID NO: 507947 - DNA, 20 bp, mouse
ggcctgcaaaggttccggtg

SEQ ID NO: 507948 - DNA, 20 bp, mouse
gggtactagcggagacgtgg

SEQ ID NO: 507949 - DNA, 20 bp, mouse
ggcgcgactcttgggaccag

SEQ ID NO: 507950 - DNA, 20 bp, mouse
gccgggtctaaggctggact

SEQ ID NO: 507951 - DNA, 20 bp, mouse
gggccccaggcagcctgcaa

SEQ ID NO: 507952 - DNA, 20 bp, mouse
ggacactccccccaccccta

SEQ ID NO: 507953 - DNA, 20 bp, mouse
gcatagtaaccaggtactag

SEQ ID NO: 507954 - DNA, 20 bp, mouse
gggcctgaggccgtgatgga

SEQ ID NO: 507955 - DNA, 20 bp, mouse
gctagggttgggtggacgga

SEQ ID NO: 507956 - DNA, 20 bp, mouse
gccagcatcgctcctcacgg

SEQ ID NO: 507957 - DNA, 20 bp, mouse
ggcatcgctcctcacggagg

SEQ ID NO: 507958 - DNA, 20 bp, mouse
gcccccagcatcgctcctca

SEQ ID NO: 507959 - DNA, 20 bp, mouse
gtggacgatttactggacct

SEQ ID NO: 507960 - DNA, 20 bp, mouse
ggatttactggacctgggcg

SEQ ID NO: 507961 - DNA, 20 bp, mouse
gttcccgggagaaaactcca

SEQ ID NO: 507962 - DNA, 20 bp, mouse
ggcgacgtctctcctcgccc

SEQ ID NO: 507963 - DNA, 20 bp, mouse
ggcggcgatggacgatttac

SEQ ID NO: 507964 - DNA, 20 bp, mouse
ggaagtgacatcagctgccg

SEQ ID NO: 507965 - DNA, 20 bp, mouse
gtagtcccggaagttctgaa

SEQ ID NO: 507966 - DNA, 20 bp, mouse
gcacttagggatccttgaag

SEQ ID NO: 507967 - DNA, 20 bp, mouse
gagagtgagaccccagtcct

SEQ ID NO: 507968 - DNA, 20 bp, mouse
gtcggagagtcaaggatcca

SEQ ID NO: 507969 - DNA, 20 bp, mouse
ggactctccgagaacccggt

SEQ ID NO: 507970 - DNA, 20 bp, mouse
gcaggcggcttgttgcactt

SEQ ID NO: 507971 - DNA, 20 bp, mouse
gagggatccttgaagtggct

SEQ ID NO: 507972 - DNA, 20 bp, mouse
gaagaaccccagccgaggac

SEQ ID NO: 507973 - DNA, 20 bp, mouse
gttggaaagaaccccagccg

SEQ ID NO: 507974 - DNA, 20 bp, mouse
gtcaaaacgggcggaagtag

SEQ ID NO: 507975 - DNA, 20 bp, mouse
gggcttctgccagaggtgga

SEQ ID NO: 507976 - DNA, 20 bp, mouse
gtctggcctcaggtaaggag

SEQ ID NO: 507977 - DNA, 20 bp, mouse
gcgcggccttggatacctgg

SEQ ID NO: 507978 - DNA, 20 bp, mouse
gcggcctctggcctcaggta

SEQ ID NO: 507979 - DNA, 20 bp, mouse
gcctcaggtaaggagaggtc

SEQ ID NO: 507980 - DNA, 20 bp, mouse
ggcgcgcggccttggatacc

SEQ ID NO: 507981 - DNA, 20 bp, mouse
gccaaggccgcgcgccgaga

SEQ ID NO: 507982 - DNA, 20 bp, mouse
gtccagccagaccaacgacc

SEQ ID NO: 507983 - DNA, 20 bp, mouse
ggcccggagccacgccttct

SEQ ID NO: 507984 - DNA, 20 bp, mouse
gggtcggcagaggtaaactg

SEQ ID NO: 507985 - DNA, 20 bp, mouse
gccacgacggaagtcactcg

SEQ ID NO: 507986 - DNA, 20 bp, mouse
ggagtagctcctcctcgtag

SEQ ID NO: 507987 - DNA, 20 bp, mouse
gaagctgctccgctacgagg

SEQ ID NO: 507988 - DNA, 20 bp, mouse
gaaggcacgcacctggacgg

SEQ ID NO: 507989 - DNA, 20 bp, mouse
gcggttgcctggtaacggtg

SEQ ID NO: 507990 - DNA, 20 bp, mouse
ggcagggcagccggtcacca

SEQ ID NO: 507991 - DNA, 20 bp, mouse
gaggctgcagagatcctggc

SEQ ID NO: 507992 - DNA, 20 bp, mouse
gggtaacggtggggactgtg

SEQ ID NO: 507993 - DNA, 20 bp, mouse
gccgttaccaggcaaccgca

SEQ ID NO: 507994 - DNA, 20 bp, mouse
ggtaatggcagggaggactg

SEQ ID NO: 507995 - DNA, 20 bp, mouse
gggcaaggcacgcacctgga

SEQ ID NO: 507996 - DNA, 20 bp, mouse
gtcatgtcgcggggacctag

SEQ ID NO: 507997 - DNA, 20 bp, mouse
gctggtgagcggtgaaacgc

SEQ ID NO: 507998 - DNA, 20 bp, mouse
ggagcggtgaaacgcggggt

SEQ ID NO: 507999 - DNA, 20 bp, mouse
ggttgggccagggaggataa

SEQ ID NO: 508000 - DNA, 20 bp, mouse
gggcgatcagccggctacag

SEQ ID NO: 508001 - DNA, 20 bp, mouse
gcgacatgaacttctttctg

SEQ ID NO: 508002 - DNA, 20 bp, mouse
gaccttgcctggtgcgactg

SEQ ID NO: 508003 - DNA, 20 bp, mouse
gtggctggttctataacttg

SEQ ID NO: 508004 - DNA, 20 bp, mouse
ggcgtagtgtggaacttccc

SEQ ID NO: 508005 - DNA, 20 bp, mouse
gatcagccggctacagggga

SEQ ID NO: 508006 - DNA, 20 bp, mouse
gtcaagttccaggaaagcgg

SEQ ID NO: 508007 - DNA, 20 bp, mouse
gcagcgcttagaaatcacta

SEQ ID NO: 508008 - DNA, 20 bp, mouse
gctatggtgacggaaaggtc

SEQ ID NO: 508009 - DNA, 20 bp, mouse
ggaaaggtcgggaggctatt

SEQ ID NO: 508010 - DNA, 20 bp, mouse
gaatcactatggtgacggaa

SEQ ID NO: 508011 - DNA, 20 bp, mouse
gcccaagatcaacaccctgg

SEQ ID NO: 508012 - DNA, 20 bp, mouse
gggccagcagggctcctagt

SEQ ID NO: 508013 - DNA, 20 bp, mouse
gtggtgacggaaaggtcggg

SEQ ID NO: 508014 - DNA, 20 bp, mouse
gcatcttcttccagccacca

SEQ ID NO: 508015 - DNA, 20 bp, mouse
ggtatcgcgggaacatggca

SEQ ID NO: 508016 - DNA, 20 bp, mouse
gccagtgcctcccgagggtg

SEQ ID NO: 508017 - DNA, 20 bp, mouse
gggcaaccgttgccaaggag

SEQ ID NO: 508018 - DNA, 20 bp, mouse
gccacctccccaccctcggg

SEQ ID NO: 508019 - DNA, 20 bp, mouse
ggcgccccagtgcctcccga

SEQ ID NO: 508020 - DNA, 20 bp, mouse
gaaaccacctccccaccctc

SEQ ID NO: 508021 - DNA, 20 bp, mouse
gcgacgcccggagaccgagg

SEQ ID NO: 508022 - DNA, 20 bp, mouse
ggttcttagagaccgctcct

SEQ ID NO: 508023 - DNA, 20 bp, mouse
gcgcatggcaaccgttgcca

SEQ ID NO: 508024 - DNA, 20 bp, mouse
gagagaccgctccttggcaa

SEQ ID NO: 508025 - DNA, 20 bp, mouse
gcagcacccagggggagccg

SEQ ID NO: 508026 - DNA, 20 bp, mouse
ggagcgggctgaccacgagt

SEQ ID NO: 508027 - DNA, 20 bp, mouse
gagaagcgacgcctgatcct

SEQ ID NO: 508028 - DNA, 20 bp, mouse
ggatcctaggcaggccagag

SEQ ID NO: 508029 - DNA, 20 bp, mouse
gacctcgcgccgaggaggag

SEQ ID NO: 508030 - DNA, 20 bp, mouse
gttggagtcgcgcctggcaa

SEQ ID NO: 508031 - DNA, 20 bp, mouse
ggtcgcgcctggcaacggct

SEQ ID NO: 508032 - DNA, 20 bp, mouse
gctgaccacgagtgggccga

SEQ ID NO: 508033 - DNA, 20 bp, mouse
gacggctgggcgtcccgctc

SEQ ID NO: 508034 - DNA, 20 bp, mouse
gtggtcagcccgctcctcct

SEQ ID NO: 508035 - DNA, 20 bp, mouse
gacgcggcgcggaggcctgt

SEQ ID NO: 508036 - DNA, 20 bp, mouse
gcaaagagctccggaagccg

SEQ ID NO: 508037 - DNA, 20 bp, mouse
gagacgagttactgctgccg

SEQ ID NO: 508038 - DNA, 20 bp, mouse
gggcagtcagccgtacacga

SEQ ID NO: 508039 - DNA, 20 bp, mouse
gctgcttctagggaagaata

SEQ ID NO: 508040 - DNA, 20 bp, mouse
ggggcagagccattgcactt

SEQ ID NO: 508041 - DNA, 20 bp, mouse
gttcagacgctgccatcttg

SEQ ID NO: 508042 - DNA, 20 bp, mouse
gtttctttctttccacaaga

SEQ ID NO: 508043 - DNA, 20 bp, mouse
gagggcaggaaccgcagaga

SEQ ID NO: 508044 - DNA, 20 bp, mouse
gtgtacacgggtgaacaagt

SEQ ID NO: 508045 - DNA, 20 bp, mouse
gtgcttgtttcaaagagctc

SEQ ID NO: 508046 - DNA, 20 bp, mouse
gccaacagctcccggagctt

SEQ ID NO: 508047 - DNA, 20 bp, mouse
gtccgggagctgttggaaac

SEQ ID NO: 508048 - DNA, 20 bp, mouse
gacgccatcttgccagaggg

SEQ ID NO: 508049 - DNA, 20 bp, mouse
gaagatggcgtcgtttatgg

SEQ ID NO: 508050 - DNA, 20 bp, mouse
gtgctcctgggcatcagagg

SEQ ID NO: 508051 - DNA, 20 bp, mouse
gttcagcaggaacgaagatt

SEQ ID NO: 508052 - DNA, 20 bp, mouse
ggatgcagaagccgaagctc

SEQ ID NO: 508053 - DNA, 20 bp, mouse
gggaggaacccggaagtctt

SEQ ID NO: 508054 - DNA, 20 bp, mouse
gatacaacttctggaggagg

SEQ ID NO: 508055 - DNA, 20 bp, mouse
gtgatgctcccggccctgaa

SEQ ID NO: 508056 - DNA, 20 bp, mouse
gtagcggggatcgggtatca

SEQ ID NO: 508057 - DNA, 20 bp, mouse
gcagcggaccgagagaccga

SEQ ID NO: 508058 - DNA, 20 bp, mouse
gcgcggctgacagatcgccg

SEQ ID NO: 508059 - DNA, 20 bp, mouse
ggacgcacggcgctactcag

SEQ ID NO: 508060 - DNA, 20 bp, mouse
gccgcatgccggccttagcg

SEQ ID NO: 508061 - DNA, 20 bp, mouse
ggctgacagatcgccgcggt

SEQ ID NO: 508062 - DNA, 20 bp, mouse
gcgccgcggtgggtgcaaga

SEQ ID NO: 508063 - DNA, 20 bp, mouse
gctcaggacccaggcgagag

SEQ ID NO: 508064 - DNA, 20 bp, mouse
ggccggccttagcggggatc

SEQ ID NO: 508065 - DNA, 20 bp, mouse
ggggtgcaagatggcgcaag

SEQ ID NO: 508066 - DNA, 20 bp, mouse
gcccaggcgcccggacgcgg

SEQ ID NO: 508067 - DNA, 20 bp, mouse
gcggcccaggcgcccggacg

SEQ ID NO: 508068 - DNA, 20 bp, mouse
gctatggcgcgggcggacac

SEQ ID NO: 508069 - DNA, 20 bp, mouse
gcggcccgagcccggcccta

SEQ ID NO: 508070 - DNA, 20 bp, mouse
gggtcagcaccaggagcccg

SEQ ID NO: 508071 - DNA, 20 bp, mouse
gccgcccgcgccatagggcc

SEQ ID NO: 508072 - DNA, 20 bp, mouse
gaaggacacacaccccctgg

SEQ ID NO: 508073 - DNA, 20 bp, mouse
gcgagcccggccctatggcg

SEQ ID NO: 508074 - DNA, 20 bp, mouse
gacgcgcagggggacacgca

SEQ ID NO: 508075 - DNA, 20 bp, mouse
ggcacaagggccacgcgcag

SEQ ID NO: 508076 - DNA, 20 bp, mouse
ggcagatagagcctgcgcaa

SEQ ID NO: 508077 - DNA, 20 bp, mouse
gttggtgggcagggataatg

SEQ ID NO: 508078 - DNA, 20 bp, mouse
gagtctggaaatgaattggt

SEQ ID NO: 508079 - DNA, 20 bp, mouse
ggctgtaaaaggagctccgg

SEQ ID NO: 508080 - DNA, 20 bp, mouse
gagatcttaaataattgagt

SEQ ID NO: 508081 - DNA, 20 bp, mouse
gggactttattccattgcgc

SEQ ID NO: 508082 - DNA, 20 bp, mouse
gtttgcagaggtatctgtac

SEQ ID NO: 508083 - DNA, 20 bp, mouse
ggggatgaatgcatttgcag

SEQ ID NO: 508084 - DNA, 20 bp, mouse
ggttctgtgcgagctgtaaa

SEQ ID NO: 508085 - DNA, 20 bp, mouse
gcgagctgtaaaaggagctc

SEQ ID NO: 508086 - DNA, 20 bp, mouse
gggtcagagtgggtactatg

SEQ ID NO: 508087 - DNA, 20 bp, mouse
gaagggcaatagttgtaagt

SEQ ID NO: 508088 - DNA, 20 bp, mouse
ggtaagtaggtactcactgc

SEQ ID NO: 508089 - DNA, 20 bp, mouse
gatggctggtcaaaatacaa

SEQ ID NO: 508090 - DNA, 20 bp, mouse
gcaggtgcggtcattttggt

SEQ ID NO: 508091 - DNA, 20 bp, mouse
gacctgctgtgtaaacgacc

SEQ ID NO: 508092 - DNA, 20 bp, mouse
gataagaagagggcgaggaa

SEQ ID NO: 508093 - DNA, 20 bp, mouse
gtaggtactcactgcaggtg

SEQ ID NO: 508094 - DNA, 20 bp, mouse
gagtgggtactatgaggccg

SEQ ID NO: 508095 - DNA, 20 bp, mouse
gtttacacagcaggtcagag

SEQ ID NO: 508096 - DNA, 20 bp, mouse
ggcgtagagcccccagtgtg

SEQ ID NO: 508097 - DNA, 20 bp, mouse
gcgccgccgccacacactgg

SEQ ID NO: 508098 - DNA, 20 bp, mouse
gcaccgggcgaactcgagag

SEQ ID NO: 508099 - DNA, 20 bp, mouse
gcgtgcctgcgagagctcca

SEQ ID NO: 508100 - DNA, 20 bp, mouse
gtcgagagaggcgagcgaca

SEQ ID NO: 508101 - DNA, 20 bp, mouse
gagcccccagtgtgtggcgg

SEQ ID NO: 508102 - DNA, 20 bp, mouse
gcgtgccgtggagctctcgc

SEQ ID NO: 508103 - DNA, 20 bp, mouse
gccccggagggaacgaccac

SEQ ID NO: 508104 - DNA, 20 bp, mouse
ggaccctcggccccgctctc

SEQ ID NO: 508105 - DNA, 20 bp, mouse
gctctcgcaggcacggggag

SEQ ID NO: 508106 - DNA, 20 bp, mouse
ggaagcctggatctagtggg

SEQ ID NO: 508107 - DNA, 20 bp, mouse
gagaggctgagggagaacga

SEQ ID NO: 508108 - DNA, 20 bp, mouse
ggccctggttacctgaagtt

SEQ ID NO: 508109 - DNA, 20 bp, mouse
gggttacctgaagttgggta

SEQ ID NO: 508110 - DNA, 20 bp, mouse
ggtagcaggcccggctgcaa

SEQ ID NO: 508111 - DNA, 20 bp, mouse
gtacctgaagttgggtaagg

SEQ ID NO: 508112 - DNA, 20 bp, mouse
ggtaaggaggccgctggggc

SEQ ID NO: 508113 - DNA, 20 bp, mouse
gtgagggagaacgaaggctt

SEQ ID NO: 508114 - DNA, 20 bp, mouse
gtgaccaggaggcaagggac

SEQ ID NO: 508115 - DNA, 20 bp, mouse
gaaggaagcctggatctagt

SEQ ID NO: 508116 - DNA, 20 bp, mouse
ggagttcgcctgctctccgg

SEQ ID NO: 508117 - DNA, 20 bp, mouse
gtctccggcggagctgcgtg

SEQ ID NO: 508118 - DNA, 20 bp, mouse
gggggtgttgaggtagatag

SEQ ID NO: 508119 - DNA, 20 bp, mouse
gccggagttcgcctgctctc

SEQ ID NO: 508120 - DNA, 20 bp, mouse
gggcggagctgcgtgaggcc

SEQ ID NO: 508121 - DNA, 20 bp, mouse
gcctctggcgaagcaggaat

SEQ ID NO: 508122 - DNA, 20 bp, mouse
gcgggcgggcgtgggccagg

SEQ ID NO: 508123 - DNA, 20 bp, mouse
gaagaagcccgggcttacga

SEQ ID NO: 508124 - DNA, 20 bp, mouse
ggtgaggccaggccggcccc

SEQ ID NO: 508125 - DNA, 20 bp, mouse
ggggccgccagcccggatgg

SEQ ID NO: 508126 - DNA, 20 bp, mouse
gtgcccgccgagtgcagggg

SEQ ID NO: 508127 - DNA, 20 bp, mouse
gaagtgcccgccgagtgcag

SEQ ID NO: 508128 - DNA, 20 bp, mouse
ggggtttcggaccgaaggga

SEQ ID NO: 508129 - DNA, 20 bp, mouse
ggcaggggtttcggaccgaa

SEQ ID NO: 508130 - DNA, 20 bp, mouse
gcagcctcccctgcactcgg

SEQ ID NO: 508131 - DNA, 20 bp, mouse
gcggcgcggctccttccctt

SEQ ID NO: 508132 - DNA, 20 bp, mouse
gcggtggcggggcaaggaca

SEQ ID NO: 508133 - DNA, 20 bp, mouse
ggagagcctcctaggccgag

SEQ ID NO: 508134 - DNA, 20 bp, mouse
ggagctccggacaacttcag

SEQ ID NO: 508135 - DNA, 20 bp, mouse
gcgagaggcgtggagacggg

SEQ ID NO: 508136 - DNA, 20 bp, mouse
gtggggccttctattcagta

SEQ ID NO: 508137 - DNA, 20 bp, mouse
gtccagaaggacttcctggg

SEQ ID NO: 508138 - DNA, 20 bp, mouse
gtattcagtatggcaggagc

SEQ ID NO: 508139 - DNA, 20 bp, mouse
gccaccaggtaccagatcca

SEQ ID NO: 508140 - DNA, 20 bp, mouse
gggaagtccttctggataga

SEQ ID NO: 508141 - DNA, 20 bp, mouse
gtcagatgggtgaagaatct

SEQ ID NO: 508142 - DNA, 20 bp, mouse
gaaactaggctcctgttctg

SEQ ID NO: 508143 - DNA, 20 bp, mouse
ggcagattggctggaatgtc

SEQ ID NO: 508144 - DNA, 20 bp, mouse
ggccttctattcagtatggc

SEQ ID NO: 508145 - DNA, 20 bp, mouse
gtccccccaggaagtccttc

SEQ ID NO: 508146 - DNA, 20 bp, mouse
ggcgggctctcgggaagacg

SEQ ID NO: 508147 - DNA, 20 bp, mouse
gagcctggggaccctcggag

SEQ ID NO: 508148 - DNA, 20 bp, mouse
gagctgccggaggtcgtcgg

SEQ ID NO: 508149 - DNA, 20 bp, mouse
ggagcagctgggcactccag

SEQ ID NO: 508150 - DNA, 20 bp, mouse
gccgccgccccggcaccggg

SEQ ID NO: 508151 - DNA, 20 bp, mouse
ggcgcgcctgagagttggag

SEQ ID NO: 508152 - DNA, 20 bp, mouse
gaagagctgccggaggtcgt

SEQ ID NO: 508153 - DNA, 20 bp, mouse
ggcgccatcgagaccctctc

SEQ ID NO: 508154 - DNA, 20 bp, mouse
ggacaggtcctactcaagtc

SEQ ID NO: 508155 - DNA, 20 bp, mouse
ggtccccgaagagctgccgg

SEQ ID NO: 508156 - DNA, 20 bp, mouse
gccgcctcctccccagagtt

SEQ ID NO: 508157 - DNA, 20 bp, mouse
ggggcgaaaaccagatccca

SEQ ID NO: 508158 - DNA, 20 bp, mouse
ggttaggaagactcgacgct

SEQ ID NO: 508159 - DNA, 20 bp, mouse
gagtgacccaagcacgggag

SEQ ID NO: 508160 - DNA, 20 bp, mouse
gacccaagcacgggagcggc

SEQ ID NO: 508161 - DNA, 20 bp, mouse
ggtcgagtcttcctaactct

SEQ ID NO: 508162 - DNA, 20 bp, mouse
gagaagaggaaaaaggaccc

SEQ ID NO: 508163 - DNA, 20 bp, mouse
gggagaggaacaaaatccac

SEQ ID NO: 508164 - DNA, 20 bp, mouse
gggcgggattagcgagagaa

SEQ ID NO: 508165 - DNA, 20 bp, mouse
gcgacgctgggctcgtcgct

SEQ ID NO: 508166 - DNA, 20 bp, mouse
gcacggtcgcgccaccacag

SEQ ID NO: 508167 - DNA, 20 bp, mouse
gtggagccgcgcctgggaca

SEQ ID NO: 508168 - DNA, 20 bp, mouse
gagcggagtcgaagctgcaa

SEQ ID NO: 508169 - DNA, 20 bp, mouse
ggagagagaactggagccag

SEQ ID NO: 508170 - DNA, 20 bp, mouse
gcacagggcgtccaagtcga

SEQ ID NO: 508171 - DNA, 20 bp, mouse
gagcttcgactccgctgtgg

SEQ ID NO: 508172 - DNA, 20 bp, mouse
gtcccaggcgcggctccaaa

SEQ ID NO: 508173 - DNA, 20 bp, mouse
gtcgaagctgcaacgggagc

SEQ ID NO: 508174 - DNA, 20 bp, mouse
gcaggcccaggccgtcgact

SEQ ID NO: 508175 - DNA, 20 bp, mouse
gcgcgaccgtgtcccaggcg

SEQ ID NO: 508176 - DNA, 20 bp, mouse
gtacagagctggccgcaggc

SEQ ID NO: 508177 - DNA, 20 bp, mouse
gccctcagagcaagtggcag

SEQ ID NO: 508178 - DNA, 20 bp, mouse
gcacagtgccgccaccaagg

SEQ ID NO: 508179 - DNA, 20 bp, mouse
gctgcggccagctctgtaca

SEQ ID NO: 508180 - DNA, 20 bp, mouse
gcaagggccgtctacagcac

SEQ ID NO: 508181 - DNA, 20 bp, mouse
gcggtagccagaaggatctc

SEQ ID NO: 508182 - DNA, 20 bp, mouse
ggtgggaaagggccagatga

SEQ ID NO: 508183 - DNA, 20 bp, mouse
ggccaggcccttaagagaaa

SEQ ID NO: 508184 - DNA, 20 bp, mouse
ggaaagtaaccgagaccctc

SEQ ID NO: 508185 - DNA, 20 bp, mouse
gcattgtgggagcacaccaa

SEQ ID NO: 508186 - DNA, 20 bp, mouse
gatggtggtcacagctctct

SEQ ID NO: 508187 - DNA, 20 bp, mouse
gtagatagtagtggcaatgg

SEQ ID NO: 508188 - DNA, 20 bp, mouse
gcaccgcaggcagcacccat

SEQ ID NO: 508189 - DNA, 20 bp, mouse
gacaggcagcagttgctcag

SEQ ID NO: 508190 - DNA, 20 bp, mouse
gtgcaggccgagaaatctcg

SEQ ID NO: 508191 - DNA, 20 bp, mouse
gcagcatggtccactgcccg

SEQ ID NO: 508192 - DNA, 20 bp, mouse
ggagtagatagtagtggcaa

SEQ ID NO: 508193 - DNA, 20 bp, mouse
ggctgggtgtgtgtctccgc

SEQ ID NO: 508194 - DNA, 20 bp, mouse
gcatcggcaaggcacatgtc

SEQ ID NO: 508195 - DNA, 20 bp, mouse
ggagcattgaacactgcaca

SEQ ID NO: 508196 - DNA, 20 bp, mouse
gggtagtgcagcgagctagc

SEQ ID NO: 508197 - DNA, 20 bp, mouse
gacgctcgggcgtgcagggt

SEQ ID NO: 508198 - DNA, 20 bp, mouse
ggcagcagcaagagcaacga

SEQ ID NO: 508199 - DNA, 20 bp, mouse
gcagcgagctagcgggcagg

SEQ ID NO: 508200 - DNA, 20 bp, mouse
ggcgcggggccgcccaatct

SEQ ID NO: 508201 - DNA, 20 bp, mouse
ggcgtctcccgcattcgtct

SEQ ID NO: 508202 - DNA, 20 bp, mouse
ggcacggcccagacgaatgc

SEQ ID NO: 508203 - DNA, 20 bp, mouse
ggtgcagcgagctagcgggc

SEQ ID NO: 508204 - DNA, 20 bp, mouse
gcccaatctcggcagcatgt

SEQ ID NO: 508205 - DNA, 20 bp, mouse
gctgtgacaagcgccttcag

SEQ ID NO: 508206 - DNA, 20 bp, mouse
gcccagatgcgagcttagag

SEQ ID NO: 508207 - DNA, 20 bp, mouse
gtggagcacgcgggatgagg

SEQ ID NO: 508208 - DNA, 20 bp, mouse
gatgaggcggcgggatgagg

SEQ ID NO: 508209 - DNA, 20 bp, mouse
gggtccgcggagcagagtga

SEQ ID NO: 508210 - DNA, 20 bp, mouse
ggagcggcgactgggcgctg

SEQ ID NO: 508211 - DNA, 20 bp, mouse
gcgagcttagagcggcgact

SEQ ID NO: 508212 - DNA, 20 bp, mouse
ggagtggagcacgcgggatg

SEQ ID NO: 508213 - DNA, 20 bp, mouse
ggggatgaggcggcgggatg

SEQ ID NO: 508214 - DNA, 20 bp, mouse
gatgggagcagcgagcaagc

SEQ ID NO: 508215 - DNA, 20 bp, mouse
gacggctcggtggaggggag

SEQ ID NO: 508216 - DNA, 20 bp, mouse
gcctcggccggcccagcagg

SEQ ID NO: 508217 - DNA, 20 bp, mouse
gaggcgctgcgctgcatcct

SEQ ID NO: 508218 - DNA, 20 bp, mouse
gcgggctgcaagggacccgg

SEQ ID NO: 508219 - DNA, 20 bp, mouse
gcatggcgaggacgagggtg

SEQ ID NO: 508220 - DNA, 20 bp, mouse
gggcagcatggcgaggacga

SEQ ID NO: 508221 - DNA, 20 bp, mouse
ggcaggcagagacggagccg

SEQ ID NO: 508222 - DNA, 20 bp, mouse
gcggagggcgcagggacacg

SEQ ID NO: 508223 - DNA, 20 bp, mouse
ggggcggccacgaggccgaa

SEQ ID NO: 508224 - DNA, 20 bp, mouse
ggccgaagggcagcatggcg

SEQ ID NO: 508225 - DNA, 20 bp, mouse
gacgaggccgaagggcagca

SEQ ID NO: 508226 - DNA, 20 bp, mouse
gttgccagggccagaacgca

SEQ ID NO: 508227 - DNA, 20 bp, mouse
gagtctgaggatttcagagg

SEQ ID NO: 508228 - DNA, 20 bp, mouse
gagcctgccggggatcccta

SEQ ID NO: 508229 - DNA, 20 bp, mouse
gttccatggacactgaatgg

SEQ ID NO: 508230 - DNA, 20 bp, mouse
gttgtgagacgtaaaggtag

SEQ ID NO: 508231 - DNA, 20 bp, mouse
gcagccctgcgttctggccc

SEQ ID NO: 508232 - DNA, 20 bp, mouse
gctgcagggccttctggatg

SEQ ID NO: 508233 - DNA, 20 bp, mouse
gttaaggttgtgagacgtaa

SEQ ID NO: 508234 - DNA, 20 bp, mouse
gactcacagatgcagacagt

SEQ ID NO: 508235 - DNA, 20 bp, mouse
ggcaaggagtctggccccaa

SEQ ID NO: 508236 - DNA, 20 bp, mouse
gaacaggtaagaggcgtcgg

SEQ ID NO: 508237 - DNA, 20 bp, mouse
gaagggtgcagaccgagggg

SEQ ID NO: 508238 - DNA, 20 bp, mouse
ggagaagggtgcagaccgag

SEQ ID NO: 508239 - DNA, 20 bp, mouse
gggcggctgacaacaagatc

SEQ ID NO: 508240 - DNA, 20 bp, mouse
gcccaggccttgagccggta

SEQ ID NO: 508241 - DNA, 20 bp, mouse
gctgcgtgaagtccggagaa

SEQ ID NO: 508242 - DNA, 20 bp, mouse
ggcaggagagcgagagtgtg

SEQ ID NO: 508243 - DNA, 20 bp, mouse
ggctggccgctgagaccgag

SEQ ID NO: 508244 - DNA, 20 bp, mouse
gccagagcccgcagtctctt

SEQ ID NO: 508245 - DNA, 20 bp, mouse
gctgccgcagaacaggtaag

SEQ ID NO: 508246 - DNA, 20 bp, mouse
gggcagcccatcccaggtca

SEQ ID NO: 508247 - DNA, 20 bp, mouse
gtctctggaaggagtgtaca

SEQ ID NO: 508248 - DNA, 20 bp, mouse
ggcagctgcactggactctc

SEQ ID NO: 508249 - DNA, 20 bp, mouse
gtgcgtgggcagcccatccc

SEQ ID NO: 508250 - DNA, 20 bp, mouse
gacggctgtacagaagccgg

SEQ ID NO: 508251 - DNA, 20 bp, mouse
gagaagccggaggctgtctc

SEQ ID NO: 508252 - DNA, 20 bp, mouse
gtgcgtggaggaggaagacg

SEQ ID NO: 508253 - DNA, 20 bp, mouse
gcagccggggcaccccgcta

SEQ ID NO: 508254 - DNA, 20 bp, mouse
gcggtcccagaggcttgaag

SEQ ID NO: 508255 - DNA, 20 bp, mouse
gcaaccccgagagaacgaag

SEQ ID NO: 508256 - DNA, 20 bp, mouse
gcggcggccgctccatcata

SEQ ID NO: 508257 - DNA, 20 bp, mouse
gcggccgctccatcataagg

SEQ ID NO: 508258 - DNA, 20 bp, mouse
ggcatccagccaccttatga

SEQ ID NO: 508259 - DNA, 20 bp, mouse
gcagccaccttatgatggag

SEQ ID NO: 508260 - DNA, 20 bp, mouse
gccgcaggcatccgaagagg

SEQ ID NO: 508261 - DNA, 20 bp, mouse
gctcgccgcgagcacacacc

SEQ ID NO: 508262 - DNA, 20 bp, mouse
ggcaggaggccggcacgcac

SEQ ID NO: 508263 - DNA, 20 bp, mouse
ggggccgcaggcatccgaag

SEQ ID NO: 508264 - DNA, 20 bp, mouse
gacggcatcacctaccccag

SEQ ID NO: 508265 - DNA, 20 bp, mouse
gaggcggaagggtaaagccg

SEQ ID NO: 508266 - DNA, 20 bp, mouse
gggagcagcagcggcagacg

SEQ ID NO: 508267 - DNA, 20 bp, mouse
gcgagaccccgggccagtga

SEQ ID NO: 508268 - DNA, 20 bp, mouse
gtggccggctcccagacgga

SEQ ID NO: 508269 - DNA, 20 bp, mouse
gcgagcgctaagaggagcag

SEQ ID NO: 508270 - DNA, 20 bp, mouse
ggcgctgctgccgtccgtct

SEQ ID NO: 508271 - DNA, 20 bp, mouse
gtcgcggagcccgagacccc

SEQ ID NO: 508272 - DNA, 20 bp, mouse
gcgtcgcgcgcggagatcca

SEQ ID NO: 508273 - DNA, 20 bp, mouse
gctcctgctcctgccatcac

SEQ ID NO: 508274 - DNA, 20 bp, mouse
ggcggcagacgcggcatggc

SEQ ID NO: 508275 - DNA, 20 bp, mouse
ggtgtcgtctacccgcgtcg

SEQ ID NO: 508276 - DNA, 20 bp, mouse
ggctgtgtggttgtaagtgg

SEQ ID NO: 508277 - DNA, 20 bp, mouse
gtaggctgtgtggttgtaag

SEQ ID NO: 508278 - DNA, 20 bp, mouse
gtgtttctggataggctgtg

SEQ ID NO: 508279 - DNA, 20 bp, mouse
gatacttggatgccacccaa

SEQ ID NO: 508280 - DNA, 20 bp, mouse
gtctacaccccaaggagaca

SEQ ID NO: 508281 - DNA, 20 bp, mouse
gaaacacccatgtctccttg

SEQ ID NO: 508282 - DNA, 20 bp, mouse
ggctatctaaagaataatga

SEQ ID NO: 508283 - DNA, 20 bp, mouse
gagaattcagggataaatga

SEQ ID NO: 508284 - DNA, 20 bp, mouse
ggacagactgatagaattca

SEQ ID NO: 508285 - DNA, 20 bp, mouse
ggtaagtattctacacccca

SEQ ID NO: 508286 - DNA, 20 bp, mouse
gggtctgcactggtaagtcg

SEQ ID NO: 508287 - DNA, 20 bp, mouse
ggcagacccagaccccaagc

SEQ ID NO: 508288 - DNA, 20 bp, mouse
gccaaccacagtctcagcag

SEQ ID NO: 508289 - DNA, 20 bp, mouse
gacctagaatggataatctg

SEQ ID NO: 508290 - DNA, 20 bp, mouse
gttggggtctgggtctgcac

SEQ ID NO: 508291 - DNA, 20 bp, mouse
gacaggcacctgtccctaaa

SEQ ID NO: 508292 - DNA, 20 bp, mouse
gtggagccagcttggggtct

SEQ ID NO: 508293 - DNA, 20 bp, mouse
gtgagagtttacagtaggtt

SEQ ID NO: 508294 - DNA, 20 bp, mouse
gactggtgagagtttacagt

SEQ ID NO: 508295 - DNA, 20 bp, mouse
gcctctggcctgtcacaaac

SEQ ID NO: 508296 - DNA, 20 bp, mouse
ggcctagtggagctactcca

SEQ ID NO: 508297 - DNA, 20 bp, mouse
gctttctttcctcaggaact

SEQ ID NO: 508298 - DNA, 20 bp, mouse
ggtggaaaccgatctcctga

SEQ ID NO: 508299 - DNA, 20 bp, mouse
gtccactaggccagtttctc

SEQ ID NO: 508300 - DNA, 20 bp, mouse
gagtaatagattaacaggtc

SEQ ID NO: 508301 - DNA, 20 bp, mouse
ggagatcggtttccactcag

SEQ ID NO: 508302 - DNA, 20 bp, mouse
gattaacaggtcaggcagca

SEQ ID NO: 508303 - DNA, 20 bp, mouse
ggatggagtgatagcaaccc

SEQ ID NO: 508304 - DNA, 20 bp, mouse
ggggttagacaacttcttag

SEQ ID NO: 508305 - DNA, 20 bp, mouse
gaggcgagtaatagattaac

SEQ ID NO: 508306 - DNA, 20 bp, mouse
ggcctttacagggcttcaag

SEQ ID NO: 508307 - DNA, 20 bp, mouse
ggcactgcttccatgaccct

SEQ ID NO: 508308 - DNA, 20 bp, mouse
gtcctttaccaggcagccca

SEQ ID NO: 508309 - DNA, 20 bp, mouse
gagggaagtagtcctttacc

SEQ ID NO: 508310 - DNA, 20 bp, mouse
gcttcaaggggtagagctga

SEQ ID NO: 508311 - DNA, 20 bp, mouse
gaataccaggtcacagtcac

SEQ ID NO: 508312 - DNA, 20 bp, mouse
gatcctaggtaagtagggat

SEQ ID NO: 508313 - DNA, 20 bp, mouse
gggactatcctaggtaagta

SEQ ID NO: 508314 - DNA, 20 bp, mouse
gctttctcacagcctctatc

SEQ ID NO: 508315 - DNA, 20 bp, mouse
gatggaagcagtgcctttac

SEQ ID NO: 508316 - DNA, 20 bp, mouse
gaggcatcctagagtcaccg

SEQ ID NO: 508317 - DNA, 20 bp, mouse
ggttgtacctccacacacag

SEQ ID NO: 508318 - DNA, 20 bp, mouse
ggccaaaacaacagccccat

SEQ ID NO: 508319 - DNA, 20 bp, mouse
gtgagctgctgagggtgtag

SEQ ID NO: 508320 - DNA, 20 bp, mouse
gggaggtacaactggctcct

SEQ ID NO: 508321 - DNA, 20 bp, mouse
gcacattgcaggtgatggtc

SEQ ID NO: 508322 - DNA, 20 bp, mouse
ggttttcaagagggagtcag

SEQ ID NO: 508323 - DNA, 20 bp, mouse
gtggctgggccaggtgttcg

SEQ ID NO: 508324 - DNA, 20 bp, mouse
gacctgcaatgtggcccacc

SEQ ID NO: 508325 - DNA, 20 bp, mouse
gggatcatgaccttgagggt

SEQ ID NO: 508326 - DNA, 20 bp, mouse
gtgggccacgaaactctcca

SEQ ID NO: 508327 - DNA, 20 bp, mouse
ggccacgaaactctccacgg

SEQ ID NO: 508328 - DNA, 20 bp, mouse
ggggatcctactgcaatcac

SEQ ID NO: 508329 - DNA, 20 bp, mouse
gaaactcagtagggaacacc

SEQ ID NO: 508330 - DNA, 20 bp, mouse
gtcagtcaggggctgcatcg

SEQ ID NO: 508331 - DNA, 20 bp, mouse
ggggaacgcaggaaacggac

SEQ ID NO: 508332 - DNA, 20 bp, mouse
gtggctccaggcggtaacta

SEQ ID NO: 508333 - DNA, 20 bp, mouse
gctggagcgggacgccgagg

SEQ ID NO: 508334 - DNA, 20 bp, mouse
gactggaactcgggtcccac

SEQ ID NO: 508335 - DNA, 20 bp, mouse
gcctggagccagtctagtgt

SEQ ID NO: 508336 - DNA, 20 bp, mouse
gagtgtgttcagggacactg

SEQ ID NO: 508337 - DNA, 20 bp, mouse
gggctgcatgcactgcatgt

SEQ ID NO: 508338 - DNA, 20 bp, mouse
ggttcagggacactgtggag

SEQ ID NO: 508339 - DNA, 20 bp, mouse
ggcatgcagcctgacctctg

SEQ ID NO: 508340 - DNA, 20 bp, mouse
ggttagtataaccatctcca

SEQ ID NO: 508341 - DNA, 20 bp, mouse
ggagatatttaccctggaga

SEQ ID NO: 508342 - DNA, 20 bp, mouse
gttcaccatggaatggagcg

SEQ ID NO: 508343 - DNA, 20 bp, mouse
gccttcactaactactggat

SEQ ID NO: 508344 - DNA, 20 bp, mouse
gactaactactggataggtt

SEQ ID NO: 508345 - DNA, 20 bp, mouse
gctacaccttcactaactac

SEQ ID NO: 508346 - DNA, 20 bp, mouse
gtcctcaggcgtccactctt

SEQ ID NO: 508347 - DNA, 20 bp, mouse
gacctaagagtggacgcctg

SEQ ID NO: 508348 - DNA, 20 bp, mouse
gcttacctgcagttccagac

SEQ ID NO: 508349 - DNA, 20 bp, mouse
gctgcagctggacctaagag

SEQ ID NO: 508350 - DNA, 20 bp, mouse
gtccactcaaggcccttccc

SEQ ID NO: 508351 - DNA, 20 bp, mouse
gctgggtgaagcagaagcct

SEQ ID NO: 508352 - DNA, 20 bp, mouse
gtgaagcagaagcctgggaa

SEQ ID NO: 508353 - DNA, 20 bp, mouse
gtgaagaagacattgatcat

SEQ ID NO: 508354 - DNA, 20 bp, mouse
gactctgtatttctctcctc

SEQ ID NO: 508355 - DNA, 20 bp, mouse
gtgagtgtgtcagaaatcct

SEQ ID NO: 508356 - DNA, 20 bp, mouse
gtctacaaaagtaaatccag

SEQ ID NO: 508357 - DNA, 20 bp, mouse
gatgtgaacctggaagtgtc

SEQ ID NO: 508358 - DNA, 20 bp, mouse
gacctggaagtgtctggagg

SEQ ID NO: 508359 - DNA, 20 bp, mouse
gtgaacctggaagtgtctgg

SEQ ID NO: 508360 - DNA, 20 bp, mouse
ggaggaggcttagttaaacc

SEQ ID NO: 508361 - DNA, 20 bp, mouse
ggaggcttagttaaacctgg

SEQ ID NO: 508362 - DNA, 20 bp, mouse
ggtccagagtgatgtgaacc

SEQ ID NO: 508363 - DNA, 20 bp, mouse
ggtagatggctggatggact

SEQ ID NO: 508364 - DNA, 20 bp, mouse
gagaactcctgcagcatggt

SEQ ID NO: 508365 - DNA, 20 bp, mouse
gggccatgtaacctagagac

SEQ ID NO: 508366 - DNA, 20 bp, mouse
gtgaaaattgaggagtcagg

SEQ ID NO: 508367 - DNA, 20 bp, mouse
gtgttctgaggtccactagt

SEQ ID NO: 508368 - DNA, 20 bp, mouse
gtacagagaatgggttggag

SEQ ID NO: 508369 - DNA, 20 bp, mouse
gttatgtggagtctgtgaat

SEQ ID NO: 508370 - DNA, 20 bp, mouse
gccaccactctacagagaat

SEQ ID NO: 508371 - DNA, 20 bp, mouse
gcctcagaacacctacaaca

SEQ ID NO: 508372 - DNA, 20 bp, mouse
gattcactttcagtgattac

SEQ ID NO: 508373 - DNA, 20 bp, mouse
gcatccacaaaccttgttgt

SEQ ID NO: 508374 - DNA, 20 bp, mouse
ggctaactgcctcaggttca

SEQ ID NO: 508375 - DNA, 20 bp, mouse
gctcctttccctggtttgca

SEQ ID NO: 508376 - DNA, 20 bp, mouse
ggaagacccacctgcttctc

SEQ ID NO: 508377 - DNA, 20 bp, mouse
gggctgtccttgtaacaggt

SEQ ID NO: 508378 - DNA, 20 bp, mouse
gaggacagccttaacaaaaa

SEQ ID NO: 508379 - DNA, 20 bp, mouse
ggctaccttctaacctcatt

SEQ ID NO: 508380 - DNA, 20 bp, mouse
ggtcctggccatttttgtta

SEQ ID NO: 508381 - DNA, 20 bp, mouse
gatagacacacagttggccg

SEQ ID NO: 508382 - DNA, 20 bp, mouse
gttaaggctgtccttgtaac

SEQ ID NO: 508383 - DNA, 20 bp, mouse
gagccttaacaaaaatggcc

SEQ ID NO: 508384 - DNA, 20 bp, mouse
gtatatatcactgcctaatg

SEQ ID NO: 508385 - DNA, 20 bp, mouse
gccaactgtgtgtctataag

SEQ ID NO: 508386 - DNA, 20 bp, mouse
ggtcaacagaacatcgctgc

SEQ ID NO: 508387 - DNA, 20 bp, mouse
gggaacaccagaatgtcgtt

SEQ ID NO: 508388 - DNA, 20 bp, mouse
ggctgagggcatgtgcatct

SEQ ID NO: 508389 - DNA, 20 bp, mouse
gtggaaattcctatttggaa

SEQ ID NO: 508390 - DNA, 20 bp, mouse
gacattctggtgttccagac

SEQ ID NO: 508391 - DNA, 20 bp, mouse
gaggtttccaaacgacattc

SEQ ID NO: 508392 - DNA, 20 bp, mouse
gacaaaactgtccttgcttg

SEQ ID NO: 508393 - DNA, 20 bp, mouse
gggctgacaggcaggaaaag

SEQ ID NO: 508394 - DNA, 20 bp, mouse
ggatagatgcttgatctcca

SEQ ID NO: 508395 - DNA, 20 bp, mouse
gtgcaggtgccattccaaat

SEQ ID NO: 508396 - DNA, 20 bp, mouse
gcctgtcagttggtgtcaat

SEQ ID NO: 508397 - DNA, 20 bp, mouse
gagtaaaggtacaggaatcg

SEQ ID NO: 508398 - DNA, 20 bp, mouse
gcatagataaactcttaatt

SEQ ID NO: 508399 - DNA, 20 bp, mouse
gaatcttaaattctgagtaa

SEQ ID NO: 508400 - DNA, 20 bp, mouse
gaaattctgagtaaaggtac

SEQ ID NO: 508401 - DNA, 20 bp, mouse
gagcaccaataccctaacac

SEQ ID NO: 508402 - DNA, 20 bp, mouse
gtagtccagtgttagggtat

SEQ ID NO: 508403 - DNA, 20 bp, mouse
gatagtgttcattctatctg

SEQ ID NO: 508404 - DNA, 20 bp, mouse
gaccatatgaatcctaaatg

SEQ ID NO: 508405 - DNA, 20 bp, mouse
gctagtgtttattcagacac

SEQ ID NO: 508406 - DNA, 20 bp, mouse
gatttgtcctctggacagta

SEQ ID NO: 508407 - DNA, 20 bp, mouse
gattactgccagcagtacag

SEQ ID NO: 508408 - DNA, 20 bp, mouse
ggggactccagaaaccaggt

SEQ ID NO: 508409 - DNA, 20 bp, mouse
ggtcataaatccagagtctg

SEQ ID NO: 508410 - DNA, 20 bp, mouse
gtggaaccctctaagtcctt

SEQ ID NO: 508411 - DNA, 20 bp, mouse
gacacatccaacctggtttc

SEQ ID NO: 508412 - DNA, 20 bp, mouse
gtgggtaaccactgtactgc

SEQ ID NO: 508413 - DNA, 20 bp, mouse
gagagtctgggggaggagcc

SEQ ID NO: 508414 - DNA, 20 bp, mouse
gtaaagcagagcaccctgtg

SEQ ID NO: 508415 - DNA, 20 bp, mouse
gcgattgcagtagtccacac

SEQ ID NO: 508416 - DNA, 20 bp, mouse
ggacccttgcaagacaacaa

SEQ ID NO: 508417 - DNA, 20 bp, mouse
gaacaagggctgggcttatt

SEQ ID NO: 508418 - DNA, 20 bp, mouse
gcactgtggctaggagaggt

SEQ ID NO: 508419 - DNA, 20 bp, mouse
gcattgtgttatgttttcgg

SEQ ID NO: 508420 - DNA, 20 bp, mouse
gttgcaagacaacaagggct

SEQ ID NO: 508421 - DNA, 20 bp, mouse
ggttttcggcggtggaacca

SEQ ID NO: 508422 - DNA, 20 bp, mouse
gaggacggtgccattcactt

SEQ ID NO: 508423 - DNA, 20 bp, mouse
gtctggtccaggtcaaaggg

SEQ ID NO: 508424 - DNA, 20 bp, mouse
gtggcaccgtccttgttctc

SEQ ID NO: 508425 - DNA, 20 bp, mouse
gtgtccaagattagatctag

SEQ ID NO: 508426 - DNA, 20 bp, mouse
gaatagcttttggccaccag

SEQ ID NO: 508427 - DNA, 20 bp, mouse
gacttgcagtgtagatctcc

SEQ ID NO: 508428 - DNA, 20 bp, mouse
gtgggccctggagcttcagt

SEQ ID NO: 508429 - DNA, 20 bp, mouse
gagcttttggccaccagagg

SEQ ID NO: 508430 - DNA, 20 bp, mouse
gcctgccgggaagggcccat

SEQ ID NO: 508431 - DNA, 20 bp, mouse
gtgcacagccccctcctctt

SEQ ID NO: 508432 - DNA, 20 bp, mouse
ggactctgggcactatcccc

SEQ ID NO: 508433 - DNA, 20 bp, mouse
gaggattgttcctcctctgg

SEQ ID NO: 508434 - DNA, 20 bp, mouse
gtcagagtaggacagactct

SEQ ID NO: 508435 - DNA, 20 bp, mouse
gtacacagatccacctgcac

SEQ ID NO: 508436 - DNA, 20 bp, mouse
gcagggagaacggccaatca

SEQ ID NO: 508437 - DNA, 20 bp, mouse
gagacctgggcagcagtcct

SEQ ID NO: 508438 - DNA, 20 bp, mouse
ggcggctgcaccggcccggg

SEQ ID NO: 508439 - DNA, 20 bp, mouse
gtgggcagcagtcctaggct

SEQ ID NO: 508440 - DNA, 20 bp, mouse
gctgggggggcgcgacgagg

SEQ ID NO: 508441 - DNA, 20 bp, mouse
gggctcggcggggaaccctg

SEQ ID NO: 508442 - DNA, 20 bp, mouse
gaccctgaggtcctgggaag

SEQ ID NO: 508443 - DNA, 20 bp, mouse
gccccggcgctgcggtacct

SEQ ID NO: 508444 - DNA, 20 bp, mouse
ggcggtacctcggctgatga

SEQ ID NO: 508445 - DNA, 20 bp, mouse
gtggagcagctgaccagacg

SEQ ID NO: 508446 - DNA, 20 bp, mouse
gggcatctggaggagctctc

SEQ ID NO: 508447 - DNA, 20 bp, mouse
gggcagtttgcggcatctgg

SEQ ID NO: 508448 - DNA, 20 bp, mouse
gtagtagaaggctcgctctg

SEQ ID NO: 508449 - DNA, 20 bp, mouse
gagaaggctcgctctgaggt

SEQ ID NO: 508450 - DNA, 20 bp, mouse
gtcccatgcccggcagtttg

SEQ ID NO: 508451 - DNA, 20 bp, mouse
gaggtacttacggtagtaga

SEQ ID NO: 508452 - DNA, 20 bp, mouse
ggccgcaaactgccgggcat

SEQ ID NO: 508453 - DNA, 20 bp, mouse
gagacagctcttcccatgcc

SEQ ID NO: 508454 - DNA, 20 bp, mouse
ggctcggatccggggaaaga

SEQ ID NO: 508455 - DNA, 20 bp, mouse
ggcggggctcggggcccgag

SEQ ID NO: 508456 - DNA, 20 bp, mouse
ggccatgagtatgaagagca

SEQ ID NO: 508457 - DNA, 20 bp, mouse
ggttgttgggaacagctcaa

SEQ ID NO: 508458 - DNA, 20 bp, mouse
gagaggaatgtcccagtctg

SEQ ID NO: 508459 - DNA, 20 bp, mouse
gtgctgtggtgagtacaaag

SEQ ID NO: 508460 - DNA, 20 bp, mouse
gctagagaagcctggttgtt

SEQ ID NO: 508461 - DNA, 20 bp, mouse
ggccatgctcttcatactca

SEQ ID NO: 508462 - DNA, 20 bp, mouse
gtggtctcgctagagaagcc

SEQ ID NO: 508463 - DNA, 20 bp, mouse
ggtggtgagtacaaaggggt

SEQ ID NO: 508464 - DNA, 20 bp, mouse
gctccaggtactgggaaaag

SEQ ID NO: 508465 - DNA, 20 bp, mouse
gttatttcggatctccagag

SEQ ID NO: 508466 - DNA, 20 bp, mouse
gcccgagtgaagacccctag

SEQ ID NO: 508467 - DNA, 20 bp, mouse
gttccattggcccaaggcag

SEQ ID NO: 508468 - DNA, 20 bp, mouse
gtcagggcgagacagagggt

SEQ ID NO: 508469 - DNA, 20 bp, mouse
ggtgcaattccattggccca

SEQ ID NO: 508470 - DNA, 20 bp, mouse
gagcggctgctaatcccctc

SEQ ID NO: 508471 - DNA, 20 bp, mouse
gaatcccctcgggaagtgaa

SEQ ID NO: 508472 - DNA, 20 bp, mouse
gcagagagtctggtagatgt

SEQ ID NO: 508473 - DNA, 20 bp, mouse
gggacaaaagcagcgaccaa

SEQ ID NO: 508474 - DNA, 20 bp, mouse
gggtcccttcacttcccgag

SEQ ID NO: 508475 - DNA, 20 bp, mouse
ggggtcttcactcgggagga

SEQ ID NO: 508476 - DNA, 20 bp, mouse
ggtgggaccaagcgggacac

SEQ ID NO: 508477 - DNA, 20 bp, mouse
ggtgcagcgtgggaccaagc

SEQ ID NO: 508478 - DNA, 20 bp, mouse
gcgtccgccgggctcctggg

SEQ ID NO: 508479 - DNA, 20 bp, mouse
gagcctgccccgagcctcgg

SEQ ID NO: 508480 - DNA, 20 bp, mouse
gaggccactccgctccgccg

SEQ ID NO: 508481 - DNA, 20 bp, mouse
gtcctggagccctctagtaa

SEQ ID NO: 508482 - DNA, 20 bp, mouse
ggcgggacacgggagcgccg

SEQ ID NO: 508483 - DNA, 20 bp, mouse
ggtcatgccggagccgccgg

SEQ ID NO: 508484 - DNA, 20 bp, mouse
gcgggctcggtcccccgagg

SEQ ID NO: 508485 - DNA, 20 bp, mouse
gccgagcctgccccgagcct

SEQ ID NO: 508486 - DNA, 20 bp, mouse
ggccggagtcggatccgtgg

SEQ ID NO: 508487 - DNA, 20 bp, mouse
gggatccgtggcggcagtgg

SEQ ID NO: 508488 - DNA, 20 bp, mouse
ggtcggatccgtggcggcag

SEQ ID NO: 508489 - DNA, 20 bp, mouse
ggcggccggagtcggatccg

SEQ ID NO: 508490 - DNA, 20 bp, mouse
gctgcgataggcggccacgg

SEQ ID NO: 508491 - DNA, 20 bp, mouse
gggcggcgcgggcagagctt

SEQ ID NO: 508492 - DNA, 20 bp, mouse
ggctggttggctgcgatagg

SEQ ID NO: 508493 - DNA, 20 bp, mouse
ggccgccacggatccgactc

SEQ ID NO: 508494 - DNA, 20 bp, mouse
gccggctggttggctgcgat

SEQ ID NO: 508495 - DNA, 20 bp, mouse
gcggccgtggcggtgacgag

SEQ ID NO: 508496 - DNA, 20 bp, mouse
gcagtctgcgccggttatag

SEQ ID NO: 508497 - DNA, 20 bp, mouse
gcgccggttatagaggacgg

SEQ ID NO: 508498 - DNA, 20 bp, mouse
gaattccctgagaggtccaa

SEQ ID NO: 508499 - DNA, 20 bp, mouse
gcggcgcagactgaatgctg

SEQ ID NO: 508500 - DNA, 20 bp, mouse
gtttagcatagagaattcta

SEQ ID NO: 508501 - DNA, 20 bp, mouse
gcagcacccctattagtggt

SEQ ID NO: 508502 - DNA, 20 bp, mouse
gcccctattagtggtgggag

SEQ ID NO: 508503 - DNA, 20 bp, mouse
ggtcccccgtcctctataac

SEQ ID NO: 508504 - DNA, 20 bp, mouse
gtcccctcccaccactaata

SEQ ID NO: 508505 - DNA, 20 bp, mouse
ggctaggtaggcccactccg

SEQ ID NO: 508506 - DNA, 20 bp, mouse
gggcgtgcgggacacaggac

SEQ ID NO: 508507 - DNA, 20 bp, mouse
gggaggaagccgtgcgtctt

SEQ ID NO: 508508 - DNA, 20 bp, mouse
ggcacgcctcccaagacgca

SEQ ID NO: 508509 - DNA, 20 bp, mouse
gccggctccgacggagaaag

SEQ ID NO: 508510 - DNA, 20 bp, mouse
gaggcgagcaagggcgaagg

SEQ ID NO: 508511 - DNA, 20 bp, mouse
gctccccgcgaggcgagcaa

SEQ ID NO: 508512 - DNA, 20 bp, mouse
gaagaaaagggtccgaaaag

SEQ ID NO: 508513 - DNA, 20 bp, mouse
gccccgggcgaggtgagcgc

SEQ ID NO: 508514 - DNA, 20 bp, mouse
ggggccaggccggagctgga

SEQ ID NO: 508515 - DNA, 20 bp, mouse
gtgagacactggcaaagaaa

SEQ ID NO: 508516 - DNA, 20 bp, mouse
ggcgttgcctcccttacctc

SEQ ID NO: 508517 - DNA, 20 bp, mouse
gtacctgcctgaggtaaggg

SEQ ID NO: 508518 - DNA, 20 bp, mouse
ggggaggcaacgccactgtg

SEQ ID NO: 508519 - DNA, 20 bp, mouse
gtcgttcacacagggcttcc

SEQ ID NO: 508520 - DNA, 20 bp, mouse
ggatttacctgcctgaggta

SEQ ID NO: 508521 - DNA, 20 bp, mouse
ggggctctgctggaattcag

SEQ ID NO: 508522 - DNA, 20 bp, mouse
gaagtacccagagagcccgg

SEQ ID NO: 508523 - DNA, 20 bp, mouse
ggccctctcagaatacccag

SEQ ID NO: 508524 - DNA, 20 bp, mouse
gtctgtatctcgttcacaca

SEQ ID NO: 508525 - DNA, 20 bp, mouse
ggcgaacgaacaccccttac

SEQ ID NO: 508526 - DNA, 20 bp, mouse
gaaaggatcaggctgatctc

SEQ ID NO: 508527 - DNA, 20 bp, mouse
ggctgatctctggccggagg

SEQ ID NO: 508528 - DNA, 20 bp, mouse
gggctcctgcgtgcactcac

SEQ ID NO: 508529 - DNA, 20 bp, mouse
gcagcactacagtaagtcgg

SEQ ID NO: 508530 - DNA, 20 bp, mouse
gcaggctgatctctggccgg

SEQ ID NO: 508531 - DNA, 20 bp, mouse
ggggccccgtgagtgcacgc

SEQ ID NO: 508532 - DNA, 20 bp, mouse
gcttcttaccgacttggaaa

SEQ ID NO: 508533 - DNA, 20 bp, mouse
gcagataaggcgagaagcag

SEQ ID NO: 508534 - DNA, 20 bp, mouse
gtcaacaaccaagggccggt

SEQ ID NO: 508535 - DNA, 20 bp, mouse
gctttagtacctaattctgt

SEQ ID NO: 508536 - DNA, 20 bp, mouse
ggggcgcatgcccaggtggg

SEQ ID NO: 508537 - DNA, 20 bp, mouse
gaagcggagcagtgaagcgt

SEQ ID NO: 508538 - DNA, 20 bp, mouse
ggctctgaggagactcctgg

SEQ ID NO: 508539 - DNA, 20 bp, mouse
gccgagcccagagacagtgg

SEQ ID NO: 508540 - DNA, 20 bp, mouse
gcccagcctgaggccagagg

SEQ ID NO: 508541 - DNA, 20 bp, mouse
ggcagcaggagcgaactcag

SEQ ID NO: 508542 - DNA, 20 bp, mouse
ggggcggcgtgggctctggg

SEQ ID NO: 508543 - DNA, 20 bp, mouse
gggacgcggcgaccaccacc

SEQ ID NO: 508544 - DNA, 20 bp, mouse
gcctctgagcgaggaaatgg

SEQ ID NO: 508545 - DNA, 20 bp, mouse
gagaggcggagccaccatca

SEQ ID NO: 508546 - DNA, 20 bp, mouse
gtgctgtgcagagcaggtga

SEQ ID NO: 508547 - DNA, 20 bp, mouse
ggggtccgccccctattgtg

SEQ ID NO: 508548 - DNA, 20 bp, mouse
gtgtacagagctccacgagg

SEQ ID NO: 508549 - DNA, 20 bp, mouse
gacctgggggagaagaacta

SEQ ID NO: 508550 - DNA, 20 bp, mouse
ggggtgccagcggggacaag

SEQ ID NO: 508551 - DNA, 20 bp, mouse
ggtgtcctggagggtagaaa

SEQ ID NO: 508552 - DNA, 20 bp, mouse
gtcgcgtcagagggactact

SEQ ID NO: 508553 - DNA, 20 bp, mouse
ggaggcgctcggggcatcta

SEQ ID NO: 508554 - DNA, 20 bp, mouse
gcagcggcaggagcacttgg

SEQ ID NO: 508555 - DNA, 20 bp, mouse
gtctcgcagccacacaatag

SEQ ID NO: 508556 - DNA, 20 bp, mouse
ggcacctgcactgccaaccg

SEQ ID NO: 508557 - DNA, 20 bp, mouse
gagacgagcggagccaggaa

SEQ ID NO: 508558 - DNA, 20 bp, mouse
gctgcgcgcgccgagacgag

SEQ ID NO: 508559 - DNA, 20 bp, mouse
gtcggcgcgcgcagcctccc

SEQ ID NO: 508560 - DNA, 20 bp, mouse
ggcccggctaggcttcaccg

SEQ ID NO: 508561 - DNA, 20 bp, mouse
gacctggctgcgctctgcct

SEQ ID NO: 508562 - DNA, 20 bp, mouse
gctaagaacgccaagagggt

SEQ ID NO: 508563 - DNA, 20 bp, mouse
gaggctggggaactgcgggt

SEQ ID NO: 508564 - DNA, 20 bp, mouse
gtgcaggtgccgctgcgccg

SEQ ID NO: 508565 - DNA, 20 bp, mouse
ggcgcggtagtactatgatt

SEQ ID NO: 508566 - DNA, 20 bp, mouse
gaagggcgagtagttctcca

SEQ ID NO: 508567 - DNA, 20 bp, mouse
gccccaaggagcagcaatga

SEQ ID NO: 508568 - DNA, 20 bp, mouse
gagttcgctgggtctcaaca

SEQ ID NO: 508569 - DNA, 20 bp, mouse
gccggagcccctcttaatga

SEQ ID NO: 508570 - DNA, 20 bp, mouse
gatggtgccatcattaagag

SEQ ID NO: 508571 - DNA, 20 bp, mouse
gtccaaggaccaagttcgct

SEQ ID NO: 508572 - DNA, 20 bp, mouse
gacccagcgaacttggtcct

SEQ ID NO: 508573 - DNA, 20 bp, mouse
gattaagaggggctccggaa

SEQ ID NO: 508574 - DNA, 20 bp, mouse
gggtaactgggccagattcc

SEQ ID NO: 508575 - DNA, 20 bp, mouse
gggccagattccaggtatag

SEQ ID NO: 508576 - DNA, 20 bp, mouse
gcccggcggtcaggcggctc

SEQ ID NO: 508577 - DNA, 20 bp, mouse
gcgggagctgctgccgtctg

SEQ ID NO: 508578 - DNA, 20 bp, mouse
gtcaggcggctcgggcagag

SEQ ID NO: 508579 - DNA, 20 bp, mouse
ggccgggcagctcagagtcg

SEQ ID NO: 508580 - DNA, 20 bp, mouse
ggcctggtgggctgataggt

SEQ ID NO: 508581 - DNA, 20 bp, mouse
gtcagagtcgaggcgccgag

SEQ ID NO: 508582 - DNA, 20 bp, mouse
ggcccggggtcgagtgagag

SEQ ID NO: 508583 - DNA, 20 bp, mouse
gccccgggctgcgccgcaga

SEQ ID NO: 508584 - DNA, 20 bp, mouse
ggcccggccggcggactgaa

SEQ ID NO: 508585 - DNA, 20 bp, mouse
gtcgccggccgccaataaat

SEQ ID NO: 508586 - DNA, 20 bp, mouse
gatccactcatccccagggt

SEQ ID NO: 508587 - DNA, 20 bp, mouse
gcttaagagaaaacgaatga

SEQ ID NO: 508588 - DNA, 20 bp, mouse
gtagtagaatgcctaccctg

SEQ ID NO: 508589 - DNA, 20 bp, mouse
ggggagatgagctatatgtt

SEQ ID NO: 508590 - DNA, 20 bp, mouse
gtgcctaccctggggatgag

SEQ ID NO: 508591 - DNA, 20 bp, mouse
ggaaactttggtctggaagt

SEQ ID NO: 508592 - DNA, 20 bp, mouse
ggaatagggaaactttggtc

SEQ ID NO: 508593 - DNA, 20 bp, mouse
gtaagatttcataggaatga

SEQ ID NO: 508594 - DNA, 20 bp, mouse
gggggggcccgggcaggccc

SEQ ID NO: 508595 - DNA, 20 bp, mouse
ggaagagcctgtagcagtga

SEQ ID NO: 508596 - DNA, 20 bp, mouse
gtgtccccctaacaagacag

SEQ ID NO: 508597 - DNA, 20 bp, mouse
gcgcgattgcggacgttgag

SEQ ID NO: 508598 - DNA, 20 bp, mouse
gtcgccgctgtcttgttagg

SEQ ID NO: 508599 - DNA, 20 bp, mouse
gttgtcgccgctgtcttgtt

SEQ ID NO: 508600 - DNA, 20 bp, mouse
gtactaaggaagggataggg

SEQ ID NO: 508601 - DNA, 20 bp, mouse
gatgccagaacgagatagta

SEQ ID NO: 508602 - DNA, 20 bp, mouse
gtggtgacgcgaaggaagac

SEQ ID NO: 508603 - DNA, 20 bp, mouse
gggcctctcctaaggaccaa

SEQ ID NO: 508604 - DNA, 20 bp, mouse
ggagccttactatctcgttc

SEQ ID NO: 508605 - DNA, 20 bp, mouse
ggccatggtttactaaggaa

SEQ ID NO: 508606 - DNA, 20 bp, mouse
gcctggcttcaagatcttca

SEQ ID NO: 508607 - DNA, 20 bp, mouse
gagccaggatggctttggag

SEQ ID NO: 508608 - DNA, 20 bp, mouse
ggctctgcagccacgtccca

SEQ ID NO: 508609 - DNA, 20 bp, mouse
gtcttcacttcggacatgtc

SEQ ID NO: 508610 - DNA, 20 bp, mouse
gagcccgagaagcggagtga

SEQ ID NO: 508611 - DNA, 20 bp, mouse
gccacgcgaggcccgaccca

SEQ ID NO: 508612 - DNA, 20 bp, mouse
gaagaagccggggcccaaag

SEQ ID NO: 508613 - DNA, 20 bp, mouse
gttctttcggctcttcactt

SEQ ID NO: 508614 - DNA, 20 bp, mouse
gtattcaagcgagagtgggt

SEQ ID NO: 508615 - DNA, 20 bp, mouse
gtgtctctggcgatgaccct

SEQ ID NO: 508616 - DNA, 20 bp, mouse
gaggaaccgccgatgcacac

SEQ ID NO: 508617 - DNA, 20 bp, mouse
gagaaacacgatccactgaa

SEQ ID NO: 508618 - DNA, 20 bp, mouse
gacgccaggtagcaccagaa

SEQ ID NO: 508619 - DNA, 20 bp, mouse
gccaggtagcaccagaaagg

SEQ ID NO: 508620 - DNA, 20 bp, mouse
gggcgtgtttcgcccttcag

SEQ ID NO: 508621 - DNA, 20 bp, mouse
gcggcgcactgggtttggaa

SEQ ID NO: 508622 - DNA, 20 bp, mouse
gacctacgacgccctcgagg

SEQ ID NO: 508623 - DNA, 20 bp, mouse
gaagaccaggccgcacacag

SEQ ID NO: 508624 - DNA, 20 bp, mouse
ggccgcctcgagggcgtcgt

SEQ ID NO: 508625 - DNA, 20 bp, mouse
gaggcggctccgagccctca

SEQ ID NO: 508626 - DNA, 20 bp, mouse
gccgccagcgacacccgctg

SEQ ID NO: 508627 - DNA, 20 bp, mouse
gtgggactcacctgccccgg

SEQ ID NO: 508628 - DNA, 20 bp, mouse
gaagcaactgggagcagcag

SEQ ID NO: 508629 - DNA, 20 bp, mouse
ggcaggtgagtcccacgcga

SEQ ID NO: 508630 - DNA, 20 bp, mouse
gctgaggacatgaaaactcg

SEQ ID NO: 508631 - DNA, 20 bp, mouse
gagaggcggagcgcacaccc

SEQ ID NO: 508632 - DNA, 20 bp, mouse
gtctagtacccgtgacgtca

SEQ ID NO: 508633 - DNA, 20 bp, mouse
gccggtggcacaatcaggta

SEQ ID NO: 508634 - DNA, 20 bp, mouse
ggctctggcaccaggaaggt

SEQ ID NO: 508635 - DNA, 20 bp, mouse
gtggagctcaagaagcaact

SEQ ID NO: 508636 - DNA, 20 bp, mouse
gtagttaagagcctgggact

SEQ ID NO: 508637 - DNA, 20 bp, mouse
gcagtggggtacccagtccc

SEQ ID NO: 508638 - DNA, 20 bp, mouse
gggcagtgcctagaagatcc

SEQ ID NO: 508639 - DNA, 20 bp, mouse
ggcaactgagataggagatg

SEQ ID NO: 508640 - DNA, 20 bp, mouse
ggcagacttgtggaactggg

SEQ ID NO: 508641 - DNA, 20 bp, mouse
ggaactgggtggcaccccca

SEQ ID NO: 508642 - DNA, 20 bp, mouse
ggggagtgcagaacactacc

SEQ ID NO: 508643 - DNA, 20 bp, mouse
gtgaggggcagggaccatga

SEQ ID NO: 508644 - DNA, 20 bp, mouse
ggaagatcctggtagctatg

SEQ ID NO: 508645 - DNA, 20 bp, mouse
ggcagggcaatgcagacttg

SEQ ID NO: 508646 - DNA, 20 bp, mouse
ggaagggtgaccgcctgact

SEQ ID NO: 508647 - DNA, 20 bp, mouse
gctagaaagtcctagtcagg

SEQ ID NO: 508648 - DNA, 20 bp, mouse
gccgaccgctccgacagaac

SEQ ID NO: 508649 - DNA, 20 bp, mouse
ggagtcggccagaagtgaag

SEQ ID NO: 508650 - DNA, 20 bp, mouse
gctaggagctccggttctgt

SEQ ID NO: 508651 - DNA, 20 bp, mouse
gctcctagaaagtcctagtc

SEQ ID NO: 508652 - DNA, 20 bp, mouse
gagctccggttctgtcggag

SEQ ID NO: 508653 - DNA, 20 bp, mouse
ggatcccgcacttacgacac

SEQ ID NO: 508654 - DNA, 20 bp, mouse
gaaactgggcctaaggtggg

SEQ ID NO: 508655 - DNA, 20 bp, mouse
ggtagcttccgagactccag

SEQ ID NO: 508656 - DNA, 20 bp, mouse
ggtcctacctcacctccctt

SEQ ID NO: 508657 - DNA, 20 bp, mouse
gcaggcagactgtcagttgc

SEQ ID NO: 508658 - DNA, 20 bp, mouse
gaagtcacccaagggaggtg

SEQ ID NO: 508659 - DNA, 20 bp, mouse
gctggcttcaagtcacccaa

SEQ ID NO: 508660 - DNA, 20 bp, mouse
ggtaggactaaggacagtgg

SEQ ID NO: 508661 - DNA, 20 bp, mouse
ggtacttgggcaatatgagg

SEQ ID NO: 508662 - DNA, 20 bp, mouse
ggaagccaacaggaaagaca

SEQ ID NO: 508663 - DNA, 20 bp, mouse
gcagatatctggccagataa

SEQ ID NO: 508664 - DNA, 20 bp, mouse
gttaacatgtgtgggagtag

SEQ ID NO: 508665 - DNA, 20 bp, mouse
ggggaggtgaggtaggacta

SEQ ID NO: 508666 - DNA, 20 bp, mouse
gctccgcagccaacttagca

SEQ ID NO: 508667 - DNA, 20 bp, mouse
gcgcgcccgggccggggaca

SEQ ID NO: 508668 - DNA, 20 bp, mouse
gtgcctgcgcggccgcgccc

SEQ ID NO: 508669 - DNA, 20 bp, mouse
ggcaggagcccccagatccc

SEQ ID NO: 508670 - DNA, 20 bp, mouse
gagagcagccggggatctgg

SEQ ID NO: 508671 - DNA, 20 bp, mouse
ggtgcagaccaggccagttg

SEQ ID NO: 508672 - DNA, 20 bp, mouse
ggcggccgagcgtcccggga

SEQ ID NO: 508673 - DNA, 20 bp, mouse
gttagagtgccctgctaagt

SEQ ID NO: 508674 - DNA, 20 bp, mouse
gactctaacaagtgcctgcg

SEQ ID NO: 508675 - DNA, 20 bp, mouse
gtgccctgctaagttggctg

SEQ ID NO: 508676 - DNA, 20 bp, mouse
gtgcctgacacgccagggag

SEQ ID NO: 508677 - DNA, 20 bp, mouse
gggagtgcctgcgtagagac

SEQ ID NO: 508678 - DNA, 20 bp, mouse
gctccgtgcctgacacgcca

SEQ ID NO: 508679 - DNA, 20 bp, mouse
ggacctctccctggcgtgtc

SEQ ID NO: 508680 - DNA, 20 bp, mouse
ggcgccgtggagcatggtgt

SEQ ID NO: 508681 - DNA, 20 bp, mouse
gaatcctacaccatgctcca

SEQ ID NO: 508682 - DNA, 20 bp, mouse
gtgcagtcctgtctctacgc

SEQ ID NO: 508683 - DNA, 20 bp, mouse
gtcctgtgcgagtgaggaga

SEQ ID NO: 508684 - DNA, 20 bp, mouse
gtactgatgcccaccctagg

SEQ ID NO: 508685 - DNA, 20 bp, mouse
gggaaggggtctatggacag

SEQ ID NO: 508686 - DNA, 20 bp, mouse
gttctaacccctcaaggagg

SEQ ID NO: 508687 - DNA, 20 bp, mouse
gttgtcacctcctccttgag

SEQ ID NO: 508688 - DNA, 20 bp, mouse
gtgaggggttagaagaagct

SEQ ID NO: 508689 - DNA, 20 bp, mouse
gaaggaggaggtgacaatgt

SEQ ID NO: 508690 - DNA, 20 bp, mouse
gtgggagctcccgacagagc

SEQ ID NO: 508691 - DNA, 20 bp, mouse
gtgcagagttgaagccgagg

SEQ ID NO: 508692 - DNA, 20 bp, mouse
ggagttgaagccgaggagga

SEQ ID NO: 508693 - DNA, 20 bp, mouse
gagtctgcgccaacagtgaa

SEQ ID NO: 508694 - DNA, 20 bp, mouse
gtcaccatttccagctctgt

SEQ ID NO: 508695 - DNA, 20 bp, mouse
gaaaccctcagtgaaggaaa

SEQ ID NO: 508696 - DNA, 20 bp, mouse
gccggggcgcgaggttagag

SEQ ID NO: 508697 - DNA, 20 bp, mouse
gcgtcggcgcagatgcaggg

SEQ ID NO: 508698 - DNA, 20 bp, mouse
gctcggagcgtgctttaaag

SEQ ID NO: 508699 - DNA, 20 bp, mouse
gcggcccgcggcgacatgga

SEQ ID NO: 508700 - DNA, 20 bp, mouse
gccagccgcgcgggtcccca

SEQ ID NO: 508701 - DNA, 20 bp, mouse
ggcggctggcgggagattcc

SEQ ID NO: 508702 - DNA, 20 bp, mouse
gcgcgaggttagagcggcgc

SEQ ID NO: 508703 - DNA, 20 bp, mouse
gaaagtgggtgcggaacccg

SEQ ID NO: 508704 - DNA, 20 bp, mouse
gctcaaagcccccagcgcag

SEQ ID NO: 508705 - DNA, 20 bp, mouse
gcgggatcgctcggtcgcgt

SEQ ID NO: 508706 - DNA, 20 bp, mouse
gtcgcaccccagggtctcac

SEQ ID NO: 508707 - DNA, 20 bp, mouse
gcccttgccggtgagaccct

SEQ ID NO: 508708 - DNA, 20 bp, mouse
gcggccgcgttcgcacccca

SEQ ID NO: 508709 - DNA, 20 bp, mouse
gagaccctggggtgcgaacg

SEQ ID NO: 508710 - DNA, 20 bp, mouse
ggcggccgccgccttggaaa

SEQ ID NO: 508711 - DNA, 20 bp, mouse
gtggaaacggcgagggagtg

SEQ ID NO: 508712 - DNA, 20 bp, mouse
gacagaggtagagcagccag

SEQ ID NO: 508713 - DNA, 20 bp, mouse
ggcgtctcggtggcaggcag

SEQ ID NO: 508714 - DNA, 20 bp, mouse
ggcagccgcacggtgagcag

SEQ ID NO: 508715 - DNA, 20 bp, mouse
ggctcccactgtccaagtca

SEQ ID NO: 508716 - DNA, 20 bp, mouse
gggagacacaacaaatatgg

SEQ ID NO: 508717 - DNA, 20 bp, mouse
ggcggcgctacggttactca

SEQ ID NO: 508718 - DNA, 20 bp, mouse
gagccggctagcaatgaacc

SEQ ID NO: 508719 - DNA, 20 bp, mouse
gtcagggcacgttgacggaa

SEQ ID NO: 508720 - DNA, 20 bp, mouse
ggggcacgttgacggaatgg

SEQ ID NO: 508721 - DNA, 20 bp, mouse
ggagtcccgagtcaccacgc

SEQ ID NO: 508722 - DNA, 20 bp, mouse
gcacgcaggaccctccgctg

SEQ ID NO: 508723 - DNA, 20 bp, mouse
gggcgtggggcgggcgggaa

SEQ ID NO: 508724 - DNA, 20 bp, mouse
gcgcagctcggagctcaggg

SEQ ID NO: 508725 - DNA, 20 bp, mouse
gtcgctcgcgagcctccggg

SEQ ID NO: 508726 - DNA, 20 bp, mouse
gaagggggaccaagaacagg

SEQ ID NO: 508727 - DNA, 20 bp, mouse
gcaggtgatggcaggaagaa

SEQ ID NO: 508728 - DNA, 20 bp, mouse
gtaggtgctggaaatagggg

SEQ ID NO: 508729 - DNA, 20 bp, mouse
ggctgcctgctcttactgac

SEQ ID NO: 508730 - DNA, 20 bp, mouse
ggagccttcagtataaaagg

SEQ ID NO: 508731 - DNA, 20 bp, mouse
gctggcatgaggatcagcag

SEQ ID NO: 508732 - DNA, 20 bp, mouse
gtaaaagggggaccaagaac

SEQ ID NO: 508733 - DNA, 20 bp, mouse
gcatgccagtcagtaagagc

SEQ ID NO: 508734 - DNA, 20 bp, mouse
ggctctggccgactgggaag

SEQ ID NO: 508735 - DNA, 20 bp, mouse
gagcatgaggtaagagctgg

SEQ ID NO: 508736 - DNA, 20 bp, mouse
gcaacatcctgggcgcacag

SEQ ID NO: 508737 - DNA, 20 bp, mouse
ggcgtaaaggccggctccag

SEQ ID NO: 508738 - DNA, 20 bp, mouse
ggcacagcggcatcgtccac

SEQ ID NO: 508739 - DNA, 20 bp, mouse
gccgccggccggaggcgtaa

SEQ ID NO: 508740 - DNA, 20 bp, mouse
gcggccggaggcgtaaaggc

SEQ ID NO: 508741 - DNA, 20 bp, mouse
gtcaggacgccgccggccgg

SEQ ID NO: 508742 - DNA, 20 bp, mouse
ggcggcagtcttcagttctc

SEQ ID NO: 508743 - DNA, 20 bp, mouse
ggaggagcctaactaagaag

SEQ ID NO: 508744 - DNA, 20 bp, mouse
ggactgccgctggatccaca

SEQ ID NO: 508745 - DNA, 20 bp, mouse
gaggggcacgatcagaccca

SEQ ID NO: 508746 - DNA, 20 bp, mouse
gcggcgcccagcaccaggaa

SEQ ID NO: 508747 - DNA, 20 bp, mouse
gcccaggacatggccccgtg

SEQ ID NO: 508748 - DNA, 20 bp, mouse
gacgctcggcgcccaggaca

SEQ ID NO: 508749 - DNA, 20 bp, mouse
gccacccaggatctagccag

SEQ ID NO: 508750 - DNA, 20 bp, mouse
gtccccgaaagggacctgtg

SEQ ID NO: 508751 - DNA, 20 bp, mouse
gggcaggcttgggaactcgg

SEQ ID NO: 508752 - DNA, 20 bp, mouse
gcccggcggaggttccggaa

SEQ ID NO: 508753 - DNA, 20 bp, mouse
gacagctgcgggctcgggaa

SEQ ID NO: 508754 - DNA, 20 bp, mouse
ggccccgtgcggcagccccg

SEQ ID NO: 508755 - DNA, 20 bp, mouse
ggctcgggaagggtccaccc

SEQ ID NO: 508756 - DNA, 20 bp, mouse
gccgctgccgggggacccag

SEQ ID NO: 508757 - DNA, 20 bp, mouse
gcccggcagcggacagggaa

SEQ ID NO: 508758 - DNA, 20 bp, mouse
gacctcccctccccaggccg

SEQ ID NO: 508759 - DNA, 20 bp, mouse
ggaggatgcgaagcagagta

SEQ ID NO: 508760 - DNA, 20 bp, mouse
ggaggcccagctgaccccct

SEQ ID NO: 508761 - DNA, 20 bp, mouse
gcgaagcagagtagggacag

SEQ ID NO: 508762 - DNA, 20 bp, mouse
gctgggcctcggcctgggga

SEQ ID NO: 508763 - DNA, 20 bp, mouse
gggtcagctgggcctcggcc

SEQ ID NO: 508764 - DNA, 20 bp, mouse
gggtcccccggcagcggaca

SEQ ID NO: 508765 - DNA, 20 bp, mouse
gacaggccaggggttcccca

SEQ ID NO: 508766 - DNA, 20 bp, mouse
gtcagcactggagggagcag

SEQ ID NO: 508767 - DNA, 20 bp, mouse
gtagggcctctcaccttctg

SEQ ID NO: 508768 - DNA, 20 bp, mouse
gcaacacccgggtcccagta

SEQ ID NO: 508769 - DNA, 20 bp, mouse
ggacttgggagtcaacaccc

SEQ ID NO: 508770 - DNA, 20 bp, mouse
gccgccctcaccctctgccc

SEQ ID NO: 508771 - DNA, 20 bp, mouse
gcccaagtcctgccaagagg

SEQ ID NO: 508772 - DNA, 20 bp, mouse
gagggctgtgaccacaccgg

SEQ ID NO: 508773 - DNA, 20 bp, mouse
ggggtggtgtgtgatctgaa

SEQ ID NO: 508774 - DNA, 20 bp, mouse
gagaggccctactgggaccc

SEQ ID NO: 508775 - DNA, 20 bp, mouse
ggttttgggaagcttctgta

SEQ ID NO: 508776 - DNA, 20 bp, mouse
gggggaggaggaagacacca

SEQ ID NO: 508777 - DNA, 20 bp, mouse
gagctgctcagggctgacca

SEQ ID NO: 508778 - DNA, 20 bp, mouse
gtggaggaccccaagcttgg

SEQ ID NO: 508779 - DNA, 20 bp, mouse
ggccacggccaccaggaccc

SEQ ID NO: 508780 - DNA, 20 bp, mouse
gttacacttgggagccagag

SEQ ID NO: 508781 - DNA, 20 bp, mouse
gcggggcagcacagcatcac

SEQ ID NO: 508782 - DNA, 20 bp, mouse
gtgctcatctgtggagaaag

SEQ ID NO: 508783 - DNA, 20 bp, mouse
gatctgggcagggtcaggaa

SEQ ID NO: 508784 - DNA, 20 bp, mouse
gcatactggacccctataaa

SEQ ID NO: 508785 - DNA, 20 bp, mouse
ggggtccagtatggacaacc

SEQ ID NO: 508786 - DNA, 20 bp, mouse
gtagccggcaggactttccc

SEQ ID NO: 508787 - DNA, 20 bp, mouse
gtacctgagggccgggacca

SEQ ID NO: 508788 - DNA, 20 bp, mouse
ggaagccctggacccattaa

SEQ ID NO: 508789 - DNA, 20 bp, mouse
gagtcctgggaaagtcctgc

SEQ ID NO: 508790 - DNA, 20 bp, mouse
gcccattaagggagactaaa

SEQ ID NO: 508791 - DNA, 20 bp, mouse
gctgttggaacgctgacctt

SEQ ID NO: 508792 - DNA, 20 bp, mouse
gggcatagccgtagccccca

SEQ ID NO: 508793 - DNA, 20 bp, mouse
gaaagcgccaccagccttgg

SEQ ID NO: 508794 - DNA, 20 bp, mouse
gttataattgtctggatagc

SEQ ID NO: 508795 - DNA, 20 bp, mouse
ggtctcccttaatgggtcca

SEQ ID NO: 508796 - DNA, 20 bp, mouse
gggagttagcgacagggaag

SEQ ID NO: 508797 - DNA, 20 bp, mouse
gatgcagggagttagcgaca

SEQ ID NO: 508798 - DNA, 20 bp, mouse
gggcagctcgcagcaaagca

SEQ ID NO: 508799 - DNA, 20 bp, mouse
gccaggggctttgacgacag

SEQ ID NO: 508800 - DNA, 20 bp, mouse
gtggacagcctctagatgca

SEQ ID NO: 508801 - DNA, 20 bp, mouse
gtccccgctggtggaaacca

SEQ ID NO: 508802 - DNA, 20 bp, mouse
gcccacgctgcctggttcag

SEQ ID NO: 508803 - DNA, 20 bp, mouse
ggtcccctggagtctgaatc

SEQ ID NO: 508804 - DNA, 20 bp, mouse
gaccaggcagcgtgggagtg

SEQ ID NO: 508805 - DNA, 20 bp, mouse
ggtccagattcagactccag

SEQ ID NO: 508806 - DNA, 20 bp, mouse
gtttctgagcgtggacaagg

SEQ ID NO: 508807 - DNA, 20 bp, mouse
gcactctcctgggtagggag

SEQ ID NO: 508808 - DNA, 20 bp, mouse
gaacttctgcagggctgaag

SEQ ID NO: 508809 - DNA, 20 bp, mouse
ggagcgtggacaaggcggct

SEQ ID NO: 508810 - DNA, 20 bp, mouse
gcagggacccctccctaccc

SEQ ID NO: 508811 - DNA, 20 bp, mouse
ggtgtttctgagcgtggaca

SEQ ID NO: 508812 - DNA, 20 bp, mouse
gcagccctgcagaagttcct

SEQ ID NO: 508813 - DNA, 20 bp, mouse
gttcctggggcctcacgact

SEQ ID NO: 508814 - DNA, 20 bp, mouse
gctcagaaaccaccaggcca

SEQ ID NO: 508815 - DNA, 20 bp, mouse
gagccgagtcgtgaggcccc

SEQ ID NO: 508816 - DNA, 20 bp, mouse
ggccatcgctggagtccacg

SEQ ID NO: 508817 - DNA, 20 bp, mouse
ggccgcgtggactccagcga

SEQ ID NO: 508818 - DNA, 20 bp, mouse
gaggacgcagagagggatcc

SEQ ID NO: 508819 - DNA, 20 bp, mouse
gacgcggcagtgtggacctc

SEQ ID NO: 508820 - DNA, 20 bp, mouse
gtggagtccacgcggcagtg

SEQ ID NO: 508821 - DNA, 20 bp, mouse
ggccactagccgcagaggga

SEQ ID NO: 508822 - DNA, 20 bp, mouse
ggtcatggccactgcaccgg

SEQ ID NO: 508823 - DNA, 20 bp, mouse
gcctagcgcagcgccatcgc

SEQ ID NO: 508824 - DNA, 20 bp, mouse
gaacccggtaaggagaaccg

SEQ ID NO: 508825 - DNA, 20 bp, mouse
ggtcagtgcccacgggtgaa

SEQ ID NO: 508826 - DNA, 20 bp, mouse
gagctccctggttctctcac

SEQ ID NO: 508827 - DNA, 20 bp, mouse
gtggggcggcgagaccacca

SEQ ID NO: 508828 - DNA, 20 bp, mouse
ggagctgtagaactgtgggc

SEQ ID NO: 508829 - DNA, 20 bp, mouse
gctctgggtgactgcagtcc

SEQ ID NO: 508830 - DNA, 20 bp, mouse
gccacagttctacagctccc

SEQ ID NO: 508831 - DNA, 20 bp, mouse
gaccaaggcaagcaagagcc

SEQ ID NO: 508832 - DNA, 20 bp, mouse
gcccggaagaggtcatgagc

SEQ ID NO: 508833 - DNA, 20 bp, mouse
ggagggagagacacagatct

SEQ ID NO: 508834 - DNA, 20 bp, mouse
gaagctgcttcaacaggcta

SEQ ID NO: 508835 - DNA, 20 bp, mouse
ggggagggtgcaacagtgta

SEQ ID NO: 508836 - DNA, 20 bp, mouse
ggaagtgggagcaagaacag

SEQ ID NO: 508837 - DNA, 20 bp, mouse
ggaggaggcggagactgccg

SEQ ID NO: 508838 - DNA, 20 bp, mouse
ggccatgcagcccctcgcct

SEQ ID NO: 508839 - DNA, 20 bp, mouse
gcgtggcccggctggagccg

SEQ ID NO: 508840 - DNA, 20 bp, mouse
gcgcgcggcggccgggaagt

SEQ ID NO: 508841 - DNA, 20 bp, mouse
ggtggtgtgtgagaaggacg

SEQ ID NO: 508842 - DNA, 20 bp, mouse
gcagggtgcgcgcactgagg

SEQ ID NO: 508843 - DNA, 20 bp, mouse
ggagccggcgcagacgggaa

SEQ ID NO: 508844 - DNA, 20 bp, mouse
ggggccacgctccgaggcga

SEQ ID NO: 508845 - DNA, 20 bp, mouse
gagtgcgcgcaccctgacca

SEQ ID NO: 508846 - DNA, 20 bp, mouse
ggagagaggtcactgttcag

SEQ ID NO: 508847 - DNA, 20 bp, mouse
gcaaagcactgtcttgagag

SEQ ID NO: 508848 - DNA, 20 bp, mouse
ggctttgctcttcacgtata

SEQ ID NO: 508849 - DNA, 20 bp, mouse
gagcagtccactaaaaatta

SEQ ID NO: 508850 - DNA, 20 bp, mouse
gtggctttacatttttgata

SEQ ID NO: 508851 - DNA, 20 bp, mouse
gttcaatgtagatattgcca

SEQ ID NO: 508852 - DNA, 20 bp, mouse
gatttagatggcttctgata

SEQ ID NO: 508853 - DNA, 20 bp, mouse
ggtagctttgataagacttt

SEQ ID NO: 508854 - DNA, 20 bp, mouse
gatctgcatttgagattcca

SEQ ID NO: 508855 - DNA, 20 bp, mouse
ggtaaagccataatttttag

SEQ ID NO: 508856 - DNA, 20 bp, mouse
gggcagtggcagaatcatgt

SEQ ID NO: 508857 - DNA, 20 bp, mouse
ggccttgcagggaggcagtt

SEQ ID NO: 508858 - DNA, 20 bp, mouse
gccagggcgcagaacctgaa

SEQ ID NO: 508859 - DNA, 20 bp, mouse
gggagttggcctgagttcac

SEQ ID NO: 508860 - DNA, 20 bp, mouse
gcagccagcgggagcaatca

SEQ ID NO: 508861 - DNA, 20 bp, mouse
gtagaagcccggaggagatc

SEQ ID NO: 508862 - DNA, 20 bp, mouse
gctctgtccagatctcctcc

SEQ ID NO: 508863 - DNA, 20 bp, mouse
gtacagcaactggccttgca

SEQ ID NO: 508864 - DNA, 20 bp, mouse
ggatgaagaagagaactctg

SEQ ID NO: 508865 - DNA, 20 bp, mouse
gggacagagactgtaccggg

SEQ ID NO: 508866 - DNA, 20 bp, mouse
gaagctcagggctacttaga

SEQ ID NO: 508867 - DNA, 20 bp, mouse
ggacaggagcagcccaactg

SEQ ID NO: 508868 - DNA, 20 bp, mouse
gagcacggacagtcaagctc

SEQ ID NO: 508869 - DNA, 20 bp, mouse
gcaaggctgaagtcaggtgt

SEQ ID NO: 508870 - DNA, 20 bp, mouse
gtgacgccccctccccagtt

SEQ ID NO: 508871 - DNA, 20 bp, mouse
gggagatcgccggcttctac

SEQ ID NO: 508872 - DNA, 20 bp, mouse
gtagcccccggattgcagag

SEQ ID NO: 508873 - DNA, 20 bp, mouse
gacgcaaggctggggtccct

SEQ ID NO: 508874 - DNA, 20 bp, mouse
ggcacctctctgcaatccgg

SEQ ID NO: 508875 - DNA, 20 bp, mouse
gcgggagccagtctagagca

SEQ ID NO: 508876 - DNA, 20 bp, mouse
gcaggaccccacgccctgat

SEQ ID NO: 508877 - DNA, 20 bp, mouse
ggggctgtaccagcagggtc

SEQ ID NO: 508878 - DNA, 20 bp, mouse
ggatcgtttcctgtagatgg

SEQ ID NO: 508879 - DNA, 20 bp, mouse
gtccccatttagtccaatca

SEQ ID NO: 508880 - DNA, 20 bp, mouse
gataaggacaagaccaggtg

SEQ ID NO: 508881 - DNA, 20 bp, mouse
gcggcaataaggacaagacc

SEQ ID NO: 508882 - DNA, 20 bp, mouse
gcttctctctgcaattgcag

SEQ ID NO: 508883 - DNA, 20 bp, mouse
gagactcagcctccatctac

SEQ ID NO: 508884 - DNA, 20 bp, mouse
gcacagtaatctgcactacc

SEQ ID NO: 508885 - DNA, 20 bp, mouse
gttagtccaatcagggcgtg

SEQ ID NO: 508886 - DNA, 20 bp, mouse
gacgcgcaaacatgagtcca

SEQ ID NO: 508887 - DNA, 20 bp, mouse
gtcttcatccacctcacacg

SEQ ID NO: 508888 - DNA, 20 bp, mouse
gacttgtgcctcgtgtgagg

SEQ ID NO: 508889 - DNA, 20 bp, mouse
ggtcctgatcagctggtgct

SEQ ID NO: 508890 - DNA, 20 bp, mouse
ggaactggaaatgaaacctt

SEQ ID NO: 508891 - DNA, 20 bp, mouse
gagtcctgcactaatgtaca

SEQ ID NO: 508892 - DNA, 20 bp, mouse
gagatacggttaaaactgaa

SEQ ID NO: 508893 - DNA, 20 bp, mouse
gtgatttcgacatctaccaa

SEQ ID NO: 508894 - DNA, 20 bp, mouse
ggcgccttgtacattagtgc

SEQ ID NO: 508895 - DNA, 20 bp, mouse
gagcattttcaagaactgat

SEQ ID NO: 508896 - DNA, 20 bp, mouse
ggcctgccgcctgacttggt

SEQ ID NO: 508897 - DNA, 20 bp, mouse
gcagtccatcccaccaagtc

SEQ ID NO: 508898 - DNA, 20 bp, mouse
gggcatctggggttcctggc

SEQ ID NO: 508899 - DNA, 20 bp, mouse
gtaggggagcaccacgtacc

SEQ ID NO: 508900 - DNA, 20 bp, mouse
gacacttacagagaaggtgg

SEQ ID NO: 508901 - DNA, 20 bp, mouse
gggacagagtcaggcactag

SEQ ID NO: 508902 - DNA, 20 bp, mouse
ggtccagccttgggccatga

SEQ ID NO: 508903 - DNA, 20 bp, mouse
gctacggcatctggggttcc

SEQ ID NO: 508904 - DNA, 20 bp, mouse
gcccaaggctggacacagtc

SEQ ID NO: 508905 - DNA, 20 bp, mouse
gtcccaccaagtcaggcggc

SEQ ID NO: 508906 - DNA, 20 bp, mouse
gaggctcaccatcacagtga

SEQ ID NO: 508907 - DNA, 20 bp, mouse
gaccatcacagtgacggtga

SEQ ID NO: 508908 - DNA, 20 bp, mouse
gcacggagcagcctcacacc

SEQ ID NO: 508909 - DNA, 20 bp, mouse
gatcacagtgacggtgacgg

SEQ ID NO: 508910 - DNA, 20 bp, mouse
gacggtcccagtgctgtaac

SEQ ID NO: 508911 - DNA, 20 bp, mouse
ggcagcctcacacctggcga

SEQ ID NO: 508912 - DNA, 20 bp, mouse
gcagcactgggaccgtcgcc

SEQ ID NO: 508913 - DNA, 20 bp, mouse
ggtagcaccgcagggtccta

SEQ ID NO: 508914 - DNA, 20 bp, mouse
ggcaaggcaggtgcatggtt

SEQ ID NO: 508915 - DNA, 20 bp, mouse
gccgaagccataggaccctg

SEQ ID NO: 508916 - DNA, 20 bp, mouse
gtcttctgcgaagtaaataa

SEQ ID NO: 508917 - DNA, 20 bp, mouse
gcgccagtccacttctgtag

SEQ ID NO: 508918 - DNA, 20 bp, mouse
gtaagggcgccgcacacgcg

SEQ ID NO: 508919 - DNA, 20 bp, mouse
ggcccggagaggcgtctcac

SEQ ID NO: 508920 - DNA, 20 bp, mouse
gcgcccctacagaagtggac

SEQ ID NO: 508921 - DNA, 20 bp, mouse
gtccagacttgttaggaggg

SEQ ID NO: 508922 - DNA, 20 bp, mouse
ggcctcgccggtacccccga

SEQ ID NO: 508923 - DNA, 20 bp, mouse
gcactggtgagcgccctcgg

SEQ ID NO: 508924 - DNA, 20 bp, mouse
gtcctcctcctccagccagg

SEQ ID NO: 508925 - DNA, 20 bp, mouse
gacgcggggcgtgtggcctg

SEQ ID NO: 508926 - DNA, 20 bp, mouse
gttcatgctggtttctccaa

SEQ ID NO: 508927 - DNA, 20 bp, mouse
gaatggctgcttcttccctc

SEQ ID NO: 508928 - DNA, 20 bp, mouse
gtagaagaaagtacttcctg

SEQ ID NO: 508929 - DNA, 20 bp, mouse
gagtggtgttgaataatcat

SEQ ID NO: 508930 - DNA, 20 bp, mouse
gtattcaacaccactcacca

SEQ ID NO: 508931 - DNA, 20 bp, mouse
gactgctgtttgacataccc

SEQ ID NO: 508932 - DNA, 20 bp, mouse
gtgcacccgtgaaacagcca

SEQ ID NO: 508933 - DNA, 20 bp, mouse
gactcaccatggctgtttca

SEQ ID NO: 508934 - DNA, 20 bp, mouse
gataatcataggctaaggat

SEQ ID NO: 508935 - DNA, 20 bp, mouse
gtcaatggaacagttagaat

SEQ ID NO: 508936 - DNA, 20 bp, mouse
gcgacagcgagggcccgcga

SEQ ID NO: 508937 - DNA, 20 bp, mouse
ggccgacgagcgccagtcct

SEQ ID NO: 508938 - DNA, 20 bp, mouse
gggagccggaagcgggacag

SEQ ID NO: 508939 - DNA, 20 bp, mouse
gtggctccgcgcgacagcga

SEQ ID NO: 508940 - DNA, 20 bp, mouse
ggaccggagccgggaagtcg

SEQ ID NO: 508941 - DNA, 20 bp, mouse
gtcggccgggaaagccatcg

SEQ ID NO: 508942 - DNA, 20 bp, mouse
gcgagcgccagtcctcggcc

SEQ ID NO: 508943 - DNA, 20 bp, mouse
gggctttcccggccgaggac

SEQ ID NO: 508944 - DNA, 20 bp, mouse
gggaggtgagagaagccggg

SEQ ID NO: 508945 - DNA, 20 bp, mouse
ggagtgcggagggctgtcaa

SEQ ID NO: 508946 - DNA, 20 bp, mouse
gagctccgcgtggtggtggg

SEQ ID NO: 508947 - DNA, 20 bp, mouse
gcccagctccgcgtggtggt

SEQ ID NO: 508948 - DNA, 20 bp, mouse
gcccatcgcggttagctcag

SEQ ID NO: 508949 - DNA, 20 bp, mouse
gaccgaaagggtgcccacaa

SEQ ID NO: 508950 - DNA, 20 bp, mouse
gggatgcttaccggctctcg

SEQ ID NO: 508951 - DNA, 20 bp, mouse
gttgctagtgttgctgatct

SEQ ID NO: 508952 - DNA, 20 bp, mouse
gatcagcaacactagcaaca

SEQ ID NO: 508953 - DNA, 20 bp, mouse
gctctggccccagctccgcg

SEQ ID NO: 508954 - DNA, 20 bp, mouse
ggtctgttgacccaagaggt

SEQ ID NO: 508955 - DNA, 20 bp, mouse
gagcaacatggcccggccac

SEQ ID NO: 508956 - DNA, 20 bp, mouse
gtgtccctgggagagagcaa

SEQ ID NO: 508957 - DNA, 20 bp, mouse
gtggggaagcatggctggag

SEQ ID NO: 508958 - DNA, 20 bp, mouse
ggcaccagacagaccagaca

SEQ ID NO: 508959 - DNA, 20 bp, mouse
ggtcctgcccccccaagggg

SEQ ID NO: 508960 - DNA, 20 bp, mouse
gcaatcagccccgtgtccct

SEQ ID NO: 508961 - DNA, 20 bp, mouse
gaagcactccagctgaaact

SEQ ID NO: 508962 - DNA, 20 bp, mouse
ggcactgggccgaaaccctg

SEQ ID NO: 508963 - DNA, 20 bp, mouse
ggacagggcagttctgatag

SEQ ID NO: 508964 - DNA, 20 bp, mouse
gccagactcgggctgtgatg

SEQ ID NO: 508965 - DNA, 20 bp, mouse
gagtgacaggagccagactc

SEQ ID NO: 508966 - DNA, 20 bp, mouse
gagcggagaccggcccaact

SEQ ID NO: 508967 - DNA, 20 bp, mouse
gggactagagagcgagctac

SEQ ID NO: 508968 - DNA, 20 bp, mouse
ggccgtacgctcgcccagtt

SEQ ID NO: 508969 - DNA, 20 bp, mouse
gcacctgtggctggagggta

SEQ ID NO: 508970 - DNA, 20 bp, mouse
ggcagcaacctagcggagac

SEQ ID NO: 508971 - DNA, 20 bp, mouse
gctaccgccgccgcccactc

SEQ ID NO: 508972 - DNA, 20 bp, mouse
gtcgctctctagtcccgagt

SEQ ID NO: 508973 - DNA, 20 bp, mouse
ggatccagacgcaggatgag

SEQ ID NO: 508974 - DNA, 20 bp, mouse
gtacgctcgcccagttgggc

SEQ ID NO: 508975 - DNA, 20 bp, mouse
gcgggttccaggttacctgg

SEQ ID NO: 508976 - DNA, 20 bp, mouse
gtgtctgcaagagggcagca

SEQ ID NO: 508977 - DNA, 20 bp, mouse
gtcggggcagggtggatcta

SEQ ID NO: 508978 - DNA, 20 bp, mouse
gctcatggggagccccagac

SEQ ID NO: 508979 - DNA, 20 bp, mouse
ggtggatctagggcagggtt

SEQ ID NO: 508980 - DNA, 20 bp, mouse
gggtccaactccgcaggcag

SEQ ID NO: 508981 - DNA, 20 bp, mouse
gtgtctcctggcctaccgtg

SEQ ID NO: 508982 - DNA, 20 bp, mouse
ggcagggtggatctagggca

SEQ ID NO: 508983 - DNA, 20 bp, mouse
ggcagcaggaccttaccaca

SEQ ID NO: 508984 - DNA, 20 bp, mouse
gccacatagaggacacactg

SEQ ID NO: 508985 - DNA, 20 bp, mouse
gggagcaaggctgccagtct

SEQ ID NO: 508986 - DNA, 20 bp, mouse
gtgcaggcagcacaccacag

SEQ ID NO: 508987 - DNA, 20 bp, mouse
gtgccacaggaagaaccctg

SEQ ID NO: 508988 - DNA, 20 bp, mouse
gggggcctgaggattatagc

SEQ ID NO: 508989 - DNA, 20 bp, mouse
ggaagcctgctataatcctc

SEQ ID NO: 508990 - DNA, 20 bp, mouse
gagttggactgctgcgcccg

SEQ ID NO: 508991 - DNA, 20 bp, mouse
gccaactgcagactggtaag

SEQ ID NO: 508992 - DNA, 20 bp, mouse
gcagcagtccaactgcagac

SEQ ID NO: 508993 - DNA, 20 bp, mouse
ggtgtaccatcgcccaggta

SEQ ID NO: 508994 - DNA, 20 bp, mouse
gcaccgcagggttcttcctg

SEQ ID NO: 508995 - DNA, 20 bp, mouse
gtccatggaaccagattcag

SEQ ID NO: 508996 - DNA, 20 bp, mouse
gtggggccaggcagctatcc

SEQ ID NO: 508997 - DNA, 20 bp, mouse
gcggggcttaggagccaggt

SEQ ID NO: 508998 - DNA, 20 bp, mouse
gagctccaagaagctattcg

SEQ ID NO: 508999 - DNA, 20 bp, mouse
gtaagccccgaatagcttct

SEQ ID NO: 509000 - DNA, 20 bp, mouse
gtggctgtgaagggtggaag

SEQ ID NO: 509001 - DNA, 20 bp, mouse
gagaggggtgaggtagatag

SEQ ID NO: 509002 - DNA, 20 bp, mouse
ggggaagttgctccttcctg

SEQ ID NO: 509003 - DNA, 20 bp, mouse
gagggtggaaggggcaagac

SEQ ID NO: 509004 - DNA, 20 bp, mouse
gtcgctaaccttagagagag

SEQ ID NO: 509005 - DNA, 20 bp, mouse
gggcccctctccaaactcac

SEQ ID NO: 509006 - DNA, 20 bp, mouse
gctccgccagacctccaggg

SEQ ID NO: 509007 - DNA, 20 bp, mouse
gctcctccgccagacctcca

SEQ ID NO: 509008 - DNA, 20 bp, mouse
gccaggcaggagaactccag

SEQ ID NO: 509009 - DNA, 20 bp, mouse
gtccgggaagccaaaggcgg

SEQ ID NO: 509010 - DNA, 20 bp, mouse
ggctgaggcgatagagcccc

SEQ ID NO: 509011 - DNA, 20 bp, mouse
gagaagaagccaacgaccgg

SEQ ID NO: 509012 - DNA, 20 bp, mouse
gaagcttgagcgctcctggg

SEQ ID NO: 509013 - DNA, 20 bp, mouse
ggccacctctctgaaggtaa

SEQ ID NO: 509014 - DNA, 20 bp, mouse
gtagacaggctgcaggttcc

SEQ ID NO: 509015 - DNA, 20 bp, mouse
ggagcttgattagagagatt

SEQ ID NO: 509016 - DNA, 20 bp, mouse
gtgtcaaggaggctggccag

SEQ ID NO: 509017 - DNA, 20 bp, mouse
gagtaaactacctttatcca

SEQ ID NO: 509018 - DNA, 20 bp, mouse
gagcctccttgacaagaaag

SEQ ID NO: 509019 - DNA, 20 bp, mouse
gaacccctttcttgtcaagg

SEQ ID NO: 509020 - DNA, 20 bp, mouse
gcaagaaaggggttgtggtt

SEQ ID NO: 509021 - DNA, 20 bp, mouse
gagttttcttccgtggataa

SEQ ID NO: 509022 - DNA, 20 bp, mouse
gtaatcacaggtgtgctatt

SEQ ID NO: 509023 - DNA, 20 bp, mouse
gcacaacccctttcttgtca

SEQ ID NO: 509024 - DNA, 20 bp, mouse
gtttctcctttgttatgact

SEQ ID NO: 509025 - DNA, 20 bp, mouse
gatttcaaaactgtatgggt

SEQ ID NO: 509026 - DNA, 20 bp, mouse
ggcgcgtctacctggctcct

SEQ ID NO: 509027 - DNA, 20 bp, mouse
ggagaatcaacgtcatgccc

SEQ ID NO: 509028 - DNA, 20 bp, mouse
gaggatccctaacaaggaac

SEQ ID NO: 509029 - DNA, 20 bp, mouse
gagttcatatctacagtctt

SEQ ID NO: 509030 - DNA, 20 bp, mouse
ggacacagtgcgcgtctacc

SEQ ID NO: 509031 - DNA, 20 bp, mouse
gaacgtcatgcccaggagcc

SEQ ID NO: 509032 - DNA, 20 bp, mouse
gagagagccatggtgagcat

SEQ ID NO: 509033 - DNA, 20 bp, mouse
gcataagggagtactggtca

SEQ ID NO: 509034 - DNA, 20 bp, mouse
gcaacaacataagggagtac

SEQ ID NO: 509035 - DNA, 20 bp, mouse
gggctcaatcaacaacataa

SEQ ID NO: 509036 - DNA, 20 bp, mouse
ggctatccggggcttccctg

SEQ ID NO: 509037 - DNA, 20 bp, mouse
gtggggtcatccagactaca

SEQ ID NO: 509038 - DNA, 20 bp, mouse
gggctggcctgggctatccg

SEQ ID NO: 509039 - DNA, 20 bp, mouse
gagtggtaacccctgtagtc

SEQ ID NO: 509040 - DNA, 20 bp, mouse
gctcttgggcaacccaagtc

SEQ ID NO: 509041 - DNA, 20 bp, mouse
ggggaagccccggatagccc

SEQ ID NO: 509042 - DNA, 20 bp, mouse
ggtcccaccgaaccaggaaa

SEQ ID NO: 509043 - DNA, 20 bp, mouse
ggtgatagctatgctcgaag

SEQ ID NO: 509044 - DNA, 20 bp, mouse
gagttaatactcaaaaggtt

SEQ ID NO: 509045 - DNA, 20 bp, mouse
ggtgggacctggtcagaaat

SEQ ID NO: 509046 - DNA, 20 bp, mouse
gagagagggagtcaactcat

SEQ ID NO: 509047 - DNA, 20 bp, mouse
gaactcattggcgcttgagt

SEQ ID NO: 509048 - DNA, 20 bp, mouse
gttggcgcttgagtcggcaa

SEQ ID NO: 509049 - DNA, 20 bp, mouse
gcatagccttagacgtgata

SEQ ID NO: 509050 - DNA, 20 bp, mouse
ggttgactccctctctgccc

SEQ ID NO: 509051 - DNA, 20 bp, mouse
gattgtccttatcacgtcta

SEQ ID NO: 509052 - DNA, 20 bp, mouse
gtctagtgacagggaactta

SEQ ID NO: 509053 - DNA, 20 bp, mouse
gacacaaggtgccttgagag

SEQ ID NO: 509054 - DNA, 20 bp, mouse
gggagacttaagtctgagtc

SEQ ID NO: 509055 - DNA, 20 bp, mouse
gccttgactgtcctctctca

SEQ ID NO: 509056 - DNA, 20 bp, mouse
gcaaggaagcttggctggag

SEQ ID NO: 509057 - DNA, 20 bp, mouse
gaggcctaataggctcatct

SEQ ID NO: 509058 - DNA, 20 bp, mouse
gcagtggttcgaggcctaat

SEQ ID NO: 509059 - DNA, 20 bp, mouse
gtaggcctcgaaccactgca

SEQ ID NO: 509060 - DNA, 20 bp, mouse
ggatcccagatgagcctatt

SEQ ID NO: 509061 - DNA, 20 bp, mouse
gagagagacttacttgcaca

SEQ ID NO: 509062 - DNA, 20 bp, mouse
gcaaaccctgcagtggttcg

SEQ ID NO: 509063 - DNA, 20 bp, mouse
ggcccaaagtccatcagtgg

SEQ ID NO: 509064 - DNA, 20 bp, mouse
gattaggaagatgctctgga

SEQ ID NO: 509065 - DNA, 20 bp, mouse
gccccccactgatggacttt

SEQ ID NO: 509066 - DNA, 20 bp, mouse
gggaatgtgctcccttccca

SEQ ID NO: 509067 - DNA, 20 bp, mouse
gtagtatcttgccatgggaa

SEQ ID NO: 509068 - DNA, 20 bp, mouse
ggagtgtctggtcttcactg

SEQ ID NO: 509069 - DNA, 20 bp, mouse
gggagcacattcctgcagtt

SEQ ID NO: 509070 - DNA, 20 bp, mouse
gacatgtagtatcttgccat

SEQ ID NO: 509071 - DNA, 20 bp, mouse
gattctgtcaccaggaaaga

SEQ ID NO: 509072 - DNA, 20 bp, mouse
gtaacgatcgctcaatcaag

SEQ ID NO: 509073 - DNA, 20 bp, mouse
gcctggagatcacatgagaa

SEQ ID NO: 509074 - DNA, 20 bp, mouse
gaatggaacaactgtaagag

SEQ ID NO: 509075 - DNA, 20 bp, mouse
gtcaatccaggtgaccataa

SEQ ID NO: 509076 - DNA, 20 bp, mouse
gggagcaagcagacaaccac

SEQ ID NO: 509077 - DNA, 20 bp, mouse
gacaaccacaggctcctacc

SEQ ID NO: 509078 - DNA, 20 bp, mouse
gaggctcctacctggagaaa

SEQ ID NO: 509079 - DNA, 20 bp, mouse
ggatctgatggatgctttgt

SEQ ID NO: 509080 - DNA, 20 bp, mouse
gaagcaggcgattctggatc

SEQ ID NO: 509081 - DNA, 20 bp, mouse
gaactgagcaggatcctcac

SEQ ID NO: 509082 - DNA, 20 bp, mouse
gagaatcgcctgcttcacac

SEQ ID NO: 509083 - DNA, 20 bp, mouse
gtccaacagctccacaggtc

SEQ ID NO: 509084 - DNA, 20 bp, mouse
gaaatagggtctacatactg

SEQ ID NO: 509085 - DNA, 20 bp, mouse
ggatttgcttaggaatgttt

SEQ ID NO: 509086 - DNA, 20 bp, mouse
gccaagcagcaagagattct

SEQ ID NO: 509087 - DNA, 20 bp, mouse
gtctctgacaagctctacta

SEQ ID NO: 509088 - DNA, 20 bp, mouse
ggacacattcctattcaatc

SEQ ID NO: 509089 - DNA, 20 bp, mouse
gtgtaggcctgaggtacaag

SEQ ID NO: 509090 - DNA, 20 bp, mouse
gacgccttaactgtgacccc

SEQ ID NO: 509091 - DNA, 20 bp, mouse
gctagggtcaatctgcagat

SEQ ID NO: 509092 - DNA, 20 bp, mouse
gaggttagaaacgcagcctg

SEQ ID NO: 509093 - DNA, 20 bp, mouse
gctgcctggggtcacagtta

SEQ ID NO: 509094 - DNA, 20 bp, mouse
gggacaataagatgaatcta

SEQ ID NO: 509095 - DNA, 20 bp, mouse
ggatgaatctaaggatacaa

SEQ ID NO: 509096 - DNA, 20 bp, mouse
ggttatgacagcaggcaatg

SEQ ID NO: 509097 - DNA, 20 bp, mouse
gactgatggtcctggataca

SEQ ID NO: 509098 - DNA, 20 bp, mouse
gtccaaagaagtcttgtctc

SEQ ID NO: 509099 - DNA, 20 bp, mouse
gacaagacttctttggacca

SEQ ID NO: 509100 - DNA, 20 bp, mouse
gtctctggtacctgtatctt

SEQ ID NO: 509101 - DNA, 20 bp, mouse
gggatcgaagttatgacagc

SEQ ID NO: 509102 - DNA, 20 bp, mouse
gtgaccttaacctaagatac

SEQ ID NO: 509103 - DNA, 20 bp, mouse
ggtacctgtatcttaggtta

SEQ ID NO: 509104 - DNA, 20 bp, mouse
gtcttagtttctccgttctc

SEQ ID NO: 509105 - DNA, 20 bp, mouse
gcccagagacaagacttctt

SEQ ID NO: 509106 - DNA, 20 bp, mouse
ggaagaccaaatcccagctt

SEQ ID NO: 509107 - DNA, 20 bp, mouse
gcagctcccaggtgtaatga

SEQ ID NO: 509108 - DNA, 20 bp, mouse
gggaagccatcattacacct

SEQ ID NO: 509109 - DNA, 20 bp, mouse
gagctgcccaagctgggatt

SEQ ID NO: 509110 - DNA, 20 bp, mouse
gtaaaggacccagactggtt

SEQ ID NO: 509111 - DNA, 20 bp, mouse
gttatctgggtgactaccag

SEQ ID NO: 509112 - DNA, 20 bp, mouse
gccagataaaggacccagac

SEQ ID NO: 509113 - DNA, 20 bp, mouse
ggtcttctagactttccata

SEQ ID NO: 509114 - DNA, 20 bp, mouse
ggatggcttccgaaccagtc

SEQ ID NO: 509115 - DNA, 20 bp, mouse
gcaagggaggtcttcatgtt

SEQ ID NO: 509116 - DNA, 20 bp, mouse
gcccgcgggcggctcagagt

SEQ ID NO: 509117 - DNA, 20 bp, mouse
ggcgcggcgcccacctagaa

SEQ ID NO: 509118 - DNA, 20 bp, mouse
gctgctcagaaggtcttagc

SEQ ID NO: 509119 - DNA, 20 bp, mouse
gggctcccgcccttctaggt

SEQ ID NO: 509120 - DNA, 20 bp, mouse
gagccctgggagccgctcaa

SEQ ID NO: 509121 - DNA, 20 bp, mouse
ggaaggtcttagctggtgcg

SEQ ID NO: 509122 - DNA, 20 bp, mouse
gcggcgcccacctagaaggg

SEQ ID NO: 509123 - DNA, 20 bp, mouse
gcacccgggcacgcccaggt

SEQ ID NO: 509124 - DNA, 20 bp, mouse
ggcgtgcccgggtgccccag

SEQ ID NO: 509125 - DNA, 20 bp, mouse
ggcgcggagcagcccttgag

SEQ ID NO: 509126 - DNA, 20 bp, mouse
gcagacgacccagagaaagt

SEQ ID NO: 509127 - DNA, 20 bp, mouse
gtcaggagcccactttctct

SEQ ID NO: 509128 - DNA, 20 bp, mouse
gcagcccagtaatcatttgg

SEQ ID NO: 509129 - DNA, 20 bp, mouse
gttgcctccaaatgattact

SEQ ID NO: 509130 - DNA, 20 bp, mouse
gacccaagaggctctgacac

SEQ ID NO: 509131 - DNA, 20 bp, mouse
gcgccagcccagtaatcatt

SEQ ID NO: 509132 - DNA, 20 bp, mouse
gctctgacacaggcgtcatc

SEQ ID NO: 509133 - DNA, 20 bp, mouse
gctgtaagtaatgctgtcct

SEQ ID NO: 509134 - DNA, 20 bp, mouse
gtgcctcctcaagtcagccc

SEQ ID NO: 509135 - DNA, 20 bp, mouse
gtctcggggagaaatgtcgc

SEQ ID NO: 509136 - DNA, 20 bp, mouse
gcagctccaggtaagaaggt

SEQ ID NO: 509137 - DNA, 20 bp, mouse
ggctgctgggacatcacaga

SEQ ID NO: 509138 - DNA, 20 bp, mouse
ggaggagaccgctcacccag

SEQ ID NO: 509139 - DNA, 20 bp, mouse
gtacacagctccaggtaaga

SEQ ID NO: 509140 - DNA, 20 bp, mouse
gaagctaggagactcataga

SEQ ID NO: 509141 - DNA, 20 bp, mouse
ggagtctcctagcttcctct

SEQ ID NO: 509142 - DNA, 20 bp, mouse
gaataaagtgacctccacac

SEQ ID NO: 509143 - DNA, 20 bp, mouse
gagcggtctcctcacctgtg

SEQ ID NO: 509144 - DNA, 20 bp, mouse
gcgctcacccagaggaagct

SEQ ID NO: 509145 - DNA, 20 bp, mouse
gtctttcccaccttcttacc

SEQ ID NO: 509146 - DNA, 20 bp, mouse
gcctggtccaagccgaacct

SEQ ID NO: 509147 - DNA, 20 bp, mouse
gtggaccagggcgctgaaag

SEQ ID NO: 509148 - DNA, 20 bp, mouse
ggaaagtaagaggctagtcg

SEQ ID NO: 509149 - DNA, 20 bp, mouse
ggtaagaggctagtcgggga

SEQ ID NO: 509150 - DNA, 20 bp, mouse
gggggaaggctgccagcatc

SEQ ID NO: 509151 - DNA, 20 bp, mouse
gcgaccagatggatgcaggg

SEQ ID NO: 509152 - DNA, 20 bp, mouse
gaagtgcggcggaaagtaag

SEQ ID NO: 509153 - DNA, 20 bp, mouse
gcggcactcctgagaaccct

SEQ ID NO: 509154 - DNA, 20 bp, mouse
gggccagccgcagtaactcc

SEQ ID NO: 509155 - DNA, 20 bp, mouse
gctactacccggagttactg

SEQ ID NO: 509156 - DNA, 20 bp, mouse
gtgtacaaggaaaaccccgt

SEQ ID NO: 509157 - DNA, 20 bp, mouse
gccgcaataacagatccgac

SEQ ID NO: 509158 - DNA, 20 bp, mouse
gaactggcgacagtcttgta

SEQ ID NO: 509159 - DNA, 20 bp, mouse
ggtatcgtcactaaacaatc

SEQ ID NO: 509160 - DNA, 20 bp, mouse
gtgagctctacgacaagaat

SEQ ID NO: 509161 - DNA, 20 bp, mouse
gcacataggattctttctta

SEQ ID NO: 509162 - DNA, 20 bp, mouse
gcttgtagggaagatctgta

SEQ ID NO: 509163 - DNA, 20 bp, mouse
ggggcactttgagaactaac

SEQ ID NO: 509164 - DNA, 20 bp, mouse
gtatggctgcatcccggatc

SEQ ID NO: 509165 - DNA, 20 bp, mouse
gaagtaaaatttccagatcc

SEQ ID NO: 509166 - DNA, 20 bp, mouse
ggcgctggagccacgcagga

SEQ ID NO: 509167 - DNA, 20 bp, mouse
gaccaggtgcggctggaagg

SEQ ID NO: 509168 - DNA, 20 bp, mouse
gagcaaggaagccaaggctc

SEQ ID NO: 509169 - DNA, 20 bp, mouse
gctgactgactgcaaccggg

SEQ ID NO: 509170 - DNA, 20 bp, mouse
gtggctgactgactgcaacc

SEQ ID NO: 509171 - DNA, 20 bp, mouse
gtatgcctggagtagggaag

SEQ ID NO: 509172 - DNA, 20 bp, mouse
ggcactggctggagggctcc

SEQ ID NO: 509173 - DNA, 20 bp, mouse
gagctgggtgggtgcaagct

SEQ ID NO: 509174 - DNA, 20 bp, mouse
gttggagaggctggcgacag

SEQ ID NO: 509175 - DNA, 20 bp, mouse
gggaagcgctggagccacgc

SEQ ID NO: 509176 - DNA, 20 bp, mouse
gggagcgccaagtagcctca

SEQ ID NO: 509177 - DNA, 20 bp, mouse
ggaataagctcagagccgtg

SEQ ID NO: 509178 - DNA, 20 bp, mouse
gagagggagcatgcccacgt

SEQ ID NO: 509179 - DNA, 20 bp, mouse
gtcagagccgtgaggctact

SEQ ID NO: 509180 - DNA, 20 bp, mouse
gttctgcagacgacccacgt

SEQ ID NO: 509181 - DNA, 20 bp, mouse
ggtctgcagaaatgagacga

SEQ ID NO: 509182 - DNA, 20 bp, mouse
gtgattcttaccccagatga

SEQ ID NO: 509183 - DNA, 20 bp, mouse
gccccttcaccagtcagagg

SEQ ID NO: 509184 - DNA, 20 bp, mouse
gtctgtatccctcctctgac

SEQ ID NO: 509185 - DNA, 20 bp, mouse
ggacctctggcaagcctccg

SEQ ID NO: 509186 - DNA, 20 bp, mouse
gggtttgggcggacagagac

SEQ ID NO: 509187 - DNA, 20 bp, mouse
gtgtgccacgcagttgtcaa

SEQ ID NO: 509188 - DNA, 20 bp, mouse
gctgggagtttgggtttggg

SEQ ID NO: 509189 - DNA, 20 bp, mouse
gtgtagaagagagattacag

SEQ ID NO: 509190 - DNA, 20 bp, mouse
gcggacagagaccggaagct

SEQ ID NO: 509191 - DNA, 20 bp, mouse
gcctcccagagaactacgga

SEQ ID NO: 509192 - DNA, 20 bp, mouse
gactgagactgtactcacag

SEQ ID NO: 509193 - DNA, 20 bp, mouse
ggtggcccttgacaactgcg

SEQ ID NO: 509194 - DNA, 20 bp, mouse
gcagcttgtttggaattatg

SEQ ID NO: 509195 - DNA, 20 bp, mouse
ggaagagagattacaggggt

SEQ ID NO: 509196 - DNA, 20 bp, mouse
gagcacccaggcagtgtcta

SEQ ID NO: 509197 - DNA, 20 bp, mouse
gtatggcacagaccttccca

SEQ ID NO: 509198 - DNA, 20 bp, mouse
gagagacttgctgtgtataa

SEQ ID NO: 509199 - DNA, 20 bp, mouse
gtgtgccatagacactgcct

SEQ ID NO: 509200 - DNA, 20 bp, mouse
gtctggagtgagacgttgga

SEQ ID NO: 509201 - DNA, 20 bp, mouse
gtctctctggagtgagacgt

SEQ ID NO: 509202 - DNA, 20 bp, mouse
gggcacagaccttcccaggg

SEQ ID NO: 509203 - DNA, 20 bp, mouse
gtctctgccccagcatatct

SEQ ID NO: 509204 - DNA, 20 bp, mouse
gtctgcttaggtagctggga

SEQ ID NO: 509205 - DNA, 20 bp, mouse
ggcttaggtagctgggaagg

SEQ ID NO: 509206 - DNA, 20 bp, mouse
gtccgcttctgacagtggaa

SEQ ID NO: 509207 - DNA, 20 bp, mouse
ggaatgacagcagcacaggc

SEQ ID NO: 509208 - DNA, 20 bp, mouse
gtccgttccactgtcagaag

SEQ ID NO: 509209 - DNA, 20 bp, mouse
ggtttttccgcttctgacag

SEQ ID NO: 509210 - DNA, 20 bp, mouse
gaaccaccttgagcctgaaa

SEQ ID NO: 509211 - DNA, 20 bp, mouse
gctttggaagacttacctga

SEQ ID NO: 509212 - DNA, 20 bp, mouse
gcacaggattgcatagacca

SEQ ID NO: 509213 - DNA, 20 bp, mouse
ggtaagtcttccaaagacac

SEQ ID NO: 509214 - DNA, 20 bp, mouse
ggactgccatttcaggctca

SEQ ID NO: 509215 - DNA, 20 bp, mouse
ggagagattaggtgactgta

SEQ ID NO: 509216 - DNA, 20 bp, mouse
gtgtgaggagtgattagcaa

SEQ ID NO: 509217 - DNA, 20 bp, mouse
gataggcagctcttcagcat

SEQ ID NO: 509218 - DNA, 20 bp, mouse
gggcagctcttcagcatggg

SEQ ID NO: 509219 - DNA, 20 bp, mouse
ggcacagccatcccatctat

SEQ ID NO: 509220 - DNA, 20 bp, mouse
gcagtgacctcaagtcctgc

SEQ ID NO: 509221 - DNA, 20 bp, mouse
ggtattgcctatagatggga

SEQ ID NO: 509222 - DNA, 20 bp, mouse
gagtgggtgcgctgttgaca

SEQ ID NO: 509223 - DNA, 20 bp, mouse
gacaagtgtcaatgtgacac

SEQ ID NO: 509224 - DNA, 20 bp, mouse
gcctttggcaagaaagctaa

SEQ ID NO: 509225 - DNA, 20 bp, mouse
gtccacttcaagctctacag

SEQ ID NO: 509226 - DNA, 20 bp, mouse
gagatccggaagggactggg

SEQ ID NO: 509227 - DNA, 20 bp, mouse
gccagtacctagatccggaa

SEQ ID NO: 509228 - DNA, 20 bp, mouse
gcctagatccggaagggact

SEQ ID NO: 509229 - DNA, 20 bp, mouse
gacagcggagaacagtccaa

SEQ ID NO: 509230 - DNA, 20 bp, mouse
gactacccagtacctagatc

SEQ ID NO: 509231 - DNA, 20 bp, mouse
gtgggtagtaccacaggtca

SEQ ID NO: 509232 - DNA, 20 bp, mouse
ggatctaggtgtaagatgaa

SEQ ID NO: 509233 - DNA, 20 bp, mouse
ggaaacctcccagtcccttc

SEQ ID NO: 509234 - DNA, 20 bp, mouse
gaggtactgggtagtaccac

SEQ ID NO: 509235 - DNA, 20 bp, mouse
gtgttcagttcccacccagt

SEQ ID NO: 509236 - DNA, 20 bp, mouse
ggggtcccgggagtgtgcat

SEQ ID NO: 509237 - DNA, 20 bp, mouse
gttgcagaggagccccgggg

SEQ ID NO: 509238 - DNA, 20 bp, mouse
gctgttgcagaggagccccg

SEQ ID NO: 509239 - DNA, 20 bp, mouse
gacgcggcgtggcctccccg

SEQ ID NO: 509240 - DNA, 20 bp, mouse
gtcagttcgggtcacatctc

SEQ ID NO: 509241 - DNA, 20 bp, mouse
ggggtcacatctcgggaacg

SEQ ID NO: 509242 - DNA, 20 bp, mouse
ggtgcatgggctgtcagttc

SEQ ID NO: 509243 - DNA, 20 bp, mouse
gtggtagtagccctcctgag

SEQ ID NO: 509244 - DNA, 20 bp, mouse
ggacagcccatgcacactcc

SEQ ID NO: 509245 - DNA, 20 bp, mouse
ggagtcgctcctctcggcaa

SEQ ID NO: 509246 - DNA, 20 bp, mouse
gtagtttgggccttgaatat

SEQ ID NO: 509247 - DNA, 20 bp, mouse
ggcttgaacagttctgaaag

SEQ ID NO: 509248 - DNA, 20 bp, mouse
gactgttttcttccagaagg

SEQ ID NO: 509249 - DNA, 20 bp, mouse
gactctgcagactatattaa

SEQ ID NO: 509250 - DNA, 20 bp, mouse
ggggccttgaatataggtta

SEQ ID NO: 509251 - DNA, 20 bp, mouse
gccagcacaatgatttccca

SEQ ID NO: 509252 - DNA, 20 bp, mouse
gttgttctgtggatattagg

SEQ ID NO: 509253 - DNA, 20 bp, mouse
gttaattcaaccccaaaccc

SEQ ID NO: 509254 - DNA, 20 bp, mouse
gctggacaagtccgttcatg

SEQ ID NO: 509255 - DNA, 20 bp, mouse
gtcaccttaacctatattca

SEQ ID NO: 509256 - DNA, 20 bp, mouse
gctaacccccaggcctgtag

SEQ ID NO: 509257 - DNA, 20 bp, mouse
gtgagggttgggcagacagg

SEQ ID NO: 509258 - DNA, 20 bp, mouse
gcaggctcctctacaggcct

SEQ ID NO: 509259 - DNA, 20 bp, mouse
gtgttgagggttgggcagac

SEQ ID NO: 509260 - DNA, 20 bp, mouse
ggagttacgaagccaaattg

SEQ ID NO: 509261 - DNA, 20 bp, mouse
gaacacccactctaaccccc

SEQ ID NO: 509262 - DNA, 20 bp, mouse
gtagcagagctgaagatggt

SEQ ID NO: 509263 - DNA, 20 bp, mouse
ggacccagcccagatgactc

SEQ ID NO: 509264 - DNA, 20 bp, mouse
gggcaaagagagtggctagg

SEQ ID NO: 509265 - DNA, 20 bp, mouse
gtggggcaaggcaaagagag

SEQ ID NO: 509266 - DNA, 20 bp, mouse
gcctggagactcagttctgg

SEQ ID NO: 509267 - DNA, 20 bp, mouse
ggtctccaggagctgatgac

SEQ ID NO: 509268 - DNA, 20 bp, mouse
gtgaagtgagaaccagacca

SEQ ID NO: 509269 - DNA, 20 bp, mouse
gcagttctggtggcatggag

SEQ ID NO: 509270 - DNA, 20 bp, mouse
gaggccctgtcatcagctcc

SEQ ID NO: 509271 - DNA, 20 bp, mouse
ggatgactaccagacagaca

SEQ ID NO: 509272 - DNA, 20 bp, mouse
gtgatgacagggccttggtc

SEQ ID NO: 509273 - DNA, 20 bp, mouse
gcgacaacctgtgcacagtc

SEQ ID NO: 509274 - DNA, 20 bp, mouse
gtgtgcacaggttgtcgcta

SEQ ID NO: 509275 - DNA, 20 bp, mouse
ggagaggacccttgtctgtc

SEQ ID NO: 509276 - DNA, 20 bp, mouse
gggcacaccacaggagaagt

SEQ ID NO: 509277 - DNA, 20 bp, mouse
gtgaccgtgaggcacaccac

SEQ ID NO: 509278 - DNA, 20 bp, mouse
gctgggcagagcctacacag

SEQ ID NO: 509279 - DNA, 20 bp, mouse
gagacaagcaagtgaccgtg

SEQ ID NO: 509280 - DNA, 20 bp, mouse
gggtgcaagtccagaatcag

SEQ ID NO: 509281 - DNA, 20 bp, mouse
gccagggatgggcagacttg

SEQ ID NO: 509282 - DNA, 20 bp, mouse
gaggccagttggctgcccca

SEQ ID NO: 509283 - DNA, 20 bp, mouse
gcagttggctgccccaggga

SEQ ID NO: 509284 - DNA, 20 bp, mouse
ggaggaccagccgggcatct

SEQ ID NO: 509285 - DNA, 20 bp, mouse
gtgtgtgcgactgaaacaca

SEQ ID NO: 509286 - DNA, 20 bp, mouse
gacacttgtgcgatctctga

SEQ ID NO: 509287 - DNA, 20 bp, mouse
gttcagtatatgtatcctga

SEQ ID NO: 509288 - DNA, 20 bp, mouse
gtcaggaacatttcctattt

SEQ ID NO: 509289 - DNA, 20 bp, mouse
ggtatcctgaaggccaaaat

SEQ ID NO: 509290 - DNA, 20 bp, mouse
gatttcctattttggccttc

SEQ ID NO: 509291 - DNA, 20 bp, mouse
ggcttgcaccgggtgttgac

SEQ ID NO: 509292 - DNA, 20 bp, mouse
gcttttgctctctcactaac

SEQ ID NO: 509293 - DNA, 20 bp, mouse
ggttgacgatgtatggctgc

SEQ ID NO: 509294 - DNA, 20 bp, mouse
ggcggccaaagtccccataa

SEQ ID NO: 509295 - DNA, 20 bp, mouse
gtcaacagttgataactgag

SEQ ID NO: 509296 - DNA, 20 bp, mouse
gcggctggcactggactggg

SEQ ID NO: 509297 - DNA, 20 bp, mouse
ggtgcaggggtccagagccg

SEQ ID NO: 509298 - DNA, 20 bp, mouse
ggtccctccagggccccttc

SEQ ID NO: 509299 - DNA, 20 bp, mouse
gtggtcagtagtgtcttcat

SEQ ID NO: 509300 - DNA, 20 bp, mouse
gggctgctaagagactcatg

SEQ ID NO: 509301 - DNA, 20 bp, mouse
ggcggggccagctgccaaag

SEQ ID NO: 509302 - DNA, 20 bp, mouse
gggccagggatcccaccgtc

SEQ ID NO: 509303 - DNA, 20 bp, mouse
gacactactgaccatcctga

SEQ ID NO: 509304 - DNA, 20 bp, mouse
gagggatcccaccgtcagga

SEQ ID NO: 509305 - DNA, 20 bp, mouse
gtgaactcagggtgctgagt

SEQ ID NO: 509306 - DNA, 20 bp, mouse
ggacctagaaggcaatgctt

SEQ ID NO: 509307 - DNA, 20 bp, mouse
gtatgatgaggagacctaga

SEQ ID NO: 509308 - DNA, 20 bp, mouse
gggaaggacgagggagacta

SEQ ID NO: 509309 - DNA, 20 bp, mouse
gtcctcagtgaaaggaactc

SEQ ID NO: 509310 - DNA, 20 bp, mouse
gggacgaggagccactttca

SEQ ID NO: 509311 - DNA, 20 bp, mouse
gtgcctaagcattgccttct

SEQ ID NO: 509312 - DNA, 20 bp, mouse
gcagcagcctcctcagtgaa

SEQ ID NO: 509313 - DNA, 20 bp, mouse
gttcatggaactattcactc

SEQ ID NO: 509314 - DNA, 20 bp, mouse
gcaaatggcaggtgaaacct

SEQ ID NO: 509315 - DNA, 20 bp, mouse
ggacaagacacaaggcccta

SEQ ID NO: 509316 - DNA, 20 bp, mouse
ggagttagactcagaaccaa

SEQ ID NO: 509317 - DNA, 20 bp, mouse
gcaggaagccgcttagaagt

SEQ ID NO: 509318 - DNA, 20 bp, mouse
ggactcagaaccaaaggagg

SEQ ID NO: 509319 - DNA, 20 bp, mouse
gccaggccctgagtgaccca

SEQ ID NO: 509320 - DNA, 20 bp, mouse
gctgtagtccgacttctaag

SEQ ID NO: 509321 - DNA, 20 bp, mouse
gaaccaaaggaggtggatag

SEQ ID NO: 509322 - DNA, 20 bp, mouse
gagtcaggactgctactcct

SEQ ID NO: 509323 - DNA, 20 bp, mouse
ggagataggacagaagactg

SEQ ID NO: 509324 - DNA, 20 bp, mouse
ggtgatctgcaccaggcctg

SEQ ID NO: 509325 - DNA, 20 bp, mouse
gaggtggatagggggtccac

SEQ ID NO: 509326 - DNA, 20 bp, mouse
gaatcaagccgctgccctcc

SEQ ID NO: 509327 - DNA, 20 bp, mouse
ggagaggtgagcatcaaaag

SEQ ID NO: 509328 - DNA, 20 bp, mouse
gtaattcctgagatacatag

SEQ ID NO: 509329 - DNA, 20 bp, mouse
gttataatgctactgatgaa

SEQ ID NO: 509330 - DNA, 20 bp, mouse
ggagcagttaatgtctggtg

SEQ ID NO: 509331 - DNA, 20 bp, mouse
ggcatcaaaagaggtgcaat

SEQ ID NO: 509332 - DNA, 20 bp, mouse
gaacttcaaaacataagtta

SEQ ID NO: 509333 - DNA, 20 bp, mouse
gtaatgaatcttcctctaag

SEQ ID NO: 509334 - DNA, 20 bp, mouse
gtttgtagcttatgaatatg

SEQ ID NO: 509335 - DNA, 20 bp, mouse
gcttttcttcggaaagaagc

SEQ ID NO: 509336 - DNA, 20 bp, mouse
gtggtagaggatcttctgct

SEQ ID NO: 509337 - DNA, 20 bp, mouse
gagtcagcattcattggtag

SEQ ID NO: 509338 - DNA, 20 bp, mouse
gggaccctaggtgagtagtg

SEQ ID NO: 509339 - DNA, 20 bp, mouse
gggtcctaaagtgaagccgg

SEQ ID NO: 509340 - DNA, 20 bp, mouse
gtagaggatcttctgctggg

SEQ ID NO: 509341 - DNA, 20 bp, mouse
ggcctttgctctgaaatgtt

SEQ ID NO: 509342 - DNA, 20 bp, mouse
gttcttgtgcacaaaaagtt

SEQ ID NO: 509343 - DNA, 20 bp, mouse
gttcaaaagtgaaagactga

SEQ ID NO: 509344 - DNA, 20 bp, mouse
gcagaggataataagatcca

SEQ ID NO: 509345 - DNA, 20 bp, mouse
gggagcaggtgtccaggact

SEQ ID NO: 509346 - DNA, 20 bp, mouse
gctctctcagaaggcctgtc

SEQ ID NO: 509347 - DNA, 20 bp, mouse
ggacactgctcaccagtcac

SEQ ID NO: 509348 - DNA, 20 bp, mouse
gctgatgtctgacagaggaa

SEQ ID NO: 509349 - DNA, 20 bp, mouse
gtcagaaggcctgtcaggca

SEQ ID NO: 509350 - DNA, 20 bp, mouse
gtggccctgatgtctgacag

SEQ ID NO: 509351 - DNA, 20 bp, mouse
ggcagtgtccggcatgtacc

SEQ ID NO: 509352 - DNA, 20 bp, mouse
gccttctgagagaggctgac

SEQ ID NO: 509353 - DNA, 20 bp, mouse
gggtactacccctgcctgac

SEQ ID NO: 509354 - DNA, 20 bp, mouse
gccggcatgtaccaggtgag

SEQ ID NO: 509355 - DNA, 20 bp, mouse
gggtctcagggagctgcagg

SEQ ID NO: 509356 - DNA, 20 bp, mouse
ggtggagcccaggagaggtt

SEQ ID NO: 509357 - DNA, 20 bp, mouse
gagaggctgggccctgacat

SEQ ID NO: 509358 - DNA, 20 bp, mouse
ggttggggcagaaagttgag

SEQ ID NO: 509359 - DNA, 20 bp, mouse
gtaggggggtcttatactgg

SEQ ID NO: 509360 - DNA, 20 bp, mouse
gggcatggctagctgaccac

SEQ ID NO: 509361 - DNA, 20 bp, mouse
ggtataagacccccctaccc

SEQ ID NO: 509362 - DNA, 20 bp, mouse
gcagccatctcctgggtagg

SEQ ID NO: 509363 - DNA, 20 bp, mouse
ggcggtgactgggaccaagg

SEQ ID NO: 509364 - DNA, 20 bp, mouse
gtgagttggaagcggcgact

SEQ ID NO: 509365 - DNA, 20 bp, mouse
ggagaaccgaggacagtcag

SEQ ID NO: 509366 - DNA, 20 bp, mouse
ggcgacagcagaagctccaa

SEQ ID NO: 509367 - DNA, 20 bp, mouse
gcggcgtgaggcgtgcaacc

SEQ ID NO: 509368 - DNA, 20 bp, mouse
gagggacaagtgacaccacc

SEQ ID NO: 509369 - DNA, 20 bp, mouse
gagccggttcatggctccca

SEQ ID NO: 509370 - DNA, 20 bp, mouse
ggaggcgtgcaacccggagc

SEQ ID NO: 509371 - DNA, 20 bp, mouse
ggcaacccggagccggttca

SEQ ID NO: 509372 - DNA, 20 bp, mouse
ggctcggggtcacagttgta

SEQ ID NO: 509373 - DNA, 20 bp, mouse
ggatggcgcagagggagtcc

SEQ ID NO: 509374 - DNA, 20 bp, mouse
gcagagagccgagaggaccg

SEQ ID NO: 509375 - DNA, 20 bp, mouse
gggcctggcacgtgctggga

SEQ ID NO: 509376 - DNA, 20 bp, mouse
ggaggcctgagcccttgttc

SEQ ID NO: 509377 - DNA, 20 bp, mouse
gcttgttctggcattctccc

SEQ ID NO: 509378 - DNA, 20 bp, mouse
gccaggaagatgcagtaaag

SEQ ID NO: 509379 - DNA, 20 bp, mouse
gagtcttcccaaggttccca

SEQ ID NO: 509380 - DNA, 20 bp, mouse
ggcctctcagtctgtcatct

SEQ ID NO: 509381 - DNA, 20 bp, mouse
ggatagattagggaccactg

SEQ ID NO: 509382 - DNA, 20 bp, mouse
ggtcgggcaggtaagagacc

SEQ ID NO: 509383 - DNA, 20 bp, mouse
ggcccgacaactgggtacta

SEQ ID NO: 509384 - DNA, 20 bp, mouse
gaccatagtacccagttgtc

SEQ ID NO: 509385 - DNA, 20 bp, mouse
gctggcacatgggatcagga

SEQ ID NO: 509386 - DNA, 20 bp, mouse
gctcccaggggaccacacag

SEQ ID NO: 509387 - DNA, 20 bp, mouse
gttgtctgctacctaagctg

SEQ ID NO: 509388 - DNA, 20 bp, mouse
ggcggagcaggagatggccg

SEQ ID NO: 509389 - DNA, 20 bp, mouse
gtgcagtcctgctggaggtt

SEQ ID NO: 509390 - DNA, 20 bp, mouse
gatctcctgctccgcagctt

SEQ ID NO: 509391 - DNA, 20 bp, mouse
gctcttgctggtcctcccaa

SEQ ID NO: 509392 - DNA, 20 bp, mouse
gagcaacagactgaaaccca

SEQ ID NO: 509393 - DNA, 20 bp, mouse
gcccagggaatcctaagaca

SEQ ID NO: 509394 - DNA, 20 bp, mouse
gctggtcctcccaagggaca

SEQ ID NO: 509395 - DNA, 20 bp, mouse
ggcatcacctggctgcaaca

SEQ ID NO: 509396 - DNA, 20 bp, mouse
ggaaggactaagaaggatct

SEQ ID NO: 509397 - DNA, 20 bp, mouse
gagcagctgaaggactaaga

SEQ ID NO: 509398 - DNA, 20 bp, mouse
gaccagagggagttgttgag

SEQ ID NO: 509399 - DNA, 20 bp, mouse
gggagcactgaggtgttcag

SEQ ID NO: 509400 - DNA, 20 bp, mouse
gcttgtgggagagtggttca

SEQ ID NO: 509401 - DNA, 20 bp, mouse
gagggcagggtggagctcca

SEQ ID NO: 509402 - DNA, 20 bp, mouse
ggacaataatagtttcaaca

SEQ ID NO: 509403 - DNA, 20 bp, mouse
ggggcagagtaggagcactg

SEQ ID NO: 509404 - DNA, 20 bp, mouse
gtgttgagaggaaggctatg

SEQ ID NO: 509405 - DNA, 20 bp, mouse
gaagcactgaacctctggaa

SEQ ID NO: 509406 - DNA, 20 bp, mouse
gtggatgctggtggtagagc

SEQ ID NO: 509407 - DNA, 20 bp, mouse
ggaggaccagaacgagacaa

SEQ ID NO: 509408 - DNA, 20 bp, mouse
gtggcttcttcagaacccct

SEQ ID NO: 509409 - DNA, 20 bp, mouse
gcttcttcagaaccccttgg

SEQ ID NO: 509410 - DNA, 20 bp, mouse
gtctcgttctggtcctccaa

SEQ ID NO: 509411 - DNA, 20 bp, mouse
gtattgtcaaggagattata

SEQ ID NO: 509412 - DNA, 20 bp, mouse
gactggcttgaggcacctgt

SEQ ID NO: 509413 - DNA, 20 bp, mouse
ggtggaagagcatcaggagc

SEQ ID NO: 509414 - DNA, 20 bp, mouse
gctgactgaggtatatactg

SEQ ID NO: 509415 - DNA, 20 bp, mouse
ggattgaagcttggagtccc

SEQ ID NO: 509416 - DNA, 20 bp, mouse
gccatctgtgggaattccgg

SEQ ID NO: 509417 - DNA, 20 bp, mouse
gcacagagcgatccatctgt

SEQ ID NO: 509418 - DNA, 20 bp, mouse
gggatggctctagtgaacac

SEQ ID NO: 509419 - DNA, 20 bp, mouse
gggtgagaacgcaaggacaa

SEQ ID NO: 509420 - DNA, 20 bp, mouse
ggtgggaattccggaggcag

SEQ ID NO: 509421 - DNA, 20 bp, mouse
gtgaacacagggaaggcata

SEQ ID NO: 509422 - DNA, 20 bp, mouse
gagaaggcatctgtgctcca

SEQ ID NO: 509423 - DNA, 20 bp, mouse
ggatccatctgtgggaattc

SEQ ID NO: 509424 - DNA, 20 bp, mouse
gtgagggtcagtgccctgca

SEQ ID NO: 509425 - DNA, 20 bp, mouse
ggggaagaagtgacttagag

SEQ ID NO: 509426 - DNA, 20 bp, mouse
gtaccaggctgatcacagaa

SEQ ID NO: 509427 - DNA, 20 bp, mouse
ggagttgcactgctttgtag

SEQ ID NO: 509428 - DNA, 20 bp, mouse
gctggccttgggagcttacc

SEQ ID NO: 509429 - DNA, 20 bp, mouse
ggataacagatacattccaa

SEQ ID NO: 509430 - DNA, 20 bp, mouse
gaagctcccaaggccagcaa

SEQ ID NO: 509431 - DNA, 20 bp, mouse
gcagccactgtgcaaaccaa

SEQ ID NO: 509432 - DNA, 20 bp, mouse
ggcaactcaggcactttgtg

SEQ ID NO: 509433 - DNA, 20 bp, mouse
gcggacagcacacgttggag

SEQ ID NO: 509434 - DNA, 20 bp, mouse
ggtcccactcgcagtaagta

SEQ ID NO: 509435 - DNA, 20 bp, mouse
gtaaatagttcaagctatgg

SEQ ID NO: 509436 - DNA, 20 bp, mouse
gaatcacggcagaatcatcg

SEQ ID NO: 509437 - DNA, 20 bp, mouse
gaccgagggaaatgtctagt

SEQ ID NO: 509438 - DNA, 20 bp, mouse
gagactgagaccaaaaccga

SEQ ID NO: 509439 - DNA, 20 bp, mouse
gacccactagacatttccct

SEQ ID NO: 509440 - DNA, 20 bp, mouse
gaagcccaaggcgctctgcg

SEQ ID NO: 509441 - DNA, 20 bp, mouse
ggaagggaggggtgctccac

SEQ ID NO: 509442 - DNA, 20 bp, mouse
gcacggcggtgtagatttaa

SEQ ID NO: 509443 - DNA, 20 bp, mouse
ggctttgtaaagtttcacgg

SEQ ID NO: 509444 - DNA, 20 bp, mouse
gctcagaaataagaagggag

SEQ ID NO: 509445 - DNA, 20 bp, mouse
gtagacatttccctcggttt

SEQ ID NO: 509446 - DNA, 20 bp, mouse
gcgccctccgagaagactgt

SEQ ID NO: 509447 - DNA, 20 bp, mouse
gcagcctacagtcttctcgg

SEQ ID NO: 509448 - DNA, 20 bp, mouse
gctagaaccggagctaacaa

SEQ ID NO: 509449 - DNA, 20 bp, mouse
ggccctcagagactgcgacg

SEQ ID NO: 509450 - DNA, 20 bp, mouse
ggtggcagtaaatgctgtgt

SEQ ID NO: 509451 - DNA, 20 bp, mouse
gcctggagcaggtgccttgg

SEQ ID NO: 509452 - DNA, 20 bp, mouse
ggttcagcctacagtcttct

SEQ ID NO: 509453 - DNA, 20 bp, mouse
gagtaaatgctgtgtgggac

SEQ ID NO: 509454 - DNA, 20 bp, mouse
ggccagcaccttatcgactg

SEQ ID NO: 509455 - DNA, 20 bp, mouse
gctctgagggccgatttaac

SEQ ID NO: 509456 - DNA, 20 bp, mouse
gcccgcggaccggacctgag

SEQ ID NO: 509457 - DNA, 20 bp, mouse
gcccccagacccccgaggac

SEQ ID NO: 509458 - DNA, 20 bp, mouse
gcggacctgagtggcgccca

SEQ ID NO: 509459 - DNA, 20 bp, mouse
ggcctcagatcctcactcac

SEQ ID NO: 509460 - DNA, 20 bp, mouse
ggcgtccgttcctgtcctcg

SEQ ID NO: 509461 - DNA, 20 bp, mouse
gggaactgcttacagggcag

SEQ ID NO: 509462 - DNA, 20 bp, mouse
gcccaggagtgaacagcatg

SEQ ID NO: 509463 - DNA, 20 bp, mouse
gtgaccggaagcagaaacgg

SEQ ID NO: 509464 - DNA, 20 bp, mouse
gcggtgaccggaagcagaaa

SEQ ID NO: 509465 - DNA, 20 bp, mouse
gtgagtggcgcccacggcgc

SEQ ID NO: 509466 - DNA, 20 bp, mouse
gtgctagagaggtggacgga

SEQ ID NO: 509467 - DNA, 20 bp, mouse
gcgccccagcagtatcacct

SEQ ID NO: 509468 - DNA, 20 bp, mouse
gcaggatgacaactagctgg

SEQ ID NO: 509469 - DNA, 20 bp, mouse
ggacggcacagagctattga

SEQ ID NO: 509470 - DNA, 20 bp, mouse
gaattgtctctcgtcactga

SEQ ID NO: 509471 - DNA, 20 bp, mouse
gaacgaggtcacaggagaag

SEQ ID NO: 509472 - DNA, 20 bp, mouse
gtacccaggtgatactgctg

SEQ ID NO: 509473 - DNA, 20 bp, mouse
gaacaatgcaatgctggcag

SEQ ID NO: 509474 - DNA, 20 bp, mouse
gtggagagatggtgccagat

SEQ ID NO: 509475 - DNA, 20 bp, mouse
gatactgctggggcgattct

SEQ ID NO: 509476 - DNA, 20 bp, mouse
gcgaaaaggcgaggaggcaa

SEQ ID NO: 509477 - DNA, 20 bp, mouse
gtggcggcgaaaaggcgagg

SEQ ID NO: 509478 - DNA, 20 bp, mouse
gaaggcagttggcgagggag

SEQ ID NO: 509479 - DNA, 20 bp, mouse
ggcggttactcactccatgg

SEQ ID NO: 509480 - DNA, 20 bp, mouse
gccatggcggcgaaaaggcg

SEQ ID NO: 509481 - DNA, 20 bp, mouse
gtcactccatggcggcgaaa

SEQ ID NO: 509482 - DNA, 20 bp, mouse
ggcggtgagcgcggagacgg

SEQ ID NO: 509483 - DNA, 20 bp, mouse
gagccccgcgagctctgaaa

SEQ ID NO: 509484 - DNA, 20 bp, mouse
gccctcgcgcggccccgacg

SEQ ID NO: 509485 - DNA, 20 bp, mouse
gtgagcggagagtgaaggcg

SEQ ID NO: 509486 - DNA, 20 bp, mouse
ggcgtggagcctgaactcgc

SEQ ID NO: 509487 - DNA, 20 bp, mouse
gactcgcaggtaggaacggg

SEQ ID NO: 509488 - DNA, 20 bp, mouse
gggagcctgaactcgcaggt

SEQ ID NO: 509489 - DNA, 20 bp, mouse
gctgaactcgcaggtaggaa

SEQ ID NO: 509490 - DNA, 20 bp, mouse
gccaggcggcgtaggaagcg

SEQ ID NO: 509491 - DNA, 20 bp, mouse
gctcgcaggaaagccccgcg

SEQ ID NO: 509492 - DNA, 20 bp, mouse
ggcccgaaggcagccgaccc

SEQ ID NO: 509493 - DNA, 20 bp, mouse
ggctagaactcagggagcct

SEQ ID NO: 509494 - DNA, 20 bp, mouse
gagaactcagggagcctcgg

SEQ ID NO: 509495 - DNA, 20 bp, mouse
gcgcaggtaggaacgggcgg

SEQ ID NO: 509496 - DNA, 20 bp, mouse
gtaggtaaggagatctggta

SEQ ID NO: 509497 - DNA, 20 bp, mouse
gagacataggtaaggagatc

SEQ ID NO: 509498 - DNA, 20 bp, mouse
gtgagcggacagctgtgtca

SEQ ID NO: 509499 - DNA, 20 bp, mouse
gcagtcagagcggtatagca

SEQ ID NO: 509500 - DNA, 20 bp, mouse
gctttcaccactgtgctcat

SEQ ID NO: 509501 - DNA, 20 bp, mouse
gtgtgtctgggccactgcca

SEQ ID NO: 509502 - DNA, 20 bp, mouse
gctggccacgtagacaagtc

SEQ ID NO: 509503 - DNA, 20 bp, mouse
ggtcaacagagctcggtgag

SEQ ID NO: 509504 - DNA, 20 bp, mouse
gtctgaagaaccatagcgtc

SEQ ID NO: 509505 - DNA, 20 bp, mouse
gactctgaagtcttcagcgc

SEQ ID NO: 509506 - DNA, 20 bp, mouse
gagagacagagctaacgctg

SEQ ID NO: 509507 - DNA, 20 bp, mouse
gaagctcactggacaggtcc

SEQ ID NO: 509508 - DNA, 20 bp, mouse
gtagaagaagctcactggac

SEQ ID NO: 509509 - DNA, 20 bp, mouse
gcagtgagcttcttctagtt

SEQ ID NO: 509510 - DNA, 20 bp, mouse
gtctgtctctgctgataaca

SEQ ID NO: 509511 - DNA, 20 bp, mouse
gaaaaatagaactgcatacc

SEQ ID NO: 509512 - DNA, 20 bp, mouse
gttagagacaaacaacaata

SEQ ID NO: 509513 - DNA, 20 bp, mouse
gataaactgtcaacagcagg

SEQ ID NO: 509514 - DNA, 20 bp, mouse
gactttaacaggactcacct

SEQ ID NO: 509515 - DNA, 20 bp, mouse
gctttctgctgaaatatctt

SEQ ID NO: 509516 - DNA, 20 bp, mouse
ggcagagaggaacttcatag

SEQ ID NO: 509517 - DNA, 20 bp, mouse
gtcccaagaaggcaactgga

SEQ ID NO: 509518 - DNA, 20 bp, mouse
gctgatgctggtgacaacca

SEQ ID NO: 509519 - DNA, 20 bp, mouse
ggtgagcagatagcacagtt

SEQ ID NO: 509520 - DNA, 20 bp, mouse
gatagctccgccagagggca

SEQ ID NO: 509521 - DNA, 20 bp, mouse
gtgtgaagtagggaaggccg

SEQ ID NO: 509522 - DNA, 20 bp, mouse
gctacttcacaagtccggag

SEQ ID NO: 509523 - DNA, 20 bp, mouse
gattgactatcgttcttggt

SEQ ID NO: 509524 - DNA, 20 bp, mouse
gaccagcatcagtcccaaga

SEQ ID NO: 509525 - DNA, 20 bp, mouse
gtccatccagttgccttctt

SEQ ID NO: 509526 - DNA, 20 bp, mouse
gccgggcggccggcagactg

SEQ ID NO: 509527 - DNA, 20 bp, mouse
gaccgatctgagccacgccg

SEQ ID NO: 509528 - DNA, 20 bp, mouse
gcagcgagagcagtcgccct

SEQ ID NO: 509529 - DNA, 20 bp, mouse
gagcagtcgccctcggcctc

SEQ ID NO: 509530 - DNA, 20 bp, mouse
gggtaagaggaacccggagc

SEQ ID NO: 509531 - DNA, 20 bp, mouse
ggcgctgggtaagaggaacc

SEQ ID NO: 509532 - DNA, 20 bp, mouse
ggccccggcgtggctcagat

SEQ ID NO: 509533 - DNA, 20 bp, mouse
gaggcgctagacgcaacagg

SEQ ID NO: 509534 - DNA, 20 bp, mouse
gaaggaagcatgctgaccgt

SEQ ID NO: 509535 - DNA, 20 bp, mouse
ggcactgcgagcgctcgccc

SEQ ID NO: 509536 - DNA, 20 bp, mouse
gcacaccaccggtccctcag

SEQ ID NO: 509537 - DNA, 20 bp, mouse
gggctccgctgagggaccgg

SEQ ID NO: 509538 - DNA, 20 bp, mouse
gggatcccggcccacaccac

SEQ ID NO: 509539 - DNA, 20 bp, mouse
ggagggtggcgtgtgcggtc

SEQ ID NO: 509540 - DNA, 20 bp, mouse
ggctgagggacgctcaggag

SEQ ID NO: 509541 - DNA, 20 bp, mouse
gcccggatggctcgaagctc

SEQ ID NO: 509542 - DNA, 20 bp, mouse
gcgggtcagcggcggacgga

SEQ ID NO: 509543 - DNA, 20 bp, mouse
gtgcggctccgctgagggac

SEQ ID NO: 509544 - DNA, 20 bp, mouse
ggtgtgggccgggatccgcg

SEQ ID NO: 509545 - DNA, 20 bp, mouse
gggacggagggtggcgtgtg

SEQ ID NO: 509546 - DNA, 20 bp, mouse
gagcagcgacgcctcctcag

SEQ ID NO: 509547 - DNA, 20 bp, mouse
gagtctgccggcagatccta

SEQ ID NO: 509548 - DNA, 20 bp, mouse
ggcgggtagtggctgaccat

SEQ ID NO: 509549 - DNA, 20 bp, mouse
gtggcaaagccagagcgcct

SEQ ID NO: 509550 - DNA, 20 bp, mouse
ggaggggccgcatgcatcac

SEQ ID NO: 509551 - DNA, 20 bp, mouse
ggtgctgggcagggcagttc

SEQ ID NO: 509552 - DNA, 20 bp, mouse
gttaagatgacttacatcgg

SEQ ID NO: 509553 - DNA, 20 bp, mouse
gtgactggggaagacgctga

SEQ ID NO: 509554 - DNA, 20 bp, mouse
gttgcaagtcagttccactg

SEQ ID NO: 509555 - DNA, 20 bp, mouse
gtggacatattagtaaccag

SEQ ID NO: 509556 - DNA, 20 bp, mouse
ggcaggcacagagctggttt

SEQ ID NO: 509557 - DNA, 20 bp, mouse
gctctcagaatgatggctct

SEQ ID NO: 509558 - DNA, 20 bp, mouse
gaaagtggaaatgcccagga

SEQ ID NO: 509559 - DNA, 20 bp, mouse
ggcctgctaaaccacagaca

SEQ ID NO: 509560 - DNA, 20 bp, mouse
gtccctgtctgtggtttagc

SEQ ID NO: 509561 - DNA, 20 bp, mouse
gagaaatgactcaccatcct

SEQ ID NO: 509562 - DNA, 20 bp, mouse
gccaacaaagaactgatatg

SEQ ID NO: 509563 - DNA, 20 bp, mouse
gcaagaatttagcactaatt

SEQ ID NO: 509564 - DNA, 20 bp, mouse
gaagctgtttctggagaaag

SEQ ID NO: 509565 - DNA, 20 bp, mouse
ggtcatcattccctctgtcc

SEQ ID NO: 509566 - DNA, 20 bp, mouse
gcggtggatcatcctacagt

SEQ ID NO: 509567 - DNA, 20 bp, mouse
gtgctggaggatggcaaagg

SEQ ID NO: 509568 - DNA, 20 bp, mouse
gagagatgcagcaccacatg

SEQ ID NO: 509569 - DNA, 20 bp, mouse
gatgtcaccaacatgttgac

SEQ ID NO: 509570 - DNA, 20 bp, mouse
gagggggctcaactcactgg

SEQ ID NO: 509571 - DNA, 20 bp, mouse
gtatagtcggaaaaaggtca

SEQ ID NO: 509572 - DNA, 20 bp, mouse
gatctgctggaggatggcaa

SEQ ID NO: 509573 - DNA, 20 bp, mouse
gcaacatgttgacgggagtc

SEQ ID NO: 509574 - DNA, 20 bp, mouse
gactggggagagtcatctgc

SEQ ID NO: 509575 - DNA, 20 bp, mouse
gagagtcatctgctggagga

SEQ ID NO: 509576 - DNA, 20 bp, mouse
gcagggccatggagagtctc

SEQ ID NO: 509577 - DNA, 20 bp, mouse
gggctgcctgagactctcca

SEQ ID NO: 509578 - DNA, 20 bp, mouse
gttggcagtaagtcacctcc

SEQ ID NO: 509579 - DNA, 20 bp, mouse
ggccctgggaagatgcattg

SEQ ID NO: 509580 - DNA, 20 bp, mouse
gatctcctggatcaggtaag

SEQ ID NO: 509581 - DNA, 20 bp, mouse
gtccgcaatgcatcttccca

SEQ ID NO: 509582 - DNA, 20 bp, mouse
gcttactgccaactgtcctt

SEQ ID NO: 509583 - DNA, 20 bp, mouse
gtaccaaccctgggcctaag

SEQ ID NO: 509584 - DNA, 20 bp, mouse
gcagtaagtcacctcctggc

SEQ ID NO: 509585 - DNA, 20 bp, mouse
ggtacaccagacaaggtcaa

SEQ ID NO: 509586 - DNA, 20 bp, mouse
ggcatctccgaggagcccgt

SEQ ID NO: 509587 - DNA, 20 bp, mouse
ggccaggacacgcatctccg

SEQ ID NO: 509588 - DNA, 20 bp, mouse
ggctggctacagaggctcaa

SEQ ID NO: 509589 - DNA, 20 bp, mouse
gtacagaggctcaagggccc

SEQ ID NO: 509590 - DNA, 20 bp, mouse
ggccccctcgctggctacag

SEQ ID NO: 509591 - DNA, 20 bp, mouse
gagatgcgtgtcctggccgg

SEQ ID NO: 509592 - DNA, 20 bp, mouse
ggagagcctcaggtaccggt

SEQ ID NO: 509593 - DNA, 20 bp, mouse
gtcctcggagatgcgtgtcc

SEQ ID NO: 509594 - DNA, 20 bp, mouse
gccagcgagggggccagcat

SEQ ID NO: 509595 - DNA, 20 bp, mouse
ggcctctgtagccagcgagg

SEQ ID NO: 509596 - DNA, 20 bp, mouse
ggcagcgcgcctctcgcagg

SEQ ID NO: 509597 - DNA, 20 bp, mouse
gaatcggactctagagccag

SEQ ID NO: 509598 - DNA, 20 bp, mouse
ggctgcgcggccagccccga

SEQ ID NO: 509599 - DNA, 20 bp, mouse
ggcggcagcgcgcctctcgc

SEQ ID NO: 509600 - DNA, 20 bp, mouse
ggcgcgcctctcgcaggcgg

SEQ ID NO: 509601 - DNA, 20 bp, mouse
gacctcgcagcagcaggcgg

SEQ ID NO: 509602 - DNA, 20 bp, mouse
gcagctggcacgataagatc

SEQ ID NO: 509603 - DNA, 20 bp, mouse
gcggcggcgtccagcgcccg

SEQ ID NO: 509604 - DNA, 20 bp, mouse
gcccgagggctgcggcgcca

SEQ ID NO: 509605 - DNA, 20 bp, mouse
gtccctggcgccgcagccct

SEQ ID NO: 509606 - DNA, 20 bp, mouse
gtcgctgggaagaactaggc

SEQ ID NO: 509607 - DNA, 20 bp, mouse
gaggctggctgagaaacgtc

SEQ ID NO: 509608 - DNA, 20 bp, mouse
gccagcgaagagcggttgtg

SEQ ID NO: 509609 - DNA, 20 bp, mouse
gctcgcttaatcctgaacaa

SEQ ID NO: 509610 - DNA, 20 bp, mouse
gagttcttcccagcgaagag

SEQ ID NO: 509611 - DNA, 20 bp, mouse
ggcttaatcctgaacaatgg

SEQ ID NO: 509612 - DNA, 20 bp, mouse
gagccaggcccccgagactt

SEQ ID NO: 509613 - DNA, 20 bp, mouse
gggcctggctgaaatggagt

SEQ ID NO: 509614 - DNA, 20 bp, mouse
gccctccgtgcgcaataagt

SEQ ID NO: 509615 - DNA, 20 bp, mouse
gcacggagggagatcttcct

SEQ ID NO: 509616 - DNA, 20 bp, mouse
gaggcgaaggacgggaacac

SEQ ID NO: 509617 - DNA, 20 bp, mouse
gctgcaatggcgagaaaagg

SEQ ID NO: 509618 - DNA, 20 bp, mouse
gcgctgacaagtgggagaac

SEQ ID NO: 509619 - DNA, 20 bp, mouse
gggagcgagacgctgagaga

SEQ ID NO: 509620 - DNA, 20 bp, mouse
gcaactgcaatggcgagaaa

SEQ ID NO: 509621 - DNA, 20 bp, mouse
ggttgggactgaagcagccc

SEQ ID NO: 509622 - DNA, 20 bp, mouse
gagccccggcgaaaaccgcg

SEQ ID NO: 509623 - DNA, 20 bp, mouse
gagccacgcggttttcgccg

SEQ ID NO: 509624 - DNA, 20 bp, mouse
gcggcggcgcctgaaggcga

SEQ ID NO: 509625 - DNA, 20 bp, mouse
gaagagccgagcgaagggga

SEQ ID NO: 509626 - DNA, 20 bp, mouse
ggcgcctgcggcccgagtcc

SEQ ID NO: 509627 - DNA, 20 bp, mouse
gtgcaagacagcgtggggta

SEQ ID NO: 509628 - DNA, 20 bp, mouse
gggagctacccacactcacc

SEQ ID NO: 509629 - DNA, 20 bp, mouse
ggggtttgcaagacagcgtg

SEQ ID NO: 509630 - DNA, 20 bp, mouse
gacgggagttcccccggaga

SEQ ID NO: 509631 - DNA, 20 bp, mouse
gggccggacgggagttcccc

SEQ ID NO: 509632 - DNA, 20 bp, mouse
gcccccggagaaggcgcctg

SEQ ID NO: 509633 - DNA, 20 bp, mouse
gcccacactcaccgggactc

SEQ ID NO: 509634 - DNA, 20 bp, mouse
gagccggctgacaccaactc

SEQ ID NO: 509635 - DNA, 20 bp, mouse
gagcgtcgcgagagggacag

SEQ ID NO: 509636 - DNA, 20 bp, mouse
gggctccgcgctaccctggg

SEQ ID NO: 509637 - DNA, 20 bp, mouse
gggtctcccgcggtgagtga

SEQ ID NO: 509638 - DNA, 20 bp, mouse
gcgattggcagggtctcccg

SEQ ID NO: 509639 - DNA, 20 bp, mouse
gtccccgaagaggtccatgg

SEQ ID NO: 509640 - DNA, 20 bp, mouse
gggaggctccgcgctaccct

SEQ ID NO: 509641 - DNA, 20 bp, mouse
ggcggcgccgtcactcaccg

SEQ ID NO: 509642 - DNA, 20 bp, mouse
gaggtccccgaagaggtcca

SEQ ID NO: 509643 - DNA, 20 bp, mouse
ggagccacaggccgagactg

SEQ ID NO: 509644 - DNA, 20 bp, mouse
gccccgcgcgtagcactctg

SEQ ID NO: 509645 - DNA, 20 bp, mouse
gccacaggccgagactgagg

SEQ ID NO: 509646 - DNA, 20 bp, mouse
gacacttgtgcgatcggtga

SEQ ID NO: 509647 - DNA, 20 bp, mouse
gcttttgacacttgtgcgat

SEQ ID NO: 509648 - DNA, 20 bp, mouse
gagagactcttttaaggact

SEQ ID NO: 509649 - DNA, 20 bp, mouse
gtcaggaccatttcctatct

SEQ ID NO: 509650 - DNA, 20 bp, mouse
gatttcctatcttggacttc

SEQ ID NO: 509651 - DNA, 20 bp, mouse
ggtgtcctgaagtccaagat

SEQ ID NO: 509652 - DNA, 20 bp, mouse
ggcttgcaccgggtgttgat

SEQ ID NO: 509653 - DNA, 20 bp, mouse
gaaagtattgcagtcgtagg

SEQ ID NO: 509654 - DNA, 20 bp, mouse
gcttttgctctctcgctaac

SEQ ID NO: 509655 - DNA, 20 bp, mouse
ggttgacgatgtacggctgc

SEQ ID NO: 509656 - DNA, 20 bp, mouse
gaggtgtggcccaggtccgg

SEQ ID NO: 509657 - DNA, 20 bp, mouse
gcgccaggagcaggaaggag

SEQ ID NO: 509658 - DNA, 20 bp, mouse
gttagtactataatctaatc

SEQ ID NO: 509659 - DNA, 20 bp, mouse
gaagcctcccgcagatgcag

SEQ ID NO: 509660 - DNA, 20 bp, mouse
gaggctgcgcgatccgatgg

SEQ ID NO: 509661 - DNA, 20 bp, mouse
gtgcctcatggaaacttctg

SEQ ID NO: 509662 - DNA, 20 bp, mouse
gaggtgcttagggtagaagg

SEQ ID NO: 509663 - DNA, 20 bp, mouse
gctgatgcacaaggtgctta

SEQ ID NO: 509664 - DNA, 20 bp, mouse
gagattggtgggctgaaggt

SEQ ID NO: 509665 - DNA, 20 bp, mouse
ggattatagtactaagattc

SEQ ID NO: 509666 - DNA, 20 bp, mouse
gccctggtccgtctgagtcc

SEQ ID NO: 509667 - DNA, 20 bp, mouse
ggcggtgcgtaaagctggag

SEQ ID NO: 509668 - DNA, 20 bp, mouse
ggaaggacggtacccacctg

SEQ ID NO: 509669 - DNA, 20 bp, mouse
gggagagcgccaactcgcag

SEQ ID NO: 509670 - DNA, 20 bp, mouse
gtgagaacccagggttaggt

SEQ ID NO: 509671 - DNA, 20 bp, mouse
ggccaggactcagacggacc

SEQ ID NO: 509672 - DNA, 20 bp, mouse
gaatcaagaatgccgaagga

SEQ ID NO: 509673 - DNA, 20 bp, mouse
gggcctattgctgaaaagtg

SEQ ID NO: 509674 - DNA, 20 bp, mouse
gggtgtttggggccgcaggt

SEQ ID NO: 509675 - DNA, 20 bp, mouse
gcagtggctggtgagctctt

SEQ ID NO: 509676 - DNA, 20 bp, mouse
gcctaactgagggagacaag

SEQ ID NO: 509677 - DNA, 20 bp, mouse
gaccctgccggggacacaga

SEQ ID NO: 509678 - DNA, 20 bp, mouse
gtgccgcggggacttcccct

SEQ ID NO: 509679 - DNA, 20 bp, mouse
gcctgggttgagctgcgcag

SEQ ID NO: 509680 - DNA, 20 bp, mouse
gagcgggtgcgcggggaatg

SEQ ID NO: 509681 - DNA, 20 bp, mouse
ggttcgggttccctaactga

SEQ ID NO: 509682 - DNA, 20 bp, mouse
gggcggcttggcacgcgggt

SEQ ID NO: 509683 - DNA, 20 bp, mouse
ggacagccgcgcggcctcac

SEQ ID NO: 509684 - DNA, 20 bp, mouse
ggagacaagaggacgaactg

SEQ ID NO: 509685 - DNA, 20 bp, mouse
gagcaacgcccactcgacgg

SEQ ID NO: 509686 - DNA, 20 bp, mouse
gccgcggccgcacgagagga

SEQ ID NO: 509687 - DNA, 20 bp, mouse
ggtggacgcgggaacgaccg

SEQ ID NO: 509688 - DNA, 20 bp, mouse
gagctaggctgtacagacgc

SEQ ID NO: 509689 - DNA, 20 bp, mouse
ggaaccgaggcagtcctcta

SEQ ID NO: 509690 - DNA, 20 bp, mouse
gacgaccgcggccgcacgag

SEQ ID NO: 509691 - DNA, 20 bp, mouse
ggaagcgacagcgctgctgg

SEQ ID NO: 509692 - DNA, 20 bp, mouse
gtgccaacggacaacgtgag

SEQ ID NO: 509693 - DNA, 20 bp, mouse
gcccctagtgcggggaaccg

SEQ ID NO: 509694 - DNA, 20 bp, mouse
gcatgatgcgcacccccccc

SEQ ID NO: 509695 - DNA, 20 bp, mouse
ggcgtggggtctctccgaag

SEQ ID NO: 509696 - DNA, 20 bp, mouse
gcgcaccatgatggagaatg

SEQ ID NO: 509697 - DNA, 20 bp, mouse
gatggagaatgcgggagaaa

SEQ ID NO: 509698 - DNA, 20 bp, mouse
ggtccgcgtgggcccagacg

SEQ ID NO: 509699 - DNA, 20 bp, mouse
ggcgtgtgctgcggcggtac

SEQ ID NO: 509700 - DNA, 20 bp, mouse
gccgcagcacacgcagttcg

SEQ ID NO: 509701 - DNA, 20 bp, mouse
ggcggcggtaccggctgcag

SEQ ID NO: 509702 - DNA, 20 bp, mouse
gccattccgcgtgcgcgcct

SEQ ID NO: 509703 - DNA, 20 bp, mouse
ggaccacgtctgggcccacg

SEQ ID NO: 509704 - DNA, 20 bp, mouse
gcgccagctcgcgcaccgct

SEQ ID NO: 509705 - DNA, 20 bp, mouse
gtaccggctgcagcggcgcg

SEQ ID NO: 509706 - DNA, 20 bp, mouse
ggagcggcgctcatcatggt

SEQ ID NO: 509707 - DNA, 20 bp, mouse
ggaagagttgggactcgtga

SEQ ID NO: 509708 - DNA, 20 bp, mouse
ggagggagcggcgctcatca

SEQ ID NO: 509709 - DNA, 20 bp, mouse
gcagcagcgccagaagagtt

SEQ ID NO: 509710 - DNA, 20 bp, mouse
ggttgggactcgtgagggag

SEQ ID NO: 509711 - DNA, 20 bp, mouse
gaaagaaggggactacggga

SEQ ID NO: 509712 - DNA, 20 bp, mouse
ggcgcaggcgagcctcccga

SEQ ID NO: 509713 - DNA, 20 bp, mouse
gatcgtgacccggaagtcaa

SEQ ID NO: 509714 - DNA, 20 bp, mouse
gctgtaccgcaaagcccggg

SEQ ID NO: 509715 - DNA, 20 bp, mouse
gtaccgcaaagcccgggagg

SEQ ID NO: 509716 - DNA, 20 bp, mouse
gctcaaccgccggcgtccga

SEQ ID NO: 509717 - DNA, 20 bp, mouse
gaagccctcagggctctaca

SEQ ID NO: 509718 - DNA, 20 bp, mouse
ggagcaatccccgttacctc

SEQ ID NO: 509719 - DNA, 20 bp, mouse
gaggcggtcctcgatctctg

SEQ ID NO: 509720 - DNA, 20 bp, mouse
gggcggttgagcatcgatcg

SEQ ID NO: 509721 - DNA, 20 bp, mouse
gccgagccctcggacgccgg

SEQ ID NO: 509722 - DNA, 20 bp, mouse
gagccgaagaaccgagccct

SEQ ID NO: 509723 - DNA, 20 bp, mouse
gtatagcgttagctcatcag

SEQ ID NO: 509724 - DNA, 20 bp, mouse
gggttcttcggctcttccgg

SEQ ID NO: 509725 - DNA, 20 bp, mouse
gttgccgtgtagagccctga

SEQ ID NO: 509726 - DNA, 20 bp, mouse
gtggccgccgccagcaccgg

SEQ ID NO: 509727 - DNA, 20 bp, mouse
gacgcgcgctggaggacgca

SEQ ID NO: 509728 - DNA, 20 bp, mouse
ggacgcacggcttggcggga

SEQ ID NO: 509729 - DNA, 20 bp, mouse
gcgctggaggacgcacggct

SEQ ID NO: 509730 - DNA, 20 bp, mouse
gctgctgcaacgcgcgctgg

SEQ ID NO: 509731 - DNA, 20 bp, mouse
gtgggacgagtgcttcgagg

SEQ ID NO: 509732 - DNA, 20 bp, mouse
gtggaggacgcacggcttgg

SEQ ID NO: 509733 - DNA, 20 bp, mouse
ggctcgaggcgcgcctactt

SEQ ID NO: 509734 - DNA, 20 bp, mouse
ggcgggacaagtgagtgcgg

SEQ ID NO: 509735 - DNA, 20 bp, mouse
gggacccgggctcccactcg

SEQ ID NO: 509736 - DNA, 20 bp, mouse
gcaaatccgaaagagacgac

SEQ ID NO: 509737 - DNA, 20 bp, mouse
ggataaccactgataagtag

SEQ ID NO: 509738 - DNA, 20 bp, mouse
gtcgcagatcctgagcacca

SEQ ID NO: 509739 - DNA, 20 bp, mouse
ggaacagccagaggcaggta

SEQ ID NO: 509740 - DNA, 20 bp, mouse
gccatggctgaagaggaagt

SEQ ID NO: 509741 - DNA, 20 bp, mouse
gctcttcagccatggtgctc

SEQ ID NO: 509742 - DNA, 20 bp, mouse
gggcaggtaaggtcccagca

SEQ ID NO: 509743 - DNA, 20 bp, mouse
gcttatcagtggttatcctg

SEQ ID NO: 509744 - DNA, 20 bp, mouse
gggatttgggcatttggagc

SEQ ID NO: 509745 - DNA, 20 bp, mouse
gctgggaccttacctgcctc

SEQ ID NO: 509746 - DNA, 20 bp, mouse
gggtcggccgggaggtgaaa

SEQ ID NO: 509747 - DNA, 20 bp, mouse
gggagcaagagtgtatatcc

SEQ ID NO: 509748 - DNA, 20 bp, mouse
gccgaggtggcgtccgacgg

SEQ ID NO: 509749 - DNA, 20 bp, mouse
gaagagtgtatatccgggtt

SEQ ID NO: 509750 - DNA, 20 bp, mouse
ggccgatcggccttccgcgt

SEQ ID NO: 509751 - DNA, 20 bp, mouse
ggcctacgcggaaggccgat

SEQ ID NO: 509752 - DNA, 20 bp, mouse
ggtatatccgggttaggaga

SEQ ID NO: 509753 - DNA, 20 bp, mouse
ggaagcgggcgcctttgtag

SEQ ID NO: 509754 - DNA, 20 bp, mouse
gggagagggaaggagcggag

SEQ ID NO: 509755 - DNA, 20 bp, mouse
gccgatgataagatgaccag

SEQ ID NO: 509756 - DNA, 20 bp, mouse
gggcggcggcgtgctcaccc

SEQ ID NO: 509757 - DNA, 20 bp, mouse
gcccgcgcgggtgtttatgt

SEQ ID NO: 509758 - DNA, 20 bp, mouse
gcggcgtgctcacccaggta

SEQ ID NO: 509759 - DNA, 20 bp, mouse
gtaggtgaggccatccgcgt

SEQ ID NO: 509760 - DNA, 20 bp, mouse
ggccgagattgcccctacct

SEQ ID NO: 509761 - DNA, 20 bp, mouse
gccaagaatagagagggacg

SEQ ID NO: 509762 - DNA, 20 bp, mouse
gctgctgctgacgcgcaccg

SEQ ID NO: 509763 - DNA, 20 bp, mouse
gaatctcggcgcttacttgt

SEQ ID NO: 509764 - DNA, 20 bp, mouse
gggatggccaagacacccag

SEQ ID NO: 509765 - DNA, 20 bp, mouse
gggtagtccgccatgctgct

SEQ ID NO: 509766 - DNA, 20 bp, mouse
gcggttcgggagcctccacg

SEQ ID NO: 509767 - DNA, 20 bp, mouse
gaggccgcagctctaggcgg

SEQ ID NO: 509768 - DNA, 20 bp, mouse
gatgcggaggccgcagctct

SEQ ID NO: 509769 - DNA, 20 bp, mouse
ggaggctcccgaaccggcgt

SEQ ID NO: 509770 - DNA, 20 bp, mouse
gcgggagcctccacgcggag

SEQ ID NO: 509771 - DNA, 20 bp, mouse
gcgggagcctctccgcgtgg

SEQ ID NO: 509772 - DNA, 20 bp, mouse
gctcccgccgcctagagctg

SEQ ID NO: 509773 - DNA, 20 bp, mouse
ggttcctccatgccatgcgg

SEQ ID NO: 509774 - DNA, 20 bp, mouse
gagcagcccggactccggtg

SEQ ID NO: 509775 - DNA, 20 bp, mouse
gcggcctccgcatggcatgg

SEQ ID NO: 509776 - DNA, 20 bp, mouse
gtatattggcgcggtccgga

SEQ ID NO: 509777 - DNA, 20 bp, mouse
ggggtctagggcacccatcg

SEQ ID NO: 509778 - DNA, 20 bp, mouse
ggagaaggccggatgaggga

SEQ ID NO: 509779 - DNA, 20 bp, mouse
ggccctagacccgcacttgt

SEQ ID NO: 509780 - DNA, 20 bp, mouse
gtggcgagaaggccggatga

SEQ ID NO: 509781 - DNA, 20 bp, mouse
gacctacaagtgcgggtcta

SEQ ID NO: 509782 - DNA, 20 bp, mouse
gcccatcggggcgaggcgag

SEQ ID NO: 509783 - DNA, 20 bp, mouse
ggcaggggcaggggtttaga

SEQ ID NO: 509784 - DNA, 20 bp, mouse
gcgcacgctggcgagaaggc

SEQ ID NO: 509785 - DNA, 20 bp, mouse
gcggcctcacctacaagtgc

SEQ ID NO: 509786 - DNA, 20 bp, mouse
gaccttcatagggtaaacca

SEQ ID NO: 509787 - DNA, 20 bp, mouse
gttcatagggtaaaccaggg

SEQ ID NO: 509788 - DNA, 20 bp, mouse
gtgagtacagacgacctccc

SEQ ID NO: 509789 - DNA, 20 bp, mouse
ggaggtcgtctgtactcagc

SEQ ID NO: 509790 - DNA, 20 bp, mouse
gcgagaattagcaccttcat

SEQ ID NO: 509791 - DNA, 20 bp, mouse
ggaccagccagagtaactta

SEQ ID NO: 509792 - DNA, 20 bp, mouse
gcttagggagaccctatctc

SEQ ID NO: 509793 - DNA, 20 bp, mouse
gatgaaaaacaatcaaatcc

SEQ ID NO: 509794 - DNA, 20 bp, mouse
gagttgtacggcatttatat

SEQ ID NO: 509795 - DNA, 20 bp, mouse
gtctgtactcagccggcacc

SEQ ID NO: 509796 - DNA, 20 bp, mouse
gaaaccagagcttctcggaa

SEQ ID NO: 509797 - DNA, 20 bp, mouse
gctgtggggaggatgtctct

SEQ ID NO: 509798 - DNA, 20 bp, mouse
gtatttacgctaactgacaa

SEQ ID NO: 509799 - DNA, 20 bp, mouse
gaaagtttatgcctgggagt

SEQ ID NO: 509800 - DNA, 20 bp, mouse
gaatcatgggagatattcta

SEQ ID NO: 509801 - DNA, 20 bp, mouse
gtgacttaatagggacacta

SEQ ID NO: 509802 - DNA, 20 bp, mouse
gataacagcaaccacatcaa

SEQ ID NO: 509803 - DNA, 20 bp, mouse
gcagatgacaaaatcctcaa

SEQ ID NO: 509804 - DNA, 20 bp, mouse
gattacctgaggctgataca

SEQ ID NO: 509805 - DNA, 20 bp, mouse
ggaagggaaacctaaatcat

SEQ ID NO: 509806 - DNA, 20 bp, mouse
gtggcgaggacgcgaaggtg

SEQ ID NO: 509807 - DNA, 20 bp, mouse
ggcgcacccggccccgaccc

SEQ ID NO: 509808 - DNA, 20 bp, mouse
gggacctggcgaggacgcga

SEQ ID NO: 509809 - DNA, 20 bp, mouse
ggctgcggcgggacctggcg

SEQ ID NO: 509810 - DNA, 20 bp, mouse
gggcaccatgagcttcggat

SEQ ID NO: 509811 - DNA, 20 bp, mouse
gaggacgcgaaggtgcggca

SEQ ID NO: 509812 - DNA, 20 bp, mouse
gcgcagcaatgtggcctcca

SEQ ID NO: 509813 - DNA, 20 bp, mouse
gaggcccaggccgagggacg

SEQ ID NO: 509814 - DNA, 20 bp, mouse
gtgctccgatccgaagctca

SEQ ID NO: 509815 - DNA, 20 bp, mouse
ggcgaaggtgcggcaaggct

SEQ ID NO: 509816 - DNA, 20 bp, mouse
ggtacttccgccaggtgagg

SEQ ID NO: 509817 - DNA, 20 bp, mouse
gggacggcctcctcacctgg

SEQ ID NO: 509818 - DNA, 20 bp, mouse
ggctgtacttccgccaggtg

SEQ ID NO: 509819 - DNA, 20 bp, mouse
gacctgatcgggcgacggcg

SEQ ID NO: 509820 - DNA, 20 bp, mouse
gccgcgagcgttacctgatc

SEQ ID NO: 509821 - DNA, 20 bp, mouse
gcacggacggcctcctcacc

SEQ ID NO: 509822 - DNA, 20 bp, mouse
ggatcgggcgacggcggggt

SEQ ID NO: 509823 - DNA, 20 bp, mouse
ggcgttacctgatcgggcga

SEQ ID NO: 509824 - DNA, 20 bp, mouse
gcagcagctgtacttccgcc

SEQ ID NO: 509825 - DNA, 20 bp, mouse
gcagctcgcaggcctagcgg

SEQ ID NO: 509826 - DNA, 20 bp, mouse
gagttctggaacctcaggtc

SEQ ID NO: 509827 - DNA, 20 bp, mouse
gaagcgagttctggaacctc

SEQ ID NO: 509828 - DNA, 20 bp, mouse
gggggcgaccgggctcacta

SEQ ID NO: 509829 - DNA, 20 bp, mouse
gcatttggccccatcacctg

SEQ ID NO: 509830 - DNA, 20 bp, mouse
gtcaggcgagccaggcaagt

SEQ ID NO: 509831 - DNA, 20 bp, mouse
gaacctcaggtcgggcagga

SEQ ID NO: 509832 - DNA, 20 bp, mouse
ggcaactgcgaagcgagttc

SEQ ID NO: 509833 - DNA, 20 bp, mouse
gcaggctcaggtggcctctt

SEQ ID NO: 509834 - DNA, 20 bp, mouse
gaaccaggctggacaggcag

SEQ ID NO: 509835 - DNA, 20 bp, mouse
gagcgtccgtgcggctatgt

SEQ ID NO: 509836 - DNA, 20 bp, mouse
gccgcaggcgaggacctacc

SEQ ID NO: 509837 - DNA, 20 bp, mouse
ggcttcccgccacgccggac

SEQ ID NO: 509838 - DNA, 20 bp, mouse
ggagtccagccggtccggcg

SEQ ID NO: 509839 - DNA, 20 bp, mouse
gtggcgggaagcttaatctg

SEQ ID NO: 509840 - DNA, 20 bp, mouse
gcccatcctgggaagcgaag

SEQ ID NO: 509841 - DNA, 20 bp, mouse
gagtaccgcgagctcgccgc

SEQ ID NO: 509842 - DNA, 20 bp, mouse
ggcgaagaggccgggaccag

SEQ ID NO: 509843 - DNA, 20 bp, mouse
gccgccgggtgagtgagaac

SEQ ID NO: 509844 - DNA, 20 bp, mouse
gactgggagtccagccggtc

SEQ ID NO: 509845 - DNA, 20 bp, mouse
ggcggtactgggagtccagc

SEQ ID NO: 509846 - DNA, 20 bp, mouse
gcccggcgccggagcgtctg

SEQ ID NO: 509847 - DNA, 20 bp, mouse
gcccgcagccccagacgctc

SEQ ID NO: 509848 - DNA, 20 bp, mouse
gcgagcgcggttagactgtg

SEQ ID NO: 509849 - DNA, 20 bp, mouse
gtgggggtacagccgagaga

SEQ ID NO: 509850 - DNA, 20 bp, mouse
gagcactctgcaccatctct

SEQ ID NO: 509851 - DNA, 20 bp, mouse
gccgaagccgcggacttacc

SEQ ID NO: 509852 - DNA, 20 bp, mouse
ggccggagcgtctggggctg

SEQ ID NO: 509853 - DNA, 20 bp, mouse
gaccaaggtggccaagaacc

SEQ ID NO: 509854 - DNA, 20 bp, mouse
gcgctcttggccctcgacta

SEQ ID NO: 509855 - DNA, 20 bp, mouse
gccgcctccgggatagcaca

SEQ ID NO: 509856 - DNA, 20 bp, mouse
gggcagggagaagccactac

SEQ ID NO: 509857 - DNA, 20 bp, mouse
gcttctccctgccaacacgt

SEQ ID NO: 509858 - DNA, 20 bp, mouse
gggccttccactttagttgt

SEQ ID NO: 509859 - DNA, 20 bp, mouse
gctcccacaactaaagtgga

SEQ ID NO: 509860 - DNA, 20 bp, mouse
gactactcccacaactaaag

SEQ ID NO: 509861 - DNA, 20 bp, mouse
gccaactcagtccagaatca

SEQ ID NO: 509862 - DNA, 20 bp, mouse
gtgctgcccacgtgttggca

SEQ ID NO: 509863 - DNA, 20 bp, mouse
gcctcccctaccaggtacag

SEQ ID NO: 509864 - DNA, 20 bp, mouse
gggagtagtagtgttttggg

SEQ ID NO: 509865 - DNA, 20 bp, mouse
gagctggagagtggtggggt

SEQ ID NO: 509866 - DNA, 20 bp, mouse
gtccggctgcgaggctatgg

SEQ ID NO: 509867 - DNA, 20 bp, mouse
gggctgcgaggctatggcgg

SEQ ID NO: 509868 - DNA, 20 bp, mouse
gaagcgatcagaggctcccg

SEQ ID NO: 509869 - DNA, 20 bp, mouse
gtctctgctctggctccccg

SEQ ID NO: 509870 - DNA, 20 bp, mouse
gtagcctcgcagccggaaag

SEQ ID NO: 509871 - DNA, 20 bp, mouse
gcgtaggctggagtggatcg

SEQ ID NO: 509872 - DNA, 20 bp, mouse
gtacatctgaagcactaagg

SEQ ID NO: 509873 - DNA, 20 bp, mouse
gccttgctcagaactactgt

SEQ ID NO: 509874 - DNA, 20 bp, mouse
gaaggcggccgtcaaaaact

SEQ ID NO: 509875 - DNA, 20 bp, mouse
gtatggcggcggtggcctcc

SEQ ID NO: 509876 - DNA, 20 bp, mouse
gtttccacgttggacaagtg

SEQ ID NO: 509877 - DNA, 20 bp, mouse
gttggacaagtgcggcgagg

SEQ ID NO: 509878 - DNA, 20 bp, mouse
gacgttggacaagtgcggcg

SEQ ID NO: 509879 - DNA, 20 bp, mouse
ggagagagcggggccggctg

SEQ ID NO: 509880 - DNA, 20 bp, mouse
ggaatcgccggggacctccg

SEQ ID NO: 509881 - DNA, 20 bp, mouse
ggtgcaggccccctcccggg

SEQ ID NO: 509882 - DNA, 20 bp, mouse
gctctctccgctctccacgc

SEQ ID NO: 509883 - DNA, 20 bp, mouse
gcgcccacccgccaccagcg

SEQ ID NO: 509884 - DNA, 20 bp, mouse
gccgttggcaggactcaaca

SEQ ID NO: 509885 - DNA, 20 bp, mouse
ggcgcgcacacacccaaaga

SEQ ID NO: 509886 - DNA, 20 bp, mouse
ggagactccgacaggcacgg

SEQ ID NO: 509887 - DNA, 20 bp, mouse
gggcacggaggctgatagag

SEQ ID NO: 509888 - DNA, 20 bp, mouse
gggctgatagagaggcgaga

SEQ ID NO: 509889 - DNA, 20 bp, mouse
ggaggcgagagggtagcgag

SEQ ID NO: 509890 - DNA, 20 bp, mouse
ggactccccagacactaccg

SEQ ID NO: 509891 - DNA, 20 bp, mouse
gcccgcggtaacaagcccag

SEQ ID NO: 509892 - DNA, 20 bp, mouse
gagtcctgtgagactccgac

SEQ ID NO: 509893 - DNA, 20 bp, mouse
gtgtgagactccgacaggca

SEQ ID NO: 509894 - DNA, 20 bp, mouse
gacacggccgccgctcgaga

SEQ ID NO: 509895 - DNA, 20 bp, mouse
gtggcggcggcaggatgtta

SEQ ID NO: 509896 - DNA, 20 bp, mouse
ggagcgggtgctgctagcgg

SEQ ID NO: 509897 - DNA, 20 bp, mouse
ggtcgagcgggtgctgctag

SEQ ID NO: 509898 - DNA, 20 bp, mouse
gattggaagggacaaaactc

SEQ ID NO: 509899 - DNA, 20 bp, mouse
gcggggacgaacgggtccag

SEQ ID NO: 509900 - DNA, 20 bp, mouse
ggctagcggaggcgccatat

SEQ ID NO: 509901 - DNA, 20 bp, mouse
ggcggaggcgccatattgga

SEQ ID NO: 509902 - DNA, 20 bp, mouse
gagcagcacccgctcgactc

SEQ ID NO: 509903 - DNA, 20 bp, mouse
gagcggtcccgtaggtccat

SEQ ID NO: 509904 - DNA, 20 bp, mouse
gtgactgttgcggggacgaa

SEQ ID NO: 509905 - DNA, 20 bp, mouse
gcagcttccgatggacctac

SEQ ID NO: 509906 - DNA, 20 bp, mouse
gaagagccaactggagaagg

SEQ ID NO: 509907 - DNA, 20 bp, mouse
gcaagatctggacgagggaa

SEQ ID NO: 509908 - DNA, 20 bp, mouse
ggaccctctacaccactcta

SEQ ID NO: 509909 - DNA, 20 bp, mouse
gatggctgctgggatgtatt

SEQ ID NO: 509910 - DNA, 20 bp, mouse
gctggacagtaagagccaac

SEQ ID NO: 509911 - DNA, 20 bp, mouse
gagaggcctcgctcaagatc

SEQ ID NO: 509912 - DNA, 20 bp, mouse
gcatgacccccttctccagt

SEQ ID NO: 509913 - DNA, 20 bp, mouse
gatgtatttggaacattatc

SEQ ID NO: 509914 - DNA, 20 bp, mouse
ggggctgctccgtgggatca

SEQ ID NO: 509915 - DNA, 20 bp, mouse
gagtcacttccggggaagat

SEQ ID NO: 509916 - DNA, 20 bp, mouse
gagatagtgctccaagtaca

SEQ ID NO: 509917 - DNA, 20 bp, mouse
gcggaaggagaccccctcac

SEQ ID NO: 509918 - DNA, 20 bp, mouse
ggtcagccaggagaaaccac

SEQ ID NO: 509919 - DNA, 20 bp, mouse
gcagaccccgagcgtggccg

SEQ ID NO: 509920 - DNA, 20 bp, mouse
ggggcggggccgcagatgga

SEQ ID NO: 509921 - DNA, 20 bp, mouse
ggcagtcgccatcttcgcct

SEQ ID NO: 509922 - DNA, 20 bp, mouse
gagtgggcggggcaactcag

SEQ ID NO: 509923 - DNA, 20 bp, mouse
gttcgcctcggccacgctcg

SEQ ID NO: 509924 - DNA, 20 bp, mouse
gatctggacagtaagcactc

SEQ ID NO: 509925 - DNA, 20 bp, mouse
gctgatcatggggactgtgg

SEQ ID NO: 509926 - DNA, 20 bp, mouse
gcatcagggcaagtgaacta

SEQ ID NO: 509927 - DNA, 20 bp, mouse
gcagctgtccacatcccgta

SEQ ID NO: 509928 - DNA, 20 bp, mouse
gaaggagcagcagagaccgc

SEQ ID NO: 509929 - DNA, 20 bp, mouse
ggtgaactatggtgagccag

SEQ ID NO: 509930 - DNA, 20 bp, mouse
gccgtagggtcaacagcaaa

SEQ ID NO: 509931 - DNA, 20 bp, mouse
ggggatgtggacagctgcca

SEQ ID NO: 509932 - DNA, 20 bp, mouse
gcacaggacctctgaaccag

SEQ ID NO: 509933 - DNA, 20 bp, mouse
gaggacctctgaaccagagg

SEQ ID NO: 509934 - DNA, 20 bp, mouse
gagggcacagggcagcgtgt

SEQ ID NO: 509935 - DNA, 20 bp, mouse
gtagccggtacctacttcat

SEQ ID NO: 509936 - DNA, 20 bp, mouse
ggccggctgacaaaacagaa

SEQ ID NO: 509937 - DNA, 20 bp, mouse
ggacctcatgagacaagagc

SEQ ID NO: 509938 - DNA, 20 bp, mouse
gaaaacagaagggacccgaa

SEQ ID NO: 509939 - DNA, 20 bp, mouse
gcagtgccaataccatgaag

SEQ ID NO: 509940 - DNA, 20 bp, mouse
gctgtctgaattcctcttca

SEQ ID NO: 509941 - DNA, 20 bp, mouse
ggaattcctcttcatggtat

SEQ ID NO: 509942 - DNA, 20 bp, mouse
gtagttgtacactcacacat

SEQ ID NO: 509943 - DNA, 20 bp, mouse
gaactttttggcacctccat

SEQ ID NO: 509944 - DNA, 20 bp, mouse
gttatccaaatgctactatt

SEQ ID NO: 509945 - DNA, 20 bp, mouse
gcaatttacaatgcctatgg

SEQ ID NO: 509946 - DNA, 20 bp, mouse
gcgcacatacggagattgtg

SEQ ID NO: 509947 - DNA, 20 bp, mouse
gcgcgcgttgagatagacgt

SEQ ID NO: 509948 - DNA, 20 bp, mouse
gggcaaagcgaagaactcct

SEQ ID NO: 509949 - DNA, 20 bp, mouse
gggccggggagagagcgagt

SEQ ID NO: 509950 - DNA, 20 bp, mouse
ggccagggcactcgattctg

SEQ ID NO: 509951 - DNA, 20 bp, mouse
gctcaacgcgcgcgcacata

SEQ ID NO: 509952 - DNA, 20 bp, mouse
gccctggctcgcgctcccac

SEQ ID NO: 509953 - DNA, 20 bp, mouse
gccccgggcgccgcatccac

SEQ ID NO: 509954 - DNA, 20 bp, mouse
gggagagagcgagtcggcgg

SEQ ID NO: 509955 - DNA, 20 bp, mouse
gcggggagagagcgagtcgg

SEQ ID NO: 509956 - DNA, 20 bp, mouse
gcctgggcaccagggaccct

SEQ ID NO: 509957 - DNA, 20 bp, mouse
gaaggagtcatgccagtcgg

SEQ ID NO: 509958 - DNA, 20 bp, mouse
gttcagggtctcaacgggag

SEQ ID NO: 509959 - DNA, 20 bp, mouse
gcctatattcagggtctcaa

SEQ ID NO: 509960 - DNA, 20 bp, mouse
gagtcggccagtgtccagag

SEQ ID NO: 509961 - DNA, 20 bp, mouse
gtggctctccaggtcaaaga

SEQ ID NO: 509962 - DNA, 20 bp, mouse
gggtcagtcacattcctccc

SEQ ID NO: 509963 - DNA, 20 bp, mouse
gacactggccgactgagtat

SEQ ID NO: 509964 - DNA, 20 bp, mouse
ggacccaaagcctatattca

SEQ ID NO: 509965 - DNA, 20 bp, mouse
gacattcctcccagggtccc

SEQ ID NO: 509966 - DNA, 20 bp, mouse
ggagagtagatcgcctggtg

SEQ ID NO: 509967 - DNA, 20 bp, mouse
gcctcaatagcctaggactc

SEQ ID NO: 509968 - DNA, 20 bp, mouse
gtacttgtcctcaatagcct

SEQ ID NO: 509969 - DNA, 20 bp, mouse
gagactgagagtagatcgcc

SEQ ID NO: 509970 - DNA, 20 bp, mouse
gtcctgtgggggcccaacac

SEQ ID NO: 509971 - DNA, 20 bp, mouse
gctcagtcttcctgagtcct

SEQ ID NO: 509972 - DNA, 20 bp, mouse
gttggtctgctctttgtcaa

SEQ ID NO: 509973 - DNA, 20 bp, mouse
gtgctttgagaacctcgaat

SEQ ID NO: 509974 - DNA, 20 bp, mouse
gctctggctaatactgctgt

SEQ ID NO: 509975 - DNA, 20 bp, mouse
ggcttcatgctccaggtaga

SEQ ID NO: 509976 - DNA, 20 bp, mouse
gggcgcgcccacgcagaacc

SEQ ID NO: 509977 - DNA, 20 bp, mouse
gcggtcgcagccgtgcaggg

SEQ ID NO: 509978 - DNA, 20 bp, mouse
gctctcgccgggttctgcgt

SEQ ID NO: 509979 - DNA, 20 bp, mouse
ggtgggcgcgcccccctgca

SEQ ID NO: 509980 - DNA, 20 bp, mouse
gactggtgacgccaagagaa

SEQ ID NO: 509981 - DNA, 20 bp, mouse
gcggcgggaaggttgtagcg

SEQ ID NO: 509982 - DNA, 20 bp, mouse
ggcattgctgcactctcgcc

SEQ ID NO: 509983 - DNA, 20 bp, mouse
ggtccggtcgcagccgtgca

SEQ ID NO: 509984 - DNA, 20 bp, mouse
gcggggtgggcgaaacccaa

SEQ ID NO: 509985 - DNA, 20 bp, mouse
gcggacagcgagctttctcc

SEQ ID NO: 509986 - DNA, 20 bp, mouse
ggtgggctggctagaatgga

SEQ ID NO: 509987 - DNA, 20 bp, mouse
gtggagggcaaggtatacat

SEQ ID NO: 509988 - DNA, 20 bp, mouse
gagggcaaggtatacatagg

SEQ ID NO: 509989 - DNA, 20 bp, mouse
gaggagtgagcattcagtag

SEQ ID NO: 509990 - DNA, 20 bp, mouse
gccagagtggaagctgtagt

SEQ ID NO: 509991 - DNA, 20 bp, mouse
ggagtggaagctgtagtagg

SEQ ID NO: 509992 - DNA, 20 bp, mouse
ggaagctgtagtaggtggtc

SEQ ID NO: 509993 - DNA, 20 bp, mouse
gtgtagagaaggtctggtag

SEQ ID NO: 509994 - DNA, 20 bp, mouse
ggagtggctgaggtctccct

SEQ ID NO: 509995 - DNA, 20 bp, mouse
ggaccttctctacaggtgag

SEQ ID NO: 509996 - DNA, 20 bp, mouse
gggagcggagcagggacacg

SEQ ID NO: 509997 - DNA, 20 bp, mouse
gtcctgggaccccaagatgg

SEQ ID NO: 509998 - DNA, 20 bp, mouse
ggcagggacacggggagcca

SEQ ID NO: 509999 - DNA, 20 bp, mouse
gggtgaggttgagaagacgt

SEQ ID NO: 510000 - DNA, 20 bp, mouse
gtcctctcagtgagtgaaag

SEQ ID NO: 510001 - DNA, 20 bp, mouse
ggacacggggagccatggcg

SEQ ID NO: 510002 - DNA, 20 bp, mouse
gtcactgagaggagcggagc

SEQ ID NO: 510003 - DNA, 20 bp, mouse
gcgaagcgcggctccacagt

SEQ ID NO: 510004 - DNA, 20 bp, mouse
gacggggagccatggcgggg

SEQ ID NO: 510005 - DNA, 20 bp, mouse
gagccgcgcttcgctctcgg

SEQ ID NO: 510006 - DNA, 20 bp, mouse
gcggcgcgggagcacatctg

SEQ ID NO: 510007 - DNA, 20 bp, mouse
ggccgccacagcttgctcat

SEQ ID NO: 510008 - DNA, 20 bp, mouse
gtgctcatggggtcctgcaa

SEQ ID NO: 510009 - DNA, 20 bp, mouse
ggggtctgcccgccacaggt

SEQ ID NO: 510010 - DNA, 20 bp, mouse
gtggtaacagctaataacgt

SEQ ID NO: 510011 - DNA, 20 bp, mouse
gcggggcggaaaaggcatgt

SEQ ID NO: 510012 - DNA, 20 bp, mouse
gagcacatctggggctatgg

SEQ ID NO: 510013 - DNA, 20 bp, mouse
ggagcaagctgtggcggcgc

SEQ ID NO: 510014 - DNA, 20 bp, mouse
ggaggggatcggccaaaaag

SEQ ID NO: 510015 - DNA, 20 bp, mouse
gccgcgcttacctggctcgg

SEQ ID NO: 510016 - DNA, 20 bp, mouse
gctgactgcgggcagaatgg

SEQ ID NO: 510017 - DNA, 20 bp, mouse
gctcgccttggaaggggtgg

SEQ ID NO: 510018 - DNA, 20 bp, mouse
gggatctgcaggctgactgc

SEQ ID NO: 510019 - DNA, 20 bp, mouse
gtagaagtggcagccacgat

SEQ ID NO: 510020 - DNA, 20 bp, mouse
gcatcgagccggaagttctc

SEQ ID NO: 510021 - DNA, 20 bp, mouse
gcctgcccccaccccttcca

SEQ ID NO: 510022 - DNA, 20 bp, mouse
gtctcgggctcgccttggaa

SEQ ID NO: 510023 - DNA, 20 bp, mouse
ggcgcatgcgcaggcccgag

SEQ ID NO: 510024 - DNA, 20 bp, mouse
ggagtttccgagcatcaaca

SEQ ID NO: 510025 - DNA, 20 bp, mouse
gaggcgagcccgagaacttc

SEQ ID NO: 510026 - DNA, 20 bp, mouse
gacatccccgggctcccgta

SEQ ID NO: 510027 - DNA, 20 bp, mouse
gcggcgagcgcgcttacgtg

SEQ ID NO: 510028 - DNA, 20 bp, mouse
gtgggccgcgtaggcagggc

SEQ ID NO: 510029 - DNA, 20 bp, mouse
ggcgtgggccggcgaatccc

SEQ ID NO: 510030 - DNA, 20 bp, mouse
gccgcgggcggagaatgaaa

SEQ ID NO: 510031 - DNA, 20 bp, mouse
ggggctgggccgcgtaggca

SEQ ID NO: 510032 - DNA, 20 bp, mouse
gtgcccgcctgcactagaag

SEQ ID NO: 510033 - DNA, 20 bp, mouse
gaggcccggcccacatcccc

SEQ ID NO: 510034 - DNA, 20 bp, mouse
gtccccgggctcccgtaggg

SEQ ID NO: 510035 - DNA, 20 bp, mouse
gctaggctgacagatcagag

SEQ ID NO: 510036 - DNA, 20 bp, mouse
gccgccagggagaaacgccc

SEQ ID NO: 510037 - DNA, 20 bp, mouse
gccggaagtggaggtgtgag

SEQ ID NO: 510038 - DNA, 20 bp, mouse
ggtagcgggactctactccg

SEQ ID NO: 510039 - DNA, 20 bp, mouse
gtgagaggccgggcggactt

SEQ ID NO: 510040 - DNA, 20 bp, mouse
gagtggaggtgtgagaggcc

SEQ ID NO: 510041 - DNA, 20 bp, mouse
gggaggtgtgagaggccggg

SEQ ID NO: 510042 - DNA, 20 bp, mouse
ggcaaagtctccggaagtgg

SEQ ID NO: 510043 - DNA, 20 bp, mouse
gctccctggcgggtcatgaa

SEQ ID NO: 510044 - DNA, 20 bp, mouse
gtggagtgtgaggcctaact

SEQ ID NO: 510045 - DNA, 20 bp, mouse
ggtccgttcatgacccgcca

SEQ ID NO: 510046 - DNA, 20 bp, mouse
ggacgctggacaccggggag

SEQ ID NO: 510047 - DNA, 20 bp, mouse
gaggtggagacgctggacac

SEQ ID NO: 510048 - DNA, 20 bp, mouse
gcaacctagaggctagtggt

SEQ ID NO: 510049 - DNA, 20 bp, mouse
gcccagagaaacggaagagg

SEQ ID NO: 510050 - DNA, 20 bp, mouse
ggggctctgcatcctcgctt

SEQ ID NO: 510051 - DNA, 20 bp, mouse
ggcccgaaccccgaaccgag

SEQ ID NO: 510052 - DNA, 20 bp, mouse
gcaagccgccaggaaaacac

SEQ ID NO: 510053 - DNA, 20 bp, mouse
gaaaggctgtatcctccttg

SEQ ID NO: 510054 - DNA, 20 bp, mouse
ggccgccaggaaaacaccgg

SEQ ID NO: 510055 - DNA, 20 bp, mouse
ggcagaggcccaggttccac

SEQ ID NO: 510056 - DNA, 20 bp, mouse
ggtgttctgagagaaggcgg

SEQ ID NO: 510057 - DNA, 20 bp, mouse
ggaaggcggtggcaggattc

SEQ ID NO: 510058 - DNA, 20 bp, mouse
ggattcgggctgcgcgggga

SEQ ID NO: 510059 - DNA, 20 bp, mouse
gtgcgctgtgttctgagaga

SEQ ID NO: 510060 - DNA, 20 bp, mouse
gaagcccggcacaccggacc

SEQ ID NO: 510061 - DNA, 20 bp, mouse
gggtctggggtggacgccac

SEQ ID NO: 510062 - DNA, 20 bp, mouse
gcgggctgcgcggggacggc

SEQ ID NO: 510063 - DNA, 20 bp, mouse
gtctgagagaaggcggtggc

SEQ ID NO: 510064 - DNA, 20 bp, mouse
gtttcctggccgcctcactc

SEQ ID NO: 510065 - DNA, 20 bp, mouse
gggcgggttcgggtctgggg

SEQ ID NO: 510066 - DNA, 20 bp, mouse
ggagtagggggcgatagcag

SEQ ID NO: 510067 - DNA, 20 bp, mouse
gtcttgcagaggctgagtag

SEQ ID NO: 510068 - DNA, 20 bp, mouse
ggacgtggcgacagtgccag

SEQ ID NO: 510069 - DNA, 20 bp, mouse
gggcgaggagcaacttctcc

SEQ ID NO: 510070 - DNA, 20 bp, mouse
ggctccccgctccctgctct

SEQ ID NO: 510071 - DNA, 20 bp, mouse
gtgaggatgggtgaatccat

SEQ ID NO: 510072 - DNA, 20 bp, mouse
gaggatgttacctcttgcag

SEQ ID NO: 510073 - DNA, 20 bp, mouse
gtgggcgcacacgctttcac

SEQ ID NO: 510074 - DNA, 20 bp, mouse
gcgcatcggacagttcaggg

SEQ ID NO: 510075 - DNA, 20 bp, mouse
gacagtaatcagggtcacag

SEQ ID NO: 510076 - DNA, 20 bp, mouse
gtcgccgccgcgcctcacag

SEQ ID NO: 510077 - DNA, 20 bp, mouse
gcgcgggccgctgtgaggcg

SEQ ID NO: 510078 - DNA, 20 bp, mouse
ggcggctgcgggaactttcc

SEQ ID NO: 510079 - DNA, 20 bp, mouse
gttgtcccagccggagtcgg

SEQ ID NO: 510080 - DNA, 20 bp, mouse
ggctgcgggaactttcccgg

SEQ ID NO: 510081 - DNA, 20 bp, mouse
ggacttgtcccagccggagt

SEQ ID NO: 510082 - DNA, 20 bp, mouse
gtagggtcccacctcctgtg

SEQ ID NO: 510083 - DNA, 20 bp, mouse
ggcttcctgcggggccggta

SEQ ID NO: 510084 - DNA, 20 bp, mouse
ggggccgctgtgaggcgcgg

SEQ ID NO: 510085 - DNA, 20 bp, mouse
gtgctggtcacggccaacgt

SEQ ID NO: 510086 - DNA, 20 bp, mouse
gctgtccaggtgggaggaga

SEQ ID NO: 510087 - DNA, 20 bp, mouse
gctgtcactgtccaggtggg

SEQ ID NO: 510088 - DNA, 20 bp, mouse
gtaccctgctgacagactca

SEQ ID NO: 510089 - DNA, 20 bp, mouse
ggacccatctgaccccctaa

SEQ ID NO: 510090 - DNA, 20 bp, mouse
ggttgtctgagacccttagg

SEQ ID NO: 510091 - DNA, 20 bp, mouse
gaccatgagggagcagacct

SEQ ID NO: 510092 - DNA, 20 bp, mouse
gggaaggtgggtctttgcag

SEQ ID NO: 510093 - DNA, 20 bp, mouse
ggcctctggcgtgtgttggg

SEQ ID NO: 510094 - DNA, 20 bp, mouse
gaccccccaacacacgccag

SEQ ID NO: 510095 - DNA, 20 bp, mouse
gaaggttgtctgagaccctt

SEQ ID NO: 510096 - DNA, 20 bp, mouse
ggaagcagactgggaaatgt

SEQ ID NO: 510097 - DNA, 20 bp, mouse
ggcgcttgaggaagcagact

SEQ ID NO: 510098 - DNA, 20 bp, mouse
gcaggtacccgggagtccta

SEQ ID NO: 510099 - DNA, 20 bp, mouse
gggagcgcgactgtgcaggt

SEQ ID NO: 510100 - DNA, 20 bp, mouse
ggggaaatgtcggcaggcgg

SEQ ID NO: 510101 - DNA, 20 bp, mouse
gcagactgggaaatgtcggc

SEQ ID NO: 510102 - DNA, 20 bp, mouse
gcggcgggatgaagcgcttg

SEQ ID NO: 510103 - DNA, 20 bp, mouse
gcgcgactgtgcaggtcggg

SEQ ID NO: 510104 - DNA, 20 bp, mouse
gctcgggagcgcgactgtgc

SEQ ID NO: 510105 - DNA, 20 bp, mouse
gtcgggcggtctctgcggag

SEQ ID NO: 510106 - DNA, 20 bp, mouse
gccaccggtgacagctcggg

SEQ ID NO: 510107 - DNA, 20 bp, mouse
gcggtgacagctcgggaggt

SEQ ID NO: 510108 - DNA, 20 bp, mouse
ggcaggacacctccgttcca

SEQ ID NO: 510109 - DNA, 20 bp, mouse
ggaggtaggctgcaatgaca

SEQ ID NO: 510110 - DNA, 20 bp, mouse
gggagcaacgggacacccac

SEQ ID NO: 510111 - DNA, 20 bp, mouse
gtccgttccagggcagatta

SEQ ID NO: 510112 - DNA, 20 bp, mouse
gtccttaatctgccctggaa

SEQ ID NO: 510113 - DNA, 20 bp, mouse
gggctccgaggaaagagcag

SEQ ID NO: 510114 - DNA, 20 bp, mouse
gaggcccaccggtgacagct

SEQ ID NO: 510115 - DNA, 20 bp, mouse
gataagtgcagagtgggagg

SEQ ID NO: 510116 - DNA, 20 bp, mouse
ggtagttcagggccctctct

SEQ ID NO: 510117 - DNA, 20 bp, mouse
gatttctgagaggcaacagg

SEQ ID NO: 510118 - DNA, 20 bp, mouse
ggcaggtctcagcctagaga

SEQ ID NO: 510119 - DNA, 20 bp, mouse
ggtcagtcagttaagctggt

SEQ ID NO: 510120 - DNA, 20 bp, mouse
gttccagagccggcaaggac

SEQ ID NO: 510121 - DNA, 20 bp, mouse
gggagtgtccgtcctgggag

SEQ ID NO: 510122 - DNA, 20 bp, mouse
ggcagagtgcgtaggcccgg

SEQ ID NO: 510123 - DNA, 20 bp, mouse
gtgtttcaggcactcagcga

SEQ ID NO: 510124 - DNA, 20 bp, mouse
gactccagcaaagtagttca

SEQ ID NO: 510125 - DNA, 20 bp, mouse
gtggtccctgggtggaacca

SEQ ID NO: 510126 - DNA, 20 bp, mouse
gggacctaggccagtcacgg

SEQ ID NO: 510127 - DNA, 20 bp, mouse
gaccccgccgaggcagagta

SEQ ID NO: 510128 - DNA, 20 bp, mouse
gggcggacctaggccagtca

SEQ ID NO: 510129 - DNA, 20 bp, mouse
gtggggcgaaccctgggcgg

SEQ ID NO: 510130 - DNA, 20 bp, mouse
gcagaacggaacctgagcca

SEQ ID NO: 510131 - DNA, 20 bp, mouse
gtctccggaagactacagaa

SEQ ID NO: 510132 - DNA, 20 bp, mouse
ggcagctggaacaacgactg

SEQ ID NO: 510133 - DNA, 20 bp, mouse
gctcagtctagtggtcaccc

SEQ ID NO: 510134 - DNA, 20 bp, mouse
gagctggggcgaaccctggg

SEQ ID NO: 510135 - DNA, 20 bp, mouse
gactgagctggggcgaaccc

SEQ ID NO: 510136 - DNA, 20 bp, mouse
gtaggtacaggagttgtggg

SEQ ID NO: 510137 - DNA, 20 bp, mouse
ggcgggccaagaacacgctt

SEQ ID NO: 510138 - DNA, 20 bp, mouse
gggtggagtctcaggatagg

SEQ ID NO: 510139 - DNA, 20 bp, mouse
gagagtggggaagcactcgg

SEQ ID NO: 510140 - DNA, 20 bp, mouse
ggcctaggtacaggagttgt

SEQ ID NO: 510141 - DNA, 20 bp, mouse
gggaggtggagtctcaggat

SEQ ID NO: 510142 - DNA, 20 bp, mouse
gggccaagaacacgcttggg

SEQ ID NO: 510143 - DNA, 20 bp, mouse
ggcccacggaagaacagagt

SEQ ID NO: 510144 - DNA, 20 bp, mouse
gggagtctcaggataggggg

SEQ ID NO: 510145 - DNA, 20 bp, mouse
gactctggtggtctcggtgg

SEQ ID NO: 510146 - DNA, 20 bp, mouse
gagctggagccagaacccaa

SEQ ID NO: 510147 - DNA, 20 bp, mouse
gagccaggctgggctgccgg

SEQ ID NO: 510148 - DNA, 20 bp, mouse
gagacatggaaggccagacc

SEQ ID NO: 510149 - DNA, 20 bp, mouse
gccatgtctgcagcagcccc

SEQ ID NO: 510150 - DNA, 20 bp, mouse
gcccttagccaggagcacca

SEQ ID NO: 510151 - DNA, 20 bp, mouse
gacctgcagagtatatgtgg

SEQ ID NO: 510152 - DNA, 20 bp, mouse
ggccagaacccaagggagcc

SEQ ID NO: 510153 - DNA, 20 bp, mouse
gggtacctgcagagtatatg

SEQ ID NO: 510154 - DNA, 20 bp, mouse
gaagggtcccagtccagtcc

SEQ ID NO: 510155 - DNA, 20 bp, mouse
gcccagtccagtcctggtcc

SEQ ID NO: 510156 - DNA, 20 bp, mouse
gtgctgagaccggagaccaa

SEQ ID NO: 510157 - DNA, 20 bp, mouse
gaattcgggtatctaaacta

SEQ ID NO: 510158 - DNA, 20 bp, mouse
gcggagaccaagggctgctc

SEQ ID NO: 510159 - DNA, 20 bp, mouse
gtaccgcgagggaataatgt

SEQ ID NO: 510160 - DNA, 20 bp, mouse
gactctggatccacctccta

SEQ ID NO: 510161 - DNA, 20 bp, mouse
gcaggtgaggacgcaggtgt

SEQ ID NO: 510162 - DNA, 20 bp, mouse
gggaggccgagcgcaccgaa

SEQ ID NO: 510163 - DNA, 20 bp, mouse
gggaagaaaaacaatccgga

SEQ ID NO: 510164 - DNA, 20 bp, mouse
ggcatctgcagtgaccaact

SEQ ID NO: 510165 - DNA, 20 bp, mouse
gccgaagcgcagtccgaatc

SEQ ID NO: 510166 - DNA, 20 bp, mouse
gagtggccgcggggagtcca

SEQ ID NO: 510167 - DNA, 20 bp, mouse
gagcctccctggactccccg

SEQ ID NO: 510168 - DNA, 20 bp, mouse
gggcggatggccatcttaag

SEQ ID NO: 510169 - DNA, 20 bp, mouse
gcccacctctagggcgactc

SEQ ID NO: 510170 - DNA, 20 bp, mouse
gacccgagtcgccctagagg

SEQ ID NO: 510171 - DNA, 20 bp, mouse
gtccccgcggccacttaaga

SEQ ID NO: 510172 - DNA, 20 bp, mouse
ggaaggcgcggggtgcgcgg

SEQ ID NO: 510173 - DNA, 20 bp, mouse
gcgggttgactcctagcccg

SEQ ID NO: 510174 - DNA, 20 bp, mouse
gccccgcaggccctccagcc

SEQ ID NO: 510175 - DNA, 20 bp, mouse
gtcaacccgagtcgccctag

SEQ ID NO: 510176 - DNA, 20 bp, mouse
ggtcgctggagtcttggctg

SEQ ID NO: 510177 - DNA, 20 bp, mouse
gcctaaagtcgctggagtct

SEQ ID NO: 510178 - DNA, 20 bp, mouse
ggcgactttagggagaatgt

SEQ ID NO: 510179 - DNA, 20 bp, mouse
gggtatgtactctcctcttt

SEQ ID NO: 510180 - DNA, 20 bp, mouse
ggctggtcactaagggctgg

SEQ ID NO: 510181 - DNA, 20 bp, mouse
ggtgggtttgggctcccaga

SEQ ID NO: 510182 - DNA, 20 bp, mouse
ggagctgggaggaagccccg

SEQ ID NO: 510183 - DNA, 20 bp, mouse
gtgggagcccaaacccaccc

SEQ ID NO: 510184 - DNA, 20 bp, mouse
gatagctggtcactaagggc

SEQ ID NO: 510185 - DNA, 20 bp, mouse
ggatggtctctgattatagc

SEQ ID NO: 510186 - DNA, 20 bp, mouse
ggtccctgaggtcttagctg

SEQ ID NO: 510187 - DNA, 20 bp, mouse
gaggaaggtactcttctcag

SEQ ID NO: 510188 - DNA, 20 bp, mouse
gctccccagctaagacctca

SEQ ID NO: 510189 - DNA, 20 bp, mouse
ggattgtagcggatcactta

SEQ ID NO: 510190 - DNA, 20 bp, mouse
ggacctcagggacttgaggt

SEQ ID NO: 510191 - DNA, 20 bp, mouse
gctaagacctcagggacttg

SEQ ID NO: 510192 - DNA, 20 bp, mouse
ggagggtctcgggataacca

SEQ ID NO: 510193 - DNA, 20 bp, mouse
ggtgaagtggaggacccaca

SEQ ID NO: 510194 - DNA, 20 bp, mouse
gcttagggctggtggttact

SEQ ID NO: 510195 - DNA, 20 bp, mouse
ggtagcggatcacttagggc

SEQ ID NO: 510196 - DNA, 20 bp, mouse
gcccatttccccagagacaa

SEQ ID NO: 510197 - DNA, 20 bp, mouse
gaaaaccccgagtcccatgg

SEQ ID NO: 510198 - DNA, 20 bp, mouse
gtacagcaccattgtctctg

SEQ ID NO: 510199 - DNA, 20 bp, mouse
gagttttggaatttcagcgt

SEQ ID NO: 510200 - DNA, 20 bp, mouse
gaatggtgctgtaatgggtt

SEQ ID NO: 510201 - DNA, 20 bp, mouse
ggagacaatggtgctgtaat

SEQ ID NO: 510202 - DNA, 20 bp, mouse
gcccgcccccatgggactcg

SEQ ID NO: 510203 - DNA, 20 bp, mouse
ggctgaaattccaaaactgg

SEQ ID NO: 510204 - DNA, 20 bp, mouse
gtatgtatatgaatgcacag

SEQ ID NO: 510205 - DNA, 20 bp, mouse
gggctctggaatggggtcat

SEQ ID NO: 510206 - DNA, 20 bp, mouse
gcggtctccaccgtggccag

SEQ ID NO: 510207 - DNA, 20 bp, mouse
gcagcgcgcggtctccaccg

SEQ ID NO: 510208 - DNA, 20 bp, mouse
gtcggagcccctggccacgg

SEQ ID NO: 510209 - DNA, 20 bp, mouse
gaggctccgccgggacgcga

SEQ ID NO: 510210 - DNA, 20 bp, mouse
ggaccgcgcgctgtcatctg

SEQ ID NO: 510211 - DNA, 20 bp, mouse
gtgcagagtccagcgatggg

SEQ ID NO: 510212 - DNA, 20 bp, mouse
gcgggacgcgagggctattt

SEQ ID NO: 510213 - DNA, 20 bp, mouse
gtgtcccgcgccaggcacag

SEQ ID NO: 510214 - DNA, 20 bp, mouse
gtggcctgcaaggctccgcc

SEQ ID NO: 510215 - DNA, 20 bp, mouse
gctgtcatctgtgggagctc

SEQ ID NO: 510216 - DNA, 20 bp, mouse
gcgcggtacgtgtagtgtcg

SEQ ID NO: 510217 - DNA, 20 bp, mouse
ggccagcgagcgggaaccac

SEQ ID NO: 510218 - DNA, 20 bp, mouse
ggctccgctgcaccaagtcg

SEQ ID NO: 510219 - DNA, 20 bp, mouse
gggcagctggcaccacgact

SEQ ID NO: 510220 - DNA, 20 bp, mouse
gggccgcgcgctgcatcctg

SEQ ID NO: 510221 - DNA, 20 bp, mouse
gggcctcaccagaccccgag

SEQ ID NO: 510222 - DNA, 20 bp, mouse
gtgaggtcacgtggctccgg

SEQ ID NO: 510223 - DNA, 20 bp, mouse
ggcccgcgcgccctgctggg

SEQ ID NO: 510224 - DNA, 20 bp, mouse
gcacgggggcacccaccagg

SEQ ID NO: 510225 - DNA, 20 bp, mouse
gtggcagcctgccttataag

SEQ ID NO: 510226 - DNA, 20 bp, mouse
ggagaggtcagcgagatcta

SEQ ID NO: 510227 - DNA, 20 bp, mouse
gtccctgaagatggcggagg

SEQ ID NO: 510228 - DNA, 20 bp, mouse
gcggaggcgggggtgaactg

SEQ ID NO: 510229 - DNA, 20 bp, mouse
gtcaggcggagctgtgggag

SEQ ID NO: 510230 - DNA, 20 bp, mouse
gcccgcctccgccatcttca

SEQ ID NO: 510231 - DNA, 20 bp, mouse
ggccggggacggctcgagga

SEQ ID NO: 510232 - DNA, 20 bp, mouse
gtagtctgggaggaagactc

SEQ ID NO: 510233 - DNA, 20 bp, mouse
gccccggcttacctggagag

SEQ ID NO: 510234 - DNA, 20 bp, mouse
gtgtgggaggggagtaggtc

SEQ ID NO: 510235 - DNA, 20 bp, mouse
gaaaccagcgggctcataga

SEQ ID NO: 510236 - DNA, 20 bp, mouse
ggcttggcgcgtgcctcggg

SEQ ID NO: 510237 - DNA, 20 bp, mouse
gcagcgtgcgcaccaggtgg

SEQ ID NO: 510238 - DNA, 20 bp, mouse
gcacgcgtggataaccgagg

SEQ ID NO: 510239 - DNA, 20 bp, mouse
gccgctgctactgatgctcc

SEQ ID NO: 510240 - DNA, 20 bp, mouse
gaggcacgcgccaagctctg

SEQ ID NO: 510241 - DNA, 20 bp, mouse
ggcgcgcgcatggtggcagg

SEQ ID NO: 510242 - DNA, 20 bp, mouse
gcaccagcgtgcgcaccagg

SEQ ID NO: 510243 - DNA, 20 bp, mouse
ggagacccgggaccgtgagt

SEQ ID NO: 510244 - DNA, 20 bp, mouse
gggacacgcgtggataaccg

SEQ ID NO: 510245 - DNA, 20 bp, mouse
gaagtactcaagcctaagta

SEQ ID NO: 510246 - DNA, 20 bp, mouse
gtgctctccggcaggatgaa

SEQ ID NO: 510247 - DNA, 20 bp, mouse
gcacagccaacagaactaag

SEQ ID NO: 510248 - DNA, 20 bp, mouse
ggtggggcccttcatcctgc

SEQ ID NO: 510249 - DNA, 20 bp, mouse
gtcacggtggaggagacatc

SEQ ID NO: 510250 - DNA, 20 bp, mouse
gcatctgtgccagctcacgg

SEQ ID NO: 510251 - DNA, 20 bp, mouse
gggtggggtggttaaaaagg

SEQ ID NO: 510252 - DNA, 20 bp, mouse
gggcatttccactctcaaca

SEQ ID NO: 510253 - DNA, 20 bp, mouse
gggcagactgtgaagctctg

SEQ ID NO: 510254 - DNA, 20 bp, mouse
gttctcatttgctctccggc

SEQ ID NO: 510255 - DNA, 20 bp, mouse
gctgtgccagctcacggtgg

SEQ ID NO: 510256 - DNA, 20 bp, mouse
ggcacagctgcttcatccct

SEQ ID NO: 510257 - DNA, 20 bp, mouse
gagcgcgcccggccctgtgg

SEQ ID NO: 510258 - DNA, 20 bp, mouse
gcctggagaaaggagtcagt

SEQ ID NO: 510259 - DNA, 20 bp, mouse
gtgcagcgcgcccggccctg

SEQ ID NO: 510260 - DNA, 20 bp, mouse
gtctccaggcggaggaagaa

SEQ ID NO: 510261 - DNA, 20 bp, mouse
gggccctgtggcggagccca

SEQ ID NO: 510262 - DNA, 20 bp, mouse
gatccctgggctccgccaca

SEQ ID NO: 510263 - DNA, 20 bp, mouse
gttccccactactcacgcaa

SEQ ID NO: 510264 - DNA, 20 bp, mouse
ggactggagccggttcgaga

SEQ ID NO: 510265 - DNA, 20 bp, mouse
gtggagccggttcgagatgg

SEQ ID NO: 510266 - DNA, 20 bp, mouse
ggcccatcgcctgcacgcgg

SEQ ID NO: 510267 - DNA, 20 bp, mouse
ggagccgggccagcagccgc

SEQ ID NO: 510268 - DNA, 20 bp, mouse
gcgcggacccggtaggacac

SEQ ID NO: 510269 - DNA, 20 bp, mouse
ggagggtcgcccggtaggtg

SEQ ID NO: 510270 - DNA, 20 bp, mouse
gccgccagggccgagcacgg

SEQ ID NO: 510271 - DNA, 20 bp, mouse
ggccgcgtgggactgtagag

SEQ ID NO: 510272 - DNA, 20 bp, mouse
gcggcggcgaggacagtgac

SEQ ID NO: 510273 - DNA, 20 bp, mouse
gtcgccgccgcggacccggt

SEQ ID NO: 510274 - DNA, 20 bp, mouse
ggcgcccgggcccggggaca

SEQ ID NO: 510275 - DNA, 20 bp, mouse
ggatgggctggggtcactga

SEQ ID NO: 510276 - DNA, 20 bp, mouse
gagggacggccaccgcgaca

SEQ ID NO: 510277 - DNA, 20 bp, mouse
gaagctgcgagcgaactgca

SEQ ID NO: 510278 - DNA, 20 bp, mouse
gcctagcgcgaggtccccgg

SEQ ID NO: 510279 - DNA, 20 bp, mouse
gacagggcgggaatccgcgc

SEQ ID NO: 510280 - DNA, 20 bp, mouse
gcttctcatcagctcagtac

SEQ ID NO: 510281 - DNA, 20 bp, mouse
gaagacgagcgggcacgaag

SEQ ID NO: 510282 - DNA, 20 bp, mouse
gacggccaccgcgacagggc

SEQ ID NO: 510283 - DNA, 20 bp, mouse
gtcagctcagtactggcgga

SEQ ID NO: 510284 - DNA, 20 bp, mouse
gagagacgcgggaagacgag

SEQ ID NO: 510285 - DNA, 20 bp, mouse
gggcgccccgacagagacgc

SEQ ID NO: 510286 - DNA, 20 bp, mouse
gcgcgcactggagggcacct

SEQ ID NO: 510287 - DNA, 20 bp, mouse
ggagggacgcgcgcactgga

SEQ ID NO: 510288 - DNA, 20 bp, mouse
ggtggtggcggcgggagcta

SEQ ID NO: 510289 - DNA, 20 bp, mouse
gccgcgcgggcccagctgac

SEQ ID NO: 510290 - DNA, 20 bp, mouse
gcgcgggccaagggaaaagg

SEQ ID NO: 510291 - DNA, 20 bp, mouse
gagaagcaggagacccggac

SEQ ID NO: 510292 - DNA, 20 bp, mouse
gcctccgtgcagctctgggt

SEQ ID NO: 510293 - DNA, 20 bp, mouse
gagtcccgggaagagcacag

SEQ ID NO: 510294 - DNA, 20 bp, mouse
gccggacaggagacgcaccg

SEQ ID NO: 510295 - DNA, 20 bp, mouse
gtccagcctagagggccctg

SEQ ID NO: 510296 - DNA, 20 bp, mouse
gaggtccgcggagtgtctcg

SEQ ID NO: 510297 - DNA, 20 bp, mouse
gtgcatgtccaggaggtccg

SEQ ID NO: 510298 - DNA, 20 bp, mouse
gtccaccccgagacactccg

SEQ ID NO: 510299 - DNA, 20 bp, mouse
gccgggagtgccccaagggg

SEQ ID NO: 510300 - DNA, 20 bp, mouse
ggcggccggtcgaccgagag

SEQ ID NO: 510301 - DNA, 20 bp, mouse
gtccgcggagtgtctcgggg

SEQ ID NO: 510302 - DNA, 20 bp, mouse
gagtggaagtctgcatgtcc

SEQ ID NO: 510303 - DNA, 20 bp, mouse
gctgtctctggaccacactg

SEQ ID NO: 510304 - DNA, 20 bp, mouse
gtggtccagagacagatact

SEQ ID NO: 510305 - DNA, 20 bp, mouse
gggacgacgacgacacacaa

SEQ ID NO: 510306 - DNA, 20 bp, mouse
ggtgctgcaccggaggtgag

SEQ ID NO: 510307 - DNA, 20 bp, mouse
gctgcagagtgctgcaccgg

SEQ ID NO: 510308 - DNA, 20 bp, mouse
gcagggagcggacttcacct

SEQ ID NO: 510309 - DNA, 20 bp, mouse
gtgcaaaggcccctcacctc

SEQ ID NO: 510310 - DNA, 20 bp, mouse
gcggatgtcaccgcagggag

SEQ ID NO: 510311 - DNA, 20 bp, mouse
ggccgcgctgggtctccgta

SEQ ID NO: 510312 - DNA, 20 bp, mouse
gggtctgcagagtgctgcac

SEQ ID NO: 510313 - DNA, 20 bp, mouse
gctctgcagacccgagacac

SEQ ID NO: 510314 - DNA, 20 bp, mouse
gggagacggatgtcaccgca

SEQ ID NO: 510315 - DNA, 20 bp, mouse
gtccggagcgcccgtgtctc

SEQ ID NO: 510316 - DNA, 20 bp, mouse
gctagtgtcgcctactggaa

SEQ ID NO: 510317 - DNA, 20 bp, mouse
gcagtcgccctgggccgaca

SEQ ID NO: 510318 - DNA, 20 bp, mouse
gagcagggtaggagcaacgt

SEQ ID NO: 510319 - DNA, 20 bp, mouse
gactggaagggcaaaaaccc

SEQ ID NO: 510320 - DNA, 20 bp, mouse
gcaaaaacccgggaccatgt

SEQ ID NO: 510321 - DNA, 20 bp, mouse
gagaaactcacagtcgccct

SEQ ID NO: 510322 - DNA, 20 bp, mouse
gatgcgcagtggccacctgg

SEQ ID NO: 510323 - DNA, 20 bp, mouse
gccgggaccatgtcggccca

SEQ ID NO: 510324 - DNA, 20 bp, mouse
gtcctggggcactagttccc

SEQ ID NO: 510325 - DNA, 20 bp, mouse
gcaaagcgcccagggccact

SEQ ID NO: 510326 - DNA, 20 bp, mouse
ggagcggtgagtggtgacga

SEQ ID NO: 510327 - DNA, 20 bp, mouse
gcccccgaggcgccaggaag

SEQ ID NO: 510328 - DNA, 20 bp, mouse
gctaccgggaaccgaccgag

SEQ ID NO: 510329 - DNA, 20 bp, mouse
gggattcgaagagagctacc

SEQ ID NO: 510330 - DNA, 20 bp, mouse
gggtctcgagcctccccccg

SEQ ID NO: 510331 - DNA, 20 bp, mouse
ggggaaccgaccgagtggcg

SEQ ID NO: 510332 - DNA, 20 bp, mouse
gctccgccccgccactcggt

SEQ ID NO: 510333 - DNA, 20 bp, mouse
gactaggaggagcgctcagg

SEQ ID NO: 510334 - DNA, 20 bp, mouse
gaggctcgagaccccgcgag

SEQ ID NO: 510335 - DNA, 20 bp, mouse
gtaaaacgggagctgtacag

SEQ ID NO: 510336 - DNA, 20 bp, mouse
gcaatgcccggagtcgactc

SEQ ID NO: 510337 - DNA, 20 bp, mouse
gagaagcttgggatgaatgg

SEQ ID NO: 510338 - DNA, 20 bp, mouse
gcggcgcgtgccagaagctt

SEQ ID NO: 510339 - DNA, 20 bp, mouse
gcgcctccgagagccagacg

SEQ ID NO: 510340 - DNA, 20 bp, mouse
gagcactgagaagacgtcgg

SEQ ID NO: 510341 - DNA, 20 bp, mouse
ggagccagacgaggcagaaa

SEQ ID NO: 510342 - DNA, 20 bp, mouse
ggctgtggacaaagaatcgt

SEQ ID NO: 510343 - DNA, 20 bp, mouse
ggagagcgcggtccgaagtt

SEQ ID NO: 510344 - DNA, 20 bp, mouse
ggtgccagcgtcagagttct

SEQ ID NO: 510345 - DNA, 20 bp, mouse
gtggtgcctgagtcgactcc

SEQ ID NO: 510346 - DNA, 20 bp, mouse
ggatgcagcaggagcgctat

SEQ ID NO: 510347 - DNA, 20 bp, mouse
ggcagcaggagcgctatggg

SEQ ID NO: 510348 - DNA, 20 bp, mouse
gcaccatggccgcctctgtg

SEQ ID NO: 510349 - DNA, 20 bp, mouse
gcaccacacagaggcggcca

SEQ ID NO: 510350 - DNA, 20 bp, mouse
gctcccccgcccttccacca

SEQ ID NO: 510351 - DNA, 20 bp, mouse
gcggtggcgccaggtctcta

SEQ ID NO: 510352 - DNA, 20 bp, mouse
gggcggccatggtggaaggg

SEQ ID NO: 510353 - DNA, 20 bp, mouse
gcttggaatccggcccctag

SEQ ID NO: 510354 - DNA, 20 bp, mouse
gatccggcccctagcgggtg

SEQ ID NO: 510355 - DNA, 20 bp, mouse
ggcgacgactctgcccgctc

SEQ ID NO: 510356 - DNA, 20 bp, mouse
gtacagaagccgagaaggtc

SEQ ID NO: 510357 - DNA, 20 bp, mouse
gtggctgcaccggaccttct

SEQ ID NO: 510358 - DNA, 20 bp, mouse
gaggtccggtgcagccatgg

SEQ ID NO: 510359 - DNA, 20 bp, mouse
ggcaagtacagaagccgaga

SEQ ID NO: 510360 - DNA, 20 bp, mouse
ggccggctacacacaagctt

SEQ ID NO: 510361 - DNA, 20 bp, mouse
gtctgtacttgctgagaacg

SEQ ID NO: 510362 - DNA, 20 bp, mouse
gtaggctgcgcgtcaggcag

SEQ ID NO: 510363 - DNA, 20 bp, mouse
gagagtacacatgagaacag

SEQ ID NO: 510364 - DNA, 20 bp, mouse
gtgtgggattgcagcgaaat

SEQ ID NO: 510365 - DNA, 20 bp, mouse
gggcggcgcacctgaaaaag

SEQ ID NO: 510366 - DNA, 20 bp, mouse
ggacatcccggagccctacc

SEQ ID NO: 510367 - DNA, 20 bp, mouse
gccgggagggtcgcacaacg

SEQ ID NO: 510368 - DNA, 20 bp, mouse
gggcgggagcggcggagcac

SEQ ID NO: 510369 - DNA, 20 bp, mouse
gcaggctccgggtagggctc

SEQ ID NO: 510370 - DNA, 20 bp, mouse
gctgagaggcgcgggaccgt

SEQ ID NO: 510371 - DNA, 20 bp, mouse
gggcactgaggtctcgggag

SEQ ID NO: 510372 - DNA, 20 bp, mouse
gccggccgaagaaggcactg

SEQ ID NO: 510373 - DNA, 20 bp, mouse
ggcgggaccgtgggtggcgg

SEQ ID NO: 510374 - DNA, 20 bp, mouse
gaagcaaggccggccgaaga

SEQ ID NO: 510375 - DNA, 20 bp, mouse
gatcctgacgcgggttctct

SEQ ID NO: 510376 - DNA, 20 bp, mouse
ggactccctccgcaccccag

SEQ ID NO: 510377 - DNA, 20 bp, mouse
gagcgcttcagtagcgagag

SEQ ID NO: 510378 - DNA, 20 bp, mouse
ggaaagtggtgacaccgctg

SEQ ID NO: 510379 - DNA, 20 bp, mouse
gggtacggccgggaggacct

SEQ ID NO: 510380 - DNA, 20 bp, mouse
gtcccgcggggacacacaca

SEQ ID NO: 510381 - DNA, 20 bp, mouse
ggcagaggtggaagcaccgg

SEQ ID NO: 510382 - DNA, 20 bp, mouse
ggggacaccggggcccgagg

SEQ ID NO: 510383 - DNA, 20 bp, mouse
gacttctctcaacagcccca

SEQ ID NO: 510384 - DNA, 20 bp, mouse
gggacgggacccccaggccg

SEQ ID NO: 510385 - DNA, 20 bp, mouse
gcacacacagggtccgggag

SEQ ID NO: 510386 - DNA, 20 bp, mouse
gagaccgcggcgggagaaga

SEQ ID NO: 510387 - DNA, 20 bp, mouse
gctagtggcggcagctacag

SEQ ID NO: 510388 - DNA, 20 bp, mouse
gggaaaaatccgcgagaccg

SEQ ID NO: 510389 - DNA, 20 bp, mouse
ggcatcggccaggaacgact

SEQ ID NO: 510390 - DNA, 20 bp, mouse
gaaaatccgcgagaccgcgg

SEQ ID NO: 510391 - DNA, 20 bp, mouse
gaggtacggaggagggacgc

SEQ ID NO: 510392 - DNA, 20 bp, mouse
ggcgggaacccaaggttcac

SEQ ID NO: 510393 - DNA, 20 bp, mouse
ggaactggacaaaggtacgg

SEQ ID NO: 510394 - DNA, 20 bp, mouse
gttctcccgccgcggtctcg

SEQ ID NO: 510395 - DNA, 20 bp, mouse
gtacactgcctgacagcgcg

SEQ ID NO: 510396 - DNA, 20 bp, mouse
gggctgtgcgagctgactag

SEQ ID NO: 510397 - DNA, 20 bp, mouse
ggctgactagaggttccggg

SEQ ID NO: 510398 - DNA, 20 bp, mouse
ggactgggcgagggtcaggt

SEQ ID NO: 510399 - DNA, 20 bp, mouse
gttcgctggataaagggact

SEQ ID NO: 510400 - DNA, 20 bp, mouse
gcgagctgactagaggttcc

SEQ ID NO: 510401 - DNA, 20 bp, mouse
gccgactactacgccatctt

SEQ ID NO: 510402 - DNA, 20 bp, mouse
gaagggactgggcgagggtc

SEQ ID NO: 510403 - DNA, 20 bp, mouse
gggcggtttcgctggataaa

SEQ ID NO: 510404 - DNA, 20 bp, mouse
gctcgctcgctcacccggac

SEQ ID NO: 510405 - DNA, 20 bp, mouse
gctgctggaggagtcgctgt

SEQ ID NO: 510406 - DNA, 20 bp, mouse
gtgggctatagagattaaac

SEQ ID NO: 510407 - DNA, 20 bp, mouse
gtggatgctagacccagatg

SEQ ID NO: 510408 - DNA, 20 bp, mouse
gaagacagggaaggatcttc

SEQ ID NO: 510409 - DNA, 20 bp, mouse
gttgccctctgacttagtag

SEQ ID NO: 510410 - DNA, 20 bp, mouse
gtcacccttgggctaaagat

SEQ ID NO: 510411 - DNA, 20 bp, mouse
gcggcggcgatgaatttgag

SEQ ID NO: 510412 - DNA, 20 bp, mouse
gtctatagcccagagcatcg

SEQ ID NO: 510413 - DNA, 20 bp, mouse
gtgacagatgcaggagctgt

SEQ ID NO: 510414 - DNA, 20 bp, mouse
gagctcctgcatctgtcagg

SEQ ID NO: 510415 - DNA, 20 bp, mouse
ggatatcatgtccctcatct

SEQ ID NO: 510416 - DNA, 20 bp, mouse
gctgggtcgcgagagctccg

SEQ ID NO: 510417 - DNA, 20 bp, mouse
ggcccgacctggcaaaatgg

SEQ ID NO: 510418 - DNA, 20 bp, mouse
ggtggcccgacctggcaaaa

SEQ ID NO: 510419 - DNA, 20 bp, mouse
ggctctcgcgacccagagga

SEQ ID NO: 510420 - DNA, 20 bp, mouse
gcagccagcagtgacacgta

SEQ ID NO: 510421 - DNA, 20 bp, mouse
ggcaaggcccgccatcctct

SEQ ID NO: 510422 - DNA, 20 bp, mouse
gaaaatggcggcgctgctgg

SEQ ID NO: 510423 - DNA, 20 bp, mouse
gacgccggggccagcagctt

SEQ ID NO: 510424 - DNA, 20 bp, mouse
gctgctggaggcgcggctgg

SEQ ID NO: 510425 - DNA, 20 bp, mouse
ggtgcgtgcgagcaagggca

SEQ ID NO: 510426 - DNA, 20 bp, mouse
ggcccacaggaacagacccc

SEQ ID NO: 510427 - DNA, 20 bp, mouse
gcccgggctctagtgtcctg

SEQ ID NO: 510428 - DNA, 20 bp, mouse
ggctctgaagaagtagcctg

SEQ ID NO: 510429 - DNA, 20 bp, mouse
gaccccaggacactagagcc

SEQ ID NO: 510430 - DNA, 20 bp, mouse
gggtaggggcggccccgtga

SEQ ID NO: 510431 - DNA, 20 bp, mouse
gacgcagcagcagcccgggg

SEQ ID NO: 510432 - DNA, 20 bp, mouse
ggccaggccactgcgcccac

SEQ ID NO: 510433 - DNA, 20 bp, mouse
gtggcctggcttggcggtag

SEQ ID NO: 510434 - DNA, 20 bp, mouse
gtctgttcctgtgggcgcag

SEQ ID NO: 510435 - DNA, 20 bp, mouse
gcagcatcggcggctcgggt

SEQ ID NO: 510436 - DNA, 20 bp, mouse
gcgccaggagctggaccgag

SEQ ID NO: 510437 - DNA, 20 bp, mouse
gttgttgatccgtacccagt

SEQ ID NO: 510438 - DNA, 20 bp, mouse
gagtgggcagcgccaggagc

SEQ ID NO: 510439 - DNA, 20 bp, mouse
gccctggcaggcggcgctgg

SEQ ID NO: 510440 - DNA, 20 bp, mouse
gggccgctcggtccagctcc

SEQ ID NO: 510441 - DNA, 20 bp, mouse
gtggaccgagcggccggtga

SEQ ID NO: 510442 - DNA, 20 bp, mouse
gggctctccgacctccaccc

SEQ ID NO: 510443 - DNA, 20 bp, mouse
gaagacccgcccgacaccca

SEQ ID NO: 510444 - DNA, 20 bp, mouse
gttgctggcgcgcgtaggta

SEQ ID NO: 510445 - DNA, 20 bp, mouse
gtcactcaccggcccgactc

SEQ ID NO: 510446 - DNA, 20 bp, mouse
gacggaagcgtcgcgggact

SEQ ID NO: 510447 - DNA, 20 bp, mouse
ggcggggcgggcgttacctg

SEQ ID NO: 510448 - DNA, 20 bp, mouse
gcaataggacggaagcgtcg

SEQ ID NO: 510449 - DNA, 20 bp, mouse
gcctgagccccggggtgaca

SEQ ID NO: 510450 - DNA, 20 bp, mouse
ggcggccgcagccattttgg

SEQ ID NO: 510451 - DNA, 20 bp, mouse
ggccccccgtaaatagggaa

SEQ ID NO: 510452 - DNA, 20 bp, mouse
gtcctccaccggaagaccca

SEQ ID NO: 510453 - DNA, 20 bp, mouse
ggacagggccacgggccggg

SEQ ID NO: 510454 - DNA, 20 bp, mouse
gagcgttgcccaccgagacg

SEQ ID NO: 510455 - DNA, 20 bp, mouse
gcaatggccccccgtaaata

SEQ ID NO: 510456 - DNA, 20 bp, mouse
gtgactgcaaggaggttccc

SEQ ID NO: 510457 - DNA, 20 bp, mouse
ggcaggccaggacactctgg

SEQ ID NO: 510458 - DNA, 20 bp, mouse
gtgtgcaggccaggacactc

SEQ ID NO: 510459 - DNA, 20 bp, mouse
gtgactgactgactgcaagg

SEQ ID NO: 510460 - DNA, 20 bp, mouse
gacgtggagccccgcaccaa

SEQ ID NO: 510461 - DNA, 20 bp, mouse
gtgaggtttggaagtagcct

SEQ ID NO: 510462 - DNA, 20 bp, mouse
gagacccctctagcagctgg

SEQ ID NO: 510463 - DNA, 20 bp, mouse
gtcctggcctgcacaaaccg

SEQ ID NO: 510464 - DNA, 20 bp, mouse
ggccttcaggaccatggacg

SEQ ID NO: 510465 - DNA, 20 bp, mouse
gcaaacacaatgatgacatg

SEQ ID NO: 510466 - DNA, 20 bp, mouse
gatcagggagtgtgcagtag

SEQ ID NO: 510467 - DNA, 20 bp, mouse
gagggaagctaccccaccat

SEQ ID NO: 510468 - DNA, 20 bp, mouse
gtaggccagctcccatggtg

SEQ ID NO: 510469 - DNA, 20 bp, mouse
ggactcccaaccagtctgta

SEQ ID NO: 510470 - DNA, 20 bp, mouse
gctcaccctggaaccatcca

SEQ ID NO: 510471 - DNA, 20 bp, mouse
gaccagagcctctttctggg

SEQ ID NO: 510472 - DNA, 20 bp, mouse
gaccccccagaaagaggctc

SEQ ID NO: 510473 - DNA, 20 bp, mouse
gtgagccctggatggttcca

SEQ ID NO: 510474 - DNA, 20 bp, mouse
gctcctctgtctgcaagcac

SEQ ID NO: 510475 - DNA, 20 bp, mouse
gctctttctggggggtatca

SEQ ID NO: 510476 - DNA, 20 bp, mouse
gcaagggaagctaccagctg

SEQ ID NO: 510477 - DNA, 20 bp, mouse
gccttgagctctgcttggag

SEQ ID NO: 510478 - DNA, 20 bp, mouse
gtcctgggcttctgacgcaa

SEQ ID NO: 510479 - DNA, 20 bp, mouse
ggcagtgtttatgagcgggg

SEQ ID NO: 510480 - DNA, 20 bp, mouse
gacggacaagaaaggaataa

SEQ ID NO: 510481 - DNA, 20 bp, mouse
gtcccttgcgtcagaagccc

SEQ ID NO: 510482 - DNA, 20 bp, mouse
gtcacactaacggacaagaa

SEQ ID NO: 510483 - DNA, 20 bp, mouse
ggaagggttaaagcccacct

SEQ ID NO: 510484 - DNA, 20 bp, mouse
gtaaagcccacctaggaaca

SEQ ID NO: 510485 - DNA, 20 bp, mouse
ggttcttcccacaataacag

SEQ ID NO: 510486 - DNA, 20 bp, mouse
ggcgtcagggaggaccgggg

SEQ ID NO: 510487 - DNA, 20 bp, mouse
gggcagcgcggtctcggcat

SEQ ID NO: 510488 - DNA, 20 bp, mouse
gcagccacctgatgcgacag

SEQ ID NO: 510489 - DNA, 20 bp, mouse
gcggcccgcactctgaaccc

SEQ ID NO: 510490 - DNA, 20 bp, mouse
gggctcggcggccatcgggg

SEQ ID NO: 510491 - DNA, 20 bp, mouse
gtgtacggcaaggacaaagt

SEQ ID NO: 510492 - DNA, 20 bp, mouse
gcactcggcgtcaggcgtca

SEQ ID NO: 510493 - DNA, 20 bp, mouse
ggccgcggcgcccttatccc

SEQ ID NO: 510494 - DNA, 20 bp, mouse
gggaccagtgactgtagggg

SEQ ID NO: 510495 - DNA, 20 bp, mouse
gcggccggggttcagagtgc

SEQ ID NO: 510496 - DNA, 20 bp, mouse
gggagtggcgacgcggaaca

SEQ ID NO: 510497 - DNA, 20 bp, mouse
ggtgtggactaggagcgtgg

SEQ ID NO: 510498 - DNA, 20 bp, mouse
gcgcctactgatgccgaaaa

SEQ ID NO: 510499 - DNA, 20 bp, mouse
ggcgccctcgtcgtttggag

SEQ ID NO: 510500 - DNA, 20 bp, mouse
gatcagtaggcggcagcgtg

SEQ ID NO: 510501 - DNA, 20 bp, mouse
gccgtggacccagcacccag

SEQ ID NO: 510502 - DNA, 20 bp, mouse
gtcgccactccaaacgacga

SEQ ID NO: 510503 - DNA, 20 bp, mouse
gaggcggcagcgtgtggact

SEQ ID NO: 510504 - DNA, 20 bp, mouse
ggatgccgaaaacggcttct

SEQ ID NO: 510505 - DNA, 20 bp, mouse
ggtcgtttggagtggcgacg

SEQ ID NO: 510506 - DNA, 20 bp, mouse
gtagcggggccaacgccggg

SEQ ID NO: 510507 - DNA, 20 bp, mouse
gccgggaggcgaacagatcg

SEQ ID NO: 510508 - DNA, 20 bp, mouse
ggcgggccaggcgaacggag

SEQ ID NO: 510509 - DNA, 20 bp, mouse
ggcagagtcggtagagttgg

SEQ ID NO: 510510 - DNA, 20 bp, mouse
gcgtgagtctggggcagagt

SEQ ID NO: 510511 - DNA, 20 bp, mouse
gaccgtagcggggccaacgc

SEQ ID NO: 510512 - DNA, 20 bp, mouse
gagatgctatgaggtcaggg

SEQ ID NO: 510513 - DNA, 20 bp, mouse
gagatcgcgggccaggcgaa

SEQ ID NO: 510514 - DNA, 20 bp, mouse
gagaggccctggcccgtgag

SEQ ID NO: 510515 - DNA, 20 bp, mouse
gggaggcagcgaccgtagcg

SEQ ID NO: 510516 - DNA, 20 bp, mouse
ggctgctacagggccgggtg

SEQ ID NO: 510517 - DNA, 20 bp, mouse
gcccggccctgtagcagcgg

SEQ ID NO: 510518 - DNA, 20 bp, mouse
gtccaaacccgcaggctcca

SEQ ID NO: 510519 - DNA, 20 bp, mouse
gcctgtagcagcggcggcgt

SEQ ID NO: 510520 - DNA, 20 bp, mouse
ggagctgctgctgcccgaca

SEQ ID NO: 510521 - DNA, 20 bp, mouse
gctacagggccgggtgggga

SEQ ID NO: 510522 - DNA, 20 bp, mouse
gcaggcctgcccatacccgg

SEQ ID NO: 510523 - DNA, 20 bp, mouse
gaggtgactcgcctgagagt

SEQ ID NO: 510524 - DNA, 20 bp, mouse
gagggtcccgaaggatggtc

SEQ ID NO: 510525 - DNA, 20 bp, mouse
gggtcaggcctgcccatacc

SEQ ID NO: 510526 - DNA, 20 bp, mouse
gtctctcacgcctagcgcaa

SEQ ID NO: 510527 - DNA, 20 bp, mouse
gacgcctagcgcaatggcgg

SEQ ID NO: 510528 - DNA, 20 bp, mouse
gaactgttgctgctccgccg

SEQ ID NO: 510529 - DNA, 20 bp, mouse
gctcgcgggcggccagaccc

SEQ ID NO: 510530 - DNA, 20 bp, mouse
gcggccgccgccattgcgct

SEQ ID NO: 510531 - DNA, 20 bp, mouse
ggtggtccggaaacaggcgg

SEQ ID NO: 510532 - DNA, 20 bp, mouse
ggccgctgcacgggccggaa

SEQ ID NO: 510533 - DNA, 20 bp, mouse
ggcgcggcgaccggcaccag

SEQ ID NO: 510534 - DNA, 20 bp, mouse
gcggcccggctggcggacag

SEQ ID NO: 510535 - DNA, 20 bp, mouse
gcgagcggcgcgggtcggcc

SEQ ID NO: 510536 - DNA, 20 bp, mouse
ggaccggccgcgctccgcag

SEQ ID NO: 510537 - DNA, 20 bp, mouse
gggtccatgtgcgcagtgag

SEQ ID NO: 510538 - DNA, 20 bp, mouse
gcgggacaccggtgctactg

SEQ ID NO: 510539 - DNA, 20 bp, mouse
gcagcggcaaccggcgcgaa

SEQ ID NO: 510540 - DNA, 20 bp, mouse
gtcggtcagacccgggacac

SEQ ID NO: 510541 - DNA, 20 bp, mouse
ggcgccagctcaatgaagta

SEQ ID NO: 510542 - DNA, 20 bp, mouse
gcccacagtggagcctggca

SEQ ID NO: 510543 - DNA, 20 bp, mouse
gcgcgcggtcggtcagaccc

SEQ ID NO: 510544 - DNA, 20 bp, mouse
gggcgagaaggttctatccg

SEQ ID NO: 510545 - DNA, 20 bp, mouse
gaagagaagcgccaaggccc

SEQ ID NO: 510546 - DNA, 20 bp, mouse
gtggagagagagttgtcggg

SEQ ID NO: 510547 - DNA, 20 bp, mouse
ggagttgtcggggggaagga

SEQ ID NO: 510548 - DNA, 20 bp, mouse
ggaatggagagagagttgtc

SEQ ID NO: 510549 - DNA, 20 bp, mouse
gagggggcgcggagtcagag

SEQ ID NO: 510550 - DNA, 20 bp, mouse
gtacgacagccggtgggagg

SEQ ID NO: 510551 - DNA, 20 bp, mouse
gggctgtcgtaaaaggtgaa

SEQ ID NO: 510552 - DNA, 20 bp, mouse
gggatcatccaggcgctgaa

SEQ ID NO: 510553 - DNA, 20 bp, mouse
gtcccaccggctgtcgtaaa

SEQ ID NO: 510554 - DNA, 20 bp, mouse
gaaagggccaggagacatcc

SEQ ID NO: 510555 - DNA, 20 bp, mouse
ggagcaactggagcacctgt

SEQ ID NO: 510556 - DNA, 20 bp, mouse
ggcggggctggcgggctgag

SEQ ID NO: 510557 - DNA, 20 bp, mouse
gaaggtgctggaggtgacag

SEQ ID NO: 510558 - DNA, 20 bp, mouse
gcgcgggagccgtcattcgg

SEQ ID NO: 510559 - DNA, 20 bp, mouse
gtctgggctgccgggtccag

SEQ ID NO: 510560 - DNA, 20 bp, mouse
gccagtggcacagggattga

SEQ ID NO: 510561 - DNA, 20 bp, mouse
ggggacccgccaccgaatga

SEQ ID NO: 510562 - DNA, 20 bp, mouse
gggcagctggtgcggcttct

SEQ ID NO: 510563 - DNA, 20 bp, mouse
ggtccgaaccatcctcgtga

SEQ ID NO: 510564 - DNA, 20 bp, mouse
gcttgagccagcggagaggt

SEQ ID NO: 510565 - DNA, 20 bp, mouse
ggtggcacagggattgaagg

SEQ ID NO: 510566 - DNA, 20 bp, mouse
gcggagggcgccggcgggaa

SEQ ID NO: 510567 - DNA, 20 bp, mouse
ggcgccggcgggaagggacg

SEQ ID NO: 510568 - DNA, 20 bp, mouse
gggtaagcgaggcctgcgtg

SEQ ID NO: 510569 - DNA, 20 bp, mouse
gtgcgcgcgcagagcaccgg

SEQ ID NO: 510570 - DNA, 20 bp, mouse
ggcctgcgcgcgcagagcac

SEQ ID NO: 510571 - DNA, 20 bp, mouse
ggccaaggcgccgtgagact

SEQ ID NO: 510572 - DNA, 20 bp, mouse
gccgccgcgtcccttcccgc

SEQ ID NO: 510573 - DNA, 20 bp, mouse
ggcagagcaccggagggcgc

SEQ ID NO: 510574 - DNA, 20 bp, mouse
gagaaacacagaccgcacgc

SEQ ID NO: 510575 - DNA, 20 bp, mouse
gacggtcagagcgcctccgg

SEQ ID NO: 510576 - DNA, 20 bp, mouse
gctgccgcctgcgctctcag

SEQ ID NO: 510577 - DNA, 20 bp, mouse
gccgccgctgagagcgcagg

SEQ ID NO: 510578 - DNA, 20 bp, mouse
gagcgcaggcggcagctgac

SEQ ID NO: 510579 - DNA, 20 bp, mouse
gacgtggggacgagagctgg

SEQ ID NO: 510580 - DNA, 20 bp, mouse
gctgcggcgggagccctgcg

SEQ ID NO: 510581 - DNA, 20 bp, mouse
gctgcgcgtgggccaccaca

SEQ ID NO: 510582 - DNA, 20 bp, mouse
gtcgccgccgctgagagcgc

SEQ ID NO: 510583 - DNA, 20 bp, mouse
gggctccgggcctcacccga

SEQ ID NO: 510584 - DNA, 20 bp, mouse
gcttcgcgggccgggacgtg

SEQ ID NO: 510585 - DNA, 20 bp, mouse
gtggcccacgcgcaggtgag

SEQ ID NO: 510586 - DNA, 20 bp, mouse
ggaggcagcaaccggagcga

SEQ ID NO: 510587 - DNA, 20 bp, mouse
gtgacctgtggccaccctcc

SEQ ID NO: 510588 - DNA, 20 bp, mouse
gcagagcccgaggcagcaac

SEQ ID NO: 510589 - DNA, 20 bp, mouse
gggcagggagaggcttggca

SEQ ID NO: 510590 - DNA, 20 bp, mouse
gagtggggttccagagcccg

SEQ ID NO: 510591 - DNA, 20 bp, mouse
ggactgggattccctcgctc

SEQ ID NO: 510592 - DNA, 20 bp, mouse
ggacgctctagtgggagaag

SEQ ID NO: 510593 - DNA, 20 bp, mouse
ggaggacagcctgtctctta

SEQ ID NO: 510594 - DNA, 20 bp, mouse
gccaggcgacccccccacta

SEQ ID NO: 510595 - DNA, 20 bp, mouse
ggcagtaggccagcctttag

SEQ ID NO: 510596 - DNA, 20 bp, mouse
gcgcgacgcacacagctcgg

SEQ ID NO: 510597 - DNA, 20 bp, mouse
gggtcgggccctgaggtgga

SEQ ID NO: 510598 - DNA, 20 bp, mouse
gtgcgggtcgggccctgagg

SEQ ID NO: 510599 - DNA, 20 bp, mouse
gacagcgtacctcagcgagg

SEQ ID NO: 510600 - DNA, 20 bp, mouse
gggcggagaccgcctcgctg

SEQ ID NO: 510601 - DNA, 20 bp, mouse
gctgtgcgggtcgggccctg

SEQ ID NO: 510602 - DNA, 20 bp, mouse
gtgaggtacgctgtgcgggt

SEQ ID NO: 510603 - DNA, 20 bp, mouse
gcgcacagcgtacctcagcg

SEQ ID NO: 510604 - DNA, 20 bp, mouse
gcgtcgcgacgcacacagct

SEQ ID NO: 510605 - DNA, 20 bp, mouse
ggccctgaggtggacggacg

SEQ ID NO: 510606 - DNA, 20 bp, mouse
gacgcacagcgcagggcggt

SEQ ID NO: 510607 - DNA, 20 bp, mouse
gagtgacgcacagcgcaggg

SEQ ID NO: 510608 - DNA, 20 bp, mouse
ggcgagtgacgcacagcgca

SEQ ID NO: 510609 - DNA, 20 bp, mouse
gagacacctttcgaaggaaa

SEQ ID NO: 510610 - DNA, 20 bp, mouse
gcagcgcagggcggttggcg

SEQ ID NO: 510611 - DNA, 20 bp, mouse
gagggcggttggcgaggaga

SEQ ID NO: 510612 - DNA, 20 bp, mouse
gcaatgtagacacctttcga

SEQ ID NO: 510613 - DNA, 20 bp, mouse
gacggtcatggggaagggtt

SEQ ID NO: 510614 - DNA, 20 bp, mouse
gggaattgcgagtgcacctg

SEQ ID NO: 510615 - DNA, 20 bp, mouse
gcagagggaacacggtcatg

SEQ ID NO: 510616 - DNA, 20 bp, mouse
gccgccgagttgcttaactg

SEQ ID NO: 510617 - DNA, 20 bp, mouse
gggaggacaggatggaggtt

SEQ ID NO: 510618 - DNA, 20 bp, mouse
gtcgtaacctagcaacataa

SEQ ID NO: 510619 - DNA, 20 bp, mouse
gcaggctgtgtgcacctagt

SEQ ID NO: 510620 - DNA, 20 bp, mouse
ggaagcaagactatcagaag

SEQ ID NO: 510621 - DNA, 20 bp, mouse
ggtgcttgcaggaggcctag

SEQ ID NO: 510622 - DNA, 20 bp, mouse
gggcccacagttaagcaact

SEQ ID NO: 510623 - DNA, 20 bp, mouse
ggtgacagcggggaagcccc

SEQ ID NO: 510624 - DNA, 20 bp, mouse
gggagctggtgagtgacagc

SEQ ID NO: 510625 - DNA, 20 bp, mouse
ggaggggagaaatcactgga

SEQ ID NO: 510626 - DNA, 20 bp, mouse
ggtggtgcccaggctcatag

SEQ ID NO: 510627 - DNA, 20 bp, mouse
gcagagctcgcaggacccgg

SEQ ID NO: 510628 - DNA, 20 bp, mouse
ggcgctgccgctatgagcct

SEQ ID NO: 510629 - DNA, 20 bp, mouse
ggggcagagctcgcaggacc

SEQ ID NO: 510630 - DNA, 20 bp, mouse
ggagcgcaggcgggagctag

SEQ ID NO: 510631 - DNA, 20 bp, mouse
gtggcaggcctcccaagccg

SEQ ID NO: 510632 - DNA, 20 bp, mouse
ggtctccgaggctatatctg

SEQ ID NO: 510633 - DNA, 20 bp, mouse
gggttgccatggtaccaggg

SEQ ID NO: 510634 - DNA, 20 bp, mouse
gagccgagggcagagctcgc

SEQ ID NO: 510635 - DNA, 20 bp, mouse
gacggtaaggagccttgggg

SEQ ID NO: 510636 - DNA, 20 bp, mouse
gccggaggagcacagacctg

SEQ ID NO: 510637 - DNA, 20 bp, mouse
gccaatccatgcgtgaataa

SEQ ID NO: 510638 - DNA, 20 bp, mouse
gtcgtcctgagagctctatg

SEQ ID NO: 510639 - DNA, 20 bp, mouse
ggaaggaagtagctgtgtgg

SEQ ID NO: 510640 - DNA, 20 bp, mouse
gcgcatggattgggtgtaga

SEQ ID NO: 510641 - DNA, 20 bp, mouse
ggtggcccatgatgtcataa

SEQ ID NO: 510642 - DNA, 20 bp, mouse
gctgttcacatcaatgccgg

SEQ ID NO: 510643 - DNA, 20 bp, mouse
ggtgtccccatagagctctc

SEQ ID NO: 510644 - DNA, 20 bp, mouse
gggtaggctggtctctgaat

SEQ ID NO: 510645 - DNA, 20 bp, mouse
gcagaccctgaggcatcaga

SEQ ID NO: 510646 - DNA, 20 bp, mouse
gaaccctgactgaccatggt

SEQ ID NO: 510647 - DNA, 20 bp, mouse
gaaaggagcaacacctagag

SEQ ID NO: 510648 - DNA, 20 bp, mouse
gcggcccctgctgaagccaa

SEQ ID NO: 510649 - DNA, 20 bp, mouse
gctgactgaccatggtggga

SEQ ID NO: 510650 - DNA, 20 bp, mouse
gaagtcctggatgactccag

SEQ ID NO: 510651 - DNA, 20 bp, mouse
gggaatgaacatctgaagct

SEQ ID NO: 510652 - DNA, 20 bp, mouse
gaggatatgtctttacccca

SEQ ID NO: 510653 - DNA, 20 bp, mouse
gacagtgacagttgggtcaa

SEQ ID NO: 510654 - DNA, 20 bp, mouse
ggccatcctcacctgccctg

SEQ ID NO: 510655 - DNA, 20 bp, mouse
gcagatgttcattcctctct

SEQ ID NO: 510656 - DNA, 20 bp, mouse
gcccatggctggggttacga

SEQ ID NO: 510657 - DNA, 20 bp, mouse
gggctggggttacgatggaa

SEQ ID NO: 510658 - DNA, 20 bp, mouse
gaatcccttaagttccccca

SEQ ID NO: 510659 - DNA, 20 bp, mouse
gcagccatgggggaacttaa

SEQ ID NO: 510660 - DNA, 20 bp, mouse
gactcttcttgccagcctcg

SEQ ID NO: 510661 - DNA, 20 bp, mouse
gacatgcccggtctccacag

SEQ ID NO: 510662 - DNA, 20 bp, mouse
gctatactcctccagccacg

SEQ ID NO: 510663 - DNA, 20 bp, mouse
gtagggatactgggccactg

SEQ ID NO: 510664 - DNA, 20 bp, mouse
ggagataagtccagcatcta

SEQ ID NO: 510665 - DNA, 20 bp, mouse
gaccgggcatgtgctaaaat

SEQ ID NO: 510666 - DNA, 20 bp, mouse
ggctaggagagcagaccgga

SEQ ID NO: 510667 - DNA, 20 bp, mouse
ggagcagaccggagggtgat

SEQ ID NO: 510668 - DNA, 20 bp, mouse
gagatgttcccatcaccctc

SEQ ID NO: 510669 - DNA, 20 bp, mouse
gacatctagcccctaaccat

SEQ ID NO: 510670 - DNA, 20 bp, mouse
gtcatccgcagactgtacat

SEQ ID NO: 510671 - DNA, 20 bp, mouse
gatccagcagacagagtaga

SEQ ID NO: 510672 - DNA, 20 bp, mouse
gacaaattacccatggttag

SEQ ID NO: 510673 - DNA, 20 bp, mouse
gaggagtgatgacgtcataa

SEQ ID NO: 510674 - DNA, 20 bp, mouse
gacagcccatgtacagtctg

SEQ ID NO: 510675 - DNA, 20 bp, mouse
gtgtagaattcagatctcag

SEQ ID NO: 510676 - DNA, 20 bp, mouse
ggctagggtagcctaaatga

SEQ ID NO: 510677 - DNA, 20 bp, mouse
ggagtggactctaaagacca

SEQ ID NO: 510678 - DNA, 20 bp, mouse
gagcctaaatgacggatgag

SEQ ID NO: 510679 - DNA, 20 bp, mouse
gcactctgctcattatccac

SEQ ID NO: 510680 - DNA, 20 bp, mouse
gtcaaaagagacctgcccag

SEQ ID NO: 510681 - DNA, 20 bp, mouse
gacagattataggccatcat

SEQ ID NO: 510682 - DNA, 20 bp, mouse
gaaggtaagtaggcatctta

SEQ ID NO: 510683 - DNA, 20 bp, mouse
ggataatgagcagagtgtga

SEQ ID NO: 510684 - DNA, 20 bp, mouse
ggtccactcatccgtcattt

SEQ ID NO: 510685 - DNA, 20 bp, mouse
gtgctcattatccactgggc

SEQ ID NO: 510686 - DNA, 20 bp, mouse
gctgggctggtagagaggta

SEQ ID NO: 510687 - DNA, 20 bp, mouse
gtctctaccagcccagctgg

SEQ ID NO: 510688 - DNA, 20 bp, mouse
gaggcgggaaccaaactaat

SEQ ID NO: 510689 - DNA, 20 bp, mouse
gcagtctccattctaggaag

SEQ ID NO: 510690 - DNA, 20 bp, mouse
gttcccgcctccagctgggc

SEQ ID NO: 510691 - DNA, 20 bp, mouse
gccaaactaatcggtagcta

SEQ ID NO: 510692 - DNA, 20 bp, mouse
ggcatttattccggagactg

SEQ ID NO: 510693 - DNA, 20 bp, mouse
gtcgcacagctagaatactg

SEQ ID NO: 510694 - DNA, 20 bp, mouse
ggcctaagcgcggagagggg

SEQ ID NO: 510695 - DNA, 20 bp, mouse
ggccgcttacaaagacgaaa

SEQ ID NO: 510696 - DNA, 20 bp, mouse
gcctgcgccatgactaagga

SEQ ID NO: 510697 - DNA, 20 bp, mouse
gagaagacactaggctccgg

SEQ ID NO: 510698 - DNA, 20 bp, mouse
gtgggcctgcgccatgacta

SEQ ID NO: 510699 - DNA, 20 bp, mouse
gggcagaagacactaggctc

SEQ ID NO: 510700 - DNA, 20 bp, mouse
ggtcatggcgcaggcccagg

SEQ ID NO: 510701 - DNA, 20 bp, mouse
gacgggtgcccgcaccatct

SEQ ID NO: 510702 - DNA, 20 bp, mouse
gacactaggctccggaggta

SEQ ID NO: 510703 - DNA, 20 bp, mouse
gccggaggtatggcctcctg

SEQ ID NO: 510704 - DNA, 20 bp, mouse
ggcatgatgccctaaagtgt

SEQ ID NO: 510705 - DNA, 20 bp, mouse
gatggggtcgctgtcctcct

SEQ ID NO: 510706 - DNA, 20 bp, mouse
gtgagaggagactgaatcag

SEQ ID NO: 510707 - DNA, 20 bp, mouse
ggagcccggtgtcactgtgg

SEQ ID NO: 510708 - DNA, 20 bp, mouse
gtcctcggaagcacagagcc

SEQ ID NO: 510709 - DNA, 20 bp, mouse
gggaatgtgaagcgagtgtg

SEQ ID NO: 510710 - DNA, 20 bp, mouse
gattcccccacagtgacacc

SEQ ID NO: 510711 - DNA, 20 bp, mouse
gacagagcccggtgtcactg

SEQ ID NO: 510712 - DNA, 20 bp, mouse
ggcatcagagagcctcaaag

SEQ ID NO: 510713 - DNA, 20 bp, mouse
gtgcaaaagccggtgaaagg

SEQ ID NO: 510714 - DNA, 20 bp, mouse
gaccgggctctgtgcttccg

SEQ ID NO: 510715 - DNA, 20 bp, mouse
gtgaatcagaggctggcgca

SEQ ID NO: 510716 - DNA, 20 bp, mouse
gctcctcacgcagcacgctg

SEQ ID NO: 510717 - DNA, 20 bp, mouse
ggtagaaaccgcgtccatgg

SEQ ID NO: 510718 - DNA, 20 bp, mouse
gtgctgcgtgaggaggcgag

SEQ ID NO: 510719 - DNA, 20 bp, mouse
gacaagtctcggcgccgcca

SEQ ID NO: 510720 - DNA, 20 bp, mouse
ggtagtgatcggcgaatccg

SEQ ID NO: 510721 - DNA, 20 bp, mouse
gggatcagatctgcgagggt

SEQ ID NO: 510722 - DNA, 20 bp, mouse
ggctgtagaaaccgcgtcca

SEQ ID NO: 510723 - DNA, 20 bp, mouse
gctcggcgccgccatggacg

SEQ ID NO: 510724 - DNA, 20 bp, mouse
gccggcgtgcgcgtagtgat

SEQ ID NO: 510725 - DNA, 20 bp, mouse
gtcacccgcctggcgcacag

SEQ ID NO: 510726 - DNA, 20 bp, mouse
gcgagtccaggtctccggtg

SEQ ID NO: 510727 - DNA, 20 bp, mouse
ggcagagaccttgaagacgc

SEQ ID NO: 510728 - DNA, 20 bp, mouse
ggcggccgagtccaggtctc

SEQ ID NO: 510729 - DNA, 20 bp, mouse
gggtctctgcgcttcctcac

SEQ ID NO: 510730 - DNA, 20 bp, mouse
ggcaggagttactgctgcta

SEQ ID NO: 510731 - DNA, 20 bp, mouse
gacggtcgcccgcgtcttca

SEQ ID NO: 510732 - DNA, 20 bp, mouse
gggacatggcggccgagtcc

SEQ ID NO: 510733 - DNA, 20 bp, mouse
gcagcgacagcccgcgcact

SEQ ID NO: 510734 - DNA, 20 bp, mouse
gtctcagtagaactaaccgg

SEQ ID NO: 510735 - DNA, 20 bp, mouse
gctgccgcagcgcctagcga

SEQ ID NO: 510736 - DNA, 20 bp, mouse
ggagcaccgagggagcggag

SEQ ID NO: 510737 - DNA, 20 bp, mouse
ggcgagtgaaggagcaccga

SEQ ID NO: 510738 - DNA, 20 bp, mouse
gtgaaggagcaccgagggag

SEQ ID NO: 510739 - DNA, 20 bp, mouse
gccccggtgtcagcgagacg

SEQ ID NO: 510740 - DNA, 20 bp, mouse
gccgccgcaggcgcgagtga

SEQ ID NO: 510741 - DNA, 20 bp, mouse
gaggggcgccccgagatcaa

SEQ ID NO: 510742 - DNA, 20 bp, mouse
ggcgctccgatcccacctct

SEQ ID NO: 510743 - DNA, 20 bp, mouse
ggctgaccgctccgctccct

SEQ ID NO: 510744 - DNA, 20 bp, mouse
gagcggggccgttgcaacga

SEQ ID NO: 510745 - DNA, 20 bp, mouse
gcggtcagctccgagaagcc

SEQ ID NO: 510746 - DNA, 20 bp, mouse
ggcggcgggagattcaaaac

SEQ ID NO: 510747 - DNA, 20 bp, mouse
gaggaacatggagccgtgcg

SEQ ID NO: 510748 - DNA, 20 bp, mouse
gaggggtggtgtcccagcgg

SEQ ID NO: 510749 - DNA, 20 bp, mouse
ggcgtgaccgcagtgagggg

SEQ ID NO: 510750 - DNA, 20 bp, mouse
ggagctcggcctgccgcgca

SEQ ID NO: 510751 - DNA, 20 bp, mouse
gagtttctggggctccaggg

SEQ ID NO: 510752 - DNA, 20 bp, mouse
gagggagtgcgccctttgaa

SEQ ID NO: 510753 - DNA, 20 bp, mouse
gtgcgggaaggatctgaggg

SEQ ID NO: 510754 - DNA, 20 bp, mouse
gcgggagattcaaaactggc

SEQ ID NO: 510755 - DNA, 20 bp, mouse
ggagctgcaaacccttcaaa

SEQ ID NO: 510756 - DNA, 20 bp, mouse
gggcctgctagtccaatcac

SEQ ID NO: 510757 - DNA, 20 bp, mouse
gagctacgcctggcaggcgg

SEQ ID NO: 510758 - DNA, 20 bp, mouse
gctggcaggcggcggcggaa

SEQ ID NO: 510759 - DNA, 20 bp, mouse
ggccaggcgtagctcaagtc

SEQ ID NO: 510760 - DNA, 20 bp, mouse
ggccggacttgagctacgcc

SEQ ID NO: 510761 - DNA, 20 bp, mouse
ggattggactagcaggccta

SEQ ID NO: 510762 - DNA, 20 bp, mouse
ggctagtccaatcaccggcc

SEQ ID NO: 510763 - DNA, 20 bp, mouse
ggtcgcaccgggccggtgat

SEQ ID NO: 510764 - DNA, 20 bp, mouse
gtgcaggttcacgcagccct

SEQ ID NO: 510765 - DNA, 20 bp, mouse
gttgagctacgcctggcagg

SEQ ID NO: 510766 - DNA, 20 bp, mouse
gcacacacacaccttcggaa

SEQ ID NO: 510767 - DNA, 20 bp, mouse
gcttcggaagggggaaactg

SEQ ID NO: 510768 - DNA, 20 bp, mouse
gggcggctgcgggcaccgag

SEQ ID NO: 510769 - DNA, 20 bp, mouse
gcccgacgtgaccttggcgg

SEQ ID NO: 510770 - DNA, 20 bp, mouse
gagaaagaggacccccgcca

SEQ ID NO: 510771 - DNA, 20 bp, mouse
gccgcccgacgtgaccttgg

SEQ ID NO: 510772 - DNA, 20 bp, mouse
ggtgccggcgatctaggtgg

SEQ ID NO: 510773 - DNA, 20 bp, mouse
gccgagaggtaggagcaggc

SEQ ID NO: 510774 - DNA, 20 bp, mouse
gacccccgccaaggtcacgt

SEQ ID NO: 510775 - DNA, 20 bp, mouse
gccgccggcccgacgcgtaa

SEQ ID NO: 510776 - DNA, 20 bp, mouse
ggcacggggcgcaggagcta

SEQ ID NO: 510777 - DNA, 20 bp, mouse
gtccttccgagccctggcgg

SEQ ID NO: 510778 - DNA, 20 bp, mouse
ggcgtccttccgagccctgg

SEQ ID NO: 510779 - DNA, 20 bp, mouse
gttccgagccctggcggtgg

SEQ ID NO: 510780 - DNA, 20 bp, mouse
gcctggcggcccagggacag

SEQ ID NO: 510781 - DNA, 20 bp, mouse
gggcccgggagacagcgctg

SEQ ID NO: 510782 - DNA, 20 bp, mouse
ggcagctgttggagacccag

SEQ ID NO: 510783 - DNA, 20 bp, mouse
ggagacagcgctggggccgg

SEQ ID NO: 510784 - DNA, 20 bp, mouse
ggccgcgtccttccgagccc

SEQ ID NO: 510785 - DNA, 20 bp, mouse
gggatctgagagccccaacc

SEQ ID NO: 510786 - DNA, 20 bp, mouse
ggagtctggacctgtcccag

SEQ ID NO: 510787 - DNA, 20 bp, mouse
gagtagtgaccgggtagcat

SEQ ID NO: 510788 - DNA, 20 bp, mouse
gcattggcaggggataggga

SEQ ID NO: 510789 - DNA, 20 bp, mouse
ggtagcattggcaggggata

SEQ ID NO: 510790 - DNA, 20 bp, mouse
ggaccgggtagcattggcag

SEQ ID NO: 510791 - DNA, 20 bp, mouse
gaggggtgggagtagtgacc

SEQ ID NO: 510792 - DNA, 20 bp, mouse
gccctggaggagcagcaggt

SEQ ID NO: 510793 - DNA, 20 bp, mouse
gactcatggaacccccctgg

SEQ ID NO: 510794 - DNA, 20 bp, mouse
gcttgagtgggtgaattcct

SEQ ID NO: 510795 - DNA, 20 bp, mouse
gggctcctccttctagggaa

SEQ ID NO: 510796 - DNA, 20 bp, mouse
gcaggcagtggggcagacgg

SEQ ID NO: 510797 - DNA, 20 bp, mouse
gccgccgcccgcctaggcgc

SEQ ID NO: 510798 - DNA, 20 bp, mouse
ggcccgcctaggcgcaggca

SEQ ID NO: 510799 - DNA, 20 bp, mouse
ggcgcatcgatgagctggag

SEQ ID NO: 510800 - DNA, 20 bp, mouse
ggccctgcctgcgcctaggc

SEQ ID NO: 510801 - DNA, 20 bp, mouse
gctgcgccctgcctgcgcct

SEQ ID NO: 510802 - DNA, 20 bp, mouse
ggatgcgctggcgctgggta

SEQ ID NO: 510803 - DNA, 20 bp, mouse
gcggcagcacaacaactcga

SEQ ID NO: 510804 - DNA, 20 bp, mouse
ggcccagcagctctggcggt

SEQ ID NO: 510805 - DNA, 20 bp, mouse
gctgcgccaggagctgaccg

SEQ ID NO: 510806 - DNA, 20 bp, mouse
gcagaaaggagctgcttccg

SEQ ID NO: 510807 - DNA, 20 bp, mouse
gatagctatcacagaccaag

SEQ ID NO: 510808 - DNA, 20 bp, mouse
gacaggtaagaggacacgtt

SEQ ID NO: 510809 - DNA, 20 bp, mouse
gactagagaagggtcaaaag

SEQ ID NO: 510810 - DNA, 20 bp, mouse
gctgccagcttcctctgcca

SEQ ID NO: 510811 - DNA, 20 bp, mouse
gccgatctctcttggataca

SEQ ID NO: 510812 - DNA, 20 bp, mouse
gtatttcttgaacaggtaag

SEQ ID NO: 510813 - DNA, 20 bp, mouse
gtagtaggtaagacaatgac

SEQ ID NO: 510814 - DNA, 20 bp, mouse
gtggctgctggttctaactg

SEQ ID NO: 510815 - DNA, 20 bp, mouse
gagaggagagtgcccgcatc

SEQ ID NO: 510816 - DNA, 20 bp, mouse
gcgcccgccgaggccccgag

SEQ ID NO: 510817 - DNA, 20 bp, mouse
gccccgggccgaggcctctc

SEQ ID NO: 510818 - DNA, 20 bp, mouse
ggcacgaggccggcctgaag

SEQ ID NO: 510819 - DNA, 20 bp, mouse
gctaaggcccgcgcccgccg

SEQ ID NO: 510820 - DNA, 20 bp, mouse
gggaagtgagtcagtgtccg

SEQ ID NO: 510821 - DNA, 20 bp, mouse
gagcggcacataacccaggg

SEQ ID NO: 510822 - DNA, 20 bp, mouse
gccgcggacccggcccgcta

SEQ ID NO: 510823 - DNA, 20 bp, mouse
ggctgggcgcctggaaccac

SEQ ID NO: 510824 - DNA, 20 bp, mouse
gcgactggtgccagttcggt

SEQ ID NO: 510825 - DNA, 20 bp, mouse
gcaccagtcggcgggctcca

SEQ ID NO: 510826 - DNA, 20 bp, mouse
gggttgcagcgacatagctg

SEQ ID NO: 510827 - DNA, 20 bp, mouse
gatgaacacccgcgatgcag

SEQ ID NO: 510828 - DNA, 20 bp, mouse
gcccggccccggtcagccca

SEQ ID NO: 510829 - DNA, 20 bp, mouse
gcgagtgagcagcaccaagg

SEQ ID NO: 510830 - DNA, 20 bp, mouse
gacacccgcgatgcaggggc

SEQ ID NO: 510831 - DNA, 20 bp, mouse
ggttcttgcaggccatgagg

SEQ ID NO: 510832 - DNA, 20 bp, mouse
gttcatggaactggttccct

SEQ ID NO: 510833 - DNA, 20 bp, mouse
ggcctcggccgacacctcct

SEQ ID NO: 510834 - DNA, 20 bp, mouse
gagttcgctgcggcccataa

SEQ ID NO: 510835 - DNA, 20 bp, mouse
gagcagcaccaaggaggtgt

SEQ ID NO: 510836 - DNA, 20 bp, mouse
gtcgccaggcagtctcgcca

SEQ ID NO: 510837 - DNA, 20 bp, mouse
gtggtagatgtagcaagcca

SEQ ID NO: 510838 - DNA, 20 bp, mouse
gctggcgactgagcctgtgg

SEQ ID NO: 510839 - DNA, 20 bp, mouse
gtgcctggcgactgagcctg

SEQ ID NO: 510840 - DNA, 20 bp, mouse
ggcagcgccgccctttacta

SEQ ID NO: 510841 - DNA, 20 bp, mouse
gcacaggtcgtccagcaccc

SEQ ID NO: 510842 - DNA, 20 bp, mouse
gagtcgcggccctccgccac

SEQ ID NO: 510843 - DNA, 20 bp, mouse
gcgactgagcctgtggcgga

SEQ ID NO: 510844 - DNA, 20 bp, mouse
gccctttactagggaagtcg

SEQ ID NO: 510845 - DNA, 20 bp, mouse
gaagccatggcgagactgcc

SEQ ID NO: 510846 - DNA, 20 bp, mouse
ggaccccacgcagagaagca

SEQ ID NO: 510847 - DNA, 20 bp, mouse
gttgtgaaaggcggtgacag

SEQ ID NO: 510848 - DNA, 20 bp, mouse
gaagctccgggcagccgtcg

SEQ ID NO: 510849 - DNA, 20 bp, mouse
gccccactgtcagagaggga

SEQ ID NO: 510850 - DNA, 20 bp, mouse
ggaatttccgcggttgtgaa

SEQ ID NO: 510851 - DNA, 20 bp, mouse
gtcgtggagctgaatttccg

SEQ ID NO: 510852 - DNA, 20 bp, mouse
gtttccgcggttgtgaaagg

SEQ ID NO: 510853 - DNA, 20 bp, mouse
gcgcgccacgggccccgcac

SEQ ID NO: 510854 - DNA, 20 bp, mouse
gggtcgaagagcagcaactg

SEQ ID NO: 510855 - DNA, 20 bp, mouse
gccgcaccggccggccatcg

SEQ ID NO: 510856 - DNA, 20 bp, mouse
ggggatgctgcgggtcaccg

SEQ ID NO: 510857 - DNA, 20 bp, mouse
ggctaagggtgagagtatag

SEQ ID NO: 510858 - DNA, 20 bp, mouse
gagggagggcaggtcagcta

SEQ ID NO: 510859 - DNA, 20 bp, mouse
ggggcatcatatccccctgt

SEQ ID NO: 510860 - DNA, 20 bp, mouse
gagcaagcgagacactccgg

SEQ ID NO: 510861 - DNA, 20 bp, mouse
gaagggtgagagtatagggg

SEQ ID NO: 510862 - DNA, 20 bp, mouse
ggaggacagcggagagatcg

SEQ ID NO: 510863 - DNA, 20 bp, mouse
gcggtccggcgaggactcgg

SEQ ID NO: 510864 - DNA, 20 bp, mouse
ggaagcgagggacgtccgag

SEQ ID NO: 510865 - DNA, 20 bp, mouse
ggcctgcgatcgggatgctg

SEQ ID NO: 510866 - DNA, 20 bp, mouse
gaagacgggcggacgggcag

SEQ ID NO: 510867 - DNA, 20 bp, mouse
gagggcccgaccgccccccc

SEQ ID NO: 510868 - DNA, 20 bp, mouse
gcctccccgcagggataata

SEQ ID NO: 510869 - DNA, 20 bp, mouse
gagggaggaagacgggcgga

SEQ ID NO: 510870 - DNA, 20 bp, mouse
ggagaacgaccaagccctga

SEQ ID NO: 510871 - DNA, 20 bp, mouse
ggaaggaagcagtctcgcgc

SEQ ID NO: 510872 - DNA, 20 bp, mouse
gcgtaagcagagcacagcga

SEQ ID NO: 510873 - DNA, 20 bp, mouse
gcgcgcgtcccgctcttcag

SEQ ID NO: 510874 - DNA, 20 bp, mouse
gctgcttacggtcacccggg

SEQ ID NO: 510875 - DNA, 20 bp, mouse
ggggcgggcagagaaagacg

SEQ ID NO: 510876 - DNA, 20 bp, mouse
gctaccaagaggccccgcag

SEQ ID NO: 510877 - DNA, 20 bp, mouse
gtcctacctcgacgaaggag

SEQ ID NO: 510878 - DNA, 20 bp, mouse
gaccactccttcgtcgaggt

SEQ ID NO: 510879 - DNA, 20 bp, mouse
ggcgcaccactccttcgtcg

SEQ ID NO: 510880 - DNA, 20 bp, mouse
gctgcaggagcgattcgcag

SEQ ID NO: 510881 - DNA, 20 bp, mouse
ggacccggtccagccagtca

SEQ ID NO: 510882 - DNA, 20 bp, mouse
ggagctgcgcgggcaccgac

SEQ ID NO: 510883 - DNA, 20 bp, mouse
gtgcgcgcgacggccactct

SEQ ID NO: 510884 - DNA, 20 bp, mouse
ggcacgtcctacctcgacga

SEQ ID NO: 510885 - DNA, 20 bp, mouse
ggtgcgcactggcgagtccg

SEQ ID NO: 510886 - DNA, 20 bp, mouse
gactgttctcaggcaagccg

SEQ ID NO: 510887 - DNA, 20 bp, mouse
gttcgatctggactgttctc

SEQ ID NO: 510888 - DNA, 20 bp, mouse
gccgtcagttgaataatcgc

SEQ ID NO: 510889 - DNA, 20 bp, mouse
gaaaactaaaagttagtccc

SEQ ID NO: 510890 - DNA, 20 bp, mouse
gcaaggtgtgagtgttgtta

SEQ ID NO: 510891 - DNA, 20 bp, mouse
gtcagcagccccagtaccag

SEQ ID NO: 510892 - DNA, 20 bp, mouse
gctctcgagggcatgttgac

SEQ ID NO: 510893 - DNA, 20 bp, mouse
gccagatcgaaagcaaaaca

SEQ ID NO: 510894 - DNA, 20 bp, mouse
gtgctgaggctgcaaagagg

SEQ ID NO: 510895 - DNA, 20 bp, mouse
ggcatgttgacggggacagg

SEQ ID NO: 510896 - DNA, 20 bp, mouse
ggagcggcgggagcctgggg

SEQ ID NO: 510897 - DNA, 20 bp, mouse
gccctgcgaagcggcctctg

SEQ ID NO: 510898 - DNA, 20 bp, mouse
ggtcggcggcgcgagcggag

SEQ ID NO: 510899 - DNA, 20 bp, mouse
gaaggaggtggaggcgacgg

SEQ ID NO: 510900 - DNA, 20 bp, mouse
ggccgttgcagcggcgtcgg

SEQ ID NO: 510901 - DNA, 20 bp, mouse
gcggcgcccgaggcccatcg

SEQ ID NO: 510902 - DNA, 20 bp, mouse
ggccgccgacgccgctgcaa

SEQ ID NO: 510903 - DNA, 20 bp, mouse
ggcggccgttgcagcggcgt

SEQ ID NO: 510904 - DNA, 20 bp, mouse
gggcggcgggtgcacagcag

SEQ ID NO: 510905 - DNA, 20 bp, mouse
ggcgacggcggccgttgcag

SEQ ID NO: 510906 - DNA, 20 bp, mouse
gcgcgcgcgggatccacggg

SEQ ID NO: 510907 - DNA, 20 bp, mouse
ggcaggagctgaggcgcagt

SEQ ID NO: 510908 - DNA, 20 bp, mouse
gagagccgcgcgaggtacgg

SEQ ID NO: 510909 - DNA, 20 bp, mouse
ggcggcgtgcagctcggtcc

SEQ ID NO: 510910 - DNA, 20 bp, mouse
ggcgcgcgcgcgggatccac

SEQ ID NO: 510911 - DNA, 20 bp, mouse
gcacgactggcgccgagagg

SEQ ID NO: 510912 - DNA, 20 bp, mouse
gtccagaccggggcaaagac

SEQ ID NO: 510913 - DNA, 20 bp, mouse
gggctggggcctccagaccg

SEQ ID NO: 510914 - DNA, 20 bp, mouse
gggcgcccccggggcacgag

SEQ ID NO: 510915 - DNA, 20 bp, mouse
gcctcacccggctcctcctg

SEQ ID NO: 510916 - DNA, 20 bp, mouse
gctcgctcgcctggaatgtg

SEQ ID NO: 510917 - DNA, 20 bp, mouse
gaggcgagcgagagcgggaa

SEQ ID NO: 510918 - DNA, 20 bp, mouse
gcgtctcagcgctcctgctc

SEQ ID NO: 510919 - DNA, 20 bp, mouse
gttgttactctacgttccgg

SEQ ID NO: 510920 - DNA, 20 bp, mouse
gccaagacacacgagagcag

SEQ ID NO: 510921 - DNA, 20 bp, mouse
ggagcgctgagacgcgcctc

SEQ ID NO: 510922 - DNA, 20 bp, mouse
gggccctcccggggaatcag

SEQ ID NO: 510923 - DNA, 20 bp, mouse
gatcccgcgcggccaagccg

SEQ ID NO: 510924 - DNA, 20 bp, mouse
gtgattgttactctacgttc

SEQ ID NO: 510925 - DNA, 20 bp, mouse
gcattccaggcgagcgagag

SEQ ID NO: 510926 - DNA, 20 bp, mouse
gtaggcggaaggccaaaaaa

SEQ ID NO: 510927 - DNA, 20 bp, mouse
ggaaatcccggagcgcactt

SEQ ID NO: 510928 - DNA, 20 bp, mouse
gcttccgcgttacctaccag

SEQ ID NO: 510929 - DNA, 20 bp, mouse
gtaacgcggaagagccggga

SEQ ID NO: 510930 - DNA, 20 bp, mouse
gaggaagtcccagcgctcgg

SEQ ID NO: 510931 - DNA, 20 bp, mouse
gcctcccctggtaggtaacg

SEQ ID NO: 510932 - DNA, 20 bp, mouse
gaaataaagtcaagaaatcc

SEQ ID NO: 510933 - DNA, 20 bp, mouse
ggcggcgcgggtgccagcag

SEQ ID NO: 510934 - DNA, 20 bp, mouse
ggaggaattgggcgcccgtg

SEQ ID NO: 510935 - DNA, 20 bp, mouse
ggagtctcagaactactgtt

SEQ ID NO: 510936 - DNA, 20 bp, mouse
gtaagagtgcgggtgaggta

SEQ ID NO: 510937 - DNA, 20 bp, mouse
gctgccctcagctaagagtg

SEQ ID NO: 510938 - DNA, 20 bp, mouse
gtcttagctgagggcagcaa

SEQ ID NO: 510939 - DNA, 20 bp, mouse
gcacccgcactcttagctga

SEQ ID NO: 510940 - DNA, 20 bp, mouse
gccgaagtgcacaggtccta

SEQ ID NO: 510941 - DNA, 20 bp, mouse
gcctgtagtcgggcagaagg

SEQ ID NO: 510942 - DNA, 20 bp, mouse
gctggagcagagagagtcag

SEQ ID NO: 510943 - DNA, 20 bp, mouse
ggtgaggtaaggcctgtagt

SEQ ID NO: 510944 - DNA, 20 bp, mouse
gctagggcagcgtagatgag

SEQ ID NO: 510945 - DNA, 20 bp, mouse
gtggtgaaactaggaaagtg

SEQ ID NO: 510946 - DNA, 20 bp, mouse
gcggccgcagcgccaggccg

SEQ ID NO: 510947 - DNA, 20 bp, mouse
gagcaaacaggtaggtcccg

SEQ ID NO: 510948 - DNA, 20 bp, mouse
gcgcggtgggcgatgatcga

SEQ ID NO: 510949 - DNA, 20 bp, mouse
gcggggctccaggctccccg

SEQ ID NO: 510950 - DNA, 20 bp, mouse
gcaacacagcccacagcccc

SEQ ID NO: 510951 - DNA, 20 bp, mouse
gagtctggcggggaccaggg

SEQ ID NO: 510952 - DNA, 20 bp, mouse
gggtgggcgatgatcgaagg

SEQ ID NO: 510953 - DNA, 20 bp, mouse
gacccgcgggcggtgcagct

SEQ ID NO: 510954 - DNA, 20 bp, mouse
gtcgggatcccgctcctccg

SEQ ID NO: 510955 - DNA, 20 bp, mouse
gaggtaggtcccggggctgt

SEQ ID NO: 510956 - DNA, 20 bp, mouse
gagagcagtgcatacctcag

SEQ ID NO: 510957 - DNA, 20 bp, mouse
gagctggcagtgctattcct

SEQ ID NO: 510958 - DNA, 20 bp, mouse
gcctgggtctctggccgctg

SEQ ID NO: 510959 - DNA, 20 bp, mouse
gttggacagagagcgtggaa

SEQ ID NO: 510960 - DNA, 20 bp, mouse
ggtgctctgaagtctgtaga

SEQ ID NO: 510961 - DNA, 20 bp, mouse
gcccagaagacactaggtgg

SEQ ID NO: 510962 - DNA, 20 bp, mouse
gagatcaagaatatggtcaa

SEQ ID NO: 510963 - DNA, 20 bp, mouse
gcgctccgctagcctggatg

SEQ ID NO: 510964 - DNA, 20 bp, mouse
gaggagagggagcaggtaga

SEQ ID NO: 510965 - DNA, 20 bp, mouse
gcagctttggacagagagcg

SEQ ID NO: 510966 - DNA, 20 bp, mouse
gctctgagcactgggcaccg

SEQ ID NO: 510967 - DNA, 20 bp, mouse
gtaggtgcggctgggaaccg

SEQ ID NO: 510968 - DNA, 20 bp, mouse
gctcccccgacggctaggtg

SEQ ID NO: 510969 - DNA, 20 bp, mouse
gagcacaggagctcccccga

SEQ ID NO: 510970 - DNA, 20 bp, mouse
ggcaggggctgtggcatcca

SEQ ID NO: 510971 - DNA, 20 bp, mouse
gggcccgcacctgcccacct

SEQ ID NO: 510972 - DNA, 20 bp, mouse
gactgggcaccgaggtgggc

SEQ ID NO: 510973 - DNA, 20 bp, mouse
ggggcctgtgccggccgcag

SEQ ID NO: 510974 - DNA, 20 bp, mouse
ggcgtgaccagaccgtgcag

SEQ ID NO: 510975 - DNA, 20 bp, mouse
gagccgcacctagccgtcgg

SEQ ID NO: 510976 - DNA, 20 bp, mouse
ggctccggtaccaggtatgt

SEQ ID NO: 510977 - DNA, 20 bp, mouse
gaggtgagctagtgccacag

SEQ ID NO: 510978 - DNA, 20 bp, mouse
ggggattgggatctgagtaa

SEQ ID NO: 510979 - DNA, 20 bp, mouse
gctcttgggccactcgggga

SEQ ID NO: 510980 - DNA, 20 bp, mouse
ggctcacctccctccccgag

SEQ ID NO: 510981 - DNA, 20 bp, mouse
gcccaagagtcccacatacc

SEQ ID NO: 510982 - DNA, 20 bp, mouse
ggtttgaggactgcactggt

SEQ ID NO: 510983 - DNA, 20 bp, mouse
gaacaggagggcagacgtcc

SEQ ID NO: 510984 - DNA, 20 bp, mouse
ggtcacatctacagccacct

SEQ ID NO: 510985 - DNA, 20 bp, mouse
ggagataaaacccgtcccgg

SEQ ID NO: 510986 - DNA, 20 bp, mouse
gcgggcagcgtgggaaccgg

SEQ ID NO: 510987 - DNA, 20 bp, mouse
ggtgggaaccggcggcaggt

SEQ ID NO: 510988 - DNA, 20 bp, mouse
gaggtaggacgcgatggggt

SEQ ID NO: 510989 - DNA, 20 bp, mouse
gcggcaggtaggacgcgatg

SEQ ID NO: 510990 - DNA, 20 bp, mouse
ggcgcgggcagcgtgggaac

SEQ ID NO: 510991 - DNA, 20 bp, mouse
gccggaggcgcgggcagcgt

SEQ ID NO: 510992 - DNA, 20 bp, mouse
ggcctccaggagcccgcggg

SEQ ID NO: 510993 - DNA, 20 bp, mouse
gactccgtttgggcgaaggt

SEQ ID NO: 510994 - DNA, 20 bp, mouse
gaggagcccgcgggcggtcc

SEQ ID NO: 510995 - DNA, 20 bp, mouse
gaccgcccgcgggctcctgg

SEQ ID NO: 510996 - DNA, 20 bp, mouse
gtctgcggcggggaccaact

SEQ ID NO: 510997 - DNA, 20 bp, mouse
ggggtggggactgtagaaag

SEQ ID NO: 510998 - DNA, 20 bp, mouse
gaactgggagcgatgagagg

SEQ ID NO: 510999 - DNA, 20 bp, mouse
gaccaactgggagcgatgag

SEQ ID NO: 511000 - DNA, 20 bp, mouse
gagggcggagctgaagaaat

SEQ ID NO: 511001 - DNA, 20 bp, mouse
gggagaaggtcagtaggctg

SEQ ID NO: 511002 - DNA, 20 bp, mouse
gctacccctctagcaaagag

SEQ ID NO: 511003 - DNA, 20 bp, mouse
gtgatatcacagggccagac

SEQ ID NO: 511004 - DNA, 20 bp, mouse
gagcaactctgcgtctgcgg

SEQ ID NO: 511005 - DNA, 20 bp, mouse
gaagagcaactctgcgtctg

SEQ ID NO: 511006 - DNA, 20 bp, mouse
ggaggaagcaatgggatcat

SEQ ID NO: 511007 - DNA, 20 bp, mouse
gcaagccaggaaggcagttt

SEQ ID NO: 511008 - DNA, 20 bp, mouse
gagcatcatgttgctctgga

SEQ ID NO: 511009 - DNA, 20 bp, mouse
gtgttgctctggagggtaac

SEQ ID NO: 511010 - DNA, 20 bp, mouse
gtctggagggtaactggctc

SEQ ID NO: 511011 - DNA, 20 bp, mouse
ggccaacagatagctaaatc

SEQ ID NO: 511012 - DNA, 20 bp, mouse
gaaggtatcgtagcacttga

SEQ ID NO: 511013 - DNA, 20 bp, mouse
gcagagcaacatgatgctca

SEQ ID NO: 511014 - DNA, 20 bp, mouse
ggtgcacagggaacttgcca

SEQ ID NO: 511015 - DNA, 20 bp, mouse
ggcctgatttagctatctgt

SEQ ID NO: 511016 - DNA, 20 bp, mouse
gcaccagctgggagagtgtg

SEQ ID NO: 511017 - DNA, 20 bp, mouse
gctggagagcctggccctca

SEQ ID NO: 511018 - DNA, 20 bp, mouse
gggaggagaccccaccagct

SEQ ID NO: 511019 - DNA, 20 bp, mouse
gcaggcaggtgagtccctga

SEQ ID NO: 511020 - DNA, 20 bp, mouse
ggatcttgggctaaccgggg

SEQ ID NO: 511021 - DNA, 20 bp, mouse
ggcctgggaaggggtagctg

SEQ ID NO: 511022 - DNA, 20 bp, mouse
gtgtgatcttgggctaaccg

SEQ ID NO: 511023 - DNA, 20 bp, mouse
ggaggctgaacagtaagagg

SEQ ID NO: 511024 - DNA, 20 bp, mouse
gagcaacaggttgtgatctt

SEQ ID NO: 511025 - DNA, 20 bp, mouse
gagctggggctggggataca

SEQ ID NO: 511026 - DNA, 20 bp, mouse
gcttctggtgacagaggagt

SEQ ID NO: 511027 - DNA, 20 bp, mouse
ggcgccttagtgacaggtga

SEQ ID NO: 511028 - DNA, 20 bp, mouse
gaggcaccttctggtgacag

SEQ ID NO: 511029 - DNA, 20 bp, mouse
gctggtagcgccttagtgac

SEQ ID NO: 511030 - DNA, 20 bp, mouse
gtcaccatcacctgtcacta

SEQ ID NO: 511031 - DNA, 20 bp, mouse
gtcaccagaaggtgcctcgt

SEQ ID NO: 511032 - DNA, 20 bp, mouse
gtcacccacgaggcaccttc

SEQ ID NO: 511033 - DNA, 20 bp, mouse
ggcctcgtgggtgagcaaag

SEQ ID NO: 511034 - DNA, 20 bp, mouse
gtcacagccttctacagcgc

SEQ ID NO: 511035 - DNA, 20 bp, mouse
gacctctttgctcacccacg

SEQ ID NO: 511036 - DNA, 20 bp, mouse
ggaggagacgaaccaagagg

SEQ ID NO: 511037 - DNA, 20 bp, mouse
gtgagaggagacgaaccaag

SEQ ID NO: 511038 - DNA, 20 bp, mouse
gggtctggagtccttctgag

SEQ ID NO: 511039 - DNA, 20 bp, mouse
gtctccggtctagaaagtgc

SEQ ID NO: 511040 - DNA, 20 bp, mouse
gacgcgatcagacctcctct

SEQ ID NO: 511041 - DNA, 20 bp, mouse
ggcctgcctgggcccagcgg

SEQ ID NO: 511042 - DNA, 20 bp, mouse
ggtactagacagtcaaagtg

SEQ ID NO: 511043 - DNA, 20 bp, mouse
gaaggggtgacgttccagga

SEQ ID NO: 511044 - DNA, 20 bp, mouse
gcatagggaacttctgccgg

SEQ ID NO: 511045 - DNA, 20 bp, mouse
ggttgagagatgagatgcag

SEQ ID NO: 511046 - DNA, 20 bp, mouse
gaagggcgagtagttctcca

SEQ ID NO: 511047 - DNA, 20 bp, mouse
gccccaaggagcagcaatga

SEQ ID NO: 511048 - DNA, 20 bp, mouse
gagttcgctgggtctcaaca

SEQ ID NO: 511049 - DNA, 20 bp, mouse
gccggagcccctcttaatga

SEQ ID NO: 511050 - DNA, 20 bp, mouse
gatggtgccatcattaagag

SEQ ID NO: 511051 - DNA, 20 bp, mouse
gtccaaggaccaagttcgct

SEQ ID NO: 511052 - DNA, 20 bp, mouse
gacccagcgaacttggtcct

SEQ ID NO: 511053 - DNA, 20 bp, mouse
gattaagaggggctccggaa

SEQ ID NO: 511054 - DNA, 20 bp, mouse
gggtaactgggccagattcc

SEQ ID NO: 511055 - DNA, 20 bp, mouse
gggccagattccaggtatag

SEQ ID NO: 511056 - DNA, 20 bp, mouse
ggtgtcttggagtgccactg

SEQ ID NO: 511057 - DNA, 20 bp, mouse
gacagccttagctagaaaga

SEQ ID NO: 511058 - DNA, 20 bp, mouse
gaaattcttcctctccgcag

SEQ ID NO: 511059 - DNA, 20 bp, mouse
gggcgtgtcacctctctgat

SEQ ID NO: 511060 - DNA, 20 bp, mouse
gacccccagggcctattcct

SEQ ID NO: 511061 - DNA, 20 bp, mouse
gccttaagacgagctgacgg

SEQ ID NO: 511062 - DNA, 20 bp, mouse
gtttctagctaaggctgttt

SEQ ID NO: 511063 - DNA, 20 bp, mouse
gaatcaccaaccgatcagag

SEQ ID NO: 511064 - DNA, 20 bp, mouse
gttccaagaccggtgtgtct

SEQ ID NO: 511065 - DNA, 20 bp, mouse
gctccaagacacaccggtct

SEQ ID NO: 511066 - DNA, 20 bp, mouse
gcagaggacgcgtcctcggg

SEQ ID NO: 511067 - DNA, 20 bp, mouse
gctgcagaggacgcgtcctc

SEQ ID NO: 511068 - DNA, 20 bp, mouse
gcgcagagaccgcggcgctg

SEQ ID NO: 511069 - DNA, 20 bp, mouse
gtccagaggggaactcggga

SEQ ID NO: 511070 - DNA, 20 bp, mouse
gctggaagtagcgattcccg

SEQ ID NO: 511071 - DNA, 20 bp, mouse
gagctcaatcgcagagaccg

SEQ ID NO: 511072 - DNA, 20 bp, mouse
gggtcgagtccgatgtaggg

SEQ ID NO: 511073 - DNA, 20 bp, mouse
gcctggtcgagtccgatgta

SEQ ID NO: 511074 - DNA, 20 bp, mouse
gtgcagcagagaaggagcta

SEQ ID NO: 511075 - DNA, 20 bp, mouse
gggaatcgctacttccagag

SEQ ID NO: 511076 - DNA, 20 bp, mouse
gacggcagcagcggccccag

SEQ ID NO: 511077 - DNA, 20 bp, mouse
ggacaagcccgggtcgtcgt

SEQ ID NO: 511078 - DNA, 20 bp, mouse
gcggggaccgcgacaagccc

SEQ ID NO: 511079 - DNA, 20 bp, mouse
gctgccaccaacgacgaccc

SEQ ID NO: 511080 - DNA, 20 bp, mouse
gaagcccgggtcgtcgttgg

SEQ ID NO: 511081 - DNA, 20 bp, mouse
ggtcgcgcagtgcagaacgg

SEQ ID NO: 511082 - DNA, 20 bp, mouse
ggcggccccagtggcagtgt

SEQ ID NO: 511083 - DNA, 20 bp, mouse
gctggctgggtcgagagtcg

SEQ ID NO: 511084 - DNA, 20 bp, mouse
gcgatgtgttactcactgtg

SEQ ID NO: 511085 - DNA, 20 bp, mouse
ggggcgccgcccgagagccc

SEQ ID NO: 511086 - DNA, 20 bp, mouse
ggaacaaggagcctgtacac

SEQ ID NO: 511087 - DNA, 20 bp, mouse
gtccaagtcaggagagggcg

SEQ ID NO: 511088 - DNA, 20 bp, mouse
gggtgagccgagggacacgt

SEQ ID NO: 511089 - DNA, 20 bp, mouse
gcacacgcactcctgtgtac

SEQ ID NO: 511090 - DNA, 20 bp, mouse
gaggagtgcgtgtgtcccag

SEQ ID NO: 511091 - DNA, 20 bp, mouse
ggttcactccaagtcaggag

SEQ ID NO: 511092 - DNA, 20 bp, mouse
gtccacgccctctcctgact

SEQ ID NO: 511093 - DNA, 20 bp, mouse
gcagtgacaccaggactcct

SEQ ID NO: 511094 - DNA, 20 bp, mouse
gcgcccccggaggagactgt

SEQ ID NO: 511095 - DNA, 20 bp, mouse
gggccccacagtctcctccg

SEQ ID NO: 511096 - DNA, 20 bp, mouse
gaaaccacggtgcatcacca

SEQ ID NO: 511097 - DNA, 20 bp, mouse
gctctggccaccaagcgctt

SEQ ID NO: 511098 - DNA, 20 bp, mouse
ggagaaggagcaactcgcca

SEQ ID NO: 511099 - DNA, 20 bp, mouse
gccacaggcagctaccccag

SEQ ID NO: 511100 - DNA, 20 bp, mouse
gcagtctcctaagcgcttgg

SEQ ID NO: 511101 - DNA, 20 bp, mouse
gtcagactcggaatccgaag

SEQ ID NO: 511102 - DNA, 20 bp, mouse
gtcgccatggtgatgcaccg

SEQ ID NO: 511103 - DNA, 20 bp, mouse
gactgctgctagagctgcgg

SEQ ID NO: 511104 - DNA, 20 bp, mouse
gcctgaggaagcagaagcat

SEQ ID NO: 511105 - DNA, 20 bp, mouse
gaccctttgggagaatctaa

SEQ ID NO: 511106 - DNA, 20 bp, mouse
gcggcgcgcgatctcggata

SEQ ID NO: 511107 - DNA, 20 bp, mouse
ggcggccgccctccgctcgg

SEQ ID NO: 511108 - DNA, 20 bp, mouse
gcgagatcgcgcgccgactg

SEQ ID NO: 511109 - DNA, 20 bp, mouse
gggagggcggccgccgcagt

SEQ ID NO: 511110 - DNA, 20 bp, mouse
ggagccccgccgccgagcgg

SEQ ID NO: 511111 - DNA, 20 bp, mouse
ggatcgcgcgccgactgcgg

SEQ ID NO: 511112 - DNA, 20 bp, mouse
gtgagagccccgccgccgag

SEQ ID NO: 511113 - DNA, 20 bp, mouse
ggacatgtccgcgggctcgg

SEQ ID NO: 511114 - DNA, 20 bp, mouse
gatgtccgcgggctcggtgg

SEQ ID NO: 511115 - DNA, 20 bp, mouse
gtcggcccagtgctcgctgg

SEQ ID NO: 511116 - DNA, 20 bp, mouse
ggccggcggtcgggatttgg

SEQ ID NO: 511117 - DNA, 20 bp, mouse
ggcggcagcgcggagccggt

SEQ ID NO: 511118 - DNA, 20 bp, mouse
gcctgcgggtaggacatggt

SEQ ID NO: 511119 - DNA, 20 bp, mouse
gatcggcggggcggcggtag

SEQ ID NO: 511120 - DNA, 20 bp, mouse
gcgcggggctggaggatcgg

SEQ ID NO: 511121 - DNA, 20 bp, mouse
gccggccgggcgtggatgga

SEQ ID NO: 511122 - DNA, 20 bp, mouse
gagtcaggagtgaggagttg

SEQ ID NO: 511123 - DNA, 20 bp, mouse
gcaggccggcggtcgggatt

SEQ ID NO: 511124 - DNA, 20 bp, mouse
gcccgcgtcacacggagcag

SEQ ID NO: 511125 - DNA, 20 bp, mouse
gggcgcgcggctgcgcccac

SEQ ID NO: 511126 - DNA, 20 bp, mouse
gcgccgcggagcagatcaat

SEQ ID NO: 511127 - DNA, 20 bp, mouse
gtgatctgctccgcggcggg

SEQ ID NO: 511128 - DNA, 20 bp, mouse
gaggtcaggtccgaacagat

SEQ ID NO: 511129 - DNA, 20 bp, mouse
gagattggccgagattccct

SEQ ID NO: 511130 - DNA, 20 bp, mouse
gcgcctattgatctgctccg

SEQ ID NO: 511131 - DNA, 20 bp, mouse
gagctcccgggcgttcgggt

SEQ ID NO: 511132 - DNA, 20 bp, mouse
ggaatctcggccaatctgtt

SEQ ID NO: 511133 - DNA, 20 bp, mouse
gcggctccggagcgcatcgg

SEQ ID NO: 511134 - DNA, 20 bp, mouse
gaaggcgccgtaaccctgag

SEQ ID NO: 511135 - DNA, 20 bp, mouse
ggcgccgtaaccctgagcgg

SEQ ID NO: 511136 - DNA, 20 bp, mouse
gcactcctggctgcccgcta

SEQ ID NO: 511137 - DNA, 20 bp, mouse
ggggagcaagcgacaactaa

SEQ ID NO: 511138 - DNA, 20 bp, mouse
gccggagcgcgcgcgcccag

SEQ ID NO: 511139 - DNA, 20 bp, mouse
gcggccgcgcagagccctag

SEQ ID NO: 511140 - DNA, 20 bp, mouse
ggggcgcgcgcgctccggcg

SEQ ID NO: 511141 - DNA, 20 bp, mouse
ggcccggcgccactgcaggt

SEQ ID NO: 511142 - DNA, 20 bp, mouse
gaactaatggagacatttcc

SEQ ID NO: 511143 - DNA, 20 bp, mouse
gtgcccgctagggctctgcg

SEQ ID NO: 511144 - DNA, 20 bp, mouse
gcgcgcagcccgggacgcac

SEQ ID NO: 511145 - DNA, 20 bp, mouse
ggttgtcgcttgctccccgc

SEQ ID NO: 511146 - DNA, 20 bp, mouse
gcctgcgagggcgagcgaga

SEQ ID NO: 511147 - DNA, 20 bp, mouse
gcccccggtgcaaagagcga

SEQ ID NO: 511148 - DNA, 20 bp, mouse
ggcgcgggaagccaaccagg

SEQ ID NO: 511149 - DNA, 20 bp, mouse
gggcgcgcgggaagccaacc

SEQ ID NO: 511150 - DNA, 20 bp, mouse
gcgcggagcccgaagaagag

SEQ ID NO: 511151 - DNA, 20 bp, mouse
gctcgaagagctgcggcccg

SEQ ID NO: 511152 - DNA, 20 bp, mouse
ggccggggctcgaagagctg

SEQ ID NO: 511153 - DNA, 20 bp, mouse
ggagggagccgtgaaggcag

SEQ ID NO: 511154 - DNA, 20 bp, mouse
ggcccgcggcgcctcctggt

SEQ ID NO: 511155 - DNA, 20 bp, mouse
gcggtgcaaagagcgaggga

SEQ ID NO: 511156 - DNA, 20 bp, mouse
ggggccaccgagtgtgccaa

SEQ ID NO: 511157 - DNA, 20 bp, mouse
gagagtgcgtgcatgtacac

SEQ ID NO: 511158 - DNA, 20 bp, mouse
gagaggggcccatggatcgg

SEQ ID NO: 511159 - DNA, 20 bp, mouse
ggctgcaggcgaaagagggt

SEQ ID NO: 511160 - DNA, 20 bp, mouse
gggatctagcggcgagtcga

SEQ ID NO: 511161 - DNA, 20 bp, mouse
gggcagaggggcccatggat

SEQ ID NO: 511162 - DNA, 20 bp, mouse
ggaggtgtcccagtccaagg

SEQ ID NO: 511163 - DNA, 20 bp, mouse
gcccgaggtgtcccagtcca

SEQ ID NO: 511164 - DNA, 20 bp, mouse
gtgaggtacagcgcagcgtc

SEQ ID NO: 511165 - DNA, 20 bp, mouse
gctgcccttggcacactcgg

SEQ ID NO: 511166 - DNA, 20 bp, mouse
gccgcgcgcggagctcgatg

SEQ ID NO: 511167 - DNA, 20 bp, mouse
ggcgcctgcgcaggagcttg

SEQ ID NO: 511168 - DNA, 20 bp, mouse
gtgcagagcgagcctggacg

SEQ ID NO: 511169 - DNA, 20 bp, mouse
gacgcgggcggccctcacac

SEQ ID NO: 511170 - DNA, 20 bp, mouse
gacgctgtcccgatcctctg

SEQ ID NO: 511171 - DNA, 20 bp, mouse
ggagcgggacgggcgacggg

SEQ ID NO: 511172 - DNA, 20 bp, mouse
ggcgtcagccccagaggatc

SEQ ID NO: 511173 - DNA, 20 bp, mouse
gcaggaggcgtcagccccag

SEQ ID NO: 511174 - DNA, 20 bp, mouse
ggagaccctagtccgcgtcc

SEQ ID NO: 511175 - DNA, 20 bp, mouse
gttgctcacagcccgcacgg

SEQ ID NO: 511176 - DNA, 20 bp, mouse
gctaactgccgaggcggtca

SEQ ID NO: 511177 - DNA, 20 bp, mouse
ggcctcggcagttagggaca

SEQ ID NO: 511178 - DNA, 20 bp, mouse
gcggagcttgcggagtaaga

SEQ ID NO: 511179 - DNA, 20 bp, mouse
ggcgctcgggaaggtatcga

SEQ ID NO: 511180 - DNA, 20 bp, mouse
gatgacagccctgaccgcct

SEQ ID NO: 511181 - DNA, 20 bp, mouse
ggccttgtccctaactgccg

SEQ ID NO: 511182 - DNA, 20 bp, mouse
gggcaccagatgaccctcta

SEQ ID NO: 511183 - DNA, 20 bp, mouse
ggagcctgcgatgtaaagaa

SEQ ID NO: 511184 - DNA, 20 bp, mouse
ggggatttggaccatgctag

SEQ ID NO: 511185 - DNA, 20 bp, mouse
gcgagggtggaacgtcactt

SEQ ID NO: 511186 - DNA, 20 bp, mouse
gcacgggagctggccgtctg

SEQ ID NO: 511187 - DNA, 20 bp, mouse
gaggtcgacgcagctcaagc

SEQ ID NO: 511188 - DNA, 20 bp, mouse
gggagctggccgtctgaggc

SEQ ID NO: 511189 - DNA, 20 bp, mouse
gccagcaccgaggagccccg

SEQ ID NO: 511190 - DNA, 20 bp, mouse
ggctggccgtctgaggcggg

SEQ ID NO: 511191 - DNA, 20 bp, mouse
ggtgctggtgatctgcgcaa

SEQ ID NO: 511192 - DNA, 20 bp, mouse
gcaaggctgacagcccagaa

SEQ ID NO: 511193 - DNA, 20 bp, mouse
gacactcggagtgacggccg

SEQ ID NO: 511194 - DNA, 20 bp, mouse
ggagcgctcggtccaaccaa

SEQ ID NO: 511195 - DNA, 20 bp, mouse
ggggtgcgcgaaccatcgag

SEQ ID NO: 511196 - DNA, 20 bp, mouse
gtggggaacgaacgagtcat

SEQ ID NO: 511197 - DNA, 20 bp, mouse
gggaacgaacgagtcattgg

SEQ ID NO: 511198 - DNA, 20 bp, mouse
ggagttccccagaagtttca

SEQ ID NO: 511199 - DNA, 20 bp, mouse
gtggttgacagccccctgaa

SEQ ID NO: 511200 - DNA, 20 bp, mouse
gggtacagtgtgtgagtcag

SEQ ID NO: 511201 - DNA, 20 bp, mouse
ggaataaaaacagccccaaa

SEQ ID NO: 511202 - DNA, 20 bp, mouse
gtaaacacagcgctaccctg

SEQ ID NO: 511203 - DNA, 20 bp, mouse
gagggggcgctcctgccaca

SEQ ID NO: 511204 - DNA, 20 bp, mouse
gctctgaccttgaaacttct

SEQ ID NO: 511205 - DNA, 20 bp, mouse
gcacacactgtaccagatct

SEQ ID NO: 511206 - DNA, 20 bp, mouse
ggagctagagcctgcagcaa

SEQ ID NO: 511207 - DNA, 20 bp, mouse
gatgagctgtgggtgtgaag

SEQ ID NO: 511208 - DNA, 20 bp, mouse
gccctaatagaggagaggat

SEQ ID NO: 511209 - DNA, 20 bp, mouse
gtggatggttcccctaatag

SEQ ID NO: 511210 - DNA, 20 bp, mouse
gtctctggaagaccctatca

SEQ ID NO: 511211 - DNA, 20 bp, mouse
gaccatccaggtatatgata

SEQ ID NO: 511212 - DNA, 20 bp, mouse
gggttcccctaatagaggag

SEQ ID NO: 511213 - DNA, 20 bp, mouse
gcccagaaggctatctttat

SEQ ID NO: 511214 - DNA, 20 bp, mouse
gaccagctctagatccctta

SEQ ID NO: 511215 - DNA, 20 bp, mouse
gcttctgggcccagccttaa

SEQ ID NO: 511216 - DNA, 20 bp, mouse
gagcatggcaggcatcccag

SEQ ID NO: 511217 - DNA, 20 bp, mouse
gcagaaagccctggaggatg

SEQ ID NO: 511218 - DNA, 20 bp, mouse
gcgacccgagggagagatca

SEQ ID NO: 511219 - DNA, 20 bp, mouse
ggtggcccaggatgcctgga

SEQ ID NO: 511220 - DNA, 20 bp, mouse
ggggctggcaggttgagtca

SEQ ID NO: 511221 - DNA, 20 bp, mouse
gcaaggctggccaggtaagg

SEQ ID NO: 511222 - DNA, 20 bp, mouse
gggcgaccctcagaaagccc

SEQ ID NO: 511223 - DNA, 20 bp, mouse
gccctaggaaggagctgagg

SEQ ID NO: 511224 - DNA, 20 bp, mouse
gcagggctcagggtgtagtt

SEQ ID NO: 511225 - DNA, 20 bp, mouse
gaggtggcactggagataat

SEQ ID NO: 511226 - DNA, 20 bp, mouse
gggtacaactcgaaggtggt

SEQ ID NO: 511227 - DNA, 20 bp, mouse
gccgtggaggtacaactcga

SEQ ID NO: 511228 - DNA, 20 bp, mouse
gtggaggtacaactcgaagg

SEQ ID NO: 511229 - DNA, 20 bp, mouse
gtacctccacggggcccgag

SEQ ID NO: 511230 - DNA, 20 bp, mouse
ggccgggacggcaagaacgc

SEQ ID NO: 511231 - DNA, 20 bp, mouse
ggcgccgacgtatgccggga

SEQ ID NO: 511232 - DNA, 20 bp, mouse
gttgccgtcccggcatacgt

SEQ ID NO: 511233 - DNA, 20 bp, mouse
gggaagtgggaccacggttc

SEQ ID NO: 511234 - DNA, 20 bp, mouse
gcctcccggaagtgggacca

SEQ ID NO: 511235 - DNA, 20 bp, mouse
gacagagtgcgccggaaccg

SEQ ID NO: 511236 - DNA, 20 bp, mouse
gggcggagttggcagagcgg

SEQ ID NO: 511237 - DNA, 20 bp, mouse
ggccggcggagttggcagag

SEQ ID NO: 511238 - DNA, 20 bp, mouse
gcagcagcggcggactcgca

SEQ ID NO: 511239 - DNA, 20 bp, mouse
gcgatttaagccggcggagt

SEQ ID NO: 511240 - DNA, 20 bp, mouse
ggccgcgccctcgcagatct

SEQ ID NO: 511241 - DNA, 20 bp, mouse
gggagtccgatttaagccgg

SEQ ID NO: 511242 - DNA, 20 bp, mouse
ggaagtttgagtaagagata

SEQ ID NO: 511243 - DNA, 20 bp, mouse
gctgggagtccgatttaagc

SEQ ID NO: 511244 - DNA, 20 bp, mouse
gcggactcccagatctgcga

SEQ ID NO: 511245 - DNA, 20 bp, mouse
gtggtgaatagcccacagag

SEQ ID NO: 511246 - DNA, 20 bp, mouse
ggaggctgggcgctcgaccc

SEQ ID NO: 511247 - DNA, 20 bp, mouse
ggagatgtgagcaaagcttg

SEQ ID NO: 511248 - DNA, 20 bp, mouse
gtgagcaaagcttgcggccg

SEQ ID NO: 511249 - DNA, 20 bp, mouse
gcacatctctctctgcatgg

SEQ ID NO: 511250 - DNA, 20 bp, mouse
gtcgctccttcaactccgcg

SEQ ID NO: 511251 - DNA, 20 bp, mouse
gaaacctctctaccttccta

SEQ ID NO: 511252 - DNA, 20 bp, mouse
ggctcacatctctctctgca

SEQ ID NO: 511253 - DNA, 20 bp, mouse
ggtttagcggattctacaag

SEQ ID NO: 511254 - DNA, 20 bp, mouse
gctgccttaggaaggtagag

SEQ ID NO: 511255 - DNA, 20 bp, mouse
gaggtcattccagccaactt

SEQ ID NO: 511256 - DNA, 20 bp, mouse
gctgggagcgaggaagctag

SEQ ID NO: 511257 - DNA, 20 bp, mouse
gagtcaggatgaagacaaga

SEQ ID NO: 511258 - DNA, 20 bp, mouse
ggtcgtgtgtgcagtcagtc

SEQ ID NO: 511259 - DNA, 20 bp, mouse
gaatcctaggctcacccggg

SEQ ID NO: 511260 - DNA, 20 bp, mouse
gtcccactagagccccccat

SEQ ID NO: 511261 - DNA, 20 bp, mouse
gcttctaacggggagagttt

SEQ ID NO: 511262 - DNA, 20 bp, mouse
gcataaagtcagctaggaac

SEQ ID NO: 511263 - DNA, 20 bp, mouse
gacaccctctaggtcacgat

SEQ ID NO: 511264 - DNA, 20 bp, mouse
gggagggctgggacttgcca

SEQ ID NO: 511265 - DNA, 20 bp, mouse
gagaagaaaccgaggcccag

SEQ ID NO: 511266 - DNA, 20 bp, mouse
gggtgagtagaggatctcta

SEQ ID NO: 511267 - DNA, 20 bp, mouse
ggtgtgcgcgcaaaagagaa

SEQ ID NO: 511268 - DNA, 20 bp, mouse
gtggcgggacgggcgcgtga

SEQ ID NO: 511269 - DNA, 20 bp, mouse
ggagatcctctactcacctc

SEQ ID NO: 511270 - DNA, 20 bp, mouse
gcgtgttgcggggcgtagaa

SEQ ID NO: 511271 - DNA, 20 bp, mouse
gtgggtgctaggggtacggt

SEQ ID NO: 511272 - DNA, 20 bp, mouse
ggaagctcgcgggcgctggc

SEQ ID NO: 511273 - DNA, 20 bp, mouse
ggggtacggtgggctggaaa

SEQ ID NO: 511274 - DNA, 20 bp, mouse
gacctcaggctgagacctgt

SEQ ID NO: 511275 - DNA, 20 bp, mouse
gtgtaaacgcagcacgaggt

SEQ ID NO: 511276 - DNA, 20 bp, mouse
gaggatggtgcgcctggctg

SEQ ID NO: 511277 - DNA, 20 bp, mouse
ggccgcgcgactcaagagga

SEQ ID NO: 511278 - DNA, 20 bp, mouse
gctgctcacgctgcacatca

SEQ ID NO: 511279 - DNA, 20 bp, mouse
gcggatccggagcctccgac

SEQ ID NO: 511280 - DNA, 20 bp, mouse
gcgagagtggaggtaactcc

SEQ ID NO: 511281 - DNA, 20 bp, mouse
gaggaggaggagggcttcag

SEQ ID NO: 511282 - DNA, 20 bp, mouse
gaggagcgcggggttagagg

SEQ ID NO: 511283 - DNA, 20 bp, mouse
gctcaagaggatggtgcgcc

SEQ ID NO: 511284 - DNA, 20 bp, mouse
gggcaccgcggccacatctg

SEQ ID NO: 511285 - DNA, 20 bp, mouse
ggtgctccttggtggaacgg

SEQ ID NO: 511286 - DNA, 20 bp, mouse
gctggcagagcagcctggaa

SEQ ID NO: 511287 - DNA, 20 bp, mouse
ggcctggaagggacacgatg

SEQ ID NO: 511288 - DNA, 20 bp, mouse
gggaaccgtgctcggctggg

SEQ ID NO: 511289 - DNA, 20 bp, mouse
ggcgggaaccgtgctcggct

SEQ ID NO: 511290 - DNA, 20 bp, mouse
ggcgctcccgccccaggagg

SEQ ID NO: 511291 - DNA, 20 bp, mouse
gtggagggacggagcagggt

SEQ ID NO: 511292 - DNA, 20 bp, mouse
gcccaggaggaggcgaggcg

SEQ ID NO: 511293 - DNA, 20 bp, mouse
gaccgtgctcggctgggcgg

SEQ ID NO: 511294 - DNA, 20 bp, mouse
ggccgcatcgtgtcccttcc

SEQ ID NO: 511295 - DNA, 20 bp, mouse
ggcggagagaggagattcca

SEQ ID NO: 511296 - DNA, 20 bp, mouse
ggcacgcgcggggaacatgg

SEQ ID NO: 511297 - DNA, 20 bp, mouse
ggcggcggcggagccctcgg

SEQ ID NO: 511298 - DNA, 20 bp, mouse
gccgccagcgcggccaccga

SEQ ID NO: 511299 - DNA, 20 bp, mouse
ggcaccggcacgccgcccga

SEQ ID NO: 511300 - DNA, 20 bp, mouse
gcacgggtgatgcagatcgt

SEQ ID NO: 511301 - DNA, 20 bp, mouse
gagtacgtggacctgcccaa

SEQ ID NO: 511302 - DNA, 20 bp, mouse
gcaggcgccgagcccaggga

SEQ ID NO: 511303 - DNA, 20 bp, mouse
gcgctcaccgcgaagccctt

SEQ ID NO: 511304 - DNA, 20 bp, mouse
gcagcagtcgcaggcctccg

SEQ ID NO: 511305 - DNA, 20 bp, mouse
ggacccacctggatctgcag

SEQ ID NO: 511306 - DNA, 20 bp, mouse
gactagtgacagtccagtgg

SEQ ID NO: 511307 - DNA, 20 bp, mouse
ggtgcgctgaagggacctag

SEQ ID NO: 511308 - DNA, 20 bp, mouse
gggaactagtgacagtccag

SEQ ID NO: 511309 - DNA, 20 bp, mouse
gcgctgaagggacctagtgg

SEQ ID NO: 511310 - DNA, 20 bp, mouse
ggtctcaggatggatcatca

SEQ ID NO: 511311 - DNA, 20 bp, mouse
gtcagcgcactctcccccac

SEQ ID NO: 511312 - DNA, 20 bp, mouse
ggtgtccaaagtgggcaaaa

SEQ ID NO: 511313 - DNA, 20 bp, mouse
gtggcctgctcgggagggag

SEQ ID NO: 511314 - DNA, 20 bp, mouse
gtcaggatggatcatcaggg

SEQ ID NO: 511315 - DNA, 20 bp, mouse
gacctcctgcggacagactg

SEQ ID NO: 511316 - DNA, 20 bp, mouse
ggcaaaaaggaggcccagta

SEQ ID NO: 511317 - DNA, 20 bp, mouse
gggcccagtacggggtcagt

SEQ ID NO: 511318 - DNA, 20 bp, mouse
gtccagcggggaaaaggtca

SEQ ID NO: 511319 - DNA, 20 bp, mouse
gggtcagtgggaatccagcg

SEQ ID NO: 511320 - DNA, 20 bp, mouse
gttcccactgaccccgtact

SEQ ID NO: 511321 - DNA, 20 bp, mouse
ggtgtctacaaagggcaaaa

SEQ ID NO: 511322 - DNA, 20 bp, mouse
gctgactacgtgtctacaaa

SEQ ID NO: 511323 - DNA, 20 bp, mouse
gtgcagggtgtcgggttcgg

SEQ ID NO: 511324 - DNA, 20 bp, mouse
ggcgcgggggtgtagacccg

SEQ ID NO: 511325 - DNA, 20 bp, mouse
ggtctcaggatagacccgcg

SEQ ID NO: 511326 - DNA, 20 bp, mouse
gtggcctcgggtgctgatcg

SEQ ID NO: 511327 - DNA, 20 bp, mouse
gcctcgggtgctgatcgcgg

SEQ ID NO: 511328 - DNA, 20 bp, mouse
gggccctgggacgagatcaa

SEQ ID NO: 511329 - DNA, 20 bp, mouse
gacctgcccggagggataga

SEQ ID NO: 511330 - DNA, 20 bp, mouse
ggaagagcattgctgcctag

SEQ ID NO: 511331 - DNA, 20 bp, mouse
ggcctgggcccagcgcccct

SEQ ID NO: 511332 - DNA, 20 bp, mouse
gctgggaagacaaggcttgc

SEQ ID NO: 511333 - DNA, 20 bp, mouse
gcccccagccggcagcacgg

SEQ ID NO: 511334 - DNA, 20 bp, mouse
ggccccagcgacggacaacg

SEQ ID NO: 511335 - DNA, 20 bp, mouse
gaccagtgcatggggaccca

SEQ ID NO: 511336 - DNA, 20 bp, mouse
gtccgcggtggggaggtcga

SEQ ID NO: 511337 - DNA, 20 bp, mouse
gagccgctcggcatccaaaa

SEQ ID NO: 511338 - DNA, 20 bp, mouse
gtggatgccgagcggctcct

SEQ ID NO: 511339 - DNA, 20 bp, mouse
gcgagcggctcctcggaagt

SEQ ID NO: 511340 - DNA, 20 bp, mouse
gagggatccggacgtgaaaa

SEQ ID NO: 511341 - DNA, 20 bp, mouse
gagatgcttaggtctaagga

SEQ ID NO: 511342 - DNA, 20 bp, mouse
gcggaagaagccgacttccg

SEQ ID NO: 511343 - DNA, 20 bp, mouse
gctcgagcggaggaatccaa

SEQ ID NO: 511344 - DNA, 20 bp, mouse
ggagggagacaaagatgctt

SEQ ID NO: 511345 - DNA, 20 bp, mouse
gacgccagcacctgtctagg

SEQ ID NO: 511346 - DNA, 20 bp, mouse
gcctggagcgaactgagtaa

SEQ ID NO: 511347 - DNA, 20 bp, mouse
ggcccagagtttactggact

SEQ ID NO: 511348 - DNA, 20 bp, mouse
gtgtaaccaaggaggagggt

SEQ ID NO: 511349 - DNA, 20 bp, mouse
gagcactggcctcagaccac

SEQ ID NO: 511350 - DNA, 20 bp, mouse
ggccatctagggcccatagg

SEQ ID NO: 511351 - DNA, 20 bp, mouse
ggcttcaggcagtccctggg

SEQ ID NO: 511352 - DNA, 20 bp, mouse
gactggactgggaatctttg

SEQ ID NO: 511353 - DNA, 20 bp, mouse
gcctctgctggcatctccct

SEQ ID NO: 511354 - DNA, 20 bp, mouse
ggatcttcaggtagaggcta

SEQ ID NO: 511355 - DNA, 20 bp, mouse
gtctacctgaagatctgcag

SEQ ID NO: 511356 - DNA, 20 bp, mouse
gacgcgggaacggaaaacag

SEQ ID NO: 511357 - DNA, 20 bp, mouse
gtgctcaggcgcccggaaca

SEQ ID NO: 511358 - DNA, 20 bp, mouse
gcaggcgcccggaacaaggc

SEQ ID NO: 511359 - DNA, 20 bp, mouse
gaggcaggcagacgcgggaa

SEQ ID NO: 511360 - DNA, 20 bp, mouse
ggcacactggcccagacctc

SEQ ID NO: 511361 - DNA, 20 bp, mouse
gtaggcgcgggatgacgcac

SEQ ID NO: 511362 - DNA, 20 bp, mouse
gattgcagtggagcttcggt

SEQ ID NO: 511363 - DNA, 20 bp, mouse
gagcacgttgcgttgcagag

SEQ ID NO: 511364 - DNA, 20 bp, mouse
ggaccggaagcgagggaggg

SEQ ID NO: 511365 - DNA, 20 bp, mouse
gttccccaacgcactcacca

SEQ ID NO: 511366 - DNA, 20 bp, mouse
gccagagttggatcagactg

SEQ ID NO: 511367 - DNA, 20 bp, mouse
ggtacttaccggcccagagt

SEQ ID NO: 511368 - DNA, 20 bp, mouse
gcaaccttacggcctaggat

SEQ ID NO: 511369 - DNA, 20 bp, mouse
ggtaagtacgaacctatcct

SEQ ID NO: 511370 - DNA, 20 bp, mouse
gcacccgagagccaacctta

SEQ ID NO: 511371 - DNA, 20 bp, mouse
gctatccacgaggatctcgg

SEQ ID NO: 511372 - DNA, 20 bp, mouse
gcgcaagtcacgcccatcag

SEQ ID NO: 511373 - DNA, 20 bp, mouse
gtcgctgccccagagccctc

SEQ ID NO: 511374 - DNA, 20 bp, mouse
gcgaggcgcgctacgagtac

SEQ ID NO: 511375 - DNA, 20 bp, mouse
ggtctgatccaactctgggc

SEQ ID NO: 511376 - DNA, 20 bp, mouse
gtgtttaccgggactcgggg

SEQ ID NO: 511377 - DNA, 20 bp, mouse
gtgtagtcggggctcgggac

SEQ ID NO: 511378 - DNA, 20 bp, mouse
gggaccggctgccatcttag

SEQ ID NO: 511379 - DNA, 20 bp, mouse
gcatcttagcggagggactg

SEQ ID NO: 511380 - DNA, 20 bp, mouse
gcggctgccatcttagcgga

SEQ ID NO: 511381 - DNA, 20 bp, mouse
ggcgtgtttaccgggactcg

SEQ ID NO: 511382 - DNA, 20 bp, mouse
gaacacgcgcaggcagactg

SEQ ID NO: 511383 - DNA, 20 bp, mouse
gccgcgggagaggaaccccc

SEQ ID NO: 511384 - DNA, 20 bp, mouse
ggagtctggacctagagccg

SEQ ID NO: 511385 - DNA, 20 bp, mouse
gcgcagccggtgtccgtggg

SEQ ID NO: 511386 - DNA, 20 bp, mouse
gcgtcggagaaacagcccca

SEQ ID NO: 511387 - DNA, 20 bp, mouse
gccaagacgccgaggagcta

SEQ ID NO: 511388 - DNA, 20 bp, mouse
gagcgtgagagtgcagcgag

SEQ ID NO: 511389 - DNA, 20 bp, mouse
gactcggggtgcggcctcac

SEQ ID NO: 511390 - DNA, 20 bp, mouse
ggcgcgagccccaagaacag

SEQ ID NO: 511391 - DNA, 20 bp, mouse
gtccgacgaccaagacgccg

SEQ ID NO: 511392 - DNA, 20 bp, mouse
gtcctcggcgtcttggtcgt

SEQ ID NO: 511393 - DNA, 20 bp, mouse
gagacgccgccctagctcct

SEQ ID NO: 511394 - DNA, 20 bp, mouse
ggccgaccgagaaaagactc

SEQ ID NO: 511395 - DNA, 20 bp, mouse
gcgggctctgcacaacgtca

SEQ ID NO: 511396 - DNA, 20 bp, mouse
gggctgtcctgagggctcgg

SEQ ID NO: 511397 - DNA, 20 bp, mouse
ggcgtgcacggctgtcctga

SEQ ID NO: 511398 - DNA, 20 bp, mouse
ggcgtgtcaggccaccgaac

SEQ ID NO: 511399 - DNA, 20 bp, mouse
gggagacgtggataacgacg

SEQ ID NO: 511400 - DNA, 20 bp, mouse
gaggcccgcctcctccccta

SEQ ID NO: 511401 - DNA, 20 bp, mouse
ggtgacgtagacttccggtt

SEQ ID NO: 511402 - DNA, 20 bp, mouse
gacgtagacttccggttcgg

SEQ ID NO: 511403 - DNA, 20 bp, mouse
ggtggcctgacacgcgtgca

SEQ ID NO: 511404 - DNA, 20 bp, mouse
gccggaactcaaggcttaag

SEQ ID NO: 511405 - DNA, 20 bp, mouse
gtttgggcggagcgagatgg

SEQ ID NO: 511406 - DNA, 20 bp, mouse
gaaggttcccgggaggacag

SEQ ID NO: 511407 - DNA, 20 bp, mouse
gggcgaggctggctcaactg

SEQ ID NO: 511408 - DNA, 20 bp, mouse
gccacatccccaaggttccc

SEQ ID NO: 511409 - DNA, 20 bp, mouse
ggatcgcccggagctagtgg

SEQ ID NO: 511410 - DNA, 20 bp, mouse
gtccgggatccacatcccca

SEQ ID NO: 511411 - DNA, 20 bp, mouse
ggttcagccgctgtcctccc

SEQ ID NO: 511412 - DNA, 20 bp, mouse
gctccagggaacagacacga

SEQ ID NO: 511413 - DNA, 20 bp, mouse
gatgtggatcccggattcca

SEQ ID NO: 511414 - DNA, 20 bp, mouse
gtcctgggtgggcccagtgg

SEQ ID NO: 511415 - DNA, 20 bp, mouse
gtccgagagcaggtcaggat

SEQ ID NO: 511416 - DNA, 20 bp, mouse
gagatcgccctctcagtgaa

SEQ ID NO: 511417 - DNA, 20 bp, mouse
gtgtttaggctaaagtccac

SEQ ID NO: 511418 - DNA, 20 bp, mouse
gcggctgcagcgccctggag

SEQ ID NO: 511419 - DNA, 20 bp, mouse
gcagcaaagcaaaccttaaa

SEQ ID NO: 511420 - DNA, 20 bp, mouse
gtgtccggcagcggccccag

SEQ ID NO: 511421 - DNA, 20 bp, mouse
gacttcgcgggaccgtgttt

SEQ ID NO: 511422 - DNA, 20 bp, mouse
ggagatgtggcaatccatct

SEQ ID NO: 511423 - DNA, 20 bp, mouse
gaaaggcagatgtcccttta

SEQ ID NO: 511424 - DNA, 20 bp, mouse
gacatctgcctttcactgag

SEQ ID NO: 511425 - DNA, 20 bp, mouse
gcagcgacgtactggttcgt

SEQ ID NO: 511426 - DNA, 20 bp, mouse
ggggatggagagagactcca

SEQ ID NO: 511427 - DNA, 20 bp, mouse
gcacctgtcagcaacgccag

SEQ ID NO: 511428 - DNA, 20 bp, mouse
gagagcctctcggactggac

SEQ ID NO: 511429 - DNA, 20 bp, mouse
ggactcagagcctctcggac

SEQ ID NO: 511430 - DNA, 20 bp, mouse
gttgtccggtccagtccgag

SEQ ID NO: 511431 - DNA, 20 bp, mouse
gtgtcagcaacgccaggggc

SEQ ID NO: 511432 - DNA, 20 bp, mouse
gtggaccggacaagcgccca

SEQ ID NO: 511433 - DNA, 20 bp, mouse
ggactccatgggcgcttgtc

SEQ ID NO: 511434 - DNA, 20 bp, mouse
gataatgaggtacaagccag

SEQ ID NO: 511435 - DNA, 20 bp, mouse
gcagtggccaaaacttcctc

SEQ ID NO: 511436 - DNA, 20 bp, mouse
gtcaggacgctcgcgaaccg

SEQ ID NO: 511437 - DNA, 20 bp, mouse
ggtcctggaggactagggag

SEQ ID NO: 511438 - DNA, 20 bp, mouse
gcgctcgcgaaccgaggctg

SEQ ID NO: 511439 - DNA, 20 bp, mouse
gtccatggcccgctgcgcgg

SEQ ID NO: 511440 - DNA, 20 bp, mouse
ggacacaggtctgccgggaa

SEQ ID NO: 511441 - DNA, 20 bp, mouse
ggggtgtcgcgatggtcgcg

SEQ ID NO: 511442 - DNA, 20 bp, mouse
gccccaagtgctactgaagg

SEQ ID NO: 511443 - DNA, 20 bp, mouse
gctaaggtcctggaggacta

SEQ ID NO: 511444 - DNA, 20 bp, mouse
ggagggtccaggccaccagg

SEQ ID NO: 511445 - DNA, 20 bp, mouse
gacttgagctaaggtcctgg

SEQ ID NO: 511446 - DNA, 20 bp, mouse
gctcgatccagggctcccag

SEQ ID NO: 511447 - DNA, 20 bp, mouse
gctttccagaaactgtacgg

SEQ ID NO: 511448 - DNA, 20 bp, mouse
gacacagtatcctcgatcca

SEQ ID NO: 511449 - DNA, 20 bp, mouse
ggtctctccagcctcggacg

SEQ ID NO: 511450 - DNA, 20 bp, mouse
gaggctggagagacccgctt

SEQ ID NO: 511451 - DNA, 20 bp, mouse
gtggtcctagaagaccaggg

SEQ ID NO: 511452 - DNA, 20 bp, mouse
ggagtttgcccaggctggag

SEQ ID NO: 511453 - DNA, 20 bp, mouse
gcctgtcccggtcccatctt

SEQ ID NO: 511454 - DNA, 20 bp, mouse
gatgggaccgggacaggcag

SEQ ID NO: 511455 - DNA, 20 bp, mouse
ggcagcactcgatccctccc

SEQ ID NO: 511456 - DNA, 20 bp, mouse
gctgcgcatggcattccctg

SEQ ID NO: 511457 - DNA, 20 bp, mouse
ggtccactgcagaagccaca

SEQ ID NO: 511458 - DNA, 20 bp, mouse
ggtccacaggagcaattcga

SEQ ID NO: 511459 - DNA, 20 bp, mouse
gggttcaaggcccagactgg

SEQ ID NO: 511460 - DNA, 20 bp, mouse
gtgccatgcgcaggaggctc

SEQ ID NO: 511461 - DNA, 20 bp, mouse
gattcctgtttaggacgttt

SEQ ID NO: 511462 - DNA, 20 bp, mouse
gccgtctatgcaggtcccaa

SEQ ID NO: 511463 - DNA, 20 bp, mouse
gttccctgtggcttctgcag

SEQ ID NO: 511464 - DNA, 20 bp, mouse
gggccagagcctcctgcgca

SEQ ID NO: 511465 - DNA, 20 bp, mouse
gagactggaggaacagcact

SEQ ID NO: 511466 - DNA, 20 bp, mouse
ggcgcggccgggaccatcta

SEQ ID NO: 511467 - DNA, 20 bp, mouse
gctgccctcctggtgatcga

SEQ ID NO: 511468 - DNA, 20 bp, mouse
gctaggtggaggatttagaa

SEQ ID NO: 511469 - DNA, 20 bp, mouse
gagagctaacacctccaagg

SEQ ID NO: 511470 - DNA, 20 bp, mouse
gaagccctcgatcaccagga

SEQ ID NO: 511471 - DNA, 20 bp, mouse
gagctctttggacctcggct

SEQ ID NO: 511472 - DNA, 20 bp, mouse
gttggacctcggctaggtgg

SEQ ID NO: 511473 - DNA, 20 bp, mouse
gtctttggacctcggctagg

SEQ ID NO: 511474 - DNA, 20 bp, mouse
gcagcaccgggagtgatgaa

SEQ ID NO: 511475 - DNA, 20 bp, mouse
ggagcaccccacaccctaga

SEQ ID NO: 511476 - DNA, 20 bp, mouse
gcctgtgcaactctggtcag

SEQ ID NO: 511477 - DNA, 20 bp, mouse
gagagttgcacaggatgcga

SEQ ID NO: 511478 - DNA, 20 bp, mouse
ggtgcagaccgaggtcccga

SEQ ID NO: 511479 - DNA, 20 bp, mouse
gcggtgctggcaggcgacag

SEQ ID NO: 511480 - DNA, 20 bp, mouse
ggagagagggacgccagaag

SEQ ID NO: 511481 - DNA, 20 bp, mouse
gacgctgtttggctactcgg

SEQ ID NO: 511482 - DNA, 20 bp, mouse
gtcccggagggcgatccctc

SEQ ID NO: 511483 - DNA, 20 bp, mouse
gggttgtaggagtgcccggt

SEQ ID NO: 511484 - DNA, 20 bp, mouse
gcgcagccatgcgctcttgg

SEQ ID NO: 511485 - DNA, 20 bp, mouse
gggaagcgaggtgcagaccg

SEQ ID NO: 511486 - DNA, 20 bp, mouse
ggggaagagcgggcactatg

SEQ ID NO: 511487 - DNA, 20 bp, mouse
gtatggggagctggacgcca

SEQ ID NO: 511488 - DNA, 20 bp, mouse
ggaggagatcgaggcgaccg

SEQ ID NO: 511489 - DNA, 20 bp, mouse
gttaggaagcggctccgggt

SEQ ID NO: 511490 - DNA, 20 bp, mouse
gcccggccggtaaaactcca

SEQ ID NO: 511491 - DNA, 20 bp, mouse
ggcagcagcaccgcgtggag

SEQ ID NO: 511492 - DNA, 20 bp, mouse
gctagacgcggaggccccgg

SEQ ID NO: 511493 - DNA, 20 bp, mouse
gtgtcctggggccaccgacc

SEQ ID NO: 511494 - DNA, 20 bp, mouse
gcccgctcttccctgtcctg

SEQ ID NO: 511495 - DNA, 20 bp, mouse
gcgcttcctaaacctcccag

SEQ ID NO: 511496 - DNA, 20 bp, mouse
gcagctagctgcgggcgtgg

SEQ ID NO: 511497 - DNA, 20 bp, mouse
gctgcgcgcggccccacccc

SEQ ID NO: 511498 - DNA, 20 bp, mouse
gccggctcacgctcactgtg

SEQ ID NO: 511499 - DNA, 20 bp, mouse
ggctgcgccagggagaacga

SEQ ID NO: 511500 - DNA, 20 bp, mouse
ggtgcccagagcctatccgt

SEQ ID NO: 511501 - DNA, 20 bp, mouse
gccccgcggacaggtagagc

SEQ ID NO: 511502 - DNA, 20 bp, mouse
gccaccgcgcgcgcccatgg

SEQ ID NO: 511503 - DNA, 20 bp, mouse
ggcgcggtgggagggacccg

SEQ ID NO: 511504 - DNA, 20 bp, mouse
ggcagcgcggcgccccggtg

SEQ ID NO: 511505 - DNA, 20 bp, mouse
gagagtctccagagaacaac

SEQ ID NO: 511506 - DNA, 20 bp, mouse
gcctggggcagcagcgggaa

SEQ ID NO: 511507 - DNA, 20 bp, mouse
gcagcgggaagggactgaag

SEQ ID NO: 511508 - DNA, 20 bp, mouse
gttgtacttagctggtcctg

SEQ ID NO: 511509 - DNA, 20 bp, mouse
gggactgaagaggggtgctg

SEQ ID NO: 511510 - DNA, 20 bp, mouse
gtacgcaaggagggagaacc

SEQ ID NO: 511511 - DNA, 20 bp, mouse
gtaagatagtagattccggg

SEQ ID NO: 511512 - DNA, 20 bp, mouse
ggccggagccggtgctccca

SEQ ID NO: 511513 - DNA, 20 bp, mouse
ggggtgctgaggtgaaagat

SEQ ID NO: 511514 - DNA, 20 bp, mouse
gtcccatggccaggattccg

SEQ ID NO: 511515 - DNA, 20 bp, mouse
gctgcacgccttgggagcac

SEQ ID NO: 511516 - DNA, 20 bp, mouse
gaagcccagagcagcggggt

SEQ ID NO: 511517 - DNA, 20 bp, mouse
gagaggccggtgtcccgggt

SEQ ID NO: 511518 - DNA, 20 bp, mouse
ggcgggccgcacagggcgag

SEQ ID NO: 511519 - DNA, 20 bp, mouse
gaaggcctgacgctccccag

SEQ ID NO: 511520 - DNA, 20 bp, mouse
gcggggtcggcgggccgcac

SEQ ID NO: 511521 - DNA, 20 bp, mouse
ggcgcgccggccccagccag

SEQ ID NO: 511522 - DNA, 20 bp, mouse
gctgtgtacagtggccccga

SEQ ID NO: 511523 - DNA, 20 bp, mouse
gccgccgaccccgctgctct

SEQ ID NO: 511524 - DNA, 20 bp, mouse
gccccagaggccggtgtccc

SEQ ID NO: 511525 - DNA, 20 bp, mouse
gtgtctgcgggaacccactg

SEQ ID NO: 511526 - DNA, 20 bp, mouse
gagagcgcagacctctcggc

SEQ ID NO: 511527 - DNA, 20 bp, mouse
gcctctcggcgggcatcgag

SEQ ID NO: 511528 - DNA, 20 bp, mouse
gtccgagagcgcagacctct

SEQ ID NO: 511529 - DNA, 20 bp, mouse
gcgggcatcgagaggacgcg

SEQ ID NO: 511530 - DNA, 20 bp, mouse
gcgagagccggagcaaggcc

SEQ ID NO: 511531 - DNA, 20 bp, mouse
gtctgcgctctcggaaggag

SEQ ID NO: 511532 - DNA, 20 bp, mouse
ggcggcactggactgcggag

SEQ ID NO: 511533 - DNA, 20 bp, mouse
gcccgggcggcactggactg

SEQ ID NO: 511534 - DNA, 20 bp, mouse
gagcagcgcgcggagccctc

SEQ ID NO: 511535 - DNA, 20 bp, mouse
gagctacccgagccaaggat

SEQ ID NO: 511536 - DNA, 20 bp, mouse
gaggcttaccccagccacac

SEQ ID NO: 511537 - DNA, 20 bp, mouse
ggaccccctgccctgctgta

SEQ ID NO: 511538 - DNA, 20 bp, mouse
gggtcgaggcacatatacag

SEQ ID NO: 511539 - DNA, 20 bp, mouse
gtggggtaagccttacagca

SEQ ID NO: 511540 - DNA, 20 bp, mouse
gggcaggagtctgaatcaaa

SEQ ID NO: 511541 - DNA, 20 bp, mouse
gaggttaactgggcactgtt

SEQ ID NO: 511542 - DNA, 20 bp, mouse
ggccagggaggagacaaggt

SEQ ID NO: 511543 - DNA, 20 bp, mouse
gtctgaatcaaagggaggat

SEQ ID NO: 511544 - DNA, 20 bp, mouse
gtaagccttacagcagggca

SEQ ID NO: 511545 - DNA, 20 bp, mouse
gtgagcagagcaaatggtcg

SEQ ID NO: 511546 - DNA, 20 bp, mouse
gggccatgcagagaagggta

SEQ ID NO: 511547 - DNA, 20 bp, mouse
gttactggccatgcagagaa

SEQ ID NO: 511548 - DNA, 20 bp, mouse
gatctgctccagctatgaag

SEQ ID NO: 511549 - DNA, 20 bp, mouse
ggcagctgtgtgagctgagt

SEQ ID NO: 511550 - DNA, 20 bp, mouse
gagaagagccctcttctggg

SEQ ID NO: 511551 - DNA, 20 bp, mouse
gggaagagccacttcatagc

SEQ ID NO: 511552 - DNA, 20 bp, mouse
ggatgtggcggagtgagggg

SEQ ID NO: 511553 - DNA, 20 bp, mouse
gctgagtggggcgacacaga

SEQ ID NO: 511554 - DNA, 20 bp, mouse
gggaagctgagtactttctg

SEQ ID NO: 511555 - DNA, 20 bp, mouse
ggatagcatctgaagacagg

SEQ ID NO: 511556 - DNA, 20 bp, mouse
gctggcaacctagacccggg

SEQ ID NO: 511557 - DNA, 20 bp, mouse
gttgctggcaacctagaccc

SEQ ID NO: 511558 - DNA, 20 bp, mouse
gacctagacccgggaggaag

SEQ ID NO: 511559 - DNA, 20 bp, mouse
ggcgcttaggagggacctgt

SEQ ID NO: 511560 - DNA, 20 bp, mouse
gtgcatggggccccttccag

SEQ ID NO: 511561 - DNA, 20 bp, mouse
gaagatgaggagccactcca

SEQ ID NO: 511562 - DNA, 20 bp, mouse
gcgtggaaggaagagcgggt

SEQ ID NO: 511563 - DNA, 20 bp, mouse
gagatcgagtccggacccac

SEQ ID NO: 511564 - DNA, 20 bp, mouse
gagccactccaggggatgga

SEQ ID NO: 511565 - DNA, 20 bp, mouse
gtaggagggacctgtgggtc

SEQ ID NO: 511566 - DNA, 20 bp, mouse
gcttctggtcacaggtatgt

SEQ ID NO: 511567 - DNA, 20 bp, mouse
ggtaggtggggagagatcaa

SEQ ID NO: 511568 - DNA, 20 bp, mouse
gctggtcacaggtatgtcgg

SEQ ID NO: 511569 - DNA, 20 bp, mouse
gtcataggaaggagtaggtg

SEQ ID NO: 511570 - DNA, 20 bp, mouse
ggggtcttgggggatcctca

SEQ ID NO: 511571 - DNA, 20 bp, mouse
ggtcatgacttaaaggaaca

SEQ ID NO: 511572 - DNA, 20 bp, mouse
gtatgtcggcggggtcttgg

SEQ ID NO: 511573 - DNA, 20 bp, mouse
gaataggaaggagctaggtg

SEQ ID NO: 511574 - DNA, 20 bp, mouse
gctgaaagaagtgtgaactg

SEQ ID NO: 511575 - DNA, 20 bp, mouse
ggaatggagaggaaggtcat

SEQ ID NO: 511576 - DNA, 20 bp, mouse
gggtgcctggcgctgagaag

SEQ ID NO: 511577 - DNA, 20 bp, mouse
gctggcgctgagaagtggcg

SEQ ID NO: 511578 - DNA, 20 bp, mouse
ggaggagcggtgtccgaccc

SEQ ID NO: 511579 - DNA, 20 bp, mouse
gcggggcgagcacagtacct

SEQ ID NO: 511580 - DNA, 20 bp, mouse
gcgaggggcagcaggagacc

SEQ ID NO: 511581 - DNA, 20 bp, mouse
ggagccgggcggcacccagg

SEQ ID NO: 511582 - DNA, 20 bp, mouse
ggcgacagagccggagtccc

SEQ ID NO: 511583 - DNA, 20 bp, mouse
gcagcagcaggaggccgccg

SEQ ID NO: 511584 - DNA, 20 bp, mouse
gggtgtccgacccgggactc

SEQ ID NO: 511585 - DNA, 20 bp, mouse
gctgggctcgaagaagtcca

SEQ ID NO: 511586 - DNA, 20 bp, mouse
gtccaggtacagctcatgac

SEQ ID NO: 511587 - DNA, 20 bp, mouse
gaagcaggctctgagcaact

SEQ ID NO: 511588 - DNA, 20 bp, mouse
gagcagaagaaaggctatcc

SEQ ID NO: 511589 - DNA, 20 bp, mouse
gagagatcaggaccttggta

SEQ ID NO: 511590 - DNA, 20 bp, mouse
gatgactggagaacagaagc

SEQ ID NO: 511591 - DNA, 20 bp, mouse
gagtcaggcccgtgagatgg

SEQ ID NO: 511592 - DNA, 20 bp, mouse
ggacgacggctgagacataa

SEQ ID NO: 511593 - DNA, 20 bp, mouse
gtccagtcatgagctgtacc

SEQ ID NO: 511594 - DNA, 20 bp, mouse
gaggctgtggttgagagatc

SEQ ID NO: 511595 - DNA, 20 bp, mouse
gttctcatttgcttcttctg

SEQ ID NO: 511596 - DNA, 20 bp, mouse
gtgaagagccgccagacccg

SEQ ID NO: 511597 - DNA, 20 bp, mouse
gtggtctcgggtggcgtcgg

SEQ ID NO: 511598 - DNA, 20 bp, mouse
gcttctcggttggtctcggg

SEQ ID NO: 511599 - DNA, 20 bp, mouse
ggagaccaaccgagaagccg

SEQ ID NO: 511600 - DNA, 20 bp, mouse
gcggcccgagaccctccgaa

SEQ ID NO: 511601 - DNA, 20 bp, mouse
ggagggtctcgggccggcgt

SEQ ID NO: 511602 - DNA, 20 bp, mouse
ggagggtctcgggtcggtgt

SEQ ID NO: 511603 - DNA, 20 bp, mouse
gcgacccgagaccctccgag

SEQ ID NO: 511604 - DNA, 20 bp, mouse
gcgtgggctccgggcaactc

SEQ ID NO: 511605 - DNA, 20 bp, mouse
gcagacccgcggagcggccg

SEQ ID NO: 511606 - DNA, 20 bp, mouse
gccggagctggaatacgaac

SEQ ID NO: 511607 - DNA, 20 bp, mouse
gaccggggaacgagccgagg

SEQ ID NO: 511608 - DNA, 20 bp, mouse
gggcgtggcccagcggacca

SEQ ID NO: 511609 - DNA, 20 bp, mouse
gcggaccagggcaggaaaac

SEQ ID NO: 511610 - DNA, 20 bp, mouse
gacgaactggaataacctac

SEQ ID NO: 511611 - DNA, 20 bp, mouse
gtccagatgggccagagtga

SEQ ID NO: 511612 - DNA, 20 bp, mouse
gctcgggacgtggagggaat

SEQ ID NO: 511613 - DNA, 20 bp, mouse
gcaggcggtagacctgtcac

SEQ ID NO: 511614 - DNA, 20 bp, mouse
gtgggatggtccagcggcgg

SEQ ID NO: 511615 - DNA, 20 bp, mouse
ggctaactccaaccccacct

SEQ ID NO: 511616 - DNA, 20 bp, mouse
ggacactgaagctcactcaa

SEQ ID NO: 511617 - DNA, 20 bp, mouse
gtcactcaaagggtatttca

SEQ ID NO: 511618 - DNA, 20 bp, mouse
gtagctggccattgggaaca

SEQ ID NO: 511619 - DNA, 20 bp, mouse
gaacagggagaacaaaaatt

SEQ ID NO: 511620 - DNA, 20 bp, mouse
gctctgctctgctataacaa

SEQ ID NO: 511621 - DNA, 20 bp, mouse
gaagggtatttcaaggagtc

SEQ ID NO: 511622 - DNA, 20 bp, mouse
gtaaaagccttcaggctaag

SEQ ID NO: 511623 - DNA, 20 bp, mouse
gcggcagcaggaccaaccct

SEQ ID NO: 511624 - DNA, 20 bp, mouse
gggaacacctcttagcctga

SEQ ID NO: 511625 - DNA, 20 bp, mouse
gcaccagggagattggtatt

SEQ ID NO: 511626 - DNA, 20 bp, mouse
gcagccagctggcaagaagt

SEQ ID NO: 511627 - DNA, 20 bp, mouse
gtccagtcagattctcggag

SEQ ID NO: 511628 - DNA, 20 bp, mouse
gtccactccgagaatctgac

SEQ ID NO: 511629 - DNA, 20 bp, mouse
gctcggagtggaggcttcct

SEQ ID NO: 511630 - DNA, 20 bp, mouse
gaggcttcctgggactgaga

SEQ ID NO: 511631 - DNA, 20 bp, mouse
gtcaggcgggggggcctcag

SEQ ID NO: 511632 - DNA, 20 bp, mouse
gataagagctacctgaacac

SEQ ID NO: 511633 - DNA, 20 bp, mouse
gctgagagggggtgagtgca

SEQ ID NO: 511634 - DNA, 20 bp, mouse
gacatctccagtcagattct

SEQ ID NO: 511635 - DNA, 20 bp, mouse
gactccagcccgacaggcac

SEQ ID NO: 511636 - DNA, 20 bp, mouse
gaagcgtccagagagctata

SEQ ID NO: 511637 - DNA, 20 bp, mouse
gtcccaggagctgacagaag

SEQ ID NO: 511638 - DNA, 20 bp, mouse
gggtcaggctggcatagagt

SEQ ID NO: 511639 - DNA, 20 bp, mouse
gaggcctccagggagcaaag

SEQ ID NO: 511640 - DNA, 20 bp, mouse
gtcaccactttgctccctgg

SEQ ID NO: 511641 - DNA, 20 bp, mouse
gaggaagcaccagactcata

SEQ ID NO: 511642 - DNA, 20 bp, mouse
gtctctgagccaaggcctcc

SEQ ID NO: 511643 - DNA, 20 bp, mouse
gactcatggagtggatcctg

SEQ ID NO: 511644 - DNA, 20 bp, mouse
gtcttcataaccctagtcca

SEQ ID NO: 511645 - DNA, 20 bp, mouse
gcagaaccctggagtgtgat

SEQ ID NO: 511646 - DNA, 20 bp, mouse
gcagtggccgggacaactct

SEQ ID NO: 511647 - DNA, 20 bp, mouse
ggcgcgcgcggcgtgaaggg

SEQ ID NO: 511648 - DNA, 20 bp, mouse
gggacaggatgcgagcgcag

SEQ ID NO: 511649 - DNA, 20 bp, mouse
ggagcggcccagagttgtcc

SEQ ID NO: 511650 - DNA, 20 bp, mouse
gggcgcgcgcgcggcgtgaa

SEQ ID NO: 511651 - DNA, 20 bp, mouse
gaggatgcgagcgcagtggc

SEQ ID NO: 511652 - DNA, 20 bp, mouse
gcgcgcggcgtgaagggcgg

SEQ ID NO: 511653 - DNA, 20 bp, mouse
gtgagaggtcggccccagaa

SEQ ID NO: 511654 - DNA, 20 bp, mouse
ggcgcaccgggacggcccag

SEQ ID NO: 511655 - DNA, 20 bp, mouse
gcttcttcccgtggcctcga

SEQ ID NO: 511656 - DNA, 20 bp, mouse
gtctggggaagggataccta

SEQ ID NO: 511657 - DNA, 20 bp, mouse
ggtgttggaagggtagaggt

SEQ ID NO: 511658 - DNA, 20 bp, mouse
gcggagtcccgaaatgccgt

SEQ ID NO: 511659 - DNA, 20 bp, mouse
gggaagggtagaggtaggtt

SEQ ID NO: 511660 - DNA, 20 bp, mouse
gagtcaaagaagtgttggaa

SEQ ID NO: 511661 - DNA, 20 bp, mouse
gaactgagaaaccgcaaacg

SEQ ID NO: 511662 - DNA, 20 bp, mouse
gagaagtgttggaagggtag

SEQ ID NO: 511663 - DNA, 20 bp, mouse
gttccggcgagctgcatacg

SEQ ID NO: 511664 - DNA, 20 bp, mouse
gaacagcaacgtctggggaa

SEQ ID NO: 511665 - DNA, 20 bp, mouse
gaagcccgcgtagtaagcgc

SEQ ID NO: 511666 - DNA, 20 bp, mouse
gcgagcccggcgggacagca

SEQ ID NO: 511667 - DNA, 20 bp, mouse
gccggtgccccgggacaaca

SEQ ID NO: 511668 - DNA, 20 bp, mouse
ggcagcgctttatggacggg

SEQ ID NO: 511669 - DNA, 20 bp, mouse
gccagcagcgctttatggac

SEQ ID NO: 511670 - DNA, 20 bp, mouse
gacgggcggcgcaggtagga

SEQ ID NO: 511671 - DNA, 20 bp, mouse
ggcacctgtcctggcagcat

SEQ ID NO: 511672 - DNA, 20 bp, mouse
ggtccgaggtagtctcacta

SEQ ID NO: 511673 - DNA, 20 bp, mouse
gatggacgggcggcgcaggt

SEQ ID NO: 511674 - DNA, 20 bp, mouse
gggtcccgctgcagatccga

SEQ ID NO: 511675 - DNA, 20 bp, mouse
ggtaggtgggtaataggagt

SEQ ID NO: 511676 - DNA, 20 bp, mouse
gtggcggcccgcaggagagg

SEQ ID NO: 511677 - DNA, 20 bp, mouse
ggctggcggccgaggaaaaa

SEQ ID NO: 511678 - DNA, 20 bp, mouse
gccgtaaactgaccgagtgg

SEQ ID NO: 511679 - DNA, 20 bp, mouse
gtagccgtaaactgaccgag

SEQ ID NO: 511680 - DNA, 20 bp, mouse
ggcgcagagcccgagcagac

SEQ ID NO: 511681 - DNA, 20 bp, mouse
gtcccagcgggccagcgagg

SEQ ID NO: 511682 - DNA, 20 bp, mouse
gtccgagagtagacgcgcgg

SEQ ID NO: 511683 - DNA, 20 bp, mouse
gccgagcagacaggcgtaga

SEQ ID NO: 511684 - DNA, 20 bp, mouse
gagggcgctcccagaagggt

SEQ ID NO: 511685 - DNA, 20 bp, mouse
ggagggtgcagtgcacccca

SEQ ID NO: 511686 - DNA, 20 bp, mouse
gaaacagaagctacctggac

SEQ ID NO: 511687 - DNA, 20 bp, mouse
gttttctgctttgcctgtcc

SEQ ID NO: 511688 - DNA, 20 bp, mouse
ggtttgtgaaagtgtctcag

SEQ ID NO: 511689 - DNA, 20 bp, mouse
ggaccagctcaatccccatt

SEQ ID NO: 511690 - DNA, 20 bp, mouse
ggtgaaaactgaaccgaatg

SEQ ID NO: 511691 - DNA, 20 bp, mouse
ggaaggaatgatcacgtcca

SEQ ID NO: 511692 - DNA, 20 bp, mouse
gagacactttcacaaactac

SEQ ID NO: 511693 - DNA, 20 bp, mouse
gcttccttataaggtgaatg

SEQ ID NO: 511694 - DNA, 20 bp, mouse
gtacctagaacattcactgg

SEQ ID NO: 511695 - DNA, 20 bp, mouse
gaaccgaatggggattgagc

SEQ ID NO: 511696 - DNA, 20 bp, mouse
gagaccgcagatggagagga

SEQ ID NO: 511697 - DNA, 20 bp, mouse
gtgtgagaccgcagatggag

SEQ ID NO: 511698 - DNA, 20 bp, mouse
gacagcttcgacttctacag

SEQ ID NO: 511699 - DNA, 20 bp, mouse
gacccggttcccatcacagt

SEQ ID NO: 511700 - DNA, 20 bp, mouse
gggcagtgtgagaccgcaga

SEQ ID NO: 511701 - DNA, 20 bp, mouse
ggcaccatcctctccatctg

SEQ ID NO: 511702 - DNA, 20 bp, mouse
gaggcacctacagcagcaag

SEQ ID NO: 511703 - DNA, 20 bp, mouse
gggacaaggggcattctggg

SEQ ID NO: 511704 - DNA, 20 bp, mouse
ggtgtcgaacctgcccaggt

SEQ ID NO: 511705 - DNA, 20 bp, mouse
gagctgtggttgagggtagt

SEQ ID NO: 511706 - DNA, 20 bp, mouse
gactgccaccggcggaggaa

SEQ ID NO: 511707 - DNA, 20 bp, mouse
ggcacctgtgagtaccctca

SEQ ID NO: 511708 - DNA, 20 bp, mouse
gcctctccatctgtacacaa

SEQ ID NO: 511709 - DNA, 20 bp, mouse
ggggctgccactgccaccgg

SEQ ID NO: 511710 - DNA, 20 bp, mouse
gagagaggtagggaacaagt

SEQ ID NO: 511711 - DNA, 20 bp, mouse
ggcagcccttcctccgccgg

SEQ ID NO: 511712 - DNA, 20 bp, mouse
gtccagtggagccagaggga

SEQ ID NO: 511713 - DNA, 20 bp, mouse
gctgccactgccaccggcgg

SEQ ID NO: 511714 - DNA, 20 bp, mouse
ggaggaagtgacacaccctg

SEQ ID NO: 511715 - DNA, 20 bp, mouse
ggggtactcacaggtgcttg

SEQ ID NO: 511716 - DNA, 20 bp, mouse
ggggtcgccagcaagcgcag

SEQ ID NO: 511717 - DNA, 20 bp, mouse
gtcgccagcaagcgcagtgg

SEQ ID NO: 511718 - DNA, 20 bp, mouse
ggctacagtgctccttgctt

SEQ ID NO: 511719 - DNA, 20 bp, mouse
gcaaggagcactgtagcgtg

SEQ ID NO: 511720 - DNA, 20 bp, mouse
gcttgctggcgacccaagca

SEQ ID NO: 511721 - DNA, 20 bp, mouse
gttggcgggagaggagacac

SEQ ID NO: 511722 - DNA, 20 bp, mouse
gggagcactgtagcgtgggg

SEQ ID NO: 511723 - DNA, 20 bp, mouse
ggcaagcgcagtggcggccc

SEQ ID NO: 511724 - DNA, 20 bp, mouse
gcactcgcgggcaaccaaca

SEQ ID NO: 511725 - DNA, 20 bp, mouse
gaagctgggagcccccacgg

SEQ ID NO: 511726 - DNA, 20 bp, mouse
gagcggagctcacaggttct

SEQ ID NO: 511727 - DNA, 20 bp, mouse
gcgcaggcaactgagcttcc

SEQ ID NO: 511728 - DNA, 20 bp, mouse
gttgggatagcggagctcac

SEQ ID NO: 511729 - DNA, 20 bp, mouse
gttccacccgaggcagcagg

SEQ ID NO: 511730 - DNA, 20 bp, mouse
gcagttgcctgcgaagactt

SEQ ID NO: 511731 - DNA, 20 bp, mouse
gtaggtggggcttccacccg

SEQ ID NO: 511732 - DNA, 20 bp, mouse
ggcagaaggacttgggatag

SEQ ID NO: 511733 - DNA, 20 bp, mouse
ggacagcccaatgaagagaa

SEQ ID NO: 511734 - DNA, 20 bp, mouse
ggctgcactgctgctaggtg

SEQ ID NO: 511735 - DNA, 20 bp, mouse
gcagcagatgtccaggcaga

SEQ ID NO: 511736 - DNA, 20 bp, mouse
ggatcatggagggtgccaca

SEQ ID NO: 511737 - DNA, 20 bp, mouse
gcagtctgagggaagtgacg

SEQ ID NO: 511738 - DNA, 20 bp, mouse
gattgagagcctggagatca

SEQ ID NO: 511739 - DNA, 20 bp, mouse
ggcactgacagaggcataca

SEQ ID NO: 511740 - DNA, 20 bp, mouse
gcacatacctcactgcccct

SEQ ID NO: 511741 - DNA, 20 bp, mouse
ggtattaactaacagtctga

SEQ ID NO: 511742 - DNA, 20 bp, mouse
gtcaagaagaaatgatcagt

SEQ ID NO: 511743 - DNA, 20 bp, mouse
ggccaagcccaaagcaggcc

SEQ ID NO: 511744 - DNA, 20 bp, mouse
ggtccctgcactgggccccg

SEQ ID NO: 511745 - DNA, 20 bp, mouse
gctgcctgttgcactgacag

SEQ ID NO: 511746 - DNA, 20 bp, mouse
gcctgctaacctggttccgt

SEQ ID NO: 511747 - DNA, 20 bp, mouse
gtcccccgagcagatggtct

SEQ ID NO: 511748 - DNA, 20 bp, mouse
gggggagaactccccaccta

SEQ ID NO: 511749 - DNA, 20 bp, mouse
gtaacctggttccgtaggtg

SEQ ID NO: 511750 - DNA, 20 bp, mouse
gactccccacctacggaacc

SEQ ID NO: 511751 - DNA, 20 bp, mouse
gccaagctcccccgagcaga

SEQ ID NO: 511752 - DNA, 20 bp, mouse
ggctattggcctggacaaac

SEQ ID NO: 511753 - DNA, 20 bp, mouse
gagacaagttcctgctaacc

SEQ ID NO: 511754 - DNA, 20 bp, mouse
gtctccccagaccatctgct

SEQ ID NO: 511755 - DNA, 20 bp, mouse
gcataatcataatcaggacg

SEQ ID NO: 511756 - DNA, 20 bp, mouse
gagagagcagagccaagaca

SEQ ID NO: 511757 - DNA, 20 bp, mouse
gggacttctcggaaagccag

SEQ ID NO: 511758 - DNA, 20 bp, mouse
gtgtgttactgggacatcgt

SEQ ID NO: 511759 - DNA, 20 bp, mouse
gttggctctgctctctggct

SEQ ID NO: 511760 - DNA, 20 bp, mouse
gggaaaaggaagcttaggac

SEQ ID NO: 511761 - DNA, 20 bp, mouse
gaggactttgagggtcatac

SEQ ID NO: 511762 - DNA, 20 bp, mouse
gtctcatcttggcctacctt

SEQ ID NO: 511763 - DNA, 20 bp, mouse
gctaggttgagcctgatggg

SEQ ID NO: 511764 - DNA, 20 bp, mouse
gcaaagtcctgatatcagat

SEQ ID NO: 511765 - DNA, 20 bp, mouse
gccccaagtcccccaagtga

SEQ ID NO: 511766 - DNA, 20 bp, mouse
gagcacaaggttccacatgt

SEQ ID NO: 511767 - DNA, 20 bp, mouse
gcagtctggcgggcaactga

SEQ ID NO: 511768 - DNA, 20 bp, mouse
gggctcagaagcagtctggc

SEQ ID NO: 511769 - DNA, 20 bp, mouse
gtgaaggcaagaacagcaca

SEQ ID NO: 511770 - DNA, 20 bp, mouse
gagaaggtagcagtacccat

SEQ ID NO: 511771 - DNA, 20 bp, mouse
gtagacacagaggcacctat

SEQ ID NO: 511772 - DNA, 20 bp, mouse
gagtatgcatgtaattaagt

SEQ ID NO: 511773 - DNA, 20 bp, mouse
gttataacccacctgctcca

SEQ ID NO: 511774 - DNA, 20 bp, mouse
gaaggttccacatgtgggca

SEQ ID NO: 511775 - DNA, 20 bp, mouse
gaggagccttaaggatctct

SEQ ID NO: 511776 - DNA, 20 bp, mouse
gcagagcgcgcgacctctct

SEQ ID NO: 511777 - DNA, 20 bp, mouse
ggacctctctgggacagcga

SEQ ID NO: 511778 - DNA, 20 bp, mouse
gaaccttcgctgtcccagag

SEQ ID NO: 511779 - DNA, 20 bp, mouse
gcagggagttggaggagccg

SEQ ID NO: 511780 - DNA, 20 bp, mouse
gggacagcgaaggtttttca

SEQ ID NO: 511781 - DNA, 20 bp, mouse
gcctcggagcaagtaagtag

SEQ ID NO: 511782 - DNA, 20 bp, mouse
gttctcagagtcccaggaag

SEQ ID NO: 511783 - DNA, 20 bp, mouse
gcgccatgctcctgctgcta

SEQ ID NO: 511784 - DNA, 20 bp, mouse
gatctgtaggatgcaaggaa

SEQ ID NO: 511785 - DNA, 20 bp, mouse
gcggggctttggtggaggaa

SEQ ID NO: 511786 - DNA, 20 bp, mouse
gcgcagtgcgactgaaggag

SEQ ID NO: 511787 - DNA, 20 bp, mouse
gcaccccgcagtgcgactga

SEQ ID NO: 511788 - DNA, 20 bp, mouse
ggagcagcggagactgagac

SEQ ID NO: 511789 - DNA, 20 bp, mouse
gcactgcggggtgatgccca

SEQ ID NO: 511790 - DNA, 20 bp, mouse
gaccgccacggggtatgaga

SEQ ID NO: 511791 - DNA, 20 bp, mouse
ggccttctcataccccgtgg

SEQ ID NO: 511792 - DNA, 20 bp, mouse
gctgaaaagtgatgcgcctt

SEQ ID NO: 511793 - DNA, 20 bp, mouse
gccgtggcggtcctcaaagt

SEQ ID NO: 511794 - DNA, 20 bp, mouse
ggaagtcccaacagaagaga

SEQ ID NO: 511795 - DNA, 20 bp, mouse
gtaagccttctcataccccg

SEQ ID NO: 511796 - DNA, 20 bp, mouse
gagagttgctagctgagtaa

SEQ ID NO: 511797 - DNA, 20 bp, mouse
gcaggagcctcagcagagaa

SEQ ID NO: 511798 - DNA, 20 bp, mouse
gttgctagctgagtaatggc

SEQ ID NO: 511799 - DNA, 20 bp, mouse
gccttccctctgcaccaggc

SEQ ID NO: 511800 - DNA, 20 bp, mouse
gtgctgtttgtggaatatgg

SEQ ID NO: 511801 - DNA, 20 bp, mouse
gtagtggtgtgagagaattt

SEQ ID NO: 511802 - DNA, 20 bp, mouse
gttctccttcaactactcaa

SEQ ID NO: 511803 - DNA, 20 bp, mouse
gagaagctaggagctgagac

SEQ ID NO: 511804 - DNA, 20 bp, mouse
gagcacgcccggcccctttg

SEQ ID NO: 511805 - DNA, 20 bp, mouse
gtcctgcatgtgtgagactt

SEQ ID NO: 511806 - DNA, 20 bp, mouse
gcagcagcgagctcaggtct

SEQ ID NO: 511807 - DNA, 20 bp, mouse
gtcctctcccagtcttccac

SEQ ID NO: 511808 - DNA, 20 bp, mouse
gcggctcgaatcagtatctt

SEQ ID NO: 511809 - DNA, 20 bp, mouse
gttgggctgcaggttgaaag

SEQ ID NO: 511810 - DNA, 20 bp, mouse
gagacagaggtgggcccagt

SEQ ID NO: 511811 - DNA, 20 bp, mouse
gcctacggcggtgcaaaagg

SEQ ID NO: 511812 - DNA, 20 bp, mouse
gacggcggtgcaaaaggagg

SEQ ID NO: 511813 - DNA, 20 bp, mouse
gaccctctcccacccagcct

SEQ ID NO: 511814 - DNA, 20 bp, mouse
gtatgacgcagtcccaggct

SEQ ID NO: 511815 - DNA, 20 bp, mouse
gcgggctgcgcggtaaggcg

SEQ ID NO: 511816 - DNA, 20 bp, mouse
gtcagggcacgactctgcag

SEQ ID NO: 511817 - DNA, 20 bp, mouse
gcgactctgcagcggaggag

SEQ ID NO: 511818 - DNA, 20 bp, mouse
ggccttgtcggccgagctca

SEQ ID NO: 511819 - DNA, 20 bp, mouse
ggactgcgcgacagcagcag

SEQ ID NO: 511820 - DNA, 20 bp, mouse
ggggcacgactctgcagcgg

SEQ ID NO: 511821 - DNA, 20 bp, mouse
ggccctgagctcggccgaca

SEQ ID NO: 511822 - DNA, 20 bp, mouse
ggtcgcggctggcaggatcc

SEQ ID NO: 511823 - DNA, 20 bp, mouse
gggcaggatcccggctgcga

SEQ ID NO: 511824 - DNA, 20 bp, mouse
ggtccctccggatgccgtgg

SEQ ID NO: 511825 - DNA, 20 bp, mouse
ggcgcctcctcgctgctctt

SEQ ID NO: 511826 - DNA, 20 bp, mouse
gacagaggagagcgtggtgt

SEQ ID NO: 511827 - DNA, 20 bp, mouse
gcgtggttccggttggacag

SEQ ID NO: 511828 - DNA, 20 bp, mouse
gggttggacagaggagagcg

SEQ ID NO: 511829 - DNA, 20 bp, mouse
ggctggcgtcatcctcggag

SEQ ID NO: 511830 - DNA, 20 bp, mouse
ggtacaggtacgcccctccg

SEQ ID NO: 511831 - DNA, 20 bp, mouse
gcgggtgacgtggttccggt

SEQ ID NO: 511832 - DNA, 20 bp, mouse
gtgcttgctggcgtcatcct

SEQ ID NO: 511833 - DNA, 20 bp, mouse
gagcccctaagcctaatgat

SEQ ID NO: 511834 - DNA, 20 bp, mouse
gatgacgccagcaagcatga

SEQ ID NO: 511835 - DNA, 20 bp, mouse
gcacggtgataggagacaac

SEQ ID NO: 511836 - DNA, 20 bp, mouse
gatcgaggttgcactggcag

SEQ ID NO: 511837 - DNA, 20 bp, mouse
gggtacctcagagtcacgag

SEQ ID NO: 511838 - DNA, 20 bp, mouse
gcagtggccgccacgaccag

SEQ ID NO: 511839 - DNA, 20 bp, mouse
gattgcgatcgaggttgcac

SEQ ID NO: 511840 - DNA, 20 bp, mouse
gggacctaggcattccccag

SEQ ID NO: 511841 - DNA, 20 bp, mouse
gggcgtcagcaggatctccg

SEQ ID NO: 511842 - DNA, 20 bp, mouse
gcgagcggaagcgggatgag

SEQ ID NO: 511843 - DNA, 20 bp, mouse
gcaggcaccggaagtttgga

SEQ ID NO: 511844 - DNA, 20 bp, mouse
gtgacgccggcgagggtgag

SEQ ID NO: 511845 - DNA, 20 bp, mouse
gaggctccgggtctcagatg

SEQ ID NO: 511846 - DNA, 20 bp, mouse
gttcccggcaaagggttact

SEQ ID NO: 511847 - DNA, 20 bp, mouse
gccggccggaagtaccttcc

SEQ ID NO: 511848 - DNA, 20 bp, mouse
gctcaaggcgccacactcca

SEQ ID NO: 511849 - DNA, 20 bp, mouse
gggagagaaggcgggaaacg

SEQ ID NO: 511850 - DNA, 20 bp, mouse
gtgtagcctcggggagtgtg

SEQ ID NO: 511851 - DNA, 20 bp, mouse
gcagggatgcacgggagaga

SEQ ID NO: 511852 - DNA, 20 bp, mouse
gaaggcgccacactccacgg

SEQ ID NO: 511853 - DNA, 20 bp, mouse
gagctggaggaggtgttgtg

SEQ ID NO: 511854 - DNA, 20 bp, mouse
gagaccttcaacacagccag

SEQ ID NO: 511855 - DNA, 20 bp, mouse
gaaagggttactgggcattc

SEQ ID NO: 511856 - DNA, 20 bp, mouse
ggtgcgggcacctcctccgg

SEQ ID NO: 511857 - DNA, 20 bp, mouse
gagcgtgcgggcacctcctc

SEQ ID NO: 511858 - DNA, 20 bp, mouse
gtccggaggaaattgcccac

SEQ ID NO: 511859 - DNA, 20 bp, mouse
gggaggtgcccgcacgctcg

SEQ ID NO: 511860 - DNA, 20 bp, mouse
gacggcgacccgggaaggag

SEQ ID NO: 511861 - DNA, 20 bp, mouse
gccccacacgctcggcctgt

SEQ ID NO: 511862 - DNA, 20 bp, mouse
gcgggcacctcctccggcgg

SEQ ID NO: 511863 - DNA, 20 bp, mouse
ggcgcgcgccgcgagcgtgc

SEQ ID NO: 511864 - DNA, 20 bp, mouse
ggcctgtgggcaatttcctc

SEQ ID NO: 511865 - DNA, 20 bp, mouse
gtggacggccagggatctcc

SEQ ID NO: 511866 - DNA, 20 bp, mouse
gcccgggcagggtcatctcc

SEQ ID NO: 511867 - DNA, 20 bp, mouse
gagccgagcccaccagcccg

SEQ ID NO: 511868 - DNA, 20 bp, mouse
gcgccgcgccgcgggctggt

SEQ ID NO: 511869 - DNA, 20 bp, mouse
gcagggtcatctcccggcac

SEQ ID NO: 511870 - DNA, 20 bp, mouse
ggtgagctgagggatcaccg

SEQ ID NO: 511871 - DNA, 20 bp, mouse
gagcccaccagcccgcggcg

SEQ ID NO: 511872 - DNA, 20 bp, mouse
gcagcacgcgggagcccgtt

SEQ ID NO: 511873 - DNA, 20 bp, mouse
gccatgcccgtcgggcgccc

SEQ ID NO: 511874 - DNA, 20 bp, mouse
gtggccgcgccatgcccgtc

SEQ ID NO: 511875 - DNA, 20 bp, mouse
ggtgggctcggctgcggctc

SEQ ID NO: 511876 - DNA, 20 bp, mouse
gggactaggcgatcccggag

SEQ ID NO: 511877 - DNA, 20 bp, mouse
ggcacagagcaacgcagggt

SEQ ID NO: 511878 - DNA, 20 bp, mouse
gcaacgcagggtcggcctgg

SEQ ID NO: 511879 - DNA, 20 bp, mouse
gtacgagcccggagtccccg

SEQ ID NO: 511880 - DNA, 20 bp, mouse
gggcctggcggtgtcccctc

SEQ ID NO: 511881 - DNA, 20 bp, mouse
gcgcagggactaggcgatcc

SEQ ID NO: 511882 - DNA, 20 bp, mouse
gatgtaccggcgcagggact

SEQ ID NO: 511883 - DNA, 20 bp, mouse
gcggaccccggaacacccag

SEQ ID NO: 511884 - DNA, 20 bp, mouse
ggaggtgagggctagaacga

SEQ ID NO: 511885 - DNA, 20 bp, mouse
gaccaagcacagagcaacgc

SEQ ID NO: 511886 - DNA, 20 bp, mouse
gctggggagccccaactcgt

SEQ ID NO: 511887 - DNA, 20 bp, mouse
gaggccgctcggatatgcag

SEQ ID NO: 511888 - DNA, 20 bp, mouse
gccccagccacacccctcgt

SEQ ID NO: 511889 - DNA, 20 bp, mouse
gggccggaacccacgagttg

SEQ ID NO: 511890 - DNA, 20 bp, mouse
gtgccagccgaggcccgcat

SEQ ID NO: 511891 - DNA, 20 bp, mouse
ggctggaggcgctgcgaggt

SEQ ID NO: 511892 - DNA, 20 bp, mouse
gtaacccctgcatatccgag

SEQ ID NO: 511893 - DNA, 20 bp, mouse
gatccgagcggcctggagct

SEQ ID NO: 511894 - DNA, 20 bp, mouse
ggtccacaggcagaatcctg

SEQ ID NO: 511895 - DNA, 20 bp, mouse
gggtcctctccgcctcggag

SEQ ID NO: 511896 - DNA, 20 bp, mouse
gtcctcaagcctgccggggt

SEQ ID NO: 511897 - DNA, 20 bp, mouse
gcggacatgggattgcccag

SEQ ID NO: 511898 - DNA, 20 bp, mouse
ggcacgccgagaggaggtgt

SEQ ID NO: 511899 - DNA, 20 bp, mouse
ggaaagcgcacgccgagagg

SEQ ID NO: 511900 - DNA, 20 bp, mouse
gggtttgggggatcaggacc

SEQ ID NO: 511901 - DNA, 20 bp, mouse
gcgtttcctcaagcctgccg

SEQ ID NO: 511902 - DNA, 20 bp, mouse
gcgtggctccccggtcacca

SEQ ID NO: 511903 - DNA, 20 bp, mouse
gcgttccgttaggatgggag

SEQ ID NO: 511904 - DNA, 20 bp, mouse
gccggccccagcagctacct

SEQ ID NO: 511905 - DNA, 20 bp, mouse
gagaggggttagcagccgct

SEQ ID NO: 511906 - DNA, 20 bp, mouse
gaggccgggagcgaactgtg

SEQ ID NO: 511907 - DNA, 20 bp, mouse
gagcagctctgctcgaggag

SEQ ID NO: 511908 - DNA, 20 bp, mouse
gagttcgctcccggcctgag

SEQ ID NO: 511909 - DNA, 20 bp, mouse
gagcctctaggtccccttgg

SEQ ID NO: 511910 - DNA, 20 bp, mouse
gggtctaaagagtcccccaa

SEQ ID NO: 511911 - DNA, 20 bp, mouse
gggacctagaggctccgctc

SEQ ID NO: 511912 - DNA, 20 bp, mouse
gcggtgcccacggaccgaga

SEQ ID NO: 511913 - DNA, 20 bp, mouse
ggccgcgcgccagagggaca

SEQ ID NO: 511914 - DNA, 20 bp, mouse
gctgtctccgctgcacgcaa

SEQ ID NO: 511915 - DNA, 20 bp, mouse
ggtcccccaaggggacctag

SEQ ID NO: 511916 - DNA, 20 bp, mouse
ggacccgggtccgggtgagg

SEQ ID NO: 511917 - DNA, 20 bp, mouse
gcgatcgggacggcaggagt

SEQ ID NO: 511918 - DNA, 20 bp, mouse
gcgcggcgcgacccgggtcc

SEQ ID NO: 511919 - DNA, 20 bp, mouse
ggagcctagggcaaagagag

SEQ ID NO: 511920 - DNA, 20 bp, mouse
gcgcgacccgggtccgggtg

SEQ ID NO: 511921 - DNA, 20 bp, mouse
ggcgacccggacgatcggga

SEQ ID NO: 511922 - DNA, 20 bp, mouse
gtcatggcttcggccctccg

SEQ ID NO: 511923 - DNA, 20 bp, mouse
ggcctctatcaagggctcag

SEQ ID NO: 511924 - DNA, 20 bp, mouse
gagcctggcagctcgcttca

SEQ ID NO: 511925 - DNA, 20 bp, mouse
gtccggggctcgaggcgacg

SEQ ID NO: 511926 - DNA, 20 bp, mouse
ggatgcgggcgactagacca

SEQ ID NO: 511927 - DNA, 20 bp, mouse
ggcgggcgactagaccaagg

SEQ ID NO: 511928 - DNA, 20 bp, mouse
ggcaggctgccggggatcca

SEQ ID NO: 511929 - DNA, 20 bp, mouse
gcgggaggagtccaggaggc

SEQ ID NO: 511930 - DNA, 20 bp, mouse
gccacacactcagcttgtgg

SEQ ID NO: 511931 - DNA, 20 bp, mouse
gtctgttgcccagtaaagct

SEQ ID NO: 511932 - DNA, 20 bp, mouse
gcgccgcagggataccgagt

SEQ ID NO: 511933 - DNA, 20 bp, mouse
gctccgcccggcgccagtaa

SEQ ID NO: 511934 - DNA, 20 bp, mouse
ggcccgcatccctggatccc

SEQ ID NO: 511935 - DNA, 20 bp, mouse
ggatctcccacgcacatcta

SEQ ID NO: 511936 - DNA, 20 bp, mouse
ggactgcagcgactaccacg

SEQ ID NO: 511937 - DNA, 20 bp, mouse
gcacgcggtgctggtcccgg

SEQ ID NO: 511938 - DNA, 20 bp, mouse
gggactccagcaatccacag

SEQ ID NO: 511939 - DNA, 20 bp, mouse
gtacgcccggaagaaggcga

SEQ ID NO: 511940 - DNA, 20 bp, mouse
gtaccacgcggtgctggtcc

SEQ ID NO: 511941 - DNA, 20 bp, mouse
gctaggggctcagttactca

SEQ ID NO: 511942 - DNA, 20 bp, mouse
ggcccggaagaaggcgaggg

SEQ ID NO: 511943 - DNA, 20 bp, mouse
gcctgaggcgggaaccgctg

SEQ ID NO: 511944 - DNA, 20 bp, mouse
ggtccaaagtctgcgggcag

SEQ ID NO: 511945 - DNA, 20 bp, mouse
gggtacagaccatgtctccg

SEQ ID NO: 511946 - DNA, 20 bp, mouse
gcctcctggaaggcagaacg

SEQ ID NO: 511947 - DNA, 20 bp, mouse
gggaaggcctggttccgggg

SEQ ID NO: 511948 - DNA, 20 bp, mouse
gctactcctgggccccctcc

SEQ ID NO: 511949 - DNA, 20 bp, mouse
gcccgcgaggctccagactc

SEQ ID NO: 511950 - DNA, 20 bp, mouse
gagggtagggtaggagtccg

SEQ ID NO: 511951 - DNA, 20 bp, mouse
gaggagggccgcccagggta

SEQ ID NO: 511952 - DNA, 20 bp, mouse
gctggaaggcagaacgggga

SEQ ID NO: 511953 - DNA, 20 bp, mouse
gcggggcagaagccagccca

SEQ ID NO: 511954 - DNA, 20 bp, mouse
gtcagatgcagccaccgccc

SEQ ID NO: 511955 - DNA, 20 bp, mouse
ggagccaggagggccgccca

SEQ ID NO: 511956 - DNA, 20 bp, mouse
gtgagggagcgaaggagcga

SEQ ID NO: 511957 - DNA, 20 bp, mouse
gaggagttaggcgggagtga

SEQ ID NO: 511958 - DNA, 20 bp, mouse
gaggagcgaaggagggcgag

SEQ ID NO: 511959 - DNA, 20 bp, mouse
ggcggcggcggagggagatg

SEQ ID NO: 511960 - DNA, 20 bp, mouse
gcttgcgagccgccgtacta

SEQ ID NO: 511961 - DNA, 20 bp, mouse
gtggttgctccgtagtacgg

SEQ ID NO: 511962 - DNA, 20 bp, mouse
ggcgcacccgcccggagatg

SEQ ID NO: 511963 - DNA, 20 bp, mouse
ggccgtcccggagcccgctc

SEQ ID NO: 511964 - DNA, 20 bp, mouse
gagggagatgaggagttagg

SEQ ID NO: 511965 - DNA, 20 bp, mouse
gcgagaggagtggagcggcg

SEQ ID NO: 511966 - DNA, 20 bp, mouse
gagagcccagcagccgtgac

SEQ ID NO: 511967 - DNA, 20 bp, mouse
gcctgttgcgcagcctgtca

SEQ ID NO: 511968 - DNA, 20 bp, mouse
gggcctgacgactgacccgg

SEQ ID NO: 511969 - DNA, 20 bp, mouse
gtccacgggccgggcagagg

SEQ ID NO: 511970 - DNA, 20 bp, mouse
gccggcccgtggaaccccgg

SEQ ID NO: 511971 - DNA, 20 bp, mouse
gctgcgcaacaggttcgctg

SEQ ID NO: 511972 - DNA, 20 bp, mouse
gggcggaggcaggaaccccg

SEQ ID NO: 511973 - DNA, 20 bp, mouse
gcgtgcgcgaggcgccaggt

SEQ ID NO: 511974 - DNA, 20 bp, mouse
ggccggcctgacgactgacc

SEQ ID NO: 511975 - DNA, 20 bp, mouse
gggcgggccgctcctctcag

SEQ ID NO: 511976 - DNA, 20 bp, mouse
gcccgccgcgggacagcgag

SEQ ID NO: 511977 - DNA, 20 bp, mouse
gtcctggtgcaccgcagaga

SEQ ID NO: 511978 - DNA, 20 bp, mouse
gagagatggcgactgcaatc

SEQ ID NO: 511979 - DNA, 20 bp, mouse
gcagcgaggggcgacggtga

SEQ ID NO: 511980 - DNA, 20 bp, mouse
ggatggccgcagtctccaac

SEQ ID NO: 511981 - DNA, 20 bp, mouse
gtggcaggcacaagtcactt

SEQ ID NO: 511982 - DNA, 20 bp, mouse
ggggacggcgagtttccagt

SEQ ID NO: 511983 - DNA, 20 bp, mouse
gcgactgcaatccggctgct

SEQ ID NO: 511984 - DNA, 20 bp, mouse
gtttcgtagaagctagggag

SEQ ID NO: 511985 - DNA, 20 bp, mouse
gagtcacttgggtaagacct
